United States Patent 11,332,783 (SAMPLE ANALYSIS, PRESENCE DETERMINATION OF A TARGET SEQUENCE) - sequence listing, part 22

SEQ ID NO: 422634 - DNA, 140 bp, Artificial Sequence
  Synthetic
caccgctgtcccaaaaggtcgtagcagctttattatctggacagtgtcgaatgtccccagcacgtcgcgcatttgttggaatagtgttctcacaaatccactgtattgacctctggcagccatatcagcagccagggcct

SEQ ID NO: 422635 - DNA, 140 bp, Artificial Sequence
  Synthetic
atacgccatgctgggtctcccaaaccatttgaatggatgtcaatccgaccctacttttcctaaaggttccagcgcagaatgccataagcatcacattcccttatactggagatcctccatcgtacttgggagtcggccat

SEQ ID NO: 422636 - DNA, 140 bp, Artificial Sequence
  Synthetic
atggccgactcccaagtacgatggaggatctccagtataagggaatgtgatgcttatggcattctgcgctggaacctttaggaaaagtagggtcggattgacatccattcaaatggtttgggagacccagcatggcgtat

SEQ ID NO: 422637 - DNA, 140 bp, Artificial Sequence
  Synthetic
aggccctggctgctgatatgaccccagctcaacccgattgatgggccactacctgaagataatgaaccaagtggatatgcacaaacagactgcgtcctggaggccatggctttccttgaagaccttttgggacagcggtg

SEQ ID NO: 422638 - DNA, 140 bp, Artificial Sequence
  Synthetic
caccgctgtcccaaaaggtcttcaaggaaagccatggcctccaggacgcagtctgtttgtgcatatccacttggttcattatcttcaggtagtggcccatcaatcgggttgagctggggtcatatcagcagccagggcct

SEQ ID NO: 422639 - DNA, 140 bp, Artificial Sequence
  Synthetic
aggccctggctgctgatatgaattctagtatgccattccacaacatacatcctctcaccatcggggaatgccccaaatatgtgaaatcaaacagattagtcctcgcgactggactcagaagaccttttgggacagcggtg

SEQ ID NO: 422640 - DNA, 140 bp, Artificial Sequence
  Synthetic
caccgctgtcccaaaaggtcttctgagtccagtcgcgaggactaatctgtttgatttcacatatttggggcattccccgatggtgagaggatgtatgttgtggaatggcatactagaattcatatcagcagccagggcct

SEQ ID NO: 422641 - DNA, 140 bp, Artificial Sequence
  Synthetic
atacgccatgctgggtctccatagcagggtttatagagggaggatggcagggaatggtagatggctggtatgggtaccaccatagtaatgagcagggaagcggatacgctgcggacaaagcgtacttgggagtcggccat

SEQ ID NO: 422642 - DNA, 140 bp, Artificial Sequence
  Synthetic
atggccgactcccaagtacgctttgtccgcagcgtatccgcttccctgctcattactatggtggtacccataccagccatctaccattccctgccatcctccctctataaaccctgctatggagacccagcatggcgtat

SEQ ID NO: 422643 - DNA, 140 bp, Artificial Sequence
  Synthetic
aggccctggctgctgatatgtgggtaccaccatagtaatgagcagggaagcggatacgctgcggacaaagaatccactcaaaaagcagtagatggaatcaccaataagatcaactcgatcgaccttttgggacagcggtg

SEQ ID NO: 422644 - DNA, 140 bp, Artificial Sequence
  Synthetic
caccgctgtcccaaaaggtcgatcgagttgatcttattggtgattccatctactgctttttgagtggattctttgtccgcagcgtatccgcttccctgctcattactatggtggtacccacatatcagcagccagggcct

SEQ ID NO: 422645 - DNA, 140 bp, Artificial Sequence
  Synthetic
atacgccatgctgggtctcctgcctgattaatgatccctgggttttgcttaatgcatcttggttcaactccttcctcacacatgcactgaaatagttgtggcaatgctactatttgctatcgtacttgggagtcggccat

SEQ ID NO: 422646 - DNA, 140 bp, Artificial Sequence
  Synthetic
atggccgactcccaagtacgatagcaaatagtagcattgccacaactatttcagtgcatgtgtgaggaaggagttgaaccaagatgcattaagcaaaacccagggatcattaatcaggcaggagacccagcatggcgtat

SEQ ID NO: 422647 - DNA, 140 bp, Artificial Sequence
  Synthetic
atacgccatgctgggtctcctgctcaggttcattctacagaagcatgagatggttgactcaaaagaacagcgattaccctattcaagacgcccaatacacaaataatcaagggaagaacacgtacttgggagtcggccat

SEQ ID NO: 422648 - DNA, 140 bp, Artificial Sequence
  Synthetic
atggccgactcccaagtacgtgttcttcccttgattatttgtgtattgggcgtcttgaatagggtaatcgctgttcttttgagtcaaccatctcatgcttctgtagaatgaacctgagcaggagacccagcatggcgtat

SEQ ID NO: 422649 - DNA, 140 bp, Artificial Sequence
  Synthetic
atacgccatgctgggtctccccgactacagcttagggataatgcaaaggagctgggtaacggttgcttcgagttctaccacaaatgtgataacgaatgtatggaaagtgtaaaaaacgggcgtacttgggagtcggccat

SEQ ID NO: 422650 - DNA, 140 bp, Artificial Sequence
  Synthetic
atggccgactcccaagtacgcccgttttttacactttccatacattcgttatcacatttgtggtagaactcgaagcaaccgttacccagctcctttgcattatccctaagctgtagtcggggagacccagcatggcgtat

SEQ ID NO: 422651 - DNA, 140 bp, Artificial Sequence
  Synthetic
aggccctggctgctgatatgctctgactaaggggattttagggtttgtgttcacgctcaccgtgcccagtgagcgaggactgcagcgtagacgctttgtccaaaatgccctaaatgggaagaccttttgggacagcggtg

SEQ ID NO: 422652 - DNA, 140 bp, Artificial Sequence
  Synthetic
caccgctgtcccaaaaggtcttcccatttagggcattttggacaaagcgtctacgctgcagtcctcgctcactgggcacggtgagcgtgaacacaaaccctaaaatccccttagtcagagcatatcagcagccagggcct

SEQ ID NO: 422653 - DNA, 140 bp, Artificial Sequence
  Synthetic
atacgccatgctgggtctccgccagtggatatgactttgagagagaagggtactccctggttggaatagatcctttccgtctgcttcaaaacagccaggtctttagtctcattagaccaacgtacttgggagtcggccat

SEQ ID NO: 422654 - DNA, 140 bp, Artificial Sequence
  Synthetic
atggccgactcccaagtacgttggtctaatgagactaaagacctggctgttttgaagcagacggaaaggatctattccaaccagggagtacccttctctctcaaagtcatatccactggcggagacccagcatggcgtat

SEQ ID NO: 422655 - DNA, 140 bp, Artificial Sequence
  Synthetic
atacgccatgctgggtctccaccggcttcgccgagatcagaagtccctgagaggaagaagcagcactcttggtctggacatcagaactgccactcgtgaaggaaagcatatagtggaacgcgtacttgggagtcggccat

SEQ ID NO: 422656 - DNA, 140 bp, Artificial Sequence
  Synthetic
atggccgactcccaagtacgcgttccactatatgctttccttcacgagtggcagttctgatgtccagaccaagagtgctgcttcttcctctcagggacttctgatctcggcgaagccggtggagacccagcatggcgtat

SEQ ID NO: 422657 - DNA, 140 bp, Artificial Sequence
  Synthetic
aggccctggctgctgatatgattggacattaaatagaaatcaaccggcagcaactgcattggccaacaccatagaagtttttagatcaaatggtctaacagctaatgagtcaggaaggctgaccttttgggacagcggtg

SEQ ID NO: 422658 - DNA, 140 bp, Artificial Sequence
  Synthetic
caccgctgtcccaaaaggtcagccttcctgactcattagctgttagaccatttgatctaaaaacttctatggtgttggccaatgcagttgctgccggttgatttctatttaatgtccaatcatatcagcagccagggcct

SEQ ID NO: 422659 - DNA, 140 bp, Artificial Sequence
  Synthetic
atacgccatgctgggtctccgaaggaagacgtaaaactaatttgtatggtttcattataaaaggaagatcccacttgaggaatgataccgatgtggtgaactttgtgagtatggaattctcgtacttgggagtcggccat

SEQ ID NO: 422660 - DNA, 140 bp, Artificial Sequence
  Synthetic
atggccgactcccaagtacgagaattccatactcacaaagttcaccacatcggtatcattcctcaagtgggatcttccttttataatgaaaccatacaaattagttttacgtcttccttcggagacccagcatggcgtat

SEQ ID NO: 422661 - DNA, 140 bp, Artificial Sequence
  Synthetic
aggccctggctgctgatatgaatttatacaatatccggaatcttcacattcccgaagtctgcttaaaatgggagctaatggatgaggattatcggggaaggctttgtaatcccctgaatcgaccttttgggacagcggtg

SEQ ID NO: 422662 - DNA, 140 bp, Artificial Sequence
  Synthetic
caccgctgtcccaaaaggtcgattcaggggattacaaagccttccccgataatcctcatccattagctcccattttaagcagacttcgggaatgtgaagattccggatattgtataaattcatatcagcagccagggcct

SEQ ID NO: 422663 - DNA, 140 bp, Artificial Sequence
  Synthetic
aggccctggctgctgatatgcatggtatctagggccagaattgatgcacggattgattttgagtctggaaggattaagaaagaagaatttgctgagatcatgaagatctgtttcaccattgaccttttgggacagcggtg

SEQ ID NO: 422664 - DNA, 140 bp, Artificial Sequence
  Synthetic
caccgctgtcccaaaaggtcaatggtgaaacagatcttcatgatctcagcaaattcttctttcttaatccttccagactcaaaatcaatccgtgcatcaattctggccctagataccatgcatatcagcagccagggcct

SEQ ID NO: 422665 - DNA, 140 bp, Artificial Sequence
  Synthetic
aggccctggctgctgatatgggatcactatccttaggattggtagtccttaatattctcctacatatagttagcattacaataacagtgttggttctccccggagatgggaataatgggagaccttttgggacagcggtg

SEQ ID NO: 422666 - DNA, 140 bp, Artificial Sequence
  Synthetic
caccgctgtcccaaaaggtctcccattattcccatctccggggagaaccaacactgttattgtaatgctaactatatgtaggagaatattaaggactaccaatcctaaggatagtgatcccatatcagcagccagggcct

SEQ ID NO: 422667 - DNA, 140 bp, Artificial Sequence
  Synthetic
atacgccatgctgggtctcctagcattacaataacagtgttggttctccccggagatgggaataatgggaactgcagtggaacagtcattagagaatacaatgaaacagtaaggattgagcgtacttgggagtcggccat

SEQ ID NO: 422668 - DNA, 140 bp, Artificial Sequence
  Synthetic
atggccgactcccaagtacgctcaatccttactgtttcattgtattctctaatgactgttccactgcagttcccattattcccatctccggggagaaccaacactgttattgtaatgctaggagacccagcatggcgtat

SEQ ID NO: 422669 - DNA, 140 bp, Artificial Sequence
  Synthetic
atacgccatgctgggtctccagagaatgatcttttcatgaacaacacagagccattgtgtgatgctaagggttttgcccccttttccaaagacaacgggataaggattgggtcaaggggtcgtacttgggagtcggccat

SEQ ID NO: 422670 - DNA, 140 bp, Artificial Sequence
  Synthetic
atggccgactcccaagtacgaccccttgacccaatccttatcccgttgtctttggaaaagggggcaaaacccttagcatcacacaatggctctgtgttgttcatgaaaagatcattctctggagacccagcatggcgtat

SEQ ID NO: 422671 - DNA, 140 bp, Artificial Sequence
  Synthetic
atacgccatgctgggtctcccatgtttttgttataagagagccatttgtttcttgctcaccaacagagtgcaggacgttcttccttactcaaggttccctactcaatgacaaacactccacgtacttgggagtcggccat

SEQ ID NO: 422672 - DNA, 140 bp, Artificial Sequence
  Synthetic
atggccgactcccaagtacgtggagtgtttgtcattgagtagggaaccttgagtaaggaagaacgtcctgcactctgttggtgagcaagaaacaaatggctctcttataacaaaaacatgggagacccagcatggcgtat

SEQ ID NO: 422673 - DNA, 140 bp, Artificial Sequence
  Synthetic
aggccctggctgctgatatgataacaacgcatttccaaaggaaaagaagagtaagagacaacatgaccaagaaaatggtcacacaaagaacaataggaaagaagaagcagaggctaaacagaccttttgggacagcggtg

SEQ ID NO: 422674 - DNA, 140 bp, Artificial Sequence
  Synthetic
caccgctgtcccaaaaggtctgtttagcctctgcttcttctttcctattgttctttgtgtgaccattttcttggtcatgttgtctcttactcttcttttcctttggaaatgcgttgttatcatatcagcagccagggcct

SEQ ID NO: 422675 - DNA, 140 bp, Artificial Sequence
  Synthetic
atacgccatgctgggtctccgcaatggtgttctcacaagaggattgcatgataaaggctgtcagaggtgatttgaactttgtaaacagagctaaccaacggctgaatcccatgcatcagccgtacttgggagtcggccat

SEQ ID NO: 422676 - DNA, 140 bp, Artificial Sequence
  Synthetic
atggccgactcccaagtacggctgatgcatgggattcagccgttggttagctctgtttacaaagttcaaatcacctctgacagcctttatcatgcaatcctcttgtgagaacaccattgcggagacccagcatggcgtat

SEQ ID NO: 422677 - DNA, 140 bp, Artificial Sequence
  Synthetic
atacgccatgctgggtctccggttcagaaacatcctgagcattgcaccaataatgttctcaaacaaaatggcaagactgggaaaaggatacatgttcgagagtaagagaatgaagctccgcgtacttgggagtcggccat

SEQ ID NO: 422678 - DNA, 140 bp, Artificial Sequence
  Synthetic
atggccgactcccaagtacgcggagcttcattctcttactctcgaacatgtatccttttcccagtcttgccattttgtttgagaacattattggtgcaatgctcaggatgtttctgaaccggagacccagcatggcgtat

SEQ ID NO: 422679 - DNA, 140 bp, Artificial Sequence
  Synthetic
atacgccatgctgggtctccactgatgtaattgattcctgggccggagatattctaagaactcaggaatcatcatgcacttgcattcaaggtgagtgttattgggtgatgacggatgggccgtacttgggagtcggccat

SEQ ID NO: 422680 - DNA, 140 bp, Artificial Sequence
  Synthetic
atggccgactcccaagtacggcccatccgtcatcacccaataacactcaccttgaatgcaagtgcatgatgattcctgagttcttagaatatctccggcccaggaatcaattacatcagtggagacccagcatggcgtat

SEQ ID NO: 422681 - DNA, 140 bp, Artificial Sequence
  Synthetic
atacgccatgctgggtctccgggatcaaacccaatcaaaggcaggattactagtatctgatggaggaccaaatttatacaatatccggaatcttcacattcctgaagtctgcttaaaatgcgtacttgggagtcggccat

SEQ ID NO: 422682 - DNA, 140 bp, Artificial Sequence
  Synthetic
atggccgactcccaagtacgcattttaagcagacttcaggaatgtgaagattccggatattgtataaatttggtcctccatcagatactagtaatcctgcctttgattgggtttgatcccggagacccagcatggcgtat

SEQ ID NO: 422683 - DNA, 140 bp, Artificial Sequence
  Synthetic
aggccctggctgctgatatgataattgggcaaactgaaatcagtttcaatggaggccatatagaagaatgttcatgctacccaaatgaaggtaaagtggagtgtgtttgtagggacaactgaccttttgggacagcggtg

SEQ ID NO: 422684 - DNA, 140 bp, Artificial Sequence
  Synthetic
caccgctgtcccaaaaggtcagttgtccctacaaacacactccactttaccttcatttgggtagcatgaacattcttctatatggcctccattgaaactgatttcagtttgcccaattatcatatcagcagccagggcct

SEQ ID NO: 422685 - DNA, 140 bp, Artificial Sequence
  Synthetic
atacgccatgctgggtctccggactggaaccaacaggccagtgttggtaatttcttcagatttgtcttacagggtaggatacctatgtgcaggcctccccagtgacactccaagaggagacgtacttgggagtcggccat

SEQ ID NO: 422686 - DNA, 140 bp, Artificial Sequence
  Synthetic
atggccgactcccaagtacgtctcctcttggagtgtcactggggaggcctgcacataggtatcctaccctgtaagacaaatctgaagaaattaccaacactggcctgttggttccagtccggagacccagcatggcgtat

SEQ ID NO: 422687 - DNA, 140 bp, Artificial Sequence
  Synthetic
aggccctggctgctgatatgggggaattcttgaggatgaacagatgtaccagaagtgctgcaatctgttcgagaaatttttccctagtagttcgtacaggagaccggttggaatttctaggaccttttgggacagcggtg

SEQ ID NO: 422688 - DNA, 140 bp, Artificial Sequence
  Synthetic
caccgctgtcccaaaaggtcctagaaattccaaccggtctcctgtacgaactactagggaaaaatttctcgaacagattgcagcacttctggtacatctgttcatcctcaagaattcccccatatcagcagccagggcct

SEQ ID NO: 422689 - DNA, 140 bp, Artificial Sequence
  Synthetic
aggccctggctgctgatatgcccggaaagaaatgagcaaggtcaaaccctgtggagcaagacaaatgatgctggatcagacagagtgatggtatcacctctggctgtgacgtggtggaacgaccttttgggacagcggtg

SEQ ID NO: 422690 - DNA, 140 bp, Artificial Sequence
  Synthetic
caccgctgtcccaaaaggtcgttccaccacgtcacagccagaggtgataccatcactctgtctgatccagcatcatttgtcttgctccacagggtttgaccttgctcatttctttccgggcatatcagcagccagggcct

SEQ ID NO: 422691 - DNA, 140 bp, Artificial Sequence
  Synthetic
aggccctggctgctgatatgaaatggctgggtacaaaatagtaaagagcagatcaaaaggcaagttgtggttgataatttaaattggtcaggatacagtggttccttcacactaccggtggaccttttgggacagcggtg

SEQ ID NO: 422692 - DNA, 140 bp, Artificial Sequence
  Synthetic
caccgctgtcccaaaaggtccaccggtagtgtgaaggaaccactgtatcctgaccaatttaaattatcaaccacaacttgccttttgatctgctctttactattttgtacccagccatttcatatcagcagccagggcct

SEQ ID NO: 422693 - DNA, 140 bp, Artificial Sequence
  Synthetic
aggccctggctgctgatatgtgatgtgtggagtagaccatgagattgccgactggtcgtggcacgatggagctatctcctttgacatcgaaaagatgtaatttacgaaaaaactccttgtgaccttttgggacagcggtg

SEQ ID NO: 422694 - DNA, 140 bp, Artificial Sequence
  Synthetic
caccgctgtcccaaaaggtcacaaggagttttttcgtaaattacatcttttcgatgtcaaaggagatagctccatcgtgccacgaccagtcggcaatctcatggtctactccacacatcacatatcagcagccagggcct

SEQ ID NO: 422695 - DNA, 140 bp, Artificial Sequence
  Synthetic
aggccctggctgctgatatggcagaacaaacgatgctggatcggaccgtgtgatggtatcacccctggccgtgacatggtggaataggaatggcccaacaacaagcacagttcactacccgaccttttgggacagcggtg

SEQ ID NO: 422696 - DNA, 140 bp, Artificial Sequence
  Synthetic
caccgctgtcccaaaaggtcgggtagtgaactgtgcttgttgttgggccattcctattccaccatgtcacggccaggggtgataccatcacacggtccgatccagcatcgtttgttctgccatatcagcagccagggcct

SEQ ID NO: 422697 - DNA, 140 bp, Artificial Sequence
  Synthetic
atacgccatgctgggtctccttattcgtctcagggagcaaaagcagggtagataatcactcactgagtgacatcagtatcatggcgtctcaaggcaccaaacgatcttatgaacagatggcgtacttgggagtcggccat

SEQ ID NO: 422698 - DNA, 140 bp, Artificial Sequence
  Synthetic
atggccgactcccaagtacgccatctgttcataagatcgtttggtgccttgagacgccatgatactgatgtcactcagtgagtgattatctaccctgcttttgctccctgagacgaataaggagacccagcatggcgtat

SEQ ID NO: 422699 - DNA, 140 bp, Artificial Sequence
  Synthetic
atacgccatgctgggtctcccaaatacttgtgttcaaagatcctaactgacacaagtcggcctaatgatcccggaagcgggaactgtgatgcaccgataacaggagggagcccagatcctcgtacttgggagtcggccat

SEQ ID NO: 422700 - DNA, 140 bp, Artificial Sequence
  Synthetic
atggccgactcccaagtacgaggatctgggctccctcctgttatcggtgcatcacagttcccgcttccgggatcattaggccgacttgtgtcagttaggatctttgaacacaagtatttgggagacccagcatggcgtat

SEQ ID NO: 422701 - DNA, 140 bp, Artificial Sequence
  Synthetic
aggccctggctgctgatatgaggatggttggtggaattgggaggttctacatacagatgtgcactgaactcaaactcagcgactatgaagggaggctgatccaaaacagcataacaatcggaccttttgggacagcggtg

SEQ ID NO: 422702 - DNA, 140 bp, Artificial Sequence
  Synthetic
caccgctgtcccaaaaggtccgattgttatgctgttttggatcagcctcccttcatagtcgctgagtttgagttcagtgcacatctgtatgtagaacctcccaattccaccaaccatcctcatatcagcagccagggcct

SEQ ID NO: 422703 - DNA, 140 bp, Artificial Sequence
  Synthetic
atacgccatgctgggtctccgaacatcccagtgcagggaaggacccaaagaagactggaggtccaatttatcgaaggagagatgggaaatgggtgagagaactggtcctgtatgacaaagcgtacttgggagtcggccat

SEQ ID NO: 422704 - DNA, 140 bp, Artificial Sequence
  Synthetic
atggccgactcccaagtacgctttgtcatacaggaccagttctctcacccatttcccatctctccttcgataaattggacctccagtcttctttgggtccttccctgcactgggatgttcggagacccagcatggcgtat

SEQ ID NO: 422705 - DNA, 140 bp, Artificial Sequence
  Synthetic
atacgccatgctgggtctccgctggtctcactcacttgatgatctggcattccaatctgaatgatgccacataccagagaacaagagcactcgtgcgtactggaatggacccccgaatgtcgtacttgggagtcggccat

SEQ ID NO: 422706 - DNA, 140 bp, Artificial Sequence
  Synthetic
atggccgactcccaagtacgacattcgggggtccattccagtacgcacgagtgctcttgttctctggtatgtggcatcattcagattggaatgccagatcatcaagtgagtgagaccagcggagacccagcatggcgtat

SEQ ID NO: 422707 - DNA, 140 bp, Artificial Sequence
  Synthetic
aggccctggctgctgatatgataccagagaacaagagcactcgtgcgtactggaatggacccccgaatgtgctcccttatgcagggatcaactctcccgaggagatctggagctgctggtgaccttttgggacagcggtg

SEQ ID NO: 422708 - DNA, 140 bp, Artificial Sequence
  Synthetic
caccgctgtcccaaaaggtcaccagcagctccagatctcctcgggagagttgatccctgcataagggagcacattcgggggtccattccagtacgcacgagtgctcttgttctctggtatcatatcagcagccagggcct

SEQ ID NO: 422709 - DNA, 140 bp, Artificial Sequence
  Synthetic
atacgccatgctgggtctccttaaaatgaatccaaatcagaaaataataaccattgggtcagtatccttaggattggtaatccttaatattctcctacacatagttagcattacagtaaccgtacttgggagtcggccat

SEQ ID NO: 422710 - DNA, 140 bp, Artificial Sequence
  Synthetic
atggccgactcccaagtacggttactgtaatgctaactatgtgtaggagaatattaaggattaccaatcctaaggatactgacccaatggttattattttctgatttggattcattttaaggagacccagcatggcgtat

SEQ ID NO: 422711 - DNA, 140 bp, Artificial Sequence
  Synthetic
atacgccatgctgggtctccaaaacgagggattaatgatcggaatttctggagaggcgaaaatggacgaaggacaaggattgcatatgagagaatgtgcaacatcctcaaagggaaatttcgtacttgggagtcggccat

SEQ ID NO: 422712 - DNA, 140 bp, Artificial Sequence
  Synthetic
atggccgactcccaagtacgaaatttccctttgaggatgttgcacattctctcatatgcaatccttgtccttcgtccattttcgcctctccagaaattccgatcattaatccctcgttttggagacccagcatggcgtat

SEQ ID NO: 422713 - DNA, 140 bp, Artificial Sequence
  Synthetic
aggccctggctgctgatatgggacaaggattgcatatgagagaatgtgcaacatcctcaaagggaaatttcaaacagcagcacaaagagcaatgatggaccaggtgcgagaaagcaggaagaccttttgggacagcggtg

SEQ ID NO: 422714 - DNA, 140 bp, Artificial Sequence
  Synthetic
caccgctgtcccaaaaggtcttcctgctttctcgcacctggtccatcattgctctttgtgctgctgtttgaaatttccctttgaggatgttgcacattctctcatatgcaatccttgtcccatatcagcagccagggcct

SEQ ID NO: 422715 - DNA, 140 bp, Artificial Sequence
  Synthetic
atacgccatgctgggtctccagcaaaagcaggggaatttcacaaccactcaagatggatacagcatcactgataactatactactagtagtaacagtaagcaatgcagataagatctgcacgtacttgggagtcggccat

SEQ ID NO: 422716 - DNA, 140 bp, Artificial Sequence
  Synthetic
atggccgactcccaagtacgtgcagatcttatctgcattgcttactgttactactagtagtatagttatcagtgatgctgtatccatcttgagtggttgtgaaattcccctgcttttgctggagacccagcatggcgtat

SEQ ID NO: 422717 - DNA, 140 bp, Artificial Sequence
  Synthetic
atacgccatgctgggtctcctcatcctgagaggatcagtggcccataagtcctgcctgcctgcttgtgtgtacggacttgctgtggccagtgggtacgactttgagagagaaggatattccgtacttgggagtcggccat

SEQ ID NO: 422718 - DNA, 140 bp, Artificial Sequence
  Synthetic
atggccgactcccaagtacggaatatccttctctctcaaagtcgtacccactggccacagcaagtccgtacacacaagcaggcaggcaggacttatgggccactgatcctctcaggatgaggagacccagcatggcgtat

SEQ ID NO: 422719 - DNA, 140 bp, Artificial Sequence
  Synthetic
atacgccatgctgggtctccgtctcattagacccaatgagaacccggcacacaagagtcaattggtatggatggcatgccattctgcagcattcgaagacctgagagtctcaagctttatcgtacttgggagtcggccat

SEQ ID NO: 422720 - DNA, 140 bp, Artificial Sequence
  Synthetic
atggccgactcccaagtacgataaagcttgagactctcaggtcttcgaatgctgcagaatggcatgccatccataccaattgactcttgtgtgccgggttctcattgggtctaatgagacggagacccagcatggcgtat

SEQ ID NO: 422721 - DNA, 140 bp, Artificial Sequence
  Synthetic
aggccctggctgctgatatgatggcatgccattctgcagcattcgaagacctgagagtctcaagctttatcagaggaacaagagtagtcccaagaggacaactatccaccagaggagttcgaccttttgggacagcggtg

SEQ ID NO: 422722 - DNA, 140 bp, Artificial Sequence
  Synthetic
caccgctgtcccaaaaggtcgaactcctctggtggatagttgtcctcttgggactactcttgttcctctgataaagcttgagactctcaggtcttcgaatgctgcagaatggcatgccatcatatcagcagccagggcct

SEQ ID NO: 422723 - DNA, 140 bp, Artificial Sequence
  Synthetic
atacgccatgctgggtctccgaaaggggagaaggctaatgtgttgatagggcaaggagacgtagtgttggtaatgaaacggaaacgggactctagcatacttactgacagtcagccaccacgtacttgggagtcggccat

SEQ ID NO: 422724 - DNA, 140 bp, Artificial Sequence
  Synthetic
atggccgactcccaagtacgtggtggctgactgtcagtaagtatgctagagtcccgtttccgtttcattaccaacactacgtctccttgccctatcaacacattagccttctcccctttcggagacccagcatggcgtat

SEQ ID NO: 422725 - DNA, 140 bp, Artificial Sequence
  Synthetic
atacgccatgctgggtctccctgaggagcagatattgggctataagaaccaggagtggaggaaacaccaaccaacagagagcatctgcaggacaaatcagtgtacagcccactttctcagcgtacttgggagtcggccat

SEQ ID NO: 422726 - DNA, 140 bp, Artificial Sequence
  Synthetic
atggccgactcccaagtacgctgagaaagtgggctgtacactgatttgtcctgcagatgctctctgttggttggtgtttcctccactcctggttcttatagcccaatatctgctcctcagggagacccagcatggcgtat

SEQ ID NO: 422727 - DNA, 140 bp, Artificial Sequence
  Synthetic
aggccctggctgctgatatgcattgaaattggagtgacacggagggaagtccacatatactacctagaaaaagccaacaagataaagtccgaaaagacacacatccacattttctcattcgaccttttgggacagcggtg

SEQ ID NO: 422728 - DNA, 140 bp, Artificial Sequence
  Synthetic
caccgctgtcccaaaaggtcgaatgagaaaatgtggatgtgtgtcttttcggactttatcttgttggctttttctaggtagtatatgtggacttccctccgtgtcactccaatttcaatgcatatcagcagccagggcct

SEQ ID NO: 422729 - DNA, 140 bp, Artificial Sequence
  Synthetic
aggccctggctgctgatatggatggaaagtgccagaccagaagatgtgtctttccaggggcggggagtcttcgagctctcggacgaaaaggcaacgaacccgatcgtgccttcctttgacgaccttttgggacagcggtg

SEQ ID NO: 422730 - DNA, 140 bp, Artificial Sequence
  Synthetic
caccgctgtcccaaaaggtcgtcaaaggaaggcacgatcgggttcgttgccttttcgtccgagagctcgaagactccccgcccctggaaagacacatcttctggtctggcactttccatccatatcagcagccagggcct

SEQ ID NO: 422731 - DNA, 140 bp, Artificial Sequence
  Synthetic
aggccctggctgctgatatgtcgagctctcggacgaaaaggcaacgaacccgatcgtgccttcctttgacatgagtaatgaaggatcttatttcttcggagacaatgcagaggagtatgagaccttttgggacagcggtg

SEQ ID NO: 422732 - DNA, 140 bp, Artificial Sequence
  Synthetic
caccgctgtcccaaaaggtctcatactcctctgcattgtctccgaagaaataagatccttcattactcatgtcaaaggaaggcacgatcgggttcgttgccttttcgtccgagagctcgacatatcagcagccagggcct

SEQ ID NO: 422733 - DNA, 140 bp, Artificial Sequence
  Synthetic
aggccctggctgctgatatgagcgcaaaatgctataagtactacattcccttatactggtgaccctccatacagccatggaacaggaacaggatataccatggacacagtcaacagaacagaccttttgggacagcggtg

SEQ ID NO: 422734 - DNA, 140 bp, Artificial Sequence
  Synthetic
caccgctgtcccaaaaggtctgttctgttgactgtgtccatggtatatcctgttcctgttccatggctgtatggagggtcaccagtataagggaatgtagtacttatagcattttgcgctcatatcagcagccagggcct

SEQ ID NO: 422735 - DNA, 140 bp, Artificial Sequence
  Synthetic
aggccctggctgctgatatgctttaagctacattttctgtctggctttcggtcaggatcttccagggaatgacaacagtacagcgacactgtgcctgggacatcatgcagtaccgaatgggaccttttgggacagcggtg

SEQ ID NO: 422736 - DNA, 140 bp, Artificial Sequence
  Synthetic
caccgctgtcccaaaaggtcccattcggtactgcatgatgtcccaggcacagtgtcgctgtactgttgtcattccctggaagatcctgaccgaaagccagacagaaaatgtagcttaaagcatatcagcagccagggcct

SEQ ID NO: 422737 - DNA, 140 bp, Artificial Sequence
  Synthetic
atacgccatgctgggtctccgacaacagtacagcgacactgtgcctgggacatcatgcagtaccgaatggaccaatagtaaagacaatcacagatgatcaaattgaggtaactaatgctacgtacttgggagtcggccat

SEQ ID NO: 422738 - DNA, 140 bp, Artificial Sequence
  Synthetic
atggccgactcccaagtacgtagcattagttacctcaatttgatcatctgtgattgtctttactattggtccattcggtactgcatgatgtcccaggcacagtgtcgctgtactgttgtcggagacccagcatggcgtat

SEQ ID NO: 422739 - DNA, 140 bp, Artificial Sequence
  Synthetic
atacgccatgctgggtctccgaactgcatctttgtcgcctgggatgatgatgggaatgtttaatatgctatctaccgtgttgggagtagctgcactaggtatcaagaacattggaaacaacgtacttgggagtcggccat

SEQ ID NO: 422740 - DNA, 140 bp, Artificial Sequence
  Synthetic
atggccgactcccaagtacgttgtttccaatgttcttgatacctagtgcagctactcccaacacggtagatagcatattaaacattcccatcatcatcccaggcgacaaagatgcagttcggagacccagcatggcgtat

SEQ ID NO: 422741 - DNA, 140 bp, Artificial Sequence
  Synthetic
atacgccatgctgggtctccagggtcctcgatggaagagactgtgcactaatagacgccctattgggggatccccactgtgatgtctttcaagatgaaacatgggacctttttgtggagccgtacttgggagtcggccat

SEQ ID NO: 422742 - DNA, 140 bp, Artificial Sequence
  Synthetic
atggccgactcccaagtacggctccacaaaaaggtcccatgtttcatcttgaaagacatcacagtggggatcccccaatagggcgtctattagtgcacagtctcttccatcgaggaccctggagacccagcatggcgtat

SEQ ID NO: 422743 - DNA, 140 bp, Artificial Sequence
  Synthetic
aggccctggctgctgatatgtccccactgtgatgtctttcaagatgaaacatgggacctttttgtggagcggagcaatgctttcagcaattgttacccttacgatgtaccagactatgcagaccttttgggacagcggtg

SEQ ID NO: 422744 - DNA, 140 bp, Artificial Sequence
  Synthetic
caccgctgtcccaaaaggtctgcatagtctggtacatcgtaagggtaacaattgctgaaagcattgctccgctccacaaaaaggtcccatgtttcatcttgaaagacatcacagtggggacatatcagcagccagggcct

SEQ ID NO: 422745 - DNA, 140 bp, Artificial Sequence
  Synthetic
atacgccatgctgggtctccttaatgcaaaggatgaagaaacatgtatggaaggaataaacgacttttaccgaacatgtaaattattgggaataaacatgagcaaaaagaaaagttactgcgtacttgggagtcggccat

SEQ ID NO: 422746 - DNA, 140 bp, Artificial Sequence
  Synthetic
atggccgactcccaagtacgcagtaacttttctttttgctcatgtttattcccaataatttacatgttcggtaaaagtcgtttattccttccatacatgtttcttcatcctttgcattaaggagacccagcatggcgtat

SEQ ID NO: 422747 - DNA, 140 bp, Artificial Sequence
  Synthetic
atacgccatgctgggtctcctaatgagactggaatgtttgaatttacaagcatgttctacagagatggatttgtatctaattttgcaatggaactcccttcgtttggggttgctggagtacgtacttgggagtcggccat

SEQ ID NO: 422748 - DNA, 140 bp, Artificial Sequence
  Synthetic
atggccgactcccaagtacgtactccagcaaccccaaacgaagggagttccattgcaaaattagatacaaatccatctctgtagaacatgcttgtaaattcaaacattccagtctcattaggagacccagcatggcgtat

SEQ ID NO: 422749 - DNA, 140 bp, Artificial Sequence
  Synthetic
atacgccatgctgggtctcctttatagtacggtatcgagcagtctggtcttggtagggctgatcatagcaatgggtctttggatgtgttcaaatggttcaatgcaatgcaggatatgtatcgtacttgggagtcggccat

SEQ ID NO: 422750 - DNA, 140 bp, Artificial Sequence
  Synthetic
atggccgactcccaagtacgatacatatcctgcattgcattgaaccatttgaacacatccaaagacccattgctatgatcagccctaccaagaccagactgctcgataccgtactataaaggagacccagcatggcgtat

SEQ ID NO: 422751 - DNA, 140 bp, Artificial Sequence
  Synthetic
aggccctggctgctgatatggaaagccaacaagataaaatccgagaagacacacattcacatcttttcatttactggagaagaaatggccaccaaagcagactatacccttgatgaagaagaccttttgggacagcggtg

SEQ ID NO: 422752 - DNA, 140 bp, Artificial Sequence
  Synthetic
caccgctgtcccaaaaggtcttcttcatcaagggtatagtctgctttggtggccatttcttctccagtaaatgaaaagatgtgaatgtgtgtcttctcggattttatcttgttggctttccatatcagcagccagggcct

SEQ ID NO: 422753 - DNA, 140 bp, Artificial Sequence
  Synthetic
atacgccatgctgggtctccaacagaccagcttatacgttcaagcatcaggaagagtcactgtctctaccaggagaagtcaacagactataatcccaaacattggatctagaccttgggtcgtacttgggagtcggccat

SEQ ID NO: 422754 - DNA, 140 bp, Artificial Sequence
  Synthetic
atggccgactcccaagtacgacccaaggtctagatccaatgtttgggattatagtctgttgacttctcctggtagagacagtgactcttcctgatgcttgaacgtataagctggtctgttggagacccagcatggcgtat

SEQ ID NO: 422755 - DNA, 140 bp, Artificial Sequence
  Synthetic
atacgccatgctgggtctccttaatggtggcctacatgttggagagagaactggttcgcaaaacaagatttctaccggtagctggagggacaagcagtgtgtatatcgaagtgttgcattcgtacttgggagtcggccat

SEQ ID NO: 422756 - DNA, 140 bp, Artificial Sequence
  Synthetic
atggccgactcccaagtacgaatgcaacacttcgatatacacactgcttgtccctccagctaccggtagaaatcttgttttgcgaaccagttctctctccaacatgtaggccaccattaaggagacccagcatggcgtat

SEQ ID NO: 422757 - DNA, 140 bp, Artificial Sequence
  Synthetic
atacgccatgctgggtctccttcaaatgacactgtacatgataggaccccttaccgaaccctattgatgaatgaattgggtgttccatttcatttgggaaccaggcaagtgtgcatagcacgtacttgggagtcggccat

SEQ ID NO: 422758 - DNA, 140 bp, Artificial Sequence
  Synthetic
atggccgactcccaagtacgtgctatgcacacttgcctggttcccaaatgaaatggaacacccaattcattcatcaatagggttcggtaaggggtcctatcatgtacagtgtcatttgaaggagacccagcatggcgtat

SEQ ID NO: 422759 - DNA, 140 bp, Artificial Sequence
  Synthetic
atacgccatgctgggtctccaactggggatgataaaaatgcaactgctagcttcatttacaatgggaggctagtagatagtatcggttcatggtccaaaaatatactaagaacccaggagcgtacttgggagtcggccat

SEQ ID NO: 422760 - DNA, 140 bp, Artificial Sequence
  Synthetic
atggccgactcccaagtacgctcctgggttcttagtatatttttggaccatgaaccgatactatctactagcctcccattgtaaatgaagctagcagttgcatttttatcatccccagttggagacccagcatggcgtat

SEQ ID NO: 422761 - DNA, 140 bp, Artificial Sequence
  Synthetic
aggccctggctgctgatatgaaaatggatgggaagggatgatagatggttggtatggtttcaggcaccaaaattccgaaggtacaggacaagcagcagaccttaaaagcactcaggcagcgaccttttgggacagcggtg

SEQ ID NO: 422762 - DNA, 140 bp, Artificial Sequence
  Synthetic
caccgctgtcccaaaaggtcgctgcctgagtgcttttaaggtctgctgcttgtcctgtaccttcggaattttggtgcctgaaaccataccaaccatctatcatcccttcccatccattttcatatcagcagccagggcct

SEQ ID NO: 422763 - DNA, 140 bp, Artificial Sequence
  Synthetic
aggccctggctgctgatatgaaccacgctggacaacaaacattcaaatggcacaatacatgatagaacccctcaccggacccttttgatgagtgagttgggtgttccgtttcatttgggagaccttttgggacagcggtg

SEQ ID NO: 422764 - DNA, 140 bp, Artificial Sequence
  Synthetic
caccgctgtcccaaaaggtctcccaaatgaaacggaacacccaactcactcatcaaaagggtccggtgaggggttctatcatgtattgtgccatttgaatgtttgttgtccagcgtggttcatatcagcagccagggcct

SEQ ID NO: 422765 - DNA, 140 bp, Artificial Sequence
  Synthetic
atacgccatgctgggtctccgacgggaaatggatgagagagctgattctgtatgacaaagaggagatcaggagaatctggcgtcaagcgaataatggagaagacgcaactgctggtctcacgtacttgggagtcggccat

SEQ ID NO: 422766 - DNA, 140 bp, Artificial Sequence
  Synthetic
atggccgactcccaagtacgtgagaccagcagttgcgtcttctccattattcgcttgacgccagattctcctgatctcctctttgtcatacagaatcagctctctcatccatttcccgtcggagacccagcatggcgtat

SEQ ID NO: 422767 - DNA, 140 bp, Artificial Sequence
  Synthetic
atacgccatgctgggtctccagaaattccatcaaattgaaaaggaattctctgaagtagaagggaggatccaggaccttgagaaatacgttgaggacacaaagatagatctctggtcttacgtacttgggagtcggccat

SEQ ID NO: 422768 - DNA, 140 bp, Artificial Sequence
  Synthetic
atggccgactcccaagtacgtaagaccagagatctatctttgtgtcctcaacgtatttctcaaggtcctggatcctcccttctacttcagagaattccttttcaatttgatggaatttctggagacccagcatggcgtat

SEQ ID NO: 422769 - DNA, 140 bp, Artificial Sequence
  Synthetic
atacgccatgctgggtctccaggtggtcatggggtgaaaggttgggcctttgatgatggagatgacgtgtggatgggaagaacgatcagcgagaagtcacgcttaggctatgaaaccttccgtacttgggagtcggccat

SEQ ID NO: 422770 - DNA, 140 bp, Artificial Sequence
  Synthetic
atggccgactcccaagtacggaaggtttcatagcctaagcgtgacttctcgctgatcgttcttcccatccacacgtcatctccatcatcaaaggcccaacctttcaccccatgaccacctggagacccagcatggcgtat

SEQ ID NO: 422771 - DNA, 140 bp, Artificial Sequence
  Synthetic
atacgccatgctgggtctccccgattcagaaatgaacaaattgtttgaaaagaccagaagacaattgagagaaaatgctgaggatatgggcaatggttgtttcaagatataccacaaatgcgtacttgggagtcggccat

SEQ ID NO: 422772 - DNA, 140 bp, Artificial Sequence
  Synthetic
atggccgactcccaagtacgcatttgtggtatatcttgaaacaaccattgcccatatcctcagcattttctctcaattgtcttctggtcttttcaaacaatttgttcatttctgaatcggggagacccagcatggcgtat

SEQ ID NO: 422773 - DNA, 140 bp, Artificial Sequence
  Synthetic
aggccctggctgctgatatggaaaatgctgaggatatgggcaatggttgtttcaagatataccacaaatgtgacaatgcttgcatagaatcaattagaaacgggacttacaatcatgacagaccttttgggacagcggtg

SEQ ID NO: 422774 - DNA, 140 bp, Artificial Sequence
  Synthetic
caccgctgtcccaaaaggtctgtcatgattgtaagtcccgtttctaattgattctatgcaagcattgtcacatttgtggtatatcttgaaacaaccattgcccatatcctcagcattttccatatcagcagccagggcct

SEQ ID NO: 422775 - DNA, 140 bp, Artificial Sequence
  Synthetic
atacgccatgctgggtctcccctgccggtagcaggcgggacaagcagtgtgtacattgaggtattgcacttgactcaaggaacttgctgggaacagatgtacactccaggtggggaggtgcgtacttgggagtcggccat

SEQ ID NO: 422776 - DNA, 140 bp, Artificial Sequence
  Synthetic
atggccgactcccaagtacgcacctccccacctggagtgtacatctgttcccagcaagttccttgagtcaagtgcaatacctcaatgtacacactgcttgtcccgcctgctaccggcaggggagacccagcatggcgtat

SEQ ID NO: 422777 - DNA, 140 bp, Artificial Sequence
  Synthetic
atacgccatgctgggtctccctaaaatctggatacaaagactggatcctgtggatttcctttgccatatcatgctttttgctttgtgttgttttgctggggttcattatgtgggcctgcccgtacttgggagtcggccat

SEQ ID NO: 422778 - DNA, 140 bp, Artificial Sequence
  Synthetic
atggccgactcccaagtacgggcaggcccacataatgaaccccagcaaaacaacacaaagcaaaaagcatgatatggcaaaggaaatccacaggatccagtctttgtatccagattttagggagacccagcatggcgtat

SEQ ID NO: 422779 - DNA, 140 bp, Artificial Sequence
  Synthetic
aggccctggctgctgatatgatgctttttgctttgtgttgttttgctggggttcattatgtgggcctgccagagaggcaacattaggtgcaacatttgcatttgagtatactaataattagaccttttgggacagcggtg

SEQ ID NO: 422780 - DNA, 140 bp, Artificial Sequence
  Synthetic
caccgctgtcccaaaaggtctaattattagtatactcaaatgcaaatgttgcacctaatgttgcctctctggcaggcccacataatgaaccccagcaaaacaacacaaagcaaaaagcatcatatcagcagccagggcct

SEQ ID NO: 422781 - DNA, 140 bp, Artificial Sequence
  Synthetic
aggccctggctgctgatatggcactcagcagcaacagccatttactgtttaatgggctcaggacagttgctgtgggacactgtcacaggtgttgacatggctctgtaatggaggaatggtgaccttttgggacagcggtg

SEQ ID NO: 422782 - DNA, 140 bp, Artificial Sequence
  Synthetic
caccgctgtcccaaaaggtcaccattcctccattacagagccatgtcaacacctgtgacagtgtcccacagcaactgtcctgagcccattaaacagtaaatggctgttgctgctgagtgccatatcagcagccagggcct

SEQ ID NO: 422783 - DNA, 140 bp, Artificial Sequence
  Synthetic
aggccctggctgctgatatgaaatgaagagaaaatcccaaggacaaaaaacatgaagagaacaagccaattgaagtgggcactcggtgaaaatatggcaccagaaaaagtagactttgatgaccttttgggacagcggtg

SEQ ID NO: 422784 - DNA, 140 bp, Artificial Sequence
  Synthetic
caccgctgtcccaaaaggtcatcaaagtctactttttctggtgccatattttcaccgagtgcccacttcaattggcttgttctcttcatgttttttgtccttgggattttctcttcatttcatatcagcagccagggcct

SEQ ID NO: 422785 - DNA, 140 bp, Artificial Sequence
  Synthetic
atacgccatgctgggtctcccagaagcatgagatggttgactcaaaagaacaacgcttaccctattcaagacgcccaatacacaaataatcaagaaaagaacattcttttcatgtggggccgtacttgggagtcggccat

SEQ ID NO: 422786 - DNA, 140 bp, Artificial Sequence
  Synthetic
atggccgactcccaagtacggccccacatgaaaagaatgttcttttcttgattatttgtgtattgggcgtcttgaatagggtaagcgttgttcttttgagtcaaccatctcatgcttctgggagacccagcatggcgtat

SEQ ID NO: 422787 - DNA, 140 bp, Artificial Sequence
  Synthetic
atacgccatgctgggtctcctgagggacgactaatccaaaatagcataacaatagagagaatggtgctctctgctttcgatgagagaagaaataagtacctagaagagcatcccagtgctcgtacttgggagtcggccat

SEQ ID NO: 422788 - DNA, 140 bp, Artificial Sequence
  Synthetic
atggccgactcccaagtacgagcactgggatgctcttctaggtacttatttcttctctcatcgaaagcagagagcaccattctctctattgttatgctattttggattagtcgtccctcaggagacccagcatggcgtat

SEQ ID NO: 422789 - DNA, 140 bp, Artificial Sequence
  Synthetic
atacgccatgctgggtctccagaagaatctgatgaggcacttaaaatgactattgcttcagtgccgacttcacgctacctaactgacatgactcttgaagagatgtcaagggactggttccgtacttgggagtcggccat

SEQ ID NO: 422790 - DNA, 140 bp, Artificial Sequence
  Synthetic
atggccgactcccaagtacggaaccagtcccttgacatctcttcaagagtcatgtcagttaggtagcgtgaagtcggcactgaagcaatagtcattttaagtgcctcatcagattcttctggagacccagcatggcgtat

SEQ ID NO: 422791 - DNA, 140 bp, Artificial Sequence
  Synthetic
aggccctggctgctgatatgcacgctacctaactgacatgactcttgaagagatgtcaagggactggttcatgctcatgcccaaacagaaagtagcaggttccctttgcatcaaaatggagaccttttgggacagcggtg

SEQ ID NO: 422792 - DNA, 140 bp, Artificial Sequence
  Synthetic
caccgctgtcccaaaaggtctccattttgatgcaaagggaacctgctactttctgtttgggcatgagcatgaaccagtcccttgacatctcttcaagagtcatgtcagttaggtagcgtgcatatcagcagccagggcct

SEQ ID NO: 422793 - DNA, 140 bp, Artificial Sequence
  Synthetic
aggccctggctgctgatatgaaagtggatgagagaactcattctttatgacaaagaagaaataaggagagtttggcgccaagcaaacaatggtgaagatgcaacagctggccttactcatgaccttttgggacagcggtg

SEQ ID NO: 422794 - DNA, 140 bp, Artificial Sequence
  Synthetic
caccgctgtcccaaaaggtcatgagtaaggccagctgttgcatcttcaccattgtttgcttggcgccaaactctccttatttcttctttgtcataaagaatgagttctctcatccactttcatatcagcagccagggcct

SEQ ID NO: 422795 - DNA, 140 bp, Artificial Sequence
  Synthetic
aggccctggctgctgatatgtttttgaccggctggaaaccctaatactacttagagctttcacagaagaaggagcaattgtgggagaaatctcaccattaccttctcttccaggacatacgaccttttgggacagcggtg

SEQ ID NO: 422796 - DNA, 140 bp, Artificial Sequence
  Synthetic
caccgctgtcccaaaaggtcgtatgtcctggaagagaaggtaatggtgagatttctcccacaattgctccttcttctgtgaaagctctaagtagtattagggtttccagccggtcaaaaacatatcagcagccagggcct

SEQ ID NO: 422797 - DNA, 140 bp, Artificial Sequence
  Synthetic
aggccctggctgctgatatgacaacacactttcaaagaaaaaggagagtaagggacaacatgaccaagaaaatggtcacacaaagaacaatagggaagaaaaaacaaagagtgaataagagaccttttgggacagcggtg

SEQ ID NO: 422798 - DNA, 140 bp, Artificial Sequence
  Synthetic
caccgctgtcccaaaaggtctcttattcactctttgttttttcttccctattgttctttgtgtgaccattttcttggtcatgttgtcccttactctcctttttctttgaaagtgtgttgtcatatcagcagccagggcct

SEQ ID NO: 422799 - DNA, 140 bp, Artificial Sequence
  Synthetic
aggccctggctgctgatatgggaatgataacacagttcgagtctctgaaactctacagagattcgcttggagaagcagtaatgaggatgggagaccttcactccctccaaagcagaaacggaccttttgggacagcggtg

SEQ ID NO: 422800 - DNA, 140 bp, Artificial Sequence
  Synthetic
caccgctgtcccaaaaggtccgtttctgctttggagggagtgaaggtctcccatcctcattactgcttctccaagcgaatctctgtagagtttcagagactcgaactgtgttatcattcccatatcagcagccagggcct

SEQ ID NO: 422801 - DNA, 140 bp, Artificial Sequence
  Synthetic
aggccctggctgctgatatgatagaggtcttcagatcgaacggtctaacagctaatgaatcggggagactcattgatttccttaaggatgtgatggattcaatggataaagaagggatgggaccttttgggacagcggtg

SEQ ID NO: 422802 - DNA, 140 bp, Artificial Sequence
  Synthetic
caccgctgtcccaaaaggtcccatcccttctttatccattgaatccatcacatccttaaggaaatcaatgagtctccccgattcattagctgttagaccgttcgatctgaagacctctatcatatcagcagccagggcct

SEQ ID NO: 422803 - DNA, 140 bp, Artificial Sequence
  Synthetic
aggccctggctgctgatatggaaaatggcgagaacaattgagtcagaagtttgaagaaataagatggctgattgaagaagtgcgacatagattgaagatcacagagaacagcttcgaacagaccttttgggacagcggtg

SEQ ID NO: 422804 - DNA, 140 bp, Artificial Sequence
  Synthetic
caccgctgtcccaaaaggtctgttcgaagctgttctctgtgatcttcaatctatgtcgcacttcttcaatcagccatcttatttcttcaaacttctgactcaattgttctcgccattttccatatcagcagccagggcct

SEQ ID NO: 422805 - DNA, 140 bp, Artificial Sequence
  Synthetic
atacgccatgctgggtctcctgatggatgctctgaagttgagcattgaggacccaagtcatgaaggggaggggataccgctatatgatgcgatcaaatgcatgaaaacattcttcggctgcgtacttgggagtcggccat

SEQ ID NO: 422806 - DNA, 140 bp, Artificial Sequence
  Synthetic
atggccgactcccaagtacgcagccgaagaatgttttcatgcatttgatcgcatcatatagcggtatcccctccccttcatgacttgggtcctcaatgctcaacttcagagcatccatcaggagacccagcatggcgtat

SEQ ID NO: 422807 - DNA, 140 bp, Artificial Sequence
  Synthetic
atacgccatgctgggtctccaacaattggaacacatcctagctccagtgccggtctgaaagatgaccttcttgaaaatttgcaggcctaccagaaacggatgggagtgcagatacagcgacgtacttgggagtcggccat

SEQ ID NO: 422808 - DNA, 140 bp, Artificial Sequence
  Synthetic
atggccgactcccaagtacgtcgctgtatctgcactcccatccgtttctggtaggcctgcaaattttcaagaaggtcatctttcagaccggcactggagctaggatgtgttccaattgttggagacccagcatggcgtat

SEQ ID NO: 422809 - DNA, 140 bp, Artificial Sequence
  Synthetic
atacgccatgctgggtctccgctgagattgaagatctcattttcctggcacggtcagcacttattctaaggggatcagttgcacataagtcttgcctgcctgcttgtgtgtatgggcttgcgtacttgggagtcggccat

SEQ ID NO: 422810 - DNA, 140 bp, Artificial Sequence
  Synthetic
atggccgactcccaagtacgcaagcccatacacacaagcaggcaggcaagacttatgtgcaactgatccccttagaataagtgctgaccgtgccaggaaaatgagatcttcaatctcagcggagacccagcatggcgtat

SEQ ID NO: 422811 - DNA, 140 bp, Artificial Sequence
  Synthetic
aggccctggctgctgatatggaggatcagctcctcctttagctttggaggtttcactttcaaaagaacaagtggatcatccgttaaaagagaagaagaagtgcttacaggcaatctccaagaccttttgggacagcggtg

SEQ ID NO: 422812 - DNA, 140 bp, Artificial Sequence
  Synthetic
caccgctgtcccaaaaggtcttggagattgcctgtaagcacttcttcttctcttttaacggatgatccacttgttcttttgaaagtgaaacctccaaagctaaaggaggagctgatcctccatatcagcagccagggcct

SEQ ID NO: 422813 - DNA, 140 bp, Artificial Sequence
  Synthetic
aggccctggctgctgatatggaagtgactaatgctactgagctggtccagagttcctcaacaggtagaatatgcaacagtcctcaccaaatccttgatgggaaaaattgcacactgataggaccttttgggacagcggtg

SEQ ID NO: 422814 - DNA, 140 bp, Artificial Sequence
  Synthetic
caccgctgtcccaaaaggtcctatcagtgtgcaatttttcccatcaaggatttggtgaggactgttgcatattctacctgttgaggaactctggaccagctcagtagcattagtcacttccatatcagcagccagggcct

SEQ ID NO: 422815 - DNA, 140 bp, Artificial Sequence
  Synthetic
atacgccatgctgggtctccgatagaagcccatttcgagctctcgtgagttgggagatgggtcaagcacccagtccatacaatgttaaggtcgaatgcgtaggatggtcgagcacatcgtcgtacttgggagtcggccat

SEQ ID NO: 422816 - DNA, 140 bp, Artificial Sequence
  Synthetic
atggccgactcccaagtacgacgatgtgctcgaccatcctacgcattcgaccttaacattgtatggactgggtgcttgacccatctcccaactcacgagagctcgaaatgggcttctatcggagacccagcatggcgtat

SEQ ID NO: 422817 - DNA, 140 bp, Artificial Sequence
  Synthetic
aggccctggctgctgatatgcaaaaaaagctacctaataagggcattgacattgaatacaatgaccaaagatgcagaaagaggtaaattgaagaggagggcgattgcaacacctggaatggaccttttgggacagcggtg

SEQ ID NO: 422818 - DNA, 140 bp, Artificial Sequence
  Synthetic
caccgctgtcccaaaaggtccattccaggtgttgcaatcgccctcctcttcaatttacctctttctgcatctttggtcattgtattcaatgtcaatgcccttattaggtagctttttttgcatatcagcagccagggcct

SEQ ID NO: 422819 - DNA, 140 bp, Artificial Sequence
  Synthetic
aggccctggctgctgatatgtggaatttacccaagaaagcttcaattggactggagttgctcaagacggatcaagctatgcctgcagaaggggatctgttaacagtttctttagtagattgaccttttgggacagcggtg

SEQ ID NO: 422820 - DNA, 140 bp, Artificial Sequence
  Synthetic
caccgctgtcccaaaaggtcaatctactaaagaaactgttaacagatccccttctgcaggcatagcttgatccgtcttgagcaactccagtccaattgaagctttcttgggtaaattccacatatcagcagccagggcct

SEQ ID NO: 422821 - DNA, 140 bp, Artificial Sequence
  Synthetic
atacgccatgctgggtctccatgcgaataataccactgacgactatactactattagtaacaacaagcaatgcagataaaatatgcattggccaccagtcaacaaattccacagaaactgcgtacttgggagtcggccat

SEQ ID NO: 422822 - DNA, 140 bp, Artificial Sequence
  Synthetic
atggccgactcccaagtacgcagtttctgtggaatttgttgactggtggccaatgcatattttatctgcattgcttgttgttactaatagtagtatagtcgtcagtggtattattcgcatggagacccagcatggcgtat

SEQ ID NO: 422823 - DNA, 140 bp, Artificial Sequence
  Synthetic
atacgccatgctgggtctccctaatgcaccaatggacaaatgtgattcgaagtgtcaaacacctaagggagctataaacagcagtcttcctttccagaatgtacacccagtcacaataggcgtacttgggagtcggccat

SEQ ID NO: 422824 - DNA, 140 bp, Artificial Sequence
  Synthetic
atggccgactcccaagtacgcctattgtgactgggtgtacattctggaaaggaagactgctgtttatagctcccttaggtgtttgacacttcgaatcacatttgtccattggtgcattagggagacccagcatggcgtat

SEQ ID NO: 422825 - DNA, 140 bp, Artificial Sequence
  Synthetic
aggccctggctgctgatatgaaagcactcaagcagcaatcaaccaaatcaccgggaaactaaatagagtaatcaagaaaacgaacgagaaattccatcaaatcgaaaaagaattctcagagaccttttgggacagcggtg

SEQ ID NO: 422826 - DNA, 140 bp, Artificial Sequence
  Synthetic
caccgctgtcccaaaaggtctctgagaattctttttcgatttgatggaatttctcgttcgttttcttgattactctatttagtttcccggtgatttggttgattgctgcttgagtgctttcatatcagcagccagggcct

SEQ ID NO: 422827 - DNA, 140 bp, Artificial Sequence
  Synthetic
atacgccatgctgggtctccatcaagaaaacgaacgagaaattccatcaaatcgaaaaagaattctcagaagtagaagggagaattcaggacctagagaaatacgttgaagacactaaaacgtacttgggagtcggccat

SEQ ID NO: 422828 - DNA, 140 bp, Artificial Sequence
  Synthetic
atggccgactcccaagtacgttttagtgtcttcaacgtatttctctaggtcctgaattctcccttctacttctgagaattctttttcgatttgatggaatttctcgttcgttttcttgatggagacccagcatggcgtat

SEQ ID NO: 422829 - DNA, 140 bp, Artificial Sequence
  Synthetic
aggccctggctgctgatatgagtagaagggagaattcaggacctagagaaatacgttgaagacactaaaatagatctctggtcttacaacgctgagcttcttgttgccctggagaaccaagaccttttgggacagcggtg

SEQ ID NO: 422830 - DNA, 140 bp, Artificial Sequence
  Synthetic
caccgctgtcccaaaaggtcttggttctccagggcaacaagaagctcagcgttgtaagaccagagatctattttagtgtcttcaacgtatttctctaggtcctgaattctcccttctactcatatcagcagccagggcct

SEQ ID NO: 422831 - DNA, 140 bp, Artificial Sequence
  Synthetic
aggccctggctgctgatatgaagaaggcaactgcgggaaaatgctgaggacatgggcaatggttgcttcaaaatataccacaaatgtgacaatgcctgcataggatcaatcagaaatggagaccttttgggacagcggtg

SEQ ID NO: 422832 - DNA, 140 bp, Artificial Sequence
  Synthetic
caccgctgtcccaaaaggtctccatttctgattgatcctatgcaggcattgtcacatttgtggtatattttgaagcaaccattgcccatgtcctcagcattttcccgcagttgccttcttcatatcagcagccagggcct

SEQ ID NO: 422833 - DNA, 140 bp, Artificial Sequence
  Synthetic
aggccctggctgctgatatgtccgaatgcactattaaaacaccgatttgaaataatcgaagggagagaccgaacgatggcctggacagtggtgaatagcatctgcaacaccacaggagtcgaccttttgggacagcggtg

SEQ ID NO: 422834 - DNA, 140 bp, Artificial Sequence
  Synthetic
caccgctgtcccaaaaggtcgactcctgtggtgttgcagatgctattcaccactgtccaggccatcgttcggtctctcccttcgattatttcaaatcggtgttttaatagtgcattcggacatatcagcagccagggcct

SEQ ID NO: 422835 - DNA, 140 bp, Artificial Sequence
  Synthetic
aggccctggctgctgatatgcattgaaattggagtgacacggagagaagttcacatatactatctagaaaaagccaacaagataaagtctgagaagacacacatccacatattctcattcgaccttttgggacagcggtg

SEQ ID NO: 422836 - DNA, 140 bp, Artificial Sequence
  Synthetic
caccgctgtcccaaaaggtcgaatgagaatatgtggatgtgtgtcttctcagactttatcttgttggctttttctagatagtatatgtgaacttctctccgtgtcactccaatttcaatgcatatcagcagccagggcct

SEQ ID NO: 422837 - DNA, 140 bp, Artificial Sequence
  Synthetic
aggccctggctgctgatatgctaaattggcaaatgttgtaagaaagatgatgactaattcgcaagacacagagctctccttcacaattactggggacaacaccaagtggaatgaaaatcagaccttttgggacagcggtg

SEQ ID NO: 422838 - DNA, 140 bp, Artificial Sequence
  Synthetic
caccgctgtcccaaaaggtctgattttcattccacttggtgttgtccccagtaattgtgaaggagagctctgtgtcttgcgaattagtcatcatctttcttacaacatttgccaatttagcatatcagcagccagggcct

SEQ ID NO: 422839 - DNA, 140 bp, Artificial Sequence
  Synthetic
aggccctggctgctgatatggacagattcaagctggattgaacttgatgaaataggagaggacattgctccaattgagcacattgcaagtatgagaagaaattatttcacagcagaagtagaccttttgggacagcggtg

SEQ ID NO: 422840 - DNA, 140 bp, Artificial Sequence
  Synthetic
caccgctgtcccaaaaggtctacttctgctgtgaaataatttcttctcatacttgcaatgtgctcaattggagcaatgtcctctcctatttcatcaagttcaatccagcttgaatctgtccatatcagcagccagggcct

SEQ ID NO: 422841 - DNA, 140 bp, Artificial Sequence
  Synthetic
aggccctggctgctgatatgaaagaagtgaacgccagaattgagccttttctgaagacaacaccgcgccctctcaggttacccaatgggcctccctgctcccagcggtcaaagttcctgtgaccttttgggacagcggtg

SEQ ID NO: 422842 - DNA, 140 bp, Artificial Sequence
  Synthetic
caccgctgtcccaaaaggtcacaggaactttgaccgctgggagcagggaggcccattgggtaacctgagagggcgcggtgttgtcttcagaaaaggctcaattctggcgttcacttctttcatatcagcagccagggcct

SEQ ID NO: 422843 - DNA, 140 bp, Artificial Sequence
  Synthetic
aggccctggctgctgatatgcagtccatacaatgttaaggtcgaatgcgtaggatggtcgagcacatcgtgccatgatggcatatcaagaatgtcaatatgcatgtcgggaccgaacaacgaccttttgggacagcggtg

SEQ ID NO: 422844 - DNA, 140 bp, Artificial Sequence
  Synthetic
caccgctgtcccaaaaggtcgttgttcggtcccgacatgcatattgacattcttgatatgccatcatggcacgatgtgctcgaccatcctacgcattcgaccttaacattgtatggactgcatatcagcagccagggcct

SEQ ID NO: 422845 - DNA, 140 bp, Artificial Sequence
  Synthetic
aggccctggctgctgatatggggataccgctgtatgatgcgatcaaatgcatgaagacatttttcggctggaaagagcccaatattgtaaagccacatgaaaagggcataaaccccaattgaccttttgggacagcggtg

SEQ ID NO: 422846 - DNA, 140 bp, Artificial Sequence
  Synthetic
caccgctgtcccaaaaggtcaattggggtttatgcccttttcatgtggctttacaatattgggctctttccagccgaaaaatgtcttcatgcatttgatcgcatcatacagcggtatccccatatcagcagccagggcct

SEQ ID NO: 422847 - DNA, 140 bp, Artificial Sequence
  Synthetic
atacgccatgctgggtctccgaaagagcccaatattgtaaagccacatgaaaagggcataaaccccaattatctcctggcttggaagcaagtgctagcagaactccaagatattgaaaatcgtacttgggagtcggccat

SEQ ID NO: 422848 - DNA, 140 bp, Artificial Sequence
  Synthetic
atggccgactcccaagtacgattttcaatatcttggagttctgctagcacttgcttccaagccaggagataattggggtttatgcccttttcatgtggctttacaatattgggctctttcggagacccagcatggcgtat

SEQ ID NO: 422849 - DNA, 140 bp, Artificial Sequence
  Synthetic
aggccctggctgctgatatggtgggcacttggtgagaacatggcaccggaaaaagtagactttgaggattgcaaaggtgttagcgatctaagacagtatgacagcgatgaaccagagcctgaccttttgggacagcggtg

SEQ ID NO: 422850 - DNA, 140 bp, Artificial Sequence
  Synthetic
caccgctgtcccaaaaggtcaggctctggttcatcgctgtcatactgtcttagatcgctaacacctttgcaatcctcaaagtctactttttccggtgccatgttctcaccaagtgcccaccatatcagcagccagggcct

SEQ ID NO: 422851 - DNA, 140 bp, Artificial Sequence
  Synthetic
atacgccatgctgggtctccgcaaaggtgttagcgatctaagacagtatgacagcgatgaaccagagcctagatcgctagcgagctgggtccagagtgaattcaacaaggcatgtgagttcgtacttgggagtcggccat

SEQ ID NO: 422852 - DNA, 140 bp, Artificial Sequence
  Synthetic
atggccgactcccaagtacgaactcacatgccttgttgaattcactctggacccagctcgctagcgatctaggctctggttcatcgctgtcatactgtcttagatcgctaacacctttgcggagacccagcatggcgtat

SEQ ID NO: 422853 - DNA, 140 bp, Artificial Sequence
  Synthetic
aggccctggctgctgatatgcaattgagcacattgcaagcatgagaaggaattatttcacagcggaggtgtcccattgcagggccactgagtacataatgaagggagtgtacataaacacgaccttttgggacagcggtg

SEQ ID NO: 422854 - DNA, 140 bp, Artificial Sequence
  Synthetic
caccgctgtcccaaaaggtcgtgtttatgtacactcccttcattatgtactcagtggccctgcaatgggacacctccgctgtgaaataattccttctcatgcttgcaatgtgctcaattgcatatcagcagccagggcct

SEQ ID NO: 422855 - DNA, 140 bp, Artificial Sequence
  Synthetic
atacgccatgctgggtctccaatagatttcttaaaagatgtaatggaatcaatgaacaaagaggaaatagagataacaacccactttcaaagaaaaaggagagtaagagacaacatgacccgtacttgggagtcggccat

SEQ ID NO: 422856 - DNA, 140 bp, Artificial Sequence
  Synthetic
atggccgactcccaagtacgggtcatgttgtctcttactctcctttttctttgaaagtgggttgttatctctatttcctctttgttcattgattccattacatcttttaagaaatctattggagacccagcatggcgtat

SEQ ID NO: 422857 - DNA, 140 bp, Artificial Sequence
  Synthetic
aggccctggctgctgatatgtatggattcatcataaaaggaagatcccatctgagaaatgacaccgatgtggtgaactttgtgagtatggagttctctcttactgacccgaggctggagcgaccttttgggacagcggtg

SEQ ID NO: 422858 - DNA, 140 bp, Artificial Sequence
  Synthetic
caccgctgtcccaaaaggtcgctccagcctcgggtcagtaagagagaactccatactcacaaagttcaccacatcggtgtcatttctcagatgggatcttccttttatgatgaatccatacatatcagcagccagggcct

SEQ ID NO: 422859 - DNA, 140 bp, Artificial Sequence
  Synthetic
atacgccatgctgggtctccggtgaactttgtgagtatggagttctctcttactgacccgaggctggagccacacaagtgggaaaagtactgcgttctcgagataggagacatgcttctacgtacttgggagtcggccat

SEQ ID NO: 422860 - DNA, 140 bp, Artificial Sequence
  Synthetic
atggccgactcccaagtacgtagaagcatgtctcctatctcgagaacgcagtacttttcccacttgtgtggctccagcctcgggtcagtaagagagaactccatactcacaaagttcaccggagacccagcatggcgtat

SEQ ID NO: 422861 - DNA, 140 bp, Artificial Sequence
  Synthetic
aggccctggctgctgatatgggccctgttgaatgcatcctgtgcagccatggatgactttcaactgattccgatgataagcaaatgcagaaccaaggaaggaagacggaaaactaacctggaccttttgggacagcggtg

SEQ ID NO: 422862 - DNA, 140 bp, Artificial Sequence
  Synthetic
caccgctgtcccaaaaggtccaggttagttttccgtcttccttccttggttctgcatttgcttatcatcggaatcagttgaaagtcatccatggctgcacaggatgcattcaacagggcccatatcagcagccagggcct

SEQ ID NO: 422863 - DNA, 140 bp, Artificial Sequence
  Synthetic
atacgccatgctgggtctccagatggccagtaggggtctatgggattcctttcgtcaatccgagagaggcgaagagacaattgaagaaaggtttgaaatcacaggaaccatgcgcaggctcgtacttgggagtcggccat

SEQ ID NO: 422864 - DNA, 140 bp, Artificial Sequence
  Synthetic
atggccgactcccaagtacgagcctgcgcatggttcctgtgatttcaaacctttcttcaattgtctcttcgcctctctcggattgacgaaaggaatcccatagacccctactggccatctggagacccagcatggcgtat

SEQ ID NO: 422865 - DNA, 140 bp, Artificial Sequence
  Synthetic
atacgccatgctgggtctccgcctccttcaatctcttcaacagattgagagcatgattgaggccgagtcttctgtcaaagagaaggatatgaccaaggaattctttgaaaacaaatcagacgtacttgggagtcggccat

SEQ ID NO: 422866 - DNA, 140 bp, Artificial Sequence
  Synthetic
atggccgactcccaagtacgtctgatttgttttcaaagaattccttggtcatatccttctctttgacagaagactcggcctcaatcatgctctcaatctgttgaagagattgaaggaggcggagacccagcatggcgtat

SEQ ID NO: 422867 - DNA, 140 bp, Artificial Sequence
  Synthetic
aggccctggctgctgatatgtctcccttttgaacgagcaaccgttttggcagctttcagcgggaacaatgaaggacggacatccgatatgcgaacagaagttataaggatgatggaaagtgaccttttgggacagcggtg

SEQ ID NO: 422868 - DNA, 140 bp, Artificial Sequence
  Synthetic
caccgctgtcccaaaaggtcactttccatcatccttataacttctgttcgcatatcggatgtccgtccttcattgttcccgctgaaagctgccaaaacggttgctcgttcaaaagggagacatatcagcagccagggcct

SEQ ID NO: 422869 - DNA, 140 bp, Artificial Sequence
  Synthetic
atacgccatgctgggtctccaccggctccgccgagaccaaaagtctctaaaaggaagaggtagcacccttggcctagacatcgagacagccactcttgttgggaaacaaattgtggagtgcgtacttgggagtcggccat

SEQ ID NO: 422870 - DNA, 140 bp, Artificial Sequence
  Synthetic
atggccgactcccaagtacgcactccacaatttgtttcccaacaagagtggctgtctcgatgtctaggccaagggtgctacctcttccttttagagacttttggtctcggcggagccggtggagacccagcatggcgtat

SEQ ID NO: 422871 - DNA, 140 bp, Artificial Sequence
  Synthetic
aggccctggctgctgatatgatttctggcaatgataacatacatcacaaggaaccaacctgaatggttcaggaatgtcttgagcattgcccctataatgttctcaaataaaatggcaagagaccttttgggacagcggtg

SEQ ID NO: 422872 - DNA, 140 bp, Artificial Sequence
  Synthetic
caccgctgtcccaaaaggtctcttgccattttatttgagaacattataggggcaatgctcaagacattcctgaaccattcaggttggttccttgtgatgtatgttatcattgccagaaatcatatcagcagccagggcct

SEQ ID NO: 422873 - DNA, 140 bp, Artificial Sequence
  Synthetic
atacgccatgctgggtctccaaggacggacatccgatatgcgaacagaagttataaggatgatggaaagtgcaaagccagaagatttgtccttccaggggcggggagtcttcgagctctccgtacttgggagtcggccat

SEQ ID NO: 422874 - DNA, 140 bp, Artificial Sequence
  Synthetic
atggccgactcccaagtacggagagctcgaagactccccgcccctggaaggacaaatcttctggctttgcactttccatcatccttataacttctgttcgcatatcggatgtccgtccttggagacccagcatggcgtat

SEQ ID NO: 422875 - DNA, 140 bp, Artificial Sequence
  Synthetic
atacgccatgctgggtctccaccaatgggacctccaagattaagatgaaatggggtatggaaatgaggcgctgccttcttcaatctcttcaacaaattgagagcatgattgaggctgagtcgtacttgggagtcggccat

SEQ ID NO: 422876 - DNA, 140 bp, Artificial Sequence
  Synthetic
atggccgactcccaagtacgactcagcctcaatcatgctctcaatttgttgaagagattgaagaaggcagcgcctcatttccataccccatttcatcttaatcttggaggtcccattggtggagacccagcatggcgtat

SEQ ID NO: 422877 - DNA, 140 bp, Artificial Sequence
  Synthetic
atacgccatgctgggtctccgagaagggaaaatggacaacaaacacggagactggagcaccccaactcaatccaattgatggaccattaccggaggacaatgagccaagcggatatgcaccgtacttgggagtcggccat

SEQ ID NO: 422878 - DNA, 140 bp, Artificial Sequence
  Synthetic
atggccgactcccaagtacggtgcatatccgcttggctcattgtcctccggtaatggtccatcaattggattgagttggggtgctccagtctccgtgtttgttgtccattttcccttctcggagacccagcatggcgtat

SEQ ID NO: 422879 - DNA, 140 bp, Artificial Sequence
  Synthetic
aggccctggctgctgatatgaagagtggacaaactaacccaaggtcgccagacttatgattggacactgaatagaaaccaaccagccgcaactgctctggccaacactatagaagtcttcgaccttttgggacagcggtg

SEQ ID NO: 422880 - DNA, 140 bp, Artificial Sequence
  Synthetic
caccgctgtcccaaaaggtcgaagacttctatagtgttggccagagcagttgcggctggttggtttctattcagtgtccaatcataagtctggcgaccttgggttagtttgtccactcttcatatcagcagccagggcct

SEQ ID NO: 422881 - DNA, 140 bp, Artificial Sequence
  Synthetic
aggccctggctgctgatatgcaaggatgtgatggaatcaatggataaagaagaaatggaaataacaacacatttccagagaaagagaagagtaagggacaacatgaccaagaagatggtcgaccttttgggacagcggtg

SEQ ID NO: 422882 - DNA, 140 bp, Artificial Sequence
  Synthetic
caccgctgtcccaaaaggtcgaccatcttcttggtcatgttgtcccttactcttctctttctctggaaatgtgttgttatttccatttcttctttatccattgattccatcacatccttgcatatcagcagccagggcct

SEQ ID NO: 422883 - DNA, 140 bp, Artificial Sequence
  Synthetic
atacgccatgctgggtctccatagatggcacagcctcattgagtcctggaatgatgatgggcatgttcaacatgttgagtacagtcttaggagtctcaatcttaaatcttgggcaaaagacgtacttgggagtcggccat

SEQ ID NO: 422884 - DNA, 140 bp, Artificial Sequence
  Synthetic
atggccgactcccaagtacgtcttttgcccaagatttaagattgagactcctaagactgtactcaacatgttgaacatgcccatcatcattccaggactcaatgaggctgtgccatctatggagacccagcatggcgtat

SEQ ID NO: 422885 - DNA, 140 bp, Artificial Sequence
  Synthetic
atacgccatgctgggtctcccttaataagagcactgacattgaacacaatgaccaaagatgcagaaaggggcaaattgaaaaggagggcaattgcaacacccgggatgcagattaggggacgtacttgggagtcggccat

SEQ ID NO: 422886 - DNA, 140 bp, Artificial Sequence
  Synthetic
atggccgactcccaagtacgtcccctaatctgcatcccgggtgttgcaattgccctccttttcaatttgcccctttctgcatctttggtcattgtgttcaatgtcagtgctcttattaagggagacccagcatggcgtat

SEQ ID NO: 422887 - DNA, 140 bp, Artificial Sequence
  Synthetic
atacgccatgctgggtctccgcaatctggactccccgttggagggaatgagaagaaggctaaactggcaaatgtcgtgagaaaaatgatgactaactcacaagatacagagctctcctttcgtacttgggagtcggccat

SEQ ID NO: 422888 - DNA, 140 bp, Artificial Sequence
  Synthetic
atggccgactcccaagtacgaaaggagagctctgtatcttgtgagttagtcatcatttttctcacgacatttgccagtttagccttcttctcattccctccaacggggagtccagattgcggagacccagcatggcgtat

SEQ ID NO: 422889 - DNA, 140 bp, Artificial Sequence
  Synthetic
aggccctggctgctgatatgatgtcgtgagaaaaatgatgactaactcacaagatacagagctctcctttacaattactggagacaacaccaaatggaatgagaatcaaaatcctcggatgaccttttgggacagcggtg

SEQ ID NO: 422890 - DNA, 140 bp, Artificial Sequence
  Synthetic
caccgctgtcccaaaaggtcatccgaggattttgattctcattccatttggtgttgtctccagtaattgtaaaggagagctctgtatcttgtgagttagtcatcatttttctcacgacatcatatcagcagccagggcct

SEQ ID NO: 422891 - DNA, 140 bp, Artificial Sequence
  Synthetic
aggccctggctgctgatatgttttattgtttatatggtctccagagacaacgtttcatgctccatctgcctataaggaagattaggccttgtattttcctttgttgtagtgcttgtttgcgaccttttgggacagcggtg

SEQ ID NO: 422892 - DNA, 140 bp, Artificial Sequence
  Synthetic
caccgctgtcccaaaaggtcgcaaacaagcactacaacaaaggaaaatacaaggcctaatcttccttataggcagatggagcatgaaacgttgtctctggagaccatataaacaataaaacatatcagcagccagggcct

SEQ ID NO: 422893 - DNA, 140 bp, Artificial Sequence
  Synthetic
atacgccatgctgggtctccgtttttggcaatgataacatacatcacaagaaaccaacctgaatggtttagaaatgtcttgagcattgcccctataatgttctcaaacaaaatggcgagacgtacttgggagtcggccat

SEQ ID NO: 422894 - DNA, 140 bp, Artificial Sequence
  Synthetic
atggccgactcccaagtacgtctcgccattttgtttgagaacattataggggcaatgctcaagacatttctaaaccattcaggttggtttcttgtgatgtatgttatcattgccaaaaacggagacccagcatggcgtat

SEQ ID NO: 422895 - DNA, 140 bp, Artificial Sequence
  Synthetic
atacgccatgctgggtctccaataccggcagaaatgcttgcaaacattgatttgaaatacttcaacgaatcaacgagaaagaaaatcgagaaaataaggcctctgctgattgatggcacacgtacttgggagtcggccat

SEQ ID NO: 422896 - DNA, 140 bp, Artificial Sequence
  Synthetic
atggccgactcccaagtacgtgtgccatcaatcagcagaggccttattttctcgattttctttctcgttgattcgttgaagtatttcaaatcaatgtttgcaagcatttctgccggtattggagacccagcatggcgtat

SEQ ID NO: 422897 - DNA, 140 bp, Artificial Sequence
  Synthetic
atacgccatgctgggtctccgtctcaaggcaccaaacgatcctatgaacagatggaaactggtggagagcgccagaatgctactgagatcagagcatctgttggaaggatggttggtggacgtacttgggagtcggccat

SEQ ID NO: 422898 - DNA, 140 bp, Artificial Sequence
  Synthetic
atggccgactcccaagtacgtccaccaaccatccttccaacagatgctctgatctcagtagcattctggcgctctccaccagtttccatctgttcataggatcgtttggtgccttgagacggagacccagcatggcgtat

SEQ ID NO: 422899 - DNA, 140 bp, Artificial Sequence
  Synthetic
aggccctggctgctgatatgccacatactggtgggatggactccaatcctctgatgatttcgctctcatagtgaatgcaccgaaccatgaggggatacaagcaggagtggataggttctagaccttttgggacagcggtg

SEQ ID NO: 422900 - DNA, 140 bp, Artificial Sequence
  Synthetic
caccgctgtcccaaaaggtctagaacctatccactcctgcttgtatcccctcatggttcggtgcattcactatgagagcgaaatcatcagaggattggagtccatcccaccagtatgtggcatatcagcagccagggcct

SEQ ID NO: 422901 - DNA, 140 bp, Artificial Sequence
  Synthetic
aggccctggctgctgatatgtaggacctgcaaactggttgggatcaacatgagcaaaaagaagtcttacataaaccggacaggaacgtttgagttcacaagctttttctaccgctatggagaccttttgggacagcggtg

SEQ ID NO: 422902 - DNA, 140 bp, Artificial Sequence
  Synthetic
caccgctgtcccaaaaggtctccatagcggtagaaaaagcttgtgaactcaaacgttcctgtccggtttatgtaagacttctttttgctcatgttgatcccaaccagtttgcaggtcctacatatcagcagccagggcct

SEQ ID NO: 422903 - DNA, 140 bp, Artificial Sequence
  Synthetic
atacgccatgctgggtctccatggcggacaatatgaccacaacacaaattgaggtgggtccgggagcaaccaatgccaccataaactttgaagcaggaattctggagtgctatgaaagaccgtacttgggagtcggccat

SEQ ID NO: 422904 - DNA, 140 bp, Artificial Sequence
  Synthetic
atggccgactcccaagtacggtctttcatagcactccagaattcctgcttcaaagtttatggtggcattggttgctcccggacccacctcaatttgtgttgtggtcatattgtccgccatggagacccagcatggcgtat

SEQ ID NO: 422905 - DNA, 140 bp, Artificial Sequence
  Synthetic
atacgccatgctgggtctccttcatcaaggactataggtacacgtaccgatgccacaggggtgatacacaaattcaaacgaggagatcattcgagctgaagaagctgtgggagcagaccccgtacttgggagtcggccat

SEQ ID NO: 422906 - DNA, 140 bp, Artificial Sequence
  Synthetic
atggccgactcccaagtacggggtctgctcccacagcttcttcagctcgaatgatctcctcgtttgaatttgtgtatcacccctgtggcatcggtacgtgtacctatagtccttgatgaaggagacccagcatggcgtat

SEQ ID NO: 422907 - DNA, 140 bp, Artificial Sequence
  Synthetic
aggccctggctgctgatatgaagggctatatgaagcaatcgaggagtgcctgattaatgatccctgggttttgcttaatgcatcttggttcaactccttcctcacacatgcactaagatagaccttttgggacagcggtg

SEQ ID NO: 422908 - DNA, 140 bp, Artificial Sequence
  Synthetic
caccgctgtcccaaaaggtctatcttagtgcatgtgtgaggaaggagttgaaccaagatgcattaagcaaaacccagggatcattaatcaggcactcctcgattgcttcatatagcccttcatatcagcagccagggcct

SEQ ID NO: 422909 - DNA, 140 bp, Artificial Sequence
  Synthetic
aggccctggctgctgatatgtgataaacaatgatcttggaccagcaacagctcaaatggctcttcagctgttcatcaaggattacagatacacgtatcggtgtcacagaggagacacacagaccttttgggacagcggtg

SEQ ID NO: 422910 - DNA, 140 bp, Artificial Sequence
  Synthetic
caccgctgtcccaaaaggtctgtgtgtctcctctgtgacaccgatacgtgtatctgtaatccttgatgaacagctgaagagccatttgagctgttgctggtccaagatcattgtttatcacatatcagcagccagggcct

SEQ ID NO: 422911 - DNA, 140 bp, Artificial Sequence
  Synthetic
atacgccatgctgggtctccattcgaaatctccacatcccagaggtctgcttgaagtgggaactaatggatgaagactaccagggcaggctgtgtaatcctctgaacccgtttgtcagtccgtacttgggagtcggccat

SEQ ID NO: 422912 - DNA, 140 bp, Artificial Sequence
  Synthetic
atggccgactcccaagtacggactgacaaacgggttcagaggattacacagcctgccctggtagtcttcatccattagttcccacttcaagcagacctctgggatgtggagatttcgaatggagacccagcatggcgtat

SEQ ID NO: 422913 - DNA, 140 bp, Artificial Sequence
  Synthetic
atacgccatgctgggtctccctacatattggtgggatggacttcaatcctctgatgatttcgctctcatagtgaatgcaccgaaccatgagggcatacaagcgggagtggacaggttctacgtacttgggagtcggccat

SEQ ID NO: 422914 - DNA, 140 bp, Artificial Sequence
  Synthetic
atggccgactcccaagtacgtagaacctgtccactcccgcttgtatgccctcatggttcggtgcattcactatgagagcgaaatcatcagaggattgaagtccatcccaccaatatgtagggagacccagcatggcgtat

SEQ ID NO: 422915 - DNA, 140 bp, Artificial Sequence
  Synthetic
aggccctggctgctgatatgccctaagaggaatcgctccatcctcaacacaagccaaaggggaatccttgaagatgaacagatgtatcaaaagtgctgcaatctattcgagaaattcttcgaccttttgggacagcggtg

SEQ ID NO: 422916 - DNA, 140 bp, Artificial Sequence
  Synthetic
caccgctgtcccaaaaggtcgaagaatttctcgaatagattgcagcacttttgatacatctgttcatcttcaaggattcccctttggcttgtgttgaggatggagcgattcctcttagggcatatcagcagccagggcct

SEQ ID NO: 422917 - DNA, 140 bp, Artificial Sequence
  Synthetic
aggccctggctgctgatatggtgaatgcaccgaaccatgagggcatacaagcgggagtggacaggttctatagaacctgcaaactagttggaatcaatatgagtaaaaagaaatcttacagaccttttgggacagcggtg

SEQ ID NO: 422918 - DNA, 140 bp, Artificial Sequence
  Synthetic
caccgctgtcccaaaaggtctgtaagatttctttttactcatattgattccaactagtttgcaggttctatagaacctgtccactcccgcttgtatgccctcatggttcggtgcattcaccatatcagcagccagggcct

SEQ ID NO: 422919 - DNA, 140 bp, Artificial Sequence
  Synthetic
aggccctggctgctgatatgatggagagaataaaagaactaagagatttgatgtcgcagtctcgcactcgcgagatactgacaaaaaccactgtggaccatatggccataatcaagaaatgaccttttgggacagcggtg

SEQ ID NO: 422920 - DNA, 140 bp, Artificial Sequence
  Synthetic
caccgctgtcccaaaaggtcatttcttgattatggccatatggtccacagtggtttttgtcagtatctcgcgagtgcgagactgcgacatcaaatctcttagttcttttattctctccatcatatcagcagccagggcct

SEQ ID NO: 422921 - DNA, 140 bp, Artificial Sequence
  Synthetic
atacgccatgctgggtctccatggcaatgaaatatccgattacagcagacaagaggataatggagatgatccctgaaagaaatgagcaaggtcagactctttggagcaaaacgaatgatgcgtacttgggagtcggccat

SEQ ID NO: 422922 - DNA, 140 bp, Artificial Sequence
  Synthetic
atggccgactcccaagtacgcatcattcgttttgctccaaagagtctgaccttgctcatttctttcagggatcatctccattatcctcttgtctgctgtaatcggatatttcattgccatggagacccagcatggcgtat

SEQ ID NO: 422923 - DNA, 140 bp, Artificial Sequence
  Synthetic
atacgccatgctgggtctcccttatttcgaaaaagtcaaaaggttgaagcacgggacttttggccctgttcacttcagaaatcaagttaaaataagacggagggtagacataaaccctggcgtacttgggagtcggccat

SEQ ID NO: 422924 - DNA, 140 bp, Artificial Sequence
  Synthetic
atggccgactcccaagtacgccagggtttatgtctaccctccgtcttattttaacttgatttctgaagtgaacagggccaaaagtcccgtgcttcaaccttttgactttttcgaaataagggagacccagcatggcgtat

SEQ ID NO: 422925 - DNA, 140 bp, Artificial Sequence
  Synthetic
aggccctggctgctgatatgtttcccaaacgaagtaggagccagaatattgacatcagagtcacagttaacaataacaaaagaaaagaaggaggagctccaggactgtaagattgctcctgaccttttgggacagcggtg

SEQ ID NO: 422926 - DNA, 140 bp, Artificial Sequence
  Synthetic
caccgctgtcccaaaaggtcaggagcaatcttacagtcctggagctcctccttcttttcttttgttattgttaactgtgactctgatgtcaatattctggctcctacttcgtttgggaaacatatcagcagccagggcct

SEQ ID NO: 422927 - DNA, 140 bp, Artificial Sequence
  Synthetic
aggccctggctgctgatatgacgataacaaaagagaagaaagaagaactccaggactgcaaaatcgcccctttgatggttgcatacatgctagaaagggagttggtccgcaaaacgagatgaccttttgggacagcggtg

SEQ ID NO: 422928 - DNA, 140 bp, Artificial Sequence
  Synthetic
caccgctgtcccaaaaggtcatctcgttttgcggaccaactccctttctagcatgtatgcaaccatcaaaggggcgattttgcagtcctggagttcttctttcttctcttttgttatcgtcatatcagcagccagggcct

SEQ ID NO: 422929 - DNA, 140 bp, Artificial Sequence
  Synthetic
atacgccatgctgggtctccttaactcaggggacatgctgggagcaaatgtacaccccgggaggggaagtgaggaatgacgatgttgatcaaagcttgattatcgctgctaggaacatagcgtacttgggagtcggccat

SEQ ID NO: 422930 - DNA, 140 bp, Artificial Sequence
  Synthetic
atggccgactcccaagtacgctatgttcctagcagcgataatcaagctttgatcaacatcgtcattcctcacttcccctcccggggtgtacatttgctcccagcatgtcccctgagttaaggagacccagcatggcgtat

SEQ ID NO: 422931 - DNA, 140 bp, Artificial Sequence
  Synthetic
aggccctggctgctgatatggtttgtacgggacctgtgttgtggcagtaacagatggaccggctgacaataaagccgaccacaggatatattggataaaagaggggagaatcataaaatagaccttttgggacagcggtg

SEQ ID NO: 422932 - DNA, 140 bp, Artificial Sequence
  Synthetic
caccgctgtcccaaaaggtctattttatgattctcccctcttttatccaatatatcctgtggtcggctttattgtcagccggtccatctgttactgccacaacacaggtcccgtacaaaccatatcagcagccagggcct

SEQ ID NO: 422933 - DNA, 140 bp, Artificial Sequence
  Synthetic
atacgccatgctgggtctcccaggagagcaacagtatcagcagacccgctggcttcgctcttggaaatgtgccatagtacacaaattggcggaataaggatggtagacatccttagacaacgtacttgggagtcggccat

SEQ ID NO: 422934 - DNA, 140 bp, Artificial Sequence
  Synthetic
atggccgactcccaagtacgttgtctaaggatgtctaccatccttattccgccaatttgtgtactatggcacatttccaagagcgaagccagcgggtctgctgatactgttgctctcctgggagacccagcatggcgtat

SEQ ID NO: 422935 - DNA, 140 bp, Artificial Sequence
  Synthetic
atacgccatgctgggtctccaaatccaacagaggaacaagcggtggacatatgcaaagcagcaatgggcttaaggattagctcatctttcagctttggcggattcactttcaaaagaacacgtacttgggagtcggccat

SEQ ID NO: 422936 - DNA, 140 bp, Artificial Sequence
  Synthetic
atggccgactcccaagtacgtgttcttttgaaagtgaatccgccaaagctgaaagatgagctaatccttaagcccattgctgctttgcatatgtccaccgcttgttcctctgttggatttggagacccagcatggcgtat

SEQ ID NO: 422937 - DNA, 140 bp, Artificial Sequence
  Synthetic
aggccctggctgctgatatgaacattaaaaataagagtacatgaggggtatgaagagttcacaatggttgggagaagggcaacagccattctcaggaaggcaactagaagactgatccaggaccttttgggacagcggtg

SEQ ID NO: 422938 - DNA, 140 bp, Artificial Sequence
  Synthetic
caccgctgtcccaaaaggtcctggatcagtcttctagttgccttcctgagaatggctgttgcccttctcccaaccattgtgaactcttcatacccctcatgtactcttatttttaatgttcatatcagcagccagggcct

SEQ ID NO: 422939 - DNA, 140 bp, Artificial Sequence
  Synthetic
atacgccatgctgggtctccggccatggtattttcacaagaggattgcatgatcaaagcagttcgaggtgatttgaactttgtcaatagggcaaaccagcgactaaacccaatgcaccaacgtacttgggagtcggccat

SEQ ID NO: 422940 - DNA, 140 bp, Artificial Sequence
  Synthetic
atggccgactcccaagtacgttggtgcattgggtttagtcgctggtttgccctattgacaaagttcaaatcacctcgaactgctttgatcatgcaatcctcttgtgaaaataccatggccggagacccagcatggcgtat

SEQ ID NO: 422941 - DNA, 140 bp, Artificial Sequence
  Synthetic
aggccctggctgctgatatgatttgaactttgtcaatagggcaaaccagcgactaaacccaatgcaccaactcttaagacacttccaaaaggatgcaaaagtgcttttccaaaattgggggaccttttgggacagcggtg

SEQ ID NO: 422942 - DNA, 140 bp, Artificial Sequence
  Synthetic
caccgctgtcccaaaaggtcccccaattttggaaaagcacttttgcatccttttggaagtgtcttaagagttggtgcattgggtttagtcgctggtttgccctattgacaaagttcaaatcatatcagcagccagggcct

SEQ ID NO: 422943 - DNA, 140 bp, Artificial Sequence
  Synthetic
atacgccatgctgggtctcctcctgaggcatttccagaaggatgcaaaggtgctgtttcaaaactggggagttgaacccattgacaatgtcatgggtatgatcggaatattacctgacatcgtacttgggagtcggccat

SEQ ID NO: 422944 - DNA, 140 bp, Artificial Sequence
  Synthetic
atggccgactcccaagtacgatgtcaggtaatattccgatcatacccatgacattgtcaatgggttcaactccccagttttgaaacagcacctttgcatccttctggaaatgcctcaggaggagacccagcatggcgtat

SEQ ID NO: 422945 - DNA, 140 bp, Artificial Sequence
  Synthetic
atacgccatgctgggtctccaattgaacccattgacaacgtaatggggatgatcgggatactacctgacatgaccccaagtactgagatgtcactgagaggggtaagagtcagtaagatgcgtacttgggagtcggccat

SEQ ID NO: 422946 - DNA, 140 bp, Artificial Sequence
  Synthetic
atggccgactcccaagtacgcatcttactgactcttacccctctcagtgacatctcagtacttggggtcatgtcaggtagtatcccgatcatccccattacgttgtcaatgggttcaattggagacccagcatggcgtat

SEQ ID NO: 422947 - DNA, 140 bp, Artificial Sequence
  Synthetic
atacgccatgctgggtctcctgaccccaagtactgagatgtcactgagaggggtaagagtcagtaagatgggagtagatgaatactccagcacagagagagtggtagtgagcattgaccgcgtacttgggagtcggccat

SEQ ID NO: 422948 - DNA, 140 bp, Artificial Sequence
  Synthetic
atggccgactcccaagtacgcggtcaatgctcactaccactctctctgtgctggagtattcatctactcccatcttactgactcttacccctctcagtgacatctcagtacttggggtcaggagacccagcatggcgtat

SEQ ID NO: 422949 - DNA, 140 bp, Artificial Sequence
  Synthetic
atacgccatgctgggtctccgagtggacgaatattccagtactgagagagtggtcgtgagcattgatcgtttcttgagggtccgagaccagagggggaatgtgctcttgtcccctgaagacgtacttgggagtcggccat

SEQ ID NO: 422950 - DNA, 140 bp, Artificial Sequence
  Synthetic
atggccgactcccaagtacgtcttcaggggacaagagcacattccccctctggtctcggaccctcaagaaacgatcaatgctcacgaccactctctcagtactggaatattcgtccactcggagacccagcatggcgtat

SEQ ID NO: 422951 - DNA, 140 bp, Artificial Sequence
  Synthetic
atacgccatgctgggtctccaagtcagcgagacacaagggacagagaagctgacaataacttattcgtcatcaatgatgtgggaaatcaatggtcctgaatcagttttggtcaatacttacgtacttgggagtcggccat

SEQ ID NO: 422952 - DNA, 140 bp, Artificial Sequence
  Synthetic
atggccgactcccaagtacgtaagtattgaccaaaactgattcaggaccattgatttcccacatcattgatgacgaataagttattgtcagcttctctgtcccttgtgtctcgctgacttggagacccagcatggcgtat

SEQ ID NO: 422953 - DNA, 140 bp, Artificial Sequence
  Synthetic
atacgccatgctgggtctccccatgatgtgggaaatcaatggcccggaatcagtgttagtcaacacatatcaatggatcattagaaactgggaaactgtgaagattcagtggtcccaagacgtacttgggagtcggccat

SEQ ID NO: 422954 - DNA, 140 bp, Artificial Sequence
  Synthetic
atggccgactcccaagtacgtcttgggaccactgaatcttcacagtttcccagtttctaatgatccattgatatgtgttgactaacactgattccgggccattgatttcccacatcatggggagacccagcatggcgtat

SEQ ID NO: 422955 - DNA, 140 bp, Artificial Sequence
  Synthetic
aggccctggctgctgatatgcaatggatcattagaaactgggaaactgtgaagattcagtggtcccaagaccctacaatgctatacaataagatggaatttgagccctttcaatccttgggaccttttgggacagcggtg

SEQ ID NO: 422956 - DNA, 140 bp, Artificial Sequence
  Synthetic
caccgctgtcccaaaaggtcccaaggattgaaagggctcaaattccatcttattgtatagcattgtagggtcttgggaccactgaatcttcacagtttcccagtttctaatgatccattgcatatcagcagccagggcct

SEQ ID NO: 422957 - DNA, 140 bp, Artificial Sequence
  Synthetic
atacgccatgctgggtctccgtccctaaggcagccagaggtcagtacagtggattcgtgaggacactgttccagcagatgcgggatgtgcttggaaccttcgacactgttcagataataacgtacttgggagtcggccat

SEQ ID NO: 422958 - DNA, 140 bp, Artificial Sequence
  Synthetic
atggccgactcccaagtacgttattatctgaacagtgtcgaaggttccaagcacatcccgcatctgctggaacagtgtcctcacgaatccactgtactgacctctggctgccttagggacggagacccagcatggcgtat

SEQ ID NO: 422959 - DNA, 140 bp, Artificial Sequence
  Synthetic
atacgccatgctgggtctccgacagtgaaaaatggtttgtacccgaacctgagcaagtcctatgaaaacgacaaagagaaagaagtccttatactatggggtattcatcatccgcctaaccgtacttgggagtcggccat

SEQ ID NO: 422960 - DNA, 140 bp, Artificial Sequence
  Synthetic
atggccgactcccaagtacggttaggcggatgatgaataccccatagtataaggacttctttctctttgtcgttttcataggacttgctcaggttcgggtacaaaccatttttcactgtcggagacccagcatggcgtat

SEQ ID NO: 422961 - DNA, 140 bp, Artificial Sequence
  Synthetic
atacgccatgctgggtctccactgctactcattgttcaggcgcttagggataacctggaacctggaaccttcgatcttgaagggctatatgaagcaatcgaggagtgcctgattaatgatcgtacttgggagtcggccat

SEQ ID NO: 422962 - DNA, 140 bp, Artificial Sequence
  Synthetic
atggccgactcccaagtacgatcattaatcaggcactcctcgattgcttcatatagcccttcaagatcgaaggttccaggttccaggttatccctaagcgcctgaacaatgagtagcagtggagacccagcatggcgtat

SEQ ID NO: 422963 - DNA, 140 bp, Artificial Sequence
  Synthetic
aggccctggctgctgatatgatcgggagattctacatacagatgtgcactgaactcaagctcagtgactacgaagggaggctgatccaaaacagcataaccatagagaggatggttctctgaccttttgggacagcggtg

SEQ ID NO: 422964 - DNA, 140 bp, Artificial Sequence
  Synthetic
caccgctgtcccaaaaggtcagagaaccatcctctctatggttatgctgttttggatcagcctcccttcgtagtcactgagcttgagttcagtgcacatctgtatgtagaatctcccgatcatatcagcagccagggcct

SEQ ID NO: 422965 - DNA, 140 bp, Artificial Sequence
  Synthetic
atacgccatgctgggtctccatgagtcttctgaccgaggtcgaaacgtatgttctctctatcgtaccgtcaggccccctcaaagccgagatcgcgcagagacttgaagatgtttttgcagcgtacttgggagtcggccat

SEQ ID NO: 422966 - DNA, 140 bp, Artificial Sequence
  Synthetic
atggccgactcccaagtacgctgcaaaaacatcttcaagtctctgcgcgatctcggctttgagggggcctgacggtacgatagagagaacatacgtttcgacctcggtcagaagactcatggagacccagcatggcgtat

SEQ ID NO: 422967 - DNA, 140 bp, Artificial Sequence
  Synthetic
aggccctggctgctgatatgaggactgcaataggccaagtatcaaggcccatgttcctgtatgttagaaccaacgggacctccaaaatcaaaatgaaatggggcatggaaatgaggcgctgaccttttgggacagcggtg

SEQ ID NO: 422968 - DNA, 140 bp, Artificial Sequence
  Synthetic
caccgctgtcccaaaaggtcagcgcctcatttccatgccccatttcattttgattttggaggtcccgttggttctaacatacaggaacatgggccttgatacttggcctattgcagtcctcatatcagcagccagggcct

SEQ ID NO: 422969 - DNA, 140 bp, Artificial Sequence
  Synthetic
aggccctggctgctgatatggccttcttcagtctcttcagcagattgaaagcatgattgaggccgagtcttctgtcaaagaaaaggacatgactagagaattctttgagaacaagtcggagaccttttgggacagcggtg

SEQ ID NO: 422970 - DNA, 140 bp, Artificial Sequence
  Synthetic
caccgctgtcccaaaaggtctccgacttgttctcaaagaattctctagtcatgtccttttctttgacagaagactcggcctcaatcatgctttcaatctgctgaagagactgaagaaggccatatcagcagccagggcct

SEQ ID NO: 422971 - DNA, 140 bp, Artificial Sequence
  Synthetic
atacgccatgctgggtctcccagctactcaacaggtgcacttgcaagttgcttgggtctcatatataacagaatgggaacagtgaccacagaaggggcttttggactagtatgtgccactcgtacttgggagtcggccat

SEQ ID NO: 422972 - DNA, 140 bp, Artificial Sequence
  Synthetic
atggccgactcccaagtacgagtggcacatactagtccaaaagccccttctgtggtcactgttcccattctgttatatatgagacccaagcaacttgcaagtgcacctgttgagtagctgggagacccagcatggcgtat

SEQ ID NO: 422973 - DNA, 140 bp, Artificial Sequence
  Synthetic
atacgccatgctgggtctcccaccactaacccactaataaggcatgagaacagaatggtgctggccagcactacggctaaggctatggagcagatggccgggtcgagtgaacaagcagcacgtacttgggagtcggccat

SEQ ID NO: 422974 - DNA, 140 bp, Artificial Sequence
  Synthetic
atggccgactcccaagtacgtgctgcttgttcactcgacccggccatctgctccatagccttagccgtagtgctggccagcaccattctgttctcatgccttattagtgggttagtggtgggagacccagcatggcgtat

SEQ ID NO: 422975 - DNA, 140 bp, Artificial Sequence
  Synthetic
aggccctggctgctgatatgccagcccatggtccagccaaaagcatggaatatgatgctgttgcaactacacattcctgggtccccaagaggaaccgttccattctcaacactagccaaagaccttttgggacagcggtg

SEQ ID NO: 422976 - DNA, 140 bp, Artificial Sequence
  Synthetic
caccgctgtcccaaaaggtctttggctagtgttgagaatggaacggttcctcttggggacccaggaatgtgtagttgcaacagcatcatattccatgcttttggctggaccatgggctggcatatcagcagccagggcct

SEQ ID NO: 422977 - DNA, 140 bp, Artificial Sequence
  Synthetic
atacgccatgctgggtctcctgagcaatcttgcgaaaggggagaaggctaatgtgttgatagggcaaggagacgtggtgttggtaatgaaacggaaacgggactctagcatacttactgacgtacttgggagtcggccat

SEQ ID NO: 422978 - DNA, 140 bp, Artificial Sequence
  Synthetic
atggccgactcccaagtacgtcagtaagtatgctagagtcccgtttccgtttcattaccaacaccacgtctccttgccctatcaacacattagccttctcccctttcgcaagattgctcaggagacccagcatggcgtat

SEQ ID NO: 422979 - DNA, 140 bp, Artificial Sequence
  Synthetic
atacgccatgctgggtctcctgctgaggatatgggcaatggttgtttcaaaatataccacaaatgtgacaatgcctgcataggatcaatcagaaatggaacttatgaccacgatgtataccgtacttgggagtcggccat

SEQ ID NO: 422980 - DNA, 140 bp, Artificial Sequence
  Synthetic
atggccgactcccaagtacggtatacatcgtggtcataagttccatttctgattgatcctatgcaggcattgtcacatttgtggtatattttgaaacaaccattgcccatatcctcagcaggagacccagcatggcgtat

SEQ ID NO: 422981 - DNA, 140 bp, Artificial Sequence
  Synthetic
aggccctggctgctgatatgggaaggagtgccggagtctatgagggaagagtatcggcaggagcagcagagtgcagcggatgttgacgatggtcattttgtcaacatagagctggagtaagaccttttgggacagcggtg

SEQ ID NO: 422982 - DNA, 140 bp, Artificial Sequence
  Synthetic
caccgctgtcccaaaaggtcttactccagctctatgttgacaaaatgaccatcgtcaacatccgctgcactctgctgctcctgccgatactcttccctcatagactccggcactccttcccatatcagcagccagggcct

SEQ ID NO: 422983 - DNA, 140 bp, Artificial Sequence
  Synthetic
atacgccatgctgggtctccatgaatccaagtcaaaagataataacaattggctctgtctctctaatcattgcaacagtatgttgcttcatgcagattgccatcctggcaatgaccataacgtacttgggagtcggccat

SEQ ID NO: 422984 - DNA, 140 bp, Artificial Sequence
  Synthetic
atggccgactcccaagtacgttatggtcattgccaggatggcaatctgcatgaagcaacatactgttgcaatgattagagagacagagccaattgttattatcttttgacttggattcatggagacccagcatggcgtat

SEQ ID NO: 422985 - DNA, 140 bp, Artificial Sequence
  Synthetic
aggccctggctgctgatatgtgcaacagtatgttgcttcatgcagattgccatcctggcaatgaccataacacattacttcaatcaaaatgagtgcagcaccccattgagcaatcaagtagaccttttgggacagcggtg

SEQ ID NO: 422986 - DNA, 140 bp, Artificial Sequence
  Synthetic
caccgctgtcccaaaaggtctacttgattgctcaatggggtgctgcactcattttgattgaagtaatgtgttatggtcattgccaggatggcaatctgcatgaagcaacatactgttgcacatatcagcagccagggcct

SEQ ID NO: 422987 - DNA, 140 bp, Artificial Sequence
  Synthetic
atacgccatgctgggtctcccatcaaatcatggagaaaggacatattaagaacccaggagtctgaatgccaatgcattgacgggacttgtgttgttgctgtcacagatggccctgctgctcgtacttgggagtcggccat

SEQ ID NO: 422988 - DNA, 140 bp, Artificial Sequence
  Synthetic
atggccgactcccaagtacgagcagcagggccatctgtgacagcaacaacacaagtcccgtcaatgcattggcattcagactcctgggttcttaatatgtcctttctccatgatttgatgggagacccagcatggcgtat

SEQ ID NO: 422989 - DNA, 140 bp, Artificial Sequence
  Synthetic
aggccctggctgctgatatgaaacatcacccaaataagcaataccaacatccaaatggaggagaaagcaaatagaggattcaataacttgaccaaaggactctgcactataaattcatgggaccttttgggacagcggtg

SEQ ID NO: 422990 - DNA, 140 bp, Artificial Sequence
  Synthetic
caccgctgtcccaaaaggtcccatgaatttatagtgcagagtcctttggtcaagttattgaatcctctatttgctttctcctccatttggatgttggtattgcttatttgggtgatgtttcatatcagcagccagggcct

SEQ ID NO: 422991 - DNA, 140 bp, Artificial Sequence
  Synthetic
atacgccatgctgggtctccacagggactggtcgaaaccacagtgtcagatcaaagggtttgctcctttctctaaggacaactcaatccggctttctgctggtggagacatttgggtaaccgtacttgggagtcggccat

SEQ ID NO: 422992 - DNA, 140 bp, Artificial Sequence
  Synthetic
atggccgactcccaagtacggttacccaaatgtctccaccagcagaaagccggattgagttgtccttagagaaaggagcaaaccctttgatctgacactgtggtttcgaccagtccctgtggagacccagcatggcgtat

SEQ ID NO: 422993 - DNA, 140 bp, Artificial Sequence
  Synthetic
aggccctggctgctgatatgtctaaggacaactcaatccggctttctgctggtggagacatttgggtaacaagggaaccttatgtgtcatgcagtcctagtaaatgttatcagttcgcacgaccttttgggacagcggtg

SEQ ID NO: 422994 - DNA, 140 bp, Artificial Sequence
  Synthetic
caccgctgtcccaaaaggtcgtgcgaactgataacatttactaggactgcatgacacataaggttcccttgttacccaaatgtctccaccagcagaaagccggattgagttgtccttagacatatcagcagccagggcct

SEQ ID NO: 422995 - DNA, 140 bp, Artificial Sequence
  Synthetic
atacgccatgctgggtctccgatagaattccccaccgaacccttttgatgaacgaattgggtgttccgttccatttggggaccaaacaggtatgcatagcatggtccagctcaagctgcccgtacttgggagtcggccat

SEQ ID NO: 422996 - DNA, 140 bp, Artificial Sequence
  Synthetic
atggccgactcccaagtacgggcagcttgagctggaccatgctatgcatacctgtttggtccccaaatggaacggaacacccaattcgttcatcaaaagggttcggtggggaattctatcggagacccagcatggcgtat

SEQ ID NO: 422997 - DNA, 140 bp, Artificial Sequence
  Synthetic
aggccctggctgctgatatgccatttggggaccaaacaggtatgcatagcatggtccagctcaagctgccatgatggaaaagcatggctgcacgtttgtattactggagatgataggaatgaccttttgggacagcggtg

SEQ ID NO: 422998 - DNA, 140 bp, Artificial Sequence
  Synthetic
caccgctgtcccaaaaggtcattcctatcatctccagtaatacaaacgtgcagccatgcttttccatcatggcagcttgagctggaccatgctatgcatacctgtttggtccccaaatggcatatcagcagccagggcct

SEQ ID NO: 422999 - DNA, 140 bp, Artificial Sequence
  Synthetic
aggccctggctgctgatatgaagagtggacaaactaacccaaggtcgccagacttatgactggacactgaatagaaaccaaccagctgcaactgctttggccaacactatagaggtcttcgaccttttgggacagcggtg

SEQ ID NO: 423000 - DNA, 140 bp, Artificial Sequence
  Synthetic
caccgctgtcccaaaaggtcgaagacctctatagtgttggccaaagcagttgcagctggttggtttctattcagtgtccagtcataagtctggcgaccttgggttagtttgtccactcttcatatcagcagccagggcct

SEQ ID NO: 423001 - DNA, 140 bp, Artificial Sequence
  Synthetic
atacgccatgctgggtctccatggtctcaaaacattctcagaactcaggagtcagaatgtgtctgcatcaatggaacttgtacagtagtaatgactgatggaagtgcatcaggaagggctcgtacttgggagtcggccat

SEQ ID NO: 423002 - DNA, 140 bp, Artificial Sequence
  Synthetic
atggccgactcccaagtacgagcccttcctgatgcacttccatcagtcattactactgtacaagttccattgatgcagacacattctgactcctgagttctgagaatgttttgagaccatggagacccagcatggcgtat

SEQ ID NO: 423003 - DNA, 140 bp, Artificial Sequence
  Synthetic
aggccctggctgctgatatgatggaacttgtacagtagtaatgactgatggaagtgcatcaggaagggctgatactaaaatattattcattaaagaggggaaaattgttcacatcagcccgaccttttgggacagcggtg

SEQ ID NO: 423004 - DNA, 140 bp, Artificial Sequence
  Synthetic
caccgctgtcccaaaaggtcgggctgatgtgaacaattttcccctctttaatgaataatattttagtatcagcccttcctgatgcacttccatcagtcattactactgtacaagttccatcatatcagcagccagggcct

SEQ ID NO: 423005 - DNA, 140 bp, Artificial Sequence
  Synthetic
atacgccatgctgggtctccaaaatgaatccaaatcagaagataatagcaattggtgccgtctctctaactattgcgataatatgcctcctcatgcagattgccctcttagttacgaccacgtacttgggagtcggccat

SEQ ID NO: 423006 - DNA, 140 bp, Artificial Sequence
  Synthetic
atggccgactcccaagtacgtggtcgtaactaagagggcaatctgcatgaggaggcatattatcgcaatagttagagagacggcaccaattgctattatcttctgatttggattcattttggagacccagcatggcgtat

SEQ ID NO: 423007 - DNA, 140 bp, Artificial Sequence
  Synthetic
atacgccatgctgggtctccatccagatgtcagatgtgtctgcagagacaattggaaaggttcaaatagacccgttatagacataaatatggcagattatagtattgattctggttatgtcgtacttgggagtcggccat

SEQ ID NO: 423008 - DNA, 140 bp, Artificial Sequence
  Synthetic
atggccgactcccaagtacgacataaccagaatcaatactataatctgccatatttatgtctataacgggtctatttgaacctttccaattgtctctgcagacacatctgacatctggatggagacccagcatggcgtat

SEQ ID NO: 423009 - DNA, 140 bp, Artificial Sequence
  Synthetic
aggccctggctgctgatatgcccgttatagacataaatatggcagattatagtattgattctggttatgtgtgctcagggctcgttggagacacaccaagaaacgatgacggctctagtagaccttttgggacagcggtg

SEQ ID NO: 423010 - DNA, 140 bp, Artificial Sequence
  Synthetic
caccgctgtcccaaaaggtctactagagccgtcatcgtttcttggtgtgtctccaacgagccctgagcacacataaccagaatcaatactataatctgccatatttatgtctataacgggcatatcagcagccagggcct

SEQ ID NO: 423011 - DNA, 140 bp, Artificial Sequence
  Synthetic
atacgccatgctgggtctccagacagattctatagaacctgcaagctggtcggaatcaacatgagcaaaaagaagtcctacataaacaggacaggaacatttgaattcacaagttttttccgtacttgggagtcggccat

SEQ ID NO: 423012 - DNA, 140 bp, Artificial Sequence
  Synthetic
atggccgactcccaagtacggaaaaaacttgtgaattcaaatgttcctgtcctgtttatgtaggacttctttttgctcatgttgattccgaccagcttgcaggttctatagaatctgtctggagacccagcatggcgtat

SEQ ID NO: 423013 - DNA, 140 bp, Artificial Sequence
  Synthetic
atacgccatgctgggtctccgggtgggcatttgactatggagatgatgtttggatgggaagaacaatcagcaaggattcacgctcaggttacgagaccttcagagtcattggtggttggacgtacttgggagtcggccat

SEQ ID NO: 423014 - DNA, 140 bp, Artificial Sequence
  Synthetic
atggccgactcccaagtacgtccaaccaccaatgactctgaaggtctcgtaacctgagcgtgaatccttgctgattgttcttcccatccaaacatcatctccatagtcaaatgcccacccggagacccagcatggcgtat

SEQ ID NO: 423015 - DNA, 140 bp, Artificial Sequence
  Synthetic
aggccctggctgctgatatgcgtcgagcttgcggaaaagacaatgaaagaacatggggaagacccaaaaattgagacaaacaaatttgctgcaatatgcacacacatggaagtctgtttcgaccttttgggacagcggtg

SEQ ID NO: 423016 - DNA, 140 bp, Artificial Sequence
  Synthetic
caccgctgtcccaaaaggtcgaaacagacttccatgtgtgtgcatattgcagcaaatttgtttgtctcaatttttgggtcttccccatgttctttcattgtcttttccgcaagctcgacgcatatcagcagccagggcct

SEQ ID NO: 423017 - DNA, 140 bp, Artificial Sequence
  Synthetic
atacgccatgctgggtctccagtgtctgggattaatgaatctgcagacatgagcattggagtaacagtgataaagaacaacatgataaacaatgatcttggaccagcaacagctcaaatgcgtacttgggagtcggccat

SEQ ID NO: 423018 - DNA, 140 bp, Artificial Sequence
  Synthetic
atggccgactcccaagtacgcatttgagctgttgctggtccaagatcattgtttatcatgttgttctttatcactgttactccaatgctcatgtctgcagattcattaatcccagacactggagacccagcatggcgtat

SEQ ID NO: 423019 - DNA, 140 bp, Artificial Sequence
  Synthetic
atacgccatgctgggtctcccatcaataggtgtttttatgtggaattgataagaggaaggcctcaagagactagagtatggtggacctcaaacagtatagtcgtattctgtgggacttcacgtacttgggagtcggccat

SEQ ID NO: 423020 - DNA, 140 bp, Artificial Sequence
  Synthetic
atggccgactcccaagtacgtgaagtcccacagaatacgactatactgtttgaggtccaccatactctagtctcttgaggccttcctcttatcaattccacataaaaacacctattgatgggagacccagcatggcgtat

SEQ ID NO: 423021 - DNA, 140 bp, Artificial Sequence
  Synthetic
aggccctggctgctgatatggctctcagcggtcgaaattcttgctgatggatgctctgaagttgagcattgaggacccaagtcatgaaggggaggggataccgctatatgatgcgatcaagaccttttgggacagcggtg

SEQ ID NO: 423022 - DNA, 140 bp, Artificial Sequence
  Synthetic
caccgctgtcccaaaaggtcttgatcgcatcatatagcggtatcccctccccttcatgacttgggtcctcaatgctcaacttcagagcatccatcagcaagaatttcgaccgctgagagccatatcagcagccagggcct

SEQ ID NO: 423023 - DNA, 140 bp, Artificial Sequence
  Synthetic
aggccctggctgctgatatgcgtttgtcagccacaaggagatagagtctgtaaacaatgctgtggtgatgccagctcatggcccagccaagagcatggaatatgatgctgtggctaccacgaccttttgggacagcggtg

SEQ ID NO: 423024 - DNA, 140 bp, Artificial Sequence
  Synthetic
caccgctgtcccaaaaggtcgtggtagccacagcatcatattccatgctcttggctgggccatgagctggcatcaccacagcattgtttacagactctatctccttgtggctgacaaacgcatatcagcagccagggcct

SEQ ID NO: 423025 - DNA, 140 bp, Artificial Sequence
  Synthetic
aggccctggctgctgatatggagaatctggcgtcaagcgaataatggagaagacgcaactgctggtctcactcatctgatgatctggcattccaacctaaatgatgccacataccagagagaccttttgggacagcggtg

SEQ ID NO: 423026 - DNA, 140 bp, Artificial Sequence
  Synthetic
caccgctgtcccaaaaggtctctctggtatgtggcatcatttaggttggaatgccagatcatcagatgagtgagaccagcagttgcgtcttctccattattcgcttgacgccagattctccatatcagcagccagggcct

SEQ ID NO: 423027 - DNA, 140 bp, Artificial Sequence
  Synthetic
atacgccatgctgggtctccgcaaggatcaactctcccgaggagatctggagctgctggcgcagcagtaaagggagtcggaacgatggtgatggaactaattcggatgataaaacgagggcgtacttgggagtcggccat

SEQ ID NO: 423028 - DNA, 140 bp, Artificial Sequence
  Synthetic
atggccgactcccaagtacgccctcgttttatcatccgaattagttccatcaccatcgttccgactccctttactgctgcgccagcagctccagatctcctcgggagagttgatccttgcggagacccagcatggcgtat

SEQ ID NO: 423029 - DNA, 140 bp, Artificial Sequence
  Synthetic
atacgccatgctgggtctccagtgacaattcgtccgggtattctggcattttctccgttgaaggcaaaagctgcatcaacaggtgtttttatgtagagctaataagaggaagaccaaaggcgtacttgggagtcggccat

SEQ ID NO: 423030 - DNA, 140 bp, Artificial Sequence
  Synthetic
atggccgactcccaagtacgcctttggtcttcctcttattagctctacataaaaacacctgttgatgcagcttttgccttcaacggagaaaatgccagaatacccggacgaattgtcactggagacccagcatggcgtat

SEQ ID NO: 423031 - DNA, 140 bp, Artificial Sequence
  Synthetic
atacgccatgctgggtctccaactgctaagcatattgaagaatgctcatgttacggggaacgaacaggaattacctgcacatgcagggacaattggcagggctcaaatagaccagtgattcgtacttgggagtcggccat

SEQ ID NO: 423032 - DNA, 140 bp, Artificial Sequence
  Synthetic
atggccgactcccaagtacgaatcactggtctatttgagccctgccaattgtccctgcatgtgcaggtaattcctgttcgttccccgtaacatgagcattcttcaatatgcttagcagttggagacccagcatggcgtat

SEQ ID NO: 423033 - DNA, 140 bp, Artificial Sequence
  Synthetic
aggccctggctgctgatatgaatggaaatgattcctgaaaggaatgaacagggacagaccctttggagcaaaacaaatgatgccggctcagaccgagtgatggtatcacctctggctgtggaccttttgggacagcggtg

SEQ ID NO: 423034 - DNA, 140 bp, Artificial Sequence
  Synthetic
caccgctgtcccaaaaggtccacagccagaggtgataccatcactcggtctgagccggcatcatttgttttgctccaaagggtctgtccctgttcattcctttcaggaatcatttccattcatatcagcagccagggcct

SEQ ID NO: 423035 - DNA, 140 bp, Artificial Sequence
  Synthetic
atacgccatgctgggtctccagcaaaagcaggggttataccatagacaaccgaactaaagacaatgaccatcacttttctcatcctcctgttcacagtagtgaaaggggaccaaatatgccgtacttgggagtcggccat

SEQ ID NO: 423036 - DNA, 140 bp, Artificial Sequence
  Synthetic
atggccgactcccaagtacggcatatttggtcccctttcactactgtgaacaggaggatgagaaaagtgatggtcattgtctttagttcggttgtctatggtataacccctgcttttgctggagacccagcatggcgtat

SEQ ID NO: 423037 - DNA, 140 bp, Artificial Sequence
  Synthetic
aggccctggctgctgatatgtcacttttctcatcctcctgttcacagtagtgaaaggggaccaaatatgcatcggataccatgccaacaattccacagaaaaagttgacacaatcttggagaccttttgggacagcggtg

SEQ ID NO: 423038 - DNA, 140 bp, Artificial Sequence
  Synthetic
caccgctgtcccaaaaggtctccaagattgtgtcaactttttctgtggaattgttggcatggtatccgatgcatatttggtcccctttcactactgtgaacaggaggatgagaaaagtgacatatcagcagccagggcct

SEQ ID NO: 423039 - DNA, 140 bp, Artificial Sequence
  Synthetic
atacgccatgctgggtctccctgtggccagtggatatgactttgagagagaagggtactctctagttggaatagatcctttccgtctgcttcaaaacagtcaggtcttcagtctcattagcgtacttgggagtcggccat

SEQ ID NO: 423040 - DNA, 140 bp, Artificial Sequence
  Synthetic
atggccgactcccaagtacgctaatgagactgaagacctgactgttttgaagcagacggaaaggatctattccaactagagagtacccttctctctcaaagtcatatccactggccacagggagacccagcatggcgtat

SEQ ID NO: 423041 - DNA, 140 bp, Artificial Sequence
  Synthetic
atacgccatgctgggtctccaccaaatgagaacccagcacacaagagtcaattggtatggatggcatgccattctgcagcatttgaggacctgagagtctcaagtttcatcagaggggcacgtacttgggagtcggccat

SEQ ID NO: 423042 - DNA, 140 bp, Artificial Sequence
  Synthetic
atggccgactcccaagtacgtgcccctctgatgaaacttgagactctcaggtcctcaaatgctgcagaatggcatgccatccataccaattgactcttgtgtgctgggttctcatttggtggagacccagcatggcgtat

SEQ ID NO: 423043 - DNA, 140 bp, Artificial Sequence
  Synthetic
atacgccatgctgggtctcctgcagcattgcaggttggctccttggaaatccagaatgtgaccggctcttaagtgtacctgaatggtcctatatagtggaaaaggaaaacccggtgaatgcgtacttgggagtcggccat

SEQ ID NO: 423044 - DNA, 140 bp, Artificial Sequence
  Synthetic
atggccgactcccaagtacgcattcaccgggttttccttttccactatataggaccattcaggtacacttaagagccggtcacattctggatttccaaggagccaacctgcaatgctgcaggagacccagcatggcgtat

SEQ ID NO: 423045 - DNA, 140 bp, Artificial Sequence
  Synthetic
aggccctggctgctgatatgagagtggtcccaagaggacaactatccaccagaggagttcaaattgcttcaaatgaaaacatggaaacaatggactccagcactcttgaactgaggagcagaccttttgggacagcggtg

SEQ ID NO: 423046 - DNA, 140 bp, Artificial Sequence
  Synthetic
caccgctgtcccaaaaggtctgctcctcagttcaagagtgctggagtccattgtttccatgttttcatttgaagcaatttgaactcctctggtggatagttgtcctcttgggaccactctcatatcagcagccagggcct

SEQ ID NO: 423047 - DNA, 140 bp, Artificial Sequence
  Synthetic
atacgccatgctgggtctcctggaacctggaaccttcgatcttggagggctatatgaagcaatcgaggagtgcctgattaatgatccctgggttttgcttaatgcatcttggttcaactccgtacttgggagtcggccat

SEQ ID NO: 423048 - DNA, 140 bp, Artificial Sequence
  Synthetic
atggccgactcccaagtacggagttgaaccaagatgcattaagcaaaacccagggatcattaatcaggcactcctcgattgcttcatatagccctccaagatcgaaggttccaggttccaggagacccagcatggcgtat

SEQ ID NO: 423049 - DNA, 140 bp, Artificial Sequence
  Synthetic
atacgccatgctgggtctccatggacccagcacacaacaactggtggttctcgggcctgtgcagtatctgggaatccatcattcttcagaaacatggtctggcttacaaagaaggggtcacgtacttgggagtcggccat

SEQ ID NO: 423050 - DNA, 140 bp, Artificial Sequence
  Synthetic
atggccgactcccaagtacgtgaccccttctttgtaagccagaccatgtttctgaagaatgatggattcccagatactgcacaggcccgagaaccaccagttgttgtgtgctgggtccatggagacccagcatggcgtat

SEQ ID NO: 423051 - DNA, 140 bp, Artificial Sequence
  Synthetic
atacgccatgctgggtctccgagatcctccatacagccatggaacaggaacaggatacaccatggacacagtcaacaggacacatcaatactcagaaaaaggaaggtggacaacaaacaccgtacttgggagtcggccat

SEQ ID NO: 423052 - DNA, 140 bp, Artificial Sequence
  Synthetic
atggccgactcccaagtacggtgtttgttgtccaccttcctttttctgagtattgatgtgtcctgttgactgtgtccatggtgtatcctgttcctgttccatggctgtatggaggatctcggagacccagcatggcgtat

SEQ ID NO: 423053 - DNA, 140 bp, Artificial Sequence
  Synthetic
aggccctggctgctgatatgcactgtaccagaatgtgggaacatatgtttccgttggaacatcaacattgaataagaggtcaatccctgagatagcaacaaggcccaaagtcaatggacagaccttttgggacagcggtg

SEQ ID NO: 423054 - DNA, 140 bp, Artificial Sequence
  Synthetic
caccgctgtcccaaaaggtctgtccattgactttgggccttgttgctatctcagggattgacctcttattcaatgttgatgttccaacggaaacatatgttcccacattctggtacagtgcatatcagcagccagggcct

SEQ ID NO: 423055 - DNA, 140 bp, Artificial Sequence
  Synthetic
atacgccatgctgggtctccatgagaaaaatagtgcttttcctgtcaatagccagtcttgttaagagtgacaaaatctgcattggttatcatgcaaacaattcaacagcaaaggttgacacgtacttgggagtcggccat

SEQ ID NO: 423056 - DNA, 140 bp, Artificial Sequence
  Synthetic
atggccgactcccaagtacgtgtcaacctttgctgttgaattgtttgcatgataaccaatgcagattttgtcactcttaacaagactggctattgacaggaaaagcactatttttctcatggagacccagcatggcgtat

SEQ ID NO: 423057 - DNA, 140 bp, Artificial Sequence
  Synthetic
aggccctggctgctgatatgcaaaatctgcattggttatcatgcaaacaattcaacagcaaaggttgacacaataatggaaaagaatgtcactgtcacacatgcgaaagacatacttgaagaccttttgggacagcggtg

SEQ ID NO: 423058 - DNA, 140 bp, Artificial Sequence
  Synthetic
caccgctgtcccaaaaggtcttcaagtatgtctttcgcatgtgtgacagtgacattcttttccattattgtgtcaacctttgctgttgaattgtttgcatgataaccaatgcagattttgcatatcagcagccagggcct

SEQ ID NO: 423059 - DNA, 140 bp, Artificial Sequence
  Synthetic
atacgccatgctgggtctcccaataatggaaaagaatgtcactgtcacacatgcgaaagacatacttgaaaagaaacacaatgggaaactatgcggtttgaatggagtgaaacctctcatcgtacttgggagtcggccat

SEQ ID NO: 423060 - DNA, 140 bp, Artificial Sequence
  Synthetic
atggccgactcccaagtacgatgagaggtttcactccattcaaaccgcatagtttcccattgtgtttcttttcaagtatgtctttcgcatgtgtgacagtgacattcttttccattattgggagacccagcatggcgtat

SEQ ID NO: 423061 - DNA, 140 bp, Artificial Sequence
  Synthetic
atacgccatgctgggtctccaaaatgattgcaatcattgtaatagcgatactggcagcagccggaaagtcagacaagatctgcatagggtatcatgccaataattcaacaacacaagtggcgtacttgggagtcggccat

SEQ ID NO: 423062 - DNA, 140 bp, Artificial Sequence
  Synthetic
atggccgactcccaagtacgccacttgtgttgttgaattattggcatgataccctatgcagatcttgtctgactttccggctgctgccagtatcgctattacaatgattgcaatcattttggagacccagcatggcgtat

SEQ ID NO: 423063 - DNA, 140 bp, Artificial Sequence
  Synthetic
atacgccatgctgggtctccacgagttcctcatggtgccagaatggtcttacatagtggaaaagaacaaaccaaccaatggcttatgctacccaggagatttccaagactatgaagaactcgtacttgggagtcggccat

SEQ ID NO: 423064 - DNA, 140 bp, Artificial Sequence
  Synthetic
atggccgactcccaagtacgagttcttcatagtcttggaaatctcctgggtagcataagccattggttggtttgttcttttccactatgtaagaccattctggcaccatgaggaactcgtggagacccagcatggcgtat

SEQ ID NO: 423065 - DNA, 140 bp, Artificial Sequence
  Synthetic
aggccctggctgctgatatgtcaaaacagccaggtctttagtctcattagaccaaatgagaacccagcacacaagagtcaattagtgtggatggcatgccactctgcagcatttgaggacgaccttttgggacagcggtg

SEQ ID NO: 423066 - DNA, 140 bp, Artificial Sequence
  Synthetic
caccgctgtcccaaaaggtcgtcctcaaatgctgcagagtggcatgccatccacactaattgactcttgtgtgctgggttctcatttggtctaatgagactaaagacctggctgttttgacatatcagcagccagggcct

SEQ ID NO: 423067 - DNA, 140 bp, Artificial Sequence
  Synthetic
aggccctggctgctgatatgaagaagaaatggaaataacaacacatttccagagaaagagaagagtgagggacaacatgaccaagaaaatggtcacacaaagaacaataggaaagaagaagaccttttgggacagcggtg

SEQ ID NO: 423068 - DNA, 140 bp, Artificial Sequence
  Synthetic
caccgctgtcccaaaaggtcttcttctttcctattgttctttgtgtgaccattttcttggtcatgttgtccctcactcttctctttctctggaaatgtgttgttatttccatttcttcttcatatcagcagccagggcct

SEQ ID NO: 423069 - DNA, 140 bp, Artificial Sequence
  Synthetic
atacgccatgctgggtctccgatggcaagggatggttgatggctggtatgggtatcatcacagcaatgatcaaggttcaggatatgcagcagacaaagaatccactcaaaaggcaattgacgtacttgggagtcggccat

SEQ ID NO: 423070 - DNA, 140 bp, Artificial Sequence
  Synthetic
atggccgactcccaagtacgtcaattgccttttgagtggattctttgtctgctgcatatcctgaaccttgatcattgctgtgatgatacccataccagccatcaaccatcccttgccatcggagacccagcatggcgtat

SEQ ID NO: 423071 - DNA, 140 bp, Artificial Sequence
  Synthetic
atacgccatgctgggtctcccaatttagtggaaggtcctcttttttcagaaatatggtgtggctcactaaaaagaacaacgaatacataacaataaagagatcatacaaaaatactaatccgtacttgggagtcggccat

SEQ ID NO: 423072 - DNA, 140 bp, Artificial Sequence
  Synthetic
atggccgactcccaagtacggattagtatttttgtatgatctctttattgttatgtattcgttgttctttttagtgagccacaccatatttctgaaaaaagaggaccttccactaaattgggagacccagcatggcgtat

SEQ ID NO: 423073 - DNA, 140 bp, Artificial Sequence
  Synthetic
aggccctggctgctgatatgaaagaacaacgaatacataacaataaagagatcatacaaaaatactaatcaggaagatcttttgatcatgtggggaatccaccaccccagtcatgatgaagaccttttgggacagcggtg

SEQ ID NO: 423074 - DNA, 140 bp, Artificial Sequence
  Synthetic
caccgctgtcccaaaaggtcttcatcatgactggggtggtggattccccacatgatcaaaagatcttcctgattagtatttttgtatgatctctttattgttatgtattcgttgttctttcatatcagcagccagggcct

SEQ ID NO: 423075 - DNA, 140 bp, Artificial Sequence
  Synthetic
atacgccatgctgggtctccttaaataagaagatggaagatggatttctagatgtatggacttacaatgccgaactcctagttctaatggaaaatgagaggacacttgatttccatgactcgtacttgggagtcggccat

SEQ ID NO: 423076 - DNA, 140 bp, Artificial Sequence
  Synthetic
atggccgactcccaagtacgagtcatggaaatcaagtgtcctctcattttccattagaactaggagttcggcattgtaagtccatacatctagaaatccatcttccatcttcttatttaaggagacccagcatggcgtat

SEQ ID NO: 423077 - DNA, 140 bp, Artificial Sequence
  Synthetic
atacgccatgctgggtctccatcaacactgaaccagaggttatccccaataataactgaaagaccccaagtaaatgggcaaagtggcagaatgagtttttattggacaattttaaagccacgtacttgggagtcggccat

SEQ ID NO: 423078 - DNA, 140 bp, Artificial Sequence
  Synthetic
atggccgactcccaagtacgtggctttaaaattgtccaataaaaactcattctgccactttgcccatttacttggggtctttcagttattattggggataacctctggttcagtgttgatggagacccagcatggcgtat

SEQ ID NO: 423079 - DNA, 140 bp, Artificial Sequence
  Synthetic
aggccctggctgctgatatgaggactgaaatcataagaatgatggaaagtgccagaccagaagatgtgtcattccaggggcggggagtcttcgagctctcggacgaaaaggcaacgaaccgaccttttgggacagcggtg

SEQ ID NO: 423080 - DNA, 140 bp, Artificial Sequence
  Synthetic
caccgctgtcccaaaaggtcggttcgttgccttttcgtccgagagctcgaagactccccgcccctggaatgacacatcttctggtctggcactttccatcattcttatgatttcagtcctcatatcagcagccagggcct

SEQ ID NO: 423081 - DNA, 140 bp, Artificial Sequence
  Synthetic
aggccctggctgctgatatgcattccaatctgaatgatgccacataccagagaacaagggcacttgtgcgtactggaatggaccctaggatgtgctctctgatgcaaggctcaacccttcgaccttttgggacagcggtg

SEQ ID NO: 423082 - DNA, 140 bp, Artificial Sequence
  Synthetic
caccgctgtcccaaaaggtcgaagggttgagccttgcatcagagagcacatcctagggtccattccagtacgcacaagtgcccttgttctctggtatgtggcatcattcagattggaatgcatatcagcagccagggcct

SEQ ID NO: 423083 - DNA, 140 bp, Artificial Sequence
  Synthetic
atacgccatgctgggtctcctggaatatggcaactgcaacactaggtgccaaactccaatgggagcattgaactccagcatgcctttccaaaacatccaccctattaccattggggagtgcgtacttgggagtcggccat

SEQ ID NO: 423084 - DNA, 140 bp, Artificial Sequence
  Synthetic
atggccgactcccaagtacgcactccccaatggtaatagggtggatgttttggaaaggcatgctggagttcaatgctcccattggagtttggcacctagtgttgcagttgccatattccaggagacccagcatggcgtat

SEQ ID NO: 423085 - DNA, 140 bp, Artificial Sequence
  Synthetic
aggccctggctgctgatatgaactccagcatgcctttccaaaacatccaccctattaccattggggagtgcccaaaatacgtgaaatcaaataaattagtccttgccactggcctcagaagaccttttgggacagcggtg

SEQ ID NO: 423086 - DNA, 140 bp, Artificial Sequence
  Synthetic
caccgctgtcccaaaaggtcttctgaggccagtggcaaggactaatttatttgatttcacgtattttgggcactccccaatggtaatagggtggatgttttggaaaggcatgctggagttcatatcagcagccagggcct

SEQ ID NO: 423087 - DNA, 140 bp, Artificial Sequence
  Synthetic
aggccctggctgctgatatgtcaacaaactccacggaaactgtagacacgctaaccgaaaacaatgttcctgttacacatgctaaagaattgcttcacacagagcacaatgggatgctatgaccttttgggacagcggtg

SEQ ID NO: 423088 - DNA, 140 bp, Artificial Sequence
  Synthetic
caccgctgtcccaaaaggtcatagcatcccattgtgctctgtgtgaagcaattctttagcatgtgtaacaggaacattgttttcggttagcgtgtctacagtttccgtggagtttgttgacatatcagcagccagggcct

SEQ ID NO: 423089 - DNA, 140 bp, Artificial Sequence
  Synthetic
atacgccatgctgggtctccatactagtaaggggcaattccccggtgttcaattacaataaggccactaagaggcttacagttctcggaaaggatgcaggtgcattgaccgaagaccccgcgtacttgggagtcggccat

SEQ ID NO: 423090 - DNA, 140 bp, Artificial Sequence
  Synthetic
atggccgactcccaagtacgcggggtcttcggtcaatgcacctgcatcctttccgagaactgtaagcctcttagtggccttattgtaattgaacaccggggaattgccccttactagtatggagacccagcatggcgtat

SEQ ID NO: 423091 - DNA, 140 bp, Artificial Sequence
  Synthetic
atacgccatgctgggtctccatagaagggggatggcaagggatggtggatggttggtatgggtatcaccatagcaatgaccaaggaagtggatatgctgctgacaaagaatccacccagacgtacttgggagtcggccat

SEQ ID NO: 423092 - DNA, 140 bp, Artificial Sequence
  Synthetic
atggccgactcccaagtacgtctgggtggattctttgtcagcagcatatccacttccttggtcattgctatggtgatacccataccaaccatccaccatcccttgccatcccccttctatggagacccagcatggcgtat

SEQ ID NO: 423093 - DNA, 140 bp, Artificial Sequence
  Synthetic
aggccctggctgctgatatgtagcaatgaccaaggaagtggatatgctgctgacaaagaatccacccagagggctatagatggaatcacaaataaggtaaattcaatcattgacaagatggaccttttgggacagcggtg

SEQ ID NO: 423094 - DNA, 140 bp, Artificial Sequence
  Synthetic
caccgctgtcccaaaaggtccatcttgtcaatgattgaatttaccttatttgtgattccatctatagccctctgggtggattctttgtcagcagcatatccacttccttggtcattgctacatatcagcagccagggcct

SEQ ID NO: 423095 - DNA, 140 bp, Artificial Sequence
  Synthetic
atacgccatgctgggtctccgtggtcctacattgtcgaaagaccatcagctgttaatggagtgtgctaccccggaaatgtagaaaacctggaagaattaaggtcactttttagttccgcccgtacttgggagtcggccat

SEQ ID NO: 423096 - DNA, 140 bp, Artificial Sequence
  Synthetic
atggccgactcccaagtacgggcggaactaaaaagtgaccttaattcttccaggttttctacatttccggggtagcacactccattaacagctgatggtctttcgacaatgtaggaccacggagacccagcatggcgtat

SEQ ID NO: 423097 - DNA, 140 bp, Artificial Sequence
  Synthetic
atacgccatgctgggtctccaatagggaacttaaataagaaaatggaagatggatttttggacatttggacttacaatgctgagcttctagttctaatggaaaatgaaagaactctagaccgtacttgggagtcggccat

SEQ ID NO: 423098 - DNA, 140 bp, Artificial Sequence
  Synthetic
atggccgactcccaagtacggtctagagttctttcattttccattagaactagaagctcagcattgtaagtccaaatgtccaaaaatccatcttccattttcttatttaagttccctattggagacccagcatggcgtat

SEQ ID NO: 423099 - DNA, 140 bp, Artificial Sequence
  Synthetic
aggccctggctgctgatatgcttacaatgctgagcttctagttctaatggaaaatgaaagaactctagaccttcatgattcaaatgtcaagaacctgtatgaaaaggttcgattacagctgaccttttgggacagcggtg

SEQ ID NO: 423100 - DNA, 140 bp, Artificial Sequence
  Synthetic
caccgctgtcccaaaaggtcagctgtaatcgaaccttttcatacaggttcttgacatttgaatcatgaaggtctagagttctttcattttccattagaactagaagctcagcattgtaagcatatcagcagccagggcct

SEQ ID NO: 423101 - DNA, 140 bp, Artificial Sequence
  Synthetic
aggccctggctgctgatatgtaaccattgcaacaatatgtttccttatgcagattgccatcctagcaacaactataacattgcatttcaagcaaaatgaatgtagcatccccgcgaacaagaccttttgggacagcggtg

SEQ ID NO: 423102 - DNA, 140 bp, Artificial Sequence
  Synthetic
caccgctgtcccaaaaggtcttgttcgcggggatgctacattcattttgcttgaaatgcaatgttatagttgttgctaggatggcaatctgcataaggaaacatattgttgcaatggttacatatcagcagccagggcct

SEQ ID NO: 423103 - DNA, 140 bp, Artificial Sequence
  Synthetic
atacgccatgctgggtctccactataacattgcatttcaagcaaaatgaatgtagcatccccgcgaacaatcaagtagtgccatgtgaaccaatcataatagagaggaacataacagagacgtacttgggagtcggccat

SEQ ID NO: 423104 - DNA, 140 bp, Artificial Sequence
  Synthetic
atggccgactcccaagtacgtctctgttatgttcctctctattatgattggttcacatggcactacttgattgttcgcggggatgctacattcattttgcttgaaatgcaatgttatagtggagacccagcatggcgtat

SEQ ID NO: 423105 - DNA, 140 bp, Artificial Sequence
  Synthetic
atacgccatgctgggtctccaatgtgataatgagtgcatggaaagtgtaaagaatggaacatatgattacccacattattcagaggaggcaagactcaagagagaggagataagtggggtcgtacttgggagtcggccat

SEQ ID NO: 423106 - DNA, 140 bp, Artificial Sequence
  Synthetic
atggccgactcccaagtacgaccccacttatctcctctctcttgagtcttgcctcctctgaataatgtgggtaatcatatgttccattctttacactttccatgcactcattatcacattggagacccagcatggcgtat

SEQ ID NO: 423107 - DNA, 140 bp, Artificial Sequence
  Synthetic
aggccctggctgctgatatgcaagtgtggcgacggaagacataaataggaccttcaaaccattgatagggccaaggcctcttgtcaatggtctacaaggaaggattgattattattgggcgaccttttgggacagcggtg

SEQ ID NO: 423108 - DNA, 140 bp, Artificial Sequence
  Synthetic
caccgctgtcccaaaaggtcgcccaataataatcaatccttccttgtagaccattgacaagaggccttggccctatcaatggtttgaaggtcctatttatgtcttccgtcgccacacttgcatatcagcagccagggcct

SEQ ID NO: 423109 - DNA, 140 bp, Artificial Sequence
  Synthetic
atacgccatgctgggtctccgtagactacaggaattggtcaaaaccgcaatgtcaaattacaggatttgcccctttttccaaggacaactctattcgactttctgctggtggggacatttcgtacttgggagtcggccat

SEQ ID NO: 423110 - DNA, 140 bp, Artificial Sequence
  Synthetic
atggccgactcccaagtacgaaatgtccccaccagcagaaagtcgaatagagttgtccttggaaaaaggggcaaatcctgtaatttgacattgcggttttgaccaattcctgtagtctacggagacccagcatggcgtat

SEQ ID NO: 423111 - DNA, 140 bp, Artificial Sequence
  Synthetic
atacgccatgctgggtctccttcaacagcagcaagttccctagtactggcaatcatgatagctggtctatctttttggatgtgttccaatgggtcattacagtgcagaatttgcatttaacgtacttgggagtcggccat

SEQ ID NO: 423112 - DNA, 140 bp, Artificial Sequence
  Synthetic
atggccgactcccaagtacgttaaatgcaaattctgcactgtaatgacccattggaacacatccaaaaagatagaccagctatcatgattgccagtactagggaacttgctgctgttgaaggagacccagcatggcgtat

SEQ ID NO: 423113 - DNA, 140 bp, Artificial Sequence
  Synthetic
aggccctggctgctgatatgatggattccaacactgtgtcaagctttcaggtagactgctttctttggcatgtccgcaaacgatttgcagaccaaggacagggtgatgccccattccttggaccttttgggacagcggtg

SEQ ID NO: 423114 - DNA, 140 bp, Artificial Sequence
  Synthetic
caccgctgtcccaaaaggtccaaggaatggggcatcaccctgtccttggtctgcaaatcgtttgcggacatgccaaagaaagcagtctacctgaaagcttgacacagtgttggaatccatcatatcagcagccagggcct

SEQ ID NO: 423115 - DNA, 140 bp, Artificial Sequence
  Synthetic
aggccctggctgctgatatgctgaaaacggatttgaagagtggtaactgtgtagtgcaatgtcaaacagaaagaggtggtttgaacactacattgccatttcacaacgtgagcaagtacggaccttttgggacagcggtg

SEQ ID NO: 423116 - DNA, 140 bp, Artificial Sequence
  Synthetic
caccgctgtcccaaaaggtccgtacttgctcacgttgtgaaatggcaatgtagtgttcaaaccacctctttctgtttgacattgcactacacagttaccactcttcaaatccgttttcagcatatcagcagccagggcct

SEQ ID NO: 423117 - DNA, 140 bp, Artificial Sequence
  Synthetic
atacgccatgctgggtctccaatacacgatagaattcctcaccgaacccttttgatgaatgagttaggtattccatttcacttgggaaccagacaagtgtgcatagcatggtccagctcacgtacttgggagtcggccat

SEQ ID NO: 423118 - DNA, 140 bp, Artificial Sequence
  Synthetic
atggccgactcccaagtacgtgagctggaccatgctatgcacacttgtctggttcccaagtgaaatggaatacctaactcattcatcaaaagggttcggtgaggaattctatcgtgtattggagacccagcatggcgtat

SEQ ID NO: 423119 - DNA, 140 bp, Artificial Sequence
  Synthetic
atacgccatgctgggtctccggtctggacatcgaaacagctactcgtgcgggaaagcagatagtggagtggattctggagggagaatctgatgaggcactcaaaatgactattgcttcagcgtacttgggagtcggccat

SEQ ID NO: 423120 - DNA, 140 bp, Artificial Sequence
  Synthetic
atggccgactcccaagtacgctgaagcaatagtcattttgagtgcctcatcagattctccctccagaatccactccactatctgctttcccgcacgagtagctgtttcgatgtccagaccggagacccagcatggcgtat

SEQ ID NO: 423121 - DNA, 140 bp, Artificial Sequence
  Synthetic
atacgccatgctgggtctccgggatctttgaaaactcttgtcttgaaacgatggaagtcgttcagcaaacaagagtggacaaactaacccaaggtcgccagacttatgattggacactgacgtacttgggagtcggccat

SEQ ID NO: 423122 - DNA, 140 bp, Artificial Sequence
  Synthetic
atggccgactcccaagtacgtcagtgtccaatcataagtctggcgaccttgggttagtttgtccactcttgtttgctgaacgacttccatcgtttcaagacaagagttttcaaagatcccggagacccagcatggcgtat

SEQ ID NO: 423123 - DNA, 140 bp, Artificial Sequence
  Synthetic
aggccctggctgctgatatgtgcaatctattcgagaaattcttccctagtagttcatacaggaggccagttggaatttccagcatggtggaggccatggtttctagggcccgaatcgatggaccttttgggacagcggtg

SEQ ID NO: 423124 - DNA, 140 bp, Artificial Sequence
  Synthetic
caccgctgtcccaaaaggtccatcgattcgggccctagaaaccatggcctccaccatgctggaaattccaactggcctcctgtatgaactactagggaagaatttctcgaatagattgcacatatcagcagccagggcct

SEQ ID NO: 423125 - DNA, 140 bp, Artificial Sequence
  Synthetic
atacgccatgctgggtctccatgggttccagcattcaaatgatcaaggaaccggaatggctgcagatagagactcaactcaaaaggcaattgacaaaataacgtccaaagtaaataatatcgtacttgggagtcggccat

SEQ ID NO: 423126 - DNA, 140 bp, Artificial Sequence
  Synthetic
atggccgactcccaagtacgatattatttactttggacgttattttgtcaattgccttttgagttgagtctctatctgcagccattccggttccttgatcatttgaatgctggaacccatggagacccagcatggcgtat

SEQ ID NO: 423127 - DNA, 140 bp, Artificial Sequence
  Synthetic
atacgccatgctgggtctccaaaggccgatactagaatattattcattaaagaggggaaaattgtccacattagcccactgtcaggaagtgctcagcatatagaggaatgctcctgttatcgtacttgggagtcggccat

SEQ ID NO: 423128 - DNA, 140 bp, Artificial Sequence
  Synthetic
atggccgactcccaagtacgataacaggagcattcctctatatgctgagcacttcctgacagtgggctaatgtggacaattttcccctctttaatgaataatattctagtatcggcctttggagacccagcatggcgtat

SEQ ID NO: 423129 - DNA, 140 bp, Artificial Sequence
  Synthetic
aggccctggctgctgatatgagattgaaactagactcaatatgatcaatgataagatcgatgaccaaattcaagacatatgggcatataatgctgaattgctagtactgcttgaaaatcagaccttttgggacagcggtg

SEQ ID NO: 423130 - DNA, 140 bp, Artificial Sequence
  Synthetic
caccgctgtcccaaaaggtctgattttcaagcagtactagcaattcagcattatatgcccatatgtcttgaatttggtcatcgatcttatcattgatcatattgagtctagtttcaatctcatatcagcagccagggcct

SEQ ID NO: 423131 - DNA, 140 bp, Artificial Sequence
  Synthetic
aggccctggctgctgatatgagatctaatgtcacagtcccgcactcgcgagatactgacaaagaccactgtggaccatatggccataatcaagaaatacacatcaggaaggcaagaaaaggaccttttgggacagcggtg

SEQ ID NO: 423132 - DNA, 140 bp, Artificial Sequence
  Synthetic
caccgctgtcccaaaaggtccttttcttgccttcctgatgtgtatttcttgattatggccatatggtccacagtggtctttgtcagtatctcgcgagtgcgggactgtgacattagatctcatatcagcagccagggcct

SEQ ID NO: 423133 - DNA, 140 bp, Artificial Sequence
  Synthetic
atacgccatgctgggtctcctaataggcctgttatagatataaatatggcagattatagcattgattccagttatgtgtgctcaggacttgttggagacacaccaaggaacgatgatagccgtacttgggagtcggccat

SEQ ID NO: 423134 - DNA, 140 bp, Artificial Sequence
  Synthetic
atggccgactcccaagtacggctatcatcgttccttggtgtgtctccaacaagtcctgagcacacataactggaatcaatgctataatctgccatatttatatctataacaggcctattaggagacccagcatggcgtat

SEQ ID NO: 423135 - DNA, 140 bp, Artificial Sequence
  Synthetic
aggccctggctgctgatatggatctataccataaatgcgataaccagtgcatggagacaattcgaaacgggacctataacagaagaaagtatcaggaggaatcaagactagagagacagagaccttttgggacagcggtg

SEQ ID NO: 423136 - DNA, 140 bp, Artificial Sequence
  Synthetic
caccgctgtcccaaaaggtctctgtctctctagtcttgattcctcctgatactttcttctgttataggtcccgtttcgaattgtctccatgcactggttatcgcatttatggtatagatccatatcagcagccagggcct

SEQ ID NO: 423137 - DNA, 140 bp, Artificial Sequence
  Synthetic
atacgccatgctgggtctccggagggaatagcttttatgcagagcttaagtggctggtatcaaagagcaaaggacaaaacttccctcagaccacgaacacttacagaaatacagacacggcgtacttgggagtcggccat

SEQ ID NO: 423138 - DNA, 140 bp, Artificial Sequence
  Synthetic
atggccgactcccaagtacgccgtgtctgtatttctgtaagtgttcgtggtctgagggaagttttgtcctttgctctttgataccagccacttaagctctgcataaaagctattccctccggagacccagcatggcgtat

SEQ ID NO: 423139 - DNA, 140 bp, Artificial Sequence
  Synthetic
atacgccatgctgggtctcccacggaaaacagcttcgaacaaataacgtttatgcaagccttacaactactacttgaagtggagcaagagataagaactttctcgtttcagcttatttaacgtacttgggagtcggccat

SEQ ID NO: 423140 - DNA, 140 bp, Artificial Sequence
  Synthetic
atggccgactcccaagtacgttaaataagctgaaacgagaaagttcttatctcttgctccacttcaagtagtagttgtaaggcttgcataaacgttatttgttcgaagctgttttccgtgggagacccagcatggcgtat

SEQ ID NO: 423141 - DNA, 140 bp, Artificial Sequence
  Synthetic
atacgccatgctgggtctccgtattttgtggcacttcaggcacctatggaacaggctcatggcctgatggggcgaatatcaatttcatgcctatataagctttcgcaattttagaaaaaacgtacttgggagtcggccat

SEQ ID NO: 423142 - DNA, 140 bp, Artificial Sequence
  Synthetic
atggccgactcccaagtacgttttttctaaaattgcgaaagcttatataggcatgaaattgatattcgccccatcaggccatgagcctgttccataggtgcctgaagtgccacaaaatacggagacccagcatggcgtat

SEQ ID NO: 423143 - DNA, 140 bp, Artificial Sequence
  Synthetic
atacgccatgctgggtctcctgaacgggcaaagtggaagaatagacttcttctggacaattttaaagccgaatgatactatcaatttcgatagtgatggaaatttcattgccccaaaatacgtacttgggagtcggccat

SEQ ID NO: 423144 - DNA, 140 bp, Artificial Sequence
  Synthetic
atggccgactcccaagtacgtattttggggcaatgaaatttccatcactatcgaaattgatagtatcattcggctttaaaattgtccagaagaagtctattcttccactttgcccgttcaggagacccagcatggcgtat

SEQ ID NO: 423145 - DNA, 140 bp, Artificial Sequence
  Synthetic
atacgccatgctgggtctccaaagaagacaagagatatggcccagcattaagcatcaatgaactgagcaatcttgcaaaaggagagaaggctaatgtgctaattgggcaaggagacgtggcgtacttgggagtcggccat

SEQ ID NO: 423146 - DNA, 140 bp, Artificial Sequence
  Synthetic
atggccgactcccaagtacgccacgtctccttgcccaattagcacattagccttctctccttttgcaagattgctcagttcattgatgcttaatgctgggccatatctcttgtcttctttggagacccagcatggcgtat

SEQ ID NO: 423147 - DNA, 140 bp, Artificial Sequence
  Synthetic
atacgccatgctgggtctccaagaagactggaggtccaatctacaggaggagagatggcaaatggatgagagagttgatcctatatgacaaagaagagatcagaagaatttggcgtcaagcgtacttgggagtcggccat

SEQ ID NO: 423148 - DNA, 140 bp, Artificial Sequence
  Synthetic
atggccgactcccaagtacgcttgacgccaaattcttctgatctcttctttgtcatataggatcaactctctcatccatttgccatctctcctcctgtagattggacctccagtcttcttggagacccagcatggcgtat

SEQ ID NO: 423149 - DNA, 140 bp, Artificial Sequence
  Synthetic
atacgccatgctgggtctccaggacatactgatgaggatgtcaaaaatgcaattgggatcctcatcggaggacttgaatggaataataacacggttcgagtctctgaaagtctacagagacgtacttgggagtcggccat

SEQ ID NO: 423150 - DNA, 140 bp, Artificial Sequence
  Synthetic
atggccgactcccaagtacgtctctgtagactttcagagactcgaaccgtgttattattccattcaagtcctccgatgaggatcccaattgcatttttgacatcctcatcagtatgtcctggagacccagcatggcgtat

SEQ ID NO: 423151 - DNA, 140 bp, Artificial Sequence
  Synthetic
atacgccatgctgggtctcccaagtgggccacaggggatggattaacataccagaaaataatgaaagaagtagcaatagatgacgaaacaatgtgccaagaagagcctaaaatccctaaccgtacttgggagtcggccat

SEQ ID NO: 423152 - DNA, 140 bp, Artificial Sequence
  Synthetic
atggccgactcccaagtacggttagggattttaggctcttcttggcacattgtttcgtcatctattgctacttctttcattattttctggtatgttaatccatcccctgtggcccacttgggagacccagcatggcgtat

SEQ ID NO: 423153 - DNA, 140 bp, Artificial Sequence
  Synthetic
aggccctggctgctgatatgtaactcaaggagcccttctgaatgacaaacattctaacggaaccgttaaggacagaagtccatatcgaaccttgatgagctgtcccattggtgaagtcccgaccttttgggacagcggtg

SEQ ID NO: 423154 - DNA, 140 bp, Artificial Sequence
  Synthetic
caccgctgtcccaaaaggtcgggacttcaccaatgggacagctcatcaaggttcgatatggacttctgtccttaacggttccgttagaatgtttgtcattcagaagggctccttgagttacatatcagcagccagggcct

SEQ ID NO: 423155 - DNA, 140 bp, Artificial Sequence
  Synthetic
aggccctggctgctgatatgatgattgcaatcattgtgatagcgatattggcagcagccggaaagtcagacaagatctgcattggatatcatgccaataattcaacaacacaagtggacagaccttttgggacagcggtg

SEQ ID NO: 423156 - DNA, 140 bp, Artificial Sequence
  Synthetic
caccgctgtcccaaaaggtctgtccacttgtgttgttgaattattggcatgatatccaatgcagatcttgtctgactttccggctgctgccaatatcgctatcacaatgattgcaatcatcatatcagcagccagggcct

SEQ ID NO: 423157 - DNA, 140 bp, Artificial Sequence
  Synthetic
aggccctggctgctgatatgatggacaaagtggcagaattgattttcactggacactagtacagccaggtgacaacatcaccttctcacacaatgggggcctgatagcaccgagccgagtgaccttttgggacagcggtg

SEQ ID NO: 423158 - DNA, 140 bp, Artificial Sequence
  Synthetic
caccgctgtcccaaaaggtcactcggctcggtgctatcaggcccccattgtgtgagaaggtgatgttgtcacctggctgtactagtgtccagtgaaaatcaattctgccactttgtccatcatatcagcagccagggcct

SEQ ID NO: 423159 - DNA, 140 bp, Artificial Sequence
  Synthetic
aggccctggctgctgatatgtactcaaggttccctactcaatgacaaacattctaatggcacagttaaagaccggagcccctatagaactctaatgagtgtagaaatagggcaatcacccgaccttttgggacagcggtg

SEQ ID NO: 423160 - DNA, 140 bp, Artificial Sequence
  Synthetic
caccgctgtcccaaaaggtcgggtgattgccctatttctacactcattagagttctataggggctccggtctttaactgtgccattagaatgtttgtcattgagtagggaaccttgagtacatatcagcagccagggcct

SEQ ID NO: 423161 - DNA, 140 bp, Artificial Sequence
  Synthetic
aggccctggctgctgatatgctttatggtctggcggttaaaggacaatctcatctgagaggagatactgatgttgtaacagttgtaactttcgaatttagtagtacagacccaagagtgggaccttttgggacagcggtg

SEQ ID NO: 423162 - DNA, 140 bp, Artificial Sequence
  Synthetic
caccgctgtcccaaaaggtcccactcttgggtctgtactactaaattcgaaagttacaactgttacaacatcagtatctcctctcagatgagattgtcctttaaccgccagaccataaagcatatcagcagccagggcct

SEQ ID NO: 423163 - DNA, 140 bp, Artificial Sequence
  Synthetic
aggccctggctgctgatatgaaataagatccaaatgaagtggggaatggaagctagaagatgtctgcttcaatcaatgcagcaaatggaagcaattgttgaacaagaatcatcgatacaagaccttttgggacagcggtg

SEQ ID NO: 423164 - DNA, 140 bp, Artificial Sequence
  Synthetic
caccgctgtcccaaaaggtcttgtatcgatgattcttgttcaacaattgcttccatttgctgcattgattgaagcagacatcttctagcttccattccccacttcatttggatcttatttcatatcagcagccagggcct

SEQ ID NO: 423165 - DNA, 140 bp, Artificial Sequence
  Synthetic
atacgccatgctgggtctcccagagcaagaatcaaaaccaggctgttcactataaggcaagaaatggccagtaggggtctatgggattcctttcgtcagtccgagagaggcgaagagacacgtacttgggagtcggccat

SEQ ID NO: 423166 - DNA, 140 bp, Artificial Sequence
  Synthetic
atggccgactcccaagtacgtgtctcttcgcctctctcggactgacgaaaggaatcccatagacccctactggccatttcttgccttatagtgaacagcctggttttgattcttgctctgggagacccagcatggcgtat

SEQ ID NO: 423167 - DNA, 140 bp, Artificial Sequence
  Synthetic
atacgccatgctgggtctccaaagaccaagtcagcagcatatccagtgattaaaggaacttacaacaacactggaaatcagccaatcctttatttttggggtgtgcaccatccacctgaccgtacttgggagtcggccat

SEQ ID NO: 423168 - DNA, 140 bp, Artificial Sequence
  Synthetic
atggccgactcccaagtacggtcaggtggatggtgcacaccccaaaaataaaggattggctgatttccagtgttgttgtaagttcctttaatcactggatatgctgctgacttggtctttggagacccagcatggcgtat

SEQ ID NO: 423169 - DNA, 140 bp, Artificial Sequence
  Synthetic
atacgccatgctgggtctcctggagggaatgtattctggaatagaagaatgtattagtaacaacccttgggtgatacagagtgcatactggttcaatgaatggttgggctttgaaaaggacgtacttgggagtcggccat

SEQ ID NO: 423170 - DNA, 140 bp, Artificial Sequence
  Synthetic
atggccgactcccaagtacgtccttttcaaagcccaaccattcattgaaccagtatgcactctgtatcacccaagggttgttactaatacattcttctattccagaatacattccctccaggagacccagcatggcgtat

SEQ ID NO: 423171 - DNA, 140 bp, Artificial Sequence
  Synthetic
atacgccatgctgggtctccgatgaaataatggatgaataaaaagacatagtactcaatttagtactattttgttcattatgtatctaaacatccaataaaaagaaccaagaatcaaaaacgtacttgggagtcggccat

SEQ ID NO: 423172 - DNA, 140 bp, Artificial Sequence
  Synthetic
atggccgactcccaagtacgtttttgattcttggttctttttattggatgtttagatacataatgaacaaaatagtactaaattgagtactatgtctttttattcatccattatttcatcggagacccagcatggcgtat

SEQ ID NO: 423173 - DNA, 140 bp, Artificial Sequence
  Synthetic
atacgccatgctgggtctccgttgaaaaacccaagtttctcccggatttatacgattacaaagagaatcgcttcattgaaattggagtaaccaggagggaagtccatatatactatttagcgtacttgggagtcggccat

SEQ ID NO: 423174 - DNA, 140 bp, Artificial Sequence
  Synthetic
atggccgactcccaagtacgctaaatagtatatatggacttccctcctggttactccaatttcaatgaagcgattctctttgtaatcgtataaatccgggagaaacttgggtttttcaacggagacccagcatggcgtat

SEQ ID NO: 423175 - DNA, 140 bp, Artificial Sequence
  Synthetic
aggccctggctgctgatatggggatctttgaaaactcgtgtctcgaaacgatggaaattgttcagcaaacaagagtggataaactgacccaaggccgccagacctatgactggacgttgagaccttttgggacagcggtg

SEQ ID NO: 423176 - DNA, 140 bp, Artificial Sequence
  Synthetic
caccgctgtcccaaaaggtctcaacgtccagtcataggtctggcggccttgggtcagtttatccactcttgtttgctgaacaatttccatcgtttcgagacacgagttttcaaagatccccatatcagcagccagggcct

SEQ ID NO: 423177 - DNA, 140 bp, Artificial Sequence
  Synthetic
aggccctggctgctgatatgcaatggttgtttcaaaatataccacaaatgtgacaatgcctgcataggatcaatcagaaatggaacttatgatcacgatgtatacagagatgaagcattagaccttttgggacagcggtg

SEQ ID NO: 423178 - DNA, 140 bp, Artificial Sequence
  Synthetic
caccgctgtcccaaaaggtctaatgcttcatctctgtatacatcgtgatcataagttccatttctgattgatcctatgcaggcattgtcacatttgtggtatattttgaaacaaccattgcatatcagcagccagggcct

SEQ ID NO: 423179 - DNA, 140 bp, Artificial Sequence
  Synthetic
atacgccatgctgggtctcccgagatactcactaagaccactgtggaccacatggccataatcaaaaagtacacatcaggaaggcaagagaagaaccctgcactcagaatgaagtggatgcgtacttgggagtcggccat

SEQ ID NO: 423180 - DNA, 140 bp, Artificial Sequence
  Synthetic
atggccgactcccaagtacgcatccacttcattctgagtgcagggttcttctcttgccttcctgatgtgtactttttgattatggccatgtggtccacagtggtcttagtgagtatctcgggagacccagcatggcgtat

SEQ ID NO: 423181 - DNA, 140 bp, Artificial Sequence
  Synthetic
atacgccatgctgggtctcctggagaatgccccaaatatgtgaaatcaaccagattagtccttgcgactgggctcagaaatagccctcaaagagaggaaagaagaaaaaagagaggattacgtacttgggagtcggccat

SEQ ID NO: 423182 - DNA, 140 bp, Artificial Sequence
  Synthetic
atggccgactcccaagtacgtaatcctctcttttttcttctttcctctctttgagggctatttctgagcccagtcgcaaggactaatctggttgatttcacatatttggggcattctccaggagacccagcatggcgtat

SEQ ID NO: 423183 - DNA, 140 bp, Artificial Sequence
  Synthetic
atacgccatgctgggtctccaagggagccattcatttcatgctcccacttggaatgcagaactttcttcttaactcaaggggccctcctgaatgacaagcattctaacggaacaattaagcgtacttgggagtcggccat

SEQ ID NO: 423184 - DNA, 140 bp, Artificial Sequence
  Synthetic
atggccgactcccaagtacgcttaattgttccgttagaatgcttgtcattcaggagggccccttgagttaagaagaaagttctgcattccaagtgggagcatgaaatgaatggctcccttggagacccagcatggcgtat

SEQ ID NO: 423185 - DNA, 140 bp, Artificial Sequence
  Synthetic
atacgccatgctgggtctccaatactcataaggggcaattcccctgtgttcaactacaataaggcgaccaaaagacttactgttcttgggaaggacgcaggtgcattaactgaggatccgcgtacttgggagtcggccat

SEQ ID NO: 423186 - DNA, 140 bp, Artificial Sequence
  Synthetic
atggccgactcccaagtacgcggatcctcagttaatgcacctgcgtccttcccaagaacagtaagtcttttggtcgccttattgtagttgaacacaggggaattgccccttatgagtattggagacccagcatggcgtat

SEQ ID NO: 423187 - DNA, 140 bp, Artificial Sequence
  Synthetic
atacgccatgctgggtctccaatctggtgaaatcacatgtgtgtatagggataattggcatggctcgaatcggccgtgggtttcttttaatcagaacctggagtatcaaataggatacatcgtacttgggagtcggccat

SEQ ID NO: 423188 - DNA, 140 bp, Artificial Sequence
  Synthetic
atggccgactcccaagtacgatgtatcctatttgatactccaggttctgattaaaagaaacccacggccgattcgagccatgccaattatccctatacacacatgtgatttcaccagattggagacccagcatggcgtat

SEQ ID NO: 423189 - DNA, 140 bp, Artificial Sequence
  Synthetic
atacgccatgctgggtctcctttcccaaatgaagtgggggcaagaatactgacatcagagtcacagctggcaataacaaaagaaaagaaagaagagctccaggattgtaaaattgctccccgtacttgggagtcggccat

SEQ ID NO: 423190 - DNA, 140 bp, Artificial Sequence
  Synthetic
atggccgactcccaagtacggggagcaattttacaatcctggagctcttctttcttttcttttgttattgccagctgtgactctgatgtcagtattcttgcccccacttcatttgggaaaggagacccagcatggcgtat

SEQ ID NO: 423191 - DNA, 140 bp, Artificial Sequence
  Synthetic
aggccctggctgctgatatgtctcccagtggctggtggaacaagcagtgtttatattgaagtgctgcacttaactcagggaacatgctgggagcaaatgtacactccaggaggagaagtggaccttttgggacagcggtg

SEQ ID NO: 423192 - DNA, 140 bp, Artificial Sequence
  Synthetic
caccgctgtcccaaaaggtccacttctcctcctggagtgtacatttgctcccagcatgttccctgagttaagtgcagcacttcaatataaacactgcttgttccaccagccactgggagacatatcagcagccagggcct

SEQ ID NO: 423193 - DNA, 140 bp, Artificial Sequence
  Synthetic
aggccctggctgctgatatgatatagtagccgatcaggatttgaagtaatcaaagtttcaaatggctggattaattcgaacgaccaaacaaaggcagttactcaaacacttgtttccaatgaccttttgggacagcggtg

SEQ ID NO: 423194 - DNA, 140 bp, Artificial Sequence
  Synthetic
caccgctgtcccaaaaggtcattggaaacaagtgtttgagtaactgcctttgtttggtcgttcgaattaatccagccatttgaaactttgattacttcaaatcctgatcggctactatatcatatcagcagccagggcct

SEQ ID NO: 423195 - DNA, 140 bp, Artificial Sequence
  Synthetic
atacgccatgctgggtctccattgtaaagactctcacaaacgaaaaggaagaggtgaccaatgctactgaaacagtggagagcaaaagcctggacaaactttgcatgaaaagtcggaactcgtacttgggagtcggccat

SEQ ID NO: 423196 - DNA, 140 bp, Artificial Sequence
  Synthetic
atggccgactcccaagtacgagttccgacttttcatgcaaagtttgtccaggcttttgctctccactgtttcagtagcattggtcacctcttccttttcgtttgtgagagtctttacaatggagacccagcatggcgtat

SEQ ID NO: 423197 - DNA, 140 bp, Artificial Sequence
  Synthetic
aggccctggctgctgatatgaggcagcaatttcaacaacattcccatacaccggtgttcccccttactcccatggaacgggaacaggccacacaatagacaccgtgatcagaacacatgagaccttttgggacagcggtg

SEQ ID NO: 423198 - DNA, 140 bp, Artificial Sequence
  Synthetic
caccgctgtcccaaaaggtctcatgtgttctgatcacggtgtctattgtgtggcctgttcccgttccatgggagtaagggggaacaccggtgtatgggaatgttgttgaaattgctgcctcatatcagcagccagggcct

SEQ ID NO: 423199 - DNA, 140 bp, Artificial Sequence
  Synthetic
atacgccatgctgggtctcctgaaggaaggctgatccagaacagcataacaatagagagaatgcttctctctgcatttgatgaaaggaggaacaaatacctggaagaacatcccagtgcgcgtacttgggagtcggccat

SEQ ID NO: 423200 - DNA, 140 bp, Artificial Sequence
  Synthetic
atggccgactcccaagtacgcgcactgggatgttcttccaggtatttgttcctcctttcatcaaatgcagagagaagcattctctctattgttatgctgttctggatcagccttccttcaggagacccagcatggcgtat

SEQ ID NO: 423201 - DNA, 140 bp, Artificial Sequence
  Synthetic
aggccctggctgctgatatgctgcatttgatgaaaggaggaacaaatacctggaagaacatcccagtgcggggaaagacccaaagaaaactggaggtccaatttatcgaagaagagatgggaccttttgggacagcggtg

SEQ ID NO: 423202 - DNA, 140 bp, Artificial Sequence
  Synthetic
caccgctgtcccaaaaggtcccatctcttcttcgataaattggacctccagttttctttgggtctttccccgcactgggatgttcttccaggtatttgttcctcctttcatcaaatgcagcatatcagcagccagggcct

SEQ ID NO: 423203 - DNA, 140 bp, Artificial Sequence
  Synthetic
aggccctggctgctgatatgtggtcacaactgtagacaaattaacccaggggagacagacttttgattggacagtatgtagaaaccagcctgctgcaacggcactaaacacaacaataacgaccttttgggacagcggtg

SEQ ID NO: 423204 - DNA, 140 bp, Artificial Sequence
  Synthetic
caccgctgtcccaaaaggtcgttattgttgtgtttagtgccgttgcagcaggctggtttctacatactgtccaatcaaaagtctgtctcccctgggttaatttgtctacagttgtgaccacatatcagcagccagggcct

SEQ ID NO: 423205 - DNA, 140 bp, Artificial Sequence
  Synthetic
atacgccatgctgggtctcctctggcgtcaagcgaacaatggagaagatgcaactgctggtctcactcacctgatgatctggcattccaacctaaatgatgccacataccagagaacaagcgtacttgggagtcggccat

SEQ ID NO: 423206 - DNA, 140 bp, Artificial Sequence
  Synthetic
atggccgactcccaagtacgcttgttctctggtatgtggcatcatttaggttggaatgccagatcatcaggtgagtgagaccagcagttgcatcttctccattgttcgcttgacgccagaggagacccagcatggcgtat

SEQ ID NO: 423207 - DNA, 140 bp, Artificial Sequence
  Synthetic
atacgccatgctgggtctccgggtagatgaatactccagtactgagagagtggttgtgagcatcgaccgcttcctaagggttcgagatcagcgggggaacgtgctcttgtcccctgaggacgtacttgggagtcggccat

SEQ ID NO: 423208 - DNA, 140 bp, Artificial Sequence
  Synthetic
atggccgactcccaagtacgtcctcaggggacaagagcacgttcccccgctgatctcgaacccttaggaagcggtcgatgctcacaaccactctctcagtactggagtattcatctacccggagacccagcatggcgtat

SEQ ID NO: 423209 - DNA, 140 bp, Artificial Sequence
  Synthetic
aggccctggctgctgatatggtcggaacgatggtgatggaactaattcggatgataaagcgagggattaatgatcggaatttctggagaggcgagaatggacgaagaacaaggattgcatgaccttttgggacagcggtg

SEQ ID NO: 423210 - DNA, 140 bp, Artificial Sequence
  Synthetic
caccgctgtcccaaaaggtcatgcaatccttgttcttcgtccattctcgcctctccagaaattccgatcattaatccctcgctttatcatccgaattagttccatcaccatcgttccgaccatatcagcagccagggcct

SEQ ID NO: 423211 - DNA, 140 bp, Artificial Sequence
  Synthetic
atacgccatgctgggtctccgaaaggggcaaactaaaaagaagagcgattgcaaccgctggaatacaaatcagagggtttgtattagtagttgaaaacttggctaaaaatatctgtgaaacgtacttgggagtcggccat

SEQ ID NO: 423212 - DNA, 140 bp, Artificial Sequence
  Synthetic
atggccgactcccaagtacgtttcacagatatttttagccaagttttcaactactaatacaaaccctctgatttgtattccagcggttgcaatcgctcttctttttagtttgcccctttcggagacccagcatggcgtat

SEQ ID NO: 423213 - DNA, 140 bp, Artificial Sequence
  Synthetic
aggccctggctgctgatatgcagagggtttgtattagtagttgaaaacttggctaaaaatatctgtgaaaatctagaacaaagtggtttgcccgtaggtggaaatgaaaagaaagccaaagaccttttgggacagcggtg

SEQ ID NO: 423214 - DNA, 140 bp, Artificial Sequence
  Synthetic
caccgctgtcccaaaaggtctttggctttcttttcatttccacctacgggcaaaccactttgttctagattttcacagatatttttagccaagttttcaactactaatacaaaccctctgcatatcagcagccagggcct

SEQ ID NO: 423215 - DNA, 140 bp, Artificial Sequence
  Synthetic
atacgccatgctgggtctccaattgaagatctcatctttctggcacggtctgcactcatcctgagaggatcagtggcccataagtcctgtctgcctgcttgtgtatatggacttgctgtgcgtacttgggagtcggccat

SEQ ID NO: 423216 - DNA, 140 bp, Artificial Sequence
  Synthetic
atggccgactcccaagtacgcacagcaagtccatatacacaagcaggcagacaggacttatgggccactgatcctctcaggatgagtgcagaccgtgccagaaagatgagatcttcaattggagacccagcatggcgtat

SEQ ID NO: 423217 - DNA, 140 bp, Artificial Sequence
  Synthetic
atacgccatgctgggtctcctcctttccgcttgcttcaaaacagccaggtcttcagtctcattagaccaaatgagaatccagcacacaagagtcaactggtgtggatggcatgccattctcgtacttgggagtcggccat

SEQ ID NO: 423218 - DNA, 140 bp, Artificial Sequence
  Synthetic
atggccgactcccaagtacgagaatggcatgccatccacaccagttgactcttgtgtgctggattctcatttggtctaatgagactgaagacctggctgttttgaagcaagcggaaaggaggagacccagcatggcgtat

SEQ ID NO: 423219 - DNA, 140 bp, Artificial Sequence
  Synthetic
atacgccatgctgggtctccccatctgagaaatgatactgacgtggtgaactttgtaagcatggagttctccctcactgacccgagactggagccacacaaatgggaaaagtactgtgttcgtacttgggagtcggccat

SEQ ID NO: 423220 - DNA, 140 bp, Artificial Sequence
  Synthetic
atggccgactcccaagtacgaacacagtacttttcccatttgtgtggctccagtctcgggtcagtgagggagaactccatgcttacaaagttcaccacgtcagtatcatttctcagatggggagacccagcatggcgtat

SEQ ID NO: 423221 - DNA, 140 bp, Artificial Sequence
  Synthetic
atacgccatgctgggtctccgcagcatttgaggacctgagagtttcaagtttcatcagaggaacaagagtgattccaagagggcaactgtccaccaggggagttcaaattgcttcaaatgcgtacttgggagtcggccat

SEQ ID NO: 423222 - DNA, 140 bp, Artificial Sequence
  Synthetic
atggccgactcccaagtacgcatttgaagcaatttgaactcccctggtggacagttgccctcttggaatcactcttgttcctctgatgaaacttgaaactctcaggtcctcaaatgctgcggagacccagcatggcgtat

SEQ ID NO: 423223 - DNA, 140 bp, Artificial Sequence
  Synthetic
atacgccatgctgggtctccaggctcaaataccttgccctgatctgtttagcataccattagaaagatataatgaagaaacaagagcaaaattaagaaagctgaaaccattcttcaatgacgtacttgggagtcggccat

SEQ ID NO: 423224 - DNA, 140 bp, Artificial Sequence
  Synthetic
atggccgactcccaagtacgtcattgaagaatggtttcagctttcttaattttgctcttgtttcttcattatatctttctaatggtatgctaaacagatcagggcaaggtatttgagcctggagacccagcatggcgtat

SEQ ID NO: 423225 - DNA, 140 bp, Artificial Sequence
  Synthetic
aggccctggctgctgatatgtgctatctaccgtgttgggagtagccgcactaggtatcaaaaacattggaaacaaagaatacttatgggatggactgcaatcttctgatgattttgctctgaccttttgggacagcggtg

SEQ ID NO: 423226 - DNA, 140 bp, Artificial Sequence
  Synthetic
caccgctgtcccaaaaggtcagagcaaaatcatcagaagattgcagtccatcccataagtattctttgtttccaatgtttttgatacctagtgcggctactcccaacacggtagatagcacatatcagcagccagggcct

SEQ ID NO: 423227 - DNA, 140 bp, Artificial Sequence
  Synthetic
aggccctggctgctgatatgaaatctgtattcaacagtctatatgcgtctccacaacttgaggggttttcggctgaatcgagaaagttgctcctcattgttcaggcacttagggacaactgaccttttgggacagcggtg

SEQ ID NO: 423228 - DNA, 140 bp, Artificial Sequence
  Synthetic
caccgctgtcccaaaaggtcagttgtccctaagtgcctgaacaatgaggagcaactttctcgattcagccgaaaacccctcaagttgtggagacgcatatagactgttgaatacagatttcatatcagcagccagggcct

SEQ ID NO: 423229 - DNA, 140 bp, Artificial Sequence
  Synthetic
aggccctggctgctgatatgttggagctgtgaaaggtcttgataaaatctgcctaggacatcatgcagtggccaatgggaccatcgtaaagactctcaccaacgaacgggaagaggtgacgaccttttgggacagcggtg

SEQ ID NO: 423230 - DNA, 140 bp, Artificial Sequence
  Synthetic
caccgctgtcccaaaaggtcgtcacctcttcccgttcgttggtgagagtctttacgatggtcccattggccactgcatgatgtcctaggcagattttatcaagacctttcacagctccaacatatcagcagccagggcct

SEQ ID NO: 423231 - DNA, 140 bp, Artificial Sequence
  Synthetic
atacgccatgctgggtctccgagtaaatgaatcagcagacatggcaataggaatgacaataataaagaacaatatgattaacaatgggatgggcccagcaacagcacaaacagccatacacgtacttgggagtcggccat

SEQ ID NO: 423232 - DNA, 140 bp, Artificial Sequence
  Synthetic
atggccgactcccaagtacgtgtatggctgtttgtgctgttgctgggcccatcccattgttaatcatattgttctttattattgtcattcctattgccatgtctgctgattcatttactcggagacccagcatggcgtat

SEQ ID NO: 423233 - DNA, 140 bp, Artificial Sequence
  Synthetic
atacgccatgctgggtctccaaggaagaaaccataaagatctgagcaattgccatccaataggaatgctaatagggacaccagcttgtgatctgcatcttacaggaacgtgggacactctcgtacttgggagtcggccat

SEQ ID NO: 423234 - DNA, 140 bp, Artificial Sequence
  Synthetic
atggccgactcccaagtacgagagtgtcccacgttcctgtaagatgcagatcacaagctggtgtccctattagcattcctattggatggcaattgctcagatctttatggtttcttccttggagacccagcatggcgtat

SEQ ID NO: 423235 - DNA, 140 bp, Artificial Sequence
  Synthetic
atacgccatgctgggtctccttcacatatggatcatccattaattcagctggaaccactaaagcatgcatgagaaatggaggaaatagtttctatgcggagctaaagtggctagtgtcaacgtacttgggagtcggccat

SEQ ID NO: 423236 - DNA, 140 bp, Artificial Sequence
  Synthetic
atggccgactcccaagtacgttgacactagccactttagctccgcatagaaactatttcctccatttctcatgcatgctttagtggttccagctgaattaatggatgatccatatgtgaaggagacccagcatggcgtat

SEQ ID NO: 423237 - DNA, 140 bp, Artificial Sequence
  Synthetic
atacgccatgctgggtctccatgaagaggcactgaggcagaaaataatggaaagtggaggaatcagcaaaataagcactggattcacttatggatcttccataaattcagccggaaccaccgtacttgggagtcggccat

SEQ ID NO: 423238 - DNA, 140 bp, Artificial Sequence
  Synthetic
atggccgactcccaagtacggtggttccggctgaatttatggaagatccataagtgaatccagtgcttattttgctgattcctccactttccattattttctgcctcagtgcctcttcatggagacccagcatggcgtat

SEQ ID NO: 423239 - DNA, 140 bp, Artificial Sequence
  Synthetic
atacgccatgctgggtctccatggattcaaatactgtatcgagtttccaggtagattgctttctttggcatgtccgcaaaagatttgcagaccaagagatgggcgatgccccattcatggcgtacttgggagtcggccat

SEQ ID NO: 423240 - DNA, 140 bp, Artificial Sequence
  Synthetic
atggccgactcccaagtacgccatgaatggggcatcgcccatctcttggtctgcaaatcttttgcggacatgccaaagaaagcaatctacctggaaactcgatacagtatttgaatccatggagacccagcatggcgtat

SEQ ID NO: 423241 - DNA, 140 bp, Artificial Sequence
  Synthetic
atacgccatgctgggtctccggagaactaaaaggaacagatctatactaaatactgatcagaggaacatgattcttgaggaacaatgctacgctaagtgttgcaacctttttgaggcctgcgtacttgggagtcggccat

SEQ ID NO: 423242 - DNA, 140 bp, Artificial Sequence
  Synthetic
atggccgactcccaagtacgcaggcctcaaaaaggttgcaacacttagcgtagcattgttcctcaagaatcatgttcctctgatcagtatttagtatagatctgttccttttagttctccggagacccagcatggcgtat

SEQ ID NO: 423243 - DNA, 140 bp, Artificial Sequence
  Synthetic
atacgccatgctgggtctcctgctggctagcactacagcaaaggctatggaacagatggctggatcgagtgaacaggcagcagaggccatggaggttgctaatcagactaggcagatggtcgtacttgggagtcggccat

SEQ ID NO: 423244 - DNA, 140 bp, Artificial Sequence
  Synthetic
atggccgactcccaagtacgaccatctgcctagtctgattagcaacctccatggcctctgctgcctgttcactcgatccagccatctgttccatagcctttgctgtagtgctagccagcaggagacccagcatggcgtat

SEQ ID NO: 423245 - DNA, 140 bp, Artificial Sequence
  Synthetic
atacgccatgctgggtctccaagctatggcccatagattaagaatggatgcacgactagattatgaatcaggaagaatgtcaaaggatgactttgaaaaagcaatggctcaccttggtgacgtacttgggagtcggccat

SEQ ID NO: 423246 - DNA, 140 bp, Artificial Sequence
  Synthetic
atggccgactcccaagtacgtcaccaaggtgagccattgctttttcaaagtcatcctttgacattcttcctgattcataatctagtcgtgcatccattcttaatctatgggccatagcttggagacccagcatggcgtat

SEQ ID NO: 423247 - DNA, 140 bp, Artificial Sequence
  Synthetic
aggccctggctgctgatatggacgctagtacggccaggtgataatatcaccttctcacacaatgggggtctaatagcaccgagccgagttagcaaattaattggaagaggattggggattgaccttttgggacagcggtg

SEQ ID NO: 423248 - DNA, 140 bp, Artificial Sequence
  Synthetic
caccgctgtcccaaaaggtcaatccccaatcctcttccaattaatttgctaactcggctcggtgctattagacccccattgtgtgagaaggtgatattatcacctggccgtactagcgtccatatcagcagccagggcct

SEQ ID NO: 423249 - DNA, 140 bp, Artificial Sequence
  Synthetic
aggccctggctgctgatatgcaccttggtgagattggatacacataagctccgaagatgtctatggggttattggtcatcattggatacatgtgacaaacaaatgattaaaatgaaaaaagaccttttgggacagcggtg

SEQ ID NO: 423250 - DNA, 140 bp, Artificial Sequence
  Synthetic
caccgctgtcccaaaaggtcttttttcattttaatcatttgtttgtcacatgtatccaatgatgaccaataaccccatagacatcttcggagcttatgtgtatccaatctcaccaaggtgcatatcagcagccagggcct

SEQ ID NO: 423251 - DNA, 140 bp, Artificial Sequence
  Synthetic
aggccctggctgctgatatggacagaagatggagaaggcaaagcagaactagcagaaaaattacactgttggttcggtgggaaagaatttgacctagactctgccttggaatggataaaagaccttttgggacagcggtg

SEQ ID NO: 423252 - DNA, 140 bp, Artificial Sequence
  Synthetic
caccgctgtcccaaaaggtcttttatccattccaaggcagagtctaggtcaaattctttcccaccgaaccaacagtgtaatttttctgctagttctgctttgccttctccatcttctgtccatatcagcagccagggcct

SEQ ID NO: 423253 - DNA, 140 bp, Artificial Sequence
  Synthetic
atacgccatgctgggtctcctgcaatagcggggtttatagagaatgggtgggaaggaatggtagacggctggtatggtttcagacaccaaaatgcccagggcacaggccaagctgctgatcgtacttgggagtcggccat

SEQ ID NO: 423254 - DNA, 140 bp, Artificial Sequence
  Synthetic
atggccgactcccaagtacgatcagcagcttggcctgtgccctgggcattttggtgtctgaaaccataccagccgtctaccattccttcccacccattctctataaaccccgctattgcaggagacccagcatggcgtat

SEQ ID NO: 423255 - DNA, 140 bp, Artificial Sequence
  Synthetic
atacgccatgctgggtctccacttattgaaaaaaccaatactgagttcgagtcaatagaatctgaattcagtgagatcgaacatcagatcggtaacgtcatcaattggactaaggattcacgtacttgggagtcggccat

SEQ ID NO: 423256 - DNA, 140 bp, Artificial Sequence
  Synthetic
atggccgactcccaagtacgtgaatccttagtccaattgatgacgttaccgatctgatgttcgatctcactgaattcagattctattgactcgaactcagtattggttttttcaataagtggagacccagcatggcgtat

SEQ ID NO: 423257 - DNA, 140 bp, Artificial Sequence
  Synthetic
aggccctggctgctgatatgtgtacctgaatcctggaaattattcaatgcaagtaaaactaggaacgctctgtgctttgtgcgagaaacaagcatcacattcacacagggctcatagcaggaccttttgggacagcggtg

SEQ ID NO: 423258 - DNA, 140 bp, Artificial Sequence
  Synthetic
caccgctgtcccaaaaggtcctgctatgagccctgtgtgaatgtgatgcttgtttctcgcacaaagcacagagcgttcctagttttacttgcattgaataatttccaggattcaggtacacatatcagcagccagggcct

SEQ ID NO: 423259 - DNA, 140 bp, Artificial Sequence
  Synthetic
aggccctggctgctgatatgtgtgctttgtgcgagaaacaagcatcacattcacacagggctcatagcagagcagcgagatcttcagtgcccggagtgagacgagaaatgcagatggtctgaccttttgggacagcggtg

SEQ ID NO: 423260 - DNA, 140 bp, Artificial Sequence
  Synthetic
caccgctgtcccaaaaggtcagaccatctgcatttctcgtctcactccgggcactgaagatctcgctgctctgctatgagccctgtgtgaatgtgatgcttgtttctcgcacaaagcacacatatcagcagccagggcct

SEQ ID NO: 423261 - DNA, 140 bp, Artificial Sequence
  Synthetic
aggccctggctgctgatatgtattcggatttccattttattgatgaacgaggcgaatcaataattgtagaatccggagatccaaatgcattattgaaacaccggtttgaaataattgaaggaccttttgggacagcggtg

SEQ ID NO: 423262 - DNA, 140 bp, Artificial Sequence
  Synthetic
caccgctgtcccaaaaggtccttcaattatttcaaaccggtgtttcaataatgcatttggatctccggattctacaattattgattcgcctcgttcatcaataaaatggaaatccgaatacatatcagcagccagggcct

SEQ ID NO: 423263 - DNA, 140 bp, Artificial Sequence
  Synthetic
aggccctggctgctgatatgggatatctttcaaccaaaacttggagtatcaaataggatatatatgcagtggggttttcggagacaatccacgccccaatgatggaaaaggtagttgtgggaccttttgggacagcggtg

SEQ ID NO: 423264 - DNA, 140 bp, Artificial Sequence
  Synthetic
caccgctgtcccaaaaggtcccacaactaccttttccatcattggggcgtggattgtctccgaaaaccccactgcatatatatcctatttgatactccaagttttggttgaaagatatcccatatcagcagccagggcct

SEQ ID NO: 423265 - DNA, 140 bp, Artificial Sequence
  Synthetic
atacgccatgctgggtctcctgaatatcaacccagtgacactctcttctggctacaaagacatcatcctctggtttagcttcggggcatcatgttttgttcttctagccgttgtcatgggcgtacttgggagtcggccat

SEQ ID NO: 423266 - DNA, 140 bp, Artificial Sequence
  Synthetic
atggccgactcccaagtacgcccatgacaacggctagaagaacaaaacatgatgccccgaagctaaaccagaggatgatgtctttgtagccagaagagagtgtcactgggttgatattcaggagacccagcatggcgtat

SEQ ID NO: 423267 - DNA, 140 bp, Artificial Sequence
  Synthetic
atacgccatgctgggtctccaagaggagtaaacatgaaaatacgaataaaggggccaaataaagagacgataaacagagaggtatcaattttgagacacaattaccaaaaagaaattcagcgtacttgggagtcggccat

SEQ ID NO: 423268 - DNA, 140 bp, Artificial Sequence
  Synthetic
atggccgactcccaagtacgctgaatttctttttggtaattgtgtctcaaaattgatacctctctgtttatcgtctctttatttggcccctttattcgtattttcatgtttactcctcttggagacccagcatggcgtat

SEQ ID NO: 423269 - DNA, 140 bp, Artificial Sequence
  Synthetic
aggccctggctgctgatatgtaaacagagaggtatcaattttgagacacaattaccaaaaagaaattcaggctaaagaagcaatgaaggaagtactctctgacaacatggaggtattgaggaccttttgggacagcggtg

SEQ ID NO: 423270 - DNA, 140 bp, Artificial Sequence
  Synthetic
caccgctgtcccaaaaggtcctcaatacctccatgttgtcagagagtacttccttcattgcttctttagcctgaatttctttttggtaattgtgtctcaaaattgatacctctctgtttacatatcagcagccagggcct

SEQ ID NO: 423271 - DNA, 140 bp, Artificial Sequence
  Synthetic
aggccctggctgctgatatgtttctgggattaatgaatcggctgacatgagcattggagttacagtaataaagaataacatgataaacaacgatcttggaccagcaacagctcaaatggcgaccttttgggacagcggtg

SEQ ID NO: 423272 - DNA, 140 bp, Artificial Sequence
  Synthetic
caccgctgtcccaaaaggtcgccatttgagctgttgctggtccaagatcgttgtttatcatgttattctttattactgtaactccaatgctcatgtcagccgattcattaatcccagaaacatatcagcagccagggcct

SEQ ID NO: 423273 - DNA, 140 bp, Artificial Sequence
  Synthetic
aggccctggctgctgatatggtgaaacagttttggaggtagaaaaatcgcattaaattcaatttttactgtacttcttactatgcatttaagcaaattgtaatcaatgtcagcaaataaagaccttttgggacagcggtg

SEQ ID NO: 423274 - DNA, 140 bp, Artificial Sequence
  Synthetic
caccgctgtcccaaaaggtctttatttgctgacattgattacaatttgcttaaatgcatagtaagaagtacagtaaaaattgaatttaatgcgatttttctacctccaaaactgtttcaccatatcagcagccagggcct

SEQ ID NO: 423275 - DNA, 140 bp, Artificial Sequence
  Synthetic
aggccctggctgctgatatgtgccgacacattatgtataggttatcatgcaaacaattcaactgacaccgtagacacagtactagaaaagaatgtaacagtaacacactctgtcaaccttgaccttttgggacagcggtg

SEQ ID NO: 423276 - DNA, 140 bp, Artificial Sequence
  Synthetic
caccgctgtcccaaaaggtcaaggttgacagagtgtgttactgttacattcttttctagtactgtgtctacggtgtcagttgaattgtttgcatgataacctatacataatgtgtcggcacatatcagcagccagggcct

SEQ ID NO: 423277 - DNA, 140 bp, Artificial Sequence
  Synthetic
atacgccatgctgggtctcccttctcaaaaaactgaggcaaataggccaaaaatgaacaatgctaccttcaactatacaaacgttaaccctatttctcacatcagggggagtgttattatcgtacttgggagtcggccat

SEQ ID NO: 423278 - DNA, 140 bp, Artificial Sequence
  Synthetic
atggccgactcccaagtacgataataacactccccctgatgtgagaaatagggttaacgtttgtatagttgaaggtagcattgttcatttttggcctatttgcctcagttttttgagaagggagacccagcatggcgtat

SEQ ID NO: 423279 - DNA, 140 bp, Artificial Sequence
  Synthetic
atacgccatgctgggtctccgaaatctcaccattaccttctcttccaggacatactgatgaggatgtcaaaaatgcaattggggtcctcatcggaggacttgaatggaatgataacacagcgtacttgggagtcggccat

SEQ ID NO: 423280 - DNA, 140 bp, Artificial Sequence
  Synthetic
atggccgactcccaagtacgctgtgttatcattccattcaagtcctccgatgaggaccccaattgcatttttgacatcctcatcagtatgtcctggaagagaaggtaatggtgagatttcggagacccagcatggcgtat

SEQ ID NO: 423281 - DNA, 140 bp, Artificial Sequence
  Synthetic
aggccctggctgctgatatgagaaatcaaaggaaactcagctcccttgataataagggaaccttttattgcttgtggaccaacggaatgcaaacactttgctctaacccattatgcagctgaccttttgggacagcggtg

SEQ ID NO: 423282 - DNA, 140 bp, Artificial Sequence
  Synthetic
caccgctgtcccaaaaggtcagctgcataatgggttagagcaaagtgtttgcattccgttggtccacaagcaataaaaggttcccttattatcaagggagctgagtttcctttgatttctcatatcagcagccagggcct

SEQ ID NO: 423283 - DNA, 140 bp, Artificial Sequence
  Synthetic
atacgccatgctgggtctccactttcgaaaccaagttaaaatacgccgcagggttgacataaacccaggccatgcagatctcagtgctaaagaagcacaagatgtcatcatggaggtcgtcgtacttgggagtcggccat

SEQ ID NO: 423284 - DNA, 140 bp, Artificial Sequence
  Synthetic
atggccgactcccaagtacgacgacctccatgatgacatcttgtgcttctttagcactgagatctgcatggcctgggtttatgtcaaccctgcggcgtattttaacttggtttcgaaagtggagacccagcatggcgtat

SEQ ID NO: 423285 - DNA, 140 bp, Artificial Sequence
  Synthetic
aggccctggctgctgatatgttaacaataaagagaaggaagttctcgtgctatgggccattcaccatccatctaccagtgccgaccaacaaagtctctaccaaaacgcagatgcctatgtgaccttttgggacagcggtg

SEQ ID NO: 423286 - DNA, 140 bp, Artificial Sequence
  Synthetic
caccgctgtcccaaaaggtcacataggcatctgcgttttggtagagactttgttggtcggcactggtagatggatggtgaatggcccatagcacgagaacttccttctctttattgttaacatatcagcagccagggcct

SEQ ID NO: 423287 - DNA, 140 bp, Artificial Sequence
  Synthetic
atacgccatgctgggtctccccaggaggagaagtgagaagtgatgatattgaccaaagtttgattattgccgctagaaacatagtaagaagagcagcagtatcagcagacccattagcatcgtacttgggagtcggccat

SEQ ID NO: 423288 - DNA, 140 bp, Artificial Sequence
  Synthetic
atggccgactcccaagtacgatgctaatgggtctgctgatactgctgctcttcttactatgtttctagcggcaataatcaaactttggtcaatatcatcacttctcacttctcctcctggggagacccagcatggcgtat

SEQ ID NO: 423289 - DNA, 140 bp, Artificial Sequence
  Synthetic
aggccctggctgctgatatgattgaacctattgataatgtcatgggaatgataggtatattgcctgacatgactccaagcacagagatgtcactaagaggggtgagggtcagtaaaacaggaccttttgggacagcggtg

SEQ ID NO: 423290 - DNA, 140 bp, Artificial Sequence
  Synthetic
caccgctgtcccaaaaggtcctgttttactgaccctcacccctcttagtgacatctctgtgcttggagtcatgtcaggcaatatacctatcattcccatgacattatcaataggttcaatcatatcagcagccagggcct

SEQ ID NO: 423291 - DNA, 140 bp, Artificial Sequence
  Synthetic
atacgccatgctgggtctccaaaatatggagaagcatatactgacacgtaccattcctatgcaaaaaacatcctaaggacacaagaaagtgcctgcaattgcatcgggggagattgttatcgtacttgggagtcggccat

SEQ ID NO: 423292 - DNA, 140 bp, Artificial Sequence
  Synthetic
atggccgactcccaagtacgataacaatctcccccgatgcaattgcaggcactttcttgtgtccttaggatgttttttgcataggaatggtacgtgtcagtatatgcttctccatattttggagacccagcatggcgtat

SEQ ID NO: 423293 - DNA, 140 bp, Artificial Sequence
  Synthetic
aggccctggctgctgatatgtaaaacatactgaggaatgcacatgcggatttgccagcaacaaaaccatagaatgtgcttgtagagataaccgttacacagcaaaaagaccctttgtcaagaccttttgggacagcggtg

SEQ ID NO: 423294 - DNA, 140 bp, Artificial Sequence
  Synthetic
caccgctgtcccaaaaggtcttgacaaagggtctttttgctgtgtaacggttatctctacaagcacattctatggttttgttgctggcaaatccgcatgtgcattcctcagtatgttttacatatcagcagccagggcct

SEQ ID NO: 423295 - DNA, 140 bp, Artificial Sequence
  Synthetic
atacgccatgctgggtctccttttcagccttgtttttatgttgaactcacacgaggagtgccaaacaaaaatgagcccgtttcatggaccagcaacagtatagttaccttctgtgggctacgtacttgggagtcggccat

SEQ ID NO: 423296 - DNA, 140 bp, Artificial Sequence
  Synthetic
atggccgactcccaagtacgtagcccacagaaggtaactatactgttgctggtccatgaaacgggctcatttttgtttggcactcctcgtgtgagttcaacataaaaacaaggctgaaaaggagacccagcatggcgtat

SEQ ID NO: 423297 - DNA, 140 bp, Artificial Sequence
  Synthetic
atacgccatgctgggtctcccttatttggacacccccagaccaaatgatggaagcataacagggccttgcgaatctgatggggacaaagggagtggaggcatcaagggaggatttgttcacgtacttgggagtcggccat

SEQ ID NO: 423298 - DNA, 140 bp, Artificial Sequence
  Synthetic
atggccgactcccaagtacgtgaacaaatcctcccttgatgcctccactccctttgtccccatcagattcgcaaggccctgttatgcttccatcatttggtctgggggtgtccaaataagggagacccagcatggcgtat

SEQ ID NO: 423299 - DNA, 140 bp, Artificial Sequence
  Synthetic
atacgccatgctgggtctcccttggaaagaagaatagagaatttaaataaaaaggttgatgatggttttctagatatttggacttacaatgccgaactgttggttctattggaaaatgaacgtacttgggagtcggccat

SEQ ID NO: 423300 - DNA, 140 bp, Artificial Sequence
  Synthetic
atggccgactcccaagtacgttcattttccaatagaaccaacagttcggcattgtaagtccaaatatctagaaaaccatcatcaacctttttatttaaattctctattcttctttccaagggagacccagcatggcgtat

SEQ ID NO: 423301 - DNA, 140 bp, Artificial Sequence
  Synthetic
aggccctggctgctgatatgaggcaatgaggacaattgggactcatcctaactctagtgctggtctgagagataatcttcttgaaaatttgcaggcataccagaaacgaatgggagtgcagaccttttgggacagcggtg

SEQ ID NO: 423302 - DNA, 140 bp, Artificial Sequence
  Synthetic
caccgctgtcccaaaaggtctgcactcccattcgtttctggtatgcctgcaaattttcaagaagattatctctcagaccagcactagagttaggatgagtcccaattgtcctcattgcctcatatcagcagccagggcct

SEQ ID NO: 423303 - DNA, 140 bp, Artificial Sequence
  Synthetic
aggccctggctgctgatatgggggctatatgaagcaattgaggagtgcctgattaatgatccctgggttttgctcaatgcgtcttggttcaactccttcctgacacatgcattgaaataggaccttttgggacagcggtg

SEQ ID NO: 423304 - DNA, 140 bp, Artificial Sequence
  Synthetic
caccgctgtcccaaaaggtcctatttcaatgcatgtgtcaggaaggagttgaaccaagacgcattgagcaaaacccagggatcattaatcaggcactcctcaattgcttcatatagcccccatatcagcagccagggcct

SEQ ID NO: 423305 - DNA, 140 bp, Artificial Sequence
  Synthetic
aggccctggctgctgatatggtaggatgcagttctcctcgctgactgtgaatgtgagaggatcagggctgaggatactggtaagaggcaactctccagtgttcaattacaacaaagcaacgaccttttgggacagcggtg

SEQ ID NO: 423306 - DNA, 140 bp, Artificial Sequence
  Synthetic
caccgctgtcccaaaaggtcgttgctttgttgtaattgaacactggagagttgcctcttaccagtatcctcagccctgatcctctcacattcacagtcagcgaggagaactgcatcctaccatatcagcagccagggcct

SEQ ID NO: 423307 - DNA, 140 bp, Artificial Sequence
  Synthetic
atacgccatgctgggtctccaggatactggtaagaggcaactctccagtgttcaattacaacaaagcaaccaaaaggcttacaattcttggaaaagatgcaggtgcattgactgaagatccgtacttgggagtcggccat

SEQ ID NO: 423308 - DNA, 140 bp, Artificial Sequence
  Synthetic
atggccgactcccaagtacggatcttcagtcaatgcacctgcatcttttccaagaattgtaagccttttggttgctttgttgtaattgaacactggagagttgcctcttaccagtatcctggagacccagcatggcgtat

SEQ ID NO: 423309 - DNA, 140 bp, Artificial Sequence
  Synthetic
aggccctggctgctgatatggctgtgggacactgtcacaggtgttgatatggctttgtaatggaggaatggttgagtctgttctaaaccctttgttcctattttgtttgaacaattgttcgaccttttgggacagcggtg

SEQ ID NO: 423310 - DNA, 140 bp, Artificial Sequence
  Synthetic
caccgctgtcccaaaaggtcgaacaattgttcaaacaaaataggaacaaagggtttagaacagactcaaccattcctccattacaaagccatatcaacacctgtgacagtgtcccacagccatatcagcagccagggcct

SEQ ID NO: 423311 - DNA, 140 bp, Artificial Sequence
  Synthetic
aggccctggctgctgatatgccatatagtcatggaactgggacaggatacaccatggacaccgtcaacagaacacatcaatattcagaaaggggaagatggacaacaaacacagaaactggaccttttgggacagcggtg

SEQ ID NO: 423312 - DNA, 140 bp, Artificial Sequence
  Synthetic
caccgctgtcccaaaaggtccagtttctgtgtttgttgtccatcttcccctttctgaatattgatgtgttctgttgacggtgtccatggtgtatcctgtcccagttccatgactatatggcatatcagcagccagggcct

SEQ ID NO: 423313 - DNA, 140 bp, Artificial Sequence
  Synthetic
atacgccatgctgggtctccatgaatccaaatcaaaagataataacaattggctctgtttctctcatcattgccacaatatgcttccttatgcaagttgccatcctggtgactactgtaacgtacttgggagtcggccat

SEQ ID NO: 423314 - DNA, 140 bp, Artificial Sequence
  Synthetic
atggccgactcccaagtacgttacagtagtcaccaggatggcaacttgcataaggaagcatattgtggcaatgatgagagaaacagagccaattgttattatcttttgatttggattcatggagacccagcatggcgtat

SEQ ID NO: 423315 - DNA, 140 bp, Artificial Sequence
  Synthetic
atacgccatgctgggtctccatgctttgtgaaccaacaataatagaaagaaacaaaacggagattgtgtatctgaccaacaccactgtagagaaggaaatatgccccaaaccagcagaatcgtacttgggagtcggccat

SEQ ID NO: 423316 - DNA, 140 bp, Artificial Sequence
  Synthetic
atggccgactcccaagtacgattctgctggtttggggcatatttccttctctacagtggtgttggtcagatacacaatctccgttttgtttctttctattattgttggttcacaaagcatggagacccagcatggcgtat

SEQ ID NO: 423317 - DNA, 140 bp, Artificial Sequence
  Synthetic
aggccctggctgctgatatgtctgaccaacaccactgtagagaaggaaatatgccccaaaccagcagaatacagaaattggtcaaagcctcaatgtaacattacaggatttgcaccttttgaccttttgggacagcggtg

SEQ ID NO: 423318 - DNA, 140 bp, Artificial Sequence
  Synthetic
caccgctgtcccaaaaggtcaaaaggtgcaaatcctgtaatgttacattgaggctttgaccaatttctgtattctgctggtttggggcatatttccttctctacagtggtgttggtcagacatatcagcagccagggcct

SEQ ID NO: 423319 - DNA, 140 bp, Artificial Sequence
  Synthetic
aggccctggctgctgatatgaaacataatctcaatatgggtcagtcattcaattcagacagggaatcaatgccaagatgaatcaatcagcaacactaaatttcttgctgagaaagctgtggaccttttgggacagcggtg

SEQ ID NO: 423320 - DNA, 140 bp, Artificial Sequence
  Synthetic
caccgctgtcccaaaaggtccacagctttctcagcaagaaatttagtgttgctgattgattcatcttggcattgattccctgtctgaattgaatgactgacccatattgagattatgtttcatatcagcagccagggcct

SEQ ID NO: 423321 - DNA, 140 bp, Artificial Sequence
  Synthetic
atacgccatgctgggtctccactgaggaaggagcgatcgttggagaaatttcaccattgccttctgttccagaacagactaatgaggatgtcaatagtgcaattggggtcctcatcggagcgtacttgggagtcggccat

SEQ ID NO: 423322 - DNA, 140 bp, Artificial Sequence
  Synthetic
atggccgactcccaagtacgctccgatgaggaccccaattgcactattgacatcctcattagtctgttctggaacagaaggcaatggtgaaatttctccaacgatcgctccttcctcagtggagacccagcatggcgtat

SEQ ID NO: 423323 - DNA, 140 bp, Artificial Sequence
  Synthetic
aggccctggctgctgatatggacagagaatagttttgagcaaataacatttatgcaagccttacaactactgcttgaagtagaacaagagataaggactttctcatttcagcttatttaagaccttttgggacagcggtg

SEQ ID NO: 423324 - DNA, 140 bp, Artificial Sequence
  Synthetic
caccgctgtcccaaaaggtcttaaataagctgaaatgagaaagtccttatctcttgttctacttcaagcagtagttgtaaggcttgcataaatgttatttgctcaaaactattctctgtccatatcagcagccagggcct

SEQ ID NO: 423325 - DNA, 140 bp, Artificial Sequence
  Synthetic
atacgccatgctgggtctcccccattccttgaccggcttcgccgagaccagaagtccctaagaggaagaggcagcactcttggtctggacatcgagacagctactcgtgcgggaaagcaacgtacttgggagtcggccat

SEQ ID NO: 423326 - DNA, 140 bp, Artificial Sequence
  Synthetic
atggccgactcccaagtacgttgctttcccgcacgagtagctgtctcgatgtccagaccaagagtgctgcctcttcctcttagggacttctggtctcggcgaagccggtcaaggaatgggggagacccagcatggcgtat

SEQ ID NO: 423327 - DNA, 140 bp, Artificial Sequence
  Synthetic
atacgccatgctgggtctccacaaatgctctgctccccaacaaaaggctctagttgatcaagtgatcggaagcagaaatccagggattgcagacattgaagatctaaccctgcttgctcgcgtacttgggagtcggccat

SEQ ID NO: 423328 - DNA, 140 bp, Artificial Sequence
  Synthetic
atggccgactcccaagtacgcgagcaagcagggttagatcttcaatgtctgcaatccctggatttctgcttccgatcacttgatcaactagagccttttgttggggagcagagcatttgtggagacccagcatggcgtat

SEQ ID NO: 423329 - DNA, 140 bp, Artificial Sequence
  Synthetic
aggccctggctgctgatatgggctgggcctttgatgatggaaatgacgtgtggatgggaagaacgatcagcgagaagtcacgcttaggctatgaaaccttcaaagtcatcaaaggatggtgaccttttgggacagcggtg

SEQ ID NO: 423330 - DNA, 140 bp, Artificial Sequence
  Synthetic
caccgctgtcccaaaaggtcaccatcctttgatgactttgaaggtttcatagcctaagcgtgacttctcgctgatcgttcttcccatccacacgtcatttccatcatcaaaggcccagcccatatcagcagccagggcct

SEQ ID NO: 423331 - DNA, 140 bp, Artificial Sequence
  Synthetic
atacgccatgctgggtctccggtaacaggtccggttattctggtattttctccgttgaaggcaaaaactgcatcaataggtgcttttatgtggagttgataaggggaaggaaagaggaaacgtacttgggagtcggccat

SEQ ID NO: 423332 - DNA, 140 bp, Artificial Sequence
  Synthetic
atggccgactcccaagtacgtttcctctttccttccccttatcaactccacataaaagcacctattgatgcagtttttgccttcaacggagaaaataccagaataaccggacctgttaccggagacccagcatggcgtat

SEQ ID NO: 423333 - DNA, 140 bp, Artificial Sequence
  Synthetic
aggccctggctgctgatatgtatctcccgaagaggtcagcgaaacccagggaacagagaagttgacaataacatattcatcatcaatgatgtgggaaatcaacggtcctgagtcagtgctgaccttttgggacagcggtg

SEQ ID NO: 423334 - DNA, 140 bp, Artificial Sequence
  Synthetic
caccgctgtcccaaaaggtcagcactgactcaggaccgttgatttcccacatcattgatgatgaatatgttattgtcaacttctctgttccctgggtttcgctgacctcttcgggagatacatatcagcagccagggcct

SEQ ID NO: 423335 - DNA, 140 bp, Artificial Sequence
  Synthetic
aggccctggctgctgatatgccatcaagctccagttttgggctccaatgaccagatctggggggaacgaagtaggtggagacggaggatctggccaaataagctgcagcccagtgttcgcgaccttttgggacagcggtg

SEQ ID NO: 423336 - DNA, 140 bp, Artificial Sequence
  Synthetic
caccgctgtcccaaaaggtcgcgaacactgggctgcagcttatttggccagatcctccgtctccacctacttcgttccccccagatctggtcattggagcccaaaactggagcttgatggcatatcagcagccagggcct

SEQ ID NO: 423337 - DNA, 140 bp, Artificial Sequence
  Synthetic
aggccctggctgctgatatggctctctgctttcgatgagagaagaaataagtacctagaagagcatcccagtgctgggaaggatcctaagaaaactggaggacccatatatagaagagtagaccttttgggacagcggtg

SEQ ID NO: 423338 - DNA, 140 bp, Artificial Sequence
  Synthetic
caccgctgtcccaaaaggtctactcttctatatatgggtcctccagttttcttaggatccttcccagcactgggatgctcttctaggtacttatttcttctctcatcgaaagcagagagccatatcagcagccagggcct

SEQ ID NO: 423339 - DNA, 140 bp, Artificial Sequence
  Synthetic
atacgccatgctgggtctccaagagtagataaactaacccaaggccgccagacctatgactggacattgaatagaaaccagccggctgcaactgctttggctaatactatagaggtattccgtacttgggagtcggccat

SEQ ID NO: 423340 - DNA, 140 bp, Artificial Sequence
  Synthetic
atggccgactcccaagtacggaatacctctatagtattagccaaagcagttgcagccggctggtttctattcaatgtccagtcataggtctggcggccttgggttagtttatctactcttggagacccagcatggcgtat

SEQ ID NO: 423341 - DNA, 140 bp, Artificial Sequence
  Synthetic
aggccctggctgctgatatggaggattatgatgacctcgattattaaagcaacaaaatagacactatgactgtgattgtttcaatacgtttggaatgtgggtgtttattcttattaaaatgaccttttgggacagcggtg

SEQ ID NO: 423342 - DNA, 140 bp, Artificial Sequence
  Synthetic
caccgctgtcccaaaaggtcattttaataagaataaacacccacattccaaacgtattgaaacaatcacagtcatagtgtctattttgttgctttaataatcgaggtcatcataatcctccatatcagcagccagggcct

SEQ ID NO: 423343 - DNA, 140 bp, Artificial Sequence
  Synthetic
atacgccatgctgggtctccaaaggcttgccgtccttggaaaggacgcaggtgcattaacagaggatccagatgaggggacaacaggagtggaatctgcagtgctgagggggttcctaatcgtacttgggagtcggccat

SEQ ID NO: 423344 - DNA, 140 bp, Artificial Sequence
  Synthetic
atggccgactcccaagtacgattaggaaccccctcagcactgcagattccactcctgttgtcccctcatctggatcctctgttaatgcacctgcgtcctttccaaggacggcaagcctttggagacccagcatggcgtat

SEQ ID NO: 423345 - DNA, 140 bp, Artificial Sequence
  Synthetic
atacgccatgctgggtctcctttctaatatccacaaaatgaaggcaataattgtactactcatggtagtaacatccaatgcagatcgaatctgcactgggataacatcttcaaactcacccgtacttgggagtcggccat

SEQ ID NO: 423346 - DNA, 140 bp, Artificial Sequence
  Synthetic
atggccgactcccaagtacgggtgagtttgaagatgttatcccagtgcagattcgatctgcattggatgttactaccatgagtagtacaattattgccttcattttgtggatattagaaaggagacccagcatggcgtat

SEQ ID NO: 423347 - DNA, 140 bp, Artificial Sequence
  Synthetic
atacgccatgctgggtctccatagacccatttaaattactccaaaacagtcaagtgttcagcctgataagaccaaatgaaaacccagctcacaagagtcaattagtgtggatggcatgcccgtacttgggagtcggccat

SEQ ID NO: 423348 - DNA, 140 bp, Artificial Sequence
  Synthetic
atggccgactcccaagtacgggcatgccatccacactaattgactcttgtgagctgggttttcatttggtcttatcaggctgaacacttgactgttttggagtaatttaaatgggtctatggagacccagcatggcgtat

SEQ ID NO: 423349 - DNA, 140 bp, Artificial Sequence
  Synthetic
atacgccatgctgggtctccaatatattggcacctcatgcgccccggcgaaaggataacgtttgagagcaatggaggccttctagcccccagatacggatatatcattgagaagtacggtcgtacttgggagtcggccat

SEQ ID NO: 423350 - DNA, 140 bp, Artificial Sequence
  Synthetic
atggccgactcccaagtacgaccgtacttctcaatgatatatccgtatctgggggctagaaggcctccattgctctcaaacgttatcctttcgccggggcgcatgaggtgccaatatattggagacccagcatggcgtat

SEQ ID NO: 423351 - DNA, 140 bp, Artificial Sequence
  Synthetic
aggccctggctgctgatatgggatgtggccttgggcaggccaatgtgtgtgggaactacaccatctgcgaaagcttcaatacttcacgaagtcagacctgttacatccgggtgcttccctgaccttttgggacagcggtg

SEQ ID NO: 423352 - DNA, 140 bp, Artificial Sequence
  Synthetic
caccgctgtcccaaaaggtcagggaagcacccggatgtaacaggtctgacttcgtgaagtattgaagctttcgcagatggtgtagttcccacacacattggcctgcccaaggccacatcccatatcagcagccagggcct

SEQ ID NO: 423353 - DNA, 140 bp, Artificial Sequence
  Synthetic
atacgccatgctgggtctcctttaaatacggcaatggtgtttggatagggagaactaaaagcactagttcaaggaggggttttgagatgatttgggatccaaacggatggaccggaacagcgtacttgggagtcggccat

SEQ ID NO: 423354 - DNA, 140 bp, Artificial Sequence
  Synthetic
atggccgactcccaagtacgctgttccggtccatccgtttggatcccaaatcatctcaaaacccctccttgaactagtgcttttagttctccctatccaaacaccattgccgtatttaaaggagacccagcatggcgtat

SEQ ID NO: 423355 - DNA, 140 bp, Artificial Sequence
  Synthetic
atacgccatgctgggtctccacacaatactggagaaaaatgtgactgttacccattcagttaacttactagaaaacagccataatggaaaactctgcagcctgaatggaaagattccattcgtacttgggagtcggccat

SEQ ID NO: 423356 - DNA, 140 bp, Artificial Sequence
  Synthetic
atggccgactcccaagtacgaatggaatctttccattcaggctgcagagttttccattatggctgttttctagtaagttaactgaatgggtaacagtcacatttttctccagtattgtgtggagacccagcatggcgtat

SEQ ID NO: 423357 - DNA, 140 bp, Artificial Sequence
  Synthetic
atacgccatgctgggtctccgttgattacatgatgcaaaaacctgggaaaacaggaacaattgtctatcaaagaggtgttttgttgcctcaaaaggtgtggtgcgcgagtggcaggagcacgtacttgggagtcggccat

SEQ ID NO: 423358 - DNA, 140 bp, Artificial Sequence
  Synthetic
atggccgactcccaagtacgtgctcctgccactcgcgcaccacaccttttgaggcaacaaaacacctctttgatagacaattgttcctgttttcccaggtttttgcatcatgtaatcaacggagacccagcatggcgtat

SEQ ID NO: 423359 - DNA, 140 bp, Artificial Sequence
  Synthetic
aggccctggctgctgatatgcaccggaatggatcccagaatgtgctctctaatgcaaggttcaacacttcccagaaggtctggtgccgcaggtgctgcagtgaaaggagttggaacaatagaccttttgggacagcggtg

SEQ ID NO: 423360 - DNA, 140 bp, Artificial Sequence
  Synthetic
caccgctgtcccaaaaggtctattgttccaactcctttcactgcagcacctgcggcaccagaccttctgggaagtgttgaaccttgcattagagagcacattctgggatccattccggtgcatatcagcagccagggcct

SEQ ID NO: 423361 - DNA, 140 bp, Artificial Sequence
  Synthetic
atacgccatgctgggtctccaagaaggcaactgcgggaaaatgctgaggacatgggcaatggttgtttcaaaatataccacaaatgtgacaatgcctgcataggatcaatcagaaatggacgtacttgggagtcggccat

SEQ ID NO: 423362 - DNA, 140 bp, Artificial Sequence
  Synthetic
atggccgactcccaagtacgtccatttctgattgatcctatgcaggcattgtcacatttgtggtatattttgaaacaaccattgcccatgtcctcagcattttcccgcagttgccttcttggagacccagcatggcgtat

SEQ ID NO: 423363 - DNA, 140 bp, Artificial Sequence
  Synthetic
atacgccatgctgggtctcctcccaagaggaaccgctctattctcaacacaagccaaaggggaattctcgaggatgaacagatgtaccagaagtgctgcaacctgttcgagaaatttttccgtacttgggagtcggccat

SEQ ID NO: 423364 - DNA, 140 bp, Artificial Sequence
  Synthetic
atggccgactcccaagtacggaaaaatttctcgaacaggttgcagcacttctggtacatctgttcatcctcgagaattcccctttggcttgtgttgagaatagagcggttcctcttgggaggagacccagcatggcgtat

SEQ ID NO: 423365 - DNA, 140 bp, Artificial Sequence
  Synthetic
atacgccatgctgggtctccaccatactatactgctctattactcaactgctgcttctagtttggctgtaacattgatgctagctatttttattgtttatatggtctccagagacaacgtcgtacttgggagtcggccat

SEQ ID NO: 423366 - DNA, 140 bp, Artificial Sequence
  Synthetic
atggccgactcccaagtacgacgttgtctctggagaccatataaacaataaaaatagctagcatcaatgttacagccaaactagaagcagcagttgagtaatagagcagtatagtatggtggagacccagcatggcgtat

SEQ ID NO: 423367 - DNA, 140 bp, Artificial Sequence
  Synthetic
aggccctggctgctgatatggaggtgggtccgggagcaaccaatgccaccataaactttgaagcaggaattctggagtgctatgaaaggctttcatggcaaagggcccttgactatcctggaccttttgggacagcggtg

SEQ ID NO: 423368 - DNA, 140 bp, Artificial Sequence
  Synthetic
caccgctgtcccaaaaggtccaggatagtcaagggccctttgccatgaaagcctttcatagcactccagaattcctgcttcaaagtttatggtggcattggttgctcccggacccacctccatatcagcagccagggcct

SEQ ID NO: 423369 - DNA, 140 bp, Artificial Sequence
  Synthetic
atacgccatgctgggtctcctttggatggccctttcttaaggaaggaaaattgtcccagagcatcaggatccaagaattggtcaaaacctcaatgtcaaattccagggtttttcccctttcgtacttgggagtcggccat

SEQ ID NO: 423370 - DNA, 140 bp, Artificial Sequence
  Synthetic
atggccgactcccaagtacgaaaggggaaaaaccctggaatttgacattgaggttttgaccaattcttggatcctgatgctctgggacaattttccttccttaagaaagggccatccaaaggagacccagcatggcgtat

SEQ ID NO: 423371 - DNA, 140 bp, Artificial Sequence
  Synthetic
atacgccatgctgggtctccactcacaacaaaagtgagcctgaaagtaaaaggatgtctcttgaagagagaaaagcaattggagtaaaaatgatgaaagtactcctatttatgaatccgtcgtacttgggagtcggccat

SEQ ID NO: 423372 - DNA, 140 bp, Artificial Sequence
  Synthetic
atggccgactcccaagtacgacggattcataaataggagtactttcatcatttttactccaattgcttttctctcttcaagagacatccttttactttcaggctcacttttgttgtgagtggagacccagcatggcgtat

SEQ ID NO: 423373 - DNA, 140 bp, Artificial Sequence
  Synthetic
aggccctggctgctgatatgaaaagcaattggagtaaaaatgatgaaagtactcctatttatgaatccgtctgctggaattgaagggtttgagccatactgtatgaaaagttcctcaaatgaccttttgggacagcggtg

SEQ ID NO: 423374 - DNA, 140 bp, Artificial Sequence
  Synthetic
caccgctgtcccaaaaggtcatttgaggaacttttcatacagtatggctcaaacccttcaattccagcagacggattcataaataggagtactttcatcatttttactccaattgcttttcatatcagcagccagggcct

SEQ ID NO: 423375 - DNA, 140 bp, Artificial Sequence
  Synthetic
atacgccatgctgggtctccaatgcaaattagaggatttgtgtactttgtagaagcactggcgaggagcatatgtgagaaacttgagcaatctggactcccagttggggggaacgagaagcgtacttgggagtcggccat

SEQ ID NO: 423376 - DNA, 140 bp, Artificial Sequence
  Synthetic
atggccgactcccaagtacgcttctcgttccccccaactgggagtccagattgctcaagtttctcacatatgctcctcgccagtgcttctacaaagtacacaaatcctctaatttgcattggagacccagcatggcgtat

SEQ ID NO: 423377 - DNA, 140 bp, Artificial Sequence
  Synthetic
aggccctggctgctgatatgaccggcctgtgctggtgatttcgcctgatctctcttacagagttgggtatttgtgtgcagggctgccaagcgacactccaagaggagaagatgcccaattgaccttttgggacagcggtg

SEQ ID NO: 423378 - DNA, 140 bp, Artificial Sequence
  Synthetic
caccgctgtcccaaaaggtcaattgggcatcttctcctcttggagtgtcgcttggcagccctgcacacaaatacccaactctgtaagagagatcaggcgaaatcaccagcacaggccggtcatatcagcagccagggcct

SEQ ID NO: 423379 - DNA, 140 bp, Artificial Sequence
  Synthetic
atacgccatgctgggtctccgtgccttgatgacatagaagaagaaccagatgatgttgatggcccaactgaaatagtattaagggacatgaacaacaaagatgcaaggcaaaagataaagcgtacttgggagtcggccat

SEQ ID NO: 423380 - DNA, 140 bp, Artificial Sequence
  Synthetic
atggccgactcccaagtacgctttatcttttgccttgcatctttgttgttcatgtcccttaatactatttcagttgggccatcaacatcatctggttcttcttctatgtcatcaaggcacggagacccagcatggcgtat

SEQ ID NO: 423381 - DNA, 140 bp, Artificial Sequence
  Synthetic
aggccctggctgctgatatggaattggttgcataatttgaatcacaaatatccagcgctgaacgtaactatgccaaacaatgacagatttgacaaattgtacatttggggagttcaccatgaccttttgggacagcggtg

SEQ ID NO: 423382 - DNA, 140 bp, Artificial Sequence
  Synthetic
caccgctgtcccaaaaggtcatggtgaactccccaaatgtacaatttgtcaaatctgtcattgtttggcatagttacgttcagcgctggatatttgtgattcaaattatgcaaccaattccatatcagcagccagggcct

SEQ ID NO: 423383 - DNA, 140 bp, Artificial Sequence
  Synthetic
aggccctggctgctgatatgtgccccattccttgatcggctccgccgagatcaaaagtccttaaaaggaagaggcaacacccttggcctcgacatcgaaacagccactcttgttgggaaagaccttttgggacagcggtg

SEQ ID NO: 423384 - DNA, 140 bp, Artificial Sequence
  Synthetic
caccgctgtcccaaaaggtctttcccaacaagagtggctgtttcgatgtcgaggccaagggtgttgcctcttccttttaaggacttttgatctcggcggagccgatcaaggaatggggcacatatcagcagccagggcct

SEQ ID NO: 423385 - DNA, 140 bp, Artificial Sequence
  Synthetic
atacgccatgctgggtctccatcttttcattcactggggaagaaatggctactaaggcagactacactcttgatgaagaaagtagagcgaggatcaaaaccagactattcaccataagaccgtacttgggagtcggccat

SEQ ID NO: 423386 - DNA, 140 bp, Artificial Sequence
  Synthetic
atggccgactcccaagtacggtcttatggtgaatagtctggttttgatcctcgctctactttcttcatcaagagtgtagtctgccttagtagccatttcttccccagtgaatgaaaagatggagacccagcatggcgtat

SEQ ID NO: 423387 - DNA, 140 bp, Artificial Sequence
  Synthetic
atacgccatgctgggtctccatggagagaataaaagaactaagagatctaatgtcgcagtcccgcactcgcgagatactcactaagaccactgtggaccacatggccataatcaaaaagtcgtacttgggagtcggccat

SEQ ID NO: 423388 - DNA, 140 bp, Artificial Sequence
  Synthetic
atggccgactcccaagtacgactttttgattatggccatgtggtccacagtggtcttagtgagtatctcgcgagtgcgggactgcgacattagatctcttagttcttttattctctccatggagacccagcatggcgtat

SEQ ID NO: 423389 - DNA, 140 bp, Artificial Sequence
  Synthetic
atacgccatgctgggtctccttggggggctatatgaagcaattgaggagtgcctgattaatgatccctgggttttgcttaatgcatcttggttcaactccttcctcacacatgcactgaacgtacttgggagtcggccat

SEQ ID NO: 423390 - DNA, 140 bp, Artificial Sequence
  Synthetic
atggccgactcccaagtacgttcagtgcatgtgtgaggaaggagttgaaccaagatgcattaagcaaaacccagggatcattaatcaggcactcctcaattgcttcatatagccccccaaggagacccagcatggcgtat

SEQ ID NO: 423391 - DNA, 140 bp, Artificial Sequence
  Synthetic
atacgccatgctgggtctccgcaaattaaggagaagagcaattgcaacacccggaatgcaaatcagagggtttgtatattttgttgaaacattagcaaggagcatttgtgagaagcttgacgtacttgggagtcggccat

SEQ ID NO: 423392 - DNA, 140 bp, Artificial Sequence
  Synthetic
atggccgactcccaagtacgtcaagcttctcacaaatgctccttgctaatgtttcaacaaaatatacaaaccctctgatttgcattccgggtgttgcaattgctcttctccttaatttgcggagacccagcatggcgtat

SEQ ID NO: 423393 - DNA, 140 bp, Artificial Sequence
  Synthetic
atacgccatgctgggtctccatggaagactttgtgcgacaatgcttcaatccaatgatcgtcgagcttgcggaaaaggcaatgaaagaatatggggaagatccgaaaatcgaaactaacacgtacttgggagtcggccat

SEQ ID NO: 423394 - DNA, 140 bp, Artificial Sequence
  Synthetic
atggccgactcccaagtacgtgttagtttcgattttcggatcttccccatattctttcattgccttttccgcaagctcgacgatcattggattgaagcattgtcgcacaaagtcttccatggagacccagcatggcgtat

SEQ ID NO: 423395 - DNA, 140 bp, Artificial Sequence
  Synthetic
atacgccatgctgggtctccgttaaactatacaagaagctcaaaagagaaataacgttccatggggccaaggaggtgtcactaagctattcaactggtgcacttgccagttgcatgggcccgtacttgggagtcggccat

SEQ ID NO: 423396 - DNA, 140 bp, Artificial Sequence
  Synthetic
atggccgactcccaagtacgggcccatgcaactggcaagtgcaccagttgaatagcttagtgacacctccttggccccatggaacgttatttctcttttgagcttcttgtatagtttaacggagacccagcatggcgtat

SEQ ID NO: 423397 - DNA, 140 bp, Artificial Sequence
  Synthetic
atacgccatgctgggtctccatgcagtggggtttttggtgataacccgcgtcctaatgatgggaagggcaattgtggcccagtaccttctaatggagcaaatggagtgaaaggattctcacgtacttgggagtcggccat

SEQ ID NO: 423398 - DNA, 140 bp, Artificial Sequence
  Synthetic
atggccgactcccaagtacgtgagaatcctttcactccatttgctccattagaaggtactgggccacaattgcccttcccatcattaggacgcgggttatcaccaaaaaccccactgcatggagacccagcatggcgtat

SEQ ID NO: 423399 - DNA, 140 bp, Artificial Sequence
  Synthetic
aggccctggctgctgatatgatggacaggcgtcatacaagatcttcaagatagaaaaagggaaagtagttaaatcagttgaattgaatgcacctaattaccactacgaggaatgctcctggaccttttgggacagcggtg

SEQ ID NO: 423400 - DNA, 140 bp, Artificial Sequence
  Synthetic
caccgctgtcccaaaaggtccaggagcattcctcgtagtggtaattaggtgcattcaattcaactgatttaactactttccctttttctatcttgaagatcttgtatgacgcctgtccatcatatcagcagccagggcct

SEQ ID NO: 423401 - DNA, 140 bp, Artificial Sequence
  Synthetic
aggccctggctgctgatatgaaacggactgtgtccttgaagcaatggctttccttgaagaatcccacccaggaatctttgaaaactcgtgtcttgaaacgatggaagttgttcaacaaacgaccttttgggacagcggtg

SEQ ID NO: 423402 - DNA, 140 bp, Artificial Sequence
  Synthetic
caccgctgtcccaaaaggtcgtttgttgaacaacttccatcgtttcaagacacgagttttcaaagattcctgggtgggattcttcaaggaaagccattgcttcaaggacacagtccgtttcatatcagcagccagggcct

SEQ ID NO: 423403 - DNA, 140 bp, Artificial Sequence
  Synthetic
atacgccatgctgggtctcccgagcttgcggaaaaggcaatgaaagagtatggagaagatccgaaaatagaaacaaacaaatttgctgcaatatgcacacacttagaagtatgtttcatgcgtacttgggagtcggccat

SEQ ID NO: 423404 - DNA, 140 bp, Artificial Sequence
  Synthetic
atggccgactcccaagtacgcatgaaacatacttctaagtgtgtgcatattgcagcaaatttgtttgtttctattttcggatcttctccatactctttcattgccttttccgcaagctcgggagacccagcatggcgtat

SEQ ID NO: 423405 - DNA, 140 bp, Artificial Sequence
  Synthetic
atacgccatgctgggtctccacaatcactggagacaacaccaaatggaatgaaaatcagaaccctaggatgtttctggcaatgataacatatataacaagaaaccaacctgaatggttcacgtacttgggagtcggccat

SEQ ID NO: 423406 - DNA, 140 bp, Artificial Sequence
  Synthetic
atggccgactcccaagtacgtgaaccattcaggttggtttcttgttatatatgttatcattgccagaaacatcctagggttctgattttcattccatttggtgttgtctccagtgattgtggagacccagcatggcgtat

SEQ ID NO: 423407 - DNA, 140 bp, Artificial Sequence
  Synthetic
aggccctggctgctgatatgaagaaaatggtcacacaaagaacaataggaaagaagaagcagaggttaaacaagagaagctatctaataagagcactgacactgaacacaatgacaaaaggaccttttgggacagcggtg

SEQ ID NO: 423408 - DNA, 140 bp, Artificial Sequence
  Synthetic
caccgctgtcccaaaaggtccttttgtcattgtgttcagtgtcagtgctcttattagatagcttctcttgtttaacctctgcttcttctttcctattgttctttgtgtgaccattttcttcatatcagcagccagggcct

SEQ ID NO: 423409 - DNA, 140 bp, Artificial Sequence
  Synthetic
atacgccatgctgggtctccgctgataatctggggggtacatcatcccaatgacgatgcagaacaaaggacactgtaccagaatgtgggaacatatgtttccattggaacatcaacactacgtacttgggagtcggccat

SEQ ID NO: 423410 - DNA, 140 bp, Artificial Sequence
  Synthetic
atggccgactcccaagtacgtagtgttgatgttccaatggaaacatatgttcccacattctggtacagtgtcctttgttctgcatcgtcattgggatgatgtaccccccagattatcagcggagacccagcatggcgtat

SEQ ID NO: 423411 - DNA, 140 bp, Artificial Sequence
  Synthetic
atacgccatgctgggtctccggggccttgaaaagcaatctaccttttcagaatgtacatcccatcactattggagaatgccccaagtatgttaaaagcacccaactgagaatggcaacagcgtacttgggagtcggccat

SEQ ID NO: 423412 - DNA, 140 bp, Artificial Sequence
  Synthetic
atggccgactcccaagtacgctgttgccattctcagttgggtgcttttaacatacttggggcattctccaatagtgatgggatgtacattctgaaaaggtagattgcttttcaaggccccggagacccagcatggcgtat

SEQ ID NO: 423413 - DNA, 140 bp, Artificial Sequence
  Synthetic
atacgccatgctgggtctccgtgggcacttggtgagaatatggcaccagagaaagtagattttgaggactgcaaagatgttagcgacctaagacagtatgacagtgatgaaccggagtctcgtacttgggagtcggccat

SEQ ID NO: 423414 - DNA, 140 bp, Artificial Sequence
  Synthetic
atggccgactcccaagtacgagactccggttcatcactgtcatactgtcttaggtcgctaacatctttgcagtcctcaaaatctactttctctggtgccatattctcaccaagtgcccacggagacccagcatggcgtat

SEQ ID NO: 423415 - DNA, 140 bp, Artificial Sequence
  Synthetic
aggccctggctgctgatatgtggagaatgccccaagtatgttaaaagcacccaactgagaatggcaacaggattaaggaatatcccctcaattcaatccagaggactgtttggggcaattgaccttttgggacagcggtg

SEQ ID NO: 423416 - DNA, 140 bp, Artificial Sequence
  Synthetic
caccgctgtcccaaaaggtcaattgccccaaacagtcctctggattgaattgaggggatattccttaatcctgttgccattctcagttgggtgcttttaacatacttggggcattctccacatatcagcagccagggcct

SEQ ID NO: 423417 - DNA, 140 bp, Artificial Sequence
  Synthetic
atacgccatgctgggtctcccaggaatgcggaatgtaccagagaaacaaactagaggcatattcggcgcaatcgcaggtttcatagaaaatggttgggaggggatggtggacggttggtacgtacttgggagtcggccat

SEQ ID NO: 423418 - DNA, 140 bp, Artificial Sequence
  Synthetic
atggccgactcccaagtacgtaccaaccgtccaccatcccctcccaaccattttctatgaaacctgcgattgcgccgaatatgcctctagtttgtttctctggtacattccgcattcctgggagacccagcatggcgtat

SEQ ID NO: 423419 - DNA, 140 bp, Artificial Sequence
  Synthetic
aggccctggctgctgatatgcgacccaaatgctctcctaaaacaccggtttgaaataatcgaaggacgagatcgtaccatggcctggacagtagtgaatagtatttgtaacactacaggagaccttttgggacagcggtg

SEQ ID NO: 423420 - DNA, 140 bp, Artificial Sequence
  Synthetic
caccgctgtcccaaaaggtctcctgtagtgttacaaatactattcactactgtccaggccatggtacgatctcgtccttcgattatttcaaaccggtgttttaggagagcatttgggtcgcatatcagcagccagggcct

SEQ ID NO: 423421 - DNA, 140 bp, Artificial Sequence
  Synthetic
aggccctggctgctgatatgaaggagcggttttgagatgatttgggatccaaacggatggactggaacagacaataatttctcagtaaagcaagatatcataggaataactgaatggtcagaccttttgggacagcggtg

SEQ ID NO: 423422 - DNA, 140 bp, Artificial Sequence
  Synthetic
caccgctgtcccaaaaggtctgaccattcagttattcctatgatatcttgctttactgagaaattattgtctgttccagtccatccgtttggatcccaaatcatctcaaaaccgctccttcatatcagcagccagggcct

SEQ ID NO: 423423 - DNA, 140 bp, Artificial Sequence
  Synthetic
aggccctggctgctgatatgagatagattctataggacttgcaagcttgtcgggatcaacatgagcaaaaagaagtcctacataaacaggacaggaacatttgaattcacaagctttttcgaccttttgggacagcggtg

SEQ ID NO: 423424 - DNA, 140 bp, Artificial Sequence
  Synthetic
caccgctgtcccaaaaggtcgaaaaagcttgtgaattcaaatgttcctgtcctgtttatgtaggacttctttttgctcatgttgatcccgacaagcttgcaagtcctatagaatctatctcatatcagcagccagggcct

SEQ ID NO: 423425 - DNA, 140 bp, Artificial Sequence
  Synthetic
atacgccatgctgggtctccataattctattaaccatgaagaccatcattgttctaagctatcttttctgtctggctctcagccaagattactcagaaaacaacaacagcactgcaacaccgtacttgggagtcggccat

SEQ ID NO: 423426 - DNA, 140 bp, Artificial Sequence
  Synthetic
atggccgactcccaagtacggtgttgcagtgctgttgttgttttctgagtaatcttggctgagagccagacagaaaagatagcttagaacaatgatggtcttcatggttaatagaattatggagacccagcatggcgtat

SEQ ID NO: 423427 - DNA, 140 bp, Artificial Sequence
  Synthetic
atacgccatgctgggtctccaaaaagaaatcttacataaataggacaggaacatttgaattcacaagctttttctaccggtatgggtttgtagccaacttcagtatggagttacccagctcgtacttgggagtcggccat

SEQ ID NO: 423428 - DNA, 140 bp, Artificial Sequence
  Synthetic
atggccgactcccaagtacgagctgggtaactccatactgaagttggctacaaacccataccggtagaaaaagcttgtgaattcaaatgttcctgtcctatttatgtaagatttctttttggagacccagcatggcgtat

SEQ ID NO: 423429 - DNA, 140 bp, Artificial Sequence
  Synthetic
aggccctggctgctgatatgatgttgtgagaaagatgatgactaattcacaagacacagagctttctttcacaatcactggggacaacactaaatggaatgaaaaccaaaatcctcgaatgaccttttgggacagcggtg

SEQ ID NO: 423430 - DNA, 140 bp, Artificial Sequence
  Synthetic
caccgctgtcccaaaaggtcattcgaggattttggttttcattccatttagtgttgtccccagtgattgtgaaagaaagctctgtgtcttgtgaattagtcatcatctttctcacaacatcatatcagcagccagggcct

SEQ ID NO: 423431 - DNA, 140 bp, Artificial Sequence
  Synthetic
aggccctggctgctgatatgcccatcgtagatattaatataaaagattatagcattgcttccagttatatgtgctcaggacttgttggagacacacccagaaaaaatgacaggtccagtagaccttttgggacagcggtg

SEQ ID NO: 423432 - DNA, 140 bp, Artificial Sequence
  Synthetic
caccgctgtcccaaaaggtctactggacctgtcattttttctgggtgtgtctccaacaagtcctgagcacatataactggaagcaatgctataatcttttatattaatatctacgatgggcatatcagcagccagggcct

SEQ ID NO: 423433 - DNA, 140 bp, Artificial Sequence
  Synthetic
atacgccatgctgggtctccggagtagatgaatactccagcacagagagagtggtagtgagcattgaccgatttttaagagtccgagaccaacgggggaatgtgctattgtcacctgaagcgtacttgggagtcggccat

SEQ ID NO: 423434 - DNA, 140 bp, Artificial Sequence
  Synthetic
atggccgactcccaagtacgcttcaggtgacaatagcacattcccccgttggtctcggactcttaaaaatcggtcaatgctcactaccactctctctgtgctggagtattcatctactccggagacccagcatggcgtat

SEQ ID NO: 423435 - DNA, 140 bp, Artificial Sequence
  Synthetic
aggccctggctgctgatatgcactgtaccagaatgtgggaacatatgtttccattggaacatcaacactaaataagagatcaatccctgaaatagcgacaaggcccaaagtcaatggacagaccttttgggacagcggtg

SEQ ID NO: 423436 - DNA, 140 bp, Artificial Sequence
  Synthetic
caccgctgtcccaaaaggtctgtccattgactttgggccttgtcgctatttcagggattgatctcttatttagtgttgatgttccaatggaaacatatgttcccacattctggtacagtgcatatcagcagccagggcct

SEQ ID NO: 423437 - DNA, 140 bp, Artificial Sequence
  Synthetic
aggccctggctgctgatatgtaagaaggaagagtttgctgagatcatgaagatctgttccaccattgaagagctcagacggcagaaatagtgaatttagcttgtccttcatgaaaaaatggaccttttgggacagcggtg

SEQ ID NO: 423438 - DNA, 140 bp, Artificial Sequence
  Synthetic
caccgctgtcccaaaaggtccattttttcatgaaggacaagctaaattcactatttctgccgtctgagctcttcaatggtggaacagatcttcatgatctcagcaaactcttccttcttacatatcagcagccagggcct

SEQ ID NO: 423439 - DNA, 140 bp, Artificial Sequence
  Synthetic
atacgccatgctgggtctcccagtggctcataagtcctgcttgcctgcatgtgtatatggacttgctgtggccagtggatacgactttgagagagagggatactccctagtcggaatcgacgtacttgggagtcggccat

SEQ ID NO: 423440 - DNA, 140 bp, Artificial Sequence
  Synthetic
atggccgactcccaagtacgtcgattccgactagggagtatccctctctctcaaagtcgtatccactggccacagcaagtccatatacacatgcaggcaagcaggacttatgagccactgggagacccagcatggcgtat

SEQ ID NO: 423441 - DNA, 140 bp, Artificial Sequence
  Synthetic
aggccctggctgctgatatgcaacatactggtgggacggactccaatcctccgacgactttgccctcatagtaaatgcaccaaattatgagggaatacaagcaggagtggatagattctagaccttttgggacagcggtg

SEQ ID NO: 423442 - DNA, 140 bp, Artificial Sequence
  Synthetic
caccgctgtcccaaaaggtctagaatctatccactcctgcttgtattccctcataatttggtgcatttactatgagggcaaagtcgtcggaggattggagtccgtcccaccagtatgttgcatatcagcagccagggcct

SEQ ID NO: 423443 - DNA, 140 bp, Artificial Sequence
  Synthetic
aggccctggctgctgatatgagtttgctgcaatatgtacgcacctagaagtctgtttcatgtattctgatttccacttcatcgatgaacgaggtgaatcgatagtcgtagaatctggtgagaccttttgggacagcggtg

SEQ ID NO: 423444 - DNA, 140 bp, Artificial Sequence
  Synthetic
caccgctgtcccaaaaggtctcaccagattctacgactatcgattcacctcgttcatcgatgaagtggaaatcagaatacatgaaacagacttctaggtgcgtacatattgcagcaaactcatatcagcagccagggcct

SEQ ID NO: 423445 - DNA, 140 bp, Artificial Sequence
  Synthetic
atacgccatgctgggtctccctccacacagatcacaatggaatgctgtgtgcaacaaatctaggacatcccctcatcctagatacatgtaacgtagaaggactgatctacggcaacccttcgtacttgggagtcggccat

SEQ ID NO: 423446 - DNA, 140 bp, Artificial Sequence
  Synthetic
atggccgactcccaagtacgaagggttgccgtagatcagtccttctacgttacatgtatctaggatgaggggatgtcctagatttgttgcacacagcattccattgtgatctgtgtggagggagacccagcatggcgtat

SEQ ID NO: 423447 - DNA, 140 bp, Artificial Sequence
  Synthetic
atacgccatgctgggtctcccatggaagttgttttcccaaatgaagtgggggctagaatactaacatcggaatcacaactgacgataacaaaagagaagaaagaagaactccaggactgccgtacttgggagtcggccat

SEQ ID NO: 423448 - DNA, 140 bp, Artificial Sequence
  Synthetic
atggccgactcccaagtacggcagtcctggagttcttctttcttctcttttgttatcgtcagttgtgattccgatgttagtattctagcccccacttcatttgggaaaacaacttccatgggagacccagcatggcgtat

SEQ ID NO: 423449 - DNA, 140 bp, Artificial Sequence
  Synthetic
aggccctggctgctgatatgcaggaacatagtaagaagagcaacagtatcagcagacccactagcatctctattggagatgtgccacagcacacagattggagggataaggatggtagacgaccttttgggacagcggtg

SEQ ID NO: 423450 - DNA, 140 bp, Artificial Sequence
  Synthetic
caccgctgtcccaaaaggtcgtctaccatccttatccctccaatctgtgtgctgtggcacatctccaatagagatgctagtgggtctgctgatactgttgctcttcttactatgttcctgcatatcagcagccagggcct

SEQ ID NO: 423451 - DNA, 140 bp, Artificial Sequence
  Synthetic
atacgccatgctgggtctccaaacagactgtgtgttggaagcaatggccttccttgaggagtcccacccaggtatctttgaaaactcatgtcttgaaacgatggaagtcattcaacaaaccgtacttgggagtcggccat

SEQ ID NO: 423452 - DNA, 140 bp, Artificial Sequence
  Synthetic
atggccgactcccaagtacggtttgttgaatgacttccatcgtttcaagacatgagttttcaaagatacctgggtgggactcctcaaggaaggccattgcttccaacacacagtctgtttggagacccagcatggcgtat

SEQ ID NO: 423453 - DNA, 140 bp, Artificial Sequence
  Synthetic
atacgccatgctgggtctccaggcaattccccagtgttcaattacaacaaggccaccaagaggctcacagttctcgggaaagatgcaggtgcattgaccgaagatccagatgaaggcacacgtacttgggagtcggccat

SEQ ID NO: 423454 - DNA, 140 bp, Artificial Sequence
  Synthetic
atggccgactcccaagtacgtgtgccttcatctggatcttcggtcaatgcacctgcatctttcccgagaactgtgagcctcttggtggccttgttgtaattgaacactggggaattgcctggagacccagcatggcgtat

SEQ ID NO: 423455 - DNA, 140 bp, Artificial Sequence
  Synthetic
aggccctggctgctgatatggcacaatggcctggacagttgtaaacagcatctgcaatactacagaggttgagaagcccaggttcctcccggatctgtatgactacaaggagaatcgattgaccttttgggacagcggtg

SEQ ID NO: 423456 - DNA, 140 bp, Artificial Sequence
  Synthetic
caccgctgtcccaaaaggtcaatcgattctccttgtagtcatacagatccgggaggaacctgggcttctcaacctctgtagtattgcagatgctgtttacaactgtccaggccattgtgccatatcagcagccagggcct

SEQ ID NO: 423457 - DNA, 140 bp, Artificial Sequence
  Synthetic
atacgccatgctgggtctccggcaaccttcaaacattaaaaataagagtacatgaggggtatgaagagttcacaatggttgggagaagggcaacagccattctcaggaaggcaaccagaacgtacttgggagtcggccat

SEQ ID NO: 423458 - DNA, 140 bp, Artificial Sequence
  Synthetic
atggccgactcccaagtacgttctggttgccttcctgagaatggctgttgcccttctcccaaccattgtgaactcttcatacccctcatgtactcttatttttaatgtttgaaggttgccggagacccagcatggcgtat

SEQ ID NO: 423459 - DNA, 140 bp, Artificial Sequence
  Synthetic
atacgccatgctgggtctcccttgaaataggagacatgctcttgaggactgcgataggccaagtgtcgaggcccatgttcctatatgtgagaaccaatggaacctccaagatcaagatgacgtacttgggagtcggccat

SEQ ID NO: 423460 - DNA, 140 bp, Artificial Sequence
  Synthetic
atggccgactcccaagtacgtcatcttgatcttggaggttccattggttctcacatataggaacatgggcctcgacacttggcctatcgcagtcctcaagagcatgtctcctatttcaagggagacccagcatggcgtat

SEQ ID NO: 423461 - DNA, 140 bp, Artificial Sequence
  Synthetic
aggccctggctgctgatatgactctagatttccatgactttaatgtaaagaatttatatgaaaaagtcaaatcacaactgaggaacaatgccaaggaaatcggaaatggctgctttgagtgaccttttgggacagcggtg

SEQ ID NO: 423462 - DNA, 140 bp, Artificial Sequence
  Synthetic
caccgctgtcccaaaaggtcactcaaagcagccatttccgatttccttggcattgttcctcagttgtgatttgactttttcatataaattctttacattaaagtcatggaaatctagagtcatatcagcagccagggcct

SEQ ID NO: 423463 - DNA, 140 bp, Artificial Sequence
  Synthetic
aggccctggctgctgatatgactacctgacatgaccccaagtactgagatgtcactgagaggaataagaatcagtaagatgggagtagatgaatactccagcacagagagagtggtagtagaccttttgggacagcggtg

SEQ ID NO: 423464 - DNA, 140 bp, Artificial Sequence
  Synthetic
caccgctgtcccaaaaggtctactaccactctctctgtgctggagtattcatctactcccatcttactgattcttattcctctcagtgacatctcagtacttggggtcatgtcaggtagtcatatcagcagccagggcct

SEQ ID NO: 423465 - DNA, 140 bp, Artificial Sequence
  Synthetic
atacgccatgctgggtctcctctcccggtggctggtggaacaagcagtgtttatattgaagtgctgcacttaactcagggaacatgctgggaacaaatgtacactccaggaggagaagtgcgtacttgggagtcggccat

SEQ ID NO: 423466 - DNA, 140 bp, Artificial Sequence
  Synthetic
atggccgactcccaagtacgcacttctcctcctggagtgtacatttgttcccagcatgttccctgagttaagtgcagcacttcaatataaacactgcttgttccaccagccaccgggagaggagacccagcatggcgtat

SEQ ID NO: 423467 - DNA, 140 bp, Artificial Sequence
  Synthetic
aggccctggctgctgatatgaaggtaacacaatggcacaataccaatgtcattgagtacatagaaaggccagagaacgatcatttcatgaacaatacagaagcattgtgtgatgccaagggaccttttgggacagcggtg

SEQ ID NO: 423468 - DNA, 140 bp, Artificial Sequence
  Synthetic
caccgctgtcccaaaaggtcccttggcatcacacaatgcttctgtattgttcatgaaatgatcgttctctggcctttctatgtactcaatgacattggtattgtgccattgtgttaccttcatatcagcagccagggcct

SEQ ID NO: 423469 - DNA, 140 bp, Artificial Sequence
  Synthetic
aggccctggctgctgatatgcatatttttgttataagagaaccatttgtctcttgctctccaacagagtgcaggacgttcttccttacccagggttccttactcaatgacaaacactctagaccttttgggacagcggtg

SEQ ID NO: 423470 - DNA, 140 bp, Artificial Sequence
  Synthetic
caccgctgtcccaaaaggtctagagtgtttgtcattgagtaaggaaccctgggtaaggaagaacgtcctgcactctgttggagagcaagagacaaatggttctcttataacaaaaatatgcatatcagcagccagggcct

SEQ ID NO: 423471 - DNA, 140 bp, Artificial Sequence
  Synthetic
atacgccatgctgggtctccatactgataaggggcaattctccagtgttcaattacaataaggccactaaaaggcttacagttctcggaaaagatgcaggtgcactgaccgaagatccagcgtacttgggagtcggccat

SEQ ID NO: 423472 - DNA, 140 bp, Artificial Sequence
  Synthetic
atggccgactcccaagtacgctggatcttcggtcagtgcacctgcatcttttccgagaactgtaagccttttagtggccttattgtaattgaacactggagaattgccccttatcagtatggagacccagcatggcgtat

SEQ ID NO: 423473 - DNA, 140 bp, Artificial Sequence
  Synthetic
aggccctggctgctgatatgtacagacactgttgacacagtactggaaaagaatgtaactgtgactcactcagtgaatttgctcgaagacagccacaatgggaagctctgcagcctgaatgaccttttgggacagcggtg

SEQ ID NO: 423474 - DNA, 140 bp, Artificial Sequence
  Synthetic
caccgctgtcccaaaaggtcattcaggctgcagagcttcccattgtggctgtcttcgagcaaattcactgagtgagtcacagttacattcttttccagtactgtgtcaacagtgtctgtacatatcagcagccagggcct

SEQ ID NO: 423475 - DNA, 140 bp, Artificial Sequence
  Synthetic
atacgccatgctgggtctcctcttgaggcatttccaaaaggatgcaaaagtgcttttccagaactggggaattgaacccatcgacagtgtaatgggaatgatcgggatattgcctgatatcgtacttgggagtcggccat

SEQ ID NO: 423476 - DNA, 140 bp, Artificial Sequence
  Synthetic
atggccgactcccaagtacgatatcaggcaatatcccgatcattcccattacactgtcgatgggttcaattccccagttctggaaaagcacttttgcatccttttggaaatgcctcaagaggagacccagcatggcgtat

SEQ ID NO: 423477 - DNA, 140 bp, Artificial Sequence
  Synthetic
atacgccatgctgggtctccgggcaatccagaatgtgatctcctactcactgcaaactcatggtcctatataatagagacgtccaattcagagaacgggacatgctatcccggtgaattccgtacttgggagtcggccat

SEQ ID NO: 423478 - DNA, 140 bp, Artificial Sequence
  Synthetic
atggccgactcccaagtacggaattcaccgggatagcatgtcccgttctctgaattggacgtctctattatataggaccatgagtttgcagtgagtaggagatcacattctggattgcccggagacccagcatggcgtat

SEQ ID NO: 423479 - DNA, 140 bp, Artificial Sequence
  Synthetic
atacgccatgctgggtctccccaattaaagaataatgctaaggaaatagggaatgggtgctttgaattctatcacaagtgtaacaacgaatgcatggagagtgtgaaaaacggaacttatcgtacttgggagtcggccat

SEQ ID NO: 423480 - DNA, 140 bp, Artificial Sequence
  Synthetic
atggccgactcccaagtacgataagttccgtttttcacactctccatgcattcgttgttacacttgtgatagaattcaaagcacccattccctatttccttagcattattctttaattggggagacccagcatggcgtat

SEQ ID NO: 423481 - DNA, 140 bp, Artificial Sequence
  Synthetic
aggccctggctgctgatatggatccaaaatggaagactttgtgcgacaatgtttcaatccaatgattgtcgagcttgcggaaaagacaatgaaagagtatggggaagacccgaaagtcgagaccttttgggacagcggtg

SEQ ID NO: 423482 - DNA, 140 bp, Artificial Sequence
  Synthetic
caccgctgtcccaaaaggtctcgactttcgggtcttccccatactctttcattgtcttttccgcaagctcgacaatcattggattgaaacattgtcgcacaaagtcttccattttggatccatatcagcagccagggcct

SEQ ID NO: 423483 - DNA, 140 bp, Artificial Sequence
  Synthetic
atacgccatgctgggtctccggactggaaccaacaggccagtattggtgatttctccagatttgtcttacagagtcggatacttgtgtgcaggtctccccagtgacactccaagaggagacgtacttgggagtcggccat

SEQ ID NO: 423484 - DNA, 140 bp, Artificial Sequence
  Synthetic
atggccgactcccaagtacgtctcctcttggagtgtcactggggagacctgcacacaagtatccgactctgtaagacaaatctggagaaatcaccaatactggcctgttggttccagtccggagacccagcatggcgtat

SEQ ID NO: 423485 - DNA, 140 bp, Artificial Sequence
  Synthetic
aggccctggctgctgatatgagggggtcggaacaatggtgatggaactaattcgaatgataaaacgagggattaatgaccgtaatttctggagaggtgaaaatggacgaaggacgagggtgaccttttgggacagcggtg

SEQ ID NO: 423486 - DNA, 140 bp, Artificial Sequence
  Synthetic
caccgctgtcccaaaaggtcaccctcgtccttcgtccattttcacctctccagaaattacggtcattaatccctcgttttatcattcgaattagttccatcaccattgttccgaccccctcatatcagcagccagggcct

SEQ ID NO: 423487 - DNA, 140 bp, Artificial Sequence
  Synthetic
atacgccatgctgggtctccagatagtcagttcacaggatcctgcactagcccaatgggaaatcagggatatggagttaagggatttggattcaggcagggcaatgatgtatggatgggacgtacttgggagtcggccat

SEQ ID NO: 423488 - DNA, 140 bp, Artificial Sequence
  Synthetic
atggccgactcccaagtacgtcccatccatacatcattgccctgcctgaatccaaatcccttaactccatatccctgatttcccattgggctagtgcaggatcctgtgaactgactatctggagacccagcatggcgtat

SEQ ID NO: 423489 - DNA, 140 bp, Artificial Sequence
  Synthetic
aggccctggctgctgatatgatggagttaagggatttggattcaggcagggcaatgatgtatggatgggaaggaccattagcaggacatcaagatcagggtttgaaatcctgaaagtcaggaccttttgggacagcggtg

SEQ ID NO: 423490 - DNA, 140 bp, Artificial Sequence
  Synthetic
caccgctgtcccaaaaggtcctgactttcaggatttcaaaccctgatcttgatgtcctgctaatggtccttcccatccatacatcattgccctgcctgaatccaaatcccttaactccatcatatcagcagccagggcct

SEQ ID NO: 423491 - DNA, 140 bp, Artificial Sequence
  Synthetic
aggccctggctgctgatatgcaggagtcgagaaacccaaatttctcccagatttgtatgactacaaagagaatcggttcattgaaattggggttacacgaagagaagttcacatatactagaccttttgggacagcggtg

SEQ ID NO: 423492 - DNA, 140 bp, Artificial Sequence
  Synthetic
caccgctgtcccaaaaggtctagtatatgtgaacttctcttcgtgtaaccccaatttcaatgaaccgattctctttgtagtcatacaaatctgggagaaatttgggtttctcgactcctgcatatcagcagccagggcct

SEQ ID NO: 423493 - DNA, 140 bp, Artificial Sequence
  Synthetic
aggccctggctgctgatatgagtactacggctaaggccatggagcaaatggcagggtcaagtgagcaggcagcagaggctatggaggttgctagtcaggctagacagatggtgcaggcaagaccttttgggacagcggtg

SEQ ID NO: 423494 - DNA, 140 bp, Artificial Sequence
  Synthetic
caccgctgtcccaaaaggtcttgcctgcaccatctgtctagcctgactagcaacctccatagcctctgctgcctgctcacttgaccctgccatttgctccatggccttagccgtagtactcatatcagcagccagggcct

SEQ ID NO: 423495 - DNA, 140 bp, Artificial Sequence
  Synthetic
aggccctggctgctgatatgtctcgttcacgggggaggaaatggccaccggagcggactacacccttgatgaagagagcagagcaaggattaaaaccaggctgttcactataaggcaagagaccttttgggacagcggtg

SEQ ID NO: 423496 - DNA, 140 bp, Artificial Sequence
  Synthetic
caccgctgtcccaaaaggtctcttgccttatagtgaacagcctggttttaatccttgctctgctctcttcatcaagggtgtagtccgctccggtggccatttcctcccccgtgaacgagacatatcagcagccagggcct

SEQ ID NO: 423497 - DNA, 140 bp, Artificial Sequence
  Synthetic
aggccctggctgctgatatgggaaggagtgcctgagtctatgagggaagaatatcggcaggaacagcagagtgctgtggatgttgacgatggtcattttgtcaacatagagctggagtaagaccttttgggacagcggtg

SEQ ID NO: 423498 - DNA, 140 bp, Artificial Sequence
  Synthetic
caccgctgtcccaaaaggtcttactccagctctatgttgacaaaatgaccatcgtcaacatccacagcactctgctgttcctgccgatattcttccctcatagactcaggcactccttcccatatcagcagccagggcct

SEQ ID NO: 423499 - DNA, 140 bp, Artificial Sequence
  Synthetic
aggccctggctgctgatatgtttggcgtcaagctaataatggagaggacgcaactgctggtctcacccatttgatgatttggcattccaatctgaatgatgccacataccagagaacaaggaccttttgggacagcggtg

SEQ ID NO: 423500 - DNA, 140 bp, Artificial Sequence
  Synthetic
caccgctgtcccaaaaggtccttgttctctggtatgtggcatcattcagattggaatgccaaatcatcaaatgggtgagaccagcagttgcgtcctctccattattagcttgacgccaaacatatcagcagccagggcct

SEQ ID NO: 423501 - DNA, 140 bp, Artificial Sequence
  Synthetic
atacgccatgctgggtctccggtaacaggtccggttattctggtattttctctgttgaaggcaaaagctgcatcaatcggtgcttttatgtggagttgataaggggaaggaaagaggaagcgtacttgggagtcggccat

SEQ ID NO: 423502 - DNA, 140 bp, Artificial Sequence
  Synthetic
atggccgactcccaagtacgcttcctctttccttccccttatcaactccacataaaagcaccgattgatgcagcttttgccttcaacagagaaaataccagaataaccggacctgttaccggagacccagcatggcgtat

SEQ ID NO: 423503 - DNA, 140 bp, Artificial Sequence
  Synthetic
atacgccatgctgggtctccgcaaattgaagaggcgggcaattgcaacacccggaatgcagatcaggggatttgtgtactttgttgaaacattggcgagaagcatctgtgaaaaacttgacgtacttgggagtcggccat

SEQ ID NO: 423504 - DNA, 140 bp, Artificial Sequence
  Synthetic
atggccgactcccaagtacgtcaagtttttcacagatgcttctcgccaatgtttcaacaaagtacacaaatcccctgatctgcattccgggtgttgcaattgcccgcctcttcaatttgcggagacccagcatggcgtat

SEQ ID NO: 423505 - DNA, 140 bp, Artificial Sequence
  Synthetic
aggccctggctgctgatatggtctccctgggggcaatcagtttctggatgtgctctaatgggtcattgcaatgcagaatatgcatttagagcttggatttcaagatgtgtggaaaaacacgaccttttgggacagcggtg

SEQ ID NO: 423506 - DNA, 140 bp, Artificial Sequence
  Synthetic
caccgctgtcccaaaaggtcgtgtttttccacacatcttgaaatccaagctctaaatgcatattctgcattgcaatgacccattagagcacatccagaaactgattgcccccagggagaccatatcagcagccagggcct

SEQ ID NO: 423507 - DNA, 140 bp, Artificial Sequence
  Synthetic
aggccctggctgctgatatgcatagctggtttcatagagggaggttggtcaggattagttgctggttggtatgggttccagcattcaaatgatcaaggaaccggaatggctgcagatagagaccttttgggacagcggtg

SEQ ID NO: 423508 - DNA, 140 bp, Artificial Sequence
  Synthetic
caccgctgtcccaaaaggtctctatctgcagccattccggttccttgatcatttgaatgctggaacccataccaaccagcaactaatcctgaccaacctccctctatgaaaccagctatgcatatcagcagccagggcct

SEQ ID NO: 423509 - DNA, 140 bp, Artificial Sequence
  Synthetic
atacgccatgctgggtctccagtcccaagaggacaactgtccaccagaggagttcagattgcttcaaatgagaacatggagacaatggactccagtactcttgaactgaggagcagataccgtacttgggagtcggccat

SEQ ID NO: 423510 - DNA, 140 bp, Artificial Sequence
  Synthetic
atggccgactcccaagtacggtatctgctcctcagttcaagagtactggagtccattgtctccatgttctcatttgaagcaatctgaactcctctggtggacagttgtcctcttgggactggagacccagcatggcgtat

SEQ ID NO: 423511 - DNA, 140 bp, Artificial Sequence
  Synthetic
aggccctggctgctgatatgtgcaggacaaatcagcgtacagcccacattctctgtgcagagaaacctcccattcgagagagcaaccatcatggcggcatttacaggaaacactgaaggcgaccttttgggacagcggtg

SEQ ID NO: 423512 - DNA, 140 bp, Artificial Sequence
  Synthetic
caccgctgtcccaaaaggtcgccttcagtgtttcctgtaaatgccgccatgatggttgctctctcgaatgggaggtttctctgcacagagaatgtgggctgtacgctgatttgtcctgcacatatcagcagccagggcct

SEQ ID NO: 423513 - DNA, 140 bp, Artificial Sequence
  Synthetic
aggccctggctgctgatatgccgagtcttctgtaagagaaaaggacatgactaaagaattctttgaaaacaaatcagaaacatggccaattggggagtcccccaaaggggtggaagaagggaccttttgggacagcggtg

SEQ ID NO: 423514 - DNA, 140 bp, Artificial Sequence
  Synthetic
caccgctgtcccaaaaggtcccttcttccacccctttgggggactccccaattggccatgtttctgatttgttttcaaagaattctttagtcatgtccttttctcttacagaagactcggcatatcagcagccagggcct

SEQ ID NO: 423515 - DNA, 140 bp, Artificial Sequence
  Synthetic
aggccctggctgctgatatgagacaagatctgcatagggtatcatgccaataattcaacaacacaagtggatacgatacttgaaaagaatgtaaccgtcacacactcagttgaattgctggaccttttgggacagcggtg

SEQ ID NO: 423516 - DNA, 140 bp, Artificial Sequence
  Synthetic
caccgctgtcccaaaaggtccagcaattcaactgagtgtgtgacggttacattcttttcaagtatcgtatccacttgtgttgttgaattattggcatgataccctatgcagatcttgtctcatatcagcagccagggcct

SEQ ID NO: 423517 - DNA, 140 bp, Artificial Sequence
  Synthetic
atacgccatgctgggtctccatacgatacttgaaaagaatgtaaccgtcacacactcagttgaattgctggagaatcaaaaagaagaaagattctgcaaaatcttgaacaaggcccccctcgtacttgggagtcggccat

SEQ ID NO: 423518 - DNA, 140 bp, Artificial Sequence
  Synthetic
atggccgactcccaagtacgaggggggccttgttcaagattttgcagaatctttcttctttttgattctccagcaattcaactgagtgtgtgacggttacattcttttcaagtatcgtatggagacccagcatggcgtat

SEQ ID NO: 423519 - DNA, 140 bp, Artificial Sequence
  Synthetic
atacgccatgctgggtctccatggtccaaaaatatactcagaacccaggagtcggaatgcgtttgcatcaatggaacttgtacagtagtaatgactgatgggagcgcttcaggaaaagctcgtacttgggagtcggccat

SEQ ID NO: 423520 - DNA, 140 bp, Artificial Sequence
  Synthetic
atggccgactcccaagtacgagcttttcctgaagcgctcccatcagtcattactactgtacaagttccattgatgcaaacgcattccgactcctgggttctgagtatatttttggaccatggagacccagcatggcgtat

SEQ ID NO: 423521 - DNA, 140 bp, Artificial Sequence
  Synthetic
atacgccatgctgggtctccgcgacctattacttggtgatcaaagctggtcatatatagtggaaaggcctactgctcaaaatgggatttgctacccaggagttttgaatgaagtagaagacgtacttgggagtcggccat

SEQ ID NO: 423522 - DNA, 140 bp, Artificial Sequence
  Synthetic
atggccgactcccaagtacgtcttctacttcattcaaaactcctgggtagcaaatcccattttgagcagtaggcctttccactatatatgaccagctttgatcaccaagtaataggtcgcggagacccagcatggcgtat

SEQ ID NO: 423523 - DNA, 140 bp, Artificial Sequence
  Synthetic
aggccctggctgctgatatgactgctcaaaatgggatttgctacccaggagttttgaatgaagtagaagaactgaaggcacttattggatcaggagaaagggtagagaggtttgagatgtgaccttttgggacagcggtg

SEQ ID NO: 423524 - DNA, 140 bp, Artificial Sequence
  Synthetic
caccgctgtcccaaaaggtcacatctcaaacctctctaccctttctcctgatccaataagtgccttcagttcttctacttcattcaaaactcctgggtagcaaatcccattttgagcagtcatatcagcagccagggcct

SEQ ID NO: 423525 - DNA, 140 bp, Artificial Sequence
  Synthetic
aggccctggctgctgatatggcaacattctcaagggaaaattccaaacagcagcacaacgagcaatgatggaccaagtgagggaaagccggaatcctgggaatgctgaaattgaagatctgaccttttgggacagcggtg

SEQ ID NO: 423526 - DNA, 140 bp, Artificial Sequence
  Synthetic
caccgctgtcccaaaaggtcagatcttcaatttcagcattcccaggattccggctttccctcacttggtccatcattgctcgttgtgctgctgtttggaattttcccttgagaatgttgccatatcagcagccagggcct

SEQ ID NO: 423527 - DNA, 140 bp, Artificial Sequence
  Synthetic
atacgccatgctgggtctccgcttgcccttataacagtggttcatctttctacagaaacctcctatggataataaaaaccaagtcagcagcatatccagtaattaagggaacttacaacacgtacttgggagtcggccat

SEQ ID NO: 423528 - DNA, 140 bp, Artificial Sequence
  Synthetic
atggccgactcccaagtacgtgttgtaagttcccttaattactggatatgctgctgacttggtttttattatccataggaggtttctgtagaaagatgaaccactgttataagggcaagcggagacccagcatggcgtat

SEQ ID NO: 423529 - DNA, 140 bp, Artificial Sequence
  Synthetic
aggccctggctgctgatatgaataaaaaccaagtcagcagcatatccagtaattaagggaacttacaacaacactggaactcaaccaatcctttacttctggggtgtgcaccatcctcctgaccttttgggacagcggtg

SEQ ID NO: 423530 - DNA, 140 bp, Artificial Sequence
  Synthetic
caccgctgtcccaaaaggtcaggaggatggtgcacaccccagaagtaaaggattggttgagttccagtgttgttgtaagttcccttaattactggatatgctgctgacttggtttttattcatatcagcagccagggcct

SEQ ID NO: 423531 - DNA, 140 bp, Artificial Sequence
  Synthetic
atacgccatgctgggtctccagcaaaagcaggagtttaaaatgaatccaaatcagaaaataataaccattggatcactatccttaggattggtagtccttaatattctcctacatatagtcgtacttgggagtcggccat

SEQ ID NO: 423532 - DNA, 140 bp, Artificial Sequence
  Synthetic
atggccgactcccaagtacgactatatgtaggagaatattaaggactaccaatcctaaggatagtgatccaatggttattattttctgatttggattcattttaaactcctgcttttgctggagacccagcatggcgtat

SEQ ID NO: 423533 - DNA, 140 bp, Artificial Sequence
  Synthetic
atacgccatgctgggtctccgatggggactgaaagcatgaatttcgccaagagtccggaaattgcagcaagacctgctgtgaacggtcaaagaggcagaattgattattactggtctgttcgtacttgggagtcggccat

SEQ ID NO: 423534 - DNA, 140 bp, Artificial Sequence
  Synthetic
atggccgactcccaagtacgaacagaccagtaataatcaattctgcctctttgaccgttcacagcaggtcttgctgcaatttccggactcttggcgaaattcatgctttcagtccccatcggagacccagcatggcgtat

SEQ ID NO: 423535 - DNA, 140 bp, Artificial Sequence
  Synthetic
aggccctggctgctgatatggacctgctgtgaacggtcaaagaggcagaattgattattactggtctgttttaaacccaggggaaaccttgaatgtggaatctaatgggaatctaatcgcgaccttttgggacagcggtg

SEQ ID NO: 423536 - DNA, 140 bp, Artificial Sequence
  Synthetic
caccgctgtcccaaaaggtcgcgattagattcccattagattccacattcaaggtttcccctgggtttaaaacagaccagtaataatcaattctgcctctttgaccgttcacagcaggtccatatcagcagccagggcct

SEQ ID NO: 423537 - DNA, 140 bp, Artificial Sequence
  Synthetic
aggccctggctgctgatatgtttgtgtactttgttgaaacattggcgagaagcatctgtgaaaaacttgaacagtcaggacttcctgttggagggaacgaaaagaaggctaaattggcgagaccttttgggacagcggtg

SEQ ID NO: 423538 - DNA, 140 bp, Artificial Sequence
  Synthetic
caccgctgtcccaaaaggtctcgccaatttagccttcttttcgttccctccaacaggaagtcctgactgttcaagtttttcacagatgcttctcgccaatgtttcaacaaagtacacaaacatatcagcagccagggcct

SEQ ID NO: 423539 - DNA, 140 bp, Artificial Sequence
  Synthetic
atacgccatgctgggtctcctcaagtcaaatctaccaatcgagaactgtgatgctacatgccagactattgcaggagtcctaaggaccaataaaacatttcagaatgtgagccctctgtgcgtacttgggagtcggccat

SEQ ID NO: 423540 - DNA, 140 bp, Artificial Sequence
  Synthetic
atggccgactcccaagtacgcacagagggctcacattctgaaatgttttattggtccttaggactcctgcaatagtctggcatgtagcatcacagttctcgattggtagatttgacttgaggagacccagcatggcgtat

SEQ ID NO: 423541 - DNA, 140 bp, Artificial Sequence
  Synthetic
aggccctggctgctgatatggcaggagtcctaaggaccaataaaacatttcagaatgtgagccctctgtggataggagaatgccccaaatatgtaaaaagtgagagcctgaggcttgcaagaccttttgggacagcggtg

SEQ ID NO: 423542 - DNA, 140 bp, Artificial Sequence
  Synthetic
caccgctgtcccaaaaggtcttgcaagcctcaggctctcactttttacatatttggggcattctcctatccacagagggctcacattctgaaatgttttattggtccttaggactcctgccatatcagcagccagggcct

SEQ ID NO: 423543 - DNA, 140 bp, Artificial Sequence
  Synthetic
aggccctggctgctgatatgatggacagggaggcagaatggaattctcgtggactatattggatatgttggacaccataaactttgagagtactggtaatctaattgcaccagaatatgggaccttttgggacagcggtg

SEQ ID NO: 423544 - DNA, 140 bp, Artificial Sequence
  Synthetic
caccgctgtcccaaaaggtcccatattctggtgcaattagattaccagtactctcaaagtttatggtgtccaacatatccaatatagtccacgagaattccattctgcctccctgtccatcatatcagcagccagggcct

SEQ ID NO: 423545 - DNA, 140 bp, Artificial Sequence
  Synthetic
atacgccatgctgggtctccggtcacaatgtacaaaatagtactaatactcgcgctccttggagcggtgcatggtcttgacaaaatatgtcttggacatcatgcagtctccaacggcacccgtacttgggagtcggccat

SEQ ID NO: 423546 - DNA, 140 bp, Artificial Sequence
  Synthetic
atggccgactcccaagtacgggtgccgttggagactgcatgatgtccaagacatattttgtcaagaccatgcaccgctccaaggagcgcgagtattagtactattttgtacattgtgaccggagacccagcatggcgtat

SEQ ID NO: 423547 - DNA, 140 bp, Artificial Sequence
  Synthetic
atacgccatgctgggtctccatcgcaggttttattgaaggaggatggactggaatgatagacgggtggtatggctatcatcatgaaaattctcaaggctcagggtatgcagcagacagggcgtacttgggagtcggccat

SEQ ID NO: 423548 - DNA, 140 bp, Artificial Sequence
  Synthetic
atggccgactcccaagtacgccctgtctgctgcataccctgagccttgagaattttcatgatgatagccataccacccgtctatcattccagtccatcctccttcaataaaacctgcgatggagacccagcatggcgtat

SEQ ID NO: 423549 - DNA, 140 bp, Artificial Sequence
  Synthetic
atacgccatgctgggtctccctaggaaagggatacatgttcgaaagtaagagcatgaagctacggacgcaaataccagcagaaatgcttgcaaacattgatctgaaatacttcaacgaatcgtacttgggagtcggccat

SEQ ID NO: 423550 - DNA, 140 bp, Artificial Sequence
  Synthetic
atggccgactcccaagtacgattcgttgaagtatttcagatcaatgtttgcaagcatttctgctggtatttgcgtccgtagcttcatgctcttactttcgaacatgtatccctttcctagggagacccagcatggcgtat

SEQ ID NO: 423551 - DNA, 140 bp, Artificial Sequence
  Synthetic
aggccctggctgctgatatgaacagtggagagcaaaagcctggacaaactttgcatgaaaagtcggaactacaaggacttaggtaattgccacccaatagggatgataatagggactcctgaccttttgggacagcggtg

SEQ ID NO: 423552 - DNA, 140 bp, Artificial Sequence
  Synthetic
caccgctgtcccaaaaggtcaggagtccctattatcatccctattgggtggcaattacctaagtccttgtagttccgacttttcatgcaaagtttgtccaggcttttgctctccactgttcatatcagcagccagggcct

SEQ ID NO: 423553 - DNA, 140 bp, Artificial Sequence
  Synthetic
atacgccatgctgggtctcctttagagagaagaattgacaatctgaacaaaagaatggaagatggatttctggatgtttggacatacaatgctgaactgttggttcttcttgaaaacgagcgtacttgggagtcggccat

SEQ ID NO: 423554 - DNA, 140 bp, Artificial Sequence
  Synthetic
atggccgactcccaagtacgctcgttttcaagaagaaccaacagttcagcattgtatgtccaaacatccagaaatccatcttccattcttttgttcagattgtcaattcttctctctaaaggagacccagcatggcgtat

SEQ ID NO: 423555 - DNA, 140 bp, Artificial Sequence
  Synthetic
atacgccatgctgggtctcccaattccattgcctactgttacccgggtgccactgtgaatgaagaagcattaaggcagaaaattatggaaagtggagggattgacaagataagcaccgggcgtacttgggagtcggccat

SEQ ID NO: 423556 - DNA, 140 bp, Artificial Sequence
  Synthetic
atggccgactcccaagtacgcccggtgcttatcttgtcaatccctccactttccataattttctgccttaatgcttcttcattcacagtggcacccgggtaacagtaggcaatggaattgggagacccagcatggcgtat

SEQ ID NO: 423557 - DNA, 140 bp, Artificial Sequence
  Synthetic
atacgccatgctgggtctcccaaatcacaactaagggacaatgctaatgatctagggaacggatgctttgaattttggcataagtgtgataatgaatgcatagagtctgtcaaaaatggtcgtacttgggagtcggccat

SEQ ID NO: 423558 - DNA, 140 bp, Artificial Sequence
  Synthetic
atggccgactcccaagtacgaccatttttgacagactctatgcattcattatcacacttatgccaaaattcaaagcatccgttccctagatcattagcattgtcccttagttgtgatttgggagacccagcatggcgtat

SEQ ID NO: 423559 - DNA, 140 bp, Artificial Sequence
  Synthetic
aggccctggctgctgatatgaattttggcataagtgtgataatgaatgcatagagtctgtcaaaaatggtacatacgactatcccaaataccaggatgagagtaaattaaacaggcaggagaccttttgggacagcggtg

SEQ ID NO: 423560 - DNA, 140 bp, Artificial Sequence
  Synthetic
caccgctgtcccaaaaggtctcctgcctgtttaatttactctcatcctggtatttgggatagtcgtatgtaccatttttgacagactctatgcattcattatcacacttatgccaaaattcatatcagcagccagggcct

SEQ ID NO: 423561 - DNA, 140 bp, Artificial Sequence
  Synthetic
atacgccatgctgggtctccgattcagcagaacaccttataatctggggaattcatcacccttcaagcacacaagaaaagaatgatctgtatggaacacaatcactttccatttcagtagcgtacttgggagtcggccat

SEQ ID NO: 423562 - DNA, 140 bp, Artificial Sequence
  Synthetic
atggccgactcccaagtacgctactgaaatggaaagtgattgtgttccatacagatcattcttttcttgtgtgcttgaagggtgatgaattccccagattataaggtgttctgctgaatcggagacccagcatggcgtat

SEQ ID NO: 423563 - DNA, 140 bp, Artificial Sequence
  Synthetic
aggccctggctgctgatatgcgaaaaaatacgctcaggttatgaaaccttcaaagtcattgaaggatggtccaaacctaactccaaattgcagataaataggcaagttatagttgacagagaccttttgggacagcggtg

SEQ ID NO: 423564 - DNA, 140 bp, Artificial Sequence
  Synthetic
caccgctgtcccaaaaggtctctgtcaactataacttgcctatttatctgcaatttggagttaggtttggaccatccttcaatgactttgaaggtttcataacctgagcgtattttttcgcatatcagcagccagggcct

SEQ ID NO: 423565 - DNA, 140 bp, Artificial Sequence
  Synthetic
atacgccatgctgggtctcccaagtgaatggtcaaagtgggcggattgatttccattggacgatggtacaaccaggtgataacatcactttttcgcataatggtggattaatagcacctacgtacttgggagtcggccat

SEQ ID NO: 423566 - DNA, 140 bp, Artificial Sequence
  Synthetic
atggccgactcccaagtacgtaggtgctattaatccaccattatgcgaaaaagtgatgttatcacctggttgtaccatcgtccaatggaaatcaatccgcccactttgaccattcacttgggagacccagcatggcgtat

SEQ ID NO: 423567 - DNA, 140 bp, Artificial Sequence
  Synthetic
aggccctggctgctgatatgaccaggtgataacatcactttttcgcataatggtggattaatagcacctagcagagtgagtaagctaaagggaagaggccttggcatccaatcagaagctgaccttttgggacagcggtg

SEQ ID NO: 423568 - DNA, 140 bp, Artificial Sequence
  Synthetic
caccgctgtcccaaaaggtcagcttctgattggatgccaaggcctcttccctttagcttactcactctgctaggtgctattaatccaccattatgcgaaaaagtgatgttatcacctggtcatatcagcagccagggcct

SEQ ID NO: 423569 - DNA, 140 bp, Artificial Sequence
  Synthetic
aggccctggctgctgatatgaaagtgattccaagaggaaagctttccacaagaggggtccagattgcttcaaatgagaatgtggaaaccatggactccaataccctggaactaagaagcagaccttttgggacagcggtg

SEQ ID NO: 423570 - DNA, 140 bp, Artificial Sequence
  Synthetic
caccgctgtcccaaaaggtctgcttcttagttccagggtattggagtccatggtttccacattctcatttgaagcaatctggacccctcttgtggaaagctttcctcttggaatcactttcatatcagcagccagggcct

SEQ ID NO: 423571 - DNA, 140 bp, Artificial Sequence
  Synthetic
atacgccatgctgggtctcccaacaccaaacttccttttcagaatctttctccaagaactgtgggtcaatgccccaagtatgtgaacaagaagagcctgttgcttgctactggaatgaggcgtacttgggagtcggccat

SEQ ID NO: 423572 - DNA, 140 bp, Artificial Sequence
  Synthetic
atggccgactcccaagtacgcctcattccagtagcaagcaacaggctcttcttgttcacatacttggggcattgacccacagttcttggagaaagattctgaaaaggaagtttggtgttgggagacccagcatggcgtat

SEQ ID NO: 423573 - DNA, 140 bp, Artificial Sequence
  Synthetic
aggccctggctgctgatatggccccaagtatgtgaacaagaagagcctgttgcttgctactggaatgaggaatgtgccagaggttgtccaaggaagaggcctgtttggagcaatagctgggaccttttgggacagcggtg

SEQ ID NO: 423574 - DNA, 140 bp, Artificial Sequence
  Synthetic
caccgctgtcccaaaaggtcccagctattgctccaaacaggcctcttccttggacaacctctggcacattcctcattccagtagcaagcaacaggctcttcttgttcacatacttggggccatatcagcagccagggcct

SEQ ID NO: 423575 - DNA, 140 bp, Artificial Sequence
  Synthetic
atacgccatgctgggtctccagcccattcaggactctcatgagtgtagaggtgggtcaatcacccaatgtctaccaagccagattcgaagctgtggcgtggtcagcaactgcttgccatgcgtacttgggagtcggccat

SEQ ID NO: 423576 - DNA, 140 bp, Artificial Sequence
  Synthetic
atggccgactcccaagtacgcatggcaagcagttgctgaccacgccacagcttcgaatctggcttggtagacattgggtgattgacccacctctacactcatgagagtcctgaatgggctggagacccagcatggcgtat

SEQ ID NO: 423577 - DNA, 140 bp, Artificial Sequence
  Synthetic
atacgccatgctgggtctcccgagatactgacaaaaaccacagtggaccacatggccataattaagaaatacacatcaggaagacaggagaagaatcccgcactcaggatgaaatggatgcgtacttgggagtcggccat

SEQ ID NO: 423578 - DNA, 140 bp, Artificial Sequence
  Synthetic
atggccgactcccaagtacgcatccatttcatcctgagtgcgggattcttctcctgtcttcctgatgtgtatttcttaattatggccatgtggtccactgtggtttttgtcagtatctcgggagacccagcatggcgtat

SEQ ID NO: 423579 - DNA, 140 bp, Artificial Sequence
  Synthetic
atacgccatgctgggtctccggcaccaaaatgcccaaggcactggccaggccgcggattacaaaagtactcaggcagctatagatcaaataaccgggaaattgaataggctgatagagaacgtacttgggagtcggccat

SEQ ID NO: 423580 - DNA, 140 bp, Artificial Sequence
  Synthetic
atggccgactcccaagtacgttctctatcagcctattcaatttcccggttatttgatctatagctgcctgagtacttttgtaatccgcggcctggccagtgccttgggcattttggtgccggagacccagcatggcgtat

SEQ ID NO: 423581 - DNA, 140 bp, Artificial Sequence
  Synthetic
atacgccatgctgggtctccgaatgccaagaaccatagcatggatggtccaaagatccttagctcaagagcatggaatagagactcccaagtatctggctgatttgtttgattataaaaccgtacttgggagtcggccat

SEQ ID NO: 423582 - DNA, 140 bp, Artificial Sequence
  Synthetic
atggccgactcccaagtacggttttataatcaaacaaatcagccagatacttgggagtctctattccatgctcttgagctaaggatctttggaccatccatgctatggttcttggcattcggagacccagcatggcgtat

SEQ ID NO: 423583 - DNA, 140 bp, Artificial Sequence
  Synthetic
aggccctggctgctgatatgtcactcactgagtgacatcaacatcatggcgtcccaaggcaccaaacgatcctatgagcagatggaaactggtggtgaacgccagaatgccactgagatcgaccttttgggacagcggtg

SEQ ID NO: 423584 - DNA, 140 bp, Artificial Sequence
  Synthetic
caccgctgtcccaaaaggtcgatctcagtggcattctggcgttcaccaccagtttccatctgctcataggatcgtttggtgccttgggacgccatgatgttgatgtcactcagtgagtgacatatcagcagccagggcct

SEQ ID NO: 423585 - DNA, 140 bp, Artificial Sequence
  Synthetic
atacgccatgctgggtctcctggacgtatcaagctgaattgctggtagcaatggaaaatcagcatacaattgacatggctgattcagaaatgctgaatctatatgagagggtgaggaagccgtacttgggagtcggccat

SEQ ID NO: 423586 - DNA, 140 bp, Artificial Sequence
  Synthetic
atggccgactcccaagtacggcttcctcaccctctcatatagattcagcatttctgaatcagccatgtcaattgtatgctgattttccattgctaccagcaattcagcttgatacgtccaggagacccagcatggcgtat

SEQ ID NO: 423587 - DNA, 140 bp, Artificial Sequence
  Synthetic
atacgccatgctgggtctccaactaaggcaaaatgctgaagaagatgggaaagggtgctttgaaatatatcacaaatgcgatgacaactgtatggaaagcatcagaaacaacacttatgacgtacttgggagtcggccat

SEQ ID NO: 423588 - DNA, 140 bp, Artificial Sequence
  Synthetic
atggccgactcccaagtacgtcataagtgttgtttctgatgctttccatacagttgtcatcgcatttgtgatatatttcaaagcaccctttcccatcttcttcagcattttgccttagttggagacccagcatggcgtat

SEQ ID NO: 423589 - DNA, 140 bp, Artificial Sequence
  Synthetic
aggccctggctgctgatatgatgctctattgggagaccctcactgtgatgacttccaaaacaaggaatgggacctttttgttgaacgaagcacagcctacagcaactgttacccttattagaccttttgggacagcggtg

SEQ ID NO: 423590 - DNA, 140 bp, Artificial Sequence
  Synthetic
caccgctgtcccaaaaggtctaataagggtaacagttgctgtaggctgtgcttcgttcaacaaaaaggtcccattccttgttttggaagtcatcacagtgagggtctcccaatagagcatcatatcagcagccagggcct

SEQ ID NO: 423591 - DNA, 140 bp, Artificial Sequence
  Synthetic
atacgccatgctgggtctcccggtggaactctcttctgggtacaaagatgttatactgtggtttagcttcggggcgtcatgctttgtacttttggctgtcatcatggggcttgttttcttcgtacttgggagtcggccat

SEQ ID NO: 423592 - DNA, 140 bp, Artificial Sequence
  Synthetic
atggccgactcccaagtacgaagaaaacaagccccatgatgacagccaaaagtacaaagcatgacgccccgaagctaaaccacagtataacatctttgtacccagaagagagttccaccgggagacccagcatggcgtat

SEQ ID NO: 423593 - DNA, 140 bp, Artificial Sequence
  Synthetic
aggccctggctgctgatatgggggcgtcatgctttgtacttttggctgtcatcatggggcttgttttcttctgcttgaaaaatggaaacatgcgatgcacaatctgtatttagttaaaaagaccttttgggacagcggtg

SEQ ID NO: 423594 - DNA, 140 bp, Artificial Sequence
  Synthetic
caccgctgtcccaaaaggtctttttaactaaatacagattgtgcatcgcatgtttccatttttcaagcagaagaaaacaagccccatgatgacagccaaaagtacaaagcatgacgcccccatatcagcagccagggcct

SEQ ID NO: 423595 - DNA, 140 bp, Artificial Sequence
  Synthetic
atacgccatgctgggtctccagggcctcacatttacgatcatgagctaccagaagttccatataatgcctttcttctaatgtctgatgaactgggattggccaatatgactgagggaaagcgtacttgggagtcggccat

SEQ ID NO: 423596 - DNA, 140 bp, Artificial Sequence
  Synthetic
atggccgactcccaagtacgctttccctcagtcatattggccaatcccagttcatcagacattagaagaaaggcattatatggaacttctggtagctcatgatcgtaaatgtgaggccctggagacccagcatggcgtat

SEQ ID NO: 423597 - DNA, 140 bp, Artificial Sequence
  Synthetic
atacgccatgctgggtctcctgccaaacaatgacagatttgacaaattgtacatttggggagttcaccatccgggtacagacaaggaccaaatcagcctatatgttcaagcatcaggaatcgtacttgggagtcggccat

SEQ ID NO: 423598 - DNA, 140 bp, Artificial Sequence
  Synthetic
atggccgactcccaagtacgattcctgatgcttgaacatataggctgatttggtccttgtctgtacccggatggtgaactccccaaatgtacaatttgtcaaatctgtcattgtttggcaggagacccagcatggcgtat

SEQ ID NO: 423599 - DNA, 140 bp, Artificial Sequence
  Synthetic
aggccctggctgctgatatggtggatcatctatcaaaagggaggaggaagtgctcacgggcaatctccagacattgaaaataatggtacatgaagggtatgaggagttcacaatggttgggaccttttgggacagcggtg

SEQ ID NO: 423600 - DNA, 140 bp, Artificial Sequence
  Synthetic
caccgctgtcccaaaaggtcccaaccattgtgaactcctcatacccttcatgtaccattattttcaatgtctggagattgcccgtgagcacttcctcctcccttttgatagatgatccaccatatcagcagccagggcct

SEQ ID NO: 423601 - DNA, 140 bp, Artificial Sequence
  Synthetic
aggccctggctgctgatatgggtctagaccctgggtaaggggtgtctccagtataataagcatctattggacaatagtaaagccgggagacatactcttgattaacagcacaggtaatctgaccttttgggacagcggtg

SEQ ID NO: 423602 - DNA, 140 bp, Artificial Sequence
  Synthetic
caccgctgtcccaaaaggtcagattacctgtgctgttaatcaagagtatgtctcccggctttactattgtccaatagatgcttattatactggagacaccccttacccagggtctagacccatatcagcagccagggcct

SEQ ID NO: 423603 - DNA, 140 bp, Artificial Sequence
  Synthetic
atacgccatgctgggtctccacaatagtaaagccgggagacatactcttgattaacagcacaggtaatctaattgcccctcggggttacttcaaaatacaaggtgggaaaagctcaataacgtacttgggagtcggccat

SEQ ID NO: 423604 - DNA, 140 bp, Artificial Sequence
  Synthetic
atggccgactcccaagtacgttattgagcttttcccaccttgtattttgaagtaaccccgaggggcaattagattacctgtgctgttaatcaagagtatgtctcccggctttactattgtggagacccagcatggcgtat

SEQ ID NO: 423605 - DNA, 140 bp, Artificial Sequence
  Synthetic
aggccctggctgctgatatgatgaaagcacatccggagtggagtccgccgtcttgagagggtttctcattataggtaaggaagacagaagatacggaccagcattaagcatcaatgaactgaccttttgggacagcggtg

SEQ ID NO: 423606 - DNA, 140 bp, Artificial Sequence
  Synthetic
caccgctgtcccaaaaggtcagttcattgatgcttaatgctggtccgtatcttctgtcttccttacctataatgagaaaccctctcaagacggcggactccactccggatgtgctttcatcatatcagcagccagggcct

SEQ ID NO: 423607 - DNA, 140 bp, Artificial Sequence
  Synthetic
atacgccatgctgggtctccatcgcaggtttcatagaaaatggttgggaggggatggtggacggttggtacggtttcaggcaccaaaactctgaaggcacaggacaagcagcagatcttacgtacttgggagtcggccat

SEQ ID NO: 423608 - DNA, 140 bp, Artificial Sequence
  Synthetic
atggccgactcccaagtacgtaagatctgctgcttgtcctgtgccttcagagttttggtgcctgaaaccgtaccaaccgtccaccatcccctcccaaccattttctatgaaacctgcgatggagacccagcatggcgtat

SEQ ID NO: 423609 - DNA, 140 bp, Artificial Sequence
  Synthetic
aggccctggctgctgatatgatggaagactttgtgcgacaatgctttaatccaatgatcatcgagcttgcggaaaaagcaatgaaagaacatggagaagacccgaaaattgaaacaaacagaccttttgggacagcggtg

SEQ ID NO: 423610 - DNA, 140 bp, Artificial Sequence
  Synthetic
caccgctgtcccaaaaggtctgtttgtttcaattttcgggtcttctccatgttctttcattgctttttccgcaagctcgatgatcattggattaaagcattgtcgcacaaagtcttccatcatatcagcagccagggcct

SEQ ID NO: 423611 - DNA, 140 bp, Artificial Sequence
  Synthetic
atacgccatgctgggtctccggaaaaagcaatgaaagaacatggagaagacccgaaaattgaaacaaacaagtttgctgcaatatgtacgcacctagaagtctgtttcatgtattctgatcgtacttgggagtcggccat

SEQ ID NO: 423612 - DNA, 140 bp, Artificial Sequence
  Synthetic
atggccgactcccaagtacgatcagaatacatgaaacagacttctaggtgcgtacatattgcagcaaacttgtttgtttcaattttcgggtcttctccatgttctttcattgctttttccggagacccagcatggcgtat

SEQ ID NO: 423613 - DNA, 140 bp, Artificial Sequence
  Synthetic
aggccctggctgctgatatgtctcactgcagggcaacggagtacataatgaagggggtgtatataaacacagccctactcaatgcatcttgtgcagcaatggatgattttcagttgatccgaccttttgggacagcggtg

SEQ ID NO: 423614 - DNA, 140 bp, Artificial Sequence
  Synthetic
caccgctgtcccaaaaggtcggatcaactgaaaatcatccattgctgcacaagatgcattgagtagggctgtgtttatatacacccccttcattatgtactccgttgccctgcagtgagacatatcagcagccagggcct

SEQ ID NO: 423615 - DNA, 140 bp, Artificial Sequence
  Synthetic
atacgccatgctgggtctccgttagtaaaatgggagtggatgaatattccagcactgaaagagtagttgtaaacattgaccgctttttaagggttcgagatcagcgggggaatgtactctcgtacttgggagtcggccat

SEQ ID NO: 423616 - DNA, 140 bp, Artificial Sequence
  Synthetic
atggccgactcccaagtacgagagtacattcccccgctgatctcgaacccttaaaaagcggtcaatgtttacaactactctttcagtgctggaatattcatccactcccattttactaacggagacccagcatggcgtat

SEQ ID NO: 423617 - DNA, 140 bp, Artificial Sequence
  Synthetic
aggccctggctgctgatatgagggaaaaatctgtgtacttgtattgccgagtgaatggcacaaataagatccaaatgaaatggggaatggaagctagaagatgtttgcttcaatcaatgcgaccttttgggacagcggtg

SEQ ID NO: 423618 - DNA, 140 bp, Artificial Sequence
  Synthetic
caccgctgtcccaaaaggtcgcattgattgaagcaaacatcttctagcttccattccccatttcatttggatcttatttgtgccattcactcggcaatacaagtacacagatttttccctcatatcagcagccagggcct

SEQ ID NO: 423619 - DNA, 140 bp, Artificial Sequence
  Synthetic
atacgccatgctgggtctccgagaagcccaggttcctcccggatctgtatgactacaaggagaatcgattcattgaaataggcgtaacaagaagagaagttcacatatactacctggaaacgtacttgggagtcggccat

SEQ ID NO: 423620 - DNA, 140 bp, Artificial Sequence
  Synthetic
atggccgactcccaagtacgtttccaggtagtatatgtgaacttctcttcttgttacgcctatttcaatgaatcgattctccttgtagtcatacagatccgggaggaacctgggcttctcggagacccagcatggcgtat

SEQ ID NO: 423621 - DNA, 140 bp, Artificial Sequence
  Synthetic
atacgccatgctgggtctccaaatataccacaagtgtgacaatgcctgcataggatcaatcagaaatggaacttatgaccatgatgtatatagagacgaggcattgaacaatcggttccacgtacttgggagtcggccat

SEQ ID NO: 423622 - DNA, 140 bp, Artificial Sequence
  Synthetic
atggccgactcccaagtacgtggaaccgattgttcaatgcctcgtctctatatacatcatggtcataagttccatttctgattgatcctatgcaggcattgtcacacttgtggtatatttggagacccagcatggcgtat

SEQ ID NO: 423623 - DNA, 140 bp, Artificial Sequence
  Synthetic
aggccctggctgctgatatgatgaccaaagcctgtttcaagggagacagagtaaatagccccaaaactttcagtattggaactcaagaaggaaaactagtaaaaggatcctttggaaaaggaccttttgggacagcggtg

SEQ ID NO: 423624 - DNA, 140 bp, Artificial Sequence
  Synthetic
caccgctgtcccaaaaggtccttttccaaaggatccttttactagttttccttcttgagttccaatactgaaagttttggggctatttactctgtctcccttgaaacaggctttggtcatcatatcagcagccagggcct

SEQ ID NO: 423625 - DNA, 140 bp, Artificial Sequence
  Synthetic
aggccctggctgctgatatgactggagaagaaatggccactaaggcagattacactcttgacgaagaaagcagagcaaggatcaagaccagactattcaccattagacaggaaatggccagaccttttgggacagcggtg

SEQ ID NO: 423626 - DNA, 140 bp, Artificial Sequence
  Synthetic
caccgctgtcccaaaaggtctggccatttcctgtctaatggtgaatagtctggtcttgatccttgctctgctttcttcgtcaagagtgtaatctgccttagtggccatttcttctccagtcatatcagcagccagggcct

SEQ ID NO: 423627 - DNA, 140 bp, Artificial Sequence
  Synthetic
aggccctggctgctgatatgaggccccctcaaagccgagatcgcgcagagacttgaggatgtttttgcaggaaaaaacacagatcttgaggctctcatggaatggctaaagacaagaccagaccttttgggacagcggtg

SEQ ID NO: 423628 - DNA, 140 bp, Artificial Sequence
  Synthetic
caccgctgtcccaaaaggtctggtcttgtctttagccattccatgagagcctcaagatctgtgttttttcctgcaaaaacatcctcaagtctctgcgcgatctcggctttgagggggcctcatatcagcagccagggcct

SEQ ID NO: 423629 - DNA, 140 bp, Artificial Sequence
  Synthetic
atacgccatgctgggtctccttttgctttgtactatttggatgggattcataatatgggcctgccagaaaggcaacattagatgcaacatttgcatctgattttattggtaattaaaaaccgtacttgggagtcggccat

SEQ ID NO: 423630 - DNA, 140 bp, Artificial Sequence
  Synthetic
atggccgactcccaagtacggtttttaattaccaataaaatcagatgcaaatgttgcatctaatgttgcctttctggcaggcccatattatgaatcccatccaaatagtacaaagcaaaaggagacccagcatggcgtat

SEQ ID NO: 423631 - DNA, 140 bp, Artificial Sequence
  Synthetic
aggccctggctgctgatatgtgaggcggtgccttcttcagtcccttcaacaaattgagagcatgattgaggctgaatcttctgttaaagagaaggacatgaccaaggaattctttgaaaagaccttttgggacagcggtg

SEQ ID NO: 423632 - DNA, 140 bp, Artificial Sequence
  Synthetic
caccgctgtcccaaaaggtcttttcaaagaattccttggtcatgtccttctctttaacagaagattcagcctcaatcatgctctcaatttgttgaagggactgaagaaggcaccgcctcacatatcagcagccagggcct

SEQ ID NO: 423633 - DNA, 140 bp, Artificial Sequence
  Synthetic
aggccctggctgctgatatgaaagaagtgaatgccagaattaactcatttttgaaggaaacaccacgctctctcagattacctgatggacctccctgttctcaacgatcaaaattcctgcgaccttttgggacagcggtg

SEQ ID NO: 423634 - DNA, 140 bp, Artificial Sequence
  Synthetic
caccgctgtcccaaaaggtcgcaggaattttgatcgttgagaacagggaggtccatcaggtaatctgagagagcgtggtgtttccttcaaaaatgagttaattctggcattcacttctttcatatcagcagccagggcct

SEQ ID NO: 423635 - DNA, 140 bp, Artificial Sequence
  Synthetic
atacgccatgctgggtctccgaaagagccccaaattgtcaagccacatgagaaaggcataaatccaaactatctcctgacttggaaacaagtgctagctgagctacaagacattgaaagtcgtacttgggagtcggccat

SEQ ID NO: 423636 - DNA, 140 bp, Artificial Sequence
  Synthetic
atggccgactcccaagtacgactttcaatgtcttgtagctcagctagcacttgtttccaagtcaggagatagtttggatttatgcctttctcatgtggcttgacaatttggggctctttcggagacccagcatggcgtat

SEQ ID NO: 423637 - DNA, 140 bp, Artificial Sequence
  Synthetic
atacgccatgctgggtctcctccgtcaaagagaaagacatgactaaagaattcttcgaaaacaaatcagaaaaatggccaattggagagtcacccaggggggtggaagaaggatccatcgcgtacttgggagtcggccat

SEQ ID NO: 423638 - DNA, 140 bp, Artificial Sequence
  Synthetic
atggccgactcccaagtacgcgatggatccttcttccacccccctgggtgactctccaattggccatttttctgatttgttttcgaagaattctttagtcatgtctttctctttgacggaggagacccagcatggcgtat

SEQ ID NO: 423639 - DNA, 140 bp, Artificial Sequence
  Synthetic
atacgccatgctgggtctccatgcatccaaatcagagaataatagcactgggctccgcttccctaactattgcgacaatatgtttactcattcaaattgccatcttagcaacgactatgacgtacttgggagtcggccat

SEQ ID NO: 423640 - DNA, 140 bp, Artificial Sequence
  Synthetic
atggccgactcccaagtacgtcatagtcgttgctaagatggcaatttgaatgagtaaacatattgtcgcaatagttagggaagcggagcccagtgctattattctctgatttggatgcatggagacccagcatggcgtat

SEQ ID NO: 423641 - DNA, 140 bp, Artificial Sequence
  Synthetic
aggccctggctgctgatatgagatcactagcaagctggattcagaatgaattcaacaaggcttgtgagctaacggattctagctggatagagcttgatgaaataggggaggatgtcgctcgaccttttgggacagcggtg

SEQ ID NO: 423642 - DNA, 140 bp, Artificial Sequence
  Synthetic
caccgctgtcccaaaaggtcgagcgacatcctcccctatttcatcaagctctatccagctagaatccgttagctcacaagccttgttgaattcattctgaatccagcttgctagtgatctcatatcagcagccagggcct

SEQ ID NO: 423643 - DNA, 140 bp, Artificial Sequence
  Synthetic
atacgccatgctgggtctcctttgaatggtactatcatagagaaggaaaattgtcccagagcatcagaatacaagaattggtcaaaacctcaatgtcaaattacagggtttgtccccttccgtacttgggagtcggccat

SEQ ID NO: 423644 - DNA, 140 bp, Artificial Sequence
  Synthetic
atggccgactcccaagtacggaaggggacaaaccctgtaatttgacattgaggttttgaccaattcttgtattctgatgctctgggacaattttccttctctatgatagtaccattcaaaggagacccagcatggcgtat

SEQ ID NO: 423645 - DNA, 140 bp, Artificial Sequence
  Synthetic
atacgccatgctgggtctccagccctactcaatgcatcttgtgcagcaatggatgattttcagttgatcccaatgataagcaaatgcagaacaaaggaaggaaggcggaagacaaatctacgtacttgggagtcggccat

SEQ ID NO: 423646 - DNA, 140 bp, Artificial Sequence
  Synthetic
atggccgactcccaagtacgtagatttgtcttccgccttccttcctttgttctgcatttgcttatcattgggatcaactgaaaatcatccattgctgcacaagatgcattgagtagggctggagacccagcatggcgtat

SEQ ID NO: 423647 - DNA, 140 bp, Artificial Sequence
  Synthetic
atacgccatgctgggtctcccgtcgagcttgcggaaaaggcaatgaaagaatatggggaagatccgaaaatcgaaaccaacaaattcgctgcaatatgcactcacttggaagtctgcttccgtacttgggagtcggccat

SEQ ID NO: 423648 - DNA, 140 bp, Artificial Sequence
  Synthetic
atggccgactcccaagtacggaagcagacttccaagtgagtgcatattgcagcgaatttgttggtttcgattttcggatcttccccatattctttcattgccttttccgcaagctcgacgggagacccagcatggcgtat

SEQ ID NO: 423649 - DNA, 140 bp, Artificial Sequence
  Synthetic
aggccctggctgctgatatgtatgggttcattgtaaaagggagatctcatctgaggaacgataccgacgtggtaaattttgtgagtatggagttttctctcaccgatccgaggctggagcgaccttttgggacagcggtg

SEQ ID NO: 423650 - DNA, 140 bp, Artificial Sequence
  Synthetic
caccgctgtcccaaaaggtcgctccagcctcggatcggtgagagaaaactccatactcacaaaatttaccacgtcggtatcgttcctcagatgagatctcccttttacaatgaacccatacatatcagcagccagggcct

SEQ ID NO: 423651 - DNA, 140 bp, Artificial Sequence
  Synthetic
aggccctggctgctgatatgggaaggggtacctgagtctatgagggaagagtaccggcaggaacagcagagtgctgtggatgttgacgatggtcattttgtcaacatagaattggagtaagaccttttgggacagcggtg

SEQ ID NO: 423652 - DNA, 140 bp, Artificial Sequence
  Synthetic
caccgctgtcccaaaaggtcttactccaattctatgttgacaaaatgaccatcgtcaacatccacagcactctgctgttcctgccggtactcttccctcatagactcaggtaccccttcccatatcagcagccagggcct

SEQ ID NO: 423653 - DNA, 140 bp, Artificial Sequence
  Synthetic
aggccctggctgctgatatgggaatctggggatccaaatgcattactgaagcatcgatttgagataattgagggaagagaccgaacaatggcctggacagtggtgaatagcatctgcaacgaccttttgggacagcggtg

SEQ ID NO: 423654 - DNA, 140 bp, Artificial Sequence
  Synthetic
caccgctgtcccaaaaggtcgttgcagatgctattcaccactgtccaggccattgttcggtctcttccctcaattatctcaaatcgatgcttcagtaatgcatttggatccccagattcccatatcagcagccagggcct

SEQ ID NO: 423655 - DNA, 140 bp, Artificial Sequence
  Synthetic
atacgccatgctgggtctccagggaagagaccgaacaatggcctggacagtggtgaatagcatctgcaacaccacaggggtcgagaagcctaaattccttccggatctgtatgattacaacgtacttgggagtcggccat

SEQ ID NO: 423656 - DNA, 140 bp, Artificial Sequence
  Synthetic
atggccgactcccaagtacgttgtaatcatacagatccggaaggaatttaggcttctcgacccctgtggtgttgcagatgctattcaccactgtccaggccattgttcggtctcttccctggagacccagcatggcgtat

SEQ ID NO: 423657 - DNA, 140 bp, Artificial Sequence
  Synthetic
aggccctggctgctgatatgacctagaaaaggcaaataagataaaatcagagaagacacacattcacatattctcattcactggggaggagatggccaccaaagctgactatacccttgagaccttttgggacagcggtg

SEQ ID NO: 423658 - DNA, 140 bp, Artificial Sequence
  Synthetic
caccgctgtcccaaaaggtctcaagggtatagtcagctttggtggccatctcctccccagtgaatgagaatatgtgaatgtgtgtcttctctgattttatcttatttgccttttctaggtcatatcagcagccagggcct

SEQ ID NO: 423659 - DNA, 140 bp, Artificial Sequence
  Synthetic
aggccctggctgctgatatgcggacttcaattggccaagtgtcgaggccaatgtttctgtatgtgagaaccaatggaacctcaaaaatcaaaatgaagtggggtatggaaatgaggcgttgaccttttgggacagcggtg

SEQ ID NO: 423660 - DNA, 140 bp, Artificial Sequence
  Synthetic
caccgctgtcccaaaaggtcaacgcctcatttccataccccacttcattttgatttttgaggttccattggttctcacatacagaaacattggcctcgacacttggccaattgaagtccgcatatcagcagccagggcct

SEQ ID NO: 423661 - DNA, 140 bp, Artificial Sequence
  Synthetic
atacgccatgctgggtctccaagaaatggccagcaggggtctatgggattcctttcgtcagtccgaaagaggcgaagagacaattgaagaaagatttgaaatcacaggaaccatgcgcagcgtacttgggagtcggccat

SEQ ID NO: 423662 - DNA, 140 bp, Artificial Sequence
  Synthetic
atggccgactcccaagtacgctgcgcatggttcctgtgatttcaaatctttcttcaattgtctcttcgcctctttcggactgacgaaaggaatcccatagacccctgctggccatttcttggagacccagcatggcgtat

SEQ ID NO: 423663 - DNA, 140 bp, Artificial Sequence
  Synthetic
aggccctggctgctgatatgaagggctgtatgatgcaattgaggagtgcctgattaatgatccttgggttttgcttaatgcgtcttggttcaactccttccttgtgcatgcactaaaatagaccttttgggacagcggtg

SEQ ID NO: 423664 - DNA, 140 bp, Artificial Sequence
  Synthetic
caccgctgtcccaaaaggtctattttagtgcatgcacaaggaaggagttgaaccaagacgcattaagcaaaacccaaggatcattaatcaggcactcctcaattgcatcatacagcccttcatatcagcagccagggcct

SEQ ID NO: 423665 - DNA, 140 bp, Artificial Sequence
  Synthetic
atacgccatgctgggtctccgcagtaactgcagggatcctaataacgagagagggagcccaggagtgaaaggatgggcctttgacaatggaaatgatgtttggatgggacgaacaatcaacgtacttgggagtcggccat

SEQ ID NO: 423666 - DNA, 140 bp, Artificial Sequence
  Synthetic
atggccgactcccaagtacgttgattgttcgtcccatccaaacatcatttccattgtcaaaggcccatcctttcactcctgggctccctctctcgttattaggatccctgcagttactgcggagacccagcatggcgtat

SEQ ID NO: 423667 - DNA, 140 bp, Artificial Sequence
  Synthetic
aggccctggctgctgatatgcatgagggagaggggataccactatacgatgcaatcaaatgcatgaagacatttttcggctggaaagagcccaacataatcaagccacatgaaaagggcagaccttttgggacagcggtg

SEQ ID NO: 423668 - DNA, 140 bp, Artificial Sequence
  Synthetic
caccgctgtcccaaaaggtctgcccttttcatgtggcttgattatgttgggctctttccagccgaaaaatgtcttcatgcatttgattgcatcgtatagtggtatcccctctccctcatgcatatcagcagccagggcct

SEQ ID NO: 423669 - DNA, 140 bp, Artificial Sequence
  Synthetic
atacgccatgctgggtctccgaaagaggaagatggacaacaaacacagagactggagcacctcagcttaacccgattgatggaccactacctgaggacaatgagccaagcgggtatgctccgtacttgggagtcggccat

SEQ ID NO: 423670 - DNA, 140 bp, Artificial Sequence
  Synthetic
atggccgactcccaagtacggagcatacccgcttggctcattgtcctcaggtagtggtccatcaatcgggttaagctgaggtgctccagtctctgtgtttgttgtccatcttcctctttcggagacccagcatggcgtat

SEQ ID NO: 423671 - DNA, 140 bp, Artificial Sequence
  Synthetic
atacgccatgctgggtctcccatcaacaggtgtttttatgtggagttaataagagggagaccacaggaggccagagtgtggtggacttcaaatagcattattgtattttgtgggacttcacgtacttgggagtcggccat

SEQ ID NO: 423672 - DNA, 140 bp, Artificial Sequence
  Synthetic
atggccgactcccaagtacgtgaagtcccacaaaatacaataatgctatttgaagtccaccacactctggcctcctgtggtctccctcttattaactccacataaaaacacctgttgatgggagacccagcatggcgtat

SEQ ID NO: 423673 - DNA, 140 bp, Artificial Sequence
  Synthetic
aggccctggctgctgatatgttttggttggaaagagcccaacattgtaaaaccacatgtaaaaggcataaatcccaactatctcttggcttggaagcaggtgctggcagaactccaagacgaccttttgggacagcggtg

SEQ ID NO: 423674 - DNA, 140 bp, Artificial Sequence
  Synthetic
caccgctgtcccaaaaggtcgtcttggagttctgccagcacctgcttccaagccaagagatagttgggatttatgccttttacatgtggttttacaatgttgggctctttccaaccaaaacatatcagcagccagggcct

SEQ ID NO: 423675 - DNA, 140 bp, Artificial Sequence
  Synthetic
aggccctggctgctgatatgtcaggtacatatggaacaggctcatggcctgatggggcagatatcaatttcatgcctatataagctttcgcaattttagaaaaaactccttgtttctactgaccttttgggacagcggtg

SEQ ID NO: 423676 - DNA, 140 bp, Artificial Sequence
  Synthetic
caccgctgtcccaaaaggtcagtagaaacaaggagttttttctaaaattgcgaaagcttatataggcatgaaattgatatctgccccatcaggccatgagcctgttccatatgtacctgacatatcagcagccagggcct

SEQ ID NO: 423677 - DNA, 140 bp, Artificial Sequence
  Synthetic
atacgccatgctgggtctccaagagtggacaagctgacccaaggccgtcagacctatgactggacattaaatagaaaccaaccggctgcaactgctttggccaacacaatagaggtcttccgtacttgggagtcggccat

SEQ ID NO: 423678 - DNA, 140 bp, Artificial Sequence
  Synthetic
atggccgactcccaagtacggaagacctctattgtgttggccaaagcagttgcagccggttggtttctatttaatgtccagtcataggtctgacggccttgggtcagcttgtccactcttggagacccagcatggcgtat

SEQ ID NO: 423679 - DNA, 140 bp, Artificial Sequence
  Synthetic
aggccctggctgctgatatgccaactaaagtgggcactcggtgagaatatggcacctgaaaaagtggactttgaggactgcagagatgttagcgatctaagacagtatgacagtgatgaagaccttttgggacagcggtg

SEQ ID NO: 423680 - DNA, 140 bp, Artificial Sequence
  Synthetic
caccgctgtcccaaaaggtcttcatcactgtcatactgtcttagatcgctaacatctctgcagtcctcaaagtccactttttcaggtgccatattctcaccgagtgcccactttagttggcatatcagcagccagggcct

SEQ ID NO: 423681 - DNA, 140 bp, Artificial Sequence
  Synthetic
atacgccatgctgggtctcccaaggatgtgatggaatcaatggataaagaagagatggaaataacaacacatttccaaaggaaaaggagaataagggacaacataaccaagaaaatgatacgtacttgggagtcggccat

SEQ ID NO: 423682 - DNA, 140 bp, Artificial Sequence
  Synthetic
atggccgactcccaagtacgtatcattttcttggttatgttgtcccttattctccttttcctttggaaatgtgttgttatttccatctcttctttatccattgattccatcacatccttgggagacccagcatggcgtat

SEQ ID NO: 423683 - DNA, 140 bp, Artificial Sequence
  Synthetic
aggccctggctgctgatatgatgcgaattgacagattcgagttggattgaacttgatgaaataggagaagatgttgctccaattgagcacattgcgagtatgagaagaaactacttcacagaccttttgggacagcggtg

SEQ ID NO: 423684 - DNA, 140 bp, Artificial Sequence
  Synthetic
caccgctgtcccaaaaggtctgtgaagtagtttcttctcatactcgcaatgtgctcaattggagcaacatcttctcctatttcatcaagttcaatccaactcgaatctgtcaattcgcatcatatcagcagccagggcct

SEQ ID NO: 423685 - DNA, 140 bp, Artificial Sequence
  Synthetic
aggccctggctgctgatatgtctaataagagcattgacattaaacacaatgacaaaggatgcagaaagaggcaaattgaaaaggcgtgcaattgcaacaccagggatgcagatcagaggagaccttttgggacagcggtg

SEQ ID NO: 423686 - DNA, 140 bp, Artificial Sequence
  Synthetic
caccgctgtcccaaaaggtctcctctgatctgcatccctggtgttgcaattgcacgccttttcaatttgcctctttctgcatcctttgtcattgtgtttaatgtcaatgctcttattagacatatcagcagccagggcct

SEQ ID NO: 423687 - DNA, 140 bp, Artificial Sequence
  Synthetic
aggccctggctgctgatatggaaggaagacgaaaaacaaatctgtatggtttcatcataaagggaaggtcccatctgagaaatgacactgacgtggtgaattttgtaagcatggagttctgaccttttgggacagcggtg

SEQ ID NO: 423688 - DNA, 140 bp, Artificial Sequence
  Synthetic
caccgctgtcccaaaaggtcagaactccatgcttacaaaattcaccacgtcagtgtcatttctcagatgggaccttccctttatgatgaaaccatacagatttgtttttcgtcttccttccatatcagcagccagggcct

SEQ ID NO: 423689 - DNA, 140 bp, Artificial Sequence
  Synthetic
atacgccatgctgggtctccgcaatctgggctcccggttggaggaaatgaaaagaaagccaaattggcaaatgttgtgaggaaaatgatgaccaactcacaggatacagagctctcattccgtacttgggagtcggccat

SEQ ID NO: 423690 - DNA, 140 bp, Artificial Sequence
  Synthetic
atggccgactcccaagtacggaatgagagctctgtatcctgtgagttggtcatcattttcctcacaacatttgccaatttggctttcttttcatttcctccaaccgggagcccagattgcggagacccagcatggcgtat

SEQ ID NO: 423691 - DNA, 140 bp, Artificial Sequence
  Synthetic
aggccctggctgctgatatgatgttgtgaggaaaatgatgaccaactcacaggatacagagctctcattcacaattacgggagacaacaccaaatggaatgagaatcaaaatcccagggtgaccttttgggacagcggtg

SEQ ID NO: 423692 - DNA, 140 bp, Artificial Sequence
  Synthetic
caccgctgtcccaaaaggtcaccctgggattttgattctcattccatttggtgttgtctcccgtaattgtgaatgagagctctgtatcctgtgagttggtcatcattttcctcacaacatcatatcagcagccagggcct

SEQ ID NO: 423693 - DNA, 140 bp, Artificial Sequence
  Synthetic
aggccctggctgctgatatgagcttggcccatcggggaatcacccaaaggagtggaggaaggctccatcggaaaagtatgcagaaccttattggcaaaatctgtattcaatagcctgtatgaccttttgggacagcggtg

SEQ ID NO: 423694 - DNA, 140 bp, Artificial Sequence
  Synthetic
caccgctgtcccaaaaggtcatacaggctattgaatacagattttgccaataaggttctgcatacttttccgatggagccttcctccactcctttgggtgattccccgatgggccaagctcatatcagcagccagggcct

SEQ ID NO: 423695 - DNA, 140 bp, Artificial Sequence
  Synthetic
atacgccatgctgggtctccgaaatgttttaagcattgcccctataatgttctcaaacaaagtggcaagactaggaaaaggatacatgttcgaaagtaagagcatgaaactacggacacacgtacttgggagtcggccat

SEQ ID NO: 423696 - DNA, 140 bp, Artificial Sequence
  Synthetic
atggccgactcccaagtacgtgtgtccgtagtttcatgctcttactttcgaacatgtatccttttcctagtcttgccactttgtttgagaacattataggggcaatgcttaaaacatttcggagacccagcatggcgtat

SEQ ID NO: 423697 - DNA, 140 bp, Artificial Sequence
  Synthetic
atacgccatgctgggtctccaacagtctatacgcatctccacaacttgagggattttcagcagaatcgaggaaattgcttctcattgttcaggcacttagggataacctggaacctggaacgtacttgggagtcggccat

SEQ ID NO: 423698 - DNA, 140 bp, Artificial Sequence
  Synthetic
atggccgactcccaagtacgttccaggttccaggttatccctaagtgcctgaacaatgagaagcaatttcctcgattctgctgaaaatccctcaagttgtggagatgcgtatagactgttggagacccagcatggcgtat

SEQ ID NO: 423699 - DNA, 140 bp, Artificial Sequence
  Synthetic
aggccctggctgctgatatggcctcattaagtcctggaatgatgatgggcatgtttaacatgcttagcactgtcctaggagtttcaatcctgaatcttgggcaaaagagatacactaaaagaccttttgggacagcggtg

SEQ ID NO: 423700 - DNA, 140 bp, Artificial Sequence
  Synthetic
caccgctgtcccaaaaggtcttttagtgtatctcttttgcccaagattcaggattgaaactcctaggacagtgctaagcatgttaaacatgcccatcatcattccaggacttaatgaggccatatcagcagccagggcct

SEQ ID NO: 423701 - DNA, 140 bp, Artificial Sequence
  Synthetic
atacgccatgctgggtctccggaaaaagcaatgaaagaatatggggaagatccgaaaatcgaaacgaacaaatttgccgcaatatgcacacacttagaagtctgcttcatgtattcagaccgtacttgggagtcggccat

SEQ ID NO: 423702 - DNA, 140 bp, Artificial Sequence
  Synthetic
atggccgactcccaagtacggtctgaatacatgaagcagacttctaagtgtgtgcatattgcggcaaatttgttcgtttcgattttcggatcttccccatattctttcattgctttttccggagacccagcatggcgtat

SEQ ID NO: 423703 - DNA, 140 bp, Artificial Sequence
  Synthetic
atacgccatgctgggtctccgtgaatgcacctgaccatgagggaatacaagcgggagtgaacaggttctataggacctgcaaactggttgggatcaatatgagcaaaaagaaatcttacacgtacttgggagtcggccat

SEQ ID NO: 423704 - DNA, 140 bp, Artificial Sequence
  Synthetic
atggccgactcccaagtacgtgtaagatttctttttgctcatattgatcccaaccagtttgcaggtcctatagaacctgttcactcccgcttgtattccctcatggtcaggtgcattcacggagacccagcatggcgtat

SEQ ID NO: 423705 - DNA, 140 bp, Artificial Sequence
  Synthetic
aggccctggctgctgatatgtaggacctgcaaactggttgggatcaatatgagcaaaaagaaatcttacataaataggacaggaacatttgaattcacaagctttttctaccgctacggggaccttttgggacagcggtg

SEQ ID NO: 423706 - DNA, 140 bp, Artificial Sequence
  Synthetic
caccgctgtcccaaaaggtccccgtagcggtagaaaaagcttgtgaattcaaatgttcctgtcctatttatgtaagatttctttttgctcatattgatcccaaccagtttgcaggtcctacatatcagcagccagggcct

SEQ ID NO: 423707 - DNA, 140 bp, Artificial Sequence
  Synthetic
aggccctggctgctgatatgctctaaaattggcaactggaatgcggaatgtacctgagaaacagaccaggggtctgttcggtgcgatagcaggattcatagaaaatggatgggagggaatgaccttttgggacagcggtg

SEQ ID NO: 423708 - DNA, 140 bp, Artificial Sequence
  Synthetic
caccgctgtcccaaaaggtcattccctcccatccattttctatgaatcctgctatcgcaccgaacagacccctggtctgtttctcaggtacattccgcattccagttgccaattttagagcatatcagcagccagggcct

SEQ ID NO: 423709 - DNA, 140 bp, Artificial Sequence
  Synthetic
atacgccatgctgggtctcctaacgaatcggctgatatgagcattggagtgacagtgataaagaacaacatgataaacaatgatctcgggccagcaactgcccaaatggctcttcagctacgtacttgggagtcggccat

SEQ ID NO: 423710 - DNA, 140 bp, Artificial Sequence
  Synthetic
atggccgactcccaagtacgtagctgaagagccatttgggcagttgctggcccgagatcattgtttatcatgttgttctttatcactgtcactccaatgctcatatcagccgattcgttaggagacccagcatggcgtat

SEQ ID NO: 423711 - DNA, 140 bp, Artificial Sequence
  Synthetic
atacgccatgctgggtctcctccaattgatggaccattgcctgaggacaatgagccaagtggatatgcacaaacggactgtgtccttgaagcaatggctttccttgaagagtcccacccacgtacttgggagtcggccat

SEQ ID NO: 423712 - DNA, 140 bp, Artificial Sequence
  Synthetic
atggccgactcccaagtacgtgggtgggactcttcaaggaaagccattgcttcaaggacacagtccgtttgtgcatatccacttggctcattgtcctcaggcaatggtccatcaattggaggagacccagcatggcgtat

SEQ ID NO: 423713 - DNA, 140 bp, Artificial Sequence
  Synthetic
atacgccatgctgggtctccggaatctttgaaaactcgtgtcttgaaacgatggaagttgttcaacaaacaagagtggacaaattgacccaaggccgtcagacctatgattggacattaacgtacttgggagtcggccat

SEQ ID NO: 423714 - DNA, 140 bp, Artificial Sequence
  Synthetic
atggccgactcccaagtacgttaatgtccaatcataggtctgacggccttgggtcaatttgtccactcttgtttgttgaacaacttccatcgtttcaagacacgagttttcaaagattccggagacccagcatggcgtat

SEQ ID NO: 423715 - DNA, 140 bp, Artificial Sequence
  Synthetic
aggccctggctgctgatatgaagagtggacaaattgacccaaggccgtcagacctatgattggacattaaacaggaatcagccggctgcaactgcattagctaatactatagaggtcttcgaccttttgggacagcggtg

SEQ ID NO: 423716 - DNA, 140 bp, Artificial Sequence
  Synthetic
caccgctgtcccaaaaggtcgaagacctctatagtattagctaatgcagttgcagccggctgattcctgtttaatgtccaatcataggtctgacggccttgggtcaatttgtccactcttcatatcagcagccagggcct

SEQ ID NO: 423717 - DNA, 140 bp, Artificial Sequence
  Synthetic
atacgccatgctgggtctccacaggaatcagccggctgcaactgcattagctaatactatagaggtcttcagatcgaacggtcttacagctaatgaatcaggaaggctaatagattttctcgtacttgggagtcggccat

SEQ ID NO: 423718 - DNA, 140 bp, Artificial Sequence
  Synthetic
atggccgactcccaagtacgagaaaatctattagccttcctgattcattagctgtaagaccgttcgatctgaagacctctatagtattagctaatgcagttgcagccggctgattcctgtggagacccagcatggcgtat

SEQ ID NO: 423719 - DNA, 140 bp, Artificial Sequence
  Synthetic
atacgccatgctgggtctccttcaacagacaagagtggataaactgacccaaggtcgtcagacctatgactggacattgaatagaaaccagccggctgcaactgctttagccaacactatcgtacttgggagtcggccat

SEQ ID NO: 423720 - DNA, 140 bp, Artificial Sequence
  Synthetic
atggccgactcccaagtacgatagtgttggctaaagcagttgcagccggctggtttctattcaatgtccagtcataggtctgacgaccttgggtcagtttatccactcttgtctgttgaaggagacccagcatggcgtat

SEQ ID NO: 423721 - DNA, 140 bp, Artificial Sequence
  Synthetic
atacgccatgctgggtctcctatagactatcgggggagattgtgtaatcctctgaatccatttgttaaccacaagggaattgagtccgtaaacagtgccgtggtaatgccagcccatggtcgtacttgggagtcggccat

SEQ ID NO: 423722 - DNA, 140 bp, Artificial Sequence
  Synthetic
atggccgactcccaagtacgaccatgggctggcattaccacggcactgtttacggactcaattcccttgtggttaacaaatggattcagaggattacacaatctcccccgatagtctataggagacccagcatggcgtat

SEQ ID NO: 423723 - DNA, 140 bp, Artificial Sequence
  Synthetic
atacgccatgctgggtctccagaacatccgacatgagaactgaaatcataagaatgatggaaagtgccagaccagaggatgtgtctttccaggggcggggagtcttcgagctctcggacgcgtacttgggagtcggccat

SEQ ID NO: 423724 - DNA, 140 bp, Artificial Sequence
  Synthetic
atggccgactcccaagtacgcgtccgagagctcgaagactccccgcccctggaaagacacatcctctggtctggcactttccatcattcttatgatttcagttctcatgtcggatgttctggagacccagcatggcgtat

SEQ ID NO: 423725 - DNA, 140 bp, Artificial Sequence
  Synthetic
atacgccatgctgggtctcctagatttcctcaaagatgtgatggagtcaatggacaaagaagaaatggaaataacaacacatttccaaagaaagagaagagtaagagacaatatgaccaacgtacttgggagtcggccat

SEQ ID NO: 423726 - DNA, 140 bp, Artificial Sequence
  Synthetic
atggccgactcccaagtacgttggtcatattgtctcttactcttctctttctttggaaatgtgttgttatttccatttcttctttgtccattgactccatcacatctttgaggaaatctaggagacccagcatggcgtat

SEQ ID NO: 423727 - DNA, 140 bp, Artificial Sequence
  Synthetic
aggccctggctgctgatatgataacaacacatttccaaagaaagagaagagtaagagacaatatgaccaagaaaatggtcacacaaagaacaatagggaagaaaaaacagagactgaacagaccttttgggacagcggtg

SEQ ID NO: 423728 - DNA, 140 bp, Artificial Sequence
  Synthetic
caccgctgtcccaaaaggtctgttcagtctctgttttttcttccctattgttctttgtgtgaccattttcttggtcatattgtctcttactcttctctttctttggaaatgtgttgttatcatatcagcagccagggcct

SEQ ID NO: 423729 - DNA, 140 bp, Artificial Sequence
  Synthetic
atacgccatgctgggtctcccctagcagttcatacaggaggccagttggaatttccagcatggtggaggccatggtatctagggccagaattgatgcacggattgatttcgagtctggaacgtacttgggagtcggccat

SEQ ID NO: 423730 - DNA, 140 bp, Artificial Sequence
  Synthetic
atggccgactcccaagtacgttccagactcgaaatcaatccgtgcatcaattctggccctagataccatggcctccaccatgctggaaattccaactggcctcctgtatgaactgctaggggagacccagcatggcgtat

SEQ ID NO: 423731 - DNA, 140 bp, Artificial Sequence
  Synthetic
atacgccatgctgggtctccgcagaaagaggcaagttgaagaggcgggcaattgcaacacccgggatgcaaatcagagggttcgtgtactttgtcgaaacattagcgaggagcatctgcgcgtacttgggagtcggccat

SEQ ID NO: 423732 - DNA, 140 bp, Artificial Sequence
  Synthetic
atggccgactcccaagtacgcgcagatgctcctcgctaatgtttcgacaaagtacacgaaccctctgatttgcatcccgggtgttgcaattgcccgcctcttcaacttgcctctttctgcggagacccagcatggcgtat

SEQ ID NO: 423733 - DNA, 140 bp, Artificial Sequence
  Synthetic
aggccctggctgctgatatgaatcagagggttcgtgtactttgtcgaaacattagcgaggagcatctgcgagaaacttgagcaatctgggctccctgttggaggaaatgaaaaaaaggctgaccttttgggacagcggtg

SEQ ID NO: 423734 - DNA, 140 bp, Artificial Sequence
  Synthetic
caccgctgtcccaaaaggtcagcctttttttcatttcctccaacagggagcccagattgctcaagtttctcgcagatgctcctcgctaatgtttcgacaaagtacacgaaccctctgattcatatcagcagccagggcct

SEQ ID NO: 423735 - DNA, 140 bp, Artificial Sequence
  Synthetic
aggccctggctgctgatatgtaattgtagaatctggagatccgaacgcattattgaaacaccgatttgaaataattgaaggaagagaccgaacgatggcctggactgtggtaaatagtgtgaccttttgggacagcggtg

SEQ ID NO: 423736 - DNA, 140 bp, Artificial Sequence
  Synthetic
caccgctgtcccaaaaggtcacactatttaccacagtccaggccatcgttcggtctcttccttcaattatttcaaatcggtgtttcaataatgcgttcggatctccagattctacaattacatatcagcagccagggcct

SEQ ID NO: 423737 - DNA, 140 bp, Artificial Sequence
  Synthetic
atacgccatgctgggtctcccgagatactgacaaaaaccacagtggaccatatggcaataatcaaaaaatacacatcaggaagacaagagaagaaccccgctcttagaatgaaatggatgcgtacttgggagtcggccat

SEQ ID NO: 423738 - DNA, 140 bp, Artificial Sequence
  Synthetic
atggccgactcccaagtacgcatccatttcattctaagagcggggttcttctcttgtcttcctgatgtgtattttttgattattgccatatggtccactgtggtttttgtcagtatctcgggagacccagcatggcgtat

SEQ ID NO: 423739 - DNA, 140 bp, Artificial Sequence
  Synthetic
aggccctggctgctgatatgctagggaaaggatacatgttcgaaagtaagagcatgaagcttcgaacacaaataccggcagaaatgctagcaagcattgatctgaagtacttcaatgagtgaccttttgggacagcggtg

SEQ ID NO: 423740 - DNA, 140 bp, Artificial Sequence
  Synthetic
caccgctgtcccaaaaggtcactcattgaagtacttcagatcaatgcttgctagcatttctgccggtatttgtgttcgaagcttcatgctcttactttcgaacatgtatcctttccctagcatatcagcagccagggcct

SEQ ID NO: 423741 - DNA, 140 bp, Artificial Sequence
  Synthetic
aggccctggctgctgatatgatcctcggatttttttggcaatgataacatatatcacaagaaatcaacctgagtggtttagaaatgtgttaagtattgcccctataatgttctcaaacaagaccttttgggacagcggtg

SEQ ID NO: 423742 - DNA, 140 bp, Artificial Sequence
  Synthetic
caccgctgtcccaaaaggtcttgtttgagaacattataggggcaatacttaacacatttctaaaccactcaggttgatttcttgtgatatatgttatcattgccaaaaaaatccgaggatcatatcagcagccagggcct

SEQ ID NO: 423743 - DNA, 140 bp, Artificial Sequence
  Synthetic
aggccctggctgctgatatgtctcaaatgtcaaaagaagtaaacgctaggattgagccattcctgagaacaacaccacgccctctcaaattacctgatgggcccccttgctcccagcgatgaccttttgggacagcggtg

SEQ ID NO: 423744 - DNA, 140 bp, Artificial Sequence
  Synthetic
caccgctgtcccaaaaggtcatcgctgggagcaagggggcccatcaggtaatttgagagggcgtggtgttgttctcaggaatggctcaatcctagcgtttacttcttttgacatttgagacatatcagcagccagggcct

SEQ ID NO: 423745 - DNA, 140 bp, Artificial Sequence
  Synthetic
atacgccatgctgggtctcctacggacacaaataccagcagaaatgcttgcaaccattgacctgaaatatttcaacgaatcgacaagaaagaaaattgagaaaataaggcctctcctaatcgtacttgggagtcggccat

SEQ ID NO: 423746 - DNA, 140 bp, Artificial Sequence
  Synthetic
atggccgactcccaagtacgattaggagaggccttattttctcaattttctttcttgtcgattcgttgaaatatttcaggtcaatggttgcaagcatttctgctggtatttgtgtccgtaggagacccagcatggcgtat

SEQ ID NO: 423747 - DNA, 140 bp, Artificial Sequence
  Synthetic
aggccctggctgctgatatgttcaacgaatcgacaagaaagaaaattgagaaaataaggcctctcctaatagaagggacagcctcgttgagtcctggaatgatgatgggcatgttcaacagaccttttgggacagcggtg

SEQ ID NO: 423748 - DNA, 140 bp, Artificial Sequence
  Synthetic
caccgctgtcccaaaaggtctgttgaacatgcccatcatcattccaggactcaacgaggctgtcccttctattaggagaggccttattttctcaattttctttcttgtcgattcgttgaacatatcagcagccagggcct

SEQ ID NO: 423749 - DNA, 140 bp, Artificial Sequence
  Synthetic
aggccctggctgctgatatgtcctttttgtctggggcatacatcatccacccactgatactgcacagacaaatttatacacaagaaccgacacaacaacaagcgtgacaacagaaaatttgaccttttgggacagcggtg

SEQ ID NO: 423750 - DNA, 140 bp, Artificial Sequence
  Synthetic
caccgctgtcccaaaaggtcaaattttctgttgtcacgcttgttgttgtgtcggttcttgtgtataaatttgtctgtgcagtatcagtgggtggatgatgtatgccccagacaaaaaggacatatcagcagccagggcct

SEQ ID NO: 423751 - DNA, 140 bp, Artificial Sequence
  Synthetic
atacgccatgctgggtctcctacaccaaaaccacatactggtgggacggactccaatcctctgatgatttcgctctcatagtaaatgcaccgaatcatgagggaatacaggcaggagtggcgtacttgggagtcggccat

SEQ ID NO: 423752 - DNA, 140 bp, Artificial Sequence
  Synthetic
atggccgactcccaagtacgccactcctgcctgtattccctcatgattcggtgcatttactatgagagcgaaatcatcagaggattggagtccgtcccaccagtatgtggttttggtgtaggagacccagcatggcgtat

SEQ ID NO: 423753 - DNA, 140 bp, Artificial Sequence
  Synthetic
aggccctggctgctgatatgcgctctcatagtaaatgcaccgaatcatgagggaatacaggcaggagtggacaggttctataggacttgtaaattggttgggatcaatatgagtaaaaaggaccttttgggacagcggtg

SEQ ID NO: 423754 - DNA, 140 bp, Artificial Sequence
  Synthetic
caccgctgtcccaaaaggtcctttttactcatattgatcccaaccaatttacaagtcctatagaacctgtccactcctgcctgtattccctcatgattcggtgcatttactatgagagcgcatatcagcagccagggcct

SEQ ID NO: 423755 - DNA, 140 bp, Artificial Sequence
  Synthetic
aggccctggctgctgatatggtaacatggtggaataggaatggcccaacaacaagcacagttcactaccctaaggtatataaaacttatttcgaaaaggtcgaaaggttaaaacatggtagaccttttgggacagcggtg

SEQ ID NO: 423756 - DNA, 140 bp, Artificial Sequence
  Synthetic
caccgctgtcccaaaaggtctaccatgttttaacctttcgaccttttcgaaataagttttatataccttagggtagtgaactgtgcttgttgttgggccattcctattccaccatgttaccatatcagcagccagggcct

SEQ ID NO: 423757 - DNA, 140 bp, Artificial Sequence
  Synthetic
aggccctggctgctgatatgcctgccggtagcaggtgggacaagcagcgtgtacattgaagtattgcacttgactcaaggaacttgctgggagcagatgtacactccaggtggggaggtggaccttttgggacagcggtg

SEQ ID NO: 423758 - DNA, 140 bp, Artificial Sequence
  Synthetic
caccgctgtcccaaaaggtccacctccccacctggagtgtacatctgctcccagcaagttccttgagtcaagtgcaatacttcaatgtacacgctgcttgtcccacctgctaccggcaggcatatcagcagccagggcct

SEQ ID NO: 423759 - DNA, 140 bp, Artificial Sequence
  Synthetic
atacgccatgctgggtctccccgttatgggtttgtagccaacttcagcatggagctgcccagctttggagtttctgggattaatgaatcggctgacatgagcattggagttacagtaatacgtacttgggagtcggccat

SEQ ID NO: 423760 - DNA, 140 bp, Artificial Sequence
  Synthetic
atggccgactcccaagtacgtattactgtaactccaatgctcatgtcagccgattcattaatcccagaaactccaaagctgggcagctccatgctgaagttggctacaaacccataacggggagacccagcatggcgtat

SEQ ID NO: 423761 - DNA, 140 bp, Artificial Sequence
  Synthetic
atacgccatgctgggtctccaattcagacaaggaggtcattcgagctgaagaagttgtgggaacaaacccgctcaaaagcaggactgctggtctcagatggaggaccaaatctatacaatcgtacttgggagtcggccat

SEQ ID NO: 423762 - DNA, 140 bp, Artificial Sequence
  Synthetic
atggccgactcccaagtacgattgtatagatttggtcctccatctgagaccagcagtcctgcttttgagcgggtttgttcccacaacttcttcagctcgaatgacctccttgtctgaattggagacccagcatggcgtat

SEQ ID NO: 423763 - DNA, 140 bp, Artificial Sequence
  Synthetic
atacgccatgctgggtctccgctcaaaagcaggactgctggtctcagatggaggaccaaatctatacaatatccggaatcttcacattccggaagtctgcttgaaatgggagctaatggacgtacttgggagtcggccat

SEQ ID NO: 423764 - DNA, 140 bp, Artificial Sequence
  Synthetic
atggccgactcccaagtacgtccattagctcccatttcaagcagacttccggaatgtgaagattccggatattgtatagatttggtcctccatctgagaccagcagtcctgcttttgagcggagacccagcatggcgtat

SEQ ID NO: 423765 - DNA, 140 bp, Artificial Sequence
  Synthetic
aggccctggctgctgatatgaatccaactgaagagcaagccgtggatatatgcaaagcagcaatgggtttgagaatcagctcctcttttagctttggaggtttcactttcaaaagaacaagaccttttgggacagcggtg

SEQ ID NO: 423766 - DNA, 140 bp, Artificial Sequence
  Synthetic
caccgctgtcccaaaaggtcttgttcttttgaaagtgaaacctccaaagctaaaagaggagctgattctcaaacccattgctgctttgcatatatccacggcttgctcttcagttggattcatatcagcagccagggcct

SEQ ID NO: 423767 - DNA, 140 bp, Artificial Sequence
  Synthetic
aggccctggctgctgatatggtgaatcatctattaaaagagaagaagaagtgcttacaggcaacctccaaacactaaaattaagagtacatgaggggtatgaggagttcacaatggttgggaccttttgggacagcggtg

SEQ ID NO: 423768 - DNA, 140 bp, Artificial Sequence
  Synthetic
caccgctgtcccaaaaggtcccaaccattgtgaactcctcatacccctcatgtactcttaattttagtgtttggaggttgcctgtaagcacttcttcttctcttttaatagatgattcaccatatcagcagccagggcct

SEQ ID NO: 423769 - DNA, 140 bp, Artificial Sequence
  Synthetic
atacgccatgctgggtctccccctaagaggaaccgctccattctcaatacaagccaaaggggaatccttgaagacgaacagatgtatcaaaagtgctgcaatctattcgaaaaattcttccgtacttgggagtcggccat

SEQ ID NO: 423770 - DNA, 140 bp, Artificial Sequence
  Synthetic
atggccgactcccaagtacggaagaatttttcgaatagattgcagcacttttgatacatctgttcgtcttcaaggattcccctttggcttgtattgagaatggagcggttcctcttagggggagacccagcatggcgtat

SEQ ID NO: 423771 - DNA, 140 bp, Artificial Sequence
  Synthetic
atacgccatgctgggtctccatcccatgcaccaactcttgaggcatttccaaaaagatgcaaaagtgcttttccagaactggggaattgaacccatcgacagtgtgatgggaatgatcggcgtacttgggagtcggccat

SEQ ID NO: 423772 - DNA, 140 bp, Artificial Sequence
  Synthetic
atggccgactcccaagtacgccgatcattcccatcacactgtcgatgggttcaattccccagttctggaaaagcacttttgcatctttttggaaatgcctcaagagttggtgcatgggatggagacccagcatggcgtat

SEQ ID NO: 423773 - DNA, 140 bp, Artificial Sequence
  Synthetic
atacgccatgctgggtctccttccagaactggggaattgaacccatcgacagtgtgatgggaatgatcgggatattgcctgatatgaccccaagcacggaaatatcgctgagagggataacgtacttgggagtcggccat

SEQ ID NO: 423774 - DNA, 140 bp, Artificial Sequence
  Synthetic
atggccgactcccaagtacgttatccctctcagcgatatttccgtgcttggggtcatatcaggcaatatcccgatcattcccatcacactgtcgatgggttcaattccccagttctggaaggagacccagcatggcgtat

SEQ ID NO: 423775 - DNA, 140 bp, Artificial Sequence
  Synthetic
aggccctggctgctgatatgaagagtatgaagttacggacacaagtaccagcggaaatgctcgcaaatattgacctgaaatacttcaacaaatcaacaagagagaaaatcgagaaaataagaccttttgggacagcggtg

SEQ ID NO: 423776 - DNA, 140 bp, Artificial Sequence
  Synthetic
caccgctgtcccaaaaggtcttattttctcgattttctctcttgttgatttgttgaagtatttcaggtcaatatttgcgagcatttccgctggtacttgtgtccgtaacttcatactcttcatatcagcagccagggcct

SEQ ID NO: 423777 - DNA, 140 bp, Artificial Sequence
  Synthetic
atacgccatgctgggtctccggaatccttgaggatgaacagatgtatcagaagtgctgcaatctatttgaaaaattcttccctagtagctcatacaggaggccagttggaatctccagtacgtacttgggagtcggccat

SEQ ID NO: 423778 - DNA, 140 bp, Artificial Sequence
  Synthetic
atggccgactcccaagtacgtactggagattccaactggcctcctgtatgagctactagggaagaatttttcaaatagattgcagcacttctgatacatctgttcatcctcaaggattccggagacccagcatggcgtat

SEQ ID NO: 423779 - DNA, 140 bp, Artificial Sequence
  Synthetic
aggccctggctgctgatatgtgaggaatgataccgatgtggtaaattttgtgagtatggaattctctcttactgatccgaggttggagccacacaaatgggaaaagtactgtgtcctcgagaccttttgggacagcggtg

SEQ ID NO: 423780 - DNA, 140 bp, Artificial Sequence
  Synthetic
caccgctgtcccaaaaggtctcgaggacacagtacttttcccatttgtgtggctccaacctcggatcagtaagagagaattccatactcacaaaatttaccacatcggtatcattcctcacatatcagcagccagggcct

SEQ ID NO: 423781 - DNA, 140 bp, Artificial Sequence
  Synthetic
atacgccatgctgggtctccactgatccgaggttggagccacacaaatgggaaaagtactgtgtcctcgagataggagacatgctcctccggactgcagtaggtcaagtttcaaggcccacgtacttgggagtcggccat

SEQ ID NO: 423782 - DNA, 140 bp, Artificial Sequence
  Synthetic
atggccgactcccaagtacgtgggccttgaaacttgacctactgcagtccggaggagcatgtctcctatctcgaggacacagtacttttcccatttgtgtggctccaacctcggatcagtggagacccagcatggcgtat

SEQ ID NO: 423783 - DNA, 140 bp, Artificial Sequence
  Synthetic
atacgccatgctgggtctccgggtagacgaatattccagtactgagagagtggttgtgagtattgatcgattcctgagagttcgagatcaaaggggaaatgtactcctgtctcctgaggacgtacttgggagtcggccat

SEQ ID NO: 423784 - DNA, 140 bp, Artificial Sequence
  Synthetic
atggccgactcccaagtacgtcctcaggagacaggagtacatttcccctttgatctcgaactctcaggaatcgatcaatactcacaaccactctctcagtactggaatattcgtctacccggagacccagcatggcgtat

SEQ ID NO: 423785 - DNA, 140 bp, Artificial Sequence
  Synthetic
atacgccatgctgggtctccagatcgaacggtctaacagccaatgagtcgggaagactaatagatttcctcaaggatgtaatggagtcaatggacaaagaagaaatggaaataacaacaccgtacttgggagtcggccat

SEQ ID NO: 423786 - DNA, 140 bp, Artificial Sequence
  Synthetic
atggccgactcccaagtacggtgttgttatttccatttcttctttgtccattgactccattacatccttgaggaaatctattagtcttcccgactcattggctgttagaccgttcgatctggagacccagcatggcgtat

SEQ ID NO: 423787 - DNA, 140 bp, Artificial Sequence
  Synthetic
aggccctggctgctgatatgggcatggaaatgagacgatgccttcttcaatcccttcaacaaattgaaagcatgattgaagctgaatcttctgtcaaggagaaggacatgaccaaagaatgaccttttgggacagcggtg

SEQ ID NO: 423788 - DNA, 140 bp, Artificial Sequence
  Synthetic
caccgctgtcccaaaaggtcattctttggtcatgtccttctccttgacagaagattcagcttcaatcatgctttcaatttgttgaagggattgaagaaggcatcgtctcatttccatgcccatatcagcagccagggcct

SEQ ID NO: 423789 - DNA, 140 bp, Artificial Sequence
  Synthetic
aggccctggctgctgatatggtgacatggtggaataggaatggaccaacaactagtacagttcattatccaaaggtatataaaacttatttcgaaaaagtcgaaaggttgaagcacgggagaccttttgggacagcggtg

SEQ ID NO: 423790 - DNA, 140 bp, Artificial Sequence
  Synthetic
caccgctgtcccaaaaggtctcccgtgcttcaacctttcgactttttcgaaataagttttatatacctttggataatgaactgtactagttgttggtccattcctattccaccatgtcaccatatcagcagccagggcct

SEQ ID NO: 423791 - DNA, 140 bp, Artificial Sequence
  Synthetic
atacgccatgctgggtctcccaatggatcattagaaattgggaaactgtgaagatccaatggtctcaagaccccacaatgctatacaacaaaatggaatttgagccttttcaatctctagcgtacttgggagtcggccat

SEQ ID NO: 423792 - DNA, 140 bp, Artificial Sequence
  Synthetic
atggccgactcccaagtacgctagagattgaaaaggctcaaattccattttgttgtatagcattgtggggtcttgagaccattggatcttcacagtttcccaatttctaatgatccattgggagacccagcatggcgtat

SEQ ID NO: 423793 - DNA, 140 bp, Artificial Sequence
  Synthetic
aggccctggctgctgatatgtaatggaaatgattcctgaaagaaatgaacaaggccagacgctttggagcaagacaaatgatgctggatcagacagagtgatggtgtctcccctagctgtgaccttttgggacagcggtg

SEQ ID NO: 423794 - DNA, 140 bp, Artificial Sequence
  Synthetic
caccgctgtcccaaaaggtcacagctaggggagacaccatcactctgtctgatccagcatcatttgtcttgctccaaagcgtctggccttgttcatttctttcaggaatcatttccattacatatcagcagccagggcct

SEQ ID NO: 423795 - DNA, 140 bp, Artificial Sequence
  Synthetic
aggccctggctgctgatatgcagcagatgcgtgatgtgctggggacatttgatactgttcaaataataaaactgctgccattcgcagcagcaccacctgagcagagtaggatgcagttctgaccttttgggacagcggtg

SEQ ID NO: 423796 - DNA, 140 bp, Artificial Sequence
  Synthetic
caccgctgtcccaaaaggtcagaactgcatcctactctgctcaggtggtgctgctgcgaatggcagcagttttattatttgaacagtatcaaatgtccccagcacatcacgcatctgctgcatatcagcagccagggcct

SEQ ID NO: 423797 - DNA, 140 bp, Artificial Sequence
  Synthetic
atacgccatgctgggtctccaggtctacaaaacatactttgagaaggttgaaaggttaaagcatggaaccttcggtcccgttcacttccgaaaccaaattaaaatacgccgccgagttgacgtacttgggagtcggccat

SEQ ID NO: 423798 - DNA, 140 bp, Artificial Sequence
  Synthetic
atggccgactcccaagtacgtcaactcggcggcgtattttaatttggtttcggaagtgaacgggaccgaaggttccatgctttaacctttcaaccttctcaaagtatgttttgtagacctggagacccagcatggcgtat

SEQ ID NO: 423799 - DNA, 140 bp, Artificial Sequence
  Synthetic
atacgccatgctgggtctccgattaacgatccctgggttttgcttaatgcgtattggttcaactccttcctcgcacatgcactgaattagttagggcaatgctactgcttgctatccatacgtacttgggagtcggccat

SEQ ID NO: 423800 - DNA, 140 bp, Artificial Sequence
  Synthetic
atggccgactcccaagtacgtatggatagcaagcagtagcattgccctaactaattcagtgcatgtgcgaggaaggagttgaaccaatacgcattaagcaaaacccagggatcgttaatcggagacccagcatggcgtat

SEQ ID NO: 423801 - DNA, 140 bp, Artificial Sequence
  Synthetic
atacgccatgctgggtctcctcatggaggtcgttttcccaaatgaagtgggagctagaatattgacatcagagtcacaattgacaataacgaaagagaaaaaagaagaactccaggattgcgtacttgggagtcggccat

SEQ ID NO: 423802 - DNA, 140 bp, Artificial Sequence
  Synthetic
atggccgactcccaagtacgcaatcctggagttcttcttttttctctttcgttattgtcaattgtgactctgatgtcaatattctagctcccacttcatttgggaaaacgacctccatgaggagacccagcatggcgtat

SEQ ID NO: 423803 - DNA, 140 bp, Artificial Sequence
  Synthetic
aggccctggctgctgatatggagtcacaattgacaataacgaaagagaaaaaagaagaactccaggattgcaagattgctcctttaatggtggcatacatgttggaaagagaactggtccgaccttttgggacagcggtg

SEQ ID NO: 423804 - DNA, 140 bp, Artificial Sequence
  Synthetic
caccgctgtcccaaaaggtcggaccagttctctttccaacatgtatgccaccattaaaggagcaatcttgcaatcctggagttcttcttttttctctttcgttattgtcaattgtgactccatatcagcagccagggcct

SEQ ID NO: 423805 - DNA, 140 bp, Artificial Sequence
  Synthetic
aggccctggctgctgatatgtgggacagggacaggatacaccatggacacagtcaacagaacacaccaatattcagaaaaggggaagtggacaaaaaacacagagactggagcaccccaagaccttttgggacagcggtg

SEQ ID NO: 423806 - DNA, 140 bp, Artificial Sequence
  Synthetic
caccgctgtcccaaaaggtcttggggtgctccagtctctgtgttttttgtccacttccccttttctgaatattggtgtgttctgttgactgtgtccatggtgtatcctgtccctgtcccacatatcagcagccagggcct

SEQ ID NO: 423807 - DNA, 140 bp, Artificial Sequence
  Synthetic
aggccctggctgctgatatgaaaaggggagaaagccaacgtgttgataggacagggagacgtggtgttggtaatgaaacggaaacgaaactctagcatacttactgacagccagacagcggaccttttgggacagcggtg

SEQ ID NO: 423808 - DNA, 140 bp, Artificial Sequence
  Synthetic
caccgctgtcccaaaaggtccgctgtctggctgtcagtaagtatgctagagtttcgtttccgtttcattaccaacaccacgtctccctgtcctatcaacacgttggctttctccccttttcatatcagcagccagggcct

SEQ ID NO: 423809 - DNA, 140 bp, Artificial Sequence
  Synthetic
atacgccatgctgggtctccgaggtactgcacttgacccaagggacctgctgggaacagatgtacactccaggcggagaagtgagaaatgacgatgttgaccagagtttgatcatcgcggcgtacttgggagtcggccat

SEQ ID NO: 423810 - DNA, 140 bp, Artificial Sequence
  Synthetic
atggccgactcccaagtacgccgcgatgatcaaactctggtcaacatcgtcatttctcacttctccgcctggagtgtacatctgttcccagcaggtcccttgggtcaagtgcagtacctcggagacccagcatggcgtat

SEQ ID NO: 423811 - DNA, 140 bp, Artificial Sequence
  Synthetic
aggccctggctgctgatatgaggcggagaagtgagaaatgacgatgttgaccagagtttgatcatcgcggccagaaacattgttaggagagcaacggtatcagcggatccactggcatcagaccttttgggacagcggtg

SEQ ID NO: 423812 - DNA, 140 bp, Artificial Sequence
  Synthetic
caccgctgtcccaaaaggtctgatgccagtggatccgctgataccgttgctctcctaacaatgtttctggccgcgatgatcaaactctggtcaacatcgtcatttctcacttctccgcctcatatcagcagccagggcct

SEQ ID NO: 423813 - DNA, 140 bp, Artificial Sequence
  Synthetic
atacgccatgctgggtctccctttcaaaagaacaagcgggtcgtcagttaagagggaagaagaagtgcttacgggcaaccttcaaacattgaaaataagagtacatgagggatatgaagacgtacttgggagtcggccat

SEQ ID NO: 423814 - DNA, 140 bp, Artificial Sequence
  Synthetic
atggccgactcccaagtacgtcttcatatccctcatgtactcttattttcaatgtttgaaggttgcccgtaagcacttcttcttccctcttaactgacgacccgcttgttcttttgaaagggagacccagcatggcgtat

SEQ ID NO: 423815 - DNA, 140 bp, Artificial Sequence
  Synthetic
atacgccatgctgggtctccggaagaacacagaccttgaggctctcatggagtggctaaagacaagaccaatcctgtcacctctgaccaagggaattttgggatttgtattcacgctcaccgtacttgggagtcggccat

SEQ ID NO: 423816 - DNA, 140 bp, Artificial Sequence
  Synthetic
atggccgactcccaagtacggtgagcgtgaatacaaatcccaaaattcccttggtcagaggtgacaggattggtcttgtctttagccactccatgagagcctcaaggtctgtgttcttccggagacccagcatggcgtat

SEQ ID NO: 423817 - DNA, 140 bp, Artificial Sequence
  Synthetic
aggccctggctgctgatatgcagcaatgggtttgaggattagttcatcctttagctttggaggattcaccttcaaaagaacaagtggttcatccgttagaaaggaagaggaagtgcttacgaccttttgggacagcggtg

SEQ ID NO: 423818 - DNA, 140 bp, Artificial Sequence
  Synthetic
caccgctgtcccaaaaggtcgtaagcacttcctcttcctttctaacggatgaaccacttgttcttttgaaggtgaatcctccaaagctaaaggatgaactaatcctcaaacccattgctgcatatcagcagccagggcct

SEQ ID NO: 423819 - DNA, 140 bp, Artificial Sequence
  Synthetic
aggccctggctgctgatatggaagcaataattgtggccatggtattttcacaagaagattgtatgatcaaggcagttcgaggtgatctgaactttgtcaatagggcaaatcagcggctaagaccttttgggacagcggtg

SEQ ID NO: 423820 - DNA, 140 bp, Artificial Sequence
  Synthetic
caccgctgtcccaaaaggtcttagccgctgatttgccctattgacaaagttcagatcacctcgaactgccttgatcatacaatcttcttgtgaaaataccatggccacaattattgcttccatatcagcagccagggcct

SEQ ID NO: 423821 - DNA, 140 bp, Artificial Sequence
  Synthetic
atacgccatgctgggtctccaacccatttccagagaaagaggcgagtgagagacaacatgaccaaaaaaatggtcacacaaagaacaatagggaagaaaaagcaaaggctgaacagaaagcgtacttgggagtcggccat

SEQ ID NO: 423822 - DNA, 140 bp, Artificial Sequence
  Synthetic
atggccgactcccaagtacgctttctgttcagcctttgctttttcttccctattgttctttgtgtgaccatttttttggtcatgttgtctctcactcgcctctttctctggaaatgggttggagacccagcatggcgtat

SEQ ID NO: 423823 - DNA, 140 bp, Artificial Sequence
  Synthetic
atacgccatgctgggtctcctcacaatggttgggcgaagagcaacagccattctaaggaaagcaactagaaggctgattcagttgatagtaagtggaagagacgaacaatcaatcgctgacgtacttgggagtcggccat

SEQ ID NO: 423824 - DNA, 140 bp, Artificial Sequence
  Synthetic
atggccgactcccaagtacgtcagcgattgattgttcgtctcttccacttactatcaactgaatcagccttctagttgctttccttagaatggctgttgctcttcgcccaaccattgtgaggagacccagcatggcgtat

SEQ ID NO: 423825 - DNA, 140 bp, Artificial Sequence
  Synthetic
aggccctggctgctgatatggaatgggaacagtgaccacagaagctgcttttggcctagtgtgtgccacttgtgagcagattgctgattcacagcatcggtctcacagacaaatggctacgaccttttgggacagcggtg

SEQ ID NO: 423826 - DNA, 140 bp, Artificial Sequence
  Synthetic
caccgctgtcccaaaaggtcgtagccatttgtctgtgagaccgatgctgtgaatcagcaatctgctcacaagtggcacacactaggccaaaagcagcttctgtggtcactgttcccattccatatcagcagccagggcct

SEQ ID NO: 423827 - DNA, 140 bp, Artificial Sequence
  Synthetic
atacgccatgctgggtctccgatattgcccgacatgaccccaagtactgagatgtcgctgagggggataagagtcagtaagatgggagttgatgaatactccagcacagagagagtagtacgtacttgggagtcggccat

SEQ ID NO: 423828 - DNA, 140 bp, Artificial Sequence
  Synthetic
atggccgactcccaagtacgtactactctctctgtgctggagtattcatcaactcccatcttactgactcttatccccctcagcgacatctcagtacttggggtcatgtcgggcaatatcggagacccagcatggcgtat

SEQ ID NO: 423829 - DNA, 140 bp, Artificial Sequence
  Synthetic
aggccctggctgctgatatggaggattcgtgtactttgttgaaacattagcgaggagtatctgtgaaaaacttgagcaatctggacttccagttggaggaaatgaaaagaaggctaaactgaccttttgggacagcggtg

SEQ ID NO: 423830 - DNA, 140 bp, Artificial Sequence
  Synthetic
caccgctgtcccaaaaggtcagtttagccttcttttcatttcctccaactggaagtccagattgctcaagtttttcacagatactcctcgctaatgtttcaacaaagtacacgaatcctccatatcagcagccagggcct

SEQ ID NO: 423831 - DNA, 140 bp, Artificial Sequence
  Synthetic
atacgccatgctgggtctcccccatgcatcaactcctgagacacttccaaaaagatgcaaaagtgctgtttcaaaattgggggattgaacctattgataatgtcatggggatgattggaacgtacttgggagtcggccat

SEQ ID NO: 423832 - DNA, 140 bp, Artificial Sequence
  Synthetic
atggccgactcccaagtacgttccaatcatccccatgacattatcaataggttcaatcccccaattttgaaacagcacttttgcatctttttggaagtgtctcaggagttgatgcatgggggagacccagcatggcgtat

SEQ ID NO: 423833 - DNA, 140 bp, Artificial Sequence
  Synthetic
aggccctggctgctgatatggaggccatggaggttgccagtcagactaggcagatggtgcatgcaatgagaacaattggaacacatcctagctccagtgccggtctgaaagatgaccttcgaccttttgggacagcggtg

SEQ ID NO: 423834 - DNA, 140 bp, Artificial Sequence
  Synthetic
caccgctgtcccaaaaggtcgaaggtcatctttcagaccggcactggagctaggatgtgttccaattgttctcattgcatgcaccatctgcctagtctgactggcaacctccatggcctccatatcagcagccagggcct

SEQ ID NO: 423835 - DNA, 140 bp, Artificial Sequence
  Synthetic
atacgccatgctgggtctccccttcacaattactggagataatactaaatggaatgagaatcagaaccctaggatgtttctggcgatgataacatacataacaaggaaccagccggaatgcgtacttgggagtcggccat

SEQ ID NO: 423836 - DNA, 140 bp, Artificial Sequence
  Synthetic
atggccgactcccaagtacgcattccggctggttccttgttatgtatgttatcatcgccagaaacatcctagggttctgattctcattccatttagtattatctccagtaattgtgaaggggagacccagcatggcgtat

SEQ ID NO: 423837 - DNA, 140 bp, Artificial Sequence
  Synthetic
aggccctggctgctgatatgaggatgtttctggcgatgataacatacataacaaggaaccagccggaatggtttcggaatgtcttaagcattgcccctataatgttctcaaacaaaatgggaccttttgggacagcggtg

SEQ ID NO: 423838 - DNA, 140 bp, Artificial Sequence
  Synthetic
caccgctgtcccaaaaggtcccattttgtttgagaacattataggggcaatgcttaagacattccgaaaccattccggctggttccttgttatgtatgttatcatcgccagaaacatcctcatatcagcagccagggcct

SEQ ID NO: 423839 - DNA, 140 bp, Artificial Sequence
  Synthetic
atacgccatgctgggtctccacgcattgaccgtttcttgcgggttcgagatcagcaggggaacgtactcctatctcccgaagaggtcagcgaaacactgggaacagaaaaattaacaatacgtacttgggagtcggccat

SEQ ID NO: 423840 - DNA, 140 bp, Artificial Sequence
  Synthetic
atggccgactcccaagtacgtattgttaatttttctgttcccagtgtttcgctgacctcttcgggagataggagtacgttcccctgctgatctcgaacccgcaagaaacggtcaatgcgtggagacccagcatggcgtat

SEQ ID NO: 423841 - DNA, 140 bp, Artificial Sequence
  Synthetic
aggccctggctgctgatatgtatctcccgaagaggtcagcgaaacactgggaacagaaaaattaacaataacatattcatcatcaatgatgtgggaaatcaatggtcctgagtcagtgctgaccttttgggacagcggtg

SEQ ID NO: 423842 - DNA, 140 bp, Artificial Sequence
  Synthetic
caccgctgtcccaaaaggtcagcactgactcaggaccattgatttcccacatcattgatgatgaatatgttattgttaatttttctgttcccagtgtttcgctgacctcttcgggagatacatatcagcagccagggcct

SEQ ID NO: 423843 - DNA, 140 bp, Artificial Sequence
  Synthetic
aggccctggctgctgatatgcttaaatacggtttgaaaagagggccttctacggaaggagtgcctgagtccatgagggaagaatatcaacaggaacagcagagtgctgtggatgttgacggaccttttgggacagcggtg

SEQ ID NO: 423844 - DNA, 140 bp, Artificial Sequence
  Synthetic
caccgctgtcccaaaaggtccgtcaacatccacagcactctgctgttcctgttgatattcttccctcatggactcaggcactccttccgtagaaggccctcttttcaaaccgtatttaagcatatcagcagccagggcct

SEQ ID NO: 423845 - DNA, 140 bp, Artificial Sequence
  Synthetic
atacgccatgctgggtctccaatggtctcaagaccccacgatgctgtacaataaggtggagtttgaaccgttccaatccttggtacctaaagctgccagaggccaatacagtggatttgtcgtacttgggagtcggccat

SEQ ID NO: 423846 - DNA, 140 bp, Artificial Sequence
  Synthetic
atggccgactcccaagtacgacaaatccactgtattggcctctggcagctttaggtaccaaggattggaacggttcaaactccaccttattgtacagcatcgtggggtcttgagaccattggagacccagcatggcgtat

SEQ ID NO: 423847 - DNA, 140 bp, Artificial Sequence
  Synthetic
atacgccatgctgggtctccagtacagttctgggagtctcaattttgaaccttgggcagaaaaggtacaccaaaaccacatattggtgggacggactccaatcctctgatgattttgctccgtacttgggagtcggccat

SEQ ID NO: 423848 - DNA, 140 bp, Artificial Sequence
  Synthetic
atggccgactcccaagtacggagcaaaatcatcagaggattggagtccgtcccaccaatatgtggttttggtgtaccttttctgcccaaggttcaaaattgagactcccagaactgtactggagacccagcatggcgtat

SEQ ID NO: 423849 - DNA, 140 bp, Artificial Sequence
  Synthetic
atacgccatgctgggtctcctttgtgtacttcgttgaaacattagcgaggagtatctgtgaaaaactagaacagtcaggactccctgttggagggaatgaaaagaaggcgaagttggcaacgtacttgggagtcggccat

SEQ ID NO: 423850 - DNA, 140 bp, Artificial Sequence
  Synthetic
atggccgactcccaagtacgttgccaacttcgccttcttttcattccctccaacagggagtcctgactgttctagtttttcacagatactcctcgctaatgtttcaacgaagtacacaaaggagacccagcatggcgtat

SEQ ID NO: 423851 - DNA, 140 bp, Artificial Sequence
  Synthetic
aggccctggctgctgatatgcaaaacgtcattacttacgaaaacaacacttgggtcaaccagacgtatgttaacatcagcaacactaattttgttgctgaacaggcagtagcttcagtgagaccttttgggacagcggtg

SEQ ID NO: 423852 - DNA, 140 bp, Artificial Sequence
  Synthetic
caccgctgtcccaaaaggtctcactgaagctactgcctgttcagcaacaaaattagtgttgctgatgttaacatacgtctggttgacccaagtgttgttttcgtaagtaatgacgttttgcatatcagcagccagggcct

SEQ ID NO: 423853 - DNA, 140 bp, Artificial Sequence
  Synthetic
atacgccatgctgggtctccagaatgcaattttcttccctgaccgtgaatgtaagaggctcgggaatgagaatactcgtaaggggtaactcccctgtgttcaactacaataaggcaaccacgtacttgggagtcggccat

SEQ ID NO: 423854 - DNA, 140 bp, Artificial Sequence
  Synthetic
atggccgactcccaagtacgtggttgccttattgtagttgaacacaggggagttaccccttacgagtattctcattcccgagcctcttacattcacggtcagggaagaaaattgcattctggagacccagcatggcgtat

SEQ ID NO: 423855 - DNA, 140 bp, Artificial Sequence
  Synthetic
aggccctggctgctgatatgagtaaagataatagtgtaagaataggttccaagggggatgtgtttgtcataagggagccattcatttcatgctcccacttggaatgcagaactttcttctgaccttttgggacagcggtg

SEQ ID NO: 423856 - DNA, 140 bp, Artificial Sequence
  Synthetic
caccgctgtcccaaaaggtcagaagaaagttctgcattccaagtgggagcatgaaatgaatggctcccttatgacaaacacatcccccttggaacctattcttacactattatctttactcatatcagcagccagggcct

SEQ ID NO: 423857 - DNA, 140 bp, Artificial Sequence
  Synthetic
atacgccatgctgggtctccaagggagccattcatttcatgctcccacttggaatgcagaactttcttcttaactcaaggggcccttttgaatgacaaacactctaacggaacaattaagcgtacttgggagtcggccat

SEQ ID NO: 423858 - DNA, 140 bp, Artificial Sequence
  Synthetic
atggccgactcccaagtacgcttaattgttccgttagagtgtttgtcattcaaaagggccccttgagttaagaagaaagttctgcattccaagtgggagcatgaaatgaatggctcccttggagacccagcatggcgtat

SEQ ID NO: 423859 - DNA, 140 bp, Artificial Sequence
  Synthetic
aggccctggctgctgatatgttctccatacaactcaagatttgagtcagtcgcttggtcagcaagtgcctgccatgatggcacaagttggctaacaattggaatttctggcccagataatgaccttttgggacagcggtg

SEQ ID NO: 423860 - DNA, 140 bp, Artificial Sequence
  Synthetic
caccgctgtcccaaaaggtcattatctgggccagaaattccaattgttagccaacttgtgccatcatggcaggcacttgctgaccaagcgactgactcaaatcttgagttgtatggagaacatatcagcagccagggcct

SEQ ID NO: 423861 - DNA, 140 bp, Artificial Sequence
  Synthetic
aggccctggctgctgatatgacaatatccgaaatctccatattcctgaggtctgcttgaaatgggaattgatggatgaagattaccaaggcagactgtgtaatcctctgaatccgttcgtgaccttttgggacagcggtg

SEQ ID NO: 423862 - DNA, 140 bp, Artificial Sequence
  Synthetic
caccgctgtcccaaaaggtcacgaacggattcagaggattacacagtctgccttggtaatcttcatccatcaattcccatttcaagcagacctcaggaatatggagatttcggatattgtcatatcagcagccagggcct

SEQ ID NO: 423863 - DNA, 140 bp, Artificial Sequence
  Synthetic
aggccctggctgctgatatggagttggagaaaaaacatattaagaacacaagagtctgaatgtgcatgcgttaatggttcttgctttacagtaatgactgatggaccaagtaatgggcaggaccttttgggacagcggtg

SEQ ID NO: 423864 - DNA, 140 bp, Artificial Sequence
  Synthetic
caccgctgtcccaaaaggtcctgcccattacttggtccatcagtcattactgtaaagcaagaaccattaacgcatgcacattcagactcttgtgttcttaatatgttttttctccaactccatatcagcagccagggcct

SEQ ID NO: 423865 - DNA, 140 bp, Artificial Sequence
  Synthetic
atacgccatgctgggtctccatggcccggccaagagtatggaatatgatgctgttgcaactacgcattcatggattcctaaaagaaatcgttccattctcaatacgagtcaaaggggaatcgtacttgggagtcggccat

SEQ ID NO: 423866 - DNA, 140 bp, Artificial Sequence
  Synthetic
atggccgactcccaagtacgattcccctttgactcgtattgagaatggaacgatttcttttaggaatccatgaatgcgtagttgcaacagcatcatattccatactcttggccgggccatggagacccagcatggcgtat

SEQ ID NO: 423867 - DNA, 140 bp, Artificial Sequence
  Synthetic
aggccctggctgctgatatgtgagttgaatgcccctaattatcactatgaggaatgctcctgttatcctgaatctggtgaaatcacatgtgtgtgtagggataattggcatggctcaaatgaccttttgggacagcggtg

SEQ ID NO: 423868 - DNA, 140 bp, Artificial Sequence
  Synthetic
caccgctgtcccaaaaggtcatttgagccatgccaattatccctacacacacatgtgatttcaccagattcaggataacaggagcattcctcatagtgataattaggggcattcaactcacatatcagcagccagggcct

SEQ ID NO: 423869 - DNA, 140 bp, Artificial Sequence
  Synthetic
atacgccatgctgggtctccaatctggtgaaatcacatgtgtgtgtagggataattggcatggctcaaataggccgtgggtgtcttttaatcagaatctggaatatcaaatgggatacatcgtacttgggagtcggccat

SEQ ID NO: 423870 - DNA, 140 bp, Artificial Sequence
  Synthetic
atggccgactcccaagtacgatgtatcccatttgatattccagattctgattaaaagacacccacggcctatttgagccatgccaattatccctacacacacatgtgatttcaccagattggagacccagcatggcgtat

SEQ ID NO: 423871 - DNA, 140 bp, Artificial Sequence
  Synthetic
aggccctggctgctgatatggttgtggtccagtattttctaatggggcaaatggagtaaaaggattttcgtttaaatacggcaatggtgtttggataggaagaactaaaagcattagttcgaccttttgggacagcggtg

SEQ ID NO: 423872 - DNA, 140 bp, Artificial Sequence
  Synthetic
caccgctgtcccaaaaggtcgaactaatgcttttagttcttcctatccaaacaccattgccgtatttaaacgaaaatccttttactccatttgccccattagaaaatactggaccacaaccatatcagcagccagggcct

SEQ ID NO: 423873 - DNA, 140 bp, Artificial Sequence
  Synthetic
atacgccatgctgggtctccgatgaatccaaatcagaagattctatgcacttctgccactgctattgtaataggcacgattgcagtactcataggaatagcaaacctgggactgaacatacgtacttgggagtcggccat

SEQ ID NO: 423874 - DNA, 140 bp, Artificial Sequence
  Synthetic
atggccgactcccaagtacgtatgttcagtcccaggtttgctattcctatgagtactgcaatcgtgcctattacaatagcagtggcagaagtgcatagaatcttctgatttggattcatcggagacccagcatggcgtat

SEQ ID NO: 423875 - DNA, 140 bp, Artificial Sequence
  Synthetic
aggccctggctgctgatatgacgataaattctcagtgaagcaagatatcataggaataaatgattggtcaggatacagtggcagttttgttcaacatccagaattgaccggactggactggaccttttgggacagcggtg

SEQ ID NO: 423876 - DNA, 140 bp, Artificial Sequence
  Synthetic
caccgctgtcccaaaaggtccagtccagtccggtcaattctggatgttgaacaaaactgccactgtatcctgaccaatcatttattcctatgatatcttgcttcactgagaatttatcgtcatatcagcagccagggcct

SEQ ID NO: 423877 - DNA, 140 bp, Artificial Sequence
  Synthetic
atacgccatgctgggtctccaagcaatacaagccaaacaataataaacaactactataacgaaacaaacatcacccaaataagcaataccaacatccaaatggaggagaaaacaaagagacgtacttgggagtcggccat

SEQ ID NO: 423878 - DNA, 140 bp, Artificial Sequence
  Synthetic
atggccgactcccaagtacgtctctttgttttctcctccatttggatgttggtattgcttatttgggtgatgtttgtttcgttatagtagttgtttattattgtttggcttgtattgcttggagacccagcatggcgtat

SEQ ID NO: 423879 - DNA, 140 bp, Artificial Sequence
  Synthetic
aggccctggctgctgatatgtcacccaaataagcaataccaacatccaaatggaggagaaaacaaagagagaattcaacaacttgaccaaaggactctgcactataaattcatggcatatgaccttttgggacagcggtg

SEQ ID NO: 423880 - DNA, 140 bp, Artificial Sequence
  Synthetic
caccgctgtcccaaaaggtcatatgccatgaatttatagtgcagagtcctttggtcaagttgttgaattctctctttgttttctcctccatttggatgttggtattgcttatttgggtgacatatcagcagccagggcct

SEQ ID NO: 423881 - DNA, 140 bp, Artificial Sequence
  Synthetic
aggccctggctgctgatatgagacactatggagcaggacaaatgatgctggatcggacagggtgatggtgtctcccctagctgtaacttggtggaataggaatgggccgacgacaagtacgaccttttgggacagcggtg

SEQ ID NO: 423882 - DNA, 140 bp, Artificial Sequence
  Synthetic
caccgctgtcccaaaaggtcgtacttgtcgtcggcccattcctattccaccaagttacagctaggggagacaccatcaccctgtccgatccagcatcatttgtcctgctccatagtgtctcatatcagcagccagggcct

SEQ ID NO: 423883 - DNA, 140 bp, Artificial Sequence
  Synthetic
atacgccatgctgggtctcctctcccctagctgtaacttggtggaataggaatgggccgacgacaagtacagttcattatccaaaggtttacaaaacatactttgagaaggttgaaaggtcgtacttgggagtcggccat

SEQ ID NO: 423884 - DNA, 140 bp, Artificial Sequence
  Synthetic
atggccgactcccaagtacgacctttcaaccttctcaaagtatgttttgtaaacctttggataatgaactgtacttgtcgtcggcccattcctattccaccaagttacagctaggggagaggagacccagcatggcgtat

SEQ ID NO: 423885 - DNA, 140 bp, Artificial Sequence
  Synthetic
aggccctggctgctgatatgcaataaggcaacaaaaaggctaacggtcctcggaaaggacgcaggtgcattgacagaagatccagatgagggaaaggctggaatagaatctgcagtgctggaccttttgggacagcggtg

SEQ ID NO: 423886 - DNA, 140 bp, Artificial Sequence
  Synthetic
caccgctgtcccaaaaggtccagcactgcagattctattccagcctttccctcatctggatcttctgtcaatgcacctgcgtcctttccgaggaccgttagcctttttgttgccttattgcatatcagcagccagggcct

SEQ ID NO: 423887 - DNA, 140 bp, Artificial Sequence
  Synthetic
aggccctggctgctgatatggctctcagccaaggaacaacaattagagggaaacactcaaatggaacaatacacgatagatcccagtaccgcgccctgataagctggccactgtcatcacgaccttttgggacagcggtg

SEQ ID NO: 423888 - DNA, 140 bp, Artificial Sequence
  Synthetic
caccgctgtcccaaaaggtcgtgatgacagtggccagcttatcagggcgcggtactgggatctatcgtgtattgttccatttgagtgtttccctctaattgttgttccttggctgagagccatatcagcagccagggcct

SEQ ID NO: 423889 - DNA, 140 bp, Artificial Sequence
  Synthetic
aggccctggctgctgatatgcgccgtcgagttgatacaaatcccggccatgcagatctcagtgctaaagaagcacaagatgtcatcatggaggtcgttttcccaaatgaagtgggagctagaccttttgggacagcggtg

SEQ ID NO: 423890 - DNA, 140 bp, Artificial Sequence
  Synthetic
caccgctgtcccaaaaggtctagctcccacttcatttgggaaaacgacctccatgatgacatcttgtgcttctttagcactgagatctgcatggccgggatttgtatcaactcgacggcgcatatcagcagccagggcct

SEQ ID NO: 423891 - DNA, 140 bp, Artificial Sequence
  Synthetic
atacgccatgctgggtctccttaaaatgaatccaaatcagaaaatagtaaccattggctccatttcattagggttggttgtattcaatgttctactgcatgccgtgagcatcatattaaccgtacttgggagtcggccat

SEQ ID NO: 423892 - DNA, 140 bp, Artificial Sequence
  Synthetic
atggccgactcccaagtacggttaatatgatgctcacggcatgcagtagaacattgaatacaaccaaccctaatgaaatggagccaatggttactattttctgatttggattcattttaaggagacccagcatggcgtat

SEQ ID NO: 423893 - DNA, 140 bp, Artificial Sequence
  Synthetic
atacgccatgctgggtctccagctgtcatgatggtagagccaggatgtcaatatgtatatcaggcccaaacaacaatgcgtcagcagtaatttggtacaatagaagacctgttacagaaacgtacttgggagtcggccat

SEQ ID NO: 423894 - DNA, 140 bp, Artificial Sequence
  Synthetic
atggccgactcccaagtacgtttctgtaacaggtcttctattgtaccaaattactgctgacgcattgttgtttgggcctgatatacatattgacatcctggctctaccatcatgacagctggagacccagcatggcgtat

SEQ ID NO: 423895 - DNA, 140 bp, Artificial Sequence
  Synthetic
atacgccatgctgggtctccgaaaatgagagaactctagacttccatgactcaaatgtaaagaacctttacgacaaggtccgattacagcttagggataatgccaaggagctgggtaacgcgtacttgggagtcggccat

SEQ ID NO: 423896 - DNA, 140 bp, Artificial Sequence
  Synthetic
atggccgactcccaagtacgcgttacccagctccttggcattatccctaagctgtaatcggaccttgtcgtaaaggttctttacatttgagtcatggaagtctagagttctctcattttcggagacccagcatggcgtat

SEQ ID NO: 423897 - DNA, 140 bp, Artificial Sequence
  Synthetic
atacgccatgctgggtctcctagtgagggaatacaatgaaacagttagaatagagaaagtgactcaatggtacaatactagcgtagtcgaatatgtaccgcattggaatgagggcacttacgtacttgggagtcggccat

SEQ ID NO: 423898 - DNA, 140 bp, Artificial Sequence
  Synthetic
atggccgactcccaagtacgtaagtgccctcattccaatgcggtacatattcgactacgctagtattgtaccattgagtcactttctctattctaactgtttcattgtattccctcactaggagacccagcatggcgtat

SEQ ID NO: 423899 - DNA, 140 bp, Artificial Sequence
  Synthetic
aggccctggctgctgatatgtacaatactagcgtagtcgaatatgtaccgcattggaatgagggcacttatataaataacaccgaaccaatatgtgatgtcaagggctttgcacctttttgaccttttgggacagcggtg

SEQ ID NO: 423900 - DNA, 140 bp, Artificial Sequence
  Synthetic
caccgctgtcccaaaaggtcaaaaaggtgcaaagcccttgacatcacatattggttcggtgttatttatataagtgccctcattccaatgcggtacatattcgactacgctagtattgtacatatcagcagccagggcct

SEQ ID NO: 423901 - DNA, 140 bp, Artificial Sequence
  Synthetic
atacgccatgctgggtctccacctgcagaaacaagagtatactatttcaaggaagggaaaatactaaaatgggaacctctaactgggactgctaaacacattgaagaatgctcatgctatcgtacttgggagtcggccat

SEQ ID NO: 423902 - DNA, 140 bp, Artificial Sequence
  Synthetic
atggccgactcccaagtacgatagcatgagcattcttcaatgtgtttagcagtcccagttagaggttcccattttagtattttcccttccttgaaatagtatactcttgtttctgcaggtggagacccagcatggcgtat

SEQ ID NO: 423903 - DNA, 140 bp, Artificial Sequence
  Synthetic
aggccctggctgctgatatggggaacctctaactgggactgctaaacacattgaagaatgctcatgctatggagtgcaggcaggtattacttgcacgtgcagagataattggcagggttcgaccttttgggacagcggtg

SEQ ID NO: 423904 - DNA, 140 bp, Artificial Sequence
  Synthetic
caccgctgtcccaaaaggtcgaaccctgccaattatctctgcacgtgcaagtaatacctgcctgcactccatagcatgagcattcttcaatgtgtttagcagtcccagttagaggttccccatatcagcagccagggcct

SEQ ID NO: 423905 - DNA, 140 bp, Artificial Sequence
  Synthetic
atacgccatgctgggtctccagagagcctttcgtctcttgttcacctgtagagtgcaggactttcttcctcactcagggatctctactcaatgacaaacactcaaatggaacagtgaaggcgtacttgggagtcggccat

SEQ ID NO: 423906 - DNA, 140 bp, Artificial Sequence
  Synthetic
atggccgactcccaagtacgccttcactgttccatttgagtgtttgtcattgagtagagatccctgagtgaggaagaaagtcctgcactctacaggtgaacaagagacgaaaggctctctggagacccagcatggcgtat

SEQ ID NO: 423907 - DNA, 140 bp, Artificial Sequence
  Synthetic
aggccctggctgctgatatgcactcagggatctctactcaatgacaaacactcaaatggaacagtgaaggatagaagcccattcagaactctcatgagtgtcgaagtgggccaatcacccgaccttttgggacagcggtg

SEQ ID NO: 423908 - DNA, 140 bp, Artificial Sequence
  Synthetic
caccgctgtcccaaaaggtcgggtgattggcccacttcgacactcatgagagttctgaatgggcttctatccttcactgttccatttgagtgtttgtcattgagtagagatccctgagtgcatatcagcagccagggcct

SEQ ID NO: 423909 - DNA, 140 bp, Artificial Sequence
  Synthetic
atacgccatgctgggtctccagtatatatgtagccctgttcttacagataatccccggccgaacgacccagcagtaggtaagtgtaatgacccttacccaggaaataacaacaatggagtcgtacttgggagtcggccat

SEQ ID NO: 423910 - DNA, 140 bp, Artificial Sequence
  Synthetic
atggccgactcccaagtacgactccattgttgttatttcctgggtaagggtcattacacttacctactgctgggtcgttcggccggggattatctgtaagaacagggctacatatatactggagacccagcatggcgtat

SEQ ID NO: 423911 - DNA, 140 bp, Artificial Sequence
  Synthetic
aggccctggctgctgatatggcagtaggtaagtgtaatgacccttacccaggaaataacaacaatggagtcaaaggattttcatacctggatgggggtaatacttggctaggaagaacaagaccttttgggacagcggtg

SEQ ID NO: 423912 - DNA, 140 bp, Artificial Sequence
  Synthetic
caccgctgtcccaaaaggtcttgttcttcctagccaagtattacccccatccaggtatgaaaatcctttgactccattgttgttatttcctgggtaagggtcattacacttacctactgccatatcagcagccagggcct

SEQ ID NO: 423913 - DNA, 140 bp, Artificial Sequence
  Synthetic
atacgccatgctgggtctcctcatgatggtaagaagtggatggcgattggtgtaacagggccagattctaaagcagtagcagtagttcattacggaggggtgcctactgacgttgttaaccgtacttgggagtcggccat

SEQ ID NO: 423914 - DNA, 140 bp, Artificial Sequence
  Synthetic
atggccgactcccaagtacggttaacaacgtcagtaggcacccctccgtaatgaactactgctactgctttagaatctggccctgttacaccaatcgccatccacttcttaccatcatgaggagacccagcatggcgtat

SEQ ID NO: 423915 - DNA, 140 bp, Artificial Sequence
  Synthetic
aggccctggctgctgatatgaagcagtagcagtagttcattacggaggggtgcctactgacgttgttaactcctgggcaggagatatattaagaactcaggagtcatcttgtacttgcatgaccttttgggacagcggtg

SEQ ID NO: 423916 - DNA, 140 bp, Artificial Sequence
  Synthetic
caccgctgtcccaaaaggtcatgcaagtacaagatgactcctgagttcttaatatatctcctgcccaggagttaacaacgtcagtaggcacccctccgtaatgaactactgctactgcttcatatcagcagccagggcct

SEQ ID NO: 423917 - DNA, 140 bp, Artificial Sequence
  Synthetic
atacgccatgctgggtctccttgaccgacgatagatcaaagcccacccaaggccaaacaattgtattaaacactgactggagtggctacagtgggtccttcatggactattgggctgaagcgtacttgggagtcggccat

SEQ ID NO: 423918 - DNA, 140 bp, Artificial Sequence
  Synthetic
atggccgactcccaagtacgcttcagcccaatagtccatgaaggacccactgtagccactccagtcagtgtttaatacaattgtttggccttgggtgggctttgatctatcgtcggtcaaggagacccagcatggcgtat

SEQ ID NO: 423919 - DNA, 140 bp, Artificial Sequence
  Synthetic
atacgccatgctgggtctcccgcagtatagaatatacaaagcaaatcaaggcaaaataattggccgaacagatgttagctttagtggaggacatattgaggaatgttcttgttatccaaacgtacttgggagtcggccat

SEQ ID NO: 423920 - DNA, 140 bp, Artificial Sequence
  Synthetic
atggccgactcccaagtacgtttggataacaagaacattcctcaatatgtcctccactaaagctaacatctgttcggccaattattttgccttgatttgctttgtatattctatactgcgggagacccagcatggcgtat

SEQ ID NO: 423921 - DNA, 140 bp, Artificial Sequence
  Synthetic
atacgccatgctgggtctccaaggaggacaaagtatggtggaccagtaatagtatagtatcaatgtgttccagcacagaattccttggacaatggaactggcctgatggggctaaaatagcgtacttgggagtcggccat

SEQ ID NO: 423922 - DNA, 140 bp, Artificial Sequence
  Synthetic
atggccgactcccaagtacgctattttagccccatcaggccagttccattgtccaaggaattctgtgctggaacacattgatactatactattactggtccaccatactttgtcctccttggagacccagcatggcgtat

SEQ ID NO: 423923 - DNA, 140 bp, Artificial Sequence
  Synthetic
aggccctggctgctgatatgattctgcagcatttgaagacctgagagtgtcaagttttatcagagggacaaaagtggtcccaagaggacaattgtccaccagaggggttcaaattgcgtcgaccttttgggacagcggtg

SEQ ID NO: 423924 - DNA, 140 bp, Artificial Sequence
  Synthetic
caccgctgtcccaaaaggtcgacgcaatttgaacccctctggtggacaattgtcctcttgggaccacttttgtccctctgataaaacttgacactctcaggtcttcaaatgctgcagaatcatatcagcagccagggcct

SEQ ID NO: 423925 - DNA, 140 bp, Artificial Sequence
  Synthetic
aggccctggctgctgatatgggggatgataggaatattacctgacatgactcccagcacggaaatgtcactgagaggagtaagagttagcaaaatgggagtagatgaatattccagcactgaccttttgggacagcggtg

SEQ ID NO: 423926 - DNA, 140 bp, Artificial Sequence
  Synthetic
caccgctgtcccaaaaggtcagtgctggaatattcatctactcccattttgctaactcttactcctctcagtgacatttccgtgctgggagtcatgtcaggtaatattcctatcatcccccatatcagcagccagggcct

SEQ ID NO: 423927 - DNA, 140 bp, Artificial Sequence
  Synthetic
atacgccatgctgggtctcctgtgcagggttgcccagtgacactccaagaggggaagatactcaatttgtcggttcatgcactagtcccatgggaaatcagggatatggcgtaaaagggtcgtacttgggagtcggccat

SEQ ID NO: 423928 - DNA, 140 bp, Artificial Sequence
  Synthetic
atggccgactcccaagtacgacccttttacgccatatccctgatttcccatgggactagtgcatgaaccgacaaattgagtatcttcccctcttggagtgtcactgggcaaccctgcacaggagacccagcatggcgtat

SEQ ID NO: 423929 - DNA, 140 bp, Artificial Sequence
  Synthetic
aggccctggctgctgatatgcggttcatgcactagtcccatgggaaatcagggatatggcgtaaaagggttcgggtttcgacagggaactgatgtgtgggtggggcggacaattagtcgagaccttttgggacagcggtg

SEQ ID NO: 423930 - DNA, 140 bp, Artificial Sequence
  Synthetic
caccgctgtcccaaaaggtctcgactaattgtccgccccacccacacatcagttccctgtcgaaacccgaacccttttacgccatatccctgatttcccatgggactagtgcatgaaccgcatatcagcagccagggcct

SEQ ID NO: 423931 - DNA, 140 bp, Artificial Sequence
  Synthetic
atacgccatgctgggtctccatagtagtttctctatgaagcaggacattatagcattgaatgattggtcaggatacagtggaagttttgtccaacatcctgaattaacaggaatgaattgcgtacttgggagtcggccat

SEQ ID NO: 423932 - DNA, 140 bp, Artificial Sequence
  Synthetic
atggccgactcccaagtacgcaattcattcctgttaattcaggatgttggacaaaacttccactgtatcctgaccaatcattcaatgctataatgtcctgcttcatagagaaactactatggagacccagcatggcgtat

SEQ ID NO: 423933 - DNA, 140 bp, Artificial Sequence
  Synthetic
atacgccatgctgggtctccgatccaaaacagcataaccatagaaaggatggttctctcggcatttgatgagaggagaaacaagtatctggaggagcatcccagtgctgggaaagatccccgtacttgggagtcggccat

SEQ ID NO: 423934 - DNA, 140 bp, Artificial Sequence
  Synthetic
atggccgactcccaagtacggggatctttcccagcactgggatgctcctccagatacttgtttctcctctcatcaaatgccgagagaaccatcctttctatggttatgctgttttggatcggagacccagcatggcgtat

SEQ ID NO: 423935 - DNA, 140 bp, Artificial Sequence
  Synthetic
atacgccatgctgggtctccaacaagcaaagaacagattagaagacaggtggttgttgataactcgaattggtcgggatacagtgggtctttcactttaccagtagaattgtctgggaggcgtacttgggagtcggccat

SEQ ID NO: 423936 - DNA, 140 bp, Artificial Sequence
  Synthetic
atggccgactcccaagtacgcctcccagacaattctactggtaaagtgaaagacccactgtatcccgaccaattcgagttatcaacaaccacctgtcttctaatctgttctttgcttgttggagacccagcatggcgtat

SEQ ID NO: 423937 - DNA, 140 bp, Artificial Sequence
  Synthetic
atacgccatgctgggtctccagagagaacaatctggacctctagtagctccattgtaatgtgtggagttgattatgaaattgccgattggtcatggcacgatggagctattcttccctttcgtacttgggagtcggccat

SEQ ID NO: 423938 - DNA, 140 bp, Artificial Sequence
  Synthetic
atggccgactcccaagtacgaaagggaagaatagctccatcgtgccatgaccaatcggcaatttcataatcaactccacacattacaatggagctactagaggtccagattgttctctctggagacccagcatggcgtat

SEQ ID NO: 423939 - DNA, 140 bp, Artificial Sequence
  Synthetic
atacgccatgctgggtctcccgaggagatctggggctgctggagcggcagtgaaaggggttggaacaatggtgatggaattgatccggatgatcaagcgagggatcaatgatcggaatttcgtacttgggagtcggccat

SEQ ID NO: 423940 - DNA, 140 bp, Artificial Sequence
  Synthetic
atggccgactcccaagtacgaaattccgatcattgatccctcgcttgatcatccggatcaattccatcaccattgttccaacccctttcactgccgctccagcagccccagatctcctcgggagacccagcatggcgtat

SEQ ID NO: 423941 - DNA, 140 bp, Artificial Sequence
  Synthetic
aggccctggctgctgatatggtgatggaattgatccggatgatcaagcgagggatcaatgatcggaatttctggagaggcgaaaatggacggagaactaggattgcctacgagagaatgtgaccttttgggacagcggtg

SEQ ID NO: 423942 - DNA, 140 bp, Artificial Sequence
  Synthetic
caccgctgtcccaaaaggtcacattctctcgtaggcaatcctagttctccgtccattttcgcctctccagaaattccgatcattgatccctcgcttgatcatccggatcaattccatcaccatatcagcagccagggcct

SEQ ID NO: 423943 - DNA, 140 bp, Artificial Sequence
  Synthetic
aggccctggctgctgatatgcaaaaccacatattggtgggacggactccaatcctctgatgattttgctctcatcgtaaatgcgccggatcatgagggaatacaagcaggagtggatagagaccttttgggacagcggtg

SEQ ID NO: 423944 - DNA, 140 bp, Artificial Sequence
  Synthetic
caccgctgtcccaaaaggtctctatccactcctgcttgtattccctcatgatccggcgcatttacgatgagagcaaaatcatcagaggattggagtccgtcccaccaatatgtggttttgcatatcagcagccagggcct

SEQ ID NO: 423945 - DNA, 140 bp, Artificial Sequence
  Synthetic
atacgccatgctgggtctccccagaacagcataacaatagaaagaatggttctctctgcatttgatgaaaggaggaacaagtacctggaagaacatcccagtgcggggaaggacccaaagcgtacttgggagtcggccat

SEQ ID NO: 423946 - DNA, 140 bp, Artificial Sequence
  Synthetic
atggccgactcccaagtacgctttgggtccttccccgcactgggatgttcttccaggtacttgttcctcctttcatcaaatgcagagagaaccattctttctattgttatgctgttctggggagacccagcatggcgtat

SEQ ID NO: 423947 - DNA, 140 bp, Artificial Sequence
  Synthetic
aggccctggctgctgatatggaccaagtgagggaaagccggaatcctgggaatgctgaaattgaagatctcatctttctcgcacgatctgctctcatcctgaggggatcagtggctcatagaccttttgggacagcggtg

SEQ ID NO: 423948 - DNA, 140 bp, Artificial Sequence
  Synthetic
caccgctgtcccaaaaggtctatgagccactgatcccctcaggatgagagcagatcgtgcgagaaagatgagatcttcaatttcagcattcccaggattccggctttccctcacttggtccatatcagcagccagggcct

SEQ ID NO: 423949 - DNA, 140 bp, Artificial Sequence
  Synthetic
aggccctggctgctgatatgtgatagggcaaggagacgtagtgttggtaatgaaacggaaacgggactctagcatacttactgacagccagacagcgaccaaaagaattcggatggccatgaccttttgggacagcggtg

SEQ ID NO: 423950 - DNA, 140 bp, Artificial Sequence
  Synthetic
caccgctgtcccaaaaggtcatggccatccgaattcttttggtcgctgtctggctgtcagtaagtatgctagagtcccgtttccgtttcattaccaacactacgtctccttgccctatcacatatcagcagccagggcct

SEQ ID NO: 423951 - DNA, 140 bp, Artificial Sequence
  Synthetic
atacgccatgctgggtctccgttgcatgctcccactctggagccaacagtttttatcggaatttactatggatagtaaagaaaggaaactcctatcctaagctcagcaattcatacacaacgtacttgggagtcggccat

SEQ ID NO: 423952 - DNA, 140 bp, Artificial Sequence
  Synthetic
atggccgactcccaagtacgttgtgtatgaattgctgagcttaggataggagtttcctttctttactatccatagtaaattccgataaaaactgttggctccagagtgggagcatgcaacggagacccagcatggcgtat

SEQ ID NO: 423953 - DNA, 140 bp, Artificial Sequence
  Synthetic
atacgccatgctgggtctcctccaacctgaatgatgccacatatcagaggacaagggctctcgtgcgcactggaatggatcccagaatgtgctctctgatgcaaggatcaactctcccaacgtacttgggagtcggccat

SEQ ID NO: 423954 - DNA, 140 bp, Artificial Sequence
  Synthetic
atggccgactcccaagtacgttgggagagttgatccttgcatcagagagcacattctgggatccattccagtgcgcacgagagcccttgtcctctgatatgtggcatcattcaggttggaggagacccagcatggcgtat

SEQ ID NO: 423955 - DNA, 140 bp, Artificial Sequence
  Synthetic
atacgccatgctgggtctccaccgacagtgaccaacaaaccctctaccagaataatcatacatatgtttcagttggatcatcaaaatactacaaaaggttcacaccagaaatagtagcaacgtacttgggagtcggccat

SEQ ID NO: 423956 - DNA, 140 bp, Artificial Sequence
  Synthetic
atggccgactcccaagtacgttgctactatttctggtgtgaaccttttgtagtattttgatgatccaactgaaacatatgtatgattattctggtagagggtttgttggtcactgtcggtggagacccagcatggcgtat

SEQ ID NO: 423957 - DNA, 140 bp, Artificial Sequence
  Synthetic
aggccctggctgctgatatggatctgagagtgtcaagcttcatcagaggaacaagagtagtcccaagaggacaactgtccaccagaggagttcagattgcttcaaatgagaacatggagagaccttttgggacagcggtg

SEQ ID NO: 423958 - DNA, 140 bp, Artificial Sequence
  Synthetic
caccgctgtcccaaaaggtctctccatgttctcatttgaagcaatctgaactcctctggtggacagttgtcctcttgggactactcttgttcctctgatgaagcttgacactctcagatccatatcagcagccagggcct

SEQ ID NO: 423959 - DNA, 140 bp, Artificial Sequence
  Synthetic
atacgccatgctgggtctccttgggatttgtattcacgctcaccgtgcccagtgagcgaggactgcagcgtagacgctttgtccagaatgccctaaatggaaatggagatccaaataatacgtacttgggagtcggccat

SEQ ID NO: 423960 - DNA, 140 bp, Artificial Sequence
  Synthetic
atggccgactcccaagtacgtattatttggatctccatttccatttagggcattctggacaaagcgtctacgctgcagtcctcgctcactgggcacggtgagcgtgaatacaaatcccaaggagacccagcatggcgtat

SEQ ID NO: 423961 - DNA, 140 bp, Artificial Sequence
  Synthetic
aggccctggctgctgatatgacaagaagcggaggaaacactaaccaacagagagcatctgcaggacaaatcagcgtacagcccacattctctgtgcagagaaacctcccattcgagagaggaccttttgggacagcggtg

SEQ ID NO: 423962 - DNA, 140 bp, Artificial Sequence
  Synthetic
caccgctgtcccaaaaggtcctctctcgaatgggaggtttctctgcacagagaatgtgggctgtacgctgatttgtcctgcagatgctctctgttggttagtgtttcctccgcttcttgtcatatcagcagccagggcct

SEQ ID NO: 423963 - DNA, 140 bp, Artificial Sequence
  Synthetic
atacgccatgctgggtctcccaaccatcatggcggcatttacaggaaacactgaaggcagaacttcagacatgagaactgagatcataaggatgatggaaaatgccagacctgaagatgtcgtacttgggagtcggccat

SEQ ID NO: 423964 - DNA, 140 bp, Artificial Sequence
  Synthetic
atggccgactcccaagtacgacatcttcaggtctggcattttccatcatccttatgatctcagttctcatgtctgaagttctgccttcagtgtttcctgtaaatgccgccatgatggttgggagacccagcatggcgtat

SEQ ID NO: 423965 - DNA, 140 bp, Artificial Sequence
  Synthetic
atacgccatgctgggtctcctttgagagagaaggatactctctggttggaatagaccctttccgtctgcttcaaaacagccaggtcttcagtctcattagaccaaatgaaaacccagcaccgtacttgggagtcggccat

SEQ ID NO: 423966 - DNA, 140 bp, Artificial Sequence
  Synthetic
atggccgactcccaagtacggtgctgggttttcatttggtctaatgagactgaagacctggctgttttgaagcagacggaaagggtctattccaaccagagagtatccttctctctcaaaggagacccagcatggcgtat

SEQ ID NO: 423967 - DNA, 140 bp, Artificial Sequence
  Synthetic
aggccctggctgctgatatgatgaagaaaacactgctccttgcagcaatcaccatctgcattcaagcagacgagatctgcatcgggtacctgagcaacaactcaacagaaaaagtggacagaccttttgggacagcggtg

SEQ ID NO: 423968 - DNA, 140 bp, Artificial Sequence
  Synthetic
caccgctgtcccaaaaggtctgtccactttttctgttgagttgttgctcaggtacccgatgcagatctcgtctgcttgaatgcagatggtgattgctgcaaggagcagtgttttcttcatcatatcagcagccagggcct

SEQ ID NO: 423969 - DNA, 140 bp, Artificial Sequence
  Synthetic
atacgccatgctgggtctccataaaagccagttggtatggatggcatgccattcagcagcgtttgaggacctgagggtatcaagtttcatcagagggacaagagtggtcccaagaggacacgtacttgggagtcggccat

SEQ ID NO: 423970 - DNA, 140 bp, Artificial Sequence
  Synthetic
atggccgactcccaagtacgtgtcctcttgggaccactcttgtccctctgatgaaacttgataccctcaggtcctcaaacgctgctgaatggcatgccatccataccaactggcttttatggagacccagcatggcgtat

SEQ ID NO: 423971 - DNA, 140 bp, Artificial Sequence
  Synthetic
aggccctggctgctgatatgaggcagatggtgcaggcaatgagaacaattgggactcatcctaactctagtgctggtctgagagataatcttcttgaaaatttgcaggcctaccagaaacgaccttttgggacagcggtg

SEQ ID NO: 423972 - DNA, 140 bp, Artificial Sequence
  Synthetic
caccgctgtcccaaaaggtcgtttctggtaggcctgcaaattttcaagaagattatctctcagaccagcactagagttaggatgagtcccaattgttctcattgcctgcaccatctgcctcatatcagcagccagggcct

SEQ ID NO: 423973 - DNA, 140 bp, Artificial Sequence
  Synthetic
aggccctggctgctgatatggaaaaaatgaacattcaatttacttcagtgggcaaggagttcaatagtctagagaaaaggatggaaaatttgaataagaaggttgatgatgggtttttaggaccttttgggacagcggtg

SEQ ID NO: 423974 - DNA, 140 bp, Artificial Sequence
  Synthetic
caccgctgtcccaaaaggtcctaaaaacccatcatcaaccttcttattcaaattttccatccttttctctagactattgaactccttgcccactgaagtaaattgaatgttcattttttccatatcagcagccagggcct

SEQ ID NO: 423975 - DNA, 140 bp, Artificial Sequence
  Synthetic
atacgccatgctgggtctcctggactccagcactcttgaattgagaagcagatactgggctataagaaccaggagtggaggaaacaccaaccaacagagagcttctgcaggacaaatcagcgtacttgggagtcggccat

SEQ ID NO: 423976 - DNA, 140 bp, Artificial Sequence
  Synthetic
atggccgactcccaagtacgctgatttgtcctgcagaagctctctgttggttggtgtttcctccactcctggttcttatagcccagtatctgcttctcaattcaagagtgctggagtccaggagacccagcatggcgtat

SEQ ID NO: 423977 - DNA, 140 bp, Artificial Sequence
  Synthetic
atacgccatgctgggtctccatgatttgattgggaaaacatcatggtcctacatcgtggagaaaccaaaccccatcaatggaatatgttatccgggtactctagaaaatgaagaggaattcgtacttgggagtcggccat

SEQ ID NO: 423978 - DNA, 140 bp, Artificial Sequence
  Synthetic
atggccgactcccaagtacgaattcctcttcattttctagagtacccggataacatattccattgatggggtttggtttctccacgatgtaggaccatgatgttttcccaatcaaatcatggagacccagcatggcgtat

SEQ ID NO: 423979 - DNA, 140 bp, Artificial Sequence
  Synthetic
atacgccatgctgggtctcccaacaaggaaaaaaattgagaagataaggccactcctaatagatggcacagcctcattaagtcctggaatgatgatgggcatgtttaacatgcttagcaccgtacttgggagtcggccat

SEQ ID NO: 423980 - DNA, 140 bp, Artificial Sequence
  Synthetic
atggccgactcccaagtacggtgctaagcatgttaaacatgcccatcatcattccaggacttaatgaggctgtgccatctattaggagtggccttatcttctcaatttttttccttgttgggagacccagcatggcgtat

SEQ ID NO: 423981 - DNA, 140 bp, Artificial Sequence
  Synthetic
atacgccatgctgggtctccgctgaatcttccgtcaaagagaaagacctgaccaaagaattctttgaaaacaaatcagaaacatggccaattggagaatcacccaagggagtggaggaagcgtacttgggagtcggccat

SEQ ID NO: 423982 - DNA, 140 bp, Artificial Sequence
  Synthetic
atggccgactcccaagtacgcttcctccactcccttgggtgattctccaattggccatgtttctgatttgttttcaaagaattctttggtcaggtctttctctttgacggaagattcagcggagacccagcatggcgtat

SEQ ID NO: 423983 - DNA, 140 bp, Artificial Sequence
  Synthetic
atacgccatgctgggtctcccttcaaatggatggggagcagtgaattctggtgctggtgttaccgcagcctgcaaatttggaagcagtaacgcctttttcaggaacatggtatggttgatcgtacttgggagtcggccat

SEQ ID NO: 423984 - DNA, 140 bp, Artificial Sequence
  Synthetic
atggccgactcccaagtacgatcaaccataccatgttcctgaaaaaggcgttactgcttccaaatttgcaggctgcggtaacaccagcaccagaattcactgctccccatccatttgaagggagacccagcatggcgtat

SEQ ID NO: 423985 - DNA, 140 bp, Artificial Sequence
  Synthetic
aggccctggctgctgatatgtgcaaatttggaagcagtaacgcctttttcaggaacatggtatggttgatccaccaatcagggacatatcctgttataaggaggacattcaataacaccagaccttttgggacagcggtg

SEQ ID NO: 423986 - DNA, 140 bp, Artificial Sequence
  Synthetic
caccgctgtcccaaaaggtctggtgttattgaatgtcctccttataacaggatatgtccctgattggtggatcaaccataccatgttcctgaaaaaggcgttactgcttccaaatttgcacatatcagcagccagggcct

SEQ ID NO: 423987 - DNA, 140 bp, Artificial Sequence
  Synthetic
atacgccatgctgggtctccggatcaatctgtatggtaattggaatagctagcttaatgttacaaattggaaacataatctcaatatgggtcagtcattcaattcagacagggaatcaatcgtacttgggagtcggccat

SEQ ID NO: 423988 - DNA, 140 bp, Artificial Sequence
  Synthetic
atggccgactcccaagtacgattgattccctgtctgaattgaatgactgacccatattgagattatgtttccaatttgtaacattaagctagctattccaattaccatacagattgatccggagacccagcatggcgtat

SEQ ID NO: 423989 - DNA, 140 bp, Artificial Sequence
  Synthetic
aggccctggctgctgatatgttcaatctgtcaaaatggagaaaatagtgcttcttcttgcagtggttagccttgttaaaagtgatcagatttgcattggttaccatgcaaacaactcaacgaccttttgggacagcggtg

SEQ ID NO: 423990 - DNA, 140 bp, Artificial Sequence
  Synthetic
caccgctgtcccaaaaggtcgttgagttgtttgcatggtaaccaatgcaaatctgatcacttttaacaaggctaaccactgcaagaagaagcactattttctccattttgacagattgaacatatcagcagccagggcct

SEQ ID NO: 423991 - DNA, 140 bp, Artificial Sequence
  Synthetic
atacgccatgctgggtctccaaggaacaccaagacttgtacaaaaaggacagttcttatgtagcagtaggatcagaaagttacaataggaggttcattcctgaaatcagtacaaggcctacgtacttgggagtcggccat

SEQ ID NO: 423992 - DNA, 140 bp, Artificial Sequence
  Synthetic
atggccgactcccaagtacgtaggccttgtactgatttcaggaatgaacctcctattgtaactttctgatcctactgctacataagaactgtcctttttgtacaagtcttggtgttccttggagacccagcatggcgtat

SEQ ID NO: 423993 - DNA, 140 bp, Artificial Sequence
  Synthetic
aggccctggctgctgatatgtctaccggtagcaggaggaacgagcagtgtttatattgaagtattgcatttgactcaaggaacctgctgggagcaaatgtacactccaggaggggaagtggaccttttgggacagcggtg

SEQ ID NO: 423994 - DNA, 140 bp, Artificial Sequence
  Synthetic
caccgctgtcccaaaaggtccacttcccctcctggagtgtacatttgctcccagcaggttccttgagtcaaatgcaatacttcaatataaacactgctcgttcctcctgctaccggtagacatatcagcagccagggcct

SEQ ID NO: 423995 - DNA, 140 bp, Artificial Sequence
  Synthetic
aggccctggctgctgatatgtatccgcaaacggtttgcagactggggacttggtgatgctccatttctcgatcggcttcgccgagatcagaagtccctaagagggagaagcagcactcttgaccttttgggacagcggtg

SEQ ID NO: 423996 - DNA, 140 bp, Artificial Sequence
  Synthetic
caccgctgtcccaaaaggtcaagagtgctgcttctccctcttagggacttctgatctcggcgaagccgatcgagaaatggagcatcaccaagtccccagtctgcaaaccgtttgcggatacatatcagcagccagggcct

SEQ ID NO: 423997 - DNA, 140 bp, Artificial Sequence
  Synthetic
aggccctggctgctgatatggtgaagcccctgattctaaaggattgtagcgtagctgggtggctccttggaaatccaatgtgcgacgagttcatcagggtgccggaatggtcttacatcggaccttttgggacagcggtg

SEQ ID NO: 423998 - DNA, 140 bp, Artificial Sequence
  Synthetic
caccgctgtcccaaaaggtccgatgtaagaccattccggcaccctgatgaactcgtcgcacattggatttccaaggagccacccagctacgctacaatcctttagaatcaggggcttcaccatatcagcagccagggcct

SEQ ID NO: 423999 - DNA, 140 bp, Artificial Sequence
  Synthetic
atacgccatgctgggtctccgacaaatggtgacaacaaccaacccgctaatcaggcatgagaacaggatggtactggccagtactacggctaaggccatggagcaaatggcagggtcaagcgtacttgggagtcggccat

SEQ ID NO: 424000 - DNA, 140 bp, Artificial Sequence
  Synthetic
atggccgactcccaagtacgcttgaccctgccatttgctccatggccttagccgtagtactggccagtaccatcctgttctcatgcctgattagcgggttggttgttgtcaccatttgtcggagacccagcatggcgtat

SEQ ID NO: 424001 - DNA, 140 bp, Artificial Sequence
  Synthetic
aggccctggctgctgatatgacttgagtattgagtcttgttcaactaagtgccagtccgaaattggagggataaacactaataggagcttccacaatgtccataggaacacaataggagagaccttttgggacagcggtg

SEQ ID NO: 424002 - DNA, 140 bp, Artificial Sequence
  Synthetic
caccgctgtcccaaaaggtctctcctattgtgttcctatggacattgtggaagctcctattagtgtttatccctccaatttcggactggcacttagttgaacaagactcaatactcaagtcatatcagcagccagggcct

SEQ ID NO: 424003 - DNA, 140 bp, Artificial Sequence
  Synthetic
atacgccatgctgggtctccgactatgaggaactgaaacacctattgagcagaataaatcattttgagaaaactctgatcatccccaagagttcttggcccaatcatgaaacatcattagcgtacttgggagtcggccat

SEQ ID NO: 424004 - DNA, 140 bp, Artificial Sequence
  Synthetic
atggccgactcccaagtacgctaatgatgtttcatgattgggccaagaactcttggggatgatcagagttttctcaaaatgatttattctgctcaataggtgtttcagttcctcatagtcggagacccagcatggcgtat

SEQ ID NO: 424005 - DNA, 140 bp, Artificial Sequence
  Synthetic
atacgccatgctgggtctccgaaatgttcctgcgatagcgacgagaggcctttttggtgcaatagctggtttcatagaaggtggttggccaggtctaatcaatggttggtatggattccacgtacttgggagtcggccat

SEQ ID NO: 424006 - DNA, 140 bp, Artificial Sequence
  Synthetic
atggccgactcccaagtacgtggaatccataccaaccattgattagacctggccaaccaccttctatgaaaccagctattgcaccaaaaaggcctctcgtcgctatcgcaggaacatttcggagacccagcatggcgtat

SEQ ID NO: 424007 - DNA, 140 bp, Artificial Sequence
  Synthetic
aggccctggctgctgatatggagccacacaaatgggaaaaatactgtgttcttgaaataggagacatgctcttgaggactgcgataggccaagtgtcgaggcccatgttcctatatgtgagaccttttgggacagcggtg

SEQ ID NO: 424008 - DNA, 140 bp, Artificial Sequence
  Synthetic
caccgctgtcccaaaaggtctcacatataggaacatgggcctcgacacttggcctatcgcagtcctcaagagcatgtctcctatttcaagaacacagtatttttcccatttgtgtggctccatatcagcagccagggcct

SEQ ID NO: 424009 - DNA, 140 bp, Artificial Sequence
  Synthetic
atacgccatgctgggtctccaggacatactgatgaggatgtcaaaaatgcaattgaggtcctcatcaaaggatttgaatggaatagtaacacagttcgagtctctgaagctctacagagacgtacttgggagtcggccat

SEQ ID NO: 424010 - DNA, 140 bp, Artificial Sequence
  Synthetic
atggccgactcccaagtacgtctctgtagagcttcagagactcgaactgtgttactattccattcaaatcctttgatgaggacctcaattgcatttttgacatcctcatcagtatgtcctggagacccagcatggcgtat

SEQ ID NO: 424011 - DNA, 140 bp, Artificial Sequence
  Synthetic
atacgccatgctgggtctcccgctgccttcttcagtctcttcagcagattgagagcatgattgaggccgagtcttctgtcaaagagaaagacatgaccaaggaattctttgaaaacaaatcgtacttgggagtcggccat

SEQ ID NO: 424012 - DNA, 140 bp, Artificial Sequence
  Synthetic
atggccgactcccaagtacgatttgttttcaaagaattccttggtcatgtctttctctttgacagaagactcggcctcaatcatgctctcaatctgctgaagagactgaagaaggcagcgggagacccagcatggcgtat

SEQ ID NO: 424013 - DNA, 140 bp, Artificial Sequence
  Synthetic
atacgccatgctgggtctccgatccctgggttttgcttaatgcatcttggttcaactccttcctcacacatgcactgaagtagttgtggcaatgctactatttgctatccatactgtccacgtacttgggagtcggccat

SEQ ID NO: 424014 - DNA, 140 bp, Artificial Sequence
  Synthetic
atggccgactcccaagtacgtggacagtatggatagcaaatagtagcattgccacaactacttcagtgcatgtgtgaggaaggagttgaaccaagatgcattaagcaaaacccagggatcggagacccagcatggcgtat

SEQ ID NO: 424015 - DNA, 140 bp, Artificial Sequence
  Synthetic
aggccctggctgctgatatggctgaaggacaatgctaaagatgaagggaacggttgttttaccttctatcacaagtgtgataatgagtgcattgagaaagtcaggaatggaacatatgacgaccttttgggacagcggtg

SEQ ID NO: 424016 - DNA, 140 bp, Artificial Sequence
  Synthetic
caccgctgtcccaaaaggtcgtcatatgttccattcctgactttctcaatgcactcattatcacacttgtgatagaaggtaaaacaaccgttcccttcatctttagcattgtccttcagccatatcagcagccagggcct

SEQ ID NO: 424017 - DNA, 140 bp, Artificial Sequence
  Synthetic
aggccctggctgctgatatgagggttttcatttaaatacggcaatggtgtttggatcgggagaaccaaaagcactaattccaggagcggctttgaaatgatttgggacccaaatgggtgggaccttttgggacagcggtg

SEQ ID NO: 424018 - DNA, 140 bp, Artificial Sequence
  Synthetic
caccgctgtcccaaaaggtcccacccatttgggtcccaaatcatttcaaagccgctcctggaattagtgcttttggttctcccgatccaaacaccattgccgtatttaaatgaaaaccctcatatcagcagccagggcct

SEQ ID NO: 424019 - DNA, 140 bp, Artificial Sequence
  Synthetic
atacgccatgctgggtctccctcaccatcggggaatgccccaaatacgtgaagtcaaacaaattagtccttgcgactgggctcagaaatagtcctctaagagaaagaagaagaaaaagagcgtacttgggagtcggccat

SEQ ID NO: 424020 - DNA, 140 bp, Artificial Sequence
  Synthetic
atggccgactcccaagtacgctctttttcttcttctttctcttagaggactatttctgagcccagtcgcaaggactaatttgtttgacttcacgtatttggggcattccccgatggtgagggagacccagcatggcgtat

SEQ ID NO: 424021 - DNA, 140 bp, Artificial Sequence
  Synthetic
aggccctggctgctgatatggctgcattgcaagcagtcttgtgttggcagcaatcattatggggttcatcctctgggcgtgcagcaatgggtcatgtagatgtaccatttgcatttagaagaccttttgggacagcggtg

SEQ ID NO: 424022 - DNA, 140 bp, Artificial Sequence
  Synthetic
caccgctgtcccaaaaggtcttctaaatgcaaatggtacatctacatgacccattgctgcacgcccagaggatgaaccccataatgattgctgccaacacaagactgcttgcaatgcagccatatcagcagccagggcct

SEQ ID NO: 424023 - DNA, 140 bp, Artificial Sequence
  Synthetic
atacgccatgctgggtctccccgagtggttcagaaacatcctgagcatggcacccataatgttctcaaacaaaatggcaagactagggaaagggtacatgttcgagagtaaaagaatgaacgtacttgggagtcggccat

SEQ ID NO: 424024 - DNA, 140 bp, Artificial Sequence
  Synthetic
atggccgactcccaagtacgttcattcttttactctcgaacatgtaccctttccctagtcttgccattttgtttgagaacattatgggtgccatgctcaggatgtttctgaaccactcggggagacccagcatggcgtat

SEQ ID NO: 424025 - DNA, 140 bp, Artificial Sequence
  Synthetic
atacgccatgctgggtctccttcatagaaggtggttggccaggattaataaatggttggtatggattccaacatcagaatgaacaaggaacgggcatagctgcagacaaagaatcaacaccgtacttgggagtcggccat

SEQ ID NO: 424026 - DNA, 140 bp, Artificial Sequence
  Synthetic
atggccgactcccaagtacggtgttgattctttgtctgcagctatgcccgttccttgttcattctgatgttggaatccataccaaccatttattaatcctggccaaccaccttctatgaaggagacccagcatggcgtat

SEQ ID NO: 424027 - DNA, 140 bp, Artificial Sequence
  Synthetic
aggccctggctgctgatatgggggtaaatggtgacactgttagttggtcttggccagacggtgctgagttgccattcactattgacaagtaatttattcaaaaaactccttgtttctactgaccttttgggacagcggtg

SEQ ID NO: 424028 - DNA, 140 bp, Artificial Sequence
  Synthetic
caccgctgtcccaaaaggtcagtagaaacaaggagttttttgaataaattacttgtcaatagtgaatggcaactcagcaccgtctggccaagaccaactaacagtgtcaccatttacccccatatcagcagccagggcct

SEQ ID NO: 424029 - DNA, 140 bp, Artificial Sequence
  Synthetic
aggccctggctgctgatatgaatacaccaagacaatatactggtgggatgggctccaatcatccgacgattttgctctcatagtgaatgcaccaaaccatgagggaatacaagcaggagtgaccttttgggacagcggtg

SEQ ID NO: 424030 - DNA, 140 bp, Artificial Sequence
  Synthetic
caccgctgtcccaaaaggtcactcctgcttgtattccctcatggtttggtgcattcactatgagagcaaaatcgtcggatgattggagcccatcccaccagtatattgtcttggtgtattcatatcagcagccagggcct

SEQ ID NO: 424031 - DNA, 140 bp, Artificial Sequence
  Synthetic
atacgccatgctgggtctccggaagacggattcctagatgtctggacttataatgctgaacttttagttctcatggaaaatgagagaactctagatttccatgactcaaatgtcaagaaccgtacttgggagtcggccat

SEQ ID NO: 424032 - DNA, 140 bp, Artificial Sequence
  Synthetic
atggccgactcccaagtacggttcttgacatttgagtcatggaaatctagagttctctcattttccatgagaactaaaagttcagcattataagtccagacatctaggaatccgtcttccggagacccagcatggcgtat

SEQ ID NO: 424033 - DNA, 140 bp, Artificial Sequence
  Synthetic
atacgccatgctgggtctcccagatagtggagaggattctggaggaagaatccgacgaggcactcaaaatgactattgcctctgtgcctgcttcacgctacctaactgacatgactcttgcgtacttgggagtcggccat

SEQ ID NO: 424034 - DNA, 140 bp, Artificial Sequence
  Synthetic
atggccgactcccaagtacgcaagagtcatgtcagttaggtagcgtgaagcaggcacagaggcaatagtcattttgagtgcctcgtcggattcttcctccagaatcctctccactatctgggagacccagcatggcgtat

SEQ ID NO: 424035 - DNA, 140 bp, Artificial Sequence
  Synthetic
atacgccatgctgggtctccctaatgtaaagaatctatacgataaggtcagaatgcagctgagggacaatgctaaggaaatagggaacggatgctttgagttttaccataaatgcgatgacgtacttgggagtcggccat

SEQ ID NO: 424036 - DNA, 140 bp, Artificial Sequence
  Synthetic
atggccgactcccaagtacgtcatcgcatttatggtaaaactcaaagcatccgttccctatttccttagcattgtccctcagctgcattctgaccttatcgtatagattctttacattagggagacccagcatggcgtat

SEQ ID NO: 424037 - DNA, 140 bp, Artificial Sequence
  Synthetic
aggccctggctgctgatatgtaatggttgtttcgagttctatcacaaatgtgataacgaatgtatggaaagcgtaagaaatgggacgtatgactaccctaagtattcagaagaagcaagagaccttttgggacagcggtg

SEQ ID NO: 424038 - DNA, 140 bp, Artificial Sequence
  Synthetic
caccgctgtcccaaaaggtctcttgcttcttctgaatacttagggtagtcatacgtcccatttcttacgctttccatacattcgttatcacatttgtgatagaactcgaaacaaccattacatatcagcagccagggcct

SEQ ID NO: 424039 - DNA, 140 bp, Artificial Sequence
  Synthetic
atacgccatgctgggtctccggctccctctgtatcagaatggaccaggcgattatggataagaacatcatactgaaggcaaacttcagtgtgatcttcgatcggctggagacactaataccgtacttgggagtcggccat

SEQ ID NO: 424040 - DNA, 140 bp, Artificial Sequence
  Synthetic
atggccgactcccaagtacggtattagtgtctccagccgatcgaagatcacactgaagtttgccttcagtatgatgttcttatccataatcgcctggtccattctgatacagagggagccggagacccagcatggcgtat

SEQ ID NO: 424041 - DNA, 140 bp, Artificial Sequence
  Synthetic
aggccctggctgctgatatgggggaaggacccgaagaaaactggaggtccaatttataagaggagagacggaaaatgggtaagagagctggttctgtatgacaaagaggagatcagaagggaccttttgggacagcggtg

SEQ ID NO: 424042 - DNA, 140 bp, Artificial Sequence
  Synthetic
caccgctgtcccaaaaggtcccttctgatctcctctttgtcatacagaaccagctctcttacccattttccgtctctcctcttataaattggacctccagttttcttcgggtccttcccccatatcagcagccagggcct

SEQ ID NO: 424043 - DNA, 140 bp, Artificial Sequence
  Synthetic
atacgccatgctgggtctccactggcaatcatagtggctggtctatctttatggatgtgctctaatgggtcgctacaatgcagaatttgcatctaaatttgtgagctcagattgtaattacgtacttgggagtcggccat

SEQ ID NO: 424044 - DNA, 140 bp, Artificial Sequence
  Synthetic
atggccgactcccaagtacgtaattacaatctgagctcacaaatttagatgcaaattctgcattgtagcgacccattagagcacatccataaagatagaccagccactatgattgccagtggagacccagcatggcgtat

SEQ ID NO: 424045 - DNA, 140 bp, Artificial Sequence
  Synthetic
aggccctggctgctgatatgtttctttggcatgtccgcaaacgatttgcagaccaagaactgggtgatgccccattccttgaccggcttcgccgagaccagaagtccctaagaggaagaggaccttttgggacagcggtg

SEQ ID NO: 424046 - DNA, 140 bp, Artificial Sequence
  Synthetic
caccgctgtcccaaaaggtcctcttcctcttagggacttctggtctcggcgaagccggtcaaggaatggggcatcacccagttcttggtctgcaaatcgtttgcggacatgccaaagaaacatatcagcagccagggcct

SEQ ID NO: 424047 - DNA, 140 bp, Artificial Sequence
  Synthetic
aggccctggctgctgatatgacgggcaacctccaaacactgaaaataagagtacatgaagggtatgaagaattcacaatggttgggagaagagcaacagctattctcagaaaggcaaccagaccttttgggacagcggtg

SEQ ID NO: 424048 - DNA, 140 bp, Artificial Sequence
  Synthetic
caccgctgtcccaaaaggtctggttgcctttctgagaatagctgttgctcttctcccaaccattgtgaattcttcatacccttcatgtactcttattttcagtgtttggaggttgcccgtcatatcagcagccagggcct

SEQ ID NO: 424049 - DNA, 140 bp, Artificial Sequence
  Synthetic
atacgccatgctgggtctcctattgcttctgtaccgacttcacgctacctaactgacatgactcttgaagaaatgtcaagagactggttcatgctcatgcccaagcagaaagtagcaggtcgtacttgggagtcggccat

SEQ ID NO: 424050 - DNA, 140 bp, Artificial Sequence
  Synthetic
atggccgactcccaagtacgacctgctactttctgcttgggcatgagcatgaaccagtctcttgacatttcttcaagagtcatgtcagttaggtagcgtgaagtcggtacagaagcaataggagacccagcatggcgtat

SEQ ID NO: 424051 - DNA, 140 bp, Artificial Sequence
  Synthetic
aggccctggctgctgatatgaagagcaatgatggatcaagtgagagagagcagaaatcctgggaatgctgaaattgaagatctcatttttctggcgcgatctgcactcattctaagaggagaccttttgggacagcggtg

SEQ ID NO: 424052 - DNA, 140 bp, Artificial Sequence
  Synthetic
caccgctgtcccaaaaggtctcctcttagaatgagtgcagatcgcgccagaaaaatgagatcttcaatttcagcattcccaggatttctgctctctctcacttgatccatcattgctcttcatatcagcagccagggcct

SEQ ID NO: 424053 - DNA, 140 bp, Artificial Sequence
  Synthetic
atacgccatgctgggtctccgaaagcaaacttcagtgtgatttttgatcggctggaaaccctaatattacttagagctttcacagaagaaggagcaattgtgggagaaatctcaccattacgtacttgggagtcggccat

SEQ ID NO: 424054 - DNA, 140 bp, Artificial Sequence
  Synthetic
atggccgactcccaagtacgtaatggtgagatttctcccacaattgctccttcttctgtgaaagctctaagtaatattagggtttccagccgatcaaaaatcacactgaagtttgctttcggagacccagcatggcgtat

SEQ ID NO: 424055 - DNA, 140 bp, Artificial Sequence
  Synthetic
aggccctggctgctgatatgagccatggaacaggaacaggatacaccatggacacagtcaacagaacgcatcaatactcagaaaagggaaagtggacaacaaacaccgagactggagcacgaccttttgggacagcggtg

SEQ ID NO: 424056 - DNA, 140 bp, Artificial Sequence
  Synthetic
caccgctgtcccaaaaggtcgtgctccagtctcggtgtttgttgtccactttcccttttctgagtattgatgcgttctgttgactgtgtccatggtgtatcctgttcctgttccatggctcatatcagcagccagggcct

SEQ ID NO: 424057 - DNA, 140 bp, Artificial Sequence
  Synthetic
atacgccatgctgggtctcctgaagattatcagggtaggttgtgtaatcctctgaacccgtttgttagtcacaaggaaatcgagtccgtaaacaatgctgtggtaatgcctgcccatggacgtacttgggagtcggccat

SEQ ID NO: 424058 - DNA, 140 bp, Artificial Sequence
  Synthetic
atggccgactcccaagtacgtccatgggcaggcattaccacagcattgtttacggactcgatttccttgtgactaacaaacgggttcagaggattacacaacctaccctgataatcttcaggagacccagcatggcgtat

SEQ ID NO: 424059 - DNA, 140 bp, Artificial Sequence
  Synthetic
atacgccatgctgggtctccattttgggcaaagaagacaagagatatggcccagcattaagcatcaatgaactgagcaatcttgcaaaaggagagaaggctaatgtgctaattgggcaagcgtacttgggagtcggccat

SEQ ID NO: 424060 - DNA, 140 bp, Artificial Sequence
  Synthetic
atggccgactcccaagtacgcttgcccaattagcacattagccttctctccttttgcaagattgctcagttcattgatgcttaatgctgggccatatctcttgtcttctttgcccaaaatggagacccagcatggcgtat

SEQ ID NO: 424061 - DNA, 140 bp, Artificial Sequence
  Synthetic
aggccctggctgctgatatgtggtcccaagaggacagctatccactagaggggttcaaattgcttcaaatgaaaacacggaagcaatggactccaacactcttgagctgagaagtagatagaccttttgggacagcggtg

SEQ ID NO: 424062 - DNA, 140 bp, Artificial Sequence
  Synthetic
caccgctgtcccaaaaggtctatctacttctcagctcaagagtgttggagtccattgcttccgtgttttcatttgaagcaatttgaacccctctagtggatagctgtcctcttgggaccacatatcagcagccagggcct

SEQ ID NO: 424063 - DNA, 140 bp, Artificial Sequence
  Synthetic
atacgccatgctgggtctccctgcaggacagataagcattcagcccactttctcggtacagagaaaccttcccttcgaaagagcgactattatggcagcattcacaggaagtactgagggcgtacttgggagtcggccat

SEQ ID NO: 424064 - DNA, 140 bp, Artificial Sequence
  Synthetic
atggccgactcccaagtacgccctcagtacttcctgtgaatgctgccataatagtcgctctttcgaagggaaggtttctctgtaccgagaaagtgggctgaatgcttatctgtcctgcagggagacccagcatggcgtat

SEQ ID NO: 424065 - DNA, 140 bp, Artificial Sequence
  Synthetic
aggccctggctgctgatatgggagtgctcctgttatcctgatgctagcgaggtagtgtgtgtatgcagagacaactggcatggttcgaatcgaccatgggtgtccttcaatcagaacttagaccttttgggacagcggtg

SEQ ID NO: 424066 - DNA, 140 bp, Artificial Sequence
  Synthetic
caccgctgtcccaaaaggtctaagttctgattgaaggacacccatggtcgattcgaaccatgccagttgtctctgcatacacacactacctcgctagcatcaggataacaggagcactcccatatcagcagccagggcct

SEQ ID NO: 424067 - DNA, 140 bp, Artificial Sequence
  Synthetic
atacgccatgctgggtctccgatcagatttgcattggttaccatgcaaacaactcgacagagcaggttgacacaataatggaaaagaacgtcactgttacacacgcccaagacatactggcgtacttgggagtcggccat

SEQ ID NO: 424068 - DNA, 140 bp, Artificial Sequence
  Synthetic
atggccgactcccaagtacgccagtatgtcttgggcgtgtgtaacagtgacgttcttttccattattgtgtcaacctgctctgtcgagttgtttgcatggtaaccaatgcaaatctgatcggagacccagcatggcgtat

SEQ ID NO: 424069 - DNA, 140 bp, Artificial Sequence
  Synthetic
aggccctggctgctgatatgattttaagagattgtagtgtagctggatggctcctcgggaacccaatgtgcgacgaattcctcaatgtgccggaatggtcttacatagtggagaagatcagaccttttgggacagcggtg

SEQ ID NO: 424070 - DNA, 140 bp, Artificial Sequence
  Synthetic
caccgctgtcccaaaaggtctgatcttctccactatgtaagaccattccggcacattgaggaattcgtcgcacattgggttcccgaggagccatccagctacactacaatctcttaaaatcatatcagcagccagggcct

SEQ ID NO: 424071 - DNA, 140 bp, Artificial Sequence
  Synthetic
atacgccatgctgggtctcccgacgaattcctcaatgtgccggaatggtcttacatagtggagaagatcaatccagccaatgacctctgttatccagggaatttcaacgactatgaagaacgtacttgggagtcggccat

SEQ ID NO: 424072 - DNA, 140 bp, Artificial Sequence
  Synthetic
atggccgactcccaagtacgttcttcatagtcgttgaaattccctggataacagaggtcattggctggattgatcttctccactatgtaagaccattccggcacattgaggaattcgtcgggagacccagcatggcgtat

SEQ ID NO: 424073 - DNA, 140 bp, Artificial Sequence
  Synthetic
atacgccatgctgggtctccggatatgcacaaacggattgtgtgttggaagcaatggctttccttgaagagtcccacccagggatctttgaaaactcatgtcttgaaacaatggaaattgcgtacttgggagtcggccat

SEQ ID NO: 424074 - DNA, 140 bp, Artificial Sequence
  Synthetic
atggccgactcccaagtacgcaatttccattgtttcaagacatgagttttcaaagatccctgggtgggactcttcaaggaaagccattgcttccaacacacaatccgtttgtgcatatccggagacccagcatggcgtat

SEQ ID NO: 424075 - DNA, 140 bp, Artificial Sequence
  Synthetic
aggccctggctgctgatatgtcccaaagattcttggtcagatcatgaagcctcaggagtgagctcagcatgtccataccagggaagatcctccttttttagaaatgtggtatggcttaccgaccttttgggacagcggtg

SEQ ID NO: 424076 - DNA, 140 bp, Artificial Sequence
  Synthetic
caccgctgtcccaaaaggtcggtaagccataccacatttctaaaaaaggaggatcttccctggtatggacatgctgagctcactcctgaggcttcatgatctgaccaagaatctttgggacatatcagcagccagggcct

SEQ ID NO: 424077 - DNA, 140 bp, Artificial Sequence
  Synthetic
atacgccatgctgggtctccgtccataccagggaagatcctccttttttagaaatgtggtatggcttaccaaaaagagcgatgcatacccaacaataaagaaaagttacaataataccaacgtacttgggagtcggccat

SEQ ID NO: 424078 - DNA, 140 bp, Artificial Sequence
  Synthetic
atggccgactcccaagtacgttggtattattgtaacttttctttattgttgggtatgcatcgctctttttggtaagccataccacatttctaaaaaaggaggatcttccctggtatggacggagacccagcatggcgtat

SEQ ID NO: 424079 - DNA, 140 bp, Artificial Sequence
  Synthetic
aggccctggctgctgatatgcagagcagacaaggctttatcaaaacccaactacctatatttccgttgggacatcaacactaaaccagagattggtacccaaaatagctactagatctaagaccttttgggacagcggtg

SEQ ID NO: 424080 - DNA, 140 bp, Artificial Sequence
  Synthetic
caccgctgtcccaaaaggtcttagatctagtagctattttgggtaccaatctctggtttagtgttgatgtcccaacggaaatataggtagttgggttttgataaagccttgtctgctctgcatatcagcagccagggcct

SEQ ID NO: 424081 - DNA, 140 bp, Artificial Sequence
  Synthetic
atacgccatgctgggtctccacatcaacactaaaccagagattggtacccaaaatagctactagatctaaggtaaacgggcaaagtggaaggatggagttcttttggacaattttaaaatcgtacttgggagtcggccat

SEQ ID NO: 424082 - DNA, 140 bp, Artificial Sequence
  Synthetic
atggccgactcccaagtacgattttaaaattgtccaaaagaactccatccttccactttgcccgtttaccttagatctagtagctattttgggtaccaatctctggtttagtgttgatgtggagacccagcatggcgtat

SEQ ID NO: 424083 - DNA, 140 bp, Artificial Sequence
  Synthetic
aggccctggctgctgatatgatgcgaacagaagttataagaatgatggaaagtgcaaagccagaagatttgtccttccaggggcggggagtcttcgagctctcggacgaaaaggcaacgagaccttttgggacagcggtg

SEQ ID NO: 424084 - DNA, 140 bp, Artificial Sequence
  Synthetic
caccgctgtcccaaaaggtctcgttgccttttcgtccgagagctcgaagactccccgcccctggaaggacaaatcttctggctttgcactttccatcattcttataacttctgttcgcatcatatcagcagccagggcct

SEQ ID NO: 424085 - DNA, 140 bp, Artificial Sequence
  Synthetic
aggccctggctgctgatatgaatgcatacaaaattgtcaagaaaggggactcaacaattatgaaaagtgagttggaatatagtaactgcaacaccaagtgtcagactccaataggggcgagaccttttgggacagcggtg

SEQ ID NO: 424086 - DNA, 140 bp, Artificial Sequence
  Synthetic
caccgctgtcccaaaaggtctcgcccctattggagtctgacacttggtgttgcagttactatattccaactcacttttcataattgttgagtcccctttcttgacaattttgtatgcattcatatcagcagccagggcct

SEQ ID NO: 424087 - DNA, 140 bp, Artificial Sequence
  Synthetic
aggccctggctgctgatatggtgggtacttggtgaaaacatggcacctgaaaaggtggattttgaggattgcaaagatatcagtgatttaaaacagtatgacagtgatgagccaaaattggaccttttgggacagcggtg

SEQ ID NO: 424088 - DNA, 140 bp, Artificial Sequence
  Synthetic
caccgctgtcccaaaaggtccaattttggctcatcactgtcatactgttttaaatcactgatatctttgcaatcctcaaaatccaccttttcaggtgccatgttttcaccaagtacccaccatatcagcagccagggcct

SEQ ID NO: 424089 - DNA, 140 bp, Artificial Sequence
  Synthetic
aggccctggctgctgatatgtgccccaaatatgtgaaatcaaatagattagtccttgctactgggctcagaaatagccctcaaggagagaaaagaagaaaaaagagaggactattcggaggaccttttgggacagcggtg

SEQ ID NO: 424090 - DNA, 140 bp, Artificial Sequence
  Synthetic
caccgctgtcccaaaaggtcctccgaatagtcctctcttttttcttcttttctctccttgagggctatttctgagcccagtagcaaggactaatctatttgatttcacatatttggggcacatatcagcagccagggcct

SEQ ID NO: 424091 - DNA, 140 bp, Artificial Sequence
  Synthetic
aggccctggctgctgatatgtgcctaaagctgccagaggccaatatagtggattcgtaagggtcctattccagcagatgcgtgacgtactggggacattcgacactgtccaaataataaagaccttttgggacagcggtg

SEQ ID NO: 424092 - DNA, 140 bp, Artificial Sequence
  Synthetic
caccgctgtcccaaaaggtctttattatttggacagtgtcgaatgtccccagtacgtcacgcatctgctggaataggacccttacgaatccactatattggcctctggcagctttaggcacatatcagcagccagggcct

SEQ ID NO: 424093 - DNA, 140 bp, Artificial Sequence
  Synthetic
atacgccatgctgggtctccatgaagaccgttattgctttaagttacatcttctgtctggctttcggtcaggacctcacagggaatgacaacagtacggcaacactgtgcctgggacacccgtacttgggagtcggccat

SEQ ID NO: 424094 - DNA, 140 bp, Artificial Sequence
  Synthetic
atggccgactcccaagtacgggtgtcccaggcacagtgttgccgtactgttgtcattccctgtgaggtcctgaccgaaagccagacagaagatgtaacttaaagcaataacggtcttcatggagacccagcatggcgtat

SEQ ID NO: 424095 - DNA, 140 bp, Artificial Sequence
  Synthetic
atacgccatgctgggtctccgaatccggaaggattaagaaggaggagtttgctgagatcatgaagatctgttccaccattgaagaactcagacggcagaagtagtgaattttgcttgtcccgtacttgggagtcggccat

SEQ ID NO: 424096 - DNA, 140 bp, Artificial Sequence
  Synthetic
atggccgactcccaagtacgggacaagcaaaattcactacttctgccgtctgagttcttcaatggtggaacagatcttcatgatctcagcaaactcctccttcttaatccttccggattcggagacccagcatggcgtat

SEQ ID NO: 424097 - DNA, 140 bp, Artificial Sequence
  Synthetic
aggccctggctgctgatatgcgagttctatcacagatgtgataatgaatgtatggaaagtgtaagaaacggaacgtatgactaccctcaatattcagaagaagcaagattaaaaagagaggaccttttgggacagcggtg

SEQ ID NO: 424098 - DNA, 140 bp, Artificial Sequence
  Synthetic
caccgctgtcccaaaaggtcctctctttttaatcttgcttcttctgaatattgagggtagtcatacgttccgtttcttacactttccatacattcattatcacatctgtgatagaactcgcatatcagcagccagggcct

SEQ ID NO: 424099 - DNA, 140 bp, Artificial Sequence
  Synthetic
atacgccatgctgggtctccatggaactgattcggatgataaaacgagggatcaacgaccggaatttctggagaggcgaaaatggaagaagaacaagaattgcatacgagagaatgtgcacgtacttgggagtcggccat

SEQ ID NO: 424100 - DNA, 140 bp, Artificial Sequence
  Synthetic
atggccgactcccaagtacgtgcacattctctcgtatgcaattcttgttcttcttccattttcgcctctccagaaattccggtcgttgatccctcgttttatcatccgaatcagttccatggagacccagcatggcgtat

SEQ ID NO: 424101 - DNA, 140 bp, Artificial Sequence
  Synthetic
atacgccatgctgggtctccgtctatttttatggatgtgctccaatggatcgctacaatgcagaatttgcatttaaatttgtgagttcaaattgtagttaaaaacacccttgtttctactcgtacttgggagtcggccat

SEQ ID NO: 424102 - DNA, 140 bp, Artificial Sequence
  Synthetic
atggccgactcccaagtacgagtagaaacaagggtgtttttaactacaatttgaactcacaaatttaaatgcaaattctgcattgtagcgatccattggagcacatccataaaaatagacggagacccagcatggcgtat

SEQ ID NO: 424103 - DNA, 140 bp, Artificial Sequence
  Synthetic
aggccctggctgctgatatgctttctttggcatgtccgcaaacgatttgcagaccaagaactgggtgatgccccattccttgatcggcttcgtagagatcagaaatccctaaaaggaagagaccttttgggacagcggtg

SEQ ID NO: 424104 - DNA, 140 bp, Artificial Sequence
  Synthetic
caccgctgtcccaaaaggtctcttccttttagggatttctgatctctacgaagccgatcaaggaatggggcatcacccagttcttggtctgcaaatcgtttgcggacatgccaaagaaagcatatcagcagccagggcct

SEQ ID NO: 424105 - DNA, 140 bp, Artificial Sequence
  Synthetic
atacgccatgctgggtctccccagctaagagcatggaatatgatgctgttgcaactacacattcttggattcctaaaaggaaccgttccattctcaataccagccaaaggggaattcttgcgtacttgggagtcggccat

SEQ ID NO: 424106 - DNA, 140 bp, Artificial Sequence
  Synthetic
atggccgactcccaagtacgcaagaattcccctttggctggtattgagaatggaacggttccttttaggaatccaagaatgtgtagttgcaacagcatcatattccatgctcttagctggggagacccagcatggcgtat

SEQ ID NO: 424107 - DNA, 140 bp, Artificial Sequence
  Synthetic
atacgccatgctgggtctccatggagagaataaaagaattaagagatctaatgttgcaatcccgcactcgcgagatactaacaaaaaccactgtagaccatatggccataatcaaaaaatcgtacttgggagtcggccat

SEQ ID NO: 424108 - DNA, 140 bp, Artificial Sequence
  Synthetic
atggccgactcccaagtacgattttttgattatggccatatggtctacagtggtttttgttagtatctcgcgagtgcgggattgcaacattagatctcttaattcttttattctctccatggagacccagcatggcgtat

SEQ ID NO: 424109 - DNA, 140 bp, Artificial Sequence
  Synthetic
atacgccatgctgggtctcctggtttatgctcatgcccaagcagaaagtgacaggttccctttgcatcaaaatggaccaggcaataatggataagaccataatattgaaagcaaacttcacgtacttgggagtcggccat

SEQ ID NO: 424110 - DNA, 140 bp, Artificial Sequence
  Synthetic
atggccgactcccaagtacgtgaagtttgctttcaatattatggtcttatccattattgcctggtccattttgatgcaaagggaacctgtcactttctgcttgggcatgagcataaaccaggagacccagcatggcgtat

SEQ ID NO: 424111 - DNA, 140 bp, Artificial Sequence
  Synthetic
aggccctggctgctgatatgtattggagtcaagagtctcaagctagcaataggtctgagaaacgtgcctgccaagtcaaagagaggactatttggagccatagctggattcatagaaggagaccttttgggacagcggtg

SEQ ID NO: 424112 - DNA, 140 bp, Artificial Sequence
  Synthetic
caccgctgtcccaaaaggtctccttctatgaatccagctatggctccaaatagtcctctctttgacttggcaggcacgtttctcagacctattgctagcttgagactcttgactccaatacatatcagcagccagggcct

SEQ ID NO: 424113 - DNA, 140 bp, Artificial Sequence
  Synthetic
atacgccatgctgggtctccacctagagaaagccaacaaaataaaatctgagaagacacacattcacatcttttcattcactggagaggagatggccaccaaagcggactacacccttgacgtacttgggagtcggccat

SEQ ID NO: 424114 - DNA, 140 bp, Artificial Sequence
  Synthetic
atggccgactcccaagtacgtcaagggtgtagtccgctttggtggccatctcctctccagtgaatgaaaagatgtgaatgtgtgtcttctcagattttattttgttggctttctctaggtggagacccagcatggcgtat

SEQ ID NO: 424115 - DNA, 140 bp, Artificial Sequence
  Synthetic
atacgccatgctgggtctccatgaatccaaatcaaaagataataacgattggctctgtttctctcaccatttccacaatatgcttcttcatgcaaattgccatcttaataactactgtaacgtacttgggagtcggccat

SEQ ID NO: 424116 - DNA, 140 bp, Artificial Sequence
  Synthetic
atggccgactcccaagtacgttacagtagttattaagatggcaatttgcatgaagaagcatattgtggaaatggtgagagaaacagagccaatcgttattatcttttgatttggattcatggagacccagcatggcgtat

SEQ ID NO: 424117 - DNA, 140 bp, Artificial Sequence
  Synthetic
atacgccatgctgggtctccgcttggagaagcattgatgaggatgggagacttccactcccttcagatcagaaacggaaaatggcgagagcaattgagtcagaagtttgaagaaataagacgtacttgggagtcggccat

SEQ ID NO: 424118 - DNA, 140 bp, Artificial Sequence
  Synthetic
atggccgactcccaagtacgtcttatttcttcaaacttctgactcaattgctctcgccattttccgtttctgatctgaagggagtggaagtctcccatcctcatcaatgcttctccaagcggagacccagcatggcgtat

SEQ ID NO: 424119 - DNA, 140 bp, Artificial Sequence
  Synthetic
atacgccatgctgggtctccgagagtatgattgaggctgagtcttctgtcaaagagaaagacatgaccaaggaattctttgaaaacaaatcggaaacatggccaatcggagaatcacccacgtacttgggagtcggccat

SEQ ID NO: 424120 - DNA, 140 bp, Artificial Sequence
  Synthetic
atggccgactcccaagtacgtgggtgattctccgattggccatgtttccgatttgttttcaaagaattccttggtcatgtctttctctttgacagaagactcagcctcaatcatactctcggagacccagcatggcgtat

SEQ ID NO: 424121 - DNA, 140 bp, Artificial Sequence
  Synthetic
atacgccatgctgggtctcccaatgattgtcgagcttgcggaaaaggcaatgaaagaatatggggaagatccgaaaattgaaacgaacaaatttgctgcaatatgcacacacttggaggtcgtacttgggagtcggccat

SEQ ID NO: 424122 - DNA, 140 bp, Artificial Sequence
  Synthetic
atggccgactcccaagtacgacctccaagtgtgtgcatattgcagcaaatttgttcgtttcaattttcggatcttccccatattctttcattgccttttccgcaagctcgacaatcattgggagacccagcatggcgtat

SEQ ID NO: 424123 - DNA, 140 bp, Artificial Sequence
  Synthetic
atacgccatgctgggtctccatgttgccccgattgaacatatcgcaagcatgaggaggaactattttacagcagaagtgtcccactgcagggctactgaatacataatgaagggagtgtacgtacttgggagtcggccat

SEQ ID NO: 424124 - DNA, 140 bp, Artificial Sequence
  Synthetic
atggccgactcccaagtacgtacactcccttcattatgtattcagtagccctgcagtgggacacttctgctgtaaaatagttcctcctcatgcttgcgatatgttcaatcggggcaacatggagacccagcatggcgtat

SEQ ID NO: 424125 - DNA, 140 bp, Artificial Sequence
  Synthetic
aggccctggctgctgatatgaactatgcgcaaacttgccgaccaaagtctcccaccgaacttctccagccttgaaaactttagagcctatgtagatggattcgagccgaacggctgcattgaccttttgggacagcggtg

SEQ ID NO: 424126 - DNA, 140 bp, Artificial Sequence
  Synthetic
caccgctgtcccaaaaggtcaatgcagccgttcggctcgaatccatctacataggctctaaagttttcaaggctggagaagttcggtgggagactttggtcggcaagtttgcgcatagttcatatcagcagccagggcct

SEQ ID NO: 424127 - DNA, 140 bp, Artificial Sequence
  Synthetic
atacgccatgctgggtctccgagcgcttcaggaaaagctgatactaaaatactattcgttgaggaggggaagatcgttcatattagcacattgtcaggaagtgctcagcatgttgaggagcgtacttgggagtcggccat

SEQ ID NO: 424128 - DNA, 140 bp, Artificial Sequence
  Synthetic
atggccgactcccaagtacgctcctcaacatgctgagcacttcctgacaatgtgctaatatgaacgatcttcccctcctcaacgaatagtattttagtatcagcttttcctgaagcgctcggagacccagcatggcgtat

SEQ ID NO: 424129 - DNA, 140 bp, Artificial Sequence
  Synthetic
atacgccatgctgggtctccatgaatccaaatcagaagatagtagcaattggctctacttctctaatcattgcgataatatgttttctcatgcaggttgccatcttaacaacgaccatgacgtacttgggagtcggccat

SEQ ID NO: 424130 - DNA, 140 bp, Artificial Sequence
  Synthetic
atggccgactcccaagtacgtcatggtcgttgttaagatggcaacctgcatgagaaaacatattatcgcaatgattagagaagtagagccaattgctactatcttctgatttggattcatggagacccagcatggcgtat

SEQ ID NO: 424131 - DNA, 140 bp, Artificial Sequence
  Synthetic
aggccctggctgctgatatgcaaatcggaaacatggccaatcggagagtcacccaggggagtggaggaaggctctattgggaaagtgtgcaggaccttactggcaaaatctgtattcaacgaccttttgggacagcggtg

SEQ ID NO: 424132 - DNA, 140 bp, Artificial Sequence
  Synthetic
caccgctgtcccaaaaggtcgttgaatacagattttgccagtaaggtcctgcacactttcccaatagagccttcctccactcccctgggtgactctccgattggccatgtttccgatttgcatatcagcagccagggcct

SEQ ID NO: 424133 - DNA, 140 bp, Artificial Sequence
  Synthetic
aggccctggctgctgatatgatttcaatgaatcaacaaggaagaaaattgagaaaataaggcctctcctaatagatggcacagcatcattgagccctgggatgatgatgggcatgttcaagaccttttgggacagcggtg

SEQ ID NO: 424134 - DNA, 140 bp, Artificial Sequence
  Synthetic
caccgctgtcccaaaaggtcttgaacatgcccatcatcatcccagggctcaatgatgctgtgccatctattaggagaggccttattttctcaattttcttccttgttgattcattgaaatcatatcagcagccagggcct

SEQ ID NO: 424135 - DNA, 140 bp, Artificial Sequence
  Synthetic
aggccctggctgctgatatgcacaggatttgcacctttttccaaggacaattcaattcggctctctgcaggtggggccatttgggtcacgagagaaccttatgtgtcatgcgatcctaacgaccttttgggacagcggtg

SEQ ID NO: 424136 - DNA, 140 bp, Artificial Sequence
  Synthetic
caccgctgtcccaaaaggtcgttaggatcgcatgacacataaggttctctcgtgacccaaatggccccacctgcagagagccgaattgaattgtccttggaaaaaggtgcaaatcctgtgcatatcagcagccagggcct

SEQ ID NO: 424137 - DNA, 140 bp, Artificial Sequence
  Synthetic
atacgccatgctgggtctccataattgaaggaagagaccgaacgatggcctggactgtggtaaatagtgtttgcaacaccacaggagtcgagaaacctaaatttctcccagatttgtatgcgtacttgggagtcggccat

SEQ ID NO: 424138 - DNA, 140 bp, Artificial Sequence
  Synthetic
atggccgactcccaagtacgcatacaaatctgggagaaatttaggtttctcgactcctgtggtgttgcaaacactatttaccacagtccaggccatcgttcggtctcttccttcaattatggagacccagcatggcgtat

SEQ ID NO: 424139 - DNA, 140 bp, Artificial Sequence
  Synthetic
atacgccatgctgggtctcccgcgggccaaatcagtgtgcaacctacattctcagtgcaacggaatctcccttttgaacgagcaaccgttttggcagctttcagtgggaacaatgaaggacgtacttgggagtcggccat

SEQ ID NO: 424140 - DNA, 140 bp, Artificial Sequence
  Synthetic
atggccgactcccaagtacgtccttcattgttcccactgaaagctgccaaaacggttgctcgttcaaaagggagattccgttgcactgagaatgtaggttgcacactgatttggcccgcgggagacccagcatggcgtat

SEQ ID NO: 424141 - DNA, 140 bp, Artificial Sequence
  Synthetic
atacgccatgctgggtctccgctatcctttacaattactggagacaataccaagtggaacgagaatcagaatcctcggatttttttggcaatgataacatatatcacaagaaatcaacctcgtacttgggagtcggccat

SEQ ID NO: 424142 - DNA, 140 bp, Artificial Sequence
  Synthetic
atggccgactcccaagtacgaggttgatttcttgtgatatatgttatcattgccaaaaaaatccgaggattctgattctcgttccacttggtattgtctccagtaattgtaaaggatagcggagacccagcatggcgtat

SEQ ID NO: 424143 - DNA, 140 bp, Artificial Sequence
  Synthetic
aggccctggctgctgatatgatggagagaataaagggacttagggatttgatgtcgcagtcttgcactcgcgagatactgccaaaaaccacagtggaccacatggccataattaagaaatgaccttttgggacagcggtg

SEQ ID NO: 424144 - DNA, 140 bp, Artificial Sequence
  Synthetic
caccgctgtcccaaaaggtcatttcttaattatggccatgtggtccactgtggtttttggcagtatctcgcgagtgcaagactgcgacatcaaatccctaagtccctttattctctccatcatatcagcagccagggcct

SEQ ID NO: 424145 - DNA, 140 bp, Artificial Sequence
  Synthetic
atacgccatgctgggtctccttcaaatgacacaatacatgatagaaccccttttagaaccctgttaatgaatgaattaggtgttccatttcatttgggaaccagacaagtatgtatagcacgtacttgggagtcggccat

SEQ ID NO: 424146 - DNA, 140 bp, Artificial Sequence
  Synthetic
atggccgactcccaagtacgtgctatacatacttgtctggttcccaaatgaaatggaacacctaattcattcattaacagggttctaaaaggggttctatcatgtattgtgtcatttgaaggagacccagcatggcgtat

SEQ ID NO: 424147 - DNA, 140 bp, Artificial Sequence
  Synthetic
atacgccatgctgggtctccagttttgggagtttcgattctaaatctagggcaaaagaggtacaccaaaacaacatactggtgggacggactccaatcctctgatgactttgctctcatacgtacttgggagtcggccat

SEQ ID NO: 424148 - DNA, 140 bp, Artificial Sequence
  Synthetic
atggccgactcccaagtacgtatgagagcaaagtcatcagaggattggagtccgtcccaccagtatgttgttttggtgtacctcttttgccctagatttagaatcgaaactcccaaaactggagacccagcatggcgtat

SEQ ID NO: 424149 - DNA, 140 bp, Artificial Sequence
  Synthetic
atacgccatgctgggtctccttgaagtgctgcacttaactcagggaacatgctgggagcaaatgtacactccaggaggagaagtgagaaatgatgatgttgaccaaagtttgattatcgccgtacttgggagtcggccat

SEQ ID NO: 424150 - DNA, 140 bp, Artificial Sequence
  Synthetic
atggccgactcccaagtacggcgataatcaaactttggtcaacatcatcatttctcacttctcctcctggagtgtacatttgctcccagcatgttccctgagttaagtgcagcacttcaaggagacccagcatggcgtat

SEQ ID NO: 424151 - DNA, 140 bp, Artificial Sequence
  Synthetic
aggccctggctgctgatatggacatccttagacagaacccaacagaggaacaagccgtggacatatgcaaggcagcaatggggctgagggttagctcctctttcagctttggtgggttcagaccttttgggacagcggtg

SEQ ID NO: 424152 - DNA, 140 bp, Artificial Sequence
  Synthetic
caccgctgtcccaaaaggtctgaacccaccaaagctgaaagaggagctaaccctcagccccattgctgccttgcatatgtccacggcttgttcctctgttgggttctgtctaaggatgtccatatcagcagccagggcct

SEQ ID NO: 424153 - DNA, 140 bp, Artificial Sequence
  Synthetic
aggccctggctgctgatatgggagattgatccagttaatagtaagtgggagagacgatcaatcgattgctgaggcaataattgtggccatggtattttcacaagaggattgcatgatcaagaccttttgggacagcggtg

SEQ ID NO: 424154 - DNA, 140 bp, Artificial Sequence
  Synthetic
caccgctgtcccaaaaggtcttgatcatgcaatcctcttgtgaaaataccatggccacaattattgcctcagcaatcgattgatcgtctctcccacttactattaactggatcaatctcccatatcagcagccagggcct

SEQ ID NO: 424155 - DNA, 140 bp, Artificial Sequence
  Synthetic
aggccctggctgctgatatggagggggaaggcataccactatatgatgcaatcaaatgcatgaagacttttttcggctggaaagagcccaacatcgtaaaaccacatgaaaagggcataagaccttttgggacagcggtg

SEQ ID NO: 424156 - DNA, 140 bp, Artificial Sequence
  Synthetic
caccgctgtcccaaaaggtcttatgcccttttcatgtggttttacgatgttgggctctttccagccgaaaaaagtcttcatgcatttgattgcatcatatagtggtatgccttccccctccatatcagcagccagggcct

SEQ ID NO: 424157 - DNA, 140 bp, Artificial Sequence
  Synthetic
aggccctggctgctgatatgatgcgaattgacagattcgagttggattgaacttgatgaaataggagaagatgtcgctccaattgagcacattgcaagtatgagaagaaactatttcacagaccttttgggacagcggtg

SEQ ID NO: 424158 - DNA, 140 bp, Artificial Sequence
  Synthetic
caccgctgtcccaaaaggtctgtgaaatagtttcttctcatacttgcaatgtgctcaattggagcgacatcttctcctatttcatcaagttcaatccaactcgaatctgtcaattcgcatcatatcagcagccagggcct

SEQ ID NO: 424159 - DNA, 140 bp, Artificial Sequence
  Synthetic
aggccctggctgctgatatgtagcagccgatcaggattcgaggtgatcaaggtctcaaatggttggatcaattcgaacaatcaagcaaaggcagttactcaaacacttgtttccaataatgaccttttgggacagcggtg

SEQ ID NO: 424160 - DNA, 140 bp, Artificial Sequence
  Synthetic
caccgctgtcccaaaaggtcattattggaaacaagtgtttgagtaactgcctttgcttgattgttcgaattgatccaaccatttgagaccttgatcacctcgaatcctgatcggctgctacatatcagcagccagggcct

SEQ ID NO: 424161 - DNA, 140 bp, Artificial Sequence
  Synthetic
aggccctggctgctgatatgacacccttgatgaagagagtagggcaagaatcaaaaccaggctgttcacaataagacaggaaatggccagtaggggtctatgggattcctttcgtcaatcgaccttttgggacagcggtg

SEQ ID NO: 424162 - DNA, 140 bp, Artificial Sequence
  Synthetic
caccgctgtcccaaaaggtcgattgacgaaaggaatcccatagacccctactggccatttcctgtcttattgtgaacagcctggttttgattcttgccctactctcttcatcaagggtgtcatatcagcagccagggcct

SEQ ID NO: 424163 - DNA, 140 bp, Artificial Sequence
  Synthetic
atacgccatgctgggtctccggctggaaccacacaagtgggaaaagtactgtgttcttgaaataggagacatgctattacgaactgcaataggccaggtgtcaagacccatgttcctgtacgtacttgggagtcggccat

SEQ ID NO: 424164 - DNA, 140 bp, Artificial Sequence
  Synthetic
atggccgactcccaagtacgtacaggaacatgggtcttgacacctggcctattgcagttcgtaatagcatgtctcctatttcaagaacacagtacttttcccacttgtgtggttccagccggagacccagcatggcgtat

SEQ ID NO: 424165 - DNA, 140 bp, Artificial Sequence
  Synthetic
aggccctggctgctgatatggatattgcctgatatggccccaagcacggaaatgtcgctgagaggtataagagtcagcaaaatgggggtagatgagtattccagcacggagagagtggtagaccttttgggacagcggtg

SEQ ID NO: 424166 - DNA, 140 bp, Artificial Sequence
  Synthetic
caccgctgtcccaaaaggtctaccactctctccgtgctggaatactcatctacccccattttgctgactcttatacctctcagcgacatttccgtgcttggggccatatcaggcaatatccatatcagcagccagggcct

SEQ ID NO: 424167 - DNA, 140 bp, Artificial Sequence
  Synthetic
aggccctggctgctgatatgtgcaaaatgctataagtaccacgttcccttatactggagaccctccatacagccatggaacaggaacaggatacaccatggacacagtcaacagaacacagaccttttgggacagcggtg

SEQ ID NO: 424168 - DNA, 140 bp, Artificial Sequence
  Synthetic
caccgctgtcccaaaaggtctgtgttctgttgactgtgtccatggtgtatcctgttcctgttccatggctgtatggagggtctccagtataagggaacgtggtacttatagcattttgcacatatcagcagccagggcct

SEQ ID NO: 424169 - DNA, 140 bp, Artificial Sequence
  Synthetic
atacgccatgctgggtctcccgagacgtcacgcttagggtatgaaaccttcaaagtcattgaaggctggtccaaccctaagtccaaattgcagataaataggcaagtcatagttgacagacgtacttgggagtcggccat

SEQ ID NO: 424170 - DNA, 140 bp, Artificial Sequence
  Synthetic
atggccgactcccaagtacgtctgtcaactatgacttgcctatttatctgcaatttggacttagggttggaccagccttcaatgactttgaaggtttcataccctaagcgtgacgtctcgggagacccagcatggcgtat

SEQ ID NO: 424171 - DNA, 140 bp, Artificial Sequence
  Synthetic
aggccctggctgctgatatgtgagaagagcaacagtgtcagcagacccactagcatctctattggagatgtgccacagcacacagattggagggataaggatggtagacattcttcggcagaccttttgggacagcggtg

SEQ ID NO: 424172 - DNA, 140 bp, Artificial Sequence
  Synthetic
caccgctgtcccaaaaggtctgccgaagaatgtctaccatccttatccctccaatctgtgtgctgtggcacatctccaatagagatgctagtgggtctgctgacactgttgctcttctcacatatcagcagccagggcct

SEQ ID NO: 424173 - DNA, 140 bp, Artificial Sequence
  Synthetic
atacgccatgctgggtctccgggtatgcacaaacggattgtgtattggaagcaatggctttccttgaagaatctcatccagggatttttgaaaactcgtgtctcgaaacgatggaaattgcgtacttgggagtcggccat

SEQ ID NO: 424174 - DNA, 140 bp, Artificial Sequence
  Synthetic
atggccgactcccaagtacgcaatttccatcgtttcgagacacgagttttcaaaaatccctggatgagattcttcaaggaaagccattgcttccaatacacaatccgtttgtgcatacccggagacccagcatggcgtat

SEQ ID NO: 424175 - DNA, 140 bp, Artificial Sequence
  Synthetic
atacgccatgctgggtctccatgccatgtgaaccgatcataatagagaggaacacagtgcatttgaatagtactaccatagagagggaaatttgtcctaaagtagcagaatacaagaattcgtacttgggagtcggccat

SEQ ID NO: 424176 - DNA, 140 bp, Artificial Sequence
  Synthetic
atggccgactcccaagtacgaattcttgtattctgctactttaggacaaatttccctctctatggtagtactattcaaatgcactgtgttcctctctattatgatcggttcacatggcatggagacccagcatggcgtat

SEQ ID NO: 424177 - DNA, 140 bp, Artificial Sequence
  Synthetic
atacgccatgctgggtctccttgtagacagtattagttcatggtctaaaaacatactccggactcaggaatcagagtgtgtttgtatcaatggaatctgcacagtggtgatgactgatggcgtacttgggagtcggccat

SEQ ID NO: 424178 - DNA, 140 bp, Artificial Sequence
  Synthetic
atggccgactcccaagtacgccatcagtcatcaccactgtgcagattccattgatacaaacacactctgattcctgagtccggagtatgtttttagaccatgaactaatactgtctacaaggagacccagcatggcgtat

SEQ ID NO: 424179 - DNA, 140 bp, Artificial Sequence
  Synthetic
aggccctggctgctgatatgattacaacacatttccagaggaagaggagagtgagggacaacatgaccaagaaaatggtcacacagagaacaatagggaagaaaaaacaaagactgaacagaccttttgggacagcggtg

SEQ ID NO: 424180 - DNA, 140 bp, Artificial Sequence
  Synthetic
caccgctgtcccaaaaggtctgttcagtctttgttttttcttccctattgttctctgtgtgaccattttcttggtcatgttgtccctcactctcctcttcctctggaaatgtgttgtaatcatatcagcagccagggcct

SEQ ID NO: 424181 - DNA, 140 bp, Artificial Sequence
  Synthetic
aggccctggctgctgatatgtaactcaagggacctgttgggaacagatgtacactccaggcggagaagtgaaaaatgatgatgtcgaccagagtttgatcatcgctgcccgaaatattgtgaccttttgggacagcggtg

SEQ ID NO: 424182 - DNA, 140 bp, Artificial Sequence
  Synthetic
caccgctgtcccaaaaggtcacaatatttcgggcagcgatgatcaaactctggtcgacatcatcatttttcacttctccgcctggagtgtacatctgttcccaacaggtcccttgagttacatatcagcagccagggcct

SEQ ID NO: 424183 - DNA, 140 bp, Artificial Sequence
  Synthetic
aggccctggctgctgatatgtcagagtgtgtttgtatcaatggaatctgcacagtggtgatgactgatggaagtgcttcagggaaagctgatactaggatactatttattgaagaagggagaccttttgggacagcggtg

SEQ ID NO: 424184 - DNA, 140 bp, Artificial Sequence
  Synthetic
caccgctgtcccaaaaggtctcccttcttcaataaatagtatcctagtatcagctttccctgaagcacttccatcagtcatcaccactgtgcagattccattgatacaaacacactctgacatatcagcagccagggcct

SEQ ID NO: 424185 - DNA, 140 bp, Artificial Sequence
  Synthetic
atacgccatgctgggtctcccactacttgagaagaatgtaactgtcacacattcagttgaattactagagaatcagaaagaaaagagattctgcaaaattatgaacaaggcccctctcgacgtacttgggagtcggccat

SEQ ID NO: 424186 - DNA, 140 bp, Artificial Sequence
  Synthetic
atggccgactcccaagtacgtcgagaggggccttgttcataattttgcagaatctcttttctttctgattctctagtaattcaactgaatgtgtgacagttacattcttctcaagtagtgggagacccagcatggcgtat

SEQ ID NO: 424187 - DNA, 140 bp, Artificial Sequence
  Synthetic
atacgccatgctgggtctcctttcccaaatgaagtgggagccagaatattaacatcagagtcgcaattaacaataacaagagagaagaaagaggaactacagggttgtacaatcgccccccgtacttgggagtcggccat

SEQ ID NO: 424188 - DNA, 140 bp, Artificial Sequence
  Synthetic
atggccgactcccaagtacggggggcgattgtacaaccctgtagttcctctttcttctctcttgttattgttaattgcgactctgatgttaatattctggctcccacttcatttgggaaaggagacccagcatggcgtat

SEQ ID NO: 424189 - DNA, 140 bp, Artificial Sequence
  Synthetic
atacgccatgctgggtctccgtcggctactgcatgtcatgatgggaagaaatggatgacaattggagtaacgggccctgatgccaaggcagtagcagtggtgcattatgggggaattcctcgtacttgggagtcggccat

SEQ ID NO: 424190 - DNA, 140 bp, Artificial Sequence
  Synthetic
atggccgactcccaagtacgaggaattcccccataatgcaccactgctactgccttggcatcagggcccgttactccaattgtcatccatttcttcccatcatgacatgcagtagccgacggagacccagcatggcgtat

SEQ ID NO: 424191 - DNA, 140 bp, Artificial Sequence
  Synthetic
atacgccatgctgggtctcccaagctttctcaaatgtcaaaagaagtgaatgctagaattgagccatttttgaaaacaacgccacgtcctctcaaattacctgatgggcctccttgctctcgtacttgggagtcggccat

SEQ ID NO: 424192 - DNA, 140 bp, Artificial Sequence
  Synthetic
atggccgactcccaagtacgagagcaaggaggcccatcaggtaatttgagaggacgtggcgttgttttcaaaaatggctcaattctagcattcacttcttttgacatttgagaaagcttgggagacccagcatggcgtat

SEQ ID NO: 424193 - DNA, 140 bp, Artificial Sequence
  Synthetic
atacgccatgctgggtctccgactttgaaagggaagggtactcactggtcgggatagacccattcaaattactccaaaacagccaagtggtcagcctgatgagaccaaatgaaaacccagcgtacttgggagtcggccat

SEQ ID NO: 424194 - DNA, 140 bp, Artificial Sequence
  Synthetic
atggccgactcccaagtacgctgggttttcatttggtctcatcaggctgaccacttggctgttttggagtaatttgaatgggtctatcccgaccagtgagtacccttccctttcaaagtcggagacccagcatggcgtat

SEQ ID NO: 424195 - DNA, 140 bp, Artificial Sequence
  Synthetic
atacgccatgctgggtctcctacggagaatagctttgagcaaataacttttatgcaagccttacaactattgcctgaagtggaggtcgagataagaactttctcgtttcagcttatttaacgtacttgggagtcggccat

SEQ ID NO: 424196 - DNA, 140 bp, Artificial Sequence
  Synthetic
atggccgactcccaagtacgttaaataagctgaaacgagaaagttcttatctcgacctccacttcaggcaatagttgtaaggcttgcataaaagttatttgctcaaagctattctccgtaggagacccagcatggcgtat

SEQ ID NO: 424197 - DNA, 140 bp, Artificial Sequence
  Synthetic
aggccctggctgctgatatgtcacatttacaatcatgagctaccagaagttccatataatgcctttcttctaatgtctgatgaactggggctggccaatatgactgagggaaagtccaaagaccttttgggacagcggtg

SEQ ID NO: 424198 - DNA, 140 bp, Artificial Sequence
  Synthetic
caccgctgtcccaaaaggtctttggactttccctcagtcatattggccagccccagttcatcagacattagaagaaaggcattatatggaacttctggtagctcatgattgtaaatgtgacatatcagcagccagggcct

SEQ ID NO: 424199 - DNA, 140 bp, Artificial Sequence
  Synthetic
atacgccatgctgggtctccaagcgcttccggaaaagctgatactaaaatattattcattgaggaggggaaaatcattcatgttagcacgttgtcaggaagtgcgcagcatgtcgaggagcgtacttgggagtcggccat

SEQ ID NO: 424200 - DNA, 140 bp, Artificial Sequence
  Synthetic
atggccgactcccaagtacgctcctcgacatgctgcgcacttcctgacaacgtgctaacatgaatgattttcccctcctcaatgaataatattttagtatcagcttttccggaagcgcttggagacccagcatggcgtat

SEQ ID NO: 424201 - DNA, 140 bp, Artificial Sequence
  Synthetic
atacgccatgctgggtctcccatccttagacaaaacccaacagaagaacaagcagtagacatttgtaaggcagcgatgggcctgaggatcagttcgtcgttcagctttggaggattcactcgtacttgggagtcggccat

SEQ ID NO: 424202 - DNA, 140 bp, Artificial Sequence
  Synthetic
atggccgactcccaagtacgagtgaatcctccaaagctgaacgacgaactgatcctcaggcccatcgctgccttacaaatgtctactgcttgttcttctgttgggttttgtctaaggatgggagacccagcatggcgtat

SEQ ID NO: 424203 - DNA, 140 bp, Artificial Sequence
  Synthetic
atacgccatgctgggtctccaaaacaaaagcaacaaaaatgaaggcaatactagtagttctgctatatacatttgcaaccgcaaatgcagacacattatgtataggttatcatgcgaacacgtacttgggagtcggccat

SEQ ID NO: 424204 - DNA, 140 bp, Artificial Sequence
  Synthetic
atggccgactcccaagtacgtgttcgcatgataacctatacataatgtgtctgcatttgcggttgcaaatgtatatagcagaactactagtattgccttcatttttgttgcttttgttttggagacccagcatggcgtat

SEQ ID NO: 424205 - DNA, 140 bp, Artificial Sequence
  Synthetic
aggccctggctgctgatatgaaacatcctcagaactcaggagtcagaatgcgtttgcatcaatggaacttgtgcagtggtaatgaccgatggaagtgcatcaggagaggccgacactagagaccttttgggacagcggtg

SEQ ID NO: 424206 - DNA, 140 bp, Artificial Sequence
  Synthetic
caccgctgtcccaaaaggtctctagtgtcggcctctcctgatgcacttccatcggtcattaccactgcacaagttccattgatgcaaacgcattctgactcctgagttctgaggatgtttcatatcagcagccagggcct

SEQ ID NO: 424207 - DNA, 140 bp, Artificial Sequence
  Synthetic
atacgccatgctgggtctcctggtggaggccatggtgtctagggcccgaattgatgcacgaattgacttcgaatctggaaggattaagaaagaagagtttgctgagatcatgaagatctgcgtacttgggagtcggccat

SEQ ID NO: 424208 - DNA, 140 bp, Artificial Sequence
  Synthetic
atggccgactcccaagtacgcagatcttcatgatctcagcaaactcttctttcttaatccttccagattcgaagtcaattcgtgcatcaattcgggccctagacaccatggcctccaccaggagacccagcatggcgtat

SEQ ID NO: 424209 - DNA, 140 bp, Artificial Sequence
  Synthetic
atacgccatgctgggtctcctcttggaaaggatgcaggtgcattgactgaagatccagatgaaggcacatctggggtggagtctgctgtcctgagaggatttctcattttgggcaaagaacgtacttgggagtcggccat

SEQ ID NO: 424210 - DNA, 140 bp, Artificial Sequence
  Synthetic
atggccgactcccaagtacgttctttgcccaaaatgagaaatcctctcaggacagcagactccaccccagatgtgccttcatctggatcttcagtcaatgcacctgcatcctttccaagaggagacccagcatggcgtat

SEQ ID NO: 424211 - DNA, 140 bp, Artificial Sequence
  Synthetic
atacgccatgctgggtctcccaaaatatactgtgtttaggattggctccctatttgtgagtgggagggaaaaatctgtgtacctgtattgccgagtgaatggcacaaataagatccaaatcgtacttgggagtcggccat

SEQ ID NO: 424212 - DNA, 140 bp, Artificial Sequence
  Synthetic
atggccgactcccaagtacgatttggatcttatttgtgccattcactcggcaatacaggtacacagatttttccctcccactcacaaatagggagccaatcctaaacacagtatattttgggagacccagcatggcgtat

SEQ ID NO: 424213 - DNA, 140 bp, Artificial Sequence
  Synthetic
atacgccatgctgggtctccgcagcatttgaagatctgagagtgtcaagctttatcagaggaacaagagtggtcccaagaggacaactgtccaccagaggagtacagattgcttcaaatgcgtacttgggagtcggccat

SEQ ID NO: 424214 - DNA, 140 bp, Artificial Sequence
  Synthetic
atggccgactcccaagtacgcatttgaagcaatctgtactcctctggtggacagttgtcctcttgggaccactcttgttcctctgataaagcttgacactctcagatcttcaaatgctgcggagacccagcatggcgtat

SEQ ID NO: 424215 - DNA, 140 bp, Artificial Sequence
  Synthetic
atacgccatgctgggtctccgagtaatatttactaaatgtttgatgcactatgtatttggaaatgcccaattggaggggtttagtgccgagtctaggagacttctactgttgattcaagccgtacttgggagtcggccat

SEQ ID NO: 424216 - DNA, 140 bp, Artificial Sequence
  Synthetic
atggccgactcccaagtacggcttgaatcaacagtagaagtctcctagactcggcactaaacccctccaattgggcatttccaaatacatagtgcatcaaacatttagtaaatattactcggagacccagcatggcgtat

SEQ ID NO: 424217 - DNA, 140 bp, Artificial Sequence
  Synthetic
atacgccatgctgggtctccataattctattaatcatgaagaccattgttgtcctgagttgttttttctgtctggctttctgccaaaatccttcagagaataacaacaacactgcaacgccgtacttgggagtcggccat

SEQ ID NO: 424218 - DNA, 140 bp, Artificial Sequence
  Synthetic
atggccgactcccaagtacggcgttgcagtgttgttgttattctctgaaggattttggcagaaagccagacagaaaaaacaactcaggacaacaatggtcttcatgattaatagaattatggagacccagcatggcgtat

SEQ ID NO: 424219 - DNA, 140 bp, Artificial Sequence
  Synthetic
atacgccatgctgggtctccggtggaggagtgaggaatgacgatattgaccaaagcctaattattgcggccaggaacatagtaagaagagccgcagtatcagcagatccactagcatcttcgtacttgggagtcggccat

SEQ ID NO: 424220 - DNA, 140 bp, Artificial Sequence
  Synthetic
atggccgactcccaagtacgaagatgctagtggatctgctgatactgcggctcttcttactatgttcctggccgcaataattaggctttggtcaatatcgtcattcctcactcctccaccggagacccagcatggcgtat

SEQ ID NO: 424221 - DNA, 140 bp, Artificial Sequence
  Synthetic
atacgccatgctgggtctcctcaacattatggcgtctcaaggcaccaaacgatcttatgaacagatggaaactggtggagagcgccagaatgctactgagatcagggcatctgttggaagcgtacttgggagtcggccat

SEQ ID NO: 424222 - DNA, 140 bp, Artificial Sequence
  Synthetic
atggccgactcccaagtacgcttccaacagatgccctgatctcagtagcattctggcgctctccaccagtttccatctgttcataagatcgtttggtgccttgagacgccataatgttgaggagacccagcatggcgtat

SEQ ID NO: 424223 - DNA, 140 bp, Artificial Sequence
  Synthetic
aggccctggctgctgatatgtcccactgcagggctactgaatacataatgaagggagtgtacataaatacggcattgctcaatgcatcctgtgcagctatggatgactttcagctgatccgaccttttgggacagcggtg

SEQ ID NO: 424224 - DNA, 140 bp, Artificial Sequence
  Synthetic
caccgctgtcccaaaaggtcggatcagctgaaagtcatccatagctgcacaggatgcattgagcaatgccgtatttatgtacactcccttcattatgtattcagtagccctgcagtgggacatatcagcagccagggcct

SEQ ID NO: 424225 - DNA, 140 bp, Artificial Sequence
  Synthetic
aggccctggctgctgatatgatggaagcaaaactatttgtattattctgtgcattcactgcactgaaagctgacaccatttgtgtaggctaccatgccaacaattccacagacactgtcggaccttttgggacagcggtg

SEQ ID NO: 424226 - DNA, 140 bp, Artificial Sequence
  Synthetic
caccgctgtcccaaaaggtccgacagtgtctgtggaattgttggcatggtagcctacacaaatggtgtcagctttcagtgcagtgaatgcacagaataatacaaatagttttgcttccatcatatcagcagccagggcct

SEQ ID NO: 424227 - DNA, 140 bp, Artificial Sequence
  Synthetic
aggccctggctgctgatatgggatgggaagaactatcagcaaggactcacgcttaggttacgaaaccttcaaagttgttggtggttggtcccaacccaattccaaattccagataaataggaccttttgggacagcggtg

SEQ ID NO: 424228 - DNA, 140 bp, Artificial Sequence
  Synthetic
caccgctgtcccaaaaggtcctatttatctggaatttggaattgggttgggaccaaccaccaacaactttgaaggtttcgtaacctaagcgtgagtccttgctgatagttcttcccatcccatatcagcagccagggcct

SEQ ID NO: 424229 - DNA, 140 bp, Artificial Sequence
  Synthetic
aggccctggctgctgatatgagttatagtctctaccaaaagaagccaacaaactgtaatcccgaatatcgggtctagaccctgggtaaggggtgtctccagcataataagcatctattgggaccttttgggacagcggtg

SEQ ID NO: 424230 - DNA, 140 bp, Artificial Sequence
  Synthetic
caccgctgtcccaaaaggtcccaatagatgcttattatgctggagacaccccttacccagggtctagacccgatattcgggattacagtttgttggcttcttttggtagagactataactcatatcagcagccagggcct

SEQ ID NO: 424231 - DNA, 140 bp, Artificial Sequence
  Synthetic
atacgccatgctgggtctccgtgatacacaaatacaaacgaggagatcattcgagctaaagaagctgtgggagcagacccgttcaaaggcaggactgttggtttcagatggaggcccaaacgtacttgggagtcggccat

SEQ ID NO: 424232 - DNA, 140 bp, Artificial Sequence
  Synthetic
atggccgactcccaagtacgtttgggcctccatctgaaaccaacagtcctgcctttgaacgggtctgctcccacagcttctttagctcgaatgatctcctcgtttgtatttgtgtatcacggagacccagcatggcgtat

SEQ ID NO: 424233 - DNA, 140 bp, Artificial Sequence
  Synthetic
atacgccatgctgggtctcctgtaaacaaaattacctatggggcatgtcccaaatatgttaagcaaaacaccctaaaactggcaaccgggatgcggaatgtacctgagaaacagaccagacgtacttgggagtcggccat

SEQ ID NO: 424234 - DNA, 140 bp, Artificial Sequence
  Synthetic
atggccgactcccaagtacgtctggtctgtttctcaggtacattccgcatcccggttgccagttttagggtgttttgcttaacatatttgggacatgccccataggtaattttgtttacaggagacccagcatggcgtat

SEQ ID NO: 424235 - DNA, 140 bp, Artificial Sequence
  Synthetic
aggccctggctgctgatatgctgggaatgctgaaattgaagatctcatttttctggcacggtctgcactcatcctgagaggatcagtggcccataagtcctgcttgcctgcttgtgtgtagaccttttgggacagcggtg

SEQ ID NO: 424236 - DNA, 140 bp, Artificial Sequence
  Synthetic
caccgctgtcccaaaaggtctacacacaagcaggcaagcaggacttatgggccactgatcctctcaggatgagtgcagaccgtgccagaaaaatgagatcttcaatttcagcattcccagcatatcagcagccagggcct

SEQ ID NO: 424237 - DNA, 140 bp, Artificial Sequence
  Synthetic
atacgccatgctgggtctccgatagatggttggtatggtttcaggcatcaaaactcggaaggtacaggacaggcagcagaccttaaaagcactcaagccgccattgaccagatcaatggacgtacttgggagtcggccat

SEQ ID NO: 424238 - DNA, 140 bp, Artificial Sequence
  Synthetic
atggccgactcccaagtacgtccattgatctggtcaatggcggcttgagtgcttttaaggtctgctgcctgtcctgtaccttccgagttttgatgcctgaaaccataccaaccatctatcggagacccagcatggcgtat

SEQ ID NO: 424239 - DNA, 140 bp, Artificial Sequence
  Synthetic
atacgccatgctgggtctccgacacttaagatgaccattgcatctgtacctacttcgcgctacatagctgacatgaccctcgaggaaatgtcacgagactggttcatgctcatgcctaggcgtacttgggagtcggccat

SEQ ID NO: 424240 - DNA, 140 bp, Artificial Sequence
  Synthetic
atggccgactcccaagtacgcctaggcatgagcatgaaccagtctcgtgacatttcctcgagggtcatgtcagctatgtagcgcgaagtaggtacagatgcaatggtcatcttaagtgtcggagacccagcatggcgtat

SEQ ID NO: 424241 - DNA, 140 bp, Artificial Sequence
  Synthetic
aggccctggctgctgatatgacatgaccctcgaggaaatgtcacgagactggttcatgctcatgcctaggcaaaagataataggccctctttgtgtgcgaatggaccaggcgatcatggagaccttttgggacagcggtg

SEQ ID NO: 424242 - DNA, 140 bp, Artificial Sequence
  Synthetic
caccgctgtcccaaaaggtctccatgatcgcctggtccattcgcacacaaagagggcctattatcttttgcctaggcatgagcatgaaccagtctcgtgacatttcctcgagggtcatgtcatatcagcagccagggcct

SEQ ID NO: 424243 - DNA, 140 bp, Artificial Sequence
  Synthetic
aggccctggctgctgatatgtgtcagactgagaaaggtggcctaaacacgaccctaccgtttcacaatgtcagcaaatatgcatttgggaattgccccaaatacgttggagtcaagagtcgaccttttgggacagcggtg

SEQ ID NO: 424244 - DNA, 140 bp, Artificial Sequence
  Synthetic
caccgctgtcccaaaaggtcgactcttgactccaacgtatttggggcaattcccaaatgcatatttgctgacattgtgaaacggtagggtcgtgtttaggccacctttctcagtctgacacatatcagcagccagggcct

SEQ ID NO: 424245 - DNA, 140 bp, Artificial Sequence
  Synthetic
aggccctggctgctgatatgaccatggtatgcatttgcattgaaaaaaggctctagttctggaattatgaggtcggatgctcaggttcacaattgcactacaaagtgccaaactccccttgaccttttgggacagcggtg

SEQ ID NO: 424246 - DNA, 140 bp, Artificial Sequence
  Synthetic
caccgctgtcccaaaaggtcaaggggagtttggcactttgtagtgcaattgtgaacctgagcatccgacctcataattccagaactagagccttttttcaatgcaaatgcataccatggtcatatcagcagccagggcct

SEQ ID NO: 424247 - DNA, 140 bp, Artificial Sequence
  Synthetic
  misc_feature (24)..(24): n is a, c, g, or t
  misc_feature (33)..(33): n is a, c, g, or t
atacgccatgctgggtctcccatntactctganttccacttcatcgacgaacgaggcgaatcaactataatagaatctggcgatccaaatgcgctgctgaaacaccgatttgaaataatccgtacttgggagtcggccat

SEQ ID NO: 424248 - DNA, 140 bp, Artificial Sequence
  Synthetic
  misc_feature (108)..(108): n is a, c, g, or t
  misc_feature (117)..(117): n is a, c, g, or t
atggccgactcccaagtacggattatttcaaatcggtgtttcagcagcgcatttggatcgccagattctattatagttgattcgcctcgttcgtcgatgaagtggaantcagagtanatgggagacccagcatggcgtat

SEQ ID NO: 424249 - DNA, 140 bp, Artificial Sequence
  Synthetic
aggccctggctgctgatatgcttgtcaaaagcgatcatatttgcattggttatcatgcaaataactcgacagagcaggttgacacaataatggaaaagaacgttactgttacacatgcccgaccttttgggacagcggtg

SEQ ID NO: 424250 - DNA, 140 bp, Artificial Sequence
  Synthetic
caccgctgtcccaaaaggtcgggcatgtgtaacagtaacgttcttttccattattgtgtcaacctgctctgtcgagttatttgcatgataaccaatgcaaatatgatcgcttttgacaagcatatcagcagccagggcct

SEQ ID NO: 424251 - DNA, 140 bp, Artificial Sequence
  Synthetic
atacgccatgctgggtctccggatcaaatggtctgacagccaatgaatcaggaaggctgatagatttcctaaaagatgtaatggaatctgtggataaagaggaaatagagataacaacaccgtacttgggagtcggccat

SEQ ID NO: 424252 - DNA, 140 bp, Artificial Sequence
  Synthetic
atggccgactcccaagtacggtgttgttatctctatttcctctttatccacagattccattacatcttttaggaaatctatcagccttcctgattcattggctgtcagaccatttgatccggagacccagcatggcgtat

SEQ ID NO: 424253 - DNA, 140 bp, Artificial Sequence
  Synthetic
aggccctggctgctgatatgtttgtcagtcataaggaaattgagtccgtaaacaatgctgtagtgatgccagcccatggtccggccaaaagcatggaatatgatgctgttgcgaccacacgaccttttgggacagcggtg

SEQ ID NO: 424254 - DNA, 140 bp, Artificial Sequence
  Synthetic
caccgctgtcccaaaaggtcgtgtggtcgcaacagcatcatattccatgcttttggccggaccatgggctggcatcactacagcattgtttacggactcaatttccttatgactgacaaacatatcagcagccagggcct

SEQ ID NO: 424255 - DNA, 140 bp, Artificial Sequence
  Synthetic
aggccctggctgctgatatggacaccaagcacagaggtgtcactgagggggataagggttagtaagatgggagtggatgaatattcaagcactgagagagtggttgtgagcattgatcgtgaccttttgggacagcggtg

SEQ ID NO: 424256 - DNA, 140 bp, Artificial Sequence
  Synthetic
caccgctgtcccaaaaggtcacgatcaatgctcacaaccactctctcagtgcttgaatattcatccactcccatcttactaacccttatccccctcagtgacacctctgtgcttggtgtccatatcagcagccagggcct

SEQ ID NO: 424257 - DNA, 140 bp, Artificial Sequence
  Synthetic
aggccctggctgctgatatgtgatagtaagtggaagagacgaacaatcaattgctgaagcgatcatagtagcaatggtattctcacaagaggattgcatgataaaggctgtcagaggtgagaccttttgggacagcggtg

SEQ ID NO: 424258 - DNA, 140 bp, Artificial Sequence
  Synthetic
caccgctgtcccaaaaggtctcacctctgacagcctttatcatgcaatcctcttgtgagaataccattgctactatgatcgcttcagcaattgattgttcgtctcttccacttactatcacatatcagcagccagggcct

SEQ ID NO: 424259 - DNA, 140 bp, Artificial Sequence
  Synthetic
aggccctggctgctgatatgttcattgctccagaatatgcatacaaaattgtcaagaagggagactccacaatcatgagaagtgaagtggaatatggtaactgcaacaccaggtgccagagaccttttgggacagcggtg

SEQ ID NO: 424260 - DNA, 140 bp, Artificial Sequence
  Synthetic
caccgctgtcccaaaaggtctctggcacctggtgttgcagttaccatattccacttcacttctcatgattgtggagtctcccttcttgacaattttgtatgcatattctggagcaatgaacatatcagcagccagggcct

SEQ ID NO: 424261 - DNA, 140 bp, Artificial Sequence
  Synthetic
atacgccatgctgggtctccagggagtgtacataaacacagccctgttgaatgcatcctgtgcagccatggatgactttcaactgattccaatgataagcaaatgcagaaccaaagaaggcgtacttgggagtcggccat

SEQ ID NO: 424262 - DNA, 140 bp, Artificial Sequence
  Synthetic
atggccgactcccaagtacgccttctttggttctgcatttgcttatcattggaatcagttgaaagtcatccatggctgcacaggatgcattcaacagggctgtgtttatgtacactccctggagacccagcatggcgtat

SEQ ID NO: 424263 - DNA, 140 bp, Artificial Sequence
  Synthetic
aggccctggctgctgatatgtctgaattttgtaaacagagcaaaccaacggctgaatcccatgcatcaacttctgaggcacttccagaaggatgcaaaggtactgattcaaaattggggagaccttttgggacagcggtg

SEQ ID NO: 424264 - DNA, 140 bp, Artificial Sequence
  Synthetic
caccgctgtcccaaaaggtctccccaattttgaatcagtacctttgcatccttctggaagtgcctcagaagttgatgcatgggattcagccgttggtttgctctgtttacaaaattcagacatatcagcagccagggcct

SEQ ID NO: 424265 - DNA, 140 bp, Artificial Sequence
  Synthetic
aggccctggctgctgatatggaggagaagtgagaaatgatgatgttgaccaaagtttgattatcgctgctagaaacatagtaagaagagcagcagtgtcagcagacccattagcatctctgaccttttgggacagcggtg

SEQ ID NO: 424266 - DNA, 140 bp, Artificial Sequence
  Synthetic
caccgctgtcccaaaaggtcagagatgctaatgggtctgctgacactgctgctcttcttactatgtttctagcagcgataatcaaactttggtcaacatcatcatttctcacttctcctccatatcagcagccagggcct

SEQ ID NO: 424267 - DNA, 140 bp, Artificial Sequence
  Synthetic
aggccctggctgctgatatgatgataccgacgtggtaaactttgtaagtatggaattttcccttaccgacccaaggttggaaccacataaatgggaaaagtattgtgttcttgaaatagggaccttttgggacagcggtg

SEQ ID NO: 424268 - DNA, 140 bp, Artificial Sequence
  Synthetic
caccgctgtcccaaaaggtccctatttcaagaacacaatacttttcccatttatgtggttccaaccttgggtcggtaagggaaaattccatacttacaaagtttaccacgtcggtatcatcatatcagcagccagggcct

SEQ ID NO: 424269 - DNA, 140 bp, Artificial Sequence
  Synthetic
aggccctggctgctgatatgtttgtagccaattttagcatggaactgcccagctttggagtatctgggattaatgagtcagctgacatgagcattggagttacagtaataaagaataatagaccttttgggacagcggtg

SEQ ID NO: 424270 - DNA, 140 bp, Artificial Sequence
  Synthetic
caccgctgtcccaaaaggtctattattctttattactgtaactccaatgctcatgtcagctgactcattaatcccagatactccaaagctgggcagttccatgctaaaattggctacaaacatatcagcagccagggcct

SEQ ID NO: 424271 - DNA, 140 bp, Artificial Sequence
  Synthetic
aggccctggctgctgatatgatggatgtcaatccgactttacttttcttgaaagtgccagtgcaaaatgctataagtaccacattcccttatactggagaccctccatacagccatggaagaccttttgggacagcggtg

SEQ ID NO: 424272 - DNA, 140 bp, Artificial Sequence
  Synthetic
caccgctgtcccaaaaggtcttccatggctgtatggagggtctccagtataagggaatgtggtacttatagcattttgcactggcactttcaagaaaagtaaagtcggattgacatccatcatatcagcagccagggcct

SEQ ID NO: 424273 - DNA, 140 bp, Artificial Sequence
  Synthetic
  misc_feature (23)..(23): n is a, c, g, or t
  misc_feature (36)..(36): n is a, c, g, or t
aggccctggctgctgatatgtgnttaatgcatcgtnggtcaactcattcctcacacatgcactaagatagatcgtttggtgccttgagacgccatgatcgtttggtgccttgagacgccagaccttttgggacagcggtg

SEQ ID NO: 424274 - DNA, 140 bp, Artificial Sequence
  Synthetic
  misc_feature (105)..(105): n is a, c, g, or t
  misc_feature (118)..(118): n is a, c, g, or t
caccgctgtcccaaaaggtctggcgtctcaaggcaccaaacgatcatggcgtctcaaggcaccaaacgatctatcttagtgcatgtgtgaggaatgagttgaccnacgatgcattaancacatatcagcagccagggcct

SEQ ID NO: 424275 - DNA, 140 bp, Artificial Sequence
  Synthetic
aggccctggctgctgatatgagtcaacacctatcaatggatcatcagaaattgggaagttgtaaagattcaatggtcccaggaccctacaatgttgtacaacaagatggaattcgaaccagaccttttgggacagcggtg

SEQ ID NO: 424276 - DNA, 140 bp, Artificial Sequence
  Synthetic
caccgctgtcccaaaaggtctggttcgaattccatcttgttgtacaacattgtagggtcctgggaccattgaatctttacaacttcccaatttctgatgatccattgataggtgttgactcatatcagcagccagggcct

SEQ ID NO: 424277 - DNA, 140 bp, Artificial Sequence
  Synthetic
aggccctggctgctgatatgggaataccactatatgatgcaatcaaatgcatgaagacattctttggctggaaagagcctaacatagtcaaaccacatgagaaaggcataaatcccaattgaccttttgggacagcggtg

SEQ ID NO: 424278 - DNA, 140 bp, Artificial Sequence
  Synthetic
caccgctgtcccaaaaggtcaattgggatttatgcctttctcatgtggtttgactatgttaggctctttccagccaaagaatgtcttcatgcatttgattgcatcatatagtggtattcccatatcagcagccagggcct

SEQ ID NO: 424279 - DNA, 140 bp, Artificial Sequence
  Synthetic
atacgccatgctgggtctcccaggaacagggtataccatggacactgtcaataggacgcatcagtactcagagaagggaaaatggacaacaaacacagagactggggcacctcagcttaacgtacttgggagtcggccat

SEQ ID NO: 424280 - DNA, 140 bp, Artificial Sequence
  Synthetic
atggccgactcccaagtacgttaagctgaggtgccccagtctctgtgtttgttgtccattttcccttctctgagtactgatgcgtcctattgacagtgtccatggtataccctgttcctgggagacccagcatggcgtat

SEQ ID NO: 424281 - DNA, 140 bp, Artificial Sequence
  Synthetic
atacgccatgctgggtctccgagaagggaaaatggacaacaaacacagagaccggagcaccccaactcaacccaattgatggaccattacctgaggacaacgagccaagcggatatgcgccgtacttgggagtcggccat

SEQ ID NO: 424282 - DNA, 140 bp, Artificial Sequence
  Synthetic
atggccgactcccaagtacggcgcatatccgcttggctcgttgtcctcaggtaatggtccatcaattgggttgagttggggtgctccggtctctgtgtttgttgtccattttcccttctcggagacccagcatggcgtat

SEQ ID NO: 424283 - DNA, 140 bp, Artificial Sequence
  Synthetic
atacgccatgctgggtctccataattctattaatcatgaagaccatcattgttctaagttattttttctgtctggctctcggccaagattactcagagaacaacaacagcactgcaacaccgtacttgggagtcggccat

SEQ ID NO: 424284 - DNA, 140 bp, Artificial Sequence
  Synthetic
atggccgactcccaagtacggtgttgcagtgctgttgttgttctctgagtaatcttggccgagagccagacagaaaaaataacttagaacaatgatggtcttcatgattaatagaattatggagacccagcatggcgtat

SEQ ID NO: 424285 - DNA, 140 bp, Artificial Sequence
  Synthetic
atacgccatgctgggtctccaggactgcgataggccaagtgtcgaggcccatgttcctatatgtgagaaccaatggaacctccaagatcaagatgaaatggggcatggaaatgaggcgctcgtacttgggagtcggccat

SEQ ID NO: 424286 - DNA, 140 bp, Artificial Sequence
  Synthetic
atggccgactcccaagtacgagcgcctcatttccatgccccatttcatcttgatcttggaggttccattggttctcacatataggaacatgggcctcgacacttggcctatcgcagtcctggagacccagcatggcgtat

SEQ ID NO: 424287 - DNA, 140 bp, Artificial Sequence
  Synthetic
aggccctggctgctgatatgttgagtacagtcttaggagtttcaattctgaatctcgggcagaagaagtacaccaaaaccacatattggtgggacggactccaatcctcagatgacttcggaccttttgggacagcggtg

SEQ ID NO: 424288 - DNA, 140 bp, Artificial Sequence
  Synthetic
caccgctgtcccaaaaggtccgaagtcatctgaggattggagtccgtcccaccaatatgtggttttggtgtacttcttctgcccgagattcagaattgaaactcctaagactgtactcaacatatcagcagccagggcct

SEQ ID NO: 424289 - DNA, 140 bp, Artificial Sequence
  Synthetic
aggccctggctgctgatatgaggttctatagaacctgcaaattagttgggataaacatgagcaagaagaaatcctacataaatcggacaggaacattcgaattcacaagctttttctaccgaccttttgggacagcggtg

SEQ ID NO: 424290 - DNA, 140 bp, Artificial Sequence
  Synthetic
caccgctgtcccaaaaggtcggtagaaaaagcttgtgaattcgaatgttcctgtccgatttatgtaggatttcttcttgctcatgtttatcccaactaatttgcaggttctatagaacctcatatcagcagccagggcct

SEQ ID NO: 424291 - DNA, 140 bp, Artificial Sequence
  Synthetic
atacgccatgctgggtctcccatggtatctagggcccgaattgatgcacggattgacttcgagtctggaaggattaagttaatagagtttggtgagatcatgcaattctgttcccccatacgtacttgggagtcggccat

SEQ ID NO: 424292 - DNA, 140 bp, Artificial Sequence
  Synthetic
atggccgactcccaagtacgtatgggggaacagaattgcatgatctcaccaaactctattaacttaatccttccagactcgaagtcaatccgtgcatcaattcgggccctagataccatgggagacccagcatggcgtat

SEQ ID NO: 424293 - DNA, 140 bp, Artificial Sequence
  Synthetic
atacgccatgctgggtctccaggacatactgatgaggatgtcaaaaatgcaattgggatcctcatcaacggacttgaatggaatggtaacaaaattcgagtctctgaagctctacagagacgtacttgggagtcggccat

SEQ ID NO: 424294 - DNA, 140 bp, Artificial Sequence
  Synthetic
atggccgactcccaagtacgtctctgtagagcttcagagactcgaattttgttaccattccattcaagtccgttgatgaggatcccaattgcatttttgacatcctcatcagtatgtcctggagacccagcatggcgtat

SEQ ID NO: 424295 - DNA, 140 bp, Artificial Sequence
  Synthetic
aggccctggctgctgatatgcaatgatgtgggagatcaacggacctgagtcagtgctcgtcaacacatatcaatggatcattagaaattgggaaactgtgaagatccaatggtctcaagagaccttttgggacagcggtg

SEQ ID NO: 424296 - DNA, 140 bp, Artificial Sequence
  Synthetic
caccgctgtcccaaaaggtctcttgagaccattggatcttcacagtttcccaatttctaatgatccattgatatgtgttgacgagcactgactcaggtccgttgatctcccacatcattgcatatcagcagccagggcct

SEQ ID NO: 424297 - DNA, 140 bp, Artificial Sequence
  Synthetic
aggccctggctgctgatatggtgcctgagtctatgagggaagaatatcggcaggaacagcagagtgctgtggatgttgacgatggtcattttgtcaacatagagctggagtaaaaaactagaccttttgggacagcggtg

SEQ ID NO: 424298 - DNA, 140 bp, Artificial Sequence
  Synthetic
caccgctgtcccaaaaggtctagttttttactccagctctatgttgacaaaatgaccatcgtcaacatccacagcactctgctgttcctgccgatattcttccctcatagactcaggcaccatatcagcagccagggcct

SEQ ID NO: 424299 - DNA, 140 bp, Artificial Sequence
  Synthetic
aggccctggctgctgatatggtggaggaaggctccatcggaaaggtgtgcagaaccttgctggcgaagtctgttttcaacagtttatatgcatcttcacaactcgaggggttttcagctggaccttttgggacagcggtg

SEQ ID NO: 424300 - DNA, 140 bp, Artificial Sequence
  Synthetic
caccgctgtcccaaaaggtccagctgaaaacccctcgagttgtgaagatgcatataaactgttgaaaacagacttcgccagcaaggttctgcacacctttccgatggagccttcctccaccatatcagcagccagggcct

SEQ ID NO: 424301 - DNA, 140 bp, Artificial Sequence
  Synthetic
aggccctggctgctgatatgatctggaaggattaagaaagaagagtttgctgagatcatgaagatctgttccaccattgaagagctcagacggcaaaaataatagtggaggtcgctagatgaccttttgggacagcggtg

SEQ ID NO: 424302 - DNA, 140 bp, Artificial Sequence
  Synthetic
caccgctgtcccaaaaggtcatctagcgacctccactattatttttgccgtctgagctcttcaatggtggaacagatcttcatgatctcagcaaactcttctttcttaatccttccagatcatatcagcagccagggcct

SEQ ID NO: 424303 - DNA, 140 bp, Artificial Sequence
  Synthetic
  misc_feature (25)..(25): n is a, c, g, or t
aggccctggctgctgatatgccacnttcccttatactggagaccctccatacagccatggaacaggaacaggatacaccatggacacagtcaacagaacacataaatactcagaaaaagggaccttttgggacagcggtg

SEQ ID NO: 424304 - DNA, 140 bp, Artificial Sequence
  Synthetic
  misc_feature (116)..(116): n is a, c, g, or t
caccgctgtcccaaaaggtccctttttctgagtatttatgtgttctgttgactgtgtccatggtgtatcctgttcctgttccatggctgtatggagggtctccagtataagggaangtggcatatcagcagccagggcct

SEQ ID NO: 424305 - DNA, 140 bp, Artificial Sequence
  Synthetic
atacgccatgctgggtctcctcgaaagtaagagtatgaagttacggacacaaataccagcggaaatgctcgcaaatattgacctgaaatacttcaacaaatcaacaagagagaaaatcgacgtacttgggagtcggccat

SEQ ID NO: 424306 - DNA, 140 bp, Artificial Sequence
  Synthetic
atggccgactcccaagtacgtcgattttctctcttgttgatttgttgaagtatttcaggtcaatatttgcgagcatttccgctggtatttgtgtccgtaacttcatactcttactttcgaggagacccagcatggcgtat

SEQ ID NO: 424307 - DNA, 140 bp, Artificial Sequence
  Synthetic
atacgccatgctgggtctccaccatctagcgacctccacgaaagcaggtcaaatatattcaatatggaaagaataaaagaactaagagatttgatgtcacagtctcgcactcgcgagatacgtacttgggagtcggccat

SEQ ID NO: 424308 - DNA, 140 bp, Artificial Sequence
  Synthetic
atggccgactcccaagtacgtatctcgcgagtgcgagactgtgacatcaaatctcttagttcttttattctttccatattgaatatatttgacctgctttcgtggaggtcgctagatggtggagacccagcatggcgtat

SEQ ID NO: 424309 - DNA, 140 bp, Artificial Sequence
  Synthetic
atacgccatgctgggtctcccatggtatctagggcccgaattgatgcacggattgacttcgagtctggaaggattaagagagaagagtttgctgaaatggtgaagatctgttccaccattcgtacttgggagtcggccat

SEQ ID NO: 424310 - DNA, 140 bp, Artificial Sequence
  Synthetic
atggccgactcccaagtacgaatggtggaacagatcttcaccatttcagcaaactcttctctcttaatccttccagactcgaagtcaatccgtgcatcaattcgggccctagataccatgggagacccagcatggcgtat

SEQ ID NO: 424311 - DNA, 140 bp, Artificial Sequence
  Synthetic
aggccctggctgctgatatgagaaatgagcaaggtcagaccctttggagcaagacaaatgatgctggatcagacagagtgatggtgtcacctctggctgtgacgtggtggaacagaaatggaccttttgggacagcggtg

SEQ ID NO: 424312 - DNA, 140 bp, Artificial Sequence
  Synthetic
caccgctgtcccaaaaggtccatttctgttccaccacgtcacagccagaggtgacaccatcactctgtctgatccagcatcatttgtcttgctccaaagggtctgaccttgctcatttctcatatcagcagccagggcct

SEQ ID NO: 424313 - DNA, 140 bp, Artificial Sequence
  Synthetic
aggccctggctgctgatatgatggagggaataaaggaactaagagatttgatgtcgcagtctcgcactcgggagatactgacaaaaaccccagtggcccacatgcccataattaagaaatgaccttttgggacagcggtg

SEQ ID NO: 424314 - DNA, 140 bp, Artificial Sequence
  Synthetic
caccgctgtcccaaaaggtcatttcttaattatgggcatgtgggccactggggtttttgtcagtatctcccgagtgcgagactgcgacatcaaatctcttagttcctttattccctccatcatatcagcagccagggcct

SEQ ID NO: 424315 - DNA, 140 bp, Artificial Sequence
  Synthetic
aggccctggctgctgatatgctgctatccctatgacgtaccagactatgcatcgctcaggtctctagttgcctcctcaggaaccctagagttcatcacagaaggattcacatggacaggagaccttttgggacagcggtg

SEQ ID NO: 424316 - DNA, 140 bp, Artificial Sequence
  Synthetic
caccgctgtcccaaaaggtctcctgtccatgtgaatccttctgtgatgaactctagggttcctgaggaggcaactagagacctgagcgatgcatagtctggtacgtcatagggatagcagcatatcagcagccagggcct

SEQ ID NO: 424317 - DNA, 140 bp, Artificial Sequence
  Synthetic
aggccctggctgctgatatgatcaatgatcggaacttctggagaggcgagaatggacgaagaacaagaattgcatatgagaggatgtgcaacatcctcaaagggaagttccagacagcaggaccttttgggacagcggtg

SEQ ID NO: 424318 - DNA, 140 bp, Artificial Sequence
  Synthetic
caccgctgtcccaaaaggtcctgctgtctggaacttccctttgaggatgttgcacatcctctcatatgcaattcttgttcttcgtccattctcgcctctccagaagttccgatcattgatcatatcagcagccagggcct

SEQ ID NO: 424319 - DNA, 140 bp, Artificial Sequence
  Synthetic
atacgccatgctgggtctccactgctgccattcgcagcagcaccacctgagcagagtaggatgcagttctcttctctaactgtgaacgtaaggggatcaggaatgagaatactcataaggcgtacttgggagtcggccat

SEQ ID NO: 424320 - DNA, 140 bp, Artificial Sequence
  Synthetic
atggccgactcccaagtacgccttatgagtattctcattcctgatccccttacgttcacagttagagaagagaactgcatcctactctgctcaggtggtgctgctgcgaatggcagcagtggagacccagcatggcgtat

SEQ ID NO: 424321 - DNA, 140 bp, Artificial Sequence
  Synthetic
aggccctggctgctgatatgcaacagatgcgcgatgtgttggggacctttgatactgtccagataatcaagttactaccatttgcagcagctccaccggaacagagtaggatgcaattttgaccttttgggacagcggtg

SEQ ID NO: 424322 - DNA, 140 bp, Artificial Sequence
  Synthetic
caccgctgtcccaaaaggtcaaaattgcatcctactctgttccggtggagctgctgcaaatggtagtaacttgattatctggacagtatcaaaggtccccaacacatcgcgcatctgttgcatatcagcagccagggcct

SEQ ID NO: 424323 - DNA, 140 bp, Artificial Sequence
  Synthetic
atacgccatgctgggtctccgcaaggagacgtagtgttggtaatgaaacgaaaacgggactctagcatacttactgacagccagacagcgaccaaaagaattcggatggccatcaattagcgtacttgggagtcggccat

SEQ ID NO: 424324 - DNA, 140 bp, Artificial Sequence
  Synthetic
atggccgactcccaagtacgctaattgatggccatccgaattcttttggtcgctgtctggctgtcagtaagtatgctagagtcccgttttcgtttcattaccaacactacgtctccttgcggagacccagcatggcgtat

SEQ ID NO: 424325 - DNA, 140 bp, Artificial Sequence
  Synthetic
aggccctggctgctgatatgcagatcaggctttgagatactaagggtaaggaatggttggacacaaacaagtaaagagcagattaggaaacaggtagttgttgataatttgaactggtcggaccttttgggacagcggtg

SEQ ID NO: 424326 - DNA, 140 bp, Artificial Sequence
  Synthetic
caccgctgtcccaaaaggtccgaccagttcaaattatcaacaactacctgtttcctaatctgctctttacttgtttgtgtccaaccattccttacccttagtatctcaaagcctgatctgcatatcagcagccagggcct

SEQ ID NO: 424327 - DNA, 140 bp, Artificial Sequence
  Synthetic
aggccctggctgctgatatgcctcggaaaggacgcaggtgcattaacagaagatccagatgaaggaacagctggagtggaatctgcagtactgagaggattcctaattctaggaaaggaagaccttttgggacagcggtg

SEQ ID NO: 424328 - DNA, 140 bp, Artificial Sequence
  Synthetic
caccgctgtcccaaaaggtcttcctttcctagaattaggaatcctctcagtactgcagattccactccagctgttccttcatctggatcttctgttaatgcacctgcgtcctttccgaggcatatcagcagccagggcct

SEQ ID NO: 424329 - DNA, 140 bp, Artificial Sequence
  Synthetic
atacgccatgctgggtctcctccctaaggcaaccagaagtcgttacagtggattcgtgaggacactgttccagcaaatgcgggatgtgcttgggacatttgacactgtccaaataataaacgtacttgggagtcggccat

SEQ ID NO: 424330 - DNA, 140 bp, Artificial Sequence
  Synthetic
atggccgactcccaagtacgtttattatttggacagtgtcaaatgtcccaagcacatcccgcatttgctggaacagtgtcctcacgaatccactgtaacgacttctggttgccttagggaggagacccagcatggcgtat

SEQ ID NO: 424331 - DNA, 140 bp, Artificial Sequence
  Synthetic
aggccctggctgctgatatgtcattccatcaggccccctcaaagccgagatagcacagagacttgaagatgtttttgcagggaagaacacagatcttgaagctctcatggagtggctaaagaccttttgggacagcggtg

SEQ ID NO: 424332 - DNA, 140 bp, Artificial Sequence
  Synthetic
caccgctgtcccaaaaggtctttagccactccatgagagcttcaagatctgtgttcttccctgcaaaaacatcttcaagtctctgtgctatctcggctttgagggggcctgatggaatgacatatcagcagccagggcct

SEQ ID NO: 424333 - DNA, 140 bp, Artificial Sequence
  Synthetic
atacgccatgctgggtctccatgagtcttctaaccgaggtcgaaacgtacgttctttctatcatcccgtcaggccccctcaaagccgagatcgcgcagagactggaaagtgtttttgcagcgtacttgggagtcggccat

SEQ ID NO: 424334 - DNA, 140 bp, Artificial Sequence
  Synthetic
atggccgactcccaagtacgctgcaaaaacactttccagtctctgcgcgatctcggctttgagggggcctgacgggatgatagaaagaacgtacgtttcgacctcggttagaagactcatggagacccagcatggcgtat

SEQ ID NO: 424335 - DNA, 140 bp, Artificial Sequence
  Synthetic
atacgccatgctgggtctcccactgcatttcaagcaatatgaatgcagctccccaccaaacaaccaagtaatgctgtgtgaaccaactattatagaaagaaacataacagaggtggtgtacgtacttgggagtcggccat

SEQ ID NO: 424336 - DNA, 140 bp, Artificial Sequence
  Synthetic
atggccgactcccaagtacgtacaccacctctgttatgtttctttctataatagttggttcacacagcattacttggttgtttggtggggagctgcattcatattgcttgaaatgcagtgggagacccagcatggcgtat

SEQ ID NO: 424337 - DNA, 140 bp, Artificial Sequence
  Synthetic
atacgccatgctgggtctcccattgcacttcaagcaacatgactacaactcccccccaaacaaccaagtaatgctgtgtgaaccaacaataatagaaaagaacacaacagagattgtgtacgtacttgggagtcggccat

SEQ ID NO: 424338 - DNA, 140 bp, Artificial Sequence
  Synthetic
atggccgactcccaagtacgtacacaatctctgttgtgttcttttctattattgttggttcacacagcattacttggttgtttgggggggagttgtagtcatgttgcttgaagtgcaatgggagacccagcatggcgtat

SEQ ID NO: 424339 - DNA, 140 bp, Artificial Sequence
  Synthetic
atacgccatgctgggtctcctccaattacggcagacaaaaggataatggagatgatcccggaaagaaatgagcaaggtcagaccctttggagcaagacaaatgatgctggatcagacagacgtacttgggagtcggccat

SEQ ID NO: 424340 - DNA, 140 bp, Artificial Sequence
  Synthetic
atggccgactcccaagtacgtctgtctgatccagcatcatttgtcttgctccaaagggtctgaccttgctcatttctttccgggatcatctccattatccttttgtctgccgtaattggaggagacccagcatggcgtat

SEQ ID NO: 424341 - DNA, 140 bp, Artificial Sequence
  Synthetic
atacgccatgctgggtctccatgggaataataccactgatgactgtacttctattagtaacaacaagcaatgcagacaaaatatgcattggccatcagtcaacaaattccacagaaactgcgtacttgggagtcggccat

SEQ ID NO: 424342 - DNA, 140 bp, Artificial Sequence
  Synthetic
atggccgactcccaagtacgcagtttctgtggaatttgttgactgatggccaatgcatattttgtctgcattgcttgttgttactaatagaagtacagtcatcagtggtattattcccatggagacccagcatggcgtat

SEQ ID NO: 424343 - DNA, 140 bp, Artificial Sequence
  Synthetic
atacgccatgctgggtctccagggaaatgacatttcatggagcaaaggaagttgcactcagttactcaactggtgcgcttgccagctgcatgggtctcatatacaacaggatggggacagcgtacttgggagtcggccat

SEQ ID NO: 424344 - DNA, 140 bp, Artificial Sequence
  Synthetic
atggccgactcccaagtacgctgtccccatcctgttgtatatgagacccatgcagctggcaagcgcaccagttgagtaactgagtgcaacttcctttgctccatgaaatgtcatttccctggagacccagcatggcgtat

SEQ ID NO: 424345 - DNA, 140 bp, Artificial Sequence
  Synthetic
aggccctggctgctgatatgttaccatcatcaaaatgagcagggatcaggatatgcagccgacaaaaagagcacacagaatgccattgacgggatcactaacaaggtaaattccattattgaccttttgggacagcggtg

SEQ ID NO: 424346 - DNA, 140 bp, Artificial Sequence
  Synthetic
caccgctgtcccaaaaggtcaataatggaatttaccttgttagtgatcccgtcaatggcattctgtgtgctctttttgtcggctgcatatcctgatccctgctcattttgatgatggtaacatatcagcagccagggcct

SEQ ID NO: 424347 - DNA, 140 bp, Artificial Sequence
  Synthetic
aggccctggctgctgatatgatgaatccaaatcaaaagataataacaattggctctgtttctctcatcattgccacaatatgcttccttatgcaaattgccatcctggtaactactgtaagaccttttgggacagcggtg

SEQ ID NO: 424348 - DNA, 140 bp, Artificial Sequence
  Synthetic
caccgctgtcccaaaaggtcttacagtagttaccaggatggcaatttgcataaggaagcatattgtggcaatgatgagagaaacagagccaattgttattatcttttgatttggattcatcatatcagcagccagggcct

SEQ ID NO: 424349 - DNA, 140 bp, Artificial Sequence
  Synthetic
atacgccatgctgggtctccgacattcttcggcaaaatccaacagaggaacaagccgtggacatatgcaaagcagcaatgggcttaaggattagctcatccttcagctttggcggatttacgtacttgggagtcggccat

SEQ ID NO: 424350 - DNA, 140 bp, Artificial Sequence
  Synthetic
atggccgactcccaagtacgtaaatccgccaaagctgaaggatgagctaatccttaagcccattgctgctttgcatatgtccacggcttgttcctctgttggattttgccgaagaatgtcggagacccagcatggcgtat

SEQ ID NO: 424351 - DNA, 140 bp, Artificial Sequence
  Synthetic
aggccctggctgctgatatgctcctggtgttagatgtgtctgcagagacaactggaaaggctccaataggcccatcgtagatataaatgtaaaggatcatagcgttgtctctagttacgtgaccttttgggacagcggtg

SEQ ID NO: 424352 - DNA, 140 bp, Artificial Sequence
  Synthetic
caccgctgtcccaaaaggtcacgtaactagagacaacgctatgatcctttacatttatatctacgatgggcctattggagcctttccagttgtctctgcagacacatctaacaccaggagcatatcagcagccagggcct

SEQ ID NO: 424353 - DNA, 140 bp, Artificial Sequence
  Synthetic
atacgccatgctgggtctccgtagtcattgtctagatcctaacaatgaggaagggggtcatggggtgaaaggctgggcctttgatgatggaaacgatgtgtggatgggaagaacgatagacgtacttgggagtcggccat

SEQ ID NO: 424354 - DNA, 140 bp, Artificial Sequence
  Synthetic
atggccgactcccaagtacgtctatcgttcttcccatccacacatcgtttccatcatcaaaggcccagcctttcaccccatgacccccttcctcattgttaggatctagacaatgactacggagacccagcatggcgtat

SEQ ID NO: 424355 - DNA, 140 bp, Artificial Sequence
  Synthetic
aggccctggctgctgatatgggctgggcctttgatgatggaaacgatgtgtggatgggaagaacgatagacgagaagtcacgattaggttatgaaaccttcaaagtcattgaaggctggtgaccttttgggacagcggtg

SEQ ID NO: 424356 - DNA, 140 bp, Artificial Sequence
  Synthetic
caccgctgtcccaaaaggtcaccagccttcaatgactttgaaggtttcataacctaatcgtgacttctcgtctatcgttcttcccatccacacatcgtttccatcatcaaaggcccagcccatatcagcagccagggcct

SEQ ID NO: 424357 - DNA, 140 bp, Artificial Sequence
  Synthetic
aggccctggctgctgatatgcgaaacgtacgttctctctatcattccatcaggccccctcaaagccgagatcgcgcagagacttgaggatgtttttgcagggaagaacgcagatctcgaggaccttttgggacagcggtg

SEQ ID NO: 424358 - DNA, 140 bp, Artificial Sequence
  Synthetic
caccgctgtcccaaaaggtcctcgagatctgcgttcttccctgcaaaaacatcctcaagtctctgcgcgatctcggctttgagggggcctgatggaatgatagagagaacgtacgtttcgcatatcagcagccagggcct

SEQ ID NO: 424359 - DNA, 140 bp, Artificial Sequence
  Synthetic
aggccctggctgctgatatgacccagggatctttggaaactcgtgtcttgaaacgatggaaattgttcaacaaacaagagtggataaactaacccaaggtcgtcagacctatgactggacgaccttttgggacagcggtg

SEQ ID NO: 424360 - DNA, 140 bp, Artificial Sequence
  Synthetic
caccgctgtcccaaaaggtcgtccagtcataggtctgacgaccttgggttagtttatccactcttgtttgttgaacaatttccatcgtttcaagacacgagtttccaaagatccctgggtcatatcagcagccagggcct

SEQ ID NO: 424361 - DNA, 140 bp, Artificial Sequence
  Synthetic
aggccctggctgctgatatgacgggcaaccttcaaacattgaaaataagagtacatgagggatatgaagagttcacaatggttggaagaagagcaacagccatcctcaggaaggcaaccagaccttttgggacagcggtg

SEQ ID NO: 424362 - DNA, 140 bp, Artificial Sequence
  Synthetic
caccgctgtcccaaaaggtctggttgccttcctgaggatggctgttgctcttcttccaaccattgtgaactcttcatatccctcatgtactcttattttcaatgtttgaaggttgcccgtcatatcagcagccagggcct

SEQ ID NO: 424363 - DNA, 140 bp, Artificial Sequence
  Synthetic
atacgccatgctgggtctccaccggctccgccgagatcagaagtccctaagaggaagaggcaacactcttggtctggacatcgaaacagccactcgtgcggggaaacaaatagtggagcgcgtacttgggagtcggccat

SEQ ID NO: 424364 - DNA, 140 bp, Artificial Sequence
  Synthetic
atggccgactcccaagtacgcgctccactatttgtttccccgcacgagtggctgtttcgatgtccagaccaagagtgttgcctcttcctcttagggacttctgatctcggcggagccggtggagacccagcatggcgtat

SEQ ID NO: 424365 - DNA, 140 bp, Artificial Sequence
  Synthetic
aggccctggctgctgatatgctggaagagcaccccagtgcaggaaaggaccctaagaaaactggaggtccaatttacaggagaagagacggaaaatgggtgagagagctgatcctgtatggaccttttgggacagcggtg

SEQ ID NO: 424366 - DNA, 140 bp, Artificial Sequence
  Synthetic
caccgctgtcccaaaaggtccatacaggatcagctctctcacccattttccgtctcttctcctgtaaattggacctccagttttcttagggtcctttcctgcactggggtgctcttccagcatatcagcagccagggcct

SEQ ID NO: 424367 - DNA, 140 bp, Artificial Sequence
  Synthetic
atacgccatgctgggtctccatctgaggggacttacaaaatacttaccatttattcgactgtcgcctcatctcttgtacttgcaatggggtttgctgccttcttattctgggccatgtcacgtacttgggagtcggccat

SEQ ID NO: 424368 - DNA, 140 bp, Artificial Sequence
  Synthetic
atggccgactcccaagtacgtgacatggcccagaataagaaggcagcaaaccccattgcaagtacaagagatgaggcgacagtcgaataaatggtaagtattttgtaagtcccctcagatggagacccagcatggcgtat

SEQ ID NO: 424369 - DNA, 140 bp, Artificial Sequence
  Synthetic
atacgccatgctgggtctccatcggcttcgccgagatcagaagtcccttagaggaaggggcagcactcttggtctggatatcgagacagctactcgggcgggaaggcaaatagtggagcgcgtacttgggagtcggccat

SEQ ID NO: 424370 - DNA, 140 bp, Artificial Sequence
  Synthetic
atggccgactcccaagtacgcgctccactatttgccttcccgcccgagtagctgtctcgatatccagaccaagagtgctgccccttcctctaagggacttctgatctcggcgaagccgatggagacccagcatggcgtat

SEQ ID NO: 424371 - DNA, 140 bp, Artificial Sequence
  Synthetic
aggccctggctgctgatatgaaatataccacaaatgtgacaatgcctgcattggatcaatcagaaatggaacttatgaccatgatgtatacagagacgaggcattaagcaatcgattccagaccttttgggacagcggtg

SEQ ID NO: 424372 - DNA, 140 bp, Artificial Sequence
  Synthetic
caccgctgtcccaaaaggtctggaatcgattgcttaatgcctcgtctctgtatacatcatggtcataagttccatttctgattgatccaatgcaggcattgtcacatttgtggtatatttcatatcagcagccagggcct

SEQ ID NO: 424373 - DNA, 140 bp, Artificial Sequence
  Synthetic
atacgccatgctgggtctcctcttcagatcgaacggtctaacagccaatgaatcgggacggctgatagatttcctcaaggatgtgatggagtcaatggacaaggaagagatggagataatcgtacttgggagtcggccat

SEQ ID NO: 424374 - DNA, 140 bp, Artificial Sequence
  Synthetic
atggccgactcccaagtacgattatctccatctcttccttgtccattgactccatcacatccttgaggaaatctatcagccgtcccgattcattggctgttagaccgttcgatctgaagaggagacccagcatggcgtat

SEQ ID NO: 424375 - DNA, 140 bp, Artificial Sequence
  Synthetic
atacgccatgctgggtctccatgaaagtaaaactactgatcctgttatgtacatttacagctgcacatgcggacacaatatgtataggataccatgccaacaactcaaccgacactgttgcgtacttgggagtcggccat

SEQ ID NO: 424376 - DNA, 140 bp, Artificial Sequence
  Synthetic
atggccgactcccaagtacgcaacagtgtcggttgagttgttggcatggtatcctatacatattgtgtccgcatgtgcagctgtaaatgtacataacaggatcagtagttttactttcatggagacccagcatggcgtat

SEQ ID NO: 424377 - DNA, 140 bp, Artificial Sequence
  Synthetic
atacgccatgctgggtctccctggaaaggctccaataggcccatcgtagatataaatgtaaagaattatagcgttgtttccagttatgtatgctcaggacttgttggagacacacccagacgtacttgggagtcggccat

SEQ ID NO: 424378 - DNA, 140 bp, Artificial Sequence
  Synthetic
atggccgactcccaagtacgtctgggtgtgtctccaacaagtcctgagcatacataactggaaacaacgctataattctttacatttatatctacgatgggcctattggagcctttccagggagacccagcatggcgtat

SEQ ID NO: 424379 - DNA, 140 bp, Artificial Sequence
  Synthetic
aggccctggctgctgatatggggttcaaattgcttcaaatgagaacatggaagcaatggactccaatactcttgaactgagaagtagatattgggctataagaaccagaagcggagggaagaccttttgggacagcggtg

SEQ ID NO: 424380 - DNA, 140 bp, Artificial Sequence
  Synthetic
caccgctgtcccaaaaggtcttccctccgcttctggttcttatagcccaatatctacttctcagttcaagagtattggagtccattgcttccatgttctcatttgaagcaatttgaaccccatatcagcagccagggcct

SEQ ID NO: 424381 - DNA, 140 bp, Artificial Sequence
  Synthetic
aggccctggctgctgatatgagtgttcagcctgataagaccaaatgaaaacccagctcacaagagtcaattagtgtggatggcatgccactctgctgcatttgaggatctaagggtatcagaccttttgggacagcggtg

SEQ ID NO: 424382 - DNA, 140 bp, Artificial Sequence
  Synthetic
caccgctgtcccaaaaggtctgatacccttagatcctcaaatgcagcagagtggcatgccatccacactaattgactcttgtgagctgggttttcatttggtcttatcaggctgaacactcatatcagcagccagggcct

SEQ ID NO: 424383 - DNA, 140 bp, Artificial Sequence
  Synthetic
aggccctggctgctgatatgtagtgtggatggcatgccactctgctgcatttgaggatctaagggtatcaagtttcataagagggaagaaagtgattccaagaggaaagctgtccacaaggaccttttgggacagcggtg

SEQ ID NO: 424384 - DNA, 140 bp, Artificial Sequence
  Synthetic
caccgctgtcccaaaaggtccttgtggacagctttcctcttggaatcactttcttccctcttatgaaacttgatacccttagatcctcaaatgcagcagagtggcatgccatccacactacatatcagcagccagggcct

SEQ ID NO: 424385 - DNA, 140 bp, Artificial Sequence
  Synthetic
atacgccatgctgggtctcccaagacatatgggcatataatgctgaattgctagtactgcttgaaaatcaaaaaactctagatgagcatgacgcaaatgtaaacaatctatataacaaagcgtacttgggagtcggccat

SEQ ID NO: 424386 - DNA, 140 bp, Artificial Sequence
  Synthetic
atggccgactcccaagtacgctttgttatatagattgtttacatttgcgtcatgctcatctagagttttttgattttcaagcagtactagcaattcagcattatatgcccatatgtcttgggagacccagcatggcgtat

SEQ ID NO: 424387 - DNA, 140 bp, Artificial Sequence
  Synthetic
aggccctggctgctgatatgtttacaggaaatactgagggtagaacgtctgacatgaggactgaaatcataagaatgatggaaagtgccagaccagaagatgtgtcattccaggggcggggaccttttgggacagcggtg

SEQ ID NO: 424388 - DNA, 140 bp, Artificial Sequence
  Synthetic
caccgctgtcccaaaaggtccccgcccctggaatgacacatcttctggtctggcactttccatcattcttatgatttcagtcctcatgtcagacgttctaccctcagtatttcctgtaaacatatcagcagccagggcct

SEQ ID NO: 424389 - DNA, 140 bp, Artificial Sequence
  Synthetic
atacgccatgctgggtctccatagaaaccaaccggctgcaacggctttggccaacacaatagaagtcttcaggatgaacagtttaacagccaatgaatcgggaagattaatagatttcctcgtacttgggagtcggccat

SEQ ID NO: 424390 - DNA, 140 bp, Artificial Sequence
  Synthetic
atggccgactcccaagtacgaggaaatctattaatcttcccgattcattggctgttaaactgttcatcctgaagacttctattgtgttggccaaagccgttgcagccggttggtttctatggagacccagcatggcgtat

SEQ ID NO: 424391 - DNA, 140 bp, Artificial Sequence
  Synthetic
  misc_feature (22)..(22): n is a, c, g, or t
aggccctggctgctgatatgtnagcggcattgggagattctacatacagatgtgtacagaactcaaactcagtgacaatgaagggaggctgattcagaacagtataacaatagagagaatgaccttttgggacagcggtg

SEQ ID NO: 424392 - DNA, 140 bp, Artificial Sequence
  Synthetic
  misc_feature (119)..(119): n is a, c, g, or t
caccgctgtcccaaaaggtcattctctctattgttatactgttctgaatcagcctcccttcattgtcactgagtttgagttctgtacacatctgtatgtagaatctcccaatgccgctnacatatcagcagccagggcct

SEQ ID NO: 424393 - DNA, 140 bp, Artificial Sequence
  Synthetic
  misc_feature (45)..(45): n is a, c, g, or t
atacgccatgctgggtctccacctgaccatctagcgacctccacnagcaggggatacaaaatgaacactcaaatcctggtattcgctctgattgcgatcattccaacaaatgcagacaaacgtacttgggagtcggccat

SEQ ID NO: 424394 - DNA, 140 bp, Artificial Sequence
  Synthetic
  misc_feature (96)..(96): n is a, c, g, or t
atggccgactcccaagtacgtttgtctgcatttgttggaatgatcgcaatcagagcgaataccaggatttgagtgttcattttgtatcccctgctngtggaggtcgctagatggtcaggtggagacccagcatggcgtat

SEQ ID NO: 424395 - DNA, 140 bp, Artificial Sequence
  Synthetic
aggccctggctgctgatatgagggggttctataaatacaaggcttccctttcaaaatttgtcaccaaggacagtgggtcaatgtcctaaatatgtaaacaaaaagagcttgatgcttgcagaccttttgggacagcggtg

SEQ ID NO: 424396 - DNA, 140 bp, Artificial Sequence
  Synthetic
caccgctgtcccaaaaggtctgcaagcatcaagctctttttgtttacatatttaggacattgacccactgtccttggtgacaaattttgaaagggaagccttgtatttatagaaccccctcatatcagcagccagggcct

SEQ ID NO: 424397 - DNA, 140 bp, Artificial Sequence
  Synthetic
atacgccatgctgggtctccatggacccagcacacaacaactggtggttctcgggcttgtgcagtatctgggaacccatcattcttccgaaacatggtctggctcacaaagaagggatcacgtacttgggagtcggccat

SEQ ID NO: 424398 - DNA, 140 bp, Artificial Sequence
  Synthetic
atggccgactcccaagtacgtgatcccttctttgtgagccagaccatgtttcggaagaatgatgggttcccagatactgcacaagcccgagaaccaccagttgttgtgtgctgggtccatggagacccagcatggcgtat

SEQ ID NO: 424399 - DNA, 140 bp, Artificial Sequence
  Synthetic
atacgccatgctgggtctcccaatgtggactcctggggacaatcactggaccacctcaatgtgaccaattcctagaattttcagccgatttaattattgagaggcgagaaggaagtgatgcgtacttgggagtcggccat

SEQ ID NO: 424400 - DNA, 140 bp, Artificial Sequence
  Synthetic
atggccgactcccaagtacgcatcacttccttctcgcctctcaataattaaatcggctgaaaattctaggaattggtcacattgaggtggtccagtgattgtccccaggagtccacattgggagacccagcatggcgtat

SEQ ID NO: 424401 - DNA, 140 bp, Artificial Sequence
  Synthetic
atacgccatgctgggtctccatggtccaaaaaaatcctcagaacccaggagtcggaatgtgtatgtatcaatggaacttgtgcagtagtaatgactgatgggagtgcttcaggaaaagctcgtacttgggagtcggccat

SEQ ID NO: 424402 - DNA, 140 bp, Artificial Sequence
  Synthetic
atggccgactcccaagtacgagcttttcctgaagcactcccatcagtcattactactgcacaagttccattgatacatacacattccgactcctgggttctgaggatttttttggaccatggagacccagcatggcgtat

SEQ ID NO: 424403 - DNA, 140 bp, Artificial Sequence
  Synthetic
aggccctggctgctgatatggatccaaatgcattactgaagcaccgatttgaaataattgaaggaagagaccgaacaatggcctggacagtggtgaatagcatctgcaacaccacagggggaccttttgggacagcggtg

SEQ ID NO: 424404 - DNA, 140 bp, Artificial Sequence
  Synthetic
caccgctgtcccaaaaggtccccctgtggtgttgcagatgctattcaccactgtccaggccattgttcggtctcttccttcaattatttcaaatcggtgcttcagtaatgcatttggatccatatcagcagccagggcct

SEQ ID NO: 424405 - DNA, 140 bp, Artificial Sequence
  Synthetic
atacgccatgctgggtctccaagccaacaaaataaaatcagagaagacacacatccacattttctcgttcactggagaagaaatggccactaaggcagattacacacttgacgaggaaagcgtacttgggagtcggccat

SEQ ID NO: 424406 - DNA, 140 bp, Artificial Sequence
  Synthetic
atggccgactcccaagtacgctttcctcgtcaagtgtgtaatctgccttagtggccatttcttctccagtgaacgagaaaatgtggatgtgtgtcttctctgattttattttgttggcttggagacccagcatggcgtat

SEQ ID NO: 424407 - DNA, 140 bp, Artificial Sequence
  Synthetic
aggccctggctgctgatatgaagagtggacaaactaacccaaggccgccagacctatgactggacattgaatagaaatcaaccagctgcaactgctttggccaacactatagaggtcttcgaccttttgggacagcggtg

SEQ ID NO: 424408 - DNA, 140 bp, Artificial Sequence
  Synthetic
caccgctgtcccaaaaggtcgaagacctctatagtgttggccaaagcagttgcagctggttgatttctattcaatgtccagtcataggtctggcggccttgggttagtttgtccactcttcatatcagcagccagggcct

SEQ ID NO: 424409 - DNA, 140 bp, Artificial Sequence
  Synthetic
atacgccatgctgggtctccttagggccctatgggactcctttcgtcagtccgaaagaggcgaagagacagttgaagaaaggtttgaaatcaaaggaaccatgcataggcttgccaatcacgtacttgggagtcggccat

SEQ ID NO: 424410 - DNA, 140 bp, Artificial Sequence
  Synthetic
atggccgactcccaagtacgtgattggcaagcctatgcatggttcctttgatttcaaacctttcttcaactgtctcttcgcctctttcggactgacgaaaggagtcccatagggccctaaggagacccagcatggcgtat

SEQ ID NO: 424411 - DNA, 140 bp, Artificial Sequence
  Synthetic
atacgccatgctgggtctccaacagtgaaaaatggtttgtacccaaacctgagcaaatcctatgaaaacgacaaagggaaagaagtccttatattatggggtgttcatcatccgcccaaccgtacttgggagtcggccat

SEQ ID NO: 424412 - DNA, 140 bp, Artificial Sequence
  Synthetic
atggccgactcccaagtacggttgggcggatgatgaacaccccataatataaggacttctttccctttgtcgttttcataggatttgctcaggtttgggtacaaaccatttttcactgttggagacccagcatggcgtat

SEQ ID NO: 424413 - DNA, 140 bp, Artificial Sequence
  Synthetic
atacgccatgctgggtctcctcagtttcaatggggctttcatagctccagaccgtgcaagcttcctgagaggaaaatctatgggaatccagagtggagtacaggttgatgccaattgtgacgtacttgggagtcggccat

SEQ ID NO: 424414 - DNA, 140 bp, Artificial Sequence
  Synthetic
atggccgactcccaagtacgtcacaattggcatcaacctgtactccactctggattcccatagattttcctctcaggaagcttgcacggtctggagctatgaaagccccattgaaactgaggagacccagcatggcgtat

SEQ ID NO: 424415 - DNA, 140 bp, Artificial Sequence
  Synthetic
atacgccatgctgggtctccgaacccggggatacaataatatttgaggcaaatggaaatctaatagctccatggtatgctttcgcactgagtagaggccttggatcaggaatcatcacctcgtacttgggagtcggccat

SEQ ID NO: 424416 - DNA, 140 bp, Artificial Sequence
  Synthetic
atggccgactcccaagtacgaggtgatgattcctgatccaaggcctctactcagtgcgaaagcataccatggagctattagatttccatttgcctcaaatattattgtatccccgggttcggagacccagcatggcgtat

SEQ ID NO: 424417 - DNA, 140 bp, Artificial Sequence
  Synthetic
atacgccatgctgggtctccgctataaacagcagtcttcctttccagaatgtacacccagttacaataggagaatgtccaaaatatgtcaggagtacaaaattaaggatggtcacaggaccgtacttgggagtcggccat

SEQ ID NO: 424418 - DNA, 140 bp, Artificial Sequence
  Synthetic
atggccgactcccaagtacggtcctgtgaccatccttaattttgtactcctgacatattttggacattctcctattgtaactgggtgtacattctggaaaggaagactgctgtttatagcggagacccagcatggcgtat

SEQ ID NO: 424419 - DNA, 140 bp, Artificial Sequence
  Synthetic
aggccctggctgctgatatgatgaagagaaaatcccaaagacgaagaacatgaagaaaacaagccaattgaagtgggcacttggtgagaacatggcaccagagaaagtggactttgaggagaccttttgggacagcggtg

SEQ ID NO: 424420 - DNA, 140 bp, Artificial Sequence
  Synthetic
caccgctgtcccaaaaggtctcctcaaagtccactttctctggtgccatgttctcaccaagtgcccacttcaattggcttgttttcttcatgttcttcgtctttgggattttctcttcatcatatcagcagccagggcct

SEQ ID NO: 424421 - DNA, 140 bp, Artificial Sequence
  Synthetic
atacgccatgctgggtctccctacagctaaggctatggaacagatggctggatcgagtgagcaggcagcagaggccatggaggttgccagtcagactaggcagatggtgcatgcaatgagcgtacttgggagtcggccat

SEQ ID NO: 424422 - DNA, 140 bp, Artificial Sequence
  Synthetic
atggccgactcccaagtacgctcattgcatgcaccatctgcctagtctgactggcaacctccatggcctctgctgcctgctcactcgatccagccatctgttccatagccttagctgtagggagacccagcatggcgtat

SEQ ID NO: 424423 - DNA, 140 bp, Artificial Sequence
  Synthetic
atacgccatgctgggtctccaacatcaacactgaatcagaggtcaatcccagaaatagccaccagacccaaagtgaatggacagagtggaaggatggagtttttttggacaatactaaggcgtacttgggagtcggccat

SEQ ID NO: 424424 - DNA, 140 bp, Artificial Sequence
  Synthetic
atggccgactcccaagtacgccttagtattgtccaaaaaaactccatccttccactctgtccattcactttgggtctggtggctatttctgggattgacctctgattcagtgttgatgttggagacccagcatggcgtat

SEQ ID NO: 424425 - DNA, 140 bp, Artificial Sequence
  Synthetic
atacgccatgctgggtctcctttggacatacaatgcagagttgttggttctactggaaaatgaaagaactttggacttccacgactccaatgtgaagagtctgtacgagaaagtgaaaagcgtacttgggagtcggccat

SEQ ID NO: 424426 - DNA, 140 bp, Artificial Sequence
  Synthetic
atggccgactcccaagtacgcttttcactttctcgtacagactcttcacattggagtcgtggaagtccaaagttctttcattttccagtagaaccaacaactctgcattgtatgtccaaaggagacccagcatggcgtat

SEQ ID NO: 424427 - DNA, 140 bp, Artificial Sequence
  Synthetic
  misc_feature (118)..(118): n is a, c, g, or t
atacgccatgctgggtctccgaagatggcactggttgctttgaaatatttcacaagtgtgatgatgactgtatggccagtattagaaataacacctatgatcacagcaaatacagggnagcgtacttgggagtcggccat

SEQ ID NO: 424428 - DNA, 140 bp, Artificial Sequence
  Synthetic
  misc_feature (23)..(23): n is a, c, g, or t
atggccgactcccaagtacgctnccctgtatttgctgtgatcataggtgttatttctaatactggccatacagtcatcatcacacttgtgaaatatttcaaagcaaccagtgccatcttcggagacccagcatggcgtat

SEQ ID NO: 424429 - DNA, 140 bp, Artificial Sequence
  Synthetic
aggccctggctgctgatatgtcaaaattgggggattgaacctattgataatgtcatggggatgattggaatattacctgacatgactccaagcacagagatgtcactaagaggagtaagagaccttttgggacagcggtg

SEQ ID NO: 424430 - DNA, 140 bp, Artificial Sequence
  Synthetic
caccgctgtcccaaaaggtctcttactcctcttagtgacatctctgtgcttggagtcatgtcaggtaatattccaatcatccccatgacattatcaataggttcaatcccccaattttgacatatcagcagccagggcct

SEQ ID NO: 424431 - DNA, 140 bp, Artificial Sequence
  Synthetic
atacgccatgctgggtctcctggagtaaaattggactcaatgggggtctatcggattctggcgatctactcaactgtcgccagttccctggttcttttggtctccctgggggcaatcagccgtacttgggagtcggccat

SEQ ID NO: 424432 - DNA, 140 bp, Artificial Sequence
  Synthetic
atggccgactcccaagtacggctgattgcccccagggagaccaaaagaaccagggaactggcgacagttgagtagatcgccagaatccgatagacccccattgagtccaattttactccaggagacccagcatggcgtat

SEQ ID NO: 424433 - DNA, 140 bp, Artificial Sequence
  Synthetic
aggccctggctgctgatatgtgaggactgcaataggccaagtgtcaaggcccatgttcctgtacgttagaaccaatgggacctccaagatcaagatgaaatggggtatggaaatgaggcggaccttttgggacagcggtg

SEQ ID NO: 424434 - DNA, 140 bp, Artificial Sequence
  Synthetic
caccgctgtcccaaaaggtccgcctcatttccataccccatttcatcttgatcttggaggtcccattggttctaacgtacaggaacatgggccttgacacttggcctattgcagtcctcacatatcagcagccagggcct

SEQ ID NO: 424435 - DNA, 140 bp, Artificial Sequence
  Synthetic
atacgccatgctgggtctccaccaatgggacctccaagatcaagatgaaatggggtatggaaatgaggcgctgccttcttcagtctcttcaacagatcgagagcatgattgaggctgagtcgtacttgggagtcggccat

SEQ ID NO: 424436 - DNA, 140 bp, Artificial Sequence
  Synthetic
atggccgactcccaagtacgactcagcctcaatcatgctctcgatctgttgaagagactgaagaaggcagcgcctcatttccataccccatttcatcttgatcttggaggtcccattggtggagacccagcatggcgtat

SEQ ID NO: 424437 - DNA, 140 bp, Artificial Sequence
  Synthetic
atacgccatgctgggtctccagactgctttctttggcatgtccgcaaacgatttgcagaccaagaaatgggtgatgccccatttctagaccggcttcgccgagatcagaagtccctgagacgtacttgggagtcggccat

SEQ ID NO: 424438 - DNA, 140 bp, Artificial Sequence
  Synthetic
atggccgactcccaagtacgtctcagggacttctgatctcggcgaagccggtctagaaatggggcatcacccatttcttggtctgcaaatcgtttgcggacatgccaaagaaagcagtctggagacccagcatggcgtat

SEQ ID NO: 424439 - DNA, 140 bp, Artificial Sequence
  Synthetic
aggccctggctgctgatatgcttctgtcaaagaaaaggacatgactaaggaattctttgaaaacaagtcggaaacatggccaattggagaatcccccaggggagtagaggaaggctctatgaccttttgggacagcggtg

SEQ ID NO: 424440 - DNA, 140 bp, Artificial Sequence
  Synthetic
caccgctgtcccaaaaggtcatagagccttcctctactcccctgggggattctccaattggccatgtttccgacttgttttcaaagaattccttagtcatgtccttttctttgacagaagcatatcagcagccagggcct

SEQ ID NO: 424441 - DNA, 140 bp, Artificial Sequence
  Synthetic
atacgccatgctgggtctccgtggatcatccgttaaaagagaagaagaagtgcttacaggcaatctccaaacactaaaaatacgcgtacatgaggggtatgaggagttcacaatggttggcgtacttgggagtcggccat

SEQ ID NO: 424442 - DNA, 140 bp, Artificial Sequence
  Synthetic
atggccgactcccaagtacgccaaccattgtgaactcctcatacccctcatgtacgcgtatttttagtgtttggagattgcctgtaagcacttcttcttctcttttaacggatgatccacggagacccagcatggcgtat

SEQ ID NO: 424443 - DNA, 140 bp, Artificial Sequence
  Synthetic
atacgccatgctgggtctccgggattatatgatgcgattgaggagtgcctgattaatgatccctgggttttgcttaatgcatcttggttcaactccttccttatgcatgcactgaaataacgtacttgggagtcggccat

SEQ ID NO: 424444 - DNA, 140 bp, Artificial Sequence
  Synthetic
atggccgactcccaagtacgttatttcagtgcatgcataaggaaggagttgaaccaagatgcattaagcaaaacccagggatcattaatcaggcactcctcaatcgcatcatataatcccggagacccagcatggcgtat

SEQ ID NO: 424445 - DNA, 140 bp, Artificial Sequence
  Synthetic
atacgccatgctgggtctccatggatgtcaacccgactctacttttcttaaaagtgccagcacaaaatgctataagcactacattcccttatactggagatcccccatatagtcatggaacgtacttgggagtcggccat

SEQ ID NO: 424446 - DNA, 140 bp, Artificial Sequence
  Synthetic
atggccgactcccaagtacgttccatgactatatgggggatctccagtataagggaatgtagtgcttatagcattttgtgctggcacttttaagaaaagtagagtcgggttgacatccatggagacccagcatggcgtat

SEQ ID NO: 424447 - DNA, 140 bp, Artificial Sequence
  Synthetic
aggccctggctgctgatatgatggatgtcaatccgactctacttttcctaaaaattccagcgcaaaatgccataagcaccacattcccttatactggagatcctccatacagccatggaagaccttttgggacagcggtg

SEQ ID NO: 424448 - DNA, 140 bp, Artificial Sequence
  Synthetic
caccgctgtcccaaaaggtcttccatggctgtatggaggatctccagtataagggaatgtggtgcttatggcattttgcgctggaatttttaggaaaagtagagtcggattgacatccatcatatcagcagccagggcct

SEQ ID NO: 424449 - DNA, 140 bp, Artificial Sequence
  Synthetic
atacgccatgctgggtctccaggtggttaattgaagaagtacggcacagattgaaagcgacagagaatagtttcgaacaaataacatttatgcaagccttacaactactgcttgaagtagcgtacttgggagtcggccat

SEQ ID NO: 424450 - DNA, 140 bp, Artificial Sequence
  Synthetic
atggccgactcccaagtacgctacttcaagcagtagttgtaaggcttgcataaatgttatttgttcgaaactattctctgtcgctttcaatctgtgccgtacttcttcaattaaccacctggagacccagcatggcgtat

SEQ ID NO: 424451 - DNA, 140 bp, Artificial Sequence
  Synthetic
aggccctggctgctgatatgtcaatggtcacaggaccccacgatgttatataacaagatggaattcgagccatttcagtctctggttcctaaggcagccagaggtcagtacagtggattcgaccttttgggacagcggtg

SEQ ID NO: 424452 - DNA, 140 bp, Artificial Sequence
  Synthetic
caccgctgtcccaaaaggtcgaatccactgtactgacctctggctgccttaggaaccagagactgaaatggctcgaattccatcttgttatataacatcgtggggtcctgtgaccattgacatatcagcagccagggcct

SEQ ID NO: 424453 - DNA, 140 bp, Artificial Sequence
  Synthetic
aggccctggctgctgatatgtctaataagagcactgacactgaacacaatgaccaaagacgccgaaagaggcaaattaaagagaagagcaattgcaacaccaggaatgcaaatcagaggagaccttttgggacagcggtg

SEQ ID NO: 424454 - DNA, 140 bp, Artificial Sequence
  Synthetic
caccgctgtcccaaaaggtctcctctgatttgcattcctggtgttgcaattgctcttctctttaatttgcctctttcggcgtctttggtcattgtgttcagtgtcagtgctcttattagacatatcagcagccagggcct

SEQ ID NO: 424455 - DNA, 140 bp, Artificial Sequence
  Synthetic
  misc_feature (102)..(102): n is a, c, g, or t
atacgccatgctgggtctccttgattgaagaagtacgacatagattaaaaattacggagaatagctttgagcaaataacttttatgcaagccttacaactantgccbgaagtggaggtcgcgtacttgggagtcggccat

SEQ ID NO: 424456 - DNA, 140 bp, Artificial Sequence
  Synthetic
  misc_feature (39)..(39): n is a, c, g, or t
atggccgactcccaagtacgcgacctccacttcbggcantagttgtaaggcttgcataaaagttatttgctcaaagctattctccgtaatttttaatctatgtcgtacttcttcaatcaaggagacccagcatggcgtat

SEQ ID NO: 424457 - DNA, 140 bp, Artificial Sequence
  Synthetic
atacgccatgctgggtctccacacaaaggacaataggaaagaaaaagcagaagctgaacaagaggaattatctaataagagcattgacattaaacacaatgacaaaggatgcagaaagagcgtacttgggagtcggccat

SEQ ID NO: 424458 - DNA, 140 bp, Artificial Sequence
  Synthetic
atggccgactcccaagtacgctctttctgcatcctttgtcattgtgtttaatgtcaatgctcttattagataattcctcttgttcagcttctgctttttctttcctattgtcctttgtgtggagacccagcatggcgtat

SEQ ID NO: 424459 - DNA, 140 bp, Artificial Sequence
  Synthetic
atacgccatgctgggtctcctgcccttccacaacattcacccattgacaataggtgagtgccccaagtatgtcaagtcagatagactggttttggcgaccggactaagaaatgtccctcacgtacttgggagtcggccat

SEQ ID NO: 424460 - DNA, 140 bp, Artificial Sequence
  Synthetic
atggccgactcccaagtacgtgagggacatttcttagtccggtcgccaaaaccagtctatctgacttgacatacttggggcactcacctattgtcaatgggtgaatgttgtggaagggcaggagacccagcatggcgtat

SEQ ID NO: 424461 - DNA, 140 bp, Artificial Sequence
  Synthetic
atacgccatgctgggtctccatgttgtgaggaaaatgatgaccaactcacaagatacagagctttcctttacaattactggggacaacaccaaatggaatgagaatcaaaaccccaggatcgtacttgggagtcggccat

SEQ ID NO: 424462 - DNA, 140 bp, Artificial Sequence
  Synthetic
atggccgactcccaagtacgatcctggggttttgattctcattccatttggtgttgtccccagtaattgtaaaggaaagctctgtatcttgtgagttggtcatcattttcctcacaacatggagacccagcatggcgtat

SEQ ID NO: 424463 - DNA, 140 bp, Artificial Sequence
  Synthetic
atacgccatgctgggtctccggtgataggtccggttattctggtattttctctgttgaaggcaaaagctgcatcaatcggtgcttttatgtggagttgattaggggaaggaaagaggaaacgtacttgggagtcggccat

SEQ ID NO: 424464 - DNA, 140 bp, Artificial Sequence
  Synthetic
atggccgactcccaagtacgtttcctctttccttcccctaatcaactccacataaaagcaccgattgatgcagcttttgccttcaacagagaaaataccagaataaccggacctatcaccggagacccagcatggcgtat

SEQ ID NO: 424465 - DNA, 140 bp, Artificial Sequence
  Synthetic
aggccctggctgctgatatggcaaattaaaaaggagggctatcgcgacacctgggatgcaaattagagggttcgtgtactttgttgagactttagctagaagcatttgcgaaaagcttgagaccttttgggacagcggtg

SEQ ID NO: 424466 - DNA, 140 bp, Artificial Sequence
  Synthetic
caccgctgtcccaaaaggtctcaagcttttcgcaaatgcttctagctaaagtctcaacaaagtacacgaaccctctaatttgcatcccaggtgtcgcgatagccctcctttttaatttgccatatcagcagccagggcct

SEQ ID NO: 424467 - DNA, 140 bp, Artificial Sequence
  Synthetic
atacgccatgctgggtctccatggcagaatcttgaagactgatttgaatagtggcaactgcgtagtgcaatgtcagactgagaaaggtggcctaaacacgaccctaccgtttcacaatgtcgtacttgggagtcggccat

SEQ ID NO: 424468 - DNA, 140 bp, Artificial Sequence
  Synthetic
atggccgactcccaagtacgacattgtgaaacggtagggtcgtgtttaggccacctttctcagtctgacattgcactacgcagttgccactattcaaatcagtcttcaagattctgccatggagacccagcatggcgtat

SEQ ID NO: 424469 - DNA, 140 bp, Artificial Sequence
  Synthetic
aggccctggctgctgatatgatatacaacaggatgggaacggtgactacggaagtggcttttggcctagtgtgtgccacttgtgagcagattgcagattcacagcatcggtctcacagacgaccttttgggacagcggtg

SEQ ID NO: 424470 - DNA, 140 bp, Artificial Sequence
  Synthetic
caccgctgtcccaaaaggtcgtctgtgagaccgatgctgtgaatctgcaatctgctcacaagtggcacacactaggccaaaagccacttccgtagtcaccgttcccatcctgttgtatatcatatcagcagccagggcct

SEQ ID NO: 424471 - DNA, 140 bp, Artificial Sequence
  Synthetic
atacgccatgctgggtctccaacatttcaggcttccattgcccttgtgtcctttcaaaggtttcttcccatttcacaaggataatgctctaaggctagctgaaaacaaagatgtcttagtcgtacttgggagtcggccat

SEQ ID NO: 424472 - DNA, 140 bp, Artificial Sequence
  Synthetic
atggccgactcccaagtacgactaagacatctttgttttcagctagccttagagcattatccttgtgaaatgggaagaaacctttgaaaggacacaagggcaatggaagcctgaaatgttggagacccagcatggcgtat

SEQ ID NO: 424473 - DNA, 140 bp, Artificial Sequence
  Synthetic
aggccctggctgctgatatgatagagactcccaagtatctggctgatttgtttgattataaaaccaaaagatttatagaagttggaataacaaagggattggctgatgattacttttggagaccttttgggacagcggtg

SEQ ID NO: 424474 - DNA, 140 bp, Artificial Sequence
  Synthetic
caccgctgtcccaaaaggtctccaaaagtaatcatcagccaatccctttgttattccaacttctataaatcttttggttttataatcaaacaaatcagccagatacttgggagtctctatcatatcagcagccagggcct

SEQ ID NO: 424475 - DNA, 140 bp, Artificial Sequence
  Synthetic
aggccctggctgctgatatgttccaatccttggtacctaaagctgccagaggccaatacagtggatttgtgagaacactgttccaacaaatgcgtgacgtattggggacatttgatactagaccttttgggacagcggtg

SEQ ID NO: 424476 - DNA, 140 bp, Artificial Sequence
  Synthetic
caccgctgtcccaaaaggtctagtatcaaatgtccccaatacgtcacgcatttgttggaacagtgttctcacaaatccactgtattggcctctggcagctttaggtaccaaggattggaacatatcagcagccagggcct

SEQ ID NO: 424477 - DNA, 140 bp, Artificial Sequence
  Synthetic
atacgccatgctgggtctccaatcaagactactcgttaagtaatgaatcctcattggatgaggaagggaaagggagagtgctaagcagactcacagaacttcaggctgaattaagtctgacgtacttgggagtcggccat

SEQ ID NO: 424478 - DNA, 140 bp, Artificial Sequence
  Synthetic
atggccgactcccaagtacgtcagacttaattcagcctgaagttctgtgagtctgcttagcactctccctttcccttcctcatccaatgaggattcattacttaacgagtagtcttgattggagacccagcatggcgtat

SEQ ID NO: 424479 - DNA, 140 bp, Artificial Sequence
  Synthetic
aggccctggctgctgatatgtttcacaaggataatgctctaaggctagctgaaaacaaagatgtcttagtaacaagggaaccctacatcagttgcgacaatgaagtctgttggtcttttggaccttttgggacagcggtg

SEQ ID NO: 424480 - DNA, 140 bp, Artificial Sequence
  Synthetic
caccgctgtcccaaaaggtccaaaagaccaacagacttcattgtcgcaactgatgtagggttcccttgttactaagacatctttgttttcagctagccttagagcattatccttgtgaaacatatcagcagccagggcct

SEQ ID NO: 424481 - DNA, 140 bp, Artificial Sequence
  Synthetic
aggccctggctgctgatatgttctgagacactttcagagggatgcaaaagtgttatttcaaaattggggggttgagcccatagacaatgtcatggggatgatcgggatactgcctgatatgaccttttgggacagcggtg

SEQ ID NO: 424482 - DNA, 140 bp, Artificial Sequence
  Synthetic
caccgctgtcccaaaaggtcatatcaggcagtatcccgatcatccccatgacattgtctatgggctcaaccccccaattttgaaataacacttttgcatccctctgaaagtgtctcagaacatatcagcagccagggcct

SEQ ID NO: 424483 - DNA, 140 bp, Artificial Sequence
  Synthetic
atacgccatgctgggtctccagcaaaagcaggggaaatatcaagaaatcaagatgaagaaaacactgctccttgcagcgatcatcatctgcattcaagcagacgagatctgcatcgggtacgtacttgggagtcggccat

SEQ ID NO: 424484 - DNA, 140 bp, Artificial Sequence
  Synthetic
atggccgactcccaagtacgtacccgatgcagatctcgtctgcttgaatgcagatgatgatcgctgcaaggagcagtgttttcttcatcttgatttcttgatatttcccctgcttttgctggagacccagcatggcgtat

SEQ ID NO: 424485 - DNA, 140 bp, Artificial Sequence
  Synthetic
atacgccatgctgggtctccaatcaaaagcaggattattagtatctgatggagggccaaatttatataatatccggaatcttcacattcctgaagtctgcctaaaatgggagctaatggacgtacttgggagtcggccat

SEQ ID NO: 424486 - DNA, 140 bp, Artificial Sequence
  Synthetic
atggccgactcccaagtacgtccattagctcccattttaggcagacttcaggaatgtgaagattccggatattatataaatttggccctccatcagatactaataatcctgcttttgattggagacccagcatggcgtat

SEQ ID NO: 424487 - DNA, 140 bp, Artificial Sequence
  Synthetic
aggccctggctgctgatatgatggagagaataaaagaattaagagatctgatgtcgcagtctcgcactcgcgagatactgacaaaaaccactgtggaccatatggcaataataaaaaaatgaccttttgggacagcggtg

SEQ ID NO: 424488 - DNA, 140 bp, Artificial Sequence
  Synthetic
caccgctgtcccaaaaggtcatttttttattattgccatatggtccacagtggtttttgtcagtatctcgcgagtgcgagactgcgacatcagatctcttaattcttttattctctccatcatatcagcagccagggcct

SEQ ID NO: 424489 - DNA, 140 bp, Artificial Sequence
  Synthetic
aggccctggctgctgatatgaatacttaccatttattcgactgtcgcctcatctcttgtacttgcaatggggtctgctgccttcttattctgggccatgtcaaacgtatcaagcagagtcgaccttttgggacagcggtg

SEQ ID NO: 424490 - DNA, 140 bp, Artificial Sequence
  Synthetic
caccgctgtcccaaaaggtcgactctgcttgatacgtttgacatggcccagaataagaaggcagcagaccccattgcaagtacaagagatgaggcgacagtcgaataaatggtaagtattcatatcagcagccagggcct

SEQ ID NO: 424491 - DNA, 140 bp, Artificial Sequence
  Synthetic
aggccctggctgctgatatgatattttgaaaaagtggaaagattgaagcatgggacctttggtccagtgcattttcgaaatcaagttaaaatacgcagaagggttgacataaacccaggcgaccttttgggacagcggtg

SEQ ID NO: 424492 - DNA, 140 bp, Artificial Sequence
  Synthetic
caccgctgtcccaaaaggtcgcctgggtttatgtcaacccttctgcgtattttaacttgatttcgaaaatgcactggaccaaaggtcccatgcttcaatctttccactttttcaaaatatcatatcagcagccagggcct

SEQ ID NO: 424493 - DNA, 140 bp, Artificial Sequence
  Synthetic
aggccctggctgctgatatggcctctacagttatgatgaagtatgtgctttttcacacttcattgttgaatgaaagcaatgccagcatgggaaaatacaaagtaataccaataaccaacagaccttttgggacagcggtg

SEQ ID NO: 424494 - DNA, 140 bp, Artificial Sequence
  Synthetic
caccgctgtcccaaaaggtctgttggttattggtattactttgtattttcccatgctggcattgctttcattcaacaatgaagtgtgaaaaagcacatacttcatcataactgtagaggccatatcagcagccagggcct

SEQ ID NO: 424495 - DNA, 140 bp, Artificial Sequence
  Synthetic
aggccctggctgctgatatgcaataacaaaggagaagaaagaggaactccaagattgtaagattgcccctttgatggtggcatacatgttggaaagagaactggtccgcaaaaccagattgaccttttgggacagcggtg

SEQ ID NO: 424496 - DNA, 140 bp, Artificial Sequence
  Synthetic
caccgctgtcccaaaaggtcaatctggttttgcggaccagttctctttccaacatgtatgccaccatcaaaggggcaatcttacaatcttggagttcctctttcttctcctttgttattgcatatcagcagccagggcct

SEQ ID NO: 424497 - DNA, 140 bp, Artificial Sequence
  Synthetic
atacgccatgctgggtctccggcaggggatatattgagaactcaagaatcatcctgtacttgcattcaaggtgattgctattgggtgatgactgacggtccagccaataggcaggcacagcgtacttgggagtcggccat

SEQ ID NO: 424498 - DNA, 140 bp, Artificial Sequence
  Synthetic
atggccgactcccaagtacgctgtgcctgcctattggctggaccgtcagtcatcacccaatagcaatcaccttgaatgcaagtacaggatgattcttgagttctcaatatatcccctgccggagacccagcatggcgtat

SEQ ID NO: 424499 - DNA, 140 bp, Artificial Sequence
  Synthetic
aggccctggctgctgatatgtaactcaaggaacatgctgggaacagatgtacactccaggtggagaagtgaagaatgatgatgtagaccagagtttgatcattgctgccagaaacattgtgaccttttgggacagcggtg

SEQ ID NO: 424500 - DNA, 140 bp, Artificial Sequence
  Synthetic
caccgctgtcccaaaaggtcacaatgtttctggcagcaatgatcaaactctggtctacatcatcattcttcacttctccacctggagtgtacatctgttcccagcatgttccttgagttacatatcagcagccagggcct

SEQ ID NO: 424501 - DNA, 140 bp, Artificial Sequence
  Synthetic
aggccctggctgctgatatgagcgaaagcaggtcaaatatattcaatatggagagaataaaggaattaagagatctaatgtcacaatctcgcactcgcgagatactaacaaagaccactggaccttttgggacagcggtg

SEQ ID NO: 424502 - DNA, 140 bp, Artificial Sequence
  Synthetic
caccgctgtcccaaaaggtccagtggtctttgttagtatctcgcgagtgcgagattgtgacattagatctcttaattcctttattctctccatattgaatatatttgacctgctttcgctcatatcagcagccagggcct

SEQ ID NO: 424503 - DNA, 140 bp, Artificial Sequence
  Synthetic
aggccctggctgctgatatgtcccgttcttgggaactacagggaaatgtgcatcgcatggtccagcagcagctgctttgatgggaaagaatggctacatgtttgtgtcacaggagatgacgaccttttgggacagcggtg

SEQ ID NO: 424504 - DNA, 140 bp, Artificial Sequence
  Synthetic
caccgctgtcccaaaaggtcgtcatctcctgtgacacaaacatgtagccattctttcccatcaaagcagctgctgctggaccatgcgatgcacatttccctgtagttcccaagaacgggacatatcagcagccagggcct

SEQ ID NO: 424505 - DNA, 140 bp, Artificial Sequence
  Synthetic
aggccctggctgctgatatgatggatgtcaatccgactctacttttcctaaaggttccagcgcaaaatgccataagcaccacattcccttatactggagatcctccatacagccatggaagaccttttgggacagcggtg

SEQ ID NO: 424506 - DNA, 140 bp, Artificial Sequence
  Synthetic
caccgctgtcccaaaaggtcttccatggctgtatggaggatctccagtataagggaatgtggtgcttatggcattttgcgctggaacctttaggaaaagtagagtcggattgacatccatcatatcagcagccagggcct

SEQ ID NO: 424507 - DNA, 140 bp, Artificial Sequence
  Synthetic
aggccctggctgctgatatgtggaactcaagaaggaaaactagtaaaaggatcctttggaaaagcactaagagtaatatttactaaatgcttgatgcactatgtatttggaaatgcccaagaccttttgggacagcggtg

SEQ ID NO: 424508 - DNA, 140 bp, Artificial Sequence
  Synthetic
caccgctgtcccaaaaggtcttgggcatttccaaatacatagtgcatcaagcatttagtaaatattactcttagtgcttttccaaaggatccttttactagttttccttcttgagttccacatatcagcagccagggcct

SEQ ID NO: 424509 - DNA, 140 bp, Artificial Sequence
  Synthetic
aggccctggctgctgatatgctggaatagaagaatgtattagcaacaacccttgggtgatacagagtgtatactggttcaatgaatggttgggctttgaaaaggaggggagtaaagtgttgaccttttgggacagcggtg

SEQ ID NO: 424510 - DNA, 140 bp, Artificial Sequence
  Synthetic
caccgctgtcccaaaaggtcaacactttactcccctccttttcaaagcccaaccattcattgaaccagtatacactctgtatcacccaagggttgttgctaatacattcttctattccagcatatcagcagccagggcct

SEQ ID NO: 424511 - DNA, 140 bp, Artificial Sequence
  Synthetic
aggccctggctgctgatatgacaagtgggtcatctgtcaaaagggaagaagaagtgctcacaggcaacctccaaacattgaaaataagagtacatgaaggatatgaggaattcacaatgggaccttttgggacagcggtg

SEQ ID NO: 424512 - DNA, 140 bp, Artificial Sequence
  Synthetic
caccgctgtcccaaaaggtcccattgtgaattcctcatatccttcatgtactcttattttcaatgtttggaggttgcctgtgagcacttcttcttcccttttgacagatgacccacttgtcatatcagcagccagggcct

SEQ ID NO: 424513 - DNA, 140 bp, Artificial Sequence
  Synthetic
atacgccatgctgggtctccatgacattagccaaaattgaattgttaaaacaactgctaagggacaatgaggccaaaacagttttgaagcaaacaacagtagaccaatataacataataacgtacttgggagtcggccat

SEQ ID NO: 424514 - DNA, 140 bp, Artificial Sequence
  Synthetic
atggccgactcccaagtacgttattatgttatattggtctactgttgtttgcttcaaaactgttttggcctcattgtcccttagcagttgttttaacaattcaattttggctaatgtcatggagacccagcatggcgtat

SEQ ID NO: 424515 - DNA, 140 bp, Artificial Sequence
  Synthetic
aggccctggctgctgatatgggccaaaacagttttgaagcaaacaacagtagaccaatataacataataagaaaattcaatacatcaaggattgaaaagaatccttcactaaggatgaaggaccttttgggacagcggtg

SEQ ID NO: 424516 - DNA, 140 bp, Artificial Sequence
  Synthetic
caccgctgtcccaaaaggtccttcatccttagtgaaggattcttttcaatccttgatgtattgaattttcttattatgttatattggtctactgttgtttgcttcaaaactgttttggcccatatcagcagccagggcct

SEQ ID NO: 424517 - DNA, 140 bp, Artificial Sequence
  Synthetic
atacgccatgctgggtctccaccaaatgagaatccagtacataagagccagctgatatggatggcatgtcattctgcagcatttgaagacctgagagtgtcaagttttatcagagggacacgtacttgggagtcggccat

SEQ ID NO: 424518 - DNA, 140 bp, Artificial Sequence
  Synthetic
atggccgactcccaagtacgtgtccctctgataaaacttgacactctcaggtcttcaaatgctgcagaatgacatgccatccatatcagctggctcttatgtactggattctcatttggtggagacccagcatggcgtat

SEQ ID NO: 424519 - DNA, 140 bp, Artificial Sequence
  Synthetic
atacgccatgctgggtctccaaacagaatccccttggaatacaaagggatacaacttaaaacaaatgctgaagacataggaaccaaaggccaaatgtgctcaatagcagcagttacttggcgtacttgggagtcggccat

SEQ ID NO: 424520 - DNA, 140 bp, Artificial Sequence
  Synthetic
atggccgactcccaagtacgccaagtaactgctgctattgagcacatttggcctttggttcctatgtcttcagcatttgttttaagttgtatccctttgtattccaaggggattctgtttggagacccagcatggcgtat

SEQ ID NO: 424521 - DNA, 140 bp, Artificial Sequence
  Synthetic
aggccctggctgctgatatgggtcagtgaaacacaaggaacagagaaattgacaataacctattcatcatcaatgatgtgggagatcaatggacctgaatcagtgctcgttaacacgtatgaccttttgggacagcggtg

SEQ ID NO: 424522 - DNA, 140 bp, Artificial Sequence
  Synthetic
caccgctgtcccaaaaggtcatacgtgttaacgagcactgattcaggtccattgatctcccacatcattgatgatgaataggttattgtcaatttctctgttccttgtgtttcactgacccatatcagcagccagggcct

SEQ ID NO: 424523 - DNA, 140 bp, Artificial Sequence
  Synthetic
atacgccatgctgggtctcccaatgatgtgggagatcaatggacctgaatcagtgctcgttaacacgtatcaatggataattagaaattgggaaactgtaaagatccaatggtcccaagacgtacttgggagtcggccat

SEQ ID NO: 424524 - DNA, 140 bp, Artificial Sequence
  Synthetic
atggccgactcccaagtacgtcttgggaccattggatctttacagtttcccaatttctaattatccattgatacgtgttaacgagcactgattcaggtccattgatctcccacatcattgggagacccagcatggcgtat

SEQ ID NO: 424525 - DNA, 140 bp, Artificial Sequence
  Synthetic
atacgccatgctgggtctcctagaaatgcgactgctagttttatttataatgggatacttgttgacagtattggttcatggtctcaaaatatcctcagaactcaggagtcagagtgcgttcgtacttgggagtcggccat

SEQ ID NO: 424526 - DNA, 140 bp, Artificial Sequence
  Synthetic
atggccgactcccaagtacgaacgcactctgactcctgagttctgaggatattttgagaccatgaaccaatactgtcaacaagtatcccattataaataaaactagcagtcgcatttctaggagacccagcatggcgtat

SEQ ID NO: 424527 - DNA, 140 bp, Artificial Sequence
  Synthetic
atacgccatgctgggtctccgagtagatgaatattccagcacggagagagtggtggtgagcattgatcgatttttaagggttcgggatcaactagggaacgtactattgtctcctgaagacgtacttgggagtcggccat

SEQ ID NO: 424528 - DNA, 140 bp, Artificial Sequence
  Synthetic
atggccgactcccaagtacgtcttcaggagacaatagtacgttccctagttgatcccgaacccttaaaaatcgatcaatgctcaccaccactctctccgtgctggaatattcatctactcggagacccagcatggcgtat

SEQ ID NO: 424529 - DNA, 140 bp, Artificial Sequence
  Synthetic
atacgccatgctgggtctcccaagtcgtggcggaacaacatattaaggacccaggagtcggaatgtcagtgtttgtacgggacctgtgttgtggcagtaacagatggaccggctgacaatcgtacttgggagtcggccat

SEQ ID NO: 424530 - DNA, 140 bp, Artificial Sequence
  Synthetic
atggccgactcccaagtacgattgtcagccggtccatctgttactgccacaacacaggtcccgtacaaacactgacattccgactcctgggtccttaatatgttgttccgccacgacttgggagacccagcatggcgtat

SEQ ID NO: 424531 - DNA, 140 bp, Artificial Sequence
  Synthetic
aggccctggctgctgatatgatagggaactgataaaagaaaaaagagaaaaattgaaaggaacaatgataactccaatcgtactggcatacatgcttgaaagagaactggttgctcgaaggaccttttgggacagcggtg

SEQ ID NO: 424532 - DNA, 140 bp, Artificial Sequence
  Synthetic
caccgctgtcccaaaaggtccttcgagcaaccagttctctttcaagcatgtatgccagtacgattggagttatcattgttcctttcaatttttctcttttttcttttatcagttccctatcatatcagcagccagggcct

SEQ ID NO: 424533 - DNA, 140 bp, Artificial Sequence
  Synthetic
atacgccatgctgggtctcctacactgcttacaaggtgaaaattggagacaaatatatcacccaggagggaataaattaactgagtccaggtctcaatcaatgatagtagcttgtaggaacgtacttgggagtcggccat

SEQ ID NO: 424534 - DNA, 140 bp, Artificial Sequence
  Synthetic
atggccgactcccaagtacgttcctacaagctactatcattgattgagacctggactcagttaatttattccctcctgggtgatatatttgtctccaattttcaccttgtaagcagtgtaggagacccagcatggcgtat

SEQ ID NO: 424535 - DNA, 140 bp, Artificial Sequence
  Synthetic
atacgccatgctgggtctccagtgaaagggtgggcctttgacaatggagatgatgtttggatgggaagaacaatcagtaaagattctcgctcaggctatgagacctttagggtcattggtcgtacttgggagtcggccat

SEQ ID NO: 424536 - DNA, 140 bp, Artificial Sequence
  Synthetic
atggccgactcccaagtacgaccaatgaccctaaaggtctcatagcctgagcgagaatctttactgattgttcttcccatccaaacatcatctccattgtcaaaggcccaccctttcactggagacccagcatggcgtat

SEQ ID NO: 424537 - DNA, 140 bp, Artificial Sequence
  Synthetic
atacgccatgctgggtctccaaattgcaaacaagactgtgatagatactgaacctttaaagtcatgtctggcagccatagacggaggtgatgtagcttgtgacataataagagctgcattcgtacttgggagtcggccat

SEQ ID NO: 424538 - DNA, 140 bp, Artificial Sequence
  Synthetic
atggccgactcccaagtacgaatgcagctcttattatgtcacaagctacatcacctccgtctatggctgccagacatgactttaaaggttcagtatctatcacagtcttgtttgcaatttggagacccagcatggcgtat

SEQ ID NO: 424539 - DNA, 140 bp, Artificial Sequence
  Synthetic
aggccctggctgctgatatgggaacaatacagaagattggaatatgggacggggaagaggagttccatgtaagatgtggtgaatgcaggggaatattaaaaaagagtaaaatgaaactgggaccttttgggacagcggtg

SEQ ID NO: 424540 - DNA, 140 bp, Artificial Sequence
  Synthetic
caccgctgtcccaaaaggtcccagtttcattttactcttttttaatattcccctgcattcaccacatcttacatggaactcctcttccccgtcccatattccaatcttctgtattgttcccatatcagcagccagggcct

SEQ ID NO: 424541 - DNA, 140 bp, Artificial Sequence
  Synthetic
atacgccatgctgggtctccatcttatgcatggtattttctcaagacactaggatgttccaaggggtgagaggagaaataaattttcttaatcgagcaggccaacttttatctccaatgtcgtacttgggagtcggccat

SEQ ID NO: 424542 - DNA, 140 bp, Artificial Sequence
  Synthetic
atggccgactcccaagtacgacattggagataaaagttggcctgctcgattaagaaaatttatttctcctctcaccccttggaacatcctagtgtcttgagaaaataccatgcataagatggagacccagcatggcgtat

SEQ ID NO: 424543 - DNA, 140 bp, Artificial Sequence
  Synthetic
aggccctggctgctgatatgaggagaaataaattttcttaatcgagcaggccaacttttatctccaatgtaccaactccaacgatattttttgaatagaagcaacgacctttttgatcaagaccttttgggacagcggtg

SEQ ID NO: 424544 - DNA, 140 bp, Artificial Sequence
  Synthetic
caccgctgtcccaaaaggtcttgatcaaaaaggtcgttgcttctattcaaaaaatatcgttggagttggtacattggagataaaagttggcctgctcgattaagaaaatttatttctcctcatatcagcagccagggcct

SEQ ID NO: 424545 - DNA, 140 bp, Artificial Sequence
  Synthetic
atacgccatgctgggtctccatcaatgaatgcatctgactatacattgaaagggattgtagtgacaagaaatgtaattgacgactttagctctactgaaacagaaaaagtatccataacacgtacttgggagtcggccat

SEQ ID NO: 424546 - DNA, 140 bp, Artificial Sequence
  Synthetic
atggccgactcccaagtacgtgttatggatactttttctgtttcagtagagctaaagtcgtcaattacatttcttgtcactacaatccctttcaatgtatagtcagatgcattcattgatggagacccagcatggcgtat

SEQ ID NO: 424547 - DNA, 140 bp, Artificial Sequence
  Synthetic
aggccctggctgctgatatgatgtaattgacgactttagctctactgaaacagaaaaagtatccataacaaaaaatcttagcttaataaaaaggactggggaagtcataatgggagctaagaccttttgggacagcggtg

SEQ ID NO: 424548 - DNA, 140 bp, Artificial Sequence
  Synthetic
caccgctgtcccaaaaggtcttagctcccattatgacttccccagtcctttttattaagctaagattttttgttatggatactttttctgtttcagtagagctaaagtcgtcaattacatcatatcagcagccagggcct

SEQ ID NO: 424549 - DNA, 140 bp, Artificial Sequence
  Synthetic
atacgccatgctgggtctcccacctaaaatgtgggaaatgggaacaaccaaagaactggtgcaaaacacttatcaatgggtgctaaaaaacttggtgacactgaaggctcagtttcttctcgtacttgggagtcggccat

SEQ ID NO: 424550 - DNA, 140 bp, Artificial Sequence
  Synthetic
atggccgactcccaagtacgagaagaaactgagccttcagtgtcaccaagttttttagcacccattgataagtgttttgcaccagttctttggttgttcccatttcccacattttaggtgggagacccagcatggcgtat

SEQ ID NO: 424551 - DNA, 140 bp, Artificial Sequence
  Synthetic
atacgccatgctgggtctccttccggcagggaactgatgtatggatggggcggacaattagtcgaacctccagatcaggctttgagatactaagggtaaggaatggttggacacaaacaacgtacttgggagtcggccat

SEQ ID NO: 424552 - DNA, 140 bp, Artificial Sequence
  Synthetic
atggccgactcccaagtacgttgtttgtgtccaaccattccttacccttagtatctcaaagcctgatctggaggttcgactaattgtccgccccatccatacatcagttccctgccggaaggagacccagcatggcgtat

SEQ ID NO: 424553 - DNA, 140 bp, Artificial Sequence
  Synthetic
aggccctggctgctgatatgatcaccaacatccaaatggaagagagaacaagcaggaatttcaataacttaactaaagggctctgtactataaattcatggcacatatatgggaaagacagaccttttgggacagcggtg

SEQ ID NO: 424554 - DNA, 140 bp, Artificial Sequence
  Synthetic
caccgctgtcccaaaaggtctgtctttcccatatatgtgccatgaatttatagtacagagccctttagttaagttattgaaattcctgcttgttctctcttccatttggatgttggtgatcatatcagcagccagggcct

SEQ ID NO: 424555 - DNA, 140 bp, Artificial Sequence
  Synthetic
aggccctggctgctgatatgctcaaacaaatgagagaccaggaggttatgaaaactgaccagttcataaagttgctgcctttttgtttctcaccaccaaaattaaggagcaatggggagcgaccttttgggacagcggtg

SEQ ID NO: 424556 - DNA, 140 bp, Artificial Sequence
  Synthetic
caccgctgtcccaaaaggtcgctccccattgctccttaattttggtggtgagaaacaaaaaggcagcaactttatgaactggtcagttttcataacctcctggtctctcatttgtttgagcatatcagcagccagggcct

SEQ ID NO: 424557 - DNA, 140 bp, Artificial Sequence
  Synthetic
aggccctggctgctgatatgaacaggccatgggttcgcatgaacaatgaaactatattggaaactggatatgtatgcagcaaattccattcggacacacccagacctagtgatccctctagaccttttgggacagcggtg

SEQ ID NO: 424558 - DNA, 140 bp, Artificial Sequence
  Synthetic
caccgctgtcccaaaaggtctagagggatcactaggtctgggtgtgtccgaatggaatttgctgcatacatatccagtttccaatatagtttcattgttcatgcgaacccatggcctgttcatatcagcagccagggcct

SEQ ID NO: 424559 - DNA, 140 bp, Artificial Sequence
  Synthetic
atacgccatgctgggtctccagtggcaagtatgacccagatcttggagatttcaaaactattgaagaacttgaaaagctgaaaccaggggaaaaggcaaacatcttgctttatcaaggaacgtacttgggagtcggccat

SEQ ID NO: 424560 - DNA, 140 bp, Artificial Sequence
  Synthetic
atggccgactcccaagtacgttccttgataaagcaagatgtttgccttttcccctggtttcagcttttcaagttcttcaatagttttgaaatctccaagatctgggtcatacttgccactggagacccagcatggcgtat

SEQ ID NO: 424561 - DNA, 140 bp, Artificial Sequence
  Synthetic
atacgccatgctgggtctccgcagaacttcaggacattgaaaatgaagagaagattccaaggacaaagaacatgaagaaaacaagccaattaaagtgggcactcggtgagaacatggcaccgtacttgggagtcggccat

SEQ ID NO: 424562 - DNA, 140 bp, Artificial Sequence
  Synthetic
atggccgactcccaagtacggtgccatgttctcaccgagtgcccactttaattggcttgttttcttcatgttctttgtccttggaatcttctcttcattttcaatgtcctgaagttctgcggagacccagcatggcgtat

SEQ ID NO: 424563 - DNA, 140 bp, Artificial Sequence
  Synthetic
aggccctggctgctgatatggtcaaaatggagaaaatagtgcttctttttgcgatagtcagtcttgttaaaagtgaccagatttgcattggctaccatgcaaacaactcgacagagcagggaccttttgggacagcggtg

SEQ ID NO: 424564 - DNA, 140 bp, Artificial Sequence
  Synthetic
caccgctgtcccaaaaggtccctgctctgtcgagttgtttgcatggtagccaatgcaaatctggtcacttttaacaagactgactatcgcaaaaagaagcactattttctccattttgaccatatcagcagccagggcct

SEQ ID NO: 424565 - DNA, 140 bp, Artificial Sequence
  Synthetic
atacgccatgctgggtctccatgaatataaatccttattttctcttcatagatgtgcccgtacaggcagcaatttcaacaacattcccatacactggtgttcccccttattcccatggaacgtacttgggagtcggccat

SEQ ID NO: 424566 - DNA, 140 bp, Artificial Sequence
  Synthetic
atggccgactcccaagtacgttccatgggaataagggggaacaccagtgtatgggaatgttgttgaaattgctgcctgtacgggcacatctatgaagagaaaataaggatttatattcatggagacccagcatggcgtat

SEQ ID NO: 424567 - DNA, 140 bp, Artificial Sequence
  Synthetic
aggccctggctgctgatatgaatagctatactgctaatggtaactgcaagcaatgcagataaaatctgcattggctaccagtcaacaaactccacagagactgttgatacactaatagaagaccttttgggacagcggtg

SEQ ID NO: 424568 - DNA, 140 bp, Artificial Sequence
  Synthetic
caccgctgtcccaaaaggtcttctattagtgtatcaacagtctctgtggagtttgttgactggtagccaatgcagattttatctgcattgcttgcagttaccattagcagtatagctattcatatcagcagccagggcct

SEQ ID NO: 424569 - DNA, 140 bp, Artificial Sequence
  Synthetic
aggccctggctgctgatatgaccagtgcatgtaggagatcaggatcttcattctatgcagaaatgaaatggctcctgtcaaacacagataatgctgcattcccgcagatgactaagtcatgaccttttgggacagcggtg

SEQ ID NO: 424570 - DNA, 140 bp, Artificial Sequence
  Synthetic
caccgctgtcccaaaaggtcatgacttagtcatctgcgggaatgcagcattatctgtgtttgacaggagccatttcatttctgcatagaatgaagatcctgatctcctacatgcactggtcatatcagcagccagggcct

SEQ ID NO: 424571 - DNA, 140 bp, Artificial Sequence
  Synthetic
aggccctggctgctgatatgcttaataagagcactgacactgaacacaatgacaaaggatgcagaaagaggcaaattgaaaaggcgggcaattgcaacacccgggatgcagattagaggagaccttttgggacagcggtg

SEQ ID NO: 424572 - DNA, 140 bp, Artificial Sequence
  Synthetic
caccgctgtcccaaaaggtctcctctaatctgcatcccgggtgttgcaattgcccgccttttcaatttgcctctttctgcatcctttgtcattgtgttcagtgtcagtgctcttattaagcatatcagcagccagggcct

SEQ ID NO: 424573 - DNA, 140 bp, Artificial Sequence
  Synthetic
atacgccatgctgggtctcctccaacaaatggaccattgcccgaagataatgagccgagtgcctatgcgcaattagattgcgttttagaggctttggatagaatggatgaagaacacccacgtacttgggagtcggccat

SEQ ID NO: 424574 - DNA, 140 bp, Artificial Sequence
  Synthetic
atggccgactcccaagtacgtgggtgttcttcatccattctatccaaagcctctaaaacgcaatctaattgcgcataggcactcggctcattatcttcgggcaatggtccatttgttggaggagacccagcatggcgtat

SEQ ID NO: 424575 - DNA, 140 bp, Artificial Sequence
  Synthetic
atacgccatgctgggtctccgcaccatcgaagggctagtctatggcaacccttcttgtgatctgctattgggagggaagaaatggtcttacattgtcgagagatcatcggctgtcaatggcgtacttgggagtcggccat

SEQ ID NO: 424576 - DNA, 140 bp, Artificial Sequence
  Synthetic
atggccgactcccaagtacgccattgacagccgatgatctctcgacaatgtaagaccatttcttccctcccaatagcagatcacaagaagggttgccatagactagcccttcgatggtgcggagacccagcatggcgtat

SEQ ID NO: 424577 - DNA, 140 bp, Artificial Sequence
  Synthetic
aggccctggctgctgatatgggagggaagaaatggtcttacattgtcgagagatcatcggctgtcaatggaatgtgttatcctgggaatgtagagaacctagaagaactcaggtctttttgaccttttgggacagcggtg

SEQ ID NO: 424578 - DNA, 140 bp, Artificial Sequence
  Synthetic
caccgctgtcccaaaaggtcaaaaagacctgagttcttctaggttctctacattcccaggataacacattccattgacagccgatgatctctcgacaatgtaagaccatttcttccctcccatatcagcagccagggcct

SEQ ID NO: 424579 - DNA, 140 bp, Artificial Sequence
  Synthetic
aggccctggctgctgatatgaactgtagacaaattaacccaggggagacagacttttgattggacagtatgcagaaaccaacctgctgcaacggcactgaatacaacaataacctcttttgaccttttgggacagcggtg

SEQ ID NO: 424580 - DNA, 140 bp, Artificial Sequence
  Synthetic
caccgctgtcccaaaaggtcaaaagaggttattgttgtattcagtgccgttgcagcaggttggtttctgcatactgtccaatcaaaagtctgtctcccctgggttaatttgtctacagttcatatcagcagccagggcct

SEQ ID NO: 424581 - DNA, 140 bp, Artificial Sequence
  Synthetic
aggccctggctgctgatatgtggattcctaaaagaaatcgttccattctcaatacgagtcaaaggggaattcttgaggatgaacagatgtaccagaagtgctgcaatctgttcgagaaatgaccttttgggacagcggtg

SEQ ID NO: 424582 - DNA, 140 bp, Artificial Sequence
  Synthetic
caccgctgtcccaaaaggtcatttctcgaacagattgcagcacttctggtacatctgttcatcctcaagaattcccctttgactcgtattgagaatggaacgatttcttttaggaatccacatatcagcagccagggcct

SEQ ID NO: 424583 - DNA, 140 bp, Artificial Sequence
  Synthetic
atacgccatgctgggtctcctggaatgtgacttacagtggaacaagcaaagcatgttcaaattcattctacagaagcatgagatggctgactcataagagcaattcttaccccgttcaagcgtacttgggagtcggccat

SEQ ID NO: 424584 - DNA, 140 bp, Artificial Sequence
  Synthetic
atggccgactcccaagtacgcttgaacggggtaagaattgctcttatgagtcagccatctcatgcttctgtagaatgaatttgaacatgctttgcttgttccactgtaagtcacattccaggagacccagcatggcgtat

SEQ ID NO: 424585 - DNA, 140 bp, Artificial Sequence
  Synthetic
atacgccatgctgggtctccccaggatatcattgattcattagaccgacctgaaatgactttcttctcagtaaagaatataaagaaaaaattgcctgccaaaaacagaaagggtttcctccgtacttgggagtcggccat

SEQ ID NO: 424586 - DNA, 140 bp, Artificial Sequence
  Synthetic
atggccgactcccaagtacggaggaaaccctttctgtttttggcaggcaattttttctttatattctttactgagaagaaagtcatttcaggtcggtctaatgaatcaatgatatcctggggagacccagcatggcgtat

SEQ ID NO: 424587 - DNA, 140 bp, Artificial Sequence
  Synthetic
aggccctggctgctgatatgtaaagaatataaagaaaaaattgcctgccaaaaacagaaagggtttcctcataaagaggataccaatgaaggtaaaagacaaaataaccaaagtggaatagaccttttgggacagcggtg

SEQ ID NO: 424588 - DNA, 140 bp, Artificial Sequence
  Synthetic
caccgctgtcccaaaaggtctattccactttggttattttgtcttttaccttcattggtatcctctttatgaggaaaccctttctgtttttggcaggcaattttttctttatattctttacatatcagcagccagggcct

SEQ ID NO: 424589 - DNA, 140 bp, Artificial Sequence
  Synthetic
aggccctggctgctgatatgcaatgatgtgggagatcaacggtccggaatcagttctagtcaacacctatcaatggatcatcagaaattgggaagttataaagattcaatggtcccaggagaccttttgggacagcggtg

SEQ ID NO: 424590 - DNA, 140 bp, Artificial Sequence
  Synthetic
caccgctgtcccaaaaggtctcctgggaccattgaatctttataacttcccaatttctgatgatccattgataggtgttgactagaactgattccggaccgttgatctcccacatcattgcatatcagcagccagggcct

SEQ ID NO: 424591 - DNA, 140 bp, Artificial Sequence
  Synthetic
atacgccatgctgggtctcctgatacaacaacaagcgtgacaacagaagatataaatcgaactttcaagccagtgataggaccaagaccccttgtaaacggacagcaggggagaattgaccgtacttgggagtcggccat

SEQ ID NO: 424592 - DNA, 140 bp, Artificial Sequence
  Synthetic
atggccgactcccaagtacggtcaattctcccctgctgtccgtttacaaggggtcttggtcctatcactggcttgaaagttcgatttatatcttctgttgtcacgcttgttgttgtatcaggagacccagcatggcgtat

SEQ ID NO: 424593 - DNA, 140 bp, Artificial Sequence
  Synthetic
atacgccatgctgggtctccgcaaactgaaaagaagagcgattgccactgctggaatacaaataagagggtttgtattagtagttgaaaacttggctaaaaatatatgtgaaaatctagacgtacttgggagtcggccat

SEQ ID NO: 424594 - DNA, 140 bp, Artificial Sequence
  Synthetic
atggccgactcccaagtacgtctagattttcacatatatttttagccaagttttcaactactaatacaaaccctcttatttgtattccagcagtggcaatcgctcttcttttcagtttgcggagacccagcatggcgtat

SEQ ID NO: 424595 - DNA, 140 bp, Artificial Sequence
  Synthetic
aggccctggctgctgatatgtttgtattagtagttgaaaacttggctaaaaatatatgtgaaaatctagaacaaagtggtttaccagtaggtggaaacgagaagaaagccaaactgtcaagaccttttgggacagcggtg

SEQ ID NO: 424596 - DNA, 140 bp, Artificial Sequence
  Synthetic
caccgctgtcccaaaaggtcttgacagtttggctttcttctcgtttccacctactggtaaaccactttgttctagattttcacatatatttttagccaagttttcaactactaatacaaacatatcagcagccagggcct

SEQ ID NO: 424597 - DNA, 140 bp, Artificial Sequence
  Synthetic
atacgccatgctgggtctccactgaactcaaactcagtgactatgagggacgattaatccaaaatagcataacaatagagagaatggtgctctctgcttttgatgagagaagaaataaatcgtacttgggagtcggccat

SEQ ID NO: 424598 - DNA, 140 bp, Artificial Sequence
  Synthetic
atggccgactcccaagtacgatttatttcttctctcatcaaaagcagagagcaccattctctctattgttatgctattttggattaatcgtccctcatagtcactgagtttgagttcagtggagacccagcatggcgtat

SEQ ID NO: 424599 - DNA, 140 bp, Artificial Sequence
  Synthetic
atacgccatgctgggtctccacagtaacaggagacaatacaaaatggaatgaatgtttaaacccaagaatctttttggccatgactgaaagaataaccagagacagcccagtttggttcacgtacttgggagtcggccat

SEQ ID NO: 424600 - DNA, 140 bp, Artificial Sequence
  Synthetic
atggccgactcccaagtacgtgaaccaaactgggctgtctctggttattctttcagtcatggccaaaaagattcttgggtttaaacattcattccattttgtattgtctcctgttactgtggagacccagcatggcgtat

SEQ ID NO: 424601 - DNA, 140 bp, Artificial Sequence
  Synthetic
atacgccatgctgggtctccagagtgttaccaagagggcaactgtccacaaggggcgttcaaatcgcatccaacgagaacatggaaactatgagctccagcacccttgaattgagaagcacgtacttgggagtcggccat

SEQ ID NO: 424602 - DNA, 140 bp, Artificial Sequence
  Synthetic
atggccgactcccaagtacgtgcttctcaattcaagggtgctggagctcatagtttccatgttctcgttggatgcgatttgaacgccccttgtggacagttgccctcttggtaacactctggagacccagcatggcgtat

SEQ ID NO: 424603 - DNA, 140 bp, Artificial Sequence
  Synthetic
atacgccatgctgggtctccttggggaaaggatttatgataacaagcaaaacaaaaagactaaaggctcaaataccttgtcctgatctgtttagtataccattagaaagatataatgaagcgtacttgggagtcggccat

SEQ ID NO: 424604 - DNA, 140 bp, Artificial Sequence
  Synthetic
atggccgactcccaagtacgcttcattatatctttctaatggtatactaaacagatcaggacaaggtatttgagcctttagtctttttgttttgcttgttatcataaatcctttccccaaggagacccagcatggcgtat

SEQ ID NO: 424605 - DNA, 140 bp, Artificial Sequence
  Synthetic
aggccctggctgctgatatgtgctggctggtatggtttccagcattcaaatgaccagggaactggaatggctgcagatagagaatcaactcaagaggcagttgacaaaataacgtccaaagaccttttgggacagcggtg

SEQ ID NO: 424606 - DNA, 140 bp, Artificial Sequence
  Synthetic
caccgctgtcccaaaaggtctttggacgttattttgtcaactgcctcttgagttgattctctatctgcagccattccagttccctggtcatttgaatgctggaaaccataccagccagcacatatcagcagccagggcct

SEQ ID NO: 424607 - DNA, 140 bp, Artificial Sequence
  Synthetic
atacgccatgctgggtctcctgaattcagtgaaattgaagccaggctcaatatgattaacaacaagattgatgatcaaatacaagacatttgggcttacaatgcagaattgctagtactgcgtacttgggagtcggccat

SEQ ID NO: 424608 - DNA, 140 bp, Artificial Sequence
  Synthetic
atggccgactcccaagtacgcagtactagcaattctgcattgtaagcccaaatgtcttgtatttgatcatcaatcttgttgttaatcatattgagcctggcttcaatttcactgaattcaggagacccagcatggcgtat

SEQ ID NO: 424609 - DNA, 140 bp, Artificial Sequence
  Synthetic
atacgccatgctgggtctccagaatgatcaaacgtgggatcaatgaccgaaacttctggagaggtgaaaatggacgaagaacaagggttgcatatgaaagaatgtgcaatattctcaaagcgtacttgggagtcggccat

SEQ ID NO: 424610 - DNA, 140 bp, Artificial Sequence
  Synthetic
atggccgactcccaagtacgctttgagaatattgcacattctttcatatgcaacccttgttcttcgtccattttcacctctccagaagtttcggtcattgatcccacgtttgatcattctggagacccagcatggcgtat

SEQ ID NO: 424611 - DNA, 140 bp, Artificial Sequence
  Synthetic
aggccctggctgctgatatgcttaaatacggtttgaaaagagggccttctacggaaggagtgcctgagtctatgagggaagaatatcggcaggaacagcagagtgctgtggatgttgacggaccttttgggacagcggtg

SEQ ID NO: 424612 - DNA, 140 bp, Artificial Sequence
  Synthetic
caccgctgtcccaaaaggtccgtcaacatccacagcactctgctgttcctgccgatattcttccctcatagactcaggcactccttccgtagaaggccctcttttcaaaccgtatttaagcatatcagcagccagggcct

SEQ ID NO: 424613 - DNA, 140 bp, Artificial Sequence
  Synthetic
atacgccatgctgggtctccagggagttgggacactagtaatggagctgattcgaatgataaaaaggggtatcaatgatcggaacttctggagaggcgagaatgggcgaaggacaagaatcgtacttgggagtcggccat

SEQ ID NO: 424614 - DNA, 140 bp, Artificial Sequence
  Synthetic
atggccgactcccaagtacgattcttgtccttcgcccattctcgcctctccagaagttccgatcattgatacccctttttatcattcgaatcagctccattactagtgtcccaactccctggagacccagcatggcgtat

SEQ ID NO: 424615 - DNA, 140 bp, Artificial Sequence
  Synthetic
atacgccatgctgggtctcctcaacaatggaatgggtccagcaacagcacaaacagccatacagctattcatagctgattatagatacacctacaaatgccacaggggagattccaaagtcgtacttgggagtcggccat

SEQ ID NO: 424616 - DNA, 140 bp, Artificial Sequence
  Synthetic
atggccgactcccaagtacgactttggaatctcccctgtggcatttgtaggtgtatctataatcagctatgaatagctgtatggctgtttgtgctgttgctggacccattccattgttgaggagacccagcatggcgtat

SEQ ID NO: 424617 - DNA, 140 bp, Artificial Sequence
  Synthetic
aggccctggctgctgatatgatagctgattatagatacacctacaaatgccacaggggagattccaaagtagaaggaaagagaatgaaaatcataaaggagttatgggaaaacactaaaggaccttttgggacagcggtg

SEQ ID NO: 424618 - DNA, 140 bp, Artificial Sequence
  Synthetic
caccgctgtcccaaaaggtcctttagtgttttcccataactcctttatgattttcattctctttccttctactttggaatctcccctgtggcatttgtaggtgtatctataatcagctatcatatcagcagccagggcct

SEQ ID NO: 424619 - DNA, 140 bp, Artificial Sequence
  Synthetic
atacgccatgctgggtctccagaaacttgcatatcccagaaatagtattaaagtataatctaatggaccctgaatacaaagggcggttacttcatcctcaaaatccctttgtgggacattcgtacttgggagtcggccat

SEQ ID NO: 424620 - DNA, 140 bp, Artificial Sequence
  Synthetic
atggccgactcccaagtacgaatgtcccacaaagggattttgaggatgaagtaaccgccctttgtattcagggtccattagattatactttaatactatttctgggatatgcaagtttctggagacccagcatggcgtat

SEQ ID NO: 424621 - DNA, 140 bp, Artificial Sequence
  Synthetic
aggccctggctgctgatatgtgaatacaaagggcggttacttcatcctcaaaatccctttgtgggacatttgtctattgagggcatcaaagaggcagacataactccagcacatggtccagaccttttgggacagcggtg

SEQ ID NO: 424622 - DNA, 140 bp, Artificial Sequence
  Synthetic
caccgctgtcccaaaaggtctggaccatgtgctggagttatgtctgcctctttgatgccctcaatagacaaatgtcccacaaagggattttgaggatgaagtaaccgccctttgtattcacatatcagcagccagggcct

SEQ ID NO: 424623 - DNA, 140 bp, Artificial Sequence
  Synthetic
atacgccatgctgggtctcccaatccaatgatcgtcgagcttgcggaaaggacaatgaaagaatatggggaaagtccgaaaatcgagacgaacaaatttgccgcaatatgcacacacctacgtacttgggagtcggccat

SEQ ID NO: 424624 - DNA, 140 bp, Artificial Sequence
  Synthetic
atggccgactcccaagtacgtaggtgtgtgcatattgcggcaaatttgttcgtctcgattttcggactttccccatattctttcattgtcctttccgcaagctcgacgatcattggattgggagacccagcatggcgtat

SEQ ID NO: 424625 - DNA, 140 bp, Artificial Sequence
  Synthetic
atacgccatgctgggtctcccaaaagaaacagatctatactaaacactgatcagaggaacatgattcttgaggaacaatgctacgctaaatgttgcaacctatttgaggcctgttttaaccgtacttgggagtcggccat

SEQ ID NO: 424626 - DNA, 140 bp, Artificial Sequence
  Synthetic
atggccgactcccaagtacggttaaaacaggcctcaaataggttgcaacatttagcgtagcattgttcctcaagaatcatgttcctctgatcagtgtttagtatagatctgtttcttttgggagacccagcatggcgtat

SEQ ID NO: 424627 - DNA, 140 bp, Artificial Sequence
  Synthetic
aggccctggctgctgatatgagcaacagtttagttgcactatgtggaagcccaatctcagttgggtccggttccttccccgatggggcacaaatccaatacttttcgtaaattgcaaaaagaccttttgggacagcggtg

SEQ ID NO: 424628 - DNA, 140 bp, Artificial Sequence
  Synthetic
caccgctgtcccaaaaggtctttttgcaatttacgaaaagtattggatttgtgccccatcggggaaggaaccggacccaactgagattgggcttccacatagtgcaactaaactgttgctcatatcagcagccagggcct

SEQ ID NO: 424629 - DNA, 140 bp, Artificial Sequence
  Synthetic
aggccctggctgctgatatgatgagcccgtttcatggaccagcaacagtatagttaccttctgtgggctagacaatgaacctggatcgggcaattggcctgatggtgctaacattgggttgaccttttgggacagcggtg

SEQ ID NO: 424630 - DNA, 140 bp, Artificial Sequence
  Synthetic
caccgctgtcccaaaaggtcaacccaatgttagcaccatcaggccaattgcccgatccaggttcattgtctagcccacagaaggtaactatactgttgctggtccatgaaacgggctcatcatatcagcagccagggcct

SEQ ID NO: 424631 - DNA, 140 bp, Artificial Sequence
  Synthetic
aggccctggctgctgatatgacgatggaaaagcatggctgcatgtttgtgtgacgggagatgacaaaaatgcaactgctagcatcatttacaatggaaggctagtagatagtattgtttcgaccttttgggacagcggtg

SEQ ID NO: 424632 - DNA, 140 bp, Artificial Sequence
  Synthetic
caccgctgtcccaaaaggtcgaaacaatactatctactagccttccattgtaaatgatgctagcagttgcatttttgtcatctcccgtcacacaaacatgcagccatgcttttccatcgtcatatcagcagccagggcct

SEQ ID NO: 424633 - DNA, 140 bp, Artificial Sequence
  Synthetic
atacgccatgctgggtctcctgataaacaacgaccttgggccagcaacagctcagatggctcttcagctattcatcaaggactacaggtacacataccgatgccacagaggagatacgcacgtacttgggagtcggccat

SEQ ID NO: 424634 - DNA, 140 bp, Artificial Sequence
  Synthetic
atggccgactcccaagtacgtgcgtatctcctctgtggcatcggtatgtgtacctgtagtccttgatgaatagctgaagagccatctgagctgttgctggcccaaggtcgttgtttatcaggagacccagcatggcgtat

SEQ ID NO: 424635 - DNA, 140 bp, Artificial Sequence
  Synthetic
atacgccatgctgggtctccatgtcgctgtttggagacacaattgcctacttgctttcattgacagaagatggagaaggcaaagcagaactagcagaaaagttacactgttggtttggtgcgtacttgggagtcggccat

SEQ ID NO: 424636 - DNA, 140 bp, Artificial Sequence
  Synthetic
atggccgactcccaagtacgcaccaaaccaacagtgtaacttttctgctagttctgctttgccttctccatcttctgtcaatgaaagcaagtaggcaattgtgtctccaaacagcgacatggagacccagcatggcgtat

SEQ ID NO: 424637 - DNA, 140 bp, Artificial Sequence
  Synthetic
aggccctggctgctgatatgtggaatttaaccaagaaagcttcaattggactggagttgctcaagacggatcaagcaatgcttgcagaagggaatctaataaaagtttcttcagtagattgaccttttgggacagcggtg

SEQ ID NO: 424638 - DNA, 140 bp, Artificial Sequence
  Synthetic
caccgctgtcccaaaaggtcaatctactgaagaaacttttattagattcccttctgcaagcattgcttgatccgtcttgagcaactccagtccaattgaagctttcttggttaaattccacatatcagcagccagggcct

SEQ ID NO: 424639 - DNA, 140 bp, Artificial Sequence
  Synthetic
atacgccatgctgggtctccccgggtacggacaaggaccaaacctacctatatgtccaagcaccagggagagttacaatctccaccaaaagaagccaacaaacagtaatcccgaatgtcgcgtacttgggagtcggccat

SEQ ID NO: 424640 - DNA, 140 bp, Artificial Sequence
  Synthetic
atggccgactcccaagtacgcgacattcgggattactgtttgttggcttcttttggtggagattgtaactctccctggtgcttggacatataggtaggtttggtccttgtccgtacccggggagacccagcatggcgtat

SEQ ID NO: 424641 - DNA, 140 bp, Artificial Sequence
  Synthetic
aggccctggctgctgatatgacaatagtaaaaccgggagacatgcttttgattaacagtacagggaatctaattgcccctcgaggttacttcaaaatacaaagtgggaaaagctcaataagaccttttgggacagcggtg

SEQ ID NO: 424642 - DNA, 140 bp, Artificial Sequence
  Synthetic
caccgctgtcccaaaaggtcttattgagcttttcccactttgtattttgaagtaacctcgaggggcaattagattccctgtactgttaatcaaaagcatgtctcccggttttactattgtcatatcagcagccagggcct

SEQ ID NO: 424643 - DNA, 140 bp, Artificial Sequence
  Synthetic
aggccctggctgctgatatgtgaggtcagatgcacctattgacaactgcaattctgaatgtattactccaaatggaagcattcccaatgacaaaccttttcaaaatgtaaacaggatcacgaccttttgggacagcggtg

SEQ ID NO: 424644 - DNA, 140 bp, Artificial Sequence
  Synthetic
caccgctgtcccaaaaggtcgtgatcctgtttacattttgaaaaggtttgtcattgggaatgcttccatttggagtaatacattcagaattgcagttgtcaataggtgcatctgacctcacatatcagcagccagggcct

SEQ ID NO: 424645 - DNA, 140 bp, Artificial Sequence
  Synthetic
atacgccatgctgggtctcctcgaaccatttcagattcttacaatttgttcttttatcttatcagctctccatttcatggcttggacaatagggcatttgaatcaaataaaaagaggaatcgtacttgggagtcggccat

SEQ ID NO: 424646 - DNA, 140 bp, Artificial Sequence
  Synthetic
atggccgactcccaagtacgattcctctttttatttgattcaaatgccctattgtccaagccatgaaatggagagctgataagataaaagaacaaattgtaagaatctgaaatggttcgaggagacccagcatggcgtat

SEQ ID NO: 424647 - DNA, 140 bp, Artificial Sequence
  Synthetic
atacgccatgctgggtctccaaacatgaaaatacgaataaaaggtccaaacaaagagacaataaacagagaggtatcaattttgagacacagttaccaaaaagaaatccaggccaaagaacgtacttgggagtcggccat

SEQ ID NO: 424648 - DNA, 140 bp, Artificial Sequence
  Synthetic
atggccgactcccaagtacgttctttggcctggatttctttttggtaactgtgtctcaaaattgatacctctctgtttattgtctctttgtttggaccttttattcgtattttcatgtttggagacccagcatggcgtat

SEQ ID NO: 424649 - DNA, 140 bp, Artificial Sequence
  Synthetic
atacgccatgctgggtctccccatggatgacttccaattgattccaatgataagcaagtgcagaaccaaagaaggaagacggaagacaaatctgtatggattcattataaaaggaaggtccgtacttgggagtcggccat

SEQ ID NO: 424650 - DNA, 140 bp, Artificial Sequence
  Synthetic
atggccgactcccaagtacggaccttccttttataatgaatccatacagatttgtcttccgtcttccttctttggttctgcacttgcttatcattggaatcaattggaagtcatccatggggagacccagcatggcgtat

SEQ ID NO: 424651 - DNA, 140 bp, Artificial Sequence
  Synthetic
aggccctggctgctgatatgctatacaaacgttaaccctatttctcacatcagggggagtattattatcactatatgtgtcagcttcattatcatacttactatattcggatatattgctgaccttttgggacagcggtg

SEQ ID NO: 424652 - DNA, 140 bp, Artificial Sequence
  Synthetic
caccgctgtcccaaaaggtcagcaatatatccgaatatagtaagtatgataatgaagctgacacatatagtgataataatactccccctgatgtgagaaatagggttaacgtttgtatagcatatcagcagccagggcct

SEQ ID NO: 424653 - DNA, 140 bp, Artificial Sequence
  Synthetic
atacgccatgctgggtctccaatggggcatggagatgaggcgatgccttcttcaatcccttcaacaaattgagagcatgattgaagccgagtcttctgtcaaagagaaagacatgaccaacgtacttgggagtcggccat

SEQ ID NO: 424654 - DNA, 140 bp, Artificial Sequence
  Synthetic
atggccgactcccaagtacgttggtcatgtctttctctttgacagaagactcggcttcaatcatgctctcaatttgttgaagggattgaagaaggcatcgcctcatctccatgccccattggagacccagcatggcgtat

SEQ ID NO: 424655 - DNA, 140 bp, Artificial Sequence
  Synthetic
aggccctggctgctgatatgagcagggtagataatcactcaccgagtgacatcaacattatggcgtctcaaggcaccaaacgatcttatgaacagatggaaactggtggagagcgccagagaccttttgggacagcggtg

SEQ ID NO: 424656 - DNA, 140 bp, Artificial Sequence
  Synthetic
caccgctgtcccaaaaggtctctggcgctctccaccagtttccatctgttcataagatcgtttggtgccttgagacgccataatgttgatgtcactcggtgagtgattatctaccctgctcatatcagcagccagggcct

SEQ ID NO: 424657 - DNA, 140 bp, Artificial Sequence
  Synthetic
aggccctggctgctgatatgtacctacttcgcgctacctagctgacatgaccctcgaggaaatgtcacgagactggttcatgctcatgcctaggcaaaagataataggccctctttgtgtgaccttttgggacagcggtg

SEQ ID NO: 424658 - DNA, 140 bp, Artificial Sequence
  Synthetic
caccgctgtcccaaaaggtcacacaaagagggcctattatcttttgcctaggcatgagcatgaaccagtctcgtgacatttcctcgagggtcatgtcagctaggtagcgcgaagtaggtacatatcagcagccagggcct

SEQ ID NO: 424659 - DNA, 140 bp, Artificial Sequence
  Synthetic
aggccctggctgctgatatggactggttcatgctcatgcctaggcaaaagataataggccctctttgtgtgcgaatggaccaggcgatcatggaaaagaacatcatactgaaagcgaactgaccttttgggacagcggtg

SEQ ID NO: 424660 - DNA, 140 bp, Artificial Sequence
  Synthetic
caccgctgtcccaaaaggtcagttcgctttcagtatgatgttcttttccatgatcgcctggtccattcgcacacaaagagggcctattatcttttgcctaggcatgagcatgaaccagtccatatcagcagccagggcct

SEQ ID NO: 424661 - DNA, 140 bp, Artificial Sequence
  Synthetic
atacgccatgctgggtctcctaacgagagagccctatgtctcctgtgatccagatgagtgcaggttctatgctctcagccaaggaacaacaattagagggaaacactcaaatggaacaatcgtacttgggagtcggccat

SEQ ID NO: 424662 - DNA, 140 bp, Artificial Sequence
  Synthetic
atggccgactcccaagtacgattgttccatttgagtgtttccctctaattgttgttccttggctgagagcatagaacctgcactcatctggatcacaggagacatagggctctctcgttaggagacccagcatggcgtat

SEQ ID NO: 424663 - DNA, 140 bp, Artificial Sequence
  Synthetic
atacgccatgctgggtctccactgaggagggagcaatcgttggagaaatttcaccattaccttctcttccaggacatactaatgaggatgtcaaaaatgcagttggggtcctcatcggagcgtacttgggagtcggccat

SEQ ID NO: 424664 - DNA, 140 bp, Artificial Sequence
  Synthetic
atggccgactcccaagtacgctccgatgaggaccccaactgcatttttgacatcctcattagtatgtcctggaagagaaggtaatggtgaaatttctccaacgattgctccctcctcagtggagacccagcatggcgtat

SEQ ID NO: 424665 - DNA, 140 bp, Artificial Sequence
  Synthetic
aggccctggctgctgatatgtttaattattgctgctagaaatattgttagaagagcaacagtatcagcagacccgttggcttcgcttttggagatgtgccatagtacacagattggcggggaccttttgggacagcggtg

SEQ ID NO: 424666 - DNA, 140 bp, Artificial Sequence
  Synthetic
caccgctgtcccaaaaggtccccgccaatctgtgtactatggcacatctccaaaagcgaagccaacgggtctgctgatactgttgctcttctaacaatatttctagcagcaataattaaacatatcagcagccagggcct

SEQ ID NO: 424667 - DNA, 140 bp, Artificial Sequence
  Synthetic
aggccctggctgctgatatgtgataaacaatgaccttggacctgcaacagctcaaatggctcttcagctgttcatcaaggattacagatacacgtaccggtgccacagaggggacacacagaccttttgggacagcggtg

SEQ ID NO: 424668 - DNA, 140 bp, Artificial Sequence
  Synthetic
caccgctgtcccaaaaggtctgtgtgtcccctctgtggcaccggtacgtgtatctgtaatccttgatgaacagctgaagagccatttgagctgttgcaggtccaaggtcattgtttatcacatatcagcagccagggcct

SEQ ID NO: 424669 - DNA, 140 bp, Artificial Sequence
  Synthetic
aggccctggctgctgatatgaaacacactgaggaatgcacatgcggatttgccagcaataaaaccatagaatgtgcctgtagagacaacaggtacacagcaaaaagaccttttgtcaaatgaccttttgggacagcggtg

SEQ ID NO: 424670 - DNA, 140 bp, Artificial Sequence
  Synthetic
caccgctgtcccaaaaggtcatttgacaaaaggtctttttgctgtgtacctgttgtctctacaggcacattctatggttttattgctggcaaatccgcatgtgcattcctcagtgtgtttcatatcagcagccagggcct

SEQ ID NO: 424671 - DNA, 140 bp, Artificial Sequence
  Synthetic
atacgccatgctgggtctcctcaactctcccgaggagatctggagctgctggtgcagcagtgaagggggtaggaacaatggtgatggagctgattcgaatgataaaacgagggattaacgcgtacttgggagtcggccat

SEQ ID NO: 424672 - DNA, 140 bp, Artificial Sequence
  Synthetic
atggccgactcccaagtacgcgttaatccctcgttttatcattcgaatcagctccatcaccattgttcctacccccttcactgctgcaccagcagctccagatctcctcgggagagttgaggagacccagcatggcgtat

SEQ ID NO: 424673 - DNA, 140 bp, Artificial Sequence
  Synthetic
atacgccatgctgggtctccactgaaaggatggggatgggactgtatgtcaagtatgatggagacccatgggctgacagtgatgccctagcttttagtggagtaatggtttcaatgaaagcgtacttgggagtcggccat

SEQ ID NO: 424674 - DNA, 140 bp, Artificial Sequence
  Synthetic
atggccgactcccaagtacgctttcattgaaaccattactccactaaaagctagggcatcactgtcagcccatgggtctccatcatacttgacatacagtcccatccccatcctttcagtggagacccagcatggcgtat

SEQ ID NO: 424675 - DNA, 140 bp, Artificial Sequence
  Synthetic
atacgccatgctgggtctccgttgaaaaacccaagtttctcccggatttgtacgattacaaagagaatcgtttcattgaaattggagtaaccaggagggaggtccatatatactatttagcgtacttgggagtcggccat

SEQ ID NO: 424676 - DNA, 140 bp, Artificial Sequence
  Synthetic
atggccgactcccaagtacgctaaatagtatatatggacctccctcctggttactccaatttcaatgaaacgattctctttgtaatcgtacaaatccgggagaaacttgggtttttcaacggagacccagcatggcgtat

SEQ ID NO: 424677 - DNA, 140 bp, Artificial Sequence
  Synthetic
atacgccatgctgggtctccatgctgtgtgaaccaacaataatagaaaggaacacaacagagattgtgtatctgaccaacacaactatagagaaggaaatatgccccaaactagctgaatcgtacttgggagtcggccat

SEQ ID NO: 424678 - DNA, 140 bp, Artificial Sequence
  Synthetic
atggccgactcccaagtacgattcagctagtttggggcatatttccttctctatagttgtgttggtcagatacacaatctctgttgtgttcctttctattattgttggttcacacagcatggagacccagcatggcgtat

SEQ ID NO: 424679 - DNA, 140 bp, Artificial Sequence
  Synthetic
atacgccatgctgggtctccgtcccctgtattgggatagagatggtacatgatggtggaaaagagacttggcactcagcagcaacagccatttactgtttaatgggctcaggacagctgccgtacttgggagtcggccat

SEQ ID NO: 424680 - DNA, 140 bp, Artificial Sequence
  Synthetic
atggccgactcccaagtacggcagctgtcctgagcccattaaacagtaaatggctgttgctgctgagtgccaagtctcttttccaccatcatgtaccatctctatcccaatacaggggacggagacccagcatggcgtat

SEQ ID NO: 424681 - DNA, 140 bp, Artificial Sequence
  Synthetic
atacgccatgctgggtctccaaacattcccaaaacaaagatacaacatttagaggagtgttcttgctatgtggacatcgatgtgtactgcatatgtagggataattggaaaggttctaaccgtacttgggagtcggccat

SEQ ID NO: 424682 - DNA, 140 bp, Artificial Sequence
  Synthetic
atggccgactcccaagtacggttagaacctttccaattatccctacatatgcagtacacatcgatgtccacatagcaagaacactcctctaaatgttgtatctttgttttgggaatgtttggagacccagcatggcgtat

SEQ ID NO: 424683 - DNA, 140 bp, Artificial Sequence
  Synthetic
atacgccatgctgggtctccatggcaatgaaatatccaatcacagcagacaaaagaataatggagatgatccctgaacgaaatgaacagggacagacgctttggagcaagacaaatgatgcgtacttgggagtcggccat

SEQ ID NO: 424684 - DNA, 140 bp, Artificial Sequence
  Synthetic
atggccgactcccaagtacgcatcatttgtcttgctccaaagcgtctgtccctgttcatttcgttcagggatcatctccattattcttttgtctgctgtgattggatatttcattgccatggagacccagcatggcgtat

SEQ ID NO: 424685 - DNA, 140 bp, Artificial Sequence
  Synthetic
aggccctggctgctgatatgtttcttgtgaacttcaagcaccagtaaaagaactgaaaatcaaaatgtccaacatggatatcgacggtatgaacactgggacaattgacaaaacaccggagaccttttgggacagcggtg

SEQ ID NO: 424686 - DNA, 140 bp, Artificial Sequence
  Synthetic
caccgctgtcccaaaaggtctccggtgttttgtcaattgtcccagtgttcataccgtcgatatccatgttggacattttgattttcagttcttttactggtgcttgaagttcacaagaaacatatcagcagccagggcct

SEQ ID NO: 424687 - DNA, 140 bp, Artificial Sequence
  Synthetic
aggccctggctgctgatatgcaacaagaaagaaaatcgagagaataagacctctattaatagatggcacagcttcattgagtcctggaatgatgatgggcatgttcaacatgctgagtacgaccttttgggacagcggtg

SEQ ID NO: 424688 - DNA, 140 bp, Artificial Sequence
  Synthetic
caccgctgtcccaaaaggtcgtactcagcatgttgaacatgcccatcatcattccaggactcaatgaagctgtgccatctattaatagaggtcttattctctcgattttctttcttgttgcatatcagcagccagggcct

SEQ ID NO: 424689 - DNA, 140 bp, Artificial Sequence
  Synthetic
aggccctggctgctgatatgatgggaagaaatggatgacaattggagtaacgggccctgatgccaaagcagtagcagtggtgcattatgggggaattcctactgatgtaatcaattcctggaccttttgggacagcggtg

SEQ ID NO: 424690 - DNA, 140 bp, Artificial Sequence
  Synthetic
caccgctgtcccaaaaggtccaggaattgattacatcagtaggaattcccccataatgcaccactgctactgctttggcatcagggcccgttactccaattgtcatccatttcttcccatcatatcagcagccagggcct

SEQ ID NO: 424691 - DNA, 140 bp, Artificial Sequence
  Synthetic
atacgccatgctgggtctcccctctctgcatttgatgagaggagaaacaaatacccagaggaacatcccagtgcggggaaagatccaaagaaaacaggaggaccaatctacaaaaagagacgtacttgggagtcggccat

SEQ ID NO: 424692 - DNA, 140 bp, Artificial Sequence
  Synthetic
atggccgactcccaagtacgtctctttttgtagattggtcctcctgttttctttggatctttccccgcactgggatgttcctctgggtatttgtttctcctctcatcaaatgcagagaggggagacccagcatggcgtat

SEQ ID NO: 424693 - DNA, 140 bp, Artificial Sequence
  Synthetic
aggccctggctgctgatatgaagaagaatggaaaacttaaataaaaaggttgatgatgggtttctagacatttggacatataatgcagaattgttagttctactggaaaatgaaaggactgaccttttgggacagcggtg

SEQ ID NO: 424694 - DNA, 140 bp, Artificial Sequence
  Synthetic
caccgctgtcccaaaaggtcagtcctttcattttccagtagaactaacaattctgcattatatgtccaaatgtctagaaacccatcatcaacctttttatttaagttttccattcttcttcatatcagcagccagggcct

SEQ ID NO: 424695 - DNA, 140 bp, Artificial Sequence
  Synthetic
aggccctggctgctgatatgattgactgactcaagttggatagaactcgatgaaataggggaggacgttgccccgatcgaacacattgcaagcatgaggaggaattactttacagctgaagaccttttgggacagcggtg

SEQ ID NO: 424696 - DNA, 140 bp, Artificial Sequence
  Synthetic
caccgctgtcccaaaaggtcttcagctgtaaagtaattcctcctcatgcttgcaatgtgttcgatcggggcaacgtcctcccctatttcatcgagttctatccaacttgagtcagtcaatcatatcagcagccagggcct

SEQ ID NO: 424697 - DNA, 140 bp, Artificial Sequence
  Synthetic
atacgccatgctgggtctcccagaaaatggcaggttccctttgcatcaaaatggaccaggcaataatggataaaaacatcacattgaaggcaaatttcagtgtggtttttaaccgactggcgtacttgggagtcggccat

SEQ ID NO: 424698 - DNA, 140 bp, Artificial Sequence
  Synthetic
atggccgactcccaagtacgccagtcggttaaaaaccacactgaaatttgccttcaatgtgatgtttttatccattattgcctggtccattttgatgcaaagggaacctgccattttctgggagacccagcatggcgtat

SEQ ID NO: 424699 - DNA, 140 bp, Artificial Sequence
  Synthetic
aggccctggctgctgatatgcaacaatgcgtcagcagtaatttggtacaatagaagacctgttacagaaatcaatacatgggcccgaaacatactacggacacaagaatctgaatgcgtagaccttttgggacagcggtg

SEQ ID NO: 424700 - DNA, 140 bp, Artificial Sequence
  Synthetic
caccgctgtcccaaaaggtctacgcattcagattcttgtgtccgtagtatgtttcgggcccatgtattgatttctgtaacaggtcttctattgtaccaaattactgctgacgcattgttgcatatcagcagccagggcct

SEQ ID NO: 424701 - DNA, 140 bp, Artificial Sequence
  Synthetic
atacgccatgctgggtctccgatcaggtgcgactggtgttgcaatcaaaggaggtggaaccttagtggctgaagccattcgatttataggaagagcaatggcagacagagggctattgagcgtacttgggagtcggccat

SEQ ID NO: 424702 - DNA, 140 bp, Artificial Sequence
  Synthetic
atggccgactcccaagtacgctcaatagccctctgtctgccattgctcttcctataaatcgaatggcttcagccactaaggttccacctcctttgattgcaacaccagtcgcacctgatcggagacccagcatggcgtat

SEQ ID NO: 424703 - DNA, 140 bp, Artificial Sequence
  Synthetic
aggccctggctgctgatatgcacaaagagcaatgatggaccaagtacgagaaagcagaaatcctggaaatgctgaaattgaagatctcatctttctggcacgttctgcactcatcctgaggaccttttgggacagcggtg

SEQ ID NO: 424704 - DNA, 140 bp, Artificial Sequence
  Synthetic
caccgctgtcccaaaaggtcctcaggatgagtgcagaacgtgccagaaagatgagatcttcaatttcagcatttccaggatttctgctttctcgtacttggtccatcattgctctttgtgcatatcagcagccagggcct

SEQ ID NO: 424705 - DNA, 140 bp, Artificial Sequence
  Synthetic
aggccctggctgctgatatgctgcttgaaatgggaattgatggatgaagactaccagggtagactgtgcaatcctctgaatccattcgtcagccatagggaaattgaatctgtcaacaatgaccttttgggacagcggtg

SEQ ID NO: 424706 - DNA, 140 bp, Artificial Sequence
  Synthetic
caccgctgtcccaaaaggtcattgttgacagattcaatttccctatggctgacgaatggattcagaggattgcacagtctaccctggtagtcttcatccatcaattcccatttcaagcagcatatcagcagccagggcct

SEQ ID NO: 424707 - DNA, 140 bp, Artificial Sequence
  Synthetic
atacgccatgctgggtctccgactccaagcacagagatgtcactaagaggggtgagggtcagtaaaacaggagtagacgaatactctagtactgaaagagtggctgtgagtattgaccgacgtacttgggagtcggccat

SEQ ID NO: 424708 - DNA, 140 bp, Artificial Sequence
  Synthetic
atggccgactcccaagtacgtcggtcaatactcacagccactctttcagtactagagtattcgtctactcctgttttactgaccctcacccctcttagtgacatctctgtgcttggagtcggagacccagcatggcgtat

SEQ ID NO: 424709 - DNA, 140 bp, Artificial Sequence
  Synthetic
atacgccatgctgggtctccccatcaagctccagttttgggctccgatgaccagatctggggggaacgaagtaggtggagacggagggtctggccaaataagctgcagcccagtgtttgccgtacttgggagtcggccat

SEQ ID NO: 424710 - DNA, 140 bp, Artificial Sequence
  Synthetic
atggccgactcccaagtacggcaaacactgggctgcagcttatttggccagaccctccgtctccacctacttcgttccccccagatctggtcatcggagcccaaaactggagcttgatggggagacccagcatggcgtat

SEQ ID NO: 424711 - DNA, 140 bp, Artificial Sequence
  Synthetic
aggccctggctgctgatatgctaggcaaatggtgcaggctatgagaacagttgggactcaccctaactccagtacaggtctaaaagatgatcttattgaaaatttgcaggcctaccagaagaccttttgggacagcggtg

SEQ ID NO: 424712 - DNA, 140 bp, Artificial Sequence
  Synthetic
caccgctgtcccaaaaggtcttctggtaggcctgcaaattttcaataagatcatcttttagacctgtactggagttagggtgagtcccaactgttctcatagcctgcaccatttgcctagcatatcagcagccagggcct

SEQ ID NO: 424713 - DNA, 140 bp, Artificial Sequence
  Synthetic
atacgccatgctgggtctccaaggggtttgggtttaaagcgggcaatgatgtatggttaggtagaacagtgtcaactagtggtagatcgggctttgaaattatcaaagttacagaggggtcgtacttgggagtcggccat

SEQ ID NO: 424714 - DNA, 140 bp, Artificial Sequence
  Synthetic
atggccgactcccaagtacgacccctctgtaactttgataatttcaaagcccgatctaccactagttgacactgttctacctaaccatacatcattgcccgctttaaacccaaaccccttggagacccagcatggcgtat

SEQ ID NO: 424715 - DNA, 140 bp, Artificial Sequence
  Synthetic
aggccctggctgctgatatgctcacctgatgatttggcattccaacctgaatgatgccacatatcagagaacaagagctttagtgcgtactggaatggatcccagaatgtgttctctgatgaccttttgggacagcggtg

SEQ ID NO: 424716 - DNA, 140 bp, Artificial Sequence
  Synthetic
caccgctgtcccaaaaggtcatcagagaacacattctgggatccattccagtacgcactaaagctcttgttctctgatatgtggcatcattcaggttggaatgccaaatcatcaggtgagcatatcagcagccagggcct

SEQ ID NO: 424717 - DNA, 140 bp, Artificial Sequence
  Synthetic
aggccctggctgctgatatgacatccaatgcagatcgaatctgcactgggataacatcgtcaaactcaccacatgtcgtcaaaactgctactcaaggggaggtcaatgtgaccggtgtaagaccttttgggacagcggtg

SEQ ID NO: 424718 - DNA, 140 bp, Artificial Sequence
  Synthetic
caccgctgtcccaaaaggtcttacaccggtcacattgacctccccttgagtagcagttttgacgacatgtggtgagtttgacgatgttatcccagtgcagattcgatctgcattggatgtcatatcagcagccagggcct

SEQ ID NO: 424719 - DNA, 140 bp, Artificial Sequence
  Synthetic
atacgccatgctgggtctccacagaaaccagggggaaactatgcccaaaatgcctcaactgcacagatctggacgtagccttgggcagaccaaaatgcacagggaaaataccctcggcaacgtacttgggagtcggccat

SEQ ID NO: 424720 - DNA, 140 bp, Artificial Sequence
  Synthetic
atggccgactcccaagtacgttgccgagggtattttccctgtgcattttggtctgcccaaggctacgtccagatctgtgcagttgaggcattttgggcatagtttccccctggtttctgtggagacccagcatggcgtat

SEQ ID NO: 424721 - DNA, 140 bp, Artificial Sequence
  Synthetic
aggccctggctgctgatatgggacgtagccttgggcagaccaaaatgcacagggaaaataccctcggcaagagtttcaatactccatgaagtcagacctgttacatctgggtgctttcctgaccttttgggacagcggtg

SEQ ID NO: 424722 - DNA, 140 bp, Artificial Sequence
  Synthetic
caccgctgtcccaaaaggtcaggaaagcacccagatgtaacaggtctgacttcatggagtattgaaactcttgccgagggtattttccctgtgcattttggtctgcccaaggctacgtcccatatcagcagccagggcct

SEQ ID NO: 424723 - DNA, 140 bp, Artificial Sequence
  Synthetic
aggccctggctgctgatatgctagggaaaggatacatgttcgaaagtaagagcatgaagcttcgaacacaaataccggcagaaatgctagcaagtattgatctgaaatatttcaatgagtgaccttttgggacagcggtg

SEQ ID NO: 424724 - DNA, 140 bp, Artificial Sequence
  Synthetic
caccgctgtcccaaaaggtcactcattgaaatatttcagatcaatacttgctagcatttctgccggtatttgtgttcgaagcttcatgctcttactttcgaacatgtatcctttccctagcatatcagcagccagggcct

SEQ ID NO: 424725 - DNA, 140 bp, Artificial Sequence
  Synthetic
atacgccatgctgggtctccatacgaacatatcaggttatcaactcacaacgttatcaatgcagaagatgcaccaggaggaccctacaaaattggaacctcagggtcttgccctaacgttcgtacttgggagtcggccat

SEQ ID NO: 424726 - DNA, 140 bp, Artificial Sequence
  Synthetic
atggccgactcccaagtacgaacgttagggcaagaccctgaggttccaattttgtagggtcctcctggtgcatcttctgcattgataacgttgtgagttgataacctgatatgttcgtatggagacccagcatggcgtat

SEQ ID NO: 424727 - DNA, 140 bp, Artificial Sequence
  Synthetic
aggccctggctgctgatatgcaccaggaggaccctacaaaattggaacctcagggtcttgccctaacgttaccaatggaaacggattcttcgcaacaatggcttgggccgtcccaaaaaagaccttttgggacagcggtg

SEQ ID NO: 424728 - DNA, 140 bp, Artificial Sequence
  Synthetic
caccgctgtcccaaaaggtcttttttgggacggcccaagccattgttgcgaagaatccgtttccattggtaacgttagggcaagaccctgaggttccaattttgtagggtcctcctggtgcatatcagcagccagggcct

SEQ ID NO: 424729 - DNA, 140 bp, Artificial Sequence
  Synthetic
atacgccatgctgggtctccttgacctgaagtatttcaatgaatcaacaaggaagaaaattgagaaaataaggcctctcctaatagatggcacagcatcactgagccctgggatgatgatcgtacttgggagtcggccat

SEQ ID NO: 424730 - DNA, 140 bp, Artificial Sequence
  Synthetic
atggccgactcccaagtacgatcatcatcccagggctcagtgatgctgtgccatctattaggagaggccttattttctcaattttcttccttgttgattcattgaaatacttcaggtcaaggagacccagcatggcgtat

SEQ ID NO: 424731 - DNA, 140 bp, Artificial Sequence
  Synthetic
atacgccatgctgggtctcctttgtacagaaggagaagaccaaattaccgtttgggggttccactctgacaacgagacccaaatggcaaagctctatggggactcaaagccccagaagttcgtacttgggagtcggccat

SEQ ID NO: 424732 - DNA, 140 bp, Artificial Sequence
  Synthetic
atggccgactcccaagtacgaacttctggggctttgagtccccatagagctttgccatttgggtctcgttgtcagagtggaacccccaaacggtaatttggtcttctccttctgtacaaaggagacccagcatggcgtat

SEQ ID NO: 424733 - DNA, 140 bp, Artificial Sequence
  Synthetic
aggccctggctgctgatatgaacgagacccaaatggcaaagctctatggggactcaaagccccagaagttcacctcatctgccaacggagtgaccacacattacgtttcacagattggtggaccttttgggacagcggtg

SEQ ID NO: 424734 - DNA, 140 bp, Artificial Sequence
  Synthetic
caccgctgtcccaaaaggtccaccaatctgtgaaacgtaatgtgtggtcactccgttggcagatgaggtgaacttctggggctttgagtccccatagagctttgccatttgggtctcgttcatatcagcagccagggcct

SEQ ID NO: 424735 - DNA, 140 bp, Artificial Sequence
  Synthetic
atacgccatgctgggtctccgttgttgattacatggtgcaaaaatctggaaaaacaggaacaattacctatcaaagaggtattttattgcctcaaaaggtgtggtgcgcaagtggcaggacgtacttgggagtcggccat

SEQ ID NO: 424736 - DNA, 140 bp, Artificial Sequence
  Synthetic
atggccgactcccaagtacgtcctgccacttgcgcaccacaccttttgaggcaataaaatacctctttgataggtaattgttcctgtttttccagatttttgcaccatgtaatcaacaacggagacccagcatggcgtat

SEQ ID NO: 424737 - DNA, 140 bp, Artificial Sequence
  Synthetic
aggccctggctgctgatatgggaaagcaactaggaggctgattcagttgatagtaagcgggaggaacgaacaatcaatcgctgaggcaatcattgtagcgatggtgttctcacaggaggagaccttttgggacagcggtg

SEQ ID NO: 424738 - DNA, 140 bp, Artificial Sequence
  Synthetic
caccgctgtcccaaaaggtctcctcctgtgagaacaccatcgctacaatgattgcctcagcgattgattgttcgttcctcccgcttactatcaactgaatcagcctcctagttgctttcccatatcagcagccagggcct

SEQ ID NO: 424739 - DNA, 140 bp, Artificial Sequence
  Synthetic
aggccctggctgctgatatgaggggtttcttcggagctattgctggtttcttagaaggaggatgggaaggaatgattgcaggttggcacggatacacatcccatggggcacatggagtaggaccttttgggacagcggtg

SEQ ID NO: 424740 - DNA, 140 bp, Artificial Sequence
  Synthetic
caccgctgtcccaaaaggtcctactccatgtgccccatgggatgtgtatccgtgccaacctgcaatcattccttcccatcctccttctaagaaaccagcaatagctccgaagaaacccctcatatcagcagccagggcct

SEQ ID NO: 424741 - DNA, 140 bp, Artificial Sequence
  Synthetic
atacgccatgctgggtctccaaaaatctcaactctttgagtgagctggaagtaaagaatcttcaaagactaagcggtgccatggatgaactccacaacgaaatactagaactagatgagacgtacttgggagtcggccat

SEQ ID NO: 424742 - DNA, 140 bp, Artificial Sequence
  Synthetic
atggccgactcccaagtacgtctcatctagttctagtatttcgttgtggagttcatccatggcaccgcttagtctttgaagattctttacttccagctcactcaaagagttgagatttttggagacccagcatggcgtat

SEQ ID NO: 424743 - DNA, 140 bp, Artificial Sequence
  Synthetic
aggccctggctgctgatatgaagcggtgccatggatgaactccacaacgaaatactagaactagatgagaaagtggatgatctcagagctgatacaataagctcacaaatagaactcgcagaccttttgggacagcggtg

SEQ ID NO: 424744 - DNA, 140 bp, Artificial Sequence
  Synthetic
caccgctgtcccaaaaggtctgcgagttctatttgtgagcttattgtatcagctctgagatcatccactttctcatctagttctagtatttcgttgtggagttcatccatggcaccgcttcatatcagcagccagggcct

SEQ ID NO: 424745 - DNA, 140 bp, Artificial Sequence
  Synthetic
atacgccatgctgggtctccggcgcttgaaagaaagctgaagaaaatgctgggcccctctgctgtagagatagggaatggatgctttgaaaccaaacacaagtgcaaccagacctgtctccgtacttgggagtcggccat

SEQ ID NO: 424746 - DNA, 140 bp, Artificial Sequence
  Synthetic
atggccgactcccaagtacggagacaggtctggttgcacttgtgtttggtttcaaagcatccattccctatctctacagcagaggggcccagcattttcttcagctttctttcaagcgccggagacccagcatggcgtat

SEQ ID NO: 424747 - DNA, 140 bp, Artificial Sequence
  Synthetic
aggccctggctgctgatatgtagggaatggatgctttgaaaccaaacacaagtgcaaccagacctgtctcgacagaatagctgctggtacctttgatgcaggagaattttctctccccacgaccttttgggacagcggtg

SEQ ID NO: 424748 - DNA, 140 bp, Artificial Sequence
  Synthetic
caccgctgtcccaaaaggtcgtggggagagaaaattctcctgcatcaaaggtaccagcagctattctgtcgagacaggtctggttgcacttgtgtttggtttcaaagcatccattccctacatatcagcagccagggcct

SEQ ID NO: 424749 - DNA, 140 bp, Artificial Sequence
  Synthetic
atacgccatgctgggtctccataatcatactatactgctttactactcaactgctgcctccagtttggctgtaacactgatgatagctatctttgttgtttatatggtctccagagacaacgtacttgggagtcggccat

SEQ ID NO: 424750 - DNA, 140 bp, Artificial Sequence
  Synthetic
atggccgactcccaagtacgttgtctctggagaccatataaacaacaaagatagctatcatcagtgttacagccaaactggaggcagcagttgagtagtaaagcagtatagtatgattatggagacccagcatggcgtat

SEQ ID NO: 424751 - DNA, 140 bp, Artificial Sequence
  Synthetic
aggccctggctgctgatatgccctgggttttgcttaatgcatcctggttcaactccttcctcacacatgcactgaagtaattggggcaatgctactatttgctatccatactgtccaaaagaccttttgggacagcggtg

SEQ ID NO: 424752 - DNA, 140 bp, Artificial Sequence
  Synthetic
caccgctgtcccaaaaggtcttttggacagtatggatagcaaatagtagcattgccccaattacttcagtgcatgtgtgaggaaggagttgaaccaggatgcattaagcaaaacccagggcatatcagcagccagggcct

SEQ ID NO: 424753 - DNA, 140 bp, Artificial Sequence
  Synthetic
atacgccatgctgggtctcctgtttcttgctccatctgtctataagggaagttaagccctgtattttcctttattgtagtgcttgtttgcttgttgtcattacaaagaaacgttattgaacgtacttgggagtcggccat

SEQ ID NO: 424754 - DNA, 140 bp, Artificial Sequence
  Synthetic
atggccgactcccaagtacgttcaataacgtttctttgtaatgacaacaagcaaacaagcactacaataaaggaaaatacagggcttaacttcccttatagacagatggagcaagaaacaggagacccagcatggcgtat

SEQ ID NO: 424755 - DNA, 140 bp, Artificial Sequence
  Synthetic
atacgccatgctgggtctccatggcgaacaacaacatgaccacaacacaaattgaggtgggtccgggagcaaccaatgccaccataaactttgaagcaggaattctggagtgctatgaaacgtacttgggagtcggccat

SEQ ID NO: 424756 - DNA, 140 bp, Artificial Sequence
  Synthetic
atggccgactcccaagtacgtttcatagcactccagaattcctgcttcaaagtttatggtggcattggttgctcccggacccacctcaatttgtgttgtggtcatgttgttgttcgccatggagacccagcatggcgtat

SEQ ID NO: 424757 - DNA, 140 bp, Artificial Sequence
  Synthetic
aggccctggctgctgatatgagaaatgatgatgttgatcagagtttgatcatcgctgccagaaacattgttaggagagcaacagtatcggcagacccactggcatcactactggagatgtgaccttttgggacagcggtg

SEQ ID NO: 424758 - DNA, 140 bp, Artificial Sequence
  Synthetic
caccgctgtcccaaaaggtcacatctccagtagtgatgccagtgggtctgccgatactgttgctctcctaacaatgtttctggcagcgatgatcaaactctgatcaacatcatcatttctcatatcagcagccagggcct

SEQ ID NO: 424759 - DNA, 140 bp, Artificial Sequence
  Synthetic
atacgccatgctgggtctccgctgagattgaagatctcatctttttggcacgatctgcactcattctgagaggatcagtggcccacaaatcatgcctacctgcttgtatatatggacttgcgtacttgggagtcggccat

SEQ ID NO: 424760 - DNA, 140 bp, Artificial Sequence
  Synthetic
atggccgactcccaagtacgcaagtccatatatacaagcaggtaggcatgatttgtgggccactgatcctctcagaatgagtgcagatcgtgccaaaaagatgagatcttcaatctcagcggagacccagcatggcgtat

SEQ ID NO: 424761 - DNA, 140 bp, Artificial Sequence
  Synthetic
aggccctggctgctgatatgaaatgatgaaagtactcctatttatgaatccgtctgctggaattgaagggtttgagccatactgtatgaacagttcctcaaatagcaactgtacgaaatagaccttttgggacagcggtg

SEQ ID NO: 424762 - DNA, 140 bp, Artificial Sequence
  Synthetic
caccgctgtcccaaaaggtctatttcgtacagttgctatttgaggaactgttcatacagtatggctcaaacccttcaattccagcagacggattcataaataggagtactttcatcatttcatatcagcagccagggcct

SEQ ID NO: 424763 - DNA, 140 bp, Artificial Sequence
  Synthetic
atacgccatgctgggtctccatggcacagtgaaagaccggagcccctatagaactctaatgagtgtagaaatagggcaatcacccaacgtgtaccaggcaaggtttgaggcagtagcatgcgtacttgggagtcggccat

SEQ ID NO: 424764 - DNA, 140 bp, Artificial Sequence
  Synthetic
atggccgactcccaagtacgcatgctactgcctcaaaccttgcctggtacacgttgggtgattgccctatttctacactcattagagttctataggggctccggtctttcactgtgccatggagacccagcatggcgtat

SEQ ID NO: 424765 - DNA, 140 bp, Artificial Sequence
  Synthetic
aggccctggctgctgatatgaggatcagtggcccacaaatcatgcctacctgcttgtatatatggacttgttgtagcaagtggatacgactttgaaagagaagggtactctctagtcggagaccttttgggacagcggtg

SEQ ID NO: 424766 - DNA, 140 bp, Artificial Sequence
  Synthetic
caccgctgtcccaaaaggtctccgactagagagtacccttctctttcaaagtcgtatccacttgctacaacaagtccatatatacaagcaggtaggcatgatttgtgggccactgatcctcatatcagcagccagggcct

SEQ ID NO: 424767 - DNA, 140 bp, Artificial Sequence
  Synthetic
aggccctggctgctgatatgtatggatagggcagttaagctatataagaagctgaaaagagaaataacattccatggagctaaggaggtcgcactcagttactcaaccggtgcacttgccgaccttttgggacagcggtg

SEQ ID NO: 424768 - DNA, 140 bp, Artificial Sequence
  Synthetic
caccgctgtcccaaaaggtcggcaagtgcaccggttgagtaactgagtgcgacctccttagctccatggaatgttatttctcttttcagcttcttatatagcttaactgccctatccatacatatcagcagccagggcct

SEQ ID NO: 424769 - DNA, 140 bp, Artificial Sequence
  Synthetic
aggccctggctgctgatatgccacatactggtgggatgggctccaatcttctgatgatttcgctctaatagtgaatgcaccgaatcatgaagggatacaagctggagttgataggttttagaccttttgggacagcggtg

SEQ ID NO: 424770 - DNA, 140 bp, Artificial Sequence
  Synthetic
caccgctgtcccaaaaggtctaaaacctatcaactccagcttgtatcccttcatgattcggtgcattcactattagagcgaaatcatcagaagattggagcccatcccaccagtatgtggcatatcagcagccagggcct

SEQ ID NO: 424771 - DNA, 140 bp, Artificial Sequence
  Synthetic
aggccctggctgctgatatgggtcccaagaggacagctatccactagaggggttcaaattgcttcaaatgagaacatggaagcaatggactccaatactcttgaactgagaagtagatatgaccttttgggacagcggtg

SEQ ID NO: 424772 - DNA, 140 bp, Artificial Sequence
  Synthetic
caccgctgtcccaaaaggtcatatctacttctcagttcaagagtattggagtccattgcttccatgttctcatttgaagcaatttgaacccctctagtggatagctgtcctcttgggacccatatcagcagccagggcct

SEQ ID NO: 424773 - DNA, 140 bp, Artificial Sequence
  Synthetic
aggccctggctgctgatatgatcggtctcacagacagatggcaaccatcaccaacccactaatcaggcatgagaacagaatggtgctggccagcactacagctaaggctatggagcagatgaccttttgggacagcggtg

SEQ ID NO: 424774 - DNA, 140 bp, Artificial Sequence
  Synthetic
caccgctgtcccaaaaggtcatctgctccatagccttagctgtagtgctggccagcaccattctgttctcatgcctgattagtgggttggtgatggttgccatctgtctgtgagaccgatcatatcagcagccagggcct

SEQ ID NO: 424775 - DNA, 140 bp, Artificial Sequence
  Synthetic
aggccctggctgctgatatggctcaaaatgggatttgctacccaggagctctgaatgaattagaagaactgaaggcatttataggatcaggagaaagagtagagagatttgagatgtttcgaccttttgggacagcggtg

SEQ ID NO: 424776 - DNA, 140 bp, Artificial Sequence
  Synthetic
caccgctgtcccaaaaggtcgaaacatctcaaatctctctactctttctcctgatcctataaatgccttcagttcttctaattcattcagagctcctgggtagcaaatcccattttgagccatatcagcagccagggcct

SEQ ID NO: 424777 - DNA, 140 bp, Artificial Sequence
  Synthetic
atacgccatgctgggtctccatctggcgatccgaatgcattattgaaacaccgatttgagataattgaagggagagaccgaacaatggcttggacagtggtaaatagtatctgcaacacccgtacttgggagtcggccat

SEQ ID NO: 424778 - DNA, 140 bp, Artificial Sequence
  Synthetic
atggccgactcccaagtacgggtgttgcagatactatttaccactgtccaagccattgttcggtctctcccttcaattatctcaaatcggtgtttcaataatgcattcggatcgccagatggagacccagcatggcgtat

SEQ ID NO: 424779 - DNA, 140 bp, Artificial Sequence
  Synthetic
atacgccatgctgggtctccttgcatgataaaagcagtccgaggcgatctgaatttcgtaaacagagcaaaccaaagattaaaccccatgcatcaactcctgaggcattttcaaaaggaccgtacttgggagtcggccat

SEQ ID NO: 424780 - DNA, 140 bp, Artificial Sequence
  Synthetic
atggccgactcccaagtacggtccttttgaaaatgcctcaggagttgatgcatggggtttaatctttggtttgctctgtttacgaaattcagatcgcctcggactgcttttatcatgcaaggagacccagcatggcgtat

SEQ ID NO: 424781 - DNA, 140 bp, Artificial Sequence
  Synthetic
atacgccatgctgggtctcccagtggctcataagtcctgcctgcctgcctgtgtgtacggacttgcggtggccagtggatacgactttgaaagagagggatactccttggtcggaatcgacgtacttgggagtcggccat

SEQ ID NO: 424782 - DNA, 140 bp, Artificial Sequence
  Synthetic
atggccgactcccaagtacgtcgattccgaccaaggagtatccctctctttcaaagtcgtatccactggccaccgcaagtccgtacacacaggcaggcaggcaggacttatgagccactgggagacccagcatggcgtat

SEQ ID NO: 424783 - DNA, 140 bp, Artificial Sequence
  Synthetic
atacgccatgctgggtctccagcaaaagcagggtgaaaatgaatccaaatcaaaagataacatgcatttcagcaacaggagtaacactatcggtagtaagcctgctaataggaatcgccacgtacttgggagtcggccat

SEQ ID NO: 424784 - DNA, 140 bp, Artificial Sequence
  Synthetic
atggccgactcccaagtacgtggcgattcctattagcaggcttactaccgatagtgttactcctgttgctgaaatgcatgttatcttttgatttggattcattttcaccctgcttttgctggagacccagcatggcgtat

SEQ ID NO: 424785 - DNA, 140 bp, Artificial Sequence
  Synthetic
aggccctggctgctgatatggatgttagctttagtggaggacatattgaggaatgttcttgttatccaaatgatggtaaagtggaatgcgtgtgtagagacaactggacgggaactaacagaccttttgggacagcggtg

SEQ ID NO: 424786 - DNA, 140 bp, Artificial Sequence
  Synthetic
caccgctgtcccaaaaggtctgttagttcccgtccagttgtctctacacacgcattccactttaccatcatttggataacaagaacattcctcaatatgtcctccactaaagctaacatccatatcagcagccagggcct

SEQ ID NO: 424787 - DNA, 140 bp, Artificial Sequence
  Synthetic
atacgccatgctgggtctccatttgggcctaaatatcggactacactacaaagtgagtgattcaacaactataaacattccaaacatgaatgagaccaacccaacaacaacaaacatcaccgtacttgggagtcggccat

SEQ ID NO: 424788 - DNA, 140 bp, Artificial Sequence
  Synthetic
atggccgactcccaagtacggtgatgtttgttgttgttgggttggtctcattcatgtttggaatgtttatagttgttgaatcactcactttgtagtgtagtccgatatttaggcccaaatggagacccagcatggcgtat

SEQ ID NO: 424789 - DNA, 140 bp, Artificial Sequence
  Synthetic
aggccctggctgctgatatgtgatgaaagaaggaacaggtacctggaagagcaccccagtgcggggaaggaccctaagaaaactggaggtccaatttatcggaggagagacgggaaatgggaccttttgggacagcggtg

SEQ ID NO: 424790 - DNA, 140 bp, Artificial Sequence
  Synthetic
caccgctgtcccaaaaggtcccatttcccgtctctcctccgataaattggacctccagttttcttagggtccttccccgcactggggtgctcttccaggtacctgttccttctttcatcacatatcagcagccagggcct

SEQ ID NO: 424791 - DNA, 140 bp, Artificial Sequence
  Synthetic
atacgccatgctgggtctccaaccgctatgtgaagtcaactcatggcacattctatcgaaagacaatgcaataagaataggtgaggatgctcatatactggtcacaagggaaccttacttcgtacttgggagtcggccat

SEQ ID NO: 424792 - DNA, 140 bp, Artificial Sequence
  Synthetic
atggccgactcccaagtacgaagtaaggttcccttgtgaccagtatatgagcatcctcacctattcttattgcattgtctttcgatagaatgtgccatgagttgacttcacatagcggttggagacccagcatggcgtat

SEQ ID NO: 424793 - DNA, 140 bp, Artificial Sequence
  Synthetic
aggccctggctgctgatatgataagaataggtgaggatgctcatatactggtcacaagggaaccttacttgtcctgtgatccacaaggatgcaggatgtttgctctgagtcaaggcacaagaccttttgggacagcggtg

SEQ ID NO: 424794 - DNA, 140 bp, Artificial Sequence
  Synthetic
caccgctgtcccaaaaggtcttgtgccttgactcagagcaaacatcctgcatccttgtggatcacaggacaagtaaggttcccttgtgaccagtatatgagcatcctcacctattcttatcatatcagcagccagggcct

SEQ ID NO: 424795 - DNA, 140 bp, Artificial Sequence
  Synthetic
atacgccatgctgggtctccataattctattaatcatgaagaccattattgttctgagttgttttttctgtctggcttcctgccaaaaatcctcagagaacaacaacaacactgcaacaccgtacttgggagtcggccat

SEQ ID NO: 424796 - DNA, 140 bp, Artificial Sequence
  Synthetic
atggccgactcccaagtacggtgttgcagtgttgttgttgttctctgaggatttttggcaggaagccagacagaaaaaacaactcagaacaataatggtcttcatgattaatagaattatggagacccagcatggcgtat

SEQ ID NO: 424797 - DNA, 140 bp, Artificial Sequence
  Synthetic
atacgccatgctgggtctcccgagctcttataagttgggaaatgggtcaggcacccagtccatataatactagggtcgaatgcataggatggtcaagcacgtcatgccatgatggcatatcgtacttgggagtcggccat

SEQ ID NO: 424798 - DNA, 140 bp, Artificial Sequence
  Synthetic
atggccgactcccaagtacgatatgccatcatggcatgacgtgcttgaccatcctatgcattcgaccctagtattatatggactgggtgcctgacccatttcccaacttataagagctcgggagacccagcatggcgtat

SEQ ID NO: 424799 - DNA, 140 bp, Artificial Sequence
  Synthetic
aggccctggctgctgatatgacggatgatcaaattgaagtaactaatgcgactgaactagttcagagctcctcaacagggaagatatgcaacaatcctcacagaattctcgatggaagaggaccttttgggacagcggtg

SEQ ID NO: 424800 - DNA, 140 bp, Artificial Sequence
  Synthetic
caccgctgtcccaaaaggtcctcttccatcgagaattctgtgaggattgttgcatatcttccctgttgaggagctctgaactagttcagtcgcattagttacttcaatttgatcatccgtcatatcagcagccagggcct

SEQ ID NO: 424801 - DNA, 140 bp, Artificial Sequence
  Synthetic
atacgccatgctgggtctccaatttctggagaggcgaaaatggaagaagaacaaggattgcatatgagagaatgtgcaacatcctcaaagggaaattccaaacagctgcacaaagagcaacgtacttgggagtcggccat

SEQ ID NO: 424802 - DNA, 140 bp, Artificial Sequence
  Synthetic
atggccgactcccaagtacgttgctctttgtgcagctgtttggaatttccctttgaggatgttgcacattctctcatatgcaatccttgttcttcttccattttcgcctctccagaaattggagacccagcatggcgtat

SEQ ID NO: 424803 - DNA, 140 bp, Artificial Sequence
  Synthetic
aggccctggctgctgatatgtgatggatcaagtgcgagagagcagaaatcctgggaatgctgaaattgaagatctcatttttctggcacggtctgcactcatcctgagaggatcagtggcgaccttttgggacagcggtg

SEQ ID NO: 424804 - DNA, 140 bp, Artificial Sequence
  Synthetic
caccgctgtcccaaaaggtcgccactgatcctctcaggatgagtgcagaccgtgccagaaaaatgagatcttcaatttcagcattcccaggatttctgctctctcgcacttgatccatcacatatcagcagccagggcct

SEQ ID NO: 424805 - DNA, 140 bp, Artificial Sequence
  Synthetic
aggccctggctgctgatatgcagtggtcatgacagatggtccagcaaacaacaaggcagcaactaagataatctacttcaaagagggaaagatacagaaaattgaagaactgcaagggaagaccttttgggacagcggtg

SEQ ID NO: 424806 - DNA, 140 bp, Artificial Sequence
  Synthetic
caccgctgtcccaaaaggtcttcccttgcagttcttcaattttctgtatctttccctctttgaagtagattatcttagttgctgccttgttgtttgctggaccatctgtcatgaccactgcatatcagcagccagggcct

SEQ ID NO: 424807 - DNA, 140 bp, Artificial Sequence
  Synthetic
atacgccatgctgggtctccgtcacacaaaatggagggagtggtgcttgcaaaagaggacccgctaatggcttttttagtagactgaattggctgactaaatctggtagtgcttatccatcgtacttgggagtcggccat

SEQ ID NO: 424808 - DNA, 140 bp, Artificial Sequence
  Synthetic
atggccgactcccaagtacgatggataagcactaccagatttagtcagccaattcagtctactaaaaaagccattagcgggtcctcttttgcaagcaccactccctccattttgtgtgacggagacccagcatggcgtat

SEQ ID NO: 424809 - DNA, 140 bp, Artificial Sequence
  Synthetic
aggccctggctgctgatatgcgtctgcttcaaaacagccaggtctttagtctcattaggccaaatgaaaacccagcacataagagtcaattagtgtggatggcatgccactctgcagcatgaccttttgggacagcggtg

SEQ ID NO: 424810 - DNA, 140 bp, Artificial Sequence
  Synthetic
caccgctgtcccaaaaggtcatgctgcagagtggcatgccatccacactaattgactcttatgtgctgggttttcatttggcctaatgagactaaagacctggctgttttgaagcagacgcatatcagcagccagggcct

SEQ ID NO: 424811 - DNA, 140 bp, Artificial Sequence
  Synthetic
atacgccatgctgggtctcctgctgaacgtgactatgccgaacaacgataattttgacaaattgtacgtgtggggagttcatcatccaagcacaaaccaagagcaaaccaatttgtatgtcgtacttgggagtcggccat

SEQ ID NO: 424812 - DNA, 140 bp, Artificial Sequence
  Synthetic
atggccgactcccaagtacgacatacaaattggtttgctcttggtttgtgcttggatgatgaactccccacacgtacaatttgtcaaaattatcgttgttcggcatagtcacgttcagcaggagacccagcatggcgtat

SEQ ID NO: 424813 - DNA, 140 bp, Artificial Sequence
  Synthetic
aggccctggctgctgatatgtggggagttcatcatccaagcacaaaccaagagcaaaccaatttgtatgtccaggcatcaggaagggtcacagtctcaactagaagaagccagcaaaccagaccttttgggacagcggtg

SEQ ID NO: 424814 - DNA, 140 bp, Artificial Sequence
  Synthetic
caccgctgtcccaaaaggtctggtttgctggcttcttctagttgagactgtgacccttcctgatgcctggacatacaaattggtttgctcttggtttgtgcttggatgatgaactccccacatatcagcagccagggcct

SEQ ID NO: 424815 - DNA, 140 bp, Artificial Sequence
  Synthetic
atacgccatgctgggtctcctaattcccaacatcggatccaggccttgggtcagaggccaatcaggaagaataagtatctactggacaatagtaaagccaggagacatactggtgattaacgtacttgggagtcggccat

SEQ ID NO: 424816 - DNA, 140 bp, Artificial Sequence
  Synthetic
atggccgactcccaagtacgttaatcaccagtatgtctcctggctttactattgtccagtagatacttattcttcctgattggcctctgacccaaggcctggatccgatgttgggaattaggagacccagcatggcgtat

SEQ ID NO: 424817 - DNA, 140 bp, Artificial Sequence
  Synthetic
atacgccatgctgggtctcccagcagatgcgtgatgtgctggggacatttgacactgtccaaatagtaaagctcctaccatttgcagcagccccaccggaacagagtaggatgcagttttcgtacttgggagtcggccat

SEQ ID NO: 424818 - DNA, 140 bp, Artificial Sequence
  Synthetic
atggccgactcccaagtacgaaaactgcatcctactctgttccggtggggctgctgcaaatggtaggagctttactatttggacagtgtcaaatgtccccagcacatcacgcatctgctgggagacccagcatggcgtat

SEQ ID NO: 424819 - DNA, 140 bp, Artificial Sequence
  Synthetic
atacgccatgctgggtctcccagcaatggaaatctaattgcccctcgaggttattttaagatgcgcactgggaaaagctcgataatgagatcagatgcacctattgacacatgtatttctcgtacttgggagtcggccat

SEQ ID NO: 424820 - DNA, 140 bp, Artificial Sequence
  Synthetic
atggccgactcccaagtacgagaaatacatgtgtcaataggtgcatctgatctcattatcgagcttttcccagtgcgcatcttaaaataacctcgaggggcaattagatttccattgctgggagacccagcatggcgtat

SEQ ID NO: 424821 - DNA, 140 bp, Artificial Sequence
  Synthetic
atacgccatgctgggtctccaatactgggctataagaaccaggagcggaggaaacaccaatcaacagagatcatccgcagggcaaattagtgtacaacctactttctcagtacagagaaacgtacttgggagtcggccat

SEQ ID NO: 424822 - DNA, 140 bp, Artificial Sequence
  Synthetic
atggccgactcccaagtacgtttctctgtactgagaaagtaggttgtacactaatttgccctgcggatgatctctgttgattggtgtttcctccgctcctggttcttatagcccagtattggagacccagcatggcgtat

SEQ ID NO: 424823 - DNA, 140 bp, Artificial Sequence
  Synthetic
atacgccatgctgggtctcctgtaaacaaaatcacctatggggcatgtcccaaatatgtcaagcagagcaccttgaaactggcaaccgggatgcggaatgtacctgagagacaaaccaggcgtacttgggagtcggccat

SEQ ID NO: 424824 - DNA, 140 bp, Artificial Sequence
  Synthetic
atggccgactcccaagtacgcctggtttgtctctcaggtacattccgcatcccggttgccagtttcaaggtgctctgcttgacatatttgggacatgccccataggtgattttgtttacaggagacccagcatggcgtat

SEQ ID NO: 424825 - DNA, 140 bp, Artificial Sequence
  Synthetic
atacgccatgctgggtctcccaatcatggagaagaatgtgacggtcacacatgctcaggacatactggaaaatgaacacaatgggagactctgcagtcttaaaggagtgaagccccttatcgtacttgggagtcggccat

SEQ ID NO: 424826 - DNA, 140 bp, Artificial Sequence
  Synthetic
atggccgactcccaagtacgataaggggcttcactcctttaagactgcagagtctcccattgtgttcattttccagtatgtcctgagcatgtgtgaccgtcacattcttctccatgattgggagacccagcatggcgtat

SEQ ID NO: 424827 - DNA, 140 bp, Artificial Sequence
  Synthetic
aggccctggctgctgatatgtcgaagacaccaaaatagatctatggtcttacaatgcggaacttcttgtggcgctggaaaaccagcatacaattgatctgactgattcagaaatgaacaagaccttttgggacagcggtg

SEQ ID NO: 424828 - DNA, 140 bp, Artificial Sequence
  Synthetic
caccgctgtcccaaaaggtcttgttcatttctgaatcagtcagatcaattgtatgctggttttccagcgccacaagaagttccgcattgtaagaccatagatctattttggtgtcttcgacatatcagcagccagggcct

SEQ ID NO: 424829 - DNA, 140 bp, Artificial Sequence
  Synthetic
aggccctggctgctgatatgcagacgaaaaggccacgaacccgatcgtgccttcctttgacatgagtaaagaaggatcttatttctttggagacaatgctgaggagtttgacagttgaaggaccttttgggacagcggtg

SEQ ID NO: 424830 - DNA, 140 bp, Artificial Sequence
  Synthetic
caccgctgtcccaaaaggtccttcaactgtcaaactcctcagcattgtctccaaagaaataagatccttctttactcatgtcaaaggaaggcacgatcgggttcgtggccttttcgtctgcatatcagcagccagggcct

SEQ ID NO: 424831 - DNA, 140 bp, Artificial Sequence
  Synthetic
atacgccatgctgggtctccggaatggctgtttcaaaatatatcacaaatgtgacaatgcttgcatagagtcaatcaggaatgggacctatgatcatgacgtatacagggacgaagcactcgtacttgggagtcggccat

SEQ ID NO: 424832 - DNA, 140 bp, Artificial Sequence
  Synthetic
atggccgactcccaagtacgagtgcttcgtccctgtatacgtcatgatcataggtcccattcctgattgactctatgcaagcattgtcacatttgtgatatattttgaaacagccattccggagacccagcatggcgtat

SEQ ID NO: 424833 - DNA, 140 bp, Artificial Sequence
  Synthetic
atacgccatgctgggtctccaatgatgaggcagagcagacaaggctctaccaaaacccaactacctatatttccattgggacttcaacactaaaccagagattggtaccaaaaatagccacgtacttgggagtcggccat

SEQ ID NO: 424834 - DNA, 140 bp, Artificial Sequence
  Synthetic
atggccgactcccaagtacgtggctatttttggtaccaatctctggtttagtgttgaagtcccaatggaaatataggtagttgggttttggtagagccttgtctgctctgcctcatcattggagacccagcatggcgtat

SEQ ID NO: 424835 - DNA, 140 bp, Artificial Sequence
  Synthetic
atacgccatgctgggtctccattggattctatggatttcctttgccatatcatgctttttgctgtgtgttgttctactgggattcatcatgtgggcctgccagagaggcaatattagatgcgtacttgggagtcggccat

SEQ ID NO: 424836 - DNA, 140 bp, Artificial Sequence
  Synthetic
atggccgactcccaagtacgcatctaatattgcctctctggcaggcccacatgatgaatcccagtagaacaacacacagcaaaaagcatgatatggcaaaggaaatccatagaatccaatggagacccagcatggcgtat

SEQ ID NO: 424837 - DNA, 140 bp, Artificial Sequence
  Synthetic
aggccctggctgctgatatgtgctttttgctgtgtgttgttctactgggattcatcatgtgggcctgccagagaggcaatattagatgcaacatttgcatttgagtatactaataattaagaccttttgggacagcggtg

SEQ ID NO: 424838 - DNA, 140 bp, Artificial Sequence
  Synthetic
caccgctgtcccaaaaggtcttaattattagtatactcaaatgcaaatgttgcatctaatattgcctctctggcaggcccacatgatgaatcccagtagaacaacacacagcaaaaagcacatatcagcagccagggcct

SEQ ID NO: 424839 - DNA, 140 bp, Artificial Sequence
  Synthetic
atacgccatgctgggtctccatgccttactgggagaccctcattgtgacgtttttcaggatgagacatgggacctctttgtggaacgaagcaatgctttcagcaattgctatccttatgacgtacttgggagtcggccat

SEQ ID NO: 424840 - DNA, 140 bp, Artificial Sequence
  Synthetic
atggccgactcccaagtacgtcataaggatagcaattgctgaaagcattgcttcgttccacaaagaggtcccatgtctcatcctgaaaaacgtcacaatgagggtctcccagtaaggcatggagacccagcatggcgtat

SEQ ID NO: 424841 - DNA, 140 bp, Artificial Sequence
  Synthetic
atacgccatgctgggtctccaaggcagaacatctgacatgaggactgaaattataagaatgatggaaagcgccagaccagaagatgtgtccttccaggggcggggagtcttcgagctctccgtacttgggagtcggccat

SEQ ID NO: 424842 - DNA, 140 bp, Artificial Sequence
  Synthetic
atggccgactcccaagtacggagagctcgaagactccccgcccctggaaggacacatcttctggtctggcgctttccatcattcttataatttcagtcctcatgtcagatgttctgccttggagacccagcatggcgtat

SEQ ID NO: 424843 - DNA, 140 bp, Artificial Sequence
  Synthetic
aggccctggctgctgatatgacttttatgcaagccttacaactattgcttgaagtggagcaagagataagaactttctcgtttcagcttatttaatgataaaaaacacccttgtttctacgaccttttgggacagcggtg

SEQ ID NO: 424844 - DNA, 140 bp, Artificial Sequence
  Synthetic
caccgctgtcccaaaaggtcgtagaaacaagggtgttttttatcattaaataagctgaaacgagaaagttcttatctcttgctccacttcaagcaatagttgtaaggcttgcataaaagtcatatcagcagccagggcct

SEQ ID NO: 424845 - DNA, 140 bp, Artificial Sequence
  Synthetic
aggccctggctgctgatatgctgcatttgatgaaaggaggaacaaatatctggaagaacatcccagtgcggggaaggatccgaagaaaaccggaggtccaatatacagaaggagagacgggaccttttgggacagcggtg

SEQ ID NO: 424846 - DNA, 140 bp, Artificial Sequence
  Synthetic
caccgctgtcccaaaaggtcccgtctctccttctgtatattggacctccggttttcttcggatccttccccgcactgggatgttcttccagatatttgttcctcctttcatcaaatgcagcatatcagcagccagggcct

SEQ ID NO: 424847 - DNA, 140 bp, Artificial Sequence
  Synthetic
atacgccatgctgggtctccgaagagaagatcccaaggacaaagaacatgaagaaaacaagccaattgaagtgggcactcggtgaaaatatggcaccagaaaaagtagactttgatgactcgtacttgggagtcggccat

SEQ ID NO: 424848 - DNA, 140 bp, Artificial Sequence
  Synthetic
atggccgactcccaagtacgagtcatcaaagtctactttttctggtgccatattttcaccgagtgcccacttcaattggcttgttttcttcatgttctttgtccttgggatcttctcttcggagacccagcatggcgtat

SEQ ID NO: 424849 - DNA, 140 bp, Artificial Sequence
  Synthetic
atacgccatgctgggtctccgttgtttcgagttctatcacaaatgtaataatgaatgtatggaaagtgtaagaaacgggacgtatgactacccacagtattcagaagaagcaagattaaacgtacttgggagtcggccat

SEQ ID NO: 424850 - DNA, 140 bp, Artificial Sequence
  Synthetic
atggccgactcccaagtacgtttaatcttgcttcttctgaatactgtgggtagtcatacgtcccgtttcttacactttccatacattcattattacatttgtgatagaactcgaaacaacggagacccagcatggcgtat

SEQ ID NO: 424851 - DNA, 140 bp, Artificial Sequence
  Synthetic
aggccctggctgctgatatgtacagtggatttgtgagaacattattccaacaaatgcgtgatgtactggggacgtttgacactgtccagataataaagctactaccatttgcagcagcccgaccttttgggacagcggtg

SEQ ID NO: 424852 - DNA, 140 bp, Artificial Sequence
  Synthetic
caccgctgtcccaaaaggtcgggctgctgcaaatggtagtagctttattatctggacagtgtcaaacgtccccagtacatcacgcatttgttggaataatgttctcacaaatccactgtacatatcagcagccagggcct

SEQ ID NO: 424853 - DNA, 140 bp, Artificial Sequence
  Synthetic
aggccctggctgctgatatggcgatctgaatggagtgaaacctctgattttaaaggattgtagtgtagctggatggcttcttggaaacccaatgtgcgacgagttcatcagagtgccggagaccttttgggacagcggtg

SEQ ID NO: 424854 - DNA, 140 bp, Artificial Sequence
  Synthetic
caccgctgtcccaaaaggtctccggcactctgatgaactcgtcgcacattgggtttccaagaagccatccagctacactacaatcctttaaaatcagaggtttcactccattcagatcgccatatcagcagccagggcct

SEQ ID NO: 424855 - DNA, 140 bp, Artificial Sequence
  Synthetic
atacgccatgctgggtctcccagggaacctcaatgactatgaagaactgaaacacctattgagcagaataaatcattttgagaagactctgatcatccccaagagttcttggcccaatcacgtacttgggagtcggccat

SEQ ID NO: 424856 - DNA, 140 bp, Artificial Sequence
  Synthetic
atggccgactcccaagtacgtgattgggccaagaactcttggggatgatcagagtcttctcaaaatgatttattctgctcaataggtgtttcagttcttcatagtcattgaggttccctgggagacccagcatggcgtat

SEQ ID NO: 424857 - DNA, 140 bp, Artificial Sequence
  Synthetic
atacgccatgctgggtctccaatcattttgagaagactctgatcatccccaagagttcttggcccaatcatgaaacatcattaggggtgagcgcagcatgtccataccagggaatgccctcgtacttgggagtcggccat

SEQ ID NO: 424858 - DNA, 140 bp, Artificial Sequence
  Synthetic
atggccgactcccaagtacgagggcattccctggtatggacatgctgcgctcacccctaatgatgtttcatgattgggccaagaactcttggggatgatcagagtcttctcaaaatgattggagacccagcatggcgtat

SEQ ID NO: 424859 - DNA, 140 bp, Artificial Sequence
  Synthetic
atacgccatgctgggtctcctttggcgtcaagcgaacaatggagaagacgcaactgctggtctcactcatctgatgatctggcattccaacctgaatgatgccacatatcagagaacaagcgtacttgggagtcggccat

SEQ ID NO: 424860 - DNA, 140 bp, Artificial Sequence
  Synthetic
atggccgactcccaagtacgcttgttctctgatatgtggcatcattcaggttggaatgccagatcatcagatgagtgagaccagcagttgcgtcttctccattgttcgcttgacgccaaaggagacccagcatggcgtat

SEQ ID NO: 424861 - DNA, 140 bp, Artificial Sequence
  Synthetic
atacgccatgctgggtctccataacttttgaagccactgggaatttaatagcaccatggcacgcatttgcattgaaaaaaggctctagttctggaattatgatgtcagatgctcaggttccgtacttgggagtcggccat

SEQ ID NO: 424862 - DNA, 140 bp, Artificial Sequence
  Synthetic
atggccgactcccaagtacggaacctgagcatctgacatcataattccagaactagagccttttttcaatgcaaatgcgtgccatggtgctattaaattcccagtggcttcaaaagttatggagacccagcatggcgtat

SEQ ID NO: 424863 - DNA, 140 bp, Artificial Sequence
  Synthetic
atacgccatgctgggtctccaaaggggactcaacaattatgaaaagtgaaatggaatatggccactgcaacaccaaatgtcaaactccaataggggcgataaactctagtatgccattcccgtacttgggagtcggccat

SEQ ID NO: 424864 - DNA, 140 bp, Artificial Sequence
  Synthetic
atggccgactcccaagtacgggaatggcatactagagtttatcgcccctattggagtttgacatttggtgttgcagtggccatattccatttcacttttcataattgttgagtcccctttggagacccagcatggcgtat

SEQ ID NO: 424865 - DNA, 140 bp, Artificial Sequence
  Synthetic
aggccctggctgctgatatgacaatatacaccctctcactatcggggagtgccccaaatacgtgaaatcaaacaaattagtccttgcgactgggctcagaaatagtcctctaagagaaaggaccttttgggacagcggtg

SEQ ID NO: 424866 - DNA, 140 bp, Artificial Sequence
  Synthetic
caccgctgtcccaaaaggtcctttctcttagaggactatttctgagcccagtcgcaaggactaatttgtttgatttcacgtatttggggcactccccgatagtgagagggtgtatattgtcatatcagcagccagggcct

SEQ ID NO: 424867 - DNA, 140 bp, Artificial Sequence
  Synthetic
atacgccatgctgggtctccctattcaatccagaggacttttcggggcaattgctggattcattgaaggaggatggacaggaatgatagatggatggtatggatatcaccatcaaaatgacgtacttgggagtcggccat

SEQ ID NO: 424868 - DNA, 140 bp, Artificial Sequence
  Synthetic
atggccgactcccaagtacgtcattttgatggtgatatccataccatccatctatcattcctgtccatcctccttcaatgaatccagcaattgccccgaaaagtcctctggattgaatagggagacccagcatggcgtat

SEQ ID NO: 424869 - DNA, 140 bp, Artificial Sequence
  Synthetic
aggccctggctgctgatatgggatattgacttcagagtcacaattgacaataacgaaagagaagaaagaagaactccaagattgtaggattgctcccttaatggttgcatacatgctggagaccttttgggacagcggtg

SEQ ID NO: 424870 - DNA, 140 bp, Artificial Sequence
  Synthetic
caccgctgtcccaaaaggtctccagcatgtatgcaaccattaagggagcaatcctacaatcttggagttcttctttcttctctttcgttattgtcaattgtgactctgaagtcaatatcccatatcagcagccagggcct

SEQ ID NO: 424871 - DNA, 140 bp, Artificial Sequence
  Synthetic
aggccctggctgctgatatgcagtggatcatcaggaattgggagactgtaaagattcaatggtctcaagaccctacaatgctgtacaataagatggaatttgaaccattccaatccttgggaccttttgggacagcggtg

SEQ ID NO: 424872 - DNA, 140 bp, Artificial Sequence
  Synthetic
caccgctgtcccaaaaggtcccaaggattggaatggttcaaattccatcttattgtacagcattgtagggtcttgagaccattgaatctttacagtctcccaattcctgatgatccactgcatatcagcagccagggcct

SEQ ID NO: 424873 - DNA, 140 bp, Artificial Sequence
  Synthetic
aggccctggctgctgatatgttaaataagaaaatggaagacggattcctagatgtctggacttataatgctgaacttctagttctcatggaaaatgagagaactctagatttccatgactgaccttttgggacagcggtg

SEQ ID NO: 424874 - DNA, 140 bp, Artificial Sequence
  Synthetic
caccgctgtcccaaaaggtcagtcatggaaatctagagttctctcattttccatgagaactagaagttcagcattataagtccagacatctaggaatccgtcttccattttcttatttaacatatcagcagccagggcct

SEQ ID NO: 424875 - DNA, 140 bp, Artificial Sequence
  Synthetic
aggccctggctgctgatatgacaactggggagctgcaacgtagcaggatggatccttggcaacccaaaatgtgactcactgctcacagcaaattcgtggtcttacataatagagacttcagaccttttgggacagcggtg

SEQ ID NO: 424876 - DNA, 140 bp, Artificial Sequence
  Synthetic
caccgctgtcccaaaaggtctgaagtctctattatgtaagaccacgaatttgctgtgagcagtgagtcacattttgggttgccaaggatccatcctgctacgttgcagctccccagttgtcatatcagcagccagggcct

SEQ ID NO: 424877 - DNA, 140 bp, Artificial Sequence
  Synthetic
aggccctggctgctgatatgtcaataggaacttaccaaatactgtcaatttattcaacagtggcgagttccctagcactggcaatcattgtggctggtctatctttatggatgtgctccagaccttttgggacagcggtg

SEQ ID NO: 424878 - DNA, 140 bp, Artificial Sequence
  Synthetic
caccgctgtcccaaaaggtctggagcacatccataaagatagaccagccacaatgattgccagtgctagggaactcgccactgttgaataaattgacagtatttggtaagttcctattgacatatcagcagccagggcct

SEQ ID NO: 424879 - DNA, 140 bp, Artificial Sequence
  Synthetic
atacgccatgctgggtctcccagaaaatggctggctccctctgtatcagaatggaccaagcaattatggataaaaacatcatactgaaagcgaatttcagtgtgatctttgatcggctggcgtacttgggagtcggccat

SEQ ID NO: 424880 - DNA, 140 bp, Artificial Sequence
  Synthetic
atggccgactcccaagtacgccagccgatcaaagatcacactgaaattcgctttcagtatgatgtttttatccataattgcttggtccattctgatacagagggagccagccattttctgggagacccagcatggcgtat

SEQ ID NO: 424881 - DNA, 140 bp, Artificial Sequence
  Synthetic
aggccctggctgctgatatgagaactgggtgatgccccattccttgaccggcttcgccgagaccagaagtccctaagaggaagaggcaacactcttggtctggacatcgaaacagctactgaccttttgggacagcggtg

SEQ ID NO: 424882 - DNA, 140 bp, Artificial Sequence
  Synthetic
caccgctgtcccaaaaggtcagtagctgtttcgatgtccagaccaagagtgttgcctcttcctcttagggacttctggtctcggcgaagccggtcaaggaatggggcatcacccagttctcatatcagcagccagggcct

SEQ ID NO: 424883 - DNA, 140 bp, Artificial Sequence
  Synthetic
aggccctggctgctgatatgaaacagattgtgtattggaagcaatggctttccttgaagaatcccacccagggatctttgaaaactcttgtcttgaaacgatggaaattgttcaacaaacgaccttttgggacagcggtg

SEQ ID NO: 424884 - DNA, 140 bp, Artificial Sequence
  Synthetic
caccgctgtcccaaaaggtcgtttgttgaacaatttccatcgtttcaagacaagagttttcaaagatccctgggtgggattcttcaaggaaagccattgcttccaatacacaatctgtttcatatcagcagccagggcct

SEQ ID NO: 424885 - DNA, 140 bp, Artificial Sequence
  Synthetic
atacgccatgctgggtctccaaaactggaggtccaatctacagaagaagagacggaaagtggatgagggagctgattctgtatgacaaagaagagatcagaaggatctggcgtcaagcaacgtacttgggagtcggccat

SEQ ID NO: 424886 - DNA, 140 bp, Artificial Sequence
  Synthetic
atggccgactcccaagtacgttgcttgacgccagatccttctgatctcttctttgtcatacagaatcagctccctcatccactttccgtctcttcttctgtagattggacctccagttttggagacccagcatggcgtat

SEQ ID NO: 424887 - DNA, 140 bp, Artificial Sequence
  Synthetic
aggccctggctgctgatatgaacagagaatagtttcgaacaaataacatttatgcaagccttacaactactgcttgaagtagagcaagagataaggactttctcgtttcagcttatttaagaccttttgggacagcggtg

SEQ ID NO: 424888 - DNA, 140 bp, Artificial Sequence
  Synthetic
caccgctgtcccaaaaggtcttaaataagctgaaacgagaaagtccttatctcttgctctacttcaagcagtagttgtaaggcttgcataaatgttatttgttcgaaactattctctgttcatatcagcagccagggcct

SEQ ID NO: 424889 - DNA, 140 bp, Artificial Sequence
  Synthetic
aggccctggctgctgatatgacagaaatcaaccggcagcaactgcattggccaacaccatagaagtttttagatcaaatggtctgacagccaatgaatcaggaagactaatagatttcctgaccttttgggacagcggtg

SEQ ID NO: 424890 - DNA, 140 bp, Artificial Sequence
  Synthetic
caccgctgtcccaaaaggtcaggaaatctattagtcttcctgattcattggctgtcagaccatttgatctaaaaacttctatggtgttggccaatgcagttgctgccggttgatttctgtcatatcagcagccagggcct

SEQ ID NO: 424891 - DNA, 140 bp, Artificial Sequence
  Synthetic
aggccctggctgctgatatgcttcctgagagggaaatctatgggaattcagagtggagtgcaggttgatgccgattgtgaaggggattgctatcatagtggagggacaatagtgagtaatgaccttttgggacagcggtg

SEQ ID NO: 424892 - DNA, 140 bp, Artificial Sequence
  Synthetic
caccgctgtcccaaaaggtcattactcactattgtccctccactatgatagcaatccccttcacaatcggcatcaacctgcactccactctgaattcccatagatttccctctcaggaagcatatcagcagccagggcct

SEQ ID NO: 424893 - DNA, 140 bp, Artificial Sequence
  Synthetic
aggccctggctgctgatatgaataccagcagaaatgcttgcaaacattgaccttaaatacttcaatgaaacaacgaaaaagaaaattgagaagataagacctctattaatagatggtacagaccttttgggacagcggtg

SEQ ID NO: 424894 - DNA, 140 bp, Artificial Sequence
  Synthetic
caccgctgtcccaaaaggtctgtaccatctattaatagaggtcttatcttctcaattttctttttcgttgtttcattgaagtatttaaggtcaatgtttgcaagcatttctgctggtattcatatcagcagccagggcct

SEQ ID NO: 424895 - DNA, 140 bp, Artificial Sequence
  Synthetic
atacgccatgctgggtctcccctcggaaaggacgctggtgcattaacagaagatccagacgagggaacagccggagttgaatctgcagtactaaggggatttctaattctgggcaaggagcgtacttgggagtcggccat

SEQ ID NO: 424896 - DNA, 140 bp, Artificial Sequence
  Synthetic
atggccgactcccaagtacgctccttgcccagaattagaaatccccttagtactgcagattcaactccggctgttccctcgtctggatcttctgttaatgcaccagcgtcctttccgaggggagacccagcatggcgtat

SEQ ID NO: 424897 - DNA, 140 bp, Artificial Sequence
  Synthetic
aggccctggctgctgatatgtaatgaatctgccgacatgagcattggagtaacagtgataaaaaacaacatgataaacaatgaccttggacctgcaacagctcaaatggctcttcagctggaccttttgggacagcggtg

SEQ ID NO: 424898 - DNA, 140 bp, Artificial Sequence
  Synthetic
caccgctgtcccaaaaggtccagctgaagagccatttgagctgttgcaggtccaaggtcattgtttatcatgttgttttttatcactgttactccaatgctcatgtcggcagattcattacatatcagcagccagggcct

SEQ ID NO: 424899 - DNA, 140 bp, Artificial Sequence
  Synthetic
aggccctggctgctgatatgtggaatggatcccagaatgtgctctctgatgcaaggatcaactctcccaagaaggtctggagctgctggtgcagcagtaaaaggggtcggaacaatggtagaccttttgggacagcggtg

SEQ ID NO: 424900 - DNA, 140 bp, Artificial Sequence
  Synthetic
caccgctgtcccaaaaggtctaccattgttccgaccccttttactgctgcaccagcagctccagaccttcttgggagagttgatccttgcatcagagagcacattctgggatccattccacatatcagcagccagggcct

SEQ ID NO: 424901 - DNA, 140 bp, Artificial Sequence
  Synthetic
aggccctggctgctgatatgtacctaaagcaatcagaggtcaatacagtggatttgtgagaacattattccagcagatgcgtgatgtgctggggacatttgacactgtccaaatagtaaagaccttttgggacagcggtg

SEQ ID NO: 424902 - DNA, 140 bp, Artificial Sequence
  Synthetic
caccgctgtcccaaaaggtctttactatttggacagtgtcaaatgtccccagcacatcacgcatctgctggaataatgttctcacaaatccactgtattgacctctgattgctttaggtacatatcagcagccagggcct

SEQ ID NO: 424903 - DNA, 140 bp, Artificial Sequence
  Synthetic
aggccctggctgctgatatgagttggatcatcaaaatactacaaaaggttcacaccagaaatagtagcaagacctaaagtcagaggacaagcaggcagaatgaattattactggacactggaccttttgggacagcggtg

SEQ ID NO: 424904 - DNA, 140 bp, Artificial Sequence
  Synthetic
caccgctgtcccaaaaggtccagtgtccagtaataattcattctgcctgcttgtcctctgactttaggtcttgctactatttctggtgtgaaccttttgtagtattttgatgatccaactcatatcagcagccagggcct

SEQ ID NO: 424905 - DNA, 140 bp, Artificial Sequence
  Synthetic
aggccctggctgctgatatgcaggtacagattcaaaatgagactttgtacgataatgcatcaaatggccagtatgagtcgatggaattcctttcgtcagtccgaaagaggcaatgaaacagaccttttgggacagcggtg

SEQ ID NO: 424906 - DNA, 140 bp, Artificial Sequence
  Synthetic
caccgctgtcccaaaaggtctgtttcattgcctctttcggactgacgaaaggaattccatcgactcatactggccatttgatgcattatcgtacaaagtctcattttgaatctgtacctgcatatcagcagccagggcct

SEQ ID NO: 424907 - DNA, 140 bp, Artificial Sequence
  Synthetic
aggccctggctgctgatatgattgtcaggaggtgctcagcatgttgaggagtgctcctgttatcctcgatttcctggtgtcagatgtgtctgcagagacaactggaaaggctccaatagggaccttttgggacagcggtg

SEQ ID NO: 424908 - DNA, 140 bp, Artificial Sequence
  Synthetic
caccgctgtcccaaaaggtccctattggagcctttccagttgtctctgcagacacatctgacaccaggaaatcgaggataacaggagcactcctcaacatgctgagcacctcctgacaatcatatcagcagccagggcct

SEQ ID NO: 424909 - DNA, 140 bp, Artificial Sequence
  Synthetic
aggccctggctgctgatatgctgggtcggacagggtgatggtgtcccccctagctgtaacttggtggaataggaatgggcctacgacaaatacagttcattatccaaaagtctacaaaacgaccttttgggacagcggtg

SEQ ID NO: 424910 - DNA, 140 bp, Artificial Sequence
  Synthetic
caccgctgtcccaaaaggtcgttttgtagacttttggataatgaactgtatttgtcgtaggcccattcctattccaccaagttacagctaggggggacaccatcaccctgtccgacccagcatatcagcagccagggcct

SEQ ID NO: 424911 - DNA, 140 bp, Artificial Sequence
  Synthetic
aggccctggctgctgatatgagatctctagcaagctgggtccaaaatgagttcaataaggcatgtgaattgactgattcaagctggatagaacttgatgaaataggggaggatgtcgaacgaccttttgggacagcggtg

SEQ ID NO: 424912 - DNA, 140 bp, Artificial Sequence
  Synthetic
caccgctgtcccaaaaggtcgttcgacatcctcccctatttcatcaagttctatccagcttgaatcagtcaattcacatgccttattgaactcattttggacccagcttgctagagatctcatatcagcagccagggcct

SEQ ID NO: 424913 - DNA, 140 bp, Artificial Sequence
  Synthetic
aggccctggctgctgatatgcaataacaaaagagaagaaagaagagctccaagattgtaagattgctcccttaatggttgcatacatgttggagagggaactggtccgcaaaaccagattgaccttttgggacagcggtg

SEQ ID NO: 424914 - DNA, 140 bp, Artificial Sequence
  Synthetic
caccgctgtcccaaaaggtcaatctggttttgcggaccagttccctctccaacatgtatgcaaccattaagggagcaatcttacaatcttggagctcttctttcttctcttttgttattgcatatcagcagccagggcct

SEQ ID NO: 424915 - DNA, 140 bp, Artificial Sequence
  Synthetic
aggccctggctgctgatatgggtaaattttgtgagtatggagttttctctcactgatccgcggctggagccccacaaatgggagaagtattgtgttcttgaaataggagacatgattctagaccttttgggacagcggtg

SEQ ID NO: 424916 - DNA, 140 bp, Artificial Sequence
  Synthetic
caccgctgtcccaaaaggtctagaatcatgtctcctatttcaagaacacaatacttctcccatttgtggggctccagccgcggatcagtgagagaaaactccatactcacaaaatttacccatatcagcagccagggcct

SEQ ID NO: 424917 - DNA, 140 bp, Artificial Sequence
  Synthetic
atacgccatgctgggtctcctgactcaaggaacctgctgggagcagatgtacactccaggcggagaagtaagaaatgacgatgttgaccagagtttgatcatcgctgccagaaacattgtcgtacttgggagtcggccat

SEQ ID NO: 424918 - DNA, 140 bp, Artificial Sequence
  Synthetic
atggccgactcccaagtacgacaatgtttctggcagcgatgatcaaactctggtcaacatcgtcatttcttacttctccgcctggagtgtacatctgctcccagcaggttccttgagtcaggagacccagcatggcgtat

SEQ ID NO: 424919 - DNA, 140 bp, Artificial Sequence
  Synthetic
atacgccatgctgggtctccgtcacagcacacaaattggtgggataaggatggtggacatccttaggcaaaatccaactgaggaacaagctgtggatatatgcaaagcagcaatgggtttcgtacttgggagtcggccat

SEQ ID NO: 424920 - DNA, 140 bp, Artificial Sequence
  Synthetic
atggccgactcccaagtacgaaacccattgctgctttgcatatatccacagcttgttcctcagttggattttgcctaaggatgtccaccatccttatcccaccaatttgtgtgctgtgacggagacccagcatggcgtat

SEQ ID NO: 424921 - DNA, 140 bp, Artificial Sequence
  Synthetic
atacgccatgctgggtctcctgggctataaggaccagaagtggaggaaacacaaaccaacagagagcatctgcagggcaaatcagtgtacagcctactttctcggtacagagaaatcttccgtacttgggagtcggccat

SEQ ID NO: 424922 - DNA, 140 bp, Artificial Sequence
  Synthetic
atggccgactcccaagtacggaagatttctctgtaccgagaaagtaggctgtacactgatttgccctgcagatgctctctgttggtttgtgtttcctccacttctggtccttatagcccaggagacccagcatggcgtat

SEQ ID NO: 424923 - DNA, 140 bp, Artificial Sequence
  Synthetic
atacgccatgctgggtctccgtgggtcatccgtcacgaaggaagaggaagtgcttacgggcaacctccaaacattgaaaataagagtacatgaggggtatgaagaattcacaatggttggcgtacttgggagtcggccat

SEQ ID NO: 424924 - DNA, 140 bp, Artificial Sequence
  Synthetic
atggccgactcccaagtacgccaaccattgtgaattcttcatacccctcatgtactcttattttcaatgtttggaggttgcccgtaagcacttcctcttccttcgtgacggatgacccacggagacccagcatggcgtat

SEQ ID NO: 424925 - DNA, 140 bp, Artificial Sequence
  Synthetic
aggccctggctgctgatatgatggatgtcaacccgactctacttttcttgaaagtgccagcgcaaaatgctataagcactacattcccttacactggagatcctccatacagccatggaagaccttttgggacagcggtg

SEQ ID NO: 424926 - DNA, 140 bp, Artificial Sequence
  Synthetic
caccgctgtcccaaaaggtcttccatggctgtatggaggatctccagtgtaagggaatgtagtgcttatagcattttgcgctggcactttcaagaaaagtagagtcgggttgacatccatcatatcagcagccagggcct

SEQ ID NO: 424927 - DNA, 140 bp, Artificial Sequence
  Synthetic
atacgccatgctgggtctccgaaaggggaagatggacaacaaacacagagactggagcacctcagctcaacccgattgatggaccactacctgaggacaatgagccaagtggatatgcaccgtacttgggagtcggccat

SEQ ID NO: 424928 - DNA, 140 bp, Artificial Sequence
  Synthetic
atggccgactcccaagtacggtgcatatccacttggctcattgtcctcaggtagtggtccatcaatcgggttgagctgaggtgctccagtctctgtgtttgttgtccatcttcccctttcggagacccagcatggcgtat

SEQ ID NO: 424929 - DNA, 140 bp, Artificial Sequence
  Synthetic
aggccctggctgctgatatgtattcggatttccactttattgatgaacgaggcgaatcaataattgtagaatctggcgatccgaatgcattgttgaaacaccgatttgagataattgaaggaccttttgggacagcggtg

SEQ ID NO: 424930 - DNA, 140 bp, Artificial Sequence
  Synthetic
caccgctgtcccaaaaggtccttcaattatctcaaatcggtgtttcaacaatgcattcggatcgccagattctacaattattgattcgcctcgttcatcaataaagtggaaatccgaatacatatcagcagccagggcct

SEQ ID NO: 424931 - DNA, 140 bp, Artificial Sequence
  Synthetic
atacgccatgctgggtctccatctggcgatccgaatgcattgttgaaacaccgatttgagataattgaagggagagaccgaacaatggcctggacagtagtgaatagtatctgcaacacccgtacttgggagtcggccat

SEQ ID NO: 424932 - DNA, 140 bp, Artificial Sequence
  Synthetic
atggccgactcccaagtacgggtgttgcagatactattcactactgtccaggccattgttcggtctctcccttcaattatctcaaatcggtgtttcaacaatgcattcggatcgccagatggagacccagcatggcgtat

SEQ ID NO: 424933 - DNA, 140 bp, Artificial Sequence
  Synthetic
aggccctggctgctgatatgtcacgctcaccgtgcccagtgagcgaggactgcagcgtagacgcttcgtccagaatgccctaaatggaaatggggatccaaataatatggataaggcagtgaccttttgggacagcggtg

SEQ ID NO: 424934 - DNA, 140 bp, Artificial Sequence
  Synthetic
caccgctgtcccaaaaggtcactgccttatccatattatttggatccccatttccatttagggcattctggacgaagcgtctacgctgcagtcctcgctcactgggcacggtgagcgtgacatatcagcagccagggcct

SEQ ID NO: 424935 - DNA, 140 bp, Artificial Sequence
  Synthetic
atacgccatgctgggtctcccagaagacaactgagggaaaatgctgaagatatgggcaatggttgtttcaagatataccataaatgtgacaatgcttgcatagagtcaattagaaatggacgtacttgggagtcggccat

SEQ ID NO: 424936 - DNA, 140 bp, Artificial Sequence
  Synthetic
atggccgactcccaagtacgtccatttctaattgactctatgcaagcattgtcacatttatggtatatcttgaaacaaccattgcccatatcttcagcattttccctcagttgtcttctgggagacccagcatggcgtat

SEQ ID NO: 424937 - DNA, 140 bp, Artificial Sequence
  Synthetic
aggccctggctgctgatatggagtcgattcattgaaattggagtgacgcgaagagaagttcacatatactatctagaaaaagccaacaagataaaatcagagaagacacacattcacatagaccttttgggacagcggtg

SEQ ID NO: 424938 - DNA, 140 bp, Artificial Sequence
  Synthetic
caccgctgtcccaaaaggtctatgtgaatgtgtgtcttctctgattttatcttgttggctttttctagatagtatatgtgaacttctcttcgcgtcactccaatttcaatgaatcgactccatatcagcagccagggcct

SEQ ID NO: 424939 - DNA, 140 bp, Artificial Sequence
  Synthetic
atacgccatgctgggtctccaacagttgggactcaccctaactctagtactggtctgagagacgatcttattgaaaatttgcaggcctaccagaaccggatgggagtgcagatgcagcgacgtacttgggagtcggccat

SEQ ID NO: 424940 - DNA, 140 bp, Artificial Sequence
  Synthetic
atggccgactcccaagtacgtcgctgcatctgcactcccatccggttctggtaggcctgcaaattttcaataagatcgtctctcagaccagtactagagttagggtgagtcccaactgttggagacccagcatggcgtat

SEQ ID NO: 424941 - DNA, 140 bp, Artificial Sequence
  Synthetic
aggccctggctgctgatatgtgacaccatctgtgtgggctaccatgcaaacaactctacagacactgttgacacagtactggaaaagaatgtaactgtgactcactcagtgaatttgctcgaccttttgggacagcggtg

SEQ ID NO: 424942 - DNA, 140 bp, Artificial Sequence
  Synthetic
caccgctgtcccaaaaggtcgagcaaattcactgagtgagtcacagttacattcttttccagtactgtgtcaacagtgtctgtagagttgtttgcatggtagcccacacagatggtgtcacatatcagcagccagggcct

SEQ ID NO: 424943 - DNA, 140 bp, Artificial Sequence
  Synthetic
aggccctggctgctgatatgagatataccataaatgtgacaatgcttgcatagagtcaattagaaatggaacttataatcatgacatatacagagatgaagcattgaacaatcggttccagaccttttgggacagcggtg

SEQ ID NO: 424944 - DNA, 140 bp, Artificial Sequence
  Synthetic
caccgctgtcccaaaaggtctggaaccgattgttcaatgcttcatctctgtatatgtcatgattataagttccatttctaattgactctatgcaagcattgtcacatttatggtatatctcatatcagcagccagggcct

SEQ ID NO: 424945 - DNA, 140 bp, Artificial Sequence
  Synthetic
aggccctggctgctgatatgccggagtggaatctgcagtactgagggggttcctaattctaggcaaggaggacaaaagatatggaccagcattgagcatcaatgaactgagcaatcttgcgaccttttgggacagcggtg

SEQ ID NO: 424946 - DNA, 140 bp, Artificial Sequence
  Synthetic
caccgctgtcccaaaaggtcgcaagattgctcagttcattgatgctcaatgctggtccatatcttttgtcctccttgcctagaattaggaaccccctcagtactgcagattccactccggcatatcagcagccagggcct

SEQ ID NO: 424947 - DNA, 140 bp, Artificial Sequence
  Synthetic
aggccctggctgctgatatgcaaatgtcaaaagaagtgaatgctagaattgagccatttctgaagacaacaccacgccctctcagattacctgatggacctccttgttctcagcggtcgagaccttttgggacagcggtg

SEQ ID NO: 424948 - DNA, 140 bp, Artificial Sequence
  Synthetic
caccgctgtcccaaaaggtctcgaccgctgagaacaaggaggtccatcaggtaatctgagagggcgtggtgttgtcttcagaaatggctcaattctagcattcacttcttttgacatttgcatatcagcagccagggcct

SEQ ID NO: 424949 - DNA, 140 bp, Artificial Sequence
  Synthetic
atacgccatgctgggtctccgagaatttggcgtcaagcgaacaatggagaggatgcaactgctggtcttacccatctgatgatatggcattccaacctgaatgatgccacctatcagagacgtacttgggagtcggccat

SEQ ID NO: 424950 - DNA, 140 bp, Artificial Sequence
  Synthetic
atggccgactcccaagtacgtctctgataggtggcatcattcaggttggaatgccatatcatcagatgggtaagaccagcagttgcatcctctccattgttcgcttgacgccaaattctcggagacccagcatggcgtat

SEQ ID NO: 424951 - DNA, 140 bp, Artificial Sequence
  Synthetic
atacgccatgctgggtctccgatgagtcttctaaccgaggtcgaaacgtacgttctctctatcatcccatcaggccccctcaaagccgagatcgcacagaaacttgaggatgtatttgcacgtacttgggagtcggccat

SEQ ID NO: 424952 - DNA, 140 bp, Artificial Sequence
  Synthetic
atggccgactcccaagtacgtgcaaatacatcctcaagtttctgtgcgatctcggctttgagggggcctgatgggatgatagagagaacgtacgtttcgacctcggttagaagactcatcggagacccagcatggcgtat

SEQ ID NO: 424953 - DNA, 140 bp, Artificial Sequence
  Synthetic
aggccctggctgctgatatggcagcatttgaagacctgagagtgtcgagtttcatcagaggaacaagagtggtcccaagaggacaactgtccaccagaggagttcaaatagcttcaaatggaccttttgggacagcggtg

SEQ ID NO: 424954 - DNA, 140 bp, Artificial Sequence
  Synthetic
caccgctgtcccaaaaggtccatttgaagctatttgaactcctctggtggacagttgtcctcttgggaccactcttgttcctctgatgaaactcgacactctcaggtcttcaaatgctgccatatcagcagccagggcct

SEQ ID NO: 424955 - DNA, 140 bp, Artificial Sequence
  Synthetic
atacgccatgctgggtctcctgatgcagtaaccgatgtttggtcatacaatgccaaacttcttgtactgcttgaaaatggtagaacattagacttgcatgatgcaaatgtcagaaacttacgtacttgggagtcggccat

SEQ ID NO: 424956 - DNA, 140 bp, Artificial Sequence
  Synthetic
atggccgactcccaagtacgtaagtttctgacatttgcatcatgcaagtctaatgttctaccattttcaagcagtacaagaagtttggcattgtatgaccaaacatcggttactgcatcaggagacccagcatggcgtat

SEQ ID NO: 424957 - DNA, 140 bp, Artificial Sequence
  Synthetic
atacgccatgctgggtctccgcacacaaattgcaattgatggaataagcaacaaagtgaactcagtaattgaaaaaatgaacattcaatttacttcagtgggcaaggagttcaatagtctcgtacttgggagtcggccat

SEQ ID NO: 424958 - DNA, 140 bp, Artificial Sequence
  Synthetic
atggccgactcccaagtacgagactattgaactccttgcccactgaagtaaattgaatgttcattttttcaattactgagttcactttgttgcttattccatcaattgcaatttgtgtgcggagacccagcatggcgtat

SEQ ID NO: 424959 - DNA, 140 bp, Artificial Sequence
  Synthetic
  misc_feature (79)..(79): n is a, c, g, or t
  misc_feature (84)..(84): n is a, c, g, or t
aggccctggctgctgatatggatcaaaggtgttcagctaaagtcaggatacaaagattggatcctatggatttcctttnccatntcatgctttttgctttgtgttgttctgctggggttcgaccttttgggacagcggtg

SEQ ID NO: 424960 - DNA, 140 bp, Artificial Sequence
  Synthetic
  misc_feature (57)..(57): n is a, c, g, or t
  misc_feature (62)..(62): n is a, c, g, or t
caccgctgtcccaaaaggtcgaaccccagcagaacaacacaaagcaaaaagcatganatggnaaaggaaatccataggatccaatctttgtatcctgactttagctgaacacctttgatccatatcagcagccagggcct

SEQ ID NO: 424961 - DNA, 140 bp, Artificial Sequence
  Synthetic
atacgccatgctgggtctcccgatccaaatgcactcttaaaacaccgatttgaaataattgaagggagagatcgtactatggcctggacagtagtgaacagtatttgcaacaccacagggcgtacttgggagtcggccat

SEQ ID NO: 424962 - DNA, 140 bp, Artificial Sequence
  Synthetic
atggccgactcccaagtacgccctgtggtgttgcaaatactgttcactactgtccaggccatagtacgatctctcccttcaattatttcaaatcggtgttttaagagtgcatttggatcgggagacccagcatggcgtat

SEQ ID NO: 424963 - DNA, 140 bp, Artificial Sequence
  Synthetic
atacgccatgctgggtctccaactgattccaatgataagtaagtgcagaaccaaagaaggaagacggaagacaaatctgtatggattcattataaaaggaagatcccatttgaggaatgacgtacttgggagtcggccat

SEQ ID NO: 424964 - DNA, 140 bp, Artificial Sequence
  Synthetic
atggccgactcccaagtacgtcattcctcaaatgggatcttccttttataatgaatccatacagatttgtcttccgtcttccttctttggttctgcacttacttatcattggaatcagttggagacccagcatggcgtat

SEQ ID NO: 424965 - DNA, 140 bp, Artificial Sequence
  Synthetic
atacgccatgctgggtctccaacgagcacactgggtctttctgctcaatcgatgggaaagcaccaataagtcttggtgattgctcctttgctggttggatccttggaaacccgatgtgtgcgtacttgggagtcggccat

SEQ ID NO: 424966 - DNA, 140 bp, Artificial Sequence
  Synthetic
atggccgactcccaagtacgcacacatcgggtttccaaggatccaaccagcaaaggagcaatcaccaagacttattggtgctttcccatcgattgagcagaaagacccagtgtgctcgttggagacccagcatggcgtat

SEQ ID NO: 424967 - DNA, 140 bp, Artificial Sequence
  Synthetic
aggccctggctgctgatatggtgatcttctactcactgcaaactcatggtcctatataatagagacgtccaattcagagaacgggacatgctatcccggtgaattcatagattatgaggagaccttttgggacagcggtg

SEQ ID NO: 424968 - DNA, 140 bp, Artificial Sequence
  Synthetic
caccgctgtcccaaaaggtctcctcataatctatgaattcaccgggatagcatgtcccgttctctgaattggacgtctctattatataggaccatgagtttgcagtgagtagaagatcaccatatcagcagccagggcct

SEQ ID NO: 424969 - DNA, 140 bp, Artificial Sequence
  Synthetic
aggccctggctgctgatatggccgagtcctctgtcaaagagaaggacatgaccaaggaattctttgaaagcaaatcagaaacatggccaattggagaatcacccaaaggggtggaggaaggaccttttgggacagcggtg

SEQ ID NO: 424970 - DNA, 140 bp, Artificial Sequence
  Synthetic
caccgctgtcccaaaaggtccttcctccacccctttgggtgattctccaattggccatgtttctgatttgctttcaaagaattccttggtcatgtccttctctttgacagaggactcggccatatcagcagccagggcct

SEQ ID NO: 424971 - DNA, 140 bp, Artificial Sequence
  Synthetic
atacgccatgctgggtctcccaaatcagaaacatggccaattggagaatcacccaaaggggtggaggaaggctccatcgggaaggtgtgcagaacattgctagcaaagtctgtgttcaaccgtacttgggagtcggccat

SEQ ID NO: 424972 - DNA, 140 bp, Artificial Sequence
  Synthetic
atggccgactcccaagtacggttgaacacagactttgctagcaatgttctgcacaccttcccgatggagccttcctccacccctttgggtgattctccaattggccatgtttctgatttgggagacccagcatggcgtat

SEQ ID NO: 424973 - DNA, 140 bp, Artificial Sequence
  Synthetic
atacgccatgctgggtctccaactggagtagttagcttaatgttacaagttgggaacatgatctcggtatggatcagtcattcaattcacacagggaatcaacaccaagctgagccaatccgtacttgggagtcggccat

SEQ ID NO: 424974 - DNA, 140 bp, Artificial Sequence
  Synthetic
atggccgactcccaagtacggattggctcagcttggtgttgattccctgtgtgaattgaatgactgatccataccgagatcatgttcccaacttgtaacattaagctaactactccagttggagacccagcatggcgtat

SEQ ID NO: 424975 - DNA, 140 bp, Artificial Sequence
  Synthetic
aggccctggctgctgatatgggatcagtcattcaattcacacagggaatcaacaccaagctgagccaatcagcaatactaatttccatactgagaaagctgtggtctcagctaaattagcgaccttttgggacagcggtg

SEQ ID NO: 424976 - DNA, 140 bp, Artificial Sequence
  Synthetic
caccgctgtcccaaaaggtcgctaatttagctgagaccacagctttctcagtatggaaattagtattgctgattggctcagcttggtgttgattccctgtgtgaattgaatgactgatcccatatcagcagccagggcct

SEQ ID NO: 424977 - DNA, 140 bp, Artificial Sequence
  Synthetic
atacgccatgctgggtctccatattgaaagatgagccttctaaccgaggtcgaaacgtatgttctctctatcgtcccatcaggccccctcaaagccgagatcgcgcagagacttgaagatcgtacttgggagtcggccat

SEQ ID NO: 424978 - DNA, 140 bp, Artificial Sequence
  Synthetic
atggccgactcccaagtacgatcttcaagtctctgcgcgatctcggctttgagggggcctgatgggacgatagagagaacatacgtttcgacctcggttagaaggctcatctttcaatatggagacccagcatggcgtat

SEQ ID NO: 424979 - DNA, 140 bp, Artificial Sequence
  Synthetic
atacgccatgctgggtctccctggatcagacagggtgatggtatcacccctagcagtaacttggtggaataggaaaggaccgacaacagatacagtccactatccaaaagtctataaaaccgtacttgggagtcggccat

SEQ ID NO: 424980 - DNA, 140 bp, Artificial Sequence
  Synthetic
atggccgactcccaagtacggttttatagacttttggatagtggactgtatctgttgtcggtcctttcctattccaccaagttactgctaggggtgataccatcaccctgtctgatccagggagacccagcatggcgtat

SEQ ID NO: 424981 - DNA, 140 bp, Artificial Sequence
  Synthetic
aggccctggctgctgatatgacaacagcataaggatcggttccaaaggggatgtgtttgttataagagagccattcatctcatgctctcactcggaatgcagaactttctttttgactcagaccttttgggacagcggtg

SEQ ID NO: 424982 - DNA, 140 bp, Artificial Sequence
  Synthetic
caccgctgtcccaaaaggtctgagtcaaaaagaaagttctgcattccgagtgagagcatgagatgaatggctctcttataacaaacacatcccctttggaaccgatccttatgctgttgtcatatcagcagccagggcct

SEQ ID NO: 424983 - DNA, 140 bp, Artificial Sequence
  Synthetic
aggccctggctgctgatatggggtgacaagagaaccttatgtgtcatgcgatcctgacaagtgttatcaatttgcccttggacagggaacaacactaaacaacatgcattcaaataacacgaccttttgggacagcggtg

SEQ ID NO: 424984 - DNA, 140 bp, Artificial Sequence
  Synthetic
caccgctgtcccaaaaggtcgtgttatttgaatgcatgttgtttagtgttgttccctgtccaagggcaaattgataacacttgtcaggatcgcatgacacataaggttctcttgtcaccccatatcagcagccagggcct

SEQ ID NO: 424985 - DNA, 140 bp, Artificial Sequence
  Synthetic
aggccctggctgctgatatgactttcaaaatcaagttaaaatacgccgaagagttgacataaacccaggccatgcagacctcagtgccaaggaagcacaagatgttatcatggaggtcgtgaccttttgggacagcggtg

SEQ ID NO: 424986 - DNA, 140 bp, Artificial Sequence
  Synthetic
caccgctgtcccaaaaggtcacgacctccatgataacatcttgtgcttccttggcactgaggtctgcatggcctgggtttatgtcaactcttcggcgtattttaacttgattttgaaagtcatatcagcagccagggcct

SEQ ID NO: 424987 - DNA, 140 bp, Artificial Sequence
  Synthetic
aggccctggctgctgatatggccctcacagaacattaatgagttgtcctgtgggtgaggctccctccccgtataactcaaggtttgagtctgttgcttggtcagcaagtgcttgccatgagaccttttgggacagcggtg

SEQ ID NO: 424988 - DNA, 140 bp, Artificial Sequence
  Synthetic
caccgctgtcccaaaaggtctcatggcaagcacttgctgaccaagcaacagactcaaaccttgagttatacggggagggagcctcacccacaggacaactcattaatgttctgtgagggccatatcagcagccagggcct

SEQ ID NO: 424989 - DNA, 140 bp, Artificial Sequence
  Synthetic
aggccctggctgctgatatgtgtccgcaaacgatttgcagaccaagaacggggtgatgccccattccttgaccggcttcgccgagatcagaagtctctaagaggaaggggcagcactcttgaccttttgggacagcggtg

SEQ ID NO: 424990 - DNA, 140 bp, Artificial Sequence
  Synthetic
caccgctgtcccaaaaggtcaagagtgctgccccttcctcttagagacttctgatctcggcgaagccggtcaaggaatggggcatcaccccgttcttggtctgcaaatcgtttgcggacacatatcagcagccagggcct

SEQ ID NO: 424991 - DNA, 140 bp, Artificial Sequence
  Synthetic
atacgccatgctgggtctccacctcagcttaacccgatcgatggaccactaccggaggataatgagccaagcggatatgcacaaacggattgtgtattggaggccatggctttccttgaacgtacttgggagtcggccat

SEQ ID NO: 424992 - DNA, 140 bp, Artificial Sequence
  Synthetic
atggccgactcccaagtacgttcaaggaaagccatggcctccaatacacaatccgtttgtgcatatccgcttggctcattatcctccggtagtggtccatcgatcgggttaagctgaggtggagacccagcatggcgtat

SEQ ID NO: 424993 - DNA, 140 bp, Artificial Sequence
  Synthetic
aggccctggctgctgatatgtggcggtattgaaatacaatggcataataacagacactatcaagagttggaggaacaacatactgagaactcaagagtctgaatgtgcatgtgtaaatgggaccttttgggacagcggtg

SEQ ID NO: 424994 - DNA, 140 bp, Artificial Sequence
  Synthetic
caccgctgtcccaaaaggtcccatttacacatgcacattcagactcttgagttctcagtatgttgttcctccaactcttgatagtgtctgttattatgccattgtatttcaataccgccacatatcagcagccagggcct

SEQ ID NO: 424995 - DNA, 140 bp, Artificial Sequence
  Synthetic
atacgccatgctgggtctccaggaacaacatactgagaactcaagagtctgaatgtgcatgtgtaaatggttattgctttactgtaatgacagatggaccaagtaatggtcaggcatcaccgtacttgggagtcggccat

SEQ ID NO: 424996 - DNA, 140 bp, Artificial Sequence
  Synthetic
atggccgactcccaagtacggtgatgcctgaccattacttggtccatctgtcattacagtaaagcaataaccatttacacatgcacattcagactcttgagttctcagtatgttgttcctggagacccagcatggcgtat

SEQ ID NO: 424997 - DNA, 140 bp, Artificial Sequence
  Synthetic
atacgccatgctgggtctcccgtacaacccaccttctcagtacagagaaatcttccctttgaaagagcgaccatcatggcggcatttacagggaacactgaaggcaggacctctgacatgcgtacttgggagtcggccat

SEQ ID NO: 424998 - DNA, 140 bp, Artificial Sequence
  Synthetic
atggccgactcccaagtacgcatgtcagaggtcctgccttcagtgttccctgtaaatgccgccatgatggtcgctctttcaaagggaagatttctctgtactgagaaggtgggttgtacgggagacccagcatggcgtat

SEQ ID NO: 424999 - DNA, 140 bp, Artificial Sequence
  Synthetic
atacgccatgctgggtctccattggacattgaatagaaaccagccagctgcaacggctttagccaacaccatagaggtcttcagatcgaacggtctaacagctaatgaatcggggagactcgtacttgggagtcggccat

SEQ ID NO: 425000 - DNA, 140 bp, Artificial Sequence
  Synthetic
atggccgactcccaagtacgagtctccccgattcattagctgttagaccgttcgatctgaagacctctatggtgttggctaaagccgttgcagctggctggtttctattcaatgtccaatggagacccagcatggcgtat

SEQ ID NO: 425001 - DNA, 140 bp, Artificial Sequence
  Synthetic
aggccctggctgctgatatgtaggagagcaacagtatcggcagatccactggcatcactattggagatgtgtcacagcacacaaattggagggataaggatggttgacattcttagacaagaccttttgggacagcggtg

SEQ ID NO: 425002 - DNA, 140 bp, Artificial Sequence
  Synthetic
caccgctgtcccaaaaggtcttgtctaagaatgtcaaccatccttatccctccaatttgtgtgctgtgacacatctccaatagtgatgccagtggatctgccgatactgttgctctcctacatatcagcagccagggcct

SEQ ID NO: 425003 - DNA, 140 bp, Artificial Sequence
  Synthetic
aggccctggctgctgatatggactggttcatgctcatgcctaaacagaaagtggcaggttccctttgtatcagaatggaccaggcaataatggataaaaacatcatactgaaagcaaactgaccttttgggacagcggtg

SEQ ID NO: 425004 - DNA, 140 bp, Artificial Sequence
  Synthetic
caccgctgtcccaaaaggtcagtttgctttcagtatgatgtttttatccattattgcctggtccattctgatacaaagggaacctgccactttctgtttaggcatgagcatgaaccagtccatatcagcagccagggcct

SEQ ID NO: 425005 - DNA, 140 bp, Artificial Sequence
  Synthetic
atacgccatgctgggtctccaagaaaatggtcacacaaagaacaatagggaaaaagaaacagagattgagcaaaaaaagctacctaataagggcattgacattgaatacaatgaccaaagcgtacttgggagtcggccat

SEQ ID NO: 425006 - DNA, 140 bp, Artificial Sequence
  Synthetic
atggccgactcccaagtacgctttggtcattgtattcaatgtcaatgcccttattaggtagctttttttgctcaatctctgtttctttttccctattgttctttgtgtgaccattttcttggagacccagcatggcgtat

SEQ ID NO: 425007 - DNA, 140 bp, Artificial Sequence
  Synthetic
aggccctggctgctgatatgatcacaactaaggaacaatgccaaggaaatcggaaatggctgctttgagttctatcacaaatgtgataatgagtgcatggaaagcgtaaagaatggcacagaccttttgggacagcggtg

SEQ ID NO: 425008 - DNA, 140 bp, Artificial Sequence
  Synthetic
caccgctgtcccaaaaggtctgtgccattctttacgctttccatgcactcattatcacatttgtgatagaactcaaagcagccatttccgatttccttggcattgttccttagttgtgatcatatcagcagccagggcct

SEQ ID NO: 425009 - DNA, 140 bp, Artificial Sequence
  Synthetic
atacgccatgctgggtctccacggcaatggtgtctggatcgggagaatcaaaagcactaattccaggagcggctttgaaatgatttgggatccaaatgggtggactgaaacagacagtagcgtacttgggagtcggccat

SEQ ID NO: 425010 - DNA, 140 bp, Artificial Sequence
  Synthetic
atggccgactcccaagtacgctactgtctgtttcagtccacccatttggatcccaaatcatttcaaagccgctcctggaattagtgcttttgattctcccgatccagacaccattgccgtggagacccagcatggcgtat

SEQ ID NO: 425011 - DNA, 140 bp, Artificial Sequence
  Synthetic
atacgccatgctgggtctcctgagaaacttgaacagtcagggctcccagttggaggaaatgagaaaaaagctaaattggcaaatgttgtaagaaagatgatgactaattcgcaagacacacgtacttgggagtcggccat

SEQ ID NO: 425012 - DNA, 140 bp, Artificial Sequence
  Synthetic
atggccgactcccaagtacgtgtgtcttgcgaattagtcatcatctttcttacaacatttgccaatttagcttttttctcatttcctccaactgggagccctgactgttcaagtttctcaggagacccagcatggcgtat

SEQ ID NO: 425013 - DNA, 140 bp, Artificial Sequence
  Synthetic
aggccctggctgctgatatggcgggagttttgtccagcatccagaactgacaggactagattgcataagaccttgtttctgggttgagttgatcagagggcggcccaaagagggcacaatgaccttttgggacagcggtg

SEQ ID NO: 425014 - DNA, 140 bp, Artificial Sequence
  Synthetic
caccgctgtcccaaaaggtcattgtgccctctttgggccgccctctgatcaactcaacccagaaacaaggtcttatgcaatctagtcctgtcagttctggatgctggacaaaactcccgccatatcagcagccagggcct

SEQ ID NO: 425015 - DNA, 140 bp, Artificial Sequence
  Synthetic
aggccctggctgctgatatgttggactagtgggagcagcatatctttctgtggtgtgagtggtgacactgtgggttggtcttggccagacggtgctgagttgccattcaccattgacaaggaccttttgggacagcggtg

SEQ ID NO: 425016 - DNA, 140 bp, Artificial Sequence
  Synthetic
caccgctgtcccaaaaggtccttgtcaatggtgaatggcaactcagcaccgtctggccaagaccaacccacagtgtcaccactcacaccacagaaagatatgctgctcccactagtccaacatatcagcagccagggcct

SEQ ID NO: 425017 - DNA, 140 bp, Artificial Sequence
  Synthetic
atacgccatgctgggtctccctgaatggttcagaaatgtcttgagcattgcccctataatgttctcaaacaaaatggcaagacttgggaaaggatatatgttcgaaagtaagagcatgaacgtacttgggagtcggccat

SEQ ID NO: 425018 - DNA, 140 bp, Artificial Sequence
  Synthetic
atggccgactcccaagtacgttcatgctcttactttcgaacatatatcctttcccaagtcttgccattttgtttgagaacattataggggcaatgctcaagacatttctgaaccattcagggagacccagcatggcgtat

SEQ ID NO: 425019 - DNA, 140 bp, Artificial Sequence
  Synthetic
aggccctggctgctgatatgaaaatggcaagacttgggaaaggatatatgttcgaaagtaagagcatgaagctacgaacacaaataccagcagaaatgcttgcaagtattgacctcaaatgaccttttgggacagcggtg

SEQ ID NO: 425020 - DNA, 140 bp, Artificial Sequence
  Synthetic
caccgctgtcccaaaaggtcatttgaggtcaatacttgcaagcatttctgctggtatttgtgttcgtagcttcatgctcttactttcgaacatatatcctttcccaagtcttgccattttcatatcagcagccagggcct

SEQ ID NO: 425021 - DNA, 140 bp, Artificial Sequence
  Synthetic
aggccctggctgctgatatggggcgatctgaactttgtcaatagggcaaaccagcgactgaatcccatgcaccaactcttgaggcatttccaaaaggatgcaaaagtgcttttccagaacgaccttttgggacagcggtg

SEQ ID NO: 425022 - DNA, 140 bp, Artificial Sequence
  Synthetic
caccgctgtcccaaaaggtcgttctggaaaagcacttttgcatccttttggaaatgcctcaagagttggtgcatgggattcagtcgctggtttgccctattgacaaagttcagatcgccccatatcagcagccagggcct

SEQ ID NO: 425023 - DNA, 140 bp, Artificial Sequence
  Synthetic
atacgccatgctgggtctcctacagatgtgtacagaactcaaactcagtgactatgaagggagactgatccagaacagcataacaatagagagaatggtactttctgcatttgatgaaagcgtacttgggagtcggccat

SEQ ID NO: 425024 - DNA, 140 bp, Artificial Sequence
  Synthetic
atggccgactcccaagtacgctttcatcaaatgcagaaagtaccattctctctattgttatgctgttctggatcagtctcccttcatagtcactgagtttgagttctgtacacatctgtaggagacccagcatggcgtat

SEQ ID NO: 425025 - DNA, 140 bp, Artificial Sequence
  Synthetic
aggccctggctgctgatatgcatgttgagtacagtcttaggagtctcaatcttaaatcttgggcaaaagaggtacaccaagaccacatactggtgggatggactccaatcctctgatgacgaccttttgggacagcggtg

SEQ ID NO: 425026 - DNA, 140 bp, Artificial Sequence
  Synthetic
caccgctgtcccaaaaggtcgtcatcagaggattggagtccatcccaccagtatgtggtcttggtgtacctcttttgcccaagatttaagattgagactcctaagactgtactcaacatgcatatcagcagccagggcct

SEQ ID NO: 425027 - DNA, 140 bp, Artificial Sequence
  Synthetic
atacgccatgctgggtctccaagtctcccaccgaacttctccagccttgaaaactttagagcctatgtggatggattcaaaccgaacggctgcattgagggcaagctttctcaaatgtcacgtacttgggagtcggccat

SEQ ID NO: 425028 - DNA, 140 bp, Artificial Sequence
  Synthetic
atggccgactcccaagtacgtgacatttgagaaagcttgccctcaatgcagccgttcggtttgaatccatccacataggctctaaagttttcaaggctggagaagttcggtgggagacttggagacccagcatggcgtat

SEQ ID NO: 425029 - DNA, 140 bp, Artificial Sequence
  Synthetic
atacgccatgctgggtctccggacagattttacagaacctgcaaattagttggaatcaacatgagtaaaaagaagtcctacataaatagaacaggaacatttgaattcacaagctttttccgtacttgggagtcggccat

SEQ ID NO: 425030 - DNA, 140 bp, Artificial Sequence
  Synthetic
atggccgactcccaagtacggaaaaagcttgtgaattcaaatgttcctgttctatttatgtaggacttctttttactcatgttgattccaactaatttgcaggttctgtaaaatctgtccggagacccagcatggcgtat

SEQ ID NO: 425031 - DNA, 140 bp, Artificial Sequence
  Synthetic
aggccctggctgctgatatgccagtagaggcctctgggattcctttcgtcagtccgagagaggcgaagagacaattgaagaaagatttgaaattacaggaaccatgcgcaggctcgccgagaccttttgggacagcggtg

SEQ ID NO: 425032 - DNA, 140 bp, Artificial Sequence
  Synthetic
caccgctgtcccaaaaggtctcggcgagcctgcgcatggttcctgtaatttcaaatctttcttcaattgtctcttcgcctctctcggactgacgaaaggaatcccagaggcctctactggcatatcagcagccagggcct

SEQ ID NO: 425033 - DNA, 140 bp, Artificial Sequence
  Synthetic
aggccctggctgctgatatggctgctgccctttgcagcagcgccaccggagcagagtaggatgcaattctcctctctaactgtaaatgtaaggggatcaggaatgagagtactcgtaagggaccttttgggacagcggtg

SEQ ID NO: 425034 - DNA, 140 bp, Artificial Sequence
  Synthetic
caccgctgtcccaaaaggtcccttacgagtactctcattcctgatccccttacatttacagttagagaggagaattgcatcctactctgctccggtggcgctgctgcaaagggcagcagccatatcagcagccagggcct

SEQ ID NO: 425035 - DNA, 140 bp, Artificial Sequence
  Synthetic
atacgccatgctgggtctccaggatactggtaagaggcaattctccagtgttcaattacaacaaagcaaccaaaaggcttacaattcttggaaaagatgcaggtgcattgactgaagatccgtacttgggagtcggccat

SEQ ID NO: 425036 - DNA, 140 bp, Artificial Sequence
  Synthetic
atggccgactcccaagtacggatcttcagtcaatgcacctgcatcttttccaagaattgtaagccttttggttgctttgttgtaattgaacactggagaattgcctcttaccagtatcctggagacccagcatggcgtat

SEQ ID NO: 425037 - DNA, 140 bp, Artificial Sequence
  Synthetic
aggccctggctgctgatatgtaaagaacaacatgataaacaatgaccttggaccagcaacagcccaaatggctcttcaactgttcatcaaggactacaggtacacatatcgatgccataggaccttttgggacagcggtg

SEQ ID NO: 425038 - DNA, 140 bp, Artificial Sequence
  Synthetic
caccgctgtcccaaaaggtcctatggcatcgatatgtgtacctgtagtccttgatgaacagttgaagagccatttgggctgttgctggtccaaggtcattgtttatcatgttgttctttacatatcagcagccagggcct

SEQ ID NO: 425039 - DNA, 140 bp, Artificial Sequence
  Synthetic
aggccctggctgctgatatgtggagctgattcggatgataaaacgagggatcaacgaccggaatttctggagaggcgaaaatggaagaagaacaaggattgcatatgagagaatgtgcaagaccttttgggacagcggtg

SEQ ID NO: 425040 - DNA, 140 bp, Artificial Sequence
  Synthetic
caccgctgtcccaaaaggtcttgcacattctctcatatgcaatccttgttcttcttccattttcgcctctccagaaattccggtcgttgatccctcgttttatcatccgaatcagctccacatatcagcagccagggcct

SEQ ID NO: 425041 - DNA, 140 bp, Artificial Sequence
  Synthetic
atacgccatgctgggtctccgggagcaaacccgttcaaaggcaggactgctgatttcagatggaggaccaaacctatataatatcagaaatctccatattccagaggtctgtctgaaatgcgtacttgggagtcggccat

SEQ ID NO: 425042 - DNA, 140 bp, Artificial Sequence
  Synthetic
atggccgactcccaagtacgcatttcagacagacctctggaatatggagatttctgatattatataggtttggtcctccatctgaaatcagcagtcctgcctttgaacgggtttgctcccggagacccagcatggcgtat

SEQ ID NO: 425043 - DNA, 140 bp, Artificial Sequence
  Synthetic
aggccctggctgctgatatgtttctggcacggtctgcactcatcctgagaggatcagtggcccataagtcttgcttgcctgcttgtgtgtacggacttgcagtggccagtggatatgactgaccttttgggacagcggtg

SEQ ID NO: 425044 - DNA, 140 bp, Artificial Sequence
  Synthetic
caccgctgtcccaaaaggtcagtcatatccactggccactgcaagtccgtacacacaagcaggcaagcaagacttatgggccactgatcctctcaggatgagtgcagaccgtgccagaaacatatcagcagccagggcct

SEQ ID NO: 425045 - DNA, 140 bp, Artificial Sequence
  Synthetic
atacgccatgctgggtctcccattcgtaagccataaggaaattgagtccgtaaacaatgctgtggtaatgccagcccatggtccagccaaaagcatggaatatgatgctgttgcaactaccgtacttgggagtcggccat

SEQ ID NO: 425046 - DNA, 140 bp, Artificial Sequence
  Synthetic
atggccgactcccaagtacggtagttgcaacagcatcatattccatgcttttggctggaccatgggctggcattaccacagcattgtttacggactcaatttccttatggcttacgaatgggagacccagcatggcgtat

SEQ ID NO: 425047 - DNA, 140 bp, Artificial Sequence
  Synthetic
atacgccatgctgggtctccagttgggtcatcaaagtacaaccggagattcaccccagagatagcagctagacccaaagttagagggcaggcaggcaggatgaactattattggacactacgtacttgggagtcggccat

SEQ ID NO: 425048 - DNA, 140 bp, Artificial Sequence
  Synthetic
atggccgactcccaagtacgtagtgtccaataatagttcatcctgcctgcctgccctctaactttgggtctagctgctatctctggggtgaatctccggttgtactttgatgacccaactggagacccagcatggcgtat

SEQ ID NO: 425049 - DNA, 140 bp, Artificial Sequence
  Synthetic
atacgccatgctgggtctcctctgggtattctggtatcttctctgttgaaggcaaaaactgcatcaacaggtgtttttatgtggagttgataagagggagaccacaggagcccagagtgtcgtacttgggagtcggccat

SEQ ID NO: 425050 - DNA, 140 bp, Artificial Sequence
  Synthetic
atggccgactcccaagtacgacactctgggctcctgtggtctccctcttatcaactccacataaaaacacctgttgatgcagtttttgccttcaacagagaagataccagaatacccagaggagacccagcatggcgtat

SEQ ID NO: 425051 - DNA, 140 bp, Artificial Sequence
  Synthetic
aggccctggctgctgatatgctatccaccagaggagttcaaattgcttcaaatgagaacatggaagcaatggactccaacactcttgaactgagaagtagatattgggctataagaaccagaccttttgggacagcggtg

SEQ ID NO: 425052 - DNA, 140 bp, Artificial Sequence
  Synthetic
caccgctgtcccaaaaggtctggttcttatagcccaatatctacttctcagttcaagagtgttggagtccattgcttccatgttctcatttgaagcaatttgaactcctctggtggatagcatatcagcagccagggcct

SEQ ID NO: 425053 - DNA, 140 bp, Artificial Sequence
  Synthetic
aggccctggctgctgatatgattgatttcgaatctggaaggataaagaaagaagagtttgctgagatcatgaagatctgttccaccattgaagagctcagacggcaaaagtagtgaatttgaccttttgggacagcggtg

SEQ ID NO: 425054 - DNA, 140 bp, Artificial Sequence
  Synthetic
caccgctgtcccaaaaggtcaaattcactacttttgccgtctgagctcttcaatggtggaacagatcttcatgatctcagcaaactcttctttctttatccttccagattcgaaatcaatcatatcagcagccagggcct

SEQ ID NO: 425055 - DNA, 140 bp, Artificial Sequence
  Synthetic
atacgccatgctgggtctccatggagagaataaaagaactaagagacctaatgtcacagtctcgcactcgcgagatactgacaaaaaccacagtggaccatatggccataatcaagaagtcgtacttgggagtcggccat

SEQ ID NO: 425056 - DNA, 140 bp, Artificial Sequence
  Synthetic
atggccgactcccaagtacgacttcttgattatggccatatggtccactgtggtttttgtcagtatctcgcgagtgcgagactgtgacattaggtctcttagttcttttattctctccatggagacccagcatggcgtat

SEQ ID NO: 425057 - DNA, 140 bp, Artificial Sequence
  Synthetic
aggccctggctgctgatatggcagcactcttggtatcgacattgaggcagctactcgctctgggaagcagataatagagcggattctggatgaagaatcagacgaggcattgaaaatgacgaccttttgggacagcggtg

SEQ ID NO: 425058 - DNA, 140 bp, Artificial Sequence
  Synthetic
caccgctgtcccaaaaggtcgtcattttcaatgcctcgtctgattcttcatccagaatccgctctattatctgcttcccagagcgagtagctgcctcaatgtcgataccaagagtgctgccatatcagcagccagggcct

SEQ ID NO: 425059 - DNA, 140 bp, Artificial Sequence
  Synthetic
atacgccatgctgggtctccatggcaatgaaatatccaatcacagcggacaaaagaataatggagatgatccctgagagaaatgaacagggtcagatcctttggagtaaaactaatgatgcgtacttgggagtcggccat

SEQ ID NO: 425060 - DNA, 140 bp, Artificial Sequence
  Synthetic
atggccgactcccaagtacgcatcattagttttactccaaaggatctgaccctgttcatttctctcagggatcatctccattattcttttgtccgctgtgattggatatttcattgccatggagacccagcatggcgtat

SEQ ID NO: 425061 - DNA, 140 bp, Artificial Sequence
  Synthetic
atacgccatgctgggtctccatggattcaaacactgtgtcaagctttcaggtagactgctttctttggcatatccgcaaacggtttgcagactggggacttggtgatgctccatttctcgcgtacttgggagtcggccat

SEQ ID NO: 425062 - DNA, 140 bp, Artificial Sequence
  Synthetic
atggccgactcccaagtacgcgagaaatggagcatcaccaagtccccagtctgcaaaccgtttgcggatatgccaaagaaagcagtctacctgaaagcttgacacagtgtttgaatccatggagacccagcatggcgtat

SEQ ID NO: 425063 - DNA, 140 bp, Artificial Sequence
  Synthetic
aggccctggctgctgatatgacagaagaaggagcaatcgtgggagaaatctcaccgttaccttctcttccaggacatactgatgaggatgtcaaaaatgcaattggagtcctcatcggaggaccttttgggacagcggtg

SEQ ID NO: 425064 - DNA, 140 bp, Artificial Sequence
  Synthetic
caccgctgtcccaaaaggtcctccgatgaggactccaattgcatttttgacatcctcatcagtatgtcctggaagagaaggtaacggtgagatttctcccacgattgctccttcttctgtcatatcagcagccagggcct

SEQ ID NO: 425065 - DNA, 140 bp, Artificial Sequence
  Synthetic
aggccctggctgctgatatgttgacacgataatggaaaagaacgttactgttacacatgcccaagacatactagaaaagacacataacggaaagctctgtgacttagatggagttaggccgaccttttgggacagcggtg

SEQ ID NO: 425066 - DNA, 140 bp, Artificial Sequence
  Synthetic
caccgctgtcccaaaaggtcggcctaactccatctaagtcacagagctttccgttatgtgtcttttctagtatgtcttgggcatgtgtaacagtaacgttcttttccattatcgtgtcaacatatcagcagccagggcct

SEQ ID NO: 425067 - DNA, 140 bp, Artificial Sequence
  Synthetic
atacgccatgctgggtctcccgcacaaatgggagaaatactgtgttcttgaaataggagacatgctcttgagaactgcgataggccaagtgtcgaggcccatgttcctatatgtgagaaccgtacttgggagtcggccat

SEQ ID NO: 425068 - DNA, 140 bp, Artificial Sequence
  Synthetic
atggccgactcccaagtacggttctcacatataggaacatgggcctcgacacttggcctatcgcagttctcaagagcatgtctcctatttcaagaacacagtatttctcccatttgtgcgggagacccagcatggcgtat

SEQ ID NO: 425069 - DNA, 140 bp, Artificial Sequence
  Synthetic
aggccctggctgctgatatgtgtgtgacgaattcatcaatgtgccagaatggtcttatatagtggagaaggccaatccagtcaatgacctctgctacccaggagttttcaatgactatgagaccttttgggacagcggtg

SEQ ID NO: 425070 - DNA, 140 bp, Artificial Sequence
  Synthetic
caccgctgtcccaaaaggtctcatagtcattgaaaactcctgggtagcagaggtcattgactggattggccttctccactatataagaccattctggcacattgatgaattcgtcacacacatatcagcagccagggcct

SEQ ID NO: 425071 - DNA, 140 bp, Artificial Sequence
  Synthetic
atacgccatgctgggtctccgccaatccagtcaatgacctctgctacccaggagttttcaatgactatgaagaattgaaacacctattgagcagaataaaccattttgagaaaattcagacgtacttgggagtcggccat

SEQ ID NO: 425072 - DNA, 140 bp, Artificial Sequence
  Synthetic
atggccgactcccaagtacgtctgaattttctcaaaatggtttattctgctcaataggtgtttcaattcttcatagtcattgaaaactcctgggtagcagaggtcattgactggattggcggagacccagcatggcgtat

SEQ ID NO: 425073 - DNA, 140 bp, Artificial Sequence
  Synthetic
aggccctggctgctgatatgtaacatcagcaacaataattttgttgttgaacaggcagtggtttcagtgaaattagcgggcaattcctctctctgccctgttagtggatgggctatatacgaccttttgggacagcggtg

SEQ ID NO: 425074 - DNA, 140 bp, Artificial Sequence
  Synthetic
caccgctgtcccaaaaggtcgtatatagcccatccactaacagggcagagagaggaattgcccgctaatttcactgaaaccactgcctgttcaacaacaaaattattgttgctgatgttacatatcagcagccagggcct

SEQ ID NO: 425075 - DNA, 140 bp, Artificial Sequence
  Synthetic
atacgccatgctgggtctccaattagcgggcaattcctctctctgccctgttagtggatgggctatatacagtaaagataatagtgtaacaatcggctccaagggggatgtgtttgtcatcgtacttgggagtcggccat

SEQ ID NO: 425076 - DNA, 140 bp, Artificial Sequence
  Synthetic
atggccgactcccaagtacgatgacaaacacatcccccttggagccgattgttacactattatctttactgtatatagcccatccactaacagggcagagagaggaattgcccgctaattggagacccagcatggcgtat

SEQ ID NO: 425077 - DNA, 140 bp, Artificial Sequence
  Synthetic
aggccctggctgctgatatggcagcatgtccataccaggggcagtcctcttttttccgaaatgtggtgtggcttatcaaaaagaacaatacatacccaacaataaagaggagttacaatagaccttttgggacagcggtg

SEQ ID NO: 425078 - DNA, 140 bp, Artificial Sequence
  Synthetic
caccgctgtcccaaaaggtctattgtaactcctctttattgttgggtatgtattgttctttttgataagccacaccacatttcggaaaaaagaggactgcccctggtatggacatgctgccatatcagcagccagggcct

SEQ ID NO: 425079 - DNA, 140 bp, Artificial Sequence
  Synthetic
atacgccatgctgggtctcctgtttgttataagagagccattcatctcatgctcccacttggaatgcagaactttctttttaacccagggagccttactgaatgacaagcactccaatggcgtacttgggagtcggccat

SEQ ID NO: 425080 - DNA, 140 bp, Artificial Sequence
  Synthetic
atggccgactcccaagtacgccattggagtgcttgtcattcagtaaggctccctgggttaaaaagaaagttctgcattccaagtgggagcatgagatgaatggctctcttataacaaacaggagacccagcatggcgtat

SEQ ID NO: 425081 - DNA, 140 bp, Artificial Sequence
  Synthetic
atacgccatgctgggtctccatggatgtcaatccgaccctacttttcttaaaggttccagcgcaaaatgccataagcaccacattcccttatactggagatcccccatatagccatggaacgtacttgggagtcggccat

SEQ ID NO: 425082 - DNA, 140 bp, Artificial Sequence
  Synthetic
atggccgactcccaagtacgttccatggctatatgggggatctccagtataagggaatgtggtgcttatggcattttgcgctggaacctttaagaaaagtagggtcggattgacatccatggagacccagcatggcgtat

SEQ ID NO: 425083 - DNA, 140 bp, Artificial Sequence
  Synthetic
aggccctggctgctgatatggatgcagtagaacagacaagactctatcaaaatccaaccacctatatctccgttgggacgtcaacattaaaccagagattgacaccaagaatagctactagaccttttgggacagcggtg

SEQ ID NO: 425084 - DNA, 140 bp, Artificial Sequence
  Synthetic
caccgctgtcccaaaaggtctagtagctattcttggtgtcaatctctggtttaatgttgacgtcccaacggagatataggtggttggattttgatagagtcttgtctgttctactgcatccatatcagcagccagggcct

SEQ ID NO: 425085 - DNA, 140 bp, Artificial Sequence
  Synthetic
atacgccatgctgggtctcccaggaacaggatacaccatggacacagtcaacagaacacaccaatattcagaaaaagggaaatggacgacaaacacagagactggggcaccccagctcaacgtacttgggagtcggccat

SEQ ID NO: 425086 - DNA, 140 bp, Artificial Sequence
  Synthetic
atggccgactcccaagtacgttgagctggggtgccccagtctctgtgtttgtcgtccatttccctttttctgaatattggtgtgttctgttgactgtgtccatggtgtatcctgttcctgggagacccagcatggcgtat

SEQ ID NO: 425087 - DNA, 140 bp, Artificial Sequence
  Synthetic
aggccctggctgctgatatgtgctgatggatgctctgaagcttagcattgaagacccgagtcatgaaggcgaggggataccgctgtatgatgcgatcaaatgtatgaagaccttttttgggaccttttgggacagcggtg

SEQ ID NO: 425088 - DNA, 140 bp, Artificial Sequence
  Synthetic
caccgctgtcccaaaaggtcccaaaaaaggtcttcatacatttgatcgcatcatacagcggtatcccctcgccttcatgactcgggtcttcaatgctaagcttcagagcatccatcagcacatatcagcagccagggcct

SEQ ID NO: 425089 - DNA, 140 bp, Artificial Sequence
  Synthetic
aggccctggctgctgatatgggggcagtggctgtgctgaaatataatggtataataacagacactatcaagagttggagaaaaaacatattaagaacacaagaatctgaatgtgcatgcggaccttttgggacagcggtg

SEQ ID NO: 425090 - DNA, 140 bp, Artificial Sequence
  Synthetic
caccgctgtcccaaaaggtccgcatgcacattcagattcttgtgttcttaatatgttttttctccaactcttgatagtgtctgttattataccattatatttcagcacagccactgcccccatatcagcagccagggcct

SEQ ID NO: 425091 - DNA, 140 bp, Artificial Sequence
  Synthetic
atacgccatgctgggtctccgtatgcttttgaattagtgtccctgggaaacgggaaattgttcagaagtgacttgagtattgagtcttgttcaactaagtgccagtccgaaattggagggcgtacttgggagtcggccat

SEQ ID NO: 425092 - DNA, 140 bp, Artificial Sequence
  Synthetic
atggccgactcccaagtacgccctccaatttcggactggcacttagttgaacaagactcaatactcaagtcacttctgaacaatttcccgtttcccagggacactaattcaaaagcatacggagacccagcatggcgtat

SEQ ID NO: 425093 - DNA, 140 bp, Artificial Sequence
  Synthetic
atacgccatgctgggtctcctccagaatatgcatacaaaattgtcaagaaaggggactcaacaattatgagaagtgaactggaatatggtaactgcaacaccaagtgtcaaactccaatgcgtacttgggagtcggccat

SEQ ID NO: 425094 - DNA, 140 bp, Artificial Sequence
  Synthetic
atggccgactcccaagtacgcattggagtttgacacttggtgttgcagttaccatattccagttcacttctcataattgttgagtcccctttcttgacaattttgtatgcatattctggaggagacccagcatggcgtat

SEQ ID NO: 425095 - DNA, 140 bp, Artificial Sequence
  Synthetic
atacgccatgctgggtctcccttgaatttcgtaaacagagcgaaccaacggctgaatcctatgcaccagcttctgaggcacttccaaaaagacgcgaaggtgttgtttcaaaattggggacgtacttgggagtcggccat

SEQ ID NO: 425096 - DNA, 140 bp, Artificial Sequence
  Synthetic
atggccgactcccaagtacgtccccaattttgaaacaacaccttcgcgtctttttggaagtgcctcagaagctggtgcataggattcagccgttggttcgctctgtttacgaaattcaagggagacccagcatggcgtat

SEQ ID NO: 425097 - DNA, 140 bp, Artificial Sequence
  Synthetic
atacgccatgctgggtctccgaggggataccgctgtatgatgcgatcaaatgtatgaagaccttttttggctggaaagagcctaacattgtcaagccacatgaaaagggaataaaccccacgtacttgggagtcggccat

SEQ ID NO: 425098 - DNA, 140 bp, Artificial Sequence
  Synthetic
atggccgactcccaagtacgtggggtttattcccttttcatgtggcttgacaatgttaggctctttccagccaaaaaaggtcttcatacatttgatcgcatcatacagcggtatcccctcggagacccagcatggcgtat

SEQ ID NO: 425099 - DNA, 140 bp, Artificial Sequence
  Synthetic
atacgccatgctgggtctccgttgagcccattgacaatgtcatggggatgataggaatattgcctgacatgacccccaacacagagatgtcactaagaggaataagaattagcaaaatggcgtacttgggagtcggccat

SEQ ID NO: 425100 - DNA, 140 bp, Artificial Sequence
  Synthetic
atggccgactcccaagtacgccattttgctaattcttattcctcttagtgacatctctgtgttgggggtcatgtcaggcaatattcctatcatccccatgacattgtcaatgggctcaacggagacccagcatggcgtat

SEQ ID NO: 425101 - DNA, 140 bp, Artificial Sequence
  Synthetic
aggccctggctgctgatatgtggttggtatgggtaccatcatagcaacgagcagggaagcgggtacgctgcagacaaagaatccactcaaaaggctatagatggagtcaccaataaggtcgaccttttgggacagcggtg

SEQ ID NO: 425102 - DNA, 140 bp, Artificial Sequence
  Synthetic
caccgctgtcccaaaaggtcgaccttattggtgactccatctatagccttttgagtggattctttgtctgcagcgtacccgcttccctgctcgttgctatgatggtacccataccaaccacatatcagcagccagggcct

SEQ ID NO: 425103 - DNA, 140 bp, Artificial Sequence
  Synthetic
aggccctggctgctgatatggttgtggcccagtatcttctaatggtacaaatggggtaaaaggattctcgtttaaatacggcaatggtgtttggatagggagaactaaaagcactagttcgaccttttgggacagcggtg

SEQ ID NO: 425104 - DNA, 140 bp, Artificial Sequence
  Synthetic
caccgctgtcccaaaaggtcgaactagtgcttttagttctccctatccaaacaccattgccgtatttaaacgagaatccttttaccccatttgtaccattagaagatactgggccacaaccatatcagcagccagggcct

SEQ ID NO: 425105 - DNA, 140 bp, Artificial Sequence
  Synthetic
aggccctggctgctgatatgaattgatggatgaagactaccagggtagactgtgcaatcctctgaatccattcgtcagccatagggaaattgaatctgtcaacaatgctatggtaatgccgaccttttgggacagcggtg

SEQ ID NO: 425106 - DNA, 140 bp, Artificial Sequence
  Synthetic
caccgctgtcccaaaaggtcggcattaccatagcattgttgacagattcaatttccctatggctgacgaatggattcagaggattgcacagtctaccctggtagtcttcatccatcaattcatatcagcagccagggcct

SEQ ID NO: 425107 - DNA, 140 bp, Artificial Sequence
  Synthetic
aggccctggctgctgatatgacgggttcctagatgtttggacttataatgctgaacttctggttctcatggaaaatgagagaactctagacttccatgactcaaatgtaaagaacctttagaccttttgggacagcggtg

SEQ ID NO: 425108 - DNA, 140 bp, Artificial Sequence
  Synthetic
caccgctgtcccaaaaggtctaaaggttctttacatttgagtcatggaagtctagagttctctcattttccatgagaaccagaagttcagcattataagtccaaacatctaggaacccgtcatatcagcagccagggcct

SEQ ID NO: 425109 - DNA, 140 bp, Artificial Sequence
  Synthetic
aggccctggctgctgatatgggatatagtgggagttttgttcagcatccagaattgaccggactggattgtattagaccttgtttttgggttgagctaatcagaggacgacccaaggaaagaccttttgggacagcggtg

SEQ ID NO: 425110 - DNA, 140 bp, Artificial Sequence
  Synthetic
caccgctgtcccaaaaggtctttccttgggtcgtcctctgattagctcaacccaaaaacaaggtctaatacaatccagtccggtcaattctggatgctgaacaaaactcccactatatcccatatcagcagccagggcct

SEQ ID NO: 425111 - DNA, 140 bp, Artificial Sequence
  Synthetic
aggccctggctgctgatatgacacaatctggactagcgcgagcagcatatccttttgtggtgtaagtagtggaacagtgggttggtcttggccagacggtgctgagttgccatttaccatgaccttttgggacagcggtg

SEQ ID NO: 425112 - DNA, 140 bp, Artificial Sequence
  Synthetic
caccgctgtcccaaaaggtcatggtaaatggcaactcagcaccgtctggccaagaccaacccactgttccactacttacaccacaaaaggatatgctgctcgcgctagtccagattgtgtcatatcagcagccagggcct

SEQ ID NO: 425113 - DNA, 140 bp, Artificial Sequence
  Synthetic
aggccctggctgctgatatgagaaatgggacatatgactatccgcagtattcagaagaagcaagattaaaaagagaggagataagtggagtgaagttggaatcgataggagtttaccaaagaccttttgggacagcggtg

SEQ ID NO: 425114 - DNA, 140 bp, Artificial Sequence
  Synthetic
caccgctgtcccaaaaggtctttggtaaactcctatcgattccaacttcactccacttatctcctctctttttaatcttgcttcttctgaatactgcggatagtcatatgtcccatttctcatatcagcagccagggcct

SEQ ID NO: 425115 - DNA, 140 bp, Artificial Sequence
  Synthetic
aggccctggctgctgatatggaaacatcctgagcatggcacccataatgttctcaaataaaatggcaagactaggaaaagggtacatgttcgagagtaaaagaatgaaactccgaacacagaccttttgggacagcggtg

SEQ ID NO: 425116 - DNA, 140 bp, Artificial Sequence
  Synthetic
caccgctgtcccaaaaggtctgtgttcggagtttcattcttttactctcgaacatgtacccttttcctagtcttgccattttatttgagaacattatgggtgccatgctcaggatgtttccatatcagcagccagggcct

SEQ ID NO: 425117 - DNA, 140 bp, Artificial Sequence
  Synthetic
atacgccatgctgggtctccggtaactccccggtgtttaactacaacaagacaaccaagaggcttacagtccttgggaaagatgcaggttcattaacagaagacccggatgagggtacagcgtacttgggagtcggccat

SEQ ID NO: 425118 - DNA, 140 bp, Artificial Sequence
  Synthetic
atggccgactcccaagtacgctgtaccctcatccgggtcttctgttaatgaacctgcatctttcccaaggactgtaagcctcttggttgtcttgttgtagttaaacaccggggagttaccggagacccagcatggcgtat

SEQ ID NO: 425119 - DNA, 140 bp, Artificial Sequence
  Synthetic
atacgccatgctgggtctcccttcttcagcagactgaattggctgactaaatctgggaatgcttacccagtgttgaatgtgactatgccaaataatgacaactttgacaagttgtatgtccgtacttgggagtcggccat

SEQ ID NO: 425120 - DNA, 140 bp, Artificial Sequence
  Synthetic
atggccgactcccaagtacggacatacaacttgtcaaagttgtcattatttggcatagtcacattcaacactgggtaagcattcccagatttagtcagccaattcagtctgctgaagaagggagacccagcatggcgtat

SEQ ID NO: 425121 - DNA, 140 bp, Artificial Sequence
  Synthetic
aggccctggctgctgatatgtacagagaacagcttcgaacagataacgtttgtacaagccttacaactactgcttgaagtggagcaagagataagaactttctcgtttcagcttatttaagaccttttgggacagcggtg

SEQ ID NO: 425122 - DNA, 140 bp, Artificial Sequence
  Synthetic
caccgctgtcccaaaaggtcttaaataagctgaaacgagaaagttcttatctcttgctccacttcaagcagtagttgtaaggcttgtacaaacgttatctgttcgaagctgttctctgtacatatcagcagccagggcct

SEQ ID NO: 425123 - DNA, 140 bp, Artificial Sequence
  Synthetic
aggccctggctgctgatatgtcccaaaggcaacctcatggccaaaccatgatacaaccagaggtaccacagttgcatgctcccactctggagccaacagtttttatcggaatttactatggaccttttgggacagcggtg

SEQ ID NO: 425124 - DNA, 140 bp, Artificial Sequence
  Synthetic
caccgctgtcccaaaaggtccatagtaaattccgataaaaactgttggctccagagtgggagcatgcaactgtggtacctctggttgtatcatggtttggccatgaggttgcctttgggacatatcagcagccagggcct

SEQ ID NO: 425125 - DNA, 140 bp, Artificial Sequence
  Synthetic
aggccctggctgctgatatgcagaatggaccaggcaataatggataaaaccatcacattgaaagcaaacttcagtgtgatttttgatcaactggaaactctaatactccttagagctttcgaccttttgggacagcggtg

SEQ ID NO: 425126 - DNA, 140 bp, Artificial Sequence
  Synthetic
caccgctgtcccaaaaggtcgaaagctctaaggagtattagagtttccagttgatcaaaaatcacactgaagtttgctttcaatgtgatggttttatccattattgcctggtccattctgcatatcagcagccagggcct

SEQ ID NO: 425127 - DNA, 140 bp, Artificial Sequence
  Synthetic
aggccctggctgctgatatgtttttacgctcaccgtgcccagtgagcgaggactgcagcgtagacgctttgtccaaaacgccctaaatgggaatggagacccaaacaacatggacagggcgaccttttgggacagcggtg

SEQ ID NO: 425128 - DNA, 140 bp, Artificial Sequence
  Synthetic
caccgctgtcccaaaaggtcgccctgtccatgttgtttgggtctccattcccatttagggcgttttggacaaagcgtctacgctgcagtcctcgctcactgggcacggtgagcgtaaaaacatatcagcagccagggcct

SEQ ID NO: 425129 - DNA, 140 bp, Artificial Sequence
  Synthetic
aggccctggctgctgatatgtgataaacaatgatcttggaccagcaacagctcaaatggctcttcagctgttcatcaaggattacaggtacacatatcggtgtcacagaggggacacacagaccttttgggacagcggtg

SEQ ID NO: 425130 - DNA, 140 bp, Artificial Sequence
  Synthetic
caccgctgtcccaaaaggtctgtgtgtcccctctgtgacaccgatatgtgtacctgtaatccttgatgaacagctgaagagccatttgagctgttgctggtccaagatcattgtttatcacatatcagcagccagggcct

SEQ ID NO: 425131 - DNA, 140 bp, Artificial Sequence
  Synthetic
atacgccatgctgggtctccagtgatgagggtgggagacttccactccctccaaatcagaaacggaaaatggcgagagcaattgagtcagaggtttgaagaaataaggtggctgattgaacgtacttgggagtcggccat

SEQ ID NO: 425132 - DNA, 140 bp, Artificial Sequence
  Synthetic
atggccgactcccaagtacgttcaatcagccaccttatttcttcaaacctctgactcaattgctctcgccattttccgtttctgatttggagggagtggaagtctcccaccctcatcactggagacccagcatggcgtat

SEQ ID NO: 425133 - DNA, 140 bp, Artificial Sequence
  Synthetic
aggccctggctgctgatatggtggtatggctcatcaaaaagaacgatgcatacccgacaataaagataagctacaataataccaatcgggaagatcttttgatactgtgggggattcatcgaccttttgggacagcggtg

SEQ ID NO: 425134 - DNA, 140 bp, Artificial Sequence
  Synthetic
caccgctgtcccaaaaggtcgatgaatcccccacagtatcaaaagatcttcccgattggtattattgtagcttatctttattgtcgggtatgcatcgttctttttgatgagccataccaccatatcagcagccagggcct

SEQ ID NO: 425135 - DNA, 140 bp, Artificial Sequence
  Synthetic
aggccctggctgctgatatgtgcagataaagcttccacccagaaagcaataaatgaaataacaacgaaaataaacaacataatagaaaagatgaacggaaattatgattcaataagaggagaccttttgggacagcggtg

SEQ ID NO: 425136 - DNA, 140 bp, Artificial Sequence
  Synthetic
caccgctgtcccaaaaggtctcctcttattgaatcataatttccgttcatcttttctattatgttgtttattttcgttgttatttcatttattgctttctgggtggaagctttatctgcacatatcagcagccagggcct

SEQ ID NO: 425137 - DNA, 140 bp, Artificial Sequence
  Synthetic
atacgccatgctgggtctccccccgatcgaacacattgcaagcatgaggaggaattactttacagctgaagtgtctcactgcagggcaacagaatacataatgaagggagtatacataaacgtacttgggagtcggccat

SEQ ID NO: 425138 - DNA, 140 bp, Artificial Sequence
  Synthetic
atggccgactcccaagtacgtttatgtatactcccttcattatgtattctgttgccctgcagtgagacacttcagctgtaaagtaattcctcctcatgcttgcaatgtgttcgatcggggggagacccagcatggcgtat

SEQ ID NO: 425139 - DNA, 140 bp, Artificial Sequence
  Synthetic
atacgccatgctgggtctccgtgacttgctgctcacagcggattcatggtcttacataatagagacttcaaattcaaaaaatggagcatgctaccccggagaattcgctgaatatgaagacgtacttgggagtcggccat

SEQ ID NO: 425140 - DNA, 140 bp, Artificial Sequence
  Synthetic
atggccgactcccaagtacgtcttcatattcagcgaattctccggggtagcatgctccattttttgaatttgaagtctctattatgtaagaccatgaatccgctgtgagcagcaagtcacggagacccagcatggcgtat

SEQ ID NO: 425141 - DNA, 140 bp, Artificial Sequence
  Synthetic
aggccctggctgctgatatgaattcaaaaaatggagcatgctaccccggagaattcgctgaatatgaagaattaagggagcagctgagtacagtttcctcatttgaaagatttgaaatttgaccttttgggacagcggtg

SEQ ID NO: 425142 - DNA, 140 bp, Artificial Sequence
  Synthetic
caccgctgtcccaaaaggtcaaatttcaaatctttcaaatgaggaaactgtactcagctgctcccttaattcttcatattcagcgaattctccggggtagcatgctccattttttgaattcatatcagcagccagggcct

SEQ ID NO: 425143 - DNA, 140 bp, Artificial Sequence
  Synthetic
atacgccatgctgggtctccctgtttggtgctatagctggtttcatagaaggaggttggccagggctagttgctggctggtatggtttccagcattcaaatgaccagggaactggaatggcgtacttgggagtcggccat

SEQ ID NO: 425144 - DNA, 140 bp, Artificial Sequence
  Synthetic
atggccgactcccaagtacgccattccagttccctggtcatttgaatgctggaaaccataccagccagcaactagccctggccaacctccttctatgaaaccagctatagcaccaaacagggagacccagcatggcgtat

SEQ ID NO: 425145 - DNA, 140 bp, Artificial Sequence
  Synthetic
atacgccatgctgggtctccgttgcatgctcccactctggagccaaaagtttttataggaacttaatatggatagtacagaaagagaactcctatcctaagctcaacaagtcatacacaacgtacttgggagtcggccat

SEQ ID NO: 425146 - DNA, 140 bp, Artificial Sequence
  Synthetic
atggccgactcccaagtacgttgtgtatgacttgttgagcttaggataggagttctctttctgtactatccatattaagttcctataaaaacttttggctccagagtgggagcatgcaacggagacccagcatggcgtat

SEQ ID NO: 425147 - DNA, 140 bp, Artificial Sequence
  Synthetic
aggccctggctgctgatatggatagtacagaaagagaactcctatcctaagctcaacaagtcatacacaaacaataaggggaagaaggtgcttgtaatttggggagtgcaccaccctccagaccttttgggacagcggtg

SEQ ID NO: 425148 - DNA, 140 bp, Artificial Sequence
  Synthetic
caccgctgtcccaaaaggtctggagggtggtgcactccccaaattacaagcaccttcttccccttattgtttgtgtatgacttgttgagcttaggataggagttctctttctgtactatccatatcagcagccagggcct

SEQ ID NO: 425149 - DNA, 140 bp, Artificial Sequence
  Synthetic
atacgccatgctgggtctccagttgaatcatcgaaatactaccaaagattcacaccagaaatagtagcaagacctaaagtcagagaacaagcaggcaggataaattattactggacactgcgtacttgggagtcggccat

SEQ ID NO: 425150 - DNA, 140 bp, Artificial Sequence
  Synthetic
atggccgactcccaagtacgcagtgtccagtaataatttatcctgcctgcttgttctctgactttaggtcttgctactatttctggtgtgaatctttggtagtatttcgatgattcaactggagacccagcatggcgtat

SEQ ID NO: 425151 - DNA, 140 bp, Artificial Sequence
  Synthetic
aggccctggctgctgatatgttgggattggttgtattcaatgttctattgcatatcgtgagcatcatagtaacagtagtggtcctgggaagtagcgggggtaatggagtttgtaatgagagaccttttgggacagcggtg

SEQ ID NO: 425152 - DNA, 140 bp, Artificial Sequence
  Synthetic
caccgctgtcccaaaaggtctctcattacaaactccattacccccgctacttcccaggaccactactgttactatgatgctcacgatatgcaatagaacattgaatacaaccaatcccaacatatcagcagccagggcct

SEQ ID NO: 425153 - DNA, 140 bp, Artificial Sequence
  Synthetic
atacgccatgctgggtctccttagatcaaggggacacaataacttttgaagccactgggaatttaatagcaccatggcaagcatttgcattgaaaaaaggcgatagttctggaatcatggcgtacttgggagtcggccat

SEQ ID NO: 425154 - DNA, 140 bp, Artificial Sequence
  Synthetic
atggccgactcccaagtacgccatgattccagaactatcgccttttttcaatgcaaatgcttgccatggtgctattaaattcccagtggcttcaaaagttattgtgtccccttgatctaaggagacccagcatggcgtat

SEQ ID NO: 425155 - DNA, 140 bp, Artificial Sequence
  Synthetic
aggccctggctgctgatatgttattttgaaaaggtcgaaagattaaaacatggtacctttggccctgtccacttcagaaaccaagttaaaataagacggagggttgacacaaaccctggtgaccttttgggacagcggtg

SEQ ID NO: 425156 - DNA, 140 bp, Artificial Sequence
  Synthetic
caccgctgtcccaaaaggtcaccagggtttgtgtcaaccctccgtcttattttaacttggtttctgaagtggacagggccaaaggtaccatgttttaatctttcgaccttttcaaaataacatatcagcagccagggcct

SEQ ID NO: 425157 - DNA, 140 bp, Artificial Sequence
  Synthetic
atacgccatgctgggtctccttacacaaacaatactgaagcagtatgtgacgtcaagggctttgcccctttctcaaaggacaatggaataagaattggttctaggggacatgtttttgttcgtacttgggagtcggccat

SEQ ID NO: 425158 - DNA, 140 bp, Artificial Sequence
  Synthetic
atggccgactcccaagtacgaacaaaaacatgtcccctagaaccaattcttattccattgtcctttgagaaaggggcaaagcccttgacgtcacatactgcttcagtattgtttgtgtaaggagacccagcatggcgtat

SEQ ID NO: 425159 - DNA, 140 bp, Artificial Sequence
  Synthetic
aggccctggctgctgatatgtctcaaaggacaatggaataagaattggttctaggggacatgtttttgttataagggaaccctttgtctcctgttcgcccagggagtgcagaactttcttgaccttttgggacagcggtg

SEQ ID NO: 425160 - DNA, 140 bp, Artificial Sequence
  Synthetic
caccgctgtcccaaaaggtcaagaaagttctgcactccctgggcgaacaggagacaaagggttcccttataacaaaaacatgtcccctagaaccaattcttattccattgtcctttgagacatatcagcagccagggcct

SEQ ID NO: 425161 - DNA, 140 bp, Artificial Sequence
  Synthetic
aggccctggctgctgatatgttaaatcagtcgaattggatgctcctaattatcactatgaggagtgctcctgttatcctgatgccggcgaaatcacatgtgtgtgcagggataattggcagaccttttgggacagcggtg

SEQ ID NO: 425162 - DNA, 140 bp, Artificial Sequence
  Synthetic
caccgctgtcccaaaaggtctgccaattatccctgcacacacatgtgatttcgccggcatcaggataacaggagcactcctcatagtgataattaggagcatccaattcgactgatttaacatatcagcagccagggcct

SEQ ID NO: 425163 - DNA, 140 bp, Artificial Sequence
  Synthetic
atacgccatgctgggtctccaggatagaagcccattcagaactcttatgagcgttgaagtaggtcaatcacccaatgtataccaagccaagtttgaagctgtagcgtggtcagcgacagccgtacttgggagtcggccat

SEQ ID NO: 425164 - DNA, 140 bp, Artificial Sequence
  Synthetic
atggccgactcccaagtacggctgtcgctgaccacgctacagcttcaaacttggcttggtatacattgggtgattgacctacttcaacgctcataagagttctgaatgggcttctatcctggagacccagcatggcgtat

SEQ ID NO: 425165 - DNA, 140 bp, Artificial Sequence
  Synthetic
aggccctggctgctgatatgcccaatgtataccaagccaagtttgaagctgtagcgtggtcagcgacagcttgccatgatggaaagaagtggatgacggttggtgttacagggcctgactgaccttttgggacagcggtg

SEQ ID NO: 425166 - DNA, 140 bp, Artificial Sequence
  Synthetic
caccgctgtcccaaaaggtcagtcaggccctgtaacaccaaccgtcatccacttctttccatcatggcaagctgtcgctgaccacgctacagcttcaaacttggcttggtatacattgggcatatcagcagccagggcct

SEQ ID NO: 425167 - DNA, 140 bp, Artificial Sequence
  Synthetic
aggccctggctgctgatatgatgaaagtaaaactactgatcctgttttgtacatttacagctacatatgcggacacaatatgtataggataccatgccaacaactcaaccgacactgttggaccttttgggacagcggtg

SEQ ID NO: 425168 - DNA, 140 bp, Artificial Sequence
  Synthetic
caccgctgtcccaaaaggtccaacagtgtcggttgagttgttggcatggtatcctatacatattgtgtccgcatatgtagctgtaaatgtacaaaacaggatcagtagttttactttcatcatatcagcagccagggcct

SEQ ID NO: 425169 - DNA, 140 bp, Artificial Sequence
  Synthetic
atacgccatgctgggtctccaattcttgggcaggagatatcttgaggacccaggagtcatcctgcacctgcatacagggtgattgctactgggtgatgactgacggccctgccaataggccgtacttgggagtcggccat

SEQ ID NO: 425170 - DNA, 140 bp, Artificial Sequence
  Synthetic
atggccgactcccaagtacggcctattggcagggccgtcagtcatcacccagtagcaatcaccctgtatgcaggtgcaggatgactcctgggtcctcaagatatctcctgcccaagaattggagacccagcatggcgtat

SEQ ID NO: 425171 - DNA, 140 bp, Artificial Sequence
  Synthetic
aggccctggctgctgatatgcatacagggtgattgctactgggtgatgactgacggccctgccaataggcaggcgcagtacagaatatacaaggctaatcaaggcaagatcattggtcaggaccttttgggacagcggtg

SEQ ID NO: 425172 - DNA, 140 bp, Artificial Sequence
  Synthetic
caccgctgtcccaaaaggtcctgaccaatgatcttgccttgattagccttgtatattctgtactgcgcctgcctattggcagggccgtcagtcatcacccagtagcaatcaccctgtatgcatatcagcagccagggcct

SEQ ID NO: 425173 - DNA, 140 bp, Artificial Sequence
  Synthetic
atacgccatgctgggtctcctaatgacggcaatgtggaatgcgtttgtagagacaactggacaggaaccaaccggcctgtgctggtgatttcgcctgatctctcttacagagttgggtatcgtacttgggagtcggccat

SEQ ID NO: 425174 - DNA, 140 bp, Artificial Sequence
  Synthetic
atggccgactcccaagtacgatacccaactctgtaagagagatcaggcgaaatcaccagcacaggccggttggttcctgtccagttgtctctacaaacgcattccacattgccgtcattaggagacccagcatggcgtat

SEQ ID NO: 425175 - DNA, 140 bp, Artificial Sequence
  Synthetic
atacgccatgctgggtctccagactatatggacctcgagtagctccattgtgatgtgtggagtagaccatgagattgccgactggtcatggcacgatggagctattcttccttttgacatcgtacttgggagtcggccat

SEQ ID NO: 425176 - DNA, 140 bp, Artificial Sequence
  Synthetic
atggccgactcccaagtacgatgtcaaaaggaagaatagctccatcgtgccatgaccagtcggcaatctcatggtctactccacacatcacaatggagctactcgaggtccatatagtctggagacccagcatggcgtat

SEQ ID NO: 425177 - DNA, 140 bp, Artificial Sequence
  Synthetic
atacgccatgctgggtctccactccacagtcgccagttccctggtcttgttagtctccctgggggcaatcagcttctggatgtgttctaatgggtcattgcaatgcagagtatgcatttacgtacttgggagtcggccat

SEQ ID NO: 425178 - DNA, 140 bp, Artificial Sequence
  Synthetic
atggccgactcccaagtacgtaaatgcatactctgcattgcaatgacccattagaacacatccagaagctgattgcccccagggagactaacaagaccagggaactggcgactgtggagtggagacccagcatggcgtat

SEQ ID NO: 425179 - DNA, 140 bp, Artificial Sequence
  Synthetic
atacgccatgctgggtctccgttttgggttcagacagggaaatgatgtatggatggggaggacaattagtcgtacctctaggtcaggatttgagataataagagtaaagaatggctggaccgtacttgggagtcggccat

SEQ ID NO: 425180 - DNA, 140 bp, Artificial Sequence
  Synthetic
atggccgactcccaagtacggtccagccattctttactcttattatctcaaatcctgacctagaggtacgactaattgtcctccccatccatacatcatttccctgtctgaacccaaaacggagacccagcatggcgtat

SEQ ID NO: 425181 - DNA, 140 bp, Artificial Sequence
  Synthetic
aggccctggctgctgatatgcgtacctctaggtcaggatttgagataataagagtaaagaatggctggacacagacaagtaaagaacagattaaaaaacaagtagttgttgataatttgagaccttttgggacagcggtg

SEQ ID NO: 425182 - DNA, 140 bp, Artificial Sequence
  Synthetic
caccgctgtcccaaaaggtctcaaattatcaacaactacttgttttttaatctgttctttacttgtctgtgtccagccattctttactcttattatctcaaatcctgacctagaggtacgcatatcagcagccagggcct

SEQ ID NO: 425183 - DNA, 140 bp, Artificial Sequence
  Synthetic
atacgccatgctgggtctccagtgtcttcacattatagcggaagattcaccccagaaataaccaaaaggcccaaagtaagagatcaggaaggaagaatcaactactactggactctgctgcgtacttgggagtcggccat

SEQ ID NO: 425184 - DNA, 140 bp, Artificial Sequence
  Synthetic
atggccgactcccaagtacgcagcagagtccagtagtagttgattcttccttcctgatctcttactttgggccttttggttatttctggggtgaatcttccgctataatgtgaagacactggagacccagcatggcgtat

SEQ ID NO: 425185 - DNA, 140 bp, Artificial Sequence
  Synthetic
atacgccatgctgggtctccaaaagctgtttggttccatgtttttgggtagaaacgatcagaggtaaaccggaggagagaacaatctggacctccagcagctccattgtgatgtgtggagcgtacttgggagtcggccat

SEQ ID NO: 425186 - DNA, 140 bp, Artificial Sequence
  Synthetic
atggccgactcccaagtacgctccacacatcacaatggagctgctggaggtccagattgttctctcctccggtttacctctgatcgtttctacccaaaaacatggaaccaaacagcttttggagacccagcatggcgtat

SEQ ID NO: 425187 - DNA, 140 bp, Artificial Sequence
  Synthetic
aggccctggctgctgatatggactggttcatgctcatgcctaggcaaaagataataggctctctttgtgtgcgaatggaccaggcgatcattgaaaagaacatcatactgaaagcgaactgaccttttgggacagcggtg

SEQ ID NO: 425188 - DNA, 140 bp, Artificial Sequence
  Synthetic
caccgctgtcccaaaaggtcagttcgctttcagtatgatgttcttttcaatgatcgcctggtccattcgcacacaaagagagcctattatcttttgcctaggcatgagcatgaaccagtccatatcagcagccagggcct

SEQ ID NO: 425189 - DNA, 140 bp, Artificial Sequence
  Synthetic
aggccctggctgctgatatgtttttgagagtacgggatcaacgagggaacgtactattgtctcccgaagaggtcagcgagacacagggaactgagaaattgacaataacttattcgtcgtgaccttttgggacagcggtg

SEQ ID NO: 425190 - DNA, 140 bp, Artificial Sequence
  Synthetic
caccgctgtcccaaaaggtcacgacgaataagttattgtcaatttctcagttccctgtgtctcgctgacctcttcgggagacaatagtacgttccctcgttgatcccgtactctcaaaaacatatcagcagccagggcct

SEQ ID NO: 425191 - DNA, 140 bp, Artificial Sequence
  Synthetic
atacgccatgctgggtctcccaatggatcataaggaactgggaaagcttgaaaattcaatggtcacaagatcccacgatgttatacaacaaaatggaatttgaaccattccagtctcttgcgtacttgggagtcggccat

SEQ ID NO: 425192 - DNA, 140 bp, Artificial Sequence
  Synthetic
atggccgactcccaagtacgcaagagactggaatggttcaaattccattttgttgtataacatcgtgggatcttgtgaccattgaattttcaagctttcccagttccttatgatccattgggagacccagcatggcgtat

SEQ ID NO: 425193 - DNA, 140 bp, Artificial Sequence
  Synthetic
aggccctggctgctgatatgaacagaaaatagctttgaacagataacatttatgcaagcattacaactactgcttgaagtagaacaagagataagaactttctcgtttcagcttatttaagaccttttgggacagcggtg

SEQ ID NO: 425194 - DNA, 140 bp, Artificial Sequence
  Synthetic
caccgctgtcccaaaaggtcttaaataagctgaaacgagaaagttcttatctcttgttctacttcaagcagtagttgtaatgcttgcataaatgttatctgttcaaagctattttctgttcatatcagcagccagggcct

SEQ ID NO: 425195 - DNA, 140 bp, Artificial Sequence
  Synthetic
atacgccatgctgggtctccagattggatcctatggatttcctttgccatatcatgttttttgctttgtgttgttttgttggggttcatcatgtgggcctgccaaaagggcaacattaggcgtacttgggagtcggccat

SEQ ID NO: 425196 - DNA, 140 bp, Artificial Sequence
  Synthetic
atggccgactcccaagtacgcctaatgttgcccttttggcaggcccacatgatgaaccccaacaaaacaacacaaagcaaaaaacatgatatggcaaaggaaatccataggatccaatctggagacccagcatggcgtat

SEQ ID NO: 425197 - DNA, 140 bp, Artificial Sequence
  Synthetic
aggccctggctgctgatatgacaagtgtgataatgagtgcattgagaaagtcaggaatggaacatatgaccataaggaatttgaagaggagtccaaactgaacagacaagaaattgaggggaccttttgggacagcggtg

SEQ ID NO: 425198 - DNA, 140 bp, Artificial Sequence
  Synthetic
caccgctgtcccaaaaggtcccctcaatttcttgtctgttcagtttggactcctcttcaaattccttatggtcatatgttccattcctgactttctcaatgcactcattatcacacttgtcatatcagcagccagggcct

SEQ ID NO: 425199 - DNA, 140 bp, Artificial Sequence
  Synthetic
aggccctggctgctgatatgggctgtgtacagtaaggataacagcataaggatcggttccaagggggatgtgtttgttataagagagccattcatctcatgctcccacttggaatgcagagaccttttgggacagcggtg

SEQ ID NO: 425200 - DNA, 140 bp, Artificial Sequence
  Synthetic
caccgctgtcccaaaaggtctctgcattccaagtgggagcatgagatgaatggctctcttataacaaacacatcccccttggaaccgatccttatgctgttatccttactgtacacagcccatatcagcagccagggcct

SEQ ID NO: 425201 - DNA, 140 bp, Artificial Sequence
  Synthetic
atacgccatgctgggtctccggaaaaggcaatgaaagaatatggggaagatccgaaaatcgaaacgaacaaattcgcagcaatatgcacacacttagaagtctgcttcatgtattcggatcgtacttgggagtcggccat

SEQ ID NO: 425202 - DNA, 140 bp, Artificial Sequence
  Synthetic
atggccgactcccaagtacgatccgaatacatgaagcagacttctaagtgtgtgcatattgctgcgaatttgttcgtttcgattttcggatcttccccatattctttcattgccttttccggagacccagcatggcgtat

SEQ ID NO: 425203 - DNA, 140 bp, Artificial Sequence
  Synthetic
aggccctggctgctgatatggtgggtatgcacaaacagactgtgttctagaggctatggctttccttgaagaatcccacccaggaatatttgagaattcatgccttgaaacaatggaagtgaccttttgggacagcggtg

SEQ ID NO: 425204 - DNA, 140 bp, Artificial Sequence
  Synthetic
caccgctgtcccaaaaggtcacttccattgtttcaaggcatgaattctcaaatattcctgggtgggattcttcaaggaaagccatagcctctagaacacagtctgtttgtgcatacccaccatatcagcagccagggcct

SEQ ID NO: 425205 - DNA, 140 bp, Artificial Sequence
  Synthetic
aggccctggctgctgatatgtcctctgatgatttcgccctcatagtaaatgcaccaaatcatgagggaatacaagctggggtagataggttctataggacctgtaaactagttggaatcagaccttttgggacagcggtg

SEQ ID NO: 425206 - DNA, 140 bp, Artificial Sequence
  Synthetic
caccgctgtcccaaaaggtctgattccaactagtttacaggtcctatagaacctatctaccccagcttgtattccctcatgatttggtgcatttactatgagggcgaaatcatcagaggacatatcagcagccagggcct

SEQ ID NO: 425207 - DNA, 140 bp, Artificial Sequence
  Synthetic
atacgccatgctgggtctcctaatgaatcagctgacatgagcattggagtaacagtgataaagaacaacatgataaataatgatcttggcccagcaacagcccaaatggctctccaactgcgtacttgggagtcggccat

SEQ ID NO: 425208 - DNA, 140 bp, Artificial Sequence
  Synthetic
atggccgactcccaagtacgcagttggagagccatttgggctgttgctgggccaagatcattatttatcatgttgttctttatcactgttactccaatgctcatgtcagctgattcattaggagacccagcatggcgtat

SEQ ID NO: 425209 - DNA, 140 bp, Artificial Sequence
  Synthetic
atacgccatgctgggtctccatggattcgaaccaaacggctgcattgagggcaagctttctcaaatgtcaaaagaagtgagtgcccaaattgaaccattcttgaagaaaacaccacgccccgtacttgggagtcggccat

SEQ ID NO: 425210 - DNA, 140 bp, Artificial Sequence
  Synthetic
atggccgactcccaagtacggggcgtggtgttttcttcaagaatggttcaatttgggcactcacttcttttgacatttgagaaagcttgccctcaatgcagccgtttggttcgaatccatggagacccagcatggcgtat

SEQ ID NO: 425211 - DNA, 140 bp, Artificial Sequence
  Synthetic
atacgccatgctgggtctccatggaagtcccagtattcgcactcctagtgttaaccagcatatgcgtacaagctgataggatttgtgttgggtacttaagcacaaactcatcagaaagggcgtacttgggagtcggccat

SEQ ID NO: 425212 - DNA, 140 bp, Artificial Sequence
  Synthetic
atggccgactcccaagtacgccctttctgatgagtttgtgcttaagtacccaacacaaatcctatcagcttgtacgcatatgctggttaacactaggagtgcgaatactgggacttccatggagacccagcatggcgtat

SEQ ID NO: 425213 - DNA, 140 bp, Artificial Sequence
  Synthetic
aggccctggctgctgatatgagctgataggatttgtgttgggtacttaagcacaaactcatcagaaagggttgacacactgttagagaataatgtcccggttacaagttctgttgacttggaccttttgggacagcggtg

SEQ ID NO: 425214 - DNA, 140 bp, Artificial Sequence
  Synthetic
caccgctgtcccaaaaggtccaagtcaacagaacttgtaaccgggacattattctctaacagtgtgtcaaccctttctgatgagtttgtgcttaagtacccaacacaaatcctatcagctcatatcagcagccagggcct

SEQ ID NO: 425215 - DNA, 140 bp, Artificial Sequence
  Synthetic
atacgccatgctgggtctccttgacacactgttagagaataatgtcccggttacaagttctgttgacttggttgagactaaccacacaggaacatattgttctttgggtggaattagtcccgtacttgggagtcggccat

SEQ ID NO: 425216 - DNA, 140 bp, Artificial Sequence
  Synthetic
atggccgactcccaagtacgggactaattccacccaaagaacaatatgttcctgtgtggttagtctcaaccaagtcaacagaacttgtaaccgggacattattctctaacagtgtgtcaaggagacccagcatggcgtat

SEQ ID NO: 425217 - DNA, 140 bp, Artificial Sequence
  Synthetic
aggccctggctgctgatatggtagatggttggtatgggtaccaccatagcaatgagcaggggagtgggtacgctgcagacaaagaatccacccaaaaggcaatagatggagttaccaatagaccttttgggacagcggtg

SEQ ID NO: 425218 - DNA, 140 bp, Artificial Sequence
  Synthetic
caccgctgtcccaaaaggtctattggtaactccatctattgccttttgggtggattctttgtctgcagcgtacccactcccctgctcattgctatggtggtacccataccaaccatctaccatatcagcagccagggcct

SEQ ID NO: 425219 - DNA, 140 bp, Artificial Sequence
  Synthetic
atacgccatgctgggtctcccctgtgccagcaacctggggattagagaatggtcatatttgattgaagacccttctgctcctcatggattgtgctatccaggagagttagacaacaatggcgtacttgggagtcggccat

SEQ ID NO: 425220 - DNA, 140 bp, Artificial Sequence
  Synthetic
atggccgactcccaagtacgccattgttgtctaactctcctggatagcacaatccatgaggagcagaagggtcttcaatcaaatatgaccattctctaatccccaggttgctggcacaggggagacccagcatggcgtat

SEQ ID NO: 425221 - DNA, 140 bp, Artificial Sequence
  Synthetic
aggccctggctgctgatatgccttctgctcctcatggattgtgctatccaggagagttagacaacaatggagaattgaggcacttgtttagtgggatcaaatctttcagtagaacagaatgaccttttgggacagcggtg

SEQ ID NO: 425222 - DNA, 140 bp, Artificial Sequence
  Synthetic
caccgctgtcccaaaaggtcattctgttctactgaaagatttgatcccactaaacaagtgcctcaattctccattgttgtctaactctcctggatagcacaatccatgaggagcagaaggcatatcagcagccagggcct

SEQ ID NO: 425223 - DNA, 140 bp, Artificial Sequence
  Synthetic
atacgccatgctgggtctcctgtcaagacagaggagctagcagcttttaccggaacctggtatggtttgtggcgagaggaaatacatatcctgtgatccgcgggacctacaacaacaccacgtacttgggagtcggccat

SEQ ID NO: 425224 - DNA, 140 bp, Artificial Sequence
  Synthetic
atggccgactcccaagtacgtggtgttgttgtaggtcccgcggatcacaggatatgtatttcctctcgccacaaaccataccaggttccggtaaaagctgctagctcctctgtcttgacaggagacccagcatggcgtat

SEQ ID NO: 425225 - DNA, 140 bp, Artificial Sequence
  Synthetic
aggccctggctgctgatatgggcgagaggaaatacatatcctgtgatccgcgggacctacaacaacaccactggcagagatgtcttggttatatggggtatacatcaccctgtctccacagaccttttgggacagcggtg

SEQ ID NO: 425226 - DNA, 140 bp, Artificial Sequence
  Synthetic
caccgctgtcccaaaaggtctgtggagacagggtgatgtataccccatataaccaagacatctctgccagtggtgttgttgtaggtcccgcggatcacaggatatgtatttcctctcgcccatatcagcagccagggcct

SEQ ID NO: 425227 - DNA, 140 bp, Artificial Sequence
  Synthetic
aggccctggctgctgatatggataggaccccttatcgaaccctattgatgaatgaattgggtgttccatttcatttgggaaccaggcaagtgtgcatagcatggtccagttcaagttgtcgaccttttgggacagcggtg

SEQ ID NO: 425228 - DNA, 140 bp, Artificial Sequence
  Synthetic
caccgctgtcccaaaaggtcgacaacttgaactggaccatgctatgcacacttgcctggttcccaaatgaaatggaacacccaattcattcatcaatagggttcgataaggggtcctatccatatcagcagccagggcct

SEQ ID NO: 425229 - DNA, 140 bp, Artificial Sequence
  Synthetic
aggccctggctgctgatatggattctagaggaagagtccgatgaggcgcttaaaatgactattgcttcagtgccggtttcacgctacctaactgatatgactcttgaagaaatgtcaagggaccttttgggacagcggtg

SEQ ID NO: 425230 - DNA, 140 bp, Artificial Sequence
  Synthetic
caccgctgtcccaaaaggtcccttgacatttcttcaagagtcatatcagttaggtagcgtgaaaccggcactgaagcaatagtcattttaagcgcctcatcggactcttcctctagaatccatatcagcagccagggcct

SEQ ID NO: 425231 - DNA, 140 bp, Artificial Sequence
  Synthetic
aggccctggctgctgatatggatacaatggccaaaagagttggatgaagatttactggtatctgatgcaccccggggattcaatcagtttcgaaagcaatgggggactactggctcccaagaccttttgggacagcggtg

SEQ ID NO: 425232 - DNA, 140 bp, Artificial Sequence
  Synthetic
caccgctgtcccaaaaggtcttgggagccagtagtcccccattgctttcgaaactgattgaatccccggggtgcatcagataccagtaaatcttcatccaactcttttggccattgtatccatatcagcagccagggcct

SEQ ID NO: 425233 - DNA, 140 bp, Artificial Sequence
  Synthetic
aggccctggctgctgatatgtggacctcaaacagtattgttgtgttttgtggcacctcaggtacgtatggaacaggctcatggcctgatggggcggatatcaatctcatgcctatataaggaccttttgggacagcggtg

SEQ ID NO: 425234 - DNA, 140 bp, Artificial Sequence
  Synthetic
caccgctgtcccaaaaggtccttatataggcatgagattgatatccgccccatcaggccatgagcctgttccatacgtacctgaggtgccacaaaacacaacaatactgtttgaggtccacatatcagcagccagggcct

SEQ ID NO: 425235 - DNA, 140 bp, Artificial Sequence
  Synthetic
atacgccatgctgggtctccgcattcgcattgctaaatgtaacactaaatgtcagacatcagtaggtggaataaatactaacaaaacatttcaaaacatagagagaaatgcacttggagacgtacttgggagtcggccat

SEQ ID NO: 425236 - DNA, 140 bp, Artificial Sequence
  Synthetic
atggccgactcccaagtacgtctccaagtgcatttctctctatgttttgaaatgttttgttagtatttattccacctactgatgtctgacatttagtgttacatttagcaatgcgaatgcggagacccagcatggcgtat

SEQ ID NO: 425237 - DNA, 140 bp, Artificial Sequence
  Synthetic
aggccctggctgctgatatgataaatactaacaaaacatttcaaaacatagagagaaatgcacttggagattgcccgaaatacataaaatctggacagctcaaattggccactggacttagaccttttgggacagcggtg

SEQ ID NO: 425238 - DNA, 140 bp, Artificial Sequence
  Synthetic
caccgctgtcccaaaaggtctaagtccagtggccaatttgagctgtccagattttatgtatttcgggcaatctccaagtgcatttctctctatgttttgaaatgttttgttagtatttatcatatcagcagccagggcct

SEQ ID NO: 425239 - DNA, 140 bp, Artificial Sequence
  Synthetic
atacgccatgctgggtctccatagaaatcaaccggctgcaactgctttggccaacactatagaggtcttcagatcgaacggtctaacagctaatgagtcaggaagactaatagatttcctcgtacttgggagtcggccat

SEQ ID NO: 425240 - DNA, 140 bp, Artificial Sequence
  Synthetic
atggccgactcccaagtacgaggaaatctattagtcttcctgactcattagctgttagaccgttcgatctgaagacctctatagtgttggccaaagcagttgcagccggttgatttctatggagacccagcatggcgtat

SEQ ID NO: 425241 - DNA, 140 bp, Artificial Sequence
  Synthetic
atacgccatgctgggtctcccccatatatagaagaatagacggaaagtggatgagagaactcaccctttatgacaaagaagaaataaggagagtttggcgccaagcaaacaatggcgaagcgtacttgggagtcggccat

SEQ ID NO: 425242 - DNA, 140 bp, Artificial Sequence
  Synthetic
atggccgactcccaagtacgcttcgccattgtttgcttggcgccaaactctccttatttcttctttgtcataaagggtgagttctctcatccactttccgtctattcttctatatatgggggagacccagcatggcgtat

SEQ ID NO: 425243 - DNA, 140 bp, Artificial Sequence
  Synthetic
aggccctggctgctgatatgcgtggaaaaagataatccagtcaatggcctgtgctatccaggaaacttcaatgattacgaagaactgaagcatttaatgagcagcacaaaccattttgaggaccttttgggacagcggtg

SEQ ID NO: 425244 - DNA, 140 bp, Artificial Sequence
  Synthetic
caccgctgtcccaaaaggtcctcaaaatggtttgtgctgctcattaaatgcttcagttcttcgtaatcattgaagtttcctggatagcacaggccattgactggattatctttttccacgcatatcagcagccagggcct

SEQ ID NO: 425245 - DNA, 140 bp, Artificial Sequence
  Synthetic
aggccctggctgctgatatgacatcagaatgaacaaggaacgggcatagctgcagacaaagaatcaacacaaaaggctattgatcaaataacaactaagataaacaatataatagaaaaagaccttttgggacagcggtg

SEQ ID NO: 425246 - DNA, 140 bp, Artificial Sequence
  Synthetic
caccgctgtcccaaaaggtctttttctattatattgtttatcttagttgttatttgatcaatagccttttgtgttgattctttgtctgcagctatgcccgttccttgttcattctgatgtcatatcagcagccagggcct

SEQ ID NO: 425247 - DNA, 140 bp, Artificial Sequence
  Synthetic
atacgccatgctgggtctccaaggataaatatgcttgcagacagaatagatgatgctgtaactgacatatggtcatacaatgcaaagcttcttgttttactagaaaacgacaagactctacgtacttgggagtcggccat

SEQ ID NO: 425248 - DNA, 140 bp, Artificial Sequence
  Synthetic
atggccgactcccaagtacgtagagtcttgtcgttttctagtaaaacaagaagctttgcattgtatgaccatatgtcagttacagcatcatctattctgtctgcaagcatatttatccttggagacccagcatggcgtat

SEQ ID NO: 425249 - DNA, 140 bp, Artificial Sequence
  Synthetic
aggccctggctgctgatatgggtcatacaatgcaaagcttcttgttttactagaaaacgacaagactctagacatgcacgacgctaatgtcaggaacctgcatgatcaagtccgcagagtgaccttttgggacagcggtg

SEQ ID NO: 425250 - DNA, 140 bp, Artificial Sequence
  Synthetic
caccgctgtcccaaaaggtcactctgcggacttgatcatgcaggttcctgacattagcgtcgtgcatgtctagagtcttgtcgttttctagtaaaacaagaagctttgcattgtatgacccatatcagcagccagggcct

SEQ ID NO: 425251 - DNA, 140 bp, Artificial Sequence
  Synthetic
aggccctggctgctgatatgtgataaataatgatcttggcccagcaacagcccaaatggctctccaactgttcatcaaagactacagatacacataccgatgccataggggagatactcagaccttttgggacagcggtg

SEQ ID NO: 425252 - DNA, 140 bp, Artificial Sequence
  Synthetic
caccgctgtcccaaaaggtctgagtatctcccctatggcatcggtatgtgtatctgtagtctttgatgaacagttggagagccatttgggctgttgctgggccaagatcattatttatcacatatcagcagccagggcct

SEQ ID NO: 425253 - DNA, 140 bp, Artificial Sequence
  Synthetic
atacgccatgctgggtctccataaatgtaatgactcttgcatggagacaataagaaatggaacgtacaatcatatagagtatgaagaggaatcaaagttaaaaaggcaggaaatagaaggcgtacttgggagtcggccat

SEQ ID NO: 425254 - DNA, 140 bp, Artificial Sequence
  Synthetic
atggccgactcccaagtacgccttctatttcctgcctttttaactttgattcctcttcatactctatatgattgtacgttccatttcttattgtctccatgcaagagtcattacatttatggagacccagcatggcgtat

SEQ ID NO: 425255 - DNA, 140 bp, Artificial Sequence
  Synthetic
atacgccatgctgggtctccgagccaaaaattagatcactggcaagctgggtccagagtgaattcaacaaggcatgtgaattgacggattccagctggatagagcttgacgaaataggagcgtacttgggagtcggccat

SEQ ID NO: 425256 - DNA, 140 bp, Artificial Sequence
  Synthetic
atggccgactcccaagtacgctcctatttcgtcaagctctatccagctggaatccgtcaattcacatgccttgttgaattcactctggacccagcttgccagtgatctaatttttggctcggagacccagcatggcgtat

SEQ ID NO: 425257 - DNA, 140 bp, Artificial Sequence
  Synthetic
atacgccatgctgggtctcccagctgcattgcaagcagtattgtattggtaggactcatacttgcattcatcatgtgggcatgcagcagtggcagttgccgattcaatatttgtatataacgtacttgggagtcggccat

SEQ ID NO: 425258 - DNA, 140 bp, Artificial Sequence
  Synthetic
atggccgactcccaagtacgttatatacaaatattgaatcggcaactgccactgctgcatgcccacatgatgaatgcaagtatgagtcctaccaatacaatactgcttgcaatgcagctgggagacccagcatggcgtat

SEQ ID NO: 425259 - DNA, 140 bp, Artificial Sequence
  Synthetic
aggccctggctgctgatatgtgaacgccagaatgccactgaaattcgggcatctgtcgggaggatggttggaggaattggaaggttctacatacaaatgtgcactgaactcaaactaagtgaccttttgggacagcggtg

SEQ ID NO: 425260 - DNA, 140 bp, Artificial Sequence
  Synthetic
caccgctgtcccaaaaggtcacttagtttgagttcagtgcacatttgtatgtagaaccttccaattcctccaaccatcctcccgacagatgcccgaatttcagtggcattctggcgttcacatatcagcagccagggcct

SEQ ID NO: 425261 - DNA, 140 bp, Artificial Sequence
  Synthetic
atacgccatgctgggtctcccactgatgtggtaaactttgtgagcatggagttttctcttactgacccgaggctggaaccacacaagtgggagaagtactgtgttctcgagataggagaccgtacttgggagtcggccat

SEQ ID NO: 425262 - DNA, 140 bp, Artificial Sequence
  Synthetic
atggccgactcccaagtacggtctcctatctcgagaacacagtacttctcccacttgtgtggttccagcctcgggtcagtaagagaaaactccatgctcacaaagtttaccacatcagtgggagacccagcatggcgtat

SEQ ID NO: 425263 - DNA, 140 bp, Artificial Sequence
  Synthetic
atacgccatgctgggtctcctgccggtttcacgctacctaactgatatgactcttgaagaaatgtcaagggactggttgatgctaatgccaaaacagaaattggccagttccctctgcatcgtacttgggagtcggccat

SEQ ID NO: 425264 - DNA, 140 bp, Artificial Sequence
  Synthetic
atggccgactcccaagtacgatgcagagggaactggccaatttctgttttggcattagcatcaaccagtcccttgacatttcttcaagagtcatatcagttaggtagcgtgaaaccggcaggagacccagcatggcgtat

SEQ ID NO: 425265 - DNA, 140 bp, Artificial Sequence
  Synthetic
aggccctggctgctgatatgatgaaggcaatactagtagtcctgctatatacatttacaaccgcaaatgccgacacattatgtataggttatcatgcaaacaattcaactgacaccgtaggaccttttgggacagcggtg

SEQ ID NO: 425266 - DNA, 140 bp, Artificial Sequence
  Synthetic
caccgctgtcccaaaaggtcctacggtgtcagttgaattgtttgcatgataacctatacataatgtgtcggcatttgcggttgtaaatgtatatagcaggactactagtattgccttcatcatatcagcagccagggcct

SEQ ID NO: 425267 - DNA, 140 bp, Artificial Sequence
  Synthetic
atacgccatgctgggtctcctctgcatttgatgaacgaagaaacaggtacctggaggaacaccccagtgcggggaaggacccgaagaaaactggaggtccaatttataagaggagagacgcgtacttgggagtcggccat

SEQ ID NO: 425268 - DNA, 140 bp, Artificial Sequence
  Synthetic
atggccgactcccaagtacgcgtctctcctcttataaattggacctccagttttcttcgggtccttccccgcactggggtgttcctccaggtacctgtttcttcgttcatcaaatgcagaggagacccagcatggcgtat

SEQ ID NO: 425269 - DNA, 140 bp, Artificial Sequence
  Synthetic
aggccctggctgctgatatggctagtaaaaaagggaaattcatacccaaagatcaacaaatcctacattaacaataaagagaaggaagttctcgtgctatgggccattcaccatccatctgaccttttgggacagcggtg

SEQ ID NO: 425270 - DNA, 140 bp, Artificial Sequence
  Synthetic
caccgctgtcccaaaaggtcagatggatggtgaatggcccatagcacgagaacttccttctctttattgttaatgtaggatttgttgatctttgggtatgaatttcccttttttactagccatatcagcagccagggcct

SEQ ID NO: 425271 - DNA, 140 bp, Artificial Sequence
  Synthetic
aggccctggctgctgatatgtgtgagaaccaatgggacctccaagatcaagatgaaatggggcatggagatgaggcgatgccttcttcaatcccttcaacaaattgagagcatgattgaggaccttttgggacagcggtg

SEQ ID NO: 425272 - DNA, 140 bp, Artificial Sequence
  Synthetic
caccgctgtcccaaaaggtcctcaatcatgctctcaatttgttgaagggattgaagaaggcatcgcctcatctccatgccccatttcatcttgatcttggaggtcccattggttctcacacatatcagcagccagggcct

SEQ ID NO: 425273 - DNA, 140 bp, Artificial Sequence
  Synthetic
aggccctggctgctgatatggcatctccacaactcgaggggttttcagctgaatcaagaaaaatgcttctcattgttcaggcacttagggatagcctggaccctggaacattcgaccttggaccttttgggacagcggtg

SEQ ID NO: 425274 - DNA, 140 bp, Artificial Sequence
  Synthetic
caccgctgtcccaaaaggtccaaggtcgaatgttccagggtccaggctatccctaagtgcctgaacaatgagaagcatttttcttgattcagctgaaaacccctcgagttgtggagatgccatatcagcagccagggcct

SEQ ID NO: 425275 - DNA, 140 bp, Artificial Sequence
  Synthetic
aggccctggctgctgatatggaagagaaaattccaaagacaaagaacatgaagaaaacaagccaattgaagtgggcactcggtgagaacatggcaccggaaaaagtggactttgatgattgaccttttgggacagcggtg

SEQ ID NO: 425276 - DNA, 140 bp, Artificial Sequence
  Synthetic
caccgctgtcccaaaaggtcaatcatcaaagtccactttttccggtgccatgttctcaccgagtgcccacttcaattggcttgttttcttcatgttctttgtctttggaattttctcttccatatcagcagccagggcct

SEQ ID NO: 425277 - DNA, 140 bp, Artificial Sequence
  Synthetic
atacgccatgctgggtctccatggatgtcaatccgactttactcttcttgaaagtgccagcacaaaatgctataagcactacattcccatatactggagcccccccatacagccatggaacgtacttgggagtcggccat

SEQ ID NO: 425278 - DNA, 140 bp, Artificial Sequence
  Synthetic
atggccgactcccaagtacgttccatggctgtatgggggggctccagtatatgggaatgtagtgcttatagcattttgtgctggcactttcaagaagagtaaagtcggattgacatccatggagacccagcatggcgtat

SEQ ID NO: 425279 - DNA, 140 bp, Artificial Sequence
  Synthetic
aggccctggctgctgatatgtataagcactacattcccatatactggagcccccccatacagccatggaacaggaacaggatacactatggacacggtcaacagaacacaccaatactcagaccttttgggacagcggtg

SEQ ID NO: 425280 - DNA, 140 bp, Artificial Sequence
  Synthetic
caccgctgtcccaaaaggtctgagtattggtgtgttctgttgaccgtgtccatagtgtatcctgttcctgttccatggctgtatgggggggctccagtatatgggaatgtagtgcttatacatatcagcagccagggcct

SEQ ID NO: 425281 - DNA, 140 bp, Artificial Sequence
  Synthetic
atacgccatgctgggtctccagatcactagcaagctggatccagagtgaattcaacaaggcatgcgaattgactgattcaagctggatagaacttgatgagataggggaagatgttgctccgtacttgggagtcggccat

SEQ ID NO: 425282 - DNA, 140 bp, Artificial Sequence
  Synthetic
atggccgactcccaagtacggagcaacatcttcccctatctcatcaagttctatccagcttgaatcagtcaattcgcatgccttgttgaattcactctggatccagcttgctagtgatctggagacccagcatggcgtat

SEQ ID NO: 425283 - DNA, 140 bp, Artificial Sequence
  Synthetic
aggccctggctgctgatatgagaaagaagaatagagaatttaaataaaaaagtagatgatggttttctagatatttggacttacaatgccgagctgttggttctattggaaaatgaaagagaccttttgggacagcggtg

SEQ ID NO: 425284 - DNA, 140 bp, Artificial Sequence
  Synthetic
caccgctgtcccaaaaggtctctttcattttccaatagaaccaacagctcggcattgtaagtccaaatatctagaaaaccatcatctacttttttatttaaattctctattcttctttctcatatcagcagccagggcct

SEQ ID NO: 425285 - DNA, 140 bp, Artificial Sequence
  Synthetic
atacgccatgctgggtctccgcccatgttcctatatgtgagaaccaatggaacctccaagatcaagatgaaatggggcatggaaatgaggcgctgccttcttcagtctcttcagcagattcgtacttgggagtcggccat

SEQ ID NO: 425286 - DNA, 140 bp, Artificial Sequence
  Synthetic
atggccgactcccaagtacgaatctgctgaagagactgaagaaggcagcgcctcatttccatgccccatttcatcttgatcttggaggttccattggttctcacatataggaacatgggcggagacccagcatggcgtat

SEQ ID NO: 425287 - DNA, 140 bp, Artificial Sequence
  Synthetic
atacgccatgctgggtctccagctctgctcaatgcatcctgtgcggccatggatgactttcagctgattccaatgataagcaaatgcaggaccaaagaagggagacggaaaacaaatctgcgtacttgggagtcggccat

SEQ ID NO: 425288 - DNA, 140 bp, Artificial Sequence
  Synthetic
atggccgactcccaagtacgcagatttgttttccgtctcccttctttggtcctgcatttgcttatcattggaatcagctgaaagtcatccatggccgcacaggatgcattgagcagagctggagacccagcatggcgtat

SEQ ID NO: 425289 - DNA, 140 bp, Artificial Sequence
  Synthetic
atacgccatgctgggtctccaagccaactaaaaaacaatgccaaggaaattggaaatggctgctttgaattttaccacaaatgtgatgacatgtgcatggaaagcgtcaaaaatggaactcgtacttgggagtcggccat

SEQ ID NO: 425290 - DNA, 140 bp, Artificial Sequence
  Synthetic
atggccgactcccaagtacgagttccatttttgacgctttccatgcacatgtcatcacatttgtggtaaaattcaaagcagccatttccaatttccttggcattgttttttagttggcttggagacccagcatggcgtat

SEQ ID NO: 425291 - DNA, 140 bp, Artificial Sequence
  Synthetic
aggccctggctgctgatatgggtaaacttcgtgagtatggagttttctcttaccgacccgaggttggaaccacacaagtgggaaaagtactgtgttcttgaaataggggacatgctcctggaccttttgggacagcggtg

SEQ ID NO: 425292 - DNA, 140 bp, Artificial Sequence
  Synthetic
caccgctgtcccaaaaggtccaggagcatgtcccctatttcaagaacacagtacttttcccacttgtgtggttccaacctcgggtcggtaagagaaaactccatactcacgaagtttacccatatcagcagccagggcct

SEQ ID NO: 425293 - DNA, 140 bp, Artificial Sequence
  Synthetic
aggccctggctgctgatatgcgaactgcaataggccaagtatcaaggcccatgttcctatatgtaagaaccaatgggacttccaaaatcaagatgaaatggggtatggaaatgagacgctgaccttttgggacagcggtg

SEQ ID NO: 425294 - DNA, 140 bp, Artificial Sequence
  Synthetic
caccgctgtcccaaaaggtcagcgtctcatttccataccccatttcatcttgattttggaagtcccattggttcttacatataggaacatgggccttgatacttggcctattgcagttcgcatatcagcagccagggcct

SEQ ID NO: 425295 - DNA, 140 bp, Artificial Sequence
  Synthetic
aggccctggctgctgatatgtcaaatatattcaatatggagagaataaaagaactaagagatctaatgtcgcagtcccgcactcgcgagatactcactaagaccactgtggaccatatgggaccttttgggacagcggtg

SEQ ID NO: 425296 - DNA, 140 bp, Artificial Sequence
  Synthetic
caccgctgtcccaaaaggtcccatatggtccacagtggtcttagtgagtatctcgcgagtgcgggactgcgacattagatctcttagttcttttattctctccatattgaatatatttgacatatcagcagccagggcct

SEQ ID NO: 425297 - DNA, 140 bp, Artificial Sequence
  Synthetic
aggccctggctgctgatatgatggatgtcaatccgactttactcttcttgaaagtaccagcgcagaatgctataagcaccacattcccttatactggagatcctccatacagccatggaagaccttttgggacagcggtg

SEQ ID NO: 425298 - DNA, 140 bp, Artificial Sequence
  Synthetic
caccgctgtcccaaaaggtcttccatggctgtatggaggatctccagtataagggaatgtggtgcttatagcattctgcgctggtactttcaagaagagtaaagtcggattgacatccatcatatcagcagccagggcct

SEQ ID NO: 425299 - DNA, 140 bp, Artificial Sequence
  Synthetic
aggccctggctgctgatatgcaggaacagggtacaccatggacacagtcaacaggacacatcaatactcagaaaaaggaaggtggacaacaaacacagagactggagcaccccaactcaagaccttttgggacagcggtg

SEQ ID NO: 425300 - DNA, 140 bp, Artificial Sequence
  Synthetic
caccgctgtcccaaaaggtcttgagttggggtgctccagtctctgtgtttgttgtccaccttcctttttctgagtattgatgtgtcctgttgactgtgtccatggtgtaccctgttcctgcatatcagcagccagggcct

SEQ ID NO: 425301 - DNA, 140 bp, Artificial Sequence
  Synthetic
aggccctggctgctgatatgtaccaccaacccactaatcaggcatgaaaacaggatggtgctagccagcactacagctaaagctatggagcagatggctgggtcaagtgagcaagcagcggaccttttgggacagcggtg

SEQ ID NO: 425302 - DNA, 140 bp, Artificial Sequence
  Synthetic
caccgctgtcccaaaaggtccgctgcttgctcacttgacccagccatctgctccatagctttagctgtagtgctggctagcaccatcctgttttcatgcctgattagtgggttggtggtacatatcagcagccagggcct

SEQ ID NO: 425303 - DNA, 140 bp, Artificial Sequence
  Synthetic
aggccctggctgctgatatgaaacagattgtgtgttggaagcaatggctttccttgaagaatcccacccaggaatctttgaaaactcatgtcttgagacgatggaggttgttcagcaaacgaccttttgggacagcggtg

SEQ ID NO: 425304 - DNA, 140 bp, Artificial Sequence
  Synthetic
caccgctgtcccaaaaggtcgtttgctgaacaacctccatcgtctcaagacatgagttttcaaagattcctgggtgggattcttcaaggaaagccattgcttccaacacacaatctgtttcatatcagcagccagggcct

SEQ ID NO: 425305 - DNA, 140 bp, Artificial Sequence
  Synthetic
atacgccatgctgggtctccttgctgatggatgctctgaaactaagtattgaagacccgagtcatgaaggggaaggaataccactatatgatgcaatcaagtgcatgaagacattttttgcgtacttgggagtcggccat

SEQ ID NO: 425306 - DNA, 140 bp, Artificial Sequence
  Synthetic
atggccgactcccaagtacgcaaaaaatgtcttcatgcacttgattgcatcatatagtggtattccttccccttcatgactcgggtcttcaatacttagtttcagagcatccatcagcaaggagacccagcatggcgtat

SEQ ID NO: 425307 - DNA, 140 bp, Artificial Sequence
  Synthetic
atacgccatgctgggtctccatgaatccaaatcagaaaataatagccattggctctatatcattgggattggttgtattcaatgttctattgcatgtcgtaagcatcatagtaacagtatcgtacttgggagtcggccat

SEQ ID NO: 425308 - DNA, 140 bp, Artificial Sequence
  Synthetic
atggccgactcccaagtacgatactgttactatgatgcttacgacatgcaatagaacattgaatacaaccaatcccaatgatatagagccaatggctattattttctgatttggattcatggagacccagcatggcgtat

SEQ ID NO: 425309 - DNA, 140 bp, Artificial Sequence
  Synthetic
aggccctggctgctgatatgggttgtattcaatgttctattgcatgtcgtaagcatcatagtaacagtattagtccttaggggaggcggcaacaatgggatttgtaacgagacggtagtagaccttttgggacagcggtg

SEQ ID NO: 425310 - DNA, 140 bp, Artificial Sequence
  Synthetic
caccgctgtcccaaaaggtctactaccgtctcgttacaaatcccattgttgccgcctcccctaaggactaatactgttactatgatgcttacgacatgcaatagaacattgaatacaacccatatcagcagccagggcct

SEQ ID NO: 425311 - DNA, 140 bp, Artificial Sequence
  Synthetic
aggccctggctgctgatatgaaatgaagagaagatcccaaagacaaagaacatgaagagaacaagccaattgaagtgggcacttggtgagaatatggcaccagagaaagtagattttgatgaccttttgggacagcggtg

SEQ ID NO: 425312 - DNA, 140 bp, Artificial Sequence
  Synthetic
caccgctgtcccaaaaggtcatcaaaatctactttctctggtgccatattctcaccaagtgcccacttcaattggcttgttctcttcatgttctttgtctttgggatcttctcttcatttcatatcagcagccagggcct

SEQ ID NO: 425313 - DNA, 140 bp, Artificial Sequence
  Synthetic
atacgccatgctgggtctccacatattcatcatcaatgatgtgggaaatcaacggtcctgaatcagtgcttgttaacacctatcaatggatcatcagaaattgggagactgtgaagattccgtacttgggagtcggccat

SEQ ID NO: 425314 - DNA, 140 bp, Artificial Sequence
  Synthetic
atggccgactcccaagtacggaatcttcacagtctcccaatttctgatgatccattgataggtgttaacaagcactgattcaggaccgttgatttcccacatcattgatgatgaatatgtggagacccagcatggcgtat

SEQ ID NO: 425315 - DNA, 140 bp, Artificial Sequence
  Synthetic
aggccctggctgctgatatgcttaataagagcactgacactaaacacaatgaccaaagatgcagaaagaggcaaattgaaaagacgggcaattgcaacactcgggatgcaaatcagaggggaccttttgggacagcggtg

SEQ ID NO: 425316 - DNA, 140 bp, Artificial Sequence
  Synthetic
caccgctgtcccaaaaggtcccctctgatttgcatcccgagtgttgcaattgcccgtcttttcaatttgcctctttctgcatctttggtcattgtgtttagtgtcagtgctcttattaagcatatcagcagccagggcct

SEQ ID NO: 425317 - DNA, 140 bp, Artificial Sequence
  Synthetic
atacgccatgctgggtctccataacacagaagcaatatgtgatgtcaagggctttgcacctttctccaaggacaatggaataagaattggttccagagggcatgtctttgtcataagggacgtacttgggagtcggccat

SEQ ID NO: 425318 - DNA, 140 bp, Artificial Sequence
  Synthetic
atggccgactcccaagtacgtcccttatgacaaagacatgccctctggaaccaattcttattccattgtccttggagaaaggtgcaaagcccttgacatcacatattgcttctgtgttatggagacccagcatggcgtat

SEQ ID NO: 425319 - DNA, 140 bp, Artificial Sequence
  Synthetic
aggccctggctgctgatatggacaatggaataagaattggttccagagggcatgtctttgtcataagggagcctttcgtttcttgttcgcccacggaatgcagaactttcttcctcactcgaccttttgggacagcggtg

SEQ ID NO: 425320 - DNA, 140 bp, Artificial Sequence
  Synthetic
caccgctgtcccaaaaggtcgagtgaggaagaaagttctgcattccgtgggcgaacaagaaacgaaaggctcccttatgacaaagacatgccctctggaaccaattcttattccattgtccatatcagcagccagggcct

SEQ ID NO: 425321 - DNA, 140 bp, Artificial Sequence
  Synthetic
atacgccatgctgggtctccgccccgattgaacacatcgcaagcatgaggaggaactattttacagcagaagtgtcccattgcagggctactgaatacataatgaagggagtgtacataacgtacttgggagtcggccat

SEQ ID NO: 425322 - DNA, 140 bp, Artificial Sequence
  Synthetic
atggccgactcccaagtacgttatgtacactcccttcattatgtattcagtagccctgcaatgggacacttctgctgtaaaatagttcctcctcatgcttgcgatgtgttcaatcggggcggagacccagcatggcgtat

SEQ ID NO: 425323 - DNA, 140 bp, Artificial Sequence
  Synthetic
atacgccatgctgggtctccatgtcgtgaggaagatgatgacaaactcacaagatacagagctctcctttacaattactggagacaacaccaaatggaatgagaatcaaaatcctcgaatcgtacttgggagtcggccat

SEQ ID NO: 425324 - DNA, 140 bp, Artificial Sequence
  Synthetic
atggccgactcccaagtacgattcgaggattttgattctcattccatttggtgttgtctccagtaattgtaaaggagagctctgtatcttgtgagtttgtcatcatcttcctcacgacatggagacccagcatggcgtat

SEQ ID NO: 425325 - DNA, 140 bp, Artificial Sequence
  Synthetic
atacgccatgctgggtctcccatgaagagaacaagccaattgaagtgggcactcggtgaaaatatggcaccagaaaaagtagactttgatgactgcaaagatgttggagaccttaaacagcgtacttgggagtcggccat

SEQ ID NO: 425326 - DNA, 140 bp, Artificial Sequence
  Synthetic
atggccgactcccaagtacgctgtttaaggtctccaacatctttgcagtcatcaaagtctactttttctggtgccatattttcaccgagtgcccacttcaattggcttgttctcttcatgggagacccagcatggcgtat

SEQ ID NO: 425327 - DNA, 140 bp, Artificial Sequence
  Synthetic
aggccctggctgctgatatggtttctggcaatgataacatatatcacaagaaaccagcctgaatggtttagaaatgtcttgagcatcgctcctataatgttctcaaacaaaatggcaagagaccttttgggacagcggtg

SEQ ID NO: 425328 - DNA, 140 bp, Artificial Sequence
  Synthetic
caccgctgtcccaaaaggtctcttgccattttgtttgagaacattataggagcgatgctcaagacatttctaaaccattcaggctggtttcttgtgatatatgttatcattgccagaaaccatatcagcagccagggcct

SEQ ID NO: 425329 - DNA, 140 bp, Artificial Sequence
  Synthetic
atacgccatgctgggtctccagcaaaagcaggggaaaataaaagcaatcaaaatgaaggcaatactagtagtcctgctgtatacatttacaaccgcaaatgccgacacactatgtataggcgtacttgggagtcggccat

SEQ ID NO: 425330 - DNA, 140 bp, Artificial Sequence
  Synthetic
atggccgactcccaagtacgcctatacatagtgtgtcggcatttgcggttgtaaatgtatacagcaggactactagtattgccttcattttgattgcttttattttcccctgcttttgctggagacccagcatggcgtat

SEQ ID NO: 425331 - DNA, 140 bp, Artificial Sequence
  Synthetic
aggccctggctgctgatatgagtaccagcagaaatgcttgcaaacattgacttgaaatatttcaatgaatcaacgagaaagaaaatcgagaaaataagacctctattaatagatggcacagaccttttgggacagcggtg

SEQ ID NO: 425332 - DNA, 140 bp, Artificial Sequence
  Synthetic
caccgctgtcccaaaaggtctgtgccatctattaatagaggtcttattttctcgattttctttctcgttgattcattgaaatatttcaagtcaatgtttgcaagcatttctgctggtactcatatcagcagccagggcct

SEQ ID NO: 425333 - DNA, 140 bp, Artificial Sequence
  Synthetic
atacgccatgctgggtctccttcgcttggagaagcagtaatgaggatgggggacctccactccttccaaaacagaaacggaaaatggcgagaacaattaagtcagaagtttgaggaaatacgtacttgggagtcggccat

SEQ ID NO: 425334 - DNA, 140 bp, Artificial Sequence
  Synthetic
atggccgactcccaagtacgtatttcctcaaacttctgacttaattgttctcgccattttccgtttctgttttggaaggagtggaggtcccccatcctcattactgcttctccaagcgaaggagacccagcatggcgtat

SEQ ID NO: 425335 - DNA, 140 bp, Artificial Sequence
  Synthetic
aggccctggctgctgatatggcctcattgagccctggaatgatgatgggtatgttcaacatgctgagtacagttttaggagtctcaatcctgaatcttggacaaaagaagtacacaaaaagaccttttgggacagcggtg

SEQ ID NO: 425336 - DNA, 140 bp, Artificial Sequence
  Synthetic
caccgctgtcccaaaaggtctttttgtgtacttcttttgtccaagattcaggattgagactcctaaaactgtactcagcatgttgaacatacccatcatcattccagggctcaatgaggccatatcagcagccagggcct

SEQ ID NO: 425337 - DNA, 140 bp, Artificial Sequence
  Synthetic
atacgccatgctgggtctccggaaagtggaatgtgtgtgtagggataattggacagggactaacagaccagttctggttatctcgcctgatctctcttacagagttgggtacttatgtgccgtacttgggagtcggccat

SEQ ID NO: 425338 - DNA, 140 bp, Artificial Sequence
  Synthetic
atggccgactcccaagtacggcacataagtacccaactctgtaagagagatcaggcgagataaccagaactggtctgttagtccctgtccaattatccctacacacacattccactttccggagacccagcatggcgtat

SEQ ID NO: 425339 - DNA, 140 bp, Artificial Sequence
  Synthetic
aggccctggctgctgatatggttctggttatctcgcctgatctctcttacagagttgggtacttatgtgcggggctgcccagtgatactccaagaggggaggatgctcaatttactggttgaccttttgggacagcggtg

SEQ ID NO: 425340 - DNA, 140 bp, Artificial Sequence
  Synthetic
caccgctgtcccaaaaggtcaaccagtaaattgagcatcctcccctcttggagtatcactgggcagccccgcacataagtacccaactctgtaagagagatcaggcgagataaccagaaccatatcagcagccagggcct

SEQ ID NO: 425341 - DNA, 140 bp, Artificial Sequence
  Synthetic
atacgccatgctgggtctcccagacaaagaatccactcaaaaggctatagatggagtcaccaataaggtcaactcgatcattgacaaaatgaacactcagtttgaggctgttgggagggacgtacttgggagtcggccat

SEQ ID NO: 425342 - DNA, 140 bp, Artificial Sequence
  Synthetic
atggccgactcccaagtacgtccctcccaacagcctcaaactgagtgttcattttgtcaatgatcgagttgaccttattggtgactccatctatagccttttgagtggattctttgtctgggagacccagcatggcgtat

SEQ ID NO: 425343 - DNA, 140 bp, Artificial Sequence
  Synthetic
aggccctggctgctgatatgtaaatcggacaggaacatttgagttcacaagtttcttctaccgttatgggttcgtagccaatttcagcatggagctgcccagctttggggtgtctgggatgaccttttgggacagcggtg

SEQ ID NO: 425344 - DNA, 140 bp, Artificial Sequence
  Synthetic
caccgctgtcccaaaaggtcatcccagacaccccaaagctgggcagctccatgctgaaattggctacgaacccataacggtagaagaaacttgtgaactcaaatgttcctgtccgatttacatatcagcagccagggcct

SEQ ID NO: 425345 - DNA, 140 bp, Artificial Sequence
  Synthetic
atacgccatgctgggtctccgggacaaacagcttctacagaaatttaatatggctagtaaaaaagggaaattcatacccaaagatcaacaaatcctacattaacaataaagagaaggaagcgtacttgggagtcggccat

SEQ ID NO: 425346 - DNA, 140 bp, Artificial Sequence
  Synthetic
atggccgactcccaagtacgcttccttctctttattgttaatgtaggatttgttgatctttgggtatgaatttcccttttttactagccatattaaatttctgtagaagctgtttgtcccggagacccagcatggcgtat

SEQ ID NO: 425347 - DNA, 140 bp, Artificial Sequence
  Synthetic
aggccctggctgctgatatgagcgcaaaatgccataagcaccacattcccttatactggagatcctccatacagccatggaacaggaacaggatacaccatggacacagtcaacagaacagaccttttgggacagcggtg

SEQ ID NO: 425348 - DNA, 140 bp, Artificial Sequence
  Synthetic
caccgctgtcccaaaaggtctgttctgttgactgtgtccatggtgtatcctgttcctgttccatggctgtatggaggatctccagtataagggaatgtggtgcttatggcattttgcgctcatatcagcagccagggcct

SEQ ID NO: 425349 - DNA, 140 bp, Artificial Sequence
  Synthetic
aggccctggctgctgatatgtgataaacaacgaccttggaccagcaacagctcaaatggccctccagctattcatcaaagactacaggtacacataccggtgccacaggggtgatacacagaccttttgggacagcggtg

SEQ ID NO: 425350 - DNA, 140 bp, Artificial Sequence
  Synthetic
caccgctgtcccaaaaggtctgtgtatcacccctgtggcaccggtatgtgtacctgtagtctttgatgaatagctggagggccatttgagctgttgctggtccaaggtcgttgtttatcacatatcagcagccagggcct

SEQ ID NO: 425351 - DNA, 140 bp, Artificial Sequence
  Synthetic
atacgccatgctgggtctccttcatcaaagactacaggtacacataccggtgccacaggggtgatacacaaattcaaacaaggagatcgttcgagctgaagaaattgtgggagcagaccccgtacttgggagtcggccat

SEQ ID NO: 425352 - DNA, 140 bp, Artificial Sequence
  Synthetic
atggccgactcccaagtacggggtctgctcccacaatttcttcagctcgaacgatctccttgtttgaatttgtgtatcacccctgtggcaccggtatgtgtacctgtagtctttgatgaaggagacccagcatggcgtat

SEQ ID NO: 425353 - DNA, 140 bp, Artificial Sequence
  Synthetic
atacgccatgctgggtctcccttagttccttgtttttgggttgaaatgatcagaggcaagccagaggaaaaaacaatctggacttccagtagctccattgtaatgtgtggagttgatgatcgtacttgggagtcggccat

SEQ ID NO: 425354 - DNA, 140 bp, Artificial Sequence
  Synthetic
atggccgactcccaagtacgatcatcaactccacacattacaatggagctactggaagtccagattgttttttcctctggcttgcctctgatcatttcaacccaaaaacaaggaactaagggagacccagcatggcgtat

SEQ ID NO: 425355 - DNA, 140 bp, Artificial Sequence
  Synthetic
aggccctggctgctgatatgaaacaatctggacttccagtagctccattgtaatgtgtggagttgatgatgaagttgccgattggtcgtggcacgacggagctattcttccctttgacatgaccttttgggacagcggtg

SEQ ID NO: 425356 - DNA, 140 bp, Artificial Sequence
  Synthetic
caccgctgtcccaaaaggtcatgtcaaagggaagaatagctccgtcgtgccacgaccaatcggcaacttcatcatcaactccacacattacaatggagctactggaagtccagattgtttcatatcagcagccagggcct

SEQ ID NO: 425357 - DNA, 140 bp, Artificial Sequence
  Synthetic
aggccctggctgctgatatgatccggaatctccacattccagaggtctgcctgaagtgggagctaatggatgaagattaccaaggtagactgtgtaatcctctgaatccatttgtcagtcgaccttttgggacagcggtg

SEQ ID NO: 425358 - DNA, 140 bp, Artificial Sequence
  Synthetic
caccgctgtcccaaaaggtcgactgacaaatggattcagaggattacacagtctaccttggtaatcttcatccattagctcccacttcaggcagacctctggaatgtggagattccggatcatatcagcagccagggcct

SEQ ID NO: 425359 - DNA, 140 bp, Artificial Sequence
  Synthetic
atacgccatgctgggtctcctaagaggagttatttaataagagcactaacattgaatacgatgaccaaagatgcagagagaggcaaattaaaaagaagggctattgcaacacctggaatgcgtacttgggagtcggccat

SEQ ID NO: 425360 - DNA, 140 bp, Artificial Sequence
  Synthetic
atggccgactcccaagtacgcattccaggtgttgcaatagcccttctttttaatttgcctctctctgcatctttggtcatcgtattcaatgttagtgctcttattaaataactcctcttaggagacccagcatggcgtat

SEQ ID NO: 425361 - DNA, 140 bp, Artificial Sequence
  Synthetic
aggccctggctgctgatatgccagccaagagtatggaatatgatgcagttgcaactacacactcatggatccccaaaagaaaccgttccattctcaacaccagtcagagaggaatccttggaccttttgggacagcggtg

SEQ ID NO: 425362 - DNA, 140 bp, Artificial Sequence
  Synthetic
caccgctgtcccaaaaggtccaaggattcctctctgactggtgttgagaatggaacggtttcttttggggatccatgagtgtgtagttgcaactgcatcatattccatactcttggctggcatatcagcagccagggcct

SEQ ID NO: 425363 - DNA, 140 bp, Artificial Sequence
  Synthetic
atacgccatgctgggtctccgggtggacaggaatgatagatggatggtacggttatcaccatcaaaatgagcagggatcaggatatgcagccgacctgaagagcacacagaatgccattgcgtacttgggagtcggccat

SEQ ID NO: 425364 - DNA, 140 bp, Artificial Sequence
  Synthetic
atggccgactcccaagtacgcaatggcattctgtgtgctcttcaggtcggctgcatatcctgatccctgctcattttgatggtgataaccgtaccatccatctatcattcctgtccacccggagacccagcatggcgtat

SEQ ID NO: 425365 - DNA, 140 bp, Artificial Sequence
  Synthetic
aggccctggctgctgatatggggatcagtggctcacaaatcctgcttgcctgcttgtgtgtatggacttgctgtagcaagcgggtacgattttgaaagagagggatattccttggtcggagaccttttgggacagcggtg

SEQ ID NO: 425366 - DNA, 140 bp, Artificial Sequence
  Synthetic
caccgctgtcccaaaaggtctccgaccaaggaatatccctctctttcaaaatcgtacccgcttgctacagcaagtccatacacacaagcaggcaagcaggatttgtgagccactgatccccatatcagcagccagggcct

SEQ ID NO: 425367 - DNA, 140 bp, Artificial Sequence
  Synthetic
aggccctggctgctgatatgacggattgatttcgagtctggaaggattaagaaagaagaatttgctgagatcatgaagatctgttccaccattgaagagctcagacggcaacaacagtgagaccttttgggacagcggtg

SEQ ID NO: 425368 - DNA, 140 bp, Artificial Sequence
  Synthetic
caccgctgtcccaaaaggtctcactgttgttgccgtctgagctcttcaatggtggaacagatcttcatgatctcagcaaattcttctttcttaatccttccagactcgaaatcaatccgtcatatcagcagccagggcct

SEQ ID NO: 425369 - DNA, 140 bp, Artificial Sequence
  Synthetic
aggccctggctgctgatatgatcaacaaggatttaccaaattttggcgatctattcaacggtcgccagttcattggtactggtagtctccctgggggcaatcagtttctggatgtgctctgaccttttgggacagcggtg

SEQ ID NO: 425370 - DNA, 140 bp, Artificial Sequence
  Synthetic
caccgctgtcccaaaaggtcagagcacatccagaaactgattgcccccagggagactaccagtaccaatgaactggcgaccgttgaatagatcgccaaaatttggtaaatccttgttgatcatatcagcagccagggcct

SEQ ID NO: 425371 - DNA, 140 bp, Artificial Sequence
  Synthetic
aggccctggctgctgatatgtatggagagaataaaagaactaagagatctaatgtcacagtctcgcactcgcgagatactcaccaaaaccactgtggaccacatggccataatcaaaaaggaccttttgggacagcggtg

SEQ ID NO: 425372 - DNA, 140 bp, Artificial Sequence
  Synthetic
caccgctgtcccaaaaggtcctttttgattatggccatgtggtccacagtggttttggtgagtatctcgcgagtgcgagactgtgacattagatctcttagttcttttattctctccatacatatcagcagccagggcct

SEQ ID NO: 425373 - DNA, 140 bp, Artificial Sequence
  Synthetic
atacgccatgctgggtctccaggaatggaccgacaacaagtacagtccattatccgaaggtttacaaaacatattttgagaaggttgaaaggttgaaacatggaacttttggtcccgttccgtacttgggagtcggccat

SEQ ID NO: 425374 - DNA, 140 bp, Artificial Sequence
  Synthetic
atggccgactcccaagtacggaacgggaccaaaagttccatgtttcaacctttcaaccttctcaaaatatgttttgtaaaccttcggataatggactgtacttgttgtcggtccattcctggagacccagcatggcgtat

SEQ ID NO: 425375 - DNA, 140 bp, Artificial Sequence
  Synthetic
aggccctggctgctgatatgatattttgagaaggttgaaaggttgaaacatggaacttttggtcccgttcatttccggaatcaagttaagatacgccgccgagtggatataaacccgggcgaccttttgggacagcggtg

SEQ ID NO: 425376 - DNA, 140 bp, Artificial Sequence
  Synthetic
caccgctgtcccaaaaggtcgcccgggtttatatccactcggcggcgtatcttaacttgattccggaaatgaacgggaccaaaagttccatgtttcaacctttcaaccttctcaaaatatcatatcagcagccagggcct

SEQ ID NO: 425377 - DNA, 140 bp, Artificial Sequence
  Synthetic
aggccctggctgctgatatgagcaacaggagtaacactatcggtagtaagcctgctaataggaatcgccaatttgggcctaaatatcggactacactacaaagtgagtgattcaacaactgaccttttgggacagcggtg

SEQ ID NO: 425378 - DNA, 140 bp, Artificial Sequence
  Synthetic
caccgctgtcccaaaaggtcagttgttgaatcactcactttgtagtgtagtccgatatttaggcccaaattggcgattcctattagcaggcttactaccgatagtgttactcctgttgctcatatcagcagccagggcct

SEQ ID NO: 425379 - DNA, 140 bp, Artificial Sequence
  Synthetic
atacgccatgctgggtctccttttccaaatgaagtgggagctaggatattgacatcagaatcgcaattgacaataacaaaagagaagaaagaagagctccatgattgtaagattgctcctcgtacttgggagtcggccat

SEQ ID NO: 425380 - DNA, 140 bp, Artificial Sequence
  Synthetic
atggccgactcccaagtacgaggagcaatcttacaatcatggagctcttctttcttctcttttgttattgtcaattgcgattctgatgtcaatatcctagctcccacttcatttggaaaaggagacccagcatggcgtat

SEQ ID NO: 425381 - DNA, 140 bp, Artificial Sequence
  Synthetic
aggccctggctgctgatatgcaataacaaaagagaagaaagaagagctccatgattgtaagattgctcctttaatggtggcatacatgctggaaagagaactggtccgcaaaactagattgaccttttgggacagcggtg

SEQ ID NO: 425382 - DNA, 140 bp, Artificial Sequence
  Synthetic
caccgctgtcccaaaaggtcaatctagttttgcggaccagttctctttccagcatgtatgccaccattaaaggagcaatcttacaatcatggagctcttctttcttctcttttgttattgcatatcagcagccagggcct

SEQ ID NO: 425383 - DNA, 140 bp, Artificial Sequence
  Synthetic
aggccctggctgctgatatgattctgcagcatttgaggacctgagagtttcaagtttcatcagaggaacaagagtgattccaagaggacaactgtctaccagaggaattcaaattgcttcgaccttttgggacagcggtg

SEQ ID NO: 425384 - DNA, 140 bp, Artificial Sequence
  Synthetic
caccgctgtcccaaaaggtcgaagcaatttgaattcctctggtagacagttgtcctcttggaatcactcttgttcctctgatgaaacttgaaactctcaggtcctcaaatgctgcagaatcatatcagcagccagggcct

SEQ ID NO: 425385 - DNA, 140 bp, Artificial Sequence
  Synthetic
atacgccatgctgggtctcctgacccaagggacctgttgggaacaaatgtacactcctggtggagaagtgagaaatgatgatgttgatcagagtttgatcatcgctgccagaaacattgtcgtacttgggagtcggccat

SEQ ID NO: 425386 - DNA, 140 bp, Artificial Sequence
  Synthetic
atggccgactcccaagtacgacaatgtttctggcagcgatgatcaaactctgatcaacatcatcatttctcacttctccaccaggagtgtacatttgttcccaacaggtcccttgggtcaggagacccagcatggcgtat

SEQ ID NO: 425387 - DNA, 140 bp, Artificial Sequence
  Synthetic
atacgccatgctgggtctccgatattgggctataagaaccaggagtggaggaaacaccaaccagcagagagcatctgcaggacaaatcagtgtgcagcctactttctcagtgcagagaaacgtacttgggagtcggccat

SEQ ID NO: 425388 - DNA, 140 bp, Artificial Sequence
  Synthetic
atggccgactcccaagtacgtttctctgcactgagaaagtaggctgcacactgatttgtcctgcagatgctctctgctggttggtgtttcctccactcctggttcttatagcccaatatcggagacccagcatggcgtat

SEQ ID NO: 425389 - DNA, 140 bp, Artificial Sequence
  Synthetic
aggccctggctgctgatatgctctacagagattcacttggagaagcagtaatgaggatgggagaccttcactcccttcaaaacagaaacggaaaatggcgagaacaattgagtcagaagtgaccttttgggacagcggtg

SEQ ID NO: 425390 - DNA, 140 bp, Artificial Sequence
  Synthetic
caccgctgtcccaaaaggtcacttctgactcaattgttctcgccattttccgtttctgttttgaagggagtgaaggtctcccatcctcattactgcttctccaagtgaatctctgtagagcatatcagcagccagggcct

SEQ ID NO: 425391 - DNA, 140 bp, Artificial Sequence
  Synthetic
atacgccatgctgggtctccaatcccaccgaggaacaagctgtggatatatgcaaagcagcaatgggcttgaggatcagttcatcctttagctttggaggcttcactttcaaaaggacaacgtacttgggagtcggccat

SEQ ID NO: 425392 - DNA, 140 bp, Artificial Sequence
  Synthetic
atggccgactcccaagtacgttgtccttttgaaagtgaagcctccaaagctaaaggatgaactgatcctcaagcccattgctgctttgcatatatccacagcttgttcctcggtgggattggagacccagcatggcgtat

SEQ ID NO: 425393 - DNA, 140 bp, Artificial Sequence
  Synthetic
aggccctggctgctgatatggaggatcagttcatcctttagctttggaggcttcactttcaaaaggacaagtgggtcatccgtaaagaaggaagaagaagtgcttacaggcaacctccaagaccttttgggacagcggtg

SEQ ID NO: 425394 - DNA, 140 bp, Artificial Sequence
  Synthetic
caccgctgtcccaaaaggtcttggaggttgcctgtaagcacttcttcttccttctttacggatgacccacttgtccttttgaaagtgaagcctccaaagctaaaggatgaactgatcctccatatcagcagccagggcct

SEQ ID NO: 425395 - DNA, 140 bp, Artificial Sequence
  Synthetic
atacgccatgctgggtctccatgttgtgagaaaaatgatgactaattcacaagacacagaactctctttcacaatcactggagacaacaccaaatggaatgaaaatcagaaccctaggatcgtacttgggagtcggccat

SEQ ID NO: 425396 - DNA, 140 bp, Artificial Sequence
  Synthetic
atggccgactcccaagtacgatcctagggttctgattttcattccatttggtgttgtctccagtgattgtgaaagagagttctgtgtcttgtgaattagtcatcatttttctcacaacatggagacccagcatggcgtat

SEQ ID NO: 425397 - DNA, 140 bp, Artificial Sequence
  Synthetic
atacgccatgctgggtctccgcggagagcaacagctattctgagaaaagcaactagaaggttgattcaattgatagtaagtggaagggatgagcaatcaatcgctgaagcgatcattgtacgtacttgggagtcggccat

SEQ ID NO: 425398 - DNA, 140 bp, Artificial Sequence
  Synthetic
atggccgactcccaagtacgtacaatgatcgcttcagcgattgattgctcatcccttccacttactatcaattgaatcaaccttctagttgcttttctcagaatagctgttgctctccgcggagacccagcatggcgtat

SEQ ID NO: 425399 - DNA, 140 bp, Artificial Sequence
  Synthetic
aggccctggctgctgatatgtgatagtaagtggaagggatgagcaatcaatcgctgaagcgatcattgtagcaatggtgttctcacaggaggattgcatgataaaggcagtccgaggcgagaccttttgggacagcggtg

SEQ ID NO: 425400 - DNA, 140 bp, Artificial Sequence
  Synthetic
caccgctgtcccaaaaggtctcgcctcggactgcctttatcatgcaatcctcctgtgagaacaccattgctacaatgatcgcttcagcgattgattgctcatcccttccacttactatcacatatcagcagccagggcct

SEQ ID NO: 425401 - DNA, 140 bp, Artificial Sequence
  Synthetic
aggccctggctgctgatatggaaccaatggaacctccaagatcaagatgaaatggggcatggaaatgaggcgctgccttcttcagtctcttcagcagatcgagagcatgatcgaggccgagaccttttgggacagcggtg

SEQ ID NO: 425402 - DNA, 140 bp, Artificial Sequence
  Synthetic
caccgctgtcccaaaaggtctcggcctcgatcatgctctcgatctgctgaagagactgaagaaggcagcgcctcatttccatgccccatttcatcttgatcttggaggttccattggttccatatcagcagccagggcct

SEQ ID NO: 425403 - DNA, 140 bp, Artificial Sequence
  Synthetic
atacgccatgctgggtctccacagtccggactcccagtagggggcaatgaaaagaaagccaaattggcaaacgttgtgagaaagatgatgactaattcacaagacacagagctttctttccgtacttgggagtcggccat

SEQ ID NO: 425404 - DNA, 140 bp, Artificial Sequence
  Synthetic
atggccgactcccaagtacggaaagaaagctctgtgtcttgtgaattagtcatcatctttctcacaacgtttgccaatttggctttcttttcattgccccctactgggagtccggactgtggagacccagcatggcgtat

SEQ ID NO: 425405 - DNA, 140 bp, Artificial Sequence
  Synthetic
atacgccatgctgggtctcctgttgaggcattttcagaaagatgcaaaagtgctgtttcagaactggggagttgaacccattgacaatgtcatggggatgatcgggatattacctgacatcgtacttgggagtcggccat

SEQ ID NO: 425406 - DNA, 140 bp, Artificial Sequence
  Synthetic
atggccgactcccaagtacgatgtcaggtaatatcccgatcatccccatgacattgtcaatgggttcaactccccagttctgaaacagcacttttgcatctttctgaaaatgcctcaacaggagacccagcatggcgtat

SEQ ID NO: 425407 - DNA, 140 bp, Artificial Sequence
  Synthetic
aggccctggctgctgatatggacctctttgtggaacgaagcaatgctttcagcaattgctatccttatgatgtaccagattatgcatcccttcgatccctagttgcatcatcaggcacatgaccttttgggacagcggtg

SEQ ID NO: 425408 - DNA, 140 bp, Artificial Sequence
  Synthetic
caccgctgtcccaaaaggtcatgtgcctgatgatgcaactagggatcgaagggatgcataatctggtacatcataaggatagcaattgctgaaagcattgcttcgttccacaaagaggtccatatcagcagccagggcct

SEQ ID NO: 425409 - DNA, 140 bp, Artificial Sequence
  Synthetic
atacgccatgctgggtctcctagagcaagaatcaagactagactattcactatcaggcaggaaatggccattagggccctatgggactcctttcgtcaatccgaaaagggcgaagagacacgtacttgggagtcggccat

SEQ ID NO: 425410 - DNA, 140 bp, Artificial Sequence
  Synthetic
atggccgactcccaagtacgtgtctcttcgcccttttcggattgacgaaaggagtcccatagggccctaatggccatttcctgcctgatagtgaatagtctagtcttgattcttgctctaggagacccagcatggcgtat

SEQ ID NO: 425411 - DNA, 140 bp, Artificial Sequence
  Synthetic
atacgccatgctgggtctccgggagtggtgcttgcaaaaggggacctgctaatggtttcttcagtaggctgaactggttaactaagtcaggaaatgcatatccagtgttgaacgttactacgtacttgggagtcggccat

SEQ ID NO: 425412 - DNA, 140 bp, Artificial Sequence
  Synthetic
atggccgactcccaagtacgtagtaacgttcaacactggatatgcatttcctgacttagttaaccagttcagcctactgaagaaaccattagcaggtccccttttgcaagcaccactcccggagacccagcatggcgtat

SEQ ID NO: 425413 - DNA, 140 bp, Artificial Sequence
  Synthetic
aggccctggctgctgatatggaactggttaactaagtcaggaaatgcatatccagtgttgaacgttactatgccaaataatgacaattttgacaaactgtacatctggggagtccatcatgaccttttgggacagcggtg

SEQ ID NO: 425414 - DNA, 140 bp, Artificial Sequence
  Synthetic
caccgctgtcccaaaaggtcatgatggactccccagatgtacagtttgtcaaaattgtcattatttggcatagtaacgttcaacactggatatgcatttcctgacttagttaaccagttccatatcagcagccagggcct

SEQ ID NO: 425415 - DNA, 140 bp, Artificial Sequence
  Synthetic
atacgccatgctgggtctccccatgatgtgggaaatcaacggccctgaatcagtgcttgtcaacacttaccagtggatcatcaggaattgggagactgtaaagattcaatggtctcaagacgtacttgggagtcggccat

SEQ ID NO: 425416 - DNA, 140 bp, Artificial Sequence
  Synthetic
atggccgactcccaagtacgtcttgagaccattgaatctttacagtctcccaattcctgatgatccactggtaagtgttgacaagcactgattcagggccgttgatttcccacatcatggggagacccagcatggcgtat

SEQ ID NO: 425417 - DNA, 140 bp, Artificial Sequence
  Synthetic
atacgccatgctgggtctccacgatggaaaagcatggcttcatgtttgtgtcactgggcatgatgcaaatgcaactgctagcgtcatttacaatgggagacttgtagatagcattggttccgtacttgggagtcggccat

SEQ ID NO: 425418 - DNA, 140 bp, Artificial Sequence
  Synthetic
atggccgactcccaagtacggaaccaatgctatctacaagtctcccattgtaaatgacgctagcagttgcatttgcatcatgcccagtgacacaaacatgaagccatgcttttccatcgtggagacccagcatggcgtat

SEQ ID NO: 425419 - DNA, 140 bp, Artificial Sequence
  Synthetic
atacgccatgctgggtctccagtcacagtctctaccaggagaagccaacagactataatcccgaatattggatccagaccctgggtaaggggccagtctggcagaataagcatctattggcgtacttgggagtcggccat

SEQ ID NO: 425420 - DNA, 140 bp, Artificial Sequence
  Synthetic
atggccgactcccaagtacgccaatagatgcttattctgccagactggccccttacccagggtctggatccaatattcgggattatagtctgttggcttctcctggtagagactgtgactggagacccagcatggcgtat

SEQ ID NO: 425421 - DNA, 140 bp, Artificial Sequence
  Synthetic
aggccctggctgctgatatggatccagaccctgggtaaggggccagtctggcagaataagcatctattggacaatagtcaaacctggggatgtattggtaatcaatagtaatggaaatttgaccttttgggacagcggtg

SEQ ID NO: 425422 - DNA, 140 bp, Artificial Sequence
  Synthetic
caccgctgtcccaaaaggtcaaatttccattactattgattaccaatacatccccaggtttgactattgtccaatagatgcttattctgccagactggccccttacccagggtctggatccatatcagcagccagggcct

SEQ ID NO: 425423 - DNA, 140 bp, Artificial Sequence
  Synthetic
atacgccatgctgggtctcccaacagatgcgtgatgtcctgggaacgtttgatactgttcaaataataaagctgctaccatttgcagcagccccaccggagcaaagcagaatgcagttttcgtacttgggagtcggccat

SEQ ID NO: 425424 - DNA, 140 bp, Artificial Sequence
  Synthetic
atggccgactcccaagtacgaaaactgcattctgctttgctccggtggggctgctgcaaatggtagcagctttattatttgaacagtatcaaacgttcccaggacatcacgcatctgttgggagacccagcatggcgtat

SEQ ID NO: 425425 - DNA, 140 bp, Artificial Sequence
  Synthetic
aggccctggctgctgatatggctgctaccatttgcagcagccccaccggagcaaagcagaatgcagttttcttctctaactgtgaacgtgagaggttcaggaatgagaatactcgtgagagaccttttgggacagcggtg

SEQ ID NO: 425426 - DNA, 140 bp, Artificial Sequence
  Synthetic
caccgctgtcccaaaaggtctctcacgagtattctcattcctgaacctctcacgttcacagttagagaagaaaactgcattctgctttgctccggtggggctgctgcaaatggtagcagccatatcagcagccagggcct

SEQ ID NO: 425427 - DNA, 140 bp, Artificial Sequence
  Synthetic
atacgccatgctgggtctcctgagatcagatgcacccattgagacttgcatttctgaatgcatcactccgaatggaagcatccccaatgagaagcccttccaaaatgtaaacaaaatcaccgtacttgggagtcggccat

SEQ ID NO: 425428 - DNA, 140 bp, Artificial Sequence
  Synthetic
atggccgactcccaagtacggtgattttgtttacattttggaagggcttctcattggggatgcttccattcggagtgatgcattcagaaatgcaagtctcaatgggtgcatctgatctcaggagacccagcatggcgtat

SEQ ID NO: 425429 - DNA, 140 bp, Artificial Sequence
  Synthetic
aggccctggctgctgatatgaatggaagcatccccaatgagaagcccttccaaaatgtaaacaaaatcacatacggggcatgtcccaaatatgttaagcaaaacaccctgaagttggcaagaccttttgggacagcggtg

SEQ ID NO: 425430 - DNA, 140 bp, Artificial Sequence
  Synthetic
caccgctgtcccaaaaggtcttgccaacttcagggtgttttgcttaacatatttgggacatgccccgtatgtgattttgtttacattttggaagggcttctcattggggatgcttccattcatatcagcagccagggcct

SEQ ID NO: 425431 - DNA, 140 bp, Artificial Sequence
  Synthetic
atacgccatgctgggtctcctggaataggaatggcccaacaacaagcacagttcactaccctaaggtatacaaaacttatttcgaaaaagtcgaaaggttaaaacatggtacctttggcccgtacttgggagtcggccat

SEQ ID NO: 425432 - DNA, 140 bp, Artificial Sequence
  Synthetic
atggccgactcccaagtacgggccaaaggtaccatgttttaacctttcgactttttcgaaataagttttgtataccttagggtagtgaactgtgcttgttgttgggccattcctattccaggagacccagcatggcgtat

SEQ ID NO: 425433 - DNA, 140 bp, Artificial Sequence
  Synthetic
aggccctggctgctgatatggagtcagcaaaatgggggtagatgagtattccagcacggagagagtggtagtgagcattgatcgatttttgagggttcgggatcaacgagggaacatattgaccttttgggacagcggtg

SEQ ID NO: 425434 - DNA, 140 bp, Artificial Sequence
  Synthetic
caccgctgtcccaaaaggtcaatatgttccctcgttgatcccgaaccctcaaaaatcgatcaatgctcactaccactctctccgtgctggaatactcatctacccccattttgctgactccatatcagcagccagggcct

SEQ ID NO: 425435 - DNA, 140 bp, Artificial Sequence
  Synthetic
aggccctggctgctgatatgtggcttcaggcatcaaaattccgaaggtacaggacaagcagcagaccttaaaagcactcaggcggccattgaccaaatcaatggaaaattgaacagagtggaccttttgggacagcggtg

SEQ ID NO: 425436 - DNA, 140 bp, Artificial Sequence
  Synthetic
caccgctgtcccaaaaggtccactctgttcaattttccattgatttggtcaatggccgcctgagtgcttttaaggtctgctgcttgtcctgtaccttcggaattttgatgcctgaagccacatatcagcagccagggcct

SEQ ID NO: 425437 - DNA, 140 bp, Artificial Sequence
  Synthetic
aggccctggctgctgatatgattgtctcccgaagaggtcagcgagacacaaggaactgagaaattgacaataacttactcatcatcaatgatgtgggagatcaatggtcctgagtcagtggaccttttgggacagcggtg

SEQ ID NO: 425438 - DNA, 140 bp, Artificial Sequence
  Synthetic
caccgctgtcccaaaaggtccactgactcaggaccattgatctcccacatcattgatgatgagtaagttattgtcaatttctcagttccttgtgtctcgctgacctcttcgggagacaatcatatcagcagccagggcct

SEQ ID NO: 425439 - DNA, 140 bp, Artificial Sequence
  Synthetic
aggccctggctgctgatatggcaaattgaagaggcgggcaattgcaactcccgggatgcagatcagaggatttgtatattttgtcgaaacactagcgaggagcatctgtgaaaaacttgagaccttttgggacagcggtg

SEQ ID NO: 425440 - DNA, 140 bp, Artificial Sequence
  Synthetic
caccgctgtcccaaaaggtctcaagtttttcacagatgctcctcgctagtgtttcgacaaaatatacaaatcctctgatctgcatcccgggagttgcaattgcccgcctcttcaatttgccatatcagcagccagggcct

SEQ ID NO: 425441 - DNA, 140 bp, Artificial Sequence
  Synthetic
atacgccatgctgggtctccagtggaaggaagaattcaggatcttgagaaatacgttgaagacacaaagatagatctctggtcttacaatgcagaacttcttgttgctttagagaatcagcgtacttgggagtcggccat

SEQ ID NO: 425442 - DNA, 140 bp, Artificial Sequence
  Synthetic
atggccgactcccaagtacgctgattctctaaagcaacaagaagttctgcattgtaagaccagagatctatctttgtgtcttcaacgtatttctcaagatcctgaattcttccttccactggagacccagcatggcgtat

SEQ ID NO: 425443 - DNA, 140 bp, Artificial Sequence
  Synthetic
atacgccatgctgggtctccgtgaggacactgttccagcaaatgcgggatgtgcttggaacatttgacactgtccaaataataaaacttctcccctttgctgctgctccaccggaacagacgtacttgggagtcggccat

SEQ ID NO: 425444 - DNA, 140 bp, Artificial Sequence
  Synthetic
atggccgactcccaagtacgtctgttccggtggagcagcagcaaaggggagaagttttattatttggacagtgtcaaatgttccaagcacatcccgcatttgctggaacagtgtcctcacggagacccagcatggcgtat

SEQ ID NO: 425445 - DNA, 140 bp, Artificial Sequence
  Synthetic
atacgccatgctgggtctccaggaaactgaagagggaaataacattccatggggctaaagaggttgcactcagttactcaaccggtgcacttgccagttgcatgggtctcatatacaacacgtacttgggagtcggccat

SEQ ID NO: 425446 - DNA, 140 bp, Artificial Sequence
  Synthetic
atggccgactcccaagtacgtgttgtatatgagacccatgcaactggcaagtgcaccggttgagtaactgagtgcaacctctttagccccatggaatgttatttccctcttcagtttcctggagacccagcatggcgtat

SEQ ID NO: 425447 - DNA, 140 bp, Artificial Sequence
  Synthetic
aggccctggctgctgatatggcggatcatctgttaagaaagaagaagaagtgctcacgggcaacctccaaacactgaaaataagagtacatgaaggatatgaagaattcacaatggtcgggaccttttgggacagcggtg

SEQ ID NO: 425448 - DNA, 140 bp, Artificial Sequence
  Synthetic
caccgctgtcccaaaaggtcccgaccattgtgaattcttcatatccttcatgtactcttattttcagtgtttggaggttgcccgtgagcacttcttcttctttcttaacagatgatccgccatatcagcagccagggcct

SEQ ID NO: 425449 - DNA, 140 bp, Artificial Sequence
  Synthetic
atacgccatgctgggtctcctgtgagcagattgctgattcacagcatcggtctcacagacagatggtgactaccaccaacccactaatcaggcatgaaaacaggatggtgctggccagcacgtacttgggagtcggccat

SEQ ID NO: 425450 - DNA, 140 bp, Artificial Sequence
  Synthetic
atggccgactcccaagtacgtgctggccagcaccatcctgttttcatgcctgattagtgggttggtggtagtcaccatctgtctgtgagaccgatgctgtgaatcagcaatctgctcacaggagacccagcatggcgtat

SEQ ID NO: 425451 - DNA, 140 bp, Artificial Sequence
  Synthetic
aggccctggctgctgatatgattttgggcaaagaagacaagagatatggtccagcattaagcatcaatgaactaagcaaccttgcaaaaggagagaaggctaatgtgctaattggacaaggaccttttgggacagcggtg

SEQ ID NO: 425452 - DNA, 140 bp, Artificial Sequence
  Synthetic
caccgctgtcccaaaaggtccttgtccaattagcacattagccttctctccttttgcaaggttgcttagttcattgatgcttaatgctggaccatatctcttgtcttctttgcccaaaatcatatcagcagccagggcct

SEQ ID NO: 425453 - DNA, 140 bp, Artificial Sequence
  Synthetic
atacgccatgctgggtctccgaagccatggaagttgctagtcaggctaggcagatggtgcaggcgatgaggacaattgggactcatcctagctccagtgccggtctgaaagatgatcttccgtacttgggagtcggccat

SEQ ID NO: 425454 - DNA, 140 bp, Artificial Sequence
  Synthetic
atggccgactcccaagtacggaagatcatctttcagaccggcactggagctaggatgagtcccaattgtcctcatcgcctgcaccatctgcctagcctgactagcaacttccatggcttcggagacccagcatggcgtat

SEQ ID NO: 425455 - DNA, 140 bp, Artificial Sequence
  Synthetic
aggccctggctgctgatatgcacagctttgctcaatgcttcttgtgctgcaatggatgattttcagctgatcccaatgataagcaaatgcagaaccaaagaagggcggcggaagacaaatgaccttttgggacagcggtg

SEQ ID NO: 425456 - DNA, 140 bp, Artificial Sequence
  Synthetic
caccgctgtcccaaaaggtcatttgtcttccgccgcccttctttggttctgcatttgcttatcattgggatcagctgaaaatcatccattgcagcacaagaagcattgagcaaagctgtgcatatcagcagccagggcct

SEQ ID NO: 425457 - DNA, 140 bp, Artificial Sequence
  Synthetic
aggccctggctgctgatatgtgtagtgaattttgtgagcatggagttttctcttactgatcctagactagagccacataaatgggagaaatactgtgtccttgaaataggggacatgctcgaccttttgggacagcggtg

SEQ ID NO: 425458 - DNA, 140 bp, Artificial Sequence
  Synthetic
caccgctgtcccaaaaggtcgagcatgtcccctatttcaaggacacagtatttctcccatttatgtggctctagtctaggatcagtaagagaaaactccatgctcacaaaattcactacacatatcagcagccagggcct

SEQ ID NO: 425459 - DNA, 140 bp, Artificial Sequence
  Synthetic
atacgccatgctgggtctccagccacataaatgggagaaatactgtgtccttgaaataggggacatgctcctgcggactgcaataggccaagtatcgagacccatgttcttgtatgtgagcgtacttgggagtcggccat

SEQ ID NO: 425460 - DNA, 140 bp, Artificial Sequence
  Synthetic
atggccgactcccaagtacgctcacatacaagaacatgggtctcgatacttggcctattgcagtccgcaggagcatgtcccctatttcaaggacacagtatttctcccatttatgtggctggagacccagcatggcgtat

SEQ ID NO: 425461 - DNA, 140 bp, Artificial Sequence
  Synthetic
aggccctggctgctgatatggagtagtaaatgaaaaaggagaaagtttcgacatgctttacggtctggcggttaaaggacaatctcatctgaggggagatactgatgttgtaacagttgtgaccttttgggacagcggtg

SEQ ID NO: 425462 - DNA, 140 bp, Artificial Sequence
  Synthetic
caccgctgtcccaaaaggtcacaactgttacaacatcagtatctcccctcagatgagattgtcctttaaccgccagaccgtaaagcatgtcgaaactttctcctttttcatttactactccatatcagcagccagggcct

SEQ ID NO: 425463 - DNA, 140 bp, Artificial Sequence
  Synthetic
aggccctggctgctgatatggttgtcttcttcaatcccttcagcaaattgaaagcatgattgaggccgaatcctctgtcaaagagaaagacatgaccaaagaattcttcgaaaacaaatcgaccttttgggacagcggtg

SEQ ID NO: 425464 - DNA, 140 bp, Artificial Sequence
  Synthetic
caccgctgtcccaaaaggtcgatttgttttcgaagaattctttggtcatgtctttctctttgacagaggattcggcctcaatcatgctttcaatttgctgaagggattgaagaagacaaccatatcagcagccagggcct

SEQ ID NO: 425465 - DNA, 140 bp, Artificial Sequence
  Synthetic
aggccctggctgctgatatgacacccccagtggtaccaaactgcagtgacaccacaattacatacaacaacactgtggtaaacaacataacagcaacaataataaataaagcggagaagcgaccttttgggacagcggtg

SEQ ID NO: 425466 - DNA, 140 bp, Artificial Sequence
  Synthetic
caccgctgtcccaaaaggtcgcttctccgctttatttattattgttgctgttatgttgtttaccacagtgttgttgtatgtaattgtggtgtcactgcagtttggtaccactgggggtgtcatatcagcagccagggcct

SEQ ID NO: 425467 - DNA, 140 bp, Artificial Sequence
  Synthetic
aggccctggctgctgatatgcgtcatcaatgatgtgggagatcaatggtcctgagtcagtgctggtcaacacttatcaatggatcataaggaactgggaaagcttgaaaattcaatggtcgaccttttgggacagcggtg

SEQ ID NO: 425468 - DNA, 140 bp, Artificial Sequence
  Synthetic
caccgctgtcccaaaaggtcgaccattgaattttcaagctttcccagttccttatgatccattgataagtgttgaccagcactgactcaggaccattgatctcccacatcattgatgacgcatatcagcagccagggcct

SEQ ID NO: 425469 - DNA, 140 bp, Artificial Sequence
  Synthetic
atacgccatgctgggtctccgatctagacccagagtaagggatatccccagcagaataagcacctattggacaatagtaaaaccgggagacatacttttgattaacagcacagggaatctcgtacttgggagtcggccat

SEQ ID NO: 425470 - DNA, 140 bp, Artificial Sequence
  Synthetic
atggccgactcccaagtacgagattccctgtgctgttaatcaaaagtatgtctcccggttttactattgtccaataggtgcttattctgctggggatatcccttactctgggtctagatcggagacccagcatggcgtat

SEQ ID NO: 425471 - DNA, 140 bp, Artificial Sequence
  Synthetic
atacgccatgctgggtctcctttgattatcgccgctagaaacatagtaagaagagcagcagtgtcagcagacccattagcatctctcttggaaatgtgccacagcacacaaattggaggacgtacttgggagtcggccat

SEQ ID NO: 425472 - DNA, 140 bp, Artificial Sequence
  Synthetic
atggccgactcccaagtacgtcctccaatttgtgtgctgtggcacatttccaagagagatgctaatgggtctgctgacactgctgctcttcttactatgtttctagcggcgataatcaaaggagacccagcatggcgtat

SEQ ID NO: 425473 - DNA, 140 bp, Artificial Sequence
  Synthetic
aggccctggctgctgatatgagtgctgggtaactacaaggaaatatgtgttgcttggtcaagtagcagttgtttcgatggaaaggaatggatgcatgtttgcatgactggaaatgacaatgaccttttgggacagcggtg

SEQ ID NO: 425474 - DNA, 140 bp, Artificial Sequence
  Synthetic
caccgctgtcccaaaaggtcattgtcatttccagtcatgcaaacatgcatccattcctttccatcgaaacaactgctacttgaccaagcaacacatatttccttgtagttacccagcactcatatcagcagccagggcct

SEQ ID NO: 425475 - DNA, 140 bp, Artificial Sequence
  Synthetic
aggccctggctgctgatatggatgcgagtggccaaataatatatgcaggaaagatgacagactccattaaatcatggagaagagatatattaagaactcaagagtctgaatgtcaatgcagaccttttgggacagcggtg

SEQ ID NO: 425476 - DNA, 140 bp, Artificial Sequence
  Synthetic
caccgctgtcccaaaaggtctgcattgacattcagactcttgagttcttaatatatctcttctccatgatttaatggagtctgtcatctttcctgcatatattatttggccactcgcatccatatcagcagccagggcct

SEQ ID NO: 425477 - DNA, 140 bp, Artificial Sequence
  Synthetic
aggccctggctgctgatatgctgcggactgcaataggccaagtatcgagacccatgttcttgtacgtgagaaccaatggaacctccaaaatcaaaatgaaatggggtatggaaatgaggcgaccttttgggacagcggtg

SEQ ID NO: 425478 - DNA, 140 bp, Artificial Sequence
  Synthetic
caccgctgtcccaaaaggtcgcctcatttccataccccatttcattttgattttggaggttccattggttctcacgtacaagaacatgggtctcgatacttggcctattgcagtccgcagcatatcagcagccagggcct

SEQ ID NO: 425479 - DNA, 140 bp, Artificial Sequence
  Synthetic
aggccctggctgctgatatgcaggacctgcaaattagttggaatcaatatgagtaaaaagaaatcttacataaataggacaggaacatttgaattcacaagctttttctaccgctatggagaccttttgggacagcggtg

SEQ ID NO: 425480 - DNA, 140 bp, Artificial Sequence
  Synthetic
caccgctgtcccaaaaggtctccatagcggtagaaaaagcttgtgaattcaaatgttcctgtcctatttatgtaagatttctttttactcatattgattccaactaatttgcaggtcctgcatatcagcagccagggcct

SEQ ID NO: 425481 - DNA, 140 bp, Artificial Sequence
  Synthetic
aggccctggctgctgatatgtcttgcaaaaggagagaaggctaatgtgctaattgggcaaggagacgtggtgttggtaatgaaacggaaacgggactctagcatacttactgacagccaggaccttttgggacagcggtg

SEQ ID NO: 425482 - DNA, 140 bp, Artificial Sequence
  Synthetic
caccgctgtcccaaaaggtcctggctgtcagtaagtatgctagagtcccgtttccgtttcattaccaacaccacgtctccttgcccaattagcacattagccttctctccttttgcaagacatatcagcagccagggcct

SEQ ID NO: 425483 - DNA, 140 bp, Artificial Sequence
  Synthetic
atacgccatgctgggtctccaattgctcctcggggttatttcaaattacaaaatgggaaaagctcaataatgagatcagatgcacccattggcaaatgcaattctgaatgtatcaccccacgtacttgggagtcggccat

SEQ ID NO: 425484 - DNA, 140 bp, Artificial Sequence
  Synthetic
atggccgactcccaagtacgtggggtgatacattcagaattgcatttgccaatgggtgcatctgatctcattattgagcttttcccattttgtaatttgaaataaccccgaggagcaattggagacccagcatggcgtat

SEQ ID NO: 425485 - DNA, 140 bp, Artificial Sequence
  Synthetic
aggccctggctgctgatatgttttaggatttgtgttcacgctcaccgtgcccagtgagcgaggactgcagcgtagacgctttgtccaaaatgccctaaatgggaatggggacccaaacaagaccttttgggacagcggtg

SEQ ID NO: 425486 - DNA, 140 bp, Artificial Sequence
  Synthetic
caccgctgtcccaaaaggtcttgtttgggtccccattcccatttagggcattttggacaaagcgtctacgctgcagtcctcgctcactgggcacggtgagcgtgaacacaaatcctaaaacatatcagcagccagggcct

SEQ ID NO: 425487 - DNA, 140 bp, Artificial Sequence
  Synthetic
atacgccatgctgggtctccctggaaaggctccaataggcccatagttgatataaatgtaaaggattatagcattgtttccagttatgtatgctctggacttgttggagacacacccagacgtacttgggagtcggccat

SEQ ID NO: 425488 - DNA, 140 bp, Artificial Sequence
  Synthetic
atggccgactcccaagtacgtctgggtgtgtctccaacaagtccagagcatacataactggaaacaatgctataatcctttacatttatatcaactatgggcctattggagcctttccagggagacccagcatggcgtat

SEQ ID NO: 425489 - DNA, 140 bp, Artificial Sequence
  Synthetic
aggccctggctgctgatatgatggcgtctcaaggcaccaaacgatcttatgaacagatggaaactggtggagagcgccagaatgctactgaaatcagagcatcagttgggagaatggttggaccttttgggacagcggtg

SEQ ID NO: 425490 - DNA, 140 bp, Artificial Sequence
  Synthetic
caccgctgtcccaaaaggtccaaccattctcccaactgatgctctgatttcagtagcattctggcgctctccaccagtttccatctgttcataagatcgtttggtgccttgagacgccatcatatcagcagccagggcct

SEQ ID NO: 425491 - DNA, 140 bp, Artificial Sequence
  Synthetic
aggccctggctgctgatatgagagcgccagaatgctactgaaatcagagcatcagttgggagaatggttggtggaatcgggagattctacatacaaatgtgcactgagctcaaactcagcgaccttttgggacagcggtg

SEQ ID NO: 425492 - DNA, 140 bp, Artificial Sequence
  Synthetic
caccgctgtcccaaaaggtcgctgagtttgagctcagtgcacatttgtatgtagaatctcccgattccaccaaccattctcccaactgatgctctgatttcagtagcattctggcgctctcatatcagcagccagggcct

SEQ ID NO: 425493 - DNA, 140 bp, Artificial Sequence
  Synthetic
atacgccatgctgggtctcctctttctgcatttgatgagagaaggaacagatacttggaagagcatcccagtgctggaaaggatcccaagaaaactgggggtccaatctacagaagaaggcgtacttgggagtcggccat

SEQ ID NO: 425494 - DNA, 140 bp, Artificial Sequence
  Synthetic
atggccgactcccaagtacgccttcttctgtagattggacccccagttttcttgggatcctttccagcactgggatgctcttccaagtatctgttccttctctcatcaaatgcagaaagaggagacccagcatggcgtat

SEQ ID NO: 425495 - DNA, 140 bp, Artificial Sequence
  Synthetic
aggccctggctgctgatatgaatcagaggatttgtatattttgttgaaacattagcaaggagcatttgtgagaagcttgaacaatctggactcccagttgggggcaatgaaaagaaagctgaccttttgggacagcggtg

SEQ ID NO: 425496 - DNA, 140 bp, Artificial Sequence
  Synthetic
caccgctgtcccaaaaggtcagctttcttttcattgcccccaactgggagtccagattgttcaagcttctcacaaatgctccttgctaatgtttcaacaaaatatacaaatcctctgattcatatcagcagccagggcct

SEQ ID NO: 425497 - DNA, 140 bp, Artificial Sequence
  Synthetic
atacgccatgctgggtctccgaggatttggcgccaggcgaataatggagaagatgcaactgctggcctcactcacctgatgatctggcattccaatctgaatgatgccacttaccaaagacgtacttgggagtcggccat

SEQ ID NO: 425498 - DNA, 140 bp, Artificial Sequence
  Synthetic
atggccgactcccaagtacgtctttggtaagtggcatcattcagattggaatgccagatcatcaggtgagtgaggccagcagttgcatcttctccattattcgcctggcgccaaatcctcggagacccagcatggcgtat

SEQ ID NO: 425499 - DNA, 140 bp, Artificial Sequence
  Synthetic
aggccctggctgctgatatgctcacctgatgatctggcattccaatctgaatgatgccacttaccaaagaacaagagcccttgtacgaactgggatggaccccagaatgtgctccctgatgaccttttgggacagcggtg

SEQ ID NO: 425500 - DNA, 140 bp, Artificial Sequence
  Synthetic
caccgctgtcccaaaaggtcatcagggagcacattctggggtccatcccagttcgtacaagggctcttgttctttggtaagtggcatcattcagattggaatgccagatcatcaggtgagcatatcagcagccagggcct

SEQ ID NO: 425501 - DNA, 140 bp, Artificial Sequence
  Synthetic
atacgccatgctgggtctccagggggttggaacaatggtaatggaactaattcggatgataaagagaggaatcaatgaccggaacttctggagaggtgaaaatggaaggagaacaagaatcgtacttgggagtcggccat

SEQ ID NO: 425502 - DNA, 140 bp, Artificial Sequence
  Synthetic
atggccgactcccaagtacgattcttgttctccttccattttcacctctccagaagttccggtcattgattcctctctttatcatccgaattagttccattaccattgttccaaccccctggagacccagcatggcgtat

SEQ ID NO: 425503 - DNA, 140 bp, Artificial Sequence
  Synthetic
atacgccatgctgggtctccatccggaatctacacattccggaagtctgcttgaaatgggagctgatggacgaagactatcagggaaggctttgcaaccccctgaatccgtttgtcagcccgtacttgggagtcggccat

SEQ ID NO: 425504 - DNA, 140 bp, Artificial Sequence
  Synthetic
atggccgactcccaagtacgggctgacaaacggattcagggggttgcaaagccttccctgatagtcttcgtccatcagctcccatttcaagcagacttccggaatgtgtagattccggatggagacccagcatggcgtat

SEQ ID NO: 425505 - DNA, 140 bp, Artificial Sequence
  Synthetic
atacgccatgctgggtctccacaaggagatagagtctgtaaacaatgctgtggtgatgccagctcatggcccagccaagagcatggaatatgatgctgtggctaccacacactcctggatcgtacttgggagtcggccat

SEQ ID NO: 425506 - DNA, 140 bp, Artificial Sequence
  Synthetic
atggccgactcccaagtacgatccaggagtgtgtggtagccacagcatcatattccatgctcttggctgggccatgagctggcatcaccacagcattgtttacagactctatctccttgtggagacccagcatggcgtat

SEQ ID NO: 425507 - DNA, 140 bp, Artificial Sequence
  Synthetic
atacgccatgctgggtctccgctgaagttgaagatcttctctttatagcacggtcggcactcatactgaggggatcagtggctcacaaatcctgcttgcctgcttgtgtgtatggacttgcgtacttgggagtcggccat

SEQ ID NO: 425508 - DNA, 140 bp, Artificial Sequence
  Synthetic
atggccgactcccaagtacgcaagtccatacacacaagcaggcaagcaggatttgtgagccactgatcccctcagtatgagtgccgaccgtgctataaagagaagatcttcaacttcagcggagacccagcatggcgtat

SEQ ID NO: 425509 - DNA, 140 bp, Artificial Sequence
  Synthetic
atacgccatgctgggtctccttgatgatttggcattccaatctgaatgatgccacataccagagaacaagggcacttgtgcgtactggaatggaccccaggatgtgctctctgatgcaagcgtacttgggagtcggccat

SEQ ID NO: 425510 - DNA, 140 bp, Artificial Sequence
  Synthetic
atggccgactcccaagtacgcttgcatcagagagcacatcctggggtccattccagtacgcacaagtgcccttgttctctggtatgtggcatcattcagattggaatgccaaatcatcaaggagacccagcatggcgtat

SEQ ID NO: 425511 - DNA, 140 bp, Artificial Sequence
  Synthetic
aggccctggctgctgatatgctcccatttcaaaatatacatccagtcacaattggagaatgtccaaaatatgtaaaaagtactaaactgagaatggccacaggtttaaggaatatcccgtgaccttttgggacagcggtg

SEQ ID NO: 425512 - DNA, 140 bp, Artificial Sequence
  Synthetic
caccgctgtcccaaaaggtcacgggatattccttaaacctgtggccattctcagtttagtactttttacatattttggacattctccaattgtgactggatgtatattttgaaatgggagcatatcagcagccagggcct

SEQ ID NO: 425513 - DNA, 140 bp, Artificial Sequence
  Synthetic
atacgccatgctgggtctccgccaaacgagaatccagcacacaagagccaattggtatggatggcatgtcattctgcagcatttgaagacttgagagtgtcaagcttcatcagaggaacacgtacttgggagtcggccat

SEQ ID NO: 425514 - DNA, 140 bp, Artificial Sequence
  Synthetic
atggccgactcccaagtacgtgttcctctgatgaagcttgacactctcaagtcttcaaatgctgcagaatgacatgccatccataccaattggctcttgtgtgctggattctcgtttggcggagacccagcatggcgtat

SEQ ID NO: 425515 - DNA, 140 bp, Artificial Sequence
  Synthetic
atacgccatgctgggtctccgaatgagaacatggaaacaatggattccagcactcttgaactgaggagcagatactgggctataagaaccagaagtgggggaaacactaatcaacaaagacgtacttgggagtcggccat

SEQ ID NO: 425516 - DNA, 140 bp, Artificial Sequence
  Synthetic
atggccgactcccaagtacgtctttgttgattagtgtttcccccacttctggttcttatagcccagtatctgctcctcagttcaagagtgctggaatccattgtttccatgttctcattcggagacccagcatggcgtat

SEQ ID NO: 425517 - DNA, 140 bp, Artificial Sequence
  Synthetic
aggccctggctgctgatatggcaactgctagcgtcatttacaatgggagacttgtagatagcattggttcatggtcccataatatccttaggacccaggaatcggaatgcgtttgtattagaccttttgggacagcggtg

SEQ ID NO: 425518 - DNA, 140 bp, Artificial Sequence
  Synthetic
caccgctgtcccaaaaggtctaatacaaacgcattccgattcctgggtcctaaggatattatgggaccatgaaccaatgctatctacaagtctcccattgtaaatgacgctagcagttgccatatcagcagccagggcct

SEQ ID NO: 425519 - DNA, 140 bp, Artificial Sequence
  Synthetic
atacgccatgctgggtctcccttatttcgaaaaagtcgaaaggttgaaacacgggacctttggccctgttcacttcagaaatcaagttaaaataagacggagggttgacataaaccctggcgtacttgggagtcggccat

SEQ ID NO: 425520 - DNA, 140 bp, Artificial Sequence
  Synthetic
atggccgactcccaagtacgccagggtttatgtcaaccctccgtcttattttaacttgatttctgaagtgaacagggccaaaggtcccgtgtttcaacctttcgactttttcgaaataagggagacccagcatggcgtat

SEQ ID NO: 425521 - DNA, 140 bp, Artificial Sequence
  Synthetic
atacgccatgctgggtctccatgaagaccatcattgctttgagctacattttctgcctggttttcggtcaagatctttcagggaatgaaaacagtacagcaacactgtgcttgggacatccgtacttgggagtcggccat

SEQ ID NO: 425522 - DNA, 140 bp, Artificial Sequence
  Synthetic
atggccgactcccaagtacggatgtcccaagcacagtgttgctgtactgttttcattccctgaaagatcttgaccgaaaaccaggcagaaaatgtagctcaaagcaatgatggtcttcatggagacccagcatggcgtat

SEQ ID NO: 425523 - DNA, 140 bp, Artificial Sequence
  Synthetic
atacgccatgctgggtctccgatactaaaatattattcattgaagaggggaagatcgttcatattagcccattgttgggaagtgctcagcatgttgaggaatgctcctgttaccctcgatcgtacttgggagtcggccat

SEQ ID NO: 425524 - DNA, 140 bp, Artificial Sequence
  Synthetic
atggccgactcccaagtacgatcgagggtaacaggagcattcctcaacatgctgagcacttcccaacaatgggctaatatgaacgatcttcccctcttcaatgaataatattttagtatcggagacccagcatggcgtat

SEQ ID NO: 425525 - DNA, 140 bp, Artificial Sequence
  Synthetic
aggccctggctgctgatatgattgttgggaagtgctcagcatgttgaggaatgctcctgttaccctcgatatcctggtgtcagatgtgtctgtagagacaactggagaggttccaatagggaccttttgggacagcggtg

SEQ ID NO: 425526 - DNA, 140 bp, Artificial Sequence
  Synthetic
caccgctgtcccaaaaggtccctattggaacctctccagttgtctctacagacacatctgacaccaggatatcgagggtaacaggagcattcctcaacatgctgagcacttcccaacaatcatatcagcagccagggcct

SEQ ID NO: 425527 - DNA, 140 bp, Artificial Sequence
  Synthetic
atacgccatgctgggtctcctttgctgagatcatgaagatctgttccaccattgaagagctcagacggcaacaacagtagatttagcttgtccttcatgaaaaaatgccttgtttctactcgtacttgggagtcggccat

SEQ ID NO: 425528 - DNA, 140 bp, Artificial Sequence
  Synthetic
atggccgactcccaagtacgagtagaaacaaggcattttttcatgaaggacaagctaaatctactgttgttgccgtctgagctcttcaatggtggaacagatcttcatgatctcagcaaaggagacccagcatggcgtat

SEQ ID NO: 425529 - DNA, 140 bp, Artificial Sequence
  Synthetic
atacgccatgctgggtctccgtgctcaggacttgttggagacacacccagaagaaacgacagatccagcaacagcaattgtctgaaccctaacaatgaggaagggggtcatggagtgaaacgtacttgggagtcggccat

SEQ ID NO: 425530 - DNA, 140 bp, Artificial Sequence
  Synthetic
atggccgactcccaagtacgtttcactccatgacccccttcctcattgttagggttcagacaattgctgttgctggatctgtcgtttcttctgggtgtgtctccaacaagtcctgagcacggagacccagcatggcgtat

SEQ ID NO: 425531 - DNA, 140 bp, Artificial Sequence
  Synthetic
aggccctggctgctgatatgacagcaattgtctgaaccctaacaatgaggaagggggtcatggagtgaaaggctgggcctttgatgacggaaatgatgtgtggatgggaagaactatcaagaccttttgggacagcggtg

SEQ ID NO: 425532 - DNA, 140 bp, Artificial Sequence
  Synthetic
caccgctgtcccaaaaggtcttgatagttcttcccatccacacatcatttccgtcatcaaaggcccagcctttcactccatgacccccttcctcattgttagggttcagacaattgctgtcatatcagcagccagggcct

SEQ ID NO: 425533 - DNA, 140 bp, Artificial Sequence
  Synthetic
aggccctggctgctgatatgatgttgtaagaaaaatgatgactaattctcaagacacggaagtctctttcacaattactggggacaacaccaaatggaatgaaaatcaaaatcctcgaatgaccttttgggacagcggtg

SEQ ID NO: 425534 - DNA, 140 bp, Artificial Sequence
  Synthetic
caccgctgtcccaaaaggtcattcgaggattttgattttcattccatttggtgttgtccccagtaattgtgaaagagacttccgtgtcttgagaattagtcatcatttttcttacaacatcatatcagcagccagggcct

SEQ ID NO: 425535 - DNA, 140 bp, Artificial Sequence
  Synthetic
atacgccatgctgggtctcctgatctcggtcaatgtggactcctgggaacaatcactgggccaccccaatgtgaccaattcctagaattttcagccgatttaattatcgagaggcgagaacgtacttgggagtcggccat

SEQ ID NO: 425536 - DNA, 140 bp, Artificial Sequence
  Synthetic
atggccgactcccaagtacgttctcgcctctcgataattaaatcggctgaaaattctaggaattggtcacattggggtggcccagtgattgttcccaggagtccacattgaccgagatcaggagacccagcatggcgtat

SEQ ID NO: 425537 - DNA, 140 bp, Artificial Sequence
  Synthetic
atacgccatgctgggtctccctaaacctaactccaaatcgcagataaataggcaagtcatagttgacaggggtgataggtctggttattctggcattttctctgttgaaggcaaaagctgcgtacttgggagtcggccat

SEQ ID NO: 425538 - DNA, 140 bp, Artificial Sequence
  Synthetic
atggccgactcccaagtacgcagcttttgccttcaacagagaaaatgccagaataaccagacctatcacccctgtcaactatgacttgcctatttatctgcgatttggagttaggtttagggagacccagcatggcgtat

SEQ ID NO: 425539 - DNA, 140 bp, Artificial Sequence
  Synthetic
aggccctggctgctgatatgaataatggacataattccagagaggaatgaacaaggacaaactctctggagcaaaacaaacgatgctggatcagaccgagtgatggtatcacctctggccgaccttttgggacagcggtg

SEQ ID NO: 425540 - DNA, 140 bp, Artificial Sequence
  Synthetic
caccgctgtcccaaaaggtcggccagaggtgataccatcactcggtctgatccagcatcgtttgttttgctccagagagtttgtccttgttcattcctctctggaattatgtccattattcatatcagcagccagggcct

SEQ ID NO: 425541 - DNA, 140 bp, Artificial Sequence
  Synthetic
atacgccatgctgggtctccgggtcttcattctatgcagaaatgaaatggctcctgtcaaacacagataatgctgctttcccacagatgactaagtcatataaaaatacaaagaaagacccgtacttgggagtcggccat

SEQ ID NO: 425542 - DNA, 140 bp, Artificial Sequence
  Synthetic
atggccgactcccaagtacgggtctttctttgtatttttatatgacttagtcatctgtgggaaagcagcattatctgtgtttgacaggagccatttcatttctgcatagaatgaagacccggagacccagcatggcgtat

SEQ ID NO: 425543 - DNA, 140 bp, Artificial Sequence
  Synthetic
atacgccatgctgggtctccaccaagctgtatgggagtggaaacaaactgataacagttgggagttctaattatcagcaatcttttgtgccgagtccaggagcgagaccacaagttaatgcgtacttgggagtcggccat

SEQ ID NO: 425544 - DNA, 140 bp, Artificial Sequence
  Synthetic
atggccgactcccaagtacgcattaacttgtggtctcgctcctggactcggcacaaaagattgctgataattagaactcccaactgttatcagtttgtttccactcccatacagcttggtggagacccagcatggcgtat

SEQ ID NO: 425545 - DNA, 140 bp, Artificial Sequence
  Synthetic
atacgccatgctgggtctccacaggagtcgataagcctaaattcctcccagacttgtatgactacaaagagaaccgattcattgaaattggagtgacacggcgggaagttcacatatactcgtacttgggagtcggccat

SEQ ID NO: 425546 - DNA, 140 bp, Artificial Sequence
  Synthetic
atggccgactcccaagtacgagtatatgtgaacttcccgccgtgtcactccaatttcaatgaatcggttctctttgtagtcatacaagtctgggaggaatttaggcttatcgactcctgtggagacccagcatggcgtat

SEQ ID NO: 425547 - DNA, 140 bp, Artificial Sequence
  Synthetic
atacgccatgctgggtctccaattgaatctattgacaatgtaatgggaatgatcgggatattgcccgacatgactccaagtactgagatgtcgctgagggggataagagtcagtaagatgcgtacttgggagtcggccat

SEQ ID NO: 425548 - DNA, 140 bp, Artificial Sequence
  Synthetic
atggccgactcccaagtacgcatcttactgactcttatccccctcagcgacatctcagtacttggagtcatgtcgggcaatatcccgatcattcccattacattgtcaatagattcaattggagacccagcatggcgtat

SEQ ID NO: 425549 - DNA, 140 bp, Artificial Sequence
  Synthetic
aggccctggctgctgatatgtgactccaagtactgagatgtcgctgagggggataagagtcagtaagatgggagtagatgaatactccagcacagagagagtggttgtgagcattgaccggaccttttgggacagcggtg

SEQ ID NO: 425550 - DNA, 140 bp, Artificial Sequence
  Synthetic
caccgctgtcccaaaaggtccggtcaatgctcacaaccactctctctgtgctggagtattcatctactcccatcttactgactcttatccccctcagcgacatctcagtacttggagtcacatatcagcagccagggcct

SEQ ID NO: 425551 - DNA, 140 bp, Artificial Sequence
  Synthetic
aggccctggctgctgatatgagagtgttcctgttatcctgatgctagtgaggtgatgtgtgtatgcagggacaattggcatggttcaaatcggccatgggtgtccttcaaccagaatctagaccttttgggacagcggtg

SEQ ID NO: 425552 - DNA, 140 bp, Artificial Sequence
  Synthetic
caccgctgtcccaaaaggtctagattctggttgaaggacacccatggccgatttgaaccatgccaattgtccctgcatacacacatcacctcactagcatcaggataacaggaacactctcatatcagcagccagggcct

SEQ ID NO: 425553 - DNA, 140 bp, Artificial Sequence
  Synthetic
atacgccatgctgggtctccaagtcagcgagacacaaggaacagagaagctgacaataacttactcgtcgtcaatgatgtgggagatcaatggccctgaatcggttttggtcaacacttacgtacttgggagtcggccat

SEQ ID NO: 425554 - DNA, 140 bp, Artificial Sequence
  Synthetic
atggccgactcccaagtacgtaagtgttgaccaaaaccgattcagggccattgatctcccacatcattgacgacgagtaagttattgtcagcttctctgttccttgtgtctcgctgacttggagacccagcatggcgtat

SEQ ID NO: 425555 - DNA, 140 bp, Artificial Sequence
  Synthetic
atacgccatgctgggtctccatcccacgatgttatataacaagatggagttcgagccattccagtctctggtccctaaagcagccagaggtcagtacagtggattcgtgagaacactgttcgtacttgggagtcggccat

SEQ ID NO: 425556 - DNA, 140 bp, Artificial Sequence
  Synthetic
atggccgactcccaagtacgaacagtgttctcacgaatccactgtactgacctctggctgctttagggaccagagactggaatggctcgaactccatcttgttatataacatcgtgggatggagacccagcatggcgtat

SEQ ID NO: 425557 - DNA, 140 bp, Artificial Sequence
  Synthetic
aggccctggctgctgatatggtccctaaagcagccagaggtcagtacagtggattcgtgagaacactgttccaacaaatgcgggatgtgcttggaacttttgacactgttcagataataagaccttttgggacagcggtg

SEQ ID NO: 425558 - DNA, 140 bp, Artificial Sequence
  Synthetic
caccgctgtcccaaaaggtcttattatctgaacagtgtcaaaagttccaagcacatcccgcatttgttggaacagtgttctcacgaatccactgtactgacctctggctgctttagggaccatatcagcagccagggcct

SEQ ID NO: 425559 - DNA, 140 bp, Artificial Sequence
  Synthetic
aggccctggctgctgatatgagatctttcagggaatgaaaacagtacagcaacactgtgcttgggacatcatgcggtgccgaatggaacgatagtgaaaacaatcacagatgatcaaattgaccttttgggacagcggtg

SEQ ID NO: 425560 - DNA, 140 bp, Artificial Sequence
  Synthetic
caccgctgtcccaaaaggtcaatttgatcatctgtgattgttttcactatcgttccattcggcaccgcatgatgtcccaagcacagtgttgctgtactgttttcattccctgaaagatctcatatcagcagccagggcct

SEQ ID NO: 425561 - DNA, 140 bp, Artificial Sequence
  Synthetic
aggccctggctgctgatatggggcaattctccagtgttcaattacaacaaggccactaagaggcttacagttctcggaaaagatgcaggtgcattgaccgaggatccagatgaaggcacagaccttttgggacagcggtg

SEQ ID NO: 425562 - DNA, 140 bp, Artificial Sequence
  Synthetic
caccgctgtcccaaaaggtctgtgccttcatctggatcctcggtcaatgcacctgcatcttttccgagaactgtaagcctcttagtggccttgttgtaattgaacactggagaattgccccatatcagcagccagggcct

SEQ ID NO: 425563 - DNA, 140 bp, Artificial Sequence
  Synthetic
atacgccatgctgggtctccatggaagactttgtgcgacaatgcttcaatccaatgatcgtcgaacttgcggaaaaggcaatgaaagaatatggggaagatccaaaaatcgaaacgaacacgtacttgggagtcggccat

SEQ ID NO: 425564 - DNA, 140 bp, Artificial Sequence
  Synthetic
atggccgactcccaagtacgtgttcgtttcgatttttggatcttccccatattctttcattgccttttccgcaagttcgacgatcattggattgaagcattgtcgcacaaagtcttccatggagacccagcatggcgtat

SEQ ID NO: 425565 - DNA, 140 bp, Artificial Sequence
  Synthetic
aggccctggctgctgatatgggccatggtattttcacaagaggattgcatgatcaaggcagttcgaggtgatttgaattttgtcaatagagcaaaccagcggctaaacccaatgcatcaagaccttttgggacagcggtg

SEQ ID NO: 425566 - DNA, 140 bp, Artificial Sequence
  Synthetic
caccgctgtcccaaaaggtcttgatgcattgggtttagccgctggtttgctctattgacaaaattcaaatcacctcgaactgccttgatcatgcaatcctcttgtgaaaataccatggcccatatcagcagccagggcct

SEQ ID NO: 425567 - DNA, 140 bp, Artificial Sequence
  Synthetic
atacgccatgctgggtctcccaagaggggtccagattgcttcaaatgagaatgtggaagccatggattccaataccttagagctgagaagcagatactgggccataaggaccagaagtggcgtacttgggagtcggccat

SEQ ID NO: 425568 - DNA, 140 bp, Artificial Sequence
  Synthetic
atggccgactcccaagtacgccacttctggtccttatggcccagtatctgcttctcagctctaaggtattggaatccatggcttccacattctcatttgaagcaatctggacccctcttgggagacccagcatggcgtat

SEQ ID NO: 425569 - DNA, 140 bp, Artificial Sequence
  Synthetic
aggccctggctgctgatatgtaggaatggaccaacaacaagtacagtccactacccaaaggtatacaaaacttatttcgaaaaagttgaaaggttgaaacacgggacctttggccctgtcgaccttttgggacagcggtg

SEQ ID NO: 425570 - DNA, 140 bp, Artificial Sequence
  Synthetic
caccgctgtcccaaaaggtcgacagggccaaaggtcccgtgtttcaacctttcaactttttcgaaataagttttgtatacctttgggtagtggactgtacttgttgttggtccattcctacatatcagcagccagggcct

SEQ ID NO: 425571 - DNA, 140 bp, Artificial Sequence
  Synthetic
aggccctggctgctgatatgaagaagtggcactcagttattcaactggtgcacttgccagttgcatgggcctcatatacaacaggatggggactgtgaccactgaagtggcatttggcctgaccttttgggacagcggtg

SEQ ID NO: 425572 - DNA, 140 bp, Artificial Sequence
  Synthetic
caccgctgtcccaaaaggtcaggccaaatgccacttcagtggtcacagtccccatcctgttgtatatgaggcccatgcaactggcaagtgcaccagttgaataactgagtgccacttcttcatatcagcagccagggcct

SEQ ID NO: 425573 - DNA, 140 bp, Artificial Sequence
  Synthetic
aggccctggctgctgatatgagtgctggtctgagagacaatcttcttgaaaatttgcaggcctaccagaaacgaatgggagtgcagatgcagcgattcaagtgatcctcttgttgttgccgaccttttgggacagcggtg

SEQ ID NO: 425574 - DNA, 140 bp, Artificial Sequence
  Synthetic
caccgctgtcccaaaaggtcggcaacaacaagaggatcacttgaatcgctgcatctgcactcccattcgtttctggtaggcctgcaaattttcaagaagattgtctctcagaccagcactcatatcagcagccagggcct

SEQ ID NO: 425575 - DNA, 140 bp, Artificial Sequence
  Synthetic
atacgccatgctgggtctccggtgtgcgccacgtgtgagcagattgctgattcccagcatcggtctcatagacaaatggtgacaacaaccaacccactaatcaggcacgagaacagaatgcgtacttgggagtcggccat

SEQ ID NO: 425576 - DNA, 140 bp, Artificial Sequence
  Synthetic
atggccgactcccaagtacgcattctgttctcgtgcctgattagtgggttggttgttgtcaccatttgtctatgagaccgatgctgggaatcagcaatctgctcacacgtggcgcacaccggagacccagcatggcgtat

SEQ ID NO: 425577 - DNA, 140 bp, Artificial Sequence
  Synthetic
aggccctggctgctgatatgtgaaagctgacaccatttgtgtaggctaccatgctaacaattccacagacactgtcgacacaatactggagaaaaatgtgactgttacccattcagttaagaccttttgggacagcggtg

SEQ ID NO: 425578 - DNA, 140 bp, Artificial Sequence
  Synthetic
caccgctgtcccaaaaggtcttaactgaatgggtaacagtcacatttttctccagtattgtgtcgacagtgtctgtggaattgttagcatggtagcctacacaaatggtgtcagctttcacatatcagcagccagggcct

SEQ ID NO: 425579 - DNA, 140 bp, Artificial Sequence
  Synthetic
atacgccatgctgggtctcctttactggaaaccagccataatgggaaactctgcagcctgaatggaaagaaccccttacaactggggaactgcaacgtagcaggatggatccttggcaaccgtacttgggagtcggccat

SEQ ID NO: 425580 - DNA, 140 bp, Artificial Sequence
  Synthetic
atggccgactcccaagtacggttgccaaggatccatcctgctacgttgcagttccccagttgtaaggggttctttccattcaggctgcagagtttcccattatggctggtttccagtaaaggagacccagcatggcgtat

SEQ ID NO: 425581 - DNA, 140 bp, Artificial Sequence
  Synthetic
aggccctggctgctgatatgaccccttacaactggggaactgcaacgtagcaggatggatccttggcaacccagaatgtgacttactgctcacatcaaattcgtggtcttacataatagagaccttttgggacagcggtg

SEQ ID NO: 425582 - DNA, 140 bp, Artificial Sequence
  Synthetic
caccgctgtcccaaaaggtctctattatgtaagaccacgaatttgatgtgagcagtaagtcacattctgggttgccaaggatccatcctgctacgttgcagttccccagttgtaaggggtcatatcagcagccagggcct

SEQ ID NO: 425583 - DNA, 140 bp, Artificial Sequence
  Synthetic
aggccctggctgctgatatggggtcaatctgcatggtaattggaataataagtctggtgctacaaattgggaatataatttcaatatgggttagccattcaatccaaactggaagtcagagaccttttgggacagcggtg

SEQ ID NO: 425584 - DNA, 140 bp, Artificial Sequence
  Synthetic
caccgctgtcccaaaaggtctctgacttccagtttggattgaatggctaacccatattgaaattatattcccaatttgtagcaccagacttattattccaattaccatgcagattgaccccatatcagcagccagggcct

SEQ ID NO: 425585 - DNA, 140 bp, Artificial Sequence
  Synthetic
atacgccatgctgggtctccacggtcaccttcagtttcaatggggccttcatagctccagatcgtgcaagcttcctgagagggaaatctatgggaattcagagtggagtgcaggttgatgcgtacttgggagtcggccat

SEQ ID NO: 425586 - DNA, 140 bp, Artificial Sequence
  Synthetic
atggccgactcccaagtacgcatcaacctgcactccactctgaattcccatagatttccctctcaggaagcttgcacgatctggagctatgaaggccccattgaaactgaaggtgaccgtggagacccagcatggcgtat

SEQ ID NO: 425587 - DNA, 140 bp, Artificial Sequence
  Synthetic
atacgccatgctgggtctcctgggtgaatcagacatacatcaacataagtaataccaatttaattgcagaacaggctgtagccccagcgacactagcaggtaattcttctctctgtcccacgtacttgggagtcggccat

SEQ ID NO: 425588 - DNA, 140 bp, Artificial Sequence
  Synthetic
atggccgactcccaagtacgtgggacagagagaagaattacctgctagtgtcgctggggctacagcctgttctgcaattaaattggtattacttatgttgatgtatgtctgattcacccaggagacccagcatggcgtat

SEQ ID NO: 425589 - DNA, 140 bp, Artificial Sequence
  Synthetic
aggccctggctgctgatatgacaggctgtagccccagcgacactagcaggtaattcttctctctgtcccatcagtggatgggctatatacagcaaggataacggtataagaataggttccgaccttttgggacagcggtg

SEQ ID NO: 425590 - DNA, 140 bp, Artificial Sequence
  Synthetic
caccgctgtcccaaaaggtcggaacctattcttataccgttatccttgctgtatatagcccatccactgatgggacagagagaagaattacctgctagtgtcgctggggctacagcctgtcatatcagcagccagggcct

SEQ ID NO: 425591 - DNA, 140 bp, Artificial Sequence
  Synthetic
atacgccatgctgggtctccggaatgcaggaccttctttctaactcagggggcattgttgaatgacaagcattccaatggaaccgttaaagacagaagcccctatagaactctgatgagccgtacttgggagtcggccat

SEQ ID NO: 425592 - DNA, 140 bp, Artificial Sequence
  Synthetic
atggccgactcccaagtacggctcatcagagttctataggggcttctgtctttaacggttccattggaatgcttgtcattcaacaatgccccctgagttagaaagaaggtcctgcattccggagacccagcatggcgtat

SEQ ID NO: 425593 - DNA, 140 bp, Artificial Sequence
  Synthetic
aggccctggctgctgatatgattccaatggaaccgttaaagacagaagcccctatagaactctgatgagctgtcccgttggtgaagctccttccccatacaactcaagatttgagtctgtgaccttttgggacagcggtg

SEQ ID NO: 425594 - DNA, 140 bp, Artificial Sequence
  Synthetic
caccgctgtcccaaaaggtcacagactcaaatcttgagttgtatggggaaggagcttcaccaacgggacagctcatcagagttctataggggcttctgtctttaacggttccattggaatcatatcagcagccagggcct

SEQ ID NO: 425595 - DNA, 140 bp, Artificial Sequence
  Synthetic
atacgccatgctgggtctccatgcggtgccgaatggaacgatagtgaaaacaatcacagatgatcaaattgaggtgaccaatgctactgagctagttcaaagctcttcaacagggaaaatcgtacttgggagtcggccat

SEQ ID NO: 425596 - DNA, 140 bp, Artificial Sequence
  Synthetic
atggccgactcccaagtacgattttccctgttgaagagctttgaactagctcagtagcattggtcacctcaatttgatcatctgtgattgttttcactatcgttccattcggcaccgcatggagacccagcatggcgtat

SEQ ID NO: 425597 - DNA, 140 bp, Artificial Sequence
  Synthetic
atacgccatgctgggtctccgtatttccggccctgacaatggggcagtggctgtattgaaatacaatggcataataacagataccatcaagagttggaggaacaacatattgagaacacacgtacttgggagtcggccat

SEQ ID NO: 425598 - DNA, 140 bp, Artificial Sequence
  Synthetic
atggccgactcccaagtacgtgtgttctcaatatgttgttcctccaactcttgatggtatctgttattatgccattgtatttcaatacagccactgccccattgtcagggccggaaatacggagacccagcatggcgtat

SEQ ID NO: 425599 - DNA, 140 bp, Artificial Sequence
  Synthetic
aggccctggctgctgatatgataataacagataccatcaagagttggaggaacaacatattgagaacacaagagtctgaatgtgcctgtattaatggttcttgctttaccctaatgactggaccttttgggacagcggtg

SEQ ID NO: 425600 - DNA, 140 bp, Artificial Sequence
  Synthetic
caccgctgtcccaaaaggtccagtcattagggtaaagcaagaaccattaatacaggcacattcagactcttgtgttctcaatatgttgttcctccaactcttgatggtatctgttattatcatatcagcagccagggcct

SEQ ID NO: 425601 - DNA, 140 bp, Artificial Sequence
  Synthetic
aggccctggctgctgatatgtcactattggagaatgccccaaatatgttaaaagcacccaactgagaatggcaacaggactaaggaatatcccatctattcaatccagaggacttttcgggaccttttgggacagcggtg

SEQ ID NO: 425602 - DNA, 140 bp, Artificial Sequence
  Synthetic
caccgctgtcccaaaaggtcccgaaaagtcctctggattgaatagatgggatattccttagtcctgttgccattctcagttgggtgcttttaacatatttggggcattctccaatagtgacatatcagcagccagggcct

SEQ ID NO: 425603 - DNA, 140 bp, Artificial Sequence
  Synthetic
aggccctggctgctgatatggtcgcctcatctcttgtacttgcaatggggtttgctgccttcttattctgggccatgtcaatcggatcaggcagatctatatattatttatagtggaaatgaccttttgggacagcggtg

SEQ ID NO: 425604 - DNA, 140 bp, Artificial Sequence
  Synthetic
caccgctgtcccaaaaggtcatttccactataaataatatatagatctgcctgatccgattgacatggcccagaataagaaggcagcaaaccccattgcaagtacaagagatgaggcgaccatatcagcagccagggcct

SEQ ID NO: 425605 - DNA, 140 bp, Artificial Sequence
  Synthetic
atacgccatgctgggtctccgggagggtagtcaaatcagttgagttgaatgcccctaattaccactatgaggagtgctcctgttatcctgatgctagcgaggtagtgtgtgtatgcagagcgtacttgggagtcggccat

SEQ ID NO: 425606 - DNA, 140 bp, Artificial Sequence
  Synthetic
atggccgactcccaagtacgctctgcatacacacactacctcgctagcatcaggataacaggagcactcctcatagtggtaattaggggcattcaactcaactgatttgactaccctcccggagacccagcatggcgtat

SEQ ID NO: 425607 - DNA, 140 bp, Artificial Sequence
  Synthetic
aggccctggctgctgatatgggtatggatatcaccatcaaaatgagcagggatctggttacgcagcagatcagaaaagcacacaaatcgcaattgatgggatcagcaacaaagtgaactcgaccttttgggacagcggtg

SEQ ID NO: 425608 - DNA, 140 bp, Artificial Sequence
  Synthetic
caccgctgtcccaaaaggtcgagttcactttgttgctgatcccatcaattgcgatttgtgtgcttttctgatctgctgcgtaaccagatccctgctcattttgatggtgatatccatacccatatcagcagccagggcct

SEQ ID NO: 425609 - DNA, 140 bp, Artificial Sequence
  Synthetic
atacgccatgctgggtctccccccaatgatggaacaggcagttgtggtccagtgtcttctaatggagcatatggagtaaaggggttttcgtttaaatacggtaatggtgtttggataggacgtacttgggagtcggccat

SEQ ID NO: 425610 - DNA, 140 bp, Artificial Sequence
  Synthetic
atggccgactcccaagtacgtcctatccaaacaccattaccgtatttaaacgaaaacccctttactccatatgctccattagaagacactggaccacaactgcctgttccatcattggggggagacccagcatggcgtat

SEQ ID NO: 425611 - DNA, 140 bp, Artificial Sequence
  Synthetic
atacgccatgctgggtctcccaatgggtggacagatacagatagcagtttctctatgaaacaagatattgtagcaataactgattggtcagggtatagtggaagttttgttcagcatccacgtacttgggagtcggccat

SEQ ID NO: 425612 - DNA, 140 bp, Artificial Sequence
  Synthetic
atggccgactcccaagtacgtggatgctgaacaaaacttccactataccctgaccaatcagttattgctacaatatcttgtttcatagagaaactgctatctgtatctgtccacccattgggagacccagcatggcgtat

SEQ ID NO: 425613 - DNA, 140 bp, Artificial Sequence
  Synthetic
atacgccatgctgggtctcctggcacatacaattatcccaaatattcagaagaatccaagttgaatagggaagaaatagatggtgtgaaactagaatcaatgggaattcaccagattttgcgtacttgggagtcggccat

SEQ ID NO: 425614 - DNA, 140 bp, Artificial Sequence
  Synthetic
atggccgactcccaagtacgcaaaatctggtgaattcccattgattctagtttcacaccatctatttcttccctattcaacttggattcttctgaatatttgggataattgtatgtgccaggagacccagcatggcgtat

SEQ ID NO: 425615 - DNA, 140 bp, Artificial Sequence
  Synthetic
atacgccatgctgggtctcccagaggaagacccaaggaaaatacaatctggactagtgggagcagcatttccttttgtggagtaaatagcgacactgtgggttggtcttggccagacggtcgtacttgggagtcggccat

SEQ ID NO: 425616 - DNA, 140 bp, Artificial Sequence
  Synthetic
atggccgactcccaagtacgaccgtctggccaagaccaacccacagtgtcgctatttactccacaaaaggaaatgctgctcccactagtccagattgtattttccttgggtcttcctctgggagacccagcatggcgtat

SEQ ID NO: 425617 - DNA, 140 bp, Artificial Sequence
  Synthetic
aggccctggctgctgatatgccttttgtggagtaaatagcgacactgtgggttggtcttggccagacggtgctgagttgccattcaccattgacaagtagtttgttcaaaaaactccttggaccttttgggacagcggtg

SEQ ID NO: 425618 - DNA, 140 bp, Artificial Sequence
  Synthetic
caccgctgtcccaaaaggtccaaggagttttttgaacaaactacttgtcaatggtgaatggcaactcagcaccgtctggccaagaccaacccacagtgtcgctatttactccacaaaaggcatatcagcagccagggcct

SEQ ID NO: 425619 - DNA, 140 bp, Artificial Sequence
  Synthetic
atacgccatgctgggtctccttggtggattcaccttcaaaaggacaagcggatcatctgttaagaaagaagaagaagtgctcacgggcaacctccaaacactgaaaataagagtacatgacgtacttgggagtcggccat

SEQ ID NO: 425620 - DNA, 140 bp, Artificial Sequence
  Synthetic
atggccgactcccaagtacgtcatgtactcttattttcagtgtttggaggttgcccgtgagcacttcttcttctttcttaacagatgatccgcttgtccttttgaaggtgaatccaccaaggagacccagcatggcgtat

SEQ ID NO: 425621 - DNA, 140 bp, Artificial Sequence
  Synthetic
aggccctggctgctgatatgaagggtggataaactaactcaaggtcgccagacttatgattggacattaaacagaaatcaaccggcagcaactgcattggccaacaccatagaagtttttgaccttttgggacagcggtg

SEQ ID NO: 425622 - DNA, 140 bp, Artificial Sequence
  Synthetic
caccgctgtcccaaaaggtcaaaaacttctatggtgttggccaatgcagttgctgccggttgatttctgtttaatgtccaatcataagtctggcgaccttgagttagtttatccacccttcatatcagcagccagggcct

SEQ ID NO: 425623 - DNA, 140 bp, Artificial Sequence
  Synthetic
atacgccatgctgggtctccactttcaaagaaaaaggagagtaagagacaacatgaccaagaagatggtcacacaaagaacaatagggaagaaaaaacaaagaatgaataagagaagttacgtacttgggagtcggccat

SEQ ID NO: 425624 - DNA, 140 bp, Artificial Sequence
  Synthetic
atggccgactcccaagtacgtaacttctcttattcattctttgttttttcttccctattgttctttgtgtgaccatcttcttggtcatgttgtctcttactctcctttttctttgaaagtggagacccagcatggcgtat

SEQ ID NO: 425625 - DNA, 140 bp, Artificial Sequence
  Synthetic
atacgccatgctgggtctcctgcagggcaaatcagcgtacagcccacattctctgtacagagaaacctcccatttgagagagcaaccattatggcagcatttacaggaaacactgaaggccgtacttgggagtcggccat

SEQ ID NO: 425626 - DNA, 140 bp, Artificial Sequence
  Synthetic
atggccgactcccaagtacggccttcagtgtttcctgtaaatgctgccataatggttgctctctcaaatgggaggtttctctgtacagagaatgtgggctgtacgctgatttgccctgcaggagacccagcatggcgtat

SEQ ID NO: 425627 - DNA, 140 bp, Artificial Sequence
  Synthetic
atacgccatgctgggtctccatggagcagaagaggtgattaaatgcatttgtagggacaattggaaaggcgcaaatagaccagtaatcaccataaacccaaaaacaatgactcatacgagcgtacttgggagtcggccat

SEQ ID NO: 425628 - DNA, 140 bp, Artificial Sequence
  Synthetic
atggccgactcccaagtacgctcgtatgagtcattgtttttgggtttatggtgattactggtctatttgcgcctttccaattgtccctacaaatgcatttaatcacctcttctgctccatggagacccagcatggcgtat

SEQ ID NO: 425629 - DNA, 140 bp, Artificial Sequence
  Synthetic
atacgccatgctgggtctccctttcaaaaggacaagcggatcatcagtcaagaaagaagaagaaatgctaacgggcaatctccaaacactgaaattaagagtacatgaagggtatgaagacgtacttgggagtcggccat

SEQ ID NO: 425630 - DNA, 140 bp, Artificial Sequence
  Synthetic
atggccgactcccaagtacgtcttcatacccttcatgtactcttaatttcagtgtttggagattgcccgttagcatttcttcttctttcttgactgatgatccgcttgtccttttgaaagggagacccagcatggcgtat

SEQ ID NO: 425631 - DNA, 140 bp, Artificial Sequence
  Synthetic
aggccctggctgctgatatggagaagcctaaatttcttccggatttatacgactacaaagaaaatcgattcgttgaaattggagtgacacgaagggaggtccacatatactacctagagagaccttttgggacagcggtg

SEQ ID NO: 425632 - DNA, 140 bp, Artificial Sequence
  Synthetic
caccgctgtcccaaaaggtctctctaggtagtatatgtggacctcccttcgtgtcactccaatttcaacgaatcgattttctttgtagtcgtataaatccggaagaaatttaggcttctccatatcagcagccagggcct

SEQ ID NO: 425633 - DNA, 140 bp, Artificial Sequence
  Synthetic
atacgccatgctgggtctccggaaagggcaatgaaagaatatggggaagatccgaaaatcgaaacaaacaagtttgccgcaatatgcacacacttggaagtatgcttcatgtattcagaccgtacttgggagtcggccat

SEQ ID NO: 425634 - DNA, 140 bp, Artificial Sequence
  Synthetic
atggccgactcccaagtacggtctgaatacatgaagcatacttccaagtgtgtgcatattgcggcaaacttgtttgtttcgattttcggatcttccccatattctttcattgccctttccggagacccagcatggcgtat

SEQ ID NO: 425635 - DNA, 140 bp, Artificial Sequence
  Synthetic
atacgccatgctgggtctcccctgagtcagtacttgttaacacctaccaatggatcatcagaaactgggagaccgtgaaaattcagtggtctcaagaccccacgatattgtacaataagacgtacttgggagtcggccat

SEQ ID NO: 425636 - DNA, 140 bp, Artificial Sequence
  Synthetic
atggccgactcccaagtacgtcttattgtacaatatcgtggggtcttgagaccactgaattttcacggtctcccagtttctgatgatccattggtaggtgttaacaagtactgactcaggggagacccagcatggcgtat

SEQ ID NO: 425637 - DNA, 140 bp, Artificial Sequence
  Synthetic
atacgccatgctgggtctcccatggtgtctagggcccggattgatgccagaattgacttcgagtctggacggattaagaaagaagagttctctgagatcatgaagatctgttccaccattcgtacttgggagtcggccat

SEQ ID NO: 425638 - DNA, 140 bp, Artificial Sequence
  Synthetic
atggccgactcccaagtacgaatggtggaacagatcttcatgatctcagagaactcttctttcttaatccgtccagactcgaagtcaattctggcatcaatccgggccctagacaccatgggagacccagcatggcgtat

SEQ ID NO: 425639 - DNA, 140 bp, Artificial Sequence
  Synthetic
atacgccatgctgggtctccctattttgaaaaggtcgaaaggctaaaacatggaacctttggccccgttcacttccgaaaccaggttaaaatacgccgcagggtcgacataaacccaggccgtacttgggagtcggccat

SEQ ID NO: 425640 - DNA, 140 bp, Artificial Sequence
  Synthetic
atggccgactcccaagtacggcctgggtttatgtcgaccctgcggcgtattttaacctggtttcggaagtgaacggggccaaaggttccatgttttagcctttcgaccttttcaaaatagggagacccagcatggcgtat

SEQ ID NO: 425641 - DNA, 140 bp, Artificial Sequence
  Synthetic
aggccctggctgctgatatgagtggatcatcagccaaaagagaagaagaagtgcttacgggcaaccttcaaacattaaaaataagagtacatgaggggtatgaagagttcacaatggttggaccttttgggacagcggtg

SEQ ID NO: 425642 - DNA, 140 bp, Artificial Sequence
  Synthetic
caccgctgtcccaaaaggtccaaccattgtgaactcttcatacccctcatgtactcttatttttaatgtttgaaggttgcccgtaagcacttcttcttctcttttggctgatgatccactcatatcagcagccagggcct

SEQ ID NO: 425643 - DNA, 140 bp, Artificial Sequence
  Synthetic
atacgccatgctgggtctccatgtaataagtgacatgaattttcttgacgaagaaggaaaagcatatacagcattagaaggacaagggaaagaacaaaacttgagaccacaatatgaagtcgtacttgggagtcggccat

SEQ ID NO: 425644 - DNA, 140 bp, Artificial Sequence
  Synthetic
atggccgactcccaagtacgacttcatattgtggtctcaagttttgttctttcccttgtccttctaatgctgtatatgcttttccttcttcgtcaagaaaattcatgtcacttattacatggagacccagcatggcgtat

SEQ ID NO: 425645 - DNA, 140 bp, Artificial Sequence
  Synthetic
atacgccatgctgggtctccgcaatggtgttctcacaagaggattgtatgataaaggcagtgagaggtgatttgaactttgtcaacagagcgaaccagcggctaaatcccatgcatcaaccgtacttgggagtcggccat

SEQ ID NO: 425646 - DNA, 140 bp, Artificial Sequence
  Synthetic
atggccgactcccaagtacggttgatgcatgggatttagccgctggttcgctctgttgacaaagttcaaatcacctctcactgcctttatcatacaatcctcttgtgagaacaccattgcggagacccagcatggcgtat

SEQ ID NO: 425647 - DNA, 140 bp, Artificial Sequence
  Synthetic
aggccctggctgctgatatgtctttccaaatgaagtgggagcgagaatactgacgtcggagtcacaattgacgataacaaaggagaagaaggaagaactccaggactgcaaaatcgccccgaccttttgggacagcggtg

SEQ ID NO: 425648 - DNA, 140 bp, Artificial Sequence
  Synthetic
caccgctgtcccaaaaggtcggggcgattttgcagtcctggagttcttccttcttctcctttgttatcgtcaattgtgactccgacgtcagtattctcgctcccacttcatttggaaagacatatcagcagccagggcct

SEQ ID NO: 425649 - DNA, 140 bp, Artificial Sequence
  Synthetic
aggccctggctgctgatatgcttctctaactgtgaacgtgagaggttcaggaatgagagtggttgtgagaggcaattctcctgtgttcaactacaacaaggcaaccaaaaggcttacagtgaccttttgggacagcggtg

SEQ ID NO: 425650 - DNA, 140 bp, Artificial Sequence
  Synthetic
caccgctgtcccaaaaggtcactgtaagccttttggttgccttgttgtagttgaacacaggagaattgcctctcacaaccactctcattcctgaacctctcacgttcacagttagagaagcatatcagcagccagggcct

SEQ ID NO: 425651 - DNA, 140 bp, Artificial Sequence
  Synthetic
aggccctggctgctgatatggtctcgcacccgcgagatactgacaaaaaccacagtggaccatatggccataattaagaagtacacatcggggagacaggaaaagaacccgtcacttagggaccttttgggacagcggtg

SEQ ID NO: 425652 - DNA, 140 bp, Artificial Sequence
  Synthetic
caccgctgtcccaaaaggtccctaagtgacgggttcttttcctgtctccccgatgtgtacttcttaattatggccatatggtccactgtggtttttgtcagtatctcgcgggtgcgagaccatatcagcagccagggcct

SEQ ID NO: 425653 - DNA, 140 bp, Artificial Sequence
  Synthetic
atacgccatgctgggtctccacacagagaacaataggaaagaaaaaacaaagactgaacaaaaggagctacctaataagagcactgacattgaacacaatgacaaaggatgctgaaagagcgtacttgggagtcggccat

SEQ ID NO: 425654 - DNA, 140 bp, Artificial Sequence
  Synthetic
atggccgactcccaagtacgctctttcagcatcctttgtcattgtgttcaatgtcagtgctcttattaggtagctccttttgttcagtctttgttttttctttcctattgttctctgtgtggagacccagcatggcgtat

SEQ ID NO: 425655 - DNA, 140 bp, Artificial Sequence
  Synthetic
atacgccatgctgggtctcctcaactactgtaaggcctctacagttatgatgaagtatgtgctttttcacacttcattgttgaatgaaagcaatgccagcatgggaaaatacaaagtaatcgtacttgggagtcggccat

SEQ ID NO: 425656 - DNA, 140 bp, Artificial Sequence
  Synthetic
atggccgactcccaagtacgattactttgtattttcccatgctggcattgctttcattcaacaatgaagtgtgaaaaagcacatacttcatcataactgtagaggccttacagtagttgaggagacccagcatggcgtat

SEQ ID NO: 425657 - DNA, 140 bp, Artificial Sequence
  Synthetic
atacgccatgctgggtctccgatccctgggttttgcttaatgcatcctggttcaactccttcctcacacatgcactgaagtaattggggcaatgctactatttgctatccatactgtccacgtacttgggagtcggccat

SEQ ID NO: 425658 - DNA, 140 bp, Artificial Sequence
  Synthetic
atggccgactcccaagtacgtggacagtatggatagcaaatagtagcattgccccaattacttcagtgcatgtgtgaggaaggagttgaaccaggatgcattaagcaaaacccagggatcggagacccagcatggcgtat

SEQ ID NO: 425659 - DNA, 140 bp, Artificial Sequence
  Synthetic
aggccctggctgctgatatgatggatgtcaacccgactttacttttcttgaaagtaccagtgcaaaatgctataagtaccacattcccttatactggagaccctccatacagccatggaagaccttttgggacagcggtg

SEQ ID NO: 425660 - DNA, 140 bp, Artificial Sequence
  Synthetic
caccgctgtcccaaaaggtcttccatggctgtatggagggtctccagtataagggaatgtggtacttatagcattttgcactggtactttcaagaaaagtaaagtcgggttgacatccatcatatcagcagccagggcct

SEQ ID NO: 425661 - DNA, 140 bp, Artificial Sequence
  Synthetic
aggccctggctgctgatatgccaagatcaagatgaaatggggcatggagatgaggcggtgccttcttcaatcccttcaacaaatcgagagcatgattgaggccgagtcttctgtcaaagagaccttttgggacagcggtg

SEQ ID NO: 425662 - DNA, 140 bp, Artificial Sequence
  Synthetic
caccgctgtcccaaaaggtctctttgacagaagactcggcctcaatcatgctctcgatttgttgaagggattgaagaaggcaccgcctcatctccatgccccatttcatcttgatcttggcatatcagcagccagggcct

SEQ ID NO: 425663 - DNA, 140 bp, Artificial Sequence
  Synthetic
atacgccatgctgggtctccgatatgacatgaccaaagcctgtttcaagggagacagagtaaatagccccaaaactttcagtattggaactcaagaaggaaaactagtaaaaggatccttcgtacttgggagtcggccat

SEQ ID NO: 425664 - DNA, 140 bp, Artificial Sequence
  Synthetic
atggccgactcccaagtacgaaggatccttttactagttttccttcttgagttccaatactgaaagttttggggctatttactctgtctcccttgaaacaggctttggtcatgtcatatcggagacccagcatggcgtat

SEQ ID NO: 425665 - DNA, 140 bp, Artificial Sequence
  Synthetic
aggccctggctgctgatatgtatggaagttgtttttcccaatgaagtgggagccagaatactaacatcagaatcacaactaacaataactaaagagaaaaaagaagaactccgagattgcgaccttttgggacagcggtg

SEQ ID NO: 425666 - DNA, 140 bp, Artificial Sequence
  Synthetic
caccgctgtcccaaaaggtcgcaatctcggagttcttcttttttctctttagttattgttagttgtgattctgatgttagtattctggctcccacttcattgggaaaaacaacttccatacatatcagcagccagggcct

SEQ ID NO: 425667 - DNA, 140 bp, Artificial Sequence
  Synthetic
atacgccatgctgggtctccaataccagcagaaatgcttgcaaacattgatctcaaatacttcaatgaaataacgaaaaagaaaattgagaagataagacctctattaatagatggtacacgtacttgggagtcggccat

SEQ ID NO: 425668 - DNA, 140 bp, Artificial Sequence
  Synthetic
atggccgactcccaagtacgtgtaccatctattaatagaggtcttatcttctcaattttctttttcgttatttcattgaagtatttgagatcaatgtttgcaagcatttctgctggtattggagacccagcatggcgtat

SEQ ID NO: 425669 - DNA, 140 bp, Artificial Sequence
  Synthetic
atacgccatgctgggtctccgggagtaaagtgttggaatcagtggatgaaataatgaatgaataaaaggaaatagtactcaatttggtactattttgttcattatgtatctaaacatccacgtacttgggagtcggccat

SEQ ID NO: 425670 - DNA, 140 bp, Artificial Sequence
  Synthetic
atggccgactcccaagtacgtggatgtttagatacataatgaacaaaatagtaccaaattgagtactatttccttttattcattcattatttcatccactgattccaacactttactcccggagacccagcatggcgtat

SEQ ID NO: 425671 - DNA, 140 bp, Artificial Sequence
  Synthetic
atacgccatgctgggtctccgtaggagtctatgggattcctttcgtcagtccgaaagaggcgaagagacaattgaagaaaaatttgagattacgggaactatgcgcaaacttgccgaccacgtacttgggagtcggccat

SEQ ID NO: 425672 - DNA, 140 bp, Artificial Sequence
  Synthetic
atggccgactcccaagtacgtggtcggcaagtttgcgcatagttcccgtaatctcaaatttttcttcaattgtctcttcgcctctttcggactgacgaaaggaatcccatagactcctacggagacccagcatggcgtat

SEQ ID NO: 425673 - DNA, 140 bp, Artificial Sequence
  Synthetic
aggccctggctgctgatatggcctcattgagccctggaatgatgatgggcatgttcaacatgctaagtacagttttgggagtttcgattctaaatctagggcaaaagaggtacaccaaaagaccttttgggacagcggtg

SEQ ID NO: 425674 - DNA, 140 bp, Artificial Sequence
  Synthetic
caccgctgtcccaaaaggtcttttggtgtacctcttttgccctagatttagaatcgaaactcccaaaactgtacttagcatgttgaacatgcccatcatcattccagggctcaatgaggccatatcagcagccagggcct

SEQ ID NO: 425675 - DNA, 140 bp, Artificial Sequence
  Synthetic
atacgccatgctgggtctccgatagtggagcgaattctggagaaggaatctgatgaggcacttaaaatgccagcttcacgctacctaacagatatgactctcgaggaaatgtcaagggaccgtacttgggagtcggccat

SEQ ID NO: 425676 - DNA, 140 bp, Artificial Sequence
  Synthetic
atggccgactcccaagtacggtcccttgacatttcctcgagagtcatatctgttaggtagcgtgaagctggcattttaagtgcctcatcagattccttctccagaattcgctccactatcggagacccagcatggcgtat

SEQ ID NO: 425677 - DNA, 140 bp, Artificial Sequence
  Synthetic
aggccctggctgctgatatgttcatagaaggtggttggccaggtctaatcaatggttggtatggattccaacacaggaatgaggaaggaacagggattgccgcagacaaagaatcaacccgaccttttgggacagcggtg

SEQ ID NO: 425678 - DNA, 140 bp, Artificial Sequence
  Synthetic
caccgctgtcccaaaaggtcgggttgattctttgtctgcggcaatccctgttccttcctcattcctgtgttggaatccataccaaccattgattagacctggccaaccaccttctatgaacatatcagcagccagggcct

SEQ ID NO: 425679 - DNA, 140 bp, Artificial Sequence
  Synthetic
atacgccatgctgggtctccgaccacataataattgaggggctttctgccgaagagataataaaaatgggtgaaacagttttggagatagaagaattgcattaaattcaattttactgtacgtacttgggagtcggccat

SEQ ID NO: 425680 - DNA, 140 bp, Artificial Sequence
  Synthetic
atggccgactcccaagtacgtacagtaaaattgaatttaatgcaattcttctatctccaaaactgtttcacccatttttattatctcttcggcagaaagcccctcaattattatgtggtcggagacccagcatggcgtat

SEQ ID NO: 425681 - DNA, 140 bp, Artificial Sequence
  Synthetic
aggccctggctgctgatatgcatttcagtctcttgtccctaaggcaaccagaagccggtacagtggattcgtaaggacactgttccagcaaatgcgggatgtgcttgggacatttgacacgaccttttgggacagcggtg

SEQ ID NO: 425682 - DNA, 140 bp, Artificial Sequence
  Synthetic
caccgctgtcccaaaaggtcgtgtcaaatgtcccaagcacatcccgcatttgctggaacagtgtccttacgaatccactgtaccggcttctggttgccttagggacaagagactgaaatgcatatcagcagccagggcct

SEQ ID NO: 425683 - DNA, 140 bp, Artificial Sequence
  Synthetic
atacgccatgctgggtctccattgaacccattgataatgtcatggggatgatcggaatattacctgacatgactcccagcacagaattgtcactgagaggagtaagagttagtaaaatggcgtacttgggagtcggccat

SEQ ID NO: 425684 - DNA, 140 bp, Artificial Sequence
  Synthetic
atggccgactcccaagtacgccattttactaactcttactcctctcagtgacaattctgtgctgggagtcatgtcaggtaatattccgatcatccccatgacattatcaatgggttcaatggagacccagcatggcgtat

SEQ ID NO: 425685 - DNA, 140 bp, Artificial Sequence
  Synthetic
atacgccatgctgggtctccggtgatgccccatttctagaccggcttcgccgagatcagaagtccctgagaggaagaagcagcactcttggtctggacatcagaacagcaactcgtgaagcgtacttgggagtcggccat

SEQ ID NO: 425686 - DNA, 140 bp, Artificial Sequence
  Synthetic
atggccgactcccaagtacgcttcacgagttgctgttctgatgtccagaccaagagtgctgcttcttcctctcagggacttctgatctcggcgaagccggtctagaaatggggcatcaccggagacccagcatggcgtat

SEQ ID NO: 425687 - DNA, 140 bp, Artificial Sequence
  Synthetic
aggccctggctgctgatatgaatatggagaagcatatactgacacataccattcctatgcaaacaaaatcctaagaacacaagaaagtgcctgcaattgcatcgggggaaattgttatctgaccttttgggacagcggtg

SEQ ID NO: 425688 - DNA, 140 bp, Artificial Sequence
  Synthetic
caccgctgtcccaaaaggtcagataacaatttcccccgatgcaattgcaggcactttcttgtgttcttaggattttgtttgcataggaatggtatgtgtcagtatatgcttctccatattcatatcagcagccagggcct

SEQ ID NO: 425689 - DNA, 140 bp, Artificial Sequence
  Synthetic
aggccctggctgctgatatgtctcccggtggctggtggaacaggcagtgtttatattgaagtgctacacttaactcagggaacatgctgggagcaaatgtacactccaggaggaaaagtggaccttttgggacagcggtg

SEQ ID NO: 425690 - DNA, 140 bp, Artificial Sequence
  Synthetic
caccgctgtcccaaaaggtccacttttcctcctggagtgtacatttgctcccagcatgttccctgagttaagtgtagcacttcaatataaacactgcctgttccaccagccaccgggagacatatcagcagccagggcct

SEQ ID NO: 425691 - DNA, 140 bp, Artificial Sequence
  Synthetic
aggccctggctgctgatatgagaaatgatgatgtcgaccagagtctgattatcgctgctagaaacatagtaagaagagcagcagtgtcagcagacccattagcatccctcttggagatgtgaccttttgggacagcggtg

SEQ ID NO: 425692 - DNA, 140 bp, Artificial Sequence
  Synthetic
caccgctgtcccaaaaggtcacatctccaagagggatgctaatgggtctgctgacactgctgctcttcttactatgtttctagcagcgataatcagactctggtcgacatcatcatttctcatatcagcagccagggcct

SEQ ID NO: 425693 - DNA, 140 bp, Artificial Sequence
  Synthetic
atacgccatgctgggtctccctggaataaatgagtcagccgacatgagcattggagtaacagtgataaagaacaacatgataaacaatgaccttggaccagcaacagcccaaatggctctcgtacttgggagtcggccat

SEQ ID NO: 425694 - DNA, 140 bp, Artificial Sequence
  Synthetic
atggccgactcccaagtacgagagccatttgggctgttgctggtccaaggtcattgtttatcatgttgttctttatcactgttactccaatgctcatgtcggctgactcatttattccagggagacccagcatggcgtat

SEQ ID NO: 425695 - DNA, 140 bp, Artificial Sequence
  Synthetic
atacgccatgctgggtctccacactgaaaataagagtacatgaaggatatgaagaattcacaatggtcgggagaagagcaacagctattctcagaaaagcaaccaggagattgatccagtcgtacttgggagtcggccat

SEQ ID NO: 425696 - DNA, 140 bp, Artificial Sequence
  Synthetic
atggccgactcccaagtacgactggatcaatctcctggttgcttttctgagaatagctgttgctcttctcccgaccattgtgaattcttcatatccttcatgtactcttattttcagtgtggagacccagcatggcgtat

SEQ ID NO: 425697 - DNA, 140 bp, Artificial Sequence
  Synthetic
atacgccatgctgggtctcccaattcgtctctttgccccattaggggatgggctgtacacagtaaggacaacagtataagaattggttccaagggggatgtgtttgtaattagagagccgcgtacttgggagtcggccat

SEQ ID NO: 425698 - DNA, 140 bp, Artificial Sequence
  Synthetic
atggccgactcccaagtacgcggctctctaattacaaacacatcccccttggaaccaattcttatactgttgtccttactgtgtacagcccatcccctaatggggcaaagagacgaattgggagacccagcatggcgtat

SEQ ID NO: 425699 - DNA, 140 bp, Artificial Sequence
  Synthetic
atacgccatgctgggtctcccagggcaagaatcaaaaccaggctcttcaccataagacaagagatggccagtaggggtctatgggattcctttcgtcagtccgagagaggcgaagagacacgtacttgggagtcggccat

SEQ ID NO: 425700 - DNA, 140 bp, Artificial Sequence
  Synthetic
atggccgactcccaagtacgtgtctcttcgcctctctcggactgacgaaaggaatcccatagacccctactggccatctcttgtcttatggtgaagagcctggttttgattcttgccctgggagacccagcatggcgtat

SEQ ID NO: 425701 - DNA, 140 bp, Artificial Sequence
  Synthetic
atacgccatgctgggtctcccagcaaatgcgggatgtgcttggaacatttgacactgtccaaataataaaacttctcccctttgctgctgctccaccggaacagagtaggatgcagttctcgtacttgggagtcggccat

SEQ ID NO: 425702 - DNA, 140 bp, Artificial Sequence
  Synthetic
atggccgactcccaagtacgagaactgcatcctactctgttccggtggagcagcagcaaaggggagaagttttattatttggacagtgtcaaatgttccaagcacatcccgcatttgctgggagacccagcatggcgtat

SEQ ID NO: 425703 - DNA, 140 bp, Artificial Sequence
  Synthetic
atacgccatgctgggtctccggcaattctccagtgttcaattacaacaaagcaaccaaaaggcttacagttcttggaaaggatgcaggtgcattgactgaagatccagatgaaggcacagcgtacttgggagtcggccat

SEQ ID NO: 425704 - DNA, 140 bp, Artificial Sequence
  Synthetic
atggccgactcccaagtacgctgtgccttcatctggatcttcagtcaatgcacctgcatcctttccaagaactgtaagccttttggttgctttgttgtaattgaacactggagaattgccggagacccagcatggcgtat

SEQ ID NO: 425705 - DNA, 140 bp, Artificial Sequence
  Synthetic
atacgccatgctgggtctccttcgatgaaacaagatatagtagcaataactgattggtcaggatatagcgggagttttgtccagcatccagaactgacaggattagattgcataagacctcgtacttgggagtcggccat

SEQ ID NO: 425706 - DNA, 140 bp, Artificial Sequence
  Synthetic
atggccgactcccaagtacgaggtcttatgcaatctaatcctgtcagttctggatgctggacaaaactcccgctatatcctgaccaatcagttattgctactatatcttgtttcatcgaaggagacccagcatggcgtat

SEQ ID NO: 425707 - DNA, 140 bp, Artificial Sequence
  Synthetic
aggccctggctgctgatatgattcaactgtcgccagttcattggtactggtagtctccctgggggcaatcagtttctggatgtgctctaatgggtcgctacagtgcagaatatgtatttagaccttttgggacagcggtg

SEQ ID NO: 425708 - DNA, 140 bp, Artificial Sequence
  Synthetic
caccgctgtcccaaaaggtctaaatacatattctgcactgtagcgacccattagagcacatccagaaactgattgcccccagggagactaccagtaccaatgaactggcgacagttgaatcatatcagcagccagggcct

SEQ ID NO: 425709 - DNA, 140 bp, Artificial Sequence
  Synthetic
atacgccatgctgggtctccactctagatttccatgaccttaacgtaaaaaatttatatgaaaaggtcaaatcacaactaaggaacaatgccaaggaaatcggaaatggctgctttgagtcgtacttgggagtcggccat

SEQ ID NO: 425710 - DNA, 140 bp, Artificial Sequence
  Synthetic
atggccgactcccaagtacgactcaaagcagccatttccgatttccttggcattgttccttagttgtgatttgaccttttcatataaattttttacgttaaggtcatggaaatctagagtggagacccagcatggcgtat

SEQ ID NO: 425711 - DNA, 140 bp, Artificial Sequence
  Synthetic
atacgccatgctgggtctcccattcttaggactcaagaatcagaatgtgtgtgccataaaggaatctgcccagtggtcatgacagatggtccagcaaacaacaaggcagcaactaagatacgtacttgggagtcggccat

SEQ ID NO: 425712 - DNA, 140 bp, Artificial Sequence
  Synthetic
atggccgactcccaagtacgtatcttagttgctgccttgttgtttgctggaccatctgtcatgaccactgggcagattcctttatggcacacacattctgattcttgagtcctaagaatgggagacccagcatggcgtat

SEQ ID NO: 425713 - DNA, 140 bp, Artificial Sequence
  Synthetic
aggccctggctgctgatatgaaacagactgtgtcctggaggccatggctttccttgaagaatcccacccagggatatttgagaattcatgccttgaaacaatggaaattgtccaacaaacgaccttttgggacagcggtg

SEQ ID NO: 425714 - DNA, 140 bp, Artificial Sequence
  Synthetic
caccgctgtcccaaaaggtcgtttgttggacaatttccattgtttcaaggcatgaattctcaaatatccctgggtgggattcttcaaggaaagccatggcctccaggacacagtctgtttcatatcagcagccagggcct

SEQ ID NO: 425715 - DNA, 140 bp, Artificial Sequence
  Synthetic
aggccctggctgctgatatgtgacaaagaagaaataaggagagtttggcgccaagcaaacaatggcgaagatgcaacagcaggtcttactcatataatgatttggcattccaacctgaatgaccttttgggacagcggtg

SEQ ID NO: 425716 - DNA, 140 bp, Artificial Sequence
  Synthetic
caccgctgtcccaaaaggtcattcaggttggaatgccaaatcattatatgagtaagacctgctgttgcatcttcgccattgtttgcttggcgccaaactctccttatttcttctttgtcacatatcagcagccagggcct

SEQ ID NO: 425717 - DNA, 140 bp, Artificial Sequence
  Synthetic
atacgccatgctgggtctcctacacatcagggaggcaagagaagaaccctgcactcaggatgaagtggatgatggcaatgaaatatccaattacagcagacaagagaataatggaaatgacgtacttgggagtcggccat

SEQ ID NO: 425718 - DNA, 140 bp, Artificial Sequence
  Synthetic
atggccgactcccaagtacgtcatttccattattctcttgtctgctgtaattggatatttcattgccatcatccacttcatcctgagtgcagggttcttctcttgcctccctgatgtgtaggagacccagcatggcgtat

SEQ ID NO: 425719 - DNA, 140 bp, Artificial Sequence
  Synthetic
aggccctggctgctgatatgtccatggggctaaggaggtcgcactcagctactcaaccggtgcacttgccagttgcatgggtcttatatacaacagaatgggaacagtaactacggaagtgaccttttgggacagcggtg

SEQ ID NO: 425720 - DNA, 140 bp, Artificial Sequence
  Synthetic
caccgctgtcccaaaaggtcacttccgtagttactgttcccattctgttgtatataagacccatgcaactggcaagtgcaccggttgagtagctgagtgcgacctccttagccccatggacatatcagcagccagggcct

SEQ ID NO: 425721 - DNA, 140 bp, Artificial Sequence
  Synthetic
atacgccatgctgggtctccatgaatacgaactttgagtctgttcaacatgaattcagtgaaattgaagagagaataaaccagttgtcaaaacatgtggatgattctgttattgacatatcgtacttgggagtcggccat

SEQ ID NO: 425722 - DNA, 140 bp, Artificial Sequence
  Synthetic
atggccgactcccaagtacgatatgtcaataacagaatcatccacatgttttgacaactggtttattctctcttcaatttcactgaattcatgttgaacagactcaaagttcgtattcatggagacccagcatggcgtat

SEQ ID NO: 425723 - DNA, 140 bp, Artificial Sequence
  Synthetic
aggccctggctgctgatatgtttcgaacaaataacatttatgcaagccttacaactactgcttgaagtagagcaagagataaggactttctcgtttcagcttatttaatgataaaaaacagaccttttgggacagcggtg

SEQ ID NO: 425724 - DNA, 140 bp, Artificial Sequence
  Synthetic
caccgctgtcccaaaaggtctgttttttatcattaaataagctgaaacgagaaagtccttatctcttgctctacttcaagcagtagttgtaaggcttgcataaatgttatttgttcgaaacatatcagcagccagggcct

SEQ ID NO: 425725 - DNA, 140 bp, Artificial Sequence
  Synthetic
aggccctggctgctgatatgatggaagactttgtgcgacaatgcttcaatccaatgatcgtcgagcttgcggaaaagacaatgaaagaatatggagaaagtccaaaaatcgaaacgaacagaccttttgggacagcggtg

SEQ ID NO: 425726 - DNA, 140 bp, Artificial Sequence
  Synthetic
caccgctgtcccaaaaggtctgttcgtttcgatttttggactttctccatattctttcattgtcttttccgcaagctcgacgatcattggattgaagcattgtcgcacaaagtcttccatcatatcagcagccagggcct

SEQ ID NO: 425727 - DNA, 140 bp, Artificial Sequence
  Synthetic
aggccctggctgctgatatgtgggaaagtatgcagaaccctactggcgaagtctgtgttcaacagtctatacgcatctccacaacttgagggattttcagcagaatcgaggaaattgcttgaccttttgggacagcggtg

SEQ ID NO: 425728 - DNA, 140 bp, Artificial Sequence
  Synthetic
caccgctgtcccaaaaggtcaagcaatttcctcgattctgctgaaaatccctcaagttgtggagatgcgtatagactgttgaacacagacttcgccagtagggttctgcatactttcccacatatcagcagccagggcct

SEQ ID NO: 425729 - DNA, 140 bp, Artificial Sequence
  Synthetic
atacgccatgctgggtctcctccgaatgcattattaaaacaccgatttgagataattgaagggagagaccggacaatggcttggacagtagtaaatagtatctgcaacaccacaggagtccgtacttgggagtcggccat

SEQ ID NO: 425730 - DNA, 140 bp, Artificial Sequence
  Synthetic
atggccgactcccaagtacggactcctgtggtgttgcagatactatttactactgtccaagccattgtccggtctctcccttcaattatctcaaatcggtgttttaataatgcattcggaggagacccagcatggcgtat

SEQ ID NO: 425731 - DNA, 140 bp, Artificial Sequence
  Synthetic
atacgccatgctgggtctccagtattaggggtctcaatcctgaatcttggacaaaagaggtacaccaaaaccacatactggtgggatggactccaatcctctgatgatttcgctctcatacgtacttgggagtcggccat

SEQ ID NO: 425732 - DNA, 140 bp, Artificial Sequence
  Synthetic
atggccgactcccaagtacgtatgagagcgaaatcatcagaggattggagtccatcccaccagtatgtggttttggtgtacctcttttgtccaagattcaggattgagacccctaatactggagacccagcatggcgtat

SEQ ID NO: 425733 - DNA, 140 bp, Artificial Sequence
  Synthetic
aggccctggctgctgatatgaaagaagtgaacgccaggatcgagccatttctaaggacaacaccacgccctctcagattgcctaatgggcctccctgctctcagcggtcgaaattcttgcgaccttttgggacagcggtg

SEQ ID NO: 425734 - DNA, 140 bp, Artificial Sequence
  Synthetic
caccgctgtcccaaaaggtcgcaagaatttcgaccgctgagagcagggaggcccattaggcaatctgagagggcgtggtgttgtccttagaaatggctcgatcctggcgttcacttctttcatatcagcagccagggcct

SEQ ID NO: 425735 - DNA, 140 bp, Artificial Sequence
  Synthetic
aggccctggctgctgatatgcagagcaagaattaaaaccaggctgttcactataaggcaagagatggccagtaggggtctatgggattcctttcgtcaatccgagagaggcgaagagacagaccttttgggacagcggtg

SEQ ID NO: 425736 - DNA, 140 bp, Artificial Sequence
  Synthetic
caccgctgtcccaaaaggtctgtctcttcgcctctctcggattgacgaaaggaatcccatagacccctactggccatctcttgccttatagtgaacagcctggttttaattcttgctctgcatatcagcagccagggcct

SEQ ID NO: 425737 - DNA, 140 bp, Artificial Sequence
  Synthetic
aggccctggctgctgatatgggttcaggaatgagaatactcataaggggcaattcccctgtattcaattataataagacaaccaaaagacttactgttcttggaaaggacgcaggtgcatgaccttttgggacagcggtg

SEQ ID NO: 425738 - DNA, 140 bp, Artificial Sequence
  Synthetic
caccgctgtcccaaaaggtcatgcacctgcgtcctttccaagaacagtaagtcttttggttgtcttattataattgaatacaggggaattgccccttatgagtattctcattcctgaacccatatcagcagccagggcct

SEQ ID NO: 425739 - DNA, 140 bp, Artificial Sequence
  Synthetic
aggccctggctgctgatatgaaggaagtgaacgccagaattgagccatttatgaagacaacaccacgccctctcagactacctgagggccctccctgctcccagcggtcgaagttcttacgaccttttgggacagcggtg

SEQ ID NO: 425740 - DNA, 140 bp, Artificial Sequence
  Synthetic
caccgctgtcccaaaaggtcgtaagaacttcgaccgctgggagcagggagggccctcaggtagtctgagagggcgtggtgttgtcttcataaatggctcaattctggcgttcacttccttcatatcagcagccagggcct

SEQ ID NO: 425741 - DNA, 140 bp, Artificial Sequence
  Synthetic
aggccctggctgctgatatgatggcgtcccaaggcaccaaacggtcttatgaacagatggaaactgatggagatcgccagaatgcaactgagattagggcatccgtcgggaagatgattggaccttttgggacagcggtg

SEQ ID NO: 425742 - DNA, 140 bp, Artificial Sequence
  Synthetic
caccgctgtcccaaaaggtccaatcatcttcccgacggatgccctaatctcagttgcattctggcgatctccatcagtttccatctgttcataagaccgtttggtgccttgggacgccatcatatcagcagccagggcct

SEQ ID NO: 425743 - DNA, 140 bp, Artificial Sequence
  Synthetic
aggccctggctgctgatatgcaatttcaacaacattcccatacactggtgttcccccttattcccatggaacaggaacaggctacacaatagacaccgtgatcagaacgcatgagtactcgaccttttgggacagcggtg

SEQ ID NO: 425744 - DNA, 140 bp, Artificial Sequence
  Synthetic
caccgctgtcccaaaaggtcgagtactcatgcgttctgatcacggtgtctattgtgtagcctgttcctgttccatgggaataagggggaacaccagtgtatgggaatgttgttgaaattgcatatcagcagccagggcct

SEQ ID NO: 425745 - DNA, 140 bp, Artificial Sequence
  Synthetic
aggccctggctgctgatatggaagataaaatcccaaaaacaaagaacatgaagaaaacaagccaattaaagtgggcacttggtgagaatatggcaccagaaaaagtagactttgaggactgaccttttgggacagcggtg

SEQ ID NO: 425746 - DNA, 140 bp, Artificial Sequence
  Synthetic
caccgctgtcccaaaaggtcagtcctcaaagtctactttttctggtgccatattctcaccaagtgcccactttaattggcttgttttcttcatgttctttgtttttgggattttatcttccatatcagcagccagggcct

SEQ ID NO: 425747 - DNA, 140 bp, Artificial Sequence
  Synthetic
aggccctggctgctgatatgatggagagaataaaggaactaagagatttgatgtcgcagtcttgcactcgcgagatactgacaaaaaccacagtggaccacatggccataattaagaaatgaccttttgggacagcggtg

SEQ ID NO: 425748 - DNA, 140 bp, Artificial Sequence
  Synthetic
caccgctgtcccaaaaggtcatttcttaattatggccatgtggtccactgtggtttttgtcagtatctcgcgagtgcaagactgcgacatcaaatctcttagttcctttattctctccatcatatcagcagccagggcct

SEQ ID NO: 425749 - DNA, 140 bp, Artificial Sequence
  Synthetic
atacgccatgctgggtctcccctctcagaactacacaggaaatcctgtgatatgtctgggacaccatgctgtacctaatgggacaatggtgaaaaccttaactgatgaccaaatagaggtcgtacttgggagtcggccat

SEQ ID NO: 425750 - DNA, 140 bp, Artificial Sequence
  Synthetic
atggccgactcccaagtacgacctctatttggtcatcagttaaggttttcaccattgtcccattaggtacagcatggtgtcccagacatatcacaggatttcctgtgtagttctgagaggggagacccagcatggcgtat

SEQ ID NO: 425751 - DNA, 140 bp, Artificial Sequence
  Synthetic
aggccctggctgctgatatggacagattcgatctggattgaacttgatgaaataggagaagatgttgctccaattgagcacattgcaagtatgagaagaaattatttcacggcggaagtggaccttttgggacagcggtg

SEQ ID NO: 425752 - DNA, 140 bp, Artificial Sequence
  Synthetic
caccgctgtcccaaaaggtccacttccgccgtgaaataatttcttctcatacttgcaatgtgctcaattggagcaacatcttctcctatttcatcaagttcaatccagatcgaatctgtccatatcagcagccagggcct

SEQ ID NO: 425753 - DNA, 140 bp, Artificial Sequence
  Synthetic
aggccctggctgctgatatgtatggattcattataaaaggaaggtcccatttgaggaacgacaccgatgtggtaaactttgtgagcatggaattctctcttactgacccgaggctggaacgaccttttgggacagcggtg

SEQ ID NO: 425754 - DNA, 140 bp, Artificial Sequence
  Synthetic
caccgctgtcccaaaaggtcgttccagcctcgggtcagtaagagagaattccatgctcacaaagtttaccacatcggtgtcgttcctcaaatgggaccttccttttataatgaatccatacatatcagcagccagggcct

SEQ ID NO: 425755 - DNA, 140 bp, Artificial Sequence
  Synthetic
aggccctggctgctgatatgaacgtggccaattggggaatcacctaaaggggtggaggaaagctccattggaaaggtgtgtagaacattactagcaaaatctgtattcaacagcctatatgaccttttgggacagcggtg

SEQ ID NO: 425756 - DNA, 140 bp, Artificial Sequence
  Synthetic
caccgctgtcccaaaaggtcatataggctgttgaatacagattttgctagtaatgttctacacacctttccaatggagctttcctccacccctttaggtgattccccaattggccacgttcatatcagcagccagggcct

SEQ ID NO: 425757 - DNA, 140 bp, Artificial Sequence
  Synthetic
atacgccatgctgggtctcctggaatagccagtctgatgttacaaattggaaacataatatcaatatggattagccactcgattcaaactggaaatcagaatcagcctgaaatatgcaatcgtacttgggagtcggccat

SEQ ID NO: 425758 - DNA, 140 bp, Artificial Sequence
  Synthetic
atggccgactcccaagtacgattgcatatttcaggctgattctgatttccagtttgaatcgagtggctaatccatattgatattatgtttccaatttgtaacatcagactggctattccaggagacccagcatggcgtat

SEQ ID NO: 425759 - DNA, 140 bp, Artificial Sequence
  Synthetic
atacgccatgctgggtctccagaaacgggccaacggcaagtacggtccactatcccaaagtctacaagacttactttgaaaaagttgagagattaaaacaaggaacattcggccccgttccgtacttgggagtcggccat

SEQ ID NO: 425760 - DNA, 140 bp, Artificial Sequence
  Synthetic
atggccgactcccaagtacggaacggggccgaatgttccttgttttaatctctcaactttttcaaagtaagtcttgtagactttgggatagtggaccgtacttgccgttggcccgtttctggagacccagcatggcgtat

SEQ ID NO: 425761 - DNA, 140 bp, Artificial Sequence
  Synthetic
aggccctggctgctgatatgatggatgtcaacccgactttacttttcttgaaagtgccagtgcaaaatgctataagtaccacattcccttatactggagaccctccatacagccatggaagaccttttgggacagcggtg

SEQ ID NO: 425762 - DNA, 140 bp, Artificial Sequence
  Synthetic
caccgctgtcccaaaaggtcttccatggctgtatggagggtctccagtataagggaatgtggtacttatagcattttgcactggcactttcaagaaaagtaaagtcgggttgacatccatcatatcagcagccagggcct

SEQ ID NO: 425763 - DNA, 140 bp, Artificial Sequence
  Synthetic
aggccctggctgctgatatgcccgattgatggaccactacctgaggataatgagcccagtgggtatgcacaaacagattgtgtattggaagcaatggctttccttgaagaatcccacccagaccttttgggacagcggtg

SEQ ID NO: 425764 - DNA, 140 bp, Artificial Sequence
  Synthetic
caccgctgtcccaaaaggtctgggtgggattcttcaaggaaagccattgcttccaatacacaatctgtttgtgcatacccactgggctcattatcctcaggtagtggtccatcaatcgggcatatcagcagccagggcct

SEQ ID NO: 425765 - DNA, 140 bp, Artificial Sequence
  Synthetic
atacgccatgctgggtctccaagagtggacaaactgacccaaggtcgccagacttatgactggacattgaatagaaaccaaccggctgcaactgctttggccaacactatagaaattttccgtacttgggagtcggccat

SEQ ID NO: 425766 - DNA, 140 bp, Artificial Sequence
  Synthetic
atggccgactcccaagtacggaaaatttctatagtgttggccaaagcagttgcagccggttggtttctattcaatgtccagtcataagtctggcgaccttgggtcagtttgtccactcttggagacccagcatggcgtat

SEQ ID NO: 425767 - DNA, 140 bp, Artificial Sequence
  Synthetic
aggccctggctgctgatatgatagaaaccaaccggctgcaactgctttggccaacactatagaaattttcagatcaaacggtctgacagcaaatgaatctggacggctgatagatttcctgaccttttgggacagcggtg

SEQ ID NO: 425768 - DNA, 140 bp, Artificial Sequence
  Synthetic
caccgctgtcccaaaaggtcaggaaatctatcagccgtccagattcatttgctgtcagaccgtttgatctgaaaatttctatagtgttggccaaagcagttgcagccggttggtttctatcatatcagcagccagggcct

SEQ ID NO: 425769 - DNA, 140 bp, Artificial Sequence
  Synthetic
atacgccatgctgggtctccttgaaaactttagagcctatgtggatggattcgaaccgaacggctgcattgagggcaagctttctcaaatgtcaaaagaagtgaacgccagaatcgagcccgtacttgggagtcggccat

SEQ ID NO: 425770 - DNA, 140 bp, Artificial Sequence
  Synthetic
atggccgactcccaagtacgggctcgattctggcgttcacttcttttgacatttgagaaagcttgccctcaatgcagccgttcggttcgaatccatccacataggctctaaagttttcaaggagacccagcatggcgtat

SEQ ID NO: 425771 - DNA, 140 bp, Artificial Sequence
  Synthetic
atacgccatgctgggtctcccaagaaatcaacctgaatggtttagaaatgtcttgagtattgctcctataatgttctcaaacaaaatggcgagattggggaaggggtacatgttcgaaagcgtacttgggagtcggccat

SEQ ID NO: 425772 - DNA, 140 bp, Artificial Sequence
  Synthetic
atggccgactcccaagtacgctttcgaacatgtaccccttccccaatctcgccattttgtttgagaacattataggagcaatactcaagacatttctaaaccattcaggttgatttcttgggagacccagcatggcgtat

SEQ ID NO: 425773 - DNA, 140 bp, Artificial Sequence
  Synthetic
aggccctggctgctgatatgattatctcctgaggaggtcagtgaaacacagggaactgagagactgacaataacttattcatcgtcgatgatgtgggagattaacggtcctgagtcggttgaccttttgggacagcggtg

SEQ ID NO: 425774 - DNA, 140 bp, Artificial Sequence
  Synthetic
caccgctgtcccaaaaggtcaaccgactcaggaccgttaatctcccacatcatcgacgatgaataagttattgtcagtctctcagttccctgtgtttcactgacctcctcaggagataatcatatcagcagccagggcct

SEQ ID NO: 425775 - DNA, 140 bp, Artificial Sequence
  Synthetic
atacgccatgctgggtctccgcaaattgaagaggcgagcaattgcaacacccggaatgcaaatcagaggattcgtgtacttcgttgaaacactagcgaggagtatctgtgagaaacttgacgtacttgggagtcggccat

SEQ ID NO: 425776 - DNA, 140 bp, Artificial Sequence
  Synthetic
atggccgactcccaagtacgtcaagtttctcacagatactcctcgctagtgtttcaacgaagtacacgaatcctctgatttgcattccgggtgttgcaattgctcgcctcttcaatttgcggagacccagcatggcgtat

SEQ ID NO: 425777 - DNA, 140 bp, Artificial Sequence
  Synthetic
atacgccatgctgggtctccgcagaacttcaggacattgaaaatgaagagaagattccaaagacaaagaatatgaagaaaacaagccaattaaagtgggcactcggtgaaaacatggcaccgtacttgggagtcggccat

SEQ ID NO: 425778 - DNA, 140 bp, Artificial Sequence
  Synthetic
atggccgactcccaagtacggtgccatgttttcaccgagtgcccactttaattggcttgttttcttcatattctttgtctttggaatcttctcttcattttcaatgtcctgaagttctgcggagacccagcatggcgtat

SEQ ID NO: 425779 - DNA, 140 bp, Artificial Sequence
  Synthetic
atacgccatgctgggtctccacgtcgtgaggaagatgatgaccaactcacaggacactgaactctcctttacaattactggggacaatacaaaatggaatgagaatcaaaatcctaggatcgtacttgggagtcggccat

SEQ ID NO: 425780 - DNA, 140 bp, Artificial Sequence
  Synthetic
atggccgactcccaagtacgatcctaggattttgattctcattccattttgtattgtccccagtaattgtaaaggagagttcagtgtcctgtgagttggtcatcatcttcctcacgacgtggagacccagcatggcgtat

SEQ ID NO: 425781 - DNA, 140 bp, Artificial Sequence
  Synthetic
aggccctggctgctgatatgacaattactggggacaatacaaaatggaatgagaatcaaaatcctaggatgtttctggcaatgataacgtacatcacaaggaaccagccagaatggtttcgaccttttgggacagcggtg

SEQ ID NO: 425782 - DNA, 140 bp, Artificial Sequence
  Synthetic
caccgctgtcccaaaaggtcgaaaccattctggctggttccttgtgatgtacgttatcattgccagaaacatcctaggattttgattctcattccattttgtattgtccccagtaattgtcatatcagcagccagggcct

SEQ ID NO: 425783 - DNA, 140 bp, Artificial Sequence
  Synthetic
atacgccatgctgggtctccgaaggaagacggaaaacaaacctatatggattcattataaaaggaagatctcatttgaggaatgataccgacgtggtaaactttgtaagtatggaattttcgtacttgggagtcggccat

SEQ ID NO: 425784 - DNA, 140 bp, Artificial Sequence
  Synthetic
atggccgactcccaagtacgaaaattccatacttacaaagtttaccacgtcggtatcattcctcaaatgagatcttccttttataatgaatccatataggtttgttttccgtcttccttcggagacccagcatggcgtat

SEQ ID NO: 425785 - DNA, 140 bp, Artificial Sequence
  Synthetic
atacgccatgctgggtctccttgacctgaaatacttcaatgaatcaacgagacagaaaattgagaaaataagacctcttctaatagagggcacagcctcattgagtcctggaatgatgatcgtacttgggagtcggccat

SEQ ID NO: 425786 - DNA, 140 bp, Artificial Sequence
  Synthetic
atggccgactcccaagtacgatcatcattccaggactcaatgaggctgtgccctctattagaagaggtcttattttctcaattttctgtctcgttgattcattgaagtatttcaggtcaaggagacccagcatggcgtat

SEQ ID NO: 425787 - DNA, 140 bp, Artificial Sequence
  Synthetic
atacgccatgctgggtctcctgataaacaacgaccttggaccagccacagctcaaatggctcttcagctattcatcaaggactacagatacacataccgatgccacagaggggatacgcacgtacttgggagtcggccat

SEQ ID NO: 425788 - DNA, 140 bp, Artificial Sequence
  Synthetic
atggccgactcccaagtacgtgcgtatcccctctgtggcatcggtatgtgtatctgtagtccttgatgaatagctgaagagccatttgagctgtggctggtccaaggtcgttgtttatcaggagacccagcatggcgtat

SEQ ID NO: 425789 - DNA, 140 bp, Artificial Sequence
  Synthetic
atacgccatgctgggtctccttgggcaaagaagacaagagatatggcccagcattgagtatcaatgagctgagcaatcttgcaaaaggagagaaggctaatgtgctaattgggcaaggagcgtacttgggagtcggccat

SEQ ID NO: 425790 - DNA, 140 bp, Artificial Sequence
  Synthetic
atggccgactcccaagtacgctccttgcccaattagcacattagccttctctccttttgcaagattgctcagctcattgatactcaatgctgggccatatctcttgtcttctttgcccaaggagacccagcatggcgtat

SEQ ID NO: 425791 - DNA, 140 bp, Artificial Sequence
  Synthetic
atacgccatgctgggtctccatagggaaattgaatctgtcaacaatgctatagtaatgccagctcatggcccggccaagagtatggagtatgatgccgttgcaaccacacattcatggaccgtacttgggagtcggccat

SEQ ID NO: 425792 - DNA, 140 bp, Artificial Sequence
  Synthetic
atggccgactcccaagtacggtccatgaatgtgtggttgcaacggcatcatactccatactcttggccgggccatgagctggcattactatagcattgttgacagattcaatttccctatggagacccagcatggcgtat

SEQ ID NO: 425793 - DNA, 140 bp, Artificial Sequence
  Synthetic
aggccctggctgctgatatgaggatgaacagatgtaccaaaagtgctgcaatctattcgagaaattctttcccagtagttcgtatcggaggccagttggaatttccagtatggtggaggcgaccttttgggacagcggtg

SEQ ID NO: 425794 - DNA, 140 bp, Artificial Sequence
  Synthetic
caccgctgtcccaaaaggtcgcctccaccatactggaaattccaactggcctccgatacgaactactgggaaagaatttctcgaatagattgcagcacttttggtacatctgttcatcctcatatcagcagccagggcct

SEQ ID NO: 425795 - DNA, 140 bp, Artificial Sequence
  Synthetic
aggccctggctgctgatatgtgaggattagctcatctttcagctttggcggattcactttcaaaagaacaagcgggtcgtcagtcaaaagggaagaggaagtgcttacaggcaaccttcagaccttttgggacagcggtg

SEQ ID NO: 425796 - DNA, 140 bp, Artificial Sequence
  Synthetic
caccgctgtcccaaaaggtctgaaggttgcctgtaagcacttcctcttcccttttgactgacgacccgcttgttcttttgaaagtgaatccgccaaagctgaaagatgagctaatcctcacatatcagcagccagggcct

SEQ ID NO: 425797 - DNA, 140 bp, Artificial Sequence
  Synthetic
atacgccatgctgggtctccatggaacgaataaaagagttaagagatctaatgtcacagtcccgcactcgcgagatactaacaaaaaccactgtggaccacatggccataatcaagaaatcgtacttgggagtcggccat

SEQ ID NO: 425798 - DNA, 140 bp, Artificial Sequence
  Synthetic
atggccgactcccaagtacgatttcttgattatggccatgtggtccacagtggtttttgttagtatctcgcgagtgcgggactgtgacattagatctcttaactcttttattcgttccatggagacccagcatggcgtat

SEQ ID NO: 425799 - DNA, 140 bp, Artificial Sequence
  Synthetic
atacgccatgctgggtctcccgagatactaacaaaaaccactgtggaccacatggccataatcaagaaatacacatcaggaagacaggagaagaatcctgcgctcagaatgaaatggatgcgtacttgggagtcggccat

SEQ ID NO: 425800 - DNA, 140 bp, Artificial Sequence
  Synthetic
atggccgactcccaagtacgcatccatttcattctgagcgcaggattcttctcctgtcttcctgatgtgtatttcttgattatggccatgtggtccacagtggtttttgttagtatctcgggagacccagcatggcgtat

SEQ ID NO: 425801 - DNA, 140 bp, Artificial Sequence
  Synthetic
aggccctggctgctgatatgatggcaatgaaatatccgattacagcggacaagagaataatagatatgattcctgaaaggaatgaacaagggcagacgctctggagcaagacaaatgatggaccttttgggacagcggtg

SEQ ID NO: 425802 - DNA, 140 bp, Artificial Sequence
  Synthetic
caccgctgtcccaaaaggtccatcatttgtcttgctccagagcgtctgcccttgttcattcctttcaggaatcatatctattattctcttgtccgctgtaatcggatatttcattgccatcatatcagcagccagggcct

SEQ ID NO: 425803 - DNA, 140 bp, Artificial Sequence
  Synthetic
atacgccatgctgggtctccatttcagaaatcaagttaaaatacgccgccgagttgatacaaaccctggccatgcagatctcagtgctaaagaagcacaagatgtcatcatggaagttgtcgtacttgggagtcggccat

SEQ ID NO: 425804 - DNA, 140 bp, Artificial Sequence
  Synthetic
atggccgactcccaagtacgacaacttccatgatgacatcttgtgcttctttagcactgagatctgcatggccagggtttgtatcaactcggcggcgtattttaacttgatttctgaaatggagacccagcatggcgtat

SEQ ID NO: 425805 - DNA, 140 bp, Artificial Sequence
  Synthetic
aggccctggctgctgatatgatggatgtcaatccgactctactgttcttaaaagttccagcgcaaaatgccataagcacaacattcccttatactggagaccctccatacagccatggaagaccttttgggacagcggtg

SEQ ID NO: 425806 - DNA, 140 bp, Artificial Sequence
  Synthetic
caccgctgtcccaaaaggtcttccatggctgtatggagggtctccagtataagggaatgttgtgcttatggcattttgcgctggaacttttaagaacagtagagtcggattgacatccatcatatcagcagccagggcct

SEQ ID NO: 425807 - DNA, 140 bp, Artificial Sequence
  Synthetic
atacgccatgctgggtctcccaataacgaaagaaaagaaagaagagctccaagattgtaaaattgctcccctaatggttgcatacatgttggagagggaactggtccgaaaaaccagattcgtacttgggagtcggccat

SEQ ID NO: 425808 - DNA, 140 bp, Artificial Sequence
  Synthetic
atggccgactcccaagtacgaatctggtttttcggaccagttccctctccaacatgtatgcaaccattaggggagcaattttacaatcttggagctcttctttcttttctttcgttattgggagacccagcatggcgtat

SEQ ID NO: 425809 - DNA, 140 bp, Artificial Sequence
  Synthetic
aggccctggctgctgatatgagtagaccatgggtgagaggtcaaagcggtaggatcagcttctattggacaattgtagaaccaggagatctcatagttttcaataccatagggaatttaagaccttttgggacagcggtg

SEQ ID NO: 425810 - DNA, 140 bp, Artificial Sequence
  Synthetic
caccgctgtcccaaaaggtcttaaattccctatggtattgaaaactatgagatctcctggttctacaattgtccaatagaagctgatcctaccgctttgacctctcacccatggtctactcatatcagcagccagggcct

SEQ ID NO: 425811 - DNA, 140 bp, Artificial Sequence
  Synthetic
aggccctggctgctgatatgaaaggggacccgctaatggttttttcagtagattgaactggttgactaaatcaggaaatgcgtatccagtattgaatgtgactatgccgaacaatgacaagaccttttgggacagcggtg

SEQ ID NO: 425812 - DNA, 140 bp, Artificial Sequence
  Synthetic
caccgctgtcccaaaaggtcttgtcattgttcggcatagtcacattcaatactggatacgcatttcctgatttagtcaaccagttcaatctactgaaaaaaccattagcgggtcccctttcatatcagcagccagggcct

SEQ ID NO: 425813 - DNA, 140 bp, Artificial Sequence
  Synthetic
aggccctggctgctgatatgatgacaattggaatggctaacttaatattacaaattggaaacataatctcaatatggattagccactcaattcaacttgggaatcaaagtcagattgaaagaccttttgggacagcggtg

SEQ ID NO: 425814 - DNA, 140 bp, Artificial Sequence
  Synthetic
caccgctgtcccaaaaggtctttcaatctgactttgattcccaagttgaattgagtggctaatccatattgagattatgtttccaatttgtaatattaagttagccattccaattgtcatcatatcagcagccagggcct

SEQ ID NO: 425815 - DNA, 140 bp, Artificial Sequence
  Synthetic
aggccctggctgctgatatgtcaatgatgtgggagatcaatggccctgaatcagtgttggtaaatacttaccagtggataatcagaaactgggaaactgtaaaaattcaatggtcacagggaccttttgggacagcggtg

SEQ ID NO: 425816 - DNA, 140 bp, Artificial Sequence
  Synthetic
caccgctgtcccaaaaggtccctgtgaccattgaatttttacagtttcccagtttctgattatccactggtaagtatttaccaacactgattcagggccattgatctcccacatcattgacatatcagcagccagggcct

SEQ ID NO: 425817 - DNA, 140 bp, Artificial Sequence
  Synthetic
aggccctggctgctgatatgacattgaaaataagagtatatgaggggtatgaagaattcacaatggtcgggcaaagggcaacagctatcttgaggaaagcaactagaaggctgattcaacgaccttttgggacagcggtg

SEQ ID NO: 425818 - DNA, 140 bp, Artificial Sequence
  Synthetic
caccgctgtcccaaaaggtcgttgaatcagccttctagttgctttcctcaagatagctgttgccctttgcccgaccattgtgaattcttcatacccctcatatactcttattttcaatgtcatatcagcagccagggcct

SEQ ID NO: 425819 - DNA, 140 bp, Artificial Sequence
  Synthetic
atacgccatgctgggtctccgcaatggtgttctcacaggaggattgcatgataaaggcagtccgaggcgatctaaactttgtaaacagagcaaaccaaagattaaaccccatgcatcaaccgtacttgggagtcggccat

SEQ ID NO: 425820 - DNA, 140 bp, Artificial Sequence
  Synthetic
atggccgactcccaagtacggttgatgcatggggtttaatctttggtttgctctgtttacaaagtttagatcgcctcggactgcctttatcatgcaatcctcctgtgagaacaccattgcggagacccagcatggcgtat

SEQ ID NO: 425821 - DNA, 140 bp, Artificial Sequence
  Synthetic
atacgccatgctgggtctccacaagttttttctaccggtatggatttgtggccaacttcagtatggagctgcccagctttggagtgtctggggtcaatgaatcagctgacatgagcattgcgtacttgggagtcggccat

SEQ ID NO: 425822 - DNA, 140 bp, Artificial Sequence
  Synthetic
atggccgactcccaagtacgcaatgctcatgtcagctgattcattgaccccagacactccaaagctgggcagctccatactgaagttggccacaaatccataccggtagaaaaaacttgtggagacccagcatggcgtat

SEQ ID NO: 425823 - DNA, 140 bp, Artificial Sequence
  Synthetic
aggccctggctgctgatatggactcccagcacagaattgtcactgagaggagtaagagttagtaaaatgggagtagatgaatattccagcactgaaagagtagttgtaagcattgaccgcgaccttttgggacagcggtg

SEQ ID NO: 425824 - DNA, 140 bp, Artificial Sequence
  Synthetic
caccgctgtcccaaaaggtcgcggtcaatgcttacaactactctttcagtgctggaatattcatctactcccattttactaactcttactcctctcagtgacaattctgtgctgggagtccatatcagcagccagggcct

SEQ ID NO: 425825 - DNA, 140 bp, Artificial Sequence
  Synthetic
atacgccatgctgggtctccggtcagtgaaacccagggaacggaaaagttgacaataacatattcgtcatcaatgatgtgggagatcaacggtcctgagtcagtgcttgtcaacacctatcgtacttgggagtcggccat

SEQ ID NO: 425826 - DNA, 140 bp, Artificial Sequence
  Synthetic
atggccgactcccaagtacgataggtgttgacaagcactgactcaggaccgttgatctcccacatcattgatgacgaatatgttattgtcaacttttccgttccctgggtttcactgaccggagacccagcatggcgtat

SEQ ID NO: 425827 - DNA, 140 bp, Artificial Sequence
  Synthetic
atacgccatgctgggtctccttctcccttgatggtcgcatacatgctagagagagaacttgtgcgaaaaacaagatttctcccagttgctggcggaacaagcagtatatacattgaagttcgtacttgggagtcggccat

SEQ ID NO: 425828 - DNA, 140 bp, Artificial Sequence
  Synthetic
atggccgactcccaagtacgaacttcaatgtatatactgcttgttccgccagcaactgggagaaatcttgtttttcgcacaagttctctctctagcatgtatgcgaccatcaagggagaaggagacccagcatggcgtat

SEQ ID NO: 425829 - DNA, 140 bp, Artificial Sequence
  Synthetic
aggccctggctgctgatatgcaaaccgtcattacttacgaaaacaacacttgggtcaaccagacgtatgttaacgtcagcaacactaattttgttgctggacaggcagtagcttcagtaagaccttttgggacagcggtg

SEQ ID NO: 425830 - DNA, 140 bp, Artificial Sequence
  Synthetic
caccgctgtcccaaaaggtcttactgaagctactgcctgtccagcaacaaaattagtgttgctgacgttaacatacgtctggttgacccaagtgttgttttcgtaagtaatgacggtttgcatatcagcagccagggcct

SEQ ID NO: 425831 - DNA, 140 bp, Artificial Sequence
  Synthetic
atacgccatgctgggtctccacatatgttaacatcagcaacaccaactttgctgctggacagtcagtggtttccgtgaaattagcgggcaattcctctctctgccctgttagtggatgggcgtacttgggagtcggccat

SEQ ID NO: 425832 - DNA, 140 bp, Artificial Sequence
  Synthetic
atggccgactcccaagtacgcccatccactaacagggcagagagaggaattgcccgctaatttcacggaaaccactgactgtccagcagcaaagttggtgttgctgatgttaacatatgtggagacccagcatggcgtat

SEQ ID NO: 425833 - DNA, 140 bp, Artificial Sequence
  Synthetic
aggccctggctgctgatatggctgctaccatttgcagcagcaccacctgagcagagcagaatgcagtttacttctctgactgtgaatgtgagaggctcaggaatgagaatactcgtaagggaccttttgggacagcggtg

SEQ ID NO: 425834 - DNA, 140 bp, Artificial Sequence
  Synthetic
caccgctgtcccaaaaggtcccttacgagtattctcattcctgagcctctcacattcacagtcagagaagtaaactgcattctgctctgctcaggtggtgctgctgcaaatggtagcagccatatcagcagccagggcct

SEQ ID NO: 425835 - DNA, 140 bp, Artificial Sequence
  Synthetic
aggccctggctgctgatatgcttctctgactgtgaatgtgagaggctcaggaatgagaatactcgtaaggggcaactcccctgttttcaactacaataaggcaaccaaaaggcttaccgtgaccttttgggacagcggtg

SEQ ID NO: 425836 - DNA, 140 bp, Artificial Sequence
  Synthetic
caccgctgtcccaaaaggtcacggtaagccttttggttgccttattgtagttgaaaacaggggagttgccccttacgagtattctcattcctgagcctctcacattcacagtcagagaagcatatcagcagccagggcct

SEQ ID NO: 425837 - DNA, 140 bp, Artificial Sequence
  Synthetic
aggccctggctgctgatatgggcaactcccctgttttcaactacaataaggcaaccaaaaggcttaccgttcttggaaaggatgcaggtgcattaacagaggatccagacgaggggacaggaccttttgggacagcggtg

SEQ ID NO: 425838 - DNA, 140 bp, Artificial Sequence
  Synthetic
caccgctgtcccaaaaggtcctgtcccctcgtctggatcctctgttaatgcacctgcatcctttccaagaacggtaagccttttggttgccttattgtagttgaaaacaggggagttgcccatatcagcagccagggcct

SEQ ID NO: 425839 - DNA, 140 bp, Artificial Sequence
  Synthetic
aggccctggctgctgatatgacacaaagaacaatagggaagaaaaaacaaagagtgaataagaggagttatttaataagagcactaacattgaatacgatgacaaaagatgcagagagaggaccttttgggacagcggtg

SEQ ID NO: 425840 - DNA, 140 bp, Artificial Sequence
  Synthetic
caccgctgtcccaaaaggtcctctctctgcatcttttgtcatcgtattcaatgttagtgctcttattaaataactcctcttattcactctttgttttttcttccctattgttctttgtgtcatatcagcagccagggcct

SEQ ID NO: 425841 - DNA, 140 bp, Artificial Sequence
  Synthetic
atacgccatgctgggtctcctcagtgtgatttttaaccggctggaaaccttaatactacttagagccttcacaaacgaaggagctattgtgggagaaatctcaccattaccttcccttcccgtacttgggagtcggccat

SEQ ID NO: 425842 - DNA, 140 bp, Artificial Sequence
  Synthetic
atggccgactcccaagtacgggaagggaaggtaatggtgagatttctcccacaatagctccttcgtttgtgaaggctctaagtagtattaaggtttccagccggttaaaaatcacactgaggagacccagcatggcgtat

SEQ ID NO: 425843 - DNA, 140 bp, Artificial Sequence
  Synthetic
aggccctggctgctgatatgggagtagatgaatactccagcactgagagagtggtagtgagcattgaccggtttttaagagtccgggaccaacgagggaatgtgctattgtcgcctgaaggaccttttgggacagcggtg

SEQ ID NO: 425844 - DNA, 140 bp, Artificial Sequence
  Synthetic
caccgctgtcccaaaaggtccttcaggcgacaatagcacattccctcgttggtcccggactcttaaaaaccggtcaatgctcactaccactctctcagtgctggagtattcatctactcccatatcagcagccagggcct

SEQ ID NO: 425845 - DNA, 140 bp, Artificial Sequence
  Synthetic
  misc_feature (29)..(29): n is a, c, g, or t
  misc_feature (34)..(34): n is a, c, g, or t
  misc_feature (46)..(46): n is a, c, g, or t
  misc_feature (57)..(57): n is a, c, g, or t
  misc_feature (98)..(98): n is a, c, g, or t
atacgccatgctgggtctcctttcctttnccatntcatgctttttnctttgtgttgntctgctggggttcattatgtgggcctgccaaaaaggcaacnttaggtgcaacatttgcatttgcgtacttgggagtcggccat

SEQ ID NO: 425846 - DNA, 140 bp, Artificial Sequence
  Synthetic
  misc_feature (43)..(43): n is a, c, g, or t
  misc_feature (84)..(84): n is a, c, g, or t
  misc_feature (95)..(95): n is a, c, g, or t
  misc_feature (107)..(107): n is a, c, g, or t
  misc_feature (112)..(112): n is a, c, g, or t
atggccgactcccaagtacgcaaatgcaaatgttgcacctaangttgcctttttggcaggcccacataatgaaccccagcagancaacacaaagnaaaaagcatganatggnaaaggaaaggagacccagcatggcgtat

SEQ ID NO: 425847 - DNA, 140 bp, Artificial Sequence
  Synthetic
atacgccatgctgggtctccatgaatccaaatcaaaagataatggccattggatcagtctgtatggtaattggaatagttagcttaatgttacagattgggaacacaatctcaatatgggcgtacttgggagtcggccat

SEQ ID NO: 425848 - DNA, 140 bp, Artificial Sequence
  Synthetic
atggccgactcccaagtacgcccatattgagattgtgttcccaatctgtaacattaagctaactattccaattaccatacagactgatccaatggccattatcttttgatttggattcatggagacccagcatggcgtat

SEQ ID NO: 425849 - DNA, 140 bp, Artificial Sequence
  Synthetic
aggccctggctgctgatatgtggaatagttagcttaatgttacagattgggaacacaatctcaatatgggtcagtcattcatttcaaacaagagtccaacaccaagctgaaccaatcagagaccttttgggacagcggtg

SEQ ID NO: 425850 - DNA, 140 bp, Artificial Sequence
  Synthetic
caccgctgtcccaaaaggtctctgattggttcagcttggtgttggactcttgtttgaaatgaatgactgacccatattgagattgtgttcccaatctgtaacattaagctaactattccacatatcagcagccagggcct

SEQ ID NO: 425851 - DNA, 140 bp, Artificial Sequence
  Synthetic
aggccctggctgctgatatgacagtataagaattggttccaagggggatgtgtttgtaattagagagccgttcatctcatgctctcatttggagtgcagaactttctttttgacccaggggaccttttgggacagcggtg

SEQ ID NO: 425852 - DNA, 140 bp, Artificial Sequence
  Synthetic
caccgctgtcccaaaaggtcccctgggtcaaaaagaaagttctgcactccaaatgagagcatgagatgaacggctctctaattacaaacacatcccccttggaaccaattcttatactgtcatatcagcagccagggcct

SEQ ID NO: 425853 - DNA, 140 bp, Artificial Sequence
  Synthetic
atacgccatgctgggtctccctcacagaacactaatgagttgccctgtgggtgaggttccctccccatacaactcaagatttgagtctgttgcttggtcagcaagtgcttgccatgatggcgtacttgggagtcggccat

SEQ ID NO: 425854 - DNA, 140 bp, Artificial Sequence
  Synthetic
atggccgactcccaagtacgccatcatggcaagcacttgctgaccaagcaacagactcaaatcttgagttgtatggggagggaacctcacccacagggcaactcattagtgttctgtgagggagacccagcatggcgtat

SEQ ID NO: 425855 - DNA, 140 bp, Artificial Sequence
  Synthetic
atacgccatgctgggtctccatattattcataagagagggaaaaattataaatgttagcccattgtcaggaagtgctcagcacgtggaggaatgctcctgttacccccggtatcctgaagcgtacttgggagtcggccat

SEQ ID NO: 425856 - DNA, 140 bp, Artificial Sequence
  Synthetic
atggccgactcccaagtacgcttcaggataccgggggtaacaggagcattcctccacgtgctgagcacttcctgacaatgggctaacatttataatttttccctctcttatgaataatatggagacccagcatggcgtat

SEQ ID NO: 425857 - DNA, 140 bp, Artificial Sequence
  Synthetic
atacgccatgctgggtctccagtttaaaatgaatccaaatcagaaaataataaccattggatccgtatcattgggattggttgtattcaatgttctattgcatatcgtgagcatcatagtcgtacttgggagtcggccat

SEQ ID NO: 425858 - DNA, 140 bp, Artificial Sequence
  Synthetic
atggccgactcccaagtacgactatgatgctcacgatatgcaatagaacattgaatacaaccaatcccaatgatacggatccaatggttattattttctgatttggattcattttaaactggagacccagcatggcgtat

SEQ ID NO: 425859 - DNA, 140 bp, Artificial Sequence
  Synthetic
aggccctggctgctgatatggcctcattaagtcctggaatgatgatgggcatgtttaacatgcttagcactgtcctaggagtttcaatcctgaatcttgggcaaaattgcccttccaaaagaccttttgggacagcggtg

SEQ ID NO: 425860 - DNA, 140 bp, Artificial Sequence
  Synthetic
caccgctgtcccaaaaggtcttttggaagggcaattttgcccaagattcaggattgaaactcctaggacagtgctaagcatgttaaacatgcccatcatcattccaggacttaatgaggccatatcagcagccagggcct

SEQ ID NO: 425861 - DNA, 140 bp, Artificial Sequence
  Synthetic
aggccctggctgctgatatgcccatcgtagatataaacataaaggattatagcattgtttccagttatgtttgctcaggacttgttggagacacacccagaaaacccgacagctccagcagaccttttgggacagcggtg

SEQ ID NO: 425862 - DNA, 140 bp, Artificial Sequence
  Synthetic
caccgctgtcccaaaaggtctgctggagctgtcgggttttctgggtgtgtctccaacaagtcctgagcaaacataactggaaacaatgctataatcctttatgtttatatctacgatgggcatatcagcagccagggcct

SEQ ID NO: 425863 - DNA, 140 bp, Artificial Sequence
  Synthetic
atacgccatgctgggtctccagatcttcaaaatgaaaaaagggaaagtagttaaatcagtcgagttgaatgctcctaattatcactatgaggaatgctcctgttatcctgatgcgggagacgtacttgggagtcggccat

SEQ ID NO: 425864 - DNA, 140 bp, Artificial Sequence
  Synthetic
atggccgactcccaagtacgtctcccgcatcaggataacaggagcattcctcatagtgataattaggagcattcaactcgactgatttaactactttcccttttttcattttgaagatctggagacccagcatggcgtat

SEQ ID NO: 425865 - DNA, 140 bp, Artificial Sequence
  Synthetic
aggccctggctgctgatatggctcctaattatcactatgaggaatgctcctgttatcctgatgcgggagaaatcatgtgtgtgtgcagggataactggcatggttcaaatagaccatggggaccttttgggacagcggtg

SEQ ID NO: 425866 - DNA, 140 bp, Artificial Sequence
  Synthetic
caccgctgtcccaaaaggtccccatggtctatttgaaccatgccagttatccctgcacacacacatgatttctcccgcatcaggataacaggagcattcctcatagtgataattaggagccatatcagcagccagggcct

SEQ ID NO: 425867 - DNA, 140 bp, Artificial Sequence
  Synthetic
atacgccatgctgggtctccaatcatgtgtgtgtgcagggataactggcatggttcaaatagaccatgggtgtctttcaatcagaatttggagtatcagatagggtatatatgcagtggacgtacttgggagtcggccat

SEQ ID NO: 425868 - DNA, 140 bp, Artificial Sequence
  Synthetic
atggccgactcccaagtacgtccactgcatatataccctatctgatactccaaattctgattgaaagacacccatggtctatttgaaccatgccagttatccctgcacacacacatgattggagacccagcatggcgtat

SEQ ID NO: 425869 - DNA, 140 bp, Artificial Sequence
  Synthetic
atacgccatgctgggtctccagtttcccctaacggggcatatgggataaaagggttctcatttaaatacggcaatggcgtttggatcgggagaaccaaaagcactaattccagaagcggccgtacttgggagtcggccat

SEQ ID NO: 425870 - DNA, 140 bp, Artificial Sequence
  Synthetic
atggccgactcccaagtacggccgcttctggaattagtgcttttggttctcccgatccaaacgccattgccgtatttaaatgagaacccttttatcccatatgccccgttaggggaaactggagacccagcatggcgtat

SEQ ID NO: 425871 - DNA, 140 bp, Artificial Sequence
  Synthetic
atacgccatgctgggtctcctgataaacaatgatcttggacctgcaacagctcagatggcccttcagttgttcatcaaagactacagatacacatatagatgccatagaggggacacacacgtacttgggagtcggccat

SEQ ID NO: 425872 - DNA, 140 bp, Artificial Sequence
  Synthetic
atggccgactcccaagtacgtgtgtgtcccctctatggcatctatatgtgtatctgtagtctttgatgaacaactgaagggccatctgagctgttgcaggtccaagatcattgtttatcaggagacccagcatggcgtat

SEQ ID NO: 425873 - DNA, 140 bp, Artificial Sequence
  Synthetic
aggccctggctgctgatatgatggcgtctcaaggcaccaaacgatcttatgaacaaatggaaactggtggagagcgccagaatgctactgagatcagggcatctgttggaagaatggttagaccttttgggacagcggtg

SEQ ID NO: 425874 - DNA, 140 bp, Artificial Sequence
  Synthetic
caccgctgtcccaaaaggtctaaccattcttccaacagatgccctgatctcagtagcattctggcgctctccaccagtttccatttgttcataagatcgtttggtgccttgagacgccatcatatcagcagccagggcct

SEQ ID NO: 425875 - DNA, 140 bp, Artificial Sequence
  Synthetic
aggccctggctgctgatatgaaagacaagaccaatcctgtcacctctgactaaggggattttagggtttgtgttcacgctcaccgtgcccagtgagcgaggactgcagcgtagacgctttgaccttttgggacagcggtg

SEQ ID NO: 425876 - DNA, 140 bp, Artificial Sequence
  Synthetic
caccgctgtcccaaaaggtcaaagcgtctacgctgcagtcctcgctcactgggcacggtgagcgtgaacacaaaccctaaaatccccttagtcagaggtgacaggattggtcttgtctttcatatcagcagccagggcct

SEQ ID NO: 425877 - DNA, 140 bp, Artificial Sequence
  Synthetic
aggccctggctgctgatatgactttctgcatttgatgaaagaaggaacaggtaccttgaagaacaccccagtgcggggaaggacccgaagaaaactggaggcccaatttatcggaggagagaccttttgggacagcggtg

SEQ ID NO: 425878 - DNA, 140 bp, Artificial Sequence
  Synthetic
caccgctgtcccaaaaggtctctcctccgataaattgggcctccagttttcttcgggtccttccccgcactggggtgttcttcaaggtacctgttccttctttcatcaaatgcagaaagtcatatcagcagccagggcct

SEQ ID NO: 425879 - DNA, 140 bp, Artificial Sequence
  Synthetic
atacgccatgctgggtctccgctctgtttctctaatcattgcgataatatgtctcctcatgcagattgccatcttaacaacgactatgacactacatttcaggcagaatgaatgcagtaacgtacttgggagtcggccat

SEQ ID NO: 425880 - DNA, 140 bp, Artificial Sequence
  Synthetic
atggccgactcccaagtacgttactgcattcattctgcctgaaatgtagtgtcatagtcgttgttaagatggcaatctgcatgaggagacatattatcgcaatgattagagaaacagagcggagacccagcatggcgtat

SEQ ID NO: 425881 - DNA, 140 bp, Artificial Sequence
  Synthetic
atacgccatgctgggtctccgcaagggtcaactctcccgaggagatctggagctgccggtgcagcagtgaagggagtagggacaatggtgatggagctgattcggatgataaaacgagggcgtacttgggagtcggccat

SEQ ID NO: 425882 - DNA, 140 bp, Artificial Sequence
  Synthetic
atggccgactcccaagtacgccctcgttttatcatccgaatcagctccatcaccattgtccctactcccttcactgctgcaccggcagctccagatctcctcgggagagttgacccttgcggagacccagcatggcgtat

SEQ ID NO: 425883 - DNA, 140 bp, Artificial Sequence
  Synthetic
aggccctggctgctgatatgcaatttgcacttgggcagggaaccaccctgaaaaacaagcactcaaatggcactacacatgatagaacccctcacagaactcttttaatgaatgagttaggaccttttgggacagcggtg

SEQ ID NO: 425884 - DNA, 140 bp, Artificial Sequence
  Synthetic
caccgctgtcccaaaaggtcctaactcattcattaaaagagttctgtgaggggttctatcatgtgtagtgccatttgagtgcttgtttttcagggtggttccctgcccaagtgcaaattgcatatcagcagccagggcct

SEQ ID NO: 425885 - DNA, 140 bp, Artificial Sequence
  Synthetic
aggccctggctgctgatatggccaaacgagaacccagcacataagagtcaattagtgtggatggcatgtcactctgcagcatttgaggaccttagggtctcaagcttcatcagaggaacagaccttttgggacagcggtg

SEQ ID NO: 425886 - DNA, 140 bp, Artificial Sequence
  Synthetic
caccgctgtcccaaaaggtctgttcctctgatgaagcttgagaccctaaggtcctcaaatgctgcagagtgacatgccatccacactaattgactcttatgtgctgggttctcgtttggccatatcagcagccagggcct

SEQ ID NO: 425887 - DNA, 140 bp, Artificial Sequence
  Synthetic
atacgccatgctgggtctccgcatctgcagggcagatcagcgttcagcccactttctcggtacagagaaaccttccctttgaaagagcgaccattatggcagcatttacaggaaatgctgcgtacttgggagtcggccat

SEQ ID NO: 425888 - DNA, 140 bp, Artificial Sequence
  Synthetic
atggccgactcccaagtacgcagcatttcctgtaaatgctgccataatggtcgctctttcaaagggaaggtttctctgtaccgagaaagtgggctgaacgctgatctgccctgcagatgcggagacccagcatggcgtat

SEQ ID NO: 425889 - DNA, 140 bp, Artificial Sequence
  Synthetic
atacgccatgctgggtctcctgttcaacaaacaagggtagataaactaactcaaggtcgccagacttatgattggacattaaacagaaatcaaccggcagcaactgcattggccaacacccgtacttgggagtcggccat

SEQ ID NO: 425890 - DNA, 140 bp, Artificial Sequence
  Synthetic
atggccgactcccaagtacgggtgttggccaatgcagttgctgccggttgatttctgtttaatgtccaatcataagtctggcgaccttgagttagtttatctacccttgtttgttgaacaggagacccagcatggcgtat

SEQ ID NO: 425891 - DNA, 140 bp, Artificial Sequence
  Synthetic
aggccctggctgctgatatgtggctatcatcatgaaaattctcaaggctcagggtatgcagcagacagggaaagcactcaaaaggctatagatgggattacaaataaggtcaattccatcgaccttttgggacagcggtg

SEQ ID NO: 425892 - DNA, 140 bp, Artificial Sequence
  Synthetic
caccgctgtcccaaaaggtcgatggaattgaccttatttgtaatcccatctatagccttttgagtgctttccctgtctgctgcataccctgagccttgagaattttcatgatgatagccacatatcagcagccagggcct

SEQ ID NO: 425893 - DNA, 140 bp, Artificial Sequence
  Synthetic
aggccctggctgctgatatgttattcgtctcagggagcaaaagcaggtcaaatatattcagtatggagagaataaaagaattaagagatctaatgtcgcagtctcgcactcgcgagatacgaccttttgggacagcggtg

SEQ ID NO: 425894 - DNA, 140 bp, Artificial Sequence
  Synthetic
caccgctgtcccaaaaggtcgtatctcgcgagtgcgagactgcgacattagatctcttaattcttttattctctccatactgaatatatttgacctgcttttgctccctgagacgaataacatatcagcagccagggcct

SEQ ID NO: 425895 - DNA, 140 bp, Artificial Sequence
  Synthetic
atacgccatgctgggtctccaagctcgaaataccagcagtcattcaccccaagcccgggggcacgaccacaggtgaatgggcaatcaggaaggattgattttcattggctactccttgatcgtacttgggagtcggccat

SEQ ID NO: 425896 - DNA, 140 bp, Artificial Sequence
  Synthetic
atggccgactcccaagtacgatcaaggagtagccaatgaaaatcaatccttcctgattgcccattcacctgtggtcgtgcccccgggcttggggtgaatgactgctggtatttcgagcttggagacccagcatggcgtat

SEQ ID NO: 425897 - DNA, 140 bp, Artificial Sequence
  Synthetic
atacgccatgctgggtctcccagagcaagtttctttagaggggagtcactaggaattcaaagtgacgttcctttggactctagttgcgagggggattgcttccacaatggaggtacgatacgtacttgggagtcggccat

SEQ ID NO: 425898 - DNA, 140 bp, Artificial Sequence
  Synthetic
atggccgactcccaagtacgtatcgtacctccattgtggaagcaatccccctcgcaactagagtccaaaggaacgtcactttgaattcctagtgactcccctctaaagaaacttgctctgggagacccagcatggcgtat

SEQ ID NO: 425899 - DNA, 140 bp, Artificial Sequence
  Synthetic
aggccctggctgctgatatgctacaataataccaaccaagaagatctcttgatactgtgggggattcatcaccctaatgatgaagcagagcagacaaggctctatcaaaacccaaccaccgaccttttgggacagcggtg

SEQ ID NO: 425900 - DNA, 140 bp, Artificial Sequence
  Synthetic
caccgctgtcccaaaaggtcggtggttgggttttgatagagccttgtctgctctgcttcatcattagggtgatgaatcccccacagtatcaagagatcttcttggttggtattattgtagcatatcagcagccagggcct

SEQ ID NO: 425901 - DNA, 140 bp, Artificial Sequence
  Synthetic
aggccctggctgctgatatgcagcaaacaggcaagcacaatatagagcattcaaagctaagcaggggaagataattgggcaagttgaaatcagtttcaatggaggccatatagaagaatggaccttttgggacagcggtg

SEQ ID NO: 425902 - DNA, 140 bp, Artificial Sequence
  Synthetic
caccgctgtcccaaaaggtccattcttctatatggcctccattgaaactgatttcaacttgcccaattatcttcccctgcttagctttgaatgctctatattgtgcttgcctgtttgctgcatatcagcagccagggcct

SEQ ID NO: 425903 - DNA, 140 bp, Artificial Sequence
  Synthetic
atacgccatgctgggtctccctcctataggggcgataaactctagtatgccattccacaacatacatcccctcaccatcggagaatgtcccaaatatgtgaaatcaaacaaattagtcctcgtacttgggagtcggccat

SEQ ID NO: 425904 - DNA, 140 bp, Artificial Sequence
  Synthetic
atggccgactcccaagtacgaggactaatttgtttgatttcacatatttgggacattctccgatggtgaggggatgtatgttgtggaatggcatactagagtttatcgcccctataggagggagacccagcatggcgtat

SEQ ID NO: 425905 - DNA, 140 bp, Artificial Sequence
  Synthetic
aggccctggctgctgatatgcgaccggaatttctggagaggcgaaaatggaagaagaacaaggattgcatacgagaggatgtgcaacatcctcaaagggaaattccaaacagcagcacaagaccttttgggacagcggtg

SEQ ID NO: 425906 - DNA, 140 bp, Artificial Sequence
  Synthetic
caccgctgtcccaaaaggtcttgtgctgctgtttggaatttccctttgaggatgttgcacatcctctcgtatgcaatccttgttcttcttccattttcgcctctccagaaattccggtcgcatatcagcagccagggcct

SEQ ID NO: 425907 - DNA, 140 bp, Artificial Sequence
  Synthetic
atacgccatgctgggtctcccgctgcagacaaagaatctactcaaaaggcaatagacggagtcaccaataaggtcaactcgatcattgacaaaatgaacactcagtttgaggccgtaggacgtacttgggagtcggccat

SEQ ID NO: 425908 - DNA, 140 bp, Artificial Sequence
  Synthetic
atggccgactcccaagtacgtcctacggcctcaaactgagtgttcattttgtcaatgatcgagttgaccttattggtgactccgtctattgccttttgagtagattctttgtctgcagcgggagacccagcatggcgtat

SEQ ID NO: 425909 - DNA, 140 bp, Artificial Sequence
  Synthetic
aggccctggctgctgatatgaaatatattcaatatggaacgaataaaagaattaagagatctaatgtcacagtcccgcactcgcgagatactaacaaaaaccactgtggaccatatggccgaccttttgggacagcggtg

SEQ ID NO: 425910 - DNA, 140 bp, Artificial Sequence
  Synthetic
caccgctgtcccaaaaggtcggccatatggtccacagtggtttttgttagtatctcgcgagtgcgggactgtgacattagatctcttaattcttttattcgttccatattgaatatatttcatatcagcagccagggcct

SEQ ID NO: 425911 - DNA, 140 bp, Artificial Sequence
  Synthetic
atacgccatgctgggtctccttaaaatgaatccaaatcaaaaaataatgaccattggctccatttcattagggttggctgtattcaatgttctactgcatgccgtgagcatcacactaaccgtacttgggagtcggccat

SEQ ID NO: 425912 - DNA, 140 bp, Artificial Sequence
  Synthetic
atggccgactcccaagtacggttagtgtgatgctcacggcatgcagtagaacattgaatacagccaaccctaatgaaatggagccaatggtcattattttttgatttggattcattttaaggagacccagcatggcgtat

SEQ ID NO: 425913 - DNA, 140 bp, Artificial Sequence
  Synthetic
aggccctggctgctgatatgccaaatattgtcaatttattcaacagtggcaagttccttagtactggcaatcatgatggctggtctatctttatggatgtgttccaacgggtcgttacaggaccttttgggacagcggtg

SEQ ID NO: 425914 - DNA, 140 bp, Artificial Sequence
  Synthetic
caccgctgtcccaaaaggtcctgtaacgacccgttggaacacatccataaagatagaccagccatcatgattgccagtactaaggaacttgccactgttgaataaattgacaatatttggcatatcagcagccagggcct

SEQ ID NO: 425915 - DNA, 140 bp, Artificial Sequence
  Synthetic
aggccctggctgctgatatgcgagcaatgatggaccaagtgagggaaagccggaatcctgggaatgctgaaattgaagatctcatctttctcgcacgatctgctctcattctgaggggatgaccttttgggacagcggtg

SEQ ID NO: 425916 - DNA, 140 bp, Artificial Sequence
  Synthetic
caccgctgtcccaaaaggtcatcccctcagaatgagagcagatcgtgcgagaaagatgagatcttcaatttcagcattcccaggattccggctttccctcacttggtccatcattgctcgcatatcagcagccagggcct

SEQ ID NO: 425917 - DNA, 140 bp, Artificial Sequence
  Synthetic
atacgccatgctgggtctccagcaaaagcaggggaatttcacaaccactcaagatggagacagtatcactaataactatactactggtagcagcagtaagcaatgcagataagatctgcacgtacttgggagtcggccat

SEQ ID NO: 425918 - DNA, 140 bp, Artificial Sequence
  Synthetic
atggccgactcccaagtacgtgcagatcttatctgcattgcttactgctgctaccagtagtatagttattagtgatactgtctccatcttgagtggttgtgaaattcccctgcttttgctggagacccagcatggcgtat

SEQ ID NO: 425919 - DNA, 140 bp, Artificial Sequence
  Synthetic
aggccctggctgctgatatgagttgtcacgatggaaaagcatggctgcatgtttgtataacgggggatgataaaaatgcaactgctagcttcatttacaatgggaggcttgtggatagtggaccttttgggacagcggtg

SEQ ID NO: 425920 - DNA, 140 bp, Artificial Sequence
  Synthetic
caccgctgtcccaaaaggtccactatccacaagcctcccattgtaaatgaagctagcagttgcatttttatcatcccccgttatacaaacatgcagccatgcttttccatcgtgacaactcatatcagcagccagggcct

SEQ ID NO: 425921 - DNA, 140 bp, Artificial Sequence
  Synthetic
atacgccatgctgggtctccacctaactgacatgactctcgaagaaatgtcaagggactggttcatgctcatgcccaagcagaaagtggtgggtcccctttgcatcaaaatggaccaggccgtacttgggagtcggccat

SEQ ID NO: 425922 - DNA, 140 bp, Artificial Sequence
  Synthetic
atggccgactcccaagtacggcctggtccattttgatgcaaaggggacccaccactttctgcttgggcatgagcatgaaccagtcccttgacatttcttcgagagtcatgtcagttaggtggagacccagcatggcgtat

SEQ ID NO: 425923 - DNA, 140 bp, Artificial Sequence
  Synthetic
aggccctggctgctgatatggcaccattgaaggactaatctatggcaatccttcttgtgatctattgttgggaggaagagaatggtcctatatcgtcgagagaccatcagctgttaacgggaccttttgggacagcggtg

SEQ ID NO: 425924 - DNA, 140 bp, Artificial Sequence
  Synthetic
caccgctgtcccaaaaggtcccgttaacagctgatggtctctcgacgatataggaccattctcttcctcccaacaatagatcacaagaaggattgccatagattagtccttcaatggtgccatatcagcagccagggcct

SEQ ID NO: 425925 - DNA, 140 bp, Artificial Sequence
  Synthetic
aggccctggctgctgatatgattgcaatgaaacagtcattagagaatacaatgaaacagtaaggattgagaaggtaacacaatggcacaataccaatgtcattgaatatatagaaagaccgaccttttgggacagcggtg

SEQ ID NO: 425926 - DNA, 140 bp, Artificial Sequence
  Synthetic
caccgctgtcccaaaaggtcggtctttctatatattcaatgacattggtattgtgccattgtgttaccttctcaatccttactgtttcattgtattctctaatgactgtttcattgcaatcatatcagcagccagggcct

SEQ ID NO: 425927 - DNA, 140 bp, Artificial Sequence
  Synthetic
atacgccatgctgggtctccattgtgggagaaatctcaccattaccttcccttccaggacatactagcgaggatgtcaaaaatgcaattggagtcctcatcggaggacttgaatggaatgcgtacttgggagtcggccat

SEQ ID NO: 425928 - DNA, 140 bp, Artificial Sequence
  Synthetic
atggccgactcccaagtacgcattccattcaagtcctccgatgaggactccaattgcatttttgacatcctcgctagtatgtcctggaagggaaggtaatggtgagatttctcccacaatggagacccagcatggcgtat

SEQ ID NO: 425929 - DNA, 140 bp, Artificial Sequence
  Synthetic
aggccctggctgctgatatgtatgtttccgttgggacatcaacattaaaccagagattggtgccaaaaatagctactagatcccaagtaaacgggcaacgtggaagaatggatttcttctgaccttttgggacagcggtg

SEQ ID NO: 425930 - DNA, 140 bp, Artificial Sequence
  Synthetic
caccgctgtcccaaaaggtcagaagaaatccattcttccacgttgcccgtttacttgggatctagtagctatttttggcaccaatctctggtttaatgttgatgtcccaacggaaacatacatatcagcagccagggcct

SEQ ID NO: 425931 - DNA, 140 bp, Artificial Sequence
  Synthetic
atacgccatgctgggtctccataacacagttaggatctctgaaactatacagagattcgcttggagaagcagtgatgagggtgggagacttccactccctccacatcagaaacggaaaatcgtacttgggagtcggccat

SEQ ID NO: 425932 - DNA, 140 bp, Artificial Sequence
  Synthetic
atggccgactcccaagtacgattttccgtttctgatgtggagggagtggaagtctcccaccctcatcactgcttctccaagcgaatctctgtatagtttcagagatcctaactgtgttatggagacccagcatggcgtat

SEQ ID NO: 425933 - DNA, 140 bp, Artificial Sequence
  Synthetic
aggccctggctgctgatatgtcccactgcagggccactgaatacataatgaagggagtgtacataaatacagctctgctcaatgcatcctgtgcagccatggatgactttcaactgattcgaccttttgggacagcggtg

SEQ ID NO: 425934 - DNA, 140 bp, Artificial Sequence
  Synthetic
caccgctgtcccaaaaggtcgaatcagttgaaagtcatccatggctgcacaggatgcattgagcagagctgtatttatgtacactcccttcattatgtattcagtggccctgcagtgggacatatcagcagccagggcct

SEQ ID NO: 425935 - DNA, 140 bp, Artificial Sequence
  Synthetic
atacgccatgctgggtctccagctctgctcaatgcatcctgtgcagccatggatgactttcaactgattccaatgataagcaagtgcagaaccaaagaaggaagacgaaaaacaaacctgcgtacttgggagtcggccat

SEQ ID NO: 425936 - DNA, 140 bp, Artificial Sequence
  Synthetic
atggccgactcccaagtacgcaggtttgtttttcgtcttccttctttggttctgcacttgcttatcattggaatcagttgaaagtcatccatggctgcacaggatgcattgagcagagctggagacccagcatggcgtat

SEQ ID NO: 425937 - DNA, 140 bp, Artificial Sequence
  Synthetic
atacgccatgctgggtctccgaaatacgacatagattgaaaattacagaaaacagcttcgaacagataacgtttatgcaagccttacaactactgcttgaagtggagcaagagataagagcgtacttgggagtcggccat

SEQ ID NO: 425938 - DNA, 140 bp, Artificial Sequence
  Synthetic
atggccgactcccaagtacgctcttatctcttgctccacttcaagcagtagttgtaaggcttgcataaacgttatctgttcgaagctgttttctgtaattttcaatctatgtcgtatttcggagacccagcatggcgtat

SEQ ID NO: 425939 - DNA, 140 bp, Artificial Sequence
  Synthetic
aggccctggctgctgatatgagcttcgaacagataacgtttatgcaagccttacaactactgcttgaagtggagcaagagataagagccttctcgtttcagcttatttaataataaaaaagaccttttgggacagcggtg

SEQ ID NO: 425940 - DNA, 140 bp, Artificial Sequence
  Synthetic
caccgctgtcccaaaaggtcttttttattattaaataagctgaaacgagaaggctcttatctcttgctccacttcaagcagtagttgtaaggcttgcataaacgttatctgttcgaagctcatatcagcagccagggcct

SEQ ID NO: 425941 - DNA, 140 bp, Artificial Sequence
  Synthetic
aggccctggctgctgatatgcgaactgcaattggtcaagtgtcaaggcccatgttcctatatgtaagaaccaatggaacttccaagatcaagatgaaatggggtatggaaatgagacgctgaccttttgggacagcggtg

SEQ ID NO: 425942 - DNA, 140 bp, Artificial Sequence
  Synthetic
caccgctgtcccaaaaggtcagcgtctcatttccataccccatttcatcttgatcttggaagttccattggttcttacatataggaacatgggccttgacacttgaccaattgcagttcgcatatcagcagccagggcct

SEQ ID NO: 425943 - DNA, 140 bp, Artificial Sequence
  Synthetic
atacgccatgctgggtctccaacatggccaattggagagtcacccaagggagtggaggaaggttccatcgggaaggtgtgcagaaccttactggcaaaatctgtatttaacagcctatatcgtacttgggagtcggccat

SEQ ID NO: 425944 - DNA, 140 bp, Artificial Sequence
  Synthetic
atggccgactcccaagtacgatataggctgttaaatacagattttgccagtaaggttctgcacaccttcccgatggaaccttcctccactcccttgggtgactctccaattggccatgttggagacccagcatggcgtat

SEQ ID NO: 425945 - DNA, 140 bp, Artificial Sequence
  Synthetic
aggccctggctgctgatatgacaataacgacccctgcgacaccgaactgcagtgacaccataataacatacaacaacactgtgataaacaacataacaacaacaataataactgaagcaggaccttttgggacagcggtg

SEQ ID NO: 425946 - DNA, 140 bp, Artificial Sequence
  Synthetic
caccgctgtcccaaaaggtcctgcttcagttattattgttgttgttatgttgtttatcacagtgttgttgtatgttattatggtgtcactgcagttcggtgtcgcaggggtcgttattgtcatatcagcagccagggcct

SEQ ID NO: 425947 - DNA, 140 bp, Artificial Sequence
  Synthetic
atacgccatgctgggtctcccattgttcaggcacttagggataacctggaacctggaaccttcgatcttggagggctatatgaagcaatcgaggagtgcctgattaatgatccctgggttcgtacttgggagtcggccat

SEQ ID NO: 425948 - DNA, 140 bp, Artificial Sequence
  Synthetic
atggccgactcccaagtacgaacccagggatcattaatcaggcactcctcgattgcttcatatagccctccaagatcgaaggttccaggttccaggttatccctaagtgcctgaacaatgggagacccagcatggcgtat

SEQ ID NO: 425949 - DNA, 140 bp, Artificial Sequence
  Synthetic
atacgccatgctgggtctccggtctggaaatcgaaccagctactcgtgcaggaaaacaaatagtgaagcgtattctggaaaaagagtatgatgaatcacttaaaatgactatcgcttctgcgtacttgggagtcggccat

SEQ ID NO: 425950 - DNA, 140 bp, Artificial Sequence
  Synthetic
atggccgactcccaagtacgcagaagcgatagtcattttaagtgattcatcatactctttttccagaatacgcttcactatttgttttcctgcacgagtagctggttcgatttccagaccggagacccagcatggcgtat

SEQ ID NO: 425951 - DNA, 140 bp, Artificial Sequence
  Synthetic
atacgccatgctgggtctccatgaatccaaatcagaagataatagcaattggatctgtttctctaaccattgcgatgatatgttttctcatgcagattgccatcttaacaacgaccatgacgtacttgggagtcggccat

SEQ ID NO: 425952 - DNA, 140 bp, Artificial Sequence
  Synthetic
atggccgactcccaagtacgtcatggtcgttgttaagatggcaatctgcatgagaaaacatatcatcgcaatggttagagaaacagatccaattgctattatcttctgatttggattcatggagacccagcatggcgtat

SEQ ID NO: 425953 - DNA, 140 bp, Artificial Sequence
  Synthetic
atacgccatgctgggtctccgggatcaaacccaatcaaaggtagggctattagtatcagatggaggaccaaacttatacaatatacggaatcttcacattcctgaagtctgcttaaaatgcgtacttgggagtcggccat

SEQ ID NO: 425954 - DNA, 140 bp, Artificial Sequence
  Synthetic
atggccgactcccaagtacgcattttaagcagacttcaggaatgtgaagattccgtatattgtataagtttggtcctccatctgatactaatagccctacctttgattgggtttgatcccggagacccagcatggcgtat

SEQ ID NO: 425955 - DNA, 140 bp, Artificial Sequence
  Synthetic
atacgccatgctgggtctccgacagaagtccatatcgaaccttgatgagctgtcccattggtgaagtcccttctccatacaactcaaggtttgagtcagtcgcttggtcagcaagtgcctcgtacttgggagtcggccat

SEQ ID NO: 425956 - DNA, 140 bp, Artificial Sequence
  Synthetic
atggccgactcccaagtacgaggcacttgctgaccaagcgactgactcaaaccttgagttgtatggagaagggacttcaccaatgggacagctcatcaaggttcgatatggacttctgtcggagacccagcatggcgtat

SEQ ID NO: 425957 - DNA, 140 bp, Artificial Sequence
  Synthetic
aggccctggctgctgatatgatacaatatccggaatcttcacatccctgaagtctgcttaaagtgggagctgatggatgaggattatcggggaagactttgtaatcccctgaatccctttgaccttttgggacagcggtg

SEQ ID NO: 425958 - DNA, 140 bp, Artificial Sequence
  Synthetic
caccgctgtcccaaaaggtcaaagggattcaggggattacaaagtcttccccgataatcctcatccatcagctcccactttaagcagacttcagggatgtgaagattccggatattgtatcatatcagcagccagggcct

SEQ ID NO: 425959 - DNA, 140 bp, Artificial Sequence
  Synthetic
aggccctggctgctgatatgtgactcaaggaacctgctgggaacagatgtacactccaggcggagaagtaagaaatgacgatgttgaccagagtctgatcattgctgccagaaacattgtgaccttttgggacagcggtg

SEQ ID NO: 425960 - DNA, 140 bp, Artificial Sequence
  Synthetic
caccgctgtcccaaaaggtcacaatgtttctggcagcaatgatcagactctggtcaacatcgtcatttcttacttctccgcctggagtgtacatctgttcccagcaggttccttgagtcacatatcagcagccagggcct

SEQ ID NO: 425961 - DNA, 140 bp, Artificial Sequence
  Synthetic
atacgccatgctgggtctccatggaagactttgtgcgacaatgcttcaatccaatgatcgtcgagcttgcggaaaaggcaatgaaagaacatggagaagacccaaaaattgagacaaacacgtacttgggagtcggccat

SEQ ID NO: 425962 - DNA, 140 bp, Artificial Sequence
  Synthetic
atggccgactcccaagtacgtgtttgtctcaatttttgggtcttctccatgttctttcattgccttttccgcaagctcgacgatcattggattgaagcattgtcgcacaaagtcttccatggagacccagcatggcgtat

SEQ ID NO: 425963 - DNA, 140 bp, Artificial Sequence
  Synthetic
atacgccatgctgggtctccgtgaatgcaccgaatcatgaggggatacaagccggagtggataggttctataggacctgcaaactggttgggatcaacatgagcaaaaagaaatcttacacgtacttgggagtcggccat

SEQ ID NO: 425964 - DNA, 140 bp, Artificial Sequence
  Synthetic
atggccgactcccaagtacgtgtaagatttctttttgctcatgttgatcccaaccagtttgcaggtcctatagaacctatccactccggcttgtatcccctcatgattcggtgcattcacggagacccagcatggcgtat

SEQ ID NO: 425965 - DNA, 140 bp, Artificial Sequence
  Synthetic
aggccctggctgctgatatggggatctttgaaaactcatgtctcgaaaccatggaaattgttcagcaaacaagagtggataaactaactcaaggtcgccagacctatgactggacattgagaccttttgggacagcggtg

SEQ ID NO: 425966 - DNA, 140 bp, Artificial Sequence
  Synthetic
caccgctgtcccaaaaggtctcaatgtccagtcataggtctggcgaccttgagttagtttatccactcttgtttgctgaacaatttccatggtttcgagacatgagttttcaaagatccccatatcagcagccagggcct

SEQ ID NO: 425967 - DNA, 140 bp, Artificial Sequence
  Synthetic
atacgccatgctgggtctccaagtctcccgccgaacttctccagccttgaaaactttagagcctatgtggatggattcgaaccgaacggctgcattgagggcaagctttctcaaatgtcccgtacttgggagtcggccat

SEQ ID NO: 425968 - DNA, 140 bp, Artificial Sequence
  Synthetic
atggccgactcccaagtacgggacatttgagaaagcttgccctcaatgcagccgttcggttcgaatccatccacataggctctaaagttttcaaggctggagaagttcggcgggagacttggagacccagcatggcgtat

SEQ ID NO: 425969 - DNA, 140 bp, Artificial Sequence
  Synthetic
atacgccatgctgggtctccaaagaagtgaatgccaggattgaaccattcttgagggaaacaccacgctctctcagattacctgatggacctccctgttctcaacgatcaaaattcctaccgtacttgggagtcggccat

SEQ ID NO: 425970 - DNA, 140 bp, Artificial Sequence
  Synthetic
atggccgactcccaagtacggtaggaattttgatcgttgagaacagggaggtccatcaggtaatctgagagagcgtggtgtttccctcaagaatggttcaatcctggcattcacttctttggagacccagcatggcgtat

SEQ ID NO: 425971 - DNA, 140 bp, Artificial Sequence
  Synthetic
atacgccatgctgggtctccgggataccgctatatgatgcaatcaagtgcatgaagacatttttcggatggaaagagccccacattgtcaagccgcatgagaaaggcataaatccaaactcgtacttgggagtcggccat

SEQ ID NO: 425972 - DNA, 140 bp, Artificial Sequence
  Synthetic
atggccgactcccaagtacgagtttggatttatgcctttctcatgcggcttgacaatgtggggctctttccatccgaaaaatgtcttcatgcacttgattgcatcatatagcggtatcccggagacccagcatggcgtat

SEQ ID NO: 425973 - DNA, 140 bp, Artificial Sequence
  Synthetic
aggccctggctgctgatatgcaatgacaaaggatgcagaaagaggcaaattgaaaaggagggcaattgcaacacccggaatgcagatcagaggattcgtgtactttgtcgaaacactagcgaccttttgggacagcggtg

SEQ ID NO: 425974 - DNA, 140 bp, Artificial Sequence
  Synthetic
caccgctgtcccaaaaggtcgctagtgtttcgacaaagtacacgaatcctctgatctgcattccgggtgttgcaattgccctccttttcaatttgcctctttctgcatcctttgtcattgcatatcagcagccagggcct

SEQ ID NO: 425975 - DNA, 140 bp, Artificial Sequence
  Synthetic
aggccctggctgctgatatggccttcttcagtctcttcaacagattgagagcatgatcgaagcggaatcttctgttaaagagaaggacatgaccaaagaattttttgaaaacaaatctgagaccttttgggacagcggtg

SEQ ID NO: 425976 - DNA, 140 bp, Artificial Sequence
  Synthetic
caccgctgtcccaaaaggtctcagatttgttttcaaaaaattctttggtcatgtccttctctttaacagaagattccgcttcgatcatgctctcaatctgttgaagagactgaagaaggccatatcagcagccagggcct

SEQ ID NO: 425977 - DNA, 140 bp, Artificial Sequence
  Synthetic
aggccctggctgctgatatgaccacgccctctcagattacctgatgggcctccttgttctcagcggtcgaaattcttactgatggatgcccttaaattaagcatcgaagatccaagccatgaccttttgggacagcggtg

SEQ ID NO: 425978 - DNA, 140 bp, Artificial Sequence
  Synthetic
caccgctgtcccaaaaggtcatggcttggatcttcgatgcttaatttaagggcatccatcagtaagaatttcgaccgctgagaacaaggaggcccatcaggtaatctgagagggcgtggtcatatcagcagccagggcct

SEQ ID NO: 425979 - DNA, 140 bp, Artificial Sequence
  Synthetic
aggccctggctgctgatatgcattttcctggcacggtcagcactcattctgaggggatcagttgcacataaatcctgcctgcctgcttgtgtgtatgggcttgcagtagcaagtgggcatgaccttttgggacagcggtg

SEQ ID NO: 425980 - DNA, 140 bp, Artificial Sequence
  Synthetic
caccgctgtcccaaaaggtcatgcccacttgctactgcaagcccatacacacaagcaggcaggcaggatttatgtgcaactgatcccctcagaatgagtgctgaccgtgccaggaaaatgcatatcagcagccagggcct

SEQ ID NO: 425981 - DNA, 140 bp, Artificial Sequence
  Synthetic
atacgccatgctgggtctcctgaatacaaagggcgattgcttcaccctcaaaatccctttgtaggacatttgtccattgaaggcatcaaagaagcagatataaccccagcacatggtcctcgtacttgggagtcggccat

SEQ ID NO: 425982 - DNA, 140 bp, Artificial Sequence
  Synthetic
atggccgactcccaagtacgaggaccatgtgctggggttatatctgcttctttgatgccttcaatggacaaatgtcctacaaagggattttgagggtgaagcaatcgccctttgtattcaggagacccagcatggcgtat

SEQ ID NO: 425983 - DNA, 140 bp, Artificial Sequence
  Synthetic
atacgccatgctgggtctccagcaaaagcaggggaatttcttaactagcaaaatggaaataataccactgatgactgtacttctattagtaacaacaagcaatgcagacaaaatatgcatcgtacttgggagtcggccat

SEQ ID NO: 425984 - DNA, 140 bp, Artificial Sequence
  Synthetic
atggccgactcccaagtacgatgcatattttgtctgcattgcttgttgttactaatagaagtacagtcatcagtggtattatttccattttgctagttaagaaattcccctgcttttgctggagacccagcatggcgtat

SEQ ID NO: 425985 - DNA, 140 bp, Artificial Sequence
  Synthetic
atacgccatgctgggtctccatgcagagagaggcaaattaaaaagaagggctattgcaacacctgggatgcaaattagagggttcgtgtacttcgttgaaactttagctagaagcatttgcgtacttgggagtcggccat

SEQ ID NO: 425986 - DNA, 140 bp, Artificial Sequence
  Synthetic
atggccgactcccaagtacgcaaatgcttctagctaaagtttcaacgaagtacacgaaccctctaatttgcatcccaggtgttgcaatagcccttctttttaatttgcctctctctgcatggagacccagcatggcgtat

SEQ ID NO: 425987 - DNA, 140 bp, Artificial Sequence
  Synthetic
aggccctggctgctgatatgctaatggtggcatacatgttggaaagagaactggttcgcaaaacaagattcctgccggtagcaggcgggacaagcagtgtgtacattgaggtattgcactgaccttttgggacagcggtg

SEQ ID NO: 425988 - DNA, 140 bp, Artificial Sequence
  Synthetic
caccgctgtcccaaaaggtcagtgcaatacctcaatgtacacactgcttgtcccgcctgctaccggcaggaatcttgttttgcgaaccagttctctttccaacatgtatgccaccattagcatatcagcagccagggcct

SEQ ID NO: 425989 - DNA, 140 bp, Artificial Sequence
  Synthetic
atacgccatgctgggtctccgagtggatgaatattccagcactgagagagtggttgtgagcattgaccgtttcttgagagtccgagatcagcgaggaaacatactcttatctcctgaagacgtacttgggagtcggccat

SEQ ID NO: 425990 - DNA, 140 bp, Artificial Sequence
  Synthetic
atggccgactcccaagtacgtcttcaggagataagagtatgtttcctcgctgatctcggactctcaagaaacggtcaatgctcacaaccactctctcagtgctggaatattcatccactcggagacccagcatggcgtat

SEQ ID NO: 425991 - DNA, 140 bp, Artificial Sequence
  Synthetic
atacgccatgctgggtctcccttaataagagcactgacactaaacacaatgacaaaagatgcagaaaggggtaaattgaagaggcgggcaattgcaacacccggaatgcagatcagagggcgtacttgggagtcggccat

SEQ ID NO: 425992 - DNA, 140 bp, Artificial Sequence
  Synthetic
atggccgactcccaagtacgccctctgatctgcattccgggtgttgcaattgcccgcctcttcaatttacccctttctgcatcttttgtcattgtgtttagtgtcagtgctcttattaagggagacccagcatggcgtat

SEQ ID NO: 425993 - DNA, 140 bp, Artificial Sequence
  Synthetic
aggccctggctgctgatatggcaaagatgtcggtgatctcaaacagtatgacagcgatgagccagagcctagatctctagcaagctgggtccaaaatgagttcaacaaggcatgtgaattgaccttttgggacagcggtg

SEQ ID NO: 425994 - DNA, 140 bp, Artificial Sequence
  Synthetic
caccgctgtcccaaaaggtcaattcacatgccttgttgaactcattttggacccagcttgctagagatctaggctctggctcatcgctgtcatactgtttgagatcaccgacatctttgccatatcagcagccagggcct

SEQ ID NO: 425995 - DNA, 140 bp, Artificial Sequence
  Synthetic
atacgccatgctgggtctcctgccaaaatggagaaaatagttcttctctttgcaacaatcagccttgtcaaaagcgatcatatttgcattggttatcatgcaaataactcgacagagcagcgtacttgggagtcggccat

SEQ ID NO: 425996 - DNA, 140 bp, Artificial Sequence
  Synthetic
atggccgactcccaagtacgctgctctgtcgagttatttgcatgataaccaatgcaaatatgatcgcttttgacaaggctgattgttgcaaagagaagaactattttctccattttggcaggagacccagcatggcgtat

SEQ ID NO: 425997 - DNA, 140 bp, Artificial Sequence
  Synthetic
atacgccatgctgggtctcctattgacacctgcatttctgagtgcatcactccaaatggaagcattcccaatgacaagccctttcaaaatgtaaacaagatcacatacggagcatgtccccgtacttgggagtcggccat

SEQ ID NO: 425998 - DNA, 140 bp, Artificial Sequence
  Synthetic
atggccgactcccaagtacggggacatgctccgtatgtgatcttgtttacattttgaaagggcttgtcattgggaatgcttccatttggagtgatgcactcagaaatgcaggtgtcaataggagacccagcatggcgtat

SEQ ID NO: 425999 - DNA, 140 bp, Artificial Sequence
  Synthetic
atacgccatgctgggtctccatggagaaaatagttctctctcttgcaacaatcagccttgtcaaaagcgatcatatttgcattggttatcatgcaaataactcgacagagcaggttgacacgtacttgggagtcggccat

SEQ ID NO: 426000 - DNA, 140 bp, Artificial Sequence
  Synthetic
atggccgactcccaagtacgtgtcaacctgctctgtcgagttatttgcatgataaccaatgcaaatatgatcgcttttgacaaggctgattgttgcaagagagagaactattttctccatggagacccagcatggcgtat

SEQ ID NO: 426001 - DNA, 140 bp, Artificial Sequence
  Synthetic
atacgccatgctgggtctccaagggagccttatgtcagttgcgacaatgatgattgctggtcctttgcccttgcccaaggggctctactaggaactaaacacagcaatggaaccatcaaacgtacttgggagtcggccat

SEQ ID NO: 426002 - DNA, 140 bp, Artificial Sequence
  Synthetic
atggccgactcccaagtacgtttgatggttccattgctgtgtttagttcctagtagagccccttgggcaagggcaaaggaccagcaatcatcattgtcgcaactgacataaggctcccttggagacccagcatggcgtat

SEQ ID NO: 426003 - DNA, 140 bp, Artificial Sequence
  Synthetic
atacgccatgctgggtctcccaataatggaaaagaacgttactgttacacatgctcaagacatactggagaagacacacaacgggaagctctgcaacctcaatggagtgaagcctttaatcgtacttgggagtcggccat

SEQ ID NO: 426004 - DNA, 140 bp, Artificial Sequence
  Synthetic
atggccgactcccaagtacgattaaaggcttcactccattgaggttgcagagcttcccgttgtgtgtcttctccagtatgtcttgagcatgtgtaacagtaacgttcttttccattattgggagacccagcatggcgtat

SEQ ID NO: 426005 - DNA, 140 bp, Artificial Sequence
  Synthetic
atacgccatgctgggtctcccaggaatagagtctgcagtgttgagagggtttctgatcttgggcaaagaagacaaaagatttggacctgcattgagcatcaacgaattgggcaatcttgccgtacttgggagtcggccat

SEQ ID NO: 426006 - DNA, 140 bp, Artificial Sequence
  Synthetic
atggccgactcccaagtacggcaagattgcccaattcgttgatgctcaatgcaggtccaaatcttttgtcttctttgcccaagatcagaaaccctctcaacactgcagactctattcctgggagacccagcatggcgtat

SEQ ID NO: 426007 - DNA, 140 bp, Artificial Sequence
  Synthetic
atacgccatgctgggtctccggtaaactttgtaagtatggaattttcccttaccgacccaaggttggaaccacataaatgggaaaagtattgtgttcttgaaataggggacatgctcctgcgtacttgggagtcggccat

SEQ ID NO: 426008 - DNA, 140 bp, Artificial Sequence
  Synthetic
atggccgactcccaagtacgcaggagcatgtcccctatttcaagaacacaatacttttcccatttatgtggttccaaccttgggtcggtaagggaaaattccatacttacaaagtttaccggagacccagcatggcgtat

SEQ ID NO: 426009 - DNA, 140 bp, Artificial Sequence
  Synthetic
atacgccatgctgggtctccccagaatacaggaattggtcgaaaccgcagtgtcagattacagggtttgctcctttctccaaggacaactcaattcggctttctgctggtggggacatttcgtacttgggagtcggccat

SEQ ID NO: 426010 - DNA, 140 bp, Artificial Sequence
  Synthetic
atggccgactcccaagtacgaaatgtccccaccagcagaaagccgaattgagttgtccttggagaaaggagcaaaccctgtaatctgacactgcggtttcgaccaattcctgtattctggggagacccagcatggcgtat

SEQ ID NO: 426011 - DNA, 140 bp, Artificial Sequence
  Synthetic
atacgccatgctgggtctccatggatgtcaatccgactctacttttcttaaaagtgccagcgcaaaatgctataagtactacattcccttacactggagatcctccatacagccatggaacgtacttgggagtcggccat

SEQ ID NO: 426012 - DNA, 140 bp, Artificial Sequence
  Synthetic
atggccgactcccaagtacgttccatggctgtatggaggatctccagtgtaagggaatgtagtacttatagcattttgcgctggcacttttaagaaaagtagagtcggattgacatccatggagacccagcatggcgtat

SEQ ID NO: 426013 - DNA, 140 bp, Artificial Sequence
  Synthetic
aggccctggctgctgatatgaaaagccaacaaaataaaatccgagaagacacacattcacatcttctcatttactggggaagaaatggccacaaaagcagactacacccttgacgaagaagaccttttgggacagcggtg

SEQ ID NO: 426014 - DNA, 140 bp, Artificial Sequence
  Synthetic
caccgctgtcccaaaaggtcttcttcgtcaagggtgtagtctgcttttgtggccatttcttccccagtaaatgagaagatgtgaatgtgtgtcttctcggattttattttgttggcttttcatatcagcagccagggcct

SEQ ID NO: 426015 - DNA, 140 bp, Artificial Sequence
  Synthetic
aggccctggctgctgatatgagaggagaaacaagtatctggaggagcatcccagtgctgggaaagatcccaagaagactggaggcccaatctacaggaggagagatggcaaatggatgaggaccttttgggacagcggtg

SEQ ID NO: 426016 - DNA, 140 bp, Artificial Sequence
  Synthetic
caccgctgtcccaaaaggtcctcatccatttgccatctctcctcctgtagattgggcctccagtcttcttgggatctttcccagcactgggatgctcctccagatacttgtttctcctctcatatcagcagccagggcct

SEQ ID NO: 426017 - DNA, 140 bp, Artificial Sequence
  Synthetic
aggccctggctgctgatatgcaaaagaagtgaatgccagaattgagccatttctgaagacaacaccacgccctctcaaattgcctgatggtcctccttgctctcagcggtcaaaattcttgaccttttgggacagcggtg

SEQ ID NO: 426018 - DNA, 140 bp, Artificial Sequence
  Synthetic
caccgctgtcccaaaaggtcaagaattttgaccgctgagagcaaggaggaccatcaggcaatttgagagggcgtggtgttgtcttcagaaatggctcaattctggcattcacttcttttgcatatcagcagccagggcct

SEQ ID NO: 426019 - DNA, 140 bp, Artificial Sequence
  Synthetic
aggccctggctgctgatatgagggaataccactatacgatgcaatcaaatgcatgaagacatttttcggctggaaagagcccaatataatcaagccacacgagaagggcataaatcctaagaccttttgggacagcggtg

SEQ ID NO: 426020 - DNA, 140 bp, Artificial Sequence
  Synthetic
caccgctgtcccaaaaggtcttaggatttatgcccttctcgtgtggcttgattatattgggctctttccagccgaaaaatgtcttcatgcatttgattgcatcgtatagtggtattccctcatatcagcagccagggcct

SEQ ID NO: 426021 - DNA, 140 bp, Artificial Sequence
  Synthetic
atacgccatgctgggtctcctggaaagagcccaatataatcaagccacacgagaagggcataaatcctaattacctcctggcttggaagcaagtgctagcagaactccaggaccttgaaacgtacttgggagtcggccat

SEQ ID NO: 426022 - DNA, 140 bp, Artificial Sequence
  Synthetic
atggccgactcccaagtacgtttcaaggtcctggagttctgctagcacttgcttccaagccaggaggtaattaggatttatgcccttctcgtgtggcttgattatattgggctctttccaggagacccagcatggcgtat

SEQ ID NO: 426023 - DNA, 140 bp, Artificial Sequence
  Synthetic
atacgccatgctgggtctccaacaaccaatccactaatcaggcacgagaacaggatggtaatagccagcacaacagctaaggccatggaacaaatggccggatcaagcgaacaagcagcacgtacttgggagtcggccat

SEQ ID NO: 426024 - DNA, 140 bp, Artificial Sequence
  Synthetic
atggccgactcccaagtacgtgctgcttgttcgcttgatccggccatttgttccatggccttagctgttgtgctggctattaccatcctgttctcgtgcctgattagtggattggttgttggagacccagcatggcgtat

SEQ ID NO: 426025 - DNA, 140 bp, Artificial Sequence
  Synthetic
aggccctggctgctgatatgttgaccgactcgagctggatagaactggatgagataggggaagatgttgctccgattgaacacattgcaagtatgaggaggaattattttacagcggaaggaccttttgggacagcggtg

SEQ ID NO: 426026 - DNA, 140 bp, Artificial Sequence
  Synthetic
caccgctgtcccaaaaggtccttccgctgtaaaataattcctcctcatacttgcaatgtgttcaatcggagcaacatcttcccctatctcatccagttctatccagctcgagtcggtcaacatatcagcagccagggcct

SEQ ID NO: 426027 - DNA, 140 bp, Artificial Sequence
  Synthetic
atacgccatgctgggtctcctccgattgaacacattgcaagtatgaggaggaattattttacagcggaagtgtcccattgtcgggccactgaatacataatgaagggagtttacataaatcgtacttgggagtcggccat

SEQ ID NO: 426028 - DNA, 140 bp, Artificial Sequence
  Synthetic
atggccgactcccaagtacgatttatgtaaactcccttcattatgtattcagtggcccgacaatgggacacttccgctgtaaaataattcctcctcatacttgcaatgtgttcaatcggaggagacccagcatggcgtat

SEQ ID NO: 426029 - DNA, 140 bp, Artificial Sequence
  Synthetic
atacgccatgctgggtctccgaaacacctattgagcagaataaaccgttttgagaaaattgagatcatccccaaaagtcattggtccaatcataatacctcaggggtaagctcagcttgtcgtacttgggagtcggccat

SEQ ID NO: 426030 - DNA, 140 bp, Artificial Sequence
  Synthetic
atggccgactcccaagtacgacaagctgagcttacccctgaggtattatgattggaccaatgacttttggggatgatctcaattttctcaaaacggtttattctgctcaataggtgtttcggagacccagcatggcgtat

SEQ ID NO: 426031 - DNA, 140 bp, Artificial Sequence
  Synthetic
aggccctggctgctgatatgacgatcttatgaacagatggaaactggtggagaacgccagaatgccactgaaatcagagcatctgttggaagaatggttggtggaattgggaggttttacgaccttttgggacagcggtg

SEQ ID NO: 426032 - DNA, 140 bp, Artificial Sequence
  Synthetic
caccgctgtcccaaaaggtcgtaaaacctcccaattccaccaaccattcttccaacagatgctctgatttcagtggcattctggcgttctccaccagtttccatctgttcataagatcgtcatatcagcagccagggcct

SEQ ID NO: 426033 - DNA, 140 bp, Artificial Sequence
  Synthetic
aggccctggctgctgatatgaggatcagtggctcataaatcctgcctgcctgcttgtgtatatggacttattgtggcaagtggatatgactttgaaaaagaagggtactccctagtcggagaccttttgggacagcggtg

SEQ ID NO: 426034 - DNA, 140 bp, Artificial Sequence
  Synthetic
caccgctgtcccaaaaggtctccgactagggagtacccttctttttcaaagtcatatccacttgccacaataagtccatatacacaagcaggcaggcaggatttatgagccactgatcctcatatcagcagccagggcct

SEQ ID NO: 426035 - DNA, 140 bp, Artificial Sequence
  Synthetic
atacgccatgctgggtctccaacaacgactggtcgggctactcaggcagtttcattgtcaaaaacaaggactgttttcagccctgtttttatgttgagcttatacgagggaggcccaacacgtacttgggagtcggccat

SEQ ID NO: 426036 - DNA, 140 bp, Artificial Sequence
  Synthetic
atggccgactcccaagtacgtgttgggcctccctcgtataagctcaacataaaaacagggctgaaaacagtccttgtttttgacaatgaaactgcctgagtagcccgaccagtcgttgttggagacccagcatggcgtat

SEQ ID NO: 426037 - DNA, 140 bp, Artificial Sequence
  Synthetic
atacgccatgctgggtctcctgccaaacaatgacaattttgacaaattgtacatttggggggttcaccacccgggtacagacaaggaccaaacctacctatatgttcaagcatcagggagcgtacttgggagtcggccat

SEQ ID NO: 426038 - DNA, 140 bp, Artificial Sequence
  Synthetic
atggccgactcccaagtacgctccctgatgcttgaacatataggtaggtttggtccttgtctgtacccgggtggtgaaccccccaaatgtacaatttgtcaaaattgtcattgtttggcaggagacccagcatggcgtat

SEQ ID NO: 426039 - DNA, 140 bp, Artificial Sequence
  Synthetic
atacgccatgctgggtctcccatggtatctagggcccgaatttattcacggcttgacttcgagtctggaaggactacgaaagaagagtttgctgagatcatgaagatcagttccaccattcgtacttgggagtcggccat

SEQ ID NO: 426040 - DNA, 140 bp, Artificial Sequence
  Synthetic
atggccgactcccaagtacgaatggtggaactgatcttcatgatctcagcaaactcttctttcgtagtccttccagactcgaagtcaagccgtgaataaattcgggccctagataccatgggagacccagcatggcgtat

SEQ ID NO: 426041 - DNA, 140 bp, Artificial Sequence
  Synthetic
atacgccatgctgggtctccgcatctgcaggacaaatcagtgttcaaccaactttctcagtacagagaaaccttcctttcgagagagcaaccatcatggcagcattcacggggaacaccgcgtacttgggagtcggccat

SEQ ID NO: 426042 - DNA, 140 bp, Artificial Sequence
  Synthetic
atggccgactcccaagtacgcggtgttccccgtgaatgctgccatgatggttgctctctcgaaaggaaggtttctctgtactgagaaagttggttgaacactgatttgtcctgcagatgcggagacccagcatggcgtat

SEQ ID NO: 426043 - DNA, 140 bp, Artificial Sequence
  Synthetic
aggccctggctgctgatatgcgagcaatgatggaccaagtgagagaaagccggaatcctgggaatgctgaaattgaggatctcatcttcctagcacggtctgctctcatcctgaggggatgaccttttgggacagcggtg

SEQ ID NO: 426044 - DNA, 140 bp, Artificial Sequence
  Synthetic
caccgctgtcccaaaaggtcatcccctcaggatgagagcagaccgtgctaggaagatgagatcctcaatttcagcattcccaggattccggctttctctcacttggtccatcattgctcgcatatcagcagccagggcct

SEQ ID NO: 426045 - DNA, 140 bp, Artificial Sequence
  Synthetic
aggccctggctgctgatatgatttccaaaggaaaagaagagtgagagacaacatgaccaagaaaatggtcacacaaaggacaataggaaagaagaagcagaggctaaacaaaaggagctagaccttttgggacagcggtg

SEQ ID NO: 426046 - DNA, 140 bp, Artificial Sequence
  Synthetic
caccgctgtcccaaaaggtctagctccttttgtttagcctctgcttcttctttcctattgtcctttgtgtgaccattttcttggtcatgttgtctctcactcttcttttcctttggaaatcatatcagcagccagggcct

SEQ ID NO: 426047 - DNA, 140 bp, Artificial Sequence
  Synthetic
aggccctggctgctgatatgaaacacagggaacagagaaattaacaataacatattcatcatcaatgatgtgggaaatcaatggtcctgagtcagtgcttgttaacacctatcaatggatgaccttttgggacagcggtg

SEQ ID NO: 426048 - DNA, 140 bp, Artificial Sequence
  Synthetic
caccgctgtcccaaaaggtcatccattgataggtgttaacaagcactgactcaggaccattgatttcccacatcattgatgatgaatatgttattgttaatttctctgttccctgtgtttcatatcagcagccagggcct

SEQ ID NO: 426049 - DNA, 140 bp, Artificial Sequence
  Synthetic
aggccctggctgctgatatgaccaagctatatgggagtggaaacaaactggtgacagttgggagttctaattatcaacaatcttttgtgccgagtccaggagcgagaccacaagttaatggaccttttgggacagcggtg

SEQ ID NO: 426050 - DNA, 140 bp, Artificial Sequence
  Synthetic
caccgctgtcccaaaaggtccattaacttgtggtctcgctcctggactcggcacaaaagattgttgataattagaactcccaactgtcaccagtttgtttccactcccatatagcttggtcatatcagcagccagggcct

SEQ ID NO: 426051 - DNA, 140 bp, Artificial Sequence
  Synthetic
atacgccatgctgggtctccaagcagcggctacaaagatgtgatactttggtttagcttcggggcatcatgtttcatacttctagccattgcaatgggccttgtcttcatatgtgtgaagcgtacttgggagtcggccat

SEQ ID NO: 426052 - DNA, 140 bp, Artificial Sequence
  Synthetic
atggccgactcccaagtacgcttcacacatatgaagacaaggcccattgcaatggctagaagtatgaaacatgatgccccgaagctaaaccaaagtatcacatctttgtagccgctgcttggagacccagcatggcgtat

SEQ ID NO: 426053 - DNA, 140 bp, Artificial Sequence
  Synthetic
atacgccatgctgggtctccgaaagccaacaagataaaatccgaaaagacacacattcacatcttttcattcactggagaggaaatggccaccaaagcagactacactcttgatgaagaacgtacttgggagtcggccat

SEQ ID NO: 426054 - DNA, 140 bp, Artificial Sequence
  Synthetic
atggccgactcccaagtacgttcttcatcaagagtgtagtctgctttggtggccatttcctctccagtgaatgaaaagatgtgaatgtgtgtcttttcggattttatcttgttggctttcggagacccagcatggcgtat

SEQ ID NO: 426055 - DNA, 140 bp, Artificial Sequence
  Synthetic
aggccctggctgctgatatgaggatccgtggcccataagtcctgcttgcctgcttgtgtgtacggacttgctgtcgccagtggatatgattttgagagagaagggtactctctggtcggagaccttttgggacagcggtg

SEQ ID NO: 426056 - DNA, 140 bp, Artificial Sequence
  Synthetic
caccgctgtcccaaaaggtctccgaccagagagtacccttctctctcaaaatcatatccactggcgacagcaagtccgtacacacaagcaggcaagcaggacttatgggccacggatcctcatatcagcagccagggcct

SEQ ID NO: 426057 - DNA, 140 bp, Artificial Sequence
  Synthetic
atacgccatgctgggtctccggagaagagcaacggccattctcaggaaggcaaccagaaggctgatccagctaatagtaagtggaagggacgagcagtcaattgctgaagcaataattgtcgtacttgggagtcggccat

SEQ ID NO: 426058 - DNA, 140 bp, Artificial Sequence
  Synthetic
atggccgactcccaagtacgacaattattgcttcagcaattgactgctcgtcccttccacttactattagctggatcagccttctggttgccttcctgagaatggccgttgctcttctccggagacccagcatggcgtat

SEQ ID NO: 426059 - DNA, 140 bp, Artificial Sequence
  Synthetic
atacgccatgctgggtctccatggaaagaataaaagaactaagagatttgatgtcgcagtctcgcactcgcgagatactgacaaaaacaactgtggaccatatggccataatcaagaaatcgtacttgggagtcggccat

SEQ ID NO: 426060 - DNA, 140 bp, Artificial Sequence
  Synthetic
atggccgactcccaagtacgatttcttgattatggccatatggtccacagttgtttttgtcagtatctcgcgagtgcgagactgcgacatcaaatctcttagttcttttattctttccatggagacccagcatggcgtat

SEQ ID NO: 426061 - DNA, 140 bp, Artificial Sequence
  Synthetic
atacgccatgctgggtctccctcttgagacatttccaaaaggatgcaaaagtgcttttccagaattggggaattgaacccattgacaatgttatgggaatgatcgggatactgcccgacacgtacttgggagtcggccat

SEQ ID NO: 426062 - DNA, 140 bp, Artificial Sequence
  Synthetic
atggccgactcccaagtacgtgtcgggcagtatcccgatcattcccataacattgtcaatgggttcaattccccaattctggaaaagcacttttgcatccttttggaaatgtctcaagagggagacccagcatggcgtat

SEQ ID NO: 426063 - DNA, 140 bp, Artificial Sequence
  Synthetic
aggccctggctgctgatatgtaatagacccgttatagatataagtatggcagattacagcattgattccagttatgtatgttcagggcttgttggtgacacacctaggaacgatgatagcgaccttttgggacagcggtg

SEQ ID NO: 426064 - DNA, 140 bp, Artificial Sequence
  Synthetic
caccgctgtcccaaaaggtcgctatcatcgttcctaggtgtgtcaccaacaagccctgaacatacataactggaatcaatgctgtaatctgccatacttatatctataacgggtctattacatatcagcagccagggcct

SEQ ID NO: 426065 - DNA, 140 bp, Artificial Sequence
  Synthetic
atacgccatgctgggtctccggaaaagctcaataatgaggtcagatgcaccaattgacacatgcatttctgagtgcatcactcctaatggaagcatcccaaatgacaagccatttcagaacgtacttgggagtcggccat

SEQ ID NO: 426066 - DNA, 140 bp, Artificial Sequence
  Synthetic
atggccgactcccaagtacgttctgaaatggcttgtcatttgggatgcttccattaggagtgatgcactcagaaatgcatgtgtcaattggtgcatctgacctcattattgagcttttccggagacccagcatggcgtat

SEQ ID NO: 426067 - DNA, 140 bp, Artificial Sequence
  Synthetic
atacgccatgctgggtctcctggagtatggtgactgcaacaccaaatgccaaactccaataggggcgataaattctagtatgccattccacaacatacatcctctcaccatcggggaatgcgtacttgggagtcggccat

SEQ ID NO: 426068 - DNA, 140 bp, Artificial Sequence
  Synthetic
atggccgactcccaagtacgcattccccgatggtgagaggatgtatgttgtggaatggcatactagaatttatcgcccctattggagtttggcatttggtgttgcagtcaccatactccaggagacccagcatggcgtat

SEQ ID NO: 426069 - DNA, 140 bp, Artificial Sequence
  Synthetic
atacgccatgctgggtctccttgaaaactttagagcctatgtagatgggttcgaaccaaacggctgcattgagggcaagctttctcaaatgtcaaaagaagtgagtgcccaaattgaacccgtacttgggagtcggccat

SEQ ID NO: 426070 - DNA, 140 bp, Artificial Sequence
  Synthetic
atggccgactcccaagtacgggttcaatttgggcactcacttcttttgacatttgagaaagcttgccctcaatgcagccgtttggttcgaacccatctacataggctctaaagttttcaaggagacccagcatggcgtat

SEQ ID NO: 426071 - DNA, 140 bp, Artificial Sequence
  Synthetic
atacgccatgctgggtctcctggaacctcaggtacatatggaacaggctcatggcctgatggagcgaatatcaacttcatgcctatataagctttcgcaattttagaaaaaaaactccttcgtacttgggagtcggccat

SEQ ID NO: 426072 - DNA, 140 bp, Artificial Sequence
  Synthetic
atggccgactcccaagtacgaaggagttttttttctaaaattgcgaaagcttatataggcatgaagttgatattcgctccatcaggccatgagcctgttccatatgtacctgaggttccaggagacccagcatggcgtat

SEQ ID NO: 426073 - DNA, 140 bp, Artificial Sequence
  Synthetic
atacgccatgctgggtctccagcgaaagcagggtgaagatgaatccaaatcagaagataatatgcatctcagcaacaggaatgacactatccgtagtaagtctgctaataggattggccacgtacttgggagtcggccat

SEQ ID NO: 426074 - DNA, 140 bp, Artificial Sequence
  Synthetic
atggccgactcccaagtacgtggccaatcctattagcagacttactacggatagtgtcattcctgttgctgagatgcatattatcttctgatttggattcatcttcaccctgctttcgctggagacccagcatggcgtat

SEQ ID NO: 426075 - DNA, 140 bp, Artificial Sequence
  Synthetic
atacgccatgctgggtctccacaactgggaaactgcaacgtagcaggatggatccttggcaacccaaaatgtgacttgctgctcacagcgaattcgtggtcttacataatagagacttcacgtacttgggagtcggccat

SEQ ID NO: 426076 - DNA, 140 bp, Artificial Sequence
  Synthetic
atggccgactcccaagtacgtgaagtctctattatgtaagaccacgaattcgctgtgagcagcaagtcacattttgggttgccaaggatccatcctgctacgttgcagtttcccagttgtggagacccagcatggcgtat

SEQ ID NO: 426077 - DNA, 140 bp, Artificial Sequence
  Synthetic
aggccctggctgctgatatgaattcaaacgaggagatcatttgagctgaaaaaactatgggagcagacccgttcaaaggcaggactgttagtatctgatggaggaccaaacctgtacaatgaccttttgggacagcggtg

SEQ ID NO: 426078 - DNA, 140 bp, Artificial Sequence
  Synthetic
caccgctgtcccaaaaggtcattgtacaggtttggtcctccatcagatactaacagtcctgcctttgaacgggtctgctcccatagttttttcagctcaaatgatctcctcgtttgaattcatatcagcagccagggcct

SEQ ID NO: 426079 - DNA, 140 bp, Artificial Sequence
  Synthetic
atacgccatgctgggtctccaacagtagtggtcctgggaagtagcgggggtaatggagtttgtaatgagacggtagtgaaggaatacaatgagacagtcagagtagaaaaggtgatccaacgtacttgggagtcggccat

SEQ ID NO: 426080 - DNA, 140 bp, Artificial Sequence
  Synthetic
atggccgactcccaagtacgttggatcaccttttctactctgactgtctcattgtattccttcactaccgtctcattacaaactccattacccccgctacttcccaggaccactactgttggagacccagcatggcgtat

SEQ ID NO: 426081 - DNA, 140 bp, Artificial Sequence
  Synthetic
aggccctggctgctgatatgcgtgcccagtgagcgaggactgcagcgtagacgctttgtccaaaatgccctaaatgggaatggagacccaaacaacatggacagggcagtcaaactttacgaccttttgggacagcggtg

SEQ ID NO: 426082 - DNA, 140 bp, Artificial Sequence
  Synthetic
caccgctgtcccaaaaggtcgtaaagtttgactgccctgtccatgttgtttgggtctccattcccatttagggcattttggacaaagcgtctacgctgcagtcctcgctcactgggcacgcatatcagcagccagggcct

SEQ ID NO: 426083 - DNA, 140 bp, Artificial Sequence
  Synthetic
atacgccatgctgggtctcccagctatgaacacagcaaaaacaatgaatggaatgggaaaaggagaagacgtccaaaaactggcagaagaactgcaaagcaacattggagtgctgagatccgtacttgggagtcggccat

SEQ ID NO: 426084 - DNA, 140 bp, Artificial Sequence
  Synthetic
atggccgactcccaagtacggatctcagcactccaatgttgctttgcagttcttctgccagtttttggacgtcttctccttttcccattccattcattgtttttgctgtgttcatagctgggagacccagcatggcgtat

SEQ ID NO: 426085 - DNA, 140 bp, Artificial Sequence
  Synthetic
atacgccatgctgggtctccctggttgggaagaaccataagcaaagattcaagatcagggtatgagatgctaaaagttccgaatgcggaaacagacaatcaatccggtccagttgcacatcgtacttgggagtcggccat

SEQ ID NO: 426086 - DNA, 140 bp, Artificial Sequence
  Synthetic
atggccgactcccaagtacgatgtgcaactggaccggattgattgtctgtttccgcattcggaacttttagcatctcataccctgatcttgaatctttgcttatggttcttcccaaccagggagacccagcatggcgtat

SEQ ID NO: 426087 - DNA, 140 bp, Artificial Sequence
  Synthetic
atacgccatgctgggtctccagcaaaagcaggggtcacaatgtacaaaatagtactagtacttgcgctcctcggagcggtgcatggtcttgacaaaatatgccttggacatcatgcagtccgtacttgggagtcggccat

SEQ ID NO: 426088 - DNA, 140 bp, Artificial Sequence
  Synthetic
atggccgactcccaagtacggactgcatgatgtccaaggcatattttgtcaagaccatgcaccgctccgaggagcgcaagtactagtactattttgtacattgtgacccctgcttttgctggagacccagcatggcgtat

SEQ ID NO: 426089 - DNA, 140 bp, Artificial Sequence
  Synthetic
aggccctggctgctgatatgatctaatttcagtcaaattgggcaaaatcccaacagtagaaaactccattttccacatggcagcatggagcgggtccgcatgccatgatggtaaggaatggaccttttgggacagcggtg

SEQ ID NO: 426090 - DNA, 140 bp, Artificial Sequence
  Synthetic
caccgctgtcccaaaaggtccattccttaccatcatggcatgcggacccgctccatgctgccatgtggaaaatggagttttctactgttgggattttgcccaatttgactgaaattagatcatatcagcagccagggcct

SEQ ID NO: 426091 - DNA, 140 bp, Artificial Sequence
  Synthetic
aggccctggctgctgatatggatccaaaacagcataaccatagagagaatggttctctcggcatttgatgagaggagaaataaatatctggaagagcatcccagtgctgggaaagaccccgaccttttgggacagcggtg

SEQ ID NO: 426092 - DNA, 140 bp, Artificial Sequence
  Synthetic
caccgctgtcccaaaaggtcggggtctttcccagcactgggatgctcttccagatatttatttctcctctcatcaaatgccgagagaaccattctctctatggttatgctgttttggatccatatcagcagccagggcct

SEQ ID NO: 426093 - DNA, 140 bp, Artificial Sequence
  Synthetic
aggccctggctgctgatatgaagaagactggaggcccaatctacaggaggagagatggaaaatggatgagagagttgatcctatatgacaaagaagagatcaggagaatttggcgtcaaggaccttttgggacagcggtg

SEQ ID NO: 426094 - DNA, 140 bp, Artificial Sequence
  Synthetic
caccgctgtcccaaaaggtccttgacgccaaattctcctgatctcttctttgtcatataggatcaactctctcatccattttccatctctcctcctgtagattgggcctccagtcttcttcatatcagcagccagggcct

SEQ ID NO: 426095 - DNA, 140 bp, Artificial Sequence
  Synthetic
atacgccatgctgggtctcccttagaaaggagaatagaaaatttaaataaaaagatggaggacggattcctagatgtctggacttataacgctgagcttttggttctcatggaaaatgagcgtacttgggagtcggccat

SEQ ID NO: 426096 - DNA, 140 bp, Artificial Sequence
  Synthetic
atggccgactcccaagtacgctcattttccatgagaaccaaaagctcagcgttataagtccagacatctaggaatccgtcctccatctttttatttaaattttctattctcctttctaagggagacccagcatggcgtat

SEQ ID NO: 426097 - DNA, 140 bp, Artificial Sequence
  Synthetic
aggccctggctgctgatatggacgatggtacaaccgggtgataacatcactttttcgcataatggtggattgatagcacctagcagggtgagcaaactaaagggaagaggcctcggcattgaccttttgggacagcggtg

SEQ ID NO: 426098 - DNA, 140 bp, Artificial Sequence
  Synthetic
caccgctgtcccaaaaggtcaatgccgaggcctcttccctttagtttgctcaccctgctaggtgctatcaatccaccattatgcgaaaaagtgatgttatcacccggttgtaccatcgtccatatcagcagccagggcct

SEQ ID NO: 426099 - DNA, 140 bp, Artificial Sequence
  Synthetic
atacgccatgctgggtctcccaagaagatctggggctgctggagcagcagtgaaaggggttggaacaatggtgatggaactgatccggatgatcaagcgaggaatcaatgataggaatttcgtacttgggagtcggccat

SEQ ID NO: 426100 - DNA, 140 bp, Artificial Sequence
  Synthetic
atggccgactcccaagtacgaaattcctatcattgattcctcgcttgatcatccggatcagttccatcaccattgttccaacccctttcactgctgctccagcagccccagatcttcttgggagacccagcatggcgtat

SEQ ID NO: 426101 - DNA, 140 bp, Artificial Sequence
  Synthetic
aggccctggctgctgatatgtcttctttgggagggacacagcagaggattatgatgacctcgattattaaatcaacaaaatagacactatgactgtgattgtttcaatacgtttggaatggaccttttgggacagcggtg

SEQ ID NO: 426102 - DNA, 140 bp, Artificial Sequence
  Synthetic
caccgctgtcccaaaaggtccattccaaacgtattgaaacaatcacagtcatagtgtctattttgttgatttaataatcgaggtcatcataatcctctgctgtgtccctcccaaagaagacatatcagcagccagggcct

SEQ ID NO: 426103 - DNA, 140 bp, Artificial Sequence
  Synthetic
atacgccatgctgggtctccactggaatgaggaatgtgccagaggtggtccaaggaagaggcctgtttggagcaatagctggattcatagagaatggatgggagggaatggtagatggctcgtacttgggagtcggccat

SEQ ID NO: 426104 - DNA, 140 bp, Artificial Sequence
  Synthetic
atggccgactcccaagtacgagccatctaccattccctcccatccattctctatgaatccagctattgctccaaacaggcctcttccttggaccacctctggcacattcctcattccagtggagacccagcatggcgtat

SEQ ID NO: 426105 - DNA, 140 bp, Artificial Sequence
  Synthetic
atacgccatgctgggtctccagtcctgcctgcctgcttgtgtgtatgggcttgcagtggccagtggatacgactttgagagagagggatattccctagtcggaattgatcctttccgtctcgtacttgggagtcggccat

SEQ ID NO: 426106 - DNA, 140 bp, Artificial Sequence
  Synthetic
atggccgactcccaagtacgagacggaaaggatcaattccgactagggaatatccctctctctcaaagtcgtatccactggccactgcaagcccatacacacaagcaggcaggcaggactggagacccagcatggcgtat

SEQ ID NO: 426107 - DNA, 140 bp, Artificial Sequence
  Synthetic
atacgccatgctgggtctccactcgaacaaaggtgtaacggcagcatgtcctcatgctggagcaaaaagcttctacaaaaatttaatatggctagttaaaaaaggaaattcatacccaaacgtacttgggagtcggccat

SEQ ID NO: 426108 - DNA, 140 bp, Artificial Sequence
  Synthetic
atggccgactcccaagtacgtttgggtatgaatttccttttttaactagccatattaaatttttgtagaagctttttgctccagcatgaggacatgctgccgttacacctttgttcgagtggagacccagcatggcgtat

SEQ ID NO: 426109 - DNA, 140 bp, Artificial Sequence
  Synthetic
aggccctggctgctgatatgccactcagattacctgatgggcctccttgctctcagcggtcaaaatttctgctgatggatgctctgaaactaagtattgaggacccgagtcatgaagggggaccttttgggacagcggtg

SEQ ID NO: 426110 - DNA, 140 bp, Artificial Sequence
  Synthetic
caccgctgtcccaaaaggtcccccttcatgactcgggtcctcaatacttagtttcagagcatccatcagcagaaattttgaccgctgagagcaaggaggcccatcaggtaatctgagtggcatatcagcagccagggcct

SEQ ID NO: 426111 - DNA, 140 bp, Artificial Sequence
  Synthetic
aggccctggctgctgatatgctcaactgtcgccagttccctggttcttttggtctccctgggggcaatcagcttctggatgtgttccaatgggtctttgcaatgtagaatatgcatctgagaccttttgggacagcggtg

SEQ ID NO: 426112 - DNA, 140 bp, Artificial Sequence
  Synthetic
caccgctgtcccaaaaggtctcagatgcatattctacattgcaaagacccattggaacacatccagaagctgattgcccccagggagaccaaaagaaccagggaactggcgacagttgagcatatcagcagccagggcct

SEQ ID NO: 426113 - DNA, 140 bp, Artificial Sequence
  Synthetic
aggccctggctgctgatatggatttgaatggaatagtaacacagttcgagtctctgaagctctacagagattcgcttggagaagcattaatgaggacaggagacctccattccctccaaagaccttttgggacagcggtg

SEQ ID NO: 426114 - DNA, 140 bp, Artificial Sequence
  Synthetic
caccgctgtcccaaaaggtctttggagggaatggaggtctcctgtcctcattaatgcttctccaagcgaatctctgtagagcttcagagactcgaactgtgttactattccattcaaatccatatcagcagccagggcct

SEQ ID NO: 426115 - DNA, 140 bp, Artificial Sequence
  Synthetic
aggccctggctgctgatatgagctggtttctccaattttgaaggaatgaggagctacatagacaatatagacccaaaaggagcaatagaaagaaatctagcaaggatgtctcccttagtagaccttttgggacagcggtg

SEQ ID NO: 426116 - DNA, 140 bp, Artificial Sequence
  Synthetic
caccgctgtcccaaaaggtctactaagggagacatccttgctagatttctttctattgctccttttgggtctatattgtctatgtagctcctcattccttcaaaattggagaaaccagctcatatcagcagccagggcct

SEQ ID NO: 426117 - DNA, 140 bp, Artificial Sequence
  Synthetic
aggccctggctgctgatatgagttctaccacaaatgtgataacgaatgtatggaaagtgtaaaaaacgggacgtatgactatccgcaatattcagaagaagcaagactaaacagagaggagaccttttgggacagcggtg

SEQ ID NO: 426118 - DNA, 140 bp, Artificial Sequence
  Synthetic
caccgctgtcccaaaaggtctcctctctgtttagtcttgcttcttctgaatattgcggatagtcatacgtcccgttttttacactttccatacattcgttatcacatttgtggtagaactcatatcagcagccagggcct

SEQ ID NO: 426119 - DNA, 140 bp, Artificial Sequence
  Synthetic
atacgccatgctgggtctcccaagtttgctgcaatatgcacccacttagaagtctgtttcatgtattcggattttcatttcatcgacgaacggggtgaatcaataattgtagaatctggtcgtacttgggagtcggccat

SEQ ID NO: 426120 - DNA, 140 bp, Artificial Sequence
  Synthetic
atggccgactcccaagtacgaccagattctacaattattgattcaccccgttcgtcgatgaaatgaaaatccgaatacatgaaacagacttctaagtgggtgcatattgcagcaaacttgggagacccagcatggcgtat

SEQ ID NO: 426121 - DNA, 140 bp, Artificial Sequence
  Synthetic
atacgccatgctgggtctcccgatccaaatgcactcctaaaacaccgatttgaaataattgaagggagagaccgcactatggcctggacagtagtgaacagtatctgcaacactacaggacgtacttgggagtcggccat

SEQ ID NO: 426122 - DNA, 140 bp, Artificial Sequence
  Synthetic
atggccgactcccaagtacgtcctgtagtgttgcagatactgttcactactgtccaggccatagtgcggtctctcccttcaattatttcaaatcggtgttttaggagtgcatttggatcgggagacccagcatggcgtat

SEQ ID NO: 426123 - DNA, 140 bp, Artificial Sequence
  Synthetic
atacgccatgctgggtctccgcgaagagcaacagccatactgaggaaagcaaccagaaggctgatccagttgatagtgagtgggagagatgaacaatctattgcagaagccataattgtacgtacttgggagtcggccat

SEQ ID NO: 426124 - DNA, 140 bp, Artificial Sequence
  Synthetic
atggccgactcccaagtacgtacaattatggcttctgcaatagattgttcatctctcccactcactatcaactggatcagccttctggttgctttcctcagtatggctgttgctcttcgcggagacccagcatggcgtat

SEQ ID NO: 426125 - DNA, 140 bp, Artificial Sequence
  Synthetic
atacgccatgctgggtctccttagatcaagaggacaccataacctttgaagccactgggaatttaatagcaccatggtatgcatttgcattgaaaaaaggctctagttctggaattatgacgtacttgggagtcggccat

SEQ ID NO: 426126 - DNA, 140 bp, Artificial Sequence
  Synthetic
atggccgactcccaagtacgtcataattccagaactagagccttttttcaatgcaaatgcataccatggtgctattaaattcccagtggcttcaaaggttatggtgtcctcttgatctaaggagacccagcatggcgtat

SEQ ID NO: 426127 - DNA, 140 bp, Artificial Sequence
  Synthetic
atacgccatgctgggtctccaacgaggagaagattccaaaaacgaaaaacatgaagaaaacaagccaattgaagtgggcacttggtgaaaatatggcaccagagaaagtggactttgaagcgtacttgggagtcggccat

SEQ ID NO: 426128 - DNA, 140 bp, Artificial Sequence
  Synthetic
atggccgactcccaagtacgcttcaaagtccactttctctggtgccatattttcaccaagtgcccacttcaattggcttgttttcttcatgtttttcgtttttggaatcttctcctcgttggagacccagcatggcgtat

SEQ ID NO: 426129 - DNA, 140 bp, Artificial Sequence
  Synthetic
aggccctggctgctgatatgcttcatagagcgacccaatgctgtggacacttgttatccatttgatgtgccggattaccagagcttacggagtatcctagcaaacaatgggaaatttgaggaccttttgggacagcggtg

SEQ ID NO: 426130 - DNA, 140 bp, Artificial Sequence
  Synthetic
caccgctgtcccaaaaggtcctcaaatttcccattgtttgctaggatactccgtaagctctggtaatccggcacatcaaatggataacaagtgtccacagcattgggtcgctctatgaagcatatcagcagccagggcct

SEQ ID NO: 426131 - DNA, 140 bp, Artificial Sequence
  Synthetic
atacgccatgctgggtctcccagcatttgatgagagaagaaacaaatacctggaagagcatcccagtgctgggaaagaccctaagaagactggaggcccaatatacaggaggagagatggcgtacttgggagtcggccat

SEQ ID NO: 426132 - DNA, 140 bp, Artificial Sequence
  Synthetic
atggccgactcccaagtacgccatctctcctcctgtatattgggcctccagtcttcttagggtctttcccagcactgggatgctcttccaggtatttgtttcttctctcatcaaatgctgggagacccagcatggcgtat

SEQ ID NO: 426133 - DNA, 140 bp, Artificial Sequence
  Synthetic
atacgccatgctgggtctcctttattcaacagtggcgagttccctagtgttggcaatcatagtggctggtctatctttatggatgtgctccaatgggtcgttacaatgcagaatttgcatcgtacttgggagtcggccat

SEQ ID NO: 426134 - DNA, 140 bp, Artificial Sequence
  Synthetic
atggccgactcccaagtacgatgcaaattctgcattgtaacgacccattggagcacatccataaagatagaccagccactatgattgccaacactagggaactcgccactgttgaataaaggagacccagcatggcgtat

SEQ ID NO: 426135 - DNA, 140 bp, Artificial Sequence
  Synthetic
atacgccatgctgggtctccatttccttttccatatcatgcttcttactcgttgcactacttttagcctttgttttgtgggcttgtcagaatggaaacatccggtgccagatttgcatttcgtacttgggagtcggccat

SEQ ID NO: 426136 - DNA, 140 bp, Artificial Sequence
  Synthetic
atggccgactcccaagtacgaaatgcaaatctggcaccggatgtttccattctgacaagcccacaaaacaaaggctaaaagtagtgcaacgagtaagaagcatgatatggaaaaggaaatggagacccagcatggcgtat

SEQ ID NO: 426137 - DNA, 140 bp, Artificial Sequence
  Synthetic
aggccctggctgctgatatgaccggtgcacttgccagttgtatgggtctcatatacaacaggatgggaacagtgaccacagaagtggcttttggcctagtgtgtgccacctgtgagcagagaccttttgggacagcggtg

SEQ ID NO: 426138 - DNA, 140 bp, Artificial Sequence
  Synthetic
caccgctgtcccaaaaggtctctgctcacaggtggcacacactaggccaaaagccacttctgtggtcactgttcccatcctgttgtatatgagacccatacaactggcaagtgcaccggtcatatcagcagccagggcct

SEQ ID NO: 426139 - DNA, 140 bp, Artificial Sequence
  Synthetic
atacgccatgctgggtctcccccatcgtagatataaatgtaaaagattacagcattgtttccagttatatatgctcgggacttgttggagacacacccagaaaaaacgatagcttcagcacgtacttgggagtcggccat

SEQ ID NO: 426140 - DNA, 140 bp, Artificial Sequence
  Synthetic
atggccgactcccaagtacgtgctgaagctatcgttttttctgggtgtgtctccaacaagtcccgagcatatataactggaaacaatgctgtaatcttttacatttatatctacgatgggggagacccagcatggcgtat

SEQ ID NO: 426141 - DNA, 140 bp, Artificial Sequence
  Synthetic
atacgccatgctgggtctcctaagaacattatactgaaagcgaatttcagtgtgatctttgatcgactagagacactaatactactcagagctttcactgaagagggagcaattgtcggccgtacttgggagtcggccat

SEQ ID NO: 426142 - DNA, 140 bp, Artificial Sequence
  Synthetic
atggccgactcccaagtacggccgacaattgctccctcttcagtgaaagctctgagtagtattagtgtctctagtcgatcaaagatcacactgaaattcgctttcagtataatgttcttaggagacccagcatggcgtat

SEQ ID NO: 426143 - DNA, 140 bp, Artificial Sequence
  Synthetic
atacgccatgctgggtctccttcgagtctctgaaactctacagagattcgcttggagaagctgtaatgaggatgggagacctccactccttccaaagcagaaacggaaaatggcgagaaccgtacttgggagtcggccat

SEQ ID NO: 426144 - DNA, 140 bp, Artificial Sequence
  Synthetic
atggccgactcccaagtacggttctcgccattttccgtttctgctttggaaggagtggaggtctcccatcctcattacagcttctccaagcgaatctctgtagagtttcagagactcgaaggagacccagcatggcgtat

SEQ ID NO: 426145 - DNA, 140 bp, Artificial Sequence
  Synthetic
aggccctggctgctgatatgctgccttctccaatcccttcagcagattgagagcatgattgaggccgagtcttccgtcaaagagaaagatatgacaaaggaattctttgagaacaaatcagaccttttgggacagcggtg

SEQ ID NO: 426146 - DNA, 140 bp, Artificial Sequence
  Synthetic
caccgctgtcccaaaaggtctgatttgttctcaaagaattcctttgtcatatctttctctttgacggaagactcggcctcaatcatgctctcaatctgctgaagggattggagaaggcagcatatcagcagccagggcct

SEQ ID NO: 426147 - DNA, 140 bp, Artificial Sequence
  Synthetic
atacgccatgctgggtctccccatgcagacctcagtgccaaagaggcacaggatgtaatcatggaagttgtctttccaaatgaagtgggagcgagaatactgacgtcggagtcacaattgcgtacttgggagtcggccat

SEQ ID NO: 426148 - DNA, 140 bp, Artificial Sequence
  Synthetic
atggccgactcccaagtacgcaattgtgactccgacgtcagtattctcgctcccacttcatttggaaagacaacttccatgattacatcctgtgcctctttggcactgaggtctgcatggggagacccagcatggcgtat

SEQ ID NO: 426149 - DNA, 140 bp, Artificial Sequence
  Synthetic
atacgccatgctgggtctcccgctgcagacaaagaatccacccaaaaggcaatagatggagttaccaataaggtcaactcaatcattgacaaaatgaacactcaatttgaggccgttggacgtacttgggagtcggccat

SEQ ID NO: 426150 - DNA, 140 bp, Artificial Sequence
  Synthetic
atggccgactcccaagtacgtccaacggcctcaaattgagtgttcattttgtcaatgattgagttgaccttattggtaactccatctattgccttttgggtggattctttgtctgcagcgggagacccagcatggcgtat

SEQ ID NO: 426151 - DNA, 140 bp, Artificial Sequence
  Synthetic
aggccctggctgctgatatgcaatgatcaaggatctgggtatgcagcagacaaagagtccactcaaaaggcaattgatggaatcaccaataaggtcaattctgtaattgagaaaatgaacgaccttttgggacagcggtg

SEQ ID NO: 426152 - DNA, 140 bp, Artificial Sequence
  Synthetic
caccgctgtcccaaaaggtcgttcattttctcaattacagaattgaccttattggtgattccatcaattgccttttgagtggactctttgtctgctgcatacccagatccttgatcattgcatatcagcagccagggcct

SEQ ID NO: 426153 - DNA, 140 bp, Artificial Sequence
  Synthetic
aggccctggctgctgatatgagatcactagcatgttggatccagaatgaattcaacaaggcatgtgaattgactgattcaagctgggtagaacttgatgaaataggggaagatgttgcccgaccttttgggacagcggtg

SEQ ID NO: 426154 - DNA, 140 bp, Artificial Sequence
  Synthetic
caccgctgtcccaaaaggtcgggcaacatcttcccctatttcatcaagttctacccagcttgaatcagtcaattcacatgccttgttgaattcattctggatccaacatgctagtgatctcatatcagcagccagggcct

SEQ ID NO: 426155 - DNA, 140 bp, Artificial Sequence
  Synthetic
aggccctggctgctgatatgggctaaccaaatccgatgggaatgcgtacccacttcaaaatctgacaaaggtcaacaacggggattatgcaaggctttacatatggggggtccatcatccgaccttttgggacagcggtg

SEQ ID NO: 426156 - DNA, 140 bp, Artificial Sequence
  Synthetic
caccgctgtcccaaaaggtcggatgatggaccccccatatgtaaagccttgcataatccccgttgttgacctttgtcagattttgaagtgggtacgcattcccatcggatttggttagcccatatcagcagccagggcct

SEQ ID NO: 426157 - DNA, 140 bp, Artificial Sequence
  Synthetic
aggccctggctgctgatatgtctaataagagcattgacactgaacacaatgacaaaagacgccgaaagaggcaaattaaagagaagagcaattgcaacacccggaatgcaaatcagaggggaccttttgggacagcggtg

SEQ ID NO: 426158 - DNA, 140 bp, Artificial Sequence
  Synthetic
caccgctgtcccaaaaggtcccctctgatttgcattccgggtgttgcaattgctcttctctttaatttgcctctttcggcgtcttttgtcattgtgttcagtgtcaatgctcttattagacatatcagcagccagggcct

SEQ ID NO: 426159 - DNA, 140 bp, Artificial Sequence
  Synthetic
aggccctggctgctgatatgccactaatcaggcatgaaaacaggatggtgctagccagcactacggctaaggctatggagcagatggctgggtcgagtgagcaggcagcggaagccatgggaccttttgggacagcggtg

SEQ ID NO: 426160 - DNA, 140 bp, Artificial Sequence
  Synthetic
caccgctgtcccaaaaggtcccatggcttccgctgcctgctcactcgacccagccatctgctccatagccttagccgtagtgctggctagcaccatcctgttttcatgcctgattagtggcatatcagcagccagggcct

SEQ ID NO: 426161 - DNA, 140 bp, Artificial Sequence
  Synthetic
atacgccatgctgggtctccccagcaaatgcgggatgtgcttggaacatttgacactgttcagataataaaactcctcccctttgctgctgccccaccggaacaaagtaggatgcagttccgtacttgggagtcggccat

SEQ ID NO: 426162 - DNA, 140 bp, Artificial Sequence
  Synthetic
atggccgactcccaagtacggaactgcatcctactttgttccggtggggcagcagcaaaggggaggagttttattatctgaacagtgtcaaatgttccaagcacatcccgcatttgctggggagacccagcatggcgtat

SEQ ID NO: 426163 - DNA, 140 bp, Artificial Sequence
  Synthetic
aggccctggctgctgatatggttggaacaatggtgatggagctgattcggatgatcaaacgaggaatcaatgatcggaacttctggagaggcgaaaatggaaggaggacaagaattgcatgaccttttgggacagcggtg

SEQ ID NO: 426164 - DNA, 140 bp, Artificial Sequence
  Synthetic
caccgctgtcccaaaaggtcatgcaattcttgtcctccttccattttcgcctctccagaagttccgatcattgattcctcgtttgatcatccgaatcagctccatcaccattgttccaaccatatcagcagccagggcct

SEQ ID NO: 426165 - DNA, 140 bp, Artificial Sequence
  Synthetic
aggccctggctgctgatatgtgatggatgctctgaaattaagcattgaggacccgagccatgaaggggaggggataccgctatatgatgcgatcaaatgcatgaaaacgttcttcgggtggaccttttgggacagcggtg

SEQ ID NO: 426166 - DNA, 140 bp, Artificial Sequence
  Synthetic
caccgctgtcccaaaaggtccacccgaagaacgttttcatgcatttgatcgcatcatatagcggtatcccctccccttcatggctcgggtcctcaatgcttaatttcagagcatccatcacatatcagcagccagggcct

SEQ ID NO: 426167 - DNA, 140 bp, Artificial Sequence
  Synthetic
atacgccatgctgggtctccgtccaaaatgcccttaatgggaatggggatccaaacaacatggacagagcagtcaaactgtacaggaagcttaaaagggagataacattccatggggcaacgtacttgggagtcggccat

SEQ ID NO: 426168 - DNA, 140 bp, Artificial Sequence
  Synthetic
atggccgactcccaagtacgttgccccatggaatgttatctcccttttaagcttcctgtacagtttgactgctctgtccatgttgtttggatccccattcccattaagggcattttggacggagacccagcatggcgtat

SEQ ID NO: 426169 - DNA, 140 bp, Artificial Sequence
  Synthetic
aggccctggctgctgatatgggtgtgcgccacgtgtgagcagattgctgattcccagcatcggtctcacagacaaatggtgacaacaaccaacccactaatcagacacgaaaacagaatggaccttttgggacagcggtg

SEQ ID NO: 426170 - DNA, 140 bp, Artificial Sequence
  Synthetic
caccgctgtcccaaaaggtccattctgttttcgtgtctgattagtgggttggttgttgtcaccatttgtctgtgagaccgatgctgggaatcagcaatctgctcacacgtggcgcacacccatatcagcagccagggcct

SEQ ID NO: 426171 - DNA, 140 bp, Artificial Sequence
  Synthetic
aggccctggctgctgatatgagtagaccatgggtgagaggccaaagtggcaggattagcttctattggacaattgtggagcctggagacctcatagtcttcaacaccatagggaatttaagaccttttgggacagcggtg

SEQ ID NO: 426172 - DNA, 140 bp, Artificial Sequence
  Synthetic
caccgctgtcccaaaaggtcttaaattccctatggtgttgaagactatgaggtctccaggctccacaattgtccaatagaagctaatcctgccactttggcctctcacccatggtctactcatatcagcagccagggcct

SEQ ID NO: 426173 - DNA, 140 bp, Artificial Sequence
  Synthetic
aggccctggctgctgatatgggctcagtgtcattaggattggtagtccttaatattctcctacatatagttagcattacagtaacagtgttagttcttcctggaaatggaaataacgggagaccttttgggacagcggtg

SEQ ID NO: 426174 - DNA, 140 bp, Artificial Sequence
  Synthetic
caccgctgtcccaaaaggtctcccgttatttccatttccaggaagaactaacactgttactgtaatgctaactatatgtaggagaatattaaggactaccaatcctaatgacactgagcccatatcagcagccagggcct

SEQ ID NO: 426175 - DNA, 140 bp, Artificial Sequence
  Synthetic
atacgccatgctgggtctcctagtattacaataacggtgttagttctccctggaaatggaaataatgggagctgcaatgaaacagtcattagggaatacaatgaaacagtacggattgagcgtacttgggagtcggccat

SEQ ID NO: 426176 - DNA, 140 bp, Artificial Sequence
  Synthetic
atggccgactcccaagtacgctcaatccgtactgtttcattgtattccctaatgactgtttcattgcagctcccattatttccatttccagggagaactaacaccgttattgtaatactaggagacccagcatggcgtat

SEQ ID NO: 426177 - DNA, 140 bp, Artificial Sequence
  Synthetic
atacgccatgctgggtctccagagagtgatcagttcatgaataatacagaagcattgtgtgatgtcaggggttttgcacccttttccaaagacaacggaataaggattggatcgagaggtcgtacttgggagtcggccat

SEQ ID NO: 426178 - DNA, 140 bp, Artificial Sequence
  Synthetic
atggccgactcccaagtacgacctctcgatccaatccttattccgttgtctttggaaaagggtgcaaaacccctgacatcacacaatgcttctgtattattcatgaactgatcactctctggagacccagcatggcgtat

SEQ ID NO: 426179 - DNA, 140 bp, Artificial Sequence
  Synthetic
aggccctggctgctgatatggagtgcatcactcctaatggaagcatcccaaatgacaagccatttcagaatgtaaataagatcacctacgggacatgtcccaagtacgtcaaacaaagcagaccttttgggacagcggtg

SEQ ID NO: 426180 - DNA, 140 bp, Artificial Sequence
  Synthetic
caccgctgtcccaaaaggtctgctttgtttgacgtacttgggacatgtcccgtaggtgatcttatttacattctgaaatggcttgtcatttgggatgcttccattaggagtgatgcactccatatcagcagccagggcct

SEQ ID NO: 426181 - DNA, 140 bp, Artificial Sequence
  Synthetic
aggccctggctgctgatatggtcagccactgcatgccatgatgggaagaaatggatgacaattggagtaacgggccctgatgccaaagcagtagcagtggtgcattatgggggaattcctgaccttttgggacagcggtg

SEQ ID NO: 426182 - DNA, 140 bp, Artificial Sequence
  Synthetic
caccgctgtcccaaaaggtcaggaattcccccataatgcaccactgctactgctttggcatcagggcccgttactccaattgtcatccatttcttcccatcatggcatgcagtggctgaccatatcagcagccagggcct

SEQ ID NO: 426183 - DNA, 140 bp, Artificial Sequence
  Synthetic
aggccctggctgctgatatgctagtcaacacttatcaatggataatcaggaactgggaaattgtgaaaattcaatggtcacaagatcccacaatgttatacaacaaaatggaatttgaacgaccttttgggacagcggtg

SEQ ID NO: 426184 - DNA, 140 bp, Artificial Sequence
  Synthetic
caccgctgtcccaaaaggtcgttcaaattccattttgttgtataacattgtgggatcttgtgaccattgaattttcacaatttcccagttcctgattatccattgataagtgttgactagcatatcagcagccagggcct

SEQ ID NO: 426185 - DNA, 140 bp, Artificial Sequence
  Synthetic
atacgccatgctgggtctccagatggttaattgaagaagtgcgacacagattaaaaataacagaaaatagctttgaacagataacatttatgcaagcattacaactactgcttgaagtagcgtacttgggagtcggccat

SEQ ID NO: 426186 - DNA, 140 bp, Artificial Sequence
  Synthetic
atggccgactcccaagtacgctacttcaagcagtagttgtaatgcttgcataaatgttatctgttcaaagctattttctgttatttttaatctgtgtcgcacttcttcaattaaccatctggagacccagcatggcgtat

SEQ ID NO: 426187 - DNA, 140 bp, Artificial Sequence
  Synthetic
atacgccatgctgggtctccaaacagtacattacctttccacaatatcagtaaatatgcatttggggattgccccaaatacattggagtcaagagtctcaaactggcaatcggtctgagacgtacttgggagtcggccat

SEQ ID NO: 426188 - DNA, 140 bp, Artificial Sequence
  Synthetic
atggccgactcccaagtacgtctcagaccgattgccagtttgagactcttgactccaatgtatttggggcaatccccaaatgcatatttactgatattgtggaaaggtaatgtactgtttggagacccagcatggcgtat

SEQ ID NO: 426189 - DNA, 140 bp, Artificial Sequence
  Synthetic
atacgccatgctgggtctccatagttgggcaaactgaaatcagtttcaatggaggtcatatagaagaatgctcatgctaccccaatgaaggtaaagtggaatgtgtttgtagggacaactcgtacttgggagtcggccat

SEQ ID NO: 426190 - DNA, 140 bp, Artificial Sequence
  Synthetic
atggccgactcccaagtacgagttgtccctacaaacacattccactttaccttcattggggtagcatgagcattcttctatatgacctccattgaaactgatttcagtttgcccaactatggagacccagcatggcgtat

SEQ ID NO: 426191 - DNA, 140 bp, Artificial Sequence
  Synthetic
aggccctggctgctgatatgctcatgctaccccaatgaaggtaaagtggaatgtgtttgtagggacaactggactggaaccaacagaccagtattggtgatttctccagatttgtcttacgaccttttgggacagcggtg

SEQ ID NO: 426192 - DNA, 140 bp, Artificial Sequence
  Synthetic
caccgctgtcccaaaaggtcgtaagacaaatctggagaaatcaccaatactggtctgttggttccagtccagttgtccctacaaacacattccactttaccttcattggggtagcatgagcatatcagcagccagggcct

SEQ ID NO: 426193 - DNA, 140 bp, Artificial Sequence
  Synthetic
atacgccatgctgggtctcctgaagacatttttcgggtggaaagagcccagcatcgtgaaaccacatgagaagggtataaaccccaattacctcctgacttggaagcaagtgctggcagacgtacttgggagtcggccat

SEQ ID NO: 426194 - DNA, 140 bp, Artificial Sequence
  Synthetic
atggccgactcccaagtacgtctgccagcacttgcttccaagtcaggaggtaattggggtttatacccttctcatgtggtttcacgatgctgggctctttccacccgaaaaatgtcttcaggagacccagcatggcgtat

SEQ ID NO: 426195 - DNA, 140 bp, Artificial Sequence
  Synthetic
atacgccatgctgggtctccgggaaggatcctaagaaaactggaggacccatatatagaagagtagacggaaagtggatgagagaactcattctttatgacaaagaagaaataaggagagcgtacttgggagtcggccat

SEQ ID NO: 426196 - DNA, 140 bp, Artificial Sequence
  Synthetic
atggccgactcccaagtacgctctccttatttcttctttgtcataaagaatgagttctctcatccactttccgtctactcttctatatatgggtcctccagttttcttaggatccttcccggagacccagcatggcgtat

SEQ ID NO: 426197 - DNA, 140 bp, Artificial Sequence
  Synthetic
atacgccatgctgggtctccagcaaaagcagggtagataatcactcactgagtgacatccacatcatggcgtctcaaggcaccaaacgatcttatgaacagatggaaactggtggggaaccgtacttgggagtcggccat

SEQ ID NO: 426198 - DNA, 140 bp, Artificial Sequence
  Synthetic
atggccgactcccaagtacggttccccaccagtttccatctgttcataagatcgtttggtgccttgagacgccatgatgtggatgtcactcagtgagtgattatctaccctgcttttgctggagacccagcatggcgtat

SEQ ID NO: 426199 - DNA, 140 bp, Artificial Sequence
  Synthetic
aggccctggctgctgatatggggaaagaccctaagaagactggaggtccaatatacaggaggagagatgggaaatggacgagagaattgatcctgtatgacaaagaagagatcagaaggagaccttttgggacagcggtg

SEQ ID NO: 426200 - DNA, 140 bp, Artificial Sequence
  Synthetic
caccgctgtcccaaaaggtctccttctgatctcttctttgtcatacaggatcaattctctcgtccatttcccatctctcctcctgtatattggacctccagtcttcttagggtctttccccatatcagcagccagggcct

SEQ ID NO: 426201 - DNA, 140 bp, Artificial Sequence
  Synthetic
atacgccatgctgggtctcctttaccgaacatgcaaattattgggaataaatatgagcaaaaagaaaagttactgtaacgaaactggaatgtttgaatttacaagcatgttctatagagacgtacttgggagtcggccat

SEQ ID NO: 426202 - DNA, 140 bp, Artificial Sequence
  Synthetic
atggccgactcccaagtacgtctctatagaacatgcttgtaaattcaaacattccagtttcgttacagtaacttttctttttgctcatatttattcccaataatttgcatgttcggtaaaggagacccagcatggcgtat

SEQ ID NO: 426203 - DNA, 140 bp, Artificial Sequence
  Synthetic
atacgccatgctgggtctccgttggaacaatggtgatggaattgatccggatgatcaaaagagggatcaatgataggaatttctggagaggcgaaaatggacggagaacgagaatcgcttcgtacttgggagtcggccat

SEQ ID NO: 426204 - DNA, 140 bp, Artificial Sequence
  Synthetic
atggccgactcccaagtacgaagcgattctcgttctccgtccattttcgcctctccagaaattcctatcattgatccctcttttgatcatccggatcaattccatcaccattgttccaacggagacccagcatggcgtat

SEQ ID NO: 426205 - DNA, 140 bp, Artificial Sequence
  Synthetic
atacgccatgctgggtctccgttggaacgatggtaatggaattgattcggatgatcaagcgggggatcaatgaccggaacttctggagaggtgaaaatggacggaggacaagaattgcttcgtacttgggagtcggccat

SEQ ID NO: 426206 - DNA, 140 bp, Artificial Sequence
  Synthetic
atggccgactcccaagtacgaagcaattcttgtcctccgtccattttcacctctccagaagttccggtcattgatcccccgcttgatcatccgaatcaattccattaccatcgttccaacggagacccagcatggcgtat

SEQ ID NO: 426207 - DNA, 140 bp, Artificial Sequence
  Synthetic
aggccctggctgctgatatgacgggtttaggcaccagaatgctgaaggaacaggaacagctgctgatctcaagtctacccaggcagctatcgatcaaattaatgggaaattgaatcgtctgaccttttgggacagcggtg

SEQ ID NO: 426208 - DNA, 140 bp, Artificial Sequence
  Synthetic
caccgctgtcccaaaaggtcagacgattcaatttcccattaatttgatcgatagctgcctgggtagacttgagatcagcagctgttcctgttccttcagcattctggtgcctaaacccgtcatatcagcagccagggcct

SEQ ID NO: 426209 - DNA, 140 bp, Artificial Sequence
  Synthetic
aggccctggctgctgatatggccagtggatacgactttgaaagagagggatactccctggtcggaattgaccccttccgtttgctccagaacagtcaagtcttcagtctcatcagaccaagaccttttgggacagcggtg

SEQ ID NO: 426210 - DNA, 140 bp, Artificial Sequence
  Synthetic
caccgctgtcccaaaaggtcttggtctgatgagactgaagacttgactgttctggagcaaacggaaggggtcaattccgaccagggagtatccctctctttcaaagtcgtatccactggccatatcagcagccagggcct

SEQ ID NO: 426211 - DNA, 140 bp, Artificial Sequence
  Synthetic
atacgccatgctgggtctccgccagcggatatgactttgagagggaggggtactctctagtcggaattgatcctttccgtctgctccaaaacagtcaggtcttcagccttataagaccaacgtacttgggagtcggccat

SEQ ID NO: 426212 - DNA, 140 bp, Artificial Sequence
  Synthetic
atggccgactcccaagtacgttggtcttataaggctgaagacctgactgttttggagcagacggaaaggatcaattccgactagagagtacccctccctctcaaagtcatatccgctggcggagacccagcatggcgtat

SEQ ID NO: 426213 - DNA, 140 bp, Artificial Sequence
  Synthetic
atacgccatgctgggtctccacattgaaaataagagtacatgaaggatatgaggaattcacaatggttgggcgaagagcaacagccattctaaggaaagcaaccagaagactgatccaaccgtacttgggagtcggccat

SEQ ID NO: 426214 - DNA, 140 bp, Artificial Sequence
  Synthetic
atggccgactcccaagtacggttggatcagtcttctggttgctttccttagaatggctgttgctcttcgcccaaccattgtgaattcctcatatccttcatgtactcttattttcaatgtggagacccagcatggcgtat

SEQ ID NO: 426215 - DNA, 140 bp, Artificial Sequence
  Synthetic
aggccctggctgctgatatgggacaattttaaaaccgaatgatgcaatccacttcgagagtaatggaaatttcattgctccagaatatgcatacaaaattgtcaagaaaggggactcaacgaccttttgggacagcggtg

SEQ ID NO: 426216 - DNA, 140 bp, Artificial Sequence
  Synthetic
caccgctgtcccaaaaggtcgttgagtcccctttcttgacaattttgtatgcatattctggagcaatgaaatttccattactctcgaagtggattgcatcattcggttttaaaattgtcccatatcagcagccagggcct

SEQ ID NO: 426217 - DNA, 140 bp, Artificial Sequence
  Synthetic
aggccctggctgctgatatggacccccagcacagagatgtcattgagaggagtgagagttagtaaaatgggagtagatgaatattccagtactgagagagtggtcgtgagtattgatcgtgaccttttgggacagcggtg

SEQ ID NO: 426218 - DNA, 140 bp, Artificial Sequence
  Synthetic
caccgctgtcccaaaaggtcacgatcaatactcacgaccactctctcagtactggaatattcatctactcccattttactaactctcactcctctcaatgacatctctgtgctgggggtccatatcagcagccagggcct

SEQ ID NO: 426219 - DNA, 140 bp, Artificial Sequence
  Synthetic
atacgccatgctgggtctcccgacctaagaggatgcaccatagagggttggatcctggggaatcctcaatgcgacctattgcttggtgatcaaagctggtcatatatagtggaaaggcctcgtacttgggagtcggccat

SEQ ID NO: 426220 - DNA, 140 bp, Artificial Sequence
  Synthetic
atggccgactcccaagtacgaggcctttccactatatatgaccagctttgatcaccaagcaataggtcgcattgaggattccccaggatccaaccctctatggtgcatcctcttaggtcgggagacccagcatggcgtat

SEQ ID NO: 426221 - DNA, 140 bp, Artificial Sequence
  Synthetic
aggccctggctgctgatatggcgacctattgcttggtgatcaaagctggtcatatatagtggaaaggcctactgctcaaaatgggatttgctacccaggagctttgagcgaagtagaagagaccttttgggacagcggtg

SEQ ID NO: 426222 - DNA, 140 bp, Artificial Sequence
  Synthetic
caccgctgtcccaaaaggtctcttctacttcgctcaaagctcctgggtagcaaatcccattttgagcagtaggcctttccactatatatgaccagctttgatcaccaagcaataggtcgccatatcagcagccagggcct

SEQ ID NO: 426223 - DNA, 140 bp, Artificial Sequence
  Synthetic
atacgccatgctgggtctccttcccaaaagtacatggacaggagtagacaccagcagtggggtaacaaaggcttgcccttataatagtggttcatctttctatagaaacctcttatggatcgtacttgggagtcggccat

SEQ ID NO: 426224 - DNA, 140 bp, Artificial Sequence
  Synthetic
atggccgactcccaagtacgatccataagaggtttctatagaaagatgaaccactattataagggcaagcctttgttaccccactgctggtgtctactcctgtccatgtacttttgggaaggagacccagcatggcgtat

SEQ ID NO: 426225 - DNA, 140 bp, Artificial Sequence
  Synthetic
aggccctggctgctgatatggcttgcccttataatagtggttcatctttctatagaaacctcttatggataataaagaccaagtcagcagcatatccagtaattaaaggaacttacaacagaccttttgggacagcggtg

SEQ ID NO: 426226 - DNA, 140 bp, Artificial Sequence
  Synthetic
caccgctgtcccaaaaggtctgttgtaagttcctttaattactggatatgctgctgacttggtctttattatccataagaggtttctatagaaagatgaaccactattataagggcaagccatatcagcagccagggcct

SEQ ID NO: 426227 - DNA, 140 bp, Artificial Sequence
  Synthetic
atacgccatgctgggtctccacactggaaaccagccaatcctttatttctggggtgtgcaccatccacctgacaccaatgagcaaaataccctatatggctctggtgataggtacgttagcgtacttgggagtcggccat

SEQ ID NO: 426228 - DNA, 140 bp, Artificial Sequence
  Synthetic
atggccgactcccaagtacgctaacgtacctatcaccagagccatatagggtattttgctcattggtgtcaggtggatggtgcacaccccagaaataaaggattggctggtttccagtgtggagacccagcatggcgtat

SEQ ID NO: 426229 - DNA, 140 bp, Artificial Sequence
  Synthetic
atacgccatgctgggtctccgacctgctgtgaacggtcaaagaggcagaattgattattactggtctgttttaaaaccaggggaaaccttgaatgtcgaatctaatggaaatctaattgccgtacttgggagtcggccat

SEQ ID NO: 426230 - DNA, 140 bp, Artificial Sequence
  Synthetic
atggccgactcccaagtacggcaattagatttccattagattcgacattcaaggtttcccctggttttaaaacagaccagtaataatcaattctgcctctttgaccgttcacagcaggtcggagacccagcatggcgtat

SEQ ID NO: 426231 - DNA, 140 bp, Artificial Sequence
  Synthetic
atacgccatgctgggtctcccagggcaagaatcaagaccaggctgtttactataaggcaggaaatggccagtagagggctatgggatacctttcgtcaatccgagagaggcgaagaaacacgtacttgggagtcggccat

SEQ ID NO: 426232 - DNA, 140 bp, Artificial Sequence
  Synthetic
atggccgactcccaagtacgtgtttcttcgcctctctcggattgacgaaaggtatcccatagccctctactggccatttcctgccttatagtaaacagcctggtcttgattcttgccctgggagacccagcatggcgtat

SEQ ID NO: 426233 - DNA, 140 bp, Artificial Sequence
  Synthetic
atacgccatgctgggtctcccccttggtatgcatacaaatttgtcagcacaaataataaaggagccgtcttcaagtcaaatttaccaatcgaaaactgtgatgccacatgtcagactatccgtacttgggagtcggccat

SEQ ID NO: 426234 - DNA, 140 bp, Artificial Sequence
  Synthetic
atggccgactcccaagtacggatagtctgacatgtggcatcacagttttcgattggtaaatttgacttgaagacggctcctttattatttgtgctgacaaatttgtatgcataccaagggggagacccagcatggcgtat

SEQ ID NO: 426235 - DNA, 140 bp, Artificial Sequence
  Synthetic
atacgccatgctgggtctccgataggagaatgccccaaatacgtgaaaagtgaaagtttgaggcttgcaactggactgagaaatgttccacagattgagactagaggactctttggagctcgtacttgggagtcggccat

SEQ ID NO: 426236 - DNA, 140 bp, Artificial Sequence
  Synthetic
atggccgactcccaagtacgagctccaaagagtcctctagtctcaatctgtggaacatttctcagtccagttgcaagcctcaaactttcacttttcacgtatttggggcattctcctatcggagacccagcatggcgtat

SEQ ID NO: 426237 - DNA, 140 bp, Artificial Sequence
  Synthetic
aggccctggctgctgatatgctggactgagaaatgttccacagattgagactagaggactctttggagctatcgcgggatttattgaaggaggatggactgggatgatagatgggtggtagaccttttgggacagcggtg

SEQ ID NO: 426238 - DNA, 140 bp, Artificial Sequence
  Synthetic
caccgctgtcccaaaaggtctaccacccatctatcatcccagtccatcctccttcaataaatcccgcgatagctccaaagagtcctctagtctcaatctgtggaacatttctcagtccagcatatcagcagccagggcct

SEQ ID NO: 426239 - DNA, 140 bp, Artificial Sequence
  Synthetic
atacgccatgctgggtctccaaagcactcaaaaggctatagacggaattacaaataaagtcaattccatcattgacaaaatgaacacacaatttgaggctgttgaccacgaattttcaaacgtacttgggagtcggccat

SEQ ID NO: 426240 - DNA, 140 bp, Artificial Sequence
  Synthetic
atggccgactcccaagtacgtttgaaaattcgtggtcaacagcctcaaattgtgtgttcattttgtcaatgatggaattgactttatttgtaattccgtctatagccttttgagtgctttggagacccagcatggcgtat

SEQ ID NO: 426241 - DNA, 140 bp, Artificial Sequence
  Synthetic
atacgccatgctgggtctcctggatgtttggacatacaatgctgaattgctggttcttcttgaaaacgaaaggacactagacctgcatgatgcgaatgtgaaaaacctatatgaaaaagtcgtacttgggagtcggccat

SEQ ID NO: 426242 - DNA, 140 bp, Artificial Sequence
  Synthetic
atggccgactcccaagtacgactttttcatataggtttttcacattcgcatcatgcaggtctagtgtcctttcgttttcaagaagaaccagcaattcagcattgtatgtccaaacatccaggagacccagcatggcgtat

SEQ ID NO: 426243 - DNA, 140 bp, Artificial Sequence
  Synthetic
aggccctggctgctgatatgtgattcaaaatggaagactttgtgcgacagtgcttcaatccaatgattgtcgagcttgcggaaaaggcaatgaaagagtatggagaagatccgaaaataggaccttttgggacagcggtg

SEQ ID NO: 426244 - DNA, 140 bp, Artificial Sequence
  Synthetic
caccgctgtcccaaaaggtcctattttcggatcttctccatactctttcattgccttttccgcaagctcgacaatcattggattgaagcactgtcgcacaaagtcttccattttgaatcacatatcagcagccagggcct

SEQ ID NO: 426245 - DNA, 140 bp, Artificial Sequence
  Synthetic
aggccctggctgctgatatgtgatccaagatggaagattttgtgcggcaatgcttcaatccaatgatcgtcgagcttgcagaaaaggcaatgaaagaatatggagaaaatccaaaaatcggaccttttgggacagcggtg

SEQ ID NO: 426246 - DNA, 140 bp, Artificial Sequence
  Synthetic
caccgctgtcccaaaaggtccgatttttggattttctccatattctttcattgccttttctgcaagctcgacgatcattggattgaagcattgccgcacaaaatcttccatcttggatcacatatcagcagccagggcct

SEQ ID NO: 426247 - DNA, 140 bp, Artificial Sequence
  Synthetic
atacgccatgctgggtctccgctaacattattgggatattgcacttgatattgtggattcttgatcgtcttttcttcaaatgcatttatcgtcgctttaaatacggtttgaaaagagggccgtacttgggagtcggccat

SEQ ID NO: 426248 - DNA, 140 bp, Artificial Sequence
  Synthetic
atggccgactcccaagtacggccctcttttcaaaccgtatttaaagcgacgataaatgcatttgaagaaaagacgatcaagaatccacaatatcaagtgcaatatcccaataatgttagcggagacccagcatggcgtat

SEQ ID NO: 426249 - DNA, 140 bp, Artificial Sequence
  Synthetic
atacgccatgctgggtctccatggattccaacacgataacctcgtttcaggtagattgctatctatggcacataagaaagctgctcagcatgagagacatgtgtgatgctccctttgatgcgtacttgggagtcggccat

SEQ ID NO: 426250 - DNA, 140 bp, Artificial Sequence
  Synthetic
atggccgactcccaagtacgcatcaaagggagcatcacacatgtctctcatgctgagcagctttcttatgtgccatagatagcaatctacctgaaacgaggttatcgtgttggaatccatggagacccagcatggcgtat

SEQ ID NO: 426251 - DNA, 140 bp, Artificial Sequence
  Synthetic
aggccctggctgctgatatgggattggtaatccttaatattctcctacacatagttagcattacagtaacagtattggttctcccagggaatggaaataatgagagttgcaatgaaacaggaccttttgggacagcggtg

SEQ ID NO: 426252 - DNA, 140 bp, Artificial Sequence
  Synthetic
caccgctgtcccaaaaggtcctgtttcattgcaactctcattatttccattccctgggagaaccaatactgttactgtaatgctaactatgtgtaggagaatattaaggattaccaatcccatatcagcagccagggcct

SEQ ID NO: 426253 - DNA, 140 bp, Artificial Sequence
  Synthetic
atacgccatgctgggtctccatagactcagaagagatcagaaggcattaaagggaagaggcagcacacttggactcgacctgcgagtggccacaatggaaggcaaaaagattgttgaagacgtacttgggagtcggccat

SEQ ID NO: 426254 - DNA, 140 bp, Artificial Sequence
  Synthetic
atggccgactcccaagtacgtcttcaacaatctttttgccttccattgtggccactcgcaggtcgagtccaagtgtgctgcctcttccctttaatgccttctgatctcttctgagtctatggagacccagcatggcgtat

SEQ ID NO: 426255 - DNA, 140 bp, Artificial Sequence
  Synthetic
atacgccatgctgggtctcccacaataccaatgttattgagtatatagagagaccggagaatgatcatttcatgaacaatacagaagcattgtgtgatgctaagggtttcgcacccttttcgtacttgggagtcggccat

SEQ ID NO: 426256 - DNA, 140 bp, Artificial Sequence
  Synthetic
atggccgactcccaagtacgaaaagggtgcgaaacccttagcatcacacaatgcttctgtattgttcatgaaatgatcattctccggtctctctatatactcaataacattggtattgtgggagacccagcatggcgtat

SEQ ID NO: 426257 - DNA, 140 bp, Artificial Sequence
  Synthetic
atacgccatgctgggtctccgccctgctcctcggtacattaccgatatgagcatagaggaaataagcagggaatggtacatgctcatgccaaggcagaaaataacagggggtctgatggtcgtacttgggagtcggccat

SEQ ID NO: 426258 - DNA, 140 bp, Artificial Sequence
  Synthetic
atggccgactcccaagtacgaccatcagaccccctgttattttctgccttggcatgagcatgtaccattccctgcttatttcctctatgctcatatcggtaatgtaccgaggagcagggcggagacccagcatggcgtat

SEQ ID NO: 426259 - DNA, 140 bp, Artificial Sequence
  Synthetic
atacgccatgctgggtctccgatggcaccagttggttgataattggaatttctggtccagacaatggggctgtggcggtattgaaatacaatggcataataacagacactatcaagagttcgtacttgggagtcggccat

SEQ ID NO: 426260 - DNA, 140 bp, Artificial Sequence
  Synthetic
atggccgactcccaagtacgaactcttgatagtgtctgttattatgccattgtatttcaataccgccacagccccattgtctggaccagaaattccaattatcaaccaactggtgccatcggagacccagcatggcgtat

SEQ ID NO: 426261 - DNA, 140 bp, Artificial Sequence
  Synthetic
atacgccatgctgggtctcctctctgtcctatttgatcaactggaaacattagtctcactgagggctttcacagacgatggcgccattgtagctgaaatatctcccattccttccatgcccgtacttgggagtcggccat

SEQ ID NO: 426262 - DNA, 140 bp, Artificial Sequence
  Synthetic
atggccgactcccaagtacgggcatggaaggaatgggagatatttcagctacaatggcgccatcgtctgtgaaagccctcagtgagactaatgtttccagttgatcaaataggacagagaggagacccagcatggcgtat

SEQ ID NO: 426263 - DNA, 140 bp, Artificial Sequence
  Synthetic
aggccctggctgctgatatgacagacgatggcgccattgtagctgaaatatctcccattccttccatgccaggacattctacagaggatgtcaaaaatgcaattggaatcctcatcggtggaccttttgggacagcggtg

SEQ ID NO: 426264 - DNA, 140 bp, Artificial Sequence
  Synthetic
caccgctgtcccaaaaggtccaccgatgaggattccaattgcatttttgacatcctctgtagaatgtcctggcatggaaggaatgggagatatttcagctacaatggcgccatcgtctgtcatatcagcagccagggcct

SEQ ID NO: 426265 - DNA, 140 bp, Artificial Sequence
  Synthetic
aggccctggctgctgatatgtcctgggcgggagatattttaagaactcaggaatcatcatgcacttgcattcaaggtgaatgtttttgggtaatgacagatggaccagcaaacagacaaggaccttttgggacagcggtg

SEQ ID NO: 426266 - DNA, 140 bp, Artificial Sequence
  Synthetic
caccgctgtcccaaaaggtccttgtctgtttgctggtccatctgtcattacccaaaaacattcaccttgaatgcaagtgcatgatgattcctgagttcttaaaatatctcccgcccaggacatatcagcagccagggcct

SEQ ID NO: 426267 - DNA, 140 bp, Artificial Sequence
  Synthetic
atacgccatgctgggtctccgaggagaaaatccctaaaactaaaaacatgaaaaaaacaagtcagttaaaatgggcacttggtgaaaacatggcacctgagaaggtggattttgaagattcgtacttgggagtcggccat

SEQ ID NO: 426268 - DNA, 140 bp, Artificial Sequence
  Synthetic
atggccgactcccaagtacgaatcttcaaaatccaccttctcaggtgccatgttttcaccaagtgcccattttaactgacttgtttttttcatgtttttagttttagggattttctcctcggagacccagcatggcgtat

SEQ ID NO: 426269 - DNA, 140 bp, Artificial Sequence
  Synthetic
atacgccatgctgggtctccgaaatcagtttcaatggaggccatatagaagaatgctcatgctaccccaatgaaggtaaagtggaatgtgtttgtagggacaattggaccggaaccaacacgtacttgggagtcggccat

SEQ ID NO: 426270 - DNA, 140 bp, Artificial Sequence
  Synthetic
atggccgactcccaagtacgtgttggttccggtccaattgtccctacaaacacattccactttaccttcattggggtagcatgagcattcttctatatggcctccattgaaactgatttcggagacccagcatggcgtat

SEQ ID NO: 426271 - DNA, 140 bp, Artificial Sequence
  Synthetic
aggccctggctgctgatatgtgaaggtaaagtggaatgtgtttgtagggacaattggaccggaaccaacaggccagtgttggtgatttctccagatttgtcttacagagtcggatatttggaccttttgggacagcggtg

SEQ ID NO: 426272 - DNA, 140 bp, Artificial Sequence
  Synthetic
caccgctgtcccaaaaggtccaaatatccgactctgtaagacaaatctggagaaatcaccaacactggcctgttggttccggtccaattgtccctacaaacacattccactttaccttcacatatcagcagccagggcct

SEQ ID NO: 426273 - DNA, 140 bp, Artificial Sequence
  Synthetic
atacgccatgctgggtctccgaaaaacccaaatttctcccggatctgtatgactacaaggaaaaccgtttcattgaaattggagtgacgaggagggaagtccacatatattacctagagacgtacttgggagtcggccat

SEQ ID NO: 426274 - DNA, 140 bp, Artificial Sequence
  Synthetic
atggccgactcccaagtacgtctctaggtaatatatgtggacttccctcctcgtcactccaatttcaatgaaacggttttccttgtagtcatacagatccgggagaaatttgggtttttcggagacccagcatggcgtat

SEQ ID NO: 426275 - DNA, 140 bp, Artificial Sequence
  Synthetic
aggccctggctgctgatatgaaacagtaaagagcagatcaagaggcaagttgtggtcgataacttgaattggtcaggatacagtggttctttcacactaccagcggagttaacaaagagagaccttttgggacagcggtg

SEQ ID NO: 426276 - DNA, 140 bp, Artificial Sequence
  Synthetic
caccgctgtcccaaaaggtctctctttgttaactccgctggtagtgtgaaagaaccactgtatcctgaccaattcaagttatcgaccacaacttgcctcttgatctgctctttactgtttcatatcagcagccagggcct

SEQ ID NO: 426277 - DNA, 140 bp, Artificial Sequence
  Synthetic
atacgccatgctgggtctcctgtgaacagattgctgatgctcagcatcgttcccacagacagatggcggctactaccaacccactaatcaggcatgagaatagaatggtgctggccagcacgtacttgggagtcggccat

SEQ ID NO: 426278 - DNA, 140 bp, Artificial Sequence
  Synthetic
atggccgactcccaagtacgtgctggccagcaccattctattctcatgcctgattagtgggttggtagtagccgccatctgtctgtgggaacgatgctgagcatcagcaatctgttcacaggagacccagcatggcgtat

SEQ ID NO: 426279 - DNA, 140 bp, Artificial Sequence
  Synthetic
aggccctggctgctgatatgtacatacagatgtgcactgaactcaaactcagtgactacgaagggagactgatccaaaacagcataaccatagagagaatggttctctcggcatttgacggaccttttgggacagcggtg

SEQ ID NO: 426280 - DNA, 140 bp, Artificial Sequence
  Synthetic
caccgctgtcccaaaaggtccgtcaaatgccgagagaaccattctctctatggttatgctgttttggatcagtctcccttcgtagtcactgagtttgagttcagtgcacatctgtatgtacatatcagcagccagggcct

SEQ ID NO: 426281 - DNA, 140 bp, Artificial Sequence
  Synthetic
aggccctggctgctgatatgtgactcaagggacctgctgggaacaaatgtacactccaggaggggaagtgagaaatgacgatgttgaccagagtttgatcattgctgctcgaaacattgtgaccttttgggacagcggtg

SEQ ID NO: 426282 - DNA, 140 bp, Artificial Sequence
  Synthetic
caccgctgtcccaaaaggtcacaatgtttcgagcagcaatgatcaaactctggtcaacatcgtcatttctcacttcccctcctggagtgtacatttgttcccagcaggtcccttgagtcacatatcagcagccagggcct

SEQ ID NO: 426283 - DNA, 140 bp, Artificial Sequence
  Synthetic
aggccctggctgctgatatgcatggtgtctagggcccgaattgatgcacgaattgacttcgaatctggaaggattaagaaagaagagtttgctgagatcatgaagatctgttccaccattgaccttttgggacagcggtg

SEQ ID NO: 426284 - DNA, 140 bp, Artificial Sequence
  Synthetic
caccgctgtcccaaaaggtcaatggtggaacagatcttcatgatctcagcaaactcttctttcttaatccttccagattcgaagtcaattcgtgcatcaattcgggccctagacaccatgcatatcagcagccagggcct

SEQ ID NO: 426285 - DNA, 140 bp, Artificial Sequence
  Synthetic
aggccctggctgctgatatgtactaccaacccactaatcaggcatgagaatagaatggtgctggccagcactacagctaaggctatggagcaagtggctgggtcaagtgagcaggcagcagaccttttgggacagcggtg

SEQ ID NO: 426286 - DNA, 140 bp, Artificial Sequence
  Synthetic
caccgctgtcccaaaaggtctgctgcctgctcacttgacccagccacttgctccatagccttagctgtagtgctggccagcaccattctattctcatgcctgattagtgggttggtagtacatatcagcagccagggcct

SEQ ID NO: 426287 - DNA, 140 bp, Artificial Sequence
  Synthetic
atacgccatgctgggtctccgacaatgaagggaggctgatccagaacagtataacaatagagagaatggtactctctgcatttgatgaaagaaggaacagatacctggaagagcaccccacgtacttgggagtcggccat

SEQ ID NO: 426288 - DNA, 140 bp, Artificial Sequence
  Synthetic
atggccgactcccaagtacgtggggtgctcttccaggtatctgttccttctttcatcaaatgcagagagtaccattctctctattgttatactgttctggatcagcctcccttcattgtcggagacccagcatggcgtat

SEQ ID NO: 426289 - DNA, 140 bp, Artificial Sequence
  Synthetic
atacgccatgctgggtctcctgatgggaagaattaattattattggtcggtattaaaaccgggtcaaacactgcgaataaaatctaatgggaatctaatagctccatggtatggacacatcgtacttgggagtcggccat

SEQ ID NO: 426290 - DNA, 140 bp, Artificial Sequence
  Synthetic
atggccgactcccaagtacgatgtgtccataccatggagctattagattcccattagattttattcgcagtgtttgacccggttttaataccgaccaataataattaattcttcccatcaggagacccagcatggcgtat

SEQ ID NO: 426291 - DNA, 140 bp, Artificial Sequence
  Synthetic
aggccctggctgctgatatgacgagagctctcgtgcgtactggaatggaccccaggatgtgctctctgatgcaaggatcaactctcccgaggagatctggagctgcaggagcagcagtaagaccttttgggacagcggtg

SEQ ID NO: 426292 - DNA, 140 bp, Artificial Sequence
  Synthetic
caccgctgtcccaaaaggtcttactgctgctcctgcagctccagatctcctcgggagagttgatccttgcatcagagagcacatcctggggtccattccagtacgcacgagagctctcgtcatatcagcagccagggcct

SEQ ID NO: 426293 - DNA, 140 bp, Artificial Sequence
  Synthetic
atacgccatgctgggtctcctcagtggatcatcagaaactgggaaactgtgaaaattcaatggtcacaagatcccacaatgttatataataagatggaattcgagccattccagtctctgcgtacttgggagtcggccat

SEQ ID NO: 426294 - DNA, 140 bp, Artificial Sequence
  Synthetic
atggccgactcccaagtacgcagagactggaatggctcgaattccatcttattatataacattgtgggatcttgtgaccattgaattttcacagtttcccagtttctgatgatccactgaggagacccagcatggcgtat

SEQ ID NO: 426295 - DNA, 140 bp, Artificial Sequence
  Synthetic
atacgccatgctgggtctccaagaacaagtgggtcatccgtcacgaaggaagaggaagtgcttacgggcaacctccaaacattgaaaataagagtacatgaggggtatgaagaattcacacgtacttgggagtcggccat

SEQ ID NO: 426296 - DNA, 140 bp, Artificial Sequence
  Synthetic
atggccgactcccaagtacgtgtgaattcttcatacccctcatgtactcttattttcaatgtttggaggttgcccgtaagcacttcctcttccttcgtgacggatgacccacttgttcttggagacccagcatggcgtat

SEQ ID NO: 426297 - DNA, 140 bp, Artificial Sequence
  Synthetic
atacgccatgctgggtctccatgtacaaaatagtagtgataatcgcgctccttggagctgtgaaaggtcttgataaaatctgtctaggacatcatgcagtggctaatgggaccatcgtaacgtacttgggagtcggccat

SEQ ID NO: 426298 - DNA, 140 bp, Artificial Sequence
  Synthetic
atggccgactcccaagtacgttacgatggtcccattagccactgcatgatgtcctagacagattttatcaagacctttcacagctccaaggagcgcgattatcactactattttgtacatggagacccagcatggcgtat

SEQ ID NO: 426299 - DNA, 140 bp, Artificial Sequence
  Synthetic
aggccctggctgctgatatgtgataaaatctgtctaggacatcatgcagtggctaatgggaccatcgtaaagactctcacaaacgaacaggaagaggtaaccaacgctactgaaacagtggaccttttgggacagcggtg

SEQ ID NO: 426300 - DNA, 140 bp, Artificial Sequence
  Synthetic
caccgctgtcccaaaaggtccactgtttcagtagcgttggttacctcttcctgttcgtttgtgagagtctttacgatggtcccattagccactgcatgatgtcctagacagattttatcacatatcagcagccagggcct

SEQ ID NO: 426301 - DNA, 140 bp, Artificial Sequence
  Synthetic
atacgccatgctgggtctcccctgggcaactgccatccaatagggatgctaatagggactccagcttgtgatctgcaccttacagggatgtgggacactctcattgaacgagagaatgctcgtacttgggagtcggccat

SEQ ID NO: 426302 - DNA, 140 bp, Artificial Sequence
  Synthetic
atggccgactcccaagtacgagcattctctcgttcaatgagagtgtcccacatccctgtaaggtgcagatcacaagctggagtccctattagcatccctattggatggcagttgcccaggggagacccagcatggcgtat

SEQ ID NO: 426303 - DNA, 140 bp, Artificial Sequence
  Synthetic
atacgccatgctgggtctccattgcttactgctaccctggagctactgtaaatgtagaagcactaaggcagaagataatggagagtggagggatcaacaagataagcactggcttcacttcgtacttgggagtcggccat

SEQ ID NO: 426304 - DNA, 140 bp, Artificial Sequence
  Synthetic
atggccgactcccaagtacgaagtgaagccagtgcttatcttgttgatccctccactctccattatcttctgccttagtgcttctacatttacagtagctccagggtagcagtaagcaatggagacccagcatggcgtat

SEQ ID NO: 426305 - DNA, 140 bp, Artificial Sequence
  Synthetic
aggccctggctgctgatatggtccaaaacgccctaaatgggaatggagacccaaacaacatggacagggcagtgaagctttacagaaagctgaagagggagataacattccacggagctagaccttttgggacagcggtg

SEQ ID NO: 426306 - DNA, 140 bp, Artificial Sequence
  Synthetic
caccgctgtcccaaaaggtctagctccgtggaatgttatctccctcttcagctttctgtaaagcttcactgccctgtccatgttgtttgggtctccattcccatttagggcgttttggaccatatcagcagccagggcct

SEQ ID NO: 426307 - DNA, 140 bp, Artificial Sequence
  Synthetic
atacgccatgctgggtctccaaaatatacagagattcgcttggagaagctgtgatgagaatgggagaccttcattacctccagagcagaaatgagaagtggcgagagcaattgggacagacgtacttgggagtcggccat

SEQ ID NO: 426308 - DNA, 140 bp, Artificial Sequence
  Synthetic
atggccgactcccaagtacgtctgtcccaattgctctcgccacttctcatttctgctctggaggtaatgaaggtctcccattctcatcacagcttctccaagcgaatctctgtatattttggagacccagcatggcgtat

SEQ ID NO: 426309 - DNA, 140 bp, Artificial Sequence
  Synthetic
aggccctggctgctgatatgaggacaaaacttccctcagaccacgaacacttacagaaatacagacacggctgaacacctcataatgtggggaattcatcacccttctagcactcaagaggaccttttgggacagcggtg

SEQ ID NO: 426310 - DNA, 140 bp, Artificial Sequence
  Synthetic
caccgctgtcccaaaaggtcctcttgagtgctagaagggtgatgaattccccacattatgaggtgttcagccgtgtctgtatttctgtaagtgttcgtggtctgagggaagttttgtcctcatatcagcagccagggcct

SEQ ID NO: 426311 - DNA, 140 bp, Artificial Sequence
  Synthetic
atacgccatgctgggtctcctgaattcaacaaggcgtgtgaactgactgactcaagctgggtagaacttgatgaaataggggaagatgttgccccaatcgaacacattgcaagcatgagacgtacttgggagtcggccat

SEQ ID NO: 426312 - DNA, 140 bp, Artificial Sequence
  Synthetic
atggccgactcccaagtacgtctcatgcttgcaatgtgttcgattggggcaacatcttcccctatttcatcaagttctacccagcttgagtcagtcagttcacacgccttgttgaattcaggagacccagcatggcgtat

SEQ ID NO: 426313 - DNA, 140 bp, Artificial Sequence
  Synthetic
atacgccatgctgggtctcccacttaccggaacaattttgttccggttgttggagcaagacctcaggtcaatggacaaagtggcagaattgattttcactggacactagtacagccaggtcgtacttgggagtcggccat

SEQ ID NO: 426314 - DNA, 140 bp, Artificial Sequence
  Synthetic
atggccgactcccaagtacgacctggctgtactagtgtccagtgaaaatcaattctgccactttgtccattgacctgaggtcttgctccaacaaccggaacaaaattgttccggtaagtgggagacccagcatggcgtat

SEQ ID NO: 426315 - DNA, 140 bp, Artificial Sequence
  Synthetic
aggccctggctgctgatatgatagtagcgctctgtggatccaaggagcgattgggatcttggtcgtggcatgatggggctgaaatcatctactttaagtagaaaagattttggaaaaacagaccttttgggacagcggtg

SEQ ID NO: 426316 - DNA, 140 bp, Artificial Sequence
  Synthetic
caccgctgtcccaaaaggtctgtttttccaaaatcttttctacttaaagtagatgatttcagccccatcatgccacgaccaagatcccaatcgctccttggatccacagagcgctactatcatatcagcagccagggcct

SEQ ID NO: 426317 - DNA, 140 bp, Artificial Sequence
  Synthetic
atacgccatgctgggtctccacaataattgtgagtccaaatgtttttggagagggggttctataaatacaaggcttccctttcaaaatttgtcaccaagaacagtgggtcagtgtcctaacgtacttgggagtcggccat

SEQ ID NO: 426318 - DNA, 140 bp, Artificial Sequence
  Synthetic
atggccgactcccaagtacgttaggacactgacccactgttcttggtgacaaattttgaaagggaagccttgtatttatagaaccccctctccaaaaacatttggactcacaattattgtggagacccagcatggcgtat

SEQ ID NO: 426319 - DNA, 140 bp, Artificial Sequence
  Synthetic
aggccctggctgctgatatgaggcttccctttcaaaatttgtcaccaagaacagtgggtcagtgtcctaaatatgtgaacagaagaagcttgatgcttgcaacaggaatgagaaacgtacgaccttttgggacagcggtg

SEQ ID NO: 426320 - DNA, 140 bp, Artificial Sequence
  Synthetic
caccgctgtcccaaaaggtcgtacgtttctcattcctgttgcaagcatcaagcttcttctgttcacatatttaggacactgacccactgttcttggtgacaaattttgaaagggaagcctcatatcagcagccagggcct

SEQ ID NO: 426321 - DNA, 140 bp, Artificial Sequence
  Synthetic
atacgccatgctgggtctccgagaatgggtgggaaggaatggtagatggctggtatggtttcagacatcaaaatgctcagggcacaggccaggccgctgattacaagagtactcaggcagcgtacttgggagtcggccat

SEQ ID NO: 426322 - DNA, 140 bp, Artificial Sequence
  Synthetic
atggccgactcccaagtacgctgcctgagtactcttgtaatcagcggcctggcctgtgccctgagcattttgatgtctgaaaccataccagccatctaccattccttcccacccattctcggagacccagcatggcgtat

SEQ ID NO: 426323 - DNA, 140 bp, Artificial Sequence
  Synthetic
atacgccatgctgggtctccactgagttcgagtcaatagaatctgagttcagtgagatcgaacaccaaatcggtaacgtcatcaattggactaaggattcaataaccgacatttggacttcgtacttgggagtcggccat

SEQ ID NO: 426324 - DNA, 140 bp, Artificial Sequence
  Synthetic
atggccgactcccaagtacgaagtccaaatgtcggttattgaatccttagtccaattgatgacgttaccgatttggtgttcgatctcactgaactcagattctattgactcgaactcagtggagacccagcatggcgtat

SEQ ID NO: 426325 - DNA, 140 bp, Artificial Sequence
  Synthetic
atacgccatgctgggtctccatgaacactcaaatcctggtattcgctctgattgcgatcattccaacaaatgcagacaaaatctgcctcggacatcatgctgtgtcaaacggaaccaaagcgtacttgggagtcggccat

SEQ ID NO: 426326 - DNA, 140 bp, Artificial Sequence
  Synthetic
atggccgactcccaagtacgctttggttccgtttgacacagcatgatgtccgaggcagattttgtctgcatttgttggaatgatcgcaatcagagcgaataccaggatttgagtgttcatggagacccagcatggcgtat

SEQ ID NO: 426327 - DNA, 140 bp, Artificial Sequence
  Synthetic
atacgccatgctgggtctccgctgactcagagatgttgaatctatatgaaagagtgaggaaacaactaaggcagaatgcagaagaagatgggaaaggatgttttgagatatatcatgcttcgtacttgggagtcggccat

SEQ ID NO: 426328 - DNA, 140 bp, Artificial Sequence
  Synthetic
atggccgactcccaagtacgaagcatgatatatctcaaaacatcctttcccatcttcttctgcattctgccttagttgtttcctcactctttcatatagattcaacatctctgagtcagcggagacccagcatggcgtat

SEQ ID NO: 426329 - DNA, 140 bp, Artificial Sequence
  Synthetic
aggccctggctgctgatatggcagaatgcagaagaagatgggaaaggatgttttgagatatatcatgcttgtgatgattcatgcatggagagcataagaaacaacacctatgaccattcagaccttttgggacagcggtg

SEQ ID NO: 426330 - DNA, 140 bp, Artificial Sequence
  Synthetic
caccgctgtcccaaaaggtctgaatggtcataggtgttgtttcttatgctctccatgcatgaatcatcacaagcatgatatatctcaaaacatcctttcccatcttcttctgcattctgccatatcagcagccagggcct

SEQ ID NO: 426331 - DNA, 140 bp, Artificial Sequence
  Synthetic
atacgccatgctgggtctcccagctctaatagtatgggggatccatcattccggatcaactgcagagcaaaccaagctatatgggagtggaaacaaactggtgacagttgggagttctaacgtacttgggagtcggccat

SEQ ID NO: 426332 - DNA, 140 bp, Artificial Sequence
  Synthetic
atggccgactcccaagtacgttagaactcccaactgtcaccagtttgtttccactcccatatagcttggtttgctctgcagttgatccggaatgatggatcccccatactattagagctgggagacccagcatggcgtat

SEQ ID NO: 426333 - DNA, 140 bp, Artificial Sequence
  Synthetic
aggccctggctgctgatatgtagcttcggggcatcatgttttgttcttctagccgttgtcatgggtcttttctttttctgtctgaagaatggaaacatgcgatgcacaatctgtatttaggaccttttgggacagcggtg

SEQ ID NO: 426334 - DNA, 140 bp, Artificial Sequence
  Synthetic
caccgctgtcccaaaaggtcctaaatacagattgtgcatcgcatgtttccattcttcagacagaaaaagaaaagacccatgacaacggctagaagaacaaaacatgatgccccgaagctacatatcagcagccagggcct

SEQ ID NO: 426335 - DNA, 140 bp, Artificial Sequence
  Synthetic
atacgccatgctgggtctccgcagggtgacaaaaacataatggattccaacactgtgtcaagcttccaggtagactgctttctttggcatgtccgcaaacggtttgcagaccaagaactgcgtacttgggagtcggccat

SEQ ID NO: 426336 - DNA, 140 bp, Artificial Sequence
  Synthetic
atggccgactcccaagtacgcagttcttggtctgcaaaccgtttgcggacatgccaaagaaagcagtctacctggaagcttgacacagtgttggaatccattatgtttttgtcaccctgcggagacccagcatggcgtat

SEQ ID NO: 426337 - DNA, 140 bp, Artificial Sequence
  Synthetic
aggccctggctgctgatatgtagcttcggggcatcatgtttcatacttctagccattgcaatgggccttgtcttcatatgtgtaaagaatggaaacatgcggtgcactatttgtatataagaccttttgggacagcggtg

SEQ ID NO: 426338 - DNA, 140 bp, Artificial Sequence
  Synthetic
caccgctgtcccaaaaggtcttatatacaaatagtgcaccgcatgtttccattctttacacatatgaagacaaggcccattgcaatggctagaagtatgaaacatgatgccccgaagctacatatcagcagccagggcct

SEQ ID NO: 426339 - DNA, 140 bp, Artificial Sequence
  Synthetic
aggccctggctgctgatatgcagttactctgctggtgcacttgccagttgcatgggcctcatatacaacagaatggggactgttgccacagaggtggcatttggtctggtgtgcgcaaccgaccttttgggacagcggtg

SEQ ID NO: 426340 - DNA, 140 bp, Artificial Sequence
  Synthetic
caccgctgtcccaaaaggtcggttgcgcacaccagaccaaatgccacctctgtggcaacagtccccattctgttgtatatgaggcccatgcaactggcaagtgcaccagcagagtaactgcatatcagcagccagggcct

SEQ ID NO: 426341 - DNA, 140 bp, Artificial Sequence
  Synthetic
atacgccatgctgggtctcctaaagattacagagaatagctttgaacaaataacttttatgcaagccttacaactattgcttgaagtggagcaagagataagaactttctcgtttcagctcgtacttgggagtcggccat

SEQ ID NO: 426342 - DNA, 140 bp, Artificial Sequence
  Synthetic
atggccgactcccaagtacgagctgaaacgagaaagttcttatctcttgctccacttcaagcaatagttgtaaggcttgcataaaagttatttgttcaaagctattctctgtaatctttaggagacccagcatggcgtat

SEQ ID NO: 426343 - DNA, 140 bp, Artificial Sequence
  Synthetic
aggccctggctgctgatatgtgtccgcaaaagatttgcagaccaagagatgggcgatgccccattcatggaccggctccgccgagaccagaagtctttaaaggggaggagcagcactcttgaccttttgggacagcggtg

SEQ ID NO: 426344 - DNA, 140 bp, Artificial Sequence
  Synthetic
caccgctgtcccaaaaggtcaagagtgctgctcctcccctttaaagacttctggtctcggcggagccggtccatgaatggggcatcgcccatctcttggtctgcaaatcttttgcggacacatatcagcagccagggcct

SEQ ID NO: 426345 - DNA, 140 bp, Artificial Sequence
  Synthetic
atacgccatgctgggtctccacttcaatgaatcaacaaagaagaaaattgagaaaataaggcctcttttaatagatggcacagcatcactgagtcctgggatgatgatgggcatgttcaacgtacttgggagtcggccat

SEQ ID NO: 426346 - DNA, 140 bp, Artificial Sequence
  Synthetic
atggccgactcccaagtacgttgaacatgcccatcatcatcccaggactcagtgatgctgtgccatctattaaaagaggccttattttctcaattttcttctttgttgattcattgaagtggagacccagcatggcgtat

SEQ ID NO: 426347 - DNA, 140 bp, Artificial Sequence
  Synthetic
aggccctggctgctgatatgggaaaaggcaatgaaagaatatggggaagatccaaaaatcgagacgaacaaatttgctgcaatatgcacacacttggaagtctgctttatgtattcagatgaccttttgggacagcggtg

SEQ ID NO: 426348 - DNA, 140 bp, Artificial Sequence
  Synthetic
caccgctgtcccaaaaggtcatctgaatacataaagcagacttccaagtgtgtgcatattgcagcaaatttgttcgtctcgatttttggatcttccccatattctttcattgccttttcccatatcagcagccagggcct

SEQ ID NO: 426349 - DNA, 140 bp, Artificial Sequence
  Synthetic
aggccctggctgctgatatgaaaactgagaacagcttcgagcagataacgttcttgcaggcattgcaactcttacttgaggttgagagtgagataaggacattttcttttcagcttatttgaccttttgggacagcggtg

SEQ ID NO: 426350 - DNA, 140 bp, Artificial Sequence
  Synthetic
caccgctgtcccaaaaggtcaaataagctgaaaagaaaatgtccttatctcactctcaacctcaagtaagagttgcaatgcctgcaagaacgttatctgctcgaagctgttctcagttttcatatcagcagccagggcct

SEQ ID NO: 426351 - DNA, 140 bp, Artificial Sequence
  Synthetic
atacgccatgctgggtctcctccaaatgcattattgaaacacagatttgaaataattgaagggagagaccggacgatggcctggacggtagtgaatagtatctgcaataacacaggagtccgtacttgggagtcggccat

SEQ ID NO: 426352 - DNA, 140 bp, Artificial Sequence
  Synthetic
atggccgactcccaagtacggactcctgtgttattgcagatactattcactaccgtccaggccatcgtccggtctctcccttcaattatttcaaatctgtgtttcaataatgcatttggaggagacccagcatggcgtat

SEQ ID NO: 426353 - DNA, 140 bp, Artificial Sequence
  Synthetic
aggccctggctgctgatatgggacgatggcctggacggtagtgaatagtatctgcaataacacaggagtcgagaagcctaaattcctcccagacctgtatgactacaaagaaaaccgattgaccttttgggacagcggtg

SEQ ID NO: 426354 - DNA, 140 bp, Artificial Sequence
  Synthetic
caccgctgtcccaaaaggtcaatcggttttctttgtagtcatacaggtctgggaggaatttaggcttctcgactcctgtgttattgcagatactattcactaccgtccaggccatcgtcccatatcagcagccagggcct

SEQ ID NO: 426355 - DNA, 140 bp, Artificial Sequence
  Synthetic
aggccctggctgctgatatgcataagcaccacattcccttatactggagatcctccatacagccatggaacaggaacagggtacaccatggacacagtcaacagaacacaccaatattcagaccttttgggacagcggtg

SEQ ID NO: 426356 - DNA, 140 bp, Artificial Sequence
  Synthetic
caccgctgtcccaaaaggtctgaatattggtgtgttctgttgactgtgtccatggtgtaccctgttcctgttccatggctgtatggaggatctccagtataagggaatgtggtgcttatgcatatcagcagccagggcct

SEQ ID NO: 426357 - DNA, 140 bp, Artificial Sequence
  Synthetic
atacgccatgctgggtctccaagctaacaagataaaatcagagaagacacacattcatatattctcattcactggagaggaaatggcaaccaaagcggactacacccttgatgaagagagcgtacttgggagtcggccat

SEQ ID NO: 426358 - DNA, 140 bp, Artificial Sequence
  Synthetic
atggccgactcccaagtacgctctcttcatcaagggtgtagtccgctttggttgccatttcctctccagtgaatgagaatatatgaatgtgtgtcttctctgattttatcttgttagcttggagacccagcatggcgtat

SEQ ID NO: 426359 - DNA, 140 bp, Artificial Sequence
  Synthetic
aggccctggctgctgatatgactggagaggaaatggcaaccaaagcggactacacccttgatgaagagagcagagctaggatcaaaaccaggctgtttactatacggcaggaaatggctagaccttttgggacagcggtg

SEQ ID NO: 426360 - DNA, 140 bp, Artificial Sequence
  Synthetic
caccgctgtcccaaaaggtctagccatttcctgccgtatagtaaacagcctggttttgatcctagctctgctctcttcatcaagggtgtagtccgctttggttgccatttcctctccagtcatatcagcagccagggcct

SEQ ID NO: 426361 - DNA, 140 bp, Artificial Sequence
  Synthetic
atacgccatgctgggtctccatgaaagtaaaaataatggttctgctatgtacacttacagctacatacgcagacacaatatgtgtaggctaccatgccaacaactcatctgacactgttgcgtacttgggagtcggccat

SEQ ID NO: 426362 - DNA, 140 bp, Artificial Sequence
  Synthetic
atggccgactcccaagtacgcaacagtgtcagatgagttgttggcatggtagcctacacatattgtgtctgcgtatgtagctgtaagtgtacatagcagaaccattatttttactttcatggagacccagcatggcgtat

SEQ ID NO: 426363 - DNA, 140 bp, Artificial Sequence
  Synthetic
atacgccatgctgggtctccaagacaaatgatgctgggtcggacagggtgatggtgtcccccctagctgtaacttggtggaataggaatgggccgacgacaaatacagttcattatccaacgtacttgggagtcggccat

SEQ ID NO: 426364 - DNA, 140 bp, Artificial Sequence
  Synthetic
atggccgactcccaagtacgttggataatgaactgtatttgtcgtcggcccattcctattccaccaagttacagctaggggggacaccatcaccctgtccgacccagcatcatttgtcttggagacccagcatggcgtat

SEQ ID NO: 426365 - DNA, 140 bp, Artificial Sequence
  Synthetic
atacgccatgctgggtctccgaaggagttttcagaggtggaaggaagaattcaggatcttgagaaatatgtcgaagacaccaaaatagatctatggtcttacaatgcggaacttcttgtacgtacttgggagtcggccat

SEQ ID NO: 426366 - DNA, 140 bp, Artificial Sequence
  Synthetic
atggccgactcccaagtacgtacaagaagttccgcattgtaagaccatagatctattttggtgtcttcgacatatttctcaagatcctgaattcttccttccacctctgaaaactccttcggagacccagcatggcgtat

SEQ ID NO: 426367 - DNA, 140 bp, Artificial Sequence
  Synthetic
atacgccatgctgggtctccatggattcgaaccgaacggctgcattgagggaaagctttctcagatgtccaaagaagtgaacgccagaattgaaccatttctgaagacaacaccacgtcccgtacttgggagtcggccat

SEQ ID NO: 426368 - DNA, 140 bp, Artificial Sequence
  Synthetic
atggccgactcccaagtacgggacgtggtgttgtcttcagaaatggttcaattctggcgttcacttctttggacatctgagaaagctttccctcaatgcagccgttcggttcgaatccatggagacccagcatggcgtat

SEQ ID NO: 426369 - DNA, 140 bp, Artificial Sequence
  Synthetic
atacgccatgctgggtctccttatggatgcccttaaactaagcattgaagacccgagtcatgagggagagggtattccattatatgatgcaatcaaatgcatgaacacattttttggatgcgtacttgggagtcggccat

SEQ ID NO: 426370 - DNA, 140 bp, Artificial Sequence
  Synthetic
atggccgactcccaagtacgcatccaaaaaatgtgttcatgcatttgattgcatcatataatggaataccctctccctcatgactcgggtcttcaatgcttagtttaagggcatccataaggagacccagcatggcgtat

SEQ ID NO: 426371 - DNA, 140 bp, Artificial Sequence
  Synthetic
aggccctggctgctgatatgggtattccattatatgatgcaatcaaatgcatgaacacattttttggatggaaagagcccaaaattctgaaaccacatgaaaagggcataaactccaattgaccttttgggacagcggtg

SEQ ID NO: 426372 - DNA, 140 bp, Artificial Sequence
  Synthetic
caccgctgtcccaaaaggtcaattggagtttatgcccttttcatgtggtttcagaattttgggctctttccatccaaaaaatgtgttcatgcatttgattgcatcatataatggaatacccatatcagcagccagggcct

SEQ ID NO: 426373 - DNA, 140 bp, Artificial Sequence
  Synthetic
aggccctggctgctgatatggtgcggggaaagatccaaagaaaactggaggtccaatctacaaaaagagagatggaaaatggatgagagagctgattctgtatgacaaagatgaaatcaggaccttttgggacagcggtg

SEQ ID NO: 426374 - DNA, 140 bp, Artificial Sequence
  Synthetic
caccgctgtcccaaaaggtcctgatttcatctttgtcatacagaatcagctctctcatccattttccatctctctttttgtagattggacctccagttttctttggatctttccccgcaccatatcagcagccagggcct

SEQ ID NO: 426375 - DNA, 140 bp, Artificial Sequence
  Synthetic
aggccctggctgctgatatggctgaaattgaagatcttatctttctggcacgatctgcactcatcctgagaggatccgtggcccataagtcctgcttacctgcttgtgtgtatggactcggaccttttgggacagcggtg

SEQ ID NO: 426376 - DNA, 140 bp, Artificial Sequence
  Synthetic
caccgctgtcccaaaaggtccgagtccatacacacaagcaggtaagcaggacttatgggccacggatcctctcaggatgagtgcagatcgtgccagaaagataagatcttcaatttcagccatatcagcagccagggcct

SEQ ID NO: 426377 - DNA, 140 bp, Artificial Sequence
  Synthetic
atacgccatgctgggtctccgaggagaaaataccaaaaacaaagaacatgaagaagacaagtcaattaaagtgggcacttggtgagaatatggcaccagaaaaggtagactttgaggattcgtacttgggagtcggccat

SEQ ID NO: 426378 - DNA, 140 bp, Artificial Sequence
  Synthetic
atggccgactcccaagtacgaatcctcaaagtctaccttttctggtgccatattctcaccaagtgcccactttaattgacttgtcttcttcatgttctttgtttttggtattttctcctcggagacccagcatggcgtat

SEQ ID NO: 426379 - DNA, 140 bp, Artificial Sequence
  Synthetic
aggccctggctgctgatatggtgggcacttggtgagaatatggcaccagaaaaggtagactttgaggattgcaaagatgttagagatctaagacagtatgacagtgatgaaccagagtcagaccttttgggacagcggtg

SEQ ID NO: 426380 - DNA, 140 bp, Artificial Sequence
  Synthetic
caccgctgtcccaaaaggtctgactctggttcatcactgtcatactgtcttagatctctaacatctttgcaatcctcaaagtctaccttttctggtgccatattctcaccaagtgcccaccatatcagcagccagggcct

SEQ ID NO: 426381 - DNA, 140 bp, Artificial Sequence
  Synthetic
atacgccatgctgggtctccgacagattcaagttggattgaacttgatgagataggggaagacgttgctccaattgaacacattgcaagtatgagaagaaattactttacagcggaagtacgtacttgggagtcggccat

SEQ ID NO: 426382 - DNA, 140 bp, Artificial Sequence
  Synthetic
atggccgactcccaagtacgtacttccgctgtaaagtaatttcttctcatacttgcaatgtgttcaattggagcaacgtcttcccctatctcatcaagttcaatccaacttgaatctgtcggagacccagcatggcgtat

SEQ ID NO: 426383 - DNA, 140 bp, Artificial Sequence
  Synthetic
aggccctggctgctgatatgcaattgaacacattgcaagtatgagaagaaattactttacagcggaagtatcccattgcagggccactgaatacataatgaagggagtttacataaacacgaccttttgggacagcggtg

SEQ ID NO: 426384 - DNA, 140 bp, Artificial Sequence
  Synthetic
caccgctgtcccaaaaggtcgtgtttatgtaaactcccttcattatgtattcagtggccctgcaatgggatacttccgctgtaaagtaatttcttctcatacttgcaatgtgttcaattgcatatcagcagccagggcct

SEQ ID NO: 426385 - DNA, 140 bp, Artificial Sequence
  Synthetic
aggccctggctgctgatatgttctcattcactggggaggaaatggccaccaaagcggactacacccttgatgaagagagcagagcaagaataaaaaccaggctattcactataagacaaggaccttttgggacagcggtg

SEQ ID NO: 426386 - DNA, 140 bp, Artificial Sequence
  Synthetic
caccgctgtcccaaaaggtccttgtcttatagtgaatagcctggtttttattcttgctctgctctcttcatcaagggtgtagtccgctttggtggccatttcctccccagtgaatgagaacatatcagcagccagggcct

SEQ ID NO: 426387 - DNA, 140 bp, Artificial Sequence
  Synthetic
atacgccatgctgggtctcccaatgataagcaaatgcagaaccaaagagggaagaaggaagactaatctatatggattcattataaaagggagatcccatttgagaaatgacaccgatgtcgtacttgggagtcggccat

SEQ ID NO: 426388 - DNA, 140 bp, Artificial Sequence
  Synthetic
atggccgactcccaagtacgacatcggtgtcatttctcaaatgggatctcccttttataatgaatccatatagattagtcttccttcttccctctttggttctgcatttgcttatcattgggagacccagcatggcgtat

SEQ ID NO: 426389 - DNA, 140 bp, Artificial Sequence
  Synthetic
aggccctggctgctgatatgtatggattcattataaaagggagatcccatttgagaaatgacaccgatgtggtgaattttgtgagtatggaattttctcttactgacccaaggctggagcgaccttttgggacagcggtg

SEQ ID NO: 426390 - DNA, 140 bp, Artificial Sequence
  Synthetic
caccgctgtcccaaaaggtcgctccagccttgggtcagtaagagaaaattccatactcacaaaattcaccacatcggtgtcatttctcaaatgggatctcccttttataatgaatccatacatatcagcagccagggcct

SEQ ID NO: 426391 - DNA, 140 bp, Artificial Sequence
  Synthetic
aggccctggctgctgatatgcccatcgtagatataaatgtaaaggattatagtattgtttccagatatgtatgctcaggacttgttggagacacacccagaaaaaacgacagcttcagcagaccttttgggacagcggtg

SEQ ID NO: 426392 - DNA, 140 bp, Artificial Sequence
  Synthetic
caccgctgtcccaaaaggtctgctgaagctgtcgttttttctgggtgtgtctccaacaagtcctgagcatacatatctggaaacaatactataatcctttacatttatatctacgatgggcatatcagcagccagggcct

SEQ ID NO: 426393 - DNA, 140 bp, Artificial Sequence
  Synthetic
atacgccatgctgggtctcccggactgcaattggccaagtgtcaaggcctatgttcttgtatgtgagaaccaatggaacctccaagataaagatgaaatggggtatggagatgaggagatcgtacttgggagtcggccat

SEQ ID NO: 426394 - DNA, 140 bp, Artificial Sequence
  Synthetic
atggccgactcccaagtacgatctcctcatctccataccccatttcatctttatcttggaggttccattggttctcacatacaagaacataggccttgacacttggccaattgcagtccgggagacccagcatggcgtat

SEQ ID NO: 426395 - DNA, 140 bp, Artificial Sequence
  Synthetic
atacgccatgctgggtctcctgcccttccataacattcacccattgacaataggtgagtgtcccaagtatgtcaagtcggatagactggtcttggcgacaggactaagaaatgtccctcacgtacttgggagtcggccat

SEQ ID NO: 426396 - DNA, 140 bp, Artificial Sequence
  Synthetic
atggccgactcccaagtacgtgagggacatttcttagtcctgtcgccaagaccagtctatccgacttgacatacttgggacactcacctattgtcaatgggtgaatgttatggaagggcaggagacccagcatggcgtat

SEQ ID NO: 426397 - DNA, 140 bp, Artificial Sequence
  Synthetic
atacgccatgctgggtctccacatattcgtcatcaatgatgtgggaaatcaacggtcctgaatcagtgcttgtcaacacctaccaatggatcatcagaaattgggaaactgtgaagattccgtacttgggagtcggccat

SEQ ID NO: 426398 - DNA, 140 bp, Artificial Sequence
  Synthetic
atggccgactcccaagtacggaatcttcacagtttcccaatttctgatgatccattggtaggtgttgacaagcactgattcaggaccgttgatttcccacatcattgatgacgaatatgtggagacccagcatggcgtat

SEQ ID NO: 426399 - DNA, 140 bp, Artificial Sequence
  Synthetic
aggccctggctgctgatatgaaaatggccaattggagagtcacccaggggggtggaagaaggatccatcggaaaagtgtgcagaaccttattagcaaaatctgtattcaacagtttatatgaccttttgggacagcggtg

SEQ ID NO: 426400 - DNA, 140 bp, Artificial Sequence
  Synthetic
caccgctgtcccaaaaggtcatataaactgttgaatacagattttgctaataaggttctgcacacttttccgatggatccttcttccacccccctgggtgactctccaattggccattttcatatcagcagccagggcct

SEQ ID NO: 426401 - DNA, 140 bp, Artificial Sequence
  Synthetic
aggccctggctgctgatatgaatggtctcaggatcccacgatgctgtacaataagatggagttcgagccgttccaatccttggtacctaaagctaccagaggtcaatacagtggatttgtgaccttttgggacagcggtg

SEQ ID NO: 426402 - DNA, 140 bp, Artificial Sequence
  Synthetic
caccgctgtcccaaaaggtcacaaatccactgtattgacctctggtagctttaggtaccaaggattggaacggctcgaactccatcttattgtacagcatcgtgggatcctgagaccattcatatcagcagccagggcct

SEQ ID NO: 426403 - DNA, 140 bp, Artificial Sequence
  Synthetic
atacgccatgctgggtctcctccagataataaagctgctaccatttgcagcagcaccacctgagcagagcagaatgcagttttcttctctaactgtgaatgtgaggggctcaggaatgagcgtacttgggagtcggccat

SEQ ID NO: 426404 - DNA, 140 bp, Artificial Sequence
  Synthetic
atggccgactcccaagtacgctcattcctgagcccctcacattcacagttagagaagaaaactgcattctgctctgctcaggtggtgctgctgcaaatggtagcagctttattatctggaggagacccagcatggcgtat

SEQ ID NO: 426405 - DNA, 140 bp, Artificial Sequence
  Synthetic
aggccctggctgctgatatgagcaaaagcaggagttcaaaatgaatccaaatcagaagataataaccatcggatcaatctgtatggtaattggaatagctagcttaatgttacaaattgggaccttttgggacagcggtg

SEQ ID NO: 426406 - DNA, 140 bp, Artificial Sequence
  Synthetic
caccgctgtcccaaaaggtcccaatttgtaacattaagctagctattccaattaccatacagattgatccgatggttattatcttctgatttggattcattttgaactcctgcttttgctcatatcagcagccagggcct

SEQ ID NO: 426407 - DNA, 140 bp, Artificial Sequence
  Synthetic
aggccctggctgctgatatgtgagcaatcttgcaaaaggggagaaagctaatgtgctgatagggcaaggagacgtggtgttggtaatgaaacggaaacgggactctagcatacttactgagaccttttgggacagcggtg

SEQ ID NO: 426408 - DNA, 140 bp, Artificial Sequence
  Synthetic
caccgctgtcccaaaaggtctcagtaagtatgctagagtcccgtttccgtttcattaccaacaccacgtctccttgccctatcagcacattagctttctccccttttgcaagattgctcacatatcagcagccagggcct

SEQ ID NO: 426409 - DNA, 140 bp, Artificial Sequence
  Synthetic
atacgccatgctgggtctcctccaattgatggaccactacctgaggataatgaaccaagcgggtatgcacaaacagattgtgtattggaggcaatggctttccttgaagaatcccacccacgtacttgggagtcggccat

SEQ ID NO: 426410 - DNA, 140 bp, Artificial Sequence
  Synthetic
atggccgactcccaagtacgtgggtgggattcttcaaggaaagccattgcctccaatacacaatctgtttgtgcatacccgcttggttcattatcctcaggtagtggtccatcaattggaggagacccagcatggcgtat

SEQ ID NO: 426411 - DNA, 140 bp, Artificial Sequence
  Synthetic
aggccctggctgctgatatgacgaggaaagcagggctaggattaaaaccaggctgtttaccataagacaagaaatggccaacagaggcctctgggattcctttcgtcagtccgaaagagggaccttttgggacagcggtg

SEQ ID NO: 426412 - DNA, 140 bp, Artificial Sequence
  Synthetic
caccgctgtcccaaaaggtccctctttcggactgacgaaaggaatcccagaggcctctgttggccatttcttgtcttatggtaaacagcctggttttaatcctagccctgctttcctcgtcatatcagcagccagggcct

SEQ ID NO: 426413 - DNA, 140 bp, Artificial Sequence
  Synthetic
aggccctggctgctgatatggtatttgcaggaaagaacactgatctcgaggctctcatggagtggctaaagacaagaccaatcctgtcacctctgactaaagggatcttgggatttgtatgaccttttgggacagcggtg

SEQ ID NO: 426414 - DNA, 140 bp, Artificial Sequence
  Synthetic
caccgctgtcccaaaaggtcatacaaatcccaagatccctttagtcagaggtgacaggattggtcttgtctttagccactccatgagagcctcgagatcagtgttctttcctgcaaataccatatcagcagccagggcct

SEQ ID NO: 426415 - DNA, 140 bp, Artificial Sequence
  Synthetic
atacgccatgctgggtctccaagagtagataaactaactcaaggccgccaaacctatgactggacattgaatagaaaccagccagctgcaactgctttggctaacactatagaggttttccgtacttgggagtcggccat

SEQ ID NO: 426416 - DNA, 140 bp, Artificial Sequence
  Synthetic
atggccgactcccaagtacggaaaacctctatagtgttagccaaagcagttgcagctggctggtttctattcaatgtccagtcataggtttggcggccttgagttagtttatctactcttggagacccagcatggcgtat

SEQ ID NO: 426417 - DNA, 140 bp, Artificial Sequence
  Synthetic
aggccctggctgctgatatgaggtcgcactcagttactcaaccggtgcacttgccagttgcatgggtctcatatacaacaggatgggaacggtgactacagaagtggcttttggcctagtgaccttttgggacagcggtg

SEQ ID NO: 426418 - DNA, 140 bp, Artificial Sequence
  Synthetic
caccgctgtcccaaaaggtcactaggccaaaagccacttctgtagtcaccgttcccatcctgttgtatatgagacccatgcaactggcaagtgcaccggttgagtaactgagtgcgacctcatatcagcagccagggcct

SEQ ID NO: 426419 - DNA, 140 bp, Artificial Sequence
  Synthetic
aggccctggctgctgatatgccttggaaaagatgcaggtgcattgactgaagatccagatgaaggcacagctggagtggagtctgctgtcctgaggggattcctcattttgggtaaagaagaccttttgggacagcggtg

SEQ ID NO: 426420 - DNA, 140 bp, Artificial Sequence
  Synthetic
caccgctgtcccaaaaggtcttctttacccaaaatgaggaatcccctcaggacagcagactccactccagctgtgccttcatctggatcttcagtcaatgcacctgcatcttttccaaggcatatcagcagccagggcct

SEQ ID NO: 426421 - DNA, 140 bp, Artificial Sequence
  Synthetic
aggccctggctgctgatatgagatggcaaccatcaccaacccactaatcaggcatgagaacagaatggtgctggccagcactacagctaaggccatggagcagatggcgggatcaagcgagaccttttgggacagcggtg

SEQ ID NO: 426422 - DNA, 140 bp, Artificial Sequence
  Synthetic
caccgctgtcccaaaaggtctcgcttgatcccgccatctgctccatggccttagctgtagtgctggccagcaccattctgttctcatgcctgattagtgggttggtgatggttgccatctcatatcagcagccagggcct

SEQ ID NO: 426423 - DNA, 140 bp, Artificial Sequence
  Synthetic
atacgccatgctgggtctccacgcaaagaacaataggaaagaagaagcataggataaacaagaagagctacttaataagagcattgacattaaacacaatgacaaaagatgcggaaagagcgtacttgggagtcggccat

SEQ ID NO: 426424 - DNA, 140 bp, Artificial Sequence
  Synthetic
atggccgactcccaagtacgctctttccgcatcttttgtcattgtgtttaatgtcaatgctcttattaagtagctcttcttgtttatcctatgcttcttctttcctattgttctttgcgtggagacccagcatggcgtat

SEQ ID NO: 426425 - DNA, 140 bp, Artificial Sequence
  Synthetic
aggccctggctgctgatatgatggaagtagtatcactaataactatactactagtagcaacagtaagcaatgcagataaaatctgcatcggctatcaatcaacaaactccacagaaactggaccttttgggacagcggtg

SEQ ID NO: 426426 - DNA, 140 bp, Artificial Sequence
  Synthetic
caccgctgtcccaaaaggtccagtttctgtggagtttgttgattgatagccgatgcagattttatctgcattgcttactgttgctactagtagtatagttattagtgatactacttccatcatatcagcagccagggcct

SEQ ID NO: 426427 - DNA, 140 bp, Artificial Sequence
  Synthetic
atacgccatgctgggtctccacgctcaggttatgagacctttagggtagtcaatggttggaccacggctaattcaaagtcacaaataaataggcaagtcatagttgacagtgaaaactggcgtacttgggagtcggccat

SEQ ID NO: 426428 - DNA, 140 bp, Artificial Sequence
  Synthetic
atggccgactcccaagtacgccagttttcactgtcaactatgacttgcctatttatttgtgactttgaattagccgtggtccaaccattgactaccctaaaggtctcataacctgagcgtggagacccagcatggcgtat

SEQ ID NO: 426429 - DNA, 140 bp, Artificial Sequence
  Synthetic
aggccctggctgctgatatggaattggttgcatagtttggagtacaaatacccagcactgaacgtaactatgccaaacaatgacaattttgacaaattgtacatttggggggttcaccacgaccttttgggacagcggtg

SEQ ID NO: 426430 - DNA, 140 bp, Artificial Sequence
  Synthetic
caccgctgtcccaaaaggtcgtggtgaaccccccaaatgtacaatttgtcaaaattgtcattgtttggcatagttacgttcagtgctgggtatttgtactccaaactatgcaaccaattccatatcagcagccagggcct

SEQ ID NO: 426431 - DNA, 140 bp, Artificial Sequence
  Synthetic
atacgccatgctgggtctcccatcagatgctccagttcacaattgcgacacaagatgccaaaccccccacggagcgttgaacagtagccttccttttcagaatgtgcatcctatcaccatcgtacttgggagtcggccat

SEQ ID NO: 426432 - DNA, 140 bp, Artificial Sequence
  Synthetic
atggccgactcccaagtacgatggtgataggatgcacattctgaaaaggaaggctactgttcaacgctccgtggggggtttggcatcttgtgtcgcaattgtgaactggagcatctgatgggagacccagcatggcgtat

SEQ ID NO: 426433 - DNA, 140 bp, Artificial Sequence
  Synthetic
atacgccatgctgggtctccctagggaaaggatacatgttcgagagtaggagcatgaagctacgcacacaaatatcagcagaaatgcttgcaaacattgacctgaggtatttcaacgactcgtacttgggagtcggccat

SEQ ID NO: 426434 - DNA, 140 bp, Artificial Sequence
  Synthetic
atggccgactcccaagtacgagtcgttgaaatacctcaggtcaatgtttgcaagcatttctgctgatatttgtgtgcgtagcttcatgctcctactctcgaacatgtatcctttccctagggagacccagcatggcgtat

SEQ ID NO: 426435 - DNA, 140 bp, Artificial Sequence
  Synthetic
aggccctggctgctgatatgaatatcagcagaaatgcttgcaaacattgacctgaggtatttcaacgactcaacaaggaagaaaattgaaaaaataaggcctctcttaatagatggcacagaccttttgggacagcggtg

SEQ ID NO: 426436 - DNA, 140 bp, Artificial Sequence
  Synthetic
caccgctgtcccaaaaggtctgtgccatctattaagagaggccttattttttcaattttcttccttgttgagtcgttgaaatacctcaggtcaatgtttgcaagcatttctgctgatattcatatcagcagccagggcct

SEQ ID NO: 426437 - DNA, 140 bp, Artificial Sequence
  Synthetic
atacgccatgctgggtctcctatgggttcatcataaaaggaagatctcatttgaggaatgatactgatgtggtaaactttgtgagcatggaattttctctcactgatccgaggctagaaccgtacttgggagtcggccat

SEQ ID NO: 426438 - DNA, 140 bp, Artificial Sequence
  Synthetic
atggccgactcccaagtacggttctagcctcggatcagtgagagaaaattccatgctcacaaagtttaccacatcagtatcattcctcaaatgagatcttccttttatgatgaacccataggagacccagcatggcgtat

SEQ ID NO: 426439 - DNA, 140 bp, Artificial Sequence
  Synthetic
atacgccatgctgggtctccagtcttaggagtttcaattctgaatcttggacaaaagaggtatactaaaaccacatactggtgggatgggctccaatcttctgatgatttcgctctaatacgtacttgggagtcggccat

SEQ ID NO: 426440 - DNA, 140 bp, Artificial Sequence
  Synthetic
atggccgactcccaagtacgtattagagcgaaatcatcagaagattggagcccatcccaccagtatgtggttttagtatacctcttttgtccaagattcagaattgaaactcctaagactggagacccagcatggcgtat

SEQ ID NO: 426441 - DNA, 140 bp, Artificial Sequence
  Synthetic
atacgccatgctgggtctccaggactgcaataggccaagtgtcaagacccatgtttctgtacattagaaccaatgggacctccaagattaagatgaaatggggtatggaaatgaggcgctcgtacttgggagtcggccat

SEQ ID NO: 426442 - DNA, 140 bp, Artificial Sequence
  Synthetic
atggccgactcccaagtacgagcgcctcatttccataccccatttcatcttaatcttggaggtcccattggttctaatgtacagaaacatgggtcttgacacttggcctattgcagtcctggagacccagcatggcgtat

SEQ ID NO: 426443 - DNA, 140 bp, Artificial Sequence
  Synthetic
atacgccatgctgggtctcctaaaccgaactgggacatttgagttcacaagttttttctaccgctatggatttgtagccaatttcagtatggaattgcccagctttggggtatctggggtcgtacttgggagtcggccat

SEQ ID NO: 426444 - DNA, 140 bp, Artificial Sequence
  Synthetic
atggccgactcccaagtacgaccccagataccccaaagctgggcaattccatactgaaattggctacaaatccatagcggtagaaaaaacttgtgaactcaaatgtcccagttcggtttaggagacccagcatggcgtat

SEQ ID NO: 426445 - DNA, 140 bp, Artificial Sequence
  Synthetic
aggccctggctgctgatatgtttgtagccaatttcagtatggaattgcccagctttggggtatctggggtcaatgaatcagctgacatgagcattggggttacggtgatcaagaacaatagaccttttgggacagcggtg

SEQ ID NO: 426446 - DNA, 140 bp, Artificial Sequence
  Synthetic
caccgctgtcccaaaaggtctattgttcttgatcaccgtaaccccaatgctcatgtcagctgattcattgaccccagataccccaaagctgggcaattccatactgaaattggctacaaacatatcagcagccagggcct

SEQ ID NO: 426447 - DNA, 140 bp, Artificial Sequence
  Synthetic
aggccctggctgctgatatgtagggcaagaatcaaaaccaggctgttcactataagacaagaaatggccagcaggggtttatgggattcctttcgtcaatccgagagaggcgaagagacagaccttttgggacagcggtg

SEQ ID NO: 426448 - DNA, 140 bp, Artificial Sequence
  Synthetic
caccgctgtcccaaaaggtctgtctcttcgcctctctcggattgacgaaaggaatcccataaacccctgctggccatttcttgtcttatagtgaacagcctggttttgattcttgccctacatatcagcagccagggcct

SEQ ID NO: 426449 - DNA, 140 bp, Artificial Sequence
  Synthetic
atacgccatgctgggtctccttcatcaaggactacagatacacatatcggtgtcacaggggtgatacacagatccaaacgaggagatcattcgagttaaagaggctatgggaacagaccccgtacttgggagtcggccat

SEQ ID NO: 426450 - DNA, 140 bp, Artificial Sequence
  Synthetic
atggccgactcccaagtacggggtctgttcccatagcctctttaactcgaatgatctcctcgtttggatctgtgtatcacccctgtgacaccgatatgtgtatctgtagtccttgatgaaggagacccagcatggcgtat

SEQ ID NO: 426451 - DNA, 140 bp, Artificial Sequence
  Synthetic
aggccctggctgctgatatggatccaaacgaggagatcattcgagttaaagaggctatgggaacagacccgttcaaaggcaggactgttggtctcagatggaggaccaaacctgtacaacgaccttttgggacagcggtg

SEQ ID NO: 426452 - DNA, 140 bp, Artificial Sequence
  Synthetic
caccgctgtcccaaaaggtcgttgtacaggtttggtcctccatctgagaccaacagtcctgcctttgaacgggtctgttcccatagcctctttaactcgaatgatctcctcgtttggatccatatcagcagccagggcct

SEQ ID NO: 426453 - DNA, 140 bp, Artificial Sequence
  Synthetic
atacgccatgctgggtctccagcagagggcatctgcagggcagatcagcgttcaacccactttttcggtacagagaaaccttcccttcgaaagagcgaccattatggcagcatttacaggcgtacttgggagtcggccat

SEQ ID NO: 426454 - DNA, 140 bp, Artificial Sequence
  Synthetic
atggccgactcccaagtacgcctgtaaatgctgccataatggtcgctctttcgaagggaaggtttctctgtaccgaaaaagtgggttgaacgctgatctgccctgcagatgccctctgctggagacccagcatggcgtat

SEQ ID NO: 426455 - DNA, 140 bp, Artificial Sequence
  Synthetic
aggccctggctgctgatatggataacaaagaaggggacttcatatccaaaactcagcaaatcatacacgaacaataaggggaaagaagtgctcgtgctctggggagtgcaccatcctccggaccttttgggacagcggtg

SEQ ID NO: 426456 - DNA, 140 bp, Artificial Sequence
  Synthetic
caccgctgtcccaaaaggtccggaggatggtgcactccccagagcacgagcacttctttccccttattgttcgtgtatgatttgctgagttttggatatgaagtccccttctttgttatccatatcagcagccagggcct

SEQ ID NO: 426457 - DNA, 140 bp, Artificial Sequence
  Synthetic
atacgccatgctgggtctccccctaagagaaaccgttctatcctcaataccagccaaagggggattcttgaagatgaacagatgtaccaaaagtgctgtaatctattcgaaaagttttttcgtacttgggagtcggccat

SEQ ID NO: 426458 - DNA, 140 bp, Artificial Sequence
  Synthetic
atggccgactcccaagtacgaaaaaacttttcgaatagattacagcacttttggtacatctgttcatcttcaagaatccccctttggctggtattgaggatagaacggtttctcttagggggagacccagcatggcgtat

SEQ ID NO: 426459 - DNA, 140 bp, Artificial Sequence
  Synthetic
atacgccatgctgggtctccagatcgaatggtctaacagctaatgaatcaggaaggctaatagattttctcaaggatgtgatggagtcaatggataaagaagaaatggaaataataacgccgtacttgggagtcggccat

SEQ ID NO: 426460 - DNA, 140 bp, Artificial Sequence
  Synthetic
atggccgactcccaagtacggcgttattatttccatttcttctttatccattgactccatcacatccttgagaaaatctattagccttcctgattcattagctgttagaccattcgatctggagacccagcatggcgtat

SEQ ID NO: 426461 - DNA, 140 bp, Artificial Sequence
  Synthetic
aggccctggctgctgatatggcaaggatcaactctcccgaggagatctggagctgcaggtgcagcagtgaaggggatagggacaatggtgatggaactgattcggatgataaaacgaggggaccttttgggacagcggtg

SEQ ID NO: 426462 - DNA, 140 bp, Artificial Sequence
  Synthetic
caccgctgtcccaaaaggtcccctcgttttatcatccgaatcagttccatcaccattgtccctatccccttcactgctgcacctgcagctccagatctcctcgggagagttgatccttgccatatcagcagccagggcct

SEQ ID NO: 426463 - DNA, 140 bp, Artificial Sequence
  Synthetic
aggccctggctgctgatatgatgaagactatcattgcttttagctgcattttatgtctgattttcgctcaaaaacttcccggaagtgacaacagcatggcaacgctgtgcctgggacaccgaccttttgggacagcggtg

SEQ ID NO: 426464 - DNA, 140 bp, Artificial Sequence
  Synthetic
caccgctgtcccaaaaggtcggtgtcccaggcacagcgttgccatgctgttgtcacttccgggaagtttttgagcgaaaatcagacataaaatgcagctaaaagcaatgatagtcttcatcatatcagcagccagggcct

SEQ ID NO: 426465 - DNA, 140 bp, Artificial Sequence
  Synthetic
aggccctggctgctgatatgcgagatactaacaaaaaccactgtagaccatatggccataatcaaaaaatacacatcaggaagacaggagaagaatccttccctcagaatgaaatggatggaccttttgggacagcggtg

SEQ ID NO: 426466 - DNA, 140 bp, Artificial Sequence
  Synthetic
caccgctgtcccaaaaggtccatccatttcattctgagggaaggattcttctcctgtcttcctgatgtgtattttttgattatggccatatggtctacagtggtttttgttagtatctcgcatatcagcagccagggcct

SEQ ID NO: 426467 - DNA, 140 bp, Artificial Sequence
  Synthetic
atacgccatgctgggtctccacacatcaggaagacaggagaagaatccttccctcagaatgaaatggatgatggcaatgaagtatccaatcacagcagacaagagaataatggatatgatcgtacttgggagtcggccat

SEQ ID NO: 426468 - DNA, 140 bp, Artificial Sequence
  Synthetic
atggccgactcccaagtacgatcatatccattattctcttgtctgctgtgattggatacttcattgccatcatccatttcattctgagggaaggattcttctcctgtcttcctgatgtgtggagacccagcatggcgtat

SEQ ID NO: 426469 - DNA, 140 bp, Artificial Sequence
  Synthetic
atacgccatgctgggtctccccgggtcagacagagtgatggtgtcccctctagctgtgacttggtggaacaggaatggaccgacaacaagtacagtccattaccccaaagtttacaaaaccgtacttgggagtcggccat

SEQ ID NO: 426470 - DNA, 140 bp, Artificial Sequence
  Synthetic
atggccgactcccaagtacggttttgtaaactttggggtaatggactgtacttgttgtcggtccattcctgttccaccaagtcacagctagaggggacaccatcactctgtctgacccggggagacccagcatggcgtat

SEQ ID NO: 426471 - DNA, 140 bp, Artificial Sequence
  Synthetic
aggccctggctgctgatatgaggaatggaccgacaacaagtacagtccattaccccaaagtttacaaaacatattttgagaaggttgagaggttaaaacatggaaccttcggtcccgttcgaccttttgggacagcggtg

SEQ ID NO: 426472 - DNA, 140 bp, Artificial Sequence
  Synthetic
caccgctgtcccaaaaggtcgaacgggaccgaaggttccatgttttaacctctcaaccttctcaaaatatgttttgtaaactttggggtaatggactgtacttgttgtcggtccattcctcatatcagcagccagggcct

SEQ ID NO: 426473 - DNA, 140 bp, Artificial Sequence
  Synthetic
aggccctggctgctgatatgcgctgcagacaaagaatctactcaaaaggctatagacggagtcaccaataaggtcaattcgatcattgacaaaatgaacactcagtttgaggctgtaggagaccttttgggacagcggtg

SEQ ID NO: 426474 - DNA, 140 bp, Artificial Sequence
  Synthetic
caccgctgtcccaaaaggtctcctacagcctcaaactgagtgttcattttgtcaatgatcgaattgaccttattggtgactccgtctatagccttttgagtagattctttgtctgcagcgcatatcagcagccagggcct

SEQ ID NO: 426475 - DNA, 140 bp, Artificial Sequence
  Synthetic
atacgccatgctgggtctcctttcccaaatgaagtgggagctagaatattgacatcagagtctcaattgacaataacgaaggagaaaaaagaagagctccaggattgtaaaattgcccctcgtacttgggagtcggccat

SEQ ID NO: 426476 - DNA, 140 bp, Artificial Sequence
  Synthetic
atggccgactcccaagtacgaggggcaattttacaatcctggagctcttcttttttctccttcgttattgtcaattgagactctgatgtcaatattctagctcccacttcatttgggaaaggagacccagcatggcgtat

SEQ ID NO: 426477 - DNA, 140 bp, Artificial Sequence
  Synthetic
atacgccatgctgggtctcccatgcagatcttagtgcaaaagaagcacaagatgttatcatggaggtggtcttcccaaatgaagtgggtgctagaatactgacttcagagtcgcaattgacgtacttgggagtcggccat

SEQ ID NO: 426478 - DNA, 140 bp, Artificial Sequence
  Synthetic
atggccgactcccaagtacgtcaattgcgactctgaagtcagtattctagcacccacttcatttgggaagaccacctccatgataacatcttgtgcttcttttgcactaagatctgcatgggagacccagcatggcgtat

SEQ ID NO: 426479 - DNA, 140 bp, Artificial Sequence
  Synthetic
aggccctggctgctgatatgcttcccaaatgaagtgggtgctagaatactgacttcagagtcgcaattgacaataacaaaggagaaaaaagaagagctccaagattgtaggattgcccctgaccttttgggacagcggtg

SEQ ID NO: 426480 - DNA, 140 bp, Artificial Sequence
  Synthetic
caccgctgtcccaaaaggtcaggggcaatcctacaatcttggagctcttcttttttctcctttgttattgtcaattgcgactctgaagtcagtattctagcacccacttcatttgggaagcatatcagcagccagggcct

SEQ ID NO: 426481 - DNA, 140 bp, Artificial Sequence
  Synthetic
aggccctggctgctgatatgctagatctagtagaggactattcggggccatagcaggatttatagagggaggttggtcaggactagttgctggttggtatggattccagcattcaaatgagaccttttgggacagcggtg

SEQ ID NO: 426482 - DNA, 140 bp, Artificial Sequence
  Synthetic
caccgctgtcccaaaaggtctcatttgaatgctggaatccataccaaccagcaactagtcctgaccaacctccctctataaatcctgctatggccccgaatagtcctctactagatctagcatatcagcagccagggcct

SEQ ID NO: 426483 - DNA, 140 bp, Artificial Sequence
  Synthetic
atacgccatgctgggtctccatagtggagcggattcttgatgaggaacctgatgaggcacttaaaatgccgacttcacgctacctaactgaaatgactctcgaagagatgtcaagggactcgtacttgggagtcggccat

SEQ ID NO: 426484 - DNA, 140 bp, Artificial Sequence
  Synthetic
atggccgactcccaagtacgagtcccttgacatctcttcgagagtcatttcagttaggtagcgtgaagtcggcattttaagtgcctcatcaggttcctcatcaagaatccgctccactatggagacccagcatggcgtat

SEQ ID NO: 426485 - DNA, 140 bp, Artificial Sequence
  Synthetic
atacgccatgctgggtctccatggaccaggcaataatggataaaaccatcatactgaaagcaaacttcagtgtgatttttgaccggttagagaccctaatactactcagagctttcacagcgtacttgggagtcggccat

SEQ ID NO: 426486 - DNA, 140 bp, Artificial Sequence
  Synthetic
atggccgactcccaagtacgctgtgaaagctctgagtagtattagggtctctaaccggtcaaaaatcacactgaagtttgctttcagtatgatggttttatccattattgcctggtccatggagacccagcatggcgtat

SEQ ID NO: 426487 - DNA, 140 bp, Artificial Sequence
  Synthetic
atacgccatgctgggtctccgtcacagcacgcaaattggtggagtaaggatggtggacatccttaggcaaaacccaactgaggagcaagctgtggatatatgtaaagcagcaataggtttcgtacttgggagtcggccat

SEQ ID NO: 426488 - DNA, 140 bp, Artificial Sequence
  Synthetic
atggccgactcccaagtacgaaacctattgctgctttacatatatccacagcttgctcctcagttgggttttgcctaaggatgtccaccatccttactccaccaatttgcgtgctgtgacggagacccagcatggcgtat

SEQ ID NO: 426489 - DNA, 140 bp, Artificial Sequence
  Synthetic
aggccctggctgctgatatggcaggagtcctaagaacaaataaaacatttcagaatgtgagccctctatggataggagaatgccctaaatatgtaaaaagtgaaagtctgaggcttgcaagaccttttgggacagcggtg

SEQ ID NO: 426490 - DNA, 140 bp, Artificial Sequence
  Synthetic
caccgctgtcccaaaaggtcttgcaagcctcagactttcactttttacatatttagggcattctcctatccatagagggctcacattctgaaatgttttatttgttcttaggactcctgccatatcagcagccagggcct

SEQ ID NO: 426491 - DNA, 140 bp, Artificial Sequence
  Synthetic
aggccctggctgctgatatgactggagaggaaatggccaccaaagcggactatactcttgatgaagagagcagagcaagaatcaaaaccaggctgttcactataaggcaagaaatggccagaccttttgggacagcggtg

SEQ ID NO: 426492 - DNA, 140 bp, Artificial Sequence
  Synthetic
caccgctgtcccaaaaggtctggccatttcttgccttatagtgaacagcctggttttgattcttgctctgctctcttcatcaagagtatagtccgctttggtggccatttcctctccagtcatatcagcagccagggcct

SEQ ID NO: 426493 - DNA, 140 bp, Artificial Sequence
  Synthetic
atacgccatgctgggtctccgtggatcatccgtcaagaaggaagaagaagtgctcaccggcaacctccaaacactgaaaatacaagtacatgaagggtacgaggaattcacaatggtgggcgtacttgggagtcggccat

SEQ ID NO: 426494 - DNA, 140 bp, Artificial Sequence
  Synthetic
atggccgactcccaagtacgcccaccattgtgaattcctcgtacccttcatgtacttgtattttcagtgtttggaggttgccggtgagcacttcttcttccttcttgacggatgatccacggagacccagcatggcgtat

SEQ ID NO: 426495 - DNA, 140 bp, Artificial Sequence
  Synthetic
atacgccatgctgggtctcctgatagtaagcggaagagatgaacaatcaatcgctgaagcaatcattgtagcaatggtattctcacaggaggattgcatgataaaagcagtccgaggtgacgtacttgggagtcggccat

SEQ ID NO: 426496 - DNA, 140 bp, Artificial Sequence
  Synthetic
atggccgactcccaagtacgtcacctcggactgcttttatcatgcaatcctcctgtgagaataccattgctacaatgattgcttcagcgattgattgttcatctcttccgcttactatcaggagacccagcatggcgtat

SEQ ID NO: 426497 - DNA, 140 bp, Artificial Sequence
  Synthetic
aggccctggctgctgatatggcaatggtattctcacaggaggattgcatgataaaagcagtccgaggtgatctaaatttcgtaaacagagcaaatcaaagattgaaccccatgcatcaacgaccttttgggacagcggtg

SEQ ID NO: 426498 - DNA, 140 bp, Artificial Sequence
  Synthetic
caccgctgtcccaaaaggtcgttgatgcatggggttcaatctttgatttgctctgtttacgaaatttagatcacctcggactgcttttatcatgcaatcctcctgtgagaataccattgccatatcagcagccagggcct

SEQ ID NO: 426499 - DNA, 140 bp, Artificial Sequence
  Synthetic
aggccctggctgctgatatgcaaaccctggccatgcagatctcagtgccaaggaggcacaggatgtgattatggaagttgttttcccaaatgaagtgggggcaagaatactgacatcagagaccttttgggacagcggtg

SEQ ID NO: 426500 - DNA, 140 bp, Artificial Sequence
  Synthetic
caccgctgtcccaaaaggtctctgatgtcagtattcttgcccccacttcatttgggaaaacaacttccataatcacatcctgtgcctccttggcactgagatctgcatggccagggtttgcatatcagcagccagggcct

SEQ ID NO: 426501 - DNA, 140 bp, Artificial Sequence
  Synthetic
atacgccatgctgggtctccgttgaaactattgataatgtcatgggaatgatcggaatattgcctgacatgacaccaagcacagaggtgtcactgagggggataagggttagtaagatggcgtacttgggagtcggccat

SEQ ID NO: 426502 - DNA, 140 bp, Artificial Sequence
  Synthetic
atggccgactcccaagtacgccatcttactaacccttatccccctcagtgacacctctgtgcttggtgtcatgtcaggcaatattccgatcattcccatgacattatcaatagtttcaacggagacccagcatggcgtat

SEQ ID NO: 426503 - DNA, 140 bp, Artificial Sequence
  Synthetic
aggccctggctgctgatatgcacacaagtgggaaaagtactgtgttctcgagataggagacatgctcctacggactgcaataggccaagtgtcaaggcccatgttcctgtatgtgagaacgaccttttgggacagcggtg

SEQ ID NO: 426504 - DNA, 140 bp, Artificial Sequence
  Synthetic
caccgctgtcccaaaaggtcgttctcacatacaggaacatgggccttgacacttggcctattgcagtccgtaggagcatgtctcctatctcgagaacacagtacttttcccacttgtgtgcatatcagcagccagggcct

SEQ ID NO: 426505 - DNA, 140 bp, Artificial Sequence
  Synthetic
aggccctggctgctgatatgatggagagaataaaagaactaagagatctaatgtcacagtctcgcactcgcgagatactcaccaaaaccactgttgaccacatggccataataaaaaaatgaccttttgggacagcggtg

SEQ ID NO: 426506 - DNA, 140 bp, Artificial Sequence
  Synthetic
caccgctgtcccaaaaggtcatttttttattatggccatgtggtcaacagtggttttggtgagtatctcgcgagtgcgagactgtgacattagatctcttagttcttttattctctccatcatatcagcagccagggcct

SEQ ID NO: 426507 - DNA, 140 bp, Artificial Sequence
  Synthetic
atacgccatgctgggtctccggttagcgaaacacaggggacagagaagctgacaataacatattcatcatcaatgatgtgggagatcaacggtccagagtcagtgcttgtcaacacttatcgtacttgggagtcggccat

SEQ ID NO: 426508 - DNA, 140 bp, Artificial Sequence
  Synthetic
atggccgactcccaagtacgataagtgttgacaagcactgactctggaccgttgatctcccacatcattgatgatgaatatgttattgtcagcttctctgtcccctgtgtttcgctaaccggagacccagcatggcgtat

SEQ ID NO: 426509 - DNA, 140 bp, Artificial Sequence
  Synthetic
aggccctggctgctgatatgcaatgatgtgggagatcaacggtccagagtcagtgcttgtcaacacttatcaatggatcatcagaaattgggagactgtaaagattcaatggtctcaagagaccttttgggacagcggtg

SEQ ID NO: 426510 - DNA, 140 bp, Artificial Sequence
  Synthetic
caccgctgtcccaaaaggtctcttgagaccattgaatctttacagtctcccaatttctgatgatccattgataagtgttgacaagcactgactctggaccgttgatctcccacatcattgcatatcagcagccagggcct

SEQ ID NO: 426511 - DNA, 140 bp, Artificial Sequence
  Synthetic
atacgccatgctgggtctccatggaagcaagattatttgtattattctgtgcattcactacactaaaagctgacaccatttgtgtaggctaccacgccaacaattccacagacactgtcgcgtacttgggagtcggccat

SEQ ID NO: 426512 - DNA, 140 bp, Artificial Sequence
  Synthetic
atggccgactcccaagtacgcgacagtgtctgtggaattgttggcgtggtagcctacacaaatggtgtcagcttttagtgtagtgaatgcacagaataatacaaataatcttgcttccatggagacccagcatggcgtat

SEQ ID NO: 426513 - DNA, 140 bp, Artificial Sequence
  Synthetic
aggccctggctgctgatatgtccttagacagaacccaactgaggaacaagccgtagacatatgcaaggcagcaatagggttgaggatcagctcatctttcagttttggtgggttcactttgaccttttgggacagcggtg

SEQ ID NO: 426514 - DNA, 140 bp, Artificial Sequence
  Synthetic
caccgctgtcccaaaaggtcaaagtgaacccaccaaaactgaaagatgagctgatcctcaaccctattgctgccttgcatatgtctacggcttgttcctcagttgggttctgtctaaggacatatcagcagccagggcct

SEQ ID NO: 426515 - DNA, 140 bp, Artificial Sequence
  Synthetic
atacgccatgctgggtctcctgcctaaagctgccagaggccaatacagtggatttgtgagaacactattccaacaaatgcgtgacgtactgggaacgtttgatactgtccagataataaacgtacttgggagtcggccat

SEQ ID NO: 426516 - DNA, 140 bp, Artificial Sequence
  Synthetic
atggccgactcccaagtacgtttattatctggacagtatcaaacgttcccagtacgtcacgcatttgttggaatagtgttctcacaaatccactgtattggcctctggcagctttaggcaggagacccagcatggcgtat

SEQ ID NO: 426517 - DNA, 140 bp, Artificial Sequence
  Synthetic
aggccctggctgctgatatgcaacaaatgcgtgacgtactgggaacgtttgatactgtccagataataaagctgctaccctttgctgcagccccaccggagcaaagcagaatgcaattttgaccttttgggacagcggtg

SEQ ID NO: 426518 - DNA, 140 bp, Artificial Sequence
  Synthetic
caccgctgtcccaaaaggtcaaaattgcattctgctttgctccggtggggctgcagcaaagggtagcagctttattatctggacagtatcaaacgttcccagtacgtcacgcatttgttgcatatcagcagccagggcct

SEQ ID NO: 426519 - DNA, 140 bp, Artificial Sequence
  Synthetic
atacgccatgctgggtctccggtaactctccagtgttcaactacagtaaagcaaccaaaaggttgacagtcctggggaaggatgcaggcgcattggttgaggatccagaggagggaacagcgtacttgggagtcggccat

SEQ ID NO: 426520 - DNA, 140 bp, Artificial Sequence
  Synthetic
atggccgactcccaagtacgctgttccctcctctggatcctcaaccaatgcgcctgcatccttccccaggactgtcaaccttttggttgctttactgtagttgaacactggagagttaccggagacccagcatggcgtat

SEQ ID NO: 426521 - DNA, 140 bp, Artificial Sequence
  Synthetic
atacgccatgctgggtctcctacctaaggctgccagaggccaatacagtggatttgttagaacattgttccaacagatgcgcgatgtgttggggacctttgatactgtccagataatcaacgtacttgggagtcggccat

SEQ ID NO: 426522 - DNA, 140 bp, Artificial Sequence
  Synthetic
atggccgactcccaagtacgttgattatctggacagtatcaaaggtccccaacacatcgcgcatctgttggaacaatgttctaacaaatccactgtattggcctctggcagccttaggtaggagacccagcatggcgtat

SEQ ID NO: 426523 - DNA, 140 bp, Artificial Sequence
  Synthetic
aggccctggctgctgatatgatcctgtcacctctgactaaggggattttagggtttgtgttcacgctcaccgtgcccagtgagcgaggactgcagcgtagacgctttgttcagaatgcccgaccttttgggacagcggtg

SEQ ID NO: 426524 - DNA, 140 bp, Artificial Sequence
  Synthetic
caccgctgtcccaaaaggtcgggcattctgaacaaagcgtctacgctgcagtcctcgctcactgggcacggtgagcgtgaacacaaaccctaaaatccccttagtcagaggtgacaggatcatatcagcagccagggcct

SEQ ID NO: 426525 - DNA, 140 bp, Artificial Sequence
  Synthetic
atacgccatgctgggtctcctggtcgcaagatcccacaatgttatacaataaaatggaatttgaaccatttcagtctcttgtccctaaggcaaccagaagccggtacagtggattcgtaacgtacttgggagtcggccat

SEQ ID NO: 426526 - DNA, 140 bp, Artificial Sequence
  Synthetic
atggccgactcccaagtacgttacgaatccactgtaccggcttctggttgccttagggacaagagactgaaatggttcaaattccattttattgtataacattgtgggatcttgcgaccaggagacccagcatggcgtat

SEQ ID NO: 426527 - DNA, 140 bp, Artificial Sequence
  Synthetic
aggccctggctgctgatatgagaacgccagaatgccaccgagatcagggcttctgttggaagaatggttggtggaattgggaggttttacatacagatgtgcactgaacttaaactcagcgaccttttgggacagcggtg

SEQ ID NO: 426528 - DNA, 140 bp, Artificial Sequence
  Synthetic
caccgctgtcccaaaaggtcgctgagtttaagttcagtgcacatctgtatgtaaaacctcccaattccaccaaccattcttccaacagaagccctgatctcggtggcattctggcgttctcatatcagcagccagggcct

SEQ ID NO: 426529 - DNA, 140 bp, Artificial Sequence
  Synthetic
aggccctggctgctgatatggaatgggaacagtaacaacagaagtggctttgggcctagtgtgtgccacttgtgagcaaattgctgattcacagcataggtctcatagacaaatggcgacgaccttttgggacagcggtg

SEQ ID NO: 426530 - DNA, 140 bp, Artificial Sequence
  Synthetic
caccgctgtcccaaaaggtcgtcgccatttgtctatgagacctatgctgtgaatcagcaatttgctcacaagtggcacacactaggcccaaagccacttctgttgttactgttcccattccatatcagcagccagggcct

SEQ ID NO: 426531 - DNA, 140 bp, Artificial Sequence
  Synthetic
atacgccatgctgggtctccccacagctaaagctatggagcagatggcaggatcaagtgagcaggcagcagaagcaatggaggttgctagtcaggctaggcaaatggtgcaggcaatgagcgtacttgggagtcggccat

SEQ ID NO: 426532 - DNA, 140 bp, Artificial Sequence
  Synthetic
atggccgactcccaagtacgctcattgcctgcaccatttgcctagcctgactagcaacctccattgcttctgctgcctgctcacttgatcctgccatctgctccatagctttagctgtggggagacccagcatggcgtat

SEQ ID NO: 426533 - DNA, 140 bp, Artificial Sequence
  Synthetic
atacgccatgctgggtctccaccggctccgccgagaccagaagtctttaaaggggaggagcagcactcttggcatggacatcgaggcagccacgtgtgctggaaagcggatagttgagagcgtacttgggagtcggccat

SEQ ID NO: 426534 - DNA, 140 bp, Artificial Sequence
  Synthetic
atggccgactcccaagtacgctctcaactatccgctttccagcacacgtggctgcctcgatgtccatgccaagagtgctgctcctcccctttaaagacttctggtctcggcggagccggtggagacccagcatggcgtat

SEQ ID NO: 426535 - DNA, 140 bp, Artificial Sequence
  Synthetic
atacgccatgctgggtctccgacaattggtactcatcctagctccagtgctggtctgagagatgatcttcttgaaaatttgcaggcataccagaaacggatgggagtgcaaatgcagcgacgtacttgggagtcggccat

SEQ ID NO: 426536 - DNA, 140 bp, Artificial Sequence
  Synthetic
atggccgactcccaagtacgtcgctgcatttgcactcccatccgtttctggtatgcctgcaaattttcaagaagatcatctctcagaccagcactggagctaggatgagtaccaattgtcggagacccagcatggcgtat

SEQ ID NO: 426537 - DNA, 140 bp, Artificial Sequence
  Synthetic
atacgccatgctgggtctccgacaagagatatggcccagcattaagcatcaatgaactgagcaatcttgcaaaaggagagaaagctaatgtgctaattgggcaaggggacgtagtgttggcgtacttgggagtcggccat

SEQ ID NO: 426538 - DNA, 140 bp, Artificial Sequence
  Synthetic
atggccgactcccaagtacgccaacactacgtccccttgcccaattagcacattagctttctctccttttgcaagattgctcagttcattgatgcttaatgctgggccatatctcttgtcggagacccagcatggcgtat

SEQ ID NO: 426539 - DNA, 140 bp, Artificial Sequence
  Synthetic
atacgccatgctgggtctccatgaacccaaatcagaagataataacaatcggttcagtctctctaaccattgcaacagtatgtttcctcatgcagatcgccatcttaacaatgactatgacgtacttgggagtcggccat

SEQ ID NO: 426540 - DNA, 140 bp, Artificial Sequence
  Synthetic
atggccgactcccaagtacgtcatagtcattgttaagatggcgatctgcatgaggaaacatactgttgcaatggttagagagactgaaccgattgttattatcttctgatttgggttcatggagacccagcatggcgtat

SEQ ID NO: 426541 - DNA, 140 bp, Artificial Sequence
  Synthetic
aggccctggctgctgatatgtgcaacagtatgtttcctcatgcagatcgccatcttaacaatgactatgacactgcatttcaaccagaacgaatgcagcattcccgccaacaaccaagtggaccttttgggacagcggtg

SEQ ID NO: 426542 - DNA, 140 bp, Artificial Sequence
  Synthetic
caccgctgtcccaaaaggtccacttggttgttggcgggaatgctgcattcgttctggttgaaatgcagtgtcatagtcattgttaagatggcgatctgcatgaggaaacatactgttgcacatatcagcagccagggcct

SEQ ID NO: 426543 - DNA, 140 bp, Artificial Sequence
  Synthetic
atacgccatgctgggtctccgtgccatgtgaaccaaccataattgagaagagcatcgactacagagactggtcaaaaccgcaatgtcgaatcacagggtttgctcctttttccaaggacacgtacttgggagtcggccat

SEQ ID NO: 426544 - DNA, 140 bp, Artificial Sequence
  Synthetic
atggccgactcccaagtacgtgtccttggaaaaaggagcaaaccctgtgattcgacattgcggttttgaccagtctctgtagtcgatgctcttctcaattatggttggttcacatggcacggagacccagcatggcgtat

SEQ ID NO: 426545 - DNA, 140 bp, Artificial Sequence
  Synthetic
atacgccatgctgggtctcctacgtgtcatgtgacactagtaaatgctatcaatttgcacttgggcaaggaaccacgctggacaacaaacattcaaatggcacaatacatgatagaaccccgtacttgggagtcggccat

SEQ ID NO: 426546 - DNA, 140 bp, Artificial Sequence
  Synthetic
atggccgactcccaagtacggggttctatcatgtattgtgccatttgaatgtttgttgtccagcgtggttccttgcccaagtgcaaattgatagcatttactagtgtcacatgacacgtaggagacccagcatggcgtat

SEQ ID NO: 426547 - DNA, 140 bp, Artificial Sequence
  Synthetic
atacgccatgctgggtctccatggagagaataaaagaactaagagatctaatgtcacagtcccgcactcgcgagatactcactaagaccactgtggaccatatggccataatcaaaaagtcgtacttgggagtcggccat

SEQ ID NO: 426548 - DNA, 140 bp, Artificial Sequence
  Synthetic
atggccgactcccaagtacgactttttgattatggccatatggtccacagtggtcttagtgagtatctcgcgagtgcgggactgtgacattagatctcttagttcttttattctctccatggagacccagcatggcgtat

SEQ ID NO: 426549 - DNA, 140 bp, Artificial Sequence
  Synthetic
atacgccatgctgggtctccagcatggttgcacatctgtattactggggatgataaaaatgcgactgctattttcatctatgatgggatgctcgttgatagtataggttcatggtctcaacgtacttgggagtcggccat

SEQ ID NO: 426550 - DNA, 140 bp, Artificial Sequence
  Synthetic
atggccgactcccaagtacgttgagaccatgaacctatactatcaacgagcatcccatcatagatgaaaatagcagtcgcatttttatcatccccagtaatacagatgtgcaaccatgctggagacccagcatggcgtat

SEQ ID NO: 426551 - DNA, 140 bp, Artificial Sequence
  Synthetic
aggccctggctgctgatatgatgagtcttctaaccgaggtcgaaacgtacgttctctctatcgtcccgtcaggccccctcaaagccgagatcgcgcagagacttgaagatgtgtttgcaggaccttttgggacagcggtg

SEQ ID NO: 426552 - DNA, 140 bp, Artificial Sequence
  Synthetic
caccgctgtcccaaaaggtcctgcaaacacatcttcaagtctctgcgcgatctcggctttgagggggcctgacgggacgatagagagaacgtacgtttcgacctcggttagaagactcatcatatcagcagccagggcct

SEQ ID NO: 426553 - DNA, 140 bp, Artificial Sequence
  Synthetic
atacgccatgctgggtctccaatattctcagaactcaggagtcagagtgtgtttgcatcaatgggacttgcacagtagtaatgactgatggaaacgcatcaggaaaagccgacactagaacgtacttgggagtcggccat

SEQ ID NO: 426554 - DNA, 140 bp, Artificial Sequence
  Synthetic
atggccgactcccaagtacgttctagtgtcggcttttcctgatgcgtttccatcagtcattactactgtgcaagtcccattgatgcaaacacactctgactcctgagttctgagaatattggagacccagcatggcgtat

SEQ ID NO: 426555 - DNA, 140 bp, Artificial Sequence
  Synthetic
atacgccatgctgggtctccagtgctcagcatatagaggaatgttcctgttatcctagatacccaaatgtcagatgtgtatgcagagacaactggaagggttctaataggcccgttatagcgtacttgggagtcggccat

SEQ ID NO: 426556 - DNA, 140 bp, Artificial Sequence
  Synthetic
atggccgactcccaagtacgctataacgggcctattagaacccttccagttgtctctgcatacacatctgacatttgggtatctaggataacaggaacattcctctatatgctgagcactggagacccagcatggcgtat

SEQ ID NO: 426557 - DNA, 140 bp, Artificial Sequence
  Synthetic
aggccctggctgctgatatgcagatgtgtatgcagagacaactggaagggttctaataggcccgttatagacataaatatggcagattatagcattgattccagttatgtgtgttcaggggaccttttgggacagcggtg

SEQ ID NO: 426558 - DNA, 140 bp, Artificial Sequence
  Synthetic
caccgctgtcccaaaaggtcccctgaacacacataactggaatcaatgctataatctgccatatttatgtctataacgggcctattagaacccttccagttgtctctgcatacacatctgcatatcagcagccagggcct

SEQ ID NO: 426559 - DNA, 140 bp, Artificial Sequence
  Synthetic
atacgccatgctgggtctcctagagatcctaataatgagaagggaaatccaggagtgaaaggatgggcctttgacgatggtgatgatatctggatgggaagaacaatcagtaaagactcgcgtacttgggagtcggccat

SEQ ID NO: 426560 - DNA, 140 bp, Artificial Sequence
  Synthetic
atggccgactcccaagtacgcgagtctttactgattgttcttcccatccagatatcatcaccatcgtcaaaggcccatcctttcactcctggatttcccttctcattattaggatctctaggagacccagcatggcgtat

SEQ ID NO: 426561 - DNA, 140 bp, Artificial Sequence
  Synthetic
aggccctggctgctgatatgttgacgatggtgatgatatctggatgggaagaacaatcagtaaagactcgcgatcaggctatgagacttttagggtcattggtggttggaccattgccaagaccttttgggacagcggtg

SEQ ID NO: 426562 - DNA, 140 bp, Artificial Sequence
  Synthetic
caccgctgtcccaaaaggtcttggcaatggtccaaccaccaatgaccctaaaagtctcatagcctgatcgcgagtctttactgattgttcttcccatccagatatcatcaccatcgtcaacatatcagcagccagggcct

SEQ ID NO: 426563 - DNA, 140 bp, Artificial Sequence
  Synthetic
aggccctggctgctgatatgctacggctaaggccatggagcaaatggcagggtcaagtgagcaggcagcagaggctatggaggttgctagtcaggccagacagatggtgcaggcaatgaggaccttttgggacagcggtg

SEQ ID NO: 426564 - DNA, 140 bp, Artificial Sequence
  Synthetic
caccgctgtcccaaaaggtcctcattgcctgcaccatctgtctggcctgactagcaacctccatagcctctgctgcctgctcacttgaccctgccatttgctccatggccttagccgtagcatatcagcagccagggcct

SEQ ID NO: 426565 - DNA, 140 bp, Artificial Sequence
  Synthetic
atacgccatgctgggtctccctggttactctggcatcttctctgttgaaaacaaaagctgcatcaataggtgtttttatgtggaattgataagaggaaggccgaaggagactagagtatgcgtacttgggagtcggccat

SEQ ID NO: 426566 - DNA, 140 bp, Artificial Sequence
  Synthetic
atggccgactcccaagtacgcatactctagtctccttcggccttcctcttatcaattccacataaaaacacctattgatgcagcttttgttttcaacagagaagatgccagagtaaccagggagacccagcatggcgtat

SEQ ID NO: 426567 - DNA, 140 bp, Artificial Sequence
  Synthetic
atacgccatgctgggtctccgtggacttcaaacagtattgtcgcattttgtggcacttcaggcacctatggaacaggctcatggcctgatggggcgaacatcaatttcatgcctatataacgtacttgggagtcggccat

SEQ ID NO: 426568 - DNA, 140 bp, Artificial Sequence
  Synthetic
atggccgactcccaagtacgttatataggcatgaaattgatgttcgccccatcaggccatgagcctgttccataggtgcctgaagtgccacaaaatgcgacaatactgtttgaagtccacggagacccagcatggcgtat

SEQ ID NO: 426569 - DNA, 140 bp, Artificial Sequence
  Synthetic
atacgccatgctgggtctccatggcgtctcaaggcaccaaacgatcttatgaacagatggaaactggtggggaacgccagaatgctactgagatcagagcatctgtcggaagaatggttgcgtacttgggagtcggccat

SEQ ID NO: 426570 - DNA, 140 bp, Artificial Sequence
  Synthetic
atggccgactcccaagtacgcaaccattcttccgacagatgctctgatctcagtagcattctggcgttccccaccagtttccatctgttcataagatcgtttggtgccttgagacgccatggagacccagcatggcgtat

SEQ ID NO: 426571 - DNA, 140 bp, Artificial Sequence
  Synthetic
aggccctggctgctgatatgggtagtccttaatattctcctacatatagttagcattacagtaacagtgttagttcttcctggaaatggaaataacgggaattgcaatgaaacagtcattgaccttttgggacagcggtg

SEQ ID NO: 426572 - DNA, 140 bp, Artificial Sequence
  Synthetic
caccgctgtcccaaaaggtcaatgactgtttcattgcaattcccgttatttccatttccaggaagaactaacactgttactgtaatgctaactatatgtaggagaatattaaggactacccatatcagcagccagggcct

SEQ ID NO: 426573 - DNA, 140 bp, Artificial Sequence
  Synthetic
atacgccatgctgggtctccgtggaattggaaggttttatatacagatgtgcactgaactcaaactcagtgacaatgaagggaggctgattcaaaacagcataacaatagaaagaatggtcgtacttgggagtcggccat

SEQ ID NO: 426574 - DNA, 140 bp, Artificial Sequence
  Synthetic
atggccgactcccaagtacgaccattctttctattgttatgctgttttgaatcagcctcccttcattgtcactgagtttgagttcagtgcacatctgtatataaaaccttccaattccacggagacccagcatggcgtat

SEQ ID NO: 426575 - DNA, 140 bp, Artificial Sequence
  Synthetic
atacgccatgctgggtctcctctctctgcatttgatgaaaggaggaacagataccttgaagagcatcccagtgcagggaaggacccaaagaaaactggaggcccaatctaccgaaggagacgtacttgggagtcggccat

SEQ ID NO: 426576 - DNA, 140 bp, Artificial Sequence
  Synthetic
atggccgactcccaagtacgtctccttcggtagattgggcctccagttttctttgggtccttccctgcactgggatgctcttcaaggtatctgttcctcctttcatcaaatgcagagagaggagacccagcatggcgtat

SEQ ID NO: 426577 - DNA, 140 bp, Artificial Sequence
  Synthetic
atacgccatgctgggtctccaaggatctggcgtcaagctaataatggagaggacgcgaccgctggtctaacccatatgatgatctggcattccaatctaaatgatgccacataccagagacgtacttgggagtcggccat

SEQ ID NO: 426578 - DNA, 140 bp, Artificial Sequence
  Synthetic
atggccgactcccaagtacgtctctggtatgtggcatcatttagattggaatgccagatcatcatatgggttagaccagcggtcgcgtcctctccattattagcttgacgccagatccttggagacccagcatggcgtat

SEQ ID NO: 426579 - DNA, 140 bp, Artificial Sequence
  Synthetic
atacgccatgctgggtctcccaagagaataatactcaaggcaaacttctctgtcctatttgatcaactggaaacattagtactactgagggctttcacagatgatggcgccattgtagctcgtacttgggagtcggccat

SEQ ID NO: 426580 - DNA, 140 bp, Artificial Sequence
  Synthetic
atggccgactcccaagtacgagctacaatggcgccatcatctgtgaaagccctcagtagtactaatgtttccagttgatcaaataggacagagaagtttgccttgagtattattctcttgggagacccagcatggcgtat

SEQ ID NO: 426581 - DNA, 140 bp, Artificial Sequence
  Synthetic
atacgccatgctgggtctccgcaaggatcaactcttccaaggagatctggagctgctggtgcagcagtaaagggggtcggaacaatggtgatggaactaattcgaatgataaaacgagggcgtacttgggagtcggccat

SEQ ID NO: 426582 - DNA, 140 bp, Artificial Sequence
  Synthetic
atggccgactcccaagtacgccctcgttttatcattcgaattagttccatcaccattgttccgaccccctttactgctgcaccagcagctccagatctccttggaagagttgatccttgcggagacccagcatggcgtat

SEQ ID NO: 426583 - DNA, 140 bp, Artificial Sequence
  Synthetic
aggccctggctgctgatatgaggatgaacagatgtaccagaagtgctgcaacttattcgagaaatttttccctagcagttcatataggagaccggttggaatttctagcatggtggaggcgaccttttgggacagcggtg

SEQ ID NO: 426584 - DNA, 140 bp, Artificial Sequence
  Synthetic
caccgctgtcccaaaaggtcgcctccaccatgctagaaattccaaccggtctcctatatgaactgctagggaaaaatttctcgaataagttgcagcacttctggtacatctgttcatcctcatatcagcagccagggcct

SEQ ID NO: 426585 - DNA, 140 bp, Artificial Sequence
  Synthetic
aggccctggctgctgatatgggcaggagacattctaagaactcaggaatcatcatgcacttgcattcaaggtgaatgttattgggtaatgacggatggaccagcaaacagacaagcacaagaccttttgggacagcggtg

SEQ ID NO: 426586 - DNA, 140 bp, Artificial Sequence
  Synthetic
caccgctgtcccaaaaggtcttgtgcttgtctgtttgctggtccatccgtcattacccaataacattcaccttgaatgcaagtgcatgatgattcctgagttcttagaatgtctcctgcccatatcagcagccagggcct

SEQ ID NO: 426587 - DNA, 140 bp, Artificial Sequence
  Synthetic
atacgccatgctgggtctcccacagagagcaatgatggatcaagtacgtgaaagcagaaatcctggaaatgctgagattgaagatctcatcttcctggcacgatctgcactcatcctgagcgtacttgggagtcggccat

SEQ ID NO: 426588 - DNA, 140 bp, Artificial Sequence
  Synthetic
atggccgactcccaagtacgctcaggatgagtgcagatcgtgccaggaagatgagatcttcaatctcagcatttccaggatttctgctttcacgtacttgatccatcattgctctctgtgggagacccagcatggcgtat

SEQ ID NO: 426589 - DNA, 140 bp, Artificial Sequence
  Synthetic
aggccctggctgctgatatggctgagattgaagatctcatcttcctggcacgatctgcactcatcctgagaggttcagtagcccataagtcctgtctgcctgcatgtgtgtacggacttggaccttttgggacagcggtg

SEQ ID NO: 426590 - DNA, 140 bp, Artificial Sequence
  Synthetic
caccgctgtcccaaaaggtccaagtccgtacacacatgcaggcagacaggacttatgggctactgaacctctcaggatgagtgcagatcgtgccaggaagatgagatcttcaatctcagccatatcagcagccagggcct

SEQ ID NO: 426591 - DNA, 140 bp, Artificial Sequence
  Synthetic
atacgccatgctgggtctcctagggagcaaaagcaggggatactttcattaatcatgaagaccgtcattgctttaagctacattttctgtctggctttcggtcaggatcttccagggaatcgtacttgggagtcggccat

SEQ ID NO: 426592 - DNA, 140 bp, Artificial Sequence
  Synthetic
atggccgactcccaagtacgattccctggaagatcctgaccgaaagccagacagaaaatgtagcttaaagcaatgacggtcttcatgattaatgaaagtatcccctgcttttgctccctaggagacccagcatggcgtat

SEQ ID NO: 426593 - DNA, 140 bp, Artificial Sequence
  Synthetic
atacgccatgctgggtctccattctgcagcatttgaagacctgagagtcttaagtttcatcagagggacaagaatggtcccaaggggacaactatctactagaggagttcaaatagcttccgtacttgggagtcggccat

SEQ ID NO: 426594 - DNA, 140 bp, Artificial Sequence
  Synthetic
atggccgactcccaagtacggaagctatttgaactcctctagtagatagttgtccccttgggaccattcttgtccctctgatgaaacttaagactctcaggtcttcaaatgctgcagaatggagacccagcatggcgtat

SEQ ID NO: 426595 - DNA, 140 bp, Artificial Sequence
  Synthetic
aggccctggctgctgatatggtaaagagcagatcaaaaggcaagtcgtggtcgataacttgaattggtcaggatacagtggttccttcacactaccggtggagttaacaaaaagaaattggaccttttgggacagcggtg

SEQ ID NO: 426596 - DNA, 140 bp, Artificial Sequence
  Synthetic
caccgctgtcccaaaaggtccaatttctttttgttaactccaccggtagtgtgaaggaaccactgtatcctgaccaattcaagttatcgaccacgacttgccttttgatctgctctttaccatatcagcagccagggcct

SEQ ID NO: 426597 - DNA, 140 bp, Artificial Sequence
  Synthetic
  misc_feature (95)..(95): n is a, c, g, or t
  misc_feature (98)..(98): n is a, c, g, or t
  misc_feature (110)..(110): n is a, c, g, or t
  misc_feature (116)..(116): n is a, c, g, or t
aggccctggctgctgatatgatggaagactttgtgcgacaatgcttcaatccaatgatcgtcgagcttgcggaaaaggcaatgaaagaatatggngangatccgaaaatngaaacnaacagaccttttgggacagcggtg

SEQ ID NO: 426598 - DNA, 140 bp, Artificial Sequence
  Synthetic
  misc_feature (25)..(25): n is a, c, g, or t
  misc_feature (31)..(31): n is a, c, g, or t
  misc_feature (43)..(43): n is a, c, g, or t
  misc_feature (46)..(46): n is a, c, g, or t
caccgctgtcccaaaaggtctgttngtttcnattttcggatcntcnccatattctttcattgccttttccgcaagctcgacgatcattggattgaagcattgtcgcacaaagtcttccatcatatcagcagccagggcct

SEQ ID NO: 426599 - DNA, 140 bp, Artificial Sequence
  Synthetic
atacgccatgctgggtctccgattttgaaagaggaatccagcgagacacttagaatgacaattgcatctgtacctacttcgcgctacatttctgacatgaccctcgaggaaatgtcacgacgtacttgggagtcggccat

SEQ ID NO: 426600 - DNA, 140 bp, Artificial Sequence
  Synthetic
atggccgactcccaagtacgtcgtgacatttcctcgagggtcatgtcagaaatgtagcgcgaagtaggtacagatgcaattgtcattctaagtgtctcgctggattcctctttcaaaatcggagacccagcatggcgtat

SEQ ID NO: 426601 - DNA, 140 bp, Artificial Sequence
  Synthetic
atacgccatgctgggtctccaaggcagaacatctgacatgaggactgaaatcataaggatgatggagagtgcaagaccagaagatgtgtctttccaggggcggggtgttttcgagctctccgtacttgggagtcggccat

SEQ ID NO: 426602 - DNA, 140 bp, Artificial Sequence
  Synthetic
atggccgactcccaagtacggagagctcgaaaacaccccgcccctggaaagacacatcttctggtcttgcactctccatcatccttatgatttcagtcctcatgtcagatgttctgccttggagacccagcatggcgtat

SEQ ID NO: 426603 - DNA, 140 bp, Artificial Sequence
  Synthetic
aggccctggctgctgatatgctcgagtagctccattgtgatgtgtggagtagaccatgagattgccgactggtcatggcacgatggagctattcttccttttgacatcgataagatgtaagaccttttgggacagcggtg

SEQ ID NO: 426604 - DNA, 140 bp, Artificial Sequence
  Synthetic
caccgctgtcccaaaaggtcttacatcttatcgatgtcaaaaggaagaatagctccatcgtgccatgaccagtcggcaatctcatggtctactccacacatcacaatggagctactcgagcatatcagcagccagggcct

SEQ ID NO: 426605 - DNA, 140 bp, Artificial Sequence
  Synthetic
aggccctggctgctgatatgctcggacgaaaaggcaacgaacccgatcgtgccttcctttgacatgagtaatgaagggtcttatttcttcggagacaatgcagaggagtatgacaattaagaccttttgggacagcggtg

SEQ ID NO: 426606 - DNA, 140 bp, Artificial Sequence
  Synthetic
caccgctgtcccaaaaggtcttaattgtcatactcctctgcattgtctccgaagaaataagacccttcattactcatgtcaaaggaaggcacgatcgggttcgttgccttttcgtccgagcatatcagcagccagggcct

SEQ ID NO: 426607 - DNA, 140 bp, Artificial Sequence
  Synthetic
atacgccatgctgggtctccatggaaagaatagtaattgcctttgcaatagtcaacattgtcacaagtgaccgtatctgcattggttatcatgcaaacaattcaacaacacaagttgacacgtacttgggagtcggccat

SEQ ID NO: 426608 - DNA, 140 bp, Artificial Sequence
  Synthetic
atggccgactcccaagtacgtgtcaacttgtgttgttgaattgtttgcatgataaccaatgcagatacggtcacttgtgacaatgttgactattgcaaaggcaattactattctttccatggagacccagcatggcgtat

SEQ ID NO: 426609 - DNA, 140 bp, Artificial Sequence
  Synthetic
aggccctggctgctgatatgccgtatctgcattggttatcatgcaaacaattcaacaacacaagttgacacaatcatggagaagaatgtgacggtcacacatgctcaggacatactggaagaccttttgggacagcggtg

SEQ ID NO: 426610 - DNA, 140 bp, Artificial Sequence
  Synthetic
caccgctgtcccaaaaggtcttccagtatgtcctgagcatgtgtgaccgtcacattcttctccatgattgtgtcaacttgtgttgttgaattgtttgcatgataaccaatgcagatacggcatatcagcagccagggcct

SEQ ID NO: 426611 - DNA, 140 bp, Artificial Sequence
  Synthetic
atacgccatgctgggtctccaggagtgggccgacgacaagtacagttcattatccaaaagtttacaaaacatacttcgagaaggttgaaaggttaaaacatggaaccttcggtcctgttccgtacttgggagtcggccat

SEQ ID NO: 426612 - DNA, 140 bp, Artificial Sequence
  Synthetic
atggccgactcccaagtacggaacaggaccgaaggttccatgttttaacctttcaaccttctcgaagtatgttttgtaaacttttggataatgaactgtacttgtcgtcggcccactcctggagacccagcatggcgtat

SEQ ID NO: 426613 - DNA, 140 bp, Artificial Sequence
  Synthetic
atacgccatgctgggtctccagaaggccaatccagccaatgacctctgttacccagggaatttcaacgattatgaagaattgaaacacctattgagcaggataaaccattttgagaaaatcgtacttgggagtcggccat

SEQ ID NO: 426614 - DNA, 140 bp, Artificial Sequence
  Synthetic
atggccgactcccaagtacgattttctcaaaatggtttatcctgctcaataggtgtttcaattcttcataatcgttgaaattccctgggtaacagaggtcattggctggattggccttctggagacccagcatggcgtat

SEQ ID NO: 426615 - DNA, 140 bp, Artificial Sequence
  Synthetic
atacgccatgctgggtctccatgaattcctaaacgtaccggaatggtcatacattgtggaaaaagacagaccagccaatggcctgtgctatccgggaactttcaactattatgaagaactcgtacttgggagtcggccat

SEQ ID NO: 426616 - DNA, 140 bp, Artificial Sequence
  Synthetic
atggccgactcccaagtacgagttcttcataatagttgaaagttcccggatagcacaggccattggctggtctgtctttttccacaatgtatgaccattccggtacgtttaggaattcatggagacccagcatggcgtat

SEQ ID NO: 426617 - DNA, 140 bp, Artificial Sequence
  Synthetic
aggccctggctgctgatatgccagccaatggcctgtgctatccgggaactttcaactattatgaagaactgaagcatttaatgagcagcacaaaccaatttgagaaaattcagatatttcgaccttttgggacagcggtg

SEQ ID NO: 426618 - DNA, 140 bp, Artificial Sequence
  Synthetic
caccgctgtcccaaaaggtcgaaatatctgaattttctcaaattggtttgtgctgctcattaaatgcttcagttcttcataatagttgaaagttcccggatagcacaggccattggctggcatatcagcagccagggcct

SEQ ID NO: 426619 - DNA, 140 bp, Artificial Sequence
  Synthetic
aggccctggctgctgatatggaccccaagcacggagatgtcgctgagagggataagagtcagcaaaatgggagtagatgaatactccagcacagagagagtggtagtgagtattgaccgagaccttttgggacagcggtg

SEQ ID NO: 426620 - DNA, 140 bp, Artificial Sequence
  Synthetic
caccgctgtcccaaaaggtctcggtcaatactcactaccactctctctgtgctggagtattcatctactcccattttgctgactcttatccctctcagcgacatctccgtgcttggggtccatatcagcagccagggcct

SEQ ID NO: 426621 - DNA, 140 bp, Artificial Sequence
  Synthetic
atacgccatgctgggtctcctgcccatacaatggtaggtcttcatttttcaggaatgtagtgtggttgatcaagaagaacaatgtataccggacaataacaaggacctacaacaacaccacgtacttgggagtcggccat

SEQ ID NO: 426622 - DNA, 140 bp, Artificial Sequence
  Synthetic
atggccgactcccaagtacgtggtgttgttgtaggtccttgttattgtccggtatacattgttcttcttgatcaaccacactacattcctgaaaaatgaagacctaccattgtatgggcaggagacccagcatggcgtat

SEQ ID NO: 426623 - DNA, 140 bp, Artificial Sequence
  Synthetic
aggccctggctgctgatatgcaagaagaacaatgtataccggacaataacaaggacctacaacaacaccaacatagaagaccttttaataatatggggaattcatcatcctaatgatgcagaccttttgggacagcggtg

SEQ ID NO: 426624 - DNA, 140 bp, Artificial Sequence
  Synthetic
caccgctgtcccaaaaggtctgcatcattaggatgatgaattccccatattattaaaaggtcttctatgttggtgttgttgtaggtccttgttattgtccggtatacattgttcttcttgcatatcagcagccagggcct

SEQ ID NO: 426625 - DNA, 140 bp, Artificial Sequence
  Synthetic
atacgccatgctgggtctccgacatcaacactgaatcagaggtcgatcccagaaatagccaccagacccaaggtaaacggacagagtgggaggatggagtttttttggacaatactaagacgtacttgggagtcggccat

SEQ ID NO: 426626 - DNA, 140 bp, Artificial Sequence
  Synthetic
atggccgactcccaagtacgtcttagtattgtccaaaaaaactccatcctcccactctgtccgtttaccttgggtctggtggctatttctgggatcgacctctgattcagtgttgatgtcggagacccagcatggcgtat

SEQ ID NO: 426627 - DNA, 140 bp, Artificial Sequence
  Synthetic
aggccctggctgctgatatgaggtaaacggacagagtgggaggatggagtttttttggacaatactaagaccgaatgactcaatcacctttgagagcactgggaactttatagctcctgagaccttttgggacagcggtg

SEQ ID NO: 426628 - DNA, 140 bp, Artificial Sequence
  Synthetic
caccgctgtcccaaaaggtctcaggagctataaagttcccagtgctctcaaaggtgattgagtcattcggtcttagtattgtccaaaaaaactccatcctcccactctgtccgtttacctcatatcagcagccagggcct

SEQ ID NO: 426629 - DNA, 140 bp, Artificial Sequence
  Synthetic
atacgccatgctgggtctccatgaatccaaatcaaaagataataacaattggctctgcttctctcactattgccacaatttgcttccttatgcaaattgccatcttagtaattaatgtaacgtacttgggagtcggccat

SEQ ID NO: 426630 - DNA, 140 bp, Artificial Sequence
  Synthetic
atggccgactcccaagtacgttacattaattactaagatggcaatttgcataaggaagcaaattgtggcaatagtgagagaagcagagccaattgttattatcttttgatttggattcatggagacccagcatggcgtat

SEQ ID NO: 426631 - DNA, 140 bp, Artificial Sequence
  Synthetic
atacgccatgctgggtctccaactgagttatggtaactgtaacaccaaatgccaaaccccagtgggtgctataaattccagtatgcctttccacaatgtccatccctttaccattggggacgtacttgggagtcggccat

SEQ ID NO: 426632 - DNA, 140 bp, Artificial Sequence
  Synthetic
atggccgactcccaagtacgtccccaatggtaaagggatggacattgtggaaaggcatactggaatttatagcacccactggggtttggcatttggtgttacagttaccataactcagttggagacccagcatggcgtat

SEQ ID NO: 426633 - DNA, 140 bp, Artificial Sequence
  Synthetic
aggccctggctgctgatatgataaattccagtatgcctttccacaatgtccatccctttaccattggggagtgccccaagtatgtcaaattgaaaaaactggtcctagcaacaggactgagaccttttgggacagcggtg

SEQ ID NO: 426634 - DNA, 140 bp, Artificial Sequence
  Synthetic
caccgctgtcccaaaaggtctcagtcctgttgctaggaccagttttttcaatttgacatacttggggcactccccaatggtaaagggatggacattgtggaaaggcatactggaatttatcatatcagcagccagggcct

SEQ ID NO: 426635 - DNA, 140 bp, Artificial Sequence
  Synthetic
atacgccatgctgggtctccttcatagaaggagggtggcaaggaatggtggatgggtggtatggataccatcacagcaatgagcaaggtagtggatatgctgcagacaaagaatctacaccgtacttgggagtcggccat

SEQ ID NO: 426636 - DNA, 140 bp, Artificial Sequence
  Synthetic
atggccgactcccaagtacggtgtagattctttgtctgcagcatatccactaccttgctcattgctgtgatggtatccataccacccatccaccattccttgccaccctccttctatgaaggagacccagcatggcgtat

SEQ ID NO: 426637 - DNA, 140 bp, Artificial Sequence
  Synthetic
aggccctggctgctgatatgtcacagcaatgagcaaggtagtggatatgctgcagacaaagaatctacacagaaagcagtcgatggaataactaataaagtcaactcaatcattagcaaagaccttttgggacagcggtg

SEQ ID NO: 426638 - DNA, 140 bp, Artificial Sequence
  Synthetic
caccgctgtcccaaaaggtctttgctaatgattgagttgactttattagttattccatcgactgctttctgtgtagattctttgtctgcagcatatccactaccttgctcattgctgtgacatatcagcagccagggcct

SEQ ID NO: 426639 - DNA, 140 bp, Artificial Sequence
  Synthetic
atacgccatgctgggtctcctttttgagggttcgggatcaacgagggaacatattattgtctcccgaagaggtcagcgaaacacaaggaacagagaaattgacaataacttattcatcatcgtacttgggagtcggccat

SEQ ID NO: 426640 - DNA, 140 bp, Artificial Sequence
  Synthetic
atggccgactcccaagtacgatgatgaataagttattgtcaatttctctgttccttgtgtttcgctgacctcttcgggagacaataatatgttccctcgttgatcccgaaccctcaaaaaggagacccagcatggcgtat

SEQ ID NO: 426641 - DNA, 140 bp, Artificial Sequence
  Synthetic
atacgccatgctgggtctccaagaatagaaaatttgaataagaaaatggaggatggctttatagatgtatggacttacaatgcagaacttctagtgctcatggaaaacgagagaactctacgtacttgggagtcggccat

SEQ ID NO: 426642 - DNA, 140 bp, Artificial Sequence
  Synthetic
atggccgactcccaagtacgtagagttctctcgttttccatgagcactagaagttctgcattgtaagtccatacatctataaagccatcctccattttcttattcaaattttctattcttggagacccagcatggcgtat

SEQ ID NO: 426643 - DNA, 140 bp, Artificial Sequence
  Synthetic
atacgccatgctgggtctccatggaagcaaaactgtttgtgctattctgtacattcactgtactgaaagctgacaccatctgtgtgggctaccatgcaaacaactctacagacactgttgcgtacttgggagtcggccat

SEQ ID NO: 426644 - DNA, 140 bp, Artificial Sequence
  Synthetic
atggccgactcccaagtacgcaacagtgtctgtagagttgtttgcatggtagcccacacagatggtgtcagctttcagtacagtgaatgtacagaatagcacaaacagttttgcttccatggagacccagcatggcgtat

SEQ ID NO: 426645 - DNA, 140 bp, Artificial Sequence
  Synthetic
atacgccatgctgggtctccgctgagggacaatgcaaaagaattaggcaatggttgctttgaattctatcacaggtgtgacaataaatgcatggaaagcgtgaggaatggaacgtatgaccgtacttgggagtcggccat

SEQ ID NO: 426646 - DNA, 140 bp, Artificial Sequence
  Synthetic
atggccgactcccaagtacggtcatacgttccattcctcacgctttccatgcatttattgtcacacctgtgatagaattcaaagcaaccattgcctaattcttttgcattgtccctcagcggagacccagcatggcgtat

SEQ ID NO: 426647 - DNA, 140 bp, Artificial Sequence
  Synthetic
aggccctggctgctgatatgacaggtgtgacaataaatgcatggaaagcgtgaggaatggaacgtatgactacccacaatactcagaagaatcaaggctgaaaagagaggcaatagatgggaccttttgggacagcggtg

SEQ ID NO: 426648 - DNA, 140 bp, Artificial Sequence
  Synthetic
caccgctgtcccaaaaggtcccatctattgcctctcttttcagccttgattcttctgagtattgtgggtagtcatacgttccattcctcacgctttccatgcatttattgtcacacctgtcatatcagcagccagggcct

SEQ ID NO: 426649 - DNA, 140 bp, Artificial Sequence
  Synthetic
aggccctggctgctgatatgcactgcatttcaagcgatatgaattcaactcccccccaaacaaccaagtgatgctgtgtgaaccaacaataatagaaagaaacataacagagatagtgtagaccttttgggacagcggtg

SEQ ID NO: 426650 - DNA, 140 bp, Artificial Sequence
  Synthetic
caccgctgtcccaaaaggtctacactatctctgttatgtttctttctattattgttggttcacacagcatcacttggttgtttgggggggagttgaattcatatcgcttgaaatgcagtgcatatcagcagccagggcct

SEQ ID NO: 426651 - DNA, 140 bp, Artificial Sequence
  Synthetic
atacgccatgctgggtctccttcaacagtagcgagttccctagcactggcaatcatggtagctggtctatctttttggatgtgttccaatggatcattgcagtgcagagtttgcatctagcgtacttgggagtcggccat

SEQ ID NO: 426652 - DNA, 140 bp, Artificial Sequence
  Synthetic
atggccgactcccaagtacgctagatgcaaactctgcactgcaatgatccattggaacacatccaaaaagatagaccagctaccatgattgccagtgctagggaactcgctactgttgaaggagacccagcatggcgtat

SEQ ID NO: 426653 - DNA, 140 bp, Artificial Sequence
  Synthetic
aggccctggctgctgatatgaattcagagaacgggacatgctatcccggtgaattcatagattatgaggaattaagggagcagctgagttcagtttcttcttttgaaaagtttgaaatttgaccttttgggacagcggtg

SEQ ID NO: 426654 - DNA, 140 bp, Artificial Sequence
  Synthetic
caccgctgtcccaaaaggtcaaatttcaaacttttcaaaagaagaaactgaactcagctgctcccttaattcctcataatctatgaattcaccgggatagcatgtcccgttctctgaattcatatcagcagccagggcct

SEQ ID NO: 426655 - DNA, 140 bp, Artificial Sequence
  Synthetic
atacgccatgctgggtctccgcacacagaatgcaattgatggaataacaaataaggtgaattcggtaattgaaaaaatgaacactcaattcactgcagtgggtaaagaattcaacaacctcgtacttgggagtcggccat

SEQ ID NO: 426656 - DNA, 140 bp, Artificial Sequence
  Synthetic
atggccgactcccaagtacgaggttgttgaattctttacccactgcagtgaattgagtgttcattttttcaattaccgaattcaccttatttgttattccatcaattgcattctgtgtgcggagacccagcatggcgtat

SEQ ID NO: 426657 - DNA, 140 bp, Artificial Sequence
  Synthetic
aggccctggctgctgatatgaaaaggccaataagataaagtctgagaagacacacatccacatcttttcattcactggagaagaaatggctactaaagcagactacactcttgatgaagagaccttttgggacagcggtg

SEQ ID NO: 426658 - DNA, 140 bp, Artificial Sequence
  Synthetic
caccgctgtcccaaaaggtctcttcatcaagagtgtagtctgctttagtagccatttcttctccagtgaatgaaaagatgtggatgtgtgtcttctcagactttatcttattggccttttcatatcagcagccagggcct

SEQ ID NO: 426659 - DNA, 140 bp, Artificial Sequence
  Synthetic
atacgccatgctgggtctccgctgcttgctcctactctggggctagcagtttttatcgaaatttgctgtggataacaaagaaggggacttcatatccaaaactcagcaaatcatacacgacgtacttgggagtcggccat

SEQ ID NO: 426660 - DNA, 140 bp, Artificial Sequence
  Synthetic
atggccgactcccaagtacgtcgtgtatgatttgctgagttttggatatgaagtccccttctttgttatccacagcaaatttcgataaaaactgctagccccagagtaggagcaagcagcggagacccagcatggcgtat

SEQ ID NO: 426661 - DNA, 140 bp, Artificial Sequence
  Synthetic
atacgccatgctgggtctccgattctggagggagagtctgacgagacacttaaaatgactattgcttctgtgccggcttcacgctacataactgacatgactcttgaggaaatgtcaaggcgtacttgggagtcggccat

SEQ ID NO: 426662 - DNA, 140 bp, Artificial Sequence
  Synthetic
atggccgactcccaagtacgccttgacatttcctcaagagtcatgtcagttatgtagcgtgaagccggcacagaagcaatagtcattttaagtgtctcgtcagactctccctccagaatcggagacccagcatggcgtat

SEQ ID NO: 426663 - DNA, 140 bp, Artificial Sequence
  Synthetic
aggccctggctgctgatatgaagtttacaaaacatacttcgagaaggttgaaaggttaaaacatggaacattcggccccgtccatttccgaaaccaagttaaaatacgccgccgagttgagaccttttgggacagcggtg

SEQ ID NO: 426664 - DNA, 140 bp, Artificial Sequence
  Synthetic
caccgctgtcccaaaaggtctcaactcggcggcgtattttaacttggtttcggaaatggacggggccgaatgttccatgttttaacctttcaaccttctcgaagtatgttttgtaaacttcatatcagcagccagggcct

SEQ ID NO: 426665 - DNA, 140 bp, Artificial Sequence
  Synthetic
atacgccatgctgggtctcctcatctggggacaaagcaggtgtgcatagcatggtccagctcaagttgtcacgatggaaaagcatggctgcatgtttgtgtgacgggagatgacaaaaatcgtacttgggagtcggccat

SEQ ID NO: 426666 - DNA, 140 bp, Artificial Sequence
  Synthetic
atggccgactcccaagtacgatttttgtcatctcccgtcacacaaacatgcagccatgcttttccatcgtgacaacttgagctggaccatgctatgcacacctgctttgtccccagatgaggagacccagcatggcgtat

SEQ ID NO: 426667 - DNA, 140 bp, Artificial Sequence
  Synthetic
atacgccatgctgggtctcccaggatggaccaagcaatactgaataaaaacatcacattgaaagcaaacttcagtgtgacttttgatcgattggaaactctaatactacttagagctttccgtacttgggagtcggccat

SEQ ID NO: 426668 - DNA, 140 bp, Artificial Sequence
  Synthetic
atggccgactcccaagtacggaaagctctaagtagtattagagtttccaatcgatcaaaagtcacactgaagtttgctttcaatgtgatgtttttattcagtattgcttggtccatcctgggagacccagcatggcgtat

SEQ ID NO: 426669 - DNA, 140 bp, Artificial Sequence
  Synthetic
aggccctggctgctgatatggacccaaagttagagggcaggcaggcaggatgaactattattggacactattagaccaagaggacaccataacatttgaggccactggaaatctgatagcgaccttttgggacagcggtg

SEQ ID NO: 426670 - DNA, 140 bp, Artificial Sequence
  Synthetic
caccgctgtcccaaaaggtcgctatcagatttccagtggcctcaaatgttatggtgtcctcttggtctaatagtgtccaataatagttcatcctgcctgcctgccctctaactttgggtccatatcagcagccagggcct

SEQ ID NO: 426671 - DNA, 140 bp, Artificial Sequence
  Synthetic
atacgccatgctgggtctccaggattcacttggccaggagtaactcagaatggaggaagcggtgcctgcaaaaggggacccgctaatggttttttcagtagattgaactggttgactaaacgtacttgggagtcggccat

SEQ ID NO: 426672 - DNA, 140 bp, Artificial Sequence
  Synthetic
atggccgactcccaagtacgtttagtcaaccagttcaatctactgaaaaaaccattagcgggtccccttttgcaggcaccgcttcctccattctgagttactcctggccaagtgaatcctggagacccagcatggcgtat

SEQ ID NO: 426673 - DNA, 140 bp, Artificial Sequence
  Synthetic
atacgccatgctgggtctccgaaaaatacggtggattaaacaaaagcaagccttactacacaggagaacatgcaaaagccataggaaattgcccaatatgggtgaaaacacccttgaagccgtacttgggagtcggccat

SEQ ID NO: 426674 - DNA, 140 bp, Artificial Sequence
  Synthetic
atggccgactcccaagtacggcttcaagggtgttttcacccatattgggcaatttcctatggcttttgcatgttctcctgtgtagtaaggcttgcttttgtttaatccaccgtatttttcggagacccagcatggcgtat

SEQ ID NO: 426675 - DNA, 140 bp, Artificial Sequence
  Synthetic
atacgccatgctgggtctccgacttgaatggaatgataacgcagttcgagtctctgaagctctacagagatttgcttggagaagcagtaatgaggatgggggacctccactctcttcaaacgtacttgggagtcggccat

SEQ ID NO: 426676 - DNA, 140 bp, Artificial Sequence
  Synthetic
atggccgactcccaagtacgtttgaagagagtggaggtcccccatcctcattactgcttctccaagcaaatctctgtagagcttcagagactcgaactgcgttatcattccattcaagtcggagacccagcatggcgtat

SEQ ID NO: 426677 - DNA, 140 bp, Artificial Sequence
  Synthetic
aggccctggctgctgatatgggagcgttgaacagtagccttccttttcagaatgtgcatcctatcaccattggagaatgtcccaaatatgtcaagagcaccaagctaaggatggcaacaggaccttttgggacagcggtg

SEQ ID NO: 426678 - DNA, 140 bp, Artificial Sequence
  Synthetic
caccgctgtcccaaaaggtcctgttgccatccttagcttggtgctcttgacatatttgggacattctccaatggtgataggatgcacattctgaaaaggaaggctactgttcaacgctcccatatcagcagccagggcct

SEQ ID NO: 426679 - DNA, 140 bp, Artificial Sequence
  Synthetic
aggccctggctgctgatatggaattggttgtatcatttgggtcacaaatatccagcgcagaatgtaactatgccaaacaatgacaactttgacaaattgtacatttggggggttcaccacgaccttttgggacagcggtg

SEQ ID NO: 426680 - DNA, 140 bp, Artificial Sequence
  Synthetic
caccgctgtcccaaaaggtcgtggtgaaccccccaaatgtacaatttgtcaaagttgtcattgtttggcatagttacattctgcgctggatatttgtgacccaaatgatacaaccaattccatatcagcagccagggcct

SEQ ID NO: 426681 - DNA, 140 bp, Artificial Sequence
  Synthetic
atacgccatgctgggtctccagatggctgattgaggaagtgcggtatagattgaggattacagagaacagcttcgaacagataacgtttgtacaagccttacaactactgcttgaagtggcgtacttgggagtcggccat

SEQ ID NO: 426682 - DNA, 140 bp, Artificial Sequence
  Synthetic
atggccgactcccaagtacgccacttcaagcagtagttgtaaggcttgtacaaacgttatctgttcgaagctgttctctgtaatcctcaatctataccgcacttcctcaatcagccatctggagacccagcatggcgtat

SEQ ID NO: 426683 - DNA, 140 bp, Artificial Sequence
  Synthetic
atacgccatgctgggtctccgccggattcattgaaggaggatggacaggcatgatagatggctggtatgggtaccaccaccagaatgagcaaggatcaggatatgccgctgatcagaaaacgtacttgggagtcggccat

SEQ ID NO: 426684 - DNA, 140 bp, Artificial Sequence
  Synthetic
atggccgactcccaagtacgttttctgatcagcggcatatcctgatccttgctcattctggtggtggtacccataccagccatctatcatgcctgtccatcctccttcaatgaatccggcggagacccagcatggcgtat

SEQ ID NO: 426685 - DNA, 140 bp, Artificial Sequence
  Synthetic
atacgccatgctgggtctccggctgggcctttgacgatggaaatgacgtgtggatgggaagaacaatcagcgagaagtcacgcttaggatatgaaacattcaaagtcattggaggctggtcgtacttgggagtcggccat

SEQ ID NO: 426686 - DNA, 140 bp, Artificial Sequence
  Synthetic
atggccgactcccaagtacgaccagcctccaatgactttgaatgtttcatatcctaagcgtgacttctcgctgattgttcttcccatccacacgtcatttccatcgtcaaaggcccagccggagacccagcatggcgtat

SEQ ID NO: 426687 - DNA, 140 bp, Artificial Sequence
  Synthetic
atacgccatgctgggtctcccaagttcgctgcaatatgcactcatttggaagtctgtttcatgtattcggatttccatttcattgatgaacggggcgaatcaataattgtggaatctggtcgtacttgggagtcggccat

SEQ ID NO: 426688 - DNA, 140 bp, Artificial Sequence
  Synthetic
atggccgactcccaagtacgaccagattccacaattattgattcgccccgttcatcaatgaaatggaaatccgaatacatgaaacagacttccaaatgagtgcatattgcagcgaacttgggagacccagcatggcgtat

SEQ ID NO: 426689 - DNA, 140 bp, Artificial Sequence
  Synthetic
atacgccatgctgggtctcctcaaccctaattccaaatcacagataaatagacaagtcatagttgtcagaggtaacaggtccggttattctggtattttctctgttgaaggcaaaagctgcgtacttgggagtcggccat

SEQ ID NO: 426690 - DNA, 140 bp, Artificial Sequence
  Synthetic
atggccgactcccaagtacgcagcttttgccttcaacagagaaaataccagaataaccggacctgttacctctgacaactatgacttgtctatttatctgtgatttggaattagggttgaggagacccagcatggcgtat

SEQ ID NO: 426691 - DNA, 140 bp, Artificial Sequence
  Synthetic
atacgccatgctgggtctccatgtttggacatacaatgctgaactgctcgttttactggaaaatgaaagaactcttgactttcatgattccaatgtgaggagtttgtatgagagagtcaacgtacttgggagtcggccat

SEQ ID NO: 426692 - DNA, 140 bp, Artificial Sequence
  Synthetic
atggccgactcccaagtacgttgactctctcatacaaactcctcacattggaatcatgaaagtcaagagttctttcattttccagtaaaacgagcagttcagcattgtatgtccaaacatggagacccagcatggcgtat

SEQ ID NO: 426693 - DNA, 140 bp, Artificial Sequence
  Synthetic
aggccctggctgctgatatgcagaacaatggcctggacagtggtgaatagcatctgcaacaccacgggagtcgagaagcctaagttccttccggatctgtatgattacaaggagaaccgagaccttttgggacagcggtg

SEQ ID NO: 426694 - DNA, 140 bp, Artificial Sequence
  Synthetic
caccgctgtcccaaaaggtctcggttctccttgtaatcatacagatccggaaggaacttaggcttctcgactcccgtggtgttgcagatgctattcaccactgtccaggccattgttctgcatatcagcagccagggcct

SEQ ID NO: 426695 - DNA, 140 bp, Artificial Sequence
  Synthetic
aggccctggctgctgatatgttcattgaaattggagtgacacggagagaggtccatatatattacctagagaaagccaacaagataaaatccgagaagacacacatccacatcttttcatgaccttttgggacagcggtg

SEQ ID NO: 426696 - DNA, 140 bp, Artificial Sequence
  Synthetic
caccgctgtcccaaaaggtcatgaaaagatgtggatgtgtgtcttctcggattttatcttgttggctttctctaggtaatatatatggacctctctccgtgtcactccaatttcaatgaacatatcagcagccagggcct

SEQ ID NO: 426697 - DNA, 140 bp, Artificial Sequence
  Synthetic
atacgccatgctgggtctccgaaagccaacaagataaaatccgagaagacacacatccacatcttttcatttactggagaagagatggccaccaaagcagactacacccttgacgaagaacgtacttgggagtcggccat

SEQ ID NO: 426698 - DNA, 140 bp, Artificial Sequence
  Synthetic
atggccgactcccaagtacgttcttcgtcaagggtgtagtctgctttggtggccatctcttctccagtaaatgaaaagatgtggatgtgtgtcttctcggattttatcttgttggctttcggagacccagcatggcgtat

SEQ ID NO: 426699 - DNA, 140 bp, Artificial Sequence
  Synthetic
aggccctggctgctgatatgttccacagtcgccagttccctggtcttgttagtctccctgggggcaatcagcttctggatgtgctctaatgggtcattgcaatgcagaatatgcatttaggaccttttgggacagcggtg

SEQ ID NO: 426700 - DNA, 140 bp, Artificial Sequence
  Synthetic
caccgctgtcccaaaaggtcctaaatgcatattctgcattgcaatgacccattagagcacatccagaagctgattgcccccagggagactaacaagaccagggaactggcgactgtggaacatatcagcagccagggcct

SEQ ID NO: 426701 - DNA, 140 bp, Artificial Sequence
  Synthetic
atacgccatgctgggtctcccaattgaagaaagatttgaaatcacaggaaccatgcgcaggcttgccgaccaaagtctcccaccgaacttctccagccttgaaaactttagagcctatgtcgtacttgggagtcggccat

SEQ ID NO: 426702 - DNA, 140 bp, Artificial Sequence
  Synthetic
atggccgactcccaagtacgacataggctctaaagttttcaaggctggagaagttcggtgggagactttggtcggcaagcctgcgcatggttcctgtgatttcaaatctttcttcaattgggagacccagcatggcgtat

SEQ ID NO: 426703 - DNA, 140 bp, Artificial Sequence
  Synthetic
aggccctggctgctgatatgcaaagtctcccaccgaacttctccagccttgaaaactttagagcctatgtggatggattcgaaccgaacggctgcattgagggcaagctttctcaaatgtgaccttttgggacagcggtg

SEQ ID NO: 426704 - DNA, 140 bp, Artificial Sequence
  Synthetic
caccgctgtcccaaaaggtcacatttgagaaagcttgccctcaatgcagccgttcggttcgaatccatccacataggctctaaagttttcaaggctggagaagttcggtgggagactttgcatatcagcagccagggcct

SEQ ID NO: 426705 - DNA, 140 bp, Artificial Sequence
  Synthetic
atacgccatgctgggtctccatggatgtcaatccgactttacttttcttgaaaattccagcacaaaatgctataagcattacattcccttatactggagatcctccctacagccatggaacgtacttgggagtcggccat

SEQ ID NO: 426706 - DNA, 140 bp, Artificial Sequence
  Synthetic
atggccgactcccaagtacgttccatggctgtagggaggatctccagtataagggaatgtaatgcttatagcattttgtgctggaattttcaagaaaagtaaagtcggattgacatccatggagacccagcatggcgtat

SEQ ID NO: 426707 - DNA, 140 bp, Artificial Sequence
  Synthetic
aggccctggctgctgatatgtggaaagagcccaatataatcaaaccacatgaaaagggcataaatcctaactatctcctggcttggaagcaagtgctagcagaactccaggaccttgaaagaccttttgggacagcggtg

SEQ ID NO: 426708 - DNA, 140 bp, Artificial Sequence
  Synthetic
caccgctgtcccaaaaggtctttcaaggtcctggagttctgctagcacttgcttccaagccaggagatagttaggatttatgcccttttcatgtggtttgattatattgggctctttccacatatcagcagccagggcct

SEQ ID NO: 426709 - DNA, 140 bp, Artificial Sequence
  Synthetic
atacgccatgctgggtctccttgcaaggatgttggcgatctaaaacagtataatagcgatgagccagagcctagatcgatagcaagctggatccagagtgaattcaataaggcatgtgaacgtacttgggagtcggccat

SEQ ID NO: 426710 - DNA, 140 bp, Artificial Sequence
  Synthetic
atggccgactcccaagtacgttcacatgccttattgaattcactctggatccagcttgctatcgatctaggctctggctcatcgctattatactgttttagatcgccaacatccttgcaaggagacccagcatggcgtat

SEQ ID NO: 426711 - DNA, 140 bp, Artificial Sequence
  Synthetic
aggccctggctgctgatatgctagatcgatagcaagctggatccagagtgaattcaataaggcatgtgaattgaccgactcaagctggatagaactggatgaaatcggggaagatgttgcgaccttttgggacagcggtg

SEQ ID NO: 426712 - DNA, 140 bp, Artificial Sequence
  Synthetic
caccgctgtcccaaaaggtcgcaacatcttccccgatttcatccagttctatccagcttgagtcggtcaattcacatgccttattgaattcactctggatccagcttgctatcgatctagcatatcagcagccagggcct

SEQ ID NO: 426713 - DNA, 140 bp, Artificial Sequence
  Synthetic
aggccctggctgctgatatgtactggaagatcaggctttgaagtcatcaaggtcatagaaggatggatcaattccctcaatcatgctaaatcagttacacaaacactagtatcgaacaatgaccttttgggacagcggtg

SEQ ID NO: 426714 - DNA, 140 bp, Artificial Sequence
  Synthetic
caccgctgtcccaaaaggtcattgttcgatactagtgtttgtgtaactgatttagcatgattgagggaattgatccatccttctatgaccttgatgacttcaaagcctgatcttccagtacatatcagcagccagggcct

SEQ ID NO: 426715 - DNA, 140 bp, Artificial Sequence
  Synthetic
atacgccatgctgggtctccaaggggccaatctggcagaattagcatctattggacaatagttaaacctggagacgtactggtaatcaatagtaatggaaacctaatcgcccctcggggtcgtacttgggagtcggccat

SEQ ID NO: 426716 - DNA, 140 bp, Artificial Sequence
  Synthetic
atggccgactcccaagtacgaccccgaggggcgattaggtttccattactattgattaccagtacgtctccaggtttaactattgtccaatagatgctaattctgccagattggccccttggagacccagcatggcgtat

SEQ ID NO: 426717 - DNA, 140 bp, Artificial Sequence
  Synthetic
atacgccatgctgggtctccatgaagactatcattgctttgagctacattctatgtctggttttcgctcaaaaatttcctggaaatgacaacaacatggcaatgctgtgccttgggcacccgtacttgggagtcggccat

SEQ ID NO: 426718 - DNA, 140 bp, Artificial Sequence
  Synthetic
atggccgactcccaagtacgggtgcccaaggcacagcattgccatgttgttgtcatttccaggaaatttttgagcgaaaaccagacatagaatgtagctcaaagcaatgatagtcttcatggagacccagcatggcgtat

SEQ ID NO: 426719 - DNA, 140 bp, Artificial Sequence
  Synthetic
aggccctggctgctgatatgaccacacaaatgggaaaagtactgcgttcttgaagtgggagatatgctactgaggactgcaataggccaagtatcaagacccatgttcctgtatgttagggaccttttgggacagcggtg

SEQ ID NO: 426720 - DNA, 140 bp, Artificial Sequence
  Synthetic
caccgctgtcccaaaaggtccctaacatacaggaacatgggtcttgatacttggcctattgcagtcctcagtagcatatctcccacttcaagaacgcagtacttttcccatttgtgtggtcatatcagcagccagggcct

SEQ ID NO: 426721 - DNA, 140 bp, Artificial Sequence
  Synthetic
atacgccatgctgggtctcccctctgtcaaagaaaaagacatgactaaagaattttttgagaacaagtcggaaacatggccaattggagaatcccccagaggggtagaggaaggatccatcgtacttgggagtcggccat

SEQ ID NO: 426722 - DNA, 140 bp, Artificial Sequence
  Synthetic
atggccgactcccaagtacgatggatccttcctctacccctctgggggattctccaattggccatgtttccgacttgttctcaaaaaattctttagtcatgtctttttctttgacagaggggagacccagcatggcgtat

SEQ ID NO: 426723 - DNA, 140 bp, Artificial Sequence
  Synthetic
aggccctggctgctgatatggcggatatgcacaaacggattgtgtattggaggccatggctttccttgaagaatcccacccagggatctttgagaactcatgtcttgaaacgatggaagtgaccttttgggacagcggtg

SEQ ID NO: 426724 - DNA, 140 bp, Artificial Sequence
  Synthetic
caccgctgtcccaaaaggtcacttccatcgtttcaagacatgagttctcaaagatccctgggtgggattcttcaaggaaagccatggcctccaatacacaatccgtttgtgcatatccgccatatcagcagccagggcct

SEQ ID NO: 426725 - DNA, 140 bp, Artificial Sequence
  Synthetic
atacgccatgctgggtctccggtgccggattatgcctcccttaggtcaatagttgcctcatccggcacgctggaatttaacaatgaaagcttcaattggactggagtcactcaaaatggacgtacttgggagtcggccat

SEQ ID NO: 426726 - DNA, 140 bp, Artificial Sequence
  Synthetic
atggccgactcccaagtacgtccattttgagtgactccagtccaattgaagctttcattgttaaattccagcgtgccggatgaggcaactattgacctaagggaggcataatccggcaccggagacccagcatggcgtat

SEQ ID NO: 426727 - DNA, 140 bp, Artificial Sequence
  Synthetic
atacgccatgctgggtctccgaattggttgacccacttaaattacaaatatccagcattgaaaattactatgccaaacaatgaaaaatttgacaaattgtacatttggggggctcaccaccgtacttgggagtcggccat

SEQ ID NO: 426728 - DNA, 140 bp, Artificial Sequence
  Synthetic
atggccgactcccaagtacggtggtgagccccccaaatgtacaatttgtcaaatttttcattgtttggcatagtaattttcaatgctggatatttgtaatttaagtgggtcaaccaattcggagacccagcatggcgtat

SEQ ID NO: 426729 - DNA, 140 bp, Artificial Sequence
  Synthetic
aggccctggctgctgatatgtgccaaacaatgaaaaatttgacaaattgtacatttggggggctcaccacccgggtacgtacaatgaccaaatcagcctatatgctcaagcatcaggaatgaccttttgggacagcggtg

SEQ ID NO: 426730 - DNA, 140 bp, Artificial Sequence
  Synthetic
caccgctgtcccaaaaggtcattcctgatgcttgagcatataggctgatttggtcattgtacgtacccgggtggtgagccccccaaatgtacaatttgtcaaatttttcattgtttggcacatatcagcagccagggcct

SEQ ID NO: 426731 - DNA, 140 bp, Artificial Sequence
  Synthetic
atacgccatgctgggtctcccaggaacaggatacaccatggacacggttaacagaacacatcaatattcagaaaaagggaaatggacaacaaactcagagactggagcaccccaactcaacgtacttgggagtcggccat

SEQ ID NO: 426732 - DNA, 140 bp, Artificial Sequence
  Synthetic
atggccgactcccaagtacgttgagttggggtgctccagtctctgagtttgttgtccatttccctttttctgaatattgatgtgttctgttaaccgtgtccatggtgtatcctgttcctgggagacccagcatggcgtat

SEQ ID NO: 426733 - DNA, 140 bp, Artificial Sequence
  Synthetic
atacgccatgctgggtctccagctcttgttcgcaccggaatggatcccagaatgtgctctctaatgcaaggttcaacacttcccagaaggtctggtgccgcaggtgcggcggtgaaaggacgtacttgggagtcggccat

SEQ ID NO: 426734 - DNA, 140 bp, Artificial Sequence
  Synthetic
atggccgactcccaagtacgtcctttcaccgccgcacctgcggcaccagaccttctgggaagtgttgaaccttgcattagagagcacattctgggatccattccggtgcgaacaagagctggagacccagcatggcgtat

SEQ ID NO: 426735 - DNA, 140 bp, Artificial Sequence
  Synthetic
atacgccatgctgggtctccctaatgtgaggaatctgtacgataaggtcagaatgcaattgagggacaatgctaaggaaatagggaacggatgctttgagttttatcataaatgtgatgacgtacttgggagtcggccat

SEQ ID NO: 426736 - DNA, 140 bp, Artificial Sequence
  Synthetic
atggccgactcccaagtacgtcatcacatttatgataaaactcaaagcatccgttccctatttccttagcattgtccctcaattgcattctgaccttatcgtacagattcctcacattagggagacccagcatggcgtat

SEQ ID NO: 426737 - DNA, 140 bp, Artificial Sequence
  Synthetic
atacgccatgctgggtctccatatggggcctgtcccagatatgtcaagcaaaacaccctgaaattggcaacaggaatgagaaatgtaccagagaaacaaactagaggcatatttggcgcacgtacttgggagtcggccat

SEQ ID NO: 426738 - DNA, 140 bp, Artificial Sequence
  Synthetic
atggccgactcccaagtacgtgcgccaaatatgcctctagtttgtttctctggtacatttctcattcctgttgccaatttcagggtgttttgcttgacatatctgggacaggccccatatggagacccagcatggcgtat

SEQ ID NO: 426739 - DNA, 140 bp, Artificial Sequence
  Synthetic
atacgccatgctgggtctccagatcgaacggtctgacagctaatgaatcagggagactaatagattttctcaaggatgtgatggagtcaatggataaaggagagatagaaataacaacgccgtacttgggagtcggccat

SEQ ID NO: 426740 - DNA, 140 bp, Artificial Sequence
  Synthetic
atggccgactcccaagtacggcgttgttatttctatctctcctttatccattgactccatcacatccttgagaaaatctattagtctccctgattcattagctgtcagaccgttcgatctggagacccagcatggcgtat

SEQ ID NO: 426741 - DNA, 140 bp, Artificial Sequence
  Synthetic
aggccctggctgctgatatgcaaggatgtgatggagtcaatggataaaggagagatagaaataacaacgcatttccaaaggaaaagaagagtgagggacaacatgaccaagaagatggtcgaccttttgggacagcggtg

SEQ ID NO: 426742 - DNA, 140 bp, Artificial Sequence
  Synthetic
caccgctgtcccaaaaggtcgaccatcttcttggtcatgttgtccctcactcttcttttcctttggaaatgcgttgttatttctatctctcctttatccattgactccatcacatccttgcatatcagcagccagggcct

SEQ ID NO: 426743 - DNA, 140 bp, Artificial Sequence
  Synthetic
atacgccatgctgggtctccaaagcactcaagcagcgattaatcaaatcaatggaaagatgaataggttgatcgggaaaaccaatgagaaattccatcagattgaaaaagaattctcagacgtacttgggagtcggccat

SEQ ID NO: 426744 - DNA, 140 bp, Artificial Sequence
  Synthetic
atggccgactcccaagtacgtctgagaattctttttcaatctgatggaatttctcattggttttcccgatcaacctattcatctttccattgatttgattaatcgctgcttgagtgctttggagacccagcatggcgtat

SEQ ID NO: 426745 - DNA, 140 bp, Artificial Sequence
  Synthetic
atacgccatgctgggtctccgaggcagcactcttggtctggatatcgaaacagccactcgcgctggaaagcagatagtggagaggattctggaggaagaatccgacgaggcactcaaaatcgtacttgggagtcggccat

SEQ ID NO: 426746 - DNA, 140 bp, Artificial Sequence
  Synthetic
atggccgactcccaagtacgattttgagtgcctcgtcggattcttcctccagaatcctctccactatctgctttccagcgcgagtggctgtttcgatatccagaccaagagtgctgcctcggagacccagcatggcgtat

SEQ ID NO: 426747 - DNA, 140 bp, Artificial Sequence
  Synthetic
atacgccatgctgggtctccccatgcagacctcagtgccaaagaggcgcaggatgtaattatggaagttgtcttcccaaatgaagtgggagcaaggatactgacatcggagtcgcaactgcgtacttgggagtcggccat

SEQ ID NO: 426748 - DNA, 140 bp, Artificial Sequence
  Synthetic
atggccgactcccaagtacgcagttgcgactccgatgtcagtatccttgctcccacttcatttgggaagacaacttccataattacatcctgcgcctctttggcactgaggtctgcatggggagacccagcatggcgtat

SEQ ID NO: 426749 - DNA, 140 bp, Artificial Sequence
  Synthetic
aggccctggctgctgatatgtcttcccaaatgaagtgggagcaaggatactgacatcggagtcgcaactgacgataacaaaggagaagaaagaagaactccaggactgcaaaatcgccccgaccttttgggacagcggtg

SEQ ID NO: 426750 - DNA, 140 bp, Artificial Sequence
  Synthetic
caccgctgtcccaaaaggtcggggcgattttgcagtcctggagttcttctttcttctcctttgttatcgtcagttgcgactccgatgtcagtatccttgctcccacttcatttgggaagacatatcagcagccagggcct

SEQ ID NO: 426751 - DNA, 140 bp, Artificial Sequence
  Synthetic
aggccctggctgctgatatgtgtgattttcgaccggttagagaccctaatactactcagagctttcacagaagaaggagcaatcgtgggagaaatctcaccattaccttctcttccaggagaccttttgggacagcggtg

SEQ ID NO: 426752 - DNA, 140 bp, Artificial Sequence
  Synthetic
caccgctgtcccaaaaggtctcctggaagagaaggtaatggtgagatttctcccacgattgctccttcttctgtgaaagctctgagtagtattagggtctctaaccggtcgaaaatcacacatatcagcagccagggcct

SEQ ID NO: 426753 - DNA, 140 bp, Artificial Sequence
  Synthetic
aggccctggctgctgatatgtaagaagagcaacagtatcagcagacccactagcatctctattggagatgtgccacagcacccagattgggggaataaggatggtcgacatccttcggcagaccttttgggacagcggtg

SEQ ID NO: 426754 - DNA, 140 bp, Artificial Sequence
  Synthetic
caccgctgtcccaaaaggtctgccgaaggatgtcgaccatccttattcccccaatctgggtgctgtggcacatctccaatagagatgctagtgggtctgctgatactgttgctcttcttacatatcagcagccagggcct

SEQ ID NO: 426755 - DNA, 140 bp, Artificial Sequence
  Synthetic
atacgccatgctgggtctcccgtcgagcttgcggaaaaggcaatgaaggaatatggggaagatccaaaaatcgaaactaacaaattcgcagcaatatgcactcacttggaagtatgtttccgtacttgggagtcggccat

SEQ ID NO: 426756 - DNA, 140 bp, Artificial Sequence
  Synthetic
atggccgactcccaagtacggaaacatacttccaagtgagtgcatattgctgcgaatttgttagtttcgatttttggatcttccccatattccttcattgccttttccgcaagctcgacgggagacccagcatggcgtat

SEQ ID NO: 426757 - DNA, 140 bp, Artificial Sequence
  Synthetic
aggccctggctgctgatatgttcgcttggagaaactgtgatgagaatgggagaccttcactacctccagagcagaaatgaaaagtggcgagagcaattgggacagaaatttgaggaaatagaccttttgggacagcggtg

SEQ ID NO: 426758 - DNA, 140 bp, Artificial Sequence
  Synthetic
caccgctgtcccaaaaggtctatttcctcaaatttctgtcccaattgctctcgccacttttcatttctgctctggaggtagtgaaggtctcccattctcatcacagtttctccaagcgaacatatcagcagccagggcct

SEQ ID NO: 426759 - DNA, 140 bp, Artificial Sequence
  Synthetic
atacgccatgctgggtctccagaacatggaaacaatggactccaatacacttgagctgagaagtagatattgggctataagaaccaggagcggagggaataccaaccagcagagggcatccgtacttgggagtcggccat

SEQ ID NO: 426760 - DNA, 140 bp, Artificial Sequence
  Synthetic
atggccgactcccaagtacggatgccctctgctggttggtattccctccgctcctggttcttatagcccaatatctacttctcagctcaagtgtattggagtccattgtttccatgttctggagacccagcatggcgtat

SEQ ID NO: 426761 - DNA, 140 bp, Artificial Sequence
  Synthetic
aggccctggctgctgatatgaaagtactcaagcagcaatcaatcagatcaccgggaaactaaatagagtaatcaagaaaacaaacgagaaattccatcagatcgaaaaagaattctcagagaccttttgggacagcggtg

SEQ ID NO: 426762 - DNA, 140 bp, Artificial Sequence
  Synthetic
caccgctgtcccaaaaggtctctgagaattctttttcgatctgatggaatttctcgtttgttttcttgattactctatttagtttcccggtgatctgattgattgctgcttgagtactttcatatcagcagccagggcct

SEQ ID NO: 426763 - DNA, 140 bp, Artificial Sequence
  Synthetic
atacgccatgctgggtctccccctaagaggaaccgctccatcctcaatacaagccaaaggggaatccttgaagatgaacagatgtatcaaaagtgctgcaatctattcgagaaattcttccgtacttgggagtcggccat

SEQ ID NO: 426764 - DNA, 140 bp, Artificial Sequence
  Synthetic
atggccgactcccaagtacggaagaatttctcgaatagattgcagcacttttgatacatctgttcatcttcaaggattcccctttggcttgtattgaggatggagcggttcctcttagggggagacccagcatggcgtat

SEQ ID NO: 426765 - DNA, 140 bp, Artificial Sequence
  Synthetic
atacgccatgctgggtctccggagtagatgaatactccagtacagagagagtagtagtgagcatcgaccgattcttaagagttcgggatcaacgggggaacgtactattgtcacctgaagcgtacttgggagtcggccat

SEQ ID NO: 426766 - DNA, 140 bp, Artificial Sequence
  Synthetic
atggccgactcccaagtacgcttcaggtgacaatagtacgttcccccgttgatcccgaactcttaagaatcggtcgatgctcactactactctctctgtactggagtattcatctactccggagacccagcatggcgtat

SEQ ID NO: 426767 - DNA, 140 bp, Artificial Sequence
  Synthetic
aggccctggctgctgatatgtcacgctcaccgtgcccagtgagcgaggactgcagcgtagacgttttgtccagaatgccctaaatggaaatggagatccaaacaatatggatagggcagtgaccttttgggacagcggtg

SEQ ID NO: 426768 - DNA, 140 bp, Artificial Sequence
  Synthetic
caccgctgtcccaaaaggtcactgccctatccatattgtttggatctccatttccatttagggcattctggacaaaacgtctacgctgcagtcctcgctcactgggcacggtgagcgtgacatatcagcagccagggcct

SEQ ID NO: 426769 - DNA, 140 bp, Artificial Sequence
  Synthetic
atacgccatgctgggtctcctacacatcgggaaggcaagagaagaaccccgcactcaggatgaaatggatgatggcaatgaaatatccaatcacagcagataagcgaataatggaaatgacgtacttgggagtcggccat

SEQ ID NO: 426770 - DNA, 140 bp, Artificial Sequence
  Synthetic
atggccgactcccaagtacgtcatttccattattcgcttatctgctgtgattggatatttcattgccatcatccatttcatcctgagtgcggggttcttctcttgccttcccgatgtgtaggagacccagcatggcgtat

SEQ ID NO: 426771 - DNA, 140 bp, Artificial Sequence
  Synthetic
aggccctggctgctgatatggatggcaatgaaatatccaatcacagcagataagcgaataatggaaatgatccctgaaaggaatgaacaagggcaaaccctctggagcaaaacaaacgatgaccttttgggacagcggtg

SEQ ID NO: 426772 - DNA, 140 bp, Artificial Sequence
  Synthetic
caccgctgtcccaaaaggtcatcgtttgttttgctccagagggtttgcccttgttcattcctttcagggatcatttccattattcgcttatctgctgtgattggatatttcattgccatccatatcagcagccagggcct

SEQ ID NO: 426773 - DNA, 140 bp, Artificial Sequence
  Synthetic
atacgccatgctgggtctccgagaaacgatgatgtagaccagagcttgattattgctgccaggaacatagtaagaagagcaacagtatcagcagacccactagcatctctattggagatgcgtacttgggagtcggccat

SEQ ID NO: 426774 - DNA, 140 bp, Artificial Sequence
  Synthetic
atggccgactcccaagtacgcatctccaatagagatgctagtgggtctgctgatactgttgctcttcttactatgttcctggcagcaataatcaagctctggtctacatcatcgtttctcggagacccagcatggcgtat

SEQ ID NO: 426775 - DNA, 140 bp, Artificial Sequence
  Synthetic
aggccctggctgctgatatgtaagaagagcaacagtatcagcagacccactagcatctctattggagatgtgccacagcacacaaattgggggaataaggatggtagacattcttcggcagaccttttgggacagcggtg

SEQ ID NO: 426776 - DNA, 140 bp, Artificial Sequence
  Synthetic
caccgctgtcccaaaaggtctgccgaagaatgtctaccatccttattcccccaatttgtgtgctgtggcacatctccaatagagatgctagtgggtctgctgatactgttgctcttcttacatatcagcagccagggcct

SEQ ID NO: 426777 - DNA, 140 bp, Artificial Sequence
  Synthetic
atacgccatgctgggtctccctacaatacccagaacaatttcacaaatgtgaccaatattgtgctaattaaagaagaaaacaaaatgttcacaaacctttctaaacccttatgtgaagtgcgtacttgggagtcggccat

SEQ ID NO: 426778 - DNA, 140 bp, Artificial Sequence
  Synthetic
atggccgactcccaagtacgcacttcacataagggtttagaaaggtttgtgaacattttgttttcttctttaattagcacaatattggtcacatttgtgaaattgttctgggtattgtagggagacccagcatggcgtat

SEQ ID NO: 426779 - DNA, 140 bp, Artificial Sequence
  Synthetic
aggccctggctgctgatatggaatagtaaatgaaaaaggagaaagtttcgacatgctttatggtctagcggttaaaggacaatctcatctgaggggagacactgatgtcgtaacagttgtgaccttttgggacagcggtg

SEQ ID NO: 426780 - DNA, 140 bp, Artificial Sequence
  Synthetic
caccgctgtcccaaaaggtcacaactgttacgacatcagtgtctcccctcagatgagattgtcctttaaccgctagaccataaagcatgtcgaaactttctcctttttcatttactattccatatcagcagccagggcct

SEQ ID NO: 426781 - DNA, 140 bp, Artificial Sequence
  Synthetic
atacgccatgctgggtctcctgcccacatacttgtcacaagagaaccatatctctcgtgtggaccaaacgagtgcagaatgtttgctctcagccaaggcaccacactaaggggtcggcatcgtacttgggagtcggccat

SEQ ID NO: 426782 - DNA, 140 bp, Artificial Sequence
  Synthetic
atggccgactcccaagtacgatgccgaccccttagtgtggtgccttggctgagagcaaacattctgcactcgtttggtccacacgagagatatggttctcttgtgacaagtatgtgggcaggagacccagcatggcgtat

SEQ ID NO: 426783 - DNA, 140 bp, Artificial Sequence
  Synthetic
aggccctggctgctgatatgagtgcagaatgtttgctctcagccaaggcaccacactaaggggtcggcatgcaaatgggactatacatgaccgaagtccgtttagagcattaataagttggaccttttgggacagcggtg

SEQ ID NO: 426784 - DNA, 140 bp, Artificial Sequence
  Synthetic
caccgctgtcccaaaaggtccaacttattaatgctctaaacggacttcggtcatgtatagtcccatttgcatgccgaccccttagtgtggtgccttggctgagagcaaacattctgcactcatatcagcagccagggcct

SEQ ID NO: 426785 - DNA, 140 bp, Artificial Sequence
  Synthetic
aggccctggctgctgatatgctaatagtaagtggaagagacgagcagtcaattgctgaagcaataattgtggccatggtattctcacaagaggactgcatgattaaggcagttcgaggtggaccttttgggacagcggtg

SEQ ID NO: 426786 - DNA, 140 bp, Artificial Sequence
  Synthetic
caccgctgtcccaaaaggtccacctcgaactgccttaatcatgcagtcctcttgtgagaataccatggccacaattattgcttcagcaattgactgctcgtctcttccacttactattagcatatcagcagccagggcct

SEQ ID NO: 426787 - DNA, 140 bp, Artificial Sequence
  Synthetic
atacgccatgctgggtctccgatggtccagcacctcatgccatgacggcatctcaagaatgtcaatctgcatgtcaggacctaataacaatgcttcggcagtggtctggtacaagggaagcgtacttgggagtcggccat

SEQ ID NO: 426788 - DNA, 140 bp, Artificial Sequence
  Synthetic
atggccgactcccaagtacgcttcccttgtaccagaccactgccgaagcattgttattaggtcctgacatgcagattgacattcttgagatgccgtcatggcatgaggtgctggaccatcggagacccagcatggcgtat

SEQ ID NO: 426789 - DNA, 140 bp, Artificial Sequence
  Synthetic
aggccctggctgctgatatgatgtcaggacctaataacaatgcttcggcagtggtctggtacaagggaaggccagtcaccgaaattgcttcgtgggcaggaaatatattaaggactcagggaccttttgggacagcggtg

SEQ ID NO: 426790 - DNA, 140 bp, Artificial Sequence
  Synthetic
caccgctgtcccaaaaggtccctgagtccttaatatatttcctgcccacgaagcaatttcggtgactggccttcccttgtaccagaccactgccgaagcattgttattaggtcctgacatcatatcagcagccagggcct

SEQ ID NO: 426791 - DNA, 140 bp, Artificial Sequence
  Synthetic
aggccctggctgctgatatgaattgaacccattgacaatgtgatggggatgatcgggatattgcccgacatgaccccaagtactgagatgtcgatgaggggagtaagagtcagtaaaatggaccttttgggacagcggtg

SEQ ID NO: 426792 - DNA, 140 bp, Artificial Sequence
  Synthetic
caccgctgtcccaaaaggtccattttactgactcttactcccctcatcgacatctcagtacttggggtcatgtcgggcaatatcccgatcatccccatcacattgtcaatgggttcaattcatatcagcagccagggcct

SEQ ID NO: 426793 - DNA, 140 bp, Artificial Sequence
  Synthetic
aggccctggctgctgatatgggaaggaatgcctgagtctatgagggaagaatatcggcaggaacagcagaatgctgtggatgttgacgatggtcattttgtcaacatagagctggagtaagaccttttgggacagcggtg

SEQ ID NO: 426794 - DNA, 140 bp, Artificial Sequence
  Synthetic
caccgctgtcccaaaaggtcttactccagctctatgttgacaaaatgaccatcgtcaacatccacagcattctgctgttcctgccgatattcttccctcatagactcaggcattccttcccatatcagcagccagggcct

SEQ ID NO: 426795 - DNA, 140 bp, Artificial Sequence
  Synthetic
atacgccatgctgggtctccggcccagctaataacagagcagaaacaaaaataatttacttcaaagaggggaaaatacagaaaatagaggaattgacaggaagtgcacagcatatagaagcgtacttgggagtcggccat

SEQ ID NO: 426796 - DNA, 140 bp, Artificial Sequence
  Synthetic
atggccgactcccaagtacgcttctatatgctgtgcacttcctgtcaattcctctattttctgtattttcccctctttgaagtaaattatttttgtttctgctctgttattagctgggccggagacccagcatggcgtat

SEQ ID NO: 426797 - DNA, 140 bp, Artificial Sequence
  Synthetic
aggccctggctgctgatatgatttttaagagttagagaccaacgggggaacgtactattgtcacccgaagaagtcagcgagacacaaggaacagagaaactgacaataacttattcgtcagaccttttgggacagcggtg

SEQ ID NO: 426798 - DNA, 140 bp, Artificial Sequence
  Synthetic
caccgctgtcccaaaaggtctgacgaataagttattgtcagtttctctgttccttgtgtctcgctgacttcttcgggtgacaatagtacgttcccccgttggtctctaactcttaaaaatcatatcagcagccagggcct

SEQ ID NO: 426799 - DNA, 140 bp, Artificial Sequence
  Synthetic
atacgccatgctgggtctccaattggaagggtgcaaatagaccagtaatcaccataaacccaaaaacaatgactcacacgagcaaatacttgtgttcaaagatcctaactgacacaagtccgtacttgggagtcggccat

SEQ ID NO: 426800 - DNA, 140 bp, Artificial Sequence
  Synthetic
atggccgactcccaagtacggacttgtgtcagttaggatctttgaacacaagtatttgctcgtgtgagtcattgtttttgggtttatggtgattactggtctatttgcacccttccaattggagacccagcatggcgtat

SEQ ID NO: 426801 - DNA, 140 bp, Artificial Sequence
  Synthetic
atacgccatgctgggtctccatcgggagattctacatacagatgtgcactgaactcaaactcagtgactacgaagggagactgatccaaaacagcataaccatagagaggatggttctctcgtacttgggagtcggccat

SEQ ID NO: 426802 - DNA, 140 bp, Artificial Sequence
  Synthetic
atggccgactcccaagtacgagagaaccatcctctctatggttatgctgttttggatcagtctcccttcgtagtcactgagtttgagttcagtgcacatctgtatgtagaatctcccgatggagacccagcatggcgtat

SEQ ID NO: 426803 - DNA, 140 bp, Artificial Sequence
  Synthetic
aggccctggctgctgatatgagcccagatcctggcgtaaagggatttgcattcttagatggggggaactcctggttgggaagaaccattagcaaagattcaaggtcaggatatgagatgcgaccttttgggacagcggtg

SEQ ID NO: 426804 - DNA, 140 bp, Artificial Sequence
  Synthetic
caccgctgtcccaaaaggtcgcatctcatatcctgaccttgaatctttgctaatggttcttcccaaccaggagttccccccatctaagaatgcaaatccctttacgccaggatctgggctcatatcagcagccagggcct

SEQ ID NO: 426805 - DNA, 140 bp, Artificial Sequence
  Synthetic
atacgccatgctgggtctcccaggtgatagtaaacaaccaaaactggtcggggtactcaggggcgtttatcgattattgggctgataaagagtgcttcaatccttgcttttatgtggaatcgtacttgggagtcggccat

SEQ ID NO: 426806 - DNA, 140 bp, Artificial Sequence
  Synthetic
atggccgactcccaagtacgattccacataaaagcaaggattgaagcactctttatcagcccaataatcgataaacgcccctgagtaccccgaccagttttggttgtttactatcacctgggagacccagcatggcgtat

SEQ ID NO: 426807 - DNA, 140 bp, Artificial Sequence
  Synthetic
atacgccatgctgggtctccaagccaataaaataaaatccgagaagacacacatccacattttctcattcactggagaagagatggccaccaaagcagattacactcttgacgaagaaagcgtacttgggagtcggccat

SEQ ID NO: 426808 - DNA, 140 bp, Artificial Sequence
  Synthetic
atggccgactcccaagtacgctttcttcgtcaagagtgtaatctgctttggtggccatctcttctccagtgaatgagaaaatgtggatgtgtgtcttctcggattttattttattggcttggagacccagcatggcgtat

SEQ ID NO: 426809 - DNA, 140 bp, Artificial Sequence
  Synthetic
atacgccatgctgggtctcctgcagggcagatcagcgttcaacccactttctcggtgcagagaaaccttccctttgaaagagcgaccattatggcagcatttgcaggaaatactgaaggccgtacttgggagtcggccat

SEQ ID NO: 426810 - DNA, 140 bp, Artificial Sequence
  Synthetic
atggccgactcccaagtacggccttcagtatttcctgcaaatgctgccataatggtcgctctttcaaagggaaggtttctctgcaccgagaaagtgggttgaacgctgatctgccctgcaggagacccagcatggcgtat

SEQ ID NO: 426811 - DNA, 140 bp, Artificial Sequence
  Synthetic
atacgccatgctgggtctcccccattccttgaccggctccgccgagatcagaagtccctaagaggaagaggcaacactcttggtctggacatcgaaacagctactcgtgcgggaaaacagcgtacttgggagtcggccat

SEQ ID NO: 426812 - DNA, 140 bp, Artificial Sequence
  Synthetic
atggccgactcccaagtacgctgttttcccgcacgagtagctgtttcgatgtccagaccaagagtgttgcctcttcctcttagggacttctgatctcggcggagccggtcaaggaatgggggagacccagcatggcgtat

SEQ ID NO: 426813 - DNA, 140 bp, Artificial Sequence
  Synthetic
aggccctggctgctgatatgaaagatgatcttcttgaaaatttgcaggcctaccagaaacggatgggagtgcaaatgcagcgattcaagtgatcctctcgttattgccgcaagtatcattgaccttttgggacagcggtg

SEQ ID NO: 426814 - DNA, 140 bp, Artificial Sequence
  Synthetic
caccgctgtcccaaaaggtcaatgatacttgcggcaataacgagaggatcacttgaatcgctgcatttgcactcccatccgtttctggtaggcctgcaaattttcaagaagatcatctttcatatcagcagccagggcct

SEQ ID NO: 426815 - DNA, 140 bp, Artificial Sequence
  Synthetic
aggccctggctgctgatatgcaatcgaacacattgcaagcatgagacggaactattttacagcagaggtgtcccactgcagggctactgaatacataatgaagggagtgtacataaatacgaccttttgggacagcggtg

SEQ ID NO: 426816 - DNA, 140 bp, Artificial Sequence
  Synthetic
caccgctgtcccaaaaggtcgtatttatgtacactcccttcattatgtattcagtagccctgcagtgggacacctctgctgtaaaatagttccgtctcatgcttgcaatgtgttcgattgcatatcagcagccagggcct

SEQ ID NO: 426817 - DNA, 140 bp, Artificial Sequence
  Synthetic
atacgccatgctgggtctcctgcgaaatgaatccaaatcagaagataataacaatcggggtagtgaataccactctgtcaacgatagcccttctcattggagtgggaaacttagtcttcacgtacttgggagtcggccat

SEQ ID NO: 426818 - DNA, 140 bp, Artificial Sequence
  Synthetic
atggccgactcccaagtacgtgaagactaagtttcccactccaatgagaagggctatcgttgacagagtggtattcactaccccgattgttattatcttctgatttggattcatttcgcaggagacccagcatggcgtat

SEQ ID NO: 426819 - DNA, 140 bp, Artificial Sequence
  Synthetic
atacgccatgctgggtctcctcctttccgtctgctccaaaacagtcaagtcttcagtctcatcagaccaaacgaaaatccagcgcataaaagtcagctggtatggatggcatgccactctcgtacttgggagtcggccat

SEQ ID NO: 426820 - DNA, 140 bp, Artificial Sequence
  Synthetic
atggccgactcccaagtacgagagtggcatgccatccataccagctgacttttatgcgctggattttcgtttggtctgatgagactgaagacttgactgttttggagcagacggaaaggaggagacccagcatggcgtat

SEQ ID NO: 426821 - DNA, 140 bp, Artificial Sequence
  Synthetic
atacgccatgctgggtctccgcagcatttgaagatctgagagtgtcaagcttcatcagaggaacaagagtagtcccaagaggacaactgtccaccagaggagttcagattgcttcaaatgcgtacttgggagtcggccat

SEQ ID NO: 426822 - DNA, 140 bp, Artificial Sequence
  Synthetic
atggccgactcccaagtacgcatttgaagcaatctgaactcctctggtggacagttgtcctcttgggactactcttgttcctctgatgaagcttgacactctcagatcttcaaatgctgcggagacccagcatggcgtat

SEQ ID NO: 426823 - DNA, 140 bp, Artificial Sequence
  Synthetic
aggccctggctgctgatatgacaccatcaagagctggaggaacaacataatgagaactcaagagtctgaatgtgcatgtgtaaatggctcttgctttactataatgactgatggaccaaggaccttttgggacagcggtg

SEQ ID NO: 426824 - DNA, 140 bp, Artificial Sequence
  Synthetic
caccgctgtcccaaaaggtccttggtccatcagtcattatagtaaagcaagagccatttacacatgcacattcagactcttgagttctcattatgttgttcctccagctcttgatggtgtcatatcagcagccagggcct

SEQ ID NO: 426825 - DNA, 140 bp, Artificial Sequence
  Synthetic
atacgccatgctgggtctcccccttccacaaggacaatgcaatacggctgggtgagaacaaagatgtcatagtcacaagggagccttatgttagctgtgacaatgacaactgctggtcctcgtacttgggagtcggccat

SEQ ID NO: 426826 - DNA, 140 bp, Artificial Sequence
  Synthetic
atggccgactcccaagtacgaggaccagcagttgtcattgtcacagctaacataaggctcccttgtgactatgacatctttgttctcacccagccgtattgcattgtccttgtggaagggggagacccagcatggcgtat

SEQ ID NO: 426827 - DNA, 140 bp, Artificial Sequence
  Synthetic
atacgccatgctgggtctccattaaagacagaacaccatataggtctctaattcgtttcccaataggaacagctccagtactaggaaattacaaagagatatgcattgcttggtcaagcacgtacttgggagtcggccat

SEQ ID NO: 426828 - DNA, 140 bp, Artificial Sequence
  Synthetic
atggccgactcccaagtacgtgcttgaccaagcaatgcatatctctttgtaatttcctagtactggagctgttcctattgggaaacgaattagagacctatatggtgttctgtctttaatggagacccagcatggcgtat

SEQ ID NO: 426829 - DNA, 140 bp, Artificial Sequence
  Synthetic
atacgccatgctgggtctccgcagctgctttgatgggaaagagtggatgcatgtgtgcatgacagggaatgataatgatgcaagtgcccagataatatatgcagggagaatgacagactccgtacttgggagtcggccat

SEQ ID NO: 426830 - DNA, 140 bp, Artificial Sequence
  Synthetic
atggccgactcccaagtacggagtctgtcattctccctgcatatattatctgggcacttgcatcattatcattccctgtcatgcacacatgcatccactctttcccatcaaagcagctgcggagacccagcatggcgtat

SEQ ID NO: 426831 - DNA, 140 bp, Artificial Sequence
  Synthetic
aggccctggctgctgatatggatagacggttggtatggtttcagacaccagaactctgagggtacaggacaagccgcagacctaaaaagcacacaggcagccattgaccagattaatggggaccttttgggacagcggtg

SEQ ID NO: 426832 - DNA, 140 bp, Artificial Sequence
  Synthetic
caccgctgtcccaaaaggtccccattaatctggtcaatggctgcctgtgtgctttttaggtctgcggcttgtcctgtaccctcagagttctggtgtctgaaaccataccaaccgtctatccatatcagcagccagggcct

SEQ ID NO: 426833 - DNA, 140 bp, Artificial Sequence
  Synthetic
aggccctggctgctgatatgcaacaaggaagaaaattgagaaaataaggcctcttctaatagatggcacagcatcattgagccctggaatgatgatgggcatgttcaacatgctaagtacgaccttttgggacagcggtg

SEQ ID NO: 426834 - DNA, 140 bp, Artificial Sequence
  Synthetic
caccgctgtcccaaaaggtcgtacttagcatgttgaacatgcccatcatcattccagggctcaatgatgctgtgccatctattagaagaggccttattttctcaattttcttccttgttgcatatcagcagccagggcct

SEQ ID NO: 426835 - DNA, 140 bp, Artificial Sequence
  Synthetic
atacgccatgctgggtctccgtatgtatgcagcaaatttcactcggacactcccaggccaactgacccttcaacagtgtcatgtgactccccaagcaatgtcaatggaggacccggagtgcgtacttgggagtcggccat

SEQ ID NO: 426836 - DNA, 140 bp, Artificial Sequence
  Synthetic
atggccgactcccaagtacgcactccgggtcctccattgacattgcttggggagtcacatgacactgttgaagggtcagttggcctgggagtgtccgagtgaaatttgctgcatacatacggagacccagcatggcgtat

SEQ ID NO: 426837 - DNA, 140 bp, Artificial Sequence
  Synthetic
atacgccatgctgggtctccgcctcgctgagtccgggaatgatgatgggcatgttcaacatgctgagcacggtcttaggagtctcaatcctgaatcttggacagaagagatacaccaaaacgtacttgggagtcggccat

SEQ ID NO: 426838 - DNA, 140 bp, Artificial Sequence
  Synthetic
atggccgactcccaagtacgttttggtgtatctcttctgtccaagattcaggattgagactcctaagaccgtgctcagcatgttgaacatgcccatcatcattcccggactcagcgaggcggagacccagcatggcgtat

SEQ ID NO: 426839 - DNA, 140 bp, Artificial Sequence
  Synthetic
atacgccatgctgggtctccaagggctttgggtttaaaacaggcgatgatgtatggttaggtagaacagtgtcaactagtggtagatcgggctttgaaatcatcaaagttaccgaagggtcgtacttgggagtcggccat

SEQ ID NO: 426840 - DNA, 140 bp, Artificial Sequence
  Synthetic
atggccgactcccaagtacgacccttcggtaactttgatgatttcaaagcccgatctaccactagttgacactgttctacctaaccatacatcatcgcctgttttaaacccaaagcccttggagacccagcatggcgtat

SEQ ID NO: 426841 - DNA, 140 bp, Artificial Sequence
  Synthetic
atacgccatgctgggtctcctctatcacaagtgtgatgatgaatgtatggaaagtgtgaagaacggcacatatgattatcccaaatattcagaagagtctaggttgaatcgagaagaaatcgtacttgggagtcggccat

SEQ ID NO: 426842 - DNA, 140 bp, Artificial Sequence
  Synthetic
atggccgactcccaagtacgatttcttctcgattcaacctagactcttctgaatatttgggataatcatatgtgccgttcttcacactttccatacattcatcatcacacttgtgatagaggagacccagcatggcgtat

SEQ ID NO: 426843 - DNA, 140 bp, Artificial Sequence
  Synthetic
atacgccatgctgggtctccaagtgaatggtcaggctgggagaatgacattctattggaccatagtgaaaccgggagaagcaataacatttgagtcaaatggcgcatttcttgctcctagcgtacttgggagtcggccat

SEQ ID NO: 426844 - DNA, 140 bp, Artificial Sequence
  Synthetic
atggccgactcccaagtacgctaggagcaagaaatgcgccatttgactcaaatgttattgcttctcccggtttcactatggtccaatagaatgtcattctcccagcctgaccattcacttggagacccagcatggcgtat

SEQ ID NO: 426845 - DNA, 140 bp, Artificial Sequence
  Synthetic
atacgccatgctgggtctccagaatgatgatgtttcttggacaagcaatagtatagttactttctgtgggctagacaatgaacctggatcgggaaattggccggatggttccaacattggcgtacttgggagtcggccat

SEQ ID NO: 426846 - DNA, 140 bp, Artificial Sequence
  Synthetic
atggccgactcccaagtacgccaatgttggaaccatccggccaatttcccgatccaggttcattgtctagcccacagaaagtaactatactattgcttgtccaagaaacatcatcattctggagacccagcatggcgtat

SEQ ID NO: 426847 - DNA, 140 bp, Artificial Sequence
  Synthetic
aggccctggctgctgatatgccaaagtaagagatcaggaaggaagaatcaactactactggactctactggaacctggggatacaataatattcgaggcaaatggaaatctgatagctccgaccttttgggacagcggtg

SEQ ID NO: 426848 - DNA, 140 bp, Artificial Sequence
  Synthetic
caccgctgtcccaaaaggtcggagctatcagatttccatttgcctcgaatattattgtatccccaggttccagtagagtccagtagtagttgattcttccttcctgatctcttactttggcatatcagcagccagggcct

SEQ ID NO: 426849 - DNA, 140 bp, Artificial Sequence
  Synthetic
aggccctggctgctgatatgttgcaatggggtttgctgcctttctattctgggccatgtcaaacggatcttgcagatgcaacatttgtatataattagcaaaaacacccttgtttctactgaccttttgggacagcggtg

SEQ ID NO: 426850 - DNA, 140 bp, Artificial Sequence
  Synthetic
caccgctgtcccaaaaggtcagtagaaacaagggtgtttttgctaattatatacaaatgttgcatctgcaagatccgtttgacatggcccagaatagaaaggcagcaaaccccattgcaacatatcagcagccagggcct

SEQ ID NO: 426851 - DNA, 140 bp, Artificial Sequence
  Synthetic
aggccctggctgctgatatgacagggatgaggaacatccctgagaaggcaaccagaggcctgtttggggcaattgctggctttatagagaatggctggcaaggattaattgatgggtggtgaccttttgggacagcggtg

SEQ ID NO: 426852 - DNA, 140 bp, Artificial Sequence
  Synthetic
caccgctgtcccaaaaggtcaccacccatcaattaatccttgccagccattctctataaagccagcaattgccccaaacaggcctctggttgccttctcagggatgttcctcatccctgtcatatcagcagccagggcct

SEQ ID NO: 426853 - DNA, 140 bp, Artificial Sequence
  Synthetic
atacgccatgctgggtctccgaagagaagatcccaaagacaaaaaatatgaagaggacaagccaattgaagtgggcacttggtgagaatatggcaccagaaaaggtagattttgatgactcgtacttgggagtcggccat

SEQ ID NO: 426854 - DNA, 140 bp, Artificial Sequence
  Synthetic
atggccgactcccaagtacgagtcatcaaaatctaccttttctggtgccatattctcaccaagtgcccacttcaattggcttgtcctcttcatattttttgtctttgggatcttctcttcggagacccagcatggcgtat

SEQ ID NO: 426855 - DNA, 140 bp, Artificial Sequence
  Synthetic
aggccctggctgctgatatgatgggttcaggcatcaaaatgcagaagggacagggacggctgcagatctcaagtcgacccaggcagctattgatcaaatcaatgggaaattgaatcgtctgaccttttgggacagcggtg

SEQ ID NO: 426856 - DNA, 140 bp, Artificial Sequence
  Synthetic
caccgctgtcccaaaaggtcagacgattcaatttcccattgatttgatcaatagctgcctgggtcgacttgagatctgcagccgtccctgtcccttctgcattttgatgcctgaacccatcatatcagcagccagggcct

SEQ ID NO: 426857 - DNA, 140 bp, Artificial Sequence
  Synthetic
atacgccatgctgggtctcctttggcgtcaagcgaataacggggaagacgcaactgctggtctaacccatatgatgatctggcattccaatctgaatgatgccacatatcagaggacaagcgtacttgggagtcggccat

SEQ ID NO: 426858 - DNA, 140 bp, Artificial Sequence
  Synthetic
atggccgactcccaagtacgcttgtcctctgatatgtggcatcattcagattggaatgccagatcatcatatgggttagaccagcagttgcgtcttccccgttattcgcttgacgccaaaggagacccagcatggcgtat

SEQ ID NO: 426859 - DNA, 140 bp, Artificial Sequence
  Synthetic
aggccctggctgctgatatgatgatgatctggcattccaatctgaatgatgccacatatcagaggacaagggcacttgtgcgtactggaatggatcctaggatgtgctctctgatgcaaggaccttttgggacagcggtg

SEQ ID NO: 426860 - DNA, 140 bp, Artificial Sequence
  Synthetic
caccgctgtcccaaaaggtccttgcatcagagagcacatcctaggatccattccagtacgcacaagtgcccttgtcctctgatatgtggcatcattcagattggaatgccagatcatcatcatatcagcagccagggcct

SEQ ID NO: 426861 - DNA, 140 bp, Artificial Sequence
  Synthetic
aggccctggctgctgatatgttggacttccacgactccaatgtgaagagtctgtacgagaaagtaaaaagccaattaaagaataatgctaaagaaatagggaatgggtgctttgaattctgaccttttgggacagcggtg

SEQ ID NO: 426862 - DNA, 140 bp, Artificial Sequence
  Synthetic
caccgctgtcccaaaaggtcagaattcaaagcacccattccctatttctttagcattattctttaattggctttttactttctcgtacagactcttcacattggagtcgtggaagtccaacatatcagcagccagggcct

SEQ ID NO: 426863 - DNA, 140 bp, Artificial Sequence
  Synthetic
atacgccatgctgggtctccggtcaactctcccaagaaggtctggggctgctggagcagcagtgaaaggagttggaacaatggtgatggaactgattcggatgatcaagcgaggggtcaacgtacttgggagtcggccat

SEQ ID NO: 426864 - DNA, 140 bp, Artificial Sequence
  Synthetic
atggccgactcccaagtacgttgacccctcgcttgatcatccgaatcagttccatcaccattgttccaactcctttcactgctgctccagcagccccagaccttcttgggagagttgaccggagacccagcatggcgtat

SEQ ID NO: 426865 - DNA, 140 bp, Artificial Sequence
  Synthetic
atacgccatgctgggtctccatgaaagaatgtgcaacatcctcaaagggaaattccaaacagcagcacaacgagcaatgatggaccaggtgagagaaagccggaatcctgggaatgctgacgtacttgggagtcggccat

SEQ ID NO: 426866 - DNA, 140 bp, Artificial Sequence
  Synthetic
atggccgactcccaagtacgtcagcattcccaggattccggctttctctcacctggtccatcattgctcgttgtgctgctgtttggaatttccctttgaggatgttgcacattctttcatggagacccagcatggcgtat

SEQ ID NO: 426867 - DNA, 140 bp, Artificial Sequence
  Synthetic
aggccctggctgctgatatggatccaaaacagcataaccatagagaggatggttctctcagcatttgatgagaggagaaacaaatatctggaggagcatcccagtgctgggaaagatcccgaccttttgggacagcggtg

SEQ ID NO: 426868 - DNA, 140 bp, Artificial Sequence
  Synthetic
caccgctgtcccaaaaggtcgggatctttcccagcactgggatgctcctccagatatttgtttctcctctcatcaaatgctgagagaaccatcctctctatggttatgctgttttggatccatatcagcagccagggcct

SEQ ID NO: 426869 - DNA, 140 bp, Artificial Sequence
  Synthetic
aggccctggctgctgatatggccagtgggtacgactttgagagagagggatactccctagtcggaatcgatcctttccgtctactccaaaatagtcaagtcttcagtcttatcagaccaagaccttttgggacagcggtg

SEQ ID NO: 426870 - DNA, 140 bp, Artificial Sequence
  Synthetic
caccgctgtcccaaaaggtcttggtctgataagactgaagacttgactattttggagtagacggaaaggatcgattccgactagggagtatccctctctctcaaagtcgtacccactggccatatcagcagccagggcct

SEQ ID NO: 426871 - DNA, 140 bp, Artificial Sequence
  Synthetic
aggccctggctgctgatatgggtcccaagaggacaactgtcaaccagaggagtacagattgcttcaaatgagaacatggaaacaatggactccagcactcttgaattgaggagcagatatgaccttttgggacagcggtg

SEQ ID NO: 426872 - DNA, 140 bp, Artificial Sequence
  Synthetic
caccgctgtcccaaaaggtcatatctgctcctcaattcaagagtgctggagtccattgtttccatgttctcatttgaagcaatctgtactcctctggttgacagttgtcctcttgggacccatatcagcagccagggcct

SEQ ID NO: 426873 - DNA, 140 bp, Artificial Sequence
  Synthetic
aggccctggctgctgatatgatttcacaaggaattaagagacaaagaatgacagttgagtctatggggtgggccttgagctaatataaatttatccattaattcaatgaacgcaattgaggaccttttgggacagcggtg

SEQ ID NO: 426874 - DNA, 140 bp, Artificial Sequence
  Synthetic
caccgctgtcccaaaaggtcctcaattgcgttcattgaattaatggataaatttatattagctcaaggcccaccccatagactcaactgtcattctttgtctcttaattccttgtgaaatcatatcagcagccagggcct

SEQ ID NO: 426875 - DNA, 140 bp, Artificial Sequence
  Synthetic
atacgccatgctgggtctcctgcaggacaaatcagcgtacaacccacattctctgtgcaaagaaacctcccattcgagagagcaaccattatggcagcattcaccggaaatactgaaggccgtacttgggagtcggccat

SEQ ID NO: 426876 - DNA, 140 bp, Artificial Sequence
  Synthetic
atggccgactcccaagtacggccttcagtatttccggtgaatgctgccataatggttgctctctcgaatgggaggtttctttgcacagagaatgtgggttgtacgctgatttgtcctgcaggagacccagcatggcgtat

SEQ ID NO: 426877 - DNA, 140 bp, Artificial Sequence
  Synthetic
atacgccatgctgggtctccggaataccactatatgatgcaatcaagtgcatgaagacattttttggctggaaagagcctaacataatcaaaccacatgagaaaggcataaaccccaattcgtacttgggagtcggccat

SEQ ID NO: 426878 - DNA, 140 bp, Artificial Sequence
  Synthetic
atggccgactcccaagtacgaattggggtttatgcctttctcatgtggtttgattatgttaggctctttccagccaaaaaatgtcttcatgcacttgattgcatcatatagtggtattccggagacccagcatggcgtat

SEQ ID NO: 426879 - DNA, 140 bp, Artificial Sequence
  Synthetic
atacgccatgctgggtctcccgatcgtgccttcctttgacatgagtaacgagggatcttatttcttcggagacaatgcagaggagtatgacaattaaagaaaaatacccttgtttctactcgtacttgggagtcggccat

SEQ ID NO: 426880 - DNA, 140 bp, Artificial Sequence
  Synthetic
atggccgactcccaagtacgagtagaaacaagggtatttttctttaattgtcatactcctctgcattgtctccgaagaaataagatccctcgttactcatgtcaaaggaaggcacgatcgggagacccagcatggcgtat

SEQ ID NO: 426881 - DNA, 140 bp, Artificial Sequence
  Synthetic
atacgccatgctgggtctccggatacaaaatgaacactcaaattttggcactcattgcttgtatgctgattggagctaaaggagataaaatatgtcttgggcaccatgctgtggcaaatgcgtacttgggagtcggccat

SEQ ID NO: 426882 - DNA, 140 bp, Artificial Sequence
  Synthetic
atggccgactcccaagtacgcatttgccacagcatggtgcccaagacatattttatctcctttagctccaatcagcatacaagcaatgagtgccaaaatttgagtgttcattttgtatccggagacccagcatggcgtat

SEQ ID NO: 426883 - DNA, 140 bp, Artificial Sequence
  Synthetic
atacgccatgctgggtctccgaacaaaagtgaacacattaacagagagaggaatcgaagtagtaaatgccacagaaacggtggagactgcaaatactaagaaaatatgcactcaggggaacgtacttgggagtcggccat

SEQ ID NO: 426884 - DNA, 140 bp, Artificial Sequence
  Synthetic
atggccgactcccaagtacgttcccctgagtgcatattttcttagtatttgcagtctccaccgtttctgtggcatttactacttcgattcctctctctgttaatgtgttcacttttgttcggagacccagcatggcgtat

SEQ ID NO: 426885 - DNA, 140 bp, Artificial Sequence
  Synthetic
atacgccatgctgggtctccaagaccaacagatctgggacaatgcggacttctaggaaccctaataggacctccccaatgcgatcaattcctggagtttgacgctgatttaataattgaacgtacttgggagtcggccat

SEQ ID NO: 426886 - DNA, 140 bp, Artificial Sequence
  Synthetic
atggccgactcccaagtacgttcaattattaaatcagcgtcaaactccaggaattgatcgcattggggaggtcctattagggttcctagaagtccgcattgtcccagatctgttggtcttggagacccagcatggcgtat

SEQ ID NO: 426887 - DNA, 140 bp, Artificial Sequence
  Synthetic
aggccctggctgctgatatgacaatggagaggacgcaactgctggccttacccacctgatgatatggcattccaatctaaatgatgccacatatcagagaacaagagctctcgtgcgtacgaccttttgggacagcggtg

SEQ ID NO: 426888 - DNA, 140 bp, Artificial Sequence
  Synthetic
caccgctgtcccaaaaggtcgtacgcacgagagctcttgttctctgatatgtggcatcatttagattggaatgccatatcatcaggtgggtaaggccagcagttgcgtcctctccattgtcatatcagcagccagggcct

SEQ ID NO: 426889 - DNA, 140 bp, Artificial Sequence
  Synthetic
aggccctggctgctgatatggacaagaccaatcttgtcacctctgactaagggaattttaggatttgtgttcacgctcaccgtgcccagtgagcgaggactgcagcgtagacgctttgtcgaccttttgggacagcggtg

SEQ ID NO: 426890 - DNA, 140 bp, Artificial Sequence
  Synthetic
caccgctgtcccaaaaggtcgacaaagcgtctacgctgcagtcctcgctcactgggcacggtgagcgtgaacacaaatcctaaaattcccttagtcagaggtgacaagattggtcttgtccatatcagcagccagggcct

SEQ ID NO: 426891 - DNA, 140 bp, Artificial Sequence
  Synthetic
atacgccatgctgggtctcccaatggaacctccaagatcaagatgaaatggggcatggaaatgaggcgctgccttctccaatctcttcagcagattgagagcatgattgaggctgagtctcgtacttgggagtcggccat

SEQ ID NO: 426892 - DNA, 140 bp, Artificial Sequence
  Synthetic
atggccgactcccaagtacgagactcagcctcaatcatgctctcaatctgctgaagagattggagaaggcagcgcctcatttccatgccccatttcatcttgatcttggaggttccattgggagacccagcatggcgtat

SEQ ID NO: 426893 - DNA, 140 bp, Artificial Sequence
  Synthetic
atacgccatgctgggtctccaagctcaaaataccagcagtcattcaccccaagcccgggggcacgaccacaggtgaatgggcaatcagggaggattgattttcactggctactccttgatcgtacttgggagtcggccat

SEQ ID NO: 426894 - DNA, 140 bp, Artificial Sequence
  Synthetic
atggccgactcccaagtacgatcaaggagtagccagtgaaaatcaatcctccctgattgcccattcacctgtggtcgtgcccccgggcttggggtgaatgactgctggtattttgagcttggagacccagcatggcgtat

SEQ ID NO: 426895 - DNA, 140 bp, Artificial Sequence
  Synthetic
atacgccatgctgggtctccttcatcaaggactacaggtacacataccgttgccacagaggtgacacacaaattcagacgaggagatcatttgagctgaaaaagttatgggagcagaccccgtacttgggagtcggccat

SEQ ID NO: 426896 - DNA, 140 bp, Artificial Sequence
  Synthetic
atggccgactcccaagtacggggtctgctcccataactttttcagctcaaatgatctcctcgtctgaatttgtgtgtcacctctgtggcaacggtatgtgtacctgtagtccttgatgaaggagacccagcatggcgtat

SEQ ID NO: 426897 - DNA, 140 bp, Artificial Sequence
  Synthetic
atacgccatgctgggtctcccagagcaagtttctttagaggagagtcaataggaattcagagtgatgttcctttggattctggttgtgagggggattgcttccacaatgggggtacgatacgtacttgggagtcggccat

SEQ ID NO: 426898 - DNA, 140 bp, Artificial Sequence
  Synthetic
atggccgactcccaagtacgtatcgtacccccattgtggaagcaatccccctcacaaccagaatccaaaggaacatcactctgaattcctattgactctcctctaaagaaacttgctctgggagacccagcatggcgtat

SEQ ID NO: 426899 - DNA, 140 bp, Artificial Sequence
  Synthetic
atacgccatgctgggtctccccctcgatatgtcaaacagacaagcctacttttggctacagggatgagaaacgtcccagagaaccccaagaccagaggcctttttggagcgattgctggacgtacttgggagtcggccat

SEQ ID NO: 426900 - DNA, 140 bp, Artificial Sequence
  Synthetic
atggccgactcccaagtacgtccagcaatcgctccaaaaaggcctctggtcttggggttctctgggacgtttctcatccctgtagccaaaagtaggcttgtctgtttgacatatcgagggggagacccagcatggcgtat

SEQ ID NO: 426901 - DNA, 140 bp, Artificial Sequence
  Synthetic
aggccctggctgctgatatgtgcgataatatgcttcctcatgcagattgccatcttaacaacgactatgacactacatttcaagcaaaatgaatgcagcaacccatcaaataatcaagtggaccttttgggacagcggtg

SEQ ID NO: 426902 - DNA, 140 bp, Artificial Sequence
  Synthetic
caccgctgtcccaaaaggtccacttgattatttgatgggttgctgcattcattttgcttgaaatgtagtgtcatagtcgttgttaagatggcaatctgcatgaggaagcatattatcgcacatatcagcagccagggcct

SEQ ID NO: 426903 - DNA, 140 bp, Artificial Sequence
  Synthetic
aggccctggctgctgatatgaattcagacgaggagatcatttgagctgaaaaagttatgggagcagacccgttcaaaaacaggactgttggtatctgatggaggaccaaacttatacaacgaccttttgggacagcggtg

SEQ ID NO: 426904 - DNA, 140 bp, Artificial Sequence
  Synthetic
caccgctgtcccaaaaggtcgttgtataagtttggtcctccatcagataccaacagtcctgtttttgaacgggtctgctcccataactttttcagctcaaatgatctcctcgtctgaattcatatcagcagccagggcct

SEQ ID NO: 426905 - DNA, 140 bp, Artificial Sequence
  Synthetic
atacgccatgctgggtctccacatcaaaatgcacaaggagaaggaactgcagctgattacaaaagcactcaatctgcaatagatcagatcacaggcaaattgaatcgtctaattgacaaacgtacttgggagtcggccat

SEQ ID NO: 426906 - DNA, 140 bp, Artificial Sequence
  Synthetic
atggccgactcccaagtacgtttgtcaattagacgattcaatttgcctgtgatctgatctattgcagattgagtgcttttgtaatcagctgcagttccttctccttgtgcattttgatgtggagacccagcatggcgtat

SEQ ID NO: 426907 - DNA, 140 bp, Artificial Sequence
  Synthetic
atacgccatgctgggtctcccctcacagaactcttttaatgaatgagttaggtgtcccatttcatttgggaaccaaacaagtgtgcatagcatggtctagttcaagttgctatgatggaacgtacttgggagtcggccat

SEQ ID NO: 426908 - DNA, 140 bp, Artificial Sequence
  Synthetic
atggccgactcccaagtacgttccatcatagcaacttgaactagaccatgctatgcacacttgtttggttcccaaatgaaatgggacacctaactcattcattaaaagagttctgtgaggggagacccagcatggcgtat

SEQ ID NO: 426909 - DNA, 140 bp, Artificial Sequence
  Synthetic
atacgccatgctgggtctccacaaattgggaatgtcattaactggacacgagattcaatgactgaggtatggtcgtacaatgctgaattgctggtagctatggaaaatcagcacacaatacgtacttgggagtcggccat

SEQ ID NO: 426910 - DNA, 140 bp, Artificial Sequence
  Synthetic
atggccgactcccaagtacgtattgtgtgctgattttccatagctaccagcaattcagcattgtacgaccatacctcagtcattgaatctcgtgtccagttaatgacattcccaatttgtggagacccagcatggcgtat

SEQ ID NO: 426911 - DNA, 140 bp, Artificial Sequence
  Synthetic
aggccctggctgctgatatgagtatcatttatgatgggatgcttgttgacagtattggttcatggtccaaaaacatcctcagaacccaggagtcagaatgcgtttgcatcaatggaacttgaccttttgggacagcggtg

SEQ ID NO: 426912 - DNA, 140 bp, Artificial Sequence
  Synthetic
caccgctgtcccaaaaggtcaagttccattgatgcaaacgcattctgactcctgggttctgaggatgtttttggaccatgaaccaatactgtcaacaagcatcccatcataaatgatactcatatcagcagccagggcct

SEQ ID NO: 426913 - DNA, 140 bp, Artificial Sequence
  Synthetic
atacgccatgctgggtctccgctgggatttctttttggatgtgttctaatgggtctctgcaatgcagaatttgcatttgactgtgagtcaatttgtaattaaaaacacccttgtttctaccgtacttgggagtcggccat

SEQ ID NO: 426914 - DNA, 140 bp, Artificial Sequence
  Synthetic
atggccgactcccaagtacggtagaaacaagggtgtttttaattacaaattgactcacagtcaaatgcaaattctgcattgcagagacccattagaacacatccaaaaagaaatcccagcggagacccagcatggcgtat

SEQ ID NO: 426915 - DNA, 140 bp, Artificial Sequence
  Synthetic
atacgccatgctgggtctccagtgaaattgagtagtggatacaaagacataatcttatggtttagcttcggggcatcatgttttcttcttctagccattgcaatgggattggttttcattcgtacttgggagtcggccat

SEQ ID NO: 426916 - DNA, 140 bp, Artificial Sequence
  Synthetic
atggccgactcccaagtacgaatgaaaaccaatcccattgcaatggctagaagaagaaaacatgatgccccgaagctaaaccataagattatgtctttgtatccactactcaatttcactggagacccagcatggcgtat

SEQ ID NO: 426917 - DNA, 140 bp, Artificial Sequence
  Synthetic
aggccctggctgctgatatgacttgttggcgacacaccaagaaatgatgatagctccagcagcagcaattgcagagaccctaataacgaaagaggggccccaggagtgaaaggatgggccgaccttttgggacagcggtg

SEQ ID NO: 426918 - DNA, 140 bp, Artificial Sequence
  Synthetic
caccgctgtcccaaaaggtcggcccatcctttcactcctggggcccctctttcgttattagggtctctgcaattgctgctgctggagctatcatcatttcttggtgtgtcgccaacaagtcatatcagcagccagggcct

SEQ ID NO: 426919 - DNA, 140 bp, Artificial Sequence
  Synthetic
atacgccatgctgggtctccattacagagaatagttttgaacaaataacatttatgcaagccttacaactattgcttgaagtggagcaagagataagaactttctcgtttcagcttatttcgtacttgggagtcggccat

SEQ ID NO: 426920 - DNA, 140 bp, Artificial Sequence
  Synthetic
atggccgactcccaagtacgaaataagctgaaacgagaaagttcttatctcttgctccacttcaagcaatagttgtaaggcttgcataaatgttatttgttcaaaactattctctgtaatggagacccagcatggcgtat

SEQ ID NO: 426921 - DNA, 140 bp, Artificial Sequence
  Synthetic
aggccctggctgctgatatgtttgaacaaataacatttatgcaagccttacaactattgcttgaagtggagcaagagataagaactttctcgtttcagcttatttaatgataaaaaacacgaccttttgggacagcggtg

SEQ ID NO: 426922 - DNA, 140 bp, Artificial Sequence
  Synthetic
caccgctgtcccaaaaggtcgtgttttttatcattaaataagctgaaacgagaaagttcttatctcttgctccacttcaagcaatagttgtaaggcttgcataaatgttatttgttcaaacatatcagcagccagggcct

SEQ ID NO: 426923 - DNA, 140 bp, Artificial Sequence
  Synthetic
atacgccatgctgggtctccgttcctggcaatgattacatacatcaccagaaatcaacccgagtggttcagaaacatcctgagcatggcacccataatgttctcaaacaaaatggcaagacgtacttgggagtcggccat

SEQ ID NO: 426924 - DNA, 140 bp, Artificial Sequence
  Synthetic
atggccgactcccaagtacgtcttgccattttgtttgagaacattatgggtgccatgctcaggatgtttctgaaccactcgggttgatttctggtgatgtatgtaatcattgccaggaacggagacccagcatggcgtat

SEQ ID NO: 426925 - DNA, 140 bp, Artificial Sequence
  Synthetic
aggccctggctgctgatatgtccgaatgcattgttgaagcaccgatttgaaataattgaagggagagatcgaacattggcctggacagtggtgaatagtatctgtaacaccacaggagtcgaccttttgggacagcggtg

SEQ ID NO: 426926 - DNA, 140 bp, Artificial Sequence
  Synthetic
caccgctgtcccaaaaggtcgactcctgtggtgttacagatactattcaccactgtccaggccaatgttcgatctctcccttcaattatttcaaatcggtgcttcaacaatgcattcggacatatcagcagccagggcct

SEQ ID NO: 426927 - DNA, 140 bp, Artificial Sequence
  Synthetic
aggccctggctgctgatatgatgaagactatcattgctttcagctgcattttatgtcaaattttcgctcaaaaacttcccggaagtgacaacagcatggcaacgctgtgcctgggacaccgaccttttgggacagcggtg

SEQ ID NO: 426928 - DNA, 140 bp, Artificial Sequence
  Synthetic
caccgctgtcccaaaaggtcggtgtcccaggcacagcgttgccatgctgttgtcacttccgggaagtttttgagcgaaaatttgacataaaatgcagctgaaagcaatgatagtcttcatcatatcagcagccagggcct

SEQ ID NO: 426929 - DNA, 140 bp, Artificial Sequence
  Synthetic
atacgccatgctgggtctccgtggacttcaaatagcatcattgtattctgtggaacctcaggtacatatgggacaggctcatggcctgatggagcgaatatcaacttcatgcctatataacgtacttgggagtcggccat

SEQ ID NO: 426930 - DNA, 140 bp, Artificial Sequence
  Synthetic
atggccgactcccaagtacgttatataggcatgaagttgatattcgctccatcaggccatgagcctgtcccatatgtacctgaggttccacagaatacaatgatgctatttgaagtccacggagacccagcatggcgtat

SEQ ID NO: 426931 - DNA, 140 bp, Artificial Sequence
  Synthetic
aggccctggctgctgatatgcattgaaattggagtaacacggagagaagttcacatatactatctagaaaaagccaataagataaaatccgaaaagacacatatccacatattctcattcgaccttttgggacagcggtg

SEQ ID NO: 426932 - DNA, 140 bp, Artificial Sequence
  Synthetic
caccgctgtcccaaaaggtcgaatgagaatatgtggatatgtgtcttttcggattttatcttattggctttttctagatagtatatgtgaacttctctccgtgttactccaatttcaatgcatatcagcagccagggcct

SEQ ID NO: 426933 - DNA, 140 bp, Artificial Sequence
  Synthetic
atacgccatgctgggtctccacatcctcaaagggaaattccaaacagctgcacaaagagcaatgatggatcaagtgcgagagagcagaaatcctgggaatgctgaaattgaagatctcatcgtacttgggagtcggccat

SEQ ID NO: 426934 - DNA, 140 bp, Artificial Sequence
  Synthetic
atggccgactcccaagtacgatgagatcttcaatttcagcattcccaggatttctgctctctcgcacttgatccatcattgctctttgtgcagctgtttggaatttccctttgaggatgtggagacccagcatggcgtat

SEQ ID NO: 426935 - DNA, 140 bp, Artificial Sequence
  Synthetic
atacgccatgctgggtctccctccacacagagcataatgggatgctgtgtgcaacaagcttgggacaacctcttattttagacacctgcaccattgaagggctaatctatggcaatccttcgtacttgggagtcggccat

SEQ ID NO: 426936 - DNA, 140 bp, Artificial Sequence
  Synthetic
atggccgactcccaagtacgaaggattgccatagattagcccttcaatggtgcaggtgtctaaaataagaggttgtcccaagcttgttgcacacagcatcccattatgctctgtgtggagggagacccagcatggcgtat

SEQ ID NO: 426937 - DNA, 140 bp, Artificial Sequence
  Synthetic
atacgccatgctgggtctcctagtccttaggggaggcggcaacaatgggatttgtaacgagacggtagtaagggaatacaatgagacagttaggatagagaaggtaattcaatggcacaacgtacttgggagtcggccat

SEQ ID NO: 426938 - DNA, 140 bp, Artificial Sequence
  Synthetic
atggccgactcccaagtacgttgtgccattgaattaccttctctatcctaactgtctcattgtattcccttactaccgtctcgttacaaatcccattgttgccgcctcccctaaggactaggagacccagcatggcgtat

SEQ ID NO: 426939 - DNA, 140 bp, Artificial Sequence
  Synthetic
atacgccatgctgggtctccccatcagctgttaacggattgtgttaccccgggaatgtagaaaatctagaagagctaaggtcactttttagttctgctaggtcttatcaaagaatccagacgtacttgggagtcggccat

SEQ ID NO: 426940 - DNA, 140 bp, Artificial Sequence
  Synthetic
atggccgactcccaagtacgtctggattctttgataagacctagcagaactaaaaagtgaccttagctcttctagattttctacattcccggggtaacacaatccgttaacagctgatggggagacccagcatggcgtat

SEQ ID NO: 426941 - DNA, 140 bp, Artificial Sequence
  Synthetic
aggccctggctgctgatatgaaagaagtgaatgccagaattgagccattcctgaagacaacaccccgccctctaaaattacctgatgggcctccatgctctcagcggtcgaagttcctgcgaccttttgggacagcggtg

SEQ ID NO: 426942 - DNA, 140 bp, Artificial Sequence
  Synthetic
caccgctgtcccaaaaggtcgcaggaacttcgaccgctgagagcatggaggcccatcaggtaattttagagggcggggtgttgtcttcaggaatggctcaattctggcattcacttctttcatatcagcagccagggcct

SEQ ID NO: 426943 - DNA, 140 bp, Artificial Sequence
  Synthetic
aggccctggctgctgatatgattctgcagcatttgaagacctgagagtctcaagtttcattagagggacgagggtaatcccaaggggacaactatccactagaggagttcagattgcttcgaccttttgggacagcggtg

SEQ ID NO: 426944 - DNA, 140 bp, Artificial Sequence
  Synthetic
caccgctgtcccaaaaggtcgaagcaatctgaactcctctagtggatagttgtccccttgggattaccctcgtccctctaatgaaacttgagactctcaggtcttcaaatgctgcagaatcatatcagcagccagggcct

SEQ ID NO: 426945 - DNA, 140 bp, Artificial Sequence
  Synthetic
aggccctggctgctgatatggggataccgctatatgatgcaatcaaatgcatgaagacatttttcggctggaaagatcccaacattgtaaaaccacataagaagggcataaatcccaattgaccttttgggacagcggtg

SEQ ID NO: 426946 - DNA, 140 bp, Artificial Sequence
  Synthetic
caccgctgtcccaaaaggtcaattgggatttatgcccttcttatgtggttttacaatgttgggatctttccagccgaaaaatgtcttcatgcatttgattgcatcatatagcggtatccccatatcagcagccagggcct

SEQ ID NO: 426947 - DNA, 140 bp, Artificial Sequence
  Synthetic
atacgccatgctgggtctccgaaagatcccaacattgtaaaaccacataagaagggcataaatcccaattaccttttggcttggaaacaggtgttggcagagctccaagacattgaaaatcgtacttgggagtcggccat

SEQ ID NO: 426948 - DNA, 140 bp, Artificial Sequence
  Synthetic
atggccgactcccaagtacgattttcaatgtcttggagctctgccaacacctgtttccaagccaaaaggtaattgggatttatgcccttcttatgtggttttacaatgttgggatctttcggagacccagcatggcgtat

SEQ ID NO: 426949 - DNA, 140 bp, Artificial Sequence
  Synthetic
aggccctggctgctgatatgaaataggatcttcaaaccattgataggaccaaggcctcttgtcaacggtttgatgggaagaattgattattattggtcggtattgaaaccgggtcaaacagaccttttgggacagcggtg

SEQ ID NO: 426950 - DNA, 140 bp, Artificial Sequence
  Synthetic
caccgctgtcccaaaaggtctgtttgacccggtttcaataccgaccaataataatcaattcttcccatcaaaccgttgacaagaggccttggtcctatcaatggtttgaagatcctatttcatatcagcagccagggcct

SEQ ID NO: 426951 - DNA, 140 bp, Artificial Sequence
  Synthetic
aggccctggctgctgatatggtgggcacttggtgagaatatggcaccagaaaaaatggactttgaggattgcaaagatgttagtgatctaaagcagtatgacagtgaagaaccagagtctgaccttttgggacagcggtg

SEQ ID NO: 426952 - DNA, 140 bp, Artificial Sequence
  Synthetic
caccgctgtcccaaaaggtcagactctggttcttcactgtcatactgctttagatcactaacatctttgcaatcctcaaagtccattttttctggtgccatattctcaccaagtgcccaccatatcagcagccagggcct

SEQ ID NO: 426953 - DNA, 140 bp, Artificial Sequence
  Synthetic
atacgccatgctgggtctcctctttcaggagagagccacggaagaattctgaagactgatttaaaaaggggtagctgcacagtgcaatgtcagacagagaaaggtggcttaaacacaacacgtacttgggagtcggccat

SEQ ID NO: 426954 - DNA, 140 bp, Artificial Sequence
  Synthetic
atggccgactcccaagtacgtgttgtgtttaagccacctttctctgtctgacattgcactgtgcagctacccctttttaaatcagtcttcagaattcttccgtggctctctcctgaaagaggagacccagcatggcgtat

SEQ ID NO: 426955 - DNA, 140 bp, Artificial Sequence
  Synthetic
aggccctggctgctgatatggtagctgcacagtgcaatgtcagacagagaaaggtggcttaaacacaacattgccattccaaaatgtaagtaagtatgcatttggaaactgctcaaaatagaccttttgggacagcggtg

SEQ ID NO: 426956 - DNA, 140 bp, Artificial Sequence
  Synthetic
caccgctgtcccaaaaggtctattttgagcagtttccaaatgcatacttacttacattttggaatggcaatgttgtgtttaagccacctttctctgtctgacattgcactgtgcagctaccatatcagcagccagggcct

SEQ ID NO: 426957 - DNA, 140 bp, Artificial Sequence
  Synthetic
aggccctggctgctgatatgcgattgagcacattgcaagcatgagaaggaattatttcactgcagaggtatctcattgcagagctactgaatacataatgaaaggagtgtacataaacacgaccttttgggacagcggtg

SEQ ID NO: 426958 - DNA, 140 bp, Artificial Sequence
  Synthetic
caccgctgtcccaaaaggtcgtgtttatgtacactcctttcattatgtattcagtagctctgcaatgagatacctctgcagtgaaataattccttctcatgcttgcaatgtgctcaatcgcatatcagcagccagggcct

SEQ ID NO: 426959 - DNA, 140 bp, Artificial Sequence
  Synthetic
atacgccatgctgggtctcctctcattgcagagctactgaatacataatgaaaggagtgtacataaacacagctttgttgaatgcatcctgtgcagccatggatgacttccaactgattccgtacttgggagtcggccat

SEQ ID NO: 426960 - DNA, 140 bp, Artificial Sequence
  Synthetic
atggccgactcccaagtacggaatcagttggaagtcatccatggctgcacaggatgcattcaacaaagctgtgtttatgtacactcctttcattatgtattcagtagctctgcaatgagaggagacccagcatggcgtat

SEQ ID NO: 426961 - DNA, 140 bp, Artificial Sequence
  Synthetic
aggccctggctgctgatatgtatgggttcattgtaaaaggaagatcccatttgagaaatgacactgatgtagtgaattttgtgagtatggaattctctcttactgacccaaggctagagcgaccttttgggacagcggtg

SEQ ID NO: 426962 - DNA, 140 bp, Artificial Sequence
  Synthetic
caccgctgtcccaaaaggtcgctctagccttgggtcagtaagagagaattccatactcacaaaattcactacatcagtgtcatttctcaaatgggatcttccttttacaatgaacccatacatatcagcagccagggcct

SEQ ID NO: 426963 - DNA, 140 bp, Artificial Sequence
  Synthetic
aggccctggctgctgatatgcacacaagtgggaaaagtactgtgttctcgagataggagacatgctcataagaactgcaataggccaagtatcaaggcccatgttcctgtacgtgagaacgaccttttgggacagcggtg

SEQ ID NO: 426964 - DNA, 140 bp, Artificial Sequence
  Synthetic
caccgctgtcccaaaaggtcgttctcacgtacaggaacatgggccttgatacttggcctattgcagttcttatgagcatgtctcctatctcgagaacacagtacttttcccacttgtgtgcatatcagcagccagggcct

SEQ ID NO: 426965 - DNA, 140 bp, Artificial Sequence
  Synthetic
aggccctggctgctgatatgaattcagacaagaaggtcattcgagctgaagaagttgtgggaacagacccgctcgaaagcaggactgctggtctcagatggaggaccaaatctatacaatgaccttttgggacagcggtg

SEQ ID NO: 426966 - DNA, 140 bp, Artificial Sequence
  Synthetic
caccgctgtcccaaaaggtcattgtatagatttggtcctccatctgagaccagcagtcctgctttcgagcgggtctgttcccacaacttcttcagctcgaatgaccttcttgtctgaattcatatcagcagccagggcct

SEQ ID NO: 426967 - DNA, 140 bp, Artificial Sequence
  Synthetic
aggccctggctgctgatatgaacgtggccaattggagagtcacccaagggagtggaggaaagctccatcgggaaggtgtgcagaactttactggcgaaatctgtatttaacagcctatatgaccttttgggacagcggtg

SEQ ID NO: 426968 - DNA, 140 bp, Artificial Sequence
  Synthetic
caccgctgtcccaaaaggtcatataggctgttaaatacagatttcgccagtaaagttctgcacaccttcccgatggagctttcctccactcccttgggtgactctccaattggccacgttcatatcagcagccagggcct

SEQ ID NO: 426969 - DNA, 140 bp, Artificial Sequence
  Synthetic
atacgccatgctgggtctccggaaaggtagtaaaatcagttgagttgagtgcccctaattatcactatgaagagtgttcctgttatcctgatgctagtgaggtgatgtgtgtatgcagggcgtacttgggagtcggccat

SEQ ID NO: 426970 - DNA, 140 bp, Artificial Sequence
  Synthetic
atggccgactcccaagtacgccctgcatacacacatcacctcactagcatcaggataacaggaacactcttcatagtgataattaggggcactcaactcaactgattttactacctttccggagacccagcatggcgtat

SEQ ID NO: 426971 - DNA, 140 bp, Artificial Sequence
  Synthetic
atacgccatgctgggtctcccttattcgtcatcaatgatgtgggagatcaacggtcctgaatctgttttggtcaatacttatcagtggatcatcagaaattgggagactgtgaaaattcacgtacttgggagtcggccat

SEQ ID NO: 426972 - DNA, 140 bp, Artificial Sequence
  Synthetic
atggccgactcccaagtacgtgaattttcacagtctcccaatttctgatgatccactgataagtattgaccaaaacagattcaggaccgttgatctcccacatcattgatgacgaataagggagacccagcatggcgtat

SEQ ID NO: 426973 - DNA, 140 bp, Artificial Sequence
  Synthetic
atacgccatgctgggtctcctttgtgtactttgttgaaacattagcaaggagcatttgtgagaagcttgaacaatctggactcccagttggaggcaatgaaaagaaggctaaactggcaacgtacttgggagtcggccat

SEQ ID NO: 426974 - DNA, 140 bp, Artificial Sequence
  Synthetic
atggccgactcccaagtacgttgccagtttagccttcttttcattgcctccaactgggagtccagattgttcaagcttctcacaaatgctccttgctaatgtttcaacaaagtacacaaaggagacccagcatggcgtat

SEQ ID NO: 426975 - DNA, 140 bp, Artificial Sequence
  Synthetic
aggccctggctgctgatatgtataagcattacattcccttatactggagatcctccctacagccatggaacaggaacaggatacaccatggacacagtaaatagaacacatcaatactcagaccttttgggacagcggtg

SEQ ID NO: 426976 - DNA, 140 bp, Artificial Sequence
  Synthetic
caccgctgtcccaaaaggtctgagtattgatgtgttctatttactgtgtccatggtgtatcctgttcctgttccatggctgtagggaggatctccagtataagggaatgtaatgcttatacatatcagcagccagggcct

SEQ ID NO: 426977 - DNA, 140 bp, Artificial Sequence
  Synthetic
atacgccatgctgggtctcctccaattgatgggccactacctgaggataatgaaccaagtggatatgcacaaacagattgtgtgttggaagcgatggctttccttgaagaatcccacccacgtacttgggagtcggccat

SEQ ID NO: 426978 - DNA, 140 bp, Artificial Sequence
  Synthetic
atggccgactcccaagtacgtgggtgggattcttcaaggaaagccatcgcttccaacacacaatctgtttgtgcatatccacttggttcattatcctcaggtagtggcccatcaattggaggagacccagcatggcgtat

SEQ ID NO: 426979 - DNA, 140 bp, Artificial Sequence
  Synthetic
aggccctggctgctgatatggaccccaagcacggaaatatcgctgagagggataagagtcagcaaaatgggagtagatgaatattccagcacggagagagtggtagtgagcattgaccgagaccttttgggacagcggtg

SEQ ID NO: 426980 - DNA, 140 bp, Artificial Sequence
  Synthetic
caccgctgtcccaaaaggtctcggtcaatgctcactaccactctctccgtgctggaatattcatctactcccattttgctgactcttatccctctcagcgatatttccgtgcttggggtccatatcagcagccagggcct

SEQ ID NO: 426981 - DNA, 140 bp, Artificial Sequence
  Synthetic
aggccctggctgctgatatgaggacatactgacaaggatgtcaaaaatgcaattggggtcctcatcggaggatttgaatggaatgataacacagttcgagtctctgaaactctacagagagaccttttgggacagcggtg

SEQ ID NO: 426982 - DNA, 140 bp, Artificial Sequence
  Synthetic
caccgctgtcccaaaaggtctctctgtagagtttcagagactcgaactgtgttatcattccattcaaatcctccgatgaggaccccaattgcatttttgacatccttgtcagtatgtcctcatatcagcagccagggcct

SEQ ID NO: 426983 - DNA, 140 bp, Artificial Sequence
  Synthetic
aggccctggctgctgatatgcagaattgacttcgagtctggaaggattaagaaggaagagttctctgagatcatgaagatctgttccaccattgaagaactcagacggcaaaaataatgagaccttttgggacagcggtg

SEQ ID NO: 426984 - DNA, 140 bp, Artificial Sequence
  Synthetic
caccgctgtcccaaaaggtctcattatttttgccgtctgagttcttcaatggtggaacagatcttcatgatctcagagaactcttccttcttaatccttccagactcgaagtcaattctgcatatcagcagccagggcct

SEQ ID NO: 426985 - DNA, 140 bp, Artificial Sequence
  Synthetic
atacgccatgctgggtctccagatcgaacggtctaacagccagtgaatcagggagactaattgatttcctcaaggatgtaatggaatcaatggataaagaagagatggaaataacaacaccgtacttgggagtcggccat

SEQ ID NO: 426986 - DNA, 140 bp, Artificial Sequence
  Synthetic
atggccgactcccaagtacggtgttgttatttccatctcttctttatccattgattccattacatccttgaggaaatcaattagtctccctgattcactggctgttagaccgttcgatctggagacccagcatggcgtat

SEQ ID NO: 426987 - DNA, 140 bp, Artificial Sequence
  Synthetic
atacgccatgctgggtctccatttccaaaggaagagaagaataagggacaacatgaccaagaaaatggtcacacaaagaacaatagggaagaagaaacaaaggttgaacaaaaagagctacgtacttgggagtcggccat

SEQ ID NO: 426988 - DNA, 140 bp, Artificial Sequence
  Synthetic
atggccgactcccaagtacgtagctctttttgttcaacctttgtttcttcttccctattgttctttgtgtgaccattttcttggtcatgttgtcccttattcttctcttcctttggaaatggagacccagcatggcgtat

SEQ ID NO: 426989 - DNA, 140 bp, Artificial Sequence
  Synthetic
aggccctggctgctgatatgacacaaagaacaatagggaagaagaaacaaaggttgaacaaaaagagctacttaataagagcactgacactaaacacaatgacaaaagatgcagaaagaggaccttttgggacagcggtg

SEQ ID NO: 426990 - DNA, 140 bp, Artificial Sequence
  Synthetic
caccgctgtcccaaaaggtcctctttctgcatcttttgtcattgtgtttagtgtcagtgctcttattaagtagctctttttgttcaacctttgtttcttcttccctattgttctttgtgtcatatcagcagccagggcct

SEQ ID NO: 426991 - DNA, 140 bp, Artificial Sequence
  Synthetic
atacgccatgctgggtctcccttaataagagcactgacactaaacacaatgacaaaagatgcagaaagaggcaaattaaagaggagggcaattgcaacacccggaatgcagatcagaggacgtacttgggagtcggccat

SEQ ID NO: 426992 - DNA, 140 bp, Artificial Sequence
  Synthetic
atggccgactcccaagtacgtcctctgatctgcattccgggtgttgcaattgccctcctctttaatttgcctctttctgcatcttttgtcattgtgtttagtgtcagtgctcttattaagggagacccagcatggcgtat

SEQ ID NO: 426993 - DNA, 140 bp, Artificial Sequence
  Synthetic
atacgccatgctgggtctccgcaatctggacttcctgtcggagggaatgagaagaaggctaaattggcaaatgtcgtaagaaagatgatgactaactcacaagacacagagctctcctttcgtacttgggagtcggccat

SEQ ID NO: 426994 - DNA, 140 bp, Artificial Sequence
  Synthetic
atggccgactcccaagtacgaaaggagagctctgtgtcttgtgagttagtcatcatctttcttacgacatttgccaatttagccttcttctcattccctccgacaggaagtccagattgcggagacccagcatggcgtat

SEQ ID NO: 426995 - DNA, 140 bp, Artificial Sequence
  Synthetic
atacgccatgctgggtctcctgagaggagtaagagttagcaaaatgggagtagatgaatattccagcactgagagagtagttgtaagcattgaccgcttcttaagggttcgagaccagcgcgtacttgggagtcggccat

SEQ ID NO: 426996 - DNA, 140 bp, Artificial Sequence
  Synthetic
atggccgactcccaagtacgcgctggtctcgaacccttaagaagcggtcaatgcttacaactactctctcagtgctggaatattcatctactcccattttgctaactcttactcctctcaggagacccagcatggcgtat

SEQ ID NO: 426997 - DNA, 140 bp, Artificial Sequence
  Synthetic
aggccctggctgctgatatgctaccaagccagattcgaagctgtggcgtggtcagcaactgcttgccatgatgggaagaagtggatgacagttggtgtgacagggccagattctaaggcagaccttttgggacagcggtg

SEQ ID NO: 426998 - DNA, 140 bp, Artificial Sequence
  Synthetic
caccgctgtcccaaaaggtctgccttagaatctggccctgtcacaccaactgtcatccacttcttcccatcatggcaagcagttgctgaccacgccacagcttcgaatctggcttggtagcatatcagcagccagggcct

SEQ ID NO: 426999 - DNA, 140 bp, Artificial Sequence
  Synthetic
atacgccatgctgggtctccttgggaaaaggttacatgttcgagagtaagagcatgaggctaaggacacaaataccagcagaaatgcttgcaaacattgatctaaagtacttcaatgagacgtacttgggagtcggccat

SEQ ID NO: 427000 - DNA, 140 bp, Artificial Sequence
  Synthetic
atggccgactcccaagtacgtctcattgaagtactttagatcaatgtttgcaagcatttctgctggtatttgtgtccttagcctcatgctcttactctcgaacatgtaaccttttcccaaggagacccagcatggcgtat

SEQ ID NO: 427001 - DNA, 140 bp, Artificial Sequence
  Synthetic
atacgccatgctgggtctcctgatggatgctctgaaactaagtatcgaagacccgagtcatgagggggaaggaataccgctatatgatgcaatcaagtgtatgaaaacattttttggctgcgtacttgggagtcggccat

SEQ ID NO: 427002 - DNA, 140 bp, Artificial Sequence
  Synthetic
atggccgactcccaagtacgcagccaaaaaatgttttcatacacttgattgcatcatatagcggtattccttccccctcatgactcgggtcttcgatacttagtttcagagcatccatcaggagacccagcatggcgtat

SEQ ID NO: 427003 - DNA, 140 bp, Artificial Sequence
  Synthetic
atacgccatgctgggtctccccagccaagagcatggagtatgatgctgttgccaccactcactcttggatccctaagaggaatcgctccattctcaacacaagccaaaggggaatccttgcgtacttgggagtcggccat

SEQ ID NO: 427004 - DNA, 140 bp, Artificial Sequence
  Synthetic
atggccgactcccaagtacgcaaggattcccctttggcttgtgttgagaatggagcgattcctcttagggatccaagagtgagtggtggcaacagcatcatactccatgctcttggctggggagacccagcatggcgtat

SEQ ID NO: 427005 - DNA, 140 bp, Artificial Sequence
  Synthetic
atacgccatgctgggtctccgatgaccttcttgaaaatttgcaggcctaccagaagcgaatgggagtgcagatgcagcgattcaagtgatcctctcgtcattgcagcaaatatcattgggcgtacttgggagtcggccat

SEQ ID NO: 427006 - DNA, 140 bp, Artificial Sequence
  Synthetic
atggccgactcccaagtacgcccaatgatatttgctgcaatgacgagaggatcacttgaatcgctgcatctgcactcccattcgcttctggtaggcctgcaaattttcaagaaggtcatcggagacccagcatggcgtat

SEQ ID NO: 427007 - DNA, 140 bp, Artificial Sequence
  Synthetic
aggccctggctgctgatatgatctacttgcttggaagcaggtgctagcagagcttcaagacattgaaaatgaagagaagatcccaaagacaaaaaatatgaagaggacaagccaattgaagaccttttgggacagcggtg

SEQ ID NO: 427008 - DNA, 140 bp, Artificial Sequence
  Synthetic
caccgctgtcccaaaaggtcttcaattggcttgtcctcttcatattttttgtctttgggatcttctcttcattttcaatgtcttgaagctctgctagcacctgcttccaagcaagtagatcatatcagcagccagggcct

SEQ ID NO: 427009 - DNA, 140 bp, Artificial Sequence
  Synthetic
atacgccatgctgggtctccccacatactggtgggatgggctccaatcctctgatgatttcgctctcatagtgaatgcaccgaatcatgagggaatacaagctggagtggacagattctacgtacttgggagtcggccat

SEQ ID NO: 427010 - DNA, 140 bp, Artificial Sequence
  Synthetic
atggccgactcccaagtacgtagaatctgtccactccagcttgtattccctcatgattcggtgcattcactatgagagcgaaatcatcagaggattggagcccatcccaccagtatgtggggagacccagcatggcgtat

SEQ ID NO: 427011 - DNA, 140 bp, Artificial Sequence
  Synthetic
atacgccatgctgggtctcctaaatcggacagggacatttgagttcacaagctttttctatcgatatggatttgtagccaattttagcatggaactgcccagctttggagtatctgggatcgtacttgggagtcggccat

SEQ ID NO: 427012 - DNA, 140 bp, Artificial Sequence
  Synthetic
atggccgactcccaagtacgatcccagatactccaaagctgggcagttccatgctaaaattggctacaaatccatatcgatagaaaaagcttgtgaactcaaatgtccctgtccgatttaggagacccagcatggcgtat

SEQ ID NO: 427013 - DNA, 140 bp, Artificial Sequence
  Synthetic
aggccctggctgctgatatgcattgcatttcaagcaacatgattgcaaatcctccctaaacaaccaagtgatgcagtgcgaaccaacaataatagaaagaaacataacagagattgtgtagaccttttgggacagcggtg

SEQ ID NO: 427014 - DNA, 140 bp, Artificial Sequence
  Synthetic
caccgctgtcccaaaaggtctacacaatctctgttatgtttctttctattattgttggttcgcactgcatcacttggttgtttagggaggatttgcaatcatgttgcttgaaatgcaatgcatatcagcagccagggcct

SEQ ID NO: 427015 - DNA, 140 bp, Artificial Sequence
  Synthetic
atacgccatgctgggtctcccaattgaacacatcgcgagcatgaggaggaactattttacagcagaagtgtcccattgcagagctactgaatacataatgaagggagtgtacataaataccgtacttgggagtcggccat

SEQ ID NO: 427016 - DNA, 140 bp, Artificial Sequence
  Synthetic
atggccgactcccaagtacggtatttatgtacactcccttcattatgtattcagtagctctgcaatgggacacttctgctgtaaaatagttcctcctcatgctcgcgatgtgttcaattgggagacccagcatggcgtat

SEQ ID NO: 427017 - DNA, 140 bp, Artificial Sequence
  Synthetic
aggccctggctgctgatatgagaacaacatgataaacaatgaccttggaccagcaacagcccaaatggctctccaattgttcatcaaagattacagatacacatataggtgccatagagggaccttttgggacagcggtg

SEQ ID NO: 427018 - DNA, 140 bp, Artificial Sequence
  Synthetic
caccgctgtcccaaaaggtccctctatggcacctatatgtgtatctgtaatctttgatgaacaattggagagccatttgggctgttgctggtccaaggtcattgtttatcatgttgttctcatatcagcagccagggcct

SEQ ID NO: 427019 - DNA, 140 bp, Artificial Sequence
  Synthetic
atacgccatgctgggtctccaagaagctgaaaagagaaattacattccatggggctaaggaggtcgcactcagctactcaaccggtgcacttgccagttgcatgggtctcatatacaacacgtacttgggagtcggccat

SEQ ID NO: 427020 - DNA, 140 bp, Artificial Sequence
  Synthetic
atggccgactcccaagtacgtgttgtatatgagacccatgcaactggcaagtgcaccggttgagtagctgagtgcgacctccttagccccatggaatgtaatttctcttttcagcttcttggagacccagcatggcgtat

SEQ ID NO: 427021 - DNA, 140 bp, Artificial Sequence
  Synthetic
atacgccatgctgggtctcctgaagactacagaggtaggctgtgtaatcctctcaatccatttgttagtcataaggaaattgagtccgtaaataatgctgtggtaatgccggcccatggtcgtacttgggagtcggccat

SEQ ID NO: 427022 - DNA, 140 bp, Artificial Sequence
  Synthetic
atggccgactcccaagtacgaccatgggccggcattaccacagcattatttacggactcaatttccttatgactaacaaatggattgagaggattacacagcctacctctgtagtcttcaggagacccagcatggcgtat

SEQ ID NO: 427023 - DNA, 140 bp, Artificial Sequence
  Synthetic
aggccctggctgctgatatgataaggaaattgagtccgtaaataatgctgtggtaatgccggcccatggtccagccaagaacatggagtatgatgctgttgctactacacattcatggatgaccttttgggacagcggtg

SEQ ID NO: 427024 - DNA, 140 bp, Artificial Sequence
  Synthetic
caccgctgtcccaaaaggtcatccatgaatgtgtagtagcaacagcatcatactccatgttcttggctggaccatgggccggcattaccacagcattatttacggactcaatttccttatcatatcagcagccagggcct

SEQ ID NO: 427025 - DNA, 140 bp, Artificial Sequence
  Synthetic
atacgccatgctgggtctccgccttcttcagtctcttcagcagattgagagcatgattgaggctgagtcttctgtcacggaaaaagacatgaccaaggaattctttgaaaacaaatcggacgtacttgggagtcggccat

SEQ ID NO: 427026 - DNA, 140 bp, Artificial Sequence
  Synthetic
atggccgactcccaagtacgtccgatttgttttcaaagaattccttggtcatgtctttttccgtgacagaagactcagcctcaatcatgctctcaatctgctgaagagactgaagaaggcggagacccagcatggcgtat

SEQ ID NO: 427027 - DNA, 140 bp, Artificial Sequence
  Synthetic
atacgccatgctgggtctccaagatgagcagatgtataaaaaatgctgcaatctattcgagaaattcttccccagtagttcatacaggagaccagttggaatctccagcatggtagaggccgtacttgggagtcggccat

SEQ ID NO: 427028 - DNA, 140 bp, Artificial Sequence
  Synthetic
atggccgactcccaagtacggcctctaccatgctggagattccaactggtctcctgtatgaactactggggaagaatttctcgaatagattgcagcattttttatacatctgctcatcttggagacccagcatggcgtat

SEQ ID NO: 427029 - DNA, 140 bp, Artificial Sequence
  Synthetic
aggccctggctgctgatatgggaaagtatgcagaaccttattggcaaaatctgtattcaacagtctatatgcatctccacaacttgaggggttttcggctgaatcgaggaaattgcttctgaccttttgggacagcggtg

SEQ ID NO: 427030 - DNA, 140 bp, Artificial Sequence
  Synthetic
caccgctgtcccaaaaggtcagaagcaatttcctcgattcagccgaaaacccctcaagttgtggagatgcatatagactgttgaatacagattttgccaataaggttctgcatactttcccatatcagcagccagggcct

SEQ ID NO: 427031 - DNA, 140 bp, Artificial Sequence
  Synthetic
atacgccatgctgggtctcccctttgtaagtcataaagagattgattctgtaaacaatgctgtggtaatgccagcccatggtccagccaaaagcatggaatatgatgccgttgcaactaccgtacttgggagtcggccat

SEQ ID NO: 427032 - DNA, 140 bp, Artificial Sequence
  Synthetic
atggccgactcccaagtacggtagttgcaacggcatcatattccatgcttttggctggaccatgggctggcattaccacagcattgtttacagaatcaatctctttatgacttacaaaggggagacccagcatggcgtat

SEQ ID NO: 427033 - DNA, 140 bp, Artificial Sequence
  Synthetic
atacgccatgctgggtctcccccatcgtagatataaatgtaaaggattatagcatcgtttccagttatgtgtgctcaggacttgttggagacacacccagaaaaaatgacagcttcagcacgtacttgggagtcggccat

SEQ ID NO: 427034 - DNA, 140 bp, Artificial Sequence
  Synthetic
atggccgactcccaagtacgtgctgaagctgtcattttttctgggtgtgtctccaacaagtcctgagcacacataactggaaacgatgctataatcctttacatttatatctacgatgggggagacccagcatggcgtat

SEQ ID NO: 427035 - DNA, 140 bp, Artificial Sequence
  Synthetic
aggccctggctgctgatatgcgagatactaacaaaaaccactgtggaccatatggccataatcaagaaatacacatctgggaggcaggagaagaacccagcactaagaatgaaatggatggaccttttgggacagcggtg

SEQ ID NO: 427036 - DNA, 140 bp, Artificial Sequence
  Synthetic
caccgctgtcccaaaaggtccatccatttcattcttagtgctgggttcttctcctgcctcccagatgtgtatttcttgattatggccatatggtccacagtggtttttgttagtatctcgcatatcagcagccagggcct

SEQ ID NO: 427037 - DNA, 140 bp, Artificial Sequence
  Synthetic
atacgccatgctgggtctccacacatctgggaggcaggagaagaacccagcactaagaatgaaatggatgatggcaatgaaatatccaataacagcagataaacggataatggagatgatcgtacttgggagtcggccat

SEQ ID NO: 427038 - DNA, 140 bp, Artificial Sequence
  Synthetic
atggccgactcccaagtacgatcatctccattatccgtttatctgctgttattggatatttcattgccatcatccatttcattcttagtgctgggttcttctcctgcctcccagatgtgtggagacccagcatggcgtat

SEQ ID NO: 427039 - DNA, 140 bp, Artificial Sequence
  Synthetic
atacgccatgctgggtctccggctgggcctttgatgatggaaatgacgtgtggatgggaagaacgatcagcgagaagttacgctcaggttatgaaaccttcaaagtcatcgaaggctggtcgtacttgggagtcggccat

SEQ ID NO: 427040 - DNA, 140 bp, Artificial Sequence
  Synthetic
atggccgactcccaagtacgaccagccttcgatgactttgaaggtttcataacctgagcgtaacttctcgctgatcgttcttcccatccacacgtcatttccatcatcaaaggcccagccggagacccagcatggcgtat

SEQ ID NO: 427041 - DNA, 140 bp, Artificial Sequence
  Synthetic
aggccctggctgctgatatgcgagaagttacgctcaggttatgaaaccttcaaagtcatcgaaggctggtccaaacctaattccaaattacagacaaataggcaagtcatagttgaaagagaccttttgggacagcggtg

SEQ ID NO: 427042 - DNA, 140 bp, Artificial Sequence
  Synthetic
caccgctgtcccaaaaggtctctttcaactatgacttgcctatttgtctgtaatttggaattaggtttggaccagccttcgatgactttgaaggtttcataacctgagcgtaacttctcgcatatcagcagccagggcct

SEQ ID NO: 427043 - DNA, 140 bp, Artificial Sequence
  Synthetic
atacgccatgctgggtctccccggatcagacagagtgatggtatcacccctagctgtaacgtggtggaacaggaatggaccaacaacaagtactgttcattatccacaggtctataaaaccgtacttgggagtcggccat

SEQ ID NO: 427044 - DNA, 140 bp, Artificial Sequence
  Synthetic
atggccgactcccaagtacggttttatagacctgtggataatgaacagtacttgttgttggtccattcctgttccaccacgttacagctaggggtgataccatcactctgtctgatccggggagacccagcatggcgtat

SEQ ID NO: 427045 - DNA, 140 bp, Artificial Sequence
  Synthetic
aggccctggctgctgatatgaggaatggaccaacaacaagtactgttcattatccacaggtctataaaacatactttgaaaaagttgaaaggttaaaacatggaacctttggtcctgttcgaccttttgggacagcggtg

SEQ ID NO: 427046 - DNA, 140 bp, Artificial Sequence
  Synthetic
caccgctgtcccaaaaggtcgaacaggaccaaaggttccatgttttaacctttcaactttttcaaagtatgttttatagacctgtggataatgaacagtacttgttgttggtccattcctcatatcagcagccagggcct

SEQ ID NO: 427047 - DNA, 140 bp, Artificial Sequence
  Synthetic
aggccctggctgctgatatgacttcaatcagtatgaagcaatgagttgtgactttaatgaagggaaaataagtgtgcaatacaatctcagtcatagttatgctatagatgcagccggccagaccttttgggacagcggtg

SEQ ID NO: 427048 - DNA, 140 bp, Artificial Sequence
  Synthetic
caccgctgtcccaaaaggtctggccggctgcatctatagcataactatgactgagattgtattgcacacttattttcccttcattaaagtcacaactcattgcttcatactgattgaagtcatatcagcagccagggcct

SEQ ID NO: 427049 - DNA, 140 bp, Artificial Sequence
  Synthetic
aggccctggctgctgatatgcctcatgtcattgaggaggtgatgaacattgtcttaattgctctcagccttctagcaatactaaaaggggtctacaatgttgccacctgtggcctctttggaccttttgggacagcggtg

SEQ ID NO: 427050 - DNA, 140 bp, Artificial Sequence
  Synthetic
caccgctgtcccaaaaggtccaaagaggccacaggtggcaacattgtagaccccttttagtattgctagaaggctgagagcaattaagacaatgttcatcacctcctcaatgacatgaggcatatcagcagccagggcct

SEQ ID NO: 427051 - DNA, 140 bp, Artificial Sequence
  Synthetic
atacgccatgctgggtctccggggcggcagttacatagcacttgattctggaaaagggaactgggattgcataatgacttcctatcagtacttgattatccagaacaccacctgggaagacgtacttgggagtcggccat

SEQ ID NO: 427052 - DNA, 140 bp, Artificial Sequence
  Synthetic
atggccgactcccaagtacgtcttcccaggtggtgttctggataatcaagtactgataggaagtcattatgcaatcccagttcccttttccagaatcaagtgctatgtaactgccgccccggagacccagcatggcgtat

SEQ ID NO: 427053 - DNA, 140 bp, Artificial Sequence
  Synthetic
aggccctggctgctgatatgataatgacttcctatcagtacttgattatccagaacaccacctgggaagatcactgtcaattttcccgcccatcccctattgggtacctaggactgctgtgaccttttgggacagcggtg

SEQ ID NO: 427054 - DNA, 140 bp, Artificial Sequence
  Synthetic
caccgctgtcccaaaaggtcacagcagtcctaggtacccaataggggatgggcgggaaaattgacagtgatcttcccaggtggtgttctggataatcaagtactgataggaagtcattatcatatcagcagccagggcct

SEQ ID NO: 427055 - DNA, 140 bp, Artificial Sequence
  Synthetic
atacgccatgctgggtctccacctggactctctctgactctgagggcaatgaagcacccggtggatactgccttactagatggatgctaattgaagctgaactgaagtgctttgggaacacgtacttgggagtcggccat

SEQ ID NO: 427056 - DNA, 140 bp, Artificial Sequence
  Synthetic
atggccgactcccaagtacgtgttcccaaagcacttcagttcagcttcaattagcatccatctagtaaggcagtatccaccgggtgcttcattgccctcagagtcagagagagtccaggtggagacccagcatggcgtat

SEQ ID NO: 427057 - DNA, 140 bp, Artificial Sequence
  Synthetic
aggccctggctgctgatatgccttactagatggatgctaattgaagctgaactgaagtgctttgggaacacagccattgcaaagtgtaatgagaagcacgatgaggaattctgtgatatggaccttttgggacagcggtg

SEQ ID NO: 427058 - DNA, 140 bp, Artificial Sequence
  Synthetic
caccgctgtcccaaaaggtccatatcacagaattcctcatcgtgcttctcattacactttgcaatggctgtgttcccaaagcacttcagttcagcttcaattagcatccatctagtaaggcatatcagcagccagggcct

SEQ ID NO: 427059 - DNA, 140 bp, Artificial Sequence
  Synthetic
aggccctggctgctgatatgactttaatcagtatgaagcaatgagttgtgacttcaatgggggaaagataagtgttcagtacaacctcagccatacttatgctgtggatgcagccaaccagaccttttgggacagcggtg

SEQ ID NO: 427060 - DNA, 140 bp, Artificial Sequence
  Synthetic
caccgctgtcccaaaaggtctggttggctgcatccacagcataagtatggctgaggttgtactgaacacttatctttcccccattgaagtcacaactcattgcttcatactgattaaagtcatatcagcagccagggcct

SEQ ID NO: 427061 - DNA, 140 bp, Artificial Sequence
  Synthetic
atacgccatgctgggtctccagcacagatgagcatccatttgataaataaagcagtaaatgcactaatcaatgaccagttgatcatgaagaaccacttgagggatatcatgggaattcctcgtacttgggagtcggccat

SEQ ID NO: 427062 - DNA, 140 bp, Artificial Sequence
  Synthetic
atggccgactcccaagtacgaggaattcccatgatatccctcaagtggttcttcatgatcaactggtcattgattagtgcatttactgctttatttatcaaatggatgctcatctgtgctggagacccagcatggcgtat

SEQ ID NO: 427063 - DNA, 140 bp, Artificial Sequence
  Synthetic
aggccctggctgctgatatgatgaccagttgatcatgaagaaccacttgagggatatcatgggaattccttattgcaattacagcaagtactggtatctaaaccacactgtgacagggaagaccttttgggacagcggtg

SEQ ID NO: 427064 - DNA, 140 bp, Artificial Sequence
  Synthetic
caccgctgtcccaaaaggtcttccctgtcacagtgtggtttagataccagtacttgctgtaattgcaataaggaattcccatgatatccctcaagtggttcttcatgatcaactggtcatcatatcagcagccagggcct

SEQ ID NO: 427065 - DNA, 140 bp, Artificial Sequence
  Synthetic
atacgccatgctgggtctccagacacatttctccgatgatattgaacagcaagcagataacatgataacagaactgttgcaaaaggagtatatggacaggcaggggaaaacaccattaggcgtacttgggagtcggccat

SEQ ID NO: 427066 - DNA, 140 bp, Artificial Sequence
  Synthetic
atggccgactcccaagtacgcctaatggtgttttcccctgcctgtccatatactccttttgcaacagttctgttatcatgttatctgcttgctgttcaatatcatcggagaaatgtgtctggagacccagcatggcgtat

SEQ ID NO: 427067 - DNA, 140 bp, Artificial Sequence
  Synthetic
atacgccatgctgggtctcccacaaagaaccagggacatttacatcagccgaagactcctaggaacttttacttggactctctctgattctgagggcaatgaaacaccgggtgggtattgcgtacttgggagtcggccat

SEQ ID NO: 427068 - DNA, 140 bp, Artificial Sequence
  Synthetic
atggccgactcccaagtacgcaatacccacccggtgtttcattgccctcagaatcagagagagtccaagtaaaagttcctaggagtcttcggctgatgtaaatgtccctggttctttgtgggagacccagcatggcgtat

SEQ ID NO: 427069 - DNA, 140 bp, Artificial Sequence
  Synthetic
atacgccatgctgggtctcctgccccaaaccacacaggctcaaccacatgggcatatgctcatgtggtttgtacaaacatcctggtgtaccagtcaagtggaagagatagagatggaccccgtacttgggagtcggccat

SEQ ID NO: 427070 - DNA, 140 bp, Artificial Sequence
  Synthetic
atggccgactcccaagtacggggtccatctctatctcttccacttgactggtacaccaggatgtttgtacaaaccacatgagcatatgcccatgtggttgagcctgtgtggtttggggcaggagacccagcatggcgtat

SEQ ID NO: 427071 - DNA, 140 bp, Artificial Sequence
  Synthetic
atacgccatgctgggtctcctattctcatagacagcgttacagaattcttcataaaaattatctggtaagacatcatgatcaaagtcctcaaccatgtgattggataattcacccttgatcgtacttgggagtcggccat

SEQ ID NO: 427072 - DNA, 140 bp, Artificial Sequence
  Synthetic
atggccgactcccaagtacgatcaagggtgaattatccaatcacatggttgaggactttgatcatgatgtcttaccagataatttttatgaagaattctgtaacgctgtctatgagaataggagacccagcatggcgtat

SEQ ID NO: 427073 - DNA, 140 bp, Artificial Sequence
  Synthetic
atacgccatgctgggtctccttgggagaacagccctcaagattggtatattaagtcctcctgacacagctgcgtcaaacattatgcaatccattaaagcacagtgtggagtgatctcctccgtacttgggagtcggccat

SEQ ID NO: 427074 - DNA, 140 bp, Artificial Sequence
  Synthetic
atggccgactcccaagtacggaggagatcactccacactgtgctttaatggattgcataatgtttgacgcagctgtgtcaggaggacttaatataccaatcttgagggctgttctcccaaggagacccagcatggcgtat

SEQ ID NO: 427075 - DNA, 140 bp, Artificial Sequence
  Synthetic
aggccctggctgctgatatggcgtcaaacattatgcaatccattaaagcacagtgtggagtgatctcctctttgcctcctctcttctttttctcaacgaccactccggtgtgcatgtgacgaccttttgggacagcggtg

SEQ ID NO: 427076 - DNA, 140 bp, Artificial Sequence
  Synthetic
caccgctgtcccaaaaggtcgtcacatgcacaccggagtggtcgttgagaaaaagaagagaggaggcaaagaggagatcactccacactgtgctttaatggattgcataatgtttgacgccatatcagcagccagggcct

SEQ ID NO: 427077 - DNA, 140 bp, Artificial Sequence
  Synthetic
atacgccatgctgggtctccgccttacctaatgagatatcgatgagcttgatgtcccttctcccctgagaatctaagagttttttaatgtcgtctgaaccttgacacgttaacaccatgtcgtacttgggagtcggccat

SEQ ID NO: 427078 - DNA, 140 bp, Artificial Sequence
  Synthetic
atggccgactcccaagtacgacatggtgttaacgtgtcaaggttcagacgacattaaaaaactcttagattctcaggggagaagggacatcaagctcatcgatatctcattaggtaaggcggagacccagcatggcgtat

SEQ ID NO: 427079 - DNA, 140 bp, Artificial Sequence
  Synthetic
aggccctggctgctgatatgagcattaggaatcaatccctctatttgcctcataattctgtaactacggttgccatctacccagtctctgacgtctgtctcgcaattcaacaagaatggggaccttttgggacagcggtg

SEQ ID NO: 427080 - DNA, 140 bp, Artificial Sequence
  Synthetic
caccgctgtcccaaaaggtccccattcttgttgaattgcgagacagacgtcagagactgggtagatggcaaccgtagttacagaattatgaggcaaatagagggattgattcctaatgctcatatcagcagccagggcct

SEQ ID NO: 427081 - DNA, 140 bp, Artificial Sequence
  Synthetic
aggccctggctgctgatatgctgttttaaatctgttggttctctgaagaaatgtatataacagcctgacataggttggtaaagagctatctcaacagggtcttctggacgaccctcgatggaccttttgggacagcggtg

SEQ ID NO: 427082 - DNA, 140 bp, Artificial Sequence
  Synthetic
caccgctgtcccaaaaggtccatcgagggtcgtccagaagaccctgttgagatagctctttaccaacctatgtcaggctgttatatacatttcttcagagaaccaacagatttaaaacagcatatcagcagccagggcct

SEQ ID NO: 427083 - DNA, 140 bp, Artificial Sequence
  Synthetic
atacgccatgctgggtctcctgtcatcagttgagaataagttagccctgttgggaaccctgcagattgcagagatttgttggatccagcagaacccactttctgtggtttcccatctgaccgtacttgggagtcggccat

SEQ ID NO: 427084 - DNA, 140 bp, Artificial Sequence
  Synthetic
atggccgactcccaagtacggtcagatgggaaaccacagaaagtgggttctgctggatccaacaaatctctgcaatctgcagggttcccaacagggctaacttattctcaactgatgacaggagacccagcatggcgtat

SEQ ID NO: 427085 - DNA, 140 bp, Artificial Sequence
  Synthetic
aggccctggctgctgatatggagatttgttggatccagcagaacccactttctgtggtttcccatctgactcaaggtccacagtggtattctcccaagctctacccacaatggaggttctgaccttttgggacagcggtg

SEQ ID NO: 427086 - DNA, 140 bp, Artificial Sequence
  Synthetic
caccgctgtcccaaaaggtcagaacctccattgtgggtagagcttgggagaataccactgtggaccttgagtcagatgggaaaccacagaaagtgggttctgctggatccaacaaatctccatatcagcagccagggcct

SEQ ID NO: 427087 - DNA, 140 bp, Artificial Sequence
  Synthetic
aggccctggctgctgatatgcatagatccttgcactgatcccaaacagcattctcaaacctcctagagtcagccttgctcagtgcaatgtcaataagctttatgtctcttcttccttggggaccttttgggacagcggtg

SEQ ID NO: 427088 - DNA, 140 bp, Artificial Sequence
  Synthetic
caccgctgtcccaaaaggtccccaaggaagaagagacataaagcttattgacattgcactgagcaaggctgactctaggaggtttgagaatgctgtttgggatcagtgcaaggatctatgcatatcagcagccagggcct

SEQ ID NO: 427089 - DNA, 140 bp, Artificial Sequence
  Synthetic
atacgccatgctgggtctcctgttttcataagggtttctttcaccaggtgtgtctgaaacaaacattcccagggaccttttcacctttagaatggacttcagaatgccatccattgtctgcgtacttgggagtcggccat

SEQ ID NO: 427090 - DNA, 140 bp, Artificial Sequence
  Synthetic
atggccgactcccaagtacgcagacaatggatggcattctgaagtccattctaaaggtgaaaaggtccctgggaatgtttgtttcagacacacctggtgaaagaaacccttatgaaaacaggagacccagcatggcgtat

SEQ ID NO: 427091 - DNA, 140 bp, Artificial Sequence
  Synthetic
aggccctggctgctgatatgagggaccttttcacctttagaatggacttcagaatgccatccattgtctgaggcgtcaccttaatagtttccaacatgttacccccatcgagcatgcaaggaccttttgggacagcggtg

SEQ ID NO: 427092 - DNA, 140 bp, Artificial Sequence
  Synthetic
caccgctgtcccaaaaggtccttgcatgctcgatgggggtaacatgttggaaactattaaggtgacgcctcagacaatggatggcattctgaagtccattctaaaggtgaaaaggtccctcatatcagcagccagggcct

SEQ ID NO: 427093 - DNA, 140 bp, Artificial Sequence
  Synthetic
atacgccatgctgggtctccagggagctcttcttggtgtctaccatgtttaatatgggatggctctgggaaagtctatctaggtcagaactattggggtatttagctgtgtatattaacccgtacttgggagtcggccat

SEQ ID NO: 427094 - DNA, 140 bp, Artificial Sequence
  Synthetic
atggccgactcccaagtacgggttaatatacacagctaaataccccaatagttctgacctagatagactttcccagagccatcccatattaaacatggtagacaccaagaagagctccctggagacccagcatggcgtat

SEQ ID NO: 427095 - DNA, 140 bp, Artificial Sequence
  Synthetic
aggccctggctgctgatatgaagtctatctaggtcagaactattggggtatttagctgtgtatattaaccccaagtctgttagcgccagaacggcgtcatttaagtcaacctgaccctgtgaccttttgggacagcggtg

SEQ ID NO: 427096 - DNA, 140 bp, Artificial Sequence
  Synthetic
caccgctgtcccaaaaggtcacagggtcaggttgacttaaatgacgccgttctggcgctaacagacttggggttaatatacacagctaaataccccaatagttctgacctagatagacttcatatcagcagccagggcct

SEQ ID NO: 427097 - DNA, 140 bp, Artificial Sequence
  Synthetic
atacgccatgctgggtctccgaggaggtccgggttttttacatcccacaccctgacaactccgtcccttccaggttgggttccctgagcaccaccgaccatgcctatcatactcaataaccgtacttgggagtcggccat

SEQ ID NO: 427098 - DNA, 140 bp, Artificial Sequence
  Synthetic
atggccgactcccaagtacggttattgagtatgataggcatggtcggtggtgctcagggaacccaacctggaagggacggagttgtcagggtgtgggatgtaaaaaacccggacctcctcggagacccagcatggcgtat

SEQ ID NO: 427099 - DNA, 140 bp, Artificial Sequence
  Synthetic
aggccctggctgctgatatgcaggttgggttccctgagcaccaccgaccatgcctatcatactcaataacgccttcctctgctcaagttgttgtgtgctcaagtttcccatatacacaccgaccttttgggacagcggtg

SEQ ID NO: 427100 - DNA, 140 bp, Artificial Sequence
  Synthetic
caccgctgtcccaaaaggtcggtgtgtatatgggaaacttgagcacacaacaacttgagcagaggaaggcgttattgagtatgataggcatggtcggtggtgctcagggaacccaacctgcatatcagcagccagggcct

SEQ ID NO: 427101 - DNA, 140 bp, Artificial Sequence
  Synthetic
atacgccatgctgggtctccgatcagctgctaaaatcagcaagtcgtctgaggtcagtgttccaactcttagaacactcttttgttgtgttgacttgagctcaacaagattgttaactgccgtacttgggagtcggccat

SEQ ID NO: 427102 - DNA, 140 bp, Artificial Sequence
  Synthetic
atggccgactcccaagtacggcagttaacaatcttgttgagctcaagtcaacacaacaaaagagtgttctaagagttggaacactgacctcagacgacttgctgattttagcagctgatcggagacccagcatggcgtat

SEQ ID NO: 427103 - DNA, 140 bp, Artificial Sequence
  Synthetic
aggccctggctgctgatatgagaacactcttttgttgtgttgacttgagctcaacaagattgttaactgcctgatttaggtctctaagacgttttaggtcaccgtcatctcttttctgttgaccttttgggacagcggtg

SEQ ID NO: 427104 - DNA, 140 bp, Artificial Sequence
  Synthetic
caccgctgtcccaaaaggtcaacagaaaagagatgacggtgacctaaaacgtcttagagacctaaatcaggcagttaacaatcttgttgagctcaagtcaacacaacaaaagagtgttctcatatcagcagccagggcct

SEQ ID NO: 427105 - DNA, 140 bp, Artificial Sequence
  Synthetic
aggccctggctgctgatatgaaagtctgtccaggtcggagctgtttgggtacttagctgtgtatattagacccaggtctgttagtgctaagacggcatcatttaaatcaacttgaccttggaccttttgggacagcggtg

SEQ ID NO: 427106 - DNA, 140 bp, Artificial Sequence
  Synthetic
caccgctgtcccaaaaggtccaaggtcaagttgatttaaatgatgccgtcttagcactaacagacctgggtctaatatacacagctaagtacccaaacagctccgacctggacagactttcatatcagcagccagggcct

SEQ ID NO: 427107 - DNA, 140 bp, Artificial Sequence
  Synthetic
atacgccatgctgggtctccagaagggcctgtgcatccttaaccacctggagttttatattagagcaatagcctgaaagctctctccttagtgactgtgtccaaaggaatgatttcacttcgtacttgggagtcggccat

SEQ ID NO: 427108 - DNA, 140 bp, Artificial Sequence
  Synthetic
atggccgactcccaagtacgaagtgaaatcattcctttggacacagtcactaaggagagagctttcaggctattgctctaatataaaactccaggtggttaaggatgcacaggcccttctggagacccagcatggcgtat

SEQ ID NO: 427109 - DNA, 140 bp, Artificial Sequence
  Synthetic
atacgccatgctgggtctccccttggaagcactcatcctggtcgatgttaattggaactcactggttgaaaatgttatccagtaaatcaacagtagtaagcgcaatctaaaagcctaggacgtacttgggagtcggccat

SEQ ID NO: 427110 - DNA, 140 bp, Artificial Sequence
  Synthetic
atggccgactcccaagtacgtcctaggcttttagattgcgcttactactgttgatttactggataacattttcaaccagtgagttccaattaacatcgaccaggatgagtgcttccaaggggagacccagcatggcgtat

SEQ ID NO: 427111 - DNA, 140 bp, Artificial Sequence
  Synthetic
aggccctggctgctgatatgacacttatgaagcaggaccctaaccaccctcttaaacatttttgtttcttaaagtcatacttacttgcaaggagaattagtgcatcgaaaattaacagaagaccttttgggacagcggtg

SEQ ID NO: 427112 - DNA, 140 bp, Artificial Sequence
  Synthetic
caccgctgtcccaaaaggtcttctgttaattttcgatgcactaattctccttgcaagtaagtatgactttaagaaacaaaaatgtttaagagggtggttagggtcctgcttcataagtgtcatatcagcagccagggcct

SEQ ID NO: 427113 - DNA, 140 bp, Artificial Sequence
  Synthetic
atacgccatgctgggtctccggggatcctaggcaatttagttggacttcactaagaagacttgtcttgtgagtttctggattgtgccacatagtcaagatgggcaacaggcaaaccaggccgtacttgggagtcggccat

SEQ ID NO: 427114 - DNA, 140 bp, Artificial Sequence
  Synthetic
atggccgactcccaagtacggcctggtttgcctgttgcccatcttgactatgtggcacaatccagaaactcacaagacaagtcttcttagtgaagtccaactaaattgcctaggatccccggagacccagcatggcgtat

SEQ ID NO: 427115 - DNA, 140 bp, Artificial Sequence
  Synthetic
aggccctggctgctgatatgagtttctggattgtgccacatagtcaagatgggcaacaggcaaaccaggccaactgaagccactgagcagagcagggcccacttggtaccagatgcatccgaccttttgggacagcggtg

SEQ ID NO: 427116 - DNA, 140 bp, Artificial Sequence
  Synthetic
caccgctgtcccaaaaggtcggatgcatctggtaccaagtgggccctgctctgctcagtggcttcagttggcctggtttgcctgttgcccatcttgactatgtggcacaatccagaaactcatatcagcagccagggcct

SEQ ID NO: 427117 - DNA, 140 bp, Artificial Sequence
  Synthetic
atacgccatgctgggtctcccaactgaagccactgagcagagcagggcccacttggtaccagatgcatcccacctgggaccccaattctgcaagagctgttggtttgaaaacaaaggtttcgtacttgggagtcggccat

SEQ ID NO: 427118 - DNA, 140 bp, Artificial Sequence
  Synthetic
atggccgactcccaagtacgaaacctttgttttcaaaccaacagctcttgcagaattggggtcccaggtgggatgcatctggtaccaagtgggccctgctctgctcagtggcttcagttgggagacccagcatggcgtat

SEQ ID NO: 427119 - DNA, 140 bp, Artificial Sequence
  Synthetic
atacgccatgctgggtctccatgtaaaacttatttgaaacaatctcatctagatcatttattgatggctggccatcaccattagggcctgagcccagcttgacaggttccctatactgatcgtacttgggagtcggccat

SEQ ID NO: 427120 - DNA, 140 bp, Artificial Sequence
  Synthetic
atggccgactcccaagtacgatcagtatagggaacctgtcaagctgggctcaggccctaatggtgatggccagccatcaataaatgatctagatgagattgtttcaaataagttttacatggagacccagcatggcgtat

SEQ ID NO: 427121 - DNA, 140 bp, Artificial Sequence
  Synthetic
atacgccatgctgggtctcctcagtgtcagcagcagatgtccaatctgcaagatgccccttcccaccaggctgaaggcatcagcacagcccagcgcacccccaaccgaagcaccccagaacgtacttgggagtcggccat

SEQ ID NO: 427122 - DNA, 140 bp, Artificial Sequence
  Synthetic
atggccgactcccaagtacgttctggggtgcttcggttgggggtgcgctgggctgtgctgatgccttcagcctggtgggaaggggcatcttgcagattggacatctgctgctgacactgaggagacccagcatggcgtat

SEQ ID NO: 427123 - DNA, 140 bp, Artificial Sequence
  Synthetic
aggccctggctgctgatatgctgaaggcatcagcacagcccagcgcacccccaaccgaagcaccccagaacaaagcacctccaccatacaccccataagcccaaggcccagctcccaatcgaccttttgggacagcggtg

SEQ ID NO: 427124 - DNA, 140 bp, Artificial Sequence
  Synthetic
caccgctgtcccaaaaggtcgattgggagctgggccttgggcttatggggtgtatggtggaggtgctttgttctggggtgcttcggttgggggtgcgctgggctgtgctgatgccttcagcatatcagcagccagggcct

SEQ ID NO: 427125 - DNA, 140 bp, Artificial Sequence
  Synthetic
atacgccatgctgggtctcccggggggagcaaccgcacaatccaatcttactcaatatccacaatatgcttctctggttcgaacaattctgaacacgttctccccttgagtctaagactgcgtacttgggagtcggccat

SEQ ID NO: 427126 - DNA, 140 bp, Artificial Sequence
  Synthetic
atggccgactcccaagtacgcagtcttagactcaaggggagaacgtgttcagaattgttcgaaccagagaagcatattgtggatattgagtaagattggattgtgcggttgctccccccgggagacccagcatggcgtat

SEQ ID NO: 427127 - DNA, 140 bp, Artificial Sequence
  Synthetic
aggccctggctgctgatatgtctctggttcgaacaattctgaacacgttctccccttgagtctaagactgcccccacttgattgaatcatcaccctctgtcttgacttactataacagaggaccttttgggacagcggtg

SEQ ID NO: 427128 - DNA, 140 bp, Artificial Sequence
  Synthetic
caccgctgtcccaaaaggtcctctgttatagtaagtcaagacagagggtgatgattcaatcaagtgggggcagtcttagactcaaggggagaacgtgttcagaattgttcgaaccagagacatatcagcagccagggcct

SEQ ID NO: 427129 - DNA, 140 bp, Artificial Sequence
  Synthetic
aggccctggctgctgatatggtgaatccctgaatcaaagtgcccagccaaaatgggcaacaaacaggccaaatcgacaaaagtcgatgaacatcaaagagctcatctagtgccagatgcagaccttttgggacagcggtg

SEQ ID NO: 427130 - DNA, 140 bp, Artificial Sequence
  Synthetic
caccgctgtcccaaaaggtctgcatctggcactagatgagctctttgatgttcatcgacttttgtcgatttggcctgtttgttgcccattttggctgggcactttgattcagggattcaccatatcagcagccagggcct

SEQ ID NO: 427131 - DNA, 140 bp, Artificial Sequence
  Synthetic
aggccctggctgctgatatgggacgtaaggagggataaatacttctttgaaacaccaggccttttataatctggtccctcgacacttgtgcatccatctttacttaaaaacttttttgcagaccttttgggacagcggtg

SEQ ID NO: 427132 - DNA, 140 bp, Artificial Sequence
  Synthetic
caccgctgtcccaaaaggtctgcaaaaaagtttttaagtaaagatggatgcacaagtgtcgagggaccagattataaaaggcctggtgtttcaaagaagtatttatccctccttacgtcccatatcagcagccagggcct

SEQ ID NO: 427133 - DNA, 140 bp, Artificial Sequence
  Synthetic
aggccctggctgctgatatgatgtcaacatttgtccactgaactctttgttttaatctatcagacatcatcgatttcagtgcaccaattaggaggtgtggagaactgtcaccaatttcccgaccttttgggacagcggtg

SEQ ID NO: 427134 - DNA, 140 bp, Artificial Sequence
  Synthetic
caccgctgtcccaaaaggtcgggaaattggtgacagttctccacacctcctaattggtgcactgaaatcgatgatgtctgatagattaaaacaaagagttcagtggacaaatgttgacatcatatcagcagccagggcct

SEQ ID NO: 427135 - DNA, 140 bp, Artificial Sequence
  Synthetic
atacgccatgctgggtctccaggatagcattttcaaattccttctcgttgttcaggcaactccctgataactgtaggcttatagcttcaaagtaatcttctataagtctagtaaacatctcgtacttgggagtcggccat

SEQ ID NO: 427136 - DNA, 140 bp, Artificial Sequence
  Synthetic
atggccgactcccaagtacgagatgtttactagacttatagaagattactttgaagctataagcctacagttatcagggagttgcctgaacaacgagaaggaatttgaaaatgctatcctggagacccagcatggcgtat

SEQ ID NO: 427137 - DNA, 140 bp, Artificial Sequence
  Synthetic
aggccctggctgctgatatgccatggtcatggagaattctttccacagatttgtcctcactattgtgctcacaaccatttgcgttgcaggaatcaatttcaatacagagggacaggagttgaccttttgggacagcggtg

SEQ ID NO: 427138 - DNA, 140 bp, Artificial Sequence
  Synthetic
caccgctgtcccaaaaggtcaactcctgtccctctgtattgaaattgattcctgcaacgcaaatggttgtgagcacaatagtgaggacaaatctgtggaaagaattctccatgaccatggcatatcagcagccagggcct

SEQ ID NO: 427139 - DNA, 140 bp, Artificial Sequence
  Synthetic
aggccctggctgctgatatgaggttcactgtcaggcccgacctttgagaaatcaaactcagtaaactgcagcttgtctggatcaacaaccagcttcaggggtgtgacatctcccagttgtgaccttttgggacagcggtg

SEQ ID NO: 427140 - DNA, 140 bp, Artificial Sequence
  Synthetic
caccgctgtcccaaaaggtcacaactgggagatgtcacacccctgaagctggttgttgatccagacaagctgcagtttactgagtttgatttctcaaaggtcgggcctgacagtgaacctcatatcagcagccagggcct

SEQ ID NO: 427141 - DNA, 140 bp, Artificial Sequence
  Synthetic
aggccctggctgctgatatgccccggggggggcaggcagcccaactctactcaatgtcttcaatacacctctccggcccaaacaactctgaacatgttcttcccttcagtctcaggctacgaccttttgggacagcggtg

SEQ ID NO: 427142 - DNA, 140 bp, Artificial Sequence
  Synthetic
caccgctgtcccaaaaggtcgtagcctgagactgaagggaagaacatgttcagagttgtttgggccggagaggtgtattgaagacattgagtagagttgggctgcctgccccccccggggcatatcagcagccagggcct

SEQ ID NO: 427143 - DNA, 140 bp, Artificial Sequence
  Synthetic
atacgccatgctgggtctcctgacctacccttgaaggttggacctgacagtgcgagtctccaacagtcaggcaggacacatggactcacagacccagagtacagtgcttgtacatcatttcgtacttgggagtcggccat

SEQ ID NO: 427144 - DNA, 140 bp, Artificial Sequence
  Synthetic
atggccgactcccaagtacgaaatgatgtacaagcactgtactctgggtctgtgagtccatgtgtcctgcctgactgttggagactcgcactgtcaggtccaaccttcaagggtaggtcaggagacccagcatggcgtat

SEQ ID NO: 427145 - DNA, 140 bp, Artificial Sequence
  Synthetic
atacgccatgctgggtctccgtcagggccctcaaaacatgtggtctgctagagcaacgattgactatagagcagagtcctgtaagaggcacagaagacacaagaggcaattaaagacaatcgtacttgggagtcggccat

SEQ ID NO: 427146 - DNA, 140 bp, Artificial Sequence
  Synthetic
atggccgactcccaagtacgattgtctttaattgcctcttgtgtcttctgtgcctcttacaggactctgctctatagtcaatcgttgctctagcagaccacatgttttgagggccctgacggagacccagcatggcgtat

SEQ ID NO: 427147 - DNA, 140 bp, Artificial Sequence
  Synthetic
atacgccatgctgggtctcctcactgcaatcttctatccaagaaatcatagtgctcactgttgtttgtaaaacctcagctgaaaatattgctggaaaatatcttttaggatcagcataaacgtacttgggagtcggccat

SEQ ID NO: 427148 - DNA, 140 bp, Artificial Sequence
  Synthetic
atggccgactcccaagtacgtttatgctgatcctaaaagatattttccagcaatattttcagctgaggttttacaaacaacagtgagcactatgatttcttggatagaagattgcagtgaggagacccagcatggcgtat

SEQ ID NO: 427149 - DNA, 140 bp, Artificial Sequence
  Synthetic
atacgccatgctgggtctccctgtctgataaaactgcacagaatcttttggcattgtactcaataagtcaagaaaatcctcaagggactcaagcttcagctcctctgtcaagcctgaggccgtacttgggagtcggccat

SEQ ID NO: 427150 - DNA, 140 bp, Artificial Sequence
  Synthetic
atggccgactcccaagtacggcctcaggcttgacagaggagctgaagcttgagtcccttgaggattttcttgacttattgagtacaatgccaaaagattctgtgcagttttatcagacagggagacccagcatggcgtat

SEQ ID NO: 427151 - DNA, 140 bp, Artificial Sequence
  Synthetic
aggccctggctgctgatatgggcatttaagattgcgcttttagagatccttttgtgagtgggtttcattaagccatggggcaaatcataacatttttccaggaagtgcctcatgtcattggaccttttgggacagcggtg

SEQ ID NO: 427152 - DNA, 140 bp, Artificial Sequence
  Synthetic
caccgctgtcccaaaaggtccaatgacatgaggcacttcctggaaaaatgttatgatttgccccatggcttaatgaaacccactcacaaaaggatctctaaaagcgcaatcttaaatgcccatatcagcagccagggcct

SEQ ID NO: 427153 - DNA, 140 bp, Artificial Sequence
  Synthetic
aggccctggctgctgatatgtctgttgcatctagaatgtcaatgacgccaagagtgtaagggaacatgtcttcctgagttttctggtaacttatagtgggtgtgataccggaaatctcaagaccttttgggacagcggtg

SEQ ID NO: 427154 - DNA, 140 bp, Artificial Sequence
  Synthetic
caccgctgtcccaaaaggtcttgagatttccggtatcacacccactataagttaccagaaaactcaggaagacatgttcccttacactcttggcgtcattgacattctagatgcaacagacatatcagcagccagggcct

SEQ ID NO: 427155 - DNA, 140 bp, Artificial Sequence
  Synthetic
atacgccatgctgggtctccttgtaaatagctttctcaacaaatgaggaaaagggacccagtcgctgcagaccttcgccctctggtattgaagttttatgagggaaccaagtaaatgatccgtacttgggagtcggccat

SEQ ID NO: 427156 - DNA, 140 bp, Artificial Sequence
  Synthetic
atggccgactcccaagtacggatcatttacttggttccctcataaaacttcaataccagagggcgaaggtctgcagcgactgggtcccttttcctcatttgttgagaaagctatttacaaggagacccagcatggcgtat

SEQ ID NO: 427157 - DNA, 140 bp, Artificial Sequence
  Synthetic
aggccctggctgctgatatgtcttctcttatgtggaaggtcatgctcaacaacttacaagggtgtttatgagcttcaaactctggagctggatatggcaagccttaatatgacaatgcccgaccttttgggacagcggtg

SEQ ID NO: 427158 - DNA, 140 bp, Artificial Sequence
  Synthetic
caccgctgtcccaaaaggtcgggcattgtcatattaaggcttgccatatccagctccagagtttgaagctcataaacacccttgtaagttgttgagcatgaccttccacataagagaagacatatcagcagccagggcct

SEQ ID NO: 427159 - DNA, 140 bp, Artificial Sequence
  Synthetic
atacgccatgctgggtctccctccaccatgggttcatgtgtacgggagtgtgaatttctcagctcagatgccaacacaacataatgttcttctcttttccacttgacaatatgtgaaacacgtacttgggagtcggccat

SEQ ID NO: 427160 - DNA, 140 bp, Artificial Sequence
  Synthetic
atggccgactcccaagtacgtgtttcacatattgtcaagtggaaaagagaagaacattatgttgtgttggcatctgagctgagaaattcacactcccgtacacatgaacccatggtggagggagacccagcatggcgtat

SEQ ID NO: 427161 - DNA, 140 bp, Artificial Sequence
  Synthetic
aggccctggctgctgatatgccaacacaacataatgttcttctcttttccacttgacaatatgtgaaacaagtgagagtgcctcacagttcacatccagagcaacacagaggtcaagaaagaccttttgggacagcggtg

SEQ ID NO: 427162 - DNA, 140 bp, Artificial Sequence
  Synthetic
caccgctgtcccaaaaggtctttcttgacctctgtgttgctctggatgtgaactgtgaggcactctcacttgtttcacatattgtcaagtggaaaagagaagaacattatgttgtgttggcatatcagcagccagggcct

SEQ ID NO: 427163 - DNA, 140 bp, Artificial Sequence
  Synthetic
atacgccatgctgggtctccatggtaatatgtgtttctcaaatagagatggatataagcgtctcaaagagtgaataatgtggctcatgccaaccctgtcctccagtaactttgaattggtcgtacttgggagtcggccat

SEQ ID NO: 427164 - DNA, 140 bp, Artificial Sequence
  Synthetic
atggccgactcccaagtacgaccaattcaaagttactggaggacagggttggcatgagccacattattcactctttgagacgcttatatccatctctatttgagaaacacatattaccatggagacccagcatggcgtat

SEQ ID NO: 427165 - DNA, 140 bp, Artificial Sequence
  Synthetic
aggccctggctgctgatatgtgaataatgtggctcatgccaaccctgtcctccagtaactttgaattggtaggtcttaaaggaaaataatcacaagggttgtatttgaaaaagtccaagagaccttttgggacagcggtg

SEQ ID NO: 427166 - DNA, 140 bp, Artificial Sequence
  Synthetic
caccgctgtcccaaaaggtctcttggactttttcaaatacaacccttgtgattattttcctttaagacctaccaattcaaagttactggaggacagggttggcatgagccacattattcacatatcagcagccagggcct

SEQ ID NO: 427167 - DNA, 140 bp, Artificial Sequence
  Synthetic
aggccctggctgctgatatggaactgttgcaaaaggagtatatggacaggcaggggaaaacaccattagggttagtggatctttttgtcttcagcaccagcttttatctcataagtatttgaccttttgggacagcggtg

SEQ ID NO: 427168 - DNA, 140 bp, Artificial Sequence
  Synthetic
caccgctgtcccaaaaggtcaaatacttatgagataaaagctggtgctgaagacaaaaagatccactaaccctaatggtgttttcccctgcctgtccatatactccttttgcaacagttccatatcagcagccagggcct

SEQ ID NO: 427169 - DNA, 140 bp, Artificial Sequence
  Synthetic
atacgccatgctgggtctccgtagacagtgttatgcacatataatcccataggaggggtctcagataagtgacagcggtgctacccccttccttggcttctggtgacactctccatatctcgtacttgggagtcggccat

SEQ ID NO: 427170 - DNA, 140 bp, Artificial Sequence
  Synthetic
atggccgactcccaagtacgagatatggagagtgtcaccagaagccaaggaagggggtagcaccgctgtcacttatctgagacccctcctatgggattatatgtgcataacactgtctacggagacccagcatggcgtat

SEQ ID NO: 427171 - DNA, 140 bp, Artificial Sequence
  Synthetic
atacgccatgctgggtctccccttcaccaacatttgcatacaaaaatctcaatattggtgatgctctcttgaactgatgaattaagtgttcgatattgtcttctgtagctaccttatcagcgtacttgggagtcggccat

SEQ ID NO: 427172 - DNA, 140 bp, Artificial Sequence
  Synthetic
atggccgactcccaagtacgctgataaggtagctacagaagacaatatcgaacacttaattcatcagttcaagagagcatcaccaatattgagatttttgtatgcaaatgttggtgaaggggagacccagcatggcgtat

SEQ ID NO: 427173 - DNA, 140 bp, Artificial Sequence
  Synthetic
atacgccatgctgggtctccacacttactgcctaatgtcctacacaaccccacgaatccggatgctatagagctttggaaggcagacttatttattgcttcagacaacaatttctgagcccgtacttgggagtcggccat

SEQ ID NO: 427174 - DNA, 140 bp, Artificial Sequence
  Synthetic
atggccgactcccaagtacgggctcagaaattgttgtctgaagcaataaataagtctgccttccaaagctctatagcatccggattcgtggggttgtgtaggacattaggcagtaagtgtggagacccagcatggcgtat

SEQ ID NO: 427175 - DNA, 140 bp, Artificial Sequence
  Synthetic
aggccctggctgctgatatgagctttggaaggcagacttatttattgcttcagacaacaatttctgagcccctctggtgaatgttgatgacaatctattctgcagagtcttcactattgtgaccttttgggacagcggtg

SEQ ID NO: 427176 - DNA, 140 bp, Artificial Sequence
  Synthetic
caccgctgtcccaaaaggtcacaatagtgaagactctgcagaatagattgtcatcaacattcaccagaggggctcagaaattgttgtctgaagcaataaataagtctgccttccaaagctcatatcagcagccagggcct

SEQ ID NO: 427177 - DNA, 140 bp, Artificial Sequence
  Synthetic
atacgccatgctgggtctccgtcgcaacaccatcctaagtggataatgggttgccaggttcagccaatgaaactctagatcagaattggacaggggttcaatgttcaaaagtttaaagagcgtacttgggagtcggccat

SEQ ID NO: 427178 - DNA, 140 bp, Artificial Sequence
  Synthetic
atggccgactcccaagtacgctctttaaacttttgaacattgaacccctgtccaattctgatctagagtttcattggctgaacctggcaacccattatccacttaggatggtgttgcgacggagacccagcatggcgtat

SEQ ID NO: 427179 - DNA, 140 bp, Artificial Sequence
  Synthetic
aggccctggctgctgatatgaactctagatcagaattggacaggggttcaatgttcaaaagtttaaagaggttctgcagtgatgtcatgtgttcacctgacagataattggtggtgaattgaccttttgggacagcggtg

SEQ ID NO: 427180 - DNA, 140 bp, Artificial Sequence
  Synthetic
caccgctgtcccaaaaggtcaattcaccaccaattatctgtcaggtgaacacatgacatcactgcagaacctctttaaacttttgaacattgaacccctgtccaattctgatctagagttcatatcagcagccagggcct

SEQ ID NO: 427181 - DNA, 140 bp, Artificial Sequence
  Synthetic
aggccctggctgctgatatgaaccactatctgtgtctcaactgcctcaccttactcctaagcgtcagcaacaggtgccccatttgcaagatgcccctccccacaaaactgagaccatcaggaccttttgggacagcggtg

SEQ ID NO: 427182 - DNA, 140 bp, Artificial Sequence
  Synthetic
caccgctgtcccaaaaggtcctgatggtctcagttttgtggggaggggcatcttgcaaatggggcacctgttgctgacgcttaggagtaaggtgaggcagttgagacacagatagtggttcatatcagcagccagggcct

SEQ ID NO: 427183 - DNA, 140 bp, Artificial Sequence
  Synthetic
atacgccatgctgggtctccgacctcattcttttacatgcatcaggaaccaatctttcaatttgcctcattattctgtaactacgattcccgtccacccagtctctcacatcagtctcaccgtacttgggagtcggccat

SEQ ID NO: 427184 - DNA, 140 bp, Artificial Sequence
  Synthetic
atggccgactcccaagtacggtgagactgatgtgagagactgggtggacgggaatcgtagttacagaataatgaggcaaattgaaagattggttcctgatgcatgtaaaagaatgaggtcggagacccagcatggcgtat

SEQ ID NO: 427185 - DNA, 140 bp, Artificial Sequence
  Synthetic
atacgccatgctgggtctccgatgacctgacaaaacactccagcagtattagaacattgcccgtcaatttgtaaccgtccggcaccacaaagcatagtgaaggagtcaagattccatggtcgtacttgggagtcggccat

SEQ ID NO: 427186 - DNA, 140 bp, Artificial Sequence
  Synthetic
atggccgactcccaagtacgaccatggaatcttgactccttcactatgctttgtggtgccggacggttacaaattgacgggcaatgttctaatactgctggagtgttttgtcaggtcatcggagacccagcatggcgtat

SEQ ID NO: 427187 - DNA, 140 bp, Artificial Sequence
  Synthetic
atacgccatgctgggtctcccacagactgatcaattatagtgtcaattgtttctgctaactgatggggctccttacactttatattgtgcaaagccgcagcaacaaattttgttagtaaacgtacttgggagtcggccat

SEQ ID NO: 427188 - DNA, 140 bp, Artificial Sequence
  Synthetic
atggccgactcccaagtacgtttactaacaaaatttgttgctgcggctttgcacaatataaagtgtaaggagccccatcagttagcagaaacaattgacactataattgatcagtctgtgggagacccagcatggcgtat

SEQ ID NO: 427189 - DNA, 140 bp, Artificial Sequence
  Synthetic
aggccctggctgctgatatgccttacactttatattgtgcaaagccgcagcaacaaattttgttagtaaaggcacctcatcaccccagacataaaatcgtgatttaaactctgcaacaaagaccttttgggacagcggtg

SEQ ID NO: 427190 - DNA, 140 bp, Artificial Sequence
  Synthetic
caccgctgtcccaaaaggtctttgttgcagagtttaaatcacgattttatgtctggggtgatgaggtgcctttactaacaaaatttgttgctgcggctttgcacaatataaagtgtaaggcatatcagcagccagggcct

SEQ ID NO: 427191 - DNA, 140 bp, Artificial Sequence
  Synthetic
aggccctggctgctgatatggtcttgataacctctcattatccactaggtactttgatactaagtctttgacataggctatgtcttcctccatgtttggctgagagtatgatgatcagaagaccttttgggacagcggtg

SEQ ID NO: 427192 - DNA, 140 bp, Artificial Sequence
  Synthetic
caccgctgtcccaaaaggtcttctgatcatcatactctcagccaaacatggaggaagacatagcctatgtcaaagacttagtatcaaagtacctagtggataatgagaggttatcaagaccatatcagcagccagggcct

SEQ ID NO: 427193 - DNA, 140 bp, Artificial Sequence
  Synthetic
aggccctggctgctgatatgtttcttcttttcaacaaccaccccagtatgcatatggcatagatccttgcattgatcccaaacagcattctcaaacctcctagagtcagccttgctcagtgaccttttgggacagcggtg

SEQ ID NO: 427194 - DNA, 140 bp, Artificial Sequence
  Synthetic
caccgctgtcccaaaaggtcactgagcaaggctgactctaggaggtttgagaatgctgtttgggatcaatgcaaggatctatgccatatgcatactggggtggttgttgaaaagaagaaacatatcagcagccagggcct

SEQ ID NO: 427195 - DNA, 140 bp, Artificial Sequence
  Synthetic
atacgccatgctgggtctccacaaggtcccgtggagggcactaaaacacaaaaggcaatcaaaaacaataaaattagacaattaaattagatagccttaatgcctaggatcctcggcgcgcgtacttgggagtcggccat

SEQ ID NO: 427196 - DNA, 140 bp, Artificial Sequence
  Synthetic
atggccgactcccaagtacgcgcgccgaggatcctaggcattaaggctatctaatttaattgtctaattttattgtttttgattgccttttgtgttttagtgccctccacgggaccttgtggagacccagcatggcgtat

SEQ ID NO: 427197 - DNA, 140 bp, Artificial Sequence
  Synthetic
aggccctggctgctgatatggtacaaacatcctggtgtaccagtcaagtggaagagatagagatggacccattaacgggcccccgtgacccaccgccgaaaggcggtgggtcacgggggcgaccttttgggacagcggtg

SEQ ID NO: 427198 - DNA, 140 bp, Artificial Sequence
  Synthetic
caccgctgtcccaaaaggtcgcccccgtgacccaccgcctttcggcggtgggtcacgggggcccgttaatgggtccatctctatctcttccacttgactggtacaccaggatgtttgtaccatatcagcagccagggcct

SEQ ID NO: 427199 - DNA, 140 bp, Artificial Sequence
  Synthetic
atacgccatgctgggtctccccttggcccatatcaagaattgaactaatgtgggaagggactgtgccagtttgaaagttggagttgaagaagtcttcagtcactgattgagtggtcttctcgtacttgggagtcggccat

SEQ ID NO: 427200 - DNA, 140 bp, Artificial Sequence
  Synthetic
atggccgactcccaagtacgagaagaccactcaatcagtgactgaagacttcttcaactccaactttcaaactggcacagtcccttcccacattagttcaattcttgatatgggccaaggggagacccagcatggcgtat

SEQ ID NO: 427201 - DNA, 140 bp, Artificial Sequence
  Synthetic
aggccctggctgctgatatgttgaaagttggagttgaagaagtcttcagtcactgattgagtggtcttcttcttcaatccaagttgagatttgatatatgatttcatcattgctgacacagaccttttgggacagcggtg

SEQ ID NO: 427202 - DNA, 140 bp, Artificial Sequence
  Synthetic
caccgctgtcccaaaaggtctgtgtcagcaatgatgaaatcatatatcaaatctcaacttggattgaagaagaagaccactcaatcagtgactgaagacttcttcaactccaactttcaacatatcagcagccagggcct

SEQ ID NO: 427203 - DNA, 140 bp, Artificial Sequence
  Synthetic
atacgccatgctgggtctcctgacaggtagtctttgccttttagatcagcctgcaggtcatcagaaagtaaaatcagattttgaataattgttaggaatagaaagggacacatcattggacgtacttgggagtcggccat

SEQ ID NO: 427204 - DNA, 140 bp, Artificial Sequence
  Synthetic
atggccgactcccaagtacgtccaatgatgtgtccctttctattcctaacaattattcaaaatctgattttactttctgatgacctgcaggctgatctaaaaggcaaagactacctgtcaggagacccagcatggcgtat

SEQ ID NO: 427205 - DNA, 140 bp, Artificial Sequence
  Synthetic
aggccctggctgctgatatgaaatcagattttgaataattgttaggaatagaaagggacacatcattggaccccacttactgtgatccatgctatatgaaacgtgtgctgatgagacattgaccttttgggacagcggtg

SEQ ID NO: 427206 - DNA, 140 bp, Artificial Sequence
  Synthetic
caccgctgtcccaaaaggtcaatgtctcatcagcacacgtttcatatagcatggatcacagtaagtggggtccaatgatgtgtccctttctattcctaacaattattcaaaatctgatttcatatcagcagccagggcct

SEQ ID NO: 427207 - DNA, 140 bp, Artificial Sequence
  Synthetic
atacgccatgctgggtctcccgcacagtggatcctaggcaattttgttgttcttttttgaggccctgtgcgctgaactccttcaaatgggaaacaagcaagctaaaaccccagaatcaaacgtacttgggagtcggccat

SEQ ID NO: 427208 - DNA, 140 bp, Artificial Sequence
  Synthetic
atggccgactcccaagtacgtttgattctggggttttagcttgcttgtttcccatttgaaggagttcagcgcacagggcctcaaaaaagaacaacaaaattgcctaggatccactgtgcgggagacccagcatggcgtat

SEQ ID NO: 427209 - DNA, 140 bp, Artificial Sequence
  Synthetic
atacgccatgctgggtctccagctgcctgtcaattgtgatgtaagtgcctcaaagtaatcctcgatgagccttgtgaacatctttgttctgaggtctccgatgtacaactctcggttgcccgtacttgggagtcggccat

SEQ ID NO: 427210 - DNA, 140 bp, Artificial Sequence
  Synthetic
atggccgactcccaagtacgggcaaccgagagttgtacatcggagacctcagaacaaagatgttcacaaggctcatcgaggattactttgaggcacttacatcacaattgacaggcagctggagacccagcatggcgtat

SEQ ID NO: 427211 - DNA, 140 bp, Artificial Sequence
  Synthetic
aggccctggctgctgatatgcttgtgaacatctttgttctgaggtctccgatgtacaactctcggttgccccccacctgttccttgtaggataaagagaattttagtctaccggtgtcaggaccttttgggacagcggtg

SEQ ID NO: 427212 - DNA, 140 bp, Artificial Sequence
  Synthetic
caccgctgtcccaaaaggtcctgacaccggtagactaaaattctctttatcctacaaggaacaggtggggggcaaccgagagttgtacatcggagacctcagaacaaagatgttcacaagcatatcagcagccagggcct

SEQ ID NO: 427213 - DNA, 140 bp, Artificial Sequence
  Synthetic
atacgccatgctgggtctccttgtgattcaagaagcttccttatgtcttcagacccctggcaagtgataaccatattccgaggaagtgcctcaataacagcactggtcagaccaggttgtcgtacttgggagtcggccat

SEQ ID NO: 427214 - DNA, 140 bp, Artificial Sequence
  Synthetic
atggccgactcccaagtacgacaacctggtctgaccagtgctgttattgaggcacttcctcggaatatggttatcacttgccaggggtctgaagacataaggaagcttcttgaatcacaaggagacccagcatggcgtat

SEQ ID NO: 427215 - DNA, 140 bp, Artificial Sequence
  Synthetic
atacgccatgctgggtctccttctttaacattgctgtggtacaattggttagagataaagctttgctaagtgcctcagaattactctcccgttcacttattctgacatcgtcagccaattcgtacttgggagtcggccat

SEQ ID NO: 427216 - DNA, 140 bp, Artificial Sequence
  Synthetic
atggccgactcccaagtacgaattggctgacgatgtcagaataagtgaacgggagagtaattctgaggcacttagcaaagctttatctctaaccaattgtaccacagcaatgttaaagaaggagacccagcatggcgtat

SEQ ID NO: 427217 - DNA, 140 bp, Artificial Sequence
  Synthetic
aggccctggctgctgatatgtgcctcagaattactctcccgttcacttattctgacatcgtcagccaatttccctgtgtcaaacttaaaatttagacatttgcttttataatgggaatatgaccttttgggacagcggtg

SEQ ID NO: 427218 - DNA, 140 bp, Artificial Sequence
  Synthetic
caccgctgtcccaaaaggtcatattcccattataaaagcaaatgtctaaattttaagtttgacacagggaaattggctgacgatgtcagaataagtgaacgggagagtaattctgaggcacatatcagcagccagggcct

SEQ ID NO: 427219 - DNA, 140 bp, Artificial Sequence
  Synthetic
aggccctggctgctgatatgcttggactctctctgattctgaaggtaatgaaacaccgggtgggtattgtctaacaagatggatgctgattgaggccgagttgaagtgctttgggaacacgaccttttgggacagcggtg

SEQ ID NO: 427220 - DNA, 140 bp, Artificial Sequence
  Synthetic
caccgctgtcccaaaaggtcgtgttcccaaagcacttcaactcggcctcaatcagcatccatcttgttagacaatacccacccggtgtttcattaccttcagaatcagagagagtccaagcatatcagcagccagggcct

SEQ ID NO: 427221 - DNA, 140 bp, Artificial Sequence
  Synthetic
atacgccatgctgggtctccttggaaatattcctggtctaagaaagtccttgttaccactgcctttgtcaactctcctataggacaagaattcattgatcctgtgtaaaagtatttgtctcgtacttgggagtcggccat

SEQ ID NO: 427222 - DNA, 140 bp, Artificial Sequence
  Synthetic
atggccgactcccaagtacgagacaaatacttttacacaggatcaatgaattcttgtcctataggagagttgacaaaggcagtggtaacaaggactttcttagaccaggaatatttccaaggagacccagcatggcgtat

SEQ ID NO: 427223 - DNA, 140 bp, Artificial Sequence
  Synthetic
aggccctggctgctgatatgactctcctataggacaagaattcattgatcctgtgtaaaagtatttgtctcttaaaatctcatcactatatatgctttcacaaattttgacatattgatcgaccttttgggacagcggtg

SEQ ID NO: 427224 - DNA, 140 bp, Artificial Sequence
  Synthetic
caccgctgtcccaaaaggtcgatcaatatgtcaaaatttgtgaaagcatatatagtgatgagattttaagagacaaatacttttacacaggatcaatgaattcttgtcctataggagagtcatatcagcagccagggcct

SEQ ID NO: 427225 - DNA, 140 bp, Artificial Sequence
  Synthetic
aggccctggctgctgatatgttctgtcttgacaatctctcgttgtccgctaggtactttgatactaaatctttgacacaggctatgtcttcctccatgttcggctgtaggtgtgatggtcgaccttttgggacagcggtg

SEQ ID NO: 427226 - DNA, 140 bp, Artificial Sequence
  Synthetic
caccgctgtcccaaaaggtcgaccatcacacctacagccgaacatggaggaagacatagcctgtgtcaaagatttagtatcaaagtacctagcggacaacgagagattgtcaagacagaacatatcagcagccagggcct

SEQ ID NO: 427227 - DNA, 140 bp, Artificial Sequence
  Synthetic
atacgccatgctgggtctcccactcttgatcaatcttatgaagagcttttcctccaccaccttgtcaaggtcagatattgagggcgaattgcaatccacttgttgttgtcttcctggtgacgtacttgggagtcggccat

SEQ ID NO: 427228 - DNA, 140 bp, Artificial Sequence
  Synthetic
atggccgactcccaagtacgtcaccaggaagacaacaacaagtggattgcaattcgccctcaatatctgaccttgacaaggtggtggaggaaaagctcttcataagattgatcaagagtgggagacccagcatggcgtat

SEQ ID NO: 427229 - DNA, 140 bp, Artificial Sequence
  Synthetic
aggccctggctgctgatatgtcagatattgagggcgaattgcaatccacttgttgttgtcttcctggtgactccctatattgactaataatgttgtcaacagtgcatcttaggtggtcaagaccttttgggacagcggtg

SEQ ID NO: 427230 - DNA, 140 bp, Artificial Sequence
  Synthetic
caccgctgtcccaaaaggtcttgaccacctaagatgcactgttgacaacattattagtcaatatagggagtcaccaggaagacaacaacaagtggattgcaattcgccctcaatatctgacatatcagcagccagggcct

SEQ ID NO: 427231 - DNA, 140 bp, Artificial Sequence
  Synthetic
atacgccatgctgggtctcctagagcagaagttcactatagaatgaggtcccgtagggggcacagaagacacaagactcaattaaagacaattaaattagatagccttaatgccgaggatcgtacttgggagtcggccat

SEQ ID NO: 427232 - DNA, 140 bp, Artificial Sequence
  Synthetic
atggccgactcccaagtacgatcctcggcattaaggctatctaatttaattgtctttaattgagtcttgtgtcttctgtgccccctacgggacctcattctatagtgaacttctgctctaggagacccagcatggcgtat

SEQ ID NO: 427233 - DNA, 140 bp, Artificial Sequence
  Synthetic
atacgccatgctgggtctcctcaacattactacttccctcttttgaacctaagacaagattactcattgcttgttgtatcttataatcatagtcctgtttgtttagcagatatttgccttcgtacttgggagtcggccat

SEQ ID NO: 427234 - DNA, 140 bp, Artificial Sequence
  Synthetic
atggccgactcccaagtacgaaggcaaatatctgctaaacaaacaggactatgattataagatacaacaagcaatgagtaatcttgtcttaggttcaaaagagggaagtagtaatgttgaggagacccagcatggcgtat

SEQ ID NO: 427235 - DNA, 140 bp, Artificial Sequence
  Synthetic
aggccctggctgctgatatgttgttgtatcttataatcatagtcctgtttgtttagcagatatttgcctttgcgtgcgaacacctctgttaattgtgtgacagccaatgctgtcaacttggaccttttgggacagcggtg

SEQ ID NO: 427236 - DNA, 140 bp, Artificial Sequence
  Synthetic
caccgctgtcccaaaaggtccaagttgacagcattggctgtcacacaattaacagaggtgttcgcacgcaaaggcaaatatctgctaaacaaacaggactatgattataagatacaacaacatatcagcagccagggcct

SEQ ID NO: 427237 - DNA, 140 bp, Artificial Sequence
  Synthetic
atacgccatgctgggtctccaacacttttattgctagccagatccaaagctgtagcacaaccacttgtaataagggggtctagcagtgccttttttacttcttttcccttgaatagagagcgtacttgggagtcggccat

SEQ ID NO: 427238 - DNA, 140 bp, Artificial Sequence
  Synthetic
atggccgactcccaagtacgctctctattcaagggaaaagaagtaaaaaaggcactgctagacccccttattacaagtggttgtgctacagctttggatctggctagcaataaaagtgttggagacccagcatggcgtat

SEQ ID NO: 427239 - DNA, 140 bp, Artificial Sequence
  Synthetic
aggccctggctgctgatatgtaagggggtctagcagtgccttttttacttcttttcccttgaatagagagccattgttaaaactagacacgagaagtgaaatgaatttcttggacacaccgaccttttgggacagcggtg

SEQ ID NO: 427240 - DNA, 140 bp, Artificial Sequence
  Synthetic
caccgctgtcccaaaaggtcggtgtgtccaagaaattcatttcacttctcgtgtctagttttaacaatggctctctattcaagggaaaagaagtaaaaaaggcactgctagacccccttacatatcagcagccagggcct

SEQ ID NO: 427241 - DNA, 140 bp, Artificial Sequence
  Synthetic
aggccctggctgctgatatgcagatattgagggtgcattgcagtctgcctgctgctgtctttctggttgctccctatactgactgacaatattgtcaacagtgcacctcagttggtcgaagaccttttgggacagcggtg

SEQ ID NO: 427242 - DNA, 140 bp, Artificial Sequence
  Synthetic
caccgctgtcccaaaaggtcttcgaccaactgaggtgcactgttgacaatattgtcagtcagtatagggagcaaccagaaagacagcagcaggcagactgcaatgcaccctcaatatctgcatatcagcagccagggcct

SEQ ID NO: 427243 - DNA, 140 bp, Artificial Sequence
  Synthetic
atacgccatgctgggtctccggaactttctcgcattgtagatcatttcatgaagctcttcttctgacgcatcatcctttgggttcacactgacatgcccaaaatccaatttgggttcaagcgtacttgggagtcggccat

SEQ ID NO: 427244 - DNA, 140 bp, Artificial Sequence
  Synthetic
atggccgactcccaagtacgcttgaacccaaattggattttgggcatgtcagtgtgaacccaaaggatgatgcgtcagaagaagagcttcatgaaatgatctacaatgcgagaaagttccggagacccagcatggcgtat

SEQ ID NO: 427245 - DNA, 140 bp, Artificial Sequence
  Synthetic
aggccctggctgctgatatgtttgcctcctcttttcttcttttcgacaaccactccagtatgcatatggcatagatctttgcactgatcccaaacagcattttcaaatctcctagagtcagaccttttgggacagcggtg

SEQ ID NO: 427246 - DNA, 140 bp, Artificial Sequence
  Synthetic
caccgctgtcccaaaaggtctgactctaggagatttgaaaatgctgtttgggatcagtgcaaagatctatgccatatgcatactggagtggttgtcgaaaagaagaaaagaggaggcaaacatatcagcagccagggcct

SEQ ID NO: 427247 - DNA, 140 bp, Artificial Sequence
  Synthetic
atacgccatgctgggtctccttggtcatcatactgacaacctcctcagataaaattattcctaataaatgacggacaagcttatagagtaggtattcaacctctgtaattaaatcctctccgtacttgggagtcggccat

SEQ ID NO: 427248 - DNA, 140 bp, Artificial Sequence
  Synthetic
atggccgactcccaagtacggagaggatttaattacagaggttgaatacctactctataagcttgtccgtcatttattaggaataattttatctgaggaggttgtcagtatgatgaccaaggagacccagcatggcgtat

SEQ ID NO: 427249 - DNA, 140 bp, Artificial Sequence
  Synthetic
aggccctggctgctgatatgacggacaagcttatagagtaggtattcaacctctgtaattaaatcctctctaattttgtcaattaggtccttgtggtgaaaatcagacacaaatgccatcgaccttttgggacagcggtg

SEQ ID NO: 427250 - DNA, 140 bp, Artificial Sequence
  Synthetic
caccgctgtcccaaaaggtcgatggcatttgtgtctgattttcaccacaaggacctaattgacaaaattagagaggatttaattacagaggttgaatacctactctataagcttgtccgtcatatcagcagccagggcct

SEQ ID NO: 427251 - DNA, 140 bp, Artificial Sequence
  Synthetic
atacgccatgctgggtctccaagagggtctcgcagtgtcctctttacttccttttctttaaacaatgaaccattattgaaactagacacaaggagtgagataaattttttggaaacaccacgtacttgggagtcggccat

SEQ ID NO: 427252 - DNA, 140 bp, Artificial Sequence
  Synthetic
atggccgactcccaagtacgtggtgtttccaaaaaatttatctcactccttgtgtctagtttcaataatggttcattgtttaaagaaaaggaagtaaagaggacactgcgagaccctcttggagacccagcatggcgtat

SEQ ID NO: 427253 - DNA, 140 bp, Artificial Sequence
  Synthetic
atacgccatgctgggtctcctgttaatattagaaccaggatcattttggtcaacagtttgatggtgaccagctgttcagataattctgagcactcttctatccagctgaccataacattgcgtacttgggagtcggccat

SEQ ID NO: 427254 - DNA, 140 bp, Artificial Sequence
  Synthetic
atggccgactcccaagtacgcaatgttatggtcagctggatagaagagtgctcagaattatctgaacagctggtcaccatcaaactgttgaccaaaatgatcctggttctaatattaacaggagacccagcatggcgtat

SEQ ID NO: 427255 - DNA, 140 bp, Artificial Sequence
  Synthetic
aggccctggctgctgatatggctgttcagataattctgagcactcttctatccagctgaccataacattgaccactctctgtaggacatcactagagaaaactgcaggaaagaatcgtttgaccttttgggacagcggtg

SEQ ID NO: 427256 - DNA, 140 bp, Artificial Sequence
  Synthetic
caccgctgtcccaaaaggtcaaacgattctttcctgcagttttctctagtgatgtcctacagagagtggtcaatgttatggtcagctggatagaagagtgctcagaattatctgaacagccatatcagcagccagggcct

SEQ ID NO: 427257 - DNA, 140 bp, Artificial Sequence
  Synthetic
aggccctggctgctgatatgtgaccagctgatcatgaagaatcatttgagagatatcatgggaattccttactgcaattacagcaagtattggtatctaaatcacactgtaacagggagggaccttttgggacagcggtg

SEQ ID NO: 427258 - DNA, 140 bp, Artificial Sequence
  Synthetic
caccgctgtcccaaaaggtccctccctgttacagtgtgatttagataccaatacttgctgtaattgcagtaaggaattcccatgatatctctcaaatgattcttcatgatcagctggtcacatatcagcagccagggcct

SEQ ID NO: 427259 - DNA, 140 bp, Artificial Sequence
  Synthetic
atacgccatgctgggtctcccataacactttgaacattcacctgtcttctgatatagcaatttaaatcctatcttgttgacaaagaactcttgacaataagcttccttgcatctaacaaccgtacttgggagtcggccat

SEQ ID NO: 427260 - DNA, 140 bp, Artificial Sequence
  Synthetic
atggccgactcccaagtacggttgttagatgcaaggaagcttattgtcaagagttctttgtcaacaagataggatttaaattgctatatcagaagacaggtgaatgttcaaagtgttatgggagacccagcatggcgtat

SEQ ID NO: 427261 - DNA, 140 bp, Artificial Sequence
  Synthetic
aggccctggctgctgatatgatcttgttgacaaagaactcttgacaataagcttccttgcatctaacaacctgatatctagaaggcccaaactcattctgcctcagcttcacggttgaaggaccttttgggacagcggtg

SEQ ID NO: 427262 - DNA, 140 bp, Artificial Sequence
  Synthetic
caccgctgtcccaaaaggtccttcaaccgtgaagctgaggcagaatgagtttgggccttctagatatcaggttgttagatgcaaggaagcttattgtcaagagttctttgtcaacaagatcatatcagcagccagggcct

SEQ ID NO: 427263 - DNA, 140 bp, Artificial Sequence
  Synthetic
atacgccatgctgggtctccaaatctgttgcgtttaggatatcaacaacacctagggtgtaagggaacatgtcttcttgagacttttgatagctcatagtaggtgtgaccccagaaacctcgtacttgggagtcggccat

SEQ ID NO: 427264 - DNA, 140 bp, Artificial Sequence
  Synthetic
atggccgactcccaagtacgaggtttctggggtcacacctactatgagctatcaaaagtctcaagaagacatgttcccttacaccctaggtgttgttgatatcctaaacgcaacagatttggagacccagcatggcgtat

SEQ ID NO: 427265 - DNA, 140 bp, Artificial Sequence
  Synthetic
aggccctggctgctgatatggtcttcttgagacttttgatagctcatagtaggtgtgaccccagaaacctcaatactcatgattgtgtcatagacatcacaatcaagaatttcaagatcagaccttttgggacagcggtg

SEQ ID NO: 427266 - DNA, 140 bp, Artificial Sequence
  Synthetic
caccgctgtcccaaaaggtctgatcttgaaattcttgattgtgatgtctatgacacaatcatgagtattgaggtttctggggtcacacctactatgagctatcaaaagtctcaagaagaccatatcagcagccagggcct

SEQ ID NO: 427267 - DNA, 140 bp, Artificial Sequence
  Synthetic
atacgccatgctgggtctcctcgagttaaaaccttgttaatgatggctaaaagctcgtggtttcgtccccctatggatgatggaagatttgcacttttgtccctggctctccttctactacgtacttgggagtcggccat

SEQ ID NO: 427268 - DNA, 140 bp, Artificial Sequence
  Synthetic
atggccgactcccaagtacgtagtagaaggagagccagggacaaaagtgcaaatcttccatcatccatagggggacgaaaccacgagcttttagccatcattaacaaggttttaactcgaggagacccagcatggcgtat

SEQ ID NO: 427269 - DNA, 140 bp, Artificial Sequence
  Synthetic
aggccctggctgctgatatgctatggatgatggaagatttgcacttttgtccctggctctccttctactatctatccaccgttttagatccctttttgttgattctaatgaaactagtctgaccttttgggacagcggtg

SEQ ID NO: 427270 - DNA, 140 bp, Artificial Sequence
  Synthetic
caccgctgtcccaaaaggtcagactagtttcattagaatcaacaaaaagggatctaaaacggtggatagatagtagaaggagagccagggacaaaagtgcaaatcttccatcatccatagcatatcagcagccagggcct

SEQ ID NO: 427271 - DNA, 140 bp, Artificial Sequence
  Synthetic
atacgccatgctgggtctcctatcataccctaaactatccaaccggcttgcaaggaggattagaacgtcaaaaacaagaagaagttttcttctagtgttaagaatccttagtgattttaccgtacttgggagtcggccat

SEQ ID NO: 427272 - DNA, 140 bp, Artificial Sequence
  Synthetic
atggccgactcccaagtacggtaaaatcactaaggattcttaacactagaagaaaacttcttcttgtttttgacgttctaatcctccttgcaagccggttggatagtttagggtatgataggagacccagcatggcgtat

SEQ ID NO: 427273 - DNA, 140 bp, Artificial Sequence
  Synthetic
aggccctggctgctgatatgaaaacaagaagaagttttcttctagtgttaagaatccttagtgattttaccttattcaagaaagatctccaacactgcatctgtccattctgagggtcaggaccttttgggacagcggtg

SEQ ID NO: 427274 - DNA, 140 bp, Artificial Sequence
  Synthetic
caccgctgtcccaaaaggtcctgaccctcagaatggacagatgcagtgttggagatctttcttgaataaggtaaaatcactaaggattcttaacactagaagaaaacttcttcttgttttcatatcagcagccagggcct

SEQ ID NO: 427275 - DNA, 140 bp, Artificial Sequence
  Synthetic
atacgccatgctgggtctccggagaggctctctgaaactggaatgtcaattgttcgatactttcatcattagtgctaatcttatcattgtacagattcctgaaatcttccaataactttacgtacttgggagtcggccat

SEQ ID NO: 427276 - DNA, 140 bp, Artificial Sequence
  Synthetic
atggccgactcccaagtacgtaaagttattggaagatttcaggaatctgtacaatgataagattagcactaatgatgaaagtatcgaacaattgacattccagtttcagagagcctctccggagacccagcatggcgtat

SEQ ID NO: 427277 - DNA, 140 bp, Artificial Sequence
  Synthetic
aggccctggctgctgatatgagtgctaatcttatcattgtacagattcctgaaatcttccaataactttatcttgtcagtctttatgaattgactttctatgcctccctgcctcaacttggaccttttgggacagcggtg

SEQ ID NO: 427278 - DNA, 140 bp, Artificial Sequence
  Synthetic
caccgctgtcccaaaaggtccaagttgaggcagggaggcatagaaagtcaattcataaagactgacaagataaagttattggaagatttcaggaatctgtacaatgataagattagcactcatatcagcagccagggcct

SEQ ID NO: 427279 - DNA, 140 bp, Artificial Sequence
  Synthetic
atacgccatgctgggtctccagaaagcttgttgttaataccttgatggcagctagaaattaattcctcaaagtgctttgcacgattatcaattagagcattgatgctttctattccggagcgtacttgggagtcggccat

SEQ ID NO: 427280 - DNA, 140 bp, Artificial Sequence
  Synthetic
atggccgactcccaagtacgctccggaatagaaagcatcaatgctctaattgataatcgtgcaaagcactttgaggaattaatttctagctgccatcaaggtattaacaacaagctttctggagacccagcatggcgtat

SEQ ID NO: 427281 - DNA, 140 bp, Artificial Sequence
  Synthetic
aggccctggctgctgatatgagtgctttgcacgattatcaattagagcattgatgctttctattccggagagtctaccagaagttaaagctaatgactcacagagtcttgaatactcagagaccttttgggacagcggtg

SEQ ID NO: 427282 - DNA, 140 bp, Artificial Sequence
  Synthetic
caccgctgtcccaaaaggtctctgagtattcaagactctgtgagtcattagctttaacttctggtagactctccggaatagaaagcatcaatgctctaattgataatcgtgcaaagcactcatatcagcagccagggcct

SEQ ID NO: 427283 - DNA, 140 bp, Artificial Sequence
  Synthetic
atacgccatgctgggtctcccggggatcctaggcaattcagttggacttcagtggcaaggctcattttagtgaattcctgaatcaaagtactaagttaaaatgggcaatagacaggctaacgtacttgggagtcggccat

SEQ ID NO: 427284 - DNA, 140 bp, Artificial Sequence
  Synthetic
atggccgactcccaagtacgttagcctgtctattgcccattttaacttagtactttgattcaggaattcactaaaatgagccttgccactgaagtccaactgaattgcctaggatccccgggagacccagcatggcgtat

SEQ ID NO: 427285 - DNA, 140 bp, Artificial Sequence
  Synthetic
atacgccatgctgggtctccaggtgtccctaagtttgtcattcacccagtcaggtatctgctcgttataaaaagttgttctaccgtctataagagggatgaggttgatgccaacagactccgtacttgggagtcggccat

SEQ ID NO: 427286 - DNA, 140 bp, Artificial Sequence
  Synthetic
atggccgactcccaagtacggagtctgttggcatcaacctcatccctcttatagacggtagaacaactttttataacgagcagatacctgactgggtgaatgacaaacttagggacacctggagacccagcatggcgtat

SEQ ID NO: 427287 - DNA, 140 bp, Artificial Sequence
  Synthetic
aggccctggctgctgatatgaaagttgttctaccgtctataagagggatgaggttgatgccaacagactccagatcacctttcagttgttctaacttcttgtagtcttccagatacttttgaccttttgggacagcggtg

SEQ ID NO: 427288 - DNA, 140 bp, Artificial Sequence
  Synthetic
caccgctgtcccaaaaggtcaaaagtatctggaagactacaagaagttagaacaactgaaaggtgatctggagtctgttggcatcaacctcatccctcttatagacggtagaacaactttcatatcagcagccagggcct

SEQ ID NO: 427289 - DNA, 140 bp, Artificial Sequence
  Synthetic
atacgccatgctgggtctccacattgccagtgaatttatagccatcagggaccacgaaacataaggcaggggtgagcaccccatgatcattgaggatggtttcaactgttttatcctctgcgtacttgggagtcggccat

SEQ ID NO: 427290 - DNA, 140 bp, Artificial Sequence
  Synthetic
atggccgactcccaagtacgcagaggataaaacagttgaaaccatcctcaatgatcatggggtgctcacccctgccttatgtttcgtggtccctgatggctataaattcactggcaatgtggagacccagcatggcgtat

SEQ ID NO: 427291 - DNA, 140 bp, Artificial Sequence
  Synthetic
aggccctggctgctgatatgggtgagcaccccatgatcattgaggatggtttcaactgttttatcctctgtattgtgttcgcagccattggccttgcaggagtcaatctcaatacagagagaccttttgggacagcggtg

SEQ ID NO: 427292 - DNA, 140 bp, Artificial Sequence
  Synthetic
caccgctgtcccaaaaggtctctctgtattgagattgactcctgcaaggccaatggctgcgaacacaatacagaggataaaacagttgaaaccatcctcaatgatcatggggtgctcacccatatcagcagccagggcct

SEQ ID NO: 427293 - DNA, 140 bp, Artificial Sequence
  Synthetic
atacgccatgctgggtctcccagaaaggccagtttctgtctagacagcttttcgttgtctacaaggtattttgagatgagatctttggcattggcaatgccttcctccattgttaattgccgtacttgggagtcggccat

SEQ ID NO: 427294 - DNA, 140 bp, Artificial Sequence
  Synthetic
atggccgactcccaagtacggcaattaacaatggaggaaggcattgccaatgccaaagatctcatctcaaaataccttgtagacaacgaaaagctgtctagacagaaactggcctttctgggagacccagcatggcgtat

SEQ ID NO: 427295 - DNA, 140 bp, Artificial Sequence
  Synthetic
atacgccatgctgggtctccaatgcttggatcgaattggggcttatgcttatttgatgtgcacgtcagttagtgacactccaagtaaaattctacagagatgagagtcaatatgcctaggcgtacttgggagtcggccat

SEQ ID NO: 427296 - DNA, 140 bp, Artificial Sequence
  Synthetic
atggccgactcccaagtacgcctaggcatattgactctcatctctgtagaattttacttggagtgtcactaactgacgtgcacatcaaataagcataagccccaattcgatccaagcattggagacccagcatggcgtat

SEQ ID NO: 427297 - DNA, 140 bp, Artificial Sequence
  Synthetic
aggccctggctgctgatatgtgcgcattaagcgctgcacattgctgacttcagaaaagtcaagaccatgaaggagagcctgagcatccttaacaacttgaagctttatgttggagcaatagaccttttgggacagcggtg

SEQ ID NO: 427298 - DNA, 140 bp, Artificial Sequence
  Synthetic
caccgctgtcccaaaaggtctattgctccaacataaagcttcaagttgttaaggatgctcaggctctccttcatggtcttgacttttctgaagtcagcaatgtgcagcgcttaatgcgcacatatcagcagccagggcct

SEQ ID NO: 427299 - DNA, 140 bp, Artificial Sequence
  Synthetic
aggccctggctgctgatatgcattaccagtgagtttgtagccgtcaggtaccacaaagcataaagctggagtgagaatcccatgatcactcagaatggattcaaccgttttgtcttcagtgaccttttgggacagcggtg

SEQ ID NO: 427300 - DNA, 140 bp, Artificial Sequence
  Synthetic
caccgctgtcccaaaaggtcactgaagacaaaacggttgaatccattctgagtgatcatgggattctcactccagctttatgctttgtggtacctgacggctacaaactcactggtaatgcatatcagcagccagggcct

SEQ ID NO: 427301 - DNA, 140 bp, Artificial Sequence
  Synthetic
atacgccatgctgggtctccgggatcctaggcaattcagctggacttcagtggtgaggctatttcagcaaatccctgaatcaaagtacccagtcggaatgggcaacaaacaggccaaatccgtacttgggagtcggccat

SEQ ID NO: 427302 - DNA, 140 bp, Artificial Sequence
  Synthetic
atggccgactcccaagtacggatttggcctgtttgttgcccattccgactgggtactttgattcagggatttgctgaaatagcctcaccactgaagtccagctgaattgcctaggatcccggagacccagcatggcgtat

SEQ ID NO: 427303 - DNA, 140 bp, Artificial Sequence
  Synthetic
aggccctggctgctgatatgtgagataagatctttagcattggcaatgtcttcctccatcgccgattatggcacctgtgttgggtttgggcttgtgcctgtatggcttgcaggtcagctggaccttttgggacagcggtg

SEQ ID NO: 427304 - DNA, 140 bp, Artificial Sequence
  Synthetic
caccgctgtcccaaaaggtccagctgacctgcaagccatacaggcacaagcccaaacccaacacaggtgccataatcggcgatggaggaagacattgccaatgctaaagatcttatctcacatatcagcagccagggcct

SEQ ID NO: 427305 - DNA, 140 bp, Artificial Sequence
  Synthetic
aggccctggctgctgatatggcacctgtgttgggtttgggcttgtgcctgtatggcttgcaggtcagctggtggtgccctacaaagaaactcccacagaaatgagagacaatatgcctaggaccttttgggacagcggtg

SEQ ID NO: 427306 - DNA, 140 bp, Artificial Sequence
  Synthetic
caccgctgtcccaaaaggtcctaggcatattgtctctcatttctgtgggagtttctttgtagggcaccaccagctgacctgcaagccatacaggcacaagcccaaacccaacacaggtgccatatcagcagccagggcct

SEQ ID NO: 427307 - DNA, 140 bp, Artificial Sequence
  Synthetic
atacgccatgctgggtctccaagtttattgaaatcataatctaaaatgcgagatccatctgtgtacttatttacaacaacactcttattactagccaaatctaaagctgttgcacagccacgtacttgggagtcggccat

SEQ ID NO: 427308 - DNA, 140 bp, Artificial Sequence
  Synthetic
atggccgactcccaagtacgtggctgtgcaacagctttagatttggctagtaataagagtgttgttgtaaataagtacacagatggatctcgcattttagattatgatttcaataaacttggagacccagcatggcgtat

SEQ ID NO: 427309 - DNA, 140 bp, Artificial Sequence
  Synthetic
atacgccatgctgggtctcccggggatcctaggcattttggaacgcgcattcctagagtcattgaagagtgcctcacactcagacatgggacaaatagtgacattctttcaagaagttcccgtacttgggagtcggccat

SEQ ID NO: 427310 - DNA, 140 bp, Artificial Sequence
  Synthetic
atggccgactcccaagtacgggaacttcttgaaagaatgtcactatttgtcccatgtctgagtgtgaggcactcttcaatgactctaggaatgcgcgttccaaaatgcctaggatccccgggagacccagcatggcgtat

SEQ ID NO: 427311 - DNA, 140 bp, Artificial Sequence
  Synthetic
aggccctggctgctgatatggcctcacactcagacatgggacaaatagtgacattctttcaagaagttcctcatgtcattgaggaaattatgaacattgtcctcatcactttgtctctacgaccttttgggacagcggtg

SEQ ID NO: 427312 - DNA, 140 bp, Artificial Sequence
  Synthetic
caccgctgtcccaaaaggtcgtagagacaaagtgatgaggacaatgttcataatttcctcaatgacatgaggaacttcttgaaagaatgtcactatttgtcccatgtctgagtgtgaggccatatcagcagccagggcct

SEQ ID NO: 427313 - DNA, 140 bp, Artificial Sequence
  Synthetic
atacgccatgctgggtctcctcatgtcattgaggaaattatgaacattgtcctcatcactttgtctctacttgcaattcttaaggggatatacaactttgccacatgtggtcttattggtcgtacttgggagtcggccat

SEQ ID NO: 427314 - DNA, 140 bp, Artificial Sequence
  Synthetic
atggccgactcccaagtacgaccaataagaccacatgtggcaaagttgtatatccccttaagaattgcaagtagagacaaagtgatgaggacaatgttcataatttcctcaatgacatgaggagacccagcatggcgtat

SEQ ID NO: 427315 - DNA, 140 bp, Artificial Sequence
  Synthetic
aggccctggctgctgatatgacaacacctccaccgtacaccccatgatcccaggaccaacactcccatctccaccacccaccccccacccccggggggaccccccgccgggggcccccccgaccttttgggacagcggtg

SEQ ID NO: 427316 - DNA, 140 bp, Artificial Sequence
  Synthetic
caccgctgtcccaaaaggtcgggggggcccccggcggggggtccccccgggggtggggggtgggtggtggagatgggagtgttggtcctgggatcatggggtgtacggtggaggtgttgtcatatcagcagccagggcct

SEQ ID NO: 427317 - DNA, 140 bp, Artificial Sequence
  Synthetic
atacgccatgctgggtctccaggaagctatcaactccagacacttgagctaaacatggaaacactcaatatgaccatgcctttatcctgtacaaaaaacaacagtcaccactatataagacgtacttgggagtcggccat

SEQ ID NO: 427318 - DNA, 140 bp, Artificial Sequence
  Synthetic
atggccgactcccaagtacgtcttatatagtggtgactgttgttttttgtacaggataaaggcatggtcatattgagtgtttccatgtttagctcaagtgtctggagttgatagcttcctggagacccagcatggcgtat

SEQ ID NO: 427319 - DNA, 140 bp, Artificial Sequence
  Synthetic
aggccctggctgctgatatgtgaccatgcctttatcctgtacaaaaaacaacagtcaccactatataagagtgggcaatgagacaggactggaattaaccttaactaacacaagcatcatgaccttttgggacagcggtg

SEQ ID NO: 427320 - DNA, 140 bp, Artificial Sequence
  Synthetic
caccgctgtcccaaaaggtcatgatgcttgtgttagttaaggttaattccagtcctgtctcattgcccactcttatatagtggtgactgttgttttttgtacaggataaaggcatggtcacatatcagcagccagggcct

SEQ ID NO: 427321 - DNA, 140 bp, Artificial Sequence
  Synthetic
atacgccatgctgggtctcctccgatgtacaactctctattgcctcccacttgttctttgtaagacaaagaaaattttagtctgccagtgtcagggccagttgaattataagattgaggtcgtacttgggagtcggccat

SEQ ID NO: 427322 - DNA, 140 bp, Artificial Sequence
  Synthetic
atggccgactcccaagtacgacctcaatcttataattcaactggccctgacactggcagactaaaattttctttgtcttacaaagaacaagtgggaggcaatagagagttgtacatcggaggagacccagcatggcgtat

SEQ ID NO: 427323 - DNA, 140 bp, Artificial Sequence
  Synthetic
aggccctggctgctgatatgttcaatcagtatgaagcaatgagttgtgacttcaatggaggcaagatcagcgttcagtacaatctaagtcatagttatgcagtggatgcagccaatcattgaccttttgggacagcggtg

SEQ ID NO: 427324 - DNA, 140 bp, Artificial Sequence
  Synthetic
caccgctgtcccaaaaggtcaatgattggctgcatccactgcataactatgacttagattgtactgaacgctgatcttgcctccattgaagtcacaactcattgcttcatactgattgaacatatcagcagccagggcct

SEQ ID NO: 427325 - DNA, 140 bp, Artificial Sequence
  Synthetic
atacgccatgctgggtctccggtggaagctacatcgcacttgattcaggccgaggaaattgggactgcataatgacaagctaccaatacttaatcattcagaatacgacatgggaagacccgtacttgggagtcggccat

SEQ ID NO: 427326 - DNA, 140 bp, Artificial Sequence
  Synthetic
atggccgactcccaagtacgggtcttcccatgtcgtattctgaatgattaagtattggtagcttgtcattatgcagtcccaatttcctcggcctgaatcaagtgcgatgtagcttccaccggagacccagcatggcgtat

SEQ ID NO: 427327 - DNA, 140 bp, Artificial Sequence
  Synthetic
aggccctggctgctgatatgaatgacaagctaccaatacttaatcattcagaatacgacatgggaagaccactgtcagttctcaagaccatctcccattggttatcttggacttctatcagaccttttgggacagcggtg

SEQ ID NO: 427328 - DNA, 140 bp, Artificial Sequence
  Synthetic
caccgctgtcccaaaaggtctgatagaagtccaagataaccaatgggagatggtcttgagaactgacagtggtcttcccatgtcgtattctgaatgattaagtattggtagcttgtcattcatatcagcagccagggcct

SEQ ID NO: 427329 - DNA, 140 bp, Artificial Sequence
  Synthetic
atacgccatgctgggtctccatggacactatcagattctgaaggtaaagaaaccccaggaggctactgcttaactagatggatgttaattgaagctgagttaaagtgtttcgggaacactcgtacttgggagtcggccat

SEQ ID NO: 427330 - DNA, 140 bp, Artificial Sequence
  Synthetic
atggccgactcccaagtacgagtgttcccgaaacactttaactcagcttcaattaacatccatctagttaagcagtagcctcctggggtttctttaccttcagaatctgatagtgtccatggagacccagcatggcgtat

SEQ ID NO: 427331 - DNA, 140 bp, Artificial Sequence
  Synthetic
aggccctggctgctgatatgtaactagatggatgttaattgaagctgagttaaagtgtttcgggaacactgcggtggctaaatgcaatgagaaacatgatgaggaattttgtgatatgctgaccttttgggacagcggtg

SEQ ID NO: 427332 - DNA, 140 bp, Artificial Sequence
  Synthetic
caccgctgtcccaaaaggtcagcatatcacaaaattcctcatcatgtttctcattgcatttagccaccgcagtgttcccgaaacactttaactcagcttcaattaacatccatctagttacatatcagcagccagggcct

SEQ ID NO: 427333 - DNA, 140 bp, Artificial Sequence
  Synthetic
atacgccatgctgggtctcccacagatgagcattcagcttatcaacaaagcagtcaacgctcttattaatgaccagcttataatgaaaaaccacctcagagacatcatgggtataccatacgtacttgggagtcggccat

SEQ ID NO: 427334 - DNA, 140 bp, Artificial Sequence
  Synthetic
atggccgactcccaagtacgtatggtatacccatgatgtctctgaggtggtttttcattataagctggtcattaataagagcgttgactgctttgttgataagctgaatgctcatctgtgggagacccagcatggcgtat

SEQ ID NO: 427335 - DNA, 140 bp, Artificial Sequence
  Synthetic
aggccctggctgctgatatggaccagcttataatgaaaaaccacctcagagacatcatgggtataccatattgtaattacagtaaatactggtatcttaatcatacatccacaggcaggagaccttttgggacagcggtg

SEQ ID NO: 427336 - DNA, 140 bp, Artificial Sequence
  Synthetic
caccgctgtcccaaaaggtctcctgcctgtggatgtatgattaagataccagtatttactgtaattacaatatggtatacccatgatgtctctgaggtggtttttcattataagctggtccatatcagcagccagggcct

SEQ ID NO: 427337 - DNA, 140 bp, Artificial Sequence
  Synthetic
aggccctggctgctgatatgagtatctcatctagatcagcattgttggtgtcaccactccctcctttggaccccagaacaagattactcattgcttgctgtatcttgtaatcataatcctgaccttttgggacagcggtg

SEQ ID NO: 427338 - DNA, 140 bp, Artificial Sequence
  Synthetic
caccgctgtcccaaaaggtcaggattatgattacaagatacagcaagcaatgagtaatcttgttctggggtccaaaggagggagtggtgacaccaacaatgctgatctagatgagatactcatatcagcagccagggcct

SEQ ID NO: 427339 - DNA, 140 bp, Artificial Sequence
  Synthetic
atacgccatgctgggtctccactcatttttcagatgatatagaacaacaagccgacaatatgataacggagatgttacagaaggagtacatagataggcaagggaagaccccacttggatcgtacttgggagtcggccat

SEQ ID NO: 427340 - DNA, 140 bp, Artificial Sequence
  Synthetic
atggccgactcccaagtacgatccaagtggggtcttcccttgcctatctatgtactccttctgtaacatctccgttatcatattgtcggcttgttgttctatatcatctgaaaaatgagtggagacccagcatggcgtat

SEQ ID NO: 427341 - DNA, 140 bp, Artificial Sequence
  Synthetic
aggccctggctgctgatatggatgttacagaaggagtacatagataggcaagggaagaccccacttggattggttgacttatttgtattcagcactagtttctacctcatcagtattttcgaccttttgggacagcggtg

SEQ ID NO: 427342 - DNA, 140 bp, Artificial Sequence
  Synthetic
caccgctgtcccaaaaggtcgaaaatactgatgaggtagaaactagtgctgaatacaaataagtcaaccaatccaagtggggtcttcccttgcctatctatgtactccttctgtaacatccatatcagcagccagggcct

SEQ ID NO: 427343 - DNA, 140 bp, Artificial Sequence
  Synthetic
atacgccatgctgggtctcctcccaaacctcacaggctaaaccatatgggcatctgttcctgtggactgtacaaacagccaggggtacctgtgaagtggaagagataatccctccacaggcgtacttgggagtcggccat

SEQ ID NO: 427344 - DNA, 140 bp, Artificial Sequence
  Synthetic
atggccgactcccaagtacgcctgtggagggattatctcttccacttcacaggtacccctggctgtttgtacagtccacaggaacagatgcccatatggtttagcctgtgaggtttgggaggagacccagcatggcgtat

SEQ ID NO: 427345 - DNA, 140 bp, Artificial Sequence
  Synthetic
atacgccatgctgggtctcccaggacgaccttaggtgttgaggtcctgaagaccatgtccctgggtaacacagctcttaagatcctggcatcaagcccacccactacagctgcgtcaaaccgtacttgggagtcggccat

SEQ ID NO: 427346 - DNA, 140 bp, Artificial Sequence
  Synthetic
atggccgactcccaagtacggtttgacgcagctgtagtgggtgggcttgatgccaggatcttaagagctgtgttacccagggacatggtcttcaggacctcaacacctaaggtcgtcctgggagacccagcatggcgtat

SEQ ID NO: 427347 - DNA, 140 bp, Artificial Sequence
  Synthetic
aggccctggctgctgatatgcagctcttaagatcctggcatcaagcccacccactacagctgcgtcaaacatgatgcaatccattagtgcacaatgtggtgtgatttcttccttgccaccgaccttttgggacagcggtg

SEQ ID NO: 427348 - DNA, 140 bp, Artificial Sequence
  Synthetic
caccgctgtcccaaaaggtcggtggcaaggaagaaatcacaccacattgtgcactaatggattgcatcatgtttgacgcagctgtagtgggtgggcttgatgccaggatcttaagagctgcatatcagcagccagggcct

SEQ ID NO: 427349 - DNA, 140 bp, Artificial Sequence
  Synthetic
atacgccatgctgggtctccatgatgcaatccattagtgcacaatgtggtgtgatttcttccttgccaccccttttctttttctcaaccacaatgcccgtatgcatgtggcacaagtcttcgtacttgggagtcggccat

SEQ ID NO: 427350 - DNA, 140 bp, Artificial Sequence
  Synthetic
atggccgactcccaagtacgaagacttgtgccacatgcatacgggcattgtggttgagaaaaagaaaaggggtggcaaggaagaaatcacaccacattgtgcactaatggattgcatcatggagacccagcatggcgtat

SEQ ID NO: 427351 - DNA, 140 bp, Artificial Sequence
  Synthetic
aggccctggctgctgatatgcagtcagtctgtcaggtgtttcttttgtaatgaaatggcacatataagagacatttaaaacaaacttgaatctattggtcatcatactgacaacttcttcgaccttttgggacagcggtg

SEQ ID NO: 427352 - DNA, 140 bp, Artificial Sequence
  Synthetic
caccgctgtcccaaaaggtcgaagaagttgtcagtatgatgaccaatagattcaagtttgttttaaatgtctcttatatgtgccatttcattacaaaagaaacacctgacagactgactgcatatcagcagccagggcct

SEQ ID NO: 427353 - DNA, 140 bp, Artificial Sequence
  Synthetic
atacgccatgctgggtctccatagagatgtccaccaattttatatcttttcttccttgtgattctaagagtttcttaatgtcttccgacccttgacaggtgatgaccatgtttcgtgggacgtacttgggagtcggccat

SEQ ID NO: 427354 - DNA, 140 bp, Artificial Sequence
  Synthetic
atggccgactcccaagtacgtcccacgaaacatggtcatcacctgtcaagggtcggaagacattaagaaactcttagaatcacaaggaagaaaagatataaaattggtggacatctctatggagacccagcatggcgtat

SEQ ID NO: 427355 - DNA, 140 bp, Artificial Sequence
  Synthetic
atacgccatgctgggtctccaaggagctcttcttagtgtccaccatattcaatataggatggctttgggaaagtctgtccaggtcggagctattaggatacttagctgtgtatattagaccgtacttgggagtcggccat

SEQ ID NO: 427356 - DNA, 140 bp, Artificial Sequence
  Synthetic
atggccgactcccaagtacggtctaatatacacagctaagtatcctaatagctccgacctggacagactttcccaaagccatcctatattgaatatggtggacactaagaagagctccttggagacccagcatggcgtat

SEQ ID NO: 427357 - DNA, 140 bp, Artificial Sequence
  Synthetic
atacgccatgctgggtctccatcagttggctccctaaagaaatgaatgtaacagcctgagcttggttgatataaagctatctcaactggatcatctggcctaccttcaatgtccatccaacgtacttgggagtcggccat

SEQ ID NO: 427358 - DNA, 140 bp, Artificial Sequence
  Synthetic
atggccgactcccaagtacgttggatggacattgaaggtaggccagatgatccagttgagatagctttatatcaaccaagctcaggctgttacattcatttctttagggagccaactgatggagacccagcatggcgtat

SEQ ID NO: 427359 - DNA, 140 bp, Artificial Sequence
  Synthetic
aggccctggctgctgatatgataaagctatctcaactggatcatctggcctaccttcaatgtccatccaagtcttggcgtttgggtccaattgcagcatggaatccttgagagtcatgaggaccttttgggacagcggtg

SEQ ID NO: 427360 - DNA, 140 bp, Artificial Sequence
  Synthetic
caccgctgtcccaaaaggtcctcatgactctcaaggattccatgctgcaattggacccaaacgccaagacttggatggacattgaaggtaggccagatgatccagttgagatagctttatcatatcagcagccagggcct

SEQ ID NO: 427361 - DNA, 140 bp, Artificial Sequence
  Synthetic
aggccctggctgctgatatgaggcaagccgtgtcccagacctcacaggttgaatcatatgggcatttgttcctgtggactctataaacagcctggtgtgcctgtaaaatggaagagatgagaccttttgggacagcggtg

SEQ ID NO: 427362 - DNA, 140 bp, Artificial Sequence
  Synthetic
caccgctgtcccaaaaggtctcatctcttccattttacaggcacaccaggctgtttatagagtccacaggaacaaatgcccatatgattcaacctgtgaggtctgggacacggcttgcctcatatcagcagccagggcct

SEQ ID NO: 427363 - DNA, 140 bp, Artificial Sequence
  Synthetic
atacgccatgctgggtctcctggacccactatttccgggcttctgaggtttgctgtctgactccaaatctactatagtgttttcccaagccctaccagtgattgaagttcttgatgcaatcgtacttgggagtcggccat

SEQ ID NO: 427364 - DNA, 140 bp, Artificial Sequence
  Synthetic
atggccgactcccaagtacgattgcatcaagaacttcaatcactggtagggcttgggaaaacactatagtagatttggagtcagacagcaaacctcagaagcccggaaatagtgggtccaggagacccagcatggcgtat

SEQ ID NO: 427365 - DNA, 140 bp, Artificial Sequence
  Synthetic
aggccctggctgctgatatgtaaatgggatctcaaccattttgtgcatatgccatgttaataatgttgataggtaatctttaccttttaaatcagcttgtaaatcatcagaaagtaagatgaccttttgggacagcggtg

SEQ ID NO: 427366 - DNA, 140 bp, Artificial Sequence
  Synthetic
caccgctgtcccaaaaggtcatcttactttctgatgatttacaagctgatttaaaaggtaaagattacctatcaacattattaacatggcatatgcacaaaatggttgagatcccatttacatatcagcagccagggcct

SEQ ID NO: 427367 - DNA, 140 bp, Artificial Sequence
  Synthetic
atacgccatgctgggtctccccggggatcctaggcatttttggttgcgcatttcaagtgtcctatttaaaatgggacaaatagtgactttcttccaggaagtaccccatgtgatagaagacgtacttgggagtcggccat

SEQ ID NO: 427368 - DNA, 140 bp, Artificial Sequence
  Synthetic
atggccgactcccaagtacgtcttctatcacatggggtacttcctggaagaaagtcactatttgtcccattttaaataggacacttgaaatgcgcaaccaaaaatgcctaggatccccggggagacccagcatggcgtat

SEQ ID NO: 427369 - DNA, 140 bp, Artificial Sequence
  Synthetic
atacgccatgctgggtctccttgaccttcagaattgattttaaaatcccatccatagtttggggtgaaactttgattgtctctaacatattgccgccatcaagcatgcaggctcctgcctcgtacttgggagtcggccat

SEQ ID NO: 427370 - DNA, 140 bp, Artificial Sequence
  Synthetic
atggccgactcccaagtacgaggcaggagcctgcatgcttgatggcggcaatatgttagagacaatcaaagtttcaccccaaactatggatgggattttaaaatcaattctgaaggtcaaggagacccagcatggcgtat

SEQ ID NO: 427371 - DNA, 140 bp, Artificial Sequence
  Synthetic
aggccctggctgctgatatgtttgattgtctctaacatattgccgccatcaagcatgcaggctcctgccttcactgcagcacccagactgaagttgtagccagagatgttgagggaactcgaccttttgggacagcggtg

SEQ ID NO: 427372 - DNA, 140 bp, Artificial Sequence
  Synthetic
caccgctgtcccaaaaggtcgagttccctcaacatctctggctacaacttcagtctgggtgctgcagtgaaggcaggagcctgcatgcttgatggcggcaatatgttagagacaatcaaacatatcagcagccagggcct

SEQ ID NO: 427373 - DNA, 140 bp, Artificial Sequence
  Synthetic
atacgccatgctgggtctcctaaatcagatgaattgggatacttagcggtataaatcagacccaaatctgtcagagcttggacagcatcattcagatccacttgcccctgtttggtcaagcgtacttgggagtcggccat

SEQ ID NO: 427374 - DNA, 140 bp, Artificial Sequence
  Synthetic
atggccgactcccaagtacgcttgaccaaacaggggcaagtggatctgaatgatgctgtccaagctctgacagatttgggtctgatttataccgctaagtatcccaattcatctgatttaggagacccagcatggcgtat

SEQ ID NO: 427375 - DNA, 140 bp, Artificial Sequence
  Synthetic
aggccctggctgctgatatgtcagagcttggacagcatcattcagatccacttgcccctgtttggtcaagcaggctagagtcagacttggcaccgtcccgaattgattatttaacaattcgaccttttgggacagcggtg

SEQ ID NO: 427376 - DNA, 140 bp, Artificial Sequence
  Synthetic
caccgctgtcccaaaaggtcgaattgttaaataatcaattcgggacggtgccaagtctgactctagcctgcttgaccaaacaggggcaagtggatctgaatgatgctgtccaagctctgacatatcagcagccagggcct

SEQ ID NO: 427377 - DNA, 140 bp, Artificial Sequence
  Synthetic
atacgccatgctgggtctccccccttgtctatcactagtcataccaatcatgttcaacagagcccttctctgatcaagctgctgggagctcagattccccatatagactcctgagcttaacgtacttgggagtcggccat

SEQ ID NO: 427378 - DNA, 140 bp, Artificial Sequence
  Synthetic
atggccgactcccaagtacgttaagctcaggagtctatatggggaatctgagctcccagcagcttgatcagagaagggctctgttgaacatgattggtatgactagtgatagacaaggggggagacccagcatggcgtat

SEQ ID NO: 427379 - DNA, 140 bp, Artificial Sequence
  Synthetic
atacgccatgctgggtctcccctgagtcacagctatgccggggatgcagccaaccattgtggcactgttgcaaatggtgtattacagactttcatgaggatggcttggggtgggagctaccgtacttgggagtcggccat

SEQ ID NO: 427380 - DNA, 140 bp, Artificial Sequence
  Synthetic
atggccgactcccaagtacggtagctcccaccccaagccatcctcatgaaagtctgtaatacaccatttgcaacagtgccacaatggttggctgcatccccggcatagctgtgactcaggggagacccagcatggcgtat

SEQ ID NO: 427381 - DNA, 140 bp, Artificial Sequence
  Synthetic
atacgccatgctgggtctccttttgttgtgtagatttaagctcaacaaggttattaactgcctgattcagatctctaaggcgttttagatcaccgtcatctctcttctgcttgcgcattacgtacttgggagtcggccat

SEQ ID NO: 427382 - DNA, 140 bp, Artificial Sequence
  Synthetic
atggccgactcccaagtacgtaatgcgcaagcagaagagagatgacggtgatctaaaacgccttagagatctgaatcaggcagttaataaccttgttgagcttaaatctacacaacaaaaggagacccagcatggcgtat

SEQ ID NO: 427383 - DNA, 140 bp, Artificial Sequence
  Synthetic
aggccctggctgctgatatgatctctaaggcgttttagatcaccgtcatctctcttctgcttgcgcattaatcgctgaacattgctaacttcagagaagtcaagaccgtgtaagagagctgaccttttgggacagcggtg

SEQ ID NO: 427384 - DNA, 140 bp, Artificial Sequence
  Synthetic
caccgctgtcccaaaaggtcagctctcttacacggtcttgacttctctgaagttagcaatgttcagcgattaatgcgcaagcagaagagagatgacggtgatctaaaacgccttagagatcatatcagcagccagggcct

SEQ ID NO: 427385 - DNA, 140 bp, Artificial Sequence
  Synthetic
atacgccatgctgggtctccagattctgaaggcaaggacacaccagggggatattgtctaaccagatggatgctaattgaggctgaactaaagtgcttcgggaacacagctgtggcaaaacgtacttgggagtcggccat

SEQ ID NO: 427386 - DNA, 140 bp, Artificial Sequence
  Synthetic
atggccgactcccaagtacgttttgccacagctgtgttcccgaagcactttagttcagcctcaattagcatccatctggttagacaatatccccctggtgtgtccttgccttcagaatctggagacccagcatggcgtat

SEQ ID NO: 427387 - DNA, 140 bp, Artificial Sequence
  Synthetic
atacgccatgctgggtctccctctctcctcagggactgagtccacaggaatgacttcacttctttcgaagcactcattgttgttgttggattgtgggccttttgcacacttgatcttacacgtacttgggagtcggccat

SEQ ID NO: 427388 - DNA, 140 bp, Artificial Sequence
  Synthetic
atggccgactcccaagtacgtgtaagatcaagtgtgcaaaaggcccacaatccaacaacaacaatgagtgcttcgaaagaagtgaagtcattcctgtggactcagtccctgaggagagagggagacccagcatggcgtat

SEQ ID NO: 427389 - DNA, 140 bp, Artificial Sequence
  Synthetic
atacgccatgctgggtctccctcgagatccacagtggtgttctcccaagctctacccacaatggaagttcttgaagctatgtagggccaaccatccccagaaagacagatcttgtaaagtcgtacttgggagtcggccat

SEQ ID NO: 427390 - DNA, 140 bp, Artificial Sequence
  Synthetic
atggccgactcccaagtacgactttacaagatctgtctttctggggatggttggccctacatagcttcaagaacttccattgtgggtagagcttgggagaacaccactgtggatctcgagggagacccagcatggcgtat

SEQ ID NO: 427391 - DNA, 140 bp, Artificial Sequence
  Synthetic
aggccctggctgctgatatgatgggacagatagtgacattcttccaggaagtgcctcatgtaatagaagaggtgatgaacattgttctcattgcactgtctatattagcagtgctgaaaggaccttttgggacagcggtg

SEQ ID NO: 427392 - DNA, 140 bp, Artificial Sequence
  Synthetic
caccgctgtcccaaaaggtcctttcagcactgctaatatagacagtgcaatgagaacaatgttcatcacctcttctattacatgaggcacttcctggaagaatgtcactatctgtcccatcatatcagcagccagggcct

SEQ ID NO: 427393 - DNA, 140 bp, Artificial Sequence
  Synthetic
aggccctggctgctgatatggatgagattgatgccaacagactccaaatcattctttaattgttctagtttcttgtgatcttctaaatacttctgttcaaaattggcgggggatgatctagaccttttgggacagcggtg

SEQ ID NO: 427394 - DNA, 140 bp, Artificial Sequence
  Synthetic
caccgctgtcccaaaaggtctagatcatcccccgccaattttgaacagaagtatttagaagatcacaagaaactagaacaattaaagaatgatttggagtctgttggcatcaatctcatccatatcagcagccagggcct

SEQ ID NO: 427395 - DNA, 140 bp, Artificial Sequence
  Synthetic
aggccctggctgctgatatgttgttctttgtaagacaaagaaaattttagcctaccagtgtcagggccggttgaattataagattgaggtgactcttggctgtaaaaacacaaattttttgaccttttgggacagcggtg

SEQ ID NO: 427396 - DNA, 140 bp, Artificial Sequence
  Synthetic
caccgctgtcccaaaaggtcaaaaaatttgtgtttttacagccaagagtcacctcaatcttataattcaaccggccctgacactggtaggctaaaattttctttgtcttacaaagaacaacatatcagcagccagggcct

SEQ ID NO: 427397 - DNA, 140 bp, Artificial Sequence
  Synthetic
atacgccatgctgggtctccatgtcttcctccatcgccgattatggcacctgtgttgagtttgggcttgtgcctgtatggcttgcaggtcagctggtggtgccccacaaaaactcccacacgtacttgggagtcggccat

SEQ ID NO: 427398 - DNA, 140 bp, Artificial Sequence
  Synthetic
atggccgactcccaagtacgtgtgggagtttttgtggggcaccaccagctgacctgcaagccatacaggcacaagcccaaactcaacacaggtgccataatcggcgatggaggaagacatggagacccagcatggcgtat

SEQ ID NO: 427399 - DNA, 140 bp, Artificial Sequence
  Synthetic
aggccctggctgctgatatgtaaaatgcccctccccaccaggctaaaggcagcaacacagccaagcgcaccctcaaccgaggcgacccagaacacaacacctccgccatacaccccgtgagaccttttgggacagcggtg

SEQ ID NO: 427400 - DNA, 140 bp, Artificial Sequence
  Synthetic
caccgctgtcccaaaaggtctcacggggtgtatggcggaggtgttgtgttctgggtcgcctcggttgagggtgcgcttggctgtgttgctgcctttagcctggtggggaggggcattttacatatcagcagccagggcct

SEQ ID NO: 427401 - DNA, 140 bp, Artificial Sequence
  Synthetic
aggccctggctgctgatatgcccccccgggggggcaggcagcccaactctactcaatgtcttcaatacacctctccggcccaaacaactctgaacatgttcttcccttcagtctcaagctgaccttttgggacagcggtg

SEQ ID NO: 427402 - DNA, 140 bp, Artificial Sequence
  Synthetic
caccgctgtcccaaaaggtcagcttgagactgaagggaagaacatgttcagagttgtttgggccggagaggtgtattgaagacattgagtagagttgggctgcctgcccccccgggggggcatatcagcagccagggcct

SEQ ID NO: 427403 - DNA, 140 bp, Artificial Sequence
  Synthetic
aggccctggctgctgatatgagattctgaaggcaaggacacaccagggggatattgtctgaccagatggatgctaattgaagctgaactaaaatgcttcgggaacacagctgtagcaaaggaccttttgggacagcggtg

SEQ ID NO: 427404 - DNA, 140 bp, Artificial Sequence
  Synthetic
caccgctgtcccaaaaggtcctttgctacagctgtgttcccgaagcattttagttcagcttcaattagcatccatctggtcagacaatatccccctggtgtgtccttgccttcagaatctcatatcagcagccagggcct

SEQ ID NO: 427405 - DNA, 140 bp, Artificial Sequence
  Synthetic
atacgccatgctgggtctccttcagttgatcaacaaggcagtaaatgctttgataaatgaccaacttataatgaagaaccatctacgggacatcatgggaattccatactgtaattacagcgtacttgggagtcggccat

SEQ ID NO: 427406 - DNA, 140 bp, Artificial Sequence
  Synthetic
atggccgactcccaagtacgctgtaattacagtatggaattcccatgatgtcccgtagatggttcttcattataagttggtcatttatcaaagcatttactgccttgttgatcaactgaaggagacccagcatggcgtat

SEQ ID NO: 427407 - DNA, 140 bp, Artificial Sequence
  Synthetic
atacgccatgctgggtctccttcaccaggggtatctgaaatgaacatcccaagagccttcttgacctttaaaatggacttgagaataccatccattgtctgaggtgacaccttgattgtccgtacttgggagtcggccat

SEQ ID NO: 427408 - DNA, 140 bp, Artificial Sequence
  Synthetic
atggccgactcccaagtacggacaatcaaggtgtcacctcagacaatggatggtattctcaagtccattttaaaggtcaagaaggctcttgggatgttcatttcagatacccctggtgaaggagacccagcatggcgtat

SEQ ID NO: 427409 - DNA, 140 bp, Artificial Sequence
  Synthetic
atacgccatgctgggtctccttgtgtttagcacaagtttctatctcattagtatcttccttcacctagtcaaaataccaacccataggcatattgtgggcaagtcgtgtcccaagccccacgtacttgggagtcggccat

SEQ ID NO: 427410 - DNA, 140 bp, Artificial Sequence
  Synthetic
atggccgactcccaagtacgtggggcttgggacacgacttgcccacaatatgcctatgggttggtattttgactaggtgaaggaagatactaatgagatagaaacttgtgctaaacacaaggagacccagcatggcgtat

SEQ ID NO: 427411 - DNA, 140 bp, Artificial Sequence
  Synthetic
aggccctggctgctgatatggtgtgcctgtgaaatggaagagatgagacccttgtcagggcccccgtgacccaccgcctattggcggtgggtcacgggggcgtccatttacagaacgactgaccttttgggacagcggtg

SEQ ID NO: 427412 - DNA, 140 bp, Artificial Sequence
  Synthetic
caccgctgtcccaaaaggtcagtcgttctgtaaatggacgcccccgtgacccaccgccaataggcggtgggtcacgggggccctgacaagggtctcatctcttccatttcacaggcacaccatatcagcagccagggcct

SEQ ID NO: 427413 - DNA, 140 bp, Artificial Sequence
  Synthetic
  misc_feature (22)..(22): n is a, c, g, or t
atacgccatgctgggtctcccncgcaccgaggatcctaggcattttgactgtcttgtaagattgtcttatctaaggtcaagttctgtcatcttatagttgcagacttggtaagctttccccgtacttgggagtcggccat

SEQ ID NO: 427414 - DNA, 140 bp, Artificial Sequence
  Synthetic
  misc_feature (119)..(119): n is a, c, g, or t
atggccgactcccaagtacggggaaagcttaccaagtctgcaactataagatgacagaacttgaccttagataagacaatcttacaagacagtcaaaatgcctaggatcctcggtgcgngggagacccagcatggcgtat

SEQ ID NO: 427415 - DNA, 140 bp, Artificial Sequence
  Synthetic
aggccctggctgctgatatgccattagtgcacagtgaggggttatctcctctttaccgcctcttttcttcttttcaacaacaacacctgtgtgcatgtggcataagtctttgtactgatcgaccttttgggacagcggtg

SEQ ID NO: 427416 - DNA, 140 bp, Artificial Sequence
  Synthetic
caccgctgtcccaaaaggtcgatcagtacaaagacttatgccacatgcacacaggtgttgttgttgaaaagaagaaaagaggcggtaaagaggagataacccctcactgtgcactaatggcatatcagcagccagggcct

SEQ ID NO: 427417 - DNA, 140 bp, Artificial Sequence
  Synthetic
aggccctggctgctgatatgataaggagaagtttccttctggtattgaggatcctcagagactttatcttattaagaaaagatctccaacattgcatctgttcaccttgagagtcagcaggaccttttgggacagcggtg

SEQ ID NO: 427418 - DNA, 140 bp, Artificial Sequence
  Synthetic
caccgctgtcccaaaaggtcctgctgactctcaaggtgaacagatgcaatgttggagatcttttcttaataagataaagtctctgaggatcctcaataccagaaggaaacttctccttatcatatcagcagccagggcct

SEQ ID NO: 427419 - DNA, 140 bp, Artificial Sequence
  Synthetic
atacgccatgctgggtctccgatctttttgtcttcagcactagtttctaccttattagcatcttcctccacctggtcaaaatcccaacccacagacatgtcatagggaaaccctgccccacgtacttgggagtcggccat

SEQ ID NO: 427420 - DNA, 140 bp, Artificial Sequence
  Synthetic
atggccgactcccaagtacgtggggcagggtttccctatgacatgtctgtgggttgggattttgaccaggtggaggaagatgctaataaggtagaaactagtgctgaagacaaaaagatcggagacccagcatggcgtat

SEQ ID NO: 427421 - DNA, 140 bp, Artificial Sequence
  Synthetic
aggccctggctgctgatatgtttcccaggcccttcctgttattgaggttcttgatgcaatatatggccatccatctcctgacaaacaaatcttgtagagtatgttctcataaggattcctgaccttttgggacagcggtg

SEQ ID NO: 427422 - DNA, 140 bp, Artificial Sequence
  Synthetic
caccgctgtcccaaaaggtcaggaatccttatgagaacatactctacaagatttgtttgtcaggagatggatggccatatattgcatcaagaacctcaataacaggaagggcctgggaaacatatcagcagccagggcct

SEQ ID NO: 427423 - DNA, 140 bp, Artificial Sequence
  Synthetic
atacgccatgctgggtctcccctgtatcgggtttgggtttgtgccagaatggcttgtgggtcagctggtggtgtcccacaaaaaactcctacagaaatgagagacaatatgcctaggatccgtacttgggagtcggccat

SEQ ID NO: 427424 - DNA, 140 bp, Artificial Sequence
  Synthetic
atggccgactcccaagtacggatcctaggcatattgtctctcatttctgtaggagttttttgtgggacaccaccagctgacccacaagccattctggcacaaacccaaacccgatacaggggagacccagcatggcgtat

SEQ ID NO: 427425 - DNA, 140 bp, Artificial Sequence
  Synthetic
aggccctggctgctgatatgttgatttcaactcaacaaggttgttgaccgcttgatttaggtccctcagccgtttcaaatcattgtcatcccttctctccttgcgcatcaaccgttggacgaccttttgggacagcggtg

SEQ ID NO: 427426 - DNA, 140 bp, Artificial Sequence
  Synthetic
caccgctgtcccaaaaggtcgtccaacggttgatgcgcaaggagagaagggatgacaatgatttgaaacggctgagggacctaaatcaagcggtcaacaaccttgttgagttgaaatcaacatatcagcagccagggcct

SEQ ID NO: 427427 - DNA, 140 bp, Artificial Sequence
  Synthetic
aggccctggctgctgatatgcgccagattgttgtattgaatgcacgcagcagaaagctgaaactgtctgccaaagtgacaagagcaaagcgcaatccaatagcctaggatccactgtgcggaccttttgggacagcggtg

SEQ ID NO: 427428 - DNA, 140 bp, Artificial Sequence
  Synthetic
caccgctgtcccaaaaggtccgcacagtggatcctaggctattggattgcgctttgctcttgtcactttggcagacagtttcagctttctgctgcgtgcattcaatacaacaatctggcgcatatcagcagccagggcct

SEQ ID NO: 427429 - DNA, 140 bp, Artificial Sequence
  Synthetic
atacgccatgctgggtctccggggatcctaggcaatttggttattctttttgaggttttgtgtgctatactcttccaaatgggaaacaagcaagccaaaaccccggaggcaaaagacagtcgtacttgggagtcggccat

SEQ ID NO: 427430 - DNA, 140 bp, Artificial Sequence
  Synthetic
atggccgactcccaagtacgactgtcttttgcctccggggttttggcttgcttgtttcccatttggaagagtatagcacacaaaacctcaaaaagaataaccaaattgcctaggatccccggagacccagcatggcgtat

SEQ ID NO: 427431 - DNA, 140 bp, Artificial Sequence
  Synthetic
aggccctggctgctgatatgtgttcagcacaagtttctatcttattagcatcttccttcacctagtcaaaataccaactcataggcatattgtaggcaagtcgtgtcccaaacctcacaggaccttttgggacagcggtg

SEQ ID NO: 427432 - DNA, 140 bp, Artificial Sequence
  Synthetic
caccgctgtcccaaaaggtcctgtgaggtttgggacacgacttgcctacaatatgcctatgagttggtattttgactaggtgaaggaagatgctaataagatagaaacttgtgctgaacacatatcagcagccagggcct

SEQ ID NO: 427433 - DNA, 140 bp, Artificial Sequence
  Synthetic
atacgccatgctgggtctccgttggacccgacaaagcaagtctccaacagtcagacagaacacatgggctcacagacccagaatatagtgcctgcacatcattcactacaaactcaccaccgtacttgggagtcggccat

SEQ ID NO: 427434 - DNA, 140 bp, Artificial Sequence
  Synthetic
atggccgactcccaagtacggtggtgagtttgtagtgaatgatgtgcaggcactatattctgggtctgtgagcccatgtgttctgtctgactgttggagacttgctttgtcgggtccaacggagacccagcatggcgtat

SEQ ID NO: 427435 - DNA, 140 bp, Artificial Sequence
  Synthetic
aggccctggctgctgatatgtttctgatgatattgaacaacaagctgacaacatgatcactgagatgttacagaaagagtacatggagaggcaggggaagacaccattgggcctagtcgagaccttttgggacagcggtg

SEQ ID NO: 427436 - DNA, 140 bp, Artificial Sequence
  Synthetic
caccgctgtcccaaaaggtctcgactaggcccaatggtgtcttcccctgcctctccatgtactctttctgtaacatctcagtgatcatgttgtcagcttgttgttcaatatcatcagaaacatatcagcagccagggcct

SEQ ID NO: 427437 - DNA, 140 bp, Artificial Sequence
  Synthetic
atacgccatgctgggtctccagcaggtgtccgatctgcaaaatgcctcttcccaccaggctaaaggcagcaacacagccgagcgcaccctcaaccgaggcgacccagaacacaacacctccgtacttgggagtcggccat

SEQ ID NO: 427438 - DNA, 140 bp, Artificial Sequence
  Synthetic
atggccgactcccaagtacggaggtgttgtgttctgggtcgcctcggttgagggtgcgctcggctgtgttgctgcctttagcctggtgggaagaggcattttgcagatcggacacctgctggagacccagcatggcgtat

SEQ ID NO: 427439 - DNA, 140 bp, Artificial Sequence
  Synthetic
aggccctggctgctgatatgtgatgtgttgtgtaatattccttggcccatgtcaagtattgaactgatatgagaaggcacaataccaatttggaaattggaataaaagaaatcttctgttgaccttttgggacagcggtg

SEQ ID NO: 427440 - DNA, 140 bp, Artificial Sequence
  Synthetic
caccgctgtcccaaaaggtcaacagaagatttcttttattccaatttccaaattggtattgtgccttctcatatcagttcaatacttgacatgggccaaggaatattacacaacacatcacatatcagcagccagggcct

SEQ ID NO: 427441 - DNA, 140 bp, Artificial Sequence
  Synthetic
atacgccatgctgggtctccggaagaagtgtatgtagcagcctgaacttggttgatagagggcaatttccactggatcttcaggtcttccttcaatgtccatccaggtcttagcatttggcgtacttgggagtcggccat

SEQ ID NO: 427442 - DNA, 140 bp, Artificial Sequence
  Synthetic
atggccgactcccaagtacgccaaatgctaagacctggatggacattgaaggaagacctgaagatccagtggaaattgccctctatcaaccaagttcaggctgctacatacacttcttccggagacccagcatggcgtat

SEQ ID NO: 427443 - DNA, 140 bp, Artificial Sequence
  Synthetic
aggccctggctgctgatatggcaacgattgactatagagcagagtcctataagaggcacaaaagacacaagaggcaattaaagacaattaaaatagatagccttagtgcctaggatcctcgaccttttgggacagcggtg

SEQ ID NO: 427444 - DNA, 140 bp, Artificial Sequence
  Synthetic
caccgctgtcccaaaaggtcgaggatcctaggcactaaggctatctattttaattgtctttaattgcctcttgtgtcttttgtgcctcttataggactctgctctatagtcaatcgttgccatatcagcagccagggcct

SEQ ID NO: 427445 - DNA, 140 bp, Artificial Sequence
  Synthetic
aggccctggctgctgatatgtcttcttttcaacgacaacacctgtgtgcatgtggcataagtctttatattgatcccagactgcattttcatacttcctggaatcagttttactgagggcgaccttttgggacagcggtg

SEQ ID NO: 427446 - DNA, 140 bp, Artificial Sequence
  Synthetic
caccgctgtcccaaaaggtcgccctcagtaaaactgattccaggaagtatgaaaatgcagtctgggatcaatataaagacttatgccacatgcacacaggtgttgtcgttgaaaagaagacatatcagcagccagggcct

SEQ ID NO: 427447 - DNA, 140 bp, Artificial Sequence
  Synthetic
atacgccatgctgggtctcctcattgagccagtatactcaaggtggatggcaaagctttctttaaagctagcatcttggcttttaatacggaacctcactgtttgactcagtttcgcagacgtacttgggagtcggccat

SEQ ID NO: 427448 - DNA, 140 bp, Artificial Sequence
  Synthetic
atggccgactcccaagtacgtctgcgaaactgagtcaaacagtgaggttccgtattaaaagccaagatgctagctttaaagaaagctttgccatccaccttgagtatactggctcaatgaggagacccagcatggcgtat

SEQ ID NO: 427449 - DNA, 140 bp, Artificial Sequence
  Synthetic
aggccctggctgctgatatgatcttcctccacctggttaaaatcccaacccacagacatatcatagggaaaccctgccctaaaccacacagactcaaccacatgggcatatgctcatgtggaccttttgggacagcggtg

SEQ ID NO: 427450 - DNA, 140 bp, Artificial Sequence
  Synthetic
caccgctgtcccaaaaggtccacatgagcatatgcccatgtggttgagtctgtgtggtttagggcagggtttccctatgatatgtctgtgggttgggattttaaccaggtggaggaagatcatatcagcagccagggcct

SEQ ID NO: 427451 - DNA, 140 bp, Artificial Sequence
  Synthetic
atacgccatgctgggtctccggtgtcaatcatgttcaggatggggtgactttgagtcagcctatctaaatctgaagtatttggatactttgctgtgtagattagacccaaatctgtcagtcgtacttgggagtcggccat

SEQ ID NO: 427452 - DNA, 140 bp, Artificial Sequence
  Synthetic
atggccgactcccaagtacgactgacagatttgggtctaatctacacagcaaagtatccaaatacttcagatttagataggctgactcaaagtcaccccatcctgaacatgattgacaccggagacccagcatggcgtat

SEQ ID NO: 427453 - DNA, 140 bp, Artificial Sequence
  Synthetic
aggccctggctgctgatatgacaatttgttttgaattgttttgacaatggtggggatcttctcatcatctaggttcacagcacctgaatatattatcttttgtctcaacaccattcttaagaccttttgggacagcggtg

SEQ ID NO: 427454 - DNA, 140 bp, Artificial Sequence
  Synthetic
caccgctgtcccaaaaggtcttaagaatggtgttgagacaaaagataatatattcaggtgctgtgaacctagatgatgagaagatccccaccattgtcaaaacaattcaaaacaaattgtcatatcagcagccagggcct

SEQ ID NO: 427455 - DNA, 140 bp, Artificial Sequence
  Synthetic
aggccctggctgctgatatgatgggggctcaacatctaacagctcacaaagatttcttagtgaagagaggtgctcactagacaaatagtttgttgtgaactcttcatggagttgcccagtgaccttttgggacagcggtg

SEQ ID NO: 427456 - DNA, 140 bp, Artificial Sequence
  Synthetic
caccgctgtcccaaaaggtcactgggcaactccatgaagagttcacaacaaactatttgtctagtgagcacctctcttcactaagaaatctttgtgagctgttagatgttgagcccccatcatatcagcagccagggcct

SEQ ID NO: 427457 - DNA, 140 bp, Artificial Sequence
  Synthetic
aggccctggctgctgatatgatctttcaccacctgtagtttgatgttagagcaataaccagacaattccctcctcaatgactgtgtccacagaaaggactttatttcctttgaggcactcgaccttttgggacagcggtg

SEQ ID NO: 427458 - DNA, 140 bp, Artificial Sequence
  Synthetic
caccgctgtcccaaaaggtcgagtgcctcaaaggaaataaagtcctttctgtggacacagtcattgaggagggaattgtctggttattgctctaacatcaaactacaggtggtgaaagatcatatcagcagccagggcct

SEQ ID NO: 427459 - DNA, 140 bp, Artificial Sequence
  Synthetic
atacgccatgctgggtctccgcgcaccggggatcctaggcaatttggttattctttctgtggccttgtgcactgtactcctcctctaaatgggaaacaagcaggccaaagccccagaagtcgtacttgggagtcggccat

SEQ ID NO: 427460 - DNA, 140 bp, Artificial Sequence
  Synthetic
atggccgactcccaagtacgacttctggggctttggcctgcttgtttcccatttagaggaggagtacagtgcacaaggccacagaaagaataaccaaattgcctaggatccccggtgcgcggagacccagcatggcgtat

SEQ ID NO: 427461 - DNA, 140 bp, Artificial Sequence
  Synthetic
atacgccatgctgggtctcccttaaattccacccagttgtccactgcctcaagaaccgcacccaggatcccttcacaacttggtgttgcagccctcagcgtggacacaatgtccacccctcgtacttgggagtcggccat

SEQ ID NO: 427462 - DNA, 140 bp, Artificial Sequence
  Synthetic
atggccgactcccaagtacgaggggtggacattgtgtccacgctgagggctgcaacaccaagttgtgaagggatcctgggtgcggttcttgaggcagtggacaactgggtggaatttaagggagacccagcatggcgtat

SEQ ID NO: 427463 - DNA, 140 bp, Artificial Sequence
  Synthetic
aggccctggctgctgatatgccattttgtgcatatgccacataagaagggttgaaagatagtccctcccttttatgtcagcttgcaagtcctttgagaggaaaattaaattctgtaagacgaccttttgggacagcggtg

SEQ ID NO: 427464 - DNA, 140 bp, Artificial Sequence
  Synthetic
caccgctgtcccaaaaggtcgtcttacagaatttaattttcctctcaaaggacttgcaagctgacataaaagggagggactatctttcaacccttcttatgtggcatatgcacaaaatggcatatcagcagccagggcct

SEQ ID NO: 427465 - DNA, 140 bp, Artificial Sequence
  Synthetic
aggccctggctgctgatatgtttatgtcagcttgcaagtcctttgagaggaaaattaaattctgtaagacagttaagaataaaaatggacacatcattgggccccacttactatgatccagaccttttgggacagcggtg

SEQ ID NO: 427466 - DNA, 140 bp, Artificial Sequence
  Synthetic
caccgctgtcccaaaaggtctggatcatagtaagtggggcccaatgatgtgtccatttttattcttaactgtcttacagaatttaattttcctctcaaaggacttgcaagctgacataaacatatcagcagccagggcct

SEQ ID NO: 427467 - DNA, 140 bp, Artificial Sequence
  Synthetic
aggccctggctgctgatatgagttaagaataaaaatggacacatcattgggccccacttactatgatccatgctataagagacatgtgccaatgaaacattcaatttcatggaaaggatagaccttttgggacagcggtg

SEQ ID NO: 427468 - DNA, 140 bp, Artificial Sequence
  Synthetic
caccgctgtcccaaaaggtctatcctttccatgaaattgaatgtttcattggcacatgtctcttatagcatggatcatagtaagtggggcccaatgatgtgtccatttttattcttaactcatatcagcagccagggcct

SEQ ID NO: 427469 - DNA, 140 bp, Artificial Sequence
  Synthetic
aggccctggctgctgatatgcaataacctgaaagctccctcctcaatgactgtgtccagagaaatgacttcacttccttggaagcactcatcttggtctggatgctttggggtttactgggaccttttgggacagcggtg

SEQ ID NO: 427470 - DNA, 140 bp, Artificial Sequence
  Synthetic
caccgctgtcccaaaaggtcccagtaaaccccaaagcatccagaccaagatgagtgcttccaaggaagtgaagtcatttctctggacacagtcattgaggagggagctttcaggttattgcatatcagcagccagggcct

SEQ ID NO: 427471 - DNA, 140 bp, Artificial Sequence
  Synthetic
aggccctggctgctgatatgcattcccacaagcttcctctatgcacaaccagaggggctggttcagtgcaagggcccaccaatacaaagtcatgctccgtaaactgcagcttctccatatgaccttttgggacagcggtg

SEQ ID NO: 427472 - DNA, 140 bp, Artificial Sequence
  Synthetic
caccgctgtcccaaaaggtcatatggagaagctgcagtttacggagcatgactttgtattggtgggcccttgcactgaaccagcccctctggttgtgcatagaggaagcttgtgggaatgcatatcagcagccagggcct

SEQ ID NO: 427473 - DNA, 140 bp, Artificial Sequence
  Synthetic
aggccctggctgctgatatgattttgttgaatccctgaatcaagtgcccagttaaaatgggcaacagacaggccaaatcaacaaaagtcgatgaacatcaaagagctcatctagtgccaggaccttttgggacagcggtg

SEQ ID NO: 427474 - DNA, 140 bp, Artificial Sequence
  Synthetic
caccgctgtcccaaaaggtcctggcactagatgagctctttgatgttcatcgacttttgttgatttggcctgtctgttgcccattttaactgggcacttgattcagggattcaacaaaatcatatcagcagccagggcct

SEQ ID NO: 427475 - DNA, 140 bp, Artificial Sequence
  Synthetic
aggccctggctgctgatatgttgtggcgactcttgactataaaaacacaagttcttcaacattgctgtggtacagtttgtcagtgacagagccttactaagtgcctctgagttgctctccgaccttttgggacagcggtg

SEQ ID NO: 427476 - DNA, 140 bp, Artificial Sequence
  Synthetic
caccgctgtcccaaaaggtcggagagcaactcagaggcacttagtaaggctctgtcactgacaaactgtaccacagcaatgttgaagaacttgtgtttttatagtcaagagtcgccacaacatatcagcagccagggcct

SEQ ID NO: 427477 - DNA, 140 bp, Artificial Sequence
  Synthetic
atacgccatgctgggtctccgcctgctggttcattgagccaatatactcaaggtggatggcaaagctttctttgaagctggcatcttgacttttaatacggaacctcactgtctgactcacgtacttgggagtcggccat

SEQ ID NO: 427478 - DNA, 140 bp, Artificial Sequence
  Synthetic
atggccgactcccaagtacgtgagtcagacagtgaggttccgtattaaaagtcaagatgccagcttcaaagaaagctttgccatccaccttgagtatattggctcaatgaaccagcaggcggagacccagcatggcgtat

SEQ ID NO: 427479 - DNA, 140 bp, Artificial Sequence
  Synthetic
atacgccatgctgggtctcctcagtatatcaacataatccacaggcctctgttttgttaagatcgaaacaatgtcaacatttgtccactgaactctttgttttaatctatcagacatcatcgtacttgggagtcggccat

SEQ ID NO: 427480 - DNA, 140 bp, Artificial Sequence
  Synthetic
atggccgactcccaagtacgatgatgtctgatagattaaaacaaagagttcagtggacaaatgttgacattgtttcgatcttaacaaaacagaggcctgtggattatgttgatatactgaggagacccagcatggcgtat

SEQ ID NO: 427481 - DNA, 140 bp, Artificial Sequence
  Synthetic
atacgccatgctgggtctccaatgagttaaacttaggatcaactaaacctgatgcaatcaattgattttgattgaatctagctggctcaatatcaaagtctatccaagcataacccatcacgtacttgggagtcggccat

SEQ ID NO: 427482 - DNA, 140 bp, Artificial Sequence
  Synthetic
atggccgactcccaagtacgtgatgggttatgcttggatagactttgatattgagccagctagattcaatcaaaatcaattgattgcatcaggtttagttgatcctaagtttaactcattggagacccagcatggcgtat

SEQ ID NO: 427483 - DNA, 140 bp, Artificial Sequence
  Synthetic
atacgccatgctgggtctcccctctccggctcaaacaactccgaacatgtccttccctttagtcttaggctgcccccacttgactggatcataactttttgctttgatttgctgtagcaacgtacttgggagtcggccat

SEQ ID NO: 427484 - DNA, 140 bp, Artificial Sequence
  Synthetic
atggccgactcccaagtacgttgctacagcaaatcaaagcaaaaagttatgatccagtcaagtgggggcagcctaagactaaagggaaggacatgttcggagttgtttgagccggagaggggagacccagcatggcgtat

SEQ ID NO: 427485 - DNA, 140 bp, Artificial Sequence
  Synthetic
atacgccatgctgggtctcccatcaccattagggcctgagcctagcttgacaggctctctatactgatcaacaattttttcaacagtttcttttagctgatcaaaataatcgcttgcacccgtacttgggagtcggccat

SEQ ID NO: 427486 - DNA, 140 bp, Artificial Sequence
  Synthetic
atggccgactcccaagtacgggtgcaagcgattattttgatcagctaaaagaaactgttgaaaaaattgttgatcagtatagagagcctgtcaagctaggctcaggccctaatggtgatgggagacccagcatggcgtat

SEQ ID NO: 427487 - DNA, 140 bp, Artificial Sequence
  Synthetic
atacgccatgctgggtctcctctgtctagatcccaggaccagattactcattgcctgctgtactttgtattcatagtcctgcttgttgagaaggtactttccctttcttgagaagacttccgtacttgggagtcggccat

SEQ ID NO: 427488 - DNA, 140 bp, Artificial Sequence
  Synthetic
atggccgactcccaagtacggaagtcttctcaagaaagggaaagtaccttctcaacaagcaggactatgaatacaaagtacagcaggcaatgagtaatctggtcctgggatctagacagaggagacccagcatggcgtat

SEQ ID NO: 427489 - DNA, 140 bp, Artificial Sequence
  Synthetic
atacgccatgctgggtctccttccctttttacttccttctccttaaatagtgaaccattgttaaaagaggacgttaggagggataaatacttctttgagacaccaggctttttatagtctcgtacttgggagtcggccat

SEQ ID NO: 427490 - DNA, 140 bp, Artificial Sequence
  Synthetic
atggccgactcccaagtacgagactataaaaagcctggtgtctcaaagaagtatttatccctcctaacgtcctcttttaacaatggttcactatttaaggagaaggaagtaaaaagggaaggagacccagcatggcgtat

SEQ ID NO: 427491 - DNA, 140 bp, Artificial Sequence
  Synthetic
aggccctggctgctgatatggttcccctaagacccatgcacccagttctattgcagttgataaggagatgcacatataatcccacaacaagggtctgaaataactgacaacactttcactgaccttttgggacagcggtg

SEQ ID NO: 427492 - DNA, 140 bp, Artificial Sequence
  Synthetic
caccgctgtcccaaaaggtcagtgaaagtgttgtcagttatttcagacccttgttgtgggattatatgtgcatctccttatcaactgcaatagaactgggtgcatgggtcttaggggaaccatatcagcagccagggcct

SEQ ID NO: 427493 - DNA, 140 bp, Artificial Sequence
  Synthetic
aggccctggctgctgatatgggtccctcaacacttgtgcatccatctttacttaaaaacttttttgcattgtagaccatgtcatccaattcttcctcagtggctgtgtctgcaggattaggaccttttgggacagcggtg

SEQ ID NO: 427494 - DNA, 140 bp, Artificial Sequence
  Synthetic
caccgctgtcccaaaaggtcctaatcctgcagacacagccactgaggaagaattggatgacatggtctacaatgcaaaaaagtttttaagtaaagatggatgcacaagtgttgagggacccatatcagcagccagggcct

SEQ ID NO: 427495 - DNA, 140 bp, Artificial Sequence
  Synthetic
aggccctggctgctgatatgtttatctgatctgtcaatctatctggtgtttctttcgtaataaagtggcacatgtaggaaatattcaaaatgaacttgaacctattagtcatcatgctctgaccttttgggacagcggtg

SEQ ID NO: 427496 - DNA, 140 bp, Artificial Sequence
  Synthetic
caccgctgtcccaaaaggtcagagcatgatgactaataggttcaagttcattttgaatatttcctacatgtgccactttattacgaaagaaacaccagatagattgacagatcagataaacatatcagcagccagggcct

SEQ ID NO: 427497 - DNA, 140 bp, Artificial Sequence
  Synthetic
aggccctggctgctgatatggtccttatgatgataatctgacacataagccattataaagtacctaagattttggaggagcttttgagaacgtttactagggtgagctaaaattaaaaccgaccttttgggacagcggtg

SEQ ID NO: 427498 - DNA, 140 bp, Artificial Sequence
  Synthetic
caccgctgtcccaaaaggtcggttttaattttagctcaccctagtaaacgttctcaaaagctcctccaaaatcttaggtactttataatggcttatgtgtcagattatcatcataaggaccatatcagcagccagggcct

SEQ ID NO: 427499 - DNA, 140 bp, Artificial Sequence
  Synthetic
atacgccatgctgggtctccatcctcctgtcagactcccacagtgctcccctgcacacaaccaacggcacaggttcactgtcaggcccgacctttgagaaatcaaactcagtaaactgcacgtacttgggagtcggccat

SEQ ID NO: 427500 - DNA, 140 bp, Artificial Sequence
  Synthetic
atggccgactcccaagtacgtgcagtttactgagtttgatttctcaaaggtcgggcctgacagtgaacctgtgccgttggttgtgtgcaggggagcactgtgggagtctgacaggaggatggagacccagcatggcgtat

SEQ ID NO: 427501 - DNA, 140 bp, Artificial Sequence
  Synthetic
aggccctggctgctgatatgagccgacagcaccaccagaaatcccaccatcccaaaatcccccaccctacagcccctgaggcagaactccgccccgaagcccctctcccaaacacccctcgaccttttgggacagcggtg

SEQ ID NO: 427502 - DNA, 140 bp, Artificial Sequence
  Synthetic
caccgctgtcccaaaaggtcgaggggtgtttgggagaggggcttcggggcggagttctgcctcaggggctgtagggtgggggattttgggatggtgggatttctggtggtgctgtcggctcatatcagcagccagggcct

SEQ ID NO: 427503 - DNA, 140 bp, Artificial Sequence
  Synthetic
aggccctggctgctgatatgaagtctgttggttctctgaagaagtgtatgtaacagcccgacacaggttggtaaagagctatttccacagggtcttctggacgaccttcaatgtctatccgaccttttgggacagcggtg

SEQ ID NO: 427504 - DNA, 140 bp, Artificial Sequence
  Synthetic
caccgctgtcccaaaaggtcggatagacattgaaggtcgtccagaagaccctgtggaaatagctctttaccaacctgtgtcgggctgttacatacacttcttcagagaaccaacagacttcatatcagcagccagggcct

SEQ ID NO: 427505 - DNA, 140 bp, Artificial Sequence
  Synthetic
aggccctggctgctgatatgtgtgattctagatctctcagcctgttgcctccgctcaacccattttttgagatccctttttgttgactccaaagaaactagtctatcattaacacttatagaccttttgggacagcggtg

SEQ ID NO: 427506 - DNA, 140 bp, Artificial Sequence
  Synthetic
caccgctgtcccaaaaggtctataagtgttaatgatagactagtttctttggagtcaacaaaaagggatctcaaaaaatgggttgagcggaggcaacaggctgagagatctagaatcacacatatcagcagccagggcct

SEQ ID NO: 427507 - DNA, 140 bp, Artificial Sequence
  Synthetic
atacgccatgctgggtctccaagcaagaccccaaccacccttttaaacacttttgtttcattaggtcatgtttacttgcaaggagaattagtgcatcaaaaattaatagaagtttcctcccgtacttgggagtcggccat

SEQ ID NO: 427508 - DNA, 140 bp, Artificial Sequence
  Synthetic
atggccgactcccaagtacgggaggaaacttctattaatttttgatgcactaattctccttgcaagtaaacatgacctaatgaaacaaaagtgtttaaaagggtggttggggtcttgcttggagacccagcatggcgtat

SEQ ID NO: 427509 - DNA, 140 bp, Artificial Sequence
  Synthetic
aggccctggctgctgatatgctcaccaacatttgcatacaaaaatctcaatattggcgatgctctcttgaactgataaattaagtgttcgatattgtcttctgcagctaccttatcagcggaccttttgggacagcggtg

SEQ ID NO: 427510 - DNA, 140 bp, Artificial Sequence
  Synthetic
caccgctgtcccaaaaggtccgctgataaggtagctgcagaagacaatatcgaacacttaatttatcagttcaagagagcatcgccaatattgagatttttgtatgcaaatgttggtgagcatatcagcagccagggcct

SEQ ID NO: 427511 - DNA, 140 bp, Artificial Sequence
  Synthetic
aggccctggctgctgatatgctctaacttcttgaggtcctcaatgtacttctgttcaaagttggcaggagatgacctgacaaagcactccaacagtattaaaatattgcccgttagtttggaccttttgggacagcggtg

SEQ ID NO: 427512 - DNA, 140 bp, Artificial Sequence
  Synthetic
caccgctgtcccaaaaggtccaaactaacgggcaatattttaatactgttggagtgctttgtcaggtcatctcctgccaactttgaacagaagtacattgaggacctcaagaagttagagcatatcagcagccagggcct

SEQ ID NO: 427513 - DNA, 140 bp, Artificial Sequence
  Synthetic
aggccctggctgctgatatgcctcttcgatctgcagctttacctcatgggctgttaacttattattgatgccttggtggcatgaggcaatcacctcctcataatgattggagcgattgtcgaccttttgggacagcggtg

SEQ ID NO: 427514 - DNA, 140 bp, Artificial Sequence
  Synthetic
caccgctgtcccaaaaggtcgacaatcgctccaatcattatgaggaggtgattgcctcatgccaccaaggcatcaataataagttaacagcccatgaggtaaagctgcagatcgaagaggcatatcagcagccagggcct

SEQ ID NO: 427515 - DNA, 140 bp, Artificial Sequence
  Synthetic
aggccctggctgctgatatggcaggacacatggactcacagacccagagtacagtgcttgtacatcatttatcacaaattcaccatgttgattaatgaatcccttcatattgaggtggatgaccttttgggacagcggtg

SEQ ID NO: 427516 - DNA, 140 bp, Artificial Sequence
  Synthetic
caccgctgtcccaaaaggtcatccacctcaatatgaagggattcattaatcaacatggtgaatttgtgataaatgatgtacaagcactgtactctgggtctgtgagtccatgtgtcctgccatatcagcagccagggcct

SEQ ID NO: 427517 - DNA, 140 bp, Artificial Sequence
  Synthetic
aggccctggctgctgatatgtaggacattgtgacatatgcccacagtaaaaatacttctcttttaacctactattctcgtagacagcattacagaattcttcataaaacttacctggtaagaccttttgggacagcggtg

SEQ ID NO: 427518 - DNA, 140 bp, Artificial Sequence
  Synthetic
caccgctgtcccaaaaggtcttaccaggtaagttttatgaagaattctgtaatgctgtctacgagaatagtaggttaaaagagaagtatttttactgtgggcatatgtcacaatgtcctacatatcagcagccagggcct

SEQ ID NO: 427519 - DNA, 140 bp, Artificial Sequence
  Synthetic
aggccctggctgctgatatggtcattcacccaatcaggtatttgttcattgtaaaatgttgtcctgccgtctatgagagggatgagattgatgccaacagactccaaatcattctttaatgaccttttgggacagcggtg

SEQ ID NO: 427520 - DNA, 140 bp, Artificial Sequence
  Synthetic
caccgctgtcccaaaaggtcattaaagaatgatttggagtctgttggcatcaatctcatccctctcatagacggcaggacaacattttacaatgaacaaatacctgattgggtgaatgaccatatcagcagccagggcct

SEQ ID NO: 427521 - DNA, 140 bp, Artificial Sequence
  Synthetic
atacgccatgctgggtctcccgcttgcacccccatcgagcagaatttcgtctaggtcagccccatcagcatcacttttgtgctgtccagatcccaggaccagattgctcattgcctgttgcgtacttgggagtcggccat

SEQ ID NO: 427522 - DNA, 140 bp, Artificial Sequence
  Synthetic
atggccgactcccaagtacgcaacaggcaatgagcaatctggtcctgggatctggacagcacaaaagtgatgctgatggggctgacctagacgaaattctgctcgatgggggtgcaagcgggagacccagcatggcgtat

SEQ ID NO: 427523 - DNA, 140 bp, Artificial Sequence
  Synthetic
aggccctggctgctgatatgtcacttttgtgctgtccagatcccaggaccagattgctcattgcctgttgcactttgtattcatagtcctgcttgttaagaaggtactttccctttcttggaccttttgggacagcggtg

SEQ ID NO: 427524 - DNA, 140 bp, Artificial Sequence
  Synthetic
caccgctgtcccaaaaggtccaagaaagggaaagtaccttcttaacaagcaggactatgaatacaaagtgcaacaggcaatgagcaatctggtcctgggatctggacagcacaaaagtgacatatcagcagccagggcct

SEQ ID NO: 427525 - DNA, 140 bp, Artificial Sequence
  Synthetic
aggccctggctgctgatatgtgtccacacccgtccattgaattctttgtttcaatctatcagacatcattgatttcaatgcaccaactaaaagatgtggggaactatcaccaacctccctgaccttttgggacagcggtg

SEQ ID NO: 427526 - DNA, 140 bp, Artificial Sequence
  Synthetic
caccgctgtcccaaaaggtcagggaggttggtgatagttccccacatcttttagttggtgcattgaaatcaatgatgtctgatagattgaaacaaagaattcaatggacgggtgtggacacatatcagcagccagggcct

SEQ ID NO: 427527 - DNA, 140 bp, Artificial Sequence
  Synthetic
atacgccatgctgggtctcctcatagtttaatattctagaaccatctgtgtatttattgacaacaacactcttgttgctggctagatccaaggctgtggcacagccactggtgatgagagcgtacttgggagtcggccat

SEQ ID NO: 427528 - DNA, 140 bp, Artificial Sequence
  Synthetic
atggccgactcccaagtacgctctcatcaccagtggctgtgccacagccttggatctagccagcaacaagagtgttgttgtcaataaatacacagatggttctagaatattaaactatgaggagacccagcatggcgtat

SEQ ID NO: 427529 - DNA, 140 bp, Artificial Sequence
  Synthetic
atacgccatgctgggtctccagcattggcaatgtcttcctccatcgccgattatggcacctgtgttgggtttgggcttgtgcctgtatggcttgcaggtcagctgctggtgcccgaaaaacgtacttgggagtcggccat

SEQ ID NO: 427530 - DNA, 140 bp, Artificial Sequence
  Synthetic
atggccgactcccaagtacgtttttcgggcaccagcagctgacctgcaagccatacaggcacaagcccaaacccaacacaggtgccataatcggcgatggaggaagacattgccaatgctggagacccagcatggcgtat

SEQ ID NO: 427531 - DNA, 140 bp, Artificial Sequence
  Synthetic
aggccctggctgctgatatgtaaagtgacacatgtaggaaatattcaaaatgaacttgaacctgttagtcatcatgctcttcacatcctcagataaaatcaaattcattaatgcccttatgaccttttgggacagcggtg

SEQ ID NO: 427532 - DNA, 140 bp, Artificial Sequence
  Synthetic
caccgctgtcccaaaaggtcataagggcattaatgaatttgattttatctgaggatgtgaagagcatgatgactaacaggttcaagttcattttgaatatttcctacatgtgtcactttacatatcagcagccagggcct

SEQ ID NO: 427533 - DNA, 140 bp, Artificial Sequence
  Synthetic
aggccctggctgctgatatgagaaaatcctcaagggactcaagcttcagctcctctgtcaagcctgaggcgatgagttgattcaagttcatcttggccggttcaatgtcaaaatctatccgaccttttgggacagcggtg

SEQ ID NO: 427534 - DNA, 140 bp, Artificial Sequence
  Synthetic
caccgctgtcccaaaaggtcggatagattttgacattgaaccggccaagatgaacttgaatcaactcatcgcctcaggcttgacagaggagctgaagcttgagtcccttgaggattttctcatatcagcagccagggcct

SEQ ID NO: 427535 - DNA, 140 bp, Artificial Sequence
  Synthetic
aggccctggctgctgatatgtgtcatcaactgagaataagtcagccctgttgggaaccccgctgactgtaaagacttgttggacccagcagtgcccactttttgcggttttccatctgacgaccttttgggacagcggtg

SEQ ID NO: 427536 - DNA, 140 bp, Artificial Sequence
  Synthetic
caccgctgtcccaaaaggtcgtcagatggaaaaccgcaaaaagtgggcactgctgggtccaacaagtctttacagtcagcggggttcccaacagggctgacttattctcagttgatgacacatatcagcagccagggcct

SEQ ID NO: 427537 - DNA, 140 bp, Artificial Sequence
  Synthetic
aggccctggctgctgatatgccttgcgggtccaaattcattctgtctcaactttacagtagaagaagttttcatggagttcaccaaagcgaggctcaatgaagaaagtctctctaagtcagaccttttgggacagcggtg

SEQ ID NO: 427538 - DNA, 140 bp, Artificial Sequence
  Synthetic
caccgctgtcccaaaaggtctgacttagagagactttcttcattgagcctcgctttggtgaactccatgaaaacttcttctactgtaaagttgagacagaatgaatttggacccgcaaggcatatcagcagccagggcct

SEQ ID NO: 427539 - DNA, 140 bp, Artificial Sequence
  Synthetic
atacgccatgctgggtctccctaacaagatggatgctgattgaggccgagttgaagtgctttggaaacacagcagttgcgaaatgcaatgagaaacatgatgaagagttttgtgacatgtcgtacttgggagtcggccat

SEQ ID NO: 427540 - DNA, 140 bp, Artificial Sequence
  Synthetic
atggccgactcccaagtacgacatgtcacaaaactcttcatcatgtttctcattgcatttcgcaactgctgtgtttccaaagcacttcaactcggcctcaatcagcatccatcttgttagggagacccagcatggcgtat

SEQ ID NO: 427541 - DNA, 140 bp, Artificial Sequence
  Synthetic
atacgccatgctgggtctccaatagttttctggaatattgaattgagaatttgattcttactcaaacactgggaggattgtgtaattttagatttttcagcctgttgcctccgctcaacccgtacttgggagtcggccat

SEQ ID NO: 427542 - DNA, 140 bp, Artificial Sequence
  Synthetic
atggccgactcccaagtacgggttgagcggaggcaacaggctgaaaaatctaaaattacacaatcctcccagtgtttgagtaagaatcaaattctcaattcaatattccagaaaactattggagacccagcatggcgtat

SEQ ID NO: 427543 - DNA, 140 bp, Artificial Sequence
  Synthetic
aggccctggctgctgatatgttttgtaatgaaatgacacatataagagatgtttaaaacaaacttgaatctattggtcatcatactgacaacttcttcagacagaattatctttaataaggaccttttgggacagcggtg

SEQ ID NO: 427544 - DNA, 140 bp, Artificial Sequence
  Synthetic
caccgctgtcccaaaaggtccttattaaagataattctgtctgaagaagttgtcagtatgatgaccaatagattcaagtttgttttaaacatctcttatatgtgtcatttcattacaaaacatatcagcagccagggcct

SEQ ID NO: 427545 - DNA, 140 bp, Artificial Sequence
  Synthetic
atacgccatgctgggtctcctctcggagcacctactcaatgtcgaggggagccccacccttcaagaggggcctgcacagcctccctcttaatctaaactcccctctgaagactggatcatcgtacttgggagtcggccat

SEQ ID NO: 427546 - DNA, 140 bp, Artificial Sequence
  Synthetic
atggccgactcccaagtacgatgatccagtcttcagaggggagtttagattaagagggaggctgtgcaggcccctcttgaagggtggggctcccctcgacattgagtaggtgctccgagaggagacccagcatggcgtat

SEQ ID NO: 427547 - DNA, 140 bp, Artificial Sequence
  Synthetic
atacgccatgctgggtctccgcaatttgattgttctattttttgagacattgtgcgctgaactcctccaaatggggaataagcaaaccaaaaccccagaagtaaaagacagtccgagagccgtacttgggagtcggccat

SEQ ID NO: 427548 - DNA, 140 bp, Artificial Sequence
  Synthetic
atggccgactcccaagtacggctctcggactgtcttttacttctggggttttggtttgcttattccccatttggaggagttcagcgcacaatgtctcaaaaaatagaacaatcaaattgcggagacccagcatggcgtat

SEQ ID NO: 427549 - DNA, 140 bp, Artificial Sequence
  Synthetic
aggccctggctgctgatatggctctcttgaactgataaattaattgttcgatattgtcttctgcagctaccttatcagcatacaaattattaagttctttaagtaaatggctcttatcaagaccttttgggacagcggtg

SEQ ID NO: 427550 - DNA, 140 bp, Artificial Sequence
  Synthetic
caccgctgtcccaaaaggtcttgataagagccatttacttaaagaacttaataatttgtatgctgataaggtagctgcagaagacaatatcgaacaattaatttatcagttcaagagagccatatcagcagccagggcct

SEQ ID NO: 427551 - DNA, 140 bp, Artificial Sequence
  Synthetic
aggccctggctgctgatatgaccttcgccctctggtattgaagttttatgagggaaccaagtaaatgatcccagagtccttgttgttgccacaaacgatcgaacatatgattcaaagtaagaccttttgggacagcggtg

SEQ ID NO: 427552 - DNA, 140 bp, Artificial Sequence
  Synthetic
caccgctgtcccaaaaggtcttactttgaatcatatgttcgatcgtttgtggcaacaacaaggactctgggatcatttacttggttccctcataaaacttcaataccagagggcgaaggtcatatcagcagccagggcct

SEQ ID NO: 427553 - DNA, 140 bp, Artificial Sequence
  Synthetic
aggccctggctgctgatatgacttgatactcctcttcgatctgcagcttcacttcatgagctgtcaacttattattgatgccttgatgacatgaggcaatcacctcttcataatgattgggaccttttgggacagcggtg

SEQ ID NO: 427554 - DNA, 140 bp, Artificial Sequence
  Synthetic
caccgctgtcccaaaaggtcccaatcattatgaagaggtgattgcctcatgtcatcaaggcatcaataataagttgacagctcatgaagtgaagctgcagatcgaagaggagtatcaagtcatatcagcagccagggcct

SEQ ID NO: 427555 - DNA, 140 bp, Artificial Sequence
  Synthetic
aggccctggctgctgatatggctgcacccaagctaaaattataacctgagatattcaaagagcttttcttggtgtcaatcatatttaggatggggtgactttgagtcagcctgtctaagtgaccttttgggacagcggtg

SEQ ID NO: 427556 - DNA, 140 bp, Artificial Sequence
  Synthetic
caccgctgtcccaaaaggtcacttagacaggctgactcaaagtcaccccatcctaaatatgattgacaccaagaaaagctctttgaatatctcaggttataattttagcttgggtgcagccatatcagcagccagggcct

SEQ ID NO: 427557 - DNA, 140 bp, Artificial Sequence
  Synthetic
atacgccatgctgggtctccttaactataggacaaggtctcgtgggagacacaaaaggaacaagagtcaattaaagacaattaaaatagatagccttaatgcctaggatcctcggtgcgccgtacttgggagtcggccat

SEQ ID NO: 427558 - DNA, 140 bp, Artificial Sequence
  Synthetic
atggccgactcccaagtacggcgcaccgaggatcctaggcattaaggctatctattttaattgtctttaattgactcttgttccttttgtgtctcccacgagaccttgtcctatagttaaggagacccagcatggcgtat

SEQ ID NO: 427559 - DNA, 140 bp, Artificial Sequence
  Synthetic
atacgccatgctgggtctccaggtcataactgttggagcaaatcacctccatatcaatcttatagtggtccacacttatcccaacatcctttaaagcagtggtggccttcaaaatggtttcgtacttgggagtcggccat

SEQ ID NO: 427560 - DNA, 140 bp, Artificial Sequence
  Synthetic
atggccgactcccaagtacgaaaccattttgaaggccaccactgctttaaaggatgttgggataagtgtggaccactataagattgatatggaggtgatttgctccaacagttatgacctggagacccagcatggcgtat

SEQ ID NO: 427561 - DNA, 140 bp, Artificial Sequence
  Synthetic
aggccctggctgctgatatgatgggacaaatagtgacatttttccaggaagtgcctcatgttatagaagaagtgatgaacattgttctcattgcactgtccatactagcagtgctgaagggaccttttgggacagcggtg

SEQ ID NO: 427562 - DNA, 140 bp, Artificial Sequence
  Synthetic
caccgctgtcccaaaaggtcccttcagcactgctagtatggacagtgcaatgagaacaatgttcatcacttcttctataacatgaggcacttcctggaaaaatgtcactatttgtcccatcatatcagcagccagggcct

SEQ ID NO: 427563 - DNA, 140 bp, Artificial Sequence
  Synthetic
aggccctggctgctgatatgttgagttgattttaattcaacaagattgttcaccgcttgattcaggtctctcaaccgtttcaaatcattgtcatccctcctctccttgcgcatcaaccgtgaccttttgggacagcggtg

SEQ ID NO: 427564 - DNA, 140 bp, Artificial Sequence
  Synthetic
caccgctgtcccaaaaggtcacggttgatgcgcaaggagaggagggatgacaatgatttgaaacggttgagagacctgaatcaagcggtgaacaatcttgttgaattaaaatcaactcaacatatcagcagccagggcct

SEQ ID NO: 427565 - DNA, 140 bp, Artificial Sequence
  Synthetic
atacgccatgctgggtctccattgccagattgttgtattgagtgcacgtgataaaactgaaactatttgccaaaatgacaaaagcaaagcgcaatccaatagcctaggatccactgtgcgcgtacttgggagtcggccat

SEQ ID NO: 427566 - DNA, 140 bp, Artificial Sequence
  Synthetic
atggccgactcccaagtacgcgcacagtggatcctaggctattggattgcgctttgcttttgtcattttggcaaatagtttcagttttatcacgtgcactcaatacaacaatctggcaatggagacccagcatggcgtat

SEQ ID NO: 427567 - DNA, 140 bp, Artificial Sequence
  Synthetic
aggccctggctgctgatatgcgctaaacttctccaaatgggaaacaagcaaaccaaagccccagaatcaaaaaacagtccgagagccagtctgatcccagatgccacatatctaggaccagaccttttgggacagcggtg

SEQ ID NO: 427568 - DNA, 140 bp, Artificial Sequence
  Synthetic
caccgctgtcccaaaaggtctggtcctagatatgtggcatctgggatcagactggctctcggactgttttttgattctggggctttggtttgcttgtttcccatttggagaagtttagcgcatatcagcagccagggcct

SEQ ID NO: 427569 - DNA, 140 bp, Artificial Sequence
  Synthetic
aggccctggctgctgatatgcttagaagcactcatcttggtctgggcacttagggacttactggttgaaagtttcactcagtgagtcagtggaaagcgcaatccaatagcctaggatccagaccttttgggacagcggtg

SEQ ID NO: 427570 - DNA, 140 bp, Artificial Sequence
  Synthetic
caccgctgtcccaaaaggtctggatcctaggctattggattgcgctttccactgactcactgagtgaaactttcaaccagtaagtccctaagtgcccagaccaagatgagtgcttctaagcatatcagcagccagggcct

SEQ ID NO: 427571 - DNA, 140 bp, Artificial Sequence
  Synthetic
aggccctggctgctgatatggtggcacctatattgggcttgggcttatacctgtgtggtgtgtaggtcagctggtagtgccccacaaaagctctcacagaaatgagagtcaatatgcctagaccttttgggacagcggtg

SEQ ID NO: 427572 - DNA, 140 bp, Artificial Sequence
  Synthetic
caccgctgtcccaaaaggtctaggcatattgactctcatttctgtgagagcttttgtggggcactaccagctgacctacacaccacacaggtataagcccaagcccaatataggtgccaccatatcagcagccagggcct

SEQ ID NO: 427573 - DNA, 140 bp, Artificial Sequence
  Synthetic
aggccctggctgctgatatgtagtcaaaatgggcaacagacaggccaaatcggcaaaagtcgatgaacatcaaagagctcatctagtgccagatgcatcccatctaggcccccagttctggaccttttgggacagcggtg

SEQ ID NO: 427574 - DNA, 140 bp, Artificial Sequence
  Synthetic
caccgctgtcccaaaaggtccagaactgggggcctagatgggatgcatctggcactagatgagctctttgatgttcatcgacttttgccgatttggcctgtctgttgcccattttgactacatatcagcagccagggcct

SEQ ID NO: 427575 - DNA, 140 bp, Artificial Sequence
  Synthetic
atacgccatgctgggtctcccccgacaccccccggggggaccccccgccgggggcccccccggggggagccggccatcaccaagagactactcaatgtcttcaatgcattcatccttcctcgtacttgggagtcggccat

SEQ ID NO: 427576 - DNA, 140 bp, Artificial Sequence
  Synthetic
atggccgactcccaagtacgaggaaggatgaatgcattgaagacattgagtagtctcttggtgatggccggctccccccgggggggcccccggcggggggtccccccggggggtgtcgggggagacccagcatggcgtat

SEQ ID NO: 427577 - DNA, 140 bp, Artificial Sequence
  Synthetic
aggccctggctgctgatatgagttaactcctcacatgttctgcccttcagtctcaatctgccaccacttgactgtaccatcaccttcccccttgacttactataacaaagagcataacccgaccttttgggacagcggtg

SEQ ID NO: 427578 - DNA, 140 bp, Artificial Sequence
  Synthetic
caccgctgtcccaaaaggtcgggttatgctctttgttatagtaagtcaagggggaaggtgatggtacagtcaagtggtggcagattgagactgaagggcagaacatgtgaggagttaactcatatcagcagccagggcct

SEQ ID NO: 427579 - DNA, 140 bp, Artificial Sequence
  Synthetic
atacgccatgctgggtctcccttcagataacaatttctgcgcacctcgagtgaaagtggaagacaacttattttggactgtcttgacgatggtaggaatcttttcatcatccaggtttaccgtacttgggagtcggccat

SEQ ID NO: 427580 - DNA, 140 bp, Artificial Sequence
  Synthetic
atggccgactcccaagtacggtaaacctggatgatgaaaagattcctaccatcgtcaagacagtccaaaataagttgtcttccactttcactcgaggtgcgcagaaattgttatctgaagggagacccagcatggcgtat

SEQ ID NO: 427581 - DNA, 140 bp, Artificial Sequence
  Synthetic
atacgccatgctgggtctccctactcaatgtcctcaatgcacctctccagcccaaacaactctgaacatgttcttcccttcagtcttaggttgcccccacttgactggatcatgacccttcgtacttgggagtcggccat

SEQ ID NO: 427582 - DNA, 140 bp, Artificial Sequence
  Synthetic
atggccgactcccaagtacgaagggtcatgatccagtcaagtgggggcaacctaagactgaagggaagaacatgttcagagttgtttgggctggagaggtgcattgaggacattgagtagggagacccagcatggcgtat

SEQ ID NO: 427583 - DNA, 140 bp, Artificial Sequence
  Synthetic
atacgccatgctgggtctccaagatcctggtcttgtataacaggtgtaaaagatgccaatttctttccacattcccacaagcctcccctatgcacaaccagaggggctggttcagtgcaacgtacttgggagtcggccat

SEQ ID NO: 427584 - DNA, 140 bp, Artificial Sequence
  Synthetic
atggccgactcccaagtacgttgcactgaaccagcccctctggttgtgcataggggaggcttgtgggaatgtggaaagaaattggcatcttttacacctgttatacaagaccaggatcttggagacccagcatggcgtat

SEQ ID NO: 427585 - DNA, 140 bp, Artificial Sequence
  Synthetic
aggccctggctgctgatatgtaatgacttcctaccaatatttgataatccaaaacaccacttgggaagatcactgccagttttctcgcccatcccctatcggttatctggggctactgtcgaccttttgggacagcggtg

SEQ ID NO: 427586 - DNA, 140 bp, Artificial Sequence
  Synthetic
caccgctgtcccaaaaggtcgacagtagccccagataaccgataggggatgggcgagaaaactggcagtgatcttcccaagtggtgttttggattatcaaatattggtaggaagtcattacatatcagcagccagggcct

SEQ ID NO: 427587 - DNA, 140 bp, Artificial Sequence
  Synthetic
aggccctggctgctgatatgtcccatgtgagtatttagcatcttgcttgaactgctttaaatcagtaggttcacggaagaagtgtatgtagcagcctgaacttggctgatagagagcaatgaccttttgggacagcggtg

SEQ ID NO: 427588 - DNA, 140 bp, Artificial Sequence
  Synthetic
caccgctgtcccaaaaggtcattgctctctatcagccaagttcaggctgctacatacacttcttccgtgaacctactgatttaaagcagttcaagcaagatgctaaatactcacatgggacatatcagcagccagggcct

SEQ ID NO: 427589 - DNA, 140 bp, Artificial Sequence
  Synthetic
atacgccatgctgggtctcctggttctatgtcaaagtctatccatgcatagcccatcattagatcaaacttaaacatgggtctctctattcctttgtaaatagctttctcaatgaatgaacgtacttgggagtcggccat

SEQ ID NO: 427590 - DNA, 140 bp, Artificial Sequence
  Synthetic
atggccgactcccaagtacgttcattcattgagaaagctatttacaaaggaatagagagacccatgtttaagtttgatctaatgatgggctatgcatggatagactttgacatagaaccaggagacccagcatggcgtat

SEQ ID NO: 427591 - DNA, 140 bp, Artificial Sequence
  Synthetic
aggccctggctgctgatatgagcggacatatgattcaaagtagatttgtctcataaagttgtccactgcatcagcagtactaactaccctttcttccatcatgggctcatgtgtgcgagagaccttttgggacagcggtg

SEQ ID NO: 427592 - DNA, 140 bp, Artificial Sequence
  Synthetic
caccgctgtcccaaaaggtctctcgcacacatgagcccatgatggaagaaagggtagttagtactgctgatgcagtggacaactttatgagacaaatctactttgaatcatatgtccgctcatatcagcagccagggcct

SEQ ID NO: 427593 - DNA, 140 bp, Artificial Sequence
  Synthetic
aggccctggctgctgatatgaaatggatttgaggatgccatccattgtctgaggtgacactttgattgtctccaacatattgccaccatccagcatgcaggctcctgccttcacagctgcgaccttttgggacagcggtg

SEQ ID NO: 427594 - DNA, 140 bp, Artificial Sequence
  Synthetic
caccgctgtcccaaaaggtcgcagctgtgaaggcaggagcctgcatgctggatggtggcaatatgttggagacaatcaaagtgtcacctcagacaatggatggcatcctcaaatccatttcatatcagcagccagggcct

SEQ ID NO: 427595 - DNA, 140 bp, Artificial Sequence
  Synthetic
aggccctggctgctgatatgacatataatcccataacaagggtctgaaataattgaccacactttcacttccacttccatttctgagttctagcgggacttgccaatattgaatgccattgaccttttgggacagcggtg

SEQ ID NO: 427596 - DNA, 140 bp, Artificial Sequence
  Synthetic
caccgctgtcccaaaaggtcaatggcattcaatattggcaagtcccgctagaactcagaaatggaagtggaagtgaaagtgtggtcaattatttcagacccttgttatgggattatatgtcatatcagcagccagggcct

SEQ ID NO: 427597 - DNA, 140 bp, Artificial Sequence
  Synthetic
aggccctggctgctgatatggacagcggtgctacccccttccttggcttctggtgacactctccatatctggattccattatcccccatcactgcctcaacaccttgagtttctaacaacgaccttttgggacagcggtg

SEQ ID NO: 427598 - DNA, 140 bp, Artificial Sequence
  Synthetic
caccgctgtcccaaaaggtcgttgttagaaactcaaggtgttgaggcagtgatgggggataatggaatccagatatggagagtgtcaccagaagccaaggaagggggtagcaccgctgtccatatcagcagccagggcct

SEQ ID NO: 427599 - DNA, 140 bp, Artificial Sequence
  Synthetic
aggccctggctgctgatatgattatgtttaaaaaagtccaagatctgagcttgttttggttccccaagcacccatgctccaagttctatagctgtagatagtgttatgcacatataatccgaccttttgggacagcggtg

SEQ ID NO: 427600 - DNA, 140 bp, Artificial Sequence
  Synthetic
caccgctgtcccaaaaggtcggattatatgtgcataacactatctacagctatagaacttggagcatgggtgcttggggaaccaaaacaagctcagatcttggacttttttaaacataatcatatcagcagccagggcct

SEQ ID NO: 427601 - DNA, 140 bp, Artificial Sequence
  Synthetic
aggccctggctgctgatatgtcaccacctgaagtttgatgttggagcagtaaccagatagttccctcctcaaggattgtgtccacagaaaggactttatttcctttgaggcactcattgcgaccttttgggacagcggtg

SEQ ID NO: 427602 - DNA, 140 bp, Artificial Sequence
  Synthetic
caccgctgtcccaaaaggtcgcaatgagtgcctcaaaggaaataaagtcctttctgtggacacaatccttgaggagggaactatctggttactgctccaacatcaaacttcaggtggtgacatatcagcagccagggcct

SEQ ID NO: 427603 - DNA, 140 bp, Artificial Sequence
  Synthetic
aggccctggctgctgatatgcacccagttgtccactgcttcaagaatcgcactcaagatcctctcacaactcggtgctgcagccctcagtgtggagacaatatccacccctgaccactgcgaccttttgggacagcggtg

SEQ ID NO: 427604 - DNA, 140 bp, Artificial Sequence
  Synthetic
caccgctgtcccaaaaggtcgcagtggtcaggggtggatattgtctccacactgagggctgcagcaccgagttgtgagaggatcttgagtgcgattcttgaagcagtggacaactgggtgcatatcagcagccagggcct

SEQ ID NO: 427605 - DNA, 140 bp, Artificial Sequence
  Synthetic
atacgccatgctgggtctcctcggtgctgcagccctcagtgtggagacaatatccacccctgaccactgcatccttaaccccagcctgtctatcatcatatcacttagtgccccgatcagcgtacttgggagtcggccat

SEQ ID NO: 427606 - DNA, 140 bp, Artificial Sequence
  Synthetic
atggccgactcccaagtacgctgatcggggcactaagtgatatgatgatagacaggctggggttaaggatgcagtggtcaggggtggatattgtctccacactgagggctgcagcaccgaggagacccagcatggcgtat

SEQ ID NO: 427607 - DNA, 140 bp, Artificial Sequence
  Synthetic
atacgccatgctgggtctccggtcttgtataacaggtgtaaaggatgccaatttctttccacattcccataagcctcccttatgcacaaccagagggactggttcaacacagggacccaccgtacttgggagtcggccat

SEQ ID NO: 427608 - DNA, 140 bp, Artificial Sequence
  Synthetic
atggccgactcccaagtacggtgggtccctgtgttgaaccagtccctctggttgtgcataagggaggcttatgggaatgtggaaagaaattggcatcctttacacctgttatacaagaccggagacccagcatggcgtat

SEQ ID NO: 427609 - DNA, 140 bp, Artificial Sequence
  Synthetic
atacgccatgctgggtctccgcaattcagctggacttcagtggtaagacttattttggtgaacccctgaatcaaagtgctcagctaaaatgggcaacagacaggccaaatcgacaaaagtcgtacttgggagtcggccat

SEQ ID NO: 427610 - DNA, 140 bp, Artificial Sequence
  Synthetic
atggccgactcccaagtacgacttttgtcgatttggcctgtctgttgcccattttagctgagcactttgattcaggggttcaccaaaataagtcttaccactgaagtccagctgaattgcggagacccagcatggcgtat

SEQ ID NO: 427611 - DNA, 140 bp, Artificial Sequence
  Synthetic
atacgccatgctgggtctcccacctgagtacatagcggttacatcatgtactaaatatttagcctgttgattcattgagccaatatattcaaggtggatggcaaagctttccttaaaactcgtacttgggagtcggccat

SEQ ID NO: 427612 - DNA, 140 bp, Artificial Sequence
  Synthetic
atggccgactcccaagtacgagttttaaggaaagctttgccatccaccttgaatatattggctcaatgaatcaacaggctaaatatttagtacatgatgtaaccgctatgtactcaggtgggagacccagcatggcgtat

SEQ ID NO: 427613 - DNA, 140 bp, Artificial Sequence
  Synthetic
aggccctggctgctgatatgcttcaaagtaatcctcaatgagccttgtgaacatctttgtccttaaatctccgatgtacaactctctattgcctcccacttgttccttgtaagacaaagagaccttttgggacagcggtg

SEQ ID NO: 427614 - DNA, 140 bp, Artificial Sequence
  Synthetic
caccgctgtcccaaaaggtctctttgtcttacaaggaacaagtgggaggcaatagagagttgtacatcggagatttaaggacaaagatgttcacaaggctcattgaggattactttgaagcatatcagcagccagggcct

SEQ ID NO: 427615 - DNA, 140 bp, Artificial Sequence
  Synthetic
atacgccatgctgggtctcctgtcaaggcaaatcacctccatatcaatcttatagtagtctacattgatcccaacatccttcaaggcagtagtggcttttaaaatggttttctgaaatatcgtacttgggagtcggccat

SEQ ID NO: 427616 - DNA, 140 bp, Artificial Sequence
  Synthetic
atggccgactcccaagtacgatatttcagaaaaccattttaaaagccactactgccttgaaggatgttgggatcaatgtagactactataagattgatatggaggtgatttgccttgacaggagacccagcatggcgtat

SEQ ID NO: 427617 - DNA, 140 bp, Artificial Sequence
  Synthetic
aggccctggctgctgatatgtccaacgccacacagagatccagaaattttatcctgggtgaccacttcattttggttgacgctagatcgctcatgaatggtaatatgtgtttctcaaacagaccttttgggacagcggtg

SEQ ID NO: 427618 - DNA, 140 bp, Artificial Sequence
  Synthetic
caccgctgtcccaaaaggtctgtttgagaaacacatattaccattcatgagcgatctagcgtcaaccaaaatgaagtggtcacccaggataaaatttctggatctctgtgtggcgttggacatatcagcagccagggcct

SEQ ID NO: 427619 - DNA, 140 bp, Artificial Sequence
  Synthetic
aggccctggctgctgatatgatatcatgatcaaagtcctcaaccatgtgattggataattcacccttaatcaacctaatgtaaaacttatttgaaacaatctcatctagatcatttattggaccttttgggacagcggtg

SEQ ID NO: 427620 - DNA, 140 bp, Artificial Sequence
  Synthetic
caccgctgtcccaaaaggtccaataaatgatctagatgagattgtttcaaataagttttacattaggttgattaagggtgaattatccaatcacatggttgaggactttgatcatgatatcatatcagcagccagggcct

SEQ ID NO: 427621 - DNA, 140 bp, Artificial Sequence
  Synthetic
aggccctggctgctgatatgcacctttgggctgcctagatcctaaaaccaaattactcattgcctgttgaactttgtattcatagtcctgcttgttgagaagatactttccttttcttgagaccttttgggacagcggtg

SEQ ID NO: 427622 - DNA, 140 bp, Artificial Sequence
  Synthetic
caccgctgtcccaaaaggtctcaagaaaaggaaagtatcttctcaacaagcaggactatgaatacaaagttcaacaggcaatgagtaatttggttttaggatctaggcagcccaaaggtgcatatcagcagccagggcct

SEQ ID NO: 427623 - DNA, 140 bp, Artificial Sequence
  Synthetic
aggccctggctgctgatatgaacagtgcacctcagttgatcgaagtattctgatgctcctccatccaatagtatctcatctagatcagcattgttggtgtcaccactccctcctttggacgaccttttgggacagcggtg

SEQ ID NO: 427624 - DNA, 140 bp, Artificial Sequence
  Synthetic
caccgctgtcccaaaaggtcgtccaaaggagggagtggtgacaccaacaatgctgatctagatgagatactattggatggaggagcatcagaatacttcgatcaactgaggtgcactgttcatatcagcagccagggcct

SEQ ID NO: 427625 - DNA, 140 bp, Artificial Sequence
  Synthetic
atacgccatgctgggtctccagctgttgcacagccgcttgcaataagggggtctctcagtgtcttcttcacttctttttctttgaacaatgaaccattattgaaactagacacaaggagtcgtacttgggagtcggccat

SEQ ID NO: 427626 - DNA, 140 bp, Artificial Sequence
  Synthetic
atggccgactcccaagtacgactccttgtgtctagtttcaataatggttcattgttcaaagaaaaagaagtgaagaagacactgagagacccccttattgcaagcggctgtgcaacagctggagacccagcatggcgtat

SEQ ID NO: 427627 - DNA, 140 bp, Artificial Sequence
  Synthetic
aggccctggctgctgatatggaagagctgctgcaacgaactttgtcaacaatggtacttcatccccccaaacaaagaatctagatttaaactctgcaacaaatctgccaatgacacttttgaccttttgggacagcggtg

SEQ ID NO: 427628 - DNA, 140 bp, Artificial Sequence
  Synthetic
caccgctgtcccaaaaggtcaaaagtgtcattggcagatttgttgcagagtttaaatctagattctttgtttggggggatgaagtaccattgttgacaaagttcgttgcagcagctcttccatatcagcagccagggcct

SEQ ID NO: 427629 - DNA, 140 bp, Artificial Sequence
  Synthetic
atacgccatgctgggtctccaacctataaagaaggtactcaacatcagtgatcaattcttcctttattttgtcaatgaggtccttatgatgataatctgacacataagccattacaaagtcgtacttgggagtcggccat

SEQ ID NO: 427630 - DNA, 140 bp, Artificial Sequence
  Synthetic
atggccgactcccaagtacgactttgtaatggcttatgtgtcagattatcatcataaggacctcattgacaaaataaaggaagaattgatcactgatgttgagtaccttctttataggttggagacccagcatggcgtat

SEQ ID NO: 427631 - DNA, 140 bp, Artificial Sequence
  Synthetic
aggccctggctgctgatatggaagtcttctgttattgactgtttagttttcttccttagccccagttgagctttaatgaaagacttcatcatagctgtcaccacattaaaaggtatttccgaccttttgggacagcggtg

SEQ ID NO: 427632 - DNA, 140 bp, Artificial Sequence
  Synthetic
caccgctgtcccaaaaggtcggaaataccttttaatgtggtgacagctatgatgaagtctttcattaaagctcaactggggctaaggaagaaaactaaacagtcaataacagaagacttccatatcagcagccagggcct

SEQ ID NO: 427633 - DNA, 140 bp, Artificial Sequence
  Synthetic
atacgccatgctgggtctcccacaaaactgagaccatcagccgctccaacagcacccccagccagagcagcggacgacaccaggcccccgccctacagcccctgaacctctcaccgatcccgtacttgggagtcggccat

SEQ ID NO: 427634 - DNA, 140 bp, Artificial Sequence
  Synthetic
atggccgactcccaagtacgggatcggtgagaggttcaggggctgtagggcgggggcctggtgtcgtccgctgctctggctgggggtgctgttggagcggctgatggtctcagttttgtgggagacccagcatggcgtat

SEQ ID NO: 427635 - DNA, 140 bp, Artificial Sequence
  Synthetic
aggccctggctgctgatatgtagttcccattagttccacatcccccatcacataagggaatgtttcttcctctgttctctgataactaattgtagggacaactccagagacatcaaaactgaccttttgggacagcggtg

SEQ ID NO: 427636 - DNA, 140 bp, Artificial Sequence
  Synthetic
caccgctgtcccaaaaggtcagttttgatgtctctggagttgtccctacaattagttatcagagaacagaggaagaaacattcccttatgtgatgggggatgtggaactaatgggaactacatatcagcagccagggcct

SEQ ID NO: 427637 - DNA, 140 bp, Artificial Sequence
  Synthetic
aggccctggctgctgatatgtattctgtaactacgattcccgtccacccagtctctcacatcagtctcacaatttaagaggaatggatctatagggtacttagcataacacaacaagctcgaccttttgggacagcggtg

SEQ ID NO: 427638 - DNA, 140 bp, Artificial Sequence
  Synthetic
caccgctgtcccaaaaggtcgagcttgttgtgttatgctaagtaccctatagatccattcctcttaaattgtgagactgatgtgagagactgggtggacgggaatcgtagttacagaatacatatcagcagccagggcct

SEQ ID NO: 427639 - DNA, 140 bp, Artificial Sequence
  Synthetic
atacgccatgctgggtctccttccagattcacagcaccagaatagattatcttttgccgcaacaccattctaagcgggtgatgggtggctaagttcaaccaatgaaaccccaagtcagaacgtacttgggagtcggccat

SEQ ID NO: 427640 - DNA, 140 bp, Artificial Sequence
  Synthetic
atggccgactcccaagtacgttctgacttggggtttcattggttgaacttagccacccatcacccgcttagaatggtgttgcggcaaaagataatctattctggtgctgtgaatctggaaggagacccagcatggcgtat

SEQ ID NO: 427641 - DNA, 140 bp, Artificial Sequence
  Synthetic
atacgccatgctgggtctccacctccttcaaagcattagtggcccgagttaaaactctgttgatgatagcaaggagttcacaatttcgttcttctttaagtgatgtgacacctacattcccgtacttgggagtcggccat

SEQ ID NO: 427642 - DNA, 140 bp, Artificial Sequence
  Synthetic
atggccgactcccaagtacgggaatgtaggtgtcacatcacttaaagaagaacgaaattgtgaactccttgctatcatcaacagagttttaactcgggccactaatgctttgaaggaggtggagacccagcatggcgtat

SEQ ID NO: 427643 - DNA, 140 bp, Artificial Sequence
  Synthetic
aggccctggctgctgatatgaatagtcacaagatgagagaaaaatatttttacagcggtcatatgtcccagtgtcccattggggaattaactaaagctgtgacaacaaggacatattttggaccttttgggacagcggtg

SEQ ID NO: 427644 - DNA, 140 bp, Artificial Sequence
  Synthetic
caccgctgtcccaaaaggtccaaaatatgtccttgttgtcacagctttagttaattccccaatgggacactgggacatatgaccgctgtaaaaatatttttctctcatcttgtgactattcatatcagcagccagggcct

SEQ ID NO: 427645 - DNA, 140 bp, Artificial Sequence
  Synthetic
aggccctggctgctgatatgggctagatccaaagctgtagcacagccactggtgataagggggtctttgatttcccttttcacttccctttccttaaatagtgaaccattattgaaagaggaccttttgggacagcggtg

SEQ ID NO: 427646 - DNA, 140 bp, Artificial Sequence
  Synthetic
caccgctgtcccaaaaggtcctctttcaataatggttcactatttaaggaaagggaagtgaaaagggaaatcaaagacccccttatcaccagtggctgtgctacagctttggatctagcccatatcagcagccagggcct

SEQ ID NO: 427647 - DNA, 140 bp, Artificial Sequence
  Synthetic
aggccctggctgctgatatggcgattgtccatcagaacatttaaactctctacccctgataatctacccgaagtcatggataaagattcacagagtctgctatactctgactcttcaaaagaccttttgggacagcggtg

SEQ ID NO: 427648 - DNA, 140 bp, Artificial Sequence
  Synthetic
caccgctgtcccaaaaggtcttttgaagagtcagagtatagcagactctgtgaatctttatccatgacttcgggtagattatcaggggtagagagtttaaatgttctgatggacaatcgccatatcagcagccagggcct

SEQ ID NO: 427649 - DNA, 140 bp, Artificial Sequence
  Synthetic
aggccctggctgctgatatgatgagattgatgccaacagactccaaatcattctttaattgttctagtttcttgtgatcttctagatacttctgttcaaaattggcgggggatgatctaagaccttttgggacagcggtg

SEQ ID NO: 427650 - DNA, 140 bp, Artificial Sequence
  Synthetic
caccgctgtcccaaaaggtcttagatcatcccccgccaattttgaacagaagtatctagaagatcacaagaaactagaacaattaaagaatgatttggagtctgttggcatcaatctcatcatatcagcagccagggcct

SEQ ID NO: 427651 - DNA, 140 bp, Artificial Sequence
  Synthetic
aggccctggctgctgatatgagtagctccacatcccccatcacataagggaatgtttcttcctctgttctctgataactgattgtggggataacccccgagacatcgaagtccataattagaccttttgggacagcggtg

SEQ ID NO: 427652 - DNA, 140 bp, Artificial Sequence
  Synthetic
caccgctgtcccaaaaggtctaattatggacttcgatgtctcgggggttatccccacaatcagttatcagagaacagaggaagaaacattcccttatgtgatgggggatgtggagctactcatatcagcagccagggcct

SEQ ID NO: 427653 - DNA, 140 bp, Artificial Sequence
  Synthetic
aggccctggctgctgatatgaatcataactattaagacaaatcacctccatatcaatcttataatggtccacactgatcccaacatcctttaacgcagtggtggccttcaaaatggttttgaccttttgggacagcggtg

SEQ ID NO: 427654 - DNA, 140 bp, Artificial Sequence
  Synthetic
caccgctgtcccaaaaggtcaaaaccattttgaaggccaccactgcgttaaaggatgttgggatcagtgtggaccattataagattgatatggaggtgatttgtcttaatagttatgattcatatcagcagccagggcct

SEQ ID NO: 427655 - DNA, 140 bp, Artificial Sequence
  Synthetic
aggccctggctgctgatatgcacagattgaatcatatgggcatttgttcctgtggactctacaaacagcctggtgtgcctgtgaaatggaagagatgagacccttgtcagggcccccgtggaccttttgggacagcggtg

SEQ ID NO: 427656 - DNA, 140 bp, Artificial Sequence
  Synthetic
caccgctgtcccaaaaggtccacgggggccctgacaagggtctcatctcttccatttcacaggcacaccaggctgtttgtagagtccacaggaacaaatgcccatatgattcaatctgtgcatatcagcagccagggcct

SEQ ID NO: 427657 - DNA, 140 bp, Artificial Sequence
  Synthetic
aggccctggctgctgatatggtctttgacacaggctatgtcttcctccatgtttcgctgcaggtatgatggtcagagccctcagaacatgtggtctgctagagcaacaattcactatagggaccttttgggacagcggtg

SEQ ID NO: 427658 - DNA, 140 bp, Artificial Sequence
  Synthetic
caccgctgtcccaaaaggtccctatagtgaattgttgctctagcagaccacatgttctgagggctctgaccatcatacctgcagcgaaacatggaggaagacatagcctgtgtcaaagaccatatcagcagccagggcct

SEQ ID NO: 427659 - DNA, 140 bp, Artificial Sequence
  Synthetic
atacgccatgctgggtctccattcactataggatgaggcctcgtaagaagcacagaagacacaagatgaaattaaagacaatttaattagatagccttaatgcctaggatccactgtgcgcgtacttgggagtcggccat

SEQ ID NO: 427660 - DNA, 140 bp, Artificial Sequence
  Synthetic
atggccgactcccaagtacgcgcacagtggatcctaggcattaaggctatctaattaaattgtctttaatttcatcttgtgtcttctgtgcttcttacgaggcctcatcctatagtgaatggagacccagcatggcgtat

SEQ ID NO: 427661 - DNA, 140 bp, Artificial Sequence
  Synthetic
atacgccatgctgggtctcctgttgggtttgggtttgtgccaatatggcctgtaggtcagctggtggtgccccacaaaagctcccacagaaatgagagacaatatgcctaggatcctcggcgtacttgggagtcggccat

SEQ ID NO: 427662 - DNA, 140 bp, Artificial Sequence
  Synthetic
atggccgactcccaagtacgccgaggatcctaggcatattgtctctcatttctgtgggagcttttgtggggcaccaccagctgacctacaggccatattggcacaaacccaaacccaacaggagacccagcatggcgtat

SEQ ID NO: 427663 - DNA, 140 bp, Artificial Sequence
  Synthetic
atacgccatgctgggtctcccctcaccaacatttgcatacaaaaatctcaatattggtgatgctctcttgaactgataaattaaatgttcaatattatcttctgcagctaccttatcagtcgtacttgggagtcggccat

SEQ ID NO: 427664 - DNA, 140 bp, Artificial Sequence
  Synthetic
atggccgactcccaagtacgactgataaggtagctgcagaagataatattgaacatttaatttatcagttcaagagagcatcaccaatattgagatttttgtatgcaaatgttggtgaggggagacccagcatggcgtat

SEQ ID NO: 427665 - DNA, 140 bp, Artificial Sequence
  Synthetic
aggccctggctgctgatatgagggtgtttatgagctacaaactctagagctagacatggcaagccttaatatgacaatgcccttatcttgcacgaagaataacagccaccattacatcatgaccttttgggacagcggtg

SEQ ID NO: 427666 - DNA, 140 bp, Artificial Sequence
  Synthetic
caccgctgtcccaaaaggtcatgatgtaatggtggctgttattcttcgtgcaagataagggcattgtcatattaaggcttgccatgtctagctctagagtttgtagctcataaacaccctcatatcagcagccagggcct

SEQ ID NO: 427667 - DNA, 140 bp, Artificial Sequence
  Synthetic
atacgccatgctgggtctccgccttggtggcatgaggcaatcacttcctcataatgattagagcgattatccatcagcacatttaaactttccactcctgacaatcttcctgaggtcatgcgtacttgggagtcggccat

SEQ ID NO: 427668 - DNA, 140 bp, Artificial Sequence
  Synthetic
atggccgactcccaagtacgcatgacctcaggaagattgtcaggagtggaaagtttaaatgtgctgatggataatcgctctaatcattatgaggaagtgattgcctcatgccaccaaggcggagacccagcatggcgtat

SEQ ID NO: 427669 - DNA, 140 bp, Artificial Sequence
  Synthetic
atacgccatgctgggtctcctgtaatagtgaaactctaacagtgttttgaactcctcttcatctcttgagagtaattgtgtcaagttctgatcaaataaagatatctggtcatcactagacgtacttgggagtcggccat

SEQ ID NO: 427670 - DNA, 140 bp, Artificial Sequence
  Synthetic
atggccgactcccaagtacgtctagtgatgaccagatatctttatttgatcagaacttgacacaattactctcaagagatgaagaggagttcaaaacactgttagagtttcactattacaggagacccagcatggcgtat

SEQ ID NO: 427671 - DNA, 140 bp, Artificial Sequence
  Synthetic
aggccctggctgctgatatgtccattaatagcatcctaggctctgtctgcacaagaaatgccaacttctgcctcgataatctctcgttgtccactaggtactttgatactaggtccttgagaccttttgggacagcggtg

SEQ ID NO: 427672 - DNA, 140 bp, Artificial Sequence
  Synthetic
caccgctgtcccaaaaggtctcaaggacctagtatcaaagtacctagtggacaacgagagattatcgaggcagaagttggcatttcttgtgcagacagagcctaggatgctattaatggacatatcagcagccagggcct

SEQ ID NO: 427673 - DNA, 140 bp, Artificial Sequence
  Synthetic
aggccctggctgctgatatgagtaattgtgtcaagttctgatcaaataaagatatctggtcatcactagatgtgtaagcatcaatctggccaccagacacacactttattgcaaaattaagaccttttgggacagcggtg

SEQ ID NO: 427674 - DNA, 140 bp, Artificial Sequence
  Synthetic
caccgctgtcccaaaaggtcttaattttgcaataaagtgtgtgtctggtggccagattgatgcttacacatctagtgatgaccagatatctttatttgatcagaacttgacacaattactcatatcagcagccagggcct

SEQ ID NO: 427675 - DNA, 140 bp, Artificial Sequence
  Synthetic
aggccctggctgctgatatgctggcttggagctgactttaacaaatacaagtattatcaaccacaagttttgtaacctttctgatgcacataaaaagaatctttatgaccatgctttaatgaccttttgggacagcggtg

SEQ ID NO: 427676 - DNA, 140 bp, Artificial Sequence
  Synthetic
caccgctgtcccaaaaggtcattaaagcatggtcataaagattctttttatgtgcatcagaaaggttacaaaacttgtggttgataatacttgtatttgttaaagtcagctccaagccagcatatcagcagccagggcct

SEQ ID NO: 427677 - DNA, 140 bp, Artificial Sequence
  Synthetic
atacgccatgctgggtctcctgctaattgaagctgaactaaaatgcttcgggaacacagctgtggcaaaatgtaatgagaagcatgatgaggaattttgtgacatgctgaggctgtttgacgtacttgggagtcggccat

SEQ ID NO: 427678 - DNA, 140 bp, Artificial Sequence
  Synthetic
atggccgactcccaagtacgtcaaacagcctcagcatgtcacaaaattcctcatcatgcttctcattacattttgccacagctgtgttcccgaagcattttagttcagcttcaattagcaggagacccagcatggcgtat

SEQ ID NO: 427679 - DNA, 140 bp, Artificial Sequence
  Synthetic
aggccctggctgctgatatgatggatgctaattgaagctgagttgaagtgctttggcaatacagctgttgcaaaatgtaatgaaaagcatgatgaagagttttgtgacatgctaaggctggaccttttgggacagcggtg

SEQ ID NO: 427680 - DNA, 140 bp, Artificial Sequence
  Synthetic
caccgctgtcccaaaaggtccagccttagcatgtcacaaaactcttcatcatgcttttcattacattttgcaacagctgtattgccaaagcacttcaactcagcttcaattagcatccatcatatcagcagccagggcct

SEQ ID NO: 427681 - DNA, 140 bp, Artificial Sequence
  Synthetic
aggccctggctgctgatatggcatcatacattatgcagtccattagagcacagtgcggggtaatttcttccttgcctcctcttttcttcttttcgacaaccactccagtgtgcatatggcgaccttttgggacagcggtg

SEQ ID NO: 427682 - DNA, 140 bp, Artificial Sequence
  Synthetic
caccgctgtcccaaaaggtcgccatatgcacactggagtggttgtcgaaaagaagaaaagaggaggcaaggaagaaattaccccgcactgtgctctaatggactgcataatgtatgatgccatatcagcagccagggcct

SEQ ID NO: 427683 - DNA, 140 bp, Artificial Sequence
  Synthetic
aggccctggctgctgatatggttgatgatggcaaggagctcacaattttgttcttctttaagtgatagggcacctgcacccctgcccttaggtatcttcccgcgtcggtgtctcccccgcgaccttttgggacagcggtg

SEQ ID NO: 427684 - DNA, 140 bp, Artificial Sequence
  Synthetic
caccgctgtcccaaaaggtcgcgggggagacaccgacgcgggaagatacctaagggcaggggtgcaggtgccctatcacttaaagaagaacaaaattgtgagctccttgccatcatcaaccatatcagcagccagggcct

SEQ ID NO: 427685 - DNA, 140 bp, Artificial Sequence
  Synthetic
aggccctggctgctgatatgtgaaactaatctatcgttgacactcacaaaacaggaacccagccaaccagcagggagcttgtcaccatgccttatgcagtccagccggctagcaagaagagaccttttgggacagcggtg

SEQ ID NO: 427686 - DNA, 140 bp, Artificial Sequence
  Synthetic
caccgctgtcccaaaaggtctcttcttgctagccggctggactgcataaggcatggtgacaagctccctgctggttggctgggttcctgttttgtgagtgtcaacgatagattagtttcacatatcagcagccagggcct

SEQ ID NO: 427687 - DNA, 140 bp, Artificial Sequence
  Synthetic
aggccctggctgctgatatgtgaagctatgtagggccagccgtcaccagaaagacagatcttgtaaagtatgttctcataagggttcctctcaccaggtgtatctgaaacaaacattcccgaccttttgggacagcggtg

SEQ ID NO: 427688 - DNA, 140 bp, Artificial Sequence
  Synthetic
caccgctgtcccaaaaggtcgggaatgtttgtttcagatacacctggtgagaggaacccttatgagaacatactttacaagatctgtctttctggtgacggctggccctacatagcttcacatatcagcagccagggcct

SEQ ID NO: 427689 - DNA, 140 bp, Artificial Sequence
  Synthetic
aggccctggctgctgatatgtttgagagtcagcaaccctttccttaccagaatccaaatctgcatacaagaacttaaggactggagaggctcttcggaactggaatgttaactgttcaatgaccttttgggacagcggtg

SEQ ID NO: 427690 - DNA, 140 bp, Artificial Sequence
  Synthetic
caccgctgtcccaaaaggtcattgaacagttaacattccagttccgaagagcctctccagtccttaagttcttgtatgcagatttggattctggtaaggaaagggttgctgactctcaaacatatcagcagccagggcct

SEQ ID NO: 427691 - DNA, 140 bp, Artificial Sequence
  Synthetic
aggccctggctgctgatatgaacttaaggactggagaggctcttcggaactggaatgttaactgttcaatgttgtcatcacaggtgtctattttatcactatatagctttctgaaatcctgaccttttgggacagcggtg

SEQ ID NO: 427692 - DNA, 140 bp, Artificial Sequence
  Synthetic
caccgctgtcccaaaaggtcaggatttcagaaagctatatagtgataaaatagacacctgtgatgacaacattgaacagttaacattccagttccgaagagcctctccagtccttaagttcatatcagcagccagggcct

SEQ ID NO: 427693 - DNA, 140 bp, Artificial Sequence
  Synthetic
aggccctggctgctgatatggttgtcatcacaggtgtctattttatcactatatagctttctgaaatcctctaataacttcatcttatcagtcttaacaaattgactttctatgttccctgaccttttgggacagcggtg

SEQ ID NO: 427694 - DNA, 140 bp, Artificial Sequence
  Synthetic
caccgctgtcccaaaaggtcagggaacatagaaagtcaatttgttaagactgataagatgaagttattagaggatttcagaaagctatatagtgataaaatagacacctgtgatgacaaccatatcagcagccagggcct

SEQ ID NO: 427695 - DNA, 140 bp, Artificial Sequence
  Synthetic
aggccctggctgctgatatggatcacagtaagtggggtccaatgatgtgtccatttttgtttttagctgttctacaaaacttgattttcctctctaaagatttacaggctgacatcaaaggaccttttgggacagcggtg

SEQ ID NO: 427696 - DNA, 140 bp, Artificial Sequence
  Synthetic
caccgctgtcccaaaaggtcctttgatgtcagcctgtaaatctttagagaggaaaatcaagttttgtagaacagctaaaaacaaaaatggacacatcattggaccccacttactgtgatccatatcagcagccagggcct

SEQ ID NO: 427697 - DNA, 140 bp, Artificial Sequence
  Synthetic
aggccctggctgctgatatgtcaattcctgagagcctcccagacgttaaggctaaagattcacaaagtcttgaatactcagactcttcgaacaatgcattactttcttgtgaatattttagaccttttgggacagcggtg

SEQ ID NO: 427698 - DNA, 140 bp, Artificial Sequence
  Synthetic
caccgctgtcccaaaaggtctaaaatattcacaagaaagtaatgcattgttcgaagagtctgagtattcaagactttgtgaatctttagccttaacgtctgggaggctctcaggaattgacatatcagcagccagggcct

SEQ ID NO: 427699 - DNA, 140 bp, Artificial Sequence
  Synthetic
atacgccatgctgggtctccccttggaagcactcatcttggtttggacacttaagggttttttggttgaaagtattgctcagtgagtcactgaaaggcgcaatccaatagcctaggatcccgtacttgggagtcggccat

SEQ ID NO: 427700 - DNA, 140 bp, Artificial Sequence
  Synthetic
atggccgactcccaagtacgggatcctaggctattggattgcgcctttcagtgactcactgagcaatactttcaaccaaaaaacccttaagtgtccaaaccaagatgagtgcttccaaggggagacccagcatggcgtat

SEQ ID NO: 427701 - DNA, 140 bp, Artificial Sequence
  Synthetic
atacgccatgctgggtctccggggatcctaggcaatttagctggacttcagtgataaggctcattttagtgaatccctgaatcaggtacccagccaaaatgggcaacagacaggccaaatcgtacttgggagtcggccat

SEQ ID NO: 427702 - DNA, 140 bp, Artificial Sequence
  Synthetic
atggccgactcccaagtacgatttggcctgtctgttgcccattttggctgggtacctgattcagggattcactaaaatgagccttatcactgaagtccagctaaattgcctaggatccccggagacccagcatggcgtat

SEQ ID NO: 427703 - DNA, 140 bp, Artificial Sequence
  Synthetic
aggccctggctgctgatatgtttctgttctaatgaccttcgactttagtttctctaagtcagctgccaatgtcagcaggtcatctgaggtcaaggtcccaactctcaagatactcttttggaccttttgggacagcggtg

SEQ ID NO: 427704 - DNA, 140 bp, Artificial Sequence
  Synthetic
caccgctgtcccaaaaggtccaaaagagtatcttgagagttgggaccttgacctcagatgacctgctgacattggcagctgacttagagaaactaaagtcgaaggtcattagaacagaaacatatcagcagccagggcct

SEQ ID NO: 427705 - DNA, 140 bp, Artificial Sequence
  Synthetic
atacgccatgctgggtctccgaaatacccttcaatgttgtatcagctatgatgaagtcatttataaaagcccagttgggtttgagaaaaagcacctcacagtcgatgacggaggatttctcgtacttgggagtcggccat

SEQ ID NO: 427706 - DNA, 140 bp, Artificial Sequence
  Synthetic
atggccgactcccaagtacgagaaatcctccgtcatcgactgtgaggtgctttttctcaaacccaactgggcttttataaatgacttcatcatagctgatacaacattgaagggtatttcggagacccagcatggcgtat

SEQ ID NO: 427707 - DNA, 140 bp, Artificial Sequence
  Synthetic
atacgccatgctgggtctcctctccgtcagcagcagatgcccgatctgcaagatgcctcttcccaccaaattaaaggcagcagcacaaccgagcgcaccctcaactgaggcgggccagaacgtacttgggagtcggccat

SEQ ID NO: 427708 - DNA, 140 bp, Artificial Sequence
  Synthetic
atggccgactcccaagtacgttctggcccgcctcagttgagggtgcgctcggttgtgctgctgcctttaatttggtgggaagaggcatcttgcagatcgggcatctgctgctgacggagaggagacccagcatggcgtat

SEQ ID NO: 427709 - DNA, 140 bp, Artificial Sequence
  Synthetic
aggccctggctgctgatatgcggggggcagacggcccagctctactcaatgtcctcaatgcacttctccagcccaaacaactctgaacatgtccttccttttagtcttaggctacccctagaccttttgggacagcggtg

SEQ ID NO: 427710 - DNA, 140 bp, Artificial Sequence
  Synthetic
caccgctgtcccaaaaggtctaggggtagcctaagactaaaaggaaggacatgttcagagttgtttgggctggagaagtgcattgaggacattgagtagagctgggccgtctgccccccgcatatcagcagccagggcct

SEQ ID NO: 427711 - DNA, 140 bp, Artificial Sequence
  Synthetic
atacgccatgctgggtctccgacttcagtggtaaggctctttttagtaaatccctgaattaaagtgcccagttaaaatgggtaacagacaggccaaatcgacaaaagtcggtgaacatcacgtacttgggagtcggccat

SEQ ID NO: 427712 - DNA, 140 bp, Artificial Sequence
  Synthetic
atggccgactcccaagtacgtgatgttcaccgacttttgtcgatttggcctgtctgttacccattttaactgggcactttaattcagggatttactaaaaagagccttaccactgaagtcggagacccagcatggcgtat

SEQ ID NO: 427713 - DNA, 140 bp, Artificial Sequence
  Synthetic
aggccctggctgctgatatgttttgtgcatatgccacataagcaaggttgagaggtagtctcttccttttatatcagcctgcaggtcctttgagaggaatatcaagttttgcaaaacagtgaccttttgggacagcggtg

SEQ ID NO: 427714 - DNA, 140 bp, Artificial Sequence
  Synthetic
caccgctgtcccaaaaggtcactgttttgcaaaacttgatattcctctcaaaggacctgcaggctgatataaaaggaagagactacctctcaaccttgcttatgtggcatatgcacaaaacatatcagcagccagggcct

SEQ ID NO: 427715 - DNA, 140 bp, Artificial Sequence
  Synthetic
atacgccatgctgggtctccatgattgtgtccacagaaaggactttatttcctttgaagcactcatcgccagattgttgtgctggatgcgcgcaacaaaaagctgaggctatctgctaaacgtacttgggagtcggccat

SEQ ID NO: 427716 - DNA, 140 bp, Artificial Sequence
  Synthetic
atggccgactcccaagtacgtttagcagatagcctcagctttttgttgcgcgcatccagcacaacaatctggcgatgagtgcttcaaaggaaataaagtcctttctgtggacacaatcatggagacccagcatggcgtat

SEQ ID NO: 427717 - DNA, 140 bp, Artificial Sequence
  Synthetic
aggccctggctgctgatatgataatcagcttcatgggtataacatcccctaactgctgtgtgtcctttaagaattcatttaccacatctgattcaataaaccaggctgacctacctttgagaccttttgggacagcggtg

SEQ ID NO: 427718 - DNA, 140 bp, Artificial Sequence
  Synthetic
caccgctgtcccaaaaggtctcaaaggtaggtcagcctggtttattgaatcagatgtggtaaatgaattcttaaaggacacacagcagttaggggatgttatacccatgaagctgattatcatatcagcagccagggcct

SEQ ID NO: 427719 - DNA, 140 bp, Artificial Sequence
  Synthetic
aggccctggctgctgatatggtgtcatcaccaacaaggctggtaagtttcttgaaggaatctgcggggtctcctgacaagtagatggctgtgaattcttcatgaagctctcctaatttcagaccttttgggacagcggtg

SEQ ID NO: 427720 - DNA, 140 bp, Artificial Sequence
  Synthetic
caccgctgtcccaaaaggtctgaaattaggagagcttcatgaagaattcacagccatctacttgtcaggagaccccgcagattccttcaagaaacttaccagccttgttggtgatgacaccatatcagcagccagggcct

SEQ ID NO: 427721 - DNA, 140 bp, Artificial Sequence
  Synthetic
atacgccatgctgggtctcccatgtgtgcgagagtgtgagtttctcagttcagaagccaatacaacataatgttcctccctcttccacttaacaatgtgtgaaacaagtgaaagtgcctccgtacttgggagtcggccat

SEQ ID NO: 427722 - DNA, 140 bp, Artificial Sequence
  Synthetic
atggccgactcccaagtacggaggcactttcacttgtttcacacattgttaagtggaagagggaggaacattatgttgtattggcttctgaactgagaaactcacactctcgcacacatgggagacccagcatggcgtat

SEQ ID NO: 427723 - DNA, 140 bp, Artificial Sequence
  Synthetic
aggccctggctgctgatatgtaaacataggtctctctatccctttgtaaatagctttctcaatgaatgaagagaagggacccagtcgctgcagaccttcaccctctggtattgaggttttgaccttttgggacagcggtg

SEQ ID NO: 427724 - DNA, 140 bp, Artificial Sequence
  Synthetic
caccgctgtcccaaaaggtcaaaacctcaataccagagggtgaaggtctgcagcgactgggtcccttctcttcattcattgagaaagctatttacaaagggatagagagacctatgtttacatatcagcagccagggcct

SEQ ID NO: 427725 - DNA, 140 bp, Artificial Sequence
  Synthetic
aggccctggctgctgatatgtctaatgtaaagattctccttgttggggcctctgacgcacttgctacctagtgttctacacaaccctacaaacccagatgctatagaactttggaaagctgaccttttgggacagcggtg

SEQ ID NO: 427726 - DNA, 140 bp, Artificial Sequence
  Synthetic
caccgctgtcccaaaaggtcagctttccaaagttctatagcatctgggtttgtagggttgtgtagaacactaggtagcaagtgcgtcagaggccccaacaaggagaatctttacattagacatatcagcagccagggcct

SEQ ID NO: 427727 - DNA, 140 bp, Artificial Sequence
  Synthetic
atacgccatgctgggtctcctttgcattgtagaccatgtcgtcaagttcttcctctgtggcagtatctgcaggattagtgctcacatgaccaaatcttacctttggttccaaaaacttttcgtacttgggagtcggccat

SEQ ID NO: 427728 - DNA, 140 bp, Artificial Sequence
  Synthetic
atggccgactcccaagtacgaaaagtttttggaaccaaaggtaagatttggtcatgtgagcactaatcctgcagatactgccacagaggaagaacttgacgacatggtctacaatgcaaaggagacccagcatggcgtat

SEQ ID NO: 427729 - DNA, 140 bp, Artificial Sequence
  Synthetic
atacgccatgctgggtctcctatggtctgctggagcagcaattcgctgtgggacaaggtcccgtggggggcacagaaaacacaaaaggcaatcaaagacaatcaaattagacaattaaatcgtacttgggagtcggccat

SEQ ID NO: 427730 - DNA, 140 bp, Artificial Sequence
  Synthetic
atggccgactcccaagtacgatttaattgtctaatttgattgtctttgattgccttttgtgttttctgtgccccccacgggaccttgtcccacagcgaattgctgctccagcagaccataggagacccagcatggcgtat

SEQ ID NO: 427731 - DNA, 140 bp, Artificial Sequence
  Synthetic
atacgccatgctgggtctcccggggatcctaggcaattcagctggacttcagtggtgaaactcattttagtgaatccctgaatcaaagtatccaatcaaaatgggcaacagacaggccaacgtacttgggagtcggccat

SEQ ID NO: 427732 - DNA, 140 bp, Artificial Sequence
  Synthetic
atggccgactcccaagtacgttggcctgtctgttgcccattttgattggatactttgattcagggattcactaaaatgagtttcaccactgaagtccagctgaattgcctaggatccccgggagacccagcatggcgtat

SEQ ID NO: 427733 - DNA, 140 bp, Artificial Sequence
  Synthetic
aggccctggctgctgatatgcccgggggggcaggcagcccagctctactcaatgtcctcaatacacctctccggcccaaacaactctgaacatgtccttcccttcagtcttaggctgcccgaccttttgggacagcggtg

SEQ ID NO: 427734 - DNA, 140 bp, Artificial Sequence
  Synthetic
caccgctgtcccaaaaggtcgggcagcctaagactgaagggaaggacatgttcagagttgtttgggccggagaggtgtattgaggacattgagtagagctgggctgcctgcccccccgggcatatcagcagccagggcct

SEQ ID NO: 427735 - DNA, 140 bp, Artificial Sequence
  Synthetic
atacgccatgctgggtctccagtcattgattgagttgtcttcttcttcaatccaagttgggatttaatgtatgatttcatcattgctgatacaacattaaatgggatctcaaccattttgcgtacttgggagtcggccat

SEQ ID NO: 427736 - DNA, 140 bp, Artificial Sequence
  Synthetic
atggccgactcccaagtacgcaaaatggttgagatcccatttaatgttgtatcagcaatgatgaaatcatacattaaatcccaacttggattgaagaagaagacaactcaatcaatgactggagacccagcatggcgtat

SEQ ID NO: 427737 - DNA, 140 bp, Artificial Sequence
  Synthetic
aggccctggctgctgatatgaacattgctgtagtacagttagttagggataaggccttgctaagtgcttcagaattactctcacgttcacttattctgacatcatcagccaatcttcctggaccttttgggacagcggtg

SEQ ID NO: 427738 - DNA, 140 bp, Artificial Sequence
  Synthetic
caccgctgtcccaaaaggtccaggaagattggctgatgatgtcagaataagtgaacgtgagagtaattctgaagcacttagcaaggccttatccctaactaactgtactacagcaatgttcatatcagcagccagggcct

SEQ ID NO: 427739 - DNA, 140 bp, Artificial Sequence
  Synthetic
aggccctggctgctgatatgcttctatcagattcccacagtgctcccctacatacaaccaatggcactggttcgttgtcaggtccgaccttggagaagtcaaactcactgaactgcagttgaccttttgggacagcggtg

SEQ ID NO: 427740 - DNA, 140 bp, Artificial Sequence
  Synthetic
caccgctgtcccaaaaggtcaactgcagttcagtgagtttgacttctccaaggtcggacctgacaacgaaccagtgccattggttgtatgtaggggagcactgtgggaatctgatagaagcatatcagcagccagggcct

SEQ ID NO: 427741 - DNA, 140 bp, Artificial Sequence
  Synthetic
atacgccatgctgggtctccatcaacttattcccattcatcactagtaaaattgacttaaagcactgaaagtattcttggtccagaaaagtcctagtcaccactgcctttgtcagctcaccgtacttgggagtcggccat

SEQ ID NO: 427742 - DNA, 140 bp, Artificial Sequence
  Synthetic
atggccgactcccaagtacggtgagctgacaaaggcagtggtgactaggacttttctggaccaagaatactttcagtgctttaagtcaattttactagtgatgaatgggaataagttgatggagacccagcatggcgtat

SEQ ID NO: 427743 - DNA, 140 bp, Artificial Sequence
  Synthetic
aggccctggctgctgatatgtgcgcattaagcgctgcacattgctgacttcagaaaagtcaagaccatgaaggagagcctgagcatctttaacaacttgaagttttatgctggagcaatagaccttttgggacagcggtg

SEQ ID NO: 427744 - DNA, 140 bp, Artificial Sequence
  Synthetic
caccgctgtcccaaaaggtctattgctccagcataaaacttcaagttgttaaagatgctcaggctctccttcatggtcttgacttttctgaagtcagcaatgtgcagcgcttaatgcgcacatatcagcagccagggcct

SEQ ID NO: 427745 - DNA, 140 bp, Artificial Sequence
  Synthetic
atacgccatgctgggtctcccggggatcctaggcaattcagctggacttcagtggtgaggcttatcctagtgaatccctgaatcaaagcacctagtcagaatgggcaacaaacaggccaacgtacttgggagtcggccat

SEQ ID NO: 427746 - DNA, 140 bp, Artificial Sequence
  Synthetic
atggccgactcccaagtacgttggcctgtttgttgcccattctgactaggtgctttgattcagggattcactaggataagcctcaccactgaagtccagctgaattgcctaggatccccgggagacccagcatggcgtat

SEQ ID NO: 427747 - DNA, 140 bp, Artificial Sequence
  Synthetic
aggccctggctgctgatatgagctaaaggcagcaacacagccgagcgcaccatcaactgaggcgacccggaacacaacacccccaccgtacaccccatgatcccaggaccaacatcccttgaccttttgggacagcggtg

SEQ ID NO: 427748 - DNA, 140 bp, Artificial Sequence
  Synthetic
caccgctgtcccaaaaggtcaagggatgttggtcctgggatcatggggtgtacggtgggggtgttgtgttccgggtcgcctcagttgatggtgcgctcggctgtgttgctgcctttagctcatatcagcagccagggcct

SEQ ID NO: 427749 - DNA, 140 bp, Artificial Sequence
  Synthetic
atacgccatgctgggtctcctcgttgtcaggtccgaccttggagaagtcaaactcactgaactgcagtttatctggatcaataatcagcttcatgggtataacatcccccaactgctgtgcgtacttgggagtcggccat

SEQ ID NO: 427750 - DNA, 140 bp, Artificial Sequence
  Synthetic
atggccgactcccaagtacgcacagcagttgggggatgttatacccatgaagctgattattgatccagataaactgcagttcagtgagtttgacttctccaaggtcggacctgacaacgaggagacccagcatggcgtat

SEQ ID NO: 427751 - DNA, 140 bp, Artificial Sequence
  Synthetic
atacgccatgctgggtctcctctaacaatgttttgaattcctctgtatctcttgagagtaactctgttaagttctgatcaaataaagatatctgatcgtcactggacgtgtaagcatcgacgtacttgggagtcggccat

SEQ ID NO: 427752 - DNA, 140 bp, Artificial Sequence
  Synthetic
atggccgactcccaagtacgtcgatgcttacacgtccagtgacgatcagatatctttatttgatcagaacttaacagagttactctcaagagatacagaggaattcaaaacattgttagaggagacccagcatggcgtat

SEQ ID NO: 427753 - DNA, 140 bp, Artificial Sequence
  Synthetic
aggccctggctgctgatatgtaagagttggtttctatgccaacctcctttaaagcattagtggctcgagttaaaactctgttgatgatggtaaggagctcacaattccgttcttctttaggaccttttgggacagcggtg

SEQ ID NO: 427754 - DNA, 140 bp, Artificial Sequence
  Synthetic
caccgctgtcccaaaaggtcctaaagaagaacggaattgtgagctccttaccatcatcaacagagttttaactcgagccactaatgctttaaaggaggttggcatagaaaccaactcttacatatcagcagccagggcct

SEQ ID NO: 427755 - DNA, 140 bp, Artificial Sequence
  Synthetic
aggccctggctgctgatatgtaggcctctttacacctcacaacctggtatctagagggtccaaattcattttgccttagtttcactgtggaagacgttttcattgagttgatcaaagccagaccttttgggacagcggtg

SEQ ID NO: 427756 - DNA, 140 bp, Artificial Sequence
  Synthetic
caccgctgtcccaaaaggtctggctttgatcaactcaatgaaaacgtcttccacagtgaaactaaggcaaaatgaatttggaccctctagataccaggttgtgaggtgtaaagaggcctacatatcagcagccagggcct

SEQ ID NO: 427757 - DNA, 140 bp, Artificial Sequence
  Synthetic
atacgccatgctgggtctccgacactcacaaaacaggagcccaaccaaccagcaaggggcctatcactatgccttatgcagtccagccggctagcaaggagaatcagaacgtcaaaaacacgtacttgggagtcggccat

SEQ ID NO: 427758 - DNA, 140 bp, Artificial Sequence
  Synthetic
atggccgactcccaagtacgtgtttttgacgttctgattctccttgctagccggctggactgcataaggcatagtgataggccccttgctggttggttgggctcctgttttgtgagtgtcggagacccagcatggcgtat

SEQ ID NO: 427759 - DNA, 140 bp, Artificial Sequence
  Synthetic
atacgccatgctgggtctccatgatgaaaaaatccccacaattattaagacgatccagaacaagttgtcgtcaactttcactcgaggggcacagaaactgttatcagaagctataaataacgtacttgggagtcggccat

SEQ ID NO: 427760 - DNA, 140 bp, Artificial Sequence
  Synthetic
atggccgactcccaagtacgttatttatagcttctgataacagtttctgtgcccctcgagtgaaagttgacgacaacttgttctggatcgtcttaataattgtggggattttttcatcatggagacccagcatggcgtat

SEQ ID NO: 427761 - DNA, 140 bp, Artificial Sequence
  Synthetic
aggccctggctgctgatatgaactctgttaagttctgatcaaataatgatatctgatcatcactggacgtgtaagcatcgatttgtcctccagacacacacctcaccgcaaaatttataagaccttttgggacagcggtg

SEQ ID NO: 427762 - DNA, 140 bp, Artificial Sequence
  Synthetic
caccgctgtcccaaaaggtcttataaattttgcggtgaggtgtgtgtctggaggacaaatcgatgcttacacgtccagtgatgatcagatatcattatttgatcagaacttaacagagttcatatcagcagccagggcct

SEQ ID NO: 427763 - DNA, 140 bp, Artificial Sequence
  Synthetic
aggccctggctgctgatatgctgatttgcccttaaaagtgggtcctgataaaaccagtctccagcagtctgacaagacacacggactcactgcacctgagtacataacggatacatcatggaccttttgggacagcggtg

SEQ ID NO: 427764 - DNA, 140 bp, Artificial Sequence
  Synthetic
caccgctgtcccaaaaggtccatgatgtatccgttatgtactcaggtgcagtgagtccgtgtgtcttgtcagactgctggagactggttttatcaggacccacttttaagggcaaatcagcatatcagcagccagggcct

SEQ ID NO: 427765 - DNA, 140 bp, Artificial Sequence
  Synthetic
aggccctggctgctgatatgtcaatccaagttgggatttgatgtatgatttcatcattgctgacacaacattaaatgggatctcaaccattttgtgcatatgccatgttaataatgttgagaccttttgggacagcggtg

SEQ ID NO: 427766 - DNA, 140 bp, Artificial Sequence
  Synthetic
caccgctgtcccaaaaggtctcaacattattaacatggcatatgcacaaaatggttgagatcccatttaatgttgtgtcagcaatgatgaaatcatacatcaaatcccaacttggattgacatatcagcagccagggcct

SEQ ID NO: 427767 - DNA, 140 bp, Artificial Sequence
  Synthetic
aggccctggctgctgatatgctgcatacaagaatttaaggactggagaggctcttcggaactggaatgtcaactgttcaatgttgtcatcacaggtgtctattttatcactatatagcttgaccttttgggacagcggtg

SEQ ID NO: 427768 - DNA, 140 bp, Artificial Sequence
  Synthetic
caccgctgtcccaaaaggtcaagctatatagtgataaaatagacacctgtgatgacaacattgaacagttgacattccagttccgaagagcctctccagtccttaaattcttgtatgcagcatatcagcagccagggcct

SEQ ID NO: 427769 - DNA, 140 bp, Artificial Sequence
  Synthetic
aggccctggctgctgatatgccctgagtttgtcattcacccaatcaggtatctgttcattgtaaaatgttgtcctgccgtctataagagggatgagattgatgccaacagaccccaaatcgaccttttgggacagcggtg

SEQ ID NO: 427770 - DNA, 140 bp, Artificial Sequence
  Synthetic
caccgctgtcccaaaaggtcgatttggggtctgttggcatcaatctcatccctcttatagacggcaggacaacattttacaatgaacagatacctgattgggtgaatgacaaactcagggcatatcagcagccagggcct

SEQ ID NO: 427771 - DNA, 140 bp, Artificial Sequence
  Synthetic
atacgccatgctgggtctccctgtgttggaattgggcctgtgcctgtatggcttgtgagtcagctgaaggtgccccacagaagctcctacagaaatgagagacaatatgcctaggatcctcgtacttgggagtcggccat

SEQ ID NO: 427772 - DNA, 140 bp, Artificial Sequence
  Synthetic
atggccgactcccaagtacgaggatcctaggcatattgtctctcatttctgtaggagcttctgtggggcaccttcagctgactcacaagccatacaggcacaggcccaattccaacacagggagacccagcatggcgtat

SEQ ID NO: 427773 - DNA, 140 bp, Artificial Sequence
  Synthetic
aggccctggctgctgatatgtgtcttcctccatcgccaattgtggcacctgtgttagatttgggtttgtgctagaatgacttgtgggttaactagtggtgtcccacaaaagttcctacaggaccttttgggacagcggtg

SEQ ID NO: 427774 - DNA, 140 bp, Artificial Sequence
  Synthetic
caccgctgtcccaaaaggtcctgtaggaacttttgtgggacaccactagttaacccacaagtcattctagcacaaacccaaatctaacacaggtgccacaattggcgatggaggaagacacatatcagcagccagggcct

SEQ ID NO: 427775 - DNA, 140 bp, Artificial Sequence
  Synthetic
aggccctggctgctgatatgaatgagtatcatctcaaccttccacttatccattcctaactttaatcagtatgaagcaatgagttgtgacttcaatggggggaagataagtgttcagtacgaccttttgggacagcggtg

SEQ ID NO: 427776 - DNA, 140 bp, Artificial Sequence
  Synthetic
caccgctgtcccaaaaggtcgtactgaacacttatcttccccccattgaagtcacaactcattgcttcatactgattaaagttaggaatggataagtggaaggttgagatgatactcattcatatcagcagccagggcct

SEQ ID NO: 427777 - DNA, 140 bp, Artificial Sequence
  Synthetic
atacgccatgctgggtctccaatgacagcactggtcaagcccggttgtgcagcgaagaggtccgtgacatcaatcccatgtgagtacttagcatcctgcttgaactgctttaaatcagtacgtacttgggagtcggccat

SEQ ID NO: 427778 - DNA, 140 bp, Artificial Sequence
  Synthetic
atggccgactcccaagtacgtactgatttaaagcagttcaagcaggatgctaagtactcacatgggattgatgtcacggacctcttcgctgcacaaccgggcttgaccagtgctgtcattggagacccagcatggcgtat

SEQ ID NO: 427779 - DNA, 140 bp, Artificial Sequence
  Synthetic
aggccctggctgctgatatgtcatcctttgggttcacactgacatgcccaaaatccaatttgggttcaaggaatttttcgaagcacttaatttggtcagtcaatctgtcaggtgtttcttgaccttttgggacagcggtg

SEQ ID NO: 427780 - DNA, 140 bp, Artificial Sequence
  Synthetic
caccgctgtcccaaaaggtcaagaaacacctgacagattgactgaccaaattaagtgcttcgaaaaattccttgaacccaaattggattttgggcatgtcagtgtgaacccaaaggatgacatatcagcagccagggcct

SEQ ID NO: 427781 - DNA, 140 bp, Artificial Sequence
  Synthetic
aggccctggctgctgatatgaagatgctggcttgtgtcaaatggttcctacctgaatgagacacatttttctgatgacattgaacaacaagcagacaacatgataacagaactgttgcaagaccttttgggacagcggtg

SEQ ID NO: 427782 - DNA, 140 bp, Artificial Sequence
  Synthetic
caccgctgtcccaaaaggtcttgcaacagttctgttatcatgttgtctgcttgttgttcaatgtcatcagaaaaatgtgtctcattcaggtaggaaccatttgacacaagccagcatcttcatatcagcagccagggcct

SEQ ID NO: 427783 - DNA, 140 bp, Artificial Sequence
  Synthetic
aggccctggctgctgatatgctgatgacattgaacaacaagcagacaacatgataacagaactgttgcaaaaggagtacatagataggcaagggaaaacacccttagggttagtagatctgaccttttgggacagcggtg

SEQ ID NO: 427784 - DNA, 140 bp, Artificial Sequence
  Synthetic
caccgctgtcccaaaaggtcagatctactaaccctaagggtgttttcccttgcctatctatgtactccttttgcaacagttctgttatcatgttgtctgcttgttgttcaatgtcatcagcatatcagcagccagggcct

SEQ ID NO: 427785 - DNA, 140 bp, Artificial Sequence
  Synthetic
aggccctggctgctgatatgatattgagggtgtattgcagtctgcctgctgctgtctttctggttgctccctatactgactgataatattatcaacagtgcacctcagttggtcaaagtagaccttttgggacagcggtg

SEQ ID NO: 427786 - DNA, 140 bp, Artificial Sequence
  Synthetic
caccgctgtcccaaaaggtctactttgaccaactgaggtgcactgttgataatattatcagtcagtatagggagcaaccagaaagacagcagcaggcagactgcaatacaccctcaatatcatatcagcagccagggcct

SEQ ID NO: 427787 - DNA, 140 bp, Artificial Sequence
  Synthetic
atacgccatgctgggtctcctctcctgcacaaagaacaatagtcaccactacataagggtaggcaatgagacaggactagaactaaccttgaccaatacaagcatcatcgagcataggttcgtacttgggagtcggccat

SEQ ID NO: 427788 - DNA, 140 bp, Artificial Sequence
  Synthetic
atggccgactcccaagtacgaacctatgctcgatgatgcttgtattggtcaaggttagttctagtcctgtctcattgcctacccttatgtagtggtgactattgttctttgtgcaggagaggagacccagcatggcgtat

SEQ ID NO: 427789 - DNA, 140 bp, Artificial Sequence
  Synthetic
aggccctggctgctgatatgtattaaaactagacacaaggagtgagatgaacttcttggaaacaccaggctttttatacctaactttttccgcatctgcacaacattctttacttagaaagaccttttgggacagcggtg

SEQ ID NO: 427790 - DNA, 140 bp, Artificial Sequence
  Synthetic
caccgctgtcccaaaaggtctttctaagtaaagaatgttgtgcagatgcggaaaaagttaggtataaaaagcctggtgtttccaagaagttcatctcactccttgtgtctagttttaatacatatcagcagccagggcct

SEQ ID NO: 427791 - DNA, 140 bp, Artificial Sequence
  Synthetic
aggccctggctgctgatatgatccaccgttttagatctctttttgttgattccaatgaaactaatctatcgttaacactcacaaaacaggagcccagccaaccagcaaggagcttgtcacgaccttttgggacagcggtg

SEQ ID NO: 427792 - DNA, 140 bp, Artificial Sequence
  Synthetic
caccgctgtcccaaaaggtcgtgacaagctccttgctggttggctgggctcctgttttgtgagtgttaacgatagattagtttcattggaatcaacaaaaagagatctaaaacggtggatcatatcagcagccagggcct

SEQ ID NO: 427793 - DNA, 140 bp, Artificial Sequence
  Synthetic
aggccctggctgctgatatgccttcgggttcacacttacatgtccaaattccaatttgggttcaaggaatttttcaaagcatttgatctggtcagtcagtctgtcaggtgtttcttttgtgaccttttgggacagcggtg

SEQ ID NO: 427794 - DNA, 140 bp, Artificial Sequence
  Synthetic
caccgctgtcccaaaaggtcacaaaagaaacacctgacagactgactgaccagatcaaatgctttgaaaaattccttgaacccaaattggaatttggacatgtaagtgtgaacccgaaggcatatcagcagccagggcct

SEQ ID NO: 427795 - DNA, 140 bp, Artificial Sequence
  Synthetic
aggccctggctgctgatatgcacatcaatcccatgagaatatttggcatcttgcttaaactgttttaaatctgttggttctctgaagaaatgtatgtaacagcccgacataggttggtaagaccttttgggacagcggtg

SEQ ID NO: 427796 - DNA, 140 bp, Artificial Sequence
  Synthetic
caccgctgtcccaaaaggtcttaccaacctatgtcgggctgttacatacatttcttcagagaaccaacagatttaaaacagtttaagcaagatgccaaatattctcatgggattgatgtgcatatcagcagccagggcct

SEQ ID NO: 427797 - DNA, 140 bp, Artificial Sequence
  Synthetic
aggccctggctgctgatatgagggccagccgtcgccggaaagacagattttgtaaagtatgttctcgtaagggttcctctcaccaggtgtatctgaaacaaacattcctaaagatcttttgaccttttgggacagcggtg

SEQ ID NO: 427798 - DNA, 140 bp, Artificial Sequence
  Synthetic
caccgctgtcccaaaaggtcaaaagatctttaggaatgtttgtttcagatacacctggtgagaggaacccttacgagaacatactttacaaaatctgtctttccggcgacggctggccctcatatcagcagccagggcct

SEQ ID NO: 427799 - DNA, 140 bp, Artificial Sequence
  Synthetic
aggccctggctgctgatatgtcagcataaaaggaacaaacctctccaaccacattgttgttaatagcataacactttgagcattcacctgttttttgatataatagtttgaatcccatccgaccttttgggacagcggtg

SEQ ID NO: 427800 - DNA, 140 bp, Artificial Sequence
  Synthetic
caccgctgtcccaaaaggtcggatgggattcaaactattatatcaaaaaacaggtgaatgctcaaagtgttatgctattaacaacaatgtggttggagaggtttgttccttttatgctgacatatcagcagccagggcct

SEQ ID NO: 427801 - DNA, 140 bp, Artificial Sequence
  Synthetic
aggccctggctgctgatatgcttagtgtccaccatattcagtataggatggctttgggaaagtctgtctaggtcggagctatttggatacttagctgtgtatattagacccaggtctgttgaccttttgggacagcggtg

SEQ ID NO: 427802 - DNA, 140 bp, Artificial Sequence
  Synthetic
caccgctgtcccaaaaggtcaacagacctgggtctaatatacacagctaagtatccaaatagctccgacctagacagactttcccaaagccatcctatactgaatatggtggacactaagcatatcagcagccagggcct

SEQ ID NO: 427803 - DNA, 140 bp, Artificial Sequence
  Synthetic
aggccctggctgctgatatgctcaagctgctgtgtactcaaattccccatataaacacctgagcttagtggtctttctgttctaatgaccttcgactttagtttctctaagtcagctgccgaccttttgggacagcggtg

SEQ ID NO: 427804 - DNA, 140 bp, Artificial Sequence
  Synthetic
caccgctgtcccaaaaggtcggcagctgacttagagaaactaaagtcgaaggtcattagaacagaaagaccactaagctcaggtgtttatatggggaatttgagtacacagcagcttgagcatatcagcagccagggcct

SEQ ID NO: 427805 - DNA, 140 bp, Artificial Sequence
  Synthetic
atacgccatgctgggtctcctctattttatcacaatataactttttgaagtcctctaacagcttcatcttttcagtcttaacaaattgactctctatgtccccttgccttagtttgttcccgtacttgggagtcggccat

SEQ ID NO: 427806 - DNA, 140 bp, Artificial Sequence
  Synthetic
atggccgactcccaagtacgggaacaaactaaggcaaggggacatagagagtcaatttgttaagactgaaaagatgaagctgttagaggacttcaaaaagttatattgtgataaaatagaggagacccagcatggcgtat

SEQ ID NO: 427807 - DNA, 140 bp, Artificial Sequence
  Synthetic
atacgccatgctgggtctccgctgtacttctgtggcaaggctcatcttagtgaatccctgaatcaaagtgcctggtcaaaatgggcaacagacaggccaaatcagcaacagtcgatgaatcgtacttgggagtcggccat

SEQ ID NO: 427808 - DNA, 140 bp, Artificial Sequence
  Synthetic
atggccgactcccaagtacgattcatcgactgttgctgatttggcctgtctgttgcccattttgaccaggcactttgattcagggattcactaagatgagccttgccacagaagtacagcggagacccagcatggcgtat

SEQ ID NO: 427809 - DNA, 140 bp, Artificial Sequence
  Synthetic
atacgccatgctgggtctcctagcaaagctttctttaaaactagcatcttgacttttaatacggaacctcactgtctgactcagttttgcagaccctggaggcagtgaagctacggcatccgtacttgggagtcggccat

SEQ ID NO: 427810 - DNA, 140 bp, Artificial Sequence
  Synthetic
atggccgactcccaagtacggatgccgtagcttcactgcctccagggtctgcaaaactgagtcagacagtgaggttccgtattaaaagtcaagatgctagttttaaagaaagctttgctaggagacccagcatggcgtat

SEQ ID NO: 427811 - DNA, 140 bp, Artificial Sequence
  Synthetic
aggccctggctgctgatatgtgaaagcctctcatcctctaagaggtacctgctcacaagatctttgctctcggacagcaactcctccatcaccacacacttgttcctcagaagagagagtgaccttttgggacagcggtg

SEQ ID NO: 427812 - DNA, 140 bp, Artificial Sequence
  Synthetic
caccgctgtcccaaaaggtcactctctcttctgaggaacaagtgtgtggtgatggaggagttgctgtccgagagcaaagatcttgtgagcaggtacctcttagaggatgagaggctttcacatatcagcagccagggcct

SEQ ID NO: 427813 - DNA, 140 bp, Artificial Sequence
  Synthetic
atacgccatgctgggtctcctcaatacctaattattcagaacacaacttgggaagatcactgccaattctcaagaccatctcccattggttaccttgggctcctttcacaaaggaccagacgtacttgggagtcggccat

SEQ ID NO: 427814 - DNA, 140 bp, Artificial Sequence
  Synthetic
atggccgactcccaagtacgtctggtcctttgtgaaaggagcccaaggtaaccaatgggagatggtcttgagaattggcagtgatcttcccaagttgtgttctgaataattaggtattgaggagacccagcatggcgtat

SEQ ID NO: 427815 - DNA, 140 bp, Artificial Sequence
  Synthetic
atacgccatgctgggtctccatcctaggcatttaagattgcgcttttaggaatctttgtgtgggtgggcctcatcaagccatgggacaaatcataacatttttccatgaagtacctcatgcgtacttgggagtcggccat

SEQ ID NO: 427816 - DNA, 140 bp, Artificial Sequence
  Synthetic
atggccgactcccaagtacgcatgaggtacttcatggaaaaatgttatgatttgtcccatggcttgatgaggcccacccacacaaagattcctaaaagcgcaatcttaaatgcctaggatggagacccagcatggcgtat

SEQ ID NO: 427817 - DNA, 140 bp, Artificial Sequence
  Synthetic
aggccctggctgctgatatgaggtgcggggaactatcaccaatctctcttacaaacatttccaaatcttgatcttgtatggatggtgcaaatgtggccacccttctatcagattcccatagaccttttgggacagcggtg

SEQ ID NO: 427818 - DNA, 140 bp, Artificial Sequence
  Synthetic
caccgctgtcccaaaaggtctatgggaatctgatagaagggtggccacatttgcaccatccatacaagatcaagatttggaaatgtttgtaagagagattggtgatagttccccgcacctcatatcagcagccagggcct

SEQ ID NO: 427819 - DNA, 140 bp, Artificial Sequence
  Synthetic
atacgccatgctgggtctcccctgtgttggatttggatttgtgccaatatggcctgtgggtcagctggtgatgcccaaaaaagctcctacagaaatgagagacaatatgcctaggatcctcgtacttgggagtcggccat

SEQ ID NO: 427820 - DNA, 140 bp, Artificial Sequence
  Synthetic
atggccgactcccaagtacgaggatcctaggcatattgtctctcatttctgtaggagcttttttgggcatcaccagctgacccacaggccatattggcacaaatccaaatccaacacaggggagacccagcatggcgtat

SEQ ID NO: 427821 - DNA, 140 bp, Artificial Sequence
  Synthetic
aggccctggctgctgatatggggatcctaggcatttaggattgcgcatttagagatctttgtgtgattgggcttcaccaaatcatggggcaaatcataacattcttccaagaggtgcctcgaccttttgggacagcggtg

SEQ ID NO: 427822 - DNA, 140 bp, Artificial Sequence
  Synthetic
caccgctgtcccaaaaggtcgaggcacctcttggaagaatgttatgatttgccccatgatttggtgaagcccaatcacacaaagatctctaaatgcgcaatcctaaatgcctaggatccccatatcagcagccagggcct

SEQ ID NO: 427823 - DNA, 140 bp, Artificial Sequence
  Synthetic
atacgccatgctgggtctccgcttcaccaaatcatggggcaaatcataacattcttccaagaggtgcctcatgtcatagaggaggtcatgaacatcgtcctaatcgccctcagtctcctgcgtacttgggagtcggccat

SEQ ID NO: 427824 - DNA, 140 bp, Artificial Sequence
  Synthetic
atggccgactcccaagtacgcaggagactgagggcgattaggacgatgttcatgacctcctctatgacatgaggcacctcttggaagaatgttatgatttgccccatgatttggtgaagcggagacccagcatggcgtat

SEQ ID NO: 427825 - DNA, 140 bp, Artificial Sequence
  Synthetic
aggccctggctgctgatatgatgtcatagaggaggtcatgaacatcgtcctaatcgccctcagtctcctggcgatgctgaaagggatttacaatattgctacctgtggtctctttgggttgaccttttgggacagcggtg

SEQ ID NO: 427826 - DNA, 140 bp, Artificial Sequence
  Synthetic
caccgctgtcccaaaaggtcaacccaaagagaccacaggtagcaatattgtaaatccctttcagcatcgccaggagactgagggcgattaggacgatgttcatgacctcctctatgacatcatatcagcagccagggcct

SEQ ID NO: 427827 - DNA, 140 bp, Artificial Sequence
  Synthetic
aggccctggctgctgatatggtgtctatgagttacaagctctagagctggacatggcaaacctcaacatgacaatgcccttgtcctgcacgaagaacaatagccaccattatatcatggtgaccttttgggacagcggtg

SEQ ID NO: 427828 - DNA, 140 bp, Artificial Sequence
  Synthetic
caccgctgtcccaaaaggtcaccatgatataatggtggctattgttcttcgtgcaggacaagggcattgtcatgttgaggtttgccatgtccagctctagagcttgtaactcatagacaccatatcagcagccagggcct

SEQ ID NO: 427829 - DNA, 140 bp, Artificial Sequence
  Synthetic
atacgccatgctgggtctccacaatgcccttgtcctgcacgaagaacaatagccaccattatatcatggttggaaatgaaacaggcttggagctgaccttaacaaatacaagcatcataacgtacttgggagtcggccat

SEQ ID NO: 427830 - DNA, 140 bp, Artificial Sequence
  Synthetic
atggccgactcccaagtacgttatgatgcttgtatttgttaaggtcagctccaagcctgtttcatttccaaccatgatataatggtggctattgttcttcgtgcaggacaagggcattgtggagacccagcatggcgtat

SEQ ID NO: 427831 - DNA, 140 bp, Artificial Sequence
  Synthetic
aggccctggctgctgatatgcatgccttgatgagcatcatctcaaccttccacttatccattccaaacttcaatcagtatgaagcaatgagctgtgactttaatggagggaaaataagtggaccttttgggacagcggtg

SEQ ID NO: 427832 - DNA, 140 bp, Artificial Sequence
  Synthetic
caccgctgtcccaaaaggtccacttattttccctccattaaagtcacagctcattgcttcatactgattgaagtttggaatggataagtggaaggttgagatgatgctcatcaaggcatgcatatcagcagccagggcct

SEQ ID NO: 427833 - DNA, 140 bp, Artificial Sequence
  Synthetic
aggccctggctgctgatatggggaccattgccaatggtgtactgcagactttcatgaggatggcttggggtggcagttacatagcacttgattccggaaagggaaactgggattgtataagaccttttgggacagcggtg

SEQ ID NO: 427834 - DNA, 140 bp, Artificial Sequence
  Synthetic
caccgctgtcccaaaaggtcttatacaatcccagtttccctttccggaatcaagtgctatgtaactgccaccccaagccatcctcatgaaagtctgcagtacaccattggcaatggtccccatatcagcagccagggcct

SEQ ID NO: 427835 - DNA, 140 bp, Artificial Sequence
  Synthetic
aggccctggctgctgatatgcagaaggagtatatggagaggcaggggaagacaccattgggtctagttgacctctttgtgttcagcacaagtttctatctcattagcatcttccttcaccgaccttttgggacagcggtg

SEQ ID NO: 427836 - DNA, 140 bp, Artificial Sequence
  Synthetic
caccgctgtcccaaaaggtcggtgaaggaagatgctaatgagatagaaacttgtgctgaacacaaagaggtcaactagacccaatggtgtcttcccctgcctctccatatactccttctgcatatcagcagccagggcct

SEQ ID NO: 427837 - DNA, 140 bp, Artificial Sequence
  Synthetic
aggccctggctgctgatatgtgacttcctatcaatacttgataattcaaaacaccacttgggaggatcactgccagttttcccgcccatctccaattggttacctgggactattgtcacagaccttttgggacagcggtg

SEQ ID NO: 427838 - DNA, 140 bp, Artificial Sequence
  Synthetic
caccgctgtcccaaaaggtctgtgacaatagtcccaggtaaccaattggagatgggcgggaaaactggcagtgatcctcccaagtggtgttttgaattatcaagtattgataggaagtcacatatcagcagccagggcct

SEQ ID NO: 427839 - DNA, 140 bp, Artificial Sequence
  Synthetic
aggccctggctgctgatatgggaccctttctgattccgaaggcaacgaaacacctggtgggtactgtctaactagatggatgttaattgaagcagaactgaagtgctttgggaacacagcgaccttttgggacagcggtg

SEQ ID NO: 427840 - DNA, 140 bp, Artificial Sequence
  Synthetic
caccgctgtcccaaaaggtcgctgtgttcccaaagcacttcagttctgcttcaattaacatccatctagttagacagtacccaccaggtgtttcgttgccttcggaatcagaaagggtcccatatcagcagccagggcct

SEQ ID NO: 427841 - DNA, 140 bp, Artificial Sequence
  Synthetic
atacgccatgctgggtctccactagatggatgttaattgaagcagaactgaagtgctttgggaacacagcagtcgcaaagtgcaacgagaaacatgatgaagaattttgtgacatgttgacgtacttgggagtcggccat

SEQ ID NO: 427842 - DNA, 140 bp, Artificial Sequence
  Synthetic
atggccgactcccaagtacgtcaacatgtcacaaaattcttcatcatgtttctcgttgcactttgcgactgctgtgttcccaaagcacttcagttctgcttcaattaacatccatctagtggagacccagcatggcgtat

SEQ ID NO: 427843 - DNA, 140 bp, Artificial Sequence
  Synthetic
aggccctggctgctgatatgtggtcccagactgcattttcatacttcctggaatcagttttgctgagggcaatgtcaattagtttgatgtcttttcttccttgtgattcaaggagtttccgaccttttgggacagcggtg

SEQ ID NO: 427844 - DNA, 140 bp, Artificial Sequence
  Synthetic
caccgctgtcccaaaaggtcggaaactccttgaatcacaaggaagaaaagacatcaaactaattgacattgccctcagcaaaactgattccaggaagtatgaaaatgcagtctgggaccacatatcagcagccagggcct

SEQ ID NO: 427845 - DNA, 140 bp, Artificial Sequence
  Synthetic
atacgccatgctgggtctccccaattaatcatgaaaaaccacttaagggacatcatgggaattccttattgcaattacagtaaatattggtatctaaatcactctgtgacagggagaacacgtacttgggagtcggccat

SEQ ID NO: 427846 - DNA, 140 bp, Artificial Sequence
  Synthetic
atggccgactcccaagtacgtgttctccctgtcacagagtgatttagataccaatatttactgtaattgcaataaggaattcccatgatgtcccttaagtggtttttcatgattaattggggagacccagcatggcgtat

SEQ ID NO: 427847 - DNA, 140 bp, Artificial Sequence
  Synthetic
aggccctggctgctgatatgacaattttctgatgacattgaacaacaggcagacaacatgataacagaaatgttgcagaaagagtatatagacaggcagggaaaaacacccttagggttggaccttttgggacagcggtg

SEQ ID NO: 427848 - DNA, 140 bp, Artificial Sequence
  Synthetic
caccgctgtcccaaaaggtccaaccctaagggtgtttttccctgcctgtctatatactctttctgcaacatttctgttatcatgttgtctgcctgttgttcaatgtcatcagaaaattgtcatatcagcagccagggcct

SEQ ID NO: 427849 - DNA, 140 bp, Artificial Sequence
  Synthetic
aggccctggctgctgatatgccacctgatcaagatcccaactcacagacacatcgtagggaaaccctgtcctaagccgcacaggcttaaccatatgggcatttgctcatgtggtctatacgaccttttgggacagcggtg

SEQ ID NO: 427850 - DNA, 140 bp, Artificial Sequence
  Synthetic
caccgctgtcccaaaaggtcgtatagaccacatgagcaaatgcccatatggttaagcctgtgcggcttaggacagggtttccctacgatgtgtctgtgagttgggatcttgatcaggtggcatatcagcagccagggcct

SEQ ID NO: 427851 - DNA, 140 bp, Artificial Sequence
  Synthetic
atacgccatgctgggtctccctaagccgcacaggcttaaccatatgggcatttgctcatgtggtctatacaaacatcctggtatcccagtcaaatggaagagataggaggacccaccctccgtacttgggagtcggccat

SEQ ID NO: 427852 - DNA, 140 bp, Artificial Sequence
  Synthetic
atggccgactcccaagtacggagggtgggtcctcctatctcttccatttgactgggataccaggatgtttgtatagaccacatgagcaaatgcccatatggttaagcctgtgcggcttagggagacccagcatggcgtat

SEQ ID NO: 427853 - DNA, 140 bp, Artificial Sequence
  Synthetic
atacgccatgctgggtctccttacaggacgaccttggggcttgaggttctaaaaaccatgtctctgggaaggacagctctcagaactggtatgttgagccctcctgacactgctgcatcacgtacttgggagtcggccat

SEQ ID NO: 427854 - DNA, 140 bp, Artificial Sequence
  Synthetic
atggccgactcccaagtacgtgatgcagcagtgtcaggagggctcaacataccagttctgagagctgtccttcccagagacatggtttttagaacctcaagccccaaggtcgtcctgtaaggagacccagcatggcgtat

SEQ ID NO: 427855 - DNA, 140 bp, Artificial Sequence
  Synthetic
aggccctggctgctgatatgtcctcttttcttcttctcaacaactactccagtgtgcatatggcacaagtctttgcactggtcccaaacagcattttcaaactttctagagtcaatcttagaccttttgggacagcggtg

SEQ ID NO: 427856 - DNA, 140 bp, Artificial Sequence
  Synthetic
caccgctgtcccaaaaggtctaagattgactctagaaagtttgaaaatgctgtttgggaccagtgcaaagacttgtgccatatgcacactggagtagttgttgagaagaagaaaagaggacatatcagcagccagggcct

SEQ ID NO: 427857 - DNA, 140 bp, Artificial Sequence
  Synthetic
atacgccatgctgggtctccctttgcactggtcccaaacagcattttcaaactttctagagtcaatcttacttaatgaaatatcaatgagttttatgtcccttcttccttgagagtccagcgtacttgggagtcggccat

SEQ ID NO: 427858 - DNA, 140 bp, Artificial Sequence
  Synthetic
atggccgactcccaagtacgctggactctcaaggaagaagggacataaaactcattgatatttcattaagtaagattgactctagaaagtttgaaaatgctgtttgggaccagtgcaaagggagacccagcatggcgtat

SEQ ID NO: 427859 - DNA, 140 bp, Artificial Sequence
  Synthetic
aggccctggctgctgatatgctgatcaacaatcttttcaacagtctcctttagctgatcaaaataatcgcttgcacctccatcgagcaaaatttcgtctaggtcagccccatcagcatcagaccttttgggacagcggtg

SEQ ID NO: 427860 - DNA, 140 bp, Artificial Sequence
  Synthetic
caccgctgtcccaaaaggtctgatgctgatggggctgacctagacgaaattttgctcgatggaggtgcaagcgattattttgatcagctaaaggagactgttgaaaagattgttgatcagcatatcagcagccagggcct

SEQ ID NO: 427861 - DNA, 140 bp, Artificial Sequence
  Synthetic
aggccctggctgctgatatgtcaattgtttctgccaactgatggggttctttgcattttatgttatgtaaagctgcagcaacaaattttgttagcaagggtacctcgtcaccccaaacatgaccttttgggacagcggtg

SEQ ID NO: 427862 - DNA, 140 bp, Artificial Sequence
  Synthetic
caccgctgtcccaaaaggtcatgtttggggtgacgaggtacccttgctaacaaaatttgttgctgcagctttacataacataaaatgcaaagaaccccatcagttggcagaaacaattgacatatcagcagccagggcct

SEQ ID NO: 427863 - DNA, 140 bp, Artificial Sequence
  Synthetic
aggccctggctgctgatatgcagctgtgaataagtcaaccctgttggaaatcctgcagactgcaaagacttattggacccagcagttcccactttttgtggttttccatctgactctagagaccttttgggacagcggtg

SEQ ID NO: 427864 - DNA, 140 bp, Artificial Sequence
  Synthetic
caccgctgtcccaaaaggtctctagagtcagatggaaaaccacaaaaagtgggaactgctgggtccaataagtctttgcagtctgcaggatttccaacagggttgacttattcacagctgcatatcagcagccagggcct

SEQ ID NO: 427865 - DNA, 140 bp, Artificial Sequence
  Synthetic
atacgccatgctgggtctccacggcacccccaaccgaagctgcggacagcatcggacccccaccctacagtccctgaatccccaccgactcccaccaccctcacctccccccgacacccccgtacttgggagtcggccat

SEQ ID NO: 427866 - DNA, 140 bp, Artificial Sequence
  Synthetic
atggccgactcccaagtacgggggtgtcggggggaggtgagggtggtgggagtcggtggggattcagggactgtagggtgggggtccgatgctgtccgcagcttcggttgggggtgccgtggagacccagcatggcgtat

SEQ ID NO: 427867 - DNA, 140 bp, Artificial Sequence
  Synthetic
aggccctggctgctgatatgcttttactgcagcccccaagctaaaattgtaaccagaaatattcagggagctcttcttagtgtccaccatgtttagtattggatgactttgggaaagtctgaccttttgggacagcggtg

SEQ ID NO: 427868 - DNA, 140 bp, Artificial Sequence
  Synthetic
caccgctgtcccaaaaggtcagactttcccaaagtcatccaatactaaacatggtggacactaagaagagctccctgaatatttctggttacaattttagcttgggggctgcagtaaaagcatatcagcagccagggcct

SEQ ID NO: 427869 - DNA, 140 bp, Artificial Sequence
  Synthetic
atacgccatgctgggtctccctcttcttagtgtccaccatgtttagtattggatgactttgggaaagtctgtctaggtcagagctgtttgggtacttagctgtgtatatcagtcccaaatcgtacttgggagtcggccat

SEQ ID NO: 427870 - DNA, 140 bp, Artificial Sequence
  Synthetic
atggccgactcccaagtacgatttgggactgatatacacagctaagtacccaaacagctctgacctagacagactttcccaaagtcatccaatactaaacatggtggacactaagaagagggagacccagcatggcgtat

SEQ ID NO: 427871 - DNA, 140 bp, Artificial Sequence
  Synthetic
aggccctggctgctgatatgtgcaccatcaccttcccctttgacttgctataacagagagcataacctttgaactccacccagttgtccactgcctcaagaaccgcactcaagatcccctgaccttttgggacagcggtg

SEQ ID NO: 427872 - DNA, 140 bp, Artificial Sequence
  Synthetic
caccgctgtcccaaaaggtcaggggatcttgagtgcggttcttgaggcagtggacaactgggtggagttcaaaggttatgctctctgttatagcaagtcaaaggggaaggtgatggtgcacatatcagcagccagggcct

SEQ ID NO: 427873 - DNA, 140 bp, Artificial Sequence
  Synthetic
aggccctggctgctgatatgtcagactctggaactgaacatggaaacactcaatgcgaccatgcctctctcctgcacaaaaaacagcagtcatcattacataagggtgggcaatgagacagaccttttgggacagcggtg

SEQ ID NO: 427874 - DNA, 140 bp, Artificial Sequence
  Synthetic
caccgctgtcccaaaaggtctgtctcattgcccacccttatgtaatgatgactgctgttttttgtgcaggagagaggcatggtcgcattgagtgtttccatgttcagttccagagtctgacatatcagcagccagggcct

SEQ ID NO: 427875 - DNA, 140 bp, Artificial Sequence
  Synthetic
aggccctggctgctgatatgagacatgccaatgtcagactgggcatggtgccgaattgattgtttaagagatctggatttttgacatcccacaccctaacaaccccatctctcccaggttgaccttttgggacagcggtg

SEQ ID NO: 427876 - DNA, 140 bp, Artificial Sequence
  Synthetic
caccgctgtcccaaaaggtcaacctgggagagatggggttgttagggtgtgggatgtcaaaaatccagatctcttaaacaatcaattcggcaccatgcccagtctgacattggcatgtctcatatcagcagccagggcct

SEQ ID NO: 427877 - DNA, 140 bp, Artificial Sequence
  Synthetic
atacgccatgctgggtctccatctggatttttgacatcccacaccctaacaaccccatctctcccaggttgggtgccctgagttccaccagccatgccaatcatgttaagcaatgcccttcgtacttgggagtcggccat

SEQ ID NO: 427878 - DNA, 140 bp, Artificial Sequence
  Synthetic
atggccgactcccaagtacgaagggcattgcttaacatgattggcatggctggtggaactcagggcacccaacctgggagagatggggttgttagggtgtgggatgtcaaaaatccagatggagacccagcatggcgtat

SEQ ID NO: 427879 - DNA, 140 bp, Artificial Sequence
  Synthetic
aggccctggctgctgatatgcagtggtctctctgttctgatgacttttgacttcagtttttctaagtcagctgccaatgtcagcaagtcatctgaggtcagtgttccaactctcaggatggaccttttgggacagcggtg

SEQ ID NO: 427880 - DNA, 140 bp, Artificial Sequence
  Synthetic
caccgctgtcccaaaaggtccatcctgagagttggaacactgacctcagatgacttgctgacattggcagctgacttagaaaaactgaagtcaaaagtcatcagaacagagagaccactgcatatcagcagccagggcct

SEQ ID NO: 427881 - DNA, 140 bp, Artificial Sequence
  Synthetic
atacgccatgctgggtctccctgccaatgtcagcaagtcatctgaggtcagtgttccaactctcaggatgctcttttgttgtgttgatttgagttcaacaaggttgttgactgcctgattcgtacttgggagtcggccat

SEQ ID NO: 427882 - DNA, 140 bp, Artificial Sequence
  Synthetic
atggccgactcccaagtacgaatcaggcagtcaacaaccttgttgaactcaaatcaacacaacaaaagagcatcctgagagttggaacactgacctcagatgacttgctgacattggcagggagacccagcatggcgtat

SEQ ID NO: 427883 - DNA, 140 bp, Artificial Sequence
  Synthetic
atacgccatgctgggtctccgggatcctaggcaatttagctggacttcagtggtaaagttcattctagtgaatccctaaatcaaagtgtgtagccaaaatgggtaatagacaggccaaatcgtacttgggagtcggccat

SEQ ID NO: 427884 - DNA, 140 bp, Artificial Sequence
  Synthetic
atggccgactcccaagtacgatttggcctgtctattacccattttggctacacactttgatttagggattcactagaatgaactttaccactgaagtccagctaaattgcctaggatcccggagacccagcatggcgtat

SEQ ID NO: 427885 - DNA, 140 bp, Artificial Sequence
  Synthetic
aggccctggctgctgatatgttaggcgttggacattgttgacttcagagaagtcaaggccgtgaaggagggcttgggcatccttgacaacttgaagctttatgttggagcagtaacctgagaccttttgggacagcggtg

SEQ ID NO: 427886 - DNA, 140 bp, Artificial Sequence
  Synthetic
caccgctgtcccaaaaggtctcaggttactgctccaacataaagcttcaagttgtcaaggatgcccaagccctccttcacggccttgacttctctgaagtcaacaatgtccaacgcctaacatatcagcagccagggcct

SEQ ID NO: 427887 - DNA, 140 bp, Artificial Sequence
  Synthetic
aggccctggctgctgatatgtggaagcactcatcctgatctaagtatcctgaaatttactagttgaagtgtttcacccagtaaatcaataataggcgcaatccagtagcctaggatccacgaccttttgggacagcggtg

SEQ ID NO: 427888 - DNA, 140 bp, Artificial Sequence
  Synthetic
caccgctgtcccaaaaggtcgtggatcctaggctactggattgcgcctattattgatttactgggtgaaacacttcaactagtaaatttcaggatacttagatcaggatgagtgcttccacatatcagcagccagggcct

SEQ ID NO: 427889 - DNA, 140 bp, Artificial Sequence
  Synthetic
aggccctggctgctgatatgggtgggtcacgggggcgtccgtttacaggacgaccttggggcttgaggttctaaaaaccatgtctctgggaaggacagctctcagaactggtatgttgaggaccttttgggacagcggtg

SEQ ID NO: 427890 - DNA, 140 bp, Artificial Sequence
  Synthetic
caccgctgtcccaaaaggtcctcaacataccagttctgagagctgtccttcccagagacatggtttttagaacctcaagccccaaggtcgtcctgtaaacggacgcccccgtgacccacccatatcagcagccagggcct

SEQ ID NO: 427891 - DNA, 140 bp, Artificial Sequence
  Synthetic
atacgccatgctgggtctcccaagtgtcctttttgacatgggacaaatagtgacatttttccaagaagtgcctcatgtgatagaggaggtgatgaacattgtactcattgcactatccatcgtacttgggagtcggccat

SEQ ID NO: 427892 - DNA, 140 bp, Artificial Sequence
  Synthetic
atggccgactcccaagtacgatggatagtgcaatgagtacaatgttcatcacctcctctatcacatgaggcacttcttggaaaaatgtcactatttgtcccatgtcaaaaaggacacttgggagacccagcatggcgtat

SEQ ID NO: 427893 - DNA, 140 bp, Artificial Sequence
  Synthetic
aggccctggctgctgatatgcctcatgtgatagaggaggtgatgaacattgtactcattgcactatccatactagcagtgctgaagggtttgtacaatgttgcaacatgtggcctcattggaccttttgggacagcggtg

SEQ ID NO: 427894 - DNA, 140 bp, Artificial Sequence
  Synthetic
caccgctgtcccaaaaggtccaatgaggccacatgttgcaacattgtacaaacccttcagcactgctagtatggatagtgcaatgagtacaatgttcatcacctcctctatcacatgaggcatatcagcagccagggcct

SEQ ID NO: 427895 - DNA, 140 bp, Artificial Sequence
  Synthetic
atacgccatgctgggtctccactagcagtgctgaagggtttgtacaatgttgcaacatgtggcctcattggtctgattgccttcctcttgctgtgtggcaggtcctgcacaactactctccgtacttgggagtcggccat

SEQ ID NO: 427896 - DNA, 140 bp, Artificial Sequence
  Synthetic
atggccgactcccaagtacggagagtagttgtgcaggacctgccacacagcaagaggaaggcaatcagaccaatgaggccacatgttgcaacattgtacaaacccttcagcactgctagtggagacccagcatggcgtat

SEQ ID NO: 427897 - DNA, 140 bp, Artificial Sequence
  Synthetic
atacgccatgctgggtctcccaacatgaccatgcccctctcctgcacaaagaacaacagccatcactacataatggtaggaaataccacgggactagaactgaccttgaccaacacaagccgtacttgggagtcggccat

SEQ ID NO: 427898 - DNA, 140 bp, Artificial Sequence
  Synthetic
atggccgactcccaagtacggcttgtgttggtcaaggtcagttctagtcccgtggtatttcctaccattatgtagtgatggctgttgttctttgtgcaggagaggggcatggtcatgttgggagacccagcatggcgtat

SEQ ID NO: 427899 - DNA, 140 bp, Artificial Sequence
  Synthetic
aggccctggctgctgatatgtaatggtaggaaataccacgggactagaactgaccttgaccaacacaagcatcattgatcacaagttctgcaacttgtctgatgctcataaaaagaacctgaccttttgggacagcggtg

SEQ ID NO: 427900 - DNA, 140 bp, Artificial Sequence
  Synthetic
caccgctgtcccaaaaggtcaggttctttttatgagcatcagacaagttgcagaacttgtgatcaatgatgcttgtgttggtcaaggtcagttctagtcccgtggtatttcctaccattacatatcagcagccagggcct

SEQ ID NO: 427901 - DNA, 140 bp, Artificial Sequence
  Synthetic
atacgccatgctgggtctccccgagcgcaccatcaaccagggcgacccagaacacaacacctccaccgtataccccataatcccaggaccaacactcccacctccatcaccccccccccgcgtacttgggagtcggccat

SEQ ID NO: 427902 - DNA, 140 bp, Artificial Sequence
  Synthetic
atggccgactcccaagtacgcggggggggggtgatggaggtgggagtgttggtcctgggattatggggtatacggtggaggtgttgtgttctgggtcgccctggttgatggtgcgctcggggagacccagcatggcgtat

SEQ ID NO: 427903 - DNA, 140 bp, Artificial Sequence
  Synthetic
atacgccatgctgggtctccccaacttcaatcaatatgaagcaatgagctgtgacttcaacgggggaaagattagtgtgcagtacaatctaagtcatgcatatgctatagatgcggccaacgtacttgggagtcggccat

SEQ ID NO: 427904 - DNA, 140 bp, Artificial Sequence
  Synthetic
atggccgactcccaagtacgttggccgcatctatagcatatgcatgacttagattgtactgcacactaatctttcccccgttgaagtcacagctcattgcttcatattgattgaagttggggagacccagcatggcgtat

SEQ ID NO: 427905 - DNA, 140 bp, Artificial Sequence
  Synthetic
aggccctggctgctgatatgattagtgtgcagtacaatctaagtcatgcatatgctatagatgcggccaaccattgtggcacagttgcaaatggtgttctacagactttcatgaggatgggaccttttgggacagcggtg

SEQ ID NO: 427906 - DNA, 140 bp, Artificial Sequence
  Synthetic
caccgctgtcccaaaaggtcccatcctcatgaaagtctgtagaacaccatttgcaactgtgccacaatggttggccgcatctatagcatatgcatgacttagattgtactgcacactaatcatatcagcagccagggcct

SEQ ID NO: 427907 - DNA, 140 bp, Artificial Sequence
  Synthetic
aggccctggctgctgatatgctttgacacaggctatgtcctcctccatgtttggctgcaggtatgatggtcagatccctcagaacatgtggtttgctagagcaacagttcactatagaatgaccttttgggacagcggtg

SEQ ID NO: 427908 - DNA, 140 bp, Artificial Sequence
  Synthetic
caccgctgtcccaaaaggtcattctatagtgaactgttgctctagcaaaccacatgttctgagggatctgaccatcatacctgcagccaaacatggaggaggacatagcctgtgtcaaagcatatcagcagccagggcct

SEQ ID NO: 427909 - DNA, 140 bp, Artificial Sequence
  Synthetic
aggccctggctgctgatatgagatcactgccagttctcaagaccatctcccatcggttatcttggactcctctcacaaagaaccagagatatttacattagcagaagactactgggcacagaccttttgggacagcggtg

SEQ ID NO: 427910 - DNA, 140 bp, Artificial Sequence
  Synthetic
caccgctgtcccaaaaggtctgtgcccagtagtcttctgctaatgtaaatatctctggttctttgtgagaggagtccaagataaccgatgggagatggtcttgagaactggcagtgatctcatatcagcagccagggcct

SEQ ID NO: 427911 - DNA, 140 bp, Artificial Sequence
  Synthetic
atacgccatgctgggtctccctgtctgaccagatggatgttaattgaagctgagctgaagtgctttggcaacacagctgtagctaagtgtaatgaaaagcatgatgaagaattctgtgaccgtacttgggagtcggccat

SEQ ID NO: 427912 - DNA, 140 bp, Artificial Sequence
  Synthetic
atggccgactcccaagtacggtcacagaattcttcatcatgcttttcattacacttagctacagctgtgttgccaaagcacttcagctcagcttcaattaacatccatctggtcagacagggagacccagcatggcgtat

SEQ ID NO: 427913 - DNA, 140 bp, Artificial Sequence
  Synthetic
atacgccatgctgggtctcctcctcctgttgtgtggcaggtcttgcacaaccagcctttacaaaggggtttatgagcttcagactctggaactaaacatggaaacactcaatatgaccatcgtacttgggagtcggccat

SEQ ID NO: 427914 - DNA, 140 bp, Artificial Sequence
  Synthetic
atggccgactcccaagtacgatggtcatattgagtgtttccatgtttagttccagagtctgaagctcataaacccctttgtaaaggctggttgtgcaagacctgccacacaacaggaggaggagacccagcatggcgtat

SEQ ID NO: 427915 - DNA, 140 bp, Artificial Sequence
  Synthetic
atacgccatgctgggtctcctgaggcacaaatgagcattcagttgatcaacaaggcagtgaatgccctgataaatgaccaactgataatgaaaaaccatcttcgggatatcatgggaatacgtacttgggagtcggccat

SEQ ID NO: 427916 - DNA, 140 bp, Artificial Sequence
  Synthetic
atggccgactcccaagtacgtattcccatgatatcccgaagatggtttttcattatcagttggtcatttatcagggcattcactgccttgttgatcaactgaatgctcatttgtgcctcaggagacccagcatggcgtat

SEQ ID NO: 427917 - DNA, 140 bp, Artificial Sequence
  Synthetic
aggccctggctgctgatatgtaaatgaccaactgataatgaaaaaccatcttcgggatatcatgggaataccatactgcaactacagcaagtactggtatctcaaccatacgactactgggaccttttgggacagcggtg

SEQ ID NO: 427918 - DNA, 140 bp, Artificial Sequence
  Synthetic
caccgctgtcccaaaaggtcccagtagtcgtatggttgagataccagtacttgctgtagttgcagtatggtattcccatgatatcccgaagatggtttttcattatcagttggtcatttacatatcagcagccagggcct

SEQ ID NO: 427919 - DNA, 140 bp, Artificial Sequence
  Synthetic
atacgccatgctgggtctcctcttccttcatctggtcaaaataccaactcatagacatattataggcaaaccatgtcctaagccacatagactaaatcacatgggcatatgctcctgtggcgtacttgggagtcggccat

SEQ ID NO: 427920 - DNA, 140 bp, Artificial Sequence
  Synthetic
atggccgactcccaagtacgccacaggagcatatgcccatgtgatttagtctatgtggcttaggacatggtttgcctataatatgtctatgagttggtattttgaccagatgaaggaagaggagacccagcatggcgtat

SEQ ID NO: 427921 - DNA, 140 bp, Artificial Sequence
  Synthetic
aggccctggctgctgatatgactctataagcaacccggtgtgcctgtgaagtggaaaagataggacccttgacagggcccccgtgacccaccgcctgttggcggtgggtcacgggggcgtgaccttttgggacagcggtg

SEQ ID NO: 427922 - DNA, 140 bp, Artificial Sequence
  Synthetic
caccgctgtcccaaaaggtcacgcccccgtgacccaccgccaacaggcggtgggtcacgggggccctgtcaagggtcctatcttttccacttcacaggcacaccgggttgcttatagagtcatatcagcagccagggcct

SEQ ID NO: 427923 - DNA, 140 bp, Artificial Sequence
  Synthetic
aggccctggctgctgatatggcctgttttggttcaccgagcacccatgctccaagttctatagctgtagatagtgttatacacatataatcccatagaagaggtcttaaataagtaacaagaccttttgggacagcggtg

SEQ ID NO: 427924 - DNA, 140 bp, Artificial Sequence
  Synthetic
caccgctgtcccaaaaggtcttgttacttatttaagacctcttctatgggattatatgtgtataacactatctacagctatagaacttggagcatgggtgctcggtgaaccaaaacaggccatatcagcagccagggcct

SEQ ID NO: 427925 - DNA, 140 bp, Artificial Sequence
  Synthetic
atacgccatgctgggtctccatcaaacataatgcaatccattagagcacagtgtggggttatttcctctttgccacctcttttcttcttttcaacaacaactcctgtatgcatatggcatcgtacttgggagtcggccat

SEQ ID NO: 427926 - DNA, 140 bp, Artificial Sequence
  Synthetic
atggccgactcccaagtacgatgccatatgcatacaggagttgttgttgaaaagaagaaaagaggtggcaaagaggaaataaccccacactgtgctctaatggattgcattatgtttgatggagacccagcatggcgtat

SEQ ID NO: 427927 - DNA, 140 bp, Artificial Sequence
  Synthetic
atacgccatgctgggtctccaaatctttatattggtcccaaactgcattttcatactttctagagtcaactttgctgagggcaatgtcaattagtttaatatcttttcttccttgtgattcgtacttgggagtcggccat

SEQ ID NO: 427928 - DNA, 140 bp, Artificial Sequence
  Synthetic
atggccgactcccaagtacgaatcacaaggaagaaaagatattaaactaattgacattgccctcagcaaagttgactctagaaagtatgaaaatgcagtttgggaccaatataaagatttggagacccagcatggcgtat

SEQ ID NO: 427929 - DNA, 140 bp, Artificial Sequence
  Synthetic
aggccctggctgctgatatgccggctagcaagaagaatcagaacgtcaaaaatgaggagaagtttcctcctggtgttgaggatcctcagagactttatcttatttagaaaagatctccaagaccttttgggacagcggtg

SEQ ID NO: 427930 - DNA, 140 bp, Artificial Sequence
  Synthetic
caccgctgtcccaaaaggtcttggagatcttttctaaataagataaagtctctgaggatcctcaacaccaggaggaaacttctcctcatttttgacgttctgattcttcttgctagccggcatatcagcagccagggcct

SEQ ID NO: 427931 - DNA, 140 bp, Artificial Sequence
  Synthetic
aggccctggctgctgatatgtggtgttgaggatcctcagagactttatcttatttagaaaagatctccaacactgcatctgttcactttgagagtcagcagccctttccttaccagaatcgaccttttgggacagcggtg

SEQ ID NO: 427932 - DNA, 140 bp, Artificial Sequence
  Synthetic
caccgctgtcccaaaaggtcgattctggtaaggaaagggctgctgactctcaaagtgaacagatgcagtgttggagatcttttctaaataagataaagtctctgaggatcctcaacaccacatatcagcagccagggcct

SEQ ID NO: 427933 - DNA, 140 bp, Artificial Sequence
  Synthetic
atacgccatgctgggtctcccactgcatctgttcactttgagagtcagcagccctttccttaccagaatccaaatctgcatacaagaacttaaggactggagaggctcttcggaactgaacgtacttgggagtcggccat

SEQ ID NO: 427934 - DNA, 140 bp, Artificial Sequence
  Synthetic
atggccgactcccaagtacgttcagttccgaagagcctctccagtccttaagttcttgtatgcagatttggattctggtaaggaaagggctgctgactctcaaagtgaacagatgcagtgggagacccagcatggcgtat

SEQ ID NO: 427935 - DNA, 140 bp, Artificial Sequence
  Synthetic
atacgccatgctgggtctcccatccaagtcttggcatttggatcaagctgcagcattgtatccttgagagtcatgagttgagaataagtgagcccagcagtgaaccctgctgactggaggcgtacttgggagtcggccat

SEQ ID NO: 427936 - DNA, 140 bp, Artificial Sequence
  Synthetic
atggccgactcccaagtacgcctccagtcagcagggttcactgctgggctcacttattctcaactcatgactctcaaggatacaatgctgcagcttgatccaaatgccaagacttggatgggagacccagcatggcgtat

SEQ ID NO: 427937 - DNA, 140 bp, Artificial Sequence
  Synthetic
aggccctggctgctgatatgcctcttctgaatttgattacatagatcaactgggacaccattagccacagattgatcaattatagtatcaattgtttctgccaattggtggggttctttggaccttttgggacagcggtg

SEQ ID NO: 427938 - DNA, 140 bp, Artificial Sequence
  Synthetic
caccgctgtcccaaaaggtccaaagaaccccaccaattggcagaaacaattgatactataattgatcaatctgtggctaatggtgtcccagttgatctatgtaatcaaattcagaagaggcatatcagcagccagggcct

SEQ ID NO: 427939 - DNA, 140 bp, Artificial Sequence
  Synthetic
aggccctggctgctgatatggtgataccttgattgtctccagcatgttgccaccatctagcatacaggctcctgctttcacagctgcacccaagctaaaattgtagcctgagatgttcaggaccttttgggacagcggtg

SEQ ID NO: 427940 - DNA, 140 bp, Artificial Sequence
  Synthetic
caccgctgtcccaaaaggtcctgaacatctcaggctacaattttagcttgggtgcagctgtgaaagcaggagcctgtatgctagatggtggcaacatgctggagacaatcaaggtatcaccatatcagcagccagggcct

SEQ ID NO: 427941 - DNA, 140 bp, Artificial Sequence
  Synthetic
atacgccatgctgggtctccgcctgtctaagtctgaggtgttggggtactttgctgtgtagatcagacccaaatctgttagtgcctgtactacatcattcaagtcaacttgtccttgtttcgtacttgggagtcggccat

SEQ ID NO: 427942 - DNA, 140 bp, Artificial Sequence
  Synthetic
atggccgactcccaagtacgaaacaaggacaagttgacttgaatgatgtagtacaggcactaacagatttgggtctgatctacacagcaaagtaccccaacacctcagacttagacaggcggagacccagcatggcgtat

SEQ ID NO: 427943 - DNA, 140 bp, Artificial Sequence
  Synthetic
aggccctggctgctgatatgaaatctgttagtgcctgtactacatcattcaagtcaacttgtccttgttttgttaaacatgccaatgtcagacttggcatggtgccgaactgattgttaagaccttttgggacagcggtg

SEQ ID NO: 427944 - DNA, 140 bp, Artificial Sequence
  Synthetic
caccgctgtcccaaaaggtcttaacaatcagttcggcaccatgccaagtctgacattggcatgtttaacaaaacaaggacaagttgacttgaatgatgtagtacaggcactaacagatttcatatcagcagccagggcct

SEQ ID NO: 427945 - DNA, 140 bp, Artificial Sequence
  Synthetic
atacgccatgctgggtctccgcctgagcccctcgactgccaccagtcattcctatcatatttagaagagctcgtctttggtcaagttgctgtgagctcaggttgcccatgtaaacacctgcgtacttgggagtcggccat

SEQ ID NO: 427946 - DNA, 140 bp, Artificial Sequence
  Synthetic
atggccgactcccaagtacgcaggtgtttacatgggcaacctgagctcacagcaacttgaccaaagacgagctcttctaaatatgataggaatgactggtggcagtcgaggggctcaggcggagacccagcatggcgtat

SEQ ID NO: 427947 - DNA, 140 bp, Artificial Sequence
  Synthetic
aggccctggctgctgatatgtcgtctttggtcaagttgctgtgagctcaggttgcccatgtaaacacctgcgctcaaaggcctttctgttctggtcacttttgattttagtttctcaagggaccttttgggacagcggtg

SEQ ID NO: 427948 - DNA, 140 bp, Artificial Sequence
  Synthetic
caccgctgtcccaaaaggtcccttgagaaactaaaatcaaaagtgaccagaacagaaaggcctttgagcgcaggtgtttacatgggcaacctgagctcacagcaacttgaccaaagacgacatatcagcagccagggcct

SEQ ID NO: 427949 - DNA, 140 bp, Artificial Sequence
  Synthetic
aggccctggctgctgatatgtagcaatgtcttcctccatcgccaactgtggcacctgtgttggttttgggtttgtgtcaatatgacttgtaggtcagctggtaatgccccacaaaagctcgaccttttgggacagcggtg

SEQ ID NO: 427950 - DNA, 140 bp, Artificial Sequence
  Synthetic
caccgctgtcccaaaaggtcgagcttttgtggggcattaccagctgacctacaagtcatattgacacaaacccaaaaccaacacaggtgccacagttggcgatggaggaagacattgctacatatcagcagccagggcct

SEQ ID NO: 427951 - DNA, 140 bp, Artificial Sequence
  Synthetic
atacgccatgctgggtctcctacactcttttgctgagtagatttcagctcaacaaggttgttcactgcttggtttaaatccctcaaccgttttagatcattatcatccctcctttgtttgcgtacttgggagtcggccat

SEQ ID NO: 427952 - DNA, 140 bp, Artificial Sequence
  Synthetic
atggccgactcccaagtacgcaaacaaaggagggatgataatgatctaaaacggttgagggatttaaaccaagcagtgaacaaccttgttgagctgaaatctactcagcaaaagagtgtaggagacccagcatggcgtat

SEQ ID NO: 427953 - DNA, 140 bp, Artificial Sequence
  Synthetic
aggccctggctgctgatatgatggggcaaatagtaacatttttccaggaagttcctcatgtgatagaggaagtgatgaacattgtactcatcgcattgtctatactagcagtgctaaaaggaccttttgggacagcggtg

SEQ ID NO: 427954 - DNA, 140 bp, Artificial Sequence
  Synthetic
caccgctgtcccaaaaggtccttttagcactgctagtatagacaatgcgatgagtacaatgttcatcacttcctctatcacatgaggaacttcctggaaaaatgttactatttgccccatcatatcagcagccagggcct

SEQ ID NO: 427955 - DNA, 140 bp, Artificial Sequence
  Synthetic
atacgccatgctgggtctccaagagcctgggcatccttcaccacctgtagtttgatgttggaacaatagccagataattctctcctcaaggattgtgtccataggaaggactttatctcccgtacttgggagtcggccat

SEQ ID NO: 427956 - DNA, 140 bp, Artificial Sequence
  Synthetic
atggccgactcccaagtacgggagataaagtccttcctatggacacaatccttgaggagagaattatctggctattgttccaacatcaaactacaggtggtgaaggatgcccaggctcttggagacccagcatggcgtat

SEQ ID NO: 427957 - DNA, 140 bp, Artificial Sequence
  Synthetic
atacgccatgctgggtctccctgttgtgcggtagatcttgcacaaccactctctacaaaggagtctatgagcttcaggctctggaattaaacatggagacactcaatatgaccatgcctccgtacttgggagtcggccat

SEQ ID NO: 427958 - DNA, 140 bp, Artificial Sequence
  Synthetic
atggccgactcccaagtacggaggcatggtcatattgagtgtctccatgtttaattccagagcctgaagctcatagactcctttgtagagagtggttgtgcaagatctaccgcacaacagggagacccagcatggcgtat

SEQ ID NO: 427959 - DNA, 140 bp, Artificial Sequence
  Synthetic
aggccctggctgctgatatggcttcaggctctggaattaaacatggagacactcaatatgaccatgcctctctcctgcacaaagaacaacagtcaccattatataagggtaggcaatgacgaccttttgggacagcggtg

SEQ ID NO: 427960 - DNA, 140 bp, Artificial Sequence
  Synthetic
caccgctgtcccaaaaggtcgtcattgcctacccttatataatggtgactgttgttctttgtgcaggagagaggcatggtcatattgagtgtctccatgtttaattccagagcctgaagccatatcagcagccagggcct

SEQ ID NO: 427961 - DNA, 140 bp, Artificial Sequence
  Synthetic
aggccctggctgctgatatgcctttgaggcactcatcgccagattattgtgttgaatgcacgcaacaaaaagctgagactatcttccaaagtgataaaagcaaagcgcaatccaatagccgaccttttgggacagcggtg

SEQ ID NO: 427962 - DNA, 140 bp, Artificial Sequence
  Synthetic
caccgctgtcccaaaaggtcggctattggattgcgctttgcttttatcactttggaagatagtctcagctttttgttgcgtgcattcaacacaataatctggcgatgagtgcctcaaaggcatatcagcagccagggcct

SEQ ID NO: 427963 - DNA, 140 bp, Artificial Sequence
  Synthetic
atacgccatgctgggtctccgaccggggatcctaggcaattttgtggatctttgctgatacttcattctgcactcaaagccgcatccggcaagagtcatggggaaaacgcagtccaagggcgtacttgggagtcggccat

SEQ ID NO: 427964 - DNA, 140 bp, Artificial Sequence
  Synthetic
atggccgactcccaagtacgcccttggactgcgttttccccatgactcttgccggatgcggctttgagtgcagaatgaagtatcagcaaagatccacaaaattgcctaggatccccggtcggagacccagcatggcgtat

SEQ ID NO: 427965 - DNA, 140 bp, Artificial Sequence
  Synthetic
atacgccatgctgggtctcccaaatggtgttctgcaaactttcatgagaatggcttggggtgggagctatattgctcttgactctggtcgtggcaattgggactgtatcatgactagttacgtacttgggagtcggccat

SEQ ID NO: 427966 - DNA, 140 bp, Artificial Sequence
  Synthetic
atggccgactcccaagtacgtaactagtcatgatacagtcccaattgccacgaccagagtcaagagcaatatagctcccaccccaagccattctcatgaaagtttgcagaacaccatttgggagacccagcatggcgtat

SEQ ID NO: 427967 - DNA, 140 bp, Artificial Sequence
  Synthetic
aggccctggctgctgatatgattgctcttgactctggtcgtggcaattgggactgtatcatgactagttaccaatatctgataattcagaatacaacctgggaggatcattgccaattctgaccttttgggacagcggtg

SEQ ID NO: 427968 - DNA, 140 bp, Artificial Sequence
  Synthetic
caccgctgtcccaaaaggtcagaattggcaatgatcctcccaggttgtattctgaattatcagatattggtaactagtcatgatacagtcccaattgccacgaccagagtcaagagcaatcatatcagcagccagggcct

SEQ ID NO: 427969 - DNA, 140 bp, Artificial Sequence
  Synthetic
atacgccatgctgggtctccgatatttacattagtagaaggctactgggtacattcacatggacattgtcagactccgaaggcagagacacaccaggagggtactgtctgaccagatggacgtacttgggagtcggccat

SEQ ID NO: 427970 - DNA, 140 bp, Artificial Sequence
  Synthetic
atggccgactcccaagtacgtccatctggtcagacagtaccctcctggtgtgtctctgccttcggagtctgacaatgtccatgtgaatgtacccagtagccttctactaatgtaaatatcggagacccagcatggcgtat

SEQ ID NO: 427971 - DNA, 140 bp, Artificial Sequence
  Synthetic
aggccctggctgctgatatgagactccgaaggcagagacacaccaggagggtactgtctgaccagatggatgttaattgaggctgaactaaaatgctttggtaacacagctgtagcaaaagaccttttgggacagcggtg

SEQ ID NO: 427972 - DNA, 140 bp, Artificial Sequence
  Synthetic
caccgctgtcccaaaaggtcttttgctacagctgtgttaccaaagcattttagttcagcctcaattaacatccatctggtcagacagtaccctcctggtgtgtctctgccttcggagtctcatatcagcagccagggcct

SEQ ID NO: 427973 - DNA, 140 bp, Artificial Sequence
  Synthetic
atacgccatgctgggtctcccttcaacaaacaggccatccaaagattgaaaactgaagcacaaatgagcatccagttgatcaacaaagcagtgaatgctttgataaatgaccaactaatccgtacttgggagtcggccat

SEQ ID NO: 427974 - DNA, 140 bp, Artificial Sequence
  Synthetic
atggccgactcccaagtacggattagttggtcatttatcaaagcattcactgctttgttgatcaactggatgctcatttgtgcttcagttttcaatctttggatggcctgtttgttgaagggagacccagcatggcgtat

SEQ ID NO: 427975 - DNA, 140 bp, Artificial Sequence
  Synthetic
aggccctggctgctgatatgtccagttgatcaacaaagcagtgaatgctttgataaatgaccaactaatcatgaagaaccatttgcgggacatcatggggattccatactgcaattacaggaccttttgggacagcggtg

SEQ ID NO: 427976 - DNA, 140 bp, Artificial Sequence
  Synthetic
caccgctgtcccaaaaggtcctgtaattgcagtatggaatccccatgatgtcccgcaaatggttcttcatgattagttggtcatttatcaaagcattcactgctttgttgatcaactggacatatcagcagccagggcct

SEQ ID NO: 427977 - DNA, 140 bp, Artificial Sequence
  Synthetic
aggccctggctgctgatatgacaaagcagtgaacgcactgatcaatgaccagctcattatgaagaatcatttaagagatatcatgggaattccttactgcaattacagcaagtattggtagaccttttgggacagcggtg

SEQ ID NO: 427978 - DNA, 140 bp, Artificial Sequence
  Synthetic
caccgctgtcccaaaaggtctaccaatacttgctgtaattgcagtaaggaattcccatgatatctcttaaatgattcttcataatgagctggtcattgatcagtgcgttcactgctttgtcatatcagcagccagggcct

SEQ ID NO: 427979 - DNA, 140 bp, Artificial Sequence
  Synthetic
atacgccatgctgggtctccaatgctggcttgtgtccaacggttcatatctaaatgagacccatttctctgatgacattgagcaagaagccgacaatatgatcactgagatgttgcaaaacgtacttgggagtcggccat

SEQ ID NO: 427980 - DNA, 140 bp, Artificial Sequence
  Synthetic
atggccgactcccaagtacgttttgcaacatctcagtgatcatattgtcggcttcttgctcaatgtcatcagagaaatgggtctcatttagatatgaaccgttggacacaagccagcattggagacccagcatggcgtat

SEQ ID NO: 427981 - DNA, 140 bp, Artificial Sequence
  Synthetic
atacgccatgctgggtctccttgtttttagtacaagtttctatcttattagcatcttcctccacctagtcaaaataccaacccataggcatattgtaggtaaaccgtgtcccaaacctcacgtacttgggagtcggccat

SEQ ID NO: 427982 - DNA, 140 bp, Artificial Sequence
  Synthetic
atggccgactcccaagtacgtgaggtttgggacacggtttacctacaatatgcctatgggttggtattttgactaggtggaggaagatgctaataagatagaaacttgtactaaaaacaaggagacccagcatggcgtat

SEQ ID NO: 427983 - DNA, 140 bp, Artificial Sequence
  Synthetic
aggccctggctgctgatatgaaaataccaacccataggcatattgtaggtaaaccgtgtcccaaacctcacaggctaaaccacatgggagtatgctcttgtggactctacaaacaacccggaccttttgggacagcggtg

SEQ ID NO: 427984 - DNA, 140 bp, Artificial Sequence
  Synthetic
caccgctgtcccaaaaggtccgggttgtttgtagagtccacaagagcatactcccatgtggtttagcctgtgaggtttgggacacggtttacctacaatatgcctatgggttggtattttcatatcagcagccagggcct

SEQ ID NO: 427985 - DNA, 140 bp, Artificial Sequence
  Synthetic
aggccctggctgctgatatgccaccgcctgttggcggtgggtcacgggggcgtccatttacaggacgaccttaggtgttgatgttctaaacaccatgtctctgggcaacactgctctcaggaccttttgggacagcggtg

SEQ ID NO: 427986 - DNA, 140 bp, Artificial Sequence
  Synthetic
caccgctgtcccaaaaggtcctgagagcagtgttgcccagagacatggtgtttagaacatcaacacctaaggtcgtcctgtaaatggacgcccccgtgacccaccgccaacaggcggtggcatatcagcagccagggcct

SEQ ID NO: 427987 - DNA, 140 bp, Artificial Sequence
  Synthetic
atacgccatgctgggtctccccattaaagcacagtgaggggttatttcctctttgccacctcttttcttcttttcaacaacgacacccgtgtgcatgtggcacaggtccttatattgatccgtacttgggagtcggccat

SEQ ID NO: 427988 - DNA, 140 bp, Artificial Sequence
  Synthetic
atggccgactcccaagtacggatcaatataaggacctgtgccacatgcacacgggtgtcgttgttgaaaagaagaaaagaggtggcaaagaggaaataacccctcactgtgctttaatggggagacccagcatggcgtat

SEQ ID NO: 427989 - DNA, 140 bp, Artificial Sequence
  Synthetic
aggccctggctgctgatatgttttcaacaacgacacccgtgtgcatgtggcacaggtccttatattgatcccaaactgcattttcatactttctggaatcaatcttgctgagggcaatgtgaccttttgggacagcggtg

SEQ ID NO: 427990 - DNA, 140 bp, Artificial Sequence
  Synthetic
caccgctgtcccaaaaggtcacattgccctcagcaagattgattccagaaagtatgaaaatgcagtttgggatcaatataaggacctgtgccacatgcacacgggtgtcgttgttgaaaacatatcagcagccagggcct

SEQ ID NO: 427991 - DNA, 140 bp, Artificial Sequence
  Synthetic
atacgccatgctgggtctcctcgtcagatccctgacaagtgataaccatgttccggggaagtgcttctatgacagcactggtcaagcctggctgtgcagcaaagaggtctgtgacatcaacgtacttgggagtcggccat

SEQ ID NO: 427992 - DNA, 140 bp, Artificial Sequence
  Synthetic
atggccgactcccaagtacgttgatgtcacagacctctttgctgcacagccaggcttgaccagtgctgtcatagaagcacttccccggaacatggttatcacttgtcagggatctgacgaggagacccagcatggcgtat

SEQ ID NO: 427993 - DNA, 140 bp, Artificial Sequence
  Synthetic
aggccctggctgctgatatggacagcactggtcaagcctggctgtgcagcaaagaggtctgtgacatcaattccatgtgagtacttggcatcctgcttgaactgcttcaaatcagtaggtgaccttttgggacagcggtg

SEQ ID NO: 427994 - DNA, 140 bp, Artificial Sequence
  Synthetic
caccgctgtcccaaaaggtcacctactgatttgaagcagttcaagcaggatgccaagtactcacatggaattgatgtcacagacctctttgctgcacagccaggcttgaccagtgctgtccatatcagcagccagggcct

SEQ ID NO: 427995 - DNA, 140 bp, Artificial Sequence
  Synthetic
atacgccatgctgggtctccttccaccggatcttcaggtctcccttcaatgtccatccaggtcttagcatttggatcaagttgcagcattgcatctttgagggtcataagctgagaatagcgtacttgggagtcggccat

SEQ ID NO: 427996 - DNA, 140 bp, Artificial Sequence
  Synthetic
atggccgactcccaagtacgctattctcagcttatgaccctcaaagatgcaatgctgcaacttgatccaaatgctaagacctggatggacattgaagggagacctgaagatccggtggaaggagacccagcatggcgtat

SEQ ID NO: 427997 - DNA, 140 bp, Artificial Sequence
  Synthetic
aggccctggctgctgatatgttggatcaagttgcagcattgcatctttgagggtcataagctgagaataggtgagtccagcagtgaaccctgccgactgtagggatttattggaactgttgaccttttgggacagcggtg

SEQ ID NO: 427998 - DNA, 140 bp, Artificial Sequence
  Synthetic
caccgctgtcccaaaaggtcaacagttccaataaatccctacagtcggcagggttcactgctggactcacctattctcagcttatgaccctcaaagatgcaatgctgcaacttgatccaacatatcagcagccagggcct

SEQ ID NO: 427999 - DNA, 140 bp, Artificial Sequence
  Synthetic
atacgccatgctgggtctcctttcccaagccctccctgttattgaagtcctcgatgcaatgtatggccatccgtcccctgacaaacaaatcttgtagagtatgttttcataaggattcctcgtacttgggagtcggccat

SEQ ID NO: 428000 - DNA, 140 bp, Artificial Sequence
  Synthetic
atggccgactcccaagtacgaggaatccttatgaaaacatactctacaagatttgtttgtcaggggacggatggccatacattgcatcgaggacttcaataacagggagggcttgggaaaggagacccagcatggcgtat

SEQ ID NO: 428001 - DNA, 140 bp, Artificial Sequence
  Synthetic
aggccctggctgctgatatgccgtcccctgacaaacaaatcttgtagagtatgttttcataaggattcctttcgccaggggtgtctgaaatgaacatccctagagcctttttaacttttagaccttttgggacagcggtg

SEQ ID NO: 428002 - DNA, 140 bp, Artificial Sequence
  Synthetic
caccgctgtcccaaaaggtctaaaagttaaaaaggctctagggatgttcatttcagacacccctggcgaaaggaatccttatgaaaacatactctacaagatttgtttgtcaggggacggcatatcagcagccagggcct

SEQ ID NO: 428003 - DNA, 140 bp, Artificial Sequence
  Synthetic
atacgccatgctgggtctcctctaacatgttaccaccatctagcatacaggctcctgctttcacagcggcacccaagctaaaattgtaacctgagatgttcaaggagctcttcttggtgtcgtacttgggagtcggccat

SEQ ID NO: 428004 - DNA, 140 bp, Artificial Sequence
  Synthetic
atggccgactcccaagtacgacaccaagaagagctccttgaacatctcaggttacaattttagcttgggtgccgctgtgaaagcaggagcctgtatgctagatggtggtaacatgttagaggagacccagcatggcgtat

SEQ ID NO: 428005 - DNA, 140 bp, Artificial Sequence
  Synthetic
aggccctggctgctgatatgacccaagctaaaattgtaacctgagatgttcaaggagctcttcttggtgtctatcatgttcagaatggggtggctctgagttagcctgtctaagtctgaagaccttttgggacagcggtg

SEQ ID NO: 428006 - DNA, 140 bp, Artificial Sequence
  Synthetic
caccgctgtcccaaaaggtcttcagacttagacaggctaactcagagccaccccattctgaacatgatagacaccaagaagagctccttgaacatctcaggttacaattttagcttgggtcatatcagcagccagggcct

SEQ ID NO: 428007 - DNA, 140 bp, Artificial Sequence
  Synthetic
atacgccatgctgggtctcccactacatcatttaggtcaacctgcccttgctttgtcaaacatgccagtgtcagacttggcatggtgccgaactggttattaagtaagtctgcattttttcgtacttgggagtcggccat

SEQ ID NO: 428008 - DNA, 140 bp, Artificial Sequence
  Synthetic
atggccgactcccaagtacgaaaaaatgcagacttacttaataaccagttcggcaccatgccaagtctgacactggcatgtttgacaaagcaagggcaggttgacctaaatgatgtagtgggagacccagcatggcgtat

SEQ ID NO: 428009 - DNA, 140 bp, Artificial Sequence
  Synthetic
aggccctggctgctgatatgtcagacttggcatggtgccgaactggttattaagtaagtctgcattttttacatcccaaactctcacaactccgtcattcccggcccgggccccctgattgaccttttgggacagcggtg

SEQ ID NO: 428010 - DNA, 140 bp, Artificial Sequence
  Synthetic
caccgctgtcccaaaaggtcaatcagggggcccgggccgggaatgacggagttgtgagagtttgggatgtaaaaaatgcagacttacttaataaccagttcggcaccatgccaagtctgacatatcagcagccagggcct

SEQ ID NO: 428011 - DNA, 140 bp, Artificial Sequence
  Synthetic
atacgccatgctgggtctccgttgcgagcttaggttacccatgtagactcctgcgctcaatggcctttctgttctagttacttttgattttagcttctctaagtctgcagctagaaccaacgtacttgggagtcggccat

SEQ ID NO: 428012 - DNA, 140 bp, Artificial Sequence
  Synthetic
atggccgactcccaagtacgttggttctagctgcagacttagagaagctaaaatcaaaagtaactagaacagaaaggccattgagcgcaggagtctacatgggtaacctaagctcgcaacggagacccagcatggcgtat

SEQ ID NO: 428013 - DNA, 140 bp, Artificial Sequence
  Synthetic
atacgccatgctgggtctccttgacttcaactcaacaaggttgtttactgcttgatttagatccctcaaccgcttcaaatcattatcgtctcttctctgtttgcgcattagccgctggaccgtacttgggagtcggccat

SEQ ID NO: 428014 - DNA, 140 bp, Artificial Sequence
  Synthetic
atggccgactcccaagtacggtccagcggctaatgcgcaaacagagaagagacgataatgatttgaagcggttgagggatctaaatcaagcagtaaacaaccttgttgagttgaagtcaaggagacccagcatggcgtat

SEQ ID NO: 428015 - DNA, 140 bp, Artificial Sequence
  Synthetic
atacgccatgctgggtctcctcaccacttgcagtttgatgttggagcaataaccagacaattctctcctcaaagattgtgtccacaggaaggactttatctcctttgaggcactcattgccgtacttgggagtcggccat

SEQ ID NO: 428016 - DNA, 140 bp, Artificial Sequence
  Synthetic
atggccgactcccaagtacggcaatgagtgcctcaaaggagataaagtccttcctgtggacacaatctttgaggagagaattgtctggttattgctccaacatcaaactgcaagtggtgaggagacccagcatggcgtat

SEQ ID NO: 428017 - DNA, 140 bp, Artificial Sequence
  Synthetic
aggccctggctgctgatatgtgccaagttgttgtactatatgcacacaacagagagttgaaactatctgctgaagtgaataaagcaaagcgcaatccaatagcctaggatccactgtgcggaccttttgggacagcggtg

SEQ ID NO: 428018 - DNA, 140 bp, Artificial Sequence
  Synthetic
caccgctgtcccaaaaggtccgcacagtggatcctaggctattggattgcgctttgctttattcacttcagcagatagtttcaactctctgttgtgtgcatatagtacaacaacttggcacatatcagcagccagggcct

SEQ ID NO: 428019 - DNA, 140 bp, Artificial Sequence
  Synthetic
atacgccatgctgggtctccctagagatatttatattagtagaagattgctaggcacattcacatggacactgtcagattctgaaggtgaagacacaccagggggatattgtctgaccagcgtacttgggagtcggccat

SEQ ID NO: 428020 - DNA, 140 bp, Artificial Sequence
  Synthetic
atggccgactcccaagtacgctggtcagacaatatccccctggtgtgtcttcaccttcagaatctgacagtgtccatgtgaatgtgcctagcaatcttctactaatataaatatctctagggagacccagcatggcgtat

SEQ ID NO: 428021 - DNA, 140 bp, Artificial Sequence
  Synthetic
aggccctggctgctgatatgtaaatggggaacaagcaagccaaaactccagaaacaaaagacagcccgagggccagtctgatcccagatgccacacatctagggccacaattctgcaagagaccttttgggacagcggtg

SEQ ID NO: 428022 - DNA, 140 bp, Artificial Sequence
  Synthetic
caccgctgtcccaaaaggtctcttgcagaattgtggccctagatgtgtggcatctgggatcagactggccctcgggctgtcttttgtttctggagttttggcttgcttgttccccatttacatatcagcagccagggcct

SEQ ID NO: 428023 - DNA, 140 bp, Artificial Sequence
  Synthetic
atacgccatgctgggtctccggccagtctgatcccagatgccacacatctagggccacaattctgcaagagctgctggttcgaaaacaagggtctggttgagtgcaacagtcactatctgcgtacttgggagtcggccat

SEQ ID NO: 428024 - DNA, 140 bp, Artificial Sequence
  Synthetic
atggccgactcccaagtacgcagatagtgactgttgcactcaaccagacccttgttttcgaaccagcagctcttgcagaattgtggccctagatgtgtggcatctgggatcagactggccggagacccagcatggcgtat

SEQ ID NO: 428025 - DNA, 140 bp, Artificial Sequence
  Synthetic
atacgccatgctgggtctccctgcaagatgcccctccccacaaggctgaggccatcaaccgctccaacagcacctccagccggagtgggggacagcaccagccccccaccctacagcccccgtacttgggagtcggccat

SEQ ID NO: 428026 - DNA, 140 bp, Artificial Sequence
  Synthetic
atggccgactcccaagtacgggggctgtagggtggggggctggtgctgtcccccactccggctggaggtgctgttggagcggttgatggcctcagccttgtggggaggggcatcttgcagggagacccagcatggcgtat

SEQ ID NO: 428027 - DNA, 140 bp, Artificial Sequence
  Synthetic
aggccctggctgctgatatgcacctccagccggagtgggggacagcaccagccccccaccctacagcccctgaatcgcccatcaacccccaccgtcctcctcaccccccgacaccccccggaccttttgggacagcggtg

SEQ ID NO: 428028 - DNA, 140 bp, Artificial Sequence
  Synthetic
caccgctgtcccaaaaggtccggggggtgtcggggggtgaggaggacggtgggggttgatgggcgattcaggggctgtagggtggggggctggtgctgtcccccactccggctggaggtgcatatcagcagccagggcct

SEQ ID NO: 428029 - DNA, 140 bp, Artificial Sequence
  Synthetic
atacgccatgctgggtctccacctgtgtagggtttagacttatgcctgtgtggcctgtaggtcagctggtggtgccccacaaaaacacctacagaaatgagagacaatatgcctaggatccgtacttgggagtcggccat

SEQ ID NO: 428030 - DNA, 140 bp, Artificial Sequence
  Synthetic
atggccgactcccaagtacggatcctaggcatattgtctctcatttctgtaggtgtttttgtggggcaccaccagctgacctacaggccacacaggcataagtctaaaccctacacaggtggagacccagcatggcgtat

SEQ ID NO: 428031 - DNA, 140 bp, Artificial Sequence
  Synthetic
atacgccatgctgggtctccgactactcaatgtcctcaatgcgctcttccccttcaatcaactcctcacatgttctgccctttagtcttaacttaccactacttgattgcaccatcacctcgtacttgggagtcggccat

SEQ ID NO: 428032 - DNA, 140 bp, Artificial Sequence
  Synthetic
atggccgactcccaagtacgaggtgatggtgcaatcaagtagtggtaagttaagactaaagggcagaacatgtgaggagttgattgaaggggaagagcgcattgaggacattgagtagtcggagacccagcatggcgtat

SEQ ID NO: 428033 - DNA, 140 bp, Artificial Sequence
  Synthetic
aggccctggctgctgatatgtgttctgccctttagtcttaacttaccactacttgattgcaccatcacctttcctcttgacttactgtagcagagagcataacccttgaactccacccaggaccttttgggacagcggtg

SEQ ID NO: 428034 - DNA, 140 bp, Artificial Sequence
  Synthetic
caccgctgtcccaaaaggtcctgggtggagttcaagggttatgctctctgctacagtaagtcaagaggaaaggtgatggtgcaatcaagtagtggtaagttaagactaaagggcagaacacatatcagcagccagggcct

SEQ ID NO: 428035 - DNA, 140 bp, Artificial Sequence
  Synthetic
atacgccatgctgggtctcctgcaaccctcagcgtggagacaatgtccactcctgaccactgcattctcaaccccagtctatctatcatcatgtcactcaatgcctcaatcagcaagtcacgtacttgggagtcggccat

SEQ ID NO: 428036 - DNA, 140 bp, Artificial Sequence
  Synthetic
atggccgactcccaagtacgtgacttgctgattgaggcattgagtgacatgatgatagatagactggggttgagaatgcagtggtcaggagtggacattgtctccacgctgagggttgcaggagacccagcatggcgtat

SEQ ID NO: 428037 - DNA, 140 bp, Artificial Sequence
  Synthetic
aggccctggctgctgatatgaccccagtctatctatcatcatgtcactcaatgcctcaatcagcaagtcagatgaggtatccccaacttctctcacaaacatctcaaggtcttggtcttggaccttttgggacagcggtg

SEQ ID NO: 428038 - DNA, 140 bp, Artificial Sequence
  Synthetic
caccgctgtcccaaaaggtccaagaccaagaccttgagatgtttgtgagagaagttggggatacctcatctgacttgctgattgaggcattgagtgacatgatgatagatagactggggtcatatcagcagccagggcct

SEQ ID NO: 428039 - DNA, 140 bp, Artificial Sequence
  Synthetic
atacgccatgctgggtctccccctgtgcacaaccagaggaactggttcagtgcaagggccaaccaacacaaagtcatactcagtaaactgcaatttttctatgtcaacgacaatctcaaccgtacttgggagtcggccat

SEQ ID NO: 428040 - DNA, 140 bp, Artificial Sequence
  Synthetic
atggccgactcccaagtacggttgagattgtcgttgacatagaaaaattgcagtttactgagtatgactttgtgttggttggcccttgcactgaaccagttcctctggttgtgcacagggggagacccagcatggcgtat

SEQ ID NO: 428041 - DNA, 140 bp, Artificial Sequence
  Synthetic
atacgccatgctgggtctccgcctgttttagtagctttctgggttaaagtatccaaccaaaatgggtaacagacaggctaaatcagccaaagttactgagcatcagagagcacatctagtcgtacttgggagtcggccat

SEQ ID NO: 428042 - DNA, 140 bp, Artificial Sequence
  Synthetic
atggccgactcccaagtacgactagatgtgctctctgatgctcagtaactttggctgatttagcctgtctgttacccattttggttggatactttaacccagaaagctactaaaacaggcggagacccagcatggcgtat

SEQ ID NO: 428043 - DNA, 140 bp, Artificial Sequence
  Synthetic
aggccctggctgctgatatgagacaggctaaatcagccaaagttactgagcatcagagagcacatctagtgccggatgcatcccatttgggtcctcaattctgtaagagctgctggtttggaccttttgggacagcggtg

SEQ ID NO: 428044 - DNA, 140 bp, Artificial Sequence
  Synthetic
caccgctgtcccaaaaggtccaaaccagcagctcttacagaattgaggacccaaatgggatgcatccggcactagatgtgctctctgatgctcagtaactttggctgatttagcctgtctcatatcagcagccagggcct

SEQ ID NO: 428045 - DNA, 140 bp, Artificial Sequence
  Synthetic
atacgccatgctgggtctccgccggatgcatcccatttgggtcctcaattctgtaagagctgctggtttgagaacaaagggctggtggaatgcaacaatcattatctgtgtctcaattgccgtacttgggagtcggccat

SEQ ID NO: 428046 - DNA, 140 bp, Artificial Sequence
  Synthetic
atggccgactcccaagtacggcaattgagacacagataatgattgttgcattccaccagccctttgttctcaaaccagcagctcttacagaattgaggacccaaatgggatgcatccggcggagacccagcatggcgtat

SEQ ID NO: 428047 - DNA, 140 bp, Artificial Sequence
  Synthetic
atacgccatgctgggtctccaaaaccaacctccagcagtctgacagaacacatggactcactgcaccagaatacatagcggttacatcatgcaccaagtacttggcctgttcagttattgcgtacttgggagtcggccat

SEQ ID NO: 428048 - DNA, 140 bp, Artificial Sequence
  Synthetic
atggccgactcccaagtacgcaataactgaacaggccaagtacttggtgcatgatgtaaccgctatgtattctggtgcagtgagtccatgtgttctgtcagactgctggaggttggttttggagacccagcatggcgtat

SEQ ID NO: 428049 - DNA, 140 bp, Artificial Sequence
  Synthetic
atacgccatgctgggtctccccttcccaccagactaaaggcagcgacacaacccagcgcaccctcagccgaggcaccccagagcacaacgcccccaccatacaccccgtaaactccgaaccgtacttgggagtcggccat

SEQ ID NO: 428050 - DNA, 140 bp, Artificial Sequence
  Synthetic
atggccgactcccaagtacggttcggagtttacggggtgtatggtgggggcgttgtgctctggggtgcctcggctgagggtgcgctgggttgtgtcgctgcctttagtctggtgggaaggggagacccagcatggcgtat

SEQ ID NO: 428051 - DNA, 140 bp, Artificial Sequence
  Synthetic
atacgccatgctgggtctcctgacttttgatacggaacctcactgtctgacttagttttgcagaccctgaaggtagtaacgcaacagcatcgaggaaatcttccaacgaatcaaatttggcgtacttgggagtcggccat

SEQ ID NO: 428052 - DNA, 140 bp, Artificial Sequence
  Synthetic
atggccgactcccaagtacgccaaatttgattcgttggaagatttcctcgatgctgttgcgttactaccttcagggtctgcaaaactaagtcagacagtgaggttccgtatcaaaagtcaggagacccagcatggcgtat

SEQ ID NO: 428053 - DNA, 140 bp, Artificial Sequence
  Synthetic
atacgccatgctgggtctccacacacctctctggtccaaataactctgaacatgttcttccctttaatctgaggctacccctgcttgactggatcataaccttttgctttgatttgctatcgtacttgggagtcggccat

SEQ ID NO: 428054 - DNA, 140 bp, Artificial Sequence
  Synthetic
atggccgactcccaagtacgatagcaaatcaaagcaaaaggttatgatccagtcaagcaggggtagcctcagattaaagggaagaacatgttcagagttatttggaccagagaggtgtgtggagacccagcatggcgtat

SEQ ID NO: 428055 - DNA, 140 bp, Artificial Sequence
  Synthetic
aggccctggctgctgatatggaggctacccctgcttgactggatcataaccttttgctttgatttgctataacaaagggcataacctttgaaatcaatccattctcctagagattcaagggaccttttgggacagcggtg

SEQ ID NO: 428056 - DNA, 140 bp, Artificial Sequence
  Synthetic
caccgctgtcccaaaaggtcccttgaatctctaggagaatggattgatttcaaaggttatgccctttgttatagcaaatcaaagcaaaaggttatgatccagtcaagcaggggtagcctccatatcagcagccagggcct

SEQ ID NO: 428057 - DNA, 140 bp, Artificial Sequence
  Synthetic
aggccctggctgctgatatgtatcctttaagaactcatttaccacatctgactcaacaaaccaggctgacttacccttaaaagttggacctgacaaagcaagtctccaacagtcacacaggaccttttgggacagcggtg

SEQ ID NO: 428058 - DNA, 140 bp, Artificial Sequence
  Synthetic
caccgctgtcccaaaaggtcctgtgtgactgttggagacttgctttgtcaggtccaacttttaagggtaagtcagcctggtttgttgagtcagatgtggtaaatgagttcttaaaggatacatatcagcagccagggcct

SEQ ID NO: 428059 - DNA, 140 bp, Artificial Sequence
  Synthetic
atacgccatgctgggtctcctgagacaatgtccacacctgtccactgagctctttgtttcaatctatcagacatcattgaacctagtgcgtcgaccagaaggtgtgaagaactgtcaccacgtacttgggagtcggccat

SEQ ID NO: 428060 - DNA, 140 bp, Artificial Sequence
  Synthetic
atggccgactcccaagtacgtggtgacagttcttcacaccttctggtcgacgcactaggttcaatgatgtctgatagattgaaacaaagagctcagtggacaggtgtggacattgtctcaggagacccagcatggcgtat

SEQ ID NO: 428061 - DNA, 140 bp, Artificial Sequence
  Synthetic
aggccctggctgctgatatgacatcattgaacctagtgcgtcgaccagaaggtgtgaagaactgtcaccaatctctcttacaaacatttctaaatcttggtcctgaataattggcgtaaagaccttttgggacagcggtg

SEQ ID NO: 428062 - DNA, 140 bp, Artificial Sequence
  Synthetic
caccgctgtcccaaaaggtctttacgccaattattcaggaccaagatttagaaatgtttgtaagagagattggtgacagttcttcacaccttctggtcgacgcactaggttcaatgatgtcatatcagcagccagggcct

SEQ ID NO: 428063 - DNA, 140 bp, Artificial Sequence
  Synthetic
aggccctggctgctgatatggatgatattgaacaacaagctgacaacatgatcactgagatgttacagaaggagtacatggagaggcaggggaagacaccattgggtctagttgacctctgaccttttgggacagcggtg

SEQ ID NO: 428064 - DNA, 140 bp, Artificial Sequence
  Synthetic
caccgctgtcccaaaaggtcagaggtcaactagacccaatggtgtcttcccctgcctctccatgtactccttctgtaacatctcagtgatcatgttgtcagcttgttgttcaatatcatccatatcagcagccagggcct

SEQ ID NO: 428065 - DNA, 140 bp, Artificial Sequence
  Synthetic
atacgccatgctgggtctccctacacaaagatccaaaaactttattctaggtgaccacttcattttggttgacgccaaatcactcataaatggtagtatgtgtttttcaaatacagatggcgtacttgggagtcggccat

SEQ ID NO: 428066 - DNA, 140 bp, Artificial Sequence
  Synthetic
atggccgactcccaagtacgccatctgtatttgaaaaacacatactaccatttatgagtgatttggcgtcaaccaaaatgaagtggtcacctagaataaagtttttggatctttgtgtagggagacccagcatggcgtat

SEQ ID NO: 428067 - DNA, 140 bp, Artificial Sequence
  Synthetic
aggccctggctgctgatatgaactgtagcttttcttgatcaacaactaatttcataggtacaacatttcccaattgctgtgtgtcctttaaaaactcatttactacatctgactcaacatgaccttttgggacagcggtg

SEQ ID NO: 428068 - DNA, 140 bp, Artificial Sequence
  Synthetic
caccgctgtcccaaaaggtcatgttgagtcagatgtagtaaatgagtttttaaaggacacacagcaattgggaaatgttgtacctatgaaattagttgttgatcaagaaaagctacagttcatatcagcagccagggcct

SEQ ID NO: 428069 - DNA, 140 bp, Artificial Sequence
  Synthetic
atacgccatgctgggtctcctgtttgaagaaatccagtgccttaactattttcggttcccccaagacccatgcacccagttctattgcagttgacaaggaaatgcacatataatcccatacgtacttgggagtcggccat

SEQ ID NO: 428070 - DNA, 140 bp, Artificial Sequence
  Synthetic
atggccgactcccaagtacgtatgggattatatgtgcatttccttgtcaactgcaatagaactgggtgcatgggtcttgggggaaccgaaaatagttaaggcactggatttcttcaaacaggagacccagcatggcgtat

SEQ ID NO: 428071 - DNA, 140 bp, Artificial Sequence
  Synthetic
aggccctggctgctgatatgatcactcactacgaactcaccacattgattgacaagtcctctcatgttgaggtggatggaaaaagtctctttgaaactggcatcttgactcttgatcttggaccttttgggacagcggtg

SEQ ID NO: 428072 - DNA, 140 bp, Artificial Sequence
  Synthetic
caccgctgtcccaaaaggtccaagatcaagagtcaagatgccagtttcaaagagactttttccatccacctcaacatgagaggacttgtcaatcaatgtggtgagttcgtagtgagtgatcatatcagcagccagggcct

SEQ ID NO: 428073 - DNA, 140 bp, Artificial Sequence
  Synthetic
atacgccatgctgggtctcccaaatcaaggaaatcttcaaaggactccaacctcaattcctctgtcaagccagaagcaataagctggtttaagtttatcttggccggttcaatatcaaagcgtacttgggagtcggccat

SEQ ID NO: 428074 - DNA, 140 bp, Artificial Sequence
  Synthetic
atggccgactcccaagtacgctttgatattgaaccggccaagataaacttaaaccagcttattgcttctggcttgacagaggaattgaggttggagtcctttgaagatttccttgatttgggagacccagcatggcgtat

SEQ ID NO: 428075 - DNA, 140 bp, Artificial Sequence
  Synthetic
aggccctggctgctgatatgcagaagcaataagctggtttaagtttatcttggccggttcaatatcaaagtctatccatgcatagcccatcataagatcaaacttgaacataggtctctcgaccttttgggacagcggtg

SEQ ID NO: 428076 - DNA, 140 bp, Artificial Sequence
  Synthetic
caccgctgtcccaaaaggtcgagagacctatgttcaagtttgatcttatgatgggctatgcatggatagactttgatattgaaccggccaagataaacttaaaccagcttattgcttctgcatatcagcagccagggcct

SEQ ID NO: 428077 - DNA, 140 bp, Artificial Sequence
  Synthetic
atacgccatgctgggtctccacaaagccagatgcaatagaactttgaaatgcggacttgttgatagcttcagacaataacttttgcgcacctcgggtaaaggtggaagacagtttattctcgtacttgggagtcggccat

SEQ ID NO: 428078 - DNA, 140 bp, Artificial Sequence
  Synthetic
atggccgactcccaagtacgagaataaactgtcttccacctttacccgaggtgcgcaaaagttattgtctgaagctatcaacaagtccgcatttcaaagttctattgcatctggctttgtggagacccagcatggcgtat

SEQ ID NO: 428079 - DNA, 140 bp, Artificial Sequence
  Synthetic
aggccctggctgctgatatgcctgaatatattattttttgtctcaacaccatccttaagggatgatgtgcagccaaattcaaccaagaatactcaaggtcagactcagatggggactcaagaccttttgggacagcggtg

SEQ ID NO: 428080 - DNA, 140 bp, Artificial Sequence
  Synthetic
caccgctgtcccaaaaggtcttgagtccccatctgagtctgaccttgagtattcttggttgaatttggctgcacatcatcccttaaggatggtgttgagacaaaaaataatatattcaggcatatcagcagccagggcct

SEQ ID NO: 428081 - DNA, 140 bp, Artificial Sequence
  Synthetic
atacgccatgctgggtctccctctctcctccaccataggctcatgtgtgcgagaatgcgaatttctcaattcagaagccaacacaacatagtgttcctcccttttccacttaacaatgtgcgtacttgggagtcggccat

SEQ ID NO: 428082 - DNA, 140 bp, Artificial Sequence
  Synthetic
atggccgactcccaagtacgcacattgttaagtggaaaagggaggaacactatgttgtgttggcttctgaattgagaaattcgcattctcgcacacatgagcctatggtggaggagagagggagacccagcatggcgtat

SEQ ID NO: 428083 - DNA, 140 bp, Artificial Sequence
  Synthetic
atacgccatgctgggtctccagatagtttgttgtgaactcctcgtggagttgtccagtcttcaacctattgtacagctttcttaacatagatctgaccttgctgcaagcatcaggaattacgtacttgggagtcggccat

SEQ ID NO: 428084 - DNA, 140 bp, Artificial Sequence
  Synthetic
atggccgactcccaagtacgtaattcctgatgcttgcagcaaggtcagatctatgttaagaaagctgtacaataggttgaagactggacaactccacgaggagttcacaacaaactatctggagacccagcatggcgtat

SEQ ID NO: 428085 - DNA, 140 bp, Artificial Sequence
  Synthetic
aggccctggctgctgatatggtacagctttcttaacatagatctgaccttgctgcaagcatcaggaattaacccctctatttgcctcataattctgtaactacggttgccatcaacccaggaccttttgggacagcggtg

SEQ ID NO: 428086 - DNA, 140 bp, Artificial Sequence
  Synthetic
caccgctgtcccaaaaggtcctgggttgatggcaaccgtagttacagaattatgaggcaaatagaggggttaattcctgatgcttgcagcaaggtcagatctatgttaagaaagctgtaccatatcagcagccagggcct

SEQ ID NO: 428087 - DNA, 140 bp, Artificial Sequence
  Synthetic
aggccctggctgctgatatgcaaggaactttattctgggtgaccatttcatctttgtggaagctagatcactcataaatggtaatatgtgcttttcaaacaaagatgggtacaaacgtctgaccttttgggacagcggtg

SEQ ID NO: 428088 - DNA, 140 bp, Artificial Sequence
  Synthetic
caccgctgtcccaaaaggtcagacgtttgtacccatctttgtttgaaaagcacatattaccatttatgagtgatctagcttccacaaagatgaaatggtcacccagaataaagttccttgcatatcagcagccagggcct

SEQ ID NO: 428089 - DNA, 140 bp, Artificial Sequence
  Synthetic
atacgccatgctgggtctccagcatactgcaaaaggctcaaggtccttttttgtattaaattgcacagatgaacagggacaccattggcaactgattgatcgatgattgtgtcaattgtccgtacttgggagtcggccat

SEQ ID NO: 428090 - DNA, 140 bp, Artificial Sequence
  Synthetic
atggccgactcccaagtacggacaattgacacaatcatcgatcaatcagttgccaatggtgtccctgttcatctgtgcaatttaatacaaaaaaggaccttgagccttttgcagtatgctggagacccagcatggcgtat

SEQ ID NO: 428091 - DNA, 140 bp, Artificial Sequence
  Synthetic
atacgccatgctgggtctccaaacagtgggtctcaaggggaaatagtcacaaggattgtgtttaaaaaagtccaaaatctgggcttgttttggttccccaagcacccatgccccaagttccgtacttgggagtcggccat

SEQ ID NO: 428092 - DNA, 140 bp, Artificial Sequence
  Synthetic
atggccgactcccaagtacggaacttggggcatgggtgcttggggaaccaaaacaagcccagattttggacttttttaaacacaatccttgtgactatttccccttgagacccactgtttggagacccagcatggcgtat

SEQ ID NO: 428093 - DNA, 140 bp, Artificial Sequence
  Synthetic
aggccctggctgctgatatgtccaaaatctgggcttgttttggttccccaagcacccatgccccaagttctatagctgtagacagtgatatacacatgtaatcccataaaagaggccttagaccttttgggacagcggtg

SEQ ID NO: 428094 - DNA, 140 bp, Artificial Sequence
  Synthetic
caccgctgtcccaaaaggtctaaggcctcttttatgggattacatgtgtatatcactgtctacagctatagaacttggggcatgggtgcttggggaaccaaaacaagcccagattttggacatatcagcagccagggcct

SEQ ID NO: 428095 - DNA, 140 bp, Artificial Sequence
  Synthetic
atacgccatgctgggtctccatttgaattctgcaacaaacctgccaataacactcttagggctcacaaacttattgagttgatcactcatgtaataatggaattctattagagtcttaaacgtacttgggagtcggccat

SEQ ID NO: 428096 - DNA, 140 bp, Artificial Sequence
  Synthetic
atggccgactcccaagtacgtttaagactctaatagaattccattattacatgagtgatcaactcaataagtttgtgagccctaagagtgttattggcaggtttgttgcagaattcaaatggagacccagcatggcgtat

SEQ ID NO: 428097 - DNA, 140 bp, Artificial Sequence
  Synthetic
atacgccatgctgggtctccgagatctctttttgttgactccaaagaaactagcctatcattaacacttaagaagcaagaccccaaccacccttttaaacatctttgtttcattaggtcacgtacttgggagtcggccat

SEQ ID NO: 428098 - DNA, 140 bp, Artificial Sequence
  Synthetic
atggccgactcccaagtacgtgacctaatgaaacaaagatgtttaaaagggtggttggggtcttgcttcttaagtgttaatgataggctagtttctttggagtcaacaaaaagagatctcggagacccagcatggcgtat

SEQ ID NO: 428099 - DNA, 140 bp, Artificial Sequence
  Synthetic
aggccctggctgctgatatgcaacaagtgagactgcacagacctaatgtaaaggttctccttattgggacccctgacgcacttactacccagtgttctacacaatcctacaaatccggatgaccttttgggacagcggtg

SEQ ID NO: 428100 - DNA, 140 bp, Artificial Sequence
  Synthetic
caccgctgtcccaaaaggtcatccggatttgtaggattgtgtagaacactgggtagtaagtgcgtcaggggtcccaataaggagaacctttacattaggtctgtgcagtctcacttgttgcatatcagcagccagggcct

SEQ ID NO: 428101 - DNA, 140 bp, Artificial Sequence
  Synthetic
atacgccatgctgggtctcctacttacttgcaaggagaattagtgcatcaaaaattaataaaagtttcctccttgtgttcaatatcctcaaagattttactttatttaggaatgatctcccgtacttgggagtcggccat

SEQ ID NO: 428102 - DNA, 140 bp, Artificial Sequence
  Synthetic
atggccgactcccaagtacgggagatcattcctaaataaagtaaaatctttgaggatattgaacacaaggaggaaacttttattaatttttgatgcactaattctccttgcaagtaagtaggagacccagcatggcgtat

SEQ ID NO: 428103 - DNA, 140 bp, Artificial Sequence
  Synthetic
aggccctggctgctgatatgcaactaatagcatagttaatgaacctctctgagatgagggcataaaagtctgatgtgttgtgtaatattccttggcccatgtcaagtattgaactgatatgaccttttgggacagcggtg

SEQ ID NO: 428104 - DNA, 140 bp, Artificial Sequence
  Synthetic
caccgctgtcccaaaaggtcatatcagttcaatacttgacatgggccaaggaatattacacaacacatcagacttttatgccctcatctcagagaggttcattaactatgctattagttgcatatcagcagccagggcct

SEQ ID NO: 428105 - DNA, 140 bp, Artificial Sequence
  Synthetic
atacgccatgctgggtctccctgagctcctctagtgaatgttgatgacagtctattttgcaaggtttttactatcgtagggatcttctcatcttccaggttaacagcgccagaataaattcgtacttgggagtcggccat

SEQ ID NO: 428106 - DNA, 140 bp, Artificial Sequence
  Synthetic
atggccgactcccaagtacgaatttattctggcgctgttaacctggaagatgagaagatccctacgatagtaaaaaccttgcaaaatagactgtcatcaacattcactagaggagctcagggagacccagcatggcgtat

SEQ ID NO: 428107 - DNA, 140 bp, Artificial Sequence
  Synthetic
aggccctggctgctgatatgctatcgtagggatcttctcatcttccaggttaacagcgccagaataaattatcttctgccgcaataccatcctaagaggatggtgagcagccaagttcaagaccttttgggacagcggtg

SEQ ID NO: 428108 - DNA, 140 bp, Artificial Sequence
  Synthetic
caccgctgtcccaaaaggtcttgaacttggctgctcaccatcctcttaggatggtattgcggcagaagataatttattctggcgctgttaacctggaagatgagaagatccctacgatagcatatcagcagccagggcct

SEQ ID NO: 428109 - DNA, 140 bp, Artificial Sequence
  Synthetic
aggccctggctgctgatatgcttcatcatggctgaaaccacattgaaaggtatttccaccatcttatgcatgtgccacataagcagggttgagagatagtccctcccctttatatctgctgaccttttgggacagcggtg

SEQ ID NO: 428110 - DNA, 140 bp, Artificial Sequence
  Synthetic
caccgctgtcccaaaaggtcagcagatataaaggggagggactatctctcaaccctgcttatgtggcacatgcataagatggtggaaatacctttcaatgtggtttcagccatgatgaagcatatcagcagccagggcct

SEQ ID NO: 428111 - DNA, 140 bp, Artificial Sequence
  Synthetic
atacgccatgctgggtctcctgaataaattctgtagtgatgttgtgtgttcacctgataagtagttggtggtgaactcttcgtgaagatcaccagtttttagtttattaaatagaatcctcgtacttgggagtcggccat

SEQ ID NO: 428112 - DNA, 140 bp, Artificial Sequence
  Synthetic
atggccgactcccaagtacgaggattctatttaataaactaaaaactggtgatcttcacgaagagttcaccaccaactacttatcaggtgaacacacaacatcactacagaatttattcaggagacccagcatggcgtat

SEQ ID NO: 428113 - DNA, 140 bp, Artificial Sequence
  Synthetic
atacgccatgctgggtctccacctgtattgggtttgggtttatgccagaatggcttgtgggtcagctggtggtgccccacaaaagctcctacagaaatgagagacaatatgcctaggatccgtacttgggagtcggccat

SEQ ID NO: 428114 - DNA, 140 bp, Artificial Sequence
  Synthetic
atggccgactcccaagtacggatcctaggcatattgtctctcatttctgtaggagcttttgtggggcaccaccagctgacccacaagccattctggcataaacccaaacccaatacaggtggagacccagcatggcgtat

SEQ ID NO: 428115 - DNA, 140 bp, Artificial Sequence
  Synthetic
atacgccatgctgggtctccaaatggacacatcatcggaccccatttactgtgatccatgctataagagacatgtgccagggaaacatttaatttcatggaaagaatagcgttctcaaatcgtacttgggagtcggccat

SEQ ID NO: 428116 - DNA, 140 bp, Artificial Sequence
  Synthetic
atggccgactcccaagtacgatttgagaacgctattctttccatgaaattaaatgtttccctggcacatgtctcttatagcatggatcacagtaaatggggtccgatgatgtgtccatttggagacccagcatggcgtat

SEQ ID NO: 428117 - DNA, 140 bp, Artificial Sequence
  Synthetic
aggccctggctgctgatatgcatgtgccagggaaacatttaatttcatggaaagaatagcgttctcaaattctttctcgttgtttaaacaactccctgataattgcagacttaaagcctcgaccttttgggacagcggtg

SEQ ID NO: 428118 - DNA, 140 bp, Artificial Sequence
  Synthetic
caccgctgtcccaaaaggtcgaggctttaagtctgcaattatcagggagttgtttaaacaacgagaaagaatttgagaacgctattctttccatgaaattaaatgtttccctggcacatgcatatcagcagccagggcct

SEQ ID NO: 428119 - DNA, 140 bp, Artificial Sequence
  Synthetic
atacgccatgctgggtctccgtttcgcagtttaaaaggaatggatcaatggggtacttagcataagataacaagttcagtgtccttttttgaatctgattgcacaaatcgactgggacaccgtacttgggagtcggccat

SEQ ID NO: 428120 - DNA, 140 bp, Artificial Sequence
  Synthetic
atggccgactcccaagtacggtgtcccagtcgatttgtgcaatcagattcaaaaaaggacactgaacttgttatcttatgctaagtaccccattgatccattccttttaaactgcgaaacggagacccagcatggcgtat

SEQ ID NO: 428121 - DNA, 140 bp, Artificial Sequence
  Synthetic
aggccctggctgctgatatgcaagttcagtgtccttttttgaatctgattgcacaaatcgactgggacaccatttgcaacagattgatcaattattgtgtcgattgtttctgccaattgggaccttttgggacagcggtg

SEQ ID NO: 428122 - DNA, 140 bp, Artificial Sequence
  Synthetic
caccgctgtcccaaaaggtcccaattggcagaaacaatcgacacaataattgatcaatctgttgcaaatggtgtcccagtcgatttgtgcaatcagattcaaaaaaggacactgaacttgcatatcagcagccagggcct

SEQ ID NO: 428123 - DNA, 140 bp, Artificial Sequence
  Synthetic
atacgccatgctgggtctccggggatcctaggcaatttggttgttcttttctgaggccttgtgcgctgaactcctccaaatgggaaacaagcaagccaaagccccagaatcaaaggacagcgtacttgggagtcggccat

SEQ ID NO: 428124 - DNA, 140 bp, Artificial Sequence
  Synthetic
atggccgactcccaagtacgctgtcctttgattctggggctttggcttgcttgtttcccatttggaggagttcagcgcacaaggcctcagaaaagaacaaccaaattgcctaggatccccggagacccagcatggcgtat

SEQ ID NO: 428125 - DNA, 140 bp, Artificial Sequence
  Synthetic
aggccctggctgctgatatgttaagtctccctgtatcaggccctactgaatcataggactgtggtgactcttggctataaaaacacaagttctttaacattgctgtggtacaatttgttagaccttttgggacagcggtg

SEQ ID NO: 428126 - DNA, 140 bp, Artificial Sequence
  Synthetic
caccgctgtcccaaaaggtctaacaaattgtaccacagcaatgttaaagaacttgtgtttttatagccaagagtcaccacagtcctatgattcagtagggcctgatacagggagacttaacatatcagcagccagggcct

SEQ ID NO: 428127 - DNA, 140 bp, Artificial Sequence
  Synthetic
atacgccatgctgggtctcctaacaagggcacctcatcaccccaaacatagaaccttgatttgaattctgcaacaaatctgccaattgcgctcttcggactcacaaacttattcaattgacgtacttgggagtcggccat

SEQ ID NO: 428128 - DNA, 140 bp, Artificial Sequence
  Synthetic
atggccgactcccaagtacgtcaattgaataagtttgtgagtccgaagagcgcaattggcagatttgttgcagaattcaaatcaaggttctatgtttggggtgatgaggtgcccttgttaggagacccagcatggcgtat

SEQ ID NO: 428129 - DNA, 140 bp, Artificial Sequence
  Synthetic
aggccctggctgctgatatgcaacaaatctgccaattgcgctcttcggactcacaaacttattcaattgatcactcatgtagtagtggaattccaataatgtcttgaattcttctgcatcgaccttttgggacagcggtg

SEQ ID NO: 428130 - DNA, 140 bp, Artificial Sequence
  Synthetic
caccgctgtcccaaaaggtcgatgcagaagaattcaagacattattggaattccactactacatgagtgatcaattgaataagtttgtgagtccgaagagcgcaattggcagatttgttgcatatcagcagccagggcct

SEQ ID NO: 428131 - DNA, 140 bp, Artificial Sequence
  Synthetic
atacgccatgctgggtctccctcacatcatcagagagcttacccatatcaaacttgaaattgaggtttcttgacttataatgagtgtaccttcccataagtgtgtttgcgttcataatcacgtacttgggagtcggccat

SEQ ID NO: 428132 - DNA, 140 bp, Artificial Sequence
  Synthetic
atggccgactcccaagtacgtgattatgaacgcaaacacacttatgggaaggtacactcattataagtcaagaaacctcaatttcaagtttgatatgggtaagctctctgatgatgtgagggagacccagcatggcgtat

SEQ ID NO: 428133 - DNA, 140 bp, Artificial Sequence
  Synthetic
aggccctggctgctgatatgccccatttgcaagatgcctctccccacaagactgagaccatcagccgctccaacagcacccccaaccggagcagcggacagcaccagacctccaccctacgaccttttgggacagcggtg

SEQ ID NO: 428134 - DNA, 140 bp, Artificial Sequence
  Synthetic
caccgctgtcccaaaaggtcgtagggtggaggtctggtgctgtccgctgctccggttgggggtgctgttggagcggctgatggtctcagtcttgtggggagaggcatcttgcaaatggggcatatcagcagccagggcct

SEQ ID NO: 428135 - DNA, 140 bp, Artificial Sequence
  Synthetic
atacgccatgctgggtctcccactagatgtgtaagcatcaacttgtcccccagacacgcactttatcgcaaagtttataaaccgttcagaaattagtgcataaaagtctgacgtgttgtgcgtacttgggagtcggccat

SEQ ID NO: 428136 - DNA, 140 bp, Artificial Sequence
  Synthetic
atggccgactcccaagtacgcacaacacgtcagacttttatgcactaatttctgaacggtttataaactttgcgataaagtgcgtgtctgggggacaagttgatgcttacacatctagtgggagacccagcatggcgtat

SEQ ID NO: 428137 - DNA, 140 bp, Artificial Sequence
  Synthetic
aggccctggctgctgatatgaagtttataaaccgttcagaaattagtgcataaaagtctgacgtgttgtgcaagatgccctgtcccatgtcgaggattgaactaatgtgtgaaggaactggaccttttgggacagcggtg

SEQ ID NO: 428138 - DNA, 140 bp, Artificial Sequence
  Synthetic
caccgctgtcccaaaaggtccagttccttcacacattagttcaatcctcgacatgggacagggcatcttgcacaacacgtcagacttttatgcactaatttctgaacggtttataaacttcatatcagcagccagggcct

SEQ ID NO: 428139 - DNA, 140 bp, Artificial Sequence
  Synthetic
atacgccatgctgggtctccgagtcacagctatgccgtagatgcagccaatcattgtggcactgttgcaaatggtgtactgcagactttcatgaggatggcttggggtgggagctacattcgtacttgggagtcggccat

SEQ ID NO: 428140 - DNA, 140 bp, Artificial Sequence
  Synthetic
atggccgactcccaagtacgaatgtagctcccaccccaagccatcctcatgaaagtctgcagtacaccatttgcaacagtgccacaatgattggctgcatctacggcatagctgtgactcggagacccagcatggcgtat

SEQ ID NO: 428141 - DNA, 140 bp, Artificial Sequence
  Synthetic
aggccctggctgctgatatgagaattcctcataaaaattgtctggtaggacatcatgatcaaaatcctcaaccatgtgattggataactcacccttaatcaacctaatataaaacttattgaccttttgggacagcggtg

SEQ ID NO: 428142 - DNA, 140 bp, Artificial Sequence
  Synthetic
caccgctgtcccaaaaggtcaataagttttatattaggttgattaagggtgagttatccaatcacatggttgaggattttgatcatgatgtcctaccagacaatttttatgaggaattctcatatcagcagccagggcct

SEQ ID NO: 428143 - DNA, 140 bp, Artificial Sequence
  Synthetic
atacgccatgctgggtctccgttttcttcttcagaccaagctgagatttgatgtatgacttcatcattgctgacacaacattgaacgggatttccaccatcttgtgcatgtgccatgttacgtacttgggagtcggccat

SEQ ID NO: 428144 - DNA, 140 bp, Artificial Sequence
  Synthetic
atggccgactcccaagtacgtaacatggcacatgcacaagatggtggaaatcccgttcaatgttgtgtcagcaatgatgaagtcatacatcaaatctcagcttggtctgaagaagaaaacggagacccagcatggcgtat

SEQ ID NO: 428145 - DNA, 140 bp, Artificial Sequence
  Synthetic
aggccctggctgctgatatgtgacacaacattgaacgggatttccaccatcttgtgcatgtgccatgttaataatgttgacaggtaatctttgccctttaaatcagcttgtagatcatcagaccttttgggacagcggtg

SEQ ID NO: 428146 - DNA, 140 bp, Artificial Sequence
  Synthetic
caccgctgtcccaaaaggtctgatgatctacaagctgatttaaagggcaaagattacctgtcaacattattaacatggcacatgcacaagatggtggaaatcccgttcaatgttgtgtcacatatcagcagccagggcct

SEQ ID NO: 428147 - DNA, 140 bp, Artificial Sequence
  Synthetic
atacgccatgctgggtctccggtttaagccaggtttaacaggttctctatactggtcaacaattttctcaacagtctcttttagctgattaaagtagacgcttgcaccgccatcgagcagcgtacttgggagtcggccat

SEQ ID NO: 428148 - DNA, 140 bp, Artificial Sequence
  Synthetic
atggccgactcccaagtacgctgctcgatggcggtgcaagcgtctactttaatcagctaaaagagactgttgagaaaattgttgaccagtatagagaacctgttaaacctggcttaaaccggagacccagcatggcgtat

SEQ ID NO: 428149 - DNA, 140 bp, Artificial Sequence
  Synthetic
atacgccatgctgggtctcccataggtccccatttactgtgatccatgctatatgaaacatgtgcggatgagacatttagcttcattgataagatggcattatcgaattccttctcattgcgtacttgggagtcggccat

SEQ ID NO: 428150 - DNA, 140 bp, Artificial Sequence
  Synthetic
atggccgactcccaagtacgcaatgagaaggaattcgataatgccatcttatcaatgaagctaaatgtctcatccgcacatgtttcatatagcatggatcacagtaaatggggacctatgggagacccagcatggcgtat

SEQ ID NO: 428151 - DNA, 140 bp, Artificial Sequence
  Synthetic
atacgccatgctgggtctccctaaaaccaaattgctcattgcctgttgcactttatattcatagtcttgcttgttgagaaggtgttttcctttccttgagaaaacttcggtgagttgtgacgtacttgggagtcggccat

SEQ ID NO: 428152 - DNA, 140 bp, Artificial Sequence
  Synthetic
atggccgactcccaagtacgtcacaactcaccgaagttttctcaaggaaaggaaaacaccttctcaacaagcaagactatgaatataaagtgcaacaggcaatgagcaatttggttttagggagacccagcatggcgtat

SEQ ID NO: 428153 - DNA, 140 bp, Artificial Sequence
  Synthetic
atacgccatgctgggtctcccatctgtgtatttattgacaacaacacttttattgctagctagatccaaggctgtggcacaaccactagtgatgagggggtctctgatttccttcttcaccgtacttgggagtcggccat

SEQ ID NO: 428154 - DNA, 140 bp, Artificial Sequence
  Synthetic
atggccgactcccaagtacggtgaagaaggaaatcagagaccccctcatcactagtggttgtgccacagccttggatctagctagcaataaaagtgttgttgtcaataaatacacagatgggagacccagcatggcgtat

SEQ ID NO: 428155 - DNA, 140 bp, Artificial Sequence
  Synthetic
aggccctggctgctgatatggtgtcagggccagttgaattgtaagactgaggtgattcttgactataaaaacataggttcttcaacattgctgttgtgcagttagttagagacaaagcctgaccttttgggacagcggtg

SEQ ID NO: 428156 - DNA, 140 bp, Artificial Sequence
  Synthetic
caccgctgtcccaaaaggtcaggctttgtctctaactaactgcacaacagcaatgttgaagaacctatgtttttatagtcaagaatcacctcagtcttacaattcaactggccctgacaccatatcagcagccagggcct

SEQ ID NO: 428157 - DNA, 140 bp, Artificial Sequence
  Synthetic
atacgccatgctgggtctccgccagtctccctgtgtcaaacttaaagttcagacacttgctcttataatgagagtacctacccatcaacttattcccattcatcaccaacaaaattgactcgtacttgggagtcggccat

SEQ ID NO: 428158 - DNA, 140 bp, Artificial Sequence
  Synthetic
atggccgactcccaagtacgagtcaattttgttggtgatgaatgggaataagttgatgggtaggtactctcattataagagcaagtgtctgaactttaagtttgacacagggagactggcggagacccagcatggcgtat

SEQ ID NO: 428159 - DNA, 140 bp, Artificial Sequence
  Synthetic
aggccctggctgctgatatgatccaattcttcttccgtggctgtgtctgctggattgacactcacatgaccgaatttcacctttggctcaagaaacttttcaaaacatttaatctggtccgaccttttgggacagcggtg

SEQ ID NO: 428160 - DNA, 140 bp, Artificial Sequence
  Synthetic
caccgctgtcccaaaaggtcggaccagattaaatgttttgaaaagtttcttgagccaaaggtgaaattcggtcatgtgagtgtcaatccagcagacacagccacggaagaagaattggatcatatcagcagccagggcct

SEQ ID NO: 428161 - DNA, 140 bp, Artificial Sequence
  Synthetic
atacgccatgctgggtctcctttgttaattctcctatagggcatgagttcattggtcctgtgtaaaaatatttgtctttcagaaccgtatcattatatatactctcgcaaattttaaagtcgtacttgggagtcggccat

SEQ ID NO: 428162 - DNA, 140 bp, Artificial Sequence
  Synthetic
atggccgactcccaagtacgactttaaaatttgcgagagtatatataatgatacggttctgaaagacaaatatttttacacaggaccaatgaactcatgccctataggagaattaacaaaggagacccagcatggcgtat

SEQ ID NO: 428163 - DNA, 140 bp, Artificial Sequence
  Synthetic
atacgccatgctgggtctccgttcagaatgaacttgaacctattggtcatcatgctcttcacatcttcggacaagaccaagttcattaatgtccttattaatttatagagcaagaactctcgtacttgggagtcggccat

SEQ ID NO: 428164 - DNA, 140 bp, Artificial Sequence
  Synthetic
atggccgactcccaagtacgagagttcttgctctataaattaataaggacattaatgaacttggtcttgtccgaagatgtgaagagcatgatgaccaataggttcaagttcattctgaacggagacccagcatggcgtat

SEQ ID NO: 428165 - DNA, 140 bp, Artificial Sequence
  Synthetic
aggccctggctgctgatatggaaagttcactctttatcaaccttataaagagtttttcttccaccactttatcaagatcagatattgaaggcacattgcagtctacccttttttgtttttgaccttttgggacagcggtg

SEQ ID NO: 428166 - DNA, 140 bp, Artificial Sequence
  Synthetic
caccgctgtcccaaaaggtcaaaaacaaaaaagggtagactgcaatgtgccttcaatatctgatcttgataaagtggtggaagaaaaactctttataaggttgataaagagtgaactttccatatcagcagccagggcct

SEQ ID NO: 428167 - DNA, 140 bp, Artificial Sequence
  Synthetic
atacgccatgctgggtctccaaaatctgacacataagccattatgaaatacctaaggttttggaggagtttctgagaacgcttgctagggtgagctagaatcaaaattaagatcatctttcgtacttgggagtcggccat

SEQ ID NO: 428168 - DNA, 140 bp, Artificial Sequence
  Synthetic
atggccgactcccaagtacgaaagatgatcttaattttgattctagctcaccctagcaagcgttctcagaaactcctccaaaaccttaggtatttcataatggcttatgtgtcagattttggagacccagcatggcgtat

SEQ ID NO: 428169 - DNA, 140 bp, Artificial Sequence
  Synthetic
atacgccatgctgggtctcctggtcaaaatattcagatgctcctccatccaacaatatttcatccaaatcagcattgtcgatgtcaccactccctcccctggatcccaaaacaaggttaccgtacttgggagtcggccat

SEQ ID NO: 428170 - DNA, 140 bp, Artificial Sequence
  Synthetic
atggccgactcccaagtacggtaaccttgttttgggatccaggggagggagtggtgacatcgacaatgctgatttggatgaaatattgttggatggaggagcatctgaatattttgaccaggagacccagcatggcgtat

SEQ ID NO: 428171 - DNA, 140 bp, Artificial Sequence
  Synthetic
aggccctggctgctgatatgagcattgtcgatgtcaccactccctcccctggatcccaaaacaaggttactcatcgcttgctgtatcttgtaatcatagtcctgtttgttgagcaagaacgaccttttgggacagcggtg

SEQ ID NO: 428172 - DNA, 140 bp, Artificial Sequence
  Synthetic
caccgctgtcccaaaaggtcgttcttgctcaacaaacaggactatgattacaagatacagcaagcgatgagtaaccttgttttgggatccaggggagggagtggtgacatcgacaatgctcatatcagcagccagggcct

SEQ ID NO: 428173 - DNA, 140 bp, Artificial Sequence
  Synthetic
atacgccatgctgggtctccctgataaattaattgaaattcagtatcacctgatgagaactcttgacaatatgcctctttgcatctgaccacttgatatcttgctggaccaaattcattccgtacttgggagtcggccat

SEQ ID NO: 428174 - DNA, 140 bp, Artificial Sequence
  Synthetic
atggccgactcccaagtacggaatgaatttggtccagcaagatatcaagtggtcagatgcaaagaggcatattgtcaagagttctcatcaggtgatactgaatttcaattaatttatcagggagacccagcatggcgtat

SEQ ID NO: 428175 - DNA, 140 bp, Artificial Sequence
  Synthetic
aggccctggctgctgatatgttacaacaacactcttattactagccaaatctaaagctgttgcacagccacttgtgatgagaggatctcgcagcgtcttttttacttccttttctttaaagaccttttgggacagcggtg

SEQ ID NO: 428176 - DNA, 140 bp, Artificial Sequence
  Synthetic
caccgctgtcccaaaaggtctttaaagaaaaggaagtaaaaaagacgctgcgagatcctctcatcacaagtggctgtgcaacagctttagatttggctagtaataagagtgttgttgtaacatatcagcagccagggcct

SEQ ID NO: 428177 - DNA, 140 bp, Artificial Sequence
  Synthetic
atacgccatgctgggtctccaaacaccgggttttttgtatctcactttgtccgcatctacacaacattctttactcagaaattttcttgcattatagaccatttcagtgagctcctcctccgtacttgggagtcggccat

SEQ ID NO: 428178 - DNA, 140 bp, Artificial Sequence
  Synthetic
atggccgactcccaagtacggaggaggagctcactgaaatggtctataatgcaagaaaatttctgagtaaagaatgttgtgtagatgcggacaaagtgagatacaaaaaacccggtgtttggagacccagcatggcgtat

SEQ ID NO: 428179 - DNA, 140 bp, Artificial Sequence
  Synthetic
aggccctggctgctgatatgttactcagaaattttcttgcattatagaccatttcagtgagctcctcctctgatgcatcgtcttttgggttcacactcacatgcccaaactccagttttggaccttttgggacagcggtg

SEQ ID NO: 428180 - DNA, 140 bp, Artificial Sequence
  Synthetic
caccgctgtcccaaaaggtccaaaactggagtttgggcatgtgagtgtgaacccaaaagacgatgcatcagaggaggagctcactgaaatggtctataatgcaagaaaatttctgagtaacatatcagcagccagggcct

SEQ ID NO: 428181 - DNA, 140 bp, Artificial Sequence
  Synthetic
aggccctggctgctgatatggccagctttctgtggcttcccatctgattccagatcaacgacagtgttttcccaagcccttcctgttattgaggttcttgatgcaatatatggccatccagaccttttgggacagcggtg

SEQ ID NO: 428182 - DNA, 140 bp, Artificial Sequence
  Synthetic
caccgctgtcccaaaaggtctggatggccatatattgcatcaagaacctcaataacaggaagggcttgggaaaacactgtcgttgatctggaatcagatgggaagccacagaaagctggccatatcagcagccagggcct

SEQ ID NO: 428183 - DNA, 140 bp, Artificial Sequence
  Synthetic
atacgccatgctgggtctccgtgagaatctgatttttatcgagacattgggaggactgcatgatcttggacctttcaacctgctgccttcgctcaacccatttctttagatccctttttgcgtacttgggagtcggccat

SEQ ID NO: 428184 - DNA, 140 bp, Artificial Sequence
  Synthetic
atggccgactcccaagtacgcaaaaagggatctaaagaaatgggttgagcgaaggcagcaggttgaaaggtccaagatcatgcagtcctcccaatgtctcgataaaaatcagattctcacggagacccagcatggcgtat

SEQ ID NO: 428185 - DNA, 140 bp, Artificial Sequence
  Synthetic
aggccctggctgctgatatgaaacctattggtcatcatactaacaacttcatcagacaaaattattcttaaaaggtgacgaacaagtctatagagcaggtattcaacttctgtgatcagagaccttttgggacagcggtg

SEQ ID NO: 428186 - DNA, 140 bp, Artificial Sequence
  Synthetic
caccgctgtcccaaaaggtctctgatcacagaagttgaatacctgctctatagacttgttcgtcaccttttaagaataattttgtctgatgaagttgttagtatgatgaccaataggtttcatatcagcagccagggcct

SEQ ID NO: 428187 - DNA, 140 bp, Artificial Sequence
  Synthetic
atacgccatgctgggtctccaagaatcagtgcatcaaaaatcaacataagtttcctccttgtgttcaatatcctcaaagacttcactttgtttaggaatgatctccagcattgcatctgacgtacttgggagtcggccat

SEQ ID NO: 428188 - DNA, 140 bp, Artificial Sequence
  Synthetic
atggccgactcccaagtacgtcagatgcaatgctggagatcattcctaaacaaagtgaagtctttgaggatattgaacacaaggaggaaacttatgttgatttttgatgcactgattcttggagacccagcatggcgtat

SEQ ID NO: 428189 - DNA, 140 bp, Artificial Sequence
  Synthetic
aggccctggctgctgatatgtaggatgtgttaatatcaaaactaagatcattttggtcagtaacttaatatttgtcagctgttcggataactctgtgcactcctcaatccagctgaccatgaccttttgggacagcggtg

SEQ ID NO: 428190 - DNA, 140 bp, Artificial Sequence
  Synthetic
caccgctgtcccaaaaggtcatggtcagctggattgaggagtgcacagagttatccgaacagctgacaaatattaagttactgaccaaaatgatcttagttttgatattaacacatcctacatatcagcagccagggcct

SEQ ID NO: 428191 - DNA, 140 bp, Artificial Sequence
  Synthetic
atacgccatgctgggtctccaccgtttggggtcagcataaaaagaacaaacctctccaactgtgttgttgttaatagcatagcactttgagcactcacctgtcttctggtataataatttcgtacttgggagtcggccat

SEQ ID NO: 428192 - DNA, 140 bp, Artificial Sequence
  Synthetic
atggccgactcccaagtacgaaattattataccagaagacaggtgagtgctcaaagtgctatgctattaacaacaacacagttggagaggtttgttctttttatgctgaccccaaacggtggagacccagcatggcgtat

SEQ ID NO: 428193 - DNA, 140 bp, Artificial Sequence
  Synthetic
aggccctggctgctgatatgttaatagcatagcactttgagcactcacctgtcttctggtataataatttaaaacccatcttattgatgaagaactcttgacagtaagcctctttgcaccgaccttttgggacagcggtg

SEQ ID NO: 428194 - DNA, 140 bp, Artificial Sequence
  Synthetic
caccgctgtcccaaaaggtcggtgcaaagaggcttactgtcaagagttcttcatcaataagatgggttttaaattattataccagaagacaggtgagtgctcaaagtgctatgctattaacatatcagcagccagggcct

SEQ ID NO: 428195 - DNA, 140 bp, Artificial Sequence
  Synthetic
atacgccatgctgggtctccgtagaagatgttttcattgagttgatcagagctagactcagtgttgacaatctatctagatcgattgcatctaaaatatcaacagtgccaagagtataagcgtacttgggagtcggccat

SEQ ID NO: 428196 - DNA, 140 bp, Artificial Sequence
  Synthetic
atggccgactcccaagtacgcttatactcttggcactgttgatattttagatgcaatcgatctagatagattgtcaacactgagtctagctctgatcaactcaatgaaaacatcttctacggagacccagcatggcgtat

SEQ ID NO: 428197 - DNA, 140 bp, Artificial Sequence
  Synthetic
aggccctggctgctgatatgtctatctagatcgattgcatctaaaatatcaacagtgccaagagtataagggaacatatcctcctgggttctctgatagctaatagtgggtgtgaccccagaccttttgggacagcggtg

SEQ ID NO: 428198 - DNA, 140 bp, Artificial Sequence
  Synthetic
caccgctgtcccaaaaggtctggggtcacacccactattagctatcagagaacccaggaggatatgttcccttatactcttggcactgttgatattttagatgcaatcgatctagatagacatatcagcagccagggcct

SEQ ID NO: 428199 - DNA, 140 bp, Artificial Sequence
  Synthetic
atacgccatgctgggtctccgagatcaattccatatgagttggtctctatacctacttcccttagagcattagtggcccgagtcaaaaccctgttaatgatggcgagaagttcatggttccgtacttgggagtcggccat

SEQ ID NO: 428200 - DNA, 140 bp, Artificial Sequence
  Synthetic
atggccgactcccaagtacggaaccatgaacttctcgccatcattaacagggttttgactcgggccactaatgctctaagggaagtaggtatagagaccaactcatatggaattgatctcggagacccagcatggcgtat

SEQ ID NO: 428201 - DNA, 140 bp, Artificial Sequence
  Synthetic
aggccctggctgctgatatgtagtggcccgagtcaaaaccctgttaatgatggcgagaagttcatggttcctttctcccttgggtggtagagtttctaggcctttgcctttagtcctcttgaccttttgggacagcggtg

SEQ ID NO: 428202 - DNA, 140 bp, Artificial Sequence
  Synthetic
caccgctgtcccaaaaggtcaagaggactaaaggcaaaggcctagaaactctaccacccaagggagaaaggaaccatgaacttctcgccatcattaacagggttttgactcgggccactacatatcagcagccagggcct

SEQ ID NO: 428203 - DNA, 140 bp, Artificial Sequence
  Synthetic
atacgccatgctgggtctccaagtcttcaatgtacttctgttcaaagttggcaggagatgacctaacaaaacactccaataatattaggacattacctgtcagtttgtaaccgtccggtacgtacttgggagtcggccat

SEQ ID NO: 428204 - DNA, 140 bp, Artificial Sequence
  Synthetic
atggccgactcccaagtacgtaccggacggttacaaactgacaggtaatgtcctaatattattggagtgttttgttaggtcatctcctgccaactttgaacagaagtacattgaagacttggagacccagcatggcgtat

SEQ ID NO: 428205 - DNA, 140 bp, Artificial Sequence
  Synthetic
atacgccatgctgggtctccccaacctgtcgttaacagatacaaagcaggagcctagccacccagtaaggcatttatcaccatgtcttatgcgatccagccggtcagcaagtagaattagcgtacttgggagtcggccat

SEQ ID NO: 428206 - DNA, 140 bp, Artificial Sequence
  Synthetic
atggccgactcccaagtacgctaattctacttgctgaccggctggatcgcataagacatggtgataaatgccttactgggtggctaggctcctgctttgtatctgttaacgacaggttggggagacccagcatggcgtat

SEQ ID NO: 428207 - DNA, 140 bp, Artificial Sequence
  Synthetic
aggccctggctgctgatatgcatttatcaccatgtcttatgcgatccagccggtcagcaagtagaattagaacgtcaaaaataaggaggagtttcctcctggtattgagaatcctcagaggaccttttgggacagcggtg

SEQ ID NO: 428208 - DNA, 140 bp, Artificial Sequence
  Synthetic
caccgctgtcccaaaaggtcctctgaggattctcaataccaggaggaaactcctccttatttttgacgttctaattctacttgctgaccggctggatcgcataagacatggtgataaatgcatatcagcagccagggcct

SEQ ID NO: 428209 - DNA, 140 bp, Artificial Sequence
  Synthetic
atacgccatgctgggtctccaccatgccctcatgagcatcatctccaccttccatttgtctattcccaatttcaatcagtatgaagcaatgagttgtgacttcaatggaggcaagatcagcgtacttgggagtcggccat

SEQ ID NO: 428210 - DNA, 140 bp, Artificial Sequence
  Synthetic
atggccgactcccaagtacgctgatcttgcctccattgaagtcacaactcattgcttcatactgattgaaattgggaatagacaaatggaaggtggagatgatgctcatgagggcatggtggagacccagcatggcgtat

SEQ ID NO: 428211 - DNA, 140 bp, Artificial Sequence
  Synthetic
atacgccatgctgggtctccgtatcagcagtcttttcatcactggaacctaaatctgcatataggaacttaagaactggggaggctctccggaactgaaatgttaactgctcaatgttgtcgtacttgggagtcggccat

SEQ ID NO: 428212 - DNA, 140 bp, Artificial Sequence
  Synthetic
atggccgactcccaagtacgacaacattgagcagttaacatttcagttccggagagcctccccagttcttaagttcctatatgcagatttaggttccagtgatgaaaagactgctgatacggagacccagcatggcgtat

SEQ ID NO: 428213 - DNA, 140 bp, Artificial Sequence
  Synthetic
aggccctggctgctgatatgaagaactggggaggctctccggaactgaaatgttaactgctcaatgttgtcatcacaggtgtcaattttatcattatatagatttctgaaatcctctaacgaccttttgggacagcggtg

SEQ ID NO: 428214 - DNA, 140 bp, Artificial Sequence
  Synthetic
caccgctgtcccaaaaggtcgttagaggatttcagaaatctatataatgataaaattgacacctgtgatgacaacattgagcagttaacatttcagttccggagagcctccccagttcttcatatcagcagccagggcct

SEQ ID NO: 428215 - DNA, 140 bp, Artificial Sequence
  Synthetic
atacgccatgctgggtctccggtcagctggggcagcggctcactgtaggatggagtcttatagggggcacaagaggcacgaaagacaacaaagacaatcaaaatagatagccttaatgcccgtacttgggagtcggccat

SEQ ID NO: 428216 - DNA, 140 bp, Artificial Sequence
  Synthetic
atggccgactcccaagtacgggcattaaggctatctattttgattgtctttgttgtctttcgtgcctcttgtgccccctataagactccatcctacagtgagccgctgccccagctgaccggagacccagcatggcgtat

SEQ ID NO: 428217 - DNA, 140 bp, Artificial Sequence
  Synthetic
aggccctggctgctgatatggaggcactcatcgccaagttattgtgttgaatacacgcaacaaaaactgagactatctgccaaagtgatatgagcaaagcgcaatccaatagcctaggatgaccttttgggacagcggtg

SEQ ID NO: 428218 - DNA, 140 bp, Artificial Sequence
  Synthetic
caccgctgtcccaaaaggtcatcctaggctattggattgcgctttgctcatatcactttggcagatagtctcagtttttgttgcgtgtattcaacacaataacttggcgatgagtgcctccatatcagcagccagggcct

SEQ ID NO: 428219 - DNA, 140 bp, Artificial Sequence
  Synthetic
atacgccatgctgggtctcctaatttattcctaaagatttggtactcctcctcaattaagctcttaacttcatgagaggagagcttgttgttgatgccctgatgacaactagagattatacgtacttgggagtcggccat

SEQ ID NO: 428220 - DNA, 140 bp, Artificial Sequence
  Synthetic
atggccgactcccaagtacgtataatctctagttgtcatcagggcatcaacaacaagctctcctctcatgaagttaagagcttaattgaggaggagtaccaaatctttaggaataaattaggagacccagcatggcgtat

SEQ ID NO: 428221 - DNA, 140 bp, Artificial Sequence
  Synthetic
aggccctggctgctgatatgcatgagaggagagcttgttgttgatgccctgatgacaactagagattatatcctcaaagtgtcttgcacgtttatcaatcaagacattgatgctttcgatgaccttttgggacagcggtg

SEQ ID NO: 428222 - DNA, 140 bp, Artificial Sequence
  Synthetic
caccgctgtcccaaaaggtcatcgaaagcatcaatgtcttgattgataaacgtgcaagacactttgaggatataatctctagttgtcatcagggcatcaacaacaagctctcctctcatgcatatcagcagccagggcct

SEQ ID NO: 428223 - DNA, 140 bp, Artificial Sequence
  Synthetic
atacgccatgctgggtctccggcttatagcttcaaagtaatcttctataagtctagtaaacatctttgtcctaagatcaccaatatataattctctgttgccacccacttgttctttatacgtacttgggagtcggccat

SEQ ID NO: 428224 - DNA, 140 bp, Artificial Sequence
  Synthetic
atggccgactcccaagtacgtataaagaacaagtgggtggcaacagagaattatatattggtgatcttaggacaaagatgtttactagacttatagaagattactttgaagctataagccggagacccagcatggcgtat

SEQ ID NO: 428225 - DNA, 140 bp, Artificial Sequence
  Synthetic
aggccctggctgctgatatggctgaactcctccaaatgggaaacaaacaagccaaggtcccagaatcaaaagacagcccgagagccagcctaatcccagatgccacacatctagggccgcgaccttttgggacagcggtg

SEQ ID NO: 428226 - DNA, 140 bp, Artificial Sequence
  Synthetic
caccgctgtcccaaaaggtcgcggccctagatgtgtggcatctgggattaggctggctctcgggctgtcttttgattctgggaccttggcttgtttgtttcccatttggaggagttcagccatatcagcagccagggcct

SEQ ID NO: 428227 - DNA, 140 bp, Artificial Sequence
  Synthetic
atacgccatgctgggtctccactcagactcctcgaacaatgcattactttcttgtgaatattttaatagagtaaataaggtgtccctgagcttgtcatttacccagtcaggtatctgttccgtacttgggagtcggccat

SEQ ID NO: 428228 - DNA, 140 bp, Artificial Sequence
  Synthetic
atggccgactcccaagtacggaacagatacctgactgggtaaatgacaagctcagggacaccttatttactctattaaaatattcacaagaaagtaatgcattgttcgaggagtctgagtggagacccagcatggcgtat

SEQ ID NO: 428229 - DNA, 140 bp, Artificial Sequence
  Synthetic
aggccctggctgctgatatggtaaataaggtgtccctgagcttgtcatttacccagtcaggtatctgttcattatagaatgttgttctgccgtctatgagagggatgaggttgatgccaagaccttttgggacagcggtg

SEQ ID NO: 428230 - DNA, 140 bp, Artificial Sequence
  Synthetic
caccgctgtcccaaaaggtcttggcatcaacctcatccctctcatagacggcagaacaacattctataatgaacagatacctgactgggtaaatgacaagctcagggacaccttatttaccatatcagcagccagggcct

SEQ ID NO: 428231 - DNA, 140 bp, Artificial Sequence
  Synthetic
atacgccatgctgggtctcctacttttgttcaaaattagctggggatgatctgacaaagcattcaagtaaaattagaacattgccagtgagtttgtaaccatcaggaaccacaaagcacacgtacttgggagtcggccat

SEQ ID NO: 428232 - DNA, 140 bp, Artificial Sequence
  Synthetic
atggccgactcccaagtacgtgtgctttgtggttcctgatggttacaaactcactggcaatgttctaattttacttgaatgctttgtcagatcatccccagctaattttgaacaaaagtaggagacccagcatggcgtat

SEQ ID NO: 428233 - DNA, 140 bp, Artificial Sequence
  Synthetic
aggccctggctgctgatatgaattagaacattgccagtgagtttgtaaccatcaggaaccacaaagcacaaagctggagtaagaatcccatgatcattaaggatggactcaactgatttggaccttttgggacagcggtg

SEQ ID NO: 428234 - DNA, 140 bp, Artificial Sequence
  Synthetic
caccgctgtcccaaaaggtccaaatcagttgagtccatccttaatgatcatgggattcttactccagctttgtgctttgtggttcctgatggttacaaactcactggcaatgttctaattcatatcagcagccagggcct

SEQ ID NO: 428235 - DNA, 140 bp, Artificial Sequence
  Synthetic
atacgccatgctgggtctccgcagagagacagcagctttaatccttccatgagcaacattctgggttcagtttggactagaaaagccaatttctgtcttgacagcttctcgttgtctgcacgtacttgggagtcggccat

SEQ ID NO: 428236 - DNA, 140 bp, Artificial Sequence
  Synthetic
atggccgactcccaagtacgtgcagacaacgagaagctgtcaagacagaaattggcttttctagtccaaactgaacccagaatgttgctcatggaaggattaaagctgctgtctctctgcggagacccagcatggcgtat

SEQ ID NO: 428237 - DNA, 140 bp, Artificial Sequence
  Synthetic
atacgccatgctgggtctccaggtactttgagatgaggtctttggcgttggcaatgtcttcctccattattgaatgtagcacttaagttgagttgaggtttgtgtttgtgtgatctgcagcgtacttgggagtcggccat

SEQ ID NO: 428238 - DNA, 140 bp, Artificial Sequence
  Synthetic
atggccgactcccaagtacgctgcagatcacacaaacacaaacctcaactcaacttaagtgctacattcaataatggaggaagacattgccaacgccaaagacctcatctcaaagtacctggagacccagcatggcgtat

SEQ ID NO: 428239 - DNA, 140 bp, Artificial Sequence
  Synthetic
aggccctggctgctgatatgggtggatgctgattgaggccgagttgaagtgctttgggaacacagcagttgcgaaatgcaatgagaaacatgatgaagagttttgtgacatgttaagattgaccttttgggacagcggtg

SEQ ID NO: 428240 - DNA, 140 bp, Artificial Sequence
  Synthetic
caccgctgtcccaaaaggtcaatcttaacatgtcacaaaactcttcatcatgtttctcattgcatttcgcaactgctgtgttcccaaagcacttcaactcggcctcaatcagcatccacccatatcagcagccagggcct

SEQ ID NO: 428241 - DNA, 140 bp, Artificial Sequence
  Synthetic
aggccctggctgctgatatgatcttctcaacggtctcctttagctgactgaaataaacacttgcacctccatcgagcagaatttcatctagatcggcttcatcggcatcacttttgcgctgaccttttgggacagcggtg

SEQ ID NO: 428242 - DNA, 140 bp, Artificial Sequence
  Synthetic
caccgctgtcccaaaaggtcagcgcaaaagtgatgccgatgaagccgatctagatgaaattctgctcgatggaggtgcaagtgtttatttcagtcagctaaaggagaccgttgagaagatcatatcagcagccagggcct

SEQ ID NO: 428243 - DNA, 140 bp, Artificial Sequence
  Synthetic
atacgccatgctgggtctccatcctggtgtaccagtcaaatggaaaagataggagacagacccacccatgggcccccgtgacccaccgccgaaaggcggtgggtcacgggggcgtccattcgtacttgggagtcggccat

SEQ ID NO: 428244 - DNA, 140 bp, Artificial Sequence
  Synthetic
atggccgactcccaagtacgaatggacgcccccgtgacccaccgcctttcggcggtgggtcacgggggcccatgggtgggtctgtctcctatcttttccatttgactggtacaccaggatggagacccagcatggcgtat

SEQ ID NO: 428245 - DNA, 140 bp, Artificial Sequence
  Synthetic
aggccctggctgctgatatgtcagtgcaatgtcaataagctttatgtcccttcttccttgggagtccaagagtctcttaatatcatctgaaccttgacaggtcagtaccatattgcgagggaccttttgggacagcggtg

SEQ ID NO: 428246 - DNA, 140 bp, Artificial Sequence
  Synthetic
caccgctgtcccaaaaggtccctcgcaatatggtactgacctgtcaaggttcagatgatattaagagactcttggactcccaaggaagaagggacataaagcttattgacattgcactgacatatcagcagccagggcct

SEQ ID NO: 428247 - DNA, 140 bp, Artificial Sequence
  Synthetic
aggccctggctgctgatatgttgccatctacccagtctctgacatctgtctcgcaattcaataagaatgggtcaatagggtatcttgcatattgcaaaagacttaaggttcttttctgtagaccttttgggacagcggtg

SEQ ID NO: 428248 - DNA, 140 bp, Artificial Sequence
  Synthetic
caccgctgtcccaaaaggtctacagaaaagaaccttaagtcttttgcaatatgcaagataccctattgacccattcttattgaattgcgagacagatgtcagagactgggtagatggcaacatatcagcagccagggcct

SEQ ID NO: 428249 - DNA, 140 bp, Artificial Sequence
  Synthetic
aggccctggctgctgatatggccctaaaccacacagactcaaccacatgggcatatgctcatgtggtctttacaaacatcctggtgtaccagttaagtggaaaagataagagataaacccgaccttttgggacagcggtg

SEQ ID NO: 428250 - DNA, 140 bp, Artificial Sequence
  Synthetic
caccgctgtcccaaaaggtcgggtttatctcttatcttttccacttaactggtacaccaggatgtttgtaaagaccacatgagcatatgcccatgtggttgagtctgtgtggtttagggccatatcagcagccagggcct

SEQ ID NO: 428251 - DNA, 140 bp, Artificial Sequence
  Synthetic
aggccctggctgctgatatgataagggttcctctcaccaggtgtgtctgagacaaacattcccaaagatttttttacctttaaaatagactttaagatgccatccattgtctggggtgtagaccttttgggacagcggtg

SEQ ID NO: 428252 - DNA, 140 bp, Artificial Sequence
  Synthetic
caccgctgtcccaaaaggtctacaccccagacaatggatggcatcttaaagtctattttaaaggtaaaaaaatctttgggaatgtttgtctcagacacacctggtgagaggaacccttatcatatcagcagccagggcct

SEQ ID NO: 428253 - DNA, 140 bp, Artificial Sequence
  Synthetic
aggccctggctgctgatatgtcttcttagtgtccaccatattcagtataggatggctttgggaaagtctgtccaggtcggagctatttgggtacttagctgtgtatattagacccaggtcgaccttttgggacagcggtg

SEQ ID NO: 428254 - DNA, 140 bp, Artificial Sequence
  Synthetic
caccgctgtcccaaaaggtcgacctgggtctaatatacacagctaagtacccaaatagctccgacctggacagactttcccaaagccatcctatactgaatatggtggacactaagaagacatatcagcagccagggcct

SEQ ID NO: 428255 - DNA, 140 bp, Artificial Sequence
  Synthetic
aggccctggctgctgatatggacatgctaatgtcagactaggcatggtgccgaactggttgttcaaaagatccggattcttaacatcccacaccctaacaactccgtctcttccaggttggaccttttgggacagcggtg

SEQ ID NO: 428256 - DNA, 140 bp, Artificial Sequence
  Synthetic
caccgctgtcccaaaaggtccaacctggaagagacggagttgttagggtgtgggatgttaagaatccggatcttttgaacaaccagttcggcaccatgcctagtctgacattagcatgtccatatcagcagccagggcct

SEQ ID NO: 428257 - DNA, 140 bp, Artificial Sequence
  Synthetic
aggccctggctgctgatatgtaacaagatggatgctgattgaggccgagttgaagtgctttgggaacacagcagttgcgaaatgcaatgagaaacatgatgaagagttttgtgacatgttgaccttttgggacagcggtg

SEQ ID NO: 428258 - DNA, 140 bp, Artificial Sequence
  Synthetic
caccgctgtcccaaaaggtcaacatgtcacaaaactcttcatcatgtttctcattgcatttcgcaactgctgtgttcccaaagcacttcaactcggcctcaatcagcatccatcttgttacatatcagcagccagggcct

SEQ ID NO: 428259 - DNA, 140 bp, Artificial Sequence
  Synthetic
atacgccatgctgggtctcccctcagaacatgtggtctgctagagcagcagttcactatagaataaggttccgtaggggcacaaaagacacaagagtcaactgaaggcaatttaattagacgtacttgggagtcggccat

SEQ ID NO: 428260 - DNA, 140 bp, Artificial Sequence
  Synthetic
atggccgactcccaagtacgtctaattaaattgccttcagttgactcttgtgtcttttgtgcccctacggaaccttattctatagtgaactgctgctctagcagaccacatgttctgaggggagacccagcatggcgtat

SEQ ID NO: 428261 - DNA, 140 bp, Artificial Sequence
  Synthetic
aggccctggctgctgatatgagtcagctgccaatgtcagcaggtcatctgaggtcaaggtcccaactctcaagatactcttttgttgtgtcgatttgagttctacaagattgttgacagcgaccttttgggacagcggtg

SEQ ID NO: 428262 - DNA, 140 bp, Artificial Sequence
  Synthetic
caccgctgtcccaaaaggtcgctgtcaacaatcttgtagaactcaaatcgacacaacaaaagagtatcttgagagttgggaccttgacctcagatgacctgctgacattggcagctgactcatatcagcagccagggcct

SEQ ID NO: 428263 - DNA, 140 bp, Artificial Sequence
  Synthetic
aggccctggctgctgatatgattgaattctttgttttaatctatcagacatcattgatttcaatgcaccaactaaaaggtgtggggaactatcaccaatctcccttacaaacatttctaagaccttttgggacagcggtg

SEQ ID NO: 428264 - DNA, 140 bp, Artificial Sequence
  Synthetic
caccgctgtcccaaaaggtcttagaaatgtttgtaagggagattggtgatagttccccacaccttttagttggtgcattgaaatcaatgatgtctgatagattaaaacaaagaattcaatcatatcagcagccagggcct

SEQ ID NO: 428265 - DNA, 140 bp, Artificial Sequence
  Synthetic
atacgccatgctgggtctccccggggatcctaggcaattcagttggactttagttgtagggctccttttagtgaatccctgaatcaaagcacccagtaaaatgggcaacaaacaggctaacgtacttgggagtcggccat

SEQ ID NO: 428266 - DNA, 140 bp, Artificial Sequence
  Synthetic
atggccgactcccaagtacgttagcctgtttgttgcccattttactgggtgctttgattcagggattcactaaaaggagccctacaactaaagtccaactgaattgcctaggatccccggggagacccagcatggcgtat

SEQ ID NO: 428267 - DNA, 140 bp, Artificial Sequence
  Synthetic
aggccctggctgctgatatggtgaatccctgaatcaaagcacccagtaaaatgggcaacaaacaggctaaatcgacaaaagtcgatgaacaccaaagagctcatctagtgccagatgcatgaccttttgggacagcggtg

SEQ ID NO: 428268 - DNA, 140 bp, Artificial Sequence
  Synthetic
caccgctgtcccaaaaggtcatgcatctggcactagatgagctctttggtgttcatcgacttttgtcgatttagcctgtttgttgcccattttactgggtgctttgattcagggattcaccatatcagcagccagggcct

SEQ ID NO: 428269 - DNA, 140 bp, Artificial Sequence
  Synthetic
aggccctggctgctgatatgattcatttaccacatctgattcaacaaaccaggctgaccttcctttgaaagttggacccgacaaagcaagtctccaacagtcagacagaacacatgggctgaccttttgggacagcggtg

SEQ ID NO: 428270 - DNA, 140 bp, Artificial Sequence
  Synthetic
caccgctgtcccaaaaggtcagcccatgtgttctgtctgactgttggagacttgctttgtcgggtccaactttcaaaggaaggtcagcctggtttgttgaatcagatgtggtaaatgaatcatatcagcagccagggcct

SEQ ID NO: 428271 - DNA, 140 bp, Artificial Sequence
  Synthetic
aggccctggctgctgatatgcgagatccacagtagtattctcccaagccctacccacaatagaagtccttgaagctatgtagggccagccgtcaccggaaagacagatcttgtaaagtatgaccttttgggacagcggtg

SEQ ID NO: 428272 - DNA, 140 bp, Artificial Sequence
  Synthetic
caccgctgtcccaaaaggtcatactttacaagatctgtctttccggtgacggctggccctacatagcttcaaggacttctattgtgggtagggcttgggagaatactactgtggatctcgcatatcagcagccagggcct

SEQ ID NO: 428273 - DNA, 140 bp, Artificial Sequence
  Synthetic
aggccctggctgctgatatgagctaaaggcagcagcacagccgagcgcaccatcaaccgaggcgacccagaacacaacacctccaccatacaccccgtaaccccaggaccaacactcccagaccttttgggacagcggtg

SEQ ID NO: 428274 - DNA, 140 bp, Artificial Sequence
  Synthetic
caccgctgtcccaaaaggtctgggagtgttggtcctggggttacggggtgtatggtggaggtgttgtgttctgggtcgcctcggttgatggtgcgctcggctgtgctgctgcctttagctcatatcagcagccagggcct

SEQ ID NO: 428275 - DNA, 140 bp, Artificial Sequence
  Synthetic
atacgccatgctgggtctccccacactgatcccaacatcctttaaagcagtagtggccttcaaaatggtcttctggaatattgaattgaggatttgatttttactctgacactgggaggacgtacttgggagtcggccat

SEQ ID NO: 428276 - DNA, 140 bp, Artificial Sequence
  Synthetic
atggccgactcccaagtacgtcctcccagtgtcagagtaaaaatcaaatcctcaattcaatattccagaagaccattttgaaggccactactgctttaaaggatgttgggatcagtgtggggagacccagcatggcgtat

SEQ ID NO: 428277 - DNA, 140 bp, Artificial Sequence
  Synthetic
aggccctggctgctgatatgttccccgagcacccatgctccaagttctatggctgtggatagtgttatgcacatataatcccatagaagaggtcttaaataagtgacaacagtatcacctgaccttttgggacagcggtg

SEQ ID NO: 428278 - DNA, 140 bp, Artificial Sequence
  Synthetic
caccgctgtcccaaaaggtcaggtgatactgttgtcacttatttaagacctcttctatgggattatatgtgcataacactatccacagccatagaacttggagcatgggtgctcggggaacatatcagcagccagggcct

SEQ ID NO: 428279 - DNA, 140 bp, Artificial Sequence
  Synthetic
atacgccatgctgggtctcccgagatccctttttgttgactccagagaaactagtctatcattaacacttaagaagcaagatcccaaccaccctcttagacacttttgtttcattaggtccgtacttgggagtcggccat

SEQ ID NO: 428280 - DNA, 140 bp, Artificial Sequence
  Synthetic
atggccgactcccaagtacggacctaatgaaacaaaagtgtctaagagggtggttgggatcttgcttcttaagtgttaatgatagactagtttctctggagtcaacaaaaagggatctcgggagacccagcatggcgtat

SEQ ID NO: 428281 - DNA, 140 bp, Artificial Sequence
  Synthetic
aggccctggctgctgatatgctatctttgacttctggtgaaactttccatatctggattccattgtctcccatcactgcttcaacaccttgaacccccaatagctgagtctgtatggatcgaccttttgggacagcggtg

SEQ ID NO: 428282 - DNA, 140 bp, Artificial Sequence
  Synthetic
caccgctgtcccaaaaggtcgatccatacagactcagctattgggggttcaaggtgttgaagcagtgatgggagacaatggaatccagatatggaaagtttcaccagaagtcaaagatagcatatcagcagccagggcct

SEQ ID NO: 428283 - DNA, 140 bp, Artificial Sequence
  Synthetic
atacgccatgctgggtctccatcctaggcaattcagctggacttcagtggtgaggtttttttctcttagtgaatccccaaatcaaagtacccagtaaaatgggcaacagacaggctaaatcgtacttgggagtcggccat

SEQ ID NO: 428284 - DNA, 140 bp, Artificial Sequence
  Synthetic
atggccgactcccaagtacgatttagcctgtctgttgcccattttactgggtactttgatttggggattcactaagagaaaaaaacctcaccactgaagtccagctgaattgcctaggatggagacccagcatggcgtat

SEQ ID NO: 428285 - DNA, 140 bp, Artificial Sequence
  Synthetic
aggccctggctgctgatatgtccttgtgttcaatatcctcaaagattttactttatttaggaatgatctccagcattgaacctgacattctccagtggtttgattttcccctttttcattgaccttttgggacagcggtg

SEQ ID NO: 428286 - DNA, 140 bp, Artificial Sequence
  Synthetic
caccgctgtcccaaaaggtcaatgaaaaaggggaaaatcaaaccactggagaatgtcaggttcaatgctggagatcattcctaaataaagtaaaatctttgaggatattgaacacaaggacatatcagcagccagggcct

SEQ ID NO: 428287 - DNA, 140 bp, Artificial Sequence
  Synthetic
aggccctggctgctgatatgcccctcatcaatatttgcatacaaaaatctcaatattggtgatgctctcttaaactgatgaattaagtgctcgatgttgtcttctgcagctaccttatcagaccttttgggacagcggtg

SEQ ID NO: 428288 - DNA, 140 bp, Artificial Sequence
  Synthetic
caccgctgtcccaaaaggtctgataaggtagctgcagaagacaacatcgagcacttaattcatcagtttaagagagcatcaccaatattgagatttttgtatgcaaatattgatgaggggcatatcagcagccagggcct

SEQ ID NO: 428289 - DNA, 140 bp, Artificial Sequence
  Synthetic
aggccctggctgctgatatgttgagttgattttaattcaacaagattgttgaccgcttgatttaggtccctcaaccgtttcaaatcattgtcatcccttctctccttgcgcatcaaccgtgaccttttgggacagcggtg

SEQ ID NO: 428290 - DNA, 140 bp, Artificial Sequence
  Synthetic
caccgctgtcccaaaaggtcacggttgatgcgcaaggagagaagggatgacaatgatttgaaacggttgagggacctaaatcaagcggtcaacaatcttgttgaattaaaatcaactcaacatatcagcagccagggcct

SEQ ID NO: 428291 - DNA, 140 bp, Artificial Sequence
  Synthetic
atacgccatgctgggtctccgccctcagaacatgtggtctgctagagcaacaattcactataggatgaagcctcgtagaatgcacagaagacacaagacgaaattaaagacaatttaattcgtacttgggagtcggccat

SEQ ID NO: 428292 - DNA, 140 bp, Artificial Sequence
  Synthetic
atggccgactcccaagtacgaattaaattgtctttaatttcgtcttgtgtcttctgtgcattctacgaggcttcatcctatagtgaattgttgctctagcagaccacatgttctgagggcggagacccagcatggcgtat

SEQ ID NO: 428293 - DNA, 140 bp, Artificial Sequence
  Synthetic
aggccctggctgctgatatgagatgcctctccctacaaaactgagatcatcagccgctccaacagcacccccaaccggagcagcggacggcaccaaacccccaccctacagcccctgaacgaccttttgggacagcggtg

SEQ ID NO: 428294 - DNA, 140 bp, Artificial Sequence
  Synthetic
caccgctgtcccaaaaggtcgttcaggggctgtagggtgggggtttggtgccgtccgctgctccggttgggggtgctgttggagcggctgatgatctcagttttgtagggagaggcatctcatatcagcagccagggcct

SEQ ID NO: 428295 - DNA, 140 bp, Artificial Sequence
  Synthetic
atacgccatgctgggtctccaacaaagagcataacccctgaactccacccagctgtccgctgcctcaagaaccgcacttaagatcccctcacaactcggcgccgcagccctgagcacagacgtacttgggagtcggccat

SEQ ID NO: 428296 - DNA, 140 bp, Artificial Sequence
  Synthetic
atggccgactcccaagtacgtctgtgctcagggctgcggcgccgagttgtgaggggatcttaagtgcggttcttgaggcagcggacagctgggtggagttcaggggttatgctctttgttggagacccagcatggcgtat

SEQ ID NO: 428297 - DNA, 140 bp, Artificial Sequence
  Synthetic
aggccctggctgctgatatgccttggaagcactcatcttggtctggacacttagggattgactggtcgaaagtttcactcagtaagtcaataaaaggcgcaatccagtagcctaggatccgaccttttgggacagcggtg

SEQ ID NO: 428298 - DNA, 140 bp, Artificial Sequence
  Synthetic
caccgctgtcccaaaaggtcggatcctaggctactggattgcgccttttattgacttactgagtgaaactttcgaccagtcaatccctaagtgtccagaccaagatgagtgcttccaaggcatatcagcagccagggcct

SEQ ID NO: 428299 - DNA, 140 bp, Artificial Sequence
  Synthetic
atacgccatgctgggtctccccggggatcctaggcaattcagctggacttcagtggtgaggcttattttagtgaactcctgaaccaaagcgcccagtcaaaatgggcaacagacaggccacgtacttgggagtcggccat

SEQ ID NO: 428300 - DNA, 140 bp, Artificial Sequence
  Synthetic
atggccgactcccaagtacgtggcctgtctgttgcccattttgactgggcgctttggttcaggagttcactaaaataagcctcaccactgaagtccagctgaattgcctaggatccccggggagacccagcatggcgtat

SEQ ID NO: 428301 - DNA, 140 bp, Artificial Sequence
  Synthetic
aggccctggctgctgatatgaatcgacaaaagtcgatgaacatcaaagagctcatctagtgccagatgcatcccatctaggcccccagttctgcaagagttgctggtttgagaacagagggaccttttgggacagcggtg

SEQ ID NO: 428302 - DNA, 140 bp, Artificial Sequence
  Synthetic
caccgctgtcccaaaaggtccctctgttctcaaaccagcaactcttgcagaactgggggcctagatgggatgcatctggcactagatgagctctttgatgttcatcgacttttgtcgattcatatcagcagccagggcct

SEQ ID NO: 428303 - DNA, 140 bp, Artificial Sequence
  Synthetic
atacgccatgctgggtctccatgtggctcatgccaaccctgtcctccagcagtttcgaaacagtaggtctcaaggggaagtaatcacaaggattatgtttaaaaaagtccaagatctgagcgtacttgggagtcggccat

SEQ ID NO: 428304 - DNA, 140 bp, Artificial Sequence
  Synthetic
atggccgactcccaagtacgctcagatcttggacttttttaaacataatccttgtgattacttccccttgagacctactgtttcgaaactgctggaggacagggttggcatgagccacatggagacccagcatggcgtat

SEQ ID NO: 428305 - DNA, 140 bp, Artificial Sequence
  Synthetic
aggccctggctgctgatatgacctccaccgcccaccccccacccccggggggaccccccgccgggggcccccccgggggggcaggcggtccagctctactcaatgtcctcaacacacttcgaccttttgggacagcggtg

SEQ ID NO: 428306 - DNA, 140 bp, Artificial Sequence
  Synthetic
caccgctgtcccaaaaggtcgaagtgtgttgaggacattgagtagagctggaccgcctgcccccccgggggggcccccggcggggggtccccccgggggtggggggtgggcggtggaggtcatatcagcagccagggcct

SEQ ID NO: 428307 - DNA, 140 bp, Artificial Sequence
  Synthetic
aggccctggctgctgatatgtcctcaaagattgtgtccacaaaaaggattttatttcctttgaggcactcatcgccagattgttgtgttgtatgcacacaacaaagaactgagactatctgaccttttgggacagcggtg

SEQ ID NO: 428308 - DNA, 140 bp, Artificial Sequence
  Synthetic
caccgctgtcccaaaaggtcagatagtctcagttctttgttgtgtgcatacaacacaacaatctggcgatgagtgcctcaaaggaaataaaatcctttttgtggacacaatctttgaggacatatcagcagccagggcct

SEQ ID NO: 428309 - DNA, 140 bp, Artificial Sequence
  Synthetic
aggccctggctgctgatatgacaatattgtcaacagtgcacctcagttggtcgaagtattctgatgcccctccatccagcagtatctcatctagatcagcattgttggtgtcaccactccgaccttttgggacagcggtg

SEQ ID NO: 428310 - DNA, 140 bp, Artificial Sequence
  Synthetic
caccgctgtcccaaaaggtcggagtggtgacaccaacaatgctgatctagatgagatactgctggatggaggggcatcagaatacttcgaccaactgaggtgcactgttgacaatattgtcatatcagcagccagggcct

SEQ ID NO: 428311 - DNA, 140 bp, Artificial Sequence
  Synthetic
aggccctggctgctgatatgtttcttaatgtcttccgacccttgacaggtgatgaccatgtttcgtgggagtgcctctataactgcacttgtcaggccgggctgcgcagcaaacaagtcagaccttttgggacagcggtg

SEQ ID NO: 428312 - DNA, 140 bp, Artificial Sequence
  Synthetic
caccgctgtcccaaaaggtctgacttgtttgctgcgcagcccggcctgacaagtgcagttatagaggcactcccacgaaacatggtcatcacctgtcaagggtcggaagacattaagaaacatatcagcagccagggcct

SEQ ID NO: 428313 - DNA, 140 bp, Artificial Sequence
  Synthetic
aggccctggctgctgatatgtgtatcctttaagaattcatttaccacatctgattcaacaaaccaggctgacctacctttgaaagttggacccgacaaagcaagtctccaacagtcagacgaccttttgggacagcggtg

SEQ ID NO: 428314 - DNA, 140 bp, Artificial Sequence
  Synthetic
caccgctgtcccaaaaggtcgtctgactgttggagacttgctttgtcgggtccaactttcaaaggtaggtcagcctggtttgttgaatcagatgtggtaaatgaattcttaaaggatacacatatcagcagccagggcct

SEQ ID NO: 428315 - DNA, 140 bp, Artificial Sequence
  Synthetic
aggccctggctgctgatatgcatcactggagaaaactgaaggaaaaaaccgtttgggatcagcataaaaggaacaaacctctccaactacattgttgttaatagcataacactttgagcagaccttttgggacagcggtg

SEQ ID NO: 428316 - DNA, 140 bp, Artificial Sequence
  Synthetic
caccgctgtcccaaaaggtctgctcaaagtgttatgctattaacaacaatgtagttggagaggtttgttccttttatgctgatcccaaacggttttttccttcagttttctccagtgatgcatatcagcagccagggcct

SEQ ID NO: 428317 - DNA, 140 bp, Artificial Sequence
  Synthetic
atacgccatgctgggtctcccggggatcctaggcaatttgattgttcttccttcttgaagctttttgcgctgaactcctccaaatgggaaacaagcaaaccaaagccccagaagtgaaagcgtacttgggagtcggccat

SEQ ID NO: 428318 - DNA, 140 bp, Artificial Sequence
  Synthetic
atggccgactcccaagtacgctttcacttctggggctttggtttgcttgtttcccatttggaggagttcagcgcaaaaagcttcaagaaggaagaacaatcaaattgcctaggatccccgggagacccagcatggcgtat

SEQ ID NO: 428319 - DNA, 140 bp, Artificial Sequence
  Synthetic
aggccctggctgctgatatgtttcctttgaggcactcatcgccagattgttgcgttgaatgcacgcaatagaaagctgagactatctgccaaagtgttaaaagcaaagcgcaatccaatagaccttttgggacagcggtg

SEQ ID NO: 428320 - DNA, 140 bp, Artificial Sequence
  Synthetic
caccgctgtcccaaaaggtctattggattgcgctttgcttttaacactttggcagatagtctcagctttctattgcgtgcattcaacgcaacaatctggcgatgagtgcctcaaaggaaacatatcagcagccagggcct

SEQ ID NO: 428321 - DNA, 140 bp, Artificial Sequence
  Synthetic
aggccctggctgctgatatgactttcttgcattataaaccatttcagcaagctcttcctccaatgcatcatccttcgggttcacacttacatgtccaaattccaatttaggctcaaggaagaccttttgggacagcggtg

SEQ ID NO: 428322 - DNA, 140 bp, Artificial Sequence
  Synthetic
caccgctgtcccaaaaggtcttccttgagcctaaattggaatttggacatgtaagtgtgaacccgaaggatgatgcattggaggaagagcttgctgaaatggtttataatgcaagaaagtcatatcagcagccagggcct

SEQ ID NO: 428323 - DNA, 140 bp, Artificial Sequence
  Synthetic
aggccctggctgctgatatgcaacacagccgagcgcaccatcaactgaggcgacccagaacacaacacccccaccgtacaccccatgataccaggaccgacatccccacctccatcacccgaccttttgggacagcggtg

SEQ ID NO: 428324 - DNA, 140 bp, Artificial Sequence
  Synthetic
caccgctgtcccaaaaggtcgggtgatggaggtggggatgtcggtcctggtatcatggggtgtacggtgggggtgttgtgttctgggtcgcctcagttgatggtgcgctcggctgtgttgcatatcagcagccagggcct

SEQ ID NO: 428325 - DNA, 140 bp, Artificial Sequence
  Synthetic
aggccctggctgctgatatgtttctatgccaacctccctcaaagcattagtggctcgagttaaaactctgttgatgatggcaaggagctcacaatttcgttcttctttaagtgataggacgaccttttgggacagcggtg

SEQ ID NO: 428326 - DNA, 140 bp, Artificial Sequence
  Synthetic
caccgctgtcccaaaaggtcgtcctatcacttaaagaagaacgaaattgtgagctccttgccatcatcaacagagttttaactcgagccactaatgctttgagggaggttggcatagaaacatatcagcagccagggcct

SEQ ID NO: 428327 - DNA, 140 bp, Artificial Sequence
  Synthetic
atacgccatgctgggtctccacctgcattcctgtctttagttttcctcctgctgtccatccaccgtttcagatctctttttgttgattctaatgagactaatctatcgttgacactcacacgtacttgggagtcggccat

SEQ ID NO: 428328 - DNA, 140 bp, Artificial Sequence
  Synthetic
atggccgactcccaagtacgtgtgagtgtcaacgatagattagtctcattagaatcaacaaaaagagatctgaaacggtggatggacagcaggaggaaaactaaagacaggaatgcaggtggagacccagcatggcgtat

SEQ ID NO: 428329 - DNA, 140 bp, Artificial Sequence
  Synthetic
aggccctggctgctgatatgattttggttgacgccaaatcgctcataaatggtaatatgtgtttctcaaacacagatgggtacagccttcttaaagaatgaatgatgtgattcaacccaagaccttttgggacagcggtg

SEQ ID NO: 428330 - DNA, 140 bp, Artificial Sequence
  Synthetic
caccgctgtcccaaaaggtcttgggttgaatcacatcattcattctttaagaaggctgtacccatctgtgtttgagaaacacatattaccatttatgagcgatttggcgtcaaccaaaatcatatcagcagccagggcct

SEQ ID NO: 428331 - DNA, 140 bp, Artificial Sequence
  Synthetic
aggccctggctgctgatatgaaattgactttctatgttcccttgccttagtttgttcctgaagatttgatattcctcttcaattagacttttgacttcatgagaggtgagcttgttattagaccttttgggacagcggtg

SEQ ID NO: 428332 - DNA, 140 bp, Artificial Sequence
  Synthetic
caccgctgtcccaaaaggtctaataacaagctcacctctcatgaagtcaaaagtctaattgaagaggaatatcaaatcttcaggaacaaactaaggcaagggaacatagaaagtcaatttcatatcagcagccagggcct

SEQ ID NO: 428333 - DNA, 140 bp, Artificial Sequence
  Synthetic
atacgccatgctgggtctccaggctaaagattcacaaagtcttgaatactcagactcttcgaacaatgcattactttcttgtgagtattttaacaaggtgaataaggtgtccctgagtttcgtacttgggagtcggccat

SEQ ID NO: 428334 - DNA, 140 bp, Artificial Sequence
  Synthetic
atggccgactcccaagtacgaaactcagggacaccttattcaccttgttaaaatactcacaagaaagtaatgcattgttcgaagagtctgagtattcaagactttgtgaatctttagcctggagacccagcatggcgtat

SEQ ID NO: 428335 - DNA, 140 bp, Artificial Sequence
  Synthetic
aggccctggctgctgatatgttctatttctcctttcctcaatctgttcctaaacacttgatattcctcttcaatctgcagtttcacttcatgagctgttaacttattattgataccttgggaccttttgggacagcggtg

SEQ ID NO: 428336 - DNA, 140 bp, Artificial Sequence
  Synthetic
caccgctgtcccaaaaggtcccaaggtatcaataataagttaacagctcatgaagtgaaactgcagattgaagaggaatatcaagtgtttaggaacagattgaggaaaggagaaatagaacatatcagcagccagggcct

SEQ ID NO: 428337 - DNA, 140 bp, Artificial Sequence
  Synthetic
aggccctggctgctgatatgactatagtgttttcccaagccctaccagtgattgaagttcttgatgcaatgtaaggccatccgtctcctgaaaggcagattttgtataatatgttctcatgaccttttgggacagcggtg

SEQ ID NO: 428338 - DNA, 140 bp, Artificial Sequence
  Synthetic
caccgctgtcccaaaaggtcatgagaacatattatacaaaatctgcctttcaggagacggatggccttacattgcatcaagaacttcaatcactggtagggcttgggaaaacactatagtcatatcagcagccagggcct

SEQ ID NO: 428339 - DNA, 140 bp, Artificial Sequence
  Synthetic
aggccctggctgctgatatgtatcagtcttaacaaattgactttctatgttcccttgccttagtttgttcctgaagatttgatactcctcttcaattagactcttgacttcatgagaggtgaccttttgggacagcggtg

SEQ ID NO: 428340 - DNA, 140 bp, Artificial Sequence
  Synthetic
caccgctgtcccaaaaggtcacctctcatgaagtcaagagtctaattgaagaggagtatcaaatcttcaggaacaaactaaggcaagggaacatagaaagtcaatttgttaagactgatacatatcagcagccagggcct

SEQ ID NO: 428341 - DNA, 140 bp, Artificial Sequence
  Synthetic
aggccctggctgctgatatggcacctgtgtagggtttgggcttgtgccagaatggcttgtgggtcagttagtggtgcctcacaaaagatccaacagaaatgagagacaatatgcctaggagaccttttgggacagcggtg

SEQ ID NO: 428342 - DNA, 140 bp, Artificial Sequence
  Synthetic
caccgctgtcccaaaaggtctcctaggcatattgtctctcatttctgttggatcttttgtgaggcaccactaactgacccacaagccattctggcacaagcccaaaccctacacaggtgccatatcagcagccagggcct

SEQ ID NO: 428343 - DNA, 140 bp, Artificial Sequence
  Synthetic
aggccctggctgctgatatgcagccgagtgcaccaccaactgaggcgatccagaacacaacacctccaccgtacaccccataatcccaggaccaacactcccacttccatcacccaccccgaccttttgggacagcggtg

SEQ ID NO: 428344 - DNA, 140 bp, Artificial Sequence
  Synthetic
caccgctgtcccaaaaggtcggggtgggtgatggaagtgggagtgttggtcctgggattatggggtgtacggtggaggtgttgtgttctggatcgcctcagttggtggtgcactcggctgcatatcagcagccagggcct

SEQ ID NO: 428345 - DNA, 140 bp, Artificial Sequence
  Synthetic
atacgccatgctgggtctcccggggatcctaggcaatttaactgcacttcagtggtaaagctcattctagtgaatccctgagttaaagtgtgtagtcaaaatgggcaatagacaagccaacgtacttgggagtcggccat

SEQ ID NO: 428346 - DNA, 140 bp, Artificial Sequence
  Synthetic
atggccgactcccaagtacgttggcttgtctattgcccattttgactacacactttaactcagggattcactagaatgagctttaccactgaagtgcagttaaattgcctaggatccccgggagacccagcatggcgtat

SEQ ID NO: 428347 - DNA, 140 bp, Artificial Sequence
  Synthetic
aggccctggctgctgatatgtcctcctgttgtgtggtaggtcttgcacaaccagtctttataaaggggtttatgagcttcagactctggaactaaacatggagacactcaatatgaccatgaccttttgggacagcggtg

SEQ ID NO: 428348 - DNA, 140 bp, Artificial Sequence
  Synthetic
caccgctgtcccaaaaggtcatggtcatattgagtgtctccatgtttagttccagagtctgaagctcataaacccctttataaagactggttgtgcaagacctaccacacaacaggaggacatatcagcagccagggcct

SEQ ID NO: 428349 - DNA, 140 bp, Artificial Sequence
  Synthetic
aggccctggctgctgatatgtatgagcttcagactctggaactaaacatggagacactcaatatgaccatgcctctctcctgcacaaagaacaacagtcatcattatataatggtgggcagaccttttgggacagcggtg

SEQ ID NO: 428350 - DNA, 140 bp, Artificial Sequence
  Synthetic
caccgctgtcccaaaaggtctgcccaccattatataatgatgactgttgttctttgtgcaggagagaggcatggtcatattgagtgtctccatgtttagttccagagtctgaagctcatacatatcagcagccagggcct

SEQ ID NO: 428351 - DNA, 140 bp, Artificial Sequence
  Synthetic
aggccctggctgctgatatgacctgtgttgggtttgggtttatgtcagaatggcttgtaggtcaactagtagtaccccacaaaagctcctacaaaaatgagagacaatatgcctaggatcgaccttttgggacagcggtg

SEQ ID NO: 428352 - DNA, 140 bp, Artificial Sequence
  Synthetic
caccgctgtcccaaaaggtcgatcctaggcatattgtctctcatttttgtaggagcttttgtggggtactactagttgacctacaagccattctgacataaacccaaacccaacacaggtcatatcagcagccagggcct

SEQ ID NO: 428353 - DNA, 140 bp, Artificial Sequence
  Synthetic
aggccctggctgctgatatgaaggagaagtttcctcctggtgttgaggatcctcagagactttatcttatttagaaaagatctccaacactgcatctgttcactttgagagtcagcagccgaccttttgggacagcggtg

SEQ ID NO: 428354 - DNA, 140 bp, Artificial Sequence
  Synthetic
caccgctgtcccaaaaggtcggctgctgactctcaaagtgaacagatgcagtgttggagatcttttctaaataagataaagtctctgaggatcctcaacaccaggaggaaacttctccttcatatcagcagccagggcct

SEQ ID NO: 428355 - DNA, 140 bp, Artificial Sequence
  Synthetic
aggccctggctgctgatatgtattctgatgctcctccatccaatagtatctcatctagatcagcattgttggtgtcaccactccctcctttggaccccagaacaagattactcattgcttgaccttttgggacagcggtg

SEQ ID NO: 428356 - DNA, 140 bp, Artificial Sequence
  Synthetic
caccgctgtcccaaaaggtcaagcaatgagtaatcttgttctggggtccaaaggagggagtggtgacaccaacaatgctgatctagatgagatactattggatggaggagcatcagaatacatatcagcagccagggcct

SEQ ID NO: 428357 - DNA, 140 bp, Artificial Sequence
  Synthetic
aggccctggctgctgatatgggtgtcaccactccctcctttggaccccagaacaagattactcattgcttgctgtatcttgtaatcataatcctgtttattaagcaagaatttgcctttagaccttttgggacagcggtg

SEQ ID NO: 428358 - DNA, 140 bp, Artificial Sequence
  Synthetic
caccgctgtcccaaaaggtctaaaggcaaattcttgcttaataaacaggattatgattacaagatacagcaagcaatgagtaatcttgttctggggtccaaaggagggagtggtgacacccatatcagcagccagggcct

SEQ ID NO: 428359 - DNA, 140 bp, Artificial Sequence
  Synthetic
aggccctggctgctgatatggctacattgctcttgactcaggccgtggcaggtgggactgtattatgactagttatcaatatctgataatccaaaatacaacctgggaagatcactgccagaccttttgggacagcggtg

SEQ ID NO: 428360 - DNA, 140 bp, Artificial Sequence
  Synthetic
caccgctgtcccaaaaggtctggcagtgatcttcccaggttgtattttggattatcagatattgataactagtcataatacagtcccacctgccacggcctgagtcaagagcaatgtagccatatcagcagccagggcct

SEQ ID NO: 428361 - DNA, 140 bp, Artificial Sequence
  Synthetic
atacgccatgctgggtctccagttatcaatatctgataatccaaaatacaacctgggaagatcactgccaattctcgagaccatctcctatcggttatctcgggctcctctcacaaaggacgtacttgggagtcggccat

SEQ ID NO: 428362 - DNA, 140 bp, Artificial Sequence
  Synthetic
atggccgactcccaagtacgtcctttgtgagaggagcccgagataaccgataggagatggtctcgagaattggcagtgatcttcccaggttgtattttggattatcagatattgataactggagacccagcatggcgtat

SEQ ID NO: 428363 - DNA, 140 bp, Artificial Sequence
  Synthetic
aggccctggctgctgatatgttataatgaagaaccatctacgggacatcatgggaattccatactgtaattacagcaagtattggtacctcaaccacacaactactgggagaacatcactgaccttttgggacagcggtg

SEQ ID NO: 428364 - DNA, 140 bp, Artificial Sequence
  Synthetic
caccgctgtcccaaaaggtcagtgatgttctcccagtagttgtgtggttgaggtaccaatacttgctgtaattacagtatggaattcccatgatgtcccgtagatggttcttcattataacatatcagcagccagggcct

SEQ ID NO: 428365 - DNA, 140 bp, Artificial Sequence
  Synthetic
aggccctggctgctgatatgtttctgatgatattgaacaacaagctgacaatatgatcactgagatgttacagaaggagtatatggagaggcaggggaagacaccattgggtctagttgagaccttttgggacagcggtg

SEQ ID NO: 428366 - DNA, 140 bp, Artificial Sequence
  Synthetic
caccgctgtcccaaaaggtctcaactagacccaatggtgtcttcccctgcctctccatatactccttctgtaacatctcagtgatcatattgtcagcttgttgttcaatatcatcagaaacatatcagcagccagggcct

SEQ ID NO: 428367 - DNA, 140 bp, Artificial Sequence
  Synthetic
aggccctggctgctgatatggaatcccatgatcactcagaatggattcaaccgttttgtcttcagtgttatgttcacatccattggccttgcaagagtcaatctcaatgcaaagagataggaccttttgggacagcggtg

SEQ ID NO: 428368 - DNA, 140 bp, Artificial Sequence
  Synthetic
caccgctgtcccaaaaggtcctatctctttgcattgagattgactcttgcaaggccaatggatgtgaacataacactgaagacaaaacggttgaatccattctgagtgatcatgggattccatatcagcagccagggcct

SEQ ID NO: 428369 - DNA, 140 bp, Artificial Sequence
  Synthetic
aggccctggctgctgatatgcgactctaggtgtcgatgttctgaacaccatatctctgggcagcactgctctcaaaaccgatgtgttcagtcctcctgacactgctgcatcaaacatgatgaccttttgggacagcggtg

SEQ ID NO: 428370 - DNA, 140 bp, Artificial Sequence
  Synthetic
caccgctgtcccaaaaggtcatcatgtttgatgcagcagtgtcaggaggactgaacacatcggttttgagagcagtgctgcccagagatatggtgttcagaacatcgacacctagagtcgcatatcagcagccagggcct

SEQ ID NO: 428371 - DNA, 140 bp, Artificial Sequence
  Synthetic
atacgccatgctgggtctccctcaaaaccgatgtgttcagtcctcctgacactgctgcatcaaacatgatgcagtccattagtgcacagtgaggggttatttcctctttaccgcctctttcgtacttgggagtcggccat

SEQ ID NO: 428372 - DNA, 140 bp, Artificial Sequence
  Synthetic
atggccgactcccaagtacgaaagaggcggtaaagaggaaataacccctcactgtgcactaatggactgcatcatgtttgatgcagcagtgtcaggaggactgaacacatcggttttgagggagacccagcatggcgtat

SEQ ID NO: 428373 - DNA, 140 bp, Artificial Sequence
  Synthetic
aggccctggctgctgatatgcctccatcgccaattgtggcacctgtattgggtttgggtttatgccagaatagcttgtgggtcagctagtggtgccccacaaagctcctacagaaatgaggaccttttgggacagcggtg

SEQ ID NO: 428374 - DNA, 140 bp, Artificial Sequence
  Synthetic
caccgctgtcccaaaaggtcctcatttctgtaggagctttgtggggcaccactagctgacccacaagctattctggcataaacccaaacccaatacaggtgccacaattggcgatggaggcatatcagcagccagggcct

SEQ ID NO: 428375 - DNA, 140 bp, Artificial Sequence
  Synthetic
aggccctggctgctgatatgatcaatcccatgtgagtacttagcatcctgcttgaactgctttaaatcagtaggttcacggaagaagtgtatgtagcagcctgaacttggttgatagagggaccttttgggacagcggtg

SEQ ID NO: 428376 - DNA, 140 bp, Artificial Sequence
  Synthetic
caccgctgtcccaaaaggtccctctatcaaccaagttcaggctgctacatacacttcttccgtgaacctactgatttaaagcagttcaagcaggatgctaagtactcacatgggattgatcatatcagcagccagggcct

SEQ ID NO: 428377 - DNA, 140 bp, Artificial Sequence
  Synthetic
aggccctggctgctgatatgtcatctttttgcatgaatcaggaattagcctctcaatttgcctcattatcctataactacgatttccgtccacccaatctctcacatcagtctcgcagttgaccttttgggacagcggtg

SEQ ID NO: 428378 - DNA, 140 bp, Artificial Sequence
  Synthetic
caccgctgtcccaaaaggtcaactgcgagactgatgtgagagattgggtggacggaaatcgtagttataggataatgaggcaaattgagaggctaattcctgattcatgcaaaaagatgacatatcagcagccagggcct

SEQ ID NO: 428379 - DNA, 140 bp, Artificial Sequence
  Synthetic
aggccctggctgctgatatggatctccagcagaggcccccgtgacccaccgcctattggcggtgggtcacgggggcgcccatttacaagacgactcttggtgttgatgttctaaacaccagaccttttgggacagcggtg

SEQ ID NO: 428380 - DNA, 140 bp, Artificial Sequence
  Synthetic
caccgctgtcccaaaaggtctggtgtttagaacatcaacaccaagagtcgtcttgtaaatgggcgcccccgtgacccaccgccaataggcggtgggtcacgggggcctctgctggagatccatatcagcagccagggcct

SEQ ID NO: 428381 - DNA, 140 bp, Artificial Sequence
  Synthetic
aggccctggctgctgatatgccaattgcactctttgggctcacaaatttatttagctgatcactcatgtagtaatggaattctaacaatgttttgaattcctctgtatctcttgagagtagaccttttgggacagcggtg

SEQ ID NO: 428382 - DNA, 140 bp, Artificial Sequence
  Synthetic
caccgctgtcccaaaaggtctactctcaagagatacagaggaattcaaaacattgttagaattccattactacatgagtgatcagctaaataaatttgtgagcccaaagagtgcaattggcatatcagcagccagggcct

SEQ ID NO: 428383 - DNA, 140 bp, Artificial Sequence
  Synthetic
atacgccatgctgggtctccatctttcaccacctgtagtttgatgttggagcagtaaccagataattccctcctcaaagattgtgtccacaaaaaggattttatttcctttgaggcactccgtacttgggagtcggccat

SEQ ID NO: 428384 - DNA, 140 bp, Artificial Sequence
  Synthetic
atggccgactcccaagtacggagtgcctcaaaggaaataaaatcctttttgtggacacaatctttgaggagggaattatctggttactgctccaacatcaaactacaggtggtgaaagatggagacccagcatggcgtat

SEQ ID NO: 428385 - DNA, 140 bp, Artificial Sequence
  Synthetic
aggccctggctgctgatatgggcactcattgccagattatagtgctgaatgcacacaacaaaaaccgagattatctgccaaagagataaaagcaaagcgcaatccaatagcctaggatccgaccttttgggacagcggtg

SEQ ID NO: 428386 - DNA, 140 bp, Artificial Sequence
  Synthetic
caccgctgtcccaaaaggtcggatcctaggctattggattgcgctttgcttttatctctttggcagataatctcggtttttgttgtgtgcattcagcactataatctggcaatgagtgcccatatcagcagccagggcct

SEQ ID NO: 428387 - DNA, 140 bp, Artificial Sequence
  Synthetic
aggccctggctgctgatatgtttatttcctttgaggcactcatcgccagattgttgtgttgtatgcacacaacaaagaactgagactatctgccaaaatgacaaaagcaaagcgcaatccgaccttttgggacagcggtg

SEQ ID NO: 428388 - DNA, 140 bp, Artificial Sequence
  Synthetic
caccgctgtcccaaaaggtcggattgcgctttgcttttgtcattttggcagatagtctcagttctttgttgtgtgcatacaacacaacaatctggcgatgagtgcctcaaaggaaataaacatatcagcagccagggcct

SEQ ID NO: 428389 - DNA, 140 bp, Artificial Sequence
  Synthetic
aggccctggctgctgatatgtgatcaagctgctgggagctcagattccccatatagactcctgagcttaatggtctctcagtacggatgactttagacttcaacttctctaaatcagcaggaccttttgggacagcggtg

SEQ ID NO: 428390 - DNA, 140 bp, Artificial Sequence
  Synthetic
caccgctgtcccaaaaggtcctgctgatttagagaagttgaagtctaaagtcatccgtactgagagaccattaagctcaggagtctatatggggaatctgagctcccagcagcttgatcacatatcagcagccagggcct

SEQ ID NO: 428391 - DNA, 140 bp, Artificial Sequence
  Synthetic
aggccctggctgctgatatgtgcactcaaagccgcatccggcaagagtcatggggaaaacgcagtccaagggacagcccagcacaaatctcctcaaggagacagaaccaaggcatccagtgaccttttgggacagcggtg

SEQ ID NO: 428392 - DNA, 140 bp, Artificial Sequence
  Synthetic
caccgctgtcccaaaaggtcactggatgccttggttctgtctccttgaggagatttgtgctgggctgtcccttggactgcgttttccccatgactcttgccggatgcggctttgagtgcacatatcagcagccagggcct

SEQ ID NO: 428393 - DNA, 140 bp, Artificial Sequence
  Synthetic
aggccctggctgctgatatgggacagcccagcacaaatctcctcaaggagacagaaccaaggcatccagtaataccagatgccaggggaactggccctgaattctgcaagagctgctggtgaccttttgggacagcggtg

SEQ ID NO: 428394 - DNA, 140 bp, Artificial Sequence
  Synthetic
caccgctgtcccaaaaggtcaccagcagctcttgcagaattcagggccagttcccctggcatctggtattactggatgccttggttctgtctccttgaggagatttgtgctgggctgtcccatatcagcagccagggcct

SEQ ID NO: 428395 - DNA, 140 bp, Artificial Sequence
  Synthetic
atacgccatgctgggtctcccggggatcctaggcaatttggttgttcttctttctgaagccttttgcgctgaactcctccaaatgggaaacaagcaagccaaagccccagaatcaaaggacgtacttgggagtcggccat

SEQ ID NO: 428396 - DNA, 140 bp, Artificial Sequence
  Synthetic
atggccgactcccaagtacgtcctttgattctggggctttggcttgcttgtttcccatttggaggagttcagcgcaaaaggcttcagaaagaagaacaaccaaattgcctaggatccccgggagacccagcatggcgtat

SEQ ID NO: 428397 - DNA, 140 bp, Artificial Sequence
  Synthetic
atacgccatgctgggtctcctgtcttacacttttacacacagtgtcagataggtgccccatctgcaaacacaaactacccttcagactagagctccagacccagccgacagcaccaccagcgtacttgggagtcggccat

SEQ ID NO: 428398 - DNA, 140 bp, Artificial Sequence
  Synthetic
atggccgactcccaagtacgctggtggtgctgtcggctgggtctggagctctagtctgaagggtagtttgtgtttgcagatggggcacctatctgacactgtgtgtaaaagtgtaagacaggagacccagcatggcgtat

SEQ ID NO: 428399 - DNA, 140 bp, Artificial Sequence
  Synthetic
atacgccatgctgggtctcctgcatcgtcccacaacccctataatatcaagttgtagccagtgtagtccttggtccattctggatctcagcatcttgctcaaagatctctccaagatttccgtacttgggagtcggccat

SEQ ID NO: 428400 - DNA, 140 bp, Artificial Sequence
  Synthetic
atggccgactcccaagtacggaaatcttggagagatctttgagcaagatgctgagatccagaatggaccaaggactacactggctacaacttgatattataggggttgtgggacgatgcaggagacccagcatggcgtat

SEQ ID NO: 428401 - DNA, 140 bp, Artificial Sequence
  Synthetic
aggccctggctgctgatatgtggtccattctggatctcagcatcttgctcaaagatctctccaagatttcggaatgattctccattagctcaccaataaaaacattaagatcctggtcatgaccttttgggacagcggtg

SEQ ID NO: 428402 - DNA, 140 bp, Artificial Sequence
  Synthetic
caccgctgtcccaaaaggtcatgaccaggatcttaatgtttttattggtgagctaatggagaatcattccgaaatcttggagagatctttgagcaagatgctgagatccagaatggaccacatatcagcagccagggcct

SEQ ID NO: 428403 - DNA, 140 bp, Artificial Sequence
  Synthetic
atacgccatgctgggtctcccctgagtcaacaactaaggggatttcaacatgctcaggccctatatgcgtgaaatcatgttcctccaggtccaggatctcctcattcaataagacggacacgtacttgggagtcggccat

SEQ ID NO: 428404 - DNA, 140 bp, Artificial Sequence
  Synthetic
atggccgactcccaagtacgtgtccgtcttattgaatgaggagatcctggacctggaggaacatgatttcacgcatatagggcctgagcatgttgaaatccccttagttgttgactcaggggagacccagcatggcgtat

SEQ ID NO: 428405 - DNA, 140 bp, Artificial Sequence
  Synthetic
aggccctggctgctgatatggaaatcatgttcctccaggtccaggatctcctcattcaataagacggacaagggtatcacatcaggaatgggggaactatccctcaagtagtcacaaatagaccttttgggacagcggtg

SEQ ID NO: 428406 - DNA, 140 bp, Artificial Sequence
  Synthetic
caccgctgtcccaaaaggtctatttgtgactacttgagggatagttcccccattcctgatgtgatacccttgtccgtcttattgaatgaggagatcctggacctggaggaacatgatttccatatcagcagccagggcct

SEQ ID NO: 428407 - DNA, 140 bp, Artificial Sequence
  Synthetic
atacgccatgctgggtctccagatgtctgtgcaactctccagcaatctttaattgcggatctttgaacactaccactgtaagttacatcaagggaatgaggcttgaataatccaccttcccgtacttgggagtcggccat

SEQ ID NO: 428408 - DNA, 140 bp, Artificial Sequence
  Synthetic
atggccgactcccaagtacgggaaggtggattattcaagcctcattcccttgatgtaacttacagtggtagtgttcaaagatccgcaattaaagattgctggagagttgcacagacatctggagacccagcatggcgtat

SEQ ID NO: 428409 - DNA, 140 bp, Artificial Sequence
  Synthetic
aggccctggctgctgatatgtaccactgtaagttacatcaagggaatgaggcttgaataatccaccttccaacaccacccctttgaaaaggaggtggagactaaatttctctttcaatgagaccttttgggacagcggtg

SEQ ID NO: 428410 - DNA, 140 bp, Artificial Sequence
  Synthetic
caccgctgtcccaaaaggtctcattgaaagagaaatttagtctccacctccttttcaaaggggtggtgttggaaggtggattattcaagcctcattcccttgatgtaacttacagtggtacatatcagcagccagggcct

SEQ ID NO: 428411 - DNA, 140 bp, Artificial Sequence
  Synthetic
aggccctggctgctgatatggaactcctccaaatgggaaacaagcaagccaaagccccagaatcaaaggacagtccgagagccagcctgatcccagatgccacacatctagggccgcagtgaccttttgggacagcggtg

SEQ ID NO: 428412 - DNA, 140 bp, Artificial Sequence
  Synthetic
caccgctgtcccaaaaggtcactgcggccctagatgtgtggcatctgggatcaggctggctctcggactgtcctttgattctggggctttggcttgcttgtttcccatttggaggagttccatatcagcagccagggcct

SEQ ID NO: 428413 - DNA, 140 bp, Artificial Sequence
  Synthetic
atacgccatgctgggtctcctcccaacactgaggtcggcaaaagcttcaagcagctcacttaccgactcaaagacgtgctgctcggttaatcctgatgctatgagctgtcctaagtttagcgtacttgggagtcggccat

SEQ ID NO: 428414 - DNA, 140 bp, Artificial Sequence
  Synthetic
atggccgactcccaagtacgctaaacttaggacagctcatagcatcaggattaaccgagcagcacgtctttgagtcggtaagtgagctgcttgaagcttttgccgacctcagtgttgggaggagacccagcatggcgtat

SEQ ID NO: 428415 - DNA, 140 bp, Artificial Sequence
  Synthetic
aggccctggctgctgatatgaagacgtgctgctcggttaatcctgatgctatgagctgtcctaagtttagaattgctggtgcacattcaaaatccagccaagcataacctgagtaaagatgaccttttgggacagcggtg

SEQ ID NO: 428416 - DNA, 140 bp, Artificial Sequence
  Synthetic
caccgctgtcccaaaaggtcatctttactcaggttatgcttggctggattttgaatgtgcaccagcaattctaaacttaggacagctcatagcatcaggattaaccgagcagcacgtcttcatatcagcagccagggcct

SEQ ID NO: 428417 - DNA, 140 bp, Artificial Sequence
  Synthetic
aggccctggctgctgatatgccccaacagcacccccaaccggagcaacggacagcaccagacctccaccctacagtccctgaacactccaccgacccctaccactcccatcctccccccggaccttttgggacagcggtg

SEQ ID NO: 428418 - DNA, 140 bp, Artificial Sequence
  Synthetic
caccgctgtcccaaaaggtccggggggaggatgggagtggtaggggtcggtggagtgttcagggactgtagggtggaggtctggtgctgtccgttgctccggttgggggtgctgttggggcatatcagcagccagggcct

SEQ ID NO: 428419 - DNA, 140 bp, Artificial Sequence
  Synthetic
atacgccatgctgggtctccaaagaagaaaaggggccgaggttgtcaagcccttccgactcaggaattgaagatctatgtggaaaccaagtaaaagaacctaaagtcctgcttgttgcaacgtacttgggagtcggccat

SEQ ID NO: 428420 - DNA, 140 bp, Artificial Sequence
  Synthetic
atggccgactcccaagtacgttgcaacaagcaggactttaggttcttttacttggtttccacatagatcttcaattcctgagtcggaagggcttgacaacctcggccccttttcttctttggagacccagcatggcgtat

SEQ ID NO: 428421 - DNA, 140 bp, Artificial Sequence
  Synthetic
aggccctggctgctgatatgagatctatgtggaaaccaagtaaaagaacctaaagtcctgcttgttgcaacgaatggtctgatgaaggactcaaagtagatttgtctcaggaaattttgtgaccttttgggacagcggtg

SEQ ID NO: 428422 - DNA, 140 bp, Artificial Sequence
  Synthetic
caccgctgtcccaaaaggtcacaaaatttcctgagacaaatctactttgagtccttcatcagaccattcgttgcaacaagcaggactttaggttcttttacttggtttccacatagatctcatatcagcagccagggcct

SEQ ID NO: 428423 - DNA, 140 bp, Artificial Sequence
  Synthetic
atacgccatgctgggtctcccctctcatgtgctattgctaaatctgaagacagaaccacataatgctcttctctcttccacttgacaacatgagaaattaatgacattgcctcacaattccgtacttgggagtcggccat

SEQ ID NO: 428424 - DNA, 140 bp, Artificial Sequence
  Synthetic
atggccgactcccaagtacggaattgtgaggcaatgtcattaatttctcatgttgtcaagtggaagagagaagagcattatgtggttctgtcttcagatttagcaatagcacatgagaggggagacccagcatggcgtat

SEQ ID NO: 428425 - DNA, 140 bp, Artificial Sequence
  Synthetic
aggccctggctgctgatatggtataagcatctatcgtaccaccacatatacaactgatagcataattaatgaacctctctgaaatgagggcataaaaatctgatgtgttatgtaatattcgaccttttgggacagcggtg

SEQ ID NO: 428426 - DNA, 140 bp, Artificial Sequence
  Synthetic
caccgctgtcccaaaaggtcgaatattacataacacatcagatttttatgccctcatttcagagaggttcattaattatgctatcagttgtatatgtggtggtacgatagatgcttataccatatcagcagccagggcct

SEQ ID NO: 428427 - DNA, 140 bp, Artificial Sequence
  Synthetic
atacgccatgctgggtctccatagagatgggtaaagtcttctgaatgagtgaataatatggttaaaccccaccttgtcttccaagagttttgtggtagtgggcttcattgggaaatagtccgtacttgggagtcggccat

SEQ ID NO: 428428 - DNA, 140 bp, Artificial Sequence
  Synthetic
atggccgactcccaagtacggactatttcccaatgaagcccactaccacaaaactcttggaagacaaggtggggtttaaccatattattcactcattcagaagactttacccatctctatggagacccagcatggcgtat

SEQ ID NO: 428429 - DNA, 140 bp, Artificial Sequence
  Synthetic
aggccctggctgctgatatgaccttgtcttccaagagttttgtggtagtgggcttcattgggaaatagtcacatggcttgaagggaattgaggatgttttctccttcactttgggttcacgaccttttgggacagcggtg

SEQ ID NO: 428430 - DNA, 140 bp, Artificial Sequence
  Synthetic
caccgctgtcccaaaaggtcgtgaacccaaagtgaaggagaaaacatcctcaattcccttcaagccatgtgactatttcccaatgaagcccactaccacaaaactcttggaagacaaggtcatatcagcagccagggcct

SEQ ID NO: 428431 - DNA, 140 bp, Artificial Sequence
  Synthetic
atacgccatgctgggtctcctaatcccaaaggacaggtctcaagaaacctaacgcttcctcagctgcctttgtgtgctccttacccaagatccaaagatcgacgcccttaactttcaagccgtacttgggagtcggccat

SEQ ID NO: 428432 - DNA, 140 bp, Artificial Sequence
  Synthetic
atggccgactcccaagtacggcttgaaagttaagggcgtcgatctttggatcttgggtaaggagcacacaaaggcagctgaggaagcgttaggtttcttgagacctgtcctttgggattaggagacccagcatggcgtat

SEQ ID NO: 428433 - DNA, 140 bp, Artificial Sequence
  Synthetic
aggccctggctgctgatatgtgtgtgctccttacccaagatccaaagatcgacgcccttaactttcaagctggaaacagaatccaatgctgacagtcttgaaactaatgattttatataggaccttttgggacagcggtg

SEQ ID NO: 428434 - DNA, 140 bp, Artificial Sequence
  Synthetic
caccgctgtcccaaaaggtcctatataaaatcattagtttcaagactgtcagcattggattctgtttccagcttgaaagttaagggcgtcgatctttggatcttgggtaaggagcacacacatatcagcagccagggcct

SEQ ID NO: 428435 - DNA, 140 bp, Artificial Sequence
  Synthetic
atacgccatgctgggtctccaagacctatgaaacctgatgctatcccactctgaaaggcacttttgttgacggcttcacagagcaacttttgtgcccctcttgtgaaattagaggataaccgtacttgggagtcggccat

SEQ ID NO: 428436 - DNA, 140 bp, Artificial Sequence
  Synthetic
atggccgactcccaagtacggttatcctctaatttcacaagaggggcacaaaagttgctctgtgaagccgtcaacaaaagtgcctttcagagtgggatagcatcaggtttcataggtcttggagacccagcatggcgtat

SEQ ID NO: 428437 - DNA, 140 bp, Artificial Sequence
  Synthetic
aggccctggctgctgatatgcggcttcacagagcaacttttgtgcccctcttgtgaaattagaggataacttgctttgcaatgttttcaccaaggtaggcagtttttcttccccgagttcgaccttttgggacagcggtg

SEQ ID NO: 428438 - DNA, 140 bp, Artificial Sequence
  Synthetic
caccgctgtcccaaaaggtcgaactcggggaagaaaaactgcctaccttggtgaaaacattgcaaagcaagttatcctctaatttcacaagaggggcacaaaagttgctctgtgaagccgcatatcagcagccagggcct

SEQ ID NO: 428439 - DNA, 140 bp, Artificial Sequence
  Synthetic
aggccctggctgctgatatgtctttaacattgctgtggtacagtttgtcagtgacagagccttactaagtgcttctgaattgctttccctttcactaattcttacatcatcagagagcttgaccttttgggacagcggtg

SEQ ID NO: 428440 - DNA, 140 bp, Artificial Sequence
  Synthetic
caccgctgtcccaaaaggtcaagctctctgatgatgtaagaattagtgaaagggaaagcaattcagaagcacttagtaaggctctgtcactgacaaactgtaccacagcaatgttaaagacatatcagcagccagggcct

SEQ ID NO: 428441 - DNA, 140 bp, Artificial Sequence
  Synthetic
atacgccatgctgggtctccgatgagttgtcaaattaagccaacacaccgataaatcctcttctgagagggtgtcatcaccaacaaggctggtaagtttcttgaaggaatctgcggggtccgtacttgggagtcggccat

SEQ ID NO: 428442 - DNA, 140 bp, Artificial Sequence
  Synthetic
atggccgactcccaagtacggaccccgcagattccttcaagaaacttaccagccttgttggtgatgacaccctctcagaagaggatttatcggtgtgttggcttaatttgacaactcatcggagacccagcatggcgtat

SEQ ID NO: 428443 - DNA, 140 bp, Artificial Sequence
  Synthetic
atacgccatgctgggtctccagaatctagacttgaattctgcaacaaacctgccaataacacttttaggactcacaaatttattgagttgatcactcatataataatgaaactctattaacgtacttgggagtcggccat

SEQ ID NO: 428444 - DNA, 140 bp, Artificial Sequence
  Synthetic
atggccgactcccaagtacgttaatagagtttcattattatatgagtgatcaactcaataaatttgtgagtcctaaaagtgttattggcaggtttgttgcagaattcaagtctagattctggagacccagcatggcgtat

SEQ ID NO: 428445 - DNA, 140 bp, Artificial Sequence
  Synthetic
aggccctggctgctgatatggtccatgatggcatcataaacatcacaatcaaggatcttgaaatcaattccataggaatcggtttctatgccaacttccctcaaggcattggtggctcgagaccttttgggacagcggtg

SEQ ID NO: 428446 - DNA, 140 bp, Artificial Sequence
  Synthetic
caccgctgtcccaaaaggtctcgagccaccaatgccttgagggaagttggcatagaaaccgattcctatggaattgatttcaagatccttgattgtgatgtttatgatgccatcatggaccatatcagcagccagggcct

SEQ ID NO: 428447 - DNA, 140 bp, Artificial Sequence
  Synthetic
atacgccatgctgggtctccggtaggattgcctcaatgttcctcataatcctatagcccctattgccatcaacccaatctttaacatcagaatccaaaaacaacaagaaaggatcaatggcgtacttgggagtcggccat

SEQ ID NO: 428448 - DNA, 140 bp, Artificial Sequence
  Synthetic
atggccgactcccaagtacgccattgatcctttcttgttgtttttggattctgatgttaaagattgggttgatggcaataggggctataggattatgaggaacattgaggcaatcctaccggagacccagcatggcgtat

SEQ ID NO: 428449 - DNA, 140 bp, Artificial Sequence
  Synthetic
aggccctggctgctgatatgaacccaatctttaacatcagaatccaaaaacaacaagaaaggatcaatgggatattgtgcatatctaagtagattcagtgttctctcctgaatagcgttagaccttttgggacagcggtg

SEQ ID NO: 428450 - DNA, 140 bp, Artificial Sequence
  Synthetic
caccgctgtcccaaaaggtctaacgctattcaggagagaacactgaatctacttagatatgcacaatatcccattgatcctttcttgttgtttttggattctgatgttaaagattgggttcatatcagcagccagggcct

SEQ ID NO: 428451 - DNA, 140 bp, Artificial Sequence
  Synthetic
aggccctggctgctgatatgctcacaaatttattgagttgatcactcatataataatgaaactctattaaggtcttgaattcttctggatctctttgcaatagttctgtcaaagtttgatgaccttttgggacagcggtg

SEQ ID NO: 428452 - DNA, 140 bp, Artificial Sequence
  Synthetic
caccgctgtcccaaaaggtcatcaaactttgacagaactattgcaaagagatccagaagaattcaagaccttaatagagtttcattattatatgagtgatcaactcaataaatttgtgagcatatcagcagccagggcct

SEQ ID NO: 428453 - DNA, 140 bp, Artificial Sequence
  Synthetic
atacgccatgctgggtctccaatagtttcagctaattgatgtggctccttacacttaacgttgtggagggcggcagccacgaatttcgttaacaatggaacttcatcaccccagacataacgtacttgggagtcggccat

SEQ ID NO: 428454 - DNA, 140 bp, Artificial Sequence
  Synthetic
atggccgactcccaagtacgttatgtctggggtgatgaagttccattgttaacgaaattcgtggctgccgccctccacaacgttaagtgtaaggagccacatcaattagctgaaactattggagacccagcatggcgtat

SEQ ID NO: 428455 - DNA, 140 bp, Artificial Sequence
  Synthetic
aggccctggctgctgatatgcggcagccacgaatttcgttaacaatggaacttcatcaccccagacataaaaccttgatttgaactcagcaacaaatgaaccaataacactctttggactgaccttttgggacagcggtg

SEQ ID NO: 428456 - DNA, 140 bp, Artificial Sequence
  Synthetic
caccgctgtcccaaaaggtcagtccaaagagtgttattggttcatttgttgctgagttcaaatcaaggttttatgtctggggtgatgaagttccattgttaacgaaattcgtggctgccgcatatcagcagccagggcct

SEQ ID NO: 428457 - DNA, 140 bp, Artificial Sequence
  Synthetic
atacgccatgctgggtctcccttggaattcctcaggctcatttgagagtaaatctgaaagatccttgccaaatagtgatatttgatcatcactagaggtatatgaatcaacttcatcttccgtacttgggagtcggccat

SEQ ID NO: 428458 - DNA, 140 bp, Artificial Sequence
  Synthetic
atggccgactcccaagtacggaagatgaagttgattcatatacctctagtgatgatcaaatatcactatttggcaaggatctttcagatttactctcaaatgagcctgaggaattccaagggagacccagcatggcgtat

SEQ ID NO: 428459 - DNA, 140 bp, Artificial Sequence
  Synthetic
aggccctggctgctgatatgaatagtgatatttgatcatcactagaggtatatgaatcaacttcatcttcaaatagacacttaatgcaataatttatgaatctctcactcactagaccgtgaccttttgggacagcggtg

SEQ ID NO: 428460 - DNA, 140 bp, Artificial Sequence
  Synthetic
caccgctgtcccaaaaggtcacggtctagtgagtgagagattcataaattattgcattaagtgtctatttgaagatgaagttgattcatatacctctagtgatgatcaaatatcactattcatatcagcagccagggcct

SEQ ID NO: 428461 - DNA, 140 bp, Artificial Sequence
  Synthetic
atacgccatgctgggtctccctgagatgtgatggtatcctgttttgtttaaagtattcaaagaagaaagcttctgttgacgtttggtggagtgattttttcaaacctaacctagacttaacgtacttgggagtcggccat

SEQ ID NO: 428462 - DNA, 140 bp, Artificial Sequence
  Synthetic
atggccgactcccaagtacgttaagtctaggttaggtttgaaaaaatcactccaccaaacgtcaacagaagctttcttctttgaatactttaaacaaaacaggataccatcacatctcagggagacccagcatggcgtat

SEQ ID NO: 428463 - DNA, 140 bp, Artificial Sequence
  Synthetic
aggccctggctgctgatatgttctgttgacgtttggtggagtgattttttcaaacctaacctagacttaagataagatctcatcattgcattcacaacattgaaaggtacctcaattaacgaccttttgggacagcggtg

SEQ ID NO: 428464 - DNA, 140 bp, Artificial Sequence
  Synthetic
caccgctgtcccaaaaggtcgttaattgaggtacctttcaatgttgtgaatgcaatgatgagatcttatcttaagtctaggttaggtttgaaaaaatcactccaccaaacgtcaacagaacatatcagcagccagggcct

SEQ ID NO: 428465 - DNA, 140 bp, Artificial Sequence
  Synthetic
atacgccatgctgggtctccgtcctctatatcatctcctgtctcccatcgcaaattttgaagaaacaccaggaaaagaaaaggggacatcataggcccccacttgctgtgatcgaggctacgtacttgggagtcggccat

SEQ ID NO: 428466 - DNA, 140 bp, Artificial Sequence
  Synthetic
atggccgactcccaagtacgtagcctcgatcacagcaagtgggggcctatgatgtccccttttcttttcctggtgtttcttcaaaatttgcgatgggagacaggagatgatatagaggacggagacccagcatggcgtat

SEQ ID NO: 428467 - DNA, 140 bp, Artificial Sequence
  Synthetic
aggccctggctgctgatatgggaaaagaaaaggggacatcataggcccccacttgctgtgatcgaggctataagagacctgacctagtgaaacattcaatttcatggctagaatggcattgaccttttgggacagcggtg

SEQ ID NO: 428468 - DNA, 140 bp, Artificial Sequence
  Synthetic
caccgctgtcccaaaaggtcaatgccattctagccatgaaattgaatgtttcactaggtcaggtctcttatagcctcgatcacagcaagtgggggcctatgatgtccccttttcttttcccatatcagcagccagggcct

SEQ ID NO: 428469 - DNA, 140 bp, Artificial Sequence
  Synthetic
atacgccatgctgggtctccgtgcctcaaaataatcctcaattaggcgtgtgaacatttttgtcctcaggtcacctatataaagttccctgttccctccaacttgttctttgtaagataacgtacttgggagtcggccat

SEQ ID NO: 428470 - DNA, 140 bp, Artificial Sequence
  Synthetic
atggccgactcccaagtacgttatcttacaaagaacaagttggagggaacagggaactttatataggtgacctgaggacaaaaatgttcacacgcctaattgaggattattttgaggcacggagacccagcatggcgtat

SEQ ID NO: 428471 - DNA, 140 bp, Artificial Sequence
  Synthetic
atacgccatgctgggtctccccacatatgcaactaatagcatagttaataaacctttctgaaatgagagcataaaaatctgatgtgttatgtaatatcccttgacccatatcaagtattgcgtacttgggagtcggccat

SEQ ID NO: 428472 - DNA, 140 bp, Artificial Sequence
  Synthetic
atggccgactcccaagtacgcaatacttgatatgggtcaagggatattacataacacatcagatttttatgctctcatttcagaaaggtttattaactatgctattagttgcatatgtggggagacccagcatggcgtat

SEQ ID NO: 428473 - DNA, 140 bp, Artificial Sequence
  Synthetic
aggccctggctgctgatatgtagcctttgaaatcaatccattctccaagagattcaagaagttcactcagtatatcagcataatccacaggtctctgttttgtgaggattgagacaatgtgaccttttgggacagcggtg

SEQ ID NO: 428474 - DNA, 140 bp, Artificial Sequence
  Synthetic
caccgctgtcccaaaaggtcacattgtctcaatcctcacaaaacagagacctgtggattatgctgatatactgagtgaacttcttgaatctcttggagaatggattgatttcaaaggctacatatcagcagccagggcct

SEQ ID NO: 428475 - DNA, 140 bp, Artificial Sequence
  Synthetic
atacgccatgctgggtctcctttgtcaatgacagtgctttacctaatgcctcagaattgctctctctttcactgatcctaacatcattcatcagcctttctctatcaatcttgaagtttacgtacttgggagtcggccat

SEQ ID NO: 428476 - DNA, 140 bp, Artificial Sequence
  Synthetic
atggccgactcccaagtacgtaaacttcaagattgatagagaaaggctgatgaatgatgttaggatcagtgaaagagagagcaattctgaggcattaggtaaagcactgtcattgacaaaggagacccagcatggcgtat

SEQ ID NO: 428477 - DNA, 140 bp, Artificial Sequence
  Synthetic
aggccctggctgctgatatgctctcttccacttgacaacatgagaaattaatgacattgcctcacaattcacatctagaaccacacaaagatcaagaaacttaatccttggtgtccacctgaccttttgggacagcggtg

SEQ ID NO: 428478 - DNA, 140 bp, Artificial Sequence
  Synthetic
caccgctgtcccaaaaggtcaggtggacaccaaggattaagtttcttgatctttgtgtggttctagatgtgaattgtgaggcaatgtcattaatttctcatgttgtcaagtggaagagagcatatcagcagccagggcct

SEQ ID NO: 428479 - DNA, 140 bp, Artificial Sequence
  Synthetic
atacgccatgctgggtctcccctgtgttggctttaggcttatgcctgtgtggcttgtaaatcagctagtggtgctccaaaaaactactacagaaatgagagacaatatgcctaggatcctcgtacttgggagtcggccat

SEQ ID NO: 428480 - DNA, 140 bp, Artificial Sequence
  Synthetic
atggccgactcccaagtacgaggatcctaggcatattgtctctcatttctgtagtagttttttggagcaccactagctgatttacaagccacacaggcataagcctaaagccaacacaggggagacccagcatggcgtat

SEQ ID NO: 428481 - DNA, 140 bp, Artificial Sequence
  Synthetic
aggccctggctgctgatatgataaaaatctgatgtgttatgtaatatcccttgacccatatcaagtattgagctaatatgagaaggcaccacaccgatttgaaaattagagtgaaagaaagaccttttgggacagcggtg

SEQ ID NO: 428482 - DNA, 140 bp, Artificial Sequence
  Synthetic
caccgctgtcccaaaaggtctttctttcactctaattttcaaatcggtgtggtgccttctcatattagctcaatacttgatatgggtcaagggatattacataacacatcagatttttatcatatcagcagccagggcct

SEQ ID NO: 428483 - DNA, 140 bp, Artificial Sequence
  Synthetic
atacgccatgctgggtctcctgttctggtggagacagcttgggtgatgcatgttattgggcaagagtccaaggaatccaaatagaaatactttgaccttaactccaaatccttaaaaaagcgtacttgggagtcggccat

SEQ ID NO: 428484 - DNA, 140 bp, Artificial Sequence
  Synthetic
atggccgactcccaagtacgcttttttaaggatttggagttaaggtcaaagtatttctatttggattccttggactcttgcccaataacatgcatcacccaagctgtctccaccagaacaggagacccagcatggcgtat

SEQ ID NO: 428485 - DNA, 140 bp, Artificial Sequence
  Synthetic
aggccctggctgctgatatgaggaatccaaatagaaatactttgaccttaactccaaatccttaaaaaagcctttgcagatcatctcataagcatctccaggtagtagtgactcatcaaagaccttttgggacagcggtg

SEQ ID NO: 428486 - DNA, 140 bp, Artificial Sequence
  Synthetic
caccgctgtcccaaaaggtctttgatgagtcactactacctggagatgcttatgagatgatctgcaaaggcttttttaaggatttggagttaaggtcaaagtatttctatttggattcctcatatcagcagccagggcct

SEQ ID NO: 428487 - DNA, 140 bp, Artificial Sequence
  Synthetic
atacgccatgctgggtctcccacagcccacatcttcagtacctaaaaccttcctcaagtctgtcaaggacttctcctctgacccatttcccacagggaacttcctgtcatatctatacttcgtacttgggagtcggccat

SEQ ID NO: 428488 - DNA, 140 bp, Artificial Sequence
  Synthetic
atggccgactcccaagtacgaagtatagatatgacaggaagttccctgtgggaaatgggtcagaggagaagtccttgacagacttgaggaaggttttaggtactgaagatgtgggctgtgggagacccagcatggcgtat

SEQ ID NO: 428489 - DNA, 140 bp, Artificial Sequence
  Synthetic
aggccctggctgctgatatgttctcctctgacccatttcccacagggaacttcctgtcatatctatacttctcaaggacgacatcaacagatttcttcacatcctctagacagtcaagtggaccttttgggacagcggtg

SEQ ID NO: 428490 - DNA, 140 bp, Artificial Sequence
  Synthetic
caccgctgtcccaaaaggtccacttgactgtctagaggatgtgaagaaatctgttgatgtcgtccttgagaagtatagatatgacaggaagttccctgtgggaaatgggtcagaggagaacatatcagcagccagggcct

SEQ ID NO: 428491 - DNA, 140 bp, Artificial Sequence
  Synthetic
atacgccatgctgggtctccttgggatttgaggaacctgacttcttccccacaacaaggtcactaatggccttttgcaccttataatcataatcctccttactcaagaggtatttagtttcgtacttgggagtcggccat

SEQ ID NO: 428492 - DNA, 140 bp, Artificial Sequence
  Synthetic
atggccgactcccaagtacgaaactaaatacctcttgagtaaggaggattatgattataaggtgcaaaaggccattagtgaccttgttgtggggaagaagtcaggttcctcaaatcccaaggagacccagcatggcgtat

SEQ ID NO: 428493 - DNA, 140 bp, Artificial Sequence
  Synthetic
aggccctggctgctgatatgcttttgcaccttataatcataatcctccttactcaagaggtatttagttttcctctggaatacctctgatagctggcaaacagaagcagccactagtttagaccttttgggacagcggtg

SEQ ID NO: 428494 - DNA, 140 bp, Artificial Sequence
  Synthetic
caccgctgtcccaaaaggtctaaactagtggctgcttctgtttgccagctatcagaggtattccagaggaaaactaaatacctcttgagtaaggaggattatgattataaggtgcaaaagcatatcagcagccagggcct

SEQ ID NO: 428495 - DNA, 140 bp, Artificial Sequence
  Synthetic
atacgccatgctgggtctcccacacttttgttgcttgcaaggtcaagagctgttgcacacccagcagtaactaatggatctttaaacccacttaggtcatctcctttcttgaaaagagagcgtacttgggagtcggccat

SEQ ID NO: 428496 - DNA, 140 bp, Artificial Sequence
  Synthetic
atggccgactcccaagtacgctctcttttcaagaaaggagatgacctaagtgggtttaaagatccattagttactgctgggtgtgcaacagctcttgaccttgcaagcaacaaaagtgtgggagacccagcatggcgtat

SEQ ID NO: 428497 - DNA, 140 bp, Artificial Sequence
  Synthetic
aggccctggctgctgatatgctaatggatctttaaacccacttaggtcatctcctttcttgaaaagagagccattgttaaaagaagacgtcatcattgagaagaattttcttgacacaccgaccttttgggacagcggtg

SEQ ID NO: 428498 - DNA, 140 bp, Artificial Sequence
  Synthetic
caccgctgtcccaaaaggtcggtgtgtcaagaaaattcttctcaatgatgacgtcttcttttaacaatggctctcttttcaagaaaggagatgacctaagtgggtttaaagatccattagcatatcagcagccagggcct

SEQ ID NO: 428499 - DNA, 140 bp, Artificial Sequence
  Synthetic
atacgccatgctgggtctccaaaatttgtttgctgattcaagcagcagcatcctttcatcttcatccccctcttcagatgggttgatgttaatactgtcaaactccaacttgggctccaacgtacttgggagtcggccat

SEQ ID NO: 428500 - DNA, 140 bp, Artificial Sequence
  Synthetic
atggccgactcccaagtacgttggagcccaagttggagtttgacagtattaacatcaacccatctgaagagggggatgaagatgaaaggatgctgctgcttgaatcagcaaacaaattttggagacccagcatggcgtat

SEQ ID NO: 428501 - DNA, 140 bp, Artificial Sequence
  Synthetic
aggccctggctgctgatatgttaatgagcataatctcaactttccacttatccattcctaactttaatcagtatgaagcaatgagctgcgatttcaatgggggaaggatcagtgtgcagtgaccttttgggacagcggtg

SEQ ID NO: 428502 - DNA, 140 bp, Artificial Sequence
  Synthetic
caccgctgtcccaaaaggtcactgcacactgatccttcccccattgaaatcgcagctcattgcttcatactgattaaagttaggaatggataagtggaaagttgagattatgctcattaacatatcagcagccagggcct

SEQ ID NO: 428503 - DNA, 140 bp, Artificial Sequence
  Synthetic
atacgccatgctgggtctccttagtcaacatagtgctcaccccttcacccaggatgatgttgagaatgctcctcaccacactatacaagaggtgctccggctctgttatgagatcctccccgtacttgggagtcggccat

SEQ ID NO: 428504 - DNA, 140 bp, Artificial Sequence
  Synthetic
atggccgactcccaagtacggggaggatctcataacagagccggagcacctcttgtatagtgtggtgaggagcattctcaacatcatcctgggtgaaggggtgagcactatgttgactaaggagacccagcatggcgtat

SEQ ID NO: 428505 - DNA, 140 bp, Artificial Sequence
  Synthetic
aggccctggctgctgatatgcctcaccacactatacaagaggtgctccggctctgttatgagatcctccctcaacttttccattaactgcttatggtggaagtctgaaacaaaggccattgaccttttgggacagcggtg

SEQ ID NO: 428506 - DNA, 140 bp, Artificial Sequence
  Synthetic
caccgctgtcccaaaaggtcaatggcctttgtttcagacttccaccataagcagttaatggaaaagttgagggaggatctcataacagagccggagcacctcttgtatagtgtggtgaggcatatcagcagccagggcct

SEQ ID NO: 428507 - DNA, 140 bp, Artificial Sequence
  Synthetic
atacgccatgctgggtctccgtatgaagcaatgagctgcgatttcaatgggggaaggatcagtgtgcagtataacctaagtcacagctatgctggggatgcagccagccattgtggtacacgtacttgggagtcggccat

SEQ ID NO: 428508 - DNA, 140 bp, Artificial Sequence
  Synthetic
atggccgactcccaagtacgtgtaccacaatggctggctgcatccccagcatagctgtgacttaggttatactgcacactgatccttcccccattgaaatcgcagctcattgcttcatacggagacccagcatggcgtat

SEQ ID NO: 428509 - DNA, 140 bp, Artificial Sequence
  Synthetic
atacgccatgctgggtctcccacaagtatgaggatcatggtgattttgagcaataattttaaagttttttgttgatctctgagttctatacattcagacaaccaactcatcatggtgttgcgtacttgggagtcggccat

SEQ ID NO: 428510 - DNA, 140 bp, Artificial Sequence
  Synthetic
atggccgactcccaagtacgcaacaccatgatgagttggttgtctgaatgtatagaactcagagatcaacaaaaaactttaaaattattgctcaaaatcaccatgatcctcatacttgtgggagacccagcatggcgtat

SEQ ID NO: 428511 - DNA, 140 bp, Artificial Sequence
  Synthetic
aggccctggctgctgatatggttgatctctgagttctatacattcagacaaccaactcatcatggtgttgatagtctcatagataacacagtgtgagaaaattgcaggaaaaaaccttttgaccttttgggacagcggtg

SEQ ID NO: 428512 - DNA, 140 bp, Artificial Sequence
  Synthetic
caccgctgtcccaaaaggtcaaaaggttttttcctgcaattttctcacactgtgttatctatgagactatcaacaccatgatgagttggttgtctgaatgtatagaactcagagatcaaccatatcagcagccagggcct

SEQ ID NO: 428513 - DNA, 140 bp, Artificial Sequence
  Synthetic
aggccctggctgctgatatgcattgcccgtcagtttgtaaccatccggtaccacaaagcatagtgaaggtgtcaagattccatgatcatggagaattctttccacagatttgtcctcactgaccttttgggacagcggtg

SEQ ID NO: 428514 - DNA, 140 bp, Artificial Sequence
  Synthetic
caccgctgtcccaaaaggtcagtgaggacaaatctgtggaaagaattctccatgatcatggaatcttgacaccttcactatgctttgtggtaccggatggttacaaactgacgggcaatgcatatcagcagccagggcct

SEQ ID NO: 428515 - DNA, 140 bp, Artificial Sequence
  Synthetic
atacgccatgctgggtctcccataacattttgagcactctcctgttttctgataaattaagttgaaattcccgcttcccatgataaagctttgattaaaagcttccttacaacgtacacgcgtacttgggagtcggccat

SEQ ID NO: 428516 - DNA, 140 bp, Artificial Sequence
  Synthetic
atggccgactcccaagtacgcgtgtacgttgtaaggaagcttttaatcaaagctttatcatgggaagcgggaatttcaacttaatttatcagaaaacaggagagtgctcaaaatgttatgggagacccagcatggcgtat

SEQ ID NO: 428517 - DNA, 140 bp, Artificial Sequence
  Synthetic
aggccctggctgctgatatgccgcttcccatgataaagctttgattaaaagcttccttacaacgtacacgtttgtaccttgcagcaccatactcattttgcctcactttggctactgatggaccttttgggacagcggtg

SEQ ID NO: 428518 - DNA, 140 bp, Artificial Sequence
  Synthetic
caccgctgtcccaaaaggtccatcagtagccaaagtgaggcaaaatgagtatggtgctgcaaggtacaaacgtgtacgttgtaaggaagcttttaatcaaagctttatcatgggaagcggcatatcagcagccagggcct

SEQ ID NO: 428519 - DNA, 140 bp, Artificial Sequence
  Synthetic
atacgccatgctgggtctccaggtcttctatggaatcagcttccaactcaataagagggtaggggaattgattcccctcttctttctcatagctcattgttggctgaatccctcttttctcgtacttgggagtcggccat

SEQ ID NO: 428520 - DNA, 140 bp, Artificial Sequence
  Synthetic
atggccgactcccaagtacgagaaaagagggattcagccaacaatgagctatgagaaagaagaggggaatcaattcccctaccctcttattgagttggaagctgattccatagaagacctggagacccagcatggcgtat

SEQ ID NO: 428521 - DNA, 140 bp, Artificial Sequence
  Synthetic
aggccctggctgctgatatgattcccctcttctttctcatagctcattgttggctgaatccctcttttctccattaacataagcctctcgtaactgtcctcctccagtatatcttcctctgaccttttgggacagcggtg

SEQ ID NO: 428522 - DNA, 140 bp, Artificial Sequence
  Synthetic
caccgctgtcccaaaaggtcagaggaagatatactggaggaggacagttacgagaggcttatgttaatggagaaaagagggattcagccaacaatgagctatgagaaagaagaggggaatcatatcagcagccagggcct

SEQ ID NO: 428523 - DNA, 140 bp, Artificial Sequence
  Synthetic
aggccctggctgctgatatgttcttccttgccacctctcttcttcttctcaacgacaacacctgtgtgcatgtgacacagatccttgtattgatcccacacagcattctcaaactttctggaccttttgggacagcggtg

SEQ ID NO: 428524 - DNA, 140 bp, Artificial Sequence
  Synthetic
caccgctgtcccaaaaggtccagaaagtttgagaatgctgtgtgggatcaatacaaggatctgtgtcacatgcacacaggtgttgtcgttgagaagaagaagagaggtggcaaggaagaacatatcagcagccagggcct

SEQ ID NO: 428525 - DNA, 140 bp, Artificial Sequence
  Synthetic
aggccctggctgctgatatgccccgggggagccaaccatcaccaggagactactcaatgtcttcgatgcattcatccttcctagtcaactcctcacatgttctgcccttcagtctcaattgaccttttgggacagcggtg

SEQ ID NO: 428526 - DNA, 140 bp, Artificial Sequence
  Synthetic
caccgctgtcccaaaaggtcaattgagactgaagggcagaacatgtgaggagttgactaggaaggatgaatgcatcgaagacattgagtagtctcctggtgatggttggctcccccggggcatatcagcagccagggcct

SEQ ID NO: 428527 - DNA, 140 bp, Artificial Sequence
  Synthetic
atacgccatgctgggtctccctttgtgaggagtttgtttatgatgtcaaagaatataagctcagatctctgacacagagttcctacacctcccttcttcttcattgcactcaccattctccgtacttgggagtcggccat

SEQ ID NO: 428528 - DNA, 140 bp, Artificial Sequence
  Synthetic
atggccgactcccaagtacggagaatggtgagtgcaatgaagaagaagggaggtgtaggaactctgtgtcagagatctgagcttatattctttgacatcataaacaaactcctcacaaagggagacccagcatggcgtat

SEQ ID NO: 428529 - DNA, 140 bp, Artificial Sequence
  Synthetic
aggccctggctgctgatatggacacagagttcctacacctcccttcttcttcattgcactcaccattctcctttcaatccactttttaaggtccttttgtgtttcttgtagtgacaccaagaccttttgggacagcggtg

SEQ ID NO: 428530 - DNA, 140 bp, Artificial Sequence
  Synthetic
caccgctgtcccaaaaggtcttggtgtcactacaagaaacacaaaaggaccttaaaaagtggattgaaaggagaatggtgagtgcaatgaagaagaagggaggtgtaggaactctgtgtccatatcagcagccagggcct

SEQ ID NO: 428531 - DNA, 140 bp, Artificial Sequence
  Synthetic
atacgccatgctgggtctccgctcgccgtgacatttaagatcctttaagtgggccaaaaggatgattgcgtcaaaagtcagcattagttttcttctggtgttcaataactttagtgatttcgtacttgggagtcggccat

SEQ ID NO: 428532 - DNA, 140 bp, Artificial Sequence
  Synthetic
atggccgactcccaagtacgaaatcactaaagttattgaacaccagaagaaaactaatgctgacttttgacgcaatcatccttttggcccacttaaaggatcttaaatgtcacggcgagcggagacccagcatggcgtat

SEQ ID NO: 428533 - DNA, 140 bp, Artificial Sequence
  Synthetic
aggccctggctgctgatatgttatattgctcttgattcaggccatggtggatgggactgcatcatgactagttaccaatatctgataattcagaacacaacctgggaagatcactgccaggaccttttgggacagcggtg

SEQ ID NO: 428534 - DNA, 140 bp, Artificial Sequence
  Synthetic
caccgctgtcccaaaaggtcctggcagtgatcttcccaggttgtgttctgaattatcagatattggtaactagtcatgatgcagtcccatccaccatggcctgaatcaagagcaatataacatatcagcagccagggcct

SEQ ID NO: 428535 - DNA, 140 bp, Artificial Sequence
  Synthetic
aggccctggctgctgatatgtttgcaatctgtctgatgcccacaaaaagaacctctatgaccacgctcttatgagcataatttcaactttccacttgtccatccccaatttcaatcagtagaccttttgggacagcggtg

SEQ ID NO: 428536 - DNA, 140 bp, Artificial Sequence
  Synthetic
caccgctgtcccaaaaggtctactgattgaaattggggatggacaagtggaaagttgaaattatgctcataagagcgtggtcatagaggttctttttgtgggcatcagacagattgcaaacatatcagcagccagggcct

SEQ ID NO: 428537 - DNA, 140 bp, Artificial Sequence
  Synthetic
aggccctggctgctgatatgtagaggatcaatctctgagggtgtgtccccctctctgtcaatataaaggttgttgaaatctctcaagagctgtcgcctatctgtcctgacaaattgtcttgaccttttgggacagcggtg

SEQ ID NO: 428538 - DNA, 140 bp, Artificial Sequence
  Synthetic
caccgctgtcccaaaaggtcaagacaatttgtcaggacagataggcgacagctcttgagagatttcaacaacctttatattgacagagagggggacacaccctcagagattgatcctctacatatcagcagccagggcct

SEQ ID NO: 428539 - DNA, 140 bp, Artificial Sequence
  Synthetic
aggccctggctgctgatatgttctcaaactctttttcgttgtttagacaactccctgataactgtaaacttagagcttcaaagtaatcctctataagtctggtaaacatctttgtcctaagaccttttgggacagcggtg

SEQ ID NO: 428540 - DNA, 140 bp, Artificial Sequence
  Synthetic
caccgctgtcccaaaaggtcttaggacaaagatgtttaccagacttatagaggattactttgaagctctaagtttacagttatcagggagttgtctaaacaacgaaaaagagtttgagaacatatcagcagccagggcct

SEQ ID NO: 428541 - DNA, 140 bp, Artificial Sequence
  Synthetic
atacgccatgctgggtctccaatctcttttttcacatcaagagtggacattttgttattgatgcctctgtggcagagctccaacaccctctcataatgatcagatcgagaatctgtcaaacgtacttgggagtcggccat

SEQ ID NO: 428542 - DNA, 140 bp, Artificial Sequence
  Synthetic
atggccgactcccaagtacgtttgacagattctcgatctgatcattatgagagggtgttggagctctgccacagaggcatcaataacaaaatgtccactcttgatgtgaaaaaagagattggagacccagcatggcgtat

SEQ ID NO: 428543 - DNA, 140 bp, Artificial Sequence
  Synthetic
aggccctggctgctgatatgggcagagctccaacaccctctcataatgatcagatcgagaatctgtcaaaacattgaggctctcaatgcccgatgttctcactcctgcttttgttaaagagaccttttgggacagcggtg

SEQ ID NO: 428544 - DNA, 140 bp, Artificial Sequence
  Synthetic
caccgctgtcccaaaaggtctctttaacaaaagcaggagtgagaacatcgggcattgagagcctcaatgttttgacagattctcgatctgatcattatgagagggtgttggagctctgcccatatcagcagccagggcct

SEQ ID NO: 428545 - DNA, 140 bp, Artificial Sequence
  Synthetic
atacgccatgctgggtctccagatatttatatcagtagaagactgctgggcacattcacatggacactgtcagattctgaaggcaaggacacaccagggggatattgtctgaccagatggcgtacttgggagtcggccat

SEQ ID NO: 428546 - DNA, 140 bp, Artificial Sequence
  Synthetic
atggccgactcccaagtacgccatctggtcagacaatatccccctggtgtgtccttgccttcagaatctgacagtgtccatgtgaatgtgcccagcagtcttctactgatataaatatctggagacccagcatggcgtat

SEQ ID NO: 428547 - DNA, 140 bp, Artificial Sequence
  Synthetic
aggccctggctgctgatatgcattctggaaacaaatcagtgtagaaattggttctgccgtctatcaagggcaacagaatgatgtcaacagatgataagtcaggctttaaagactctagctgaccttttgggacagcggtg

SEQ ID NO: 428548 - DNA, 140 bp, Artificial Sequence
  Synthetic
caccgctgtcccaaaaggtcagctagagtctttaaagcctgacttatcatctgttgacatcattctgttgcccttgatagacggcagaaccaatttctacactgatttgtttccagaatgcatatcagcagccagggcct

SEQ ID NO: 428549 - DNA, 140 bp, Artificial Sequence
  Synthetic
atacgccatgctgggtctccacaaagcattccagtaatattaatgtgttcccactgaatttgaatccatctggcaccacaaatggtagaccagggcacagaacaccttgtctctgcagaacgtacttgggagtcggccat

SEQ ID NO: 428550 - DNA, 140 bp, Artificial Sequence
  Synthetic
atggccgactcccaagtacgttctgcagagacaaggtgttctgtgccctggtctaccatttgtggtgccagatggattcaaattcagtgggaacacattaatattactggaatgctttgtggagacccagcatggcgtat

SEQ ID NO: 428551 - DNA, 140 bp, Artificial Sequence
  Synthetic
aggccctggctgctgatatgtggcaccacaaatggtagaccagggcacagaacaccttgtctctgcagaaggatttcaacagaaaggtcttctgagttgtgctcacaaccattggctttggaccttttgggacagcggtg

SEQ ID NO: 428552 - DNA, 140 bp, Artificial Sequence
  Synthetic
caccgctgtcccaaaaggtccaaagccaatggttgtgagcacaactcagaagacctttctgttgaaatccttctgcagagacaaggtgttctgtgccctggtctaccatttgtggtgccacatatcagcagccagggcct

SEQ ID NO: 428553 - DNA, 140 bp, Artificial Sequence
  Synthetic
aggccctggctgctgatatgtccttggaagcactcatctcagtctggacacttagggatttgctgattgaaagctttaatcagtaaatcaatgaaaagcgcaatccaatagcctaggatcgaccttttgggacagcggtg

SEQ ID NO: 428554 - DNA, 140 bp, Artificial Sequence
  Synthetic
caccgctgtcccaaaaggtcgatcctaggctattggattgcgcttttcattgatttactgattaaagctttcaatcagcaaatccctaagtgtccagactgagatgagtgcttccaaggacatatcagcagccagggcct

SEQ ID NO: 428555 - DNA, 140 bp, Artificial Sequence
  Synthetic
atacgccatgctgggtctccatcctaggcaatttagctggacttcagtggtaaggctcaacctagtggatccctgaatcaaagtgcctaataaaaatgggcaacaaacaggccaaatcaacgtacttgggagtcggccat

SEQ ID NO: 428556 - DNA, 140 bp, Artificial Sequence
  Synthetic
atggccgactcccaagtacgttgatttggcctgtttgttgcccatttttattaggcactttgattcagggatccactaggttgagccttaccactgaagtccagctaaattgcctaggatggagacccagcatggcgtat

SEQ ID NO: 428557 - DNA, 140 bp, Artificial Sequence
  Synthetic
atacgccatgctgggtctccaaagagaatttgagcctccctgtatcaggccccactgaattataagactgtggtgattcttggctataaaagcataagttctttaacattgctgtggtgccgtacttgggagtcggccat

SEQ ID NO: 428558 - DNA, 140 bp, Artificial Sequence
  Synthetic
atggccgactcccaagtacggcaccacagcaatgttaaagaacttatgcttttatagccaagaatcaccacagtcttataattcagtggggcctgatacagggaggctcaaattctctttggagacccagcatggcgtat

SEQ ID NO: 428559 - DNA, 140 bp, Artificial Sequence
  Synthetic
atacgccatgctgggtctccctgcacccaagctaaaattatagcctgagatgtttagagagctcttattagcgtcaatcatctttaggatggggtggctttgagtcagcctgtccaggtccgtacttgggagtcggccat

SEQ ID NO: 428560 - DNA, 140 bp, Artificial Sequence
  Synthetic
atggccgactcccaagtacggacctggacaggctgactcaaagccaccccatcctaaagatgattgacgctaataagagctctctaaacatctcaggctataattttagcttgggtgcagggagacccagcatggcgtat

SEQ ID NO: 428561 - DNA, 140 bp, Artificial Sequence
  Synthetic
aggccctggctgctgatatgaaagcagcagcacagccgagcgcacccccaaccgaggcgacccagaacacaacacccccaccgtacaccccatgatcccaggaccaacacccacacctccgaccttttgggacagcggtg

SEQ ID NO: 428562 - DNA, 140 bp, Artificial Sequence
  Synthetic
caccgctgtcccaaaaggtcggaggtgtgggtgttggtcctgggatcatggggtgtacggtgggggtgttgtgttctgggtcgcctcggttgggggtgcgctcggctgtgctgctgctttcatatcagcagccagggcct

SEQ ID NO: 428563 - DNA, 140 bp, Artificial Sequence
  Synthetic
aggccctggctgctgatatgtctgtcttgataatctctcgttgtccgctaggtactttgatactaagtctttgacacaggctatgtcttcctccatgtctggctgcaggtatgatggtcagaccttttgggacagcggtg

SEQ ID NO: 428564 - DNA, 140 bp, Artificial Sequence
  Synthetic
caccgctgtcccaaaaggtctgaccatcatacctgcagccagacatggaggaagacatagcctgtgtcaaagacttagtatcaaagtacctagcggacaacgagagattatcaagacagacatatcagcagccagggcct

SEQ ID NO: 428565 - DNA, 140 bp, Artificial Sequence
  Synthetic
aggccctggctgctgatatgggatcaataatcagcttcatgggtattacatcccctaactgctgtgtatcctttaagaactcattcactacatctgaatcaacaaaccaagctgacctacgaccttttgggacagcggtg

SEQ ID NO: 428566 - DNA, 140 bp, Artificial Sequence
  Synthetic
caccgctgtcccaaaaggtcgtaggtcagcttggtttgttgattcagatgtagtgaatgagttcttaaaggatacacagcagttaggggatgtaatacccatgaagctgattattgatcccatatcagcagccagggcct

SEQ ID NO: 428567 - DNA, 140 bp, Artificial Sequence
  Synthetic
atacgccatgctgggtctccggtctgctggagcaacagttcactatagaataaggtcctgtagggggcacagaagacacaagagtcaaataaaggcaatttaattagatagtcttaatgccgtacttgggagtcggccat

SEQ ID NO: 428568 - DNA, 140 bp, Artificial Sequence
  Synthetic
atggccgactcccaagtacggcattaagactatctaattaaattgcctttatttgactcttgtgtcttctgtgccccctacaggaccttattctatagtgaactgttgctccagcagaccggagacccagcatggcgtat

SEQ ID NO: 428569 - DNA, 140 bp, Artificial Sequence
  Synthetic
aggccctggctgctgatatgaaggtttcttgatttataatgagtgtactttcccataagtgtatttgcattcatgattaaaagtatagctttaaaacactggaaatagtcatgatctaaggaccttttgggacagcggtg

SEQ ID NO: 428570 - DNA, 140 bp, Artificial Sequence
  Synthetic
caccgctgtcccaaaaggtccttagatcatgactatttccagtgttttaaagctatacttttaatcatgaatgcaaatacacttatgggaaagtacactcattataaatcaagaaaccttcatatcagcagccagggcct

SEQ ID NO: 428571 - DNA, 140 bp, Artificial Sequence
  Synthetic
aggccctggctgctgatatgatgtcttgtgtggaaaccacgtgaaggaccccaatgttcttgtagtcgcaacaaatggtctcacataagactcaaaataaatttgcctcatgaaattgtcgaccttttgggacagcggtg

SEQ ID NO: 428572 - DNA, 140 bp, Artificial Sequence
  Synthetic
caccgctgtcccaaaaggtcgacaatttcatgaggcaaatttattttgagtcttatgtgagaccatttgttgcgactacaagaacattggggtccttcacgtggtttccacacaagacatcatatcagcagccagggcct

SEQ ID NO: 428573 - DNA, 140 bp, Artificial Sequence
  Synthetic
aggccctggctgctgatatggggcccccgtgacccaccgccgaaaggcggtgggtcacgggggcgtccatttacaggacgaccttggggcttgaggttctaaacaccatgtctctggggagaccttttgggacagcggtg

SEQ ID NO: 428574 - DNA, 140 bp, Artificial Sequence
  Synthetic
caccgctgtcccaaaaggtctccccagagacatggtgtttagaacctcaagccccaaggtcgtcctgtaaatggacgcccccgtgacccaccgcctttcggcggtgggtcacgggggccccatatcagcagccagggcct

SEQ ID NO: 428575 - DNA, 140 bp, Artificial Sequence
  Synthetic
aggccctggctgctgatatgttacaggacgaccttggggcttgaggttctaaacaccatgtctctggggagaactgctcttaaaactggtatattgagtcctcctgacacagctgcatcagaccttttgggacagcggtg

SEQ ID NO: 428576 - DNA, 140 bp, Artificial Sequence
  Synthetic
caccgctgtcccaaaaggtctgatgcagctgtgtcaggaggactcaatataccagttttaagagcagttctccccagagacatggtgtttagaacctcaagccccaaggtcgtcctgtaacatatcagcagccagggcct

SEQ ID NO: 428577 - DNA, 140 bp, Artificial Sequence
  Synthetic
atacgccatgctgggtctccgcaccggggatcctaggcaatttagacgttcttctttctgaagccttgtgtgctgagctcctccaaatgggaaacaagcaagccaaggcctcagataaaacgtacttgggagtcggccat

SEQ ID NO: 428578 - DNA, 140 bp, Artificial Sequence
  Synthetic
atggccgactcccaagtacgttttatctgaggccttggcttgcttgtttcccatttggaggagctcagcacacaaggcttcagaaagaagaacgtctaaattgcctaggatccccggtgcggagacccagcatggcgtat

SEQ ID NO: 428579 - DNA, 140 bp, Artificial Sequence
  Synthetic
atacgccatgctgggtctccggtgccccatctgcaagatgcctcttcccacaaaactgagaccatcagccactccaacagcacccccaaccggagcagcggacagcatcagacccccacccgtacttgggagtcggccat

SEQ ID NO: 428580 - DNA, 140 bp, Artificial Sequence
  Synthetic
atggccgactcccaagtacgggtgggggtctgatgctgtccgctgctccggttgggggtgctgttggagtggctgatggtctcagttttgtgggaagaggcatcttgcagatggggcaccggagacccagcatggcgtat

SEQ ID NO: 428581 - DNA, 140 bp, Artificial Sequence
  Synthetic
aggccctggctgctgatatgcagtgttgcagaattcctcataaaatttgtctggtaaaacatcatgatcaaagtcttcaaccatgtgattagacaattcacctttaatcagcctaatgtagaccttttgggacagcggtg

SEQ ID NO: 428582 - DNA, 140 bp, Artificial Sequence
  Synthetic
caccgctgtcccaaaaggtctacattaggctgattaaaggtgaattgtctaatcacatggttgaagactttgatcatgatgttttaccagacaaattttatgaggaattctgcaacactgcatatcagcagccagggcct

SEQ ID NO: 428583 - DNA, 140 bp, Artificial Sequence
  Synthetic
aggccctggctgctgatatgctttcactgcagctcctaagctgaagttgtaaccagaaatgttcaaggagctcttcttagtgtccaccatattcagtataggatggctttgggaaagtctgaccttttgggacagcggtg

SEQ ID NO: 428584 - DNA, 140 bp, Artificial Sequence
  Synthetic
caccgctgtcccaaaaggtcagactttcccaaagccatcctatactgaatatggtggacactaagaagagctccttgaacatttctggttacaacttcagcttaggagctgcagtgaaagcatatcagcagccagggcct

SEQ ID NO: 428585 - DNA, 140 bp, Artificial Sequence
  Synthetic
aggccctggctgctgatatgctgttagtgccaggacggcatcattcagatcaacttgaccttgtttggtgagacatgctaatgtcaaactgggcatggtgccgaactggttgttcaaaaggaccttttgggacagcggtg

SEQ ID NO: 428586 - DNA, 140 bp, Artificial Sequence
  Synthetic
caccgctgtcccaaaaggtccttttgaacaaccagttcggcaccatgcccagtttgacattagcatgtctcaccaaacaaggtcaagttgatctgaatgatgccgtcctggcactaacagcatatcagcagccagggcct

SEQ ID NO: 428587 - DNA, 140 bp, Artificial Sequence
  Synthetic
aggccctggctgctgatatgagacatgctaatgtcaaactgggcatggtgccgaactggttgttcaaaagatctggattcttaacatcccacaccctaacaactccgtctcttccaggttgaccttttgggacagcggtg

SEQ ID NO: 428588 - DNA, 140 bp, Artificial Sequence
  Synthetic
caccgctgtcccaaaaggtcaacctggaagagacggagttgttagggtgtgggatgttaagaatccagatcttttgaacaaccagttcggcaccatgcccagtttgacattagcatgtctcatatcagcagccagggcct

SEQ ID NO: 428589 - DNA, 140 bp, Artificial Sequence
  Synthetic
atacgccatgctgggtctcccatgcttaaacattggcctttcaacacctttgtaaataactttctctacaaatgaagaaaaaggacccattctatgtagcccttcaccctctgggactgacgtacttgggagtcggccat

SEQ ID NO: 428590 - DNA, 140 bp, Artificial Sequence
  Synthetic
atggccgactcccaagtacgtcagtcccagagggtgaagggctacatagaatgggtcctttttcttcatttgtagagaaagttatttacaaaggtgttgaaaggccaatgtttaagcatgggagacccagcatggcgtat

SEQ ID NO: 428591 - DNA, 140 bp, Artificial Sequence
  Synthetic
atacgccatgctgggtctcccggggatcctaggcaattcagctggacttcagtggaaagactctttttagtgaatccctaaatcaaagtgcctaatcaaaatgggcaacagacaggccaacgtacttgggagtcggccat

SEQ ID NO: 428592 - DNA, 140 bp, Artificial Sequence
  Synthetic
atggccgactcccaagtacgttggcctgtctgttgcccattttgattaggcactttgatttagggattcactaaaaagagtctttccactgaagtccagctgaattgcctaggatccccgggagacccagcatggcgtat

SEQ ID NO: 428593 - DNA, 140 bp, Artificial Sequence
  Synthetic
aggccctggctgctgatatgtgaatccctaaatcaaagtgcctaatcaaaatgggcaacagacaggccaaatcgacaaaagtcgatgaacatcaaagagctcatctagtgccagatgcatgaccttttgggacagcggtg

SEQ ID NO: 428594 - DNA, 140 bp, Artificial Sequence
  Synthetic
caccgctgtcccaaaaggtcatgcatctggcactagatgagctctttgatgttcatcgacttttgtcgatttggcctgtctgttgcccattttgattaggcactttgatttagggattcacatatcagcagccagggcct

SEQ ID NO: 428595 - DNA, 140 bp, Artificial Sequence
  Synthetic
atacgccatgctgggtctccatgagacaggactagaactgaccttgaccaacacgagcattattaatcataaattttgcaatctgtctgatgcccacaaaaagaacctctatgaccacgccgtacttgggagtcggccat

SEQ ID NO: 428596 - DNA, 140 bp, Artificial Sequence
  Synthetic
atggccgactcccaagtacggcgtggtcatagaggttctttttgtgggcatcagacagattgcaaaatttatgattaataatgctcgtgttggtcaaggtcagttctagtcctgtctcatggagacccagcatggcgtat

SEQ ID NO: 428597 - DNA, 140 bp, Artificial Sequence
  Synthetic
atacgccatgctgggtctccacaagggttgtgcttgaaaaaatccaacaccttaactgtcttaggttcccctaagacccatgcacccagttctattgcagttgataaggagatgcacatacgtacttgggagtcggccat

SEQ ID NO: 428598 - DNA, 140 bp, Artificial Sequence
  Synthetic
atggccgactcccaagtacgtatgtgcatctccttatcaactgcaatagaactgggtgcatgggtcttaggggaacctaagacagttaaggtgttggattttttcaagcacaacccttgtggagacccagcatggcgtat

SEQ ID NO: 428599 - DNA, 140 bp, Artificial Sequence
  Synthetic
atacgccatgctgggtctccccacacccgtccattgaatcctctgtttcaatctatcagacaacattgatttcaatgcaccaattaaaaggtgcggcgaactatcaccaatctcctttaccgtacttgggagtcggccat

SEQ ID NO: 428600 - DNA, 140 bp, Artificial Sequence
  Synthetic
atggccgactcccaagtacggtaaaggagattggtgatagttcgccgcaccttttaattggtgcattgaaatcaatgttgtctgatagattgaaacagaggattcaatggacgggtgtggggagacccagcatggcgtat

SEQ ID NO: 428601 - DNA, 140 bp, Artificial Sequence
  Synthetic
atacgccatgctgggtctccccggggatcctaggcaattaagctggatttcagtggtgaaactcattttggtgaatccttgaaccaaagtgtgtagtcaaaatgggcaacagacaggccacgtacttgggagtcggccat

SEQ ID NO: 428602 - DNA, 140 bp, Artificial Sequence
  Synthetic
atggccgactcccaagtacgtggcctgtctgttgcccattttgactacacactttggttcaaggattcaccaaaatgagtttcaccactgaaatccagcttaattgcctaggatccccggggagacccagcatggcgtat

SEQ ID NO: 428603 - DNA, 140 bp, Artificial Sequence
  Synthetic
aggccctggctgctgatatggtgaatccttgaaccaaagtgtgtagtcaaaatgggcaacagacaggccaaatcgacagaagtcaatgaacatcaaagagctcatctagtgccagatgcagaccttttgggacagcggtg

SEQ ID NO: 428604 - DNA, 140 bp, Artificial Sequence
  Synthetic
caccgctgtcccaaaaggtctgcatctggcactagatgagctctttgatgttcattgacttctgtcgatttggcctgtctgttgcccattttgactacacactttggttcaaggattcaccatatcagcagccagggcct

SEQ ID NO: 428605 - DNA, 140 bp, Artificial Sequence
  Synthetic
aggccctggctgctgatatgattagattgcacaggtgaacagggacaccattcgcaaccgactgatcaatgattgtgtcaattgtttctgccagttggtgtggctctttacactttatatgaccttttgggacagcggtg

SEQ ID NO: 428606 - DNA, 140 bp, Artificial Sequence
  Synthetic
caccgctgtcccaaaaggtcatataaagtgtaaagagccacaccaactggcagaaacaattgacacaatcattgatcagtcggttgcgaatggtgtccctgttcacctgtgcaatctaatcatatcagcagccagggcct

SEQ ID NO: 428607 - DNA, 140 bp, Artificial Sequence
  Synthetic
aggccctggctgctgatatggagctgtgagacagccaatgctgtaagtttgttaaagtcatagttcaaaaccctggaaccatctgtgtatttgttgacgacaacactcttgttgctagctgaccttttgggacagcggtg

SEQ ID NO: 428608 - DNA, 140 bp, Artificial Sequence
  Synthetic
caccgctgtcccaaaaggtcagctagcaacaagagtgttgtcgtcaacaaatacacagatggttccagggttttgaactatgactttaacaaacttacagcattggctgtctcacagctccatatcagcagccagggcct

SEQ ID NO: 428609 - DNA, 140 bp, Artificial Sequence
  Synthetic
atacgccatgctgggtctccggggagatgcgcgagctgttctcggagcacctactcaatgtcgaggggaggccccacctcttcaaagaggggcctgcacagcctccctcttaatctaaaccgtacttgggagtcggccat

SEQ ID NO: 428610 - DNA, 140 bp, Artificial Sequence
  Synthetic
atggccgactcccaagtacggtttagattaagagggaggctgtgcaggcccctctttgaagaggtggggcctcccctcgacattgagtaggtgctccgagaacagctcgcgcatctccccggagacccagcatggcgtat

SEQ ID NO: 428611 - DNA, 140 bp, Artificial Sequence
  Synthetic
aggccctggctgctgatatgaaagtgcctcacaattcacatctagggcaacacaaagatcaaggaactttattctaggtgaccatttcatctttgtggaagctaaatcactcataaatgggaccttttgggacagcggtg

SEQ ID NO: 428612 - DNA, 140 bp, Artificial Sequence
  Synthetic
caccgctgtcccaaaaggtcccatttatgagtgatttagcttccacaaagatgaaatggtcacctagaataaagttccttgatctttgtgttgccctagatgtgaattgtgaggcactttcatatcagcagccagggcct

SEQ ID NO: 428613 - DNA, 140 bp, Artificial Sequence
  Synthetic
atacgccatgctgggtctccacaaacatttccaaatcttgatcttggatagatggtgtaaatgtagctacccttctatcagattcccacagtgctcccctacatacaaccaatggcactgcgtacttgggagtcggccat

SEQ ID NO: 428614 - DNA, 140 bp, Artificial Sequence
  Synthetic
atggccgactcccaagtacgcagtgccattggttgtatgtaggggagcactgtgggaatctgatagaagggtagctacatttacaccatctatccaagatcaagatttggaaatgtttgtggagacccagcatggcgtat

SEQ ID NO: 428615 - DNA, 140 bp, Artificial Sequence
  Synthetic
atacgccatgctgggtctcctccattgtcccccatcactacttcaacaccttgagtccctagtagctgggtctgtatggatttgatgtaaagattctccttgttggggcccctgacacaccgtacttgggagtcggccat

SEQ ID NO: 428616 - DNA, 140 bp, Artificial Sequence
  Synthetic
atggccgactcccaagtacggtgtgtcaggggccccaacaaggagaatctttacatcaaatccatacagacccagctactagggactcaaggtgttgaagtagtgatgggggacaatggaggagacccagcatggcgtat

SEQ ID NO: 428617 - DNA, 140 bp, Artificial Sequence
  Synthetic
atacgccatgctgggtctccggcaattcagctggacttcagtggaaagactcttttagtgaatccctaaatcaaggtgcctaatcaaaatgggcaacagacaggccaaatcgacaaaagtcgtacttgggagtcggccat

SEQ ID NO: 428618 - DNA, 140 bp, Artificial Sequence
  Synthetic
atggccgactcccaagtacgacttttgtcgatttggcctgtctgttgcccattttgattaggcaccttgatttagggattcactaaaagagtctttccactgaagtccagctgaattgccggagacccagcatggcgtat

SEQ ID NO: 428619 - DNA, 140 bp, Artificial Sequence
  Synthetic
aggccctggctgctgatatgcagcaccattctaagcggatgatgggtggctaagttcaaccaatgaaactccaagtcagaatcagacaaaggttcaacgtctagaagtttaaacaagttcgaccttttgggacagcggtg

SEQ ID NO: 428620 - DNA, 140 bp, Artificial Sequence
  Synthetic
caccgctgtcccaaaaggtcgaacttgtttaaacttctagacgttgaacctttgtctgattctgacttggagtttcattggttgaacttagccacccatcatccgcttagaatggtgctgcatatcagcagccagggcct

SEQ ID NO: 428621 - DNA, 140 bp, Artificial Sequence
  Synthetic
aggccctggctgctgatatgttttgcacgcttgtcagttagaacattgatgctttcaattcctgagagcctcccagacgttaaggctaaagattcacaaagtcttgaatactcagactctgaccttttgggacagcggtg

SEQ ID NO: 428622 - DNA, 140 bp, Artificial Sequence
  Synthetic
caccgctgtcccaaaaggtcagagtctgagtattcaagactttgtgaatctttagccttaacgtctgggaggctctcaggaattgaaagcatcaatgttctaactgacaagcgtgcaaaacatatcagcagccagggcct

SEQ ID NO: 428623 - DNA, 140 bp, Artificial Sequence
  Synthetic
aggccctggctgctgatatggtcccatatcaaggattgaactaatgtgtgaggggactgtgccaatttgaaaattggagttaaaaaagtcttcagtcattgattgagttgtcttcttcttgaccttttgggacagcggtg

SEQ ID NO: 428624 - DNA, 140 bp, Artificial Sequence
  Synthetic
caccgctgtcccaaaaggtcaagaagaagacaactcaatcaatgactgaagacttttttaactccaattttcaaattggcacagtcccctcacacattagttcaatccttgatatgggaccatatcagcagccagggcct

SEQ ID NO: 428625 - DNA, 140 bp, Artificial Sequence
  Synthetic
aggccctggctgctgatatgataggcctctttgcacctcacaacctggtatctagagggtccaaattcattttgccttagtttcactgtggaagacgttttcattgagttgatcaaagccgaccttttgggacagcggtg

SEQ ID NO: 428626 - DNA, 140 bp, Artificial Sequence
  Synthetic
caccgctgtcccaaaaggtcggctttgatcaactcaatgaaaacgtcttccacagtgaaactaaggcaaaatgaatttggaccctctagataccaggttgtgaggtgcaaagaggcctatcatatcagcagccagggcct

SEQ ID NO: 428627 - DNA, 140 bp, Artificial Sequence
  Synthetic
atacgccatgctgggtctccagatctttagcattggcgatgtcttcctccattgccaactgtggcacttgtgttgagtttaggcttgtgccagtatgacttgtgggtcaactggtggtgccgtacttgggagtcggccat

SEQ ID NO: 428628 - DNA, 140 bp, Artificial Sequence
  Synthetic
atggccgactcccaagtacggcaccaccagttgacccacaagtcatactggcacaagcctaaactcaacacaagtgccacagttggcaatggaggaagacatcgccaatgctaaagatctggagacccagcatggcgtat

SEQ ID NO: 428629 - DNA, 140 bp, Artificial Sequence
  Synthetic
aggccctggctgctgatatgcacttgtgttgagtttaggcttgtgccagtatgacttgtgggtcaactggtggtgccccacagaagctcctatagaaatgagagacaatatgcctaggatgaccttttgggacagcggtg

SEQ ID NO: 428630 - DNA, 140 bp, Artificial Sequence
  Synthetic
caccgctgtcccaaaaggtcatcctaggcatattgtctctcatttctataggagcttctgtggggcaccaccagttgacccacaagtcatactggcacaagcctaaactcaacacaagtgcatatcagcagccagggcct

SEQ ID NO: 428631 - DNA, 140 bp, Artificial Sequence
  Synthetic
atacgccatgctgggtctcccccccggggggaccccccgccgggggcccccccggggggcgagcggctcagctctactcaatgtcctcaatgcacttctccgacccaaacagctctgaaccgtacttgggagtcggccat

SEQ ID NO: 428632 - DNA, 140 bp, Artificial Sequence
  Synthetic
atggccgactcccaagtacggttcagagctgtttgggtcggagaagtgcattgaggacattgagtagagctgagccgctcgccccccgggggggcccccggcggggggtccccccgggggggagacccagcatggcgtat

SEQ ID NO: 428633 - DNA, 140 bp, Artificial Sequence
  Synthetic
atacgccatgctgggtctccatcctaggcaattcagctggacttcagtggtgaggctcactttggtgaattcctgaattaaagtacctagtcaaaatgggcaacagacaggccaaatcgacgtacttgggagtcggccat

SEQ ID NO: 428634 - DNA, 140 bp, Artificial Sequence
  Synthetic
atggccgactcccaagtacgtcgatttggcctgtctgttgcccattttgactaggtactttaattcaggaattcaccaaagtgagcctcaccactgaagtccagctgaattgcctaggatggagacccagcatggcgtat

SEQ ID NO: 428635 - DNA, 140 bp, Artificial Sequence
  Synthetic
aggccctggctgctgatatgaagggtgtttatgagctacaaactctagagctagacatggcaagccttaacatgacaatgcccttgtcttgcacgaagaacaactcccaccattacatcagaccttttgggacagcggtg

SEQ ID NO: 428636 - DNA, 140 bp, Artificial Sequence
  Synthetic
caccgctgtcccaaaaggtctgatgtaatggtgggagttgttcttcgtgcaagacaagggcattgtcatgttaaggcttgccatgtctagctctagagtttgtagctcataaacacccttcatatcagcagccagggcct

SEQ ID NO: 428637 - DNA, 140 bp, Artificial Sequence
  Synthetic
aggccctggctgctgatatgccgaattaaagtgctttgggaacacagcagttgcgaaatgcaatgagaaacatgatgaagagttttgtgacatgttaagattgtttgactttaacaaacagaccttttgggacagcggtg

SEQ ID NO: 428638 - DNA, 140 bp, Artificial Sequence
  Synthetic
caccgctgtcccaaaaggtctgtttgttaaagtcaaacaatcttaacatgtcacaaaactcttcatcatgtttctcattgcatttcgcaactgctgtgttcccaaagcactttaattcggcatatcagcagccagggcct

SEQ ID NO: 428639 - DNA, 140 bp, Artificial Sequence
  Synthetic
atacgccatgctgggtctccggggcccccccgggggagccaaccacctccaaaaactactcaatgtcctcaacatgttcgtccccctcagtcaactcctcgcatgttctgcccttcagtccgtacttgggagtcggccat

SEQ ID NO: 428640 - DNA, 140 bp, Artificial Sequence
  Synthetic
atggccgactcccaagtacggactgaagggcagaacatgcgaggagttgactgagggggacgaacatgttgaggacattgagtagtttttggaggtggttggctcccccgggggggccccggagacccagcatggcgtat

SEQ ID NO: 428641 - DNA, 140 bp, Artificial Sequence
  Synthetic
atacgccatgctgggtctccactgtgtgattctagatctttcagcctgttgcctccgctcaacccattttttaagatccctttttgttgactccaaagaaactagtctatcattgacactcgtacttgggagtcggccat

SEQ ID NO: 428642 - DNA, 140 bp, Artificial Sequence
  Synthetic
atggccgactcccaagtacgagtgtcaatgatagactagtttctttggagtcaacaaaaagggatcttaaaaaatgggttgagcggaggcaacaggctgaaagatctagaatcacacagtggagacccagcatggcgtat

SEQ ID NO: 428643 - DNA, 140 bp, Artificial Sequence
  Synthetic
atacgccatgctgggtctccgcatttggatcaagctgcagcattgcatccttaagggtcatgagctgagaataagtgagcccagcagcaaaccctgctgattgtagggacttgctggagtcgtacttgggagtcggccat

SEQ ID NO: 428644 - DNA, 140 bp, Artificial Sequence
  Synthetic
atggccgactcccaagtacgactccagcaagtccctacaatcagcagggtttgctgctgggctcacttattctcagctcatgacccttaaggatgcaatgctgcagcttgatccaaatgcggagacccagcatggcgtat

SEQ ID NO: 428645 - DNA, 140 bp, Artificial Sequence
  Synthetic
aggccctggctgctgatatgtcatcatactgacaacttcttcagacagaattatctttaataagtgacgaacaagtctgtagagcagatattcaacttctgtgatcaaatcttccctgatgaccttttgggacagcggtg

SEQ ID NO: 428646 - DNA, 140 bp, Artificial Sequence
  Synthetic
caccgctgtcccaaaaggtcatcagggaagatttgatcacagaagttgaatatctgctctacagacttgttcgtcacttattaaagataattctgtctgaagaagttgtcagtatgatgacatatcagcagccagggcct

SEQ ID NO: 428647 - DNA, 140 bp, Artificial Sequence
  Synthetic
atacgccatgctgggtctccctctattagagtcctaaattcttctgggtctctttgcaaaagttctgtgagagattgatcaaagagagaaatttgatcatcactagaggtataagcatctcgtacttgggagtcggccat

SEQ ID NO: 428648 - DNA, 140 bp, Artificial Sequence
  Synthetic
atggccgactcccaagtacgagatgcttatacctctagtgatgatcaaatttctctctttgatcaatctctcacagaacttttgcaaagagacccagaagaatttaggactctaatagagggagacccagcatggcgtat

SEQ ID NO: 428649 - DNA, 140 bp, Artificial Sequence
  Synthetic
aggccctggctgctgatatgtcacctatataaagttccctgttccctccaacttgttctttgtaagataaggaaaacttgagccttccagtatcaggacccaaggatgtgtatgactgtggaccttttgggacagcggtg

SEQ ID NO: 428650 - DNA, 140 bp, Artificial Sequence
  Synthetic
caccgctgtcccaaaaggtccacagtcatacacatccttgggtcctgatactggaaggctcaagttttccttatcttacaaagaacaagttggagggaacagggaactttatataggtgacatatcagcagccagggcct

SEQ ID NO: 428651 - DNA, 140 bp, Artificial Sequence
  Synthetic
atacgccatgctgggtctccccatccatcccctgacagacagattttgtagagtatattctcataagggtttctctcgccaggggtgtctgaaatgaacatcccaaggctctttttgacccgtacttgggagtcggccat

SEQ ID NO: 428652 - DNA, 140 bp, Artificial Sequence
  Synthetic
atggccgactcccaagtacgggtcaaaaagagccttgggatgttcatttcagacacccctggcgagagaaacccttatgagaatatactctacaaaatctgtctgtcaggggatggatggggagacccagcatggcgtat

SEQ ID NO: 428653 - DNA, 140 bp, Artificial Sequence
  Synthetic
aggccctggctgctgatatgcaaggtcccgtggggggcgcagaaaacacaaaaggcaatcaaagacaatcaaattagacaattaaattagatagccttaatgcctaggatcctcggtgcggaccttttgggacagcggtg

SEQ ID NO: 428654 - DNA, 140 bp, Artificial Sequence
  Synthetic
caccgctgtcccaaaaggtccgcaccgaggatcctaggcattaaggctatctaatttaattgtctaatttgattgtctttgattgccttttgtgttttctgcgccccccacgggaccttgcatatcagcagccagggcct

SEQ ID NO: 428655 - DNA, 140 bp, Artificial Sequence
  Synthetic
aggccctggctgctgatatggtccatgatggcatcataaacatcacaatcaaggatcttgaaatcaattccataagagttggtttctataccaacctccctcaaagcattagtggctcgagaccttttgggacagcggtg

SEQ ID NO: 428656 - DNA, 140 bp, Artificial Sequence
  Synthetic
caccgctgtcccaaaaggtctcgagccactaatgctttgagggaggttggtatagaaaccaactcttatggaattgatttcaagatccttgattgtgatgtttatgatgccatcatggaccatatcagcagccagggcct

SEQ ID NO: 428657 - DNA, 140 bp, Artificial Sequence
  Synthetic
aggccctggctgctgatatgcccaccgttttaaatctctttttgttgattccaatgagactaatctatcgttaacactcacaaaacaggagcccagccaaccagcaaggagcctgtcaccgaccttttgggacagcggtg

SEQ ID NO: 428658 - DNA, 140 bp, Artificial Sequence
  Synthetic
caccgctgtcccaaaaggtcggtgacaggctccttgctggttggctgggctcctgttttgtgagtgttaacgatagattagtctcattggaatcaacaaaaagagatttaaaacggtgggcatatcagcagccagggcct

SEQ ID NO: 428659 - DNA, 140 bp, Artificial Sequence
  Synthetic
atacgccatgctgggtctccagttaaaactctgttgataatggaaaggagctcacaattccgttcttctttaagtgatagggcacctgcatttctgtctctggttctcttccggctgtctcgtacttgggagtcggccat

SEQ ID NO: 428660 - DNA, 140 bp, Artificial Sequence
  Synthetic
atggccgactcccaagtacgagacagccggaagagaaccagagacagaaatgcaggtgccctatcacttaaagaagaacggaattgtgagctcctttccattatcaacagagttttaactggagacccagcatggcgtat

SEQ ID NO: 428661 - DNA, 140 bp, Artificial Sequence
  Synthetic
atacgccatgctgggtctcctatatcagcataatccacaggtctctgttttgtgaggattgagacaatgtccacacctgtccattgaattctttgcttcaatctatcagacatcattgatcgtacttgggagtcggccat

SEQ ID NO: 428662 - DNA, 140 bp, Artificial Sequence
  Synthetic
atggccgactcccaagtacgatcaatgatgtctgatagattgaagcaaagaattcaatggacaggtgtggacattgtctcaatcctcacaaaacagagacctgtggattatgctgatataggagacccagcatggcgtat

SEQ ID NO: 428663 - DNA, 140 bp, Artificial Sequence
  Synthetic
atacgccatgctgggtctcccctttcctcaccaaaattcaagtctgcatacaagaacttgaggactggagaggctcttcggaactggaatgtcaactgttcaatgttgtcatcacaggtgcgtacttgggagtcggccat

SEQ ID NO: 428664 - DNA, 140 bp, Artificial Sequence
  Synthetic
atggccgactcccaagtacgcacctgtgatgacaacattgaacagttgacattccagttccgaagagcctctccagtcctcaagttcttgtatgcagacttgaattttggtgaggaaaggggagacccagcatggcgtat

SEQ ID NO: 428665 - DNA, 140 bp, Artificial Sequence
  Synthetic
aggccctggctgctgatatgactgatcctaacatcattcatcagcctttctctatcaatcttgaagtttaagcatttgtttttgtaatggctgtattttccagccaatttccctgcattcgaccttttgggacagcggtg

SEQ ID NO: 428666 - DNA, 140 bp, Artificial Sequence
  Synthetic
caccgctgtcccaaaaggtcgaatgcagggaaattggctggaaaatacagccattacaaaaacaaatgcttaaacttcaagattgatagagaaaggctgatgaatgatgttaggatcagtcatatcagcagccagggcct

SEQ ID NO: 428667 - DNA, 140 bp, Artificial Sequence
  Synthetic
aggccctggctgctgatatgtgtctctaacatgttcccaccgtccagcatacaggctcctgccttcacagctgcacccaagctaaaattatagcctgagatgtttagagagctcttattagaccttttgggacagcggtg

SEQ ID NO: 428668 - DNA, 140 bp, Artificial Sequence
  Synthetic
caccgctgtcccaaaaggtctaataagagctctctaaacatctcaggctataattttagcttgggtgcagctgtgaaggcaggagcctgtatgctggacggtgggaacatgttagagacacatatcagcagccagggcct

SEQ ID NO: 428669 - DNA, 140 bp, Artificial Sequence
  Synthetic
atacgccatgctgggtctccggatcctaggcaatttagctggacttcagtggtaaagtccattctagtgaatccctgaatcaaagtgcccagaaaatgggcaacaagcaggccaaatcgacgtacttgggagtcggccat

SEQ ID NO: 428670 - DNA, 140 bp, Artificial Sequence
  Synthetic
atggccgactcccaagtacgtcgatttggcctgcttgttgcccattttctgggcactttgattcagggattcactagaatggactttaccactgaagtccagctaaattgcctaggatccggagacccagcatggcgtat

SEQ ID NO: 428671 - DNA, 140 bp, Artificial Sequence
  Synthetic
aggccctggctgctgatatgtccttagaagcactcatttcggtctggacacctgggggcttactggttgaaagttttactcagtaagtcaatgaaaagcgcaatccaatagcctaggatcgaccttttgggacagcggtg

SEQ ID NO: 428672 - DNA, 140 bp, Artificial Sequence
  Synthetic
caccgctgtcccaaaaggtcgatcctaggctattggattgcgcttttcattgacttactgagtaaaactttcaaccagtaagcccccaggtgtccagaccgaaatgagtgcttctaaggacatatcagcagccagggcct

SEQ ID NO: 428673 - DNA, 140 bp, Artificial Sequence
  Synthetic
aggccctggctgctgatatgaaagctaacttctgtcttgatagcttctcattgtctgcaaggtactttgagataagatctttagcattggcaatgtcttcctccatcgccaattgtggcagaccttttgggacagcggtg

SEQ ID NO: 428674 - DNA, 140 bp, Artificial Sequence
  Synthetic
caccgctgtcccaaaaggtctgccacaattggcgatggaggaagacattgccaatgctaaagatcttatctcaaagtaccttgcagacaatgagaagctatcaagacagaagttagctttcatatcagcagccagggcct

SEQ ID NO: 428675 - DNA, 140 bp, Artificial Sequence
  Synthetic
aggccctggctgctgatatgcctgtgttgggttcgggtttgtgccagtatggcttgtaggtcagatggtggtgccccacaaaggcttcaacaaaaatgagagacaatatgcctaggatccgaccttttgggacagcggtg

SEQ ID NO: 428676 - DNA, 140 bp, Artificial Sequence
  Synthetic
caccgctgtcccaaaaggtcggatcctaggcatattgtctctcatttttgttgaagcctttgtggggcaccaccatctgacctacaagccatactggcacaaacccgaacccaacacaggcatatcagcagccagggcct

SEQ ID NO: 428677 - DNA, 140 bp, Artificial Sequence
  Synthetic
atacgccatgctgggtctcctgctgaactcctccaaatgggaaacaagcaagccaaaaccccagaaataaaagacagcccgagagccagcctaatcccagatgctacacacctagggccacgtacttgggagtcggccat

SEQ ID NO: 428678 - DNA, 140 bp, Artificial Sequence
  Synthetic
atggccgactcccaagtacgtggccctaggtgtgtagcatctgggattaggctggctctcgggctgtcttttatttctggggttttggcttgcttgtttcccatttggaggagttcagcaggagacccagcatggcgtat

SEQ ID NO: 428679 - DNA, 140 bp, Artificial Sequence
  Synthetic
atacgccatgctgggtctcctacctattttatcacaatacagctttctgaaatcctccaacaatttcatcttatcagtcttaacaaactgactttctatattgccttgccttagtttgttcgtacttgggagtcggccat

SEQ ID NO: 428680 - DNA, 140 bp, Artificial Sequence
  Synthetic
atggccgactcccaagtacgaacaaactaaggcaaggcaatatagaaagtcagtttgttaagactgataagatgaaattgttggaggatttcagaaagctgtattgtgataaaataggtaggagacccagcatggcgtat

SEQ ID NO: 428681 - DNA, 140 bp, Artificial Sequence
  Synthetic
aggccctggctgctgatatgccacaggtctctgttttgtgaggattgaaacaatgtccacacccgtccattgaatcctttgtttcaatctatcggacatcattgatttcaatgcaccaacgaccttttgggacagcggtg

SEQ ID NO: 428682 - DNA, 140 bp, Artificial Sequence
  Synthetic
caccgctgtcccaaaaggtcgttggtgcattgaaatcaatgatgtccgatagattgaaacaaaggattcaatggacgggtgtggacattgtttcaatcctcacaaaacagagacctgtggcatatcagcagccagggcct

SEQ ID NO: 428683 - DNA, 140 bp, Artificial Sequence
  Synthetic
atacgccatgctgggtctccaatgtcaggcttggcatggtcccaaactgattattaagtagatctgcattcttcacatcccaaaccctcaccactccatcccttccagcccgagccccttcgtacttgggagtcggccat

SEQ ID NO: 428684 - DNA, 140 bp, Artificial Sequence
  Synthetic
atggccgactcccaagtacgaaggggctcgggctggaagggatggagtggtgagggtttgggatgtgaagaatgcagatctacttaataatcagtttgggaccatgccaagcctgacattggagacccagcatggcgtat

SEQ ID NO: 428685 - DNA, 140 bp, Artificial Sequence
  Synthetic
aggccctggctgctgatatgaacagaactgttgcagaaggagtacatggacaggcaagggaaaacacccttagggttagtagatctttttgtctttagcaccagcttttatctcattagcgaccttttgggacagcggtg

SEQ ID NO: 428686 - DNA, 140 bp, Artificial Sequence
  Synthetic
caccgctgtcccaaaaggtcgctaatgagataaaagctggtgctaaagacaaaaagatctactaaccctaagggtgttttcccttgcctgtccatgtactccttctgcaacagttctgttcatatcagcagccagggcct

SEQ ID NO: 428687 - DNA, 140 bp, Artificial Sequence
  Synthetic
aggccctggctgctgatatgcacttgtgttaagtttgggtttgtgtcgatgtagcttgtgggtcagctggtgatgccccacagaagctcccacagaaatgagaatcaatatgcctaggatgaccttttgggacagcggtg

SEQ ID NO: 428688 - DNA, 140 bp, Artificial Sequence
  Synthetic
caccgctgtcccaaaaggtcatcctaggcatattgattctcatttctgtgggagcttctgtggggcatcaccagctgacccacaagctacatcgacacaaacccaaacttaacacaagtgcatatcagcagccagggcct

SEQ ID NO: 428689 - DNA, 140 bp, Artificial Sequence
  Synthetic
atacgccatgctgggtctccaccagcctttacaaaggagtttatgagcttcagactctggaactaaacatggagactctcaatatgaccatgcctctctcttgcacaaagaacaatagtccgtacttgggagtcggccat

SEQ ID NO: 428690 - DNA, 140 bp, Artificial Sequence
  Synthetic
atggccgactcccaagtacggactattgttctttgtgcaagagagaggcatggtcatattgagagtctccatgtttagttccagagtctgaagctcataaactcctttgtaaaggctggtggagacccagcatggcgtat

SEQ ID NO: 428691 - DNA, 140 bp, Artificial Sequence
  Synthetic
atacgccatgctgggtctccttctgtcctgatcacctttgattttagtttctctaggtcagcagctaaaactaacaagtcatccgaggtcagagtcccaactcgcagtacactcttttgtcgtacttgggagtcggccat

SEQ ID NO: 428692 - DNA, 140 bp, Artificial Sequence
  Synthetic
atggccgactcccaagtacgacaaaagagtgtactgcgagttgggactctgacctcggatgacttgttagttttagctgctgacctagagaaactaaaatcaaaggtgatcaggacagaaggagacccagcatggcgtat

SEQ ID NO: 428693 - DNA, 140 bp, Artificial Sequence
  Synthetic
atacgccatgctgggtctcctgcagccaaccattgtggcacagttgcaaatggtgtcctgcagactttcatgaggatggcctggggtggaagctacattgctcttgactcaggccatggccgtacttgggagtcggccat

SEQ ID NO: 428694 - DNA, 140 bp, Artificial Sequence
  Synthetic
atggccgactcccaagtacggccatggcctgagtcaagagcaatgtagcttccaccccaggccatcctcatgaaagtctgcaggacaccatttgcaactgtgccacaatggttggctgcaggagacccagcatggcgtat

SEQ ID NO: 428695 - DNA, 140 bp, Artificial Sequence
  Synthetic
aggccctggctgctgatatgcacttccttggaagcactcatcttggtctggatgctttagggttcactggttcactggttgaaagtattactcagtgagtcaatgaaaagcgcaatccaagaccttttgggacagcggtg

SEQ ID NO: 428696 - DNA, 140 bp, Artificial Sequence
  Synthetic
caccgctgtcccaaaaggtcttggattgcgcttttcattgactcactgagtaatactttcaaccagtgaaccagtgaaccctaaagcatccagaccaagatgagtgcttccaaggaagtgcatatcagcagccagggcct

SEQ ID NO: 428697 - DNA, 140 bp, Artificial Sequence
  Synthetic
aggccctggctgctgatatgatataatcccatagaagaggtcttaaataagtgacaacagtatcacctctatctttgacttctggtgaaactttccatatctggattccattgtcccccagaccttttgggacagcggtg

SEQ ID NO: 428698 - DNA, 140 bp, Artificial Sequence
  Synthetic
caccgctgtcccaaaaggtctgggggacaatggaatccagatatggaaagtttcaccagaagtcaaagatagaggtgatactgttgtcacttatttaagacctcttctatgggattatatcatatcagcagccagggcct

SEQ ID NO: 428699 - DNA, 140 bp, Artificial Sequence
  Synthetic
atacgccatgctgggtctcccatcccatctaggccctcagttttgcaaaagttgctggtttgagaacaaggggttggtagagtgcaacaaccactacctgtgtctcaactgtctcagcctcgtacttgggagtcggccat

SEQ ID NO: 428700 - DNA, 140 bp, Artificial Sequence
  Synthetic
atggccgactcccaagtacgaggctgagacagttgagacacaggtagtggttgttgcactctaccaaccccttgttctcaaaccagcaacttttgcaaaactgagggcctagatgggatgggagacccagcatggcgtat

SEQ ID NO: 428701 - DNA, 140 bp, Artificial Sequence
  Synthetic
aggccctggctgctgatatggggttggtagagtgcaacaaccactacctgtgtctcaactgtctcagcctgctcctcagcgttagcagcagatgcccgatctgcaagatgccccttcccagaccttttgggacagcggtg

SEQ ID NO: 428702 - DNA, 140 bp, Artificial Sequence
  Synthetic
caccgctgtcccaaaaggtctgggaaggggcatcttgcagatcgggcatctgctgctaacgctgaggagcaggctgagacagttgagacacaggtagtggttgttgcactctaccaaccccatatcagcagccagggcct

SEQ ID NO: 428703 - DNA, 140 bp, Artificial Sequence
  Synthetic
atacgccatgctgggtctccgctcctcagcgttagcagcagatgcccgatctgcaagatgccccttcccaccaagctgaaggcagcagcacagccgagcgcaccctcaactgaggcggcccgtacttgggagtcggccat

SEQ ID NO: 428704 - DNA, 140 bp, Artificial Sequence
  Synthetic
atggccgactcccaagtacgggccgcctcagttgagggtgcgctcggctgtgctgctgccttcagcttggtgggaaggggcatcttgcagatcgggcatctgctgctaacgctgaggagcggagacccagcatggcgtat

SEQ ID NO: 428705 - DNA, 140 bp, Artificial Sequence
  Synthetic
atacgccatgctgggtctccaatatgatcactgagatgttgcagaaagagtatatggagagacaggggaaaacaccattaggcctagttgacctctttgtgttcagcacaagtttctatccgtacttgggagtcggccat

SEQ ID NO: 428706 - DNA, 140 bp, Artificial Sequence
  Synthetic
atggccgactcccaagtacggatagaaacttgtgctgaacacaaagaggtcaactaggcctaatggtgttttcccctgtctctccatatactctttctgcaacatctcagtgatcatattggagacccagcatggcgtat

SEQ ID NO: 428707 - DNA, 140 bp, Artificial Sequence
  Synthetic
aggccctggctgctgatatgcacctgttttgggtttaggcttgtgcctgtatggcctgcaggccagctgatggtgccccacaaaaactcccacagaaatgagagacaatatgcctaggatgaccttttgggacagcggtg

SEQ ID NO: 428708 - DNA, 140 bp, Artificial Sequence
  Synthetic
caccgctgtcccaaaaggtcatcctaggcatattgtctctcatttctgtgggagtttttgtggggcaccatcagctggcctgcaggccatacaggcacaagcctaaacccaaaacaggtgcatatcagcagccagggcct

SEQ ID NO: 428709 - DNA, 140 bp, Artificial Sequence
  Synthetic
atacgccatgctgggtctccgtaggcaagtcgtgtccaaaacctcacaggttgaatcacatgggcatatgttcctgcggtttctataaacagcccggtgtgcctgtgaaatggaagagatcgtacttgggagtcggccat

SEQ ID NO: 428710 - DNA, 140 bp, Artificial Sequence
  Synthetic
atggccgactcccaagtacgatctcttccatttcacaggcacaccgggctgtttatagaaaccgcaggaacatatgcccatgtgattcaacctgtgaggttttggacacgacttgcctacggagacccagcatggcgtat

SEQ ID NO: 428711 - DNA, 140 bp, Artificial Sequence
  Synthetic
atacgccatgctgggtctccgtaaagctgcagcaacaaattttgttagcaggggcacctcgtcaccccaaacatagaaccttgatttgaactctgcaacaaacctgccaattgcactcttcgtacttgggagtcggccat

SEQ ID NO: 428712 - DNA, 140 bp, Artificial Sequence
  Synthetic
atggccgactcccaagtacgaagagtgcaattggcaggtttgttgcagagttcaaatcaaggttctatgtttggggtgacgaggtgcccctgctaacaaaatttgttgctgcagctttacggagacccagcatggcgtat

SEQ ID NO: 428713 - DNA, 140 bp, Artificial Sequence
  Synthetic
aggccctggctgctgatatgacatagaaccttgatttgaactctgcaacaaacctgccaattgcactctttggactcacaaacttatttagctggtcactcatgtagtaatggaattctagaccttttgggacagcggtg

SEQ ID NO: 428714 - DNA, 140 bp, Artificial Sequence
  Synthetic
caccgctgtcccaaaaggtctagaattccattactacatgagtgaccagctaaataagtttgtgagtccaaagagtgcaattggcaggtttgttgcagagttcaaatcaaggttctatgtcatatcagcagccagggcct

SEQ ID NO: 428715 - DNA, 140 bp, Artificial Sequence
  Synthetic
aggccctggctgctgatatgctgagcttagtggcctttctgttctaatgaccttcgactttagtttctctaagtcagctgccaatgtcagcaggtcatctgaggtcaaggtcccaactctgaccttttgggacagcggtg

SEQ ID NO: 428716 - DNA, 140 bp, Artificial Sequence
  Synthetic
caccgctgtcccaaaaggtcagagttgggaccttgacctcagatgacctgctgacattggcagctgacttagagaaactaaagtcgaaggtcattagaacagaaaggccactaagctcagcatatcagcagccagggcct

SEQ ID NO: 428717 - DNA, 140 bp, Artificial Sequence
  Synthetic
aggccctggctgctgatatgtgcagcaaagaggtctgtgacatcaatcccatgtgagtatttagcatcctgcttgaactgctttaaatcagtaggctcacggaagaagtgtatgtagcaggaccttttgggacagcggtg

SEQ ID NO: 428718 - DNA, 140 bp, Artificial Sequence
  Synthetic
caccgctgtcccaaaaggtcctgctacatacacttcttccgtgagcctactgatttaaagcagttcaagcaggatgctaaatactcacatgggattgatgtcacagacctctttgctgcacatatcagcagccagggcct

SEQ ID NO: 428719 - DNA, 140 bp, Artificial Sequence
  Synthetic
aggccctggctgctgatatgcctctcatcctctaagaggtacctgctcacaagatctttgctctcggacagcaactcctccatcaccaacacacttgttcctcagaagagagagtcaaatgaccttttgggacagcggtg

SEQ ID NO: 428720 - DNA, 140 bp, Artificial Sequence
  Synthetic
caccgctgtcccaaaaggtcatttgactctctcttctgaggaacaagtgtgttggtgatggaggagttgctgtccgagagcaaagatcttgtgagcaggtacctcttagaggatgagaggcatatcagcagccagggcct

SEQ ID NO: 428721 - DNA, 140 bp, Artificial Sequence
  Synthetic
aggccctggctgctgatatgcccatctaggcccccagttctgcaagagttgctggtttgagaacagagggttggtagagtgcaacaatcactacctgtgtctcaactgtctcagcctgctgaccttttgggacagcggtg

SEQ ID NO: 428722 - DNA, 140 bp, Artificial Sequence
  Synthetic
caccgctgtcccaaaaggtcagcaggctgagacagttgagacacaggtagtgattgttgcactctaccaaccctctgttctcaaaccagcaactcttgcagaactgggggcctagatgggcatatcagcagccagggcct

SEQ ID NO: 428723 - DNA, 140 bp, Artificial Sequence
  Synthetic
aggccctggctgctgatatgcagacccagccgacagcaccaccagaaatcccaccatcccaaaatcccccaccctacagcccctgaggcagaactccgccccgaagcccctctcaaacacgaccttttgggacagcggtg

SEQ ID NO: 428724 - DNA, 140 bp, Artificial Sequence
  Synthetic
caccgctgtcccaaaaggtcgtgtttgagaggggcttcggggcggagttctgcctcaggggctgtagggtgggggattttgggatggtgggatttctggtggtgctgtcggctgggtctgcatatcagcagccagggcct

SEQ ID NO: 428725 - DNA, 140 bp, Artificial Sequence
  Synthetic
aggccctggctgctgatatgaacacaacacctccaccatacaccccataatcccaggaccaacaccctcacctccatcacccaccccccacccccggggggaccccccgccgggggccccgaccttttgggacagcggtg

SEQ ID NO: 428726 - DNA, 140 bp, Artificial Sequence
  Synthetic
caccgctgtcccaaaaggtcggggcccccggcggggggtccccccgggggtggggggtgggtgatggaggtgagggtgttggtcctgggattatggggtgtatggtggaggtgttgtgttcatatcagcagccagggcct

SEQ ID NO: 428727 - DNA, 140 bp, Artificial Sequence
  Synthetic
aggccctggctgctgatatgcaaaaaagtcctagtcaccactgcttttgtcagctcactaataggacatgaattcattggccctacataaaaatatttacttctcaaagcagcatcattggaccttttgggacagcggtg

SEQ ID NO: 428728 - DNA, 140 bp, Artificial Sequence
  Synthetic
caccgctgtcccaaaaggtccaatgatgctgctttgagaagtaaatatttttatgtagggccaatgaattcatgtcctattagtgagctgacaaaagcagtggtgactaggacttttttgcatatcagcagccagggcct

SEQ ID NO: 428729 - DNA, 140 bp, Artificial Sequence
  Synthetic
atacgccatgctgggtctccctctctttgcgcatcaaccgttgaacattgctgacttcggagaagtcaagtccatgcaaaagagcctgagcatctttcaccacctgaagtttgatgttggcgtacttgggagtcggccat

SEQ ID NO: 428730 - DNA, 140 bp, Artificial Sequence
  Synthetic
atggccgactcccaagtacgccaacatcaaacttcaggtggtgaaagatgctcaggctcttttgcatggacttgacttctccgaagtcagcaatgttcaacggttgatgcgcaaagagagggagacccagcatggcgtat

SEQ ID NO: 428731 - DNA, 140 bp, Artificial Sequence
  Synthetic
atacgccatgctgggtctccagcagtagccagataattccctcctcaaagattgtgtccacaaaaaggactttatttcttttgaggcactcatcgccaaattgttgtgctggatacacgccgtacttgggagtcggccat

SEQ ID NO: 428732 - DNA, 140 bp, Artificial Sequence
  Synthetic
atggccgactcccaagtacggcgtgtatccagcacaacaatttggcgatgagtgcctcaaaagaaataaagtcctttttgtggacacaatctttgaggagggaattatctggctactgctggagacccagcatggcgtat

SEQ ID NO: 428733 - DNA, 140 bp, Artificial Sequence
  Synthetic
aggccctggctgctgatatgcatttaggattgcgcttttagagatctttgtgtgagtgggccttattaagtcatgggacaaatcataacatttttccaggaagtgcctcatgtcatagaagaccttttgggacagcggtg

SEQ ID NO: 428734 - DNA, 140 bp, Artificial Sequence
  Synthetic
caccgctgtcccaaaaggtcttctatgacatgaggcacttcctggaaaaatgttatgatttgtcccatgacttaataaggcccactcacacaaagatctctaaaagcgcaatcctaaatgcatatcagcagccagggcct

SEQ ID NO: 428735 - DNA, 140 bp, Artificial Sequence
  Synthetic
aggccctggctgctgatatgaaatcgttgaactccttaagcagctgacctctctcaacctttaagaattgaccttctatctctccctttcttaacctattcctgaatacttgatactcttgaccttttgggacagcggtg

SEQ ID NO: 428736 - DNA, 140 bp, Artificial Sequence
  Synthetic
caccgctgtcccaaaaggtcaagagtatcaagtattcaggaataggttaagaaagggagagatagaaggtcaattcttaaaggttgagagaggtcagctgcttaaggagttcaacgatttcatatcagcagccagggcct

SEQ ID NO: 428737 - DNA, 140 bp, Artificial Sequence
  Synthetic
aggccctggctgctgatatgtcttcagatgggttgatgttaatactgtcaaactccaacttgggctccaaatacttctcaaagcacttaatctgatctgtcaacctatctggagtttcctgaccttttgggacagcggtg

SEQ ID NO: 428738 - DNA, 140 bp, Artificial Sequence
  Synthetic
caccgctgtcccaaaaggtcaggaaactccagataggttgacagatcagattaagtgctttgagaagtatttggagcccaagttggagtttgacagtattaacatcaacccatctgaagacatatcagcagccagggcct

SEQ ID NO: 428739 - DNA, 140 bp, Artificial Sequence
  Synthetic
aggccctggctgctgatatgttccattgtcccccatcactgcttcaacaccttgaatccctaataactgagtctgtatggatctaatgtaaagattctccttgttggggcctctgacgcagaccttttgggacagcggtg

SEQ ID NO: 428740 - DNA, 140 bp, Artificial Sequence
  Synthetic
caccgctgtcccaaaaggtctgcgtcagaggccccaacaaggagaatctttacattagatccatacagactcagttattagggattcaaggtgttgaagcagtgatgggggacaatggaacatatcagcagccagggcct

SEQ ID NO: 428741 - DNA, 140 bp, Artificial Sequence
  Synthetic
aggccctggctgctgatatggctacattgctcttgactcaggccatggcaggtgggactgcattatgactagttatcagtacctgataatccaaaatacaacctgggaagatcactgccagaccttttgggacagcggtg

SEQ ID NO: 428742 - DNA, 140 bp, Artificial Sequence
  Synthetic
caccgctgtcccaaaaggtctggcagtgatcttcccaggttgtattttggattatcaggtactgataactagtcataatgcagtcccacctgccatggcctgagtcaagagcaatgtagccatatcagcagccagggcct

SEQ ID NO: 428743 - DNA, 140 bp, Artificial Sequence
  Synthetic
aggccctggctgctgatatgccaacactgcatctgttcacttttaaagtcaacacccctttccttactagaatccaaatctgcatacaagaacttgaggactggagaggctctttggaacgaccttttgggacagcggtg

SEQ ID NO: 428744 - DNA, 140 bp, Artificial Sequence
  Synthetic
caccgctgtcccaaaaggtcgttccaaagagcctctccagtcctcaagttcttgtatgcagatttggattctagtaaggaaaggggtgttgactttaaaagtgaacagatgcagtgttggcatatcagcagccagggcct

SEQ ID NO: 428745 - DNA, 140 bp, Artificial Sequence
  Synthetic
aggccctggctgctgatatgtcagacaggatctctcgatcaaaatcttctatcatatggtttgaaagttcactttttatcaaccttattaggagcttttcttccaccaccttgtcaagatgaccttttgggacagcggtg

SEQ ID NO: 428746 - DNA, 140 bp, Artificial Sequence
  Synthetic
caccgctgtcccaaaaggtcatcttgacaaggtggtggaagaaaagctcctaataaggttgataaaaagtgaactttcaaaccatatgatagaagattttgatcgagagatcctgtctgacatatcagcagccagggcct

SEQ ID NO: 428747 - DNA, 140 bp, Artificial Sequence
  Synthetic
atacgccatgctgggtctccacctcgtcaccccaaacatagaaccttgatttgaactctgcaacaaacctgccaattgcactctttggactcacaaatttatttagctgatcactcatgtcgtacttgggagtcggccat

SEQ ID NO: 428748 - DNA, 140 bp, Artificial Sequence
  Synthetic
atggccgactcccaagtacgacatgagtgatcagctaaataaatttgtgagtccaaagagtgcaattggcaggtttgttgcagagttcaaatcaaggttctatgtttggggtgacgaggtggagacccagcatggcgtat

SEQ ID NO: 428749 - DNA, 140 bp, Artificial Sequence
  Synthetic
aggccctggctgctgatatgatgagtatccaactgataaacaaagcagtaaacgcactgatcaatgaccagctgatcatgaagaatcatttgagagatatcatgggaattccttactgcagaccttttgggacagcggtg

SEQ ID NO: 428750 - DNA, 140 bp, Artificial Sequence
  Synthetic
caccgctgtcccaaaaggtctgcagtaaggaattcccatgatatctctcaaatgattcttcatgatcagctggtcattgatcagtgcgtttactgctttgtttatcagttggatactcatcatatcagcagccagggcct

SEQ ID NO: 428751 - DNA, 140 bp, Artificial Sequence
  Synthetic
atacgccatgctgggtctcctgtgtcggatttgggtttatgccaatatggcctgtagatcagctggtgatgccccacaaaagctcttacagaaatgagagacaaaatgcctaggatcctccgtacttgggagtcggccat

SEQ ID NO: 428752 - DNA, 140 bp, Artificial Sequence
  Synthetic
atggccgactcccaagtacggaggatcctaggcattttgtctctcatttctgtaagagcttttgtggggcatcaccagctgatctacaggccatattggcataaacccaaatccgacacaggagacccagcatggcgtat

SEQ ID NO: 428753 - DNA, 140 bp, Artificial Sequence
  Synthetic
atacgccatgctgggtctccacacctgtgtcggatttggatttgtgccaatatggcttgtaggtcagctggtgatgccccacaaaagttcctacagaaatgagagacaatatgcctaggacgtacttgggagtcggccat

SEQ ID NO: 428754 - DNA, 140 bp, Artificial Sequence
  Synthetic
atggccgactcccaagtacgtcctaggcatattgtctctcatttctgtaggaacttttgtggggcatcaccagctgacctacaagccatattggcacaaatccaaatccgacacaggtgtggagacccagcatggcgtat

SEQ ID NO: 428755 - DNA, 140 bp, Artificial Sequence
  Synthetic
atacgccatgctgggtctcccccatcagcttattcccattcatcactaataaaattgacttaaagcactggaagtattcttggtccaaaaaagtcctagtcaccactgcttttgtcagctcgtacttgggagtcggccat

SEQ ID NO: 428756 - DNA, 140 bp, Artificial Sequence
  Synthetic
atggccgactcccaagtacgagctgacaaaagcagtggtgactaggacttttttggaccaagaatacttccagtgctttaagtcaattttattagtgatgaatgggaataagctgatgggggagacccagcatggcgtat

SEQ ID NO: 428757 - DNA, 140 bp, Artificial Sequence
  Synthetic
atacgccatgctgggtctccaaagtagcatcattgtagatattctcacaaattttgatgtattgatcttcagacaggatttctcgatcaaaatcttctatcatatggtttgaaagttcaccgtacttgggagtcggccat

SEQ ID NO: 428758 - DNA, 140 bp, Artificial Sequence
  Synthetic
atggccgactcccaagtacggtgaactttcaaaccatatgatagaagattttgatcgagaaatcctgtctgaagatcaatacatcaaaatttgtgagaatatctacaatgatgctactttggagacccagcatggcgtat

SEQ ID NO: 428759 - DNA, 140 bp, Artificial Sequence
  Synthetic
aggccctggctgctgatatgtcctcaatgactgtgtccagagaaatgacttcacttccttagaagcactcatcttgatctggatactttgggatttactggttgaaagtattactcagtagaccttttgggacagcggtg

SEQ ID NO: 428760 - DNA, 140 bp, Artificial Sequence
  Synthetic
caccgctgtcccaaaaggtctactgagtaatactttcaaccagtaaatcccaaagtatccagatcaagatgagtgcttctaaggaagtgaagtcatttctctggacacagtcattgaggacatatcagcagccagggcct

SEQ ID NO: 428761 - DNA, 140 bp, Artificial Sequence
  Synthetic
aggccctggctgctgatatgttagaagcactcatcttgatctggatactttgggatttactggttgaaagtattactcagtaaatcaatgaaaagcgcaatccaatagcctaggatccacgaccttttgggacagcggtg

SEQ ID NO: 428762 - DNA, 140 bp, Artificial Sequence
  Synthetic
caccgctgtcccaaaaggtcgtggatcctaggctattggattgcgcttttcattgatttactgagtaatactttcaaccagtaaatcccaaagtatccagatcaagatgagtgcttctaacatatcagcagccagggcct

SEQ ID NO: 428763 - DNA, 140 bp, Artificial Sequence
  Synthetic
atacgccatgctgggtctccatttagctggactctagtggtaaggctcattttagtgaatccctgaatcaagtgcccagccgtaatgggcaacaaacaagccaaatcaacaaaagtcgatcgtacttgggagtcggccat

SEQ ID NO: 428764 - DNA, 140 bp, Artificial Sequence
  Synthetic
atggccgactcccaagtacgatcgacttttgttgatttggcttgtttgttgcccattacggctgggcacttgattcagggattcactaaaatgagccttaccactagagtccagctaaatggagacccagcatggcgtat

SEQ ID NO: 428765 - DNA, 140 bp, Artificial Sequence
  Synthetic
aggccctggctgctgatatggtgtcaccactccctcctttggatcccagaacaagattactcattgcttgctgtattttgtaatcataatcctgcttattaagcaagaacttgcctttacgaccttttgggacagcggtg

SEQ ID NO: 428766 - DNA, 140 bp, Artificial Sequence
  Synthetic
caccgctgtcccaaaaggtcgtaaaggcaagttcttgcttaataagcaggattatgattacaaaatacagcaagcaatgagtaatcttgttctgggatccaaaggagggagtggtgacaccatatcagcagccagggcct

SEQ ID NO: 428767 - DNA, 140 bp, Artificial Sequence
  Synthetic
aggccctggctgctgatatgacagccgagcgcaccctcaactgaggcgacccagaacgcagcacctccaccgtatgccccatgatcccaagaccaacactcccatctccatcacccacccgaccttttgggacagcggtg

SEQ ID NO: 428768 - DNA, 140 bp, Artificial Sequence
  Synthetic
caccgctgtcccaaaaggtcgggtgggtgatggagatgggagtgttggtcttgggatcatggggcatacggtggaggtgctgcgttctgggtcgcctcagttgagggtgcgctcggctgtcatatcagcagccagggcct

SEQ ID NO: 428769 - DNA, 140 bp, Artificial Sequence
  Synthetic
aggccctggctgctgatatgcttatcagttttaacaaattgactttctatgtccccctgccttagtttgtttctgaagatttgatactcctcctcaattaaactcttaacttcgtgagaagaccttttgggacagcggtg

SEQ ID NO: 428770 - DNA, 140 bp, Artificial Sequence
  Synthetic
caccgctgtcccaaaaggtcttctcacgaagttaagagtttaattgaggaggagtatcaaatcttcagaaacaaactaaggcagggggacatagaaagtcaatttgttaaaactgataagcatatcagcagccagggcct

SEQ ID NO: 428771 - DNA, 140 bp, Artificial Sequence
  Synthetic
aggccctggctgctgatatgacatcccctaactgctgtgtatcctttaagaactcattcaccacatctgattcaacaaaccaggctgacctacctttaaaagttggacccgacagggcaagaccttttgggacagcggtg

SEQ ID NO: 428772 - DNA, 140 bp, Artificial Sequence
  Synthetic
caccgctgtcccaaaaggtcttgccctgtcgggtccaacttttaaaggtaggtcagcctggtttgttgaatcagatgtggtgaatgagttcttaaaggatacacagcagttaggggatgtcatatcagcagccagggcct

SEQ ID NO: 428773 - DNA, 140 bp, Artificial Sequence
  Synthetic
aggccctggctgctgatatgagaaaagctaacttctgtcttgatagcttctcattgtctgcaaggtactttgagatgagatccttagcattggcaatgtcttcctccatcgtcagttgtggaccttttgggacagcggtg

SEQ ID NO: 428774 - DNA, 140 bp, Artificial Sequence
  Synthetic
caccgctgtcccaaaaggtccacaactgacgatggaggaagacattgccaatgctaaggatctcatctcaaagtaccttgcagacaatgagaagctatcaagacagaagttagcttttctcatatcagcagccagggcct

SEQ ID NO: 428775 - DNA, 140 bp, Artificial Sequence
  Synthetic
atacgccatgctgggtctccgcacctgtgttaggcttgggcttgtacctgtgtggcgtgtgggccagctggcagtgcttcacaaaagctcccacagaaatgagagacaatatgcctaggacgtacttgggagtcggccat

SEQ ID NO: 428776 - DNA, 140 bp, Artificial Sequence
  Synthetic
atggccgactcccaagtacgtcctaggcatattgtctctcatttctgtgggagcttttgtgaagcactgccagctggcccacacgccacacaggtacaagcccaagcctaacacaggtgcggagacccagcatggcgtat

SEQ ID NO: 428777 - DNA, 140 bp, Artificial Sequence
  Synthetic
aggccctggctgctgatatgcatgctttatgcagtccagccggctagcaagaagaattaggacgtcaaaaataaggagaagtttcctcctagtgttgaggatccttagagactttattttgaccttttgggacagcggtg

SEQ ID NO: 428778 - DNA, 140 bp, Artificial Sequence
  Synthetic
caccgctgtcccaaaaggtcaaaataaagtctctaaggatcctcaacactaggaggaaacttctccttatttttgacgtcctaattcttcttgctagccggctggactgcataaagcatgcatatcagcagccagggcct

SEQ ID NO: 428779 - DNA, 140 bp, Artificial Sequence
  Synthetic
aggccctggctgctgatatgctgaagatttgatactcctcttcaattaaacttttgacttcatgggaggtgagcttgttattaatgccctgatgacaactagaaattatttcctcaaagtgaccttttgggacagcggtg

SEQ ID NO: 428780 - DNA, 140 bp, Artificial Sequence
  Synthetic
caccgctgtcccaaaaggtcactttgaggaaataatttctagttgtcatcagggcattaataacaagctcacctcccatgaagtcaaaagtttaattgaagaggagtatcaaatcttcagcatatcagcagccagggcct

SEQ ID NO: 428781 - DNA, 140 bp, Artificial Sequence
  Synthetic
atacgccatgctgggtctccgaagtgtgtgatcaactggagcaacagttcactataagacagggttccataagagaaacaaaggacacaaccaattaattaaagacaattagaatagatacgtacttgggagtcggccat

SEQ ID NO: 428782 - DNA, 140 bp, Artificial Sequence
  Synthetic
atggccgactcccaagtacgtatctattctaattgtctttaattaattggttgtgtcctttgtttctcttatggaaccctgtcttatagtgaactgttgctccagttgatcacacacttcggagacccagcatggcgtat

SEQ ID NO: 428783 - DNA, 140 bp, Artificial Sequence
  Synthetic
aggccctggctgctgatatggttgtcctaccatctatgagagggataaggttgatgccaacagattccaaatcattctttaattgttctagtttcttgtgatcttctaaatacttctgttgaccttttgggacagcggtg

SEQ ID NO: 428784 - DNA, 140 bp, Artificial Sequence
  Synthetic
caccgctgtcccaaaaggtcaacagaagtatttagaagatcacaagaaactagaacaattaaagaatgatttggaatctgttggcatcaaccttatccctctcatagatggtaggacaaccatatcagcagccagggcct

SEQ ID NO: 428785 - DNA, 140 bp, Artificial Sequence
  Synthetic
atacgccatgctgggtctcccgcaccggggatcctaggcatttaggattgcgcttttagagattcactactagttaggaattcctaaatcatggggcagattattacattctttcaagaacgtacttgggagtcggccat

SEQ ID NO: 428786 - DNA, 140 bp, Artificial Sequence
  Synthetic
atggccgactcccaagtacgttcttgaaagaatgtaataatctgccccatgatttaggaattcctaactagtagtgaatctctaaaagcgcaatcctaaatgcctaggatccccggtgcgggagacccagcatggcgtat

SEQ ID NO: 428787 - DNA, 140 bp, Artificial Sequence
  Synthetic
aggccctggctgctgatatgtagttaggaattcctaaatcatggggcagattattacattctttcaagaagtgccacatgtaatagaggaagtcatgaacattgtgctaattgcgctttcgaccttttgggacagcggtg

SEQ ID NO: 428788 - DNA, 140 bp, Artificial Sequence
  Synthetic
caccgctgtcccaaaaggtcgaaagcgcaattagcacaatgttcatgacttcctctattacatgtggcacttcttgaaagaatgtaataatctgccccatgatttaggaattcctaactacatatcagcagccagggcct

SEQ ID NO: 428789 - DNA, 140 bp, Artificial Sequence
  Synthetic
atacgccatgctgggtctccgtgccacatgtaatagaggaagtcatgaacattgtgctaattgcgctttctctattggcaatcttgaagggcttgtataacatcgctacatgtgggattacgtacttgggagtcggccat

SEQ ID NO: 428790 - DNA, 140 bp, Artificial Sequence
  Synthetic
atggccgactcccaagtacgtaatcccacatgtagcgatgttatacaagcccttcaagattgccaatagagaaagcgcaattagcacaatgttcatgacttcctctattacatgtggcacggagacccagcatggcgtat

SEQ ID NO: 428791 - DNA, 140 bp, Artificial Sequence
  Synthetic
atacgccatgctgggtctccagtagtttcaatccctccatgagcaacattctaggttcagtttggaccaaaaaagctaacttctgtcttgatagcttctcattatctgcaaggtactttgcgtacttgggagtcggccat

SEQ ID NO: 428792 - DNA, 140 bp, Artificial Sequence
  Synthetic
atggccgactcccaagtacgcaaagtaccttgcagataatgagaagctatcaagacagaagttagcttttttggtccaaactgaacctagaatgttgctcatggagggattgaaactactggagacccagcatggcgtat

SEQ ID NO: 428793 - DNA, 140 bp, Artificial Sequence
  Synthetic
atacgccatgctgggtctccaaaagctaacttctgtcttgatagcttctcattatctgcaaggtactttgagataagatctttagcattagcaatgtcttcctccatcaccaattgtggtcgtacttgggagtcggccat

SEQ ID NO: 428794 - DNA, 140 bp, Artificial Sequence
  Synthetic
atggccgactcccaagtacgaccacaattggtgatggaggaagacattgctaatgctaaagatcttatctcaaagtaccttgcagataatgagaagctatcaagacagaagttagcttttggagacccagcatggcgtat

SEQ ID NO: 428795 - DNA, 140 bp, Artificial Sequence
  Synthetic
atacgccatgctgggtctcccttaaagggggatatgagctgcaaaccttagaattaaatatggagaccctaaacatgaccatgcccttatcatgcaccaagaacagcagtcatcattacacgtacttgggagtcggccat

SEQ ID NO: 428796 - DNA, 140 bp, Artificial Sequence
  Synthetic
atggccgactcccaagtacgtgtaatgatgactgctgttcttggtgcatgataagggcatggtcatgtttagggtctccatatttaattctaaggtttgcagctcatatccccctttaagggagacccagcatggcgtat

SEQ ID NO: 428797 - DNA, 140 bp, Artificial Sequence
  Synthetic
atacgccatgctgggtctccaggtgccccatttgcaagatgcctctccccacaaaactgagaccatcagctgctccaacagcacccccagtcggagcagcagacagcaccagacccccaccgtacttgggagtcggccat

SEQ ID NO: 428798 - DNA, 140 bp, Artificial Sequence
  Synthetic
atggccgactcccaagtacggtgggggtctggtgctgtctgctgctccgactgggggtgctgttggagcagctgatggtctcagttttgtggggagaggcatcttgcaaatggggcacctggagacccagcatggcgtat

SEQ ID NO: 428799 - DNA, 140 bp, Artificial Sequence
  Synthetic
atacgccatgctgggtctccagtctggtccctcgacacttgtgcatccatctttacttaaaaacttttttgcattgtagaccatgtcatccaattcttcctcagtggctgtgtctgcaggcgtacttgggagtcggccat

SEQ ID NO: 428800 - DNA, 140 bp, Artificial Sequence
  Synthetic
atggccgactcccaagtacgcctgcagacacagccactgaggaagaattggatgacatggtctacaatgcaaaaaagtttttaagtaaagatggatgcacaagtgtcgagggaccagactggagacccagcatggcgtat

SEQ ID NO: 428801 - DNA, 140 bp, Artificial Sequence
  Synthetic
atacgccatgctgggtctccttatgatcatgctctcatgagcatcatctcaacattccatctatccattccaaacttcaatcagtatgaagccatgagttgtgatttcaatggagggaaacgtacttgggagtcggccat

SEQ ID NO: 428802 - DNA, 140 bp, Artificial Sequence
  Synthetic
atggccgactcccaagtacgtttccctccattgaaatcacaactcatggcttcatactgattgaagtttggaatggatagatggaatgttgagatgatgctcatgagagcatgatcataaggagacccagcatggcgtat

SEQ ID NO: 428803 - DNA, 140 bp, Artificial Sequence
  Synthetic
aggccctggctgctgatatgcaaacttcaatcagtatgaagccatgagttgtgatttcaatggagggaaaatcagtgtgcaatacaacctctctcattcctatgctggggatgcggccgagaccttttgggacagcggtg

SEQ ID NO: 428804 - DNA, 140 bp, Artificial Sequence
  Synthetic
caccgctgtcccaaaaggtctcggccgcatccccagcataggaatgagagaggttgtattgcacactgattttccctccattgaaatcacaactcatggcttcatactgattgaagtttgcatatcagcagccagggcct

SEQ ID NO: 428805 - DNA, 140 bp, Artificial Sequence
  Synthetic
aggccctggctgctgatatgcctctcatcctctaagaggtacctgctcacaagatctttgctctcggacagcaactcctccatcaaacacacttgttcctcagaagagagagtcacaatggaccttttgggacagcggtg

SEQ ID NO: 428806 - DNA, 140 bp, Artificial Sequence
  Synthetic
caccgctgtcccaaaaggtccattgtgactctctcttctgaggaacaagtgtgtttgatggaggagttgctgtccgagagcaaagatcttgtgagcaggtacctcttagaggatgagaggcatatcagcagccagggcct

SEQ ID NO: 428807 - DNA, 140 bp, Artificial Sequence
  Synthetic
atacgccatgctgggtctcccctggggtggaagatacattgcattagactcaggaaagggaaactgggactgtataatgaccagctaccagtacctgataattcaaaatacaacatgggacgtacttgggagtcggccat

SEQ ID NO: 428808 - DNA, 140 bp, Artificial Sequence
  Synthetic
atggccgactcccaagtacgtcccatgttgtattttgaattatcaggtactggtagctggtcattatacagtcccagtttccctttcctgagtctaatgcaatgtatcttccaccccaggggagacccagcatggcgtat

SEQ ID NO: 428809 - DNA, 140 bp, Artificial Sequence
  Synthetic
aggccctggctgctgatatgacctcttcaaagaggggcctgcacagcctccctcttaatctaaacttcccctctgaagactggatcatcagtgaagcctgcgatctactgtagcagagacgaccttttgggacagcggtg

SEQ ID NO: 428810 - DNA, 140 bp, Artificial Sequence
  Synthetic
caccgctgtcccaaaaggtcgtctctgctacagtagatcgcaggcttcactgatgatccagtcttcagaggggaagtttagattaagagggaggctgtgcaggcccctctttgaagaggtcatatcagcagccagggcct

SEQ ID NO: 428811 - DNA, 140 bp, Artificial Sequence
  Synthetic
atacgccatgctgggtctccttcacctggacattgtcagattctgagggcaatgaaacaccaggtggttattgtttaaccaggtggatgctaattgaagcagaactcaagtgttttgggacgtacttgggagtcggccat

SEQ ID NO: 428812 - DNA, 140 bp, Artificial Sequence
  Synthetic
atggccgactcccaagtacgtcccaaaacacttgagttctgcttcaattagcatccacctggttaaacaataaccacctggtgtttcattgccctcagaatctgacaatgtccaggtgaaggagacccagcatggcgtat

SEQ ID NO: 428813 - DNA, 140 bp, Artificial Sequence
  Synthetic
aggccctggctgctgatatgttgtttaaccaggtggatgctaattgaagcagaactcaagtgttttgggaatacagctgtggcaaaatgcaatgagaagcatgatgaggagttttgtgacgaccttttgggacagcggtg

SEQ ID NO: 428814 - DNA, 140 bp, Artificial Sequence
  Synthetic
caccgctgtcccaaaaggtcgtcacaaaactcctcatcatgcttctcattgcattttgccacagctgtattcccaaaacacttgagttctgcttcaattagcatccacctggttaaacaacatatcagcagccagggcct

SEQ ID NO: 428815 - DNA, 140 bp, Artificial Sequence
  Synthetic
atacgccatgctgggtctcctgaggcccagatgagtattcaattaataaataaagccgtgaatgccttaatcaatgatcaattaatcatgaagaaccatttaagagacatcatgggcattcgtacttgggagtcggccat

SEQ ID NO: 428816 - DNA, 140 bp, Artificial Sequence
  Synthetic
atggccgactcccaagtacgaatgcccatgatgtctcttaaatggttcttcatgattaattgatcattgattaaggcattcacggctttatttattaattgaatactcatctgggcctcaggagacccagcatggcgtat

SEQ ID NO: 428817 - DNA, 140 bp, Artificial Sequence
  Synthetic
aggccctggctgctgatatgtcaatgatcaattaatcatgaagaaccatttaagagacatcatgggcattccctactgcaattacagcaagtattggtaccttaatcatactagtagcgggaccttttgggacagcggtg

SEQ ID NO: 428818 - DNA, 140 bp, Artificial Sequence
  Synthetic
caccgctgtcccaaaaggtcccgctactagtatgattaaggtaccaatacttgctgtaattgcagtagggaatgcccatgatgtctcttaaatggttcttcatgattaattgatcattgacatatcagcagccagggcct

SEQ ID NO: 428819 - DNA, 140 bp, Artificial Sequence
  Synthetic
atacgccatgctgggtctccatgaaacccagttctctgatgacatagaacagcaagccgacaatatgatcacagagatgcttcagaaagaatacattgaaagacaagggaaaacgcccttcgtacttgggagtcggccat

SEQ ID NO: 428820 - DNA, 140 bp, Artificial Sequence
  Synthetic
atggccgactcccaagtacgaagggcgttttcccttgtctttcaatgtattctttctgaagcatctctgtgatcatattgtcggcttgctgttctatgtcatcagagaactgggtttcatggagacccagcatggcgtat

SEQ ID NO: 428821 - DNA, 140 bp, Artificial Sequence
  Synthetic
aggccctggctgctgatatgacagagatgcttcagaaagaatacattgaaagacaagggaaaacgcccttgggactagtggacattttcatctttagcacaagcttttatctgatcagcagaccttttgggacagcggtg

SEQ ID NO: 428822 - DNA, 140 bp, Artificial Sequence
  Synthetic
caccgctgtcccaaaaggtctgctgatcagataaaagcttgtgctaaagatgaaaatgtccactagtcccaagggcgttttcccttgtctttcaatgtattctttctgaagcatctctgtcatatcagcagccagggcct

SEQ ID NO: 428823 - DNA, 140 bp, Artificial Sequence
  Synthetic
atacgccatgctgggtctccccctgtcccaaaccccatagactaaatcacatgggagtatgttcctgtggactgtacaaacaccctggtgttccaacaaagtggaagagatagactccaacgtacttgggagtcggccat

SEQ ID NO: 428824 - DNA, 140 bp, Artificial Sequence
  Synthetic
atggccgactcccaagtacgttggagtctatctcttccactttgttggaacaccagggtgtttgtacagtccacaggaacatactcccatgtgatttagtctatggggtttgggacagggggagacccagcatggcgtat

SEQ ID NO: 428825 - DNA, 140 bp, Artificial Sequence
  Synthetic
aggccctggctgctgatatgactgtacaaacaccctggtgttccaacaaagtggaagagatagactccaaacagggagcccccgtgacccaccgccaatggcggtgggtcacgggggcgtgaccttttgggacagcggtg

SEQ ID NO: 428826 - DNA, 140 bp, Artificial Sequence
  Synthetic
caccgctgtcccaaaaggtcacgcccccgtgacccaccgccattggcggtgggtcacgggggctccctgtttggagtctatctcttccactttgttggaacaccagggtgtttgtacagtcatatcagcagccagggcct

SEQ ID NO: 428827 - DNA, 140 bp, Artificial Sequence
  Synthetic
atacgccatgctgggtctccggaagtactgccctcagtgttgtgatgttcaaactaccagtagtagctgcatcaaacatgatgcagtccagtaaagcgcaatgtggggtgatttcctcttcgtacttgggagtcggccat

SEQ ID NO: 428828 - DNA, 140 bp, Artificial Sequence
  Synthetic
atggccgactcccaagtacgaagaggaaatcaccccacattgcgctttactggactgcatcatgtttgatgcagctactactggtagtttgaacatcacaacactgagggcagtacttccggagacccagcatggcgtat

SEQ ID NO: 428829 - DNA, 140 bp, Artificial Sequence
  Synthetic
aggccctggctgctgatatgatcaaacatgatgcagtccagtaaagcgcaatgtggggtgatttcctcttttccacccctctttttcttctcaacgactactcccgtgtgcatgtgacacgaccttttgggacagcggtg

SEQ ID NO: 428830 - DNA, 140 bp, Artificial Sequence
  Synthetic
caccgctgtcccaaaaggtcgtgtcacatgcacacgggagtagtcgttgagaagaaaaagaggggtggaaaagaggaaatcaccccacattgcgctttactggactgcatcatgtttgatcatatcagcagccagggcct

SEQ ID NO: 428831 - DNA, 140 bp, Artificial Sequence
  Synthetic
atacgccatgctgggtctcctttgctcaaagaaatatcaatcaatttgatgtctcttctcccttgagactccaacagctttttgatgtcatctgacccctggcaggtcaacaccatattgcgtacttgggagtcggccat

SEQ ID NO: 428832 - DNA, 140 bp, Artificial Sequence
  Synthetic
atggccgactcccaagtacgcaatatggtgttgacctgccaggggtcagatgacatcaaaaagctgttggagtctcaagggagaagagacatcaaattgattgatatttctttgagcaaaggagacccagcatggcgtat

SEQ ID NO: 428833 - DNA, 140 bp, Artificial Sequence
  Synthetic
aggccctggctgctgatatgccaacagctttttgatgtcatctgacccctggcaggtcaacaccatattgcggggaagtgcctctatgacagcacttgtcagcccgggttgtgtggaaaagaccttttgggacagcggtg

SEQ ID NO: 428834 - DNA, 140 bp, Artificial Sequence
  Synthetic
caccgctgtcccaaaaggtcttttccacacaacccgggctgacaagtgctgtcatagaggcacttccccgcaatatggtgttgacctgccaggggtcagatgacatcaaaaagctgttggcatatcagcagccagggcct

SEQ ID NO: 428835 - DNA, 140 bp, Artificial Sequence
  Synthetic
atacgccatgctgggtctccgcttaaggtcagtaggttctctaaaaaagtgtatgtaacaaccagagcttggttgaaacaaagcaatctccactgggtcttcaggcctgccctcaatatccgtacttgggagtcggccat

SEQ ID NO: 428836 - DNA, 140 bp, Artificial Sequence
  Synthetic
atggccgactcccaagtacggatattgagggcaggcctgaagacccagtggagattgctttgtttcaaccaagctctggttgttacatacacttttttagagaacctactgaccttaagcggagacccagcatggcgtat

SEQ ID NO: 428837 - DNA, 140 bp, Artificial Sequence
  Synthetic
aggccctggctgctgatatgggttgaaacaaagcaatctccactgggtcttcaggcctgccctcaatatctatccatgttttgctacttgggtccaactgtaacatacaatcttttagtggaccttttgggacagcggtg

SEQ ID NO: 428838 - DNA, 140 bp, Artificial Sequence
  Synthetic
caccgctgtcccaaaaggtccactaaaagattgtatgttacagttggacccaagtagcaaaacatggatagatattgagggcaggcctgaagacccagtggagattgctttgtttcaacccatatcagcagccagggcct

SEQ ID NO: 428839 - DNA, 140 bp, Artificial Sequence
  Synthetic
aggccctggctgctgatatgtcaaaagtcagcattagttttcttctggtgttcaataactttagtgattttattttattcaacagtgacttccatccaggcacagagctttggaagtgatgaccttttgggacagcggtg

SEQ ID NO: 428840 - DNA, 140 bp, Artificial Sequence
  Synthetic
caccgctgtcccaaaaggtcatcacttccaaagctctgtgcctggatggaagtcactgttgaataaaataaaatcactaaagttattgaacaccagaagaaaactaatgctgacttttgacatatcagcagccagggcct

SEQ ID NO: 428841 - DNA, 140 bp, Artificial Sequence
  Synthetic
atacgccatgctgggtctcccttttattggaaccagcgctatttagtttcggtggtttgttgtcagattccaaatcaacaagagtgttttcccaagctctcccagtaattgatgttcttgcgtacttgggagtcggccat

SEQ ID NO: 428842 - DNA, 140 bp, Artificial Sequence
  Synthetic
atggccgactcccaagtacgcaagaacatcaattactgggagagcttgggaaaacactcttgttgatttggaatctgacaacaaaccaccgaaactaaatagcgctggttccaataaaagggagacccagcatggcgtat

SEQ ID NO: 428843 - DNA, 140 bp, Artificial Sequence
  Synthetic
aggccctggctgctgatatgcaaatcaacaagagtgttttcccaagctctcccagtaattgatgttcttgatgcaatatacggccaaccttcacctgaaaggcagatcttatagaggatggaccttttgggacagcggtg

SEQ ID NO: 428844 - DNA, 140 bp, Artificial Sequence
  Synthetic
caccgctgtcccaaaaggtccatcctctataagatctgcctttcaggtgaaggttggccgtatattgcatcaagaacatcaattactgggagagcttgggaaaacactcttgttgatttgcatatcagcagccagggcct

SEQ ID NO: 428845 - DNA, 140 bp, Artificial Sequence
  Synthetic
aggccctggctgctgatatgtgtcaggtgtttcttttgtaatgaaatgacacatataagagatgtttaaaacaaacttgaatctattggtcatcatactgacaacttcttcagacagaatgaccttttgggacagcggtg

SEQ ID NO: 428846 - DNA, 140 bp, Artificial Sequence
  Synthetic
caccgctgtcccaaaaggtcattctgtctgaagaagttgtcagtatgatgaccaatagattcaagtttgttttaaacatctcttatatgtgtcatttcattacaaaagaaacacctgacacatatcagcagccagggcct

SEQ ID NO: 428847 - DNA, 140 bp, Artificial Sequence
  Synthetic
aggccctggctgctgatatggtgacacttttattgtttccaacatgttgcccccatcaagcatgcaagcaccagctttaactgcagcccccagactgaagttgtaacctgagatgttcaggaccttttgggacagcggtg

SEQ ID NO: 428848 - DNA, 140 bp, Artificial Sequence
  Synthetic
caccgctgtcccaaaaggtcctgaacatctcaggttacaacttcagtctgggggctgcagttaaagctggtgcttgcatgcttgatgggggcaacatgttggaaacaataaaagtgtcaccatatcagcagccagggcct

SEQ ID NO: 428849 - DNA, 140 bp, Artificial Sequence
  Synthetic
atacgccatgctgggtctccgcatgtctagatctgaagagttcgggtactttgctgtgtaaatcaaacctaaatctgttaaagcttgcacagcatcattgaggtccacttgcccttgtttcgtacttgggagtcggccat

SEQ ID NO: 428850 - DNA, 140 bp, Artificial Sequence
  Synthetic
atggccgactcccaagtacgaaacaagggcaagtggacctcaatgatgctgtgcaagctttaacagatttaggtttgatttacacagcaaagtacccgaactcttcagatctagacatgcggagacccagcatggcgtat

SEQ ID NO: 428851 - DNA, 140 bp, Artificial Sequence
  Synthetic
atacgccatgctgggtctccttgagagatatcatgggaattccttactgcaattacagcaagtactggtatctaaatcacactgtaacagggaagacatcgttgccaaggtgctggcttgcgtacttgggagtcggccat

SEQ ID NO: 428852 - DNA, 140 bp, Artificial Sequence
  Synthetic
atggccgactcccaagtacgcaagccagcaccttggcaacgatgtcttccctgttacagtgtgatttagataccagtacttgctgtaattgcagtaaggaattcccatgatatctctcaaggagacccagcatggcgtat

SEQ ID NO: 428853 - DNA, 140 bp, Artificial Sequence
  Synthetic
atacgccatgctgggtctccgtcctatttccttgaggtccacctgacatcccaatcatgctcaagagagccctcctttgatcaagctgttgtgagcttaaattccccatgtaaacacctgcgtacttgggagtcggccat

SEQ ID NO: 428854 - DNA, 140 bp, Artificial Sequence
  Synthetic
atggccgactcccaagtacgcaggtgtttacatggggaatttaagctcacaacagcttgatcaaaggagggctctcttgagcatgattgggatgtcaggtggacctcaaggaaataggacggagacccagcatggcgtat

SEQ ID NO: 428855 - DNA, 140 bp, Artificial Sequence
  Synthetic
aggccctggctgctgatatgcctcctttgatcaagctgttgtgagcttaaattccccatgtaaacacctgagctcaaaggcctttctgtccttatgactttggacttgagtttttccagggaccttttgggacagcggtg

SEQ ID NO: 428856 - DNA, 140 bp, Artificial Sequence
  Synthetic
caccgctgtcccaaaaggtccctggaaaaactcaagtccaaagtcataaggacagaaaggcctttgagctcaggtgtttacatggggaatttaagctcacaacagcttgatcaaaggaggcatatcagcagccagggcct

SEQ ID NO: 428857 - DNA, 140 bp, Artificial Sequence
  Synthetic
aggccctggctgctgatatgctcattgccagattgttgtgctggatgcacgcagcaggaagctgagactacctgtcaaaaatgacaaatgcaaagcgcaatccaatagcctaggatccacgaccttttgggacagcggtg

SEQ ID NO: 428858 - DNA, 140 bp, Artificial Sequence
  Synthetic
caccgctgtcccaaaaggtcgtggatcctaggctattggattgcgctttgcatttgtcatttttgacaggtagtctcagcttcctgctgcgtgcatccagcacaacaatctggcaatgagcatatcagcagccagggcct

SEQ ID NO: 428859 - DNA, 140 bp, Artificial Sequence
  Synthetic
atacgccatgctgggtctccgacattcttctgttgagttgacttcagttcaacaagattgttgacagcttgattcagatccctcagtcgctttaggtctgcatcatctctcttctgcttgcgtacttgggagtcggccat

SEQ ID NO: 428860 - DNA, 140 bp, Artificial Sequence
  Synthetic
atggccgactcccaagtacgcaagcagaagagagatgatgcagacctaaagcgactgagggatctgaatcaagctgtcaacaatcttgttgaactgaagtcaactcaacagaagaatgtcggagacccagcatggcgtat

SEQ ID NO: 428861 - DNA, 140 bp, Artificial Sequence
  Synthetic
atacgccatgctgggtctcctcaccatagagcgctgttaccataggcgaggattttacaaacctctcttttagaggatcaatctctgagggtgtgtccccctctctgtcaatataaaggtcgtacttgggagtcggccat

SEQ ID NO: 428862 - DNA, 140 bp, Artificial Sequence
  Synthetic
atggccgactcccaagtacgacctttatattgacagagagggggacacaccctcagagattgatcctctaaaagagaggtttgtaaaatcctcgcctatggtaacagcgctctatggtgaggagacccagcatggcgtat

SEQ ID NO: 428863 - DNA, 140 bp, Artificial Sequence
  Synthetic
atacgccatgctgggtctcctgattaccaccactcattcctatcatgttcagaagagctcttctttggtcaagttgctgtgagcttaggttgcccatatagacacctgcactcaatggcccgtacttgggagtcggccat

SEQ ID NO: 428864 - DNA, 140 bp, Artificial Sequence
  Synthetic
atggccgactcccaagtacgggccattgagtgcaggtgtctatatgggcaacctaagctcacagcaacttgaccaaagaagagctcttctgaacatgataggaatgagtggtggtaatcaggagacccagcatggcgtat

SEQ ID NO: 428865 - DNA, 140 bp, Artificial Sequence
  Synthetic
atacgccatgctgggtctcccagatagttcccttcgtaaggactgagtccaaaggaatgatttgatttccttggagttgctcattgctgatgtgcttggagcaacctaaaggtggagtgacgtacttgggagtcggccat

SEQ ID NO: 428866 - DNA, 140 bp, Artificial Sequence
  Synthetic
atggccgactcccaagtacgtcactccacctttaggttgctccaagcacatcagcaatgagcaactccaaggaaatcaaatcattcctttggactcagtccttacgaagggaactatctgggagacccagcatggcgtat

SEQ ID NO: 428867 - DNA, 140 bp, Artificial Sequence
  Synthetic
atacgccatgctgggtctcctaaagcattagtggctcgagttaaaactctgttgatgatggtaaggagctcacaattccgttcctctttgggtgataggacacttgcatctctgtctctacgtacttgggagtcggccat

SEQ ID NO: 428868 - DNA, 140 bp, Artificial Sequence
  Synthetic
atggccgactcccaagtacgtagagacagagatgcaagtgtcctatcacccaaagaggaacggaattgtgagctccttaccatcatcaacagagttttaactcgagccactaatgctttaggagacccagcatggcgtat

SEQ ID NO: 428869 - DNA, 140 bp, Artificial Sequence
  Synthetic
atacgccatgctgggtctcccaccaaccccagcagagagcccccacaacacagccaagcccacccagcccccagaaccgcccacatcagcaggcatgggcaacaagcagaccaggtcccccgtacttgggagtcggccat

SEQ ID NO: 428870 - DNA, 140 bp, Artificial Sequence
  Synthetic
atggccgactcccaagtacgggggacctggtctgcttgttgcccatgcctgctgatgtgggcggttctgggggctgggtgggcttggctgtgttgtgggggctctctgctggggttggtgggagacccagcatggcgtat

SEQ ID NO: 428871 - DNA, 140 bp, Artificial Sequence
  Synthetic
aggccctggctgctgatatgccagaaccgcccacatcagcaggcatgggcaacaagcagaccaggtccccacccaaaccagagcaccccagaccaaccctgctacccgacgcatcccaccgaccttttgggacagcggtg

SEQ ID NO: 428872 - DNA, 140 bp, Artificial Sequence
  Synthetic
caccgctgtcccaaaaggtcggtgggatgcgtcgggtagcagggttggtctggggtgctctggtttgggtggggacctggtctgcttgttgcccatgcctgctgatgtgggcggttctggcatatcagcagccagggcct

SEQ ID NO: 428873 - DNA, 140 bp, Artificial Sequence
  Synthetic
atacgccatgctgggtctccacccaaaccagagcaccccagaccaaccctgctacccgacgcatcccacctgggcccccaattctgcaagagctgctggtttgagaacaagggactggtgcgtacttgggagtcggccat

SEQ ID NO: 428874 - DNA, 140 bp, Artificial Sequence
  Synthetic
atggccgactcccaagtacgcaccagtcccttgttctcaaaccagcagctcttgcagaattgggggcccaggtgggatgcgtcgggtagcagggttggtctggggtgctctggtttgggtggagacccagcatggcgtat

SEQ ID NO: 428875 - DNA, 140 bp, Artificial Sequence
  Synthetic
atacgccatgctgggtctcccgtgagcgacagatgtcctatttgtaagatgcccctccccaccaagctggcagtccgaacccaaccaagtgcacccccactcaaccagggcaacactcaacgtacttgggagtcggccat

SEQ ID NO: 428876 - DNA, 140 bp, Artificial Sequence
  Synthetic
atggccgactcccaagtacgttgagtgttgccctggttgagtgggggtgcacttggttgggttcggactgccagcttggtggggaggggcatcttacaaataggacatctgtcgctcacgggagacccagcatggcgtat

SEQ ID NO: 428877 - DNA, 140 bp, Artificial Sequence
  Synthetic
atacgccatgctgggtctccatcctaggcaatttggttgttcttttttgagaccttgtgcgctgaactcctccaaatgggaaacaaacaagccaaggtcccagaatcaaaagacagcccgcgtacttgggagtcggccat

SEQ ID NO: 428878 - DNA, 140 bp, Artificial Sequence
  Synthetic
atggccgactcccaagtacgcgggctgtcttttgattctgggaccttggcttgtttgtttcccatttggaggagttcagcgcacaaggtctcaaaaaagaacaaccaaattgcctaggatggagacccagcatggcgtat

SEQ ID NO: 428879 - DNA, 140 bp, Artificial Sequence
  Synthetic
atacgccatgctgggtctccagacacacacacacgcacacacacccacagtccccacccgcacccccggggggaccccccgccgggggcccccccggggggctcagaggctggcatcactcgtacttgggagtcggccat

SEQ ID NO: 428880 - DNA, 140 bp, Artificial Sequence
  Synthetic
atggccgactcccaagtacgagtgatgccagcctctgagccccccgggggggcccccggcggggggtccccccgggggtgcgggtggggactgtgggtgtgtgtgcgtgtgtgtgtgtctggagacccagcatggcgtat

SEQ ID NO: 428881 - DNA, 140 bp, Artificial Sequence
  Synthetic
aggccctggctgctgatatgtgcaatctgtctgatgcccataagaagaacctctatgatcacgctcttatgagcataatctcaaccttccacttgtccatccccaacttcaatcagtatggaccttttgggacagcggtg

SEQ ID NO: 428882 - DNA, 140 bp, Artificial Sequence
  Synthetic
caccgctgtcccaaaaggtccatactgattgaagttggggatggacaagtggaaggttgagattatgctcataagagcgtgatcatagaggttcttcttatgggcatcagacagattgcacatatcagcagccagggcct

SEQ ID NO: 428883 - DNA, 140 bp, Artificial Sequence
  Synthetic
atacgccatgctgggtctcctgacttactataacacagtgagtagcccttgaaatccacccagtcaccaactgcttcaagaagccgaacaagaattggtctttgcaattctaacacagtccgtacttgggagtcggccat

SEQ ID NO: 428884 - DNA, 140 bp, Artificial Sequence
  Synthetic
atggccgactcccaagtacggactgtgttagaattgcaaagaccaattcttgttcggcttcttgaagcagttggtgactgggtggatttcaagggctactcactgtgttatagtaagtcaggagacccagcatggcgtat

SEQ ID NO: 428885 - DNA, 140 bp, Artificial Sequence
  Synthetic
atacgccatgctgggtctccaagacccatgcacctagttctattgcagttgataaggagatgcacatataatcccataataagggtctaaaataactaaccacactttcacttccacttccgtacttgggagtcggccat

SEQ ID NO: 428886 - DNA, 140 bp, Artificial Sequence
  Synthetic
atggccgactcccaagtacggaagtggaagtgaaagtgtggttagttattttagacccttattatgggattatatgtgcatctccttatcaactgcaatagaactaggtgcatgggtcttggagacccagcatggcgtat

SEQ ID NO: 428887 - DNA, 140 bp, Artificial Sequence
  Synthetic
aggccctggctgctgatatgtcatgatcaaagtcctcaaccatgtgattggataattcacccttaatcaacctaatgtaaaacttatttgagacaatctcatctaaatcatttattgatggaccttttgggacagcggtg

SEQ ID NO: 428888 - DNA, 140 bp, Artificial Sequence
  Synthetic
caccgctgtcccaaaaggtccatcaataaatgatttagatgagattgtctcaaataagttttacattaggttgattaagggtgaattatccaatcacatggttgaggactttgatcatgacatatcagcagccagggcct

SEQ ID NO: 428889 - DNA, 140 bp, Artificial Sequence
  Synthetic
atacgccatgctgggtctcctcaagtaggattagaacattaccagtgagtttgtagccgtcaggtaccacaaagcataaagctggagtgagaatcccatgatcactcagaatggattcaacgtacttgggagtcggccat

SEQ ID NO: 428890 - DNA, 140 bp, Artificial Sequence
  Synthetic
atggccgactcccaagtacgttgaatccattctgagtgatcatgggattctcactccagctttatgctttgtggtacctgacggctacaaactcactggtaatgttctaatcctacttgaggagacccagcatggcgtat

SEQ ID NO: 428891 - DNA, 140 bp, Artificial Sequence
  Synthetic
aggccctggctgctgatatgaaagcataaagctggagtgagaatcccatgatcactcagaatggattcaaccgttttgtcctcagtgttgtgttcacatccattagccttgcaagagtcagaccttttgggacagcggtg

SEQ ID NO: 428892 - DNA, 140 bp, Artificial Sequence
  Synthetic
caccgctgtcccaaaaggtctgactcttgcaaggctaatggatgtgaacacaacactgaggacaaaacggttgaatccattctgagtgatcatgggattctcactccagctttatgctttcatatcagcagccagggcct

SEQ ID NO: 428893 - DNA, 140 bp, Artificial Sequence
  Synthetic
atacgccatgctgggtctccgttacaggccctaattctttagtgtcctctaggaactcattaatgacctcagtatcgacaaaccatgcagatttccccttgaaaacagatccagacagcacgtacttgggagtcggccat

SEQ ID NO: 428894 - DNA, 140 bp, Artificial Sequence
  Synthetic
atggccgactcccaagtacgtgctgtctggatctgttttcaaggggaaatctgcatggtttgtcgatactgaggtcattaatgagttcctagaggacactaaagaattagggcctgtaacggagacccagcatggcgtat

SEQ ID NO: 428895 - DNA, 140 bp, Artificial Sequence
  Synthetic
aggccctggctgctgatatgagtatcgacaaaccatgcagatttccccttgaaaacagatccagacagcacaagcctccagcagtcaggcagcacacattggttgactgatccggaaaacgaccttttgggacagcggtg

SEQ ID NO: 428896 - DNA, 140 bp, Artificial Sequence
  Synthetic
caccgctgtcccaaaaggtcgttttccggatcagtcaaccaatgtgtgctgcctgactgctggaggcttgtgctgtctggatctgttttcaaggggaaatctgcatggtttgtcgatactcatatcagcagccagggcct

SEQ ID NO: 428897 - DNA, 140 bp, Artificial Sequence
  Synthetic
aggccctggctgctgatatgtgtctgcaaggtactttgagatgagatctttagcattggcaacatcttcctccattgtcagttgtggcacctgtgttggacttgggcttgtacctgtatggaccttttgggacagcggtg

SEQ ID NO: 428898 - DNA, 140 bp, Artificial Sequence
  Synthetic
caccgctgtcccaaaaggtccatacaggtacaagcccaagtccaacacaggtgccacaactgacaatggaggaagatgttgccaatgctaaagatctcatctcaaagtaccttgcagacacatatcagcagccagggcct

SEQ ID NO: 428899 - DNA, 140 bp, Artificial Sequence
  Synthetic
atacgccatgctgggtctcctccattgtcagttgtggcacctgtgttggacttgggcttgtacctgtatggcgtgtgggtcagctggcagtgccccacaaaagctcccacagagatgagacgtacttgggagtcggccat

SEQ ID NO: 428900 - DNA, 140 bp, Artificial Sequence
  Synthetic
atggccgactcccaagtacgtctcatctctgtgggagcttttgtggggcactgccagctgacccacacgccatacaggtacaagcccaagtccaacacaggtgccacaactgacaatggaggagacccagcatggcgtat

SEQ ID NO: 428901 - DNA, 140 bp, Artificial Sequence
  Synthetic
atacgccatgctgggtctccaatgaaattaagatgaatagaaaaattttctttaaaacttgcgtcttggcttctgatttggaatcttattgtctggctgaatctcactgaaccaactggtcgtacttgggagtcggccat

SEQ ID NO: 428902 - DNA, 140 bp, Artificial Sequence
  Synthetic
atggccgactcccaagtacgaccagttggttcagtgagattcagccagacaataagattccaaatcagaagccaagacgcaagttttaaagaaaatttttctattcatcttaatttcattggagacccagcatggcgtat

SEQ ID NO: 428903 - DNA, 140 bp, Artificial Sequence
  Synthetic
aggccctggctgctgatatgttctgatttggaatcttattgtctggctgaatctcactgaaccaactggtagttcactgattccatctaagaagtcttcaagacatttaaatttgacatcgaccttttgggacagcggtg

SEQ ID NO: 428904 - DNA, 140 bp, Artificial Sequence
  Synthetic
caccgctgtcccaaaaggtcgatgtcaaatttaaatgtcttgaagacttcttagatggaatcagtgaactaccagttggttcagtgagattcagccagacaataagattccaaatcagaacatatcagcagccagggcct

SEQ ID NO: 428905 - DNA, 140 bp, Artificial Sequence
  Synthetic
atacgccatgctgggtctccaatcataatcaatccatgcataacccatcatcaaatcatatttgaacataggtctttctatacctttgtataccaccttctcaacaaaagaggaaaagggcgtacttgggagtcggccat

SEQ ID NO: 428906 - DNA, 140 bp, Artificial Sequence
  Synthetic
atggccgactcccaagtacgcccttttcctcttttgttgagaaggtggtatacaaaggtatagaaagacctatgttcaaatatgatttgatgatgggttatgcatggattgattatgattggagacccagcatggcgtat

SEQ ID NO: 428907 - DNA, 140 bp, Artificial Sequence
  Synthetic
aggccctggctgctgatatgggtctttctatacctttgtataccaccttctcaacaaaagaggaaaaggggccaagtctctgcaaaccttcaccctctgggatagaggttttatgagggagaccttttgggacagcggtg

SEQ ID NO: 428908 - DNA, 140 bp, Artificial Sequence
  Synthetic
caccgctgtcccaaaaggtctccctcataaaacctctatcccagagggtgaaggtttgcagagacttggccccttttcctcttttgttgagaaggtggtatacaaaggtatagaaagacccatatcagcagccagggcct

SEQ ID NO: 428909 - DNA, 140 bp, Artificial Sequence
  Synthetic
atacgccatgctgggtctcctacgactcaaaataaatctgtctcataaaattatcaacaacgtcactcgagctgacaaccctttcttctatcatgggttcatgtgtcctggtgtgtgacacgtacttgggagtcggccat

SEQ ID NO: 428910 - DNA, 140 bp, Artificial Sequence
  Synthetic
atggccgactcccaagtacgtgtcacacaccaggacacatgaacccatgatagaagaaagggttgtcagctcgagtgacgttgttgataattttatgagacagatttattttgagtcgtaggagacccagcatggcgtat

SEQ ID NO: 428911 - DNA, 140 bp, Artificial Sequence
  Synthetic
aggccctggctgctgatatggctgacaaccctttcttctatcatgggttcatgtgtcctggtgtgtgacaatctcagctcagatgaaagcactatgtagtgttcctctctcttccacttcgaccttttgggacagcggtg

SEQ ID NO: 428912 - DNA, 140 bp, Artificial Sequence
  Synthetic
caccgctgtcccaaaaggtcgaagtggaagagagaggaacactacatagtgctttcatctgagctgagattgtcacacaccaggacacatgaacccatgatagaagaaagggttgtcagccatatcagcagccagggcct

SEQ ID NO: 428913 - DNA, 140 bp, Artificial Sequence
  Synthetic
atacgccatgctgggtctccacaaagatctagaaatttaattctaggtgaccacttcattttagtcgaggccaaatcactcatgaagggcaacaaatgtttctcaaacagactggggtaccgtacttgggagtcggccat

SEQ ID NO: 428914 - DNA, 140 bp, Artificial Sequence
  Synthetic
atggccgactcccaagtacggtaccccagtctgtttgagaaacatttgttgcccttcatgagtgatttggcctcgactaaaatgaagtggtcacctagaattaaatttctagatctttgtggagacccagcatggcgtat

SEQ ID NO: 428915 - DNA, 140 bp, Artificial Sequence
  Synthetic
aggccctggctgctgatatgccaaatcactcatgaagggcaacaaatgtttctcaaacagactggggtacagtctccttaatgagtgtattatatggttcatgccaactctatcttctaggaccttttgggacagcggtg

SEQ ID NO: 428916 - DNA, 140 bp, Artificial Sequence
  Synthetic
caccgctgtcccaaaaggtcctagaagatagagttggcatgaaccatataatacactcattaaggagactgtaccccagtctgtttgagaaacatttgttgcccttcatgagtgatttggcatatcagcagccagggcct

SEQ ID NO: 428917 - DNA, 140 bp, Artificial Sequence
  Synthetic
aggccctggctgctgatatgtatcaatatctgataatccaaaacacaacctgggaagatcactgccaattctcaagaccatctcccatcggttatcttgggctcctctcacaaaggaccagaccttttgggacagcggtg

SEQ ID NO: 428918 - DNA, 140 bp, Artificial Sequence
  Synthetic
caccgctgtcccaaaaggtctggtcctttgtgagaggagcccaagataaccgatgggagatggtcttgagaattggcagtgatcttcccaggttgtgttttggattatcagatattgatacatatcagcagccagggcct

SEQ ID NO: 428919 - DNA, 140 bp, Artificial Sequence
  Synthetic
atacgccatgctgggtctcctgaaaaactccagctgtcctgctggcttagggttccctagaacccatgcccccaactctatcgctgttgataatgaaatgcacatataatcccataacaacgtacttgggagtcggccat

SEQ ID NO: 428920 - DNA, 140 bp, Artificial Sequence
  Synthetic
atggccgactcccaagtacgttgttatgggattatatgtgcatttcattatcaacagcgatagagttgggggcatgggttctagggaaccctaagccagcaggacagctggagtttttcaggagacccagcatggcgtat

SEQ ID NO: 428921 - DNA, 140 bp, Artificial Sequence
  Synthetic
atacgccatgctgggtctccgcgagaattcaagtaagctaaataggatatgcctaaacctctcattggcccattctggaaacaaatcagtgtagaaattggttctgccgtctatcaagggcgtacttgggagtcggccat

SEQ ID NO: 428922 - DNA, 140 bp, Artificial Sequence
  Synthetic
atggccgactcccaagtacgcccttgatagacggcagaaccaatttctacactgatttgtttccagaatgggccaatgagaggtttaggcatatcctatttagcttacttgaattctcgcggagacccagcatggcgtat

SEQ ID NO: 428923 - DNA, 140 bp, Artificial Sequence
  Synthetic
atacgccatgctgggtctccacgccctgaattgccaggacctcagattgcagtgatttgatgtataggttttccttgttagaccccctcacacacttgctgccaagtgttctgcataatccgtacttgggagtcggccat

SEQ ID NO: 428924 - DNA, 140 bp, Artificial Sequence
  Synthetic
atggccgactcccaagtacggattatgcagaacacttggcagcaagtgtgtgagggggtctaacaaggaaaacctatacatcaaatcactgcaatctgaggtcctggcaattcagggcgtggagacccagcatggcgtat

SEQ ID NO: 428925 - DNA, 140 bp, Artificial Sequence
  Synthetic
aggccctggctgctgatatgttccttgttagaccccctcacacacttgctgccaagtgttctgcataatcctacaaagcctgaagcgattgaactttggaaagcagatttatttatggccgaccttttgggacagcggtg

SEQ ID NO: 428926 - DNA, 140 bp, Artificial Sequence
  Synthetic
caccgctgtcccaaaaggtcggccataaataaatctgctttccaaagttcaatcgcttcaggctttgtaggattatgcagaacacttggcagcaagtgtgtgagggggtctaacaaggaacatatcagcagccagggcct

SEQ ID NO: 428927 - DNA, 140 bp, Artificial Sequence
  Synthetic
atacgccatgctgggtctccctgaatggttttcactattgttggtattctctcatcatctaaactcactgccccagcataaatcaccttctgtctcagcaccattcttaatgggtgatgtcgtacttgggagtcggccat

SEQ ID NO: 428928 - DNA, 140 bp, Artificial Sequence
  Synthetic
atggccgactcccaagtacgacatcacccattaagaatggtgctgagacagaaggtgatttatgctggggcagtgagtttagatgatgagagaataccaacaatagtgaaaaccattcagggagacccagcatggcgtat

SEQ ID NO: 428929 - DNA, 140 bp, Artificial Sequence
  Synthetic
aggccctggctgctgatatgccccagcataaatcaccttctgtctcagcaccattcttaatgggtgatgtgtagccagattcaaccaacaaatttctagatcagagtcatccaacatctcgaccttttgggacagcggtg

SEQ ID NO: 428930 - DNA, 140 bp, Artificial Sequence
  Synthetic
caccgctgtcccaaaaggtcgagatgttggatgactctgatctagaaatttgttggttgaatctggctacacatcacccattaagaatggtgctgagacagaaggtgatttatgctggggcatatcagcagccagggcct

SEQ ID NO: 428931 - DNA, 140 bp, Artificial Sequence
  Synthetic
atacgccatgctgggtctccacagataattggtggtaaattcctcatgcaactcacctgtctttaatttgttaaacaactttcttagcattgatcttaccttactacaagcctctggggccgtacttgggagtcggccat

SEQ ID NO: 428932 - DNA, 140 bp, Artificial Sequence
  Synthetic
atggccgactcccaagtacggccccagaggcttgtagtaaggtaagatcaatgctaagaaagttgtttaacaaattaaagacaggtgagttgcatgaggaatttaccaccaattatctgtggagacccagcatggcgtat

SEQ ID NO: 428933 - DNA, 140 bp, Artificial Sequence
  Synthetic
aggccctggctgctgatatgttaaacaactttcttagcattgatcttaccttactacaagcctctggggccaactcttcaatcagtctcatgatcctgtaactacggttgccgtcaacccgaccttttgggacagcggtg

SEQ ID NO: 428934 - DNA, 140 bp, Artificial Sequence
  Synthetic
caccgctgtcccaaaaggtcgggttgacggcaaccgtagttacaggatcatgagactgattgaagagttggccccagaggcttgtagtaaggtaagatcaatgctaagaaagttgtttaacatatcagcagccagggcct

SEQ ID NO: 428935 - DNA, 140 bp, Artificial Sequence
  Synthetic
atacgccatgctgggtctccctcgcatacttcagcaagttcaaagttctcttctgaataagattacataggctaactggaacaccgttagcaatggactgatcaattatggtgtcaattgcgtacttgggagtcggccat

SEQ ID NO: 428936 - DNA, 140 bp, Artificial Sequence
  Synthetic
atggccgactcccaagtacgcaattgacaccataattgatcagtccattgctaacggtgttccagttagcctatgtaatcttattcagaagagaactttgaacttgctgaagtatgcgagggagacccagcatggcgtat

SEQ ID NO: 428937 - DNA, 140 bp, Artificial Sequence
  Synthetic
aggccctggctgctgatatggctaactggaacaccgttagcaatggactgatcaattatggtgtcaattgtctctgctaactggtgtggttctttacacttaacattatgtagcgcagcagaccttttgggacagcggtg

SEQ ID NO: 428938 - DNA, 140 bp, Artificial Sequence
  Synthetic
caccgctgtcccaaaaggtctgctgcgctacataatgttaagtgtaaagaaccacaccagttagcagagacaattgacaccataattgatcagtccattgctaacggtgttccagttagccatatcagcagccagggcct

SEQ ID NO: 428939 - DNA, 140 bp, Artificial Sequence
  Synthetic
atacgccatgctgggtctcctgatttaaattctgctacaaatcttccaatcacacttttcgggctgacaaacttatttaactgatcactcatatagtaatgaaattctaacagggttttacgtacttgggagtcggccat

SEQ ID NO: 428940 - DNA, 140 bp, Artificial Sequence
  Synthetic
atggccgactcccaagtacgtaaaaccctgttagaatttcattactatatgagtgatcagttaaataagtttgtcagcccgaaaagtgtgattggaagatttgtagcagaatttaaatcaggagacccagcatggcgtat

SEQ ID NO: 428941 - DNA, 140 bp, Artificial Sequence
  Synthetic
aggccctggctgctgatatgacttatttaactgatcactcatatagtaatgaaattctaacagggttttaaactcatcttggtctctagacattaactctgtcaggttctggtcaaaaaggaccttttgggacagcggtg

SEQ ID NO: 428942 - DNA, 140 bp, Artificial Sequence
  Synthetic
caccgctgtcccaaaaggtcctttttgaccagaacctgacagagttaatgtctagagaccaagatgagtttaaaaccctgttagaatttcattactatatgagtgatcagttaaataagtcatatcagcagccagggcct

SEQ ID NO: 428943 - DNA, 140 bp, Artificial Sequence
  Synthetic
atacgccatgctgggtctcccacaactcacagcatagtttataaatctctccgaaatgagtccataaaagtctgaagtgttgtgcagaataccttgccccatgtcaaggatggaacttatcgtacttgggagtcggccat

SEQ ID NO: 428944 - DNA, 140 bp, Artificial Sequence
  Synthetic
atggccgactcccaagtacgataagttccatccttgacatggggcaaggtattctgcacaacacttcagacttttatggactcatttcggagagatttataaactatgctgtgagttgtgggagacccagcatggcgtat

SEQ ID NO: 428945 - DNA, 140 bp, Artificial Sequence
  Synthetic
aggccctggctgctgatatgtctgaagtgttgtgcagaataccttgccccatgtcaaggatggaacttatatgagatggcacaacacccaaatgaaagtttgagtaaaagaaatcttctggaccttttgggacagcggtg

SEQ ID NO: 428946 - DNA, 140 bp, Artificial Sequence
  Synthetic
caccgctgtcccaaaaggtccagaagatttcttttactcaaactttcatttgggtgttgtgccatctcatataagttccatccttgacatggggcaaggtattctgcacaacacttcagacatatcagcagccagggcct

SEQ ID NO: 428947 - DNA, 140 bp, Artificial Sequence
  Synthetic
atacgccatgctgggtctccgatttcatcattgctgacactacattaaagggaatttctaccatcttgtgcatgtgccatgccaatagtgttgagagataatcctttcctttggcatcagcgtacttgggagtcggccat

SEQ ID NO: 428948 - DNA, 140 bp, Artificial Sequence
  Synthetic
atggccgactcccaagtacgctgatgccaaaggaaaggattatctctcaacactattggcatggcacatgcacaagatggtagaaattccctttaatgtagtgtcagcaatgatgaaatcggagacccagcatggcgtat

SEQ ID NO: 428949 - DNA, 140 bp, Artificial Sequence
  Synthetic
aggccctggctgctgatatgcatgtgccatgccaatagtgttgagagataatcctttcctttggcatcagcctgagtgtccccagtgagtagaattaagttctgtagggttgcaaggaatgaccttttgggacagcggtg

SEQ ID NO: 428950 - DNA, 140 bp, Artificial Sequence
  Synthetic
caccgctgtcccaaaaggtcattccttgcaaccctacagaacttaattctactcactggggacactcaggctgatgccaaaggaaaggattatctctcaacactattggcatggcacatgcatatcagcagccagggcct

SEQ ID NO: 428951 - DNA, 140 bp, Artificial Sequence
  Synthetic
atacgccatgctgggtctccagtgctcacgtgaccaaattttacctttggttccagaaacttttcaaaacattttatctgatctgtcaatctatctggtgtttcttttgtaataaagtgacgtacttgggagtcggccat

SEQ ID NO: 428952 - DNA, 140 bp, Artificial Sequence
  Synthetic
atggccgactcccaagtacgtcactttattacaaaagaaacaccagatagattgacagatcagataaaatgttttgaaaagtttctggaaccaaaggtaaaatttggtcacgtgagcactggagacccagcatggcgtat

SEQ ID NO: 428953 - DNA, 140 bp, Artificial Sequence
  Synthetic
atacgccatgctgggtctcctacatgtgcttgtgagacatttaatttcattgacaaaattgcattctcaaactctctttcatcatttaaacaacttcccgagaattgcgtcgtcaatgctcgtacttgggagtcggccat

SEQ ID NO: 428954 - DNA, 140 bp, Artificial Sequence
  Synthetic
atggccgactcccaagtacgagcattgacgacgcaattctcgggaagttgtttaaatgatgaaagagagtttgagaatgcaattttgtcaatgaaattaaatgtctcacaagcacatgtaggagacccagcatggcgtat

SEQ ID NO: 428955 - DNA, 140 bp, Artificial Sequence
  Synthetic
aggccctggctgctgatatgactctctttcatcatttaaacaacttcccgagaattgcgtcgtcaatgcttcaaaataatcctctatcaatcttgtgaacattttggtcctaaggtctccgaccttttgggacagcggtg

SEQ ID NO: 428956 - DNA, 140 bp, Artificial Sequence
  Synthetic
caccgctgtcccaaaaggtcggagaccttaggaccaaaatgttcacaagattgatagaggattattttgaagcattgacgacgcaattctcgggaagttgtttaaatgatgaaagagagtcatatcagcagccagggcct

SEQ ID NO: 428957 - DNA, 140 bp, Artificial Sequence
  Synthetic
atacgccatgctgggtctccgggtccctcagaacatgtgttttgcttgagcaacagttcactgtagaatgaggtcccgtagggggcacagaggacacaagagtcaattaaaggcaattaacgtacttgggagtcggccat

SEQ ID NO: 428958 - DNA, 140 bp, Artificial Sequence
  Synthetic
atggccgactcccaagtacgttaattgcctttaattgactcttgtgtcctctgtgccccctacgggacctcattctacagtgaactgttgctcaagcaaaacacatgttctgagggacccggagacccagcatggcgtat

SEQ ID NO: 428959 - DNA, 140 bp, Artificial Sequence
  Synthetic
atacgccatgctgggtctccattttagtctccctgtatcaggaccaactgagttgaatgattgtggagattcctggctataaaaacacagatttttcaacatggcagttgtgcaatttgtcgtacttgggagtcggccat

SEQ ID NO: 428960 - DNA, 140 bp, Artificial Sequence
  Synthetic
atggccgactcccaagtacgacaaattgcacaactgccatgttgaaaaatctgtgtttttatagccaggaatctccacaatcattcaactcagttggtcctgatacagggagactaaaatggagacccagcatggcgtat

SEQ ID NO: 428961 - DNA, 140 bp, Artificial Sequence
  Synthetic
aggccctggctgctgatatgtcctggctataaaaacacagatttttcaacatggcagttgtgcaatttgttagtgagagtgctttactaagtgcttcggagttgctctctctttcacttagaccttttgggacagcggtg

SEQ ID NO: 428962 - DNA, 140 bp, Artificial Sequence
  Synthetic
caccgctgtcccaaaaggtctaagtgaaagagagagcaactccgaagcacttagtaaagcactctcactaacaaattgcacaactgccatgttgaaaaatctgtgtttttatagccaggacatatcagcagccagggcct

SEQ ID NO: 428963 - DNA, 140 bp, Artificial Sequence
  Synthetic
atacgccatgctgggtctccaaagaaaacttaagccttcccgtatcaggtcctactgagtcataagattgtggcgactcctggctatagaaacacaaattctttaacattgctgtggtaccgtacttgggagtcggccat

SEQ ID NO: 428964 - DNA, 140 bp, Artificial Sequence
  Synthetic
atggccgactcccaagtacggtaccacagcaatgttaaagaatttgtgtttctatagccaggagtcgccacaatcttatgactcagtaggacctgatacgggaaggcttaagttttctttggagacccagcatggcgtat

SEQ ID NO: 428965 - DNA, 140 bp, Artificial Sequence
  Synthetic
atacgccatgctgggtctccttcgacttatagtgggtatacctccccatcaacctgttgccattcatcaacaagagaattgatttgaaacacaggaaatattcctgatctgaataagtcccgtacttgggagtcggccat

SEQ ID NO: 428966 - DNA, 140 bp, Artificial Sequence
  Synthetic
atggccgactcccaagtacgggacttattcagatcaggaatatttcctgtgtttcaaatcaattctcttgttgatgaatggcaacaggttgatggggaggtatacccactataagtcgaaggagacccagcatggcgtat

SEQ ID NO: 428967 - DNA, 140 bp, Artificial Sequence
  Synthetic
aggccctggctgctgatatgcaagagaattgatttgaaacacaggaaatattcctgatctgaataagtcctggttacaactgcttttgttagttcaccaatagggcaagacaccatgggtgaccttttgggacagcggtg

SEQ ID NO: 428968 - DNA, 140 bp, Artificial Sequence
  Synthetic
caccgctgtcccaaaaggtcacccatggtgtcttgccctattggtgaactaacaaaagcagttgtaaccaggacttattcagatcaggaatatttcctgtgtttcaaatcaattctcttgcatatcagcagccagggcct

SEQ ID NO: 428969 - DNA, 140 bp, Artificial Sequence
  Synthetic
atacgccatgctgggtctccacagaactctttataaaaagtgtcagggagtgtgttataatcaaagtcctccaccatgtggtttgagagttcccctttaatcaatctgatgtacagttttcgtacttgggagtcggccat

SEQ ID NO: 428970 - DNA, 140 bp, Artificial Sequence
  Synthetic
atggccgactcccaagtacgaaaactgtacatcagattgattaaaggggaactctcaaaccacatggtggaggactttgattataacacactccctgacactttttataaagagttctgtggagacccagcatggcgtat

SEQ ID NO: 428971 - DNA, 140 bp, Artificial Sequence
  Synthetic
aggccctggctgctgatatgccaccatgtggtttgagagttcccctttaatcaatctgatgtacagtttttccttaacaatctcatttaaatcgtcaattgaacaaatctccccggttgtgaccttttgggacagcggtg

SEQ ID NO: 428972 - DNA, 140 bp, Artificial Sequence
  Synthetic
caccgctgtcccaaaaggtcacaaccggggagatttgttcaattgacgatttaaatgagattgttaaggaaaaactgtacatcagattgattaaaggggaactctcaaaccacatggtggcatatcagcagccagggcct

SEQ ID NO: 428973 - DNA, 140 bp, Artificial Sequence
  Synthetic
atacgccatgctgggtctccctatagtttcttttaactcatcaaaatatgacatcgcattcccttcaagcaatatctcatccaggtcggccctgtctgtttctacatctttcccttgagacgtacttgggagtcggccat

SEQ ID NO: 428974 - DNA, 140 bp, Artificial Sequence
  Synthetic
atggccgactcccaagtacgtctcaagggaaagatgtagaaacagacagggccgacctggatgagatattgcttgaagggaatgcgatgtcatattttgatgagttaaaagaaactatagggagacccagcatggcgtat

SEQ ID NO: 428975 - DNA, 140 bp, Artificial Sequence
  Synthetic
atacgccatgctgggtctcccacactgatcccaacatcccttaaagcagtggtggccttcaagatggttttctggaacattgagttaagaatttgattcttactcaagcactgggaggaccgtacttgggagtcggccat

SEQ ID NO: 428976 - DNA, 140 bp, Artificial Sequence
  Synthetic
atggccgactcccaagtacggtcctcccagtgcttgagtaagaatcaaattcttaactcaatgttccagaaaaccatcttgaaggccaccactgctttaagggatgttgggatcagtgtgggagacccagcatggcgtat

SEQ ID NO: 428977 - DNA, 140 bp, Artificial Sequence
  Synthetic
atacgccatgctgggtctcctcagggattgtgtccacagaaaagactttatttcctttgaggcactcatcgccaaattgctgtgttggagacacgcagcagaaagttgggactatctgcccgtacttgggagtcggccat

SEQ ID NO: 428978 - DNA, 140 bp, Artificial Sequence
  Synthetic
atggccgactcccaagtacgggcagatagtcccaactttctgctgcgtgtctccaacacagcaatttggcgatgagtgcctcaaaggaaataaagtcttttctgtggacacaatccctgaggagacccagcatggcgtat

SEQ ID NO: 428979 - DNA, 140 bp, Artificial Sequence
  Synthetic
atacgccatgctgggtctccatcgagcaaaatttcgtctaggtcagccccatcagcatcacttttaggctgcccagatcctagaaccaaattgctcattgcctgctgaactttgtattcacgtacttgggagtcggccat

SEQ ID NO: 428980 - DNA, 140 bp, Artificial Sequence
  Synthetic
atggccgactcccaagtacgtgaatacaaagttcagcaggcaatgagcaatttggttctaggatctgggcagcctaaaagtgatgctgatggggctgacctagacgaaattttgctcgatggagacccagcatggcgtat

SEQ ID NO: 428981 - DNA, 140 bp, Artificial Sequence
  Synthetic
atacgccatgctgggtctccgtaactgctaaggctgttagcttgttgaaatcataatttaagaccctacatccatctgtgtacttattaatcacaacactcttattgcttgccagatctacgtacttgggagtcggccat

SEQ ID NO: 428982 - DNA, 140 bp, Artificial Sequence
  Synthetic
atggccgactcccaagtacgtagatctggcaagcaataagagtgttgtgattaataagtacacagatggatgtagggtcttaaattatgatttcaacaagctaacagccttagcagttacggagacccagcatggcgtat

SEQ ID NO: 428983 - DNA, 140 bp, Artificial Sequence
  Synthetic
aggccctggctgctgatatgtccatctgtgtacttattaatcacaacactcttattgcttgccagatctaaagcagtcgcacagccactggttgacagagggtcttttaattctttcctcgaccttttgggacagcggtg

SEQ ID NO: 428984 - DNA, 140 bp, Artificial Sequence
  Synthetic
caccgctgtcccaaaaggtcgaggaaagaattaaaagaccctctgtcaaccagtggctgtgcgactgctttagatctggcaagcaataagagtgttgtgattaataagtacacagatggacatatcagcagccagggcct

SEQ ID NO: 428985 - DNA, 140 bp, Artificial Sequence
  Synthetic
aggccctggctgctgatatggagctgcgacacggccagtgctgttagcttattgaagtcatagtttaatattctagaaccatctgtgtatttattaacaacaacacttttgttactggccgaccttttgggacagcggtg

SEQ ID NO: 428986 - DNA, 140 bp, Artificial Sequence
  Synthetic
caccgctgtcccaaaaggtcggccagtaacaaaagtgttgttgttaataaatacacagatggttctagaatattaaactatgacttcaataagctaacagcactggccgtgtcgcagctccatatcagcagccagggcct

SEQ ID NO: 428987 - DNA, 140 bp, Artificial Sequence
  Synthetic
aggccctggctgctgatatgtttgcaagagctgctggttcgaaaacaagggcctggttgagtgcaataaccactatctgtgcctcaattgtcttaccctacttctaagtgtcagcaacaggaccttttgggacagcggtg

SEQ ID NO: 428988 - DNA, 140 bp, Artificial Sequence
  Synthetic
caccgctgtcccaaaaggtcctgttgctgacacttagaagtagggtaagacaattgaggcacagatagtggttattgcactcaaccaggcccttgttttcgaaccagcagctcttgcaaacatatcagcagccagggcct

SEQ ID NO: 428989 - DNA, 140 bp, Artificial Sequence
  Synthetic
atacgccatgctgggtctccggacaagtacttcttggagacaccaggtttcttgtaccttatttcagctgattccacacagcattccttacctaagaactttttagcgttgtacaccattcgtacttgggagtcggccat

SEQ ID NO: 428990 - DNA, 140 bp, Artificial Sequence
  Synthetic
atggccgactcccaagtacgaatggtgtacaacgctaaaaagttcttaggtaaggaatgctgtgtggaatcagctgaaataaggtacaagaaacctggtgtctccaagaagtacttgtccggagacccagcatggcgtat

SEQ ID NO: 428991 - DNA, 140 bp, Artificial Sequence
  Synthetic
aggccctggctgctgatatgccctcgtcaacattcgcatacaaaaatctcaatattggtgatgctctcttgaactgataaattaagtgttcgatattgtcttctgcagccaccttgtcaggaccttttgggacagcggtg

SEQ ID NO: 428992 - DNA, 140 bp, Artificial Sequence
  Synthetic
caccgctgtcccaaaaggtcctgacaaggtggctgcagaagacaatatcgaacacttaatttatcagttcaagagagcatcaccaatattgagatttttgtatgcgaatgttgacgagggcatatcagcagccagggcct

SEQ ID NO: 428993 - DNA, 140 bp, Artificial Sequence
  Synthetic
aggccctggctgctgatatgtatagcccctgaacctcccatcgaccccaaccacctccaccttccccccgacaccccccggggggaaccccccgccgggggccccccccgggggagccaagaccttttgggacagcggtg

SEQ ID NO: 428994 - DNA, 140 bp, Artificial Sequence
  Synthetic
caccgctgtcccaaaaggtcttggctcccccggggggggcccccggcggggggttccccccggggggtgtcggggggaaggtggaggtggttggggtcgatgggaggttcaggggctatacatatcagcagccagggcct

SEQ ID NO: 428995 - DNA, 140 bp, Artificial Sequence
  Synthetic
atacgccatgctgggtctccctgttagtctatcaggggtttccttagtgataaaatgacacatgtaagaaatgttcaaaacaaatttgaacctgtttgttagcatactagtcacattaggcgtacttgggagtcggccat

SEQ ID NO: 428996 - DNA, 140 bp, Artificial Sequence
  Synthetic
atggccgactcccaagtacgcctaatgtgactagtatgctaacaaacaggttcaaatttgttttgaacatttcttacatgtgtcattttatcactaaggaaacccctgatagactaacagggagacccagcatggcgtat

SEQ ID NO: 428997 - DNA, 140 bp, Artificial Sequence
  Synthetic
aggccctggctgctgatatgatgttcaaaacaaatttgaacctgtttgttagcatactagtcacattaggagataaaacagtgcttaacagggctcttaccactctgaaaagcaagtactgaccttttgggacagcggtg

SEQ ID NO: 428998 - DNA, 140 bp, Artificial Sequence
  Synthetic
caccgctgtcccaaaaggtcagtacttgcttttcagagtggtaagagccctgttaagcactgttttatctcctaatgtgactagtatgctaacaaacaggttcaaatttgttttgaacatcatatcagcagccagggcct

SEQ ID NO: 428999 - DNA, 140 bp, Artificial Sequence
  Synthetic
aggccctggctgctgatatgtcaactcctcacatgttctgcccttcagtctcaatctaccactgcttgactgtatcatcaccttcccctttgacttactataacagagagcataacccttgaccttttgggacagcggtg

SEQ ID NO: 429000 - DNA, 140 bp, Artificial Sequence
  Synthetic
caccgctgtcccaaaaggtcaagggttatgctctctgttatagtaagtcaaaggggaaggtgatgatacagtcaagcagtggtagattgagactgaagggcagaacatgtgaggagttgacatatcagcagccagggcct

SEQ ID NO: 429001 - DNA, 140 bp, Artificial Sequence
  Synthetic
atacgccatgctgggtctcctaataatcagagacaaaggccattatgaagtatctaagattttgcaaaaacttctgacatcgcttactagggtgggtcaagattaaaaccaaaatcatttcgtacttgggagtcggccat

SEQ ID NO: 429002 - DNA, 140 bp, Artificial Sequence
  Synthetic
atggccgactcccaagtacgaaatgattttggttttaatcttgacccaccctagtaagcgatgtcagaagtttttgcaaaatcttagatacttcataatggcctttgtctctgattattaggagacccagcatggcgtat

SEQ ID NO: 429003 - DNA, 140 bp, Artificial Sequence
  Synthetic
aggccctggctgctgatatgcttctgacatcgcttactagggtgggtcaagattaaaaccaaaatcattttggttagcactttaattgaggatatatcatccttaagctcagaacaatctgaccttttgggacagcggtg

SEQ ID NO: 429004 - DNA, 140 bp, Artificial Sequence
  Synthetic
caccgctgtcccaaaaggtcagattgttctgagcttaaggatgatatatcctcaattaaagtgctaaccaaaatgattttggttttaatcttgacccaccctagtaagcgatgtcagaagcatatcagcagccagggcct

SEQ ID NO: 429005 - DNA, 140 bp, Artificial Sequence
  Synthetic
aggccctggctgctgatatggatcagcaggtcagacgaagtgtccccaacttccctcacaaacatctcaagatcttggtcttgtataacaggtgtaaaggatgccaatttctttccacatgaccttttgggacagcggtg

SEQ ID NO: 429006 - DNA, 140 bp, Artificial Sequence
  Synthetic
caccgctgtcccaaaaggtcatgtggaaagaaattggcatcctttacacctgttatacaagaccaagatcttgagatgtttgtgagggaagttggggacacttcgtctgacctgctgatccatatcagcagccagggcct

SEQ ID NO: 429007 - DNA, 140 bp, Artificial Sequence
  Synthetic
atacgccatgctgggtctccaaagattgcggggaaaaacctcttgggatccgcataaaaggaacagacttcaccaactaagttgttgtttaccgcataacattttgaacactcgcccgttcgtacttgggagtcggccat

SEQ ID NO: 429008 - DNA, 140 bp, Artificial Sequence
  Synthetic
atggccgactcccaagtacgaacgggcgagtgttcaaaatgttatgcggtaaacaacaacttagttggtgaagtctgttccttttatgcggatcccaagaggtttttccccgcaatctttggagacccagcatggcgtat

SEQ ID NO: 429009 - DNA, 140 bp, Artificial Sequence
  Synthetic
atacgccatgctgggtctcctcccacaagcctcccctatgcacaaccagagggactggttcaatgcatggacccactaatacaaagtcataccctgtaaactgcaacttttccacatcaacgtacttgggagtcggccat

SEQ ID NO: 429010 - DNA, 140 bp, Artificial Sequence
  Synthetic
atggccgactcccaagtacgttgatgtggaaaagttgcagtttacagggtatgactttgtattagtgggtccatgcattgaaccagtccctctggttgtgcataggggaggcttgtgggaggagacccagcatggcgtat

SEQ ID NO: 429011 - DNA, 140 bp, Artificial Sequence
  Synthetic
atacgccatgctgggtctcctttgcctcaacttaacagtggaggaagtcttcattgaattcaccaatgcaagactcaatgttgagagcctttcaagatcagctgactctgaaacgctcaccgtacttgggagtcggccat

SEQ ID NO: 429012 - DNA, 140 bp, Artificial Sequence
  Synthetic
atggccgactcccaagtacggtgagcgtttcagagtcagctgatcttgaaaggctctcaacattgagtcttgcattggtgaattcaatgaagacttcctccactgttaagttgaggcaaaggagacccagcatggcgtat

SEQ ID NO: 429013 - DNA, 140 bp, Artificial Sequence
  Synthetic
aggccctggctgctgatatgagactcaatgttgagagcctttcaagatcagctgactctgaaacgctcactgtgcccattgagtagggaaacagtccttcgtcagacttttgataagacagaccttttgggacagcggtg

SEQ ID NO: 429014 - DNA, 140 bp, Artificial Sequence
  Synthetic
caccgctgtcccaaaaggtctgtcttatcaaaagtctgacgaaggactgtttccctactcaatgggcacagtgagcgtttcagagtcagctgatcttgaaaggctctcaacattgagtctcatatcagcagccagggcct

SEQ ID NO: 429015 - DNA, 140 bp, Artificial Sequence
  Synthetic
aggccctggctgctgatatgaactcattctgtctcaactttacagtagaagaagttttcatagagttcaccaaagcgaggctcaatgaagaaagtctctctaagtcagtggttcccagtagaccttttgggacagcggtg

SEQ ID NO: 429016 - DNA, 140 bp, Artificial Sequence
  Synthetic
caccgctgtcccaaaaggtctactgggaaccactgacttagagagactttcttcattgagcctcgctttggtgaactctatgaaaacttcttctactgtaaagttgagacagaatgagttcatatcagcagccagggcct

SEQ ID NO: 429017 - DNA, 140 bp, Artificial Sequence
  Synthetic
aggccctggctgctgatatgaaaactagcatcttgacttttgatgcggaaccttactgtctgactcatttttgcagaccctgaaggtaatgaagcaacagcatcaaagaaatcctccaatgaccttttgggacagcggtg

SEQ ID NO: 429018 - DNA, 140 bp, Artificial Sequence
  Synthetic
caccgctgtcccaaaaggtcattggaggatttctttgatgctgttgcttcattaccttcagggtctgcaaaaatgagtcagacagtaaggttccgcatcaaaagtcaagatgctagttttcatatcagcagccagggcct

SEQ ID NO: 429019 - DNA, 140 bp, Artificial Sequence
  Synthetic
aggccctggctgctgatatgtaggtctttgagggcacttattgctttggtaacagttttctgcaacatgcaactcaagatttgatttctatctaatctaacggagtgagtgcttgatgctgaccttttgggacagcggtg

SEQ ID NO: 429020 - DNA, 140 bp, Artificial Sequence
  Synthetic
caccgctgtcccaaaaggtcagcatcaagcactcactccgttagattagatagaaatcaaatcttgagttgcatgttgcagaaaactgttaccaaagcaataagtgccctcaaagacctacatatcagcagccagggcct

SEQ ID NO: 429021 - DNA, 140 bp, Artificial Sequence
  Synthetic
aggccctggctgctgatatgcccattctatgcaacccttcaccctctggaactgatgtcttgtgtgggaaccacgtgaaggaccccaatgtccttgtagtcgcaacaaatggtctcacatgaccttttgggacagcggtg

SEQ ID NO: 429022 - DNA, 140 bp, Artificial Sequence
  Synthetic
caccgctgtcccaaaaggtcatgtgagaccatttgttgcgactacaaggacattggggtccttcacgtggttcccacacaagacatcagttccagagggtgaagggttgcatagaatgggcatatcagcagccagggcct

SEQ ID NO: 429023 - DNA, 140 bp, Artificial Sequence
  Synthetic
atacgccatgctgggtctcccctcttagtgtattctaaagacaccaagcggtcattcacactgataaaactggatcctaaccagccttcctgagcttgatcttcacatttaatcttgtcccgtacttgggagtcggccat

SEQ ID NO: 429024 - DNA, 140 bp, Artificial Sequence
  Synthetic
atggccgactcccaagtacgggacaagattaaatgtgaagatcaagctcaggaaggctggttaggatccagttttatcagtgtgaatgaccgcttggtgtctttagaatacactaagaggggagacccagcatggcgtat

SEQ ID NO: 429025 - DNA, 140 bp, Artificial Sequence
  Synthetic
aggccctggctgctgatatgtggatcctaaccagccttcctgagcttgatcttcacatttaatcttgtccctctcataagcaaggagaatcattacatcaaaaatcaatagaagtttcctgaccttttgggacagcggtg

SEQ ID NO: 429026 - DNA, 140 bp, Artificial Sequence
  Synthetic
caccgctgtcccaaaaggtcaggaaacttctattgatttttgatgtaatgattctccttgcttatgagagggacaagattaaatgtgaagatcaagctcaggaaggctggttaggatccacatatcagcagccagggcct

SEQ ID NO: 429027 - DNA, 140 bp, Artificial Sequence
  Synthetic
aggccctggctgctgatatgtgtgttcagcacaagtttctatctcattagcatcttccttcatttagtcaagataccaactcataggcatattgtaggcaagtcgtgtcccaaacctcacgaccttttgggacagcggtg

SEQ ID NO: 429028 - DNA, 140 bp, Artificial Sequence
  Synthetic
caccgctgtcccaaaaggtcgtgaggtttgggacacgacttgcctacaatatgcctatgagttggtatcttgactaaatgaaggaagatgctaatgagatagaaacttgtgctgaacacacatatcagcagccagggcct

SEQ ID NO: 429029 - DNA, 140 bp, Artificial Sequence
  Synthetic
aggccctggctgctgatatgacttgcaaggagaattagtgcatcaaaaatcaatagaagtttcctccttgtgttcagtatcctcaaagattttactttatttaggaatgatctccagcatgaccttttgggacagcggtg

SEQ ID NO: 429030 - DNA, 140 bp, Artificial Sequence
  Synthetic
caccgctgtcccaaaaggtcatgctggagatcattcctaaataaagtaaaatctttgaggatactgaacacaaggaggaaacttctattgatttttgatgcactaattctccttgcaagtcatatcagcagccagggcct

SEQ ID NO: 429031 - DNA, 140 bp, Artificial Sequence
  Synthetic
aggccctggctgctgatatggttaaatctgcatacaagaatttcaacacaggagaggctcttttaaaggaatacatcaattcttccactccatcttcattagaaaccatttcagaatcatgaccttttgggacagcggtg

SEQ ID NO: 429032 - DNA, 140 bp, Artificial Sequence
  Synthetic
caccgctgtcccaaaaggtcatgattctgaaatggtttctaatgaagatggagtggaagaattgatgtattcctttaaaagagcctctcctgtgttgaaattcttgtatgcagatttaaccatatcagcagccagggcct

SEQ ID NO: 429033 - DNA, 140 bp, Artificial Sequence
  Synthetic
atacgccatgctgggtctcctattgggatactttgccgtgtagatcagacccaaatctgtcaatgcttgcactgcatcattcaagtcaacctgcccctgttttgtcagacatgccagtgtcgtacttgggagtcggccat

SEQ ID NO: 429034 - DNA, 140 bp, Artificial Sequence
  Synthetic
atggccgactcccaagtacgacactggcatgtctgacaaaacaggggcaggttgacttgaatgatgcagtgcaagcattgacagatttgggtctgatctacacggcaaagtatcccaataggagacccagcatggcgtat

SEQ ID NO: 429035 - DNA, 140 bp, Artificial Sequence
  Synthetic
aggccctggctgctgatatgactgcatcattcaagtcaacctgcccctgttttgtcagacatgccagtgtaagacttggcatggtcccgaactgattattgagcaactctgcatttttcagaccttttgggacagcggtg

SEQ ID NO: 429036 - DNA, 140 bp, Artificial Sequence
  Synthetic
caccgctgtcccaaaaggtctgaaaaatgcagagttgctcaataatcagttcgggaccatgccaagtcttacactggcatgtctgacaaaacaggggcaggttgacttgaatgatgcagtcatatcagcagccagggcct

SEQ ID NO: 429037 - DNA, 140 bp, Artificial Sequence
  Synthetic
atacgccatgctgggtctcctgatcttctatttggccctgccttaacttgtttctgaatatctgatactcctcctcaatctgattcttaacctcatgggcagtcattttgttgttgatgccgtacttgggagtcggccat

SEQ ID NO: 429038 - DNA, 140 bp, Artificial Sequence
  Synthetic
atggccgactcccaagtacggcatcaacaacaaaatgactgcccatgaggttaagaatcagattgaggaggagtatcagatattcagaaacaagttaaggcagggccaaatagaagatcaggagacccagcatggcgtat

SEQ ID NO: 429039 - DNA, 140 bp, Artificial Sequence
  Synthetic
aggccctggctgctgatatgctcctcaatctgattcttaacctcatgggcagtcattttgttgttgatgccttgatggcagctggcaattatatcatcaaaatggttggttcgtttatctgaccttttgggacagcggtg

SEQ ID NO: 429040 - DNA, 140 bp, Artificial Sequence
  Synthetic
caccgctgtcccaaaaggtcagataaacgaaccaaccattttgatgatataattgccagctgccatcaaggcatcaacaacaaaatgactgcccatgaggttaagaatcagattgaggagcatatcagcagccagggcct

SEQ ID NO: 429041 - DNA, 140 bp, Artificial Sequence
  Synthetic
atacgccatgctgggtctccccaaccctatcctccaatagttttgatgcagttggcttcaagggaaaatagtcacaagggttgtgcttaaaaaaatccaacaccttaactatcttaggttcgtacttgggagtcggccat

SEQ ID NO: 429042 - DNA, 140 bp, Artificial Sequence
  Synthetic
atggccgactcccaagtacgaacctaagatagttaaggtgttggatttttttaagcacaacccttgtgactattttcccttgaagccaactgcatcaaaactattggaggatagggttggggagacccagcatggcgtat

SEQ ID NO: 429043 - DNA, 140 bp, Artificial Sequence
  Synthetic
aggccctggctgctgatatggtcacaagggttgtgcttaaaaaaatccaacaccttaactatcttaggttcccctaagacccatgcacccagttctattgcagttgacaaggagatacacgaccttttgggacagcggtg

SEQ ID NO: 429044 - DNA, 140 bp, Artificial Sequence
  Synthetic
caccgctgtcccaaaaggtcgtgtatctccttgtcaactgcaatagaactgggtgcatgggtcttaggggaacctaagatagttaaggtgttggatttttttaagcacaacccttgtgaccatatcagcagccagggcct

SEQ ID NO: 429045 - DNA, 140 bp, Artificial Sequence
  Synthetic
atacgccatgctgggtctccaagagattcgcataatctagagtactcagactcttcaaagagtgaattgctctcctgagcatatttcatcaaggagaatagtgtatctctgagtttgtcacgtacttgggagtcggccat

SEQ ID NO: 429046 - DNA, 140 bp, Artificial Sequence
  Synthetic
atggccgactcccaagtacgtgacaaactcagagatacactattctccttgatgaaatatgctcaggagagcaattcactctttgaagagtctgagtactctagattatgcgaatctcttggagacccagcatggcgtat

SEQ ID NO: 429047 - DNA, 140 bp, Artificial Sequence
  Synthetic
aggccctggctgctgatatgtctcctgagcatatttcatcaaggagaatagtgtatctctgagtttgtcattcacccagtccggaatttgttcattataaaatgtagttcttccgtcaatgaccttttgggacagcggtg

SEQ ID NO: 429048 - DNA, 140 bp, Artificial Sequence
  Synthetic
caccgctgtcccaaaaggtcattgacggaagaactacattttataatgaacaaattccggactgggtgaatgacaaactcagagatacactattctccttgatgaaatatgctcaggagacatatcagcagccagggcct

SEQ ID NO: 429049 - DNA, 140 bp, Artificial Sequence
  Synthetic
aggccctggctgctgatatgcactcatcgccagattgttgtgctggatgcgcgcaacaaaaagctgaggctatctgctaaaatgataaaagcaaagcgcaatccaatagcctaggatccagaccttttgggacagcggtg

SEQ ID NO: 429050 - DNA, 140 bp, Artificial Sequence
  Synthetic
caccgctgtcccaaaaggtctggatcctaggctattggattgcgctttgcttttatcattttagcagatagcctcagctttttgttgcgcgcatccagcacaacaatctggcgatgagtgcatatcagcagccagggcct

SEQ ID NO: 429051 - DNA, 140 bp, Artificial Sequence
  Synthetic
atacgccatgctgggtctccctaacttctttaagtcctctaggtacttctgctcaaagttcactggggatgatctcacaaagcactcaaggagtatgaggacattcccattcaatttgaacgtacttgggagtcggccat

SEQ ID NO: 429052 - DNA, 140 bp, Artificial Sequence
  Synthetic
atggccgactcccaagtacgttcaaattgaatgggaatgtcctcatactccttgagtgctttgtgagatcatccccagtgaactttgagcagaagtacctagaggacttaaagaagttagggagacccagcatggcgtat

SEQ ID NO: 429053 - DNA, 140 bp, Artificial Sequence
  Synthetic
aggccctggctgctgatatgcaatgttctgcacaatcccacgaagccagatgcaatagaactttggaatgcagatttgttgatagcttcagacaacaatttctgtgcaccacgagtgaaagaccttttgggacagcggtg

SEQ ID NO: 429054 - DNA, 140 bp, Artificial Sequence
  Synthetic
caccgctgtcccaaaaggtctttcactcgtggtgcacagaaattgttgtctgaagctatcaacaaatctgcattccaaagttctattgcatctggcttcgtgggattgtgcagaacattgcatatcagcagccagggcct

SEQ ID NO: 429055 - DNA, 140 bp, Artificial Sequence
  Synthetic
atacgccatgctgggtctccgccttgcaggaatcaacctctatacataaggataaaagttttagtccttccatcaacaacatcctcggctcagtctgcaccaagaatgccaatttttgtccgtacttgggagtcggccat

SEQ ID NO: 429056 - DNA, 140 bp, Artificial Sequence
  Synthetic
atggccgactcccaagtacggacaaaaattggcattcttggtgcagactgagccgaggatgttgttgatggaaggactaaaacttttatccttatgtatagaggttgattcctgcaaggcggagacccagcatggcgtat

SEQ ID NO: 429057 - DNA, 140 bp, Artificial Sequence
  Synthetic
atacgccatgctgggtctccagaattctttccacagatttgtcctcactgttgtgctcgcatccatttgcgttgcaggagtcaacctcaatacagagggacaagagtttcaacccttccacgtacttgggagtcggccat

SEQ ID NO: 429058 - DNA, 140 bp, Artificial Sequence
  Synthetic
atggccgactcccaagtacgtggaagggttgaaactcttgtccctctgtattgaggttgactcctgcaacgcaaatggatgcgagcacaacagtgaggacaaatctgtggaaagaattctggagacccagcatggcgtat

SEQ ID NO: 429059 - DNA, 140 bp, Artificial Sequence
  Synthetic
atacgccatgctgggtctcctagataatctctcatcatcagaaagatattttgaaacaagatcttttacataagctatctcctcctccattaaagaagttgtcaacaatagagcgtctaacgtacttgggagtcggccat

SEQ ID NO: 429060 - DNA, 140 bp, Artificial Sequence
  Synthetic
atggccgactcccaagtacgttagacgctctattgttgacaacttctttaatggaggaggagatagcttatgtaaaagatcttgtttcaaaatatctttctgatgatgagagattatctaggagacccagcatggcgtat

SEQ ID NO: 429061 - DNA, 140 bp, Artificial Sequence
  Synthetic
aggccctggctgctgatatgtgctcactagacaaatagtttgttgtgaactcttcatggagttgcccagtcttcaacctattgtatagttttcttagcatagatctaatcttgctgcaaggaccttttgggacagcggtg

SEQ ID NO: 429062 - DNA, 140 bp, Artificial Sequence
  Synthetic
caccgctgtcccaaaaggtccttgcagcaagattagatctatgctaagaaaactatacaataggttgaagactgggcaactccatgaagagttcacaacaaactatttgtctagtgagcacatatcagcagccagggcct

SEQ ID NO: 429063 - DNA, 140 bp, Artificial Sequence
  Synthetic
atacgccatgctgggtctccagaacatgtggtttgctagagcaacagttcactatggaatgaggtcccgcggggggcacagaagacacaagagtcaattaaaagcaattaaattagatagcgtacttgggagtcggccat

SEQ ID NO: 429064 - DNA, 140 bp, Artificial Sequence
  Synthetic
atggccgactcccaagtacgctatctaatttaattgcttttaattgactcttgtgtcttctgtgccccccgcgggacctcattccatagtgaactgttgctctagcaaaccacatgttctggagacccagcatggcgtat

SEQ ID NO: 429065 - DNA, 140 bp, Artificial Sequence
  Synthetic
aggccctggctgctgatatgcccccggggggaccccccgccgggggcccccccgggggagccaaccatcaccaggagactactcaatgtcttcgatgcattcatccttcctagtcaactcgaccttttgggacagcggtg

SEQ ID NO: 429066 - DNA, 140 bp, Artificial Sequence
  Synthetic
caccgctgtcccaaaaggtcgagttgactaggaaggatgaatgcatcgaagacattgagtagtctcctggtgatggttggctcccccgggggggcccccggcggggggtccccccgggggcatatcagcagccagggcct

SEQ ID NO: 429067 - DNA, 140 bp, Artificial Sequence
  Synthetic
atacgccatgctgggtctccccccaaacaaaaaatctagatttaaactctgcaacaaacctgccaatgacacttttagggctcacaaacttattgagttgatcactcatataataatggacgtacttgggagtcggccat

SEQ ID NO: 429068 - DNA, 140 bp, Artificial Sequence
  Synthetic
atggccgactcccaagtacgtccattattatatgagtgatcaactcaataagtttgtgagccctaaaagtgtcattggcaggtttgttgcagagtttaaatctagattttttgtttggggggagacccagcatggcgtat

SEQ ID NO: 429069 - DNA, 140 bp, Artificial Sequence
  Synthetic
atacgccatgctgggtctccttgctacctgtggcctctttggattggtgtcctttctcctcttatgtggaagatcatgctcaacaacttacaagggtgtttatgagctacaaactctagacgtacttgggagtcggccat

SEQ ID NO: 429070 - DNA, 140 bp, Artificial Sequence
  Synthetic
atggccgactcccaagtacgtctagagtttgtagctcataaacacccttgtaagttgttgagcatgatcttccacataagaggagaaaggacaccaatccaaagaggccacaggtagcaaggagacccagcatggcgtat

SEQ ID NO: 429071 - DNA, 140 bp, Artificial Sequence
  Synthetic
aggccctggctgctgatatgcagccaaccattgtggcacagttgcaaatggtgtcttacagactttcatgaggatggcctggggtggaggatacattgctcttgactcaggccgtggcaagaccttttgggacagcggtg

SEQ ID NO: 429072 - DNA, 140 bp, Artificial Sequence
  Synthetic
caccgctgtcccaaaaggtcttgccacggcctgagtcaagagcaatgtatcctccaccccaggccatcctcatgaaagtctgtaagacaccatttgcaactgtgccacaatggttggctgcatatcagcagccagggcct

SEQ ID NO: 429073 - DNA, 140 bp, Artificial Sequence
  Synthetic
atacgccatgctgggtctccatcttgatcttgtatcacaggtgtgaaggatgccaatttcttcccacattcccacagacctcctctatgcacaaccagaggggctggttcagtgcagggacgtacttgggagtcggccat

SEQ ID NO: 429074 - DNA, 140 bp, Artificial Sequence
  Synthetic
atggccgactcccaagtacgtccctgcactgaaccagcccctctggttgtgcatagaggaggtctgtgggaatgtgggaagaaattggcatccttcacacctgtgatacaagatcaagatggagacccagcatggcgtat

SEQ ID NO: 429075 - DNA, 140 bp, Artificial Sequence
  Synthetic
aggccctggctgctgatatgggtctcctttcacaaaggaccagagatatttatatcagcagaagactactaggcacatttacatggacactgtcagactctgaaggcaaggacacaccaggaccttttgggacagcggtg

SEQ ID NO: 429076 - DNA, 140 bp, Artificial Sequence
  Synthetic
caccgctgtcccaaaaggtcctggtgtgtccttgccttcagagtctgacagtgtccatgtaaatgtgcctagtagtcttctgctgatataaatatctctggtcctttgtgaaaggagacccatatcagcagccagggcct

SEQ ID NO: 429077 - DNA, 140 bp, Artificial Sequence
  Synthetic
aggccctggctgctgatatgttcgggaacacagctgtggcaaaatgcaatgagaaacatgatgaggaattttgtgatatgctgaggctgtttgacttcaacaaacaagccattcaaaggtgaccttttgggacagcggtg

SEQ ID NO: 429078 - DNA, 140 bp, Artificial Sequence
  Synthetic
caccgctgtcccaaaaggtcacctttgaatggcttgtttgttgaagtcaaacagcctcagcatatcacaaaattcctcatcatgtttctcattgcattttgccacagctgtgttcccgaacatatcagcagccagggcct

SEQ ID NO: 429079 - DNA, 140 bp, Artificial Sequence
  Synthetic
aggccctggctgctgatatgccccatcgagcagaatttcgtctagatcggccccatcagcatcacttttgtgttgtccagatcctaagaccaaattgctcattgcctgctgcaccttgtagaccttttgggacagcggtg

SEQ ID NO: 429080 - DNA, 140 bp, Artificial Sequence
  Synthetic
caccgctgtcccaaaaggtctacaaggtgcagcaggcaatgagcaatttggtcttaggatctggacaacacaaaagtgatgctgatggggccgatctagacgaaattctgctcgatggggcatatcagcagccagggcct

SEQ ID NO: 429081 - DNA, 140 bp, Artificial Sequence
  Synthetic
atacgccatgctgggtctccttactgggaaaacatcactgcctaaatgttggcttgtatcaaatggttcatatttgaatgagactcacttttctgatgacattgagcaacaagctgacaacgtacttgggagtcggccat

SEQ ID NO: 429082 - DNA, 140 bp, Artificial Sequence
  Synthetic
atggccgactcccaagtacgttgtcagcttgttgctcaatgtcatcagaaaagtgagtctcattcaaatatgaaccatttgatacaagccaacatttaggcagtgatgttttcccagtaaggagacccagcatggcgtat

SEQ ID NO: 429083 - DNA, 140 bp, Artificial Sequence
  Synthetic
aggccctggctgctgatatgacttgaaattaaggttccttgacttataatgagtgtacctccccataagtgtatttgcattcatgatcaagagtatggacttaaaacactgaaagtattcgaccttttgggacagcggtg

SEQ ID NO: 429084 - DNA, 140 bp, Artificial Sequence
  Synthetic
caccgctgtcccaaaaggtcgaatactttcagtgttttaagtccatactcttgatcatgaatgcaaatacacttatggggaggtacactcattataagtcaaggaaccttaatttcaagtcatatcagcagccagggcct

SEQ ID NO: 429085 - DNA, 140 bp, Artificial Sequence
  Synthetic
aggccctggctgctgatatgaaaggcggtgggtcacgggggcgtccatttacaggacgaccttggggcttgaggttctaaacaccatgtccctggggagaactgctctcaaaactggtatgaccttttgggacagcggtg

SEQ ID NO: 429086 - DNA, 140 bp, Artificial Sequence
  Synthetic
caccgctgtcccaaaaggtcataccagttttgagagcagttctccccagggacatggtgtttagaacctcaagccccaaggtcgtcctgtaaatggacgcccccgtgacccaccgcctttcatatcagcagccagggcct

SEQ ID NO: 429087 - DNA, 140 bp, Artificial Sequence
  Synthetic
aggccctggctgctgatatgatggtctccaacatgttccccccatcaagcatacaagctccagcttttactgcagctcctaagctgaagttgtaaccagaaatgttcaaggagctcttctgaccttttgggacagcggtg

SEQ ID NO: 429088 - DNA, 140 bp, Artificial Sequence
  Synthetic
caccgctgtcccaaaaggtcagaagagctccttgaacatttctggttacaacttcagcttaggagctgcagtaaaagctggagcttgtatgcttgatggggggaacatgttggagaccatcatatcagcagccagggcct

SEQ ID NO: 429089 - DNA, 140 bp, Artificial Sequence
  Synthetic
aggccctggctgctgatatgccttgacaggtcagtaccatattgcgagggagggcttcaatgactgcactggtcaaaccaggttgagcagggaaaagatctgccacatcaatcccatgaggaccttttgggacagcggtg

SEQ ID NO: 429090 - DNA, 140 bp, Artificial Sequence
  Synthetic
caccgctgtcccaaaaggtcctcatgggattgatgtggcagatcttttccctgctcaacctggtttgaccagtgcagtcattgaagccctccctcgcaatatggtactgacctgtcaaggcatatcagcagccagggcct

SEQ ID NO: 429091 - DNA, 140 bp, Artificial Sequence
  Synthetic
atacgccatgctgggtctcctctgtagagcaggaactcaacatcagtgattaattcttcccttatcttgtcaatgagatccttatgatgataatctgacacataagccattatgaagtaccgtacttgggagtcggccat

SEQ ID NO: 429092 - DNA, 140 bp, Artificial Sequence
  Synthetic
atggccgactcccaagtacggtacttcataatggcttatgtgtcagattatcatcataaggatctcattgacaagataagggaagaattaatcactgatgttgagttcctgctctacagaggagacccagcatggcgtat

SEQ ID NO: 429093 - DNA, 140 bp, Artificial Sequence
  Synthetic
aggccctggctgctgatatgttccctccatcaagcatacaagccccagctttcactgcagctcctaagctgaagttgtaaccagaaatgttcaaggagcttttcttagtgtccaccatatgaccttttgggacagcggtg

SEQ ID NO: 429094 - DNA, 140 bp, Artificial Sequence
  Synthetic
caccgctgtcccaaaaggtcatatggtggacactaagaaaagctccttgaacatttctggttacaacttcagcttaggagctgcagtgaaagctggggcttgtatgcttgatggagggaacatatcagcagccagggcct

SEQ ID NO: 429095 - DNA, 140 bp, Artificial Sequence
  Synthetic
aggccctggctgctgatatgaacaagaactcttgacaatatgcttctttgcatctaaccacttgataccttgcgggtccatattcattctgtctcaacttcacggtagaagaagtcttcagaccttttgggacagcggtg

SEQ ID NO: 429096 - DNA, 140 bp, Artificial Sequence
  Synthetic
caccgctgtcccaaaaggtctgaagacttcttctaccgtgaagttgagacagaatgaatatggacccgcaaggtatcaagtggttagatgcaaagaagcatattgtcaagagttcttgttcatatcagcagccagggcct

SEQ ID NO: 429097 - DNA, 140 bp, Artificial Sequence
  Synthetic
atacgccatgctgggtctccattcaaatcaacttgaccttgtttagtgagacatgctaatgtcagactaggcatggtgccgaactggttgttcaaaagatccggattcttaacatcccaccgtacttgggagtcggccat

SEQ ID NO: 429098 - DNA, 140 bp, Artificial Sequence
  Synthetic
atggccgactcccaagtacggtgggatgttaagaatccggatcttttgaacaaccagttcggcaccatgcctagtctgacattagcatgtctcactaaacaaggtcaagttgatttgaatggagacccagcatggcgtat

SEQ ID NO: 429099 - DNA, 140 bp, Artificial Sequence
  Synthetic
aggccctggctgctgatatgtaattaagtcataactgtcagggcaaatcacctccatatcaatcttataatggtccacactgatcccaacatccttcaacgcggtggtagccttcaaaatgaccttttgggacagcggtg

SEQ ID NO: 429100 - DNA, 140 bp, Artificial Sequence
  Synthetic
caccgctgtcccaaaaggtcattttgaaggctaccaccgcgttgaaggatgttgggatcagtgtggaccattataagattgatatggaggtgatttgccctgacagttatgacttaattacatatcagcagccagggcct

SEQ ID NO: 429101 - DNA, 140 bp, Artificial Sequence
  Synthetic
atacgccatgctgggtctcctatttcttttgaggcactcattgccagactgttgtcttagatgcacgcagcagaaagctgagactatctgctgaagtgacaaaagcaaagcgcaatccaacgtacttgggagtcggccat

SEQ ID NO: 429102 - DNA, 140 bp, Artificial Sequence
  Synthetic
atggccgactcccaagtacgttggattgcgctttgcttttgtcacttcagcagatagtctcagctttctgctgcgtgcatctaagacaacagtctggcaatgagtgcctcaaaagaaataggagacccagcatggcgtat

SEQ ID NO: 429103 - DNA, 140 bp, Artificial Sequence
  Synthetic
atacgccatgctgggtctccctttaaggcattgtgtgctgaattctcccagatggggaacaagcaaaccaaagccccagaggtaaaggacagtccgagagctagcctaatcccagatgcccgtacttgggagtcggccat

SEQ ID NO: 429104 - DNA, 140 bp, Artificial Sequence
  Synthetic
atggccgactcccaagtacgggcatctgggattaggctagctctcggactgtcctttacctctggggctttggtttgcttgttccccatctgggagaattcagcacacaatgccttaaagggagacccagcatggcgtat

SEQ ID NO: 429105 - DNA, 140 bp, Artificial Sequence
  Synthetic
atacgccatgctgggtctccatccaccgttttaaatctctttttgttgattccaatgaaactaatctatcgttaacactcacaaaacaggagcccagccaaccagcaaggagcccgtcaccgtacttgggagtcggccat

SEQ ID NO: 429106 - DNA, 140 bp, Artificial Sequence
  Synthetic
atggccgactcccaagtacggtgacgggctccttgctggttggctgggctcctgttttgtgagtgttaacgatagattagtttcattggaatcaacaaaaagagatttaaaacggtggatggagacccagcatggcgtat

SEQ ID NO: 429107 - DNA, 140 bp, Artificial Sequence
  Synthetic
aggccctggctgctgatatggtccagagaaatgacttcacttccttagaagcactcatcttgatctagacactaggggacttgctggttgaaagtatcactcagtaagtcaatgaaaagcgaccttttgggacagcggtg

SEQ ID NO: 429108 - DNA, 140 bp, Artificial Sequence
  Synthetic
caccgctgtcccaaaaggtcgcttttcattgacttactgagtgatactttcaaccagcaagtcccctagtgtctagatcaagatgagtgcttctaaggaagtgaagtcatttctctggaccatatcagcagccagggcct

SEQ ID NO: 429109 - DNA, 140 bp, Artificial Sequence
  Synthetic
atacgccatgctgggtctccgcgcaccggggatcctaggcatttttggtagcgcttcctaagtgtcttttgtgacatggggcaaatagtaacattcttccaagaagtgcctcatgtgatacgtacttgggagtcggccat

SEQ ID NO: 429110 - DNA, 140 bp, Artificial Sequence
  Synthetic
atggccgactcccaagtacgtatcacatgaggcacttcttggaagaatgttactatttgccccatgtcacaaaagacacttaggaagcgctaccaaaaatgcctaggatccccggtgcgcggagacccagcatggcgtat

SEQ ID NO: 429111 - DNA, 140 bp, Artificial Sequence
  Synthetic
aggccctggctgctgatatggtgacatggggcaaatagtaacattcttccaagaagtgcctcatgtgatagaggaggtaatgaatattgtactcatcgcactgtcgataatggcagtactgaccttttgggacagcggtg

SEQ ID NO: 429112 - DNA, 140 bp, Artificial Sequence
  Synthetic
caccgctgtcccaaaaggtcagtactgccattatcgacagtgcgatgagtacaatattcattacctcctctatcacatgaggcacttcttggaagaatgttactatttgccccatgtcaccatatcagcagccagggcct

SEQ ID NO: 429113 - DNA, 140 bp, Artificial Sequence
  Synthetic
atacgccatgctgggtctccgaggaggtaatgaatattgtactcatcgcactgtcgataatggcagtactgaaaggtttgtacaatattgcaacatgtggcctcgtcggtttagttacctcgtacttgggagtcggccat

SEQ ID NO: 429114 - DNA, 140 bp, Artificial Sequence
  Synthetic
atggccgactcccaagtacgaggtaactaaaccgacgaggccacatgttgcaatattgtacaaacctttcagtactgccattatcgacagtgcgatgagtacaatattcattacctcctcggagacccagcatggcgtat

SEQ ID NO: 429115 - DNA, 140 bp, Artificial Sequence
  Synthetic
aggccctggctgctgatatggacaatgtctacccctgaccactgcatccttaaccccagcctgtctatcatcatgtcactcaatgctccaatcagcaggtcagatgaagtgtccccaactgaccttttgggacagcggtg

SEQ ID NO: 429116 - DNA, 140 bp, Artificial Sequence
  Synthetic
caccgctgtcccaaaaggtcagttggggacacttcatctgacctgctgattggagcattgagtgacatgatgatagacaggctggggttaaggatgcagtggtcaggggtagacattgtccatatcagcagccagggcct

SEQ ID NO: 429117 - DNA, 140 bp, Artificial Sequence
  Synthetic
atacgccatgctgggtctcctatgagctgcagaccctggaactgaacatggaaacactcaacatgaccatgcctctctcttgcacaaagaataatagtcaccactatattatggtgggtacgtacttgggagtcggccat

SEQ ID NO: 429118 - DNA, 140 bp, Artificial Sequence
  Synthetic
atggccgactcccaagtacgtacccaccataatatagtggtgactattattctttgtgcaagagagaggcatggtcatgttgagtgtttccatgttcagttccagggtctgcagctcataggagacccagcatggcgtat

SEQ ID NO: 429119 - DNA, 140 bp, Artificial Sequence
  Synthetic
aggccctggctgctgatatggcctctctcttgcacaaagaataatagtcaccactatattatggtgggtaatgagacaggactagaactgaccttaaccaatacaagcattatcaaccacgaccttttgggacagcggtg

SEQ ID NO: 429120 - DNA, 140 bp, Artificial Sequence
  Synthetic
caccgctgtcccaaaaggtcgtggttgataatgcttgtattggttaaggtcagttctagtcctgtctcattacccaccataatatagtggtgactattattctttgtgcaagagagaggccatatcagcagccagggcct

SEQ ID NO: 429121 - DNA, 140 bp, Artificial Sequence
  Synthetic
atacgccatgctgggtctcctcttatgagcataatctcaactttccatttatccattcctaacttcaatcagtatgaggcaatgagctgtgacttcaatgggggaaagatcagtgtgcagcgtacttgggagtcggccat

SEQ ID NO: 429122 - DNA, 140 bp, Artificial Sequence
  Synthetic
atggccgactcccaagtacgctgcacactgatctttcccccattgaagtcacagctcattgcctcatactgattgaagttaggaatggataaatggaaagttgagattatgctcataagaggagacccagcatggcgtat

SEQ ID NO: 429123 - DNA, 140 bp, Artificial Sequence
  Synthetic
aggccctggctgctgatatgagtatgaggcaatgagctgtgacttcaatgggggaaagatcagtgtgcagtacaacctgagtcacagctatgctggagatgcagctaaccattgtggcacgaccttttgggacagcggtg

SEQ ID NO: 429124 - DNA, 140 bp, Artificial Sequence
  Synthetic
caccgctgtcccaaaaggtcgtgccacaatggttagctgcatctccagcatagctgtgactcaggttgtactgcacactgatctttcccccattgaagtcacagctcattgcctcatactcatatcagcagccagggcct

SEQ ID NO: 429125 - DNA, 140 bp, Artificial Sequence
  Synthetic
atacgccatgctgggtctccatgttgatgtgcccttaaaagtgggccccgacaagaccaacctccaacagtctgacaaaacacacggactcactgcacctgagtacatagctgtcacatccgtacttgggagtcggccat

SEQ ID NO: 429126 - DNA, 140 bp, Artificial Sequence
  Synthetic
atggccgactcccaagtacggatgtgacagctatgtactcaggtgcagtgagtccgtgtgttttgtcagactgttggaggttggtcttgtcggggcccacttttaagggcacatcaacatggagacccagcatggcgtat

SEQ ID NO: 429127 - DNA, 140 bp, Artificial Sequence
  Synthetic
aggccctggctgctgatatgaccatcttgtgcatgtgccacataagcaaagttgagaggtagtctcttccctttatatcagcctgtaagtccttcgagaggaaaatcaaattctgcaggagaccttttgggacagcggtg

SEQ ID NO: 429128 - DNA, 140 bp, Artificial Sequence
  Synthetic
caccgctgtcccaaaaggtctcctgcagaatttgattttcctctcgaaggacttacaggctgatataaagggaagagactacctctcaactttgcttatgtggcacatgcacaagatggtcatatcagcagccagggcct

SEQ ID NO: 429129 - DNA, 140 bp, Artificial Sequence
  Synthetic
atacgccatgctgggtctccgttatattgctcttgattcaggccacggtggatgggactgtattatgaccagttatcagtatctaataattcaaaatacaacctgggaagatcactgccacgtacttgggagtcggccat

SEQ ID NO: 429130 - DNA, 140 bp, Artificial Sequence
  Synthetic
atggccgactcccaagtacgtggcagtgatcttcccaggttgtattttgaattattagatactgataactggtcataatacagtcccatccaccgtggcctgaatcaagagcaatataacggagacccagcatggcgtat

SEQ ID NO: 429131 - DNA, 140 bp, Artificial Sequence
  Synthetic
aggccctggctgctgatatgagttatcagtatctaataattcaaaatacaacctgggaagatcactgccaattcacaagaccatctcccatcggttatcttgggctcctctcacaaagaagaccttttgggacagcggtg

SEQ ID NO: 429132 - DNA, 140 bp, Artificial Sequence
  Synthetic
caccgctgtcccaaaaggtcttctttgtgagaggagcccaagataaccgatgggagatggtcttgtgaattggcagtgatcttcccaggttgtattttgaattattagatactgataactcatatcagcagccagggcct

SEQ ID NO: 429133 - DNA, 140 bp, Artificial Sequence
  Synthetic
atacgccatgctgggtctccctgtcagattctgaagggaatgacacaccaggggggtattgtttgactagatggatgctaattgaagctgagttgaagtgctttggcaatacagctgttgcgtacttgggagtcggccat

SEQ ID NO: 429134 - DNA, 140 bp, Artificial Sequence
  Synthetic
atggccgactcccaagtacgcaacagctgtattgccaaagcacttcaactcagcttcaattagcatccatctagtcaaacaatacccccctggtgtgtcattcccttcagaatctgacagggagacccagcatggcgtat

SEQ ID NO: 429135 - DNA, 140 bp, Artificial Sequence
  Synthetic
aggccctggctgctgatatgttgctggctagatccaaggctgtggcacagccactggtgatgagaggatctttgatttccctttttacttccttctccttaaatagtgaaccattgttaagaccttttgggacagcggtg

SEQ ID NO: 429136 - DNA, 140 bp, Artificial Sequence
  Synthetic
caccgctgtcccaaaaggtcttaacaatggttcactatttaaggagaaggaagtaaaaagggaaatcaaagatcctctcatcaccagtggctgtgccacagccttggatctagccagcaacatatcagcagccagggcct

SEQ ID NO: 429137 - DNA, 140 bp, Artificial Sequence
  Synthetic
aggccctggctgctgatatggtttagtacaggacaaattcttgtaaaggcatagaagaaacaaaaggcaatcaaagacaatcaaattggatagccttaatgcctaggatcctcggtgcgcgaccttttgggacagcggtg

SEQ ID NO: 429138 - DNA, 140 bp, Artificial Sequence
  Synthetic
caccgctgtcccaaaaggtcgcgcaccgaggatcctaggcattaaggctatccaatttgattgtctttgattgccttttgtttcttctatgcctttacaagaatttgtcctgtactaaaccatatcagcagccagggcct

SEQ ID NO: 429139 - DNA, 140 bp, Artificial Sequence
  Synthetic
atacgccatgctgggtctccgagtattcaattaatcaacaaagcagtgaatgccctgataaatgatcaactaataatgaaaaaccatttacgggacattatgggaattccatactgtaaccgtacttgggagtcggccat

SEQ ID NO: 429140 - DNA, 140 bp, Artificial Sequence
  Synthetic
atggccgactcccaagtacggttacagtatggaattcccataatgtcccgtaaatggtttttcattattagttgatcatttatcagggcattcactgctttgttgattaattgaatactcggagacccagcatggcgtat

SEQ ID NO: 429141 - DNA, 140 bp, Artificial Sequence
  Synthetic
aggccctggctgctgatatgtaataatgaaaaaccatttacgggacattatgggaattccatactgtaactacagcaagtattggtatcttaaccacacaaccaccggaagaacatcattgaccttttgggacagcggtg

SEQ ID NO: 429142 - DNA, 140 bp, Artificial Sequence
  Synthetic
caccgctgtcccaaaaggtcaatgatgttcttccggtggttgtgtggttaagataccaatacttgctgtagttacagtatggaattcccataatgtcccgtaaatggtttttcattattacatatcagcagccagggcct

SEQ ID NO: 429143 - DNA, 140 bp, Artificial Sequence
  Synthetic
aggccctggctgctgatatgcgagggagggcttcaatgactgcactggttaatccaggttgagcagggaaaagatctgttacatcaatcccatgagaatatttggcatcttgcttgaactgaccttttgggacagcggtg

SEQ ID NO: 429144 - DNA, 140 bp, Artificial Sequence
  Synthetic
caccgctgtcccaaaaggtcagttcaagcaagatgccaaatattctcatgggattgatgtaacagatcttttccctgctcaacctggattaaccagtgcagtcattgaagccctccctcgcatatcagcagccagggcct

SEQ ID NO: 429145 - DNA, 140 bp, Artificial Sequence
  Synthetic
atacgccatgctgggtctcctctcagatgacattgaacagcaggctgacaacatgattactgagatgttacaaaaggagtacatggagagacaggggaaaacaccattgggtttggttgacgtacttgggagtcggccat

SEQ ID NO: 429146 - DNA, 140 bp, Artificial Sequence
  Synthetic
atggccgactcccaagtacgtcaaccaaacccaatggtgttttcccctgtctctccatgtactccttttgtaacatctcagtaatcatgttgtcagcctgctgttcaatgtcatctgagaggagacccagcatggcgtat

SEQ ID NO: 429147 - DNA, 140 bp, Artificial Sequence
  Synthetic
atacgccatgctgggtctccctatagagcagaaactcaacatcagttattaattcttcccttattttttcaataaggtccttatgatgataatctgacacataagccattacaaagtacccgtacttgggagtcggccat

SEQ ID NO: 429148 - DNA, 140 bp, Artificial Sequence
  Synthetic
atggccgactcccaagtacgggtactttgtaatggcttatgtgtcagattatcatcataaggaccttattgaaaaaataagggaagaattaataactgatgttgagtttctgctctatagggagacccagcatggcgtat

SEQ ID NO: 429149 - DNA, 140 bp, Artificial Sequence
  Synthetic
atacgccatgctgggtctcctgatcaaaataccaactcacaggcatattgtgggcaaaccatgtcccaaacctcacaggttaaaccacatgggtgtttgctcctgtggactctataagcacgtacttgggagtcggccat

SEQ ID NO: 429150 - DNA, 140 bp, Artificial Sequence
  Synthetic
atggccgactcccaagtacgtgcttatagagtccacaggagcaaacacccatgtggtttaacctgtgaggtttgggacatggtttgcccacaatatgcctgtgagttggtattttgatcaggagacccagcatggcgtat

SEQ ID NO: 429151 - DNA, 140 bp, Artificial Sequence
  Synthetic
atacgccatgctgggtctccacaaagtcatactccgtaaactgcagcttttccatatcaacaacaatctcaacaggggtcacatgccctagttgatttgtgtcagttaaaaactcattaacgtacttgggagtcggccat

SEQ ID NO: 429152 - DNA, 140 bp, Artificial Sequence
  Synthetic
atggccgactcccaagtacgttaatgagtttttaactgacacaaatcaactagggcatgtgacccctgttgagattgttgttgatatggaaaagctgcagtttacggagtatgactttgtggagacccagcatggcgtat

SEQ ID NO: 429153 - DNA, 140 bp, Artificial Sequence
  Synthetic
aggccctggctgctgatatgtaaccacactctcacttccactcccatttctaagctctgacggaacttgccaatattgaacaccattgggatttgtcaacaatttgattcccttgatatcgaccttttgggacagcggtg

SEQ ID NO: 429154 - DNA, 140 bp, Artificial Sequence
  Synthetic
caccgctgtcccaaaaggtcgatatcaagggaatcaaattgttgacaaatcccaatggtgttcaatattggcaagttccgtcagagcttagaaatgggagtggaagtgagagtgtggttacatatcagcagccagggcct

SEQ ID NO: 429155 - DNA, 140 bp, Artificial Sequence
  Synthetic
aggccctggctgctgatatggcagtccattagggcacagtgaggggttatttcctctttaccacctcttttcttcttttcaacaacgattcctgtgtgcatattgcataggtctttatacgaccttttgggacagcggtg

SEQ ID NO: 429156 - DNA, 140 bp, Artificial Sequence
  Synthetic
caccgctgtcccaaaaggtcgtataaagacctatgcaatatgcacacaggaatcgttgttgaaaagaagaaaagaggtggtaaagaggaaataacccctcactgtgccctaatggactgccatatcagcagccagggcct

SEQ ID NO: 429157 - DNA, 140 bp, Artificial Sequence
  Synthetic
atacgccatgctgggtctccaatgtcaatgagtttgatatcctttcttccctgtgattctaggagtttccttatgtcatcagatccctgacaagtaatgaccatattccgggggagtgcacgtacttgggagtcggccat

SEQ ID NO: 429158 - DNA, 140 bp, Artificial Sequence
  Synthetic
atggccgactcccaagtacgtgcactcccccggaatatggtcattacttgtcagggatctgatgacataaggaaactcctagaatcacagggaagaaaggatatcaaactcattgacattggagacccagcatggcgtat

SEQ ID NO: 429159 - DNA, 140 bp, Artificial Sequence
  Synthetic
atacgccatgctgggtctccccaagaatactcaaggtcagactcagacgggggctcaacatctaatagctcacaaaggttccttaatgaagagaggtgctcactagacaaatagtttgttcgtacttgggagtcggccat

SEQ ID NO: 429160 - DNA, 140 bp, Artificial Sequence
  Synthetic
atggccgactcccaagtacgaacaaactatttgtctagtgagcacctctcttcattaaggaacctttgtgagctattagatgttgagcccccgtctgagtctgaccttgagtattcttggggagacccagcatggcgtat

SEQ ID NO: 429161 - DNA, 140 bp, Artificial Sequence
  Synthetic
aggccctggctgctgatatgtgggttcacggaagaagtgaatgtaacaacctgaacttggctgatagagggcaatttccactggatcttcgggccttccctcaatgtccatccaggtcttgaccttttgggacagcggtg

SEQ ID NO: 429162 - DNA, 140 bp, Artificial Sequence
  Synthetic
caccgctgtcccaaaaggtcaagacctggatggacattgagggaaggcccgaagatccagtggaaattgccctctatcagccaagttcaggttgttacattcacttcttccgtgaacccacatatcagcagccagggcct

SEQ ID NO: 429163 - DNA, 140 bp, Artificial Sequence
  Synthetic
atacgccatgctgggtctccaataagtgagcccagcagtgaaccctgccgactgtagggatttgttggagttgttgcccccagctttctgtggtttcccgtctgattccaaatcaacgaccgtacttgggagtcggccat

SEQ ID NO: 429164 - DNA, 140 bp, Artificial Sequence
  Synthetic
atggccgactcccaagtacggtcgttgatttggaatcagacgggaaaccacagaaagctgggggcaacaactccaacaaatccctacagtcggcagggttcactgctgggctcacttattggagacccagcatggcgtat

SEQ ID NO: 429165 - DNA, 140 bp, Artificial Sequence
  Synthetic
aggccctggctgctgatatgttgttgcccccagctttctgtggtttcccgtctgattccaaatcaacgacagtgttttcccaggcccttcctgttatagaagttcttgatgcaatatacggaccttttgggacagcggtg

SEQ ID NO: 429166 - DNA, 140 bp, Artificial Sequence
  Synthetic
caccgctgtcccaaaaggtccgtatattgcatcaagaacttctataacaggaagggcctgggaaaacactgtcgttgatttggaatcagacgggaaaccacagaaagctgggggcaacaacatatcagcagccagggcct

SEQ ID NO: 429167 - DNA, 140 bp, Artificial Sequence
  Synthetic
aggccctggctgctgatatgtgtggctctttacactttatattgtgaagagctgctgcaacgaactttgtcaacaatggcacttcatctccccaaacaaaaaatctagatttaaactctggaccttttgggacagcggtg

SEQ ID NO: 429168 - DNA, 140 bp, Artificial Sequence
  Synthetic
caccgctgtcccaaaaggtccagagtttaaatctagattttttgtttggggagatgaagtgccattgttgacaaagttcgttgcagcagctcttcacaatataaagtgtaaagagccacacatatcagcagccagggcct

SEQ ID NO: 429169 - DNA, 140 bp, Artificial Sequence
  Synthetic
aggccctggctgctgatatgctttagaatggacttgaggatgccatccattgtctgaggtgacaccttgattgtctccagcatgttaccaccatccaacatgcaagctcctgccttcacagaccttttgggacagcggtg

SEQ ID NO: 429170 - DNA, 140 bp, Artificial Sequence
  Synthetic
caccgctgtcccaaaaggtctgtgaaggcaggagcttgcatgttggatggtggtaacatgctggagacaatcaaggtgtcacctcagacaatggatggcatcctcaagtccattctaaagcatatcagcagccagggcct

SEQ ID NO: 429171 - DNA, 140 bp, Artificial Sequence
  Synthetic
aggccctggctgctgatatgttgtctccagcatgttaccaccatccaacatgcaagctcctgccttcacagccgcacccaagctaaaattataacctgagatgttcaaggaacttttattgaccttttgggacagcggtg

SEQ ID NO: 429172 - DNA, 140 bp, Artificial Sequence
  Synthetic
caccgctgtcccaaaaggtcaataaaagttccttgaacatctcaggttataattttagcttgggtgcggctgtgaaggcaggagcttgcatgttggatggtggtaacatgctggagacaacatatcagcagccagggcct

SEQ ID NO: 429173 - DNA, 140 bp, Artificial Sequence
  Synthetic
aggccctggctgctgatatgttggaagcactcatcttggtctggatgctttggggtttactggttgaaagtatcaaacagtaagtcaatgaaaagcgcaatccaatagcctaggatccacgaccttttgggacagcggtg

SEQ ID NO: 429174 - DNA, 140 bp, Artificial Sequence
  Synthetic
caccgctgtcccaaaaggtcgtggatcctaggctattggattgcgcttttcattgacttactgtttgatactttcaaccagtaaaccccaaagcatccagaccaagatgagtgcttccaacatatcagcagccagggcct

SEQ ID NO: 429175 - DNA, 140 bp, Artificial Sequence
  Synthetic
atacgccatgctgggtctcccggaggtgttagggtactttgctgtgtagatcaagcccaaatctgtcaatgcttgcaccacatcattcaagtcaacctgcccctgcttcgttaaacatgccgtacttgggagtcggccat

SEQ ID NO: 429176 - DNA, 140 bp, Artificial Sequence
  Synthetic
atggccgactcccaagtacggcatgtttaacgaagcaggggcaggttgacttgaatgatgtggtgcaagcattgacagatttgggcttgatctacacagcaaagtaccctaacacctccgggagacccagcatggcgtat

SEQ ID NO: 429177 - DNA, 140 bp, Artificial Sequence
  Synthetic
atacgccatgctgggtctccaaacatttctaaatcttgatcttgaatagatggtgaaaatgtggctaccctcctatcagattcccacagtgctcccctacatacaaccaatggcactggtcgtacttgggagtcggccat

SEQ ID NO: 429178 - DNA, 140 bp, Artificial Sequence
  Synthetic
atggccgactcccaagtacgaccagtgccattggttgtatgtaggggagcactgtgggaatctgataggagggtagccacattttcaccatctattcaagatcaagatttagaaatgtttggagacccagcatggcgtat

SEQ ID NO: 429179 - DNA, 140 bp, Artificial Sequence
  Synthetic
aggccctggctgctgatatggccaaatcaacaaaagtcgatgaacatcaaagagctcatctagtgccagatgcatcccatctaggcccccagttttgcaaaagttgctggtttgagaacagaccttttgggacagcggtg

SEQ ID NO: 429180 - DNA, 140 bp, Artificial Sequence
  Synthetic
caccgctgtcccaaaaggtctgttctcaaaccagcaacttttgcaaaactgggggcctagatgggatgcatctggcactagatgagctctttgatgttcatcgacttttgttgatttggccatatcagcagccagggcct

SEQ ID NO: 429181 - DNA, 140 bp, Artificial Sequence
  Synthetic
atacgccatgctgggtctcccaccgacttggaaattagagtaaaagaaatcttctgttattgactgtttagttttcttccttaaccctagttgagctttaatgaaagacttcatcatagccgtacttgggagtcggccat

SEQ ID NO: 429182 - DNA, 140 bp, Artificial Sequence
  Synthetic
atggccgactcccaagtacggctatgatgaagtctttcattaaagctcaactagggttaaggaagaaaactaaacagtcaataacagaagatttcttttactctaatttccaagtcggtgggagacccagcatggcgtat

SEQ ID NO: 429183 - DNA, 140 bp, Artificial Sequence
  Synthetic
atacgccatgctgggtctcctgattaccaccactcatccctatcatgttcagaagagctcgcctctgatctagctgttgtgtgcttaagttgcccatataaacacctgcactcaatggcccgtacttgggagtcggccat

SEQ ID NO: 429184 - DNA, 140 bp, Artificial Sequence
  Synthetic
atggccgactcccaagtacgggccattgagtgcaggtgtttatatgggcaacttaagcacacaacagctagatcagaggcgagctcttctgaacatgatagggatgagtggtggtaatcaggagacccagcatggcgtat

SEQ ID NO: 429185 - DNA, 140 bp, Artificial Sequence
  Synthetic
aggccctggctgctgatatgtagctgttgtgtgcttaagttgcccatataaacacctgcactcaatggcctctctgttctggtaacttttgacttcaatttctctaggtcagcagccagagaccttttgggacagcggtg

SEQ ID NO: 429186 - DNA, 140 bp, Artificial Sequence
  Synthetic
caccgctgtcccaaaaggtctctggctgctgacctagagaaattgaagtcaaaagttaccagaacagagaggccattgagtgcaggtgtttatatgggcaacttaagcacacaacagctacatatcagcagccagggcct

SEQ ID NO: 429187 - DNA, 140 bp, Artificial Sequence
  Synthetic
aggccctggctgctgatatggtagggttgagagatagtccctcccttttatgtcagcttgcaagtcctttgagaggaaaattaagttctgtaagacagtcaagaataaaaatggacacatgaccttttgggacagcggtg

SEQ ID NO: 429188 - DNA, 140 bp, Artificial Sequence
  Synthetic
caccgctgtcccaaaaggtcatgtgtccatttttattcttgactgtcttacagaacttaattttcctctcaaaggacttgcaagctgacataaaagggagggactatctctcaaccctaccatatcagcagccagggcct

SEQ ID NO: 429189 - DNA, 140 bp, Artificial Sequence
  Synthetic
atacgccatgctgggtctccttgagttgatttcagctcaacaagattgttgactgcctgatttagatcccttaatcgtttcagatcattgtcatctcttctctgtttgcgcatcagccgtcgtacttgggagtcggccat

SEQ ID NO: 429190 - DNA, 140 bp, Artificial Sequence
  Synthetic
atggccgactcccaagtacgacggctgatgcgcaaacagagaagagatgacaatgatctgaaacgattaagggatctaaatcaggcagtcaacaatcttgttgagctgaaatcaactcaaggagacccagcatggcgtat

SEQ ID NO: 429191 - DNA, 140 bp, Artificial Sequence
  Synthetic
atacgccatgctgggtctcctattaccacccacttgttctttgtatgataaagaaaatttaagcctccctgtgtcaggccccactgagtcataggattgtggcgactcttggctatagaacgtacttgggagtcggccat

SEQ ID NO: 429192 - DNA, 140 bp, Artificial Sequence
  Synthetic
atggccgactcccaagtacgttctatagccaagagtcgccacaatcctatgactcagtggggcctgacacagggaggcttaaattttctttatcatacaaagaacaagtgggtggtaataggagacccagcatggcgtat

SEQ ID NO: 429193 - DNA, 140 bp, Artificial Sequence
  Synthetic
aggccctggctgctgatatgattgccaagttgttgtgttgtctatacacagcagggagctgatgctacctactagaatgaacaaagcaaagcgcaatccaatagcctaggatccactgtggaccttttgggacagcggtg

SEQ ID NO: 429194 - DNA, 140 bp, Artificial Sequence
  Synthetic
caccgctgtcccaaaaggtccacagtggatcctaggctattggattgcgctttgctttgttcattctagtaggtagcatcagctccctgctgtgtatagacaacacaacaacttggcaatcatatcagcagccagggcct

SEQ ID NO: 429195 - DNA, 140 bp, Artificial Sequence
  Synthetic
atacgccatgctgggtctcccgcaccggggatcctaggcaatttagttgttcttcttttgaggccttgtgtgctgaattccaccaaatggggaacaagcaagccagggctccagaagcgacgtacttgggagtcggccat

SEQ ID NO: 429196 - DNA, 140 bp, Artificial Sequence
  Synthetic
atggccgactcccaagtacgtcgcttctggagccctggcttgcttgttccccatttggtggaattcagcacacaaggcctcaaaagaagaacaactaaattgcctaggatccccggtgcgggagacccagcatggcgtat

SEQ ID NO: 429197 - DNA, 140 bp, Artificial Sequence
  Synthetic
aggccctggctgctgatatgtgctgaattccaccaaatggggaacaagcaagccagggctccagaagcgaaggacagcccgagggccagtctgatcccagatgctacacacctagggccagaccttttgggacagcggtg

SEQ ID NO: 429198 - DNA, 140 bp, Artificial Sequence
  Synthetic
caccgctgtcccaaaaggtctggccctaggtgtgtagcatctgggatcagactggccctcgggctgtccttcgcttctggagccctggcttgcttgttccccatttggtggaattcagcacatatcagcagccagggcct

SEQ ID NO: 429199 - DNA, 140 bp, Artificial Sequence
  Synthetic
atacgccatgctgggtctccagtgtactttcccataagtgtatttgcattcatgatcagaagtatggacttgaaacattgaaagtattcgtggttaaagtatgtccttgttgatactgctcgtacttgggagtcggccat

SEQ ID NO: 429200 - DNA, 140 bp, Artificial Sequence
  Synthetic
atggccgactcccaagtacgagcagtatcaacaaggacatactttaaccacgaatactttcaatgtttcaagtccatacttctgatcatgaatgcaaatacacttatgggaaagtacactggagacccagcatggcgtat

SEQ ID NO: 429201 - DNA, 140 bp, Artificial Sequence
  Synthetic
aggccctggctgctgatatgtgaaacattgaaagtattcgtggttaaagtatgtccttgttgatactgcttttgtcaactccccaataggacactgcgacatatgtccacagtaaaaatagaccttttgggacagcggtg

SEQ ID NO: 429202 - DNA, 140 bp, Artificial Sequence
  Synthetic
caccgctgtcccaaaaggtctatttttactgtggacatatgtcgcagtgtcctattggggagttgacaaaagcagtatcaacaaggacatactttaaccacgaatactttcaatgtttcacatatcagcagccagggcct

SEQ ID NO: 429203 - DNA, 140 bp, Artificial Sequence
  Synthetic
atacgccatgctgggtctccgcaggtgccccatctgcaagatgcccctccccacaagactgagaccatcagccatcccaacggcacccccagccgggacgggagacagcagcagaccccccgtacttgggagtcggccat

SEQ ID NO: 429204 - DNA, 140 bp, Artificial Sequence
  Synthetic
atggccgactcccaagtacggggggtctgctgctgtctcccgtcccggctgggggtgccgttgggatggctgatggtctcagtcttgtggggaggggcatcttgcagatggggcacctgcggagacccagcatggcgtat

SEQ ID NO: 429205 - DNA, 140 bp, Artificial Sequence
  Synthetic
aggccctggctgctgatatggccatcccaacggcacccccagccgggacgggagacagcagcagacccccaccctacagcccctgagccgcccaccgacccccaccatccctccgtccccgaccttttgggacagcggtg

SEQ ID NO: 429206 - DNA, 140 bp, Artificial Sequence
  Synthetic
caccgctgtcccaaaaggtcggggacggagggatggtgggggtcggtgggcggctcaggggctgtagggtgggggtctgctgctgtctcccgtcccggctgggggtgccgttgggatggccatatcagcagccagggcct

SEQ ID NO: 429207 - DNA, 140 bp, Artificial Sequence
  Synthetic
atacgccatgctgggtctcccacctccgaaaagctactctatgtcctcaacatgctcatccttttcaatcagctcctcacatgttctgccttttagtctcagcctgccactacttgattgcgtacttgggagtcggccat

SEQ ID NO: 429208 - DNA, 140 bp, Artificial Sequence
  Synthetic
atggccgactcccaagtacgcaatcaagtagtggcaggctgagactaaaaggcagaacatgtgaggagctgattgaaaaggatgagcatgttgaggacatagagtagcttttcggaggtgggagacccagcatggcgtat

SEQ ID NO: 429209 - DNA, 140 bp, Artificial Sequence
  Synthetic
aggccctggctgctgatatgagctcctcacatgttctgccttttagtctcagcctgccactacttgattgcaccatcaccctcctccttgacttactgtagcagagggcataacctttgagaccttttgggacagcggtg

SEQ ID NO: 429210 - DNA, 140 bp, Artificial Sequence
  Synthetic
caccgctgtcccaaaaggtctcaaaggttatgccctctgctacagtaagtcaaggaggagggtgatggtgcaatcaagtagtggcaggctgagactaaaaggcagaacatgtgaggagctcatatcagcagccagggcct

SEQ ID NO: 429211 - DNA, 140 bp, Artificial Sequence
  Synthetic
atacgccatgctgggtctcctgctcattacctgctgcactttgtattcataatcctgcttgttgagtagatacttcccctttcttgagaagacctcggtaagctgcgacacagccagcgccgtacttgggagtcggccat

SEQ ID NO: 429212 - DNA, 140 bp, Artificial Sequence
  Synthetic
atggccgactcccaagtacggcgctggctgtgtcgcagcttaccgaggtcttctcaagaaaggggaagtatctactcaacaagcaggattatgaatacaaagtgcagcaggtaatgagcaggagacccagcatggcgtat

SEQ ID NO: 429213 - DNA, 140 bp, Artificial Sequence
  Synthetic
atacgccatgctgggtctccctattcggtgctgcaaccctcaacgtggagacaatgtccactcctgaccactgcattcttaaacccagcctgtctgtcatcatgtcactcagtgccccaacgtacttgggagtcggccat

SEQ ID NO: 429214 - DNA, 140 bp, Artificial Sequence
  Synthetic
atggccgactcccaagtacgttggggcactgagtgacatgatgacagacaggctgggtttaagaatgcagtggtcaggagtggacattgtctccacgttgagggttgcagcaccgaatagggagacccagcatggcgtat

SEQ ID NO: 429215 - DNA, 140 bp, Artificial Sequence
  Synthetic
aggccctggctgctgatatgctgcattcttaaacccagcctgtctgtcatcatgtcactcagtgccccaatcagcaagtcagatgaagtgtccccaacttctcttacaaacatttcaagagaccttttgggacagcggtg

SEQ ID NO: 429216 - DNA, 140 bp, Artificial Sequence
  Synthetic
caccgctgtcccaaaaggtctcttgaaatgtttgtaagagaagttggggacacttcatctgacttgctgattggggcactgagtgacatgatgacagacaggctgggtttaagaatgcagcatatcagcagccagggcct

SEQ ID NO: 429217 - DNA, 140 bp, Artificial Sequence
  Synthetic
atacgccatgctgggtctccccataagcctcccctatgcacaaccagagggactggttcagtgcaagggcctaccagtacaaagtcatactccgtaaactgcagcttctccatgtcaacgcgtacttgggagtcggccat

SEQ ID NO: 429218 - DNA, 140 bp, Artificial Sequence
  Synthetic
atggccgactcccaagtacgcgttgacatggagaagctgcagtttacggagtatgactttgtactggtaggcccttgcactgaaccagtccctctggttgtgcataggggaggcttatggggagacccagcatggcgtat

SEQ ID NO: 429219 - DNA, 140 bp, Artificial Sequence
  Synthetic
aggccctggctgctgatatgctaccagtacaaagtcatactccgtaaactgcagcttctccatgtcaacggcaatttcaacaggagtgacatgccctagttgatttgtgtcaaccagaaagaccttttgggacagcggtg

SEQ ID NO: 429220 - DNA, 140 bp, Artificial Sequence
  Synthetic
caccgctgtcccaaaaggtctttctggttgacacaaatcaactagggcatgtcactcctgttgaaattgccgttgacatggagaagctgcagtttacggagtatgactttgtactggtagcatatcagcagccagggcct

SEQ ID NO: 429221 - DNA, 140 bp, Artificial Sequence
  Synthetic
atacgccatgctgggtctccccggggatcctaggcaatttagctggacttcagtggtaaggctcttcttagtgaatccctgaatcaagtgcccagccgaaatgggcaacagacaggctaacgtacttgggagtcggccat

SEQ ID NO: 429222 - DNA, 140 bp, Artificial Sequence
  Synthetic
atggccgactcccaagtacgttagcctgtctgttgcccatttcggctgggcacttgattcagggattcactaagaagagccttaccactgaagtccagctaaattgcctaggatccccggggagacccagcatggcgtat

SEQ ID NO: 429223 - DNA, 140 bp, Artificial Sequence
  Synthetic
aggccctggctgctgatatgctccgtggctgtatctgcaggattggtgctcacatgaccaaatctcacttttggttccaggaacttctcaaaacactttatctggtctgtcaacctatctgaccttttgggacagcggtg

SEQ ID NO: 429224 - DNA, 140 bp, Artificial Sequence
  Synthetic
caccgctgtcccaaaaggtcagataggttgacagaccagataaagtgttttgagaagttcctggaaccaaaagtgagatttggtcatgtgagcaccaatcctgcagatacagccacggagcatatcagcagccagggcct

SEQ ID NO: 429225 - DNA, 140 bp, Artificial Sequence
  Synthetic
atacgccatgctgggtctcctaggtcctgatagaaccaacctccaacagtctgataagacacatggactcactgcaccagaatacatagcagtcacatcatacaccaaatacttgccctgcgtacttgggagtcggccat

SEQ ID NO: 429226 - DNA, 140 bp, Artificial Sequence
  Synthetic
atggccgactcccaagtacgcagggcaagtatttggtgtatgatgtgactgctatgtattctggtgcagtgagtccatgtgtcttatcagactgttggaggttggttctatcaggacctaggagacccagcatggcgtat

SEQ ID NO: 429227 - DNA, 140 bp, Artificial Sequence
  Synthetic
atacgccatgctgggtctcccttgaacctattagtcatcatgcttttcacatcctcagataaaaccagattcatcagtgtccttattaatttatagagcagaaactcaacatcggtgattcgtacttgggagtcggccat

SEQ ID NO: 429228 - DNA, 140 bp, Artificial Sequence
  Synthetic
atggccgactcccaagtacgaatcaccgatgttgagtttctgctctataaattaataaggacactgatgaatctggttttatctgaggatgtgaaaagcatgatgactaataggttcaagggagacccagcatggcgtat

SEQ ID NO: 429229 - DNA, 140 bp, Artificial Sequence
  Synthetic
atacgccatgctgggtctccaactagcatcttgacttttaatgcggaacctcactgtctgacttagttttgcagaccctgaaggtagtaatgcaacagcatcaaagaaatcctccaatgacgtacttgggagtcggccat

SEQ ID NO: 429230 - DNA, 140 bp, Artificial Sequence
  Synthetic
atggccgactcccaagtacgtcattggaggatttctttgatgctgttgcattactaccttcagggtctgcaaaactaagtcagacagtgaggttccgcattaaaagtcaagatgctagttggagacccagcatggcgtat

SEQ ID NO: 429231 - DNA, 140 bp, Artificial Sequence
  Synthetic
aggccctggctgctgatatgatctgagcttgttttggttccccgagcacccatgctccaagttctatggctgtagatagtgttatgcacatataatcccatagaagaggtcttaaataaggaccttttgggacagcggtg

SEQ ID NO: 429232 - DNA, 140 bp, Artificial Sequence
  Synthetic
caccgctgtcccaaaaggtccttatttaagacctcttctatgggattatatgtgcataacactatctacagccatagaacttggagcatgggtgctcggggaaccaaaacaagctcagatcatatcagcagccagggcct

SEQ ID NO: 429233 - DNA, 140 bp, Artificial Sequence
  Synthetic
atacgccatgctgggtctccataagccattacgaagtacctaagattttggagaagcttttgagaacgtttactagggtgagctaaaattaaaatcaatatcatctttgtcaaagacctgcgtacttgggagtcggccat

SEQ ID NO: 429234 - DNA, 140 bp, Artificial Sequence
  Synthetic
atggccgactcccaagtacgcaggtctttgacaaagatgatattgattttaattttagctcaccctagtaaacgttctcaaaagcttctccaaaatcttaggtacttcgtaatggcttatggagacccagcatggcgtat

SEQ ID NO: 429235 - DNA, 140 bp, Artificial Sequence
  Synthetic
aggccctggctgctgatatgatctagctggttcaatgtcaaagtctatccaggcataacccatcataagatcatgtttgaacattggcctctcaacacccttgtgaataaccttctctacgaccttttgggacagcggtg

SEQ ID NO: 429236 - DNA, 140 bp, Artificial Sequence
  Synthetic
caccgctgtcccaaaaggtcgtagagaaggttattcacaagggtgttgagaggccaatgttcaaacatgatcttatgatgggttatgcctggatagactttgacattgaaccagctagatcatatcagcagccagggcct

SEQ ID NO: 429237 - DNA, 140 bp, Artificial Sequence
  Synthetic
atacgccatgctgggtctccatgtcttgtgtggaaaccacgtgaaggaccccaatgtccttgttgtagcaacaaatggtctcacatatgattcaaagtagatctgtctcatgaaattgtccgtacttgggagtcggccat

SEQ ID NO: 429238 - DNA, 140 bp, Artificial Sequence
  Synthetic
atggccgactcccaagtacggacaatttcatgagacagatctactttgaatcatatgtgagaccatttgttgctacaacaaggacattggggtccttcacgtggtttccacacaagacatggagacccagcatggcgtat

SEQ ID NO: 429239 - DNA, 140 bp, Artificial Sequence
  Synthetic
aggccctggctgctgatatgacaaatggtctcacatatgattcaaagtagatctgtctcatgaaattgtcaacagcatcactagtactcaccactctttcctctaccatgggttcatgtggaccttttgggacagcggtg

SEQ ID NO: 429240 - DNA, 140 bp, Artificial Sequence
  Synthetic
caccgctgtcccaaaaggtccacatgaacccatggtagaggaaagagtggtgagtactagtgatgctgttgacaatttcatgagacagatctactttgaatcatatgtgagaccatttgtcatatcagcagccagggcct

SEQ ID NO: 429241 - DNA, 140 bp, Artificial Sequence
  Synthetic
aggccctggctgctgatatgatctgaccacttgataccttgcgggtccaaattcgttctgtctcaactttacggtagaagaagtcttcatagagttcaccaaggcgagactcaatgaggagaccttttgggacagcggtg

SEQ ID NO: 429242 - DNA, 140 bp, Artificial Sequence
  Synthetic
caccgctgtcccaaaaggtctcctcattgagtctcgccttggtgaactctatgaagacttcttctaccgtaaagttgagacagaacgaatttggacccgcaaggtatcaagtggtcagatcatatcagcagccagggcct

SEQ ID NO: 429243 - DNA, 140 bp, Artificial Sequence
  Synthetic
atacgccatgctgggtctcctctcttttccattttactatgtgtgagacaagagataaggcttcacagttgacatccaatgctacacaaagatccaaaaattttatcctgggtgaccattcgtacttgggagtcggccat

SEQ ID NO: 429244 - DNA, 140 bp, Artificial Sequence
  Synthetic
atggccgactcccaagtacgaatggtcacccaggataaaatttttggatctttgtgtagcattggatgtcaactgtgaagccttatctcttgtctcacacatagtaaaatggaaaagagaggagacccagcatggcgtat

SEQ ID NO: 429245 - DNA, 140 bp, Artificial Sequence
  Synthetic
atacgccatgctgggtctccaaggaaatgttccttcttctgccctctgataactgattgtgggaacaaccccagagatatcgaagtccataatcaagtcataactgtcaaggcaaattaccgtacttgggagtcggccat

SEQ ID NO: 429246 - DNA, 140 bp, Artificial Sequence
  Synthetic
atggccgactcccaagtacggtaatttgccttgacagttatgacttgattatggacttcgatatctctggggttgttcccacaatcagttatcagagggcagaagaaggaacatttccttggagacccagcatggcgtat

SEQ ID NO: 429247 - DNA, 140 bp, Artificial Sequence
  Synthetic
aggccctggctgctgatatggataaggtctttagcattggcaatgtcttcctccatcgccaattgtggcacctgtgttggctttaggcttatgcctgtgtggcttgtaaatcagctagtggaccttttgggacagcggtg

SEQ ID NO: 429248 - DNA, 140 bp, Artificial Sequence
  Synthetic
caccgctgtcccaaaaggtccactagctgatttacaagccacacaggcataagcctaaagccaacacaggtgccacaattggcgatggaggaagacattgccaatgctaaagaccttatccatatcagcagccagggcct

SEQ ID NO: 429249 - DNA, 140 bp, Artificial Sequence
  Synthetic
atacgccatgctgggtctcccacaagggttgtgcttgaagaaatccagtgccttgactatcttcggttcacctaaaacccatgcgcccaattctattgcagttgacaaagaaatacacatcgtacttgggagtcggccat

SEQ ID NO: 429250 - DNA, 140 bp, Artificial Sequence
  Synthetic
atggccgactcccaagtacgatgtgtatttctttgtcaactgcaatagaattgggcgcatgggttttaggtgaaccgaagatagtcaaggcactggatttcttcaagcacaacccttgtgggagacccagcatggcgtat

SEQ ID NO: 429251 - DNA, 140 bp, Artificial Sequence
  Synthetic
atacgccatgctgggtctccaagtatgtccttgttgacactgcctttgtcaactctccaatggggcattgtgacatatgtccacagtaaaaatacttctccttcaacctactattctcatcgtacttgggagtcggccat

SEQ ID NO: 429252 - DNA, 140 bp, Artificial Sequence
  Synthetic
atggccgactcccaagtacgatgagaatagtaggttgaaggagaagtatttttactgtggacatatgtcacaatgccccattggagagttgacaaaggcagtgtcaacaaggacatacttggagacccagcatggcgtat

SEQ ID NO: 429253 - DNA, 140 bp, Artificial Sequence
  Synthetic
atacgccatgctgggtctccttgcctccgctcaacccatttcttaagatcccttttagttgactccaaagaaactagtctatcattaacacttatgaagcaggaccctaaccaccctcttcgtacttgggagtcggccat

SEQ ID NO: 429254 - DNA, 140 bp, Artificial Sequence
  Synthetic
atggccgactcccaagtacgaagagggtggttagggtcctgcttcataagtgttaatgatagactagtttctttggagtcaactaaaagggatcttaagaaatgggttgagcggaggcaaggagacccagcatggcgtat

SEQ ID NO: 429255 - DNA, 140 bp, Artificial Sequence
  Synthetic
atacgccatgctgggtctccaacaattcgatcccctgaacaccagaaaccaaagattgtatagatttaatatacaggttctccttattgggcccccgaacacacttgctacccaatgtcccgtacttgggagtcggccat

SEQ ID NO: 429256 - DNA, 140 bp, Artificial Sequence
  Synthetic
atggccgactcccaagtacgggacattgggtagcaagtgtgttcgggggcccaataaggagaacctgtatattaaatctatacaatctttggtttctggtgttcaggggatcgaattgttggagacccagcatggcgtat

SEQ ID NO: 429257 - DNA, 140 bp, Artificial Sequence
  Synthetic
aggccctggctgctgatatgatacaggttctccttattgggcccccgaacacacttgctacccaatgtcctgcataagccaacaaagccagatgcaatagaactctgaaatgcagatttggaccttttgggacagcggtg

SEQ ID NO: 429258 - DNA, 140 bp, Artificial Sequence
  Synthetic
caccgctgtcccaaaaggtccaaatctgcatttcagagttctattgcatctggctttgttggcttatgcaggacattgggtagcaagtgtgttcgggggcccaataaggagaacctgtatcatatcagcagccagggcct

SEQ ID NO: 429259 - DNA, 140 bp, Artificial Sequence
  Synthetic
atacgccatgctgggtctcctcactttgttcaggaatgatctccagcattgcacctgacattctccagtggtttggtttccccctttttcattcccttcaccaatatttgcatataaaaacgtacttgggagtcggccat

SEQ ID NO: 429260 - DNA, 140 bp, Artificial Sequence
  Synthetic
atggccgactcccaagtacgtttttatatgcaaatattggtgaagggaatgaaaaagggggaaaccaaaccactggagaatgtcaggtgcaatgctggagatcattcctgaacaaagtgaggagacccagcatggcgtat

SEQ ID NO: 429261 - DNA, 140 bp, Artificial Sequence
  Synthetic
aggccctggctgctgatatggtttggtttccccctttttcattcccttcaccaatatttgcatataaaaattttaatattggtgatgctcttttgaactgataaattaaatgttcaatatgaccttttgggacagcggtg

SEQ ID NO: 429262 - DNA, 140 bp, Artificial Sequence
  Synthetic
caccgctgtcccaaaaggtcatattgaacatttaatttatcagttcaaaagagcatcaccaatattaaaatttttatatgcaaatattggtgaagggaatgaaaaagggggaaaccaaaccatatcagcagccagggcct

SEQ ID NO: 429263 - DNA, 140 bp, Artificial Sequence
  Synthetic
atacgccatgctgggtctcccaatttattctggattgtcttgacaatagtggggatcttttcatcatctaggttcacagcacctgaatatattatcttctgcctcagcaccatccttagacgtacttgggagtcggccat

SEQ ID NO: 429264 - DNA, 140 bp, Artificial Sequence
  Synthetic
atggccgactcccaagtacgtctaaggatggtgctgaggcagaagataatatattcaggtgctgtgaacctagatgatgaaaagatccccactattgtcaagacaatccagaataaattgggagacccagcatggcgtat

SEQ ID NO: 429265 - DNA, 140 bp, Artificial Sequence
  Synthetic
aggccctggctgctgatatgggttcacagcacctgaatatattatcttctgcctcagcaccatccttagaggatgatgtgcagccaagttcaaccaagaatattcaaggtcagactcagagaccttttgggacagcggtg

SEQ ID NO: 429266 - DNA, 140 bp, Artificial Sequence
  Synthetic
caccgctgtcccaaaaggtctctgagtctgaccttgaatattcttggttgaacttggctgcacatcatcctctaaggatggtgctgaggcagaagataatatattcaggtgctgtgaacccatatcagcagccagggcct

SEQ ID NO: 429267 - DNA, 140 bp, Artificial Sequence
  Synthetic
atacgccatgctgggtctccaaccggcccttatcgacttttaaaaactgaccttctatttctcctttccttagtctgttcctaaaaacctgatattcttcctcaatctgcagctttacttcgtacttgggagtcggccat

SEQ ID NO: 429268 - DNA, 140 bp, Artificial Sequence
  Synthetic
atggccgactcccaagtacgaagtaaagctgcagattgaggaagaatatcaggtttttaggaacagactaaggaaaggagaaatagaaggtcagtttttaaaagtcgataagggccggttggagacccagcatggcgtat

SEQ ID NO: 429269 - DNA, 140 bp, Artificial Sequence
  Synthetic
atacgccatgctgggtctccgctcactagacaagtagtttgttgtgaactcctcatggagttgtccagtcttcaatctgttgtacaactttctcaacatagatctgatcttgccacaagccgtacttgggagtcggccat

SEQ ID NO: 429270 - DNA, 140 bp, Artificial Sequence
  Synthetic
atggccgactcccaagtacggcttgtggcaagatcagatctatgttgagaaagttgtacaacagattgaagactggacaactccatgaggagttcacaacaaactacttgtctagtgagcggagacccagcatggcgtat

SEQ ID NO: 429271 - DNA, 140 bp, Artificial Sequence
  Synthetic
atacgccatgctgggtctcctcctcatagtgattagaacgattgtccgtcagaacatttaaactctctacacctgacaatcttcctgaggtcatggataaagattcacagagcctgctatcgtacttgggagtcggccat

SEQ ID NO: 429272 - DNA, 140 bp, Artificial Sequence
  Synthetic
atggccgactcccaagtacgatagcaggctctgtgaatctttatccatgacctcaggaagattgtcaggtgtagagagtttaaatgttctgacggacaatcgttctaatcactatgaggaggagacccagcatggcgtat

SEQ ID NO: 429273 - DNA, 140 bp, Artificial Sequence
  Synthetic
atacgccatgctgggtctccatcaggaatcagtccttctatttgcctcataatcctgtaactgcggttgccatccacccagtctctgacatctgtctcgcaattcaataagaacggatcacgtacttgggagtcggccat

SEQ ID NO: 429274 - DNA, 140 bp, Artificial Sequence
  Synthetic
atggccgactcccaagtacgtgatccgttcttattgaattgcgagacagatgtcagagactgggtggatggcaaccgcagttacaggattatgaggcaaatagaaggactgattcctgatggagacccagcatggcgtat

SEQ ID NO: 429275 - DNA, 140 bp, Artificial Sequence
  Synthetic
aggccctggctgctgatatgattgcacagatgaacagggacaccatttgcaactgattgatcaatgattgtgtcaattgtctctgccagttggtgtggctccttgcactttatattgtgggaccttttgggacagcggtg

SEQ ID NO: 429276 - DNA, 140 bp, Artificial Sequence
  Synthetic
caccgctgtcccaaaaggtcccacaatataaagtgcaaggagccacaccaactggcagagacaattgacacaatcattgatcaatcagttgcaaatggtgtccctgttcatctgtgcaatcatatcagcagccagggcct

SEQ ID NO: 429277 - DNA, 140 bp, Artificial Sequence
  Synthetic
atacgccatgctgggtctccaaagaatctggatttgaattctgcaacaaacctgccaataacacttttggggctaacaaatttgttgagctgatcactcatgtagtagtggaactccattcgtacttgggagtcggccat

SEQ ID NO: 429278 - DNA, 140 bp, Artificial Sequence
  Synthetic
atggccgactcccaagtacgaatggagttccactactacatgagtgatcagctcaacaaatttgttagccccaaaagtgttattggcaggtttgttgcagaattcaaatccagattctttggagacccagcatggcgtat

SEQ ID NO: 429279 - DNA, 140 bp, Artificial Sequence
  Synthetic
aggccctggctgctgatatgggctaacaaatttgttgagctgatcactcatgtagtagtggaactccattagaatcctaaattcttctggatccctttgcaacaattctgtcagagtctggaccttttgggacagcggtg

SEQ ID NO: 429280 - DNA, 140 bp, Artificial Sequence
  Synthetic
caccgctgtcccaaaaggtccagactctgacagaattgttgcaaagggatccagaagaatttaggattctaatggagttccactactacatgagtgatcagctcaacaaatttgttagcccatatcagcagccagggcct

SEQ ID NO: 429281 - DNA, 140 bp, Artificial Sequence
  Synthetic
atacgccatgctgggtctcccaccacaaatacaaccaatagcataattaataaacctctctgaaatgagggcatagaagtctgatgtattatgtagtattccctgacccatgtcaagtatcgtacttgggagtcggccat

SEQ ID NO: 429282 - DNA, 140 bp, Artificial Sequence
  Synthetic
atggccgactcccaagtacgatacttgacatgggtcagggaatactacataatacatcagacttctatgccctcatttcagagaggtttattaattatgctattggttgtatttgtggtgggagacccagcatggcgtat

SEQ ID NO: 429283 - DNA, 140 bp, Artificial Sequence
  Synthetic
aggccctggctgctgatatgaggtactttgacactaagtctttgacgcaggccatgtcttcttccatgtctgactgtaggtatggtggtcaaaaccttcagaacatgtgatctgctagaagaccttttgggacagcggtg

SEQ ID NO: 429284 - DNA, 140 bp, Artificial Sequence
  Synthetic
caccgctgtcccaaaaggtcttctagcagatcacatgttctgaaggttttgaccaccatacctacagtcagacatggaagaagacatggcctgcgtcaaagacttagtgtcaaagtacctcatatcagcagccagggcct

SEQ ID NO: 429285 - DNA, 140 bp, Artificial Sequence
  Synthetic
aggccctggctgctgatatgactggaagtattcttggtccaaaaaggtcctagtcaccactgcctttgtcagttcactaataggacatgagttcaatggccctacataaaagtatttatcgaccttttgggacagcggtg

SEQ ID NO: 429286 - DNA, 140 bp, Artificial Sequence
  Synthetic
caccgctgtcccaaaaggtcgataaatacttttatgtagggccattgaactcatgtcctattagtgaactgacaaaggcagtggtgactaggacctttttggaccaagaatacttccagtcatatcagcagccagggcct

SEQ ID NO: 429287 - DNA, 140 bp, Artificial Sequence
  Synthetic
atacgccatgctgggtctccttaatgtatgatttcatcatagccgatactacattaaaaggtatctccaccatcttatgcatatgccacataagtaaggttgagaggtagtctctcccctcgtacttgggagtcggccat

SEQ ID NO: 429288 - DNA, 140 bp, Artificial Sequence
  Synthetic
atggccgactcccaagtacgaggggagagactacctctcaaccttacttatgtggcatatgcataagatggtggagataccttttaatgtagtatcggctatgatgaaatcatacattaaggagacccagcatggcgtat

SEQ ID NO: 429289 - DNA, 140 bp, Artificial Sequence
  Synthetic
aggccctggctgctgatatgcatcttatgcatatgccacataagtaaggttgagaggtagtctctcccctttatatcagcttgcaagtcttttgaaagaaatatcaaattctgcagaatggaccttttgggacagcggtg

SEQ ID NO: 429290 - DNA, 140 bp, Artificial Sequence
  Synthetic
caccgctgtcccaaaaggtccattctgcagaatttgatatttctttcaaaagacttgcaagctgatataaaggggagagactacctctcaaccttacttatgtggcatatgcataagatgcatatcagcagccagggcct

SEQ ID NO: 429291 - DNA, 140 bp, Artificial Sequence
  Synthetic
atacgccatgctgggtctcccggggatcctaggcaatttggttgtttttcttttttgggttttttaggtttttggttttttggttttttggtttttggttttttggttttgtacgcagaacgtacttgggagtcggccat

SEQ ID NO: 429292 - DNA, 140 bp, Artificial Sequence
  Synthetic
atggccgactcccaagtacgttctgcgtacaaaaccaaaaaaccaaaaaccaaaaaaccaaaaaaccaaaaacctaaaaaacccaaaaaagaaaaacaaccaaattgcctaggatccccgggagacccagcatggcgtat

SEQ ID NO: 429293 - DNA, 140 bp, Artificial Sequence
  Synthetic
atacgccatgctgggtctcctgttgtcgggatcctagaactaagttgctcatcgcttgctgcaccttgtactcatagtcctgtttgttgagaaggtgcttcccttttcttgagaagacctcgtacttgggagtcggccat

SEQ ID NO: 429294 - DNA, 140 bp, Artificial Sequence
  Synthetic
atggccgactcccaagtacgaggtcttctcaagaaaagggaagcaccttctcaacaaacaggactatgagtacaaggtgcagcaagcgatgagcaacttagttctaggatcccgacaacaggagacccagcatggcgtat

SEQ ID NO: 429295 - DNA, 140 bp, Artificial Sequence
  Synthetic
atacgccatgctgggtctccgctataagagacatgtgccaaagaaacatttagtttcatggaaagaatggcattttcaaactccttctcgttattcaaacaactccctgataactgtaaacgtacttgggagtcggccat

SEQ ID NO: 429296 - DNA, 140 bp, Artificial Sequence
  Synthetic
atggccgactcccaagtacgtttacagttatcagggagttgtttgaataacgagaaggagtttgaaaatgccattctttccatgaaactaaatgtttctttggcacatgtctcttatagcggagacccagcatggcgtat

SEQ ID NO: 429297 - DNA, 140 bp, Artificial Sequence
  Synthetic
aggccctggctgctgatatgcattttcaaactccttctcgttattcaaacaactccctgataactgtaaactcaaggcctcaaagtaatcctctatgagtctagtaaacatctttgtcctgaccttttgggacagcggtg

SEQ ID NO: 429298 - DNA, 140 bp, Artificial Sequence
  Synthetic
caccgctgtcccaaaaggtcaggacaaagatgtttactagactcatagaggattactttgaggccttgagtttacagttatcagggagttgtttgaataacgagaaggagtttgaaaatgcatatcagcagccagggcct

SEQ ID NO: 429299 - DNA, 140 bp, Artificial Sequence
  Synthetic
atacgccatgctgggtctccataaggagaatttaagcctccctgtatcaggtcccactgaattataagactgtggtgactcttggctatagaagcataagttttttaacattgctgtggtcgtacttgggagtcggccat

SEQ ID NO: 429300 - DNA, 140 bp, Artificial Sequence
  Synthetic
atggccgactcccaagtacgaccacagcaatgttaaaaaacttatgcttctatagccaagagtcaccacagtcttataattcagtgggacctgatacagggaggcttaaattctccttatggagacccagcatggcgtat

SEQ ID NO: 429301 - DNA, 140 bp, Artificial Sequence
  Synthetic
aggccctggctgctgatatgtgtggtgactcttggctatagaagcataagttttttaacattgctgtggtgcagtttgtcaatgacagagctttgctaagtgcttccgagttactctcccgaccttttgggacagcggtg

SEQ ID NO: 429302 - DNA, 140 bp, Artificial Sequence
  Synthetic
caccgctgtcccaaaaggtcgggagagtaactcggaagcacttagcaaagctctgtcattgacaaactgcaccacagcaatgttaaaaaacttatgcttctatagccaagagtcaccacacatatcagcagccagggcct

SEQ ID NO: 429303 - DNA, 140 bp, Artificial Sequence
  Synthetic
atacgccatgctgggtctccagtccctgaatccctcaccgactcccaccactctcaccctccccccgacaccccccggggggaccccccgccgggggcccccccgggggagccaaccgtccgtacttgggagtcggccat

SEQ ID NO: 429304 - DNA, 140 bp, Artificial Sequence
  Synthetic
atggccgactcccaagtacggacggttggctcccccgggggggcccccggcggggggtccccccggggggtgtcggggggagggtgagagtggtgggagtcggtgagggattcagggactggagacccagcatggcgtat

SEQ ID NO: 429305 - DNA, 140 bp, Artificial Sequence
  Synthetic
aggccctggctgctgatatggtgttgggtttgggcttgtgcctgtgtggcttgcaggtcagccgatggtgccccacaaaaactcccacagaaatgagagacaatatgcctaggatcctcggaccttttgggacagcggtg

SEQ ID NO: 429306 - DNA, 140 bp, Artificial Sequence
  Synthetic
caccgctgtcccaaaaggtccgaggatcctaggcatattgtctctcatttctgtgggagtttttgtggggcaccatcggctgacctgcaagccacacaggcacaagcccaaacccaacaccatatcagcagccagggcct

SEQ ID NO: 429307 - DNA, 140 bp, Artificial Sequence
  Synthetic
atacgccatgctgggtctccttgaggtttttggacttataatgagtgtaccttcccataagtgtgtttgcattcataatcaagagtatggacttaaaacattgaaagtattcatgatcaacgtacttgggagtcggccat

SEQ ID NO: 429308 - DNA, 140 bp, Artificial Sequence
  Synthetic
atggccgactcccaagtacgttgatcatgaatactttcaatgttttaagtccatactcttgattatgaatgcaaacacacttatgggaaggtacactcattataagtccaaaaacctcaaggagacccagcatggcgtat

SEQ ID NO: 429309 - DNA, 140 bp, Artificial Sequence
  Synthetic
aggccctggctgctgatatgattcataatcaagagtatggacttaaaacattgaaagtattcatgatcaaagtatgtccttgttgacactgccttcgttaactccccaataggacattgtgaccttttgggacagcggtg

SEQ ID NO: 429310 - DNA, 140 bp, Artificial Sequence
  Synthetic
caccgctgtcccaaaaggtcacaatgtcctattggggagttaacgaaggcagtgtcaacaaggacatactttgatcatgaatactttcaatgttttaagtccatactcttgattatgaatcatatcagcagccagggcct

SEQ ID NO: 429311 - DNA, 140 bp, Artificial Sequence
  Synthetic
atacgccatgctgggtctccgacagcattgcagaattcctcataaaatttgtctggtaagacatcacgatcaaaatcctcaaccatgtgattagataactcacctttaattaatctaatacgtacttgggagtcggccat

SEQ ID NO: 429312 - DNA, 140 bp, Artificial Sequence
  Synthetic
atggccgactcccaagtacgtattagattaattaaaggtgagttatctaatcacatggttgaggattttgatcgtgatgtcttaccagacaaattttatgaggaattctgcaatgctgtcggagacccagcatggcgtat

SEQ ID NO: 429313 - DNA, 140 bp, Artificial Sequence
  Synthetic
aggccctggctgctgatatgcaaaatcctcaaccatgtgattagataactcacctttaattaatctaatataaaatttgtttgagacaatctcatccagatcatttactgatggctggtcgaccttttgggacagcggtg

SEQ ID NO: 429314 - DNA, 140 bp, Artificial Sequence
  Synthetic
caccgctgtcccaaaaggtcgaccagccatcagtaaatgatctggatgagattgtctcaaacaaattttatattagattaattaaaggtgagttatctaatcacatggttgaggattttgcatatcagcagccagggcct

SEQ ID NO: 429315 - DNA, 140 bp, Artificial Sequence
  Synthetic
atacgccatgctgggtctcccaattttttcaacggtctctctcagttggtcaaaataaatgcttgcacccccatcaagcaaaatttcgtctaggtcagccttgtctacaccatctttgtgcgtacttgggagtcggccat

SEQ ID NO: 429316 - DNA, 140 bp, Artificial Sequence
  Synthetic
atggccgactcccaagtacgcacaaagatggtgtagacaaggctgacctagacgaaattttgcttgatgggggtgcaagcatttattttgaccaactgagagagaccgttgaaaaaattgggagacccagcatggcgtat

SEQ ID NO: 429317 - DNA, 140 bp, Artificial Sequence
  Synthetic
aggccctggctgctgatatgccatcaagcaaaatttcgtctaggtcagccttgtctacaccatctttgtgctgtccagaccctagaactagattgctcattgcctgttgcactttatactgaccttttgggacagcggtg

SEQ ID NO: 429318 - DNA, 140 bp, Artificial Sequence
  Synthetic
caccgctgtcccaaaaggtcagtataaagtgcaacaggcaatgagcaatctagttctagggtctggacagcacaaagatggtgtagacaaggctgacctagacgaaattttgcttgatggcatatcagcagccagggcct

SEQ ID NO: 429319 - DNA, 140 bp, Artificial Sequence
  Synthetic
atacgccatgctgggtctccgtgagttgtgaaacagccagtgctgtaagcttattgaagtcataatttaatactctagaaccatctgtgtatttgttgacaacaacacttttattgctagcgtacttgggagtcggccat

SEQ ID NO: 429320 - DNA, 140 bp, Artificial Sequence
  Synthetic
atggccgactcccaagtacgctagcaataaaagtgttgttgtcaacaaatacacagatggttctagagtattaaattatgacttcaataagcttacagcactggctgtttcacaactcacggagacccagcatggcgtat

SEQ ID NO: 429321 - DNA, 140 bp, Artificial Sequence
  Synthetic
atacgccatgctgggtctccgaccactttctgcaacacatcactggagaaaactgaaggaaaaaaccgtttaggatcagcataaaaggaacaaacctctccaaccacattgttgttaatacgtacttgggagtcggccat

SEQ ID NO: 429322 - DNA, 140 bp, Artificial Sequence
  Synthetic
atggccgactcccaagtacgtattaacaacaatgtggttggagaggtttgttccttttatgctgatcctaaacggttttttccttcagttttctccagtgatgtgttgcagaaagtggtcggagacccagcatggcgtat

SEQ ID NO: 429323 - DNA, 140 bp, Artificial Sequence
  Synthetic
aggccctggctgctgatatgttcattgagccaatatactcaaggtggatggcaaagctttccttaaaactagcatcttgacttttaatacggaacctcactgtctgactcagtttcgcaggaccttttgggacagcggtg

SEQ ID NO: 429324 - DNA, 140 bp, Artificial Sequence
  Synthetic
caccgctgtcccaaaaggtcctgcgaaactgagtcagacagtgaggttccgtattaaaagtcaagatgctagttttaaggaaagctttgccatccaccttgagtatattggctcaatgaacatatcagcagccagggcct

SEQ ID NO: 429325 - DNA, 140 bp, Artificial Sequence
  Synthetic
atacgccatgctgggtctcctgtgaggagggacaagaacttttttgagacaccaggactcttgtagttgggaccctcggcgcttgtacacccatttttgctcagaaacctttttgcattgcgtacttgggagtcggccat

SEQ ID NO: 429326 - DNA, 140 bp, Artificial Sequence
  Synthetic
atggccgactcccaagtacgcaatgcaaaaaggtttctgagcaaaaatgggtgtacaagcgccgagggtcccaactacaagagtcctggtgtctcaaaaaagttcttgtccctcctcacaggagacccagcatggcgtat

SEQ ID NO: 429327 - DNA, 140 bp, Artificial Sequence
  Synthetic
aggccctggctgctgatatggaccctcggcgcttgtacacccatttttgctcagaaacctttttgcattgtggatcatatcatccagttcttcttccgttgctgtgtctgcaggattaatgaccttttgggacagcggtg

SEQ ID NO: 429328 - DNA, 140 bp, Artificial Sequence
  Synthetic
caccgctgtcccaaaaggtcattaatcctgcagacacagcaacggaagaagaactggatgatatgatccacaatgcaaaaaggtttctgagcaaaaatgggtgtacaagcgccgagggtccatatcagcagccagggcct

SEQ ID NO: 429329 - DNA, 140 bp, Artificial Sequence
  Synthetic
atacgccatgctgggtctccttatctgatctgttaacctatctggtgtttcttttgtaataaaatgacacatataagaaatgttcaagatgaacttgaatctattggtcatcatactcttcgtacttgggagtcggccat

SEQ ID NO: 429330 - DNA, 140 bp, Artificial Sequence
  Synthetic
atggccgactcccaagtacgaagagtatgatgaccaatagattcaagttcatcttgaacatttcttatatgtgtcattttattacaaaagaaacaccagataggttaacagatcagataaggagacccagcatggcgtat

SEQ ID NO: 429331 - DNA, 140 bp, Artificial Sequence
  Synthetic
aggccctggctgctgatatgatataagaaatgttcaagatgaacttgaatctattggtcatcatactcttcacttcctcagacaagatcaagcccattaatgcccttattagcctatagagaccttttgggacagcggtg

SEQ ID NO: 429332 - DNA, 140 bp, Artificial Sequence
  Synthetic
caccgctgtcccaaaaggtctctataggctaataagggcattaatgggcttgatcttgtctgaggaagtgaagagtatgatgaccaatagattcaagttcatcttgaacatttcttatatcatatcagcagccagggcct

SEQ ID NO: 429333 - DNA, 140 bp, Artificial Sequence
  Synthetic
aggccctggctgctgatatgaccactatctgtgtctcaactgcctcaccttacttttaagtgtcagcaacaggtgccccatttgcaagatgcctctccccacaaaactgagaccatcagcgaccttttgggacagcggtg

SEQ ID NO: 429334 - DNA, 140 bp, Artificial Sequence
  Synthetic
caccgctgtcccaaaaggtcgctgatggtctcagttttgtggggagaggcatcttgcaaatggggcacctgttgctgacacttaaaagtaaggtgaggcagttgagacacagatagtggtcatatcagcagccagggcct

SEQ ID NO: 429335 - DNA, 140 bp, Artificial Sequence
  Synthetic
atacgccatgctgggtctcctccttatgatgaaaatccgaaacataggccataatgaagtacctaaggttttggagaagtttttgggagcgtttactgggatgggctaggattaagatcacgtacttgggagtcggccat

SEQ ID NO: 429336 - DNA, 140 bp, Artificial Sequence
  Synthetic
atggccgactcccaagtacgtgatcttaatcctagcccatcccagtaaacgctcccaaaaacttctccaaaaccttaggtacttcattatggcctatgtttcggattttcatcataaggaggagacccagcatggcgtat

SEQ ID NO: 429337 - DNA, 140 bp, Artificial Sequence
  Synthetic
aggccctggctgctgatatgttggagaagtttttgggagcgtttactgggatgggctaggattaagatcaagatcatctttgttaaaaacttaatgttgtttagttgttctttcagctcggaccttttgggacagcggtg

SEQ ID NO: 429338 - DNA, 140 bp, Artificial Sequence
  Synthetic
caccgctgtcccaaaaggtccgagctgaaagaacaactaaacaacattaagtttttaacaaagatgatcttgatcttaatcctagcccatcccagtaaacgctcccaaaaacttctccaacatatcagcagccagggcct

SEQ ID NO: 429339 - DNA, 140 bp, Artificial Sequence
  Synthetic
atacgccatgctgggtctccttcagctgaaaatattgctgggaaatatctttttggatcagcataaaatgagcatacctcgccaaccctgttatcattaatggcataacactttgaacatcgtacttgggagtcggccat

SEQ ID NO: 429340 - DNA, 140 bp, Artificial Sequence
  Synthetic
atggccgactcccaagtacgatgttcaaagtgttatgccattaatgataacagggttggcgaggtatgctcattttatgctgatccaaaaagatatttcccagcaatattttcagctgaaggagacccagcatggcgtat

SEQ ID NO: 429341 - DNA, 140 bp, Artificial Sequence
  Synthetic
aggccctggctgctgatatgtttcttgcattataaaccatttcagcaagctcttcctctgatgcatcatcctttgggttcacactcacatgtccaaattccaatttgggctcaaggaattgaccttttgggacagcggtg

SEQ ID NO: 429342 - DNA, 140 bp, Artificial Sequence
  Synthetic
caccgctgtcccaaaaggtcaattccttgagcccaaattggaatttggacatgtgagtgtgaacccaaaggatgatgcatcagaggaagagcttgctgaaatggtttataatgcaagaaacatatcagcagccagggcct

SEQ ID NO: 429343 - DNA, 140 bp, Artificial Sequence
  Synthetic
atacgccatgctgggtctccgcaaccctttcttcaccagagtccaaatctgcatacaagaacttaaggactggagaggctcttcggaattgaaatgttaactgttcaatgttgtcatcaccgtacttgggagtcggccat

SEQ ID NO: 429344 - DNA, 140 bp, Artificial Sequence
  Synthetic
atggccgactcccaagtacggtgatgacaacattgaacagttaacatttcaattccgaagagcctctccagtccttaagttcttgtatgcagatttggactctggtgaagaaagggttgcggagacccagcatggcgtat

SEQ ID NO: 429345 - DNA, 140 bp, Artificial Sequence
  Synthetic
atacgccatgctgggtctcccgaactcattctgtctcagctttacagtggaagaggttttcatagagtttatcaaggcaagactcaatgaggaaagtctctccaaatcagtggttcccaccgtacttgggagtcggccat

SEQ ID NO: 429346 - DNA, 140 bp, Artificial Sequence
  Synthetic
atggccgactcccaagtacggtgggaaccactgatttggagagactttcctcattgagtcttgccttgataaactctatgaaaacctcttccactgtaaagctgagacagaatgagttcgggagacccagcatggcgtat

SEQ ID NO: 429347 - DNA, 140 bp, Artificial Sequence
  Synthetic
aggccctggctgctgatatgatcaaggcaagactcaatgaggaaagtctctccaaatcagtggttcccactagatctacaacccccatgacataaggaaacatttcttcctccgatctctgaccttttgggacagcggtg

SEQ ID NO: 429348 - DNA, 140 bp, Artificial Sequence
  Synthetic
caccgctgtcccaaaaggtcagagatcggaggaagaaatgtttccttatgtcatgggggttgtagatctagtgggaaccactgatttggagagactttcctcattgagtcttgccttgatcatatcagcagccagggcct

SEQ ID NO: 429349 - DNA, 140 bp, Artificial Sequence
  Synthetic
atacgccatgctgggtctcctcataggcattaggacaaattacctccatatcgatcttatagtggtccacactaattccaacatcttttaaagcagtggttgcctttaaaacggttttctcgtacttgggagtcggccat

SEQ ID NO: 429350 - DNA, 140 bp, Artificial Sequence
  Synthetic
atggccgactcccaagtacgagaaaaccgttttaaaggcaaccactgctttaaaagatgttggaattagtgtggaccactataagatcgatatggaggtaatttgtcctaatgcctatgaggagacccagcatggcgtat

SEQ ID NO: 429351 - DNA, 140 bp, Artificial Sequence
  Synthetic
aggccctggctgctgatatgactaattccaacatcttttaaagcagtggttgcctttaaaacggttttctggaatattgagttaagaatctgatttttactcaaacattggggagactgtgaccttttgggacagcggtg

SEQ ID NO: 429352 - DNA, 140 bp, Artificial Sequence
  Synthetic
caccgctgtcccaaaaggtcacagtctccccaatgtttgagtaaaaatcagattcttaactcaatattccagaaaaccgttttaaaggcaaccactgctttaaaagatgttggaattagtcatatcagcagccagggcct

SEQ ID NO: 429353 - DNA, 140 bp, Artificial Sequence
  Synthetic
atacgccatgctgggtctccatctctttttgttgactctaaggagaccagtctatcattaacacttatgaaacaggatcccaaccacccttttaagctcctttgtttcatttggtcatgccgtacttgggagtcggccat

SEQ ID NO: 429354 - DNA, 140 bp, Artificial Sequence
  Synthetic
atggccgactcccaagtacggcatgaccaaatgaaacaaaggagcttaaaagggtggttgggatcctgtttcataagtgttaatgatagactggtctccttagagtcaacaaaaagagatggagacccagcatggcgtat

SEQ ID NO: 429355 - DNA, 140 bp, Artificial Sequence
  Synthetic
aggccctggctgctgatatgaacaggatcccaaccacccttttaagctcctttgtttcatttggtcatgcctactcgcaagaagaattagcgcatcaaaaatcaataaaagttttctcctgaccttttgggacagcggtg

SEQ ID NO: 429356 - DNA, 140 bp, Artificial Sequence
  Synthetic
caccgctgtcccaaaaggtcaggagaaaacttttattgatttttgatgcgctaattcttcttgcgagtaggcatgaccaaatgaaacaaaggagcttaaaagggtggttgggatcctgttcatatcagcagccagggcct

SEQ ID NO: 429357 - DNA, 140 bp, Artificial Sequence
  Synthetic
atacgccatgctgggtctccattgcacttgacattctccagctgcttgatcaccccctctgccatttccttcgctaatgtctgcatacaaaaatctcaatattggtgatgccctcttaaacgtacttgggagtcggccat

SEQ ID NO: 429358 - DNA, 140 bp, Artificial Sequence
  Synthetic
atggccgactcccaagtacgtttaagagggcatcaccaatattgagatttttgtatgcagacattagcgaaggaaatggcagagggggtgatcaagcagctggagaatgtcaagtgcaatggagacccagcatggcgtat

SEQ ID NO: 429359 - DNA, 140 bp, Artificial Sequence
  Synthetic
aggccctggctgctgatatgtcgctaatgtctgcatacaaaaatctcaatattggtgatgccctcttaaactggtgaatcaaatgctcgacattgtcttctgcagaaaccttgtcagcgtgaccttttgggacagcggtg

SEQ ID NO: 429360 - DNA, 140 bp, Artificial Sequence
  Synthetic
caccgctgtcccaaaaggtcacgctgacaaggtttctgcagaagacaatgtcgagcatttgattcaccagtttaagagggcatcaccaatattgagatttttgtatgcagacattagcgacatatcagcagccagggcct

SEQ ID NO: 429361 - DNA, 140 bp, Artificial Sequence
  Synthetic
atacgccatgctgggtctcctgaccttctatctcccctcttctcaatctgtttctaaacacttgatactcttcttcaatttgcaacttcacttcatgagctgtcagcttgttgttgataccgtacttgggagtcggccat

SEQ ID NO: 429362 - DNA, 140 bp, Artificial Sequence
  Synthetic
atggccgactcccaagtacggtatcaacaacaagctgacagctcatgaagtgaagttgcaaattgaagaagagtatcaagtgtttagaaacagattgagaagaggggagatagaaggtcaggagacccagcatggcgtat

SEQ ID NO: 429363 - DNA, 140 bp, Artificial Sequence
  Synthetic
aggccctggctgctgatatgttcttcaatttgcaacttcacttcatgagctgtcagcttgttgttgataccttggtgacatgaagcaatcacttcctcataatgattagagcgattatccgaccttttgggacagcggtg

SEQ ID NO: 429364 - DNA, 140 bp, Artificial Sequence
  Synthetic
caccgctgtcccaaaaggtcggataatcgctctaatcattatgaggaagtgattgcttcatgtcaccaaggtatcaacaacaagctgacagctcatgaagtgaagttgcaaattgaagaacatatcagcagccagggcct

SEQ ID NO: 429365 - DNA, 140 bp, Artificial Sequence
  Synthetic
aggccctggctgctgatatgcacatataatcccacaacaagggtctgaaataactgacaacactttcacttccacttccatttctaagttctagtggaacttgccaatattgaatgccatgaccttttgggacagcggtg

SEQ ID NO: 429366 - DNA, 140 bp, Artificial Sequence
  Synthetic
caccgctgtcccaaaaggtcatggcattcaatattggcaagttccactagaacttagaaatggaagtggaagtgaaagtgttgtcagttatttcagacccttgttgtgggattatatgtgcatatcagcagccagggcct

SEQ ID NO: 429367 - DNA, 140 bp, Artificial Sequence
  Synthetic
atacgccatgctgggtctcctaaagattcacagagtctactgtactctgactcttcaaaaagtgagttactttcctgagcatatctcaataatgagaaaagtgtgtctctcaacttgtcacgtacttgggagtcggccat

SEQ ID NO: 429368 - DNA, 140 bp, Artificial Sequence
  Synthetic
atggccgactcccaagtacgtgacaagttgagagacacacttttctcattattgagatatgctcaggaaagtaactcactttttgaagagtcagagtacagtagactctgtgaatctttaggagacccagcatggcgtat

SEQ ID NO: 429369 - DNA, 140 bp, Artificial Sequence
  Synthetic
aggccctggctgctgatatgtttcctgagcatatctcaataatgagaaaagtgtgtctctcaacttgtcattaacccaatcaggtatttgttcgttataaaatgttgttctcccatctatgaccttttgggacagcggtg

SEQ ID NO: 429370 - DNA, 140 bp, Artificial Sequence
  Synthetic
caccgctgtcccaaaaggtcatagatgggagaacaacattttataacgaacaaatacctgattgggttaatgacaagttgagagacacacttttctcattattgagatatgctcaggaaacatatcagcagccagggcct

SEQ ID NO: 429371 - DNA, 140 bp, Artificial Sequence
  Synthetic
atacgccatgctgggtctccctaatttcttgaaatcctcaatgtacttctgttcaaaattggcaggagatgacctaacaaaacattccaataatattaggacattgcccgtcagtttgtacgtacttgggagtcggccat

SEQ ID NO: 429372 - DNA, 140 bp, Artificial Sequence
  Synthetic
atggccgactcccaagtacgtacaaactgacgggcaatgtcctaatattattggaatgttttgttaggtcatctcctgccaattttgaacagaagtacattgaggatttcaagaaattagggagacccagcatggcgtat

SEQ ID NO: 429373 - DNA, 140 bp, Artificial Sequence
  Synthetic
aggccctggctgctgatatggacctaacaaaacattccaataatattaggacattgcccgtcagtttgtaaccatccggcaccacaaagcataaggagggggtcaagactccattgtcatgaccttttgggacagcggtg

SEQ ID NO: 429374 - DNA, 140 bp, Artificial Sequence
  Synthetic
caccgctgtcccaaaaggtcatgacaatggagtcttgaccccctccttatgctttgtggtgccggatggttacaaactgacgggcaatgtcctaatattattggaatgttttgttaggtccatatcagcagccagggcct

SEQ ID NO: 429375 - DNA, 140 bp, Artificial Sequence
  Synthetic
atacgccatgctgggtctccgcattgcaagaatcgacctcaatacaaagggacagaagtttcaacccttccattaaaagcatcctgggctctgtttgtacaagaaatgccaacttctgcccgtacttgggagtcggccat

SEQ ID NO: 429376 - DNA, 140 bp, Artificial Sequence
  Synthetic
atggccgactcccaagtacgggcagaagttggcatttcttgtacaaacagagcccaggatgcttttaatggaagggttgaaacttctgtccctttgtattgaggtcgattcttgcaatgcggagacccagcatggcgtat

SEQ ID NO: 429377 - DNA, 140 bp, Artificial Sequence
  Synthetic
atacgccatgctgggtctcccaggctatgtcttcctccatgtctgactgagggtgtagtgatcgaaactctcagagcatgtggtcaactagaacaacagttcaatacacaagagatacttcgtacttgggagtcggccat

SEQ ID NO: 429378 - DNA, 140 bp, Artificial Sequence
  Synthetic
atggccgactcccaagtacgaagtatctcttgtgtattgaactgttgttctagttgaccacatgctctgagagtttcgatcactacaccctcagtcagacatggaggaagacatagcctgggagacccagcatggcgtat

SEQ ID NO: 429379 - DNA, 140 bp, Artificial Sequence
  Synthetic
aggccctggctgctgatatgactctcagagcatgtggtcaactagaacaacagttcaatacacaagagatacttaaagacaattaattagatagccttaatgcctaggatcctcggtgcggaccttttgggacagcggtg

SEQ ID NO: 429380 - DNA, 140 bp, Artificial Sequence
  Synthetic
caccgctgtcccaaaaggtccgcaccgaggatcctaggcattaaggctatctaattaattgtctttaagtatctcttgtgtattgaactgttgttctagttgaccacatgctctgagagtcatatcagcagccagggcct

SEQ ID NO: 429381 - DNA, 140 bp, Artificial Sequence
  Synthetic
atacgccatgctgggtctcctgacaaagaaaacttaagtcttcctgtatcaggtcccactgagtcataagattgtggcgactcttggctataaaaacacaagttttttaacattgctgtgcgtacttgggagtcggccat

SEQ ID NO: 429382 - DNA, 140 bp, Artificial Sequence
  Synthetic
atggccgactcccaagtacgcacagcaatgttaaaaaacttgtgtttttatagccaagagtcgccacaatcttatgactcagtgggacctgatacaggaagacttaagttttctttgtcaggagacccagcatggcgtat

SEQ ID NO: 429383 - DNA, 140 bp, Artificial Sequence
  Synthetic
atacgccatgctgggtctccatggacttaatatacaggttctctttatttggtccccgaacacatttgctgcccaatgttctgcacaatcccacaaagcctgatgcaatggaactttgaacgtacttgggagtcggccat

SEQ ID NO: 429384 - DNA, 140 bp, Artificial Sequence
  Synthetic
atggccgactcccaagtacgttcaaagttccattgcatcaggctttgtgggattgtgcagaacattgggcagcaaatgtgttcggggaccaaataaagagaacctgtatattaagtccatggagacccagcatggcgtat

SEQ ID NO: 429385 - DNA, 140 bp, Artificial Sequence
  Synthetic
atacgccatgctgggtctccctgtgttgggcttgggcttgtacctgtattgcgtgtgggccagctggcagcgcctcacaaaagctcttacagaaatgagagacaatatgcctaggatcctcgtacttgggagtcggccat

SEQ ID NO: 429386 - DNA, 140 bp, Artificial Sequence
  Synthetic
atggccgactcccaagtacgaggatcctaggcatattgtctctcatttctgtaagagcttttgtgaggcgctgccagctggcccacacgcaatacaggtacaagcccaagcccaacacagggagacccagcatggcgtat

SEQ ID NO: 429387 - DNA, 140 bp, Artificial Sequence
  Synthetic
aggccctggctgctgatatgccatcaccattagggcctgagcccagcttggcaggttccctatactgatcaacaattttttcaacagtttcctttagttgatcaaaataatcgcttgcacgaccttttgggacagcggtg

SEQ ID NO: 429388 - DNA, 140 bp, Artificial Sequence
  Synthetic
caccgctgtcccaaaaggtcgtgcaagcgattattttgatcaactaaaggaaactgttgaaaaaattgttgatcagtatagggaacctgccaagctgggctcaggccctaatggtgatggcatatcagcagccagggcct

SEQ ID NO: 429389 - DNA, 140 bp, Artificial Sequence
  Synthetic
aggccctggctgctgatatgtatttagaaaagatctccaacattgcatctgttcactttgagagttagcagccctttccttactagaatccaaatccgcatacaagaacttgaggactgggaccttttgggacagcggtg

SEQ ID NO: 429390 - DNA, 140 bp, Artificial Sequence
  Synthetic
caccgctgtcccaaaaggtcccagtcctcaagttcttgtatgcggatttggattctagtaaggaaagggctgctaactctcaaagtgaacagatgcaatgttggagatcttttctaaatacatatcagcagccagggcct

SEQ ID NO: 429391 - DNA, 140 bp, Artificial Sequence
  Synthetic
aggccctggctgctgatatgcacatttttctgatgacattgaacaacaagcagacaacatgataacagaattgttacagaaggagtacatagacaggcaagggaaaacacccttagggttgaccttttgggacagcggtg

SEQ ID NO: 429392 - DNA, 140 bp, Artificial Sequence
  Synthetic
caccgctgtcccaaaaggtcaaccctaagggtgttttcccttgcctgtctatgtactccttctgtaacaattctgttatcatgttgtctgcttgttgttcaatgtcatcagaaaaatgtgcatatcagcagccagggcct

SEQ ID NO: 429393 - DNA, 140 bp, Artificial Sequence
  Synthetic
aggccctggctgctgatatgaatcagcaggtcagacgaagtgtccccaacctctctcacaaatacttcaagatcctggtcttgtataacaggtgtaaaggatgccaatttctttccacatgaccttttgggacagcggtg

SEQ ID NO: 429394 - DNA, 140 bp, Artificial Sequence
  Synthetic
caccgctgtcccaaaaggtcatgtggaaagaaattggcatcctttacacctgttatacaagaccaggatcttgaagtatttgtgagagaggttggggacacttcgtctgacctgctgattcatatcagcagccagggcct

SEQ ID NO: 429395 - DNA, 140 bp, Artificial Sequence
  Synthetic
aggccctggctgctgatatgctttgtaaatggctttctcaatgaatgaagagaagggacccagtcgctgcagaccttcaccctctggtattgaggttttgtgagggaaccaagtgaatgagaccttttgggacagcggtg

SEQ ID NO: 429396 - DNA, 140 bp, Artificial Sequence
  Synthetic
caccgctgtcccaaaaggtctcattcacttggttccctcacaaaacctcaataccagagggtgaaggtctgcagcgactgggtcccttctcttcattcattgagaaagccatttacaaagcatatcagcagccagggcct

SEQ ID NO: 429397 - DNA, 140 bp, Artificial Sequence
  Synthetic
aggccctggctgctgatatgtcccacaagcctcccctatgcacaactagaggggctggttcagtgcaaggacccaccaatacaaagtcatactccgtaaactgcagcttttccatatcaagaccttttgggacagcggtg

SEQ ID NO: 429398 - DNA, 140 bp, Artificial Sequence
  Synthetic
caccgctgtcccaaaaggtcttgatatggaaaagctgcagtttacggagtatgactttgtattggtgggtccttgcactgaaccagcccctctagttgtgcataggggaggcttgtgggacatatcagcagccagggcct

SEQ ID NO: 429399 - DNA, 140 bp, Artificial Sequence
  Synthetic
aggccctggctgctgatatgtaagtgtcatcaactgagaataggtcaaccctgttggaaaccccgctgactgtaaagacttgttggacccagcagtgcccaccttttgtggttttccatcgaccttttgggacagcggtg

SEQ ID NO: 429400 - DNA, 140 bp, Artificial Sequence
  Synthetic
caccgctgtcccaaaaggtcgatggaaaaccacaaaaggtgggcactgctgggtccaacaagtctttacagtcagcggggtttccaacagggttgacctattctcagttgatgacacttacatatcagcagccagggcct

SEQ ID NO: 429401 - DNA, 140 bp, Artificial Sequence
  Synthetic
aggccctggctgctgatatgttaccaaagcaaggctcaatgaagaaagcctctctaagtcaatggttcccagtaattccacaccccccgccacataagggaatgtttcttcctctgctctgaccttttgggacagcggtg

SEQ ID NO: 429402 - DNA, 140 bp, Artificial Sequence
  Synthetic
caccgctgtcccaaaaggtcagagcagaggaagaaacattcccttatgtggcggggggtgtggaattactgggaaccattgacttagagaggctttcttcattgagccttgctttggtaacatatcagcagccagggcct

SEQ ID NO: 429403 - DNA, 140 bp, Artificial Sequence
  Synthetic
aggccctggctgctgatatgacctacctttaaaagttggaccggacaaagcaagtctccaacagtcaggcagaacacatgggcttacagacccagagtatagtgcctgtacatcattcacgaccttttgggacagcggtg

SEQ ID NO: 429404 - DNA, 140 bp, Artificial Sequence
  Synthetic
caccgctgtcccaaaaggtcgtgaatgatgtacaggcactatactctgggtctgtaagcccatgtgttctgcctgactgttggagacttgctttgtccggtccaacttttaaaggtaggtcatatcagcagccagggcct

SEQ ID NO: 429405 - DNA, 140 bp, Artificial Sequence
  Synthetic
atacgccatgctgggtctccaatcataactgttaaggcaaatcacctccatatcaatcttatagtggtcaacactgatcccaacatcctttaaagcagtggtggccttcaaaatggttttcgtacttgggagtcggccat

SEQ ID NO: 429406 - DNA, 140 bp, Artificial Sequence
  Synthetic
atggccgactcccaagtacgaaaaccattttgaaggccaccactgctttaaaggatgttgggatcagtgttgaccactataagattgatatggaggtgatttgccttaacagttatgattggagacccagcatggcgtat

SEQ ID NO: 429407 - DNA, 140 bp, Artificial Sequence
  Synthetic
atacgccatgctgggtctcctcatcaactgagaataggtcaatcctgttggaaaccctgctgactgtaaggacctgctggacccagcagtacccactttttgtggcttcccgtctgtctccgtacttgggagtcggccat

SEQ ID NO: 429408 - DNA, 140 bp, Artificial Sequence
  Synthetic
atggccgactcccaagtacggagacagacgggaagccacaaaaagtgggtactgctgggtccagcaggtccttacagtcagcagggtttccaacaggattgacctattctcagttgatgaggagacccagcatggcgtat

SEQ ID NO: 429409 - DNA, 140 bp, Artificial Sequence
  Synthetic
atacgccatgctgggtctcccctcaccaagattagcatacaggaatctcaatattggtgatgctctcttgaactgataaattaggtgttcgacattgtcttcagcagctaccttatcagtcgtacttgggagtcggccat

SEQ ID NO: 429410 - DNA, 140 bp, Artificial Sequence
  Synthetic
atggccgactcccaagtacgactgataaggtagctgctgaagacaatgtcgaacacctaatttatcagttcaagagagcatcaccaatattgagattcctgtatgctaatcttggtgaggggagacccagcatggcgtat

SEQ ID NO: 429411 - DNA, 140 bp, Artificial Sequence
  Synthetic
aggccctggctgctgatatgtgcatctcatctaggcccccagttctgtaagagttgctggtttgagaacagagggctggtagagtgcaacaaccactacctgtgtctcaactgtctcagcgaccttttgggacagcggtg

SEQ ID NO: 429412 - DNA, 140 bp, Artificial Sequence
  Synthetic
caccgctgtcccaaaaggtcgctgagacagttgagacacaggtagtggttgttgcactctaccagccctctgttctcaaaccagcaactcttacagaactgggggcctagatgagatgcacatatcagcagccagggcct

SEQ ID NO: 429413 - DNA, 140 bp, Artificial Sequence
  Synthetic
atacgccatgctgggtctccaatcatatcgtaactgttaaggcaaatcacctccatatcaattttatagtggtccacactgatcccaacatcctttaaaacagtggtggccttcagaatgcgtacttgggagtcggccat

SEQ ID NO: 429414 - DNA, 140 bp, Artificial Sequence
  Synthetic
atggccgactcccaagtacgcattctgaaggccaccactgttttaaaggatgttgggatcagtgtggaccactataaaattgatatggaggtgatttgccttaacagttacgatatgattggagacccagcatggcgtat

SEQ ID NO: 429415 - DNA, 140 bp, Artificial Sequence
  Synthetic
atacgccatgctgggtctccttggaagcactcatcttgatctgggttctcagggattttctggttgagagtttcactcagtaagtcaatgagaagcgcaatccaatagcctaggatccaccgtacttgggagtcggccat

SEQ ID NO: 429416 - DNA, 140 bp, Artificial Sequence
  Synthetic
atggccgactcccaagtacggtggatcctaggctattggattgcgcttctcattgacttactgagtgaaactctcaaccagaaaatccctgagaacccagatcaagatgagtgcttccaaggagacccagcatggcgtat

SEQ ID NO: 429417 - DNA, 140 bp, Artificial Sequence
  Synthetic
atacgccatgctgggtctcccggggatcctaggcaatttagctggactttagtggtaaagctcatttcagtgagtctctgaatcaaagtgcctagtcagaatgggcaacagacaggccaacgtacttgggagtcggccat

SEQ ID NO: 429418 - DNA, 140 bp, Artificial Sequence
  Synthetic
atggccgactcccaagtacgttggcctgtctgttgcccattctgactaggcactttgattcagagactcactgaaatgagctttaccactaaagtccagctaaattgcctaggatccccgggagacccagcatggcgtat

SEQ ID NO: 429419 - DNA, 140 bp, Artificial Sequence
  Synthetic
atacgccatgctgggtctcccctcggaacatgtggactgctggagtaatagttcactttaagacaagatcccgtaggaggctcagaagacacaagaggtaattaaagacaattatataagcgtacttgggagtcggccat

SEQ ID NO: 429420 - DNA, 140 bp, Artificial Sequence
  Synthetic
atggccgactcccaagtacgcttatataattgtctttaattacctcttgtgtcttctgagcctcctacgggatcttgtcttaaagtgaactattactccagcagtccacatgttccgaggggagacccagcatggcgtat

SEQ ID NO: 429421 - DNA, 140 bp, Artificial Sequence
  Synthetic
aggccctggctgctgatatgctggtagagtgcaacaaccactacctgtgtctcaattgtctcagcctgctcctcagcgtcagcagcagatgcccgatctgtaagatgcctcttcccaccagaccttttgggacagcggtg

SEQ ID NO: 429422 - DNA, 140 bp, Artificial Sequence
  Synthetic
caccgctgtcccaaaaggtctggtgggaagaggcatcttacagatcgggcatctgctgctgacgctgaggagcaggctgagacaattgagacacaggtagtggttgttgcactctaccagcatatcagcagccagggcct

SEQ ID NO: 429423 - DNA, 140 bp, Artificial Sequence
  Synthetic
aggccctggctgctgatatggcaagacagtcaagaataaaaatggacacatcattgggccccacttactatgatccatgctataggacacatgtgccaatgaaacattcaatttcatggagaccttttgggacagcggtg

SEQ ID NO: 429424 - DNA, 140 bp, Artificial Sequence
  Synthetic
caccgctgtcccaaaaggtctccatgaaattgaatgtttcattggcacatgtgtcctatagcatggatcatagtaagtggggcccaatgatgtgtccatttttattcttgactgtcttgccatatcagcagccagggcct

SEQ ID NO: 429425 - DNA, 140 bp, Artificial Sequence
  Synthetic
aggccctggctgctgatatgctgacctacctttgaaagttggacccgacaaagcaagtctccaacagtcagacagaacacatgggctcacagacccagaatatagtgcctgtacatcattgaccttttgggacagcggtg

SEQ ID NO: 429426 - DNA, 140 bp, Artificial Sequence
  Synthetic
caccgctgtcccaaaaggtcaatgatgtacaggcactatattctgggtctgtgagcccatgtgttctgtctgactgttggagacttgctttgtcgggtccaactttcaaaggtaggtcagcatatcagcagccagggcct

SEQ ID NO: 429427 - DNA, 140 bp, Artificial Sequence
  Synthetic
aggccctggctgctgatatgttggtagctaattgtagggacaaccccagaaacaatgaagtccatgattaagtcataactattaggacgaatcacctccatatcaattttataatgatccgaccttttgggacagcggtg

SEQ ID NO: 429428 - DNA, 140 bp, Artificial Sequence
  Synthetic
caccgctgtcccaaaaggtcggatcattataaaattgatatggaggtgattcgtcctaatagttatgacttaatcatggacttcattgtttctggggttgtccctacaattagctaccaacatatcagcagccagggcct

SEQ ID NO: 429429 - DNA, 140 bp, Artificial Sequence
  Synthetic
aggccctggctgctgatatggggtctcgcagtgtcttctttacttccttttctttaaacaatgaaccattattaaaactagatacaaggagtgaaataaattttttggaaacaccaggctgaccttttgggacagcggtg

SEQ ID NO: 429430 - DNA, 140 bp, Artificial Sequence
  Synthetic
caccgctgtcccaaaaggtcagcctggtgtttccaaaaaatttatttcactccttgtatctagttttaataatggttcattgtttaaagaaaaggaagtaaagaagacactgcgagaccccatatcagcagccagggcct

SEQ ID NO: 429431 - DNA, 140 bp, Artificial Sequence
  Synthetic
atacgccatgctgggtctccaaatcctcaagggagtccaacctcaactcctctgttaggcctgaagcaatgagctggttcaaatttatttgggctggctcaatatcaaagtctatccatgcgtacttgggagtcggccat

SEQ ID NO: 429432 - DNA, 140 bp, Artificial Sequence
  Synthetic
atggccgactcccaagtacgcatggatagactttgatattgagccagcccaaataaatttgaaccagctcattgcttcaggcctaacagaggagttgaggttggactcccttgaggatttggagacccagcatggcgtat

SEQ ID NO: 429433 - DNA, 140 bp, Artificial Sequence
  Synthetic
atacgccatgctgggtctccagttcactataggacaaggtcccgtaggaggcaaaggagacacaagaggcaattaaagacaataaaattagatagccttaatgcctaggatcctcggtgccgtacttgggagtcggccat

SEQ ID NO: 429434 - DNA, 140 bp, Artificial Sequence
  Synthetic
atggccgactcccaagtacggcaccgaggatcctaggcattaaggctatctaattttattgtctttaattgcctcttgtgtctcctttgcctcctacgggaccttgtcctatagtgaactggagacccagcatggcgtat

SEQ ID NO: 429435 - DNA, 140 bp, Artificial Sequence
  Synthetic
atacgccatgctgggtctccttccattatcccttaccactgcttcaactccttgggtccccagtagctgagtctgtatggatttaatatagagattctctttgttaggacccctgacgcacgtacttgggagtcggccat

SEQ ID NO: 429436 - DNA, 140 bp, Artificial Sequence
  Synthetic
atggccgactcccaagtacgtgcgtcaggggtcctaacaaagagaatctctatattaaatccatacagactcagctactggggacccaaggagttgaagcagtggtaagggataatggaaggagacccagcatggcgtat

SEQ ID NO: 429437 - DNA, 140 bp, Artificial Sequence
  Synthetic
atacgccatgctgggtctccgccaattgcactctttgggctcacaaatttatttagttgatcactcatatagtaatggaattctaacaatgttttgaactcttctgcatcccttgagagtcgtacttgggagtcggccat

SEQ ID NO: 429438 - DNA, 140 bp, Artificial Sequence
  Synthetic
atggccgactcccaagtacgactctcaagggatgcagaagagttcaaaacattgttagaattccattactatatgagtgatcaactaaataaatttgtgagcccaaagagtgcaattggcggagacccagcatggcgtat

SEQ ID NO: 429439 - DNA, 140 bp, Artificial Sequence
  Synthetic
aggccctggctgctgatatgctcccacttgttccttgtaagacaaagaaaattttagtctgccagtgtcagggccagttgaattataagattgaggtgattcctgactgtaaaaacacaggaccttttgggacagcggtg

SEQ ID NO: 429440 - DNA, 140 bp, Artificial Sequence
  Synthetic
caccgctgtcccaaaaggtcctgtgtttttacagtcaggaatcacctcaatcttataattcaactggccctgacactggcagactaaaattttctttgtcttacaaggaacaagtgggagcatatcagcagccagggcct

SEQ ID NO: 429441 - DNA, 140 bp, Artificial Sequence
  Synthetic
atacgccatgctgggtctccttaaaaactgaccttctatctctcctttcctcaatctgttcctaaacacttgatactcctcttcgatctgcagctttacttcatgagctgttaacttattcgtacttgggagtcggccat

SEQ ID NO: 429442 - DNA, 140 bp, Artificial Sequence
  Synthetic
atggccgactcccaagtacgaataagttaacagctcatgaagtaaagctgcagatcgaagaggagtatcaagtgtttaggaacagattgaggaaaggagagatagaaggtcagtttttaaggagacccagcatggcgtat

SEQ ID NO: 429443 - DNA, 140 bp, Artificial Sequence
  Synthetic
aggccctggctgctgatatggtcatagataaagattcacagagtctgctatactctgactcttcaaaaagtgaattgctctcctgtgcatactttaaaagtgagaagagcgtatccctcagaccttttgggacagcggtg

SEQ ID NO: 429444 - DNA, 140 bp, Artificial Sequence
  Synthetic
caccgctgtcccaaaaggtctgagggatacgctcttctcacttttaaagtatgcacaggagagcaattcactttttgaagagtcagagtatagcagactctgtgaatctttatctatgaccatatcagcagccagggcct

SEQ ID NO: 429445 - DNA, 140 bp, Artificial Sequence
  Synthetic
aggccctggctgctgatatgagctcactaataggacatgagttcattggccctacataaaaatatttacttctcaaagcagcatcattgtagatattctcacaaattttgatgtattgatgaccttttgggacagcggtg

SEQ ID NO: 429446 - DNA, 140 bp, Artificial Sequence
  Synthetic
caccgctgtcccaaaaggtcatcaatacatcaaaatttgtgagaatatctacaatgatgctgctttgagaagtaaatatttttatgtagggccaatgaactcatgtcctattagtgagctcatatcagcagccagggcct

SEQ ID NO: 429447 - DNA, 140 bp, Artificial Sequence
  Synthetic
aggccctggctgctgatatgatttagctggacttcagtggtaaagtccattctagtgaatccctgaattaaagtgcccagccaaaatgggcaacaagcaggccaagtcgacaaaagtcgagaccttttgggacagcggtg

SEQ ID NO: 429448 - DNA, 140 bp, Artificial Sequence
  Synthetic
caccgctgtcccaaaaggtctcgacttttgtcgacttggcctgcttgttgcccattttggctgggcactttaattcagggattcactagaatggactttaccactgaagtccagctaaatcatatcagcagccagggcct

SEQ ID NO: 429449 - DNA, 140 bp, Artificial Sequence
  Synthetic
aggccctggctgctgatatgtgcccgctaattgtgatgtaagcgcttcaaagtaatcctcaatgagccttgtgaacatttttgtccttaagtctccgatatacaattctctattacctccgaccttttgggacagcggtg

SEQ ID NO: 429450 - DNA, 140 bp, Artificial Sequence
  Synthetic
caccgctgtcccaaaaggtcggaggtaatagagaattgtatatcggagacttaaggacaaaaatgttcacaaggctcattgaggattactttgaagcgcttacatcacaattagcgggcacatatcagcagccagggcct

SEQ ID NO: 429451 - DNA, 140 bp, Artificial Sequence
  Synthetic
atacgccatgctgggtctccctgtatcaaatttaaagttcaaacacttgctcttgtaatgggagtactttcccatcagcttattcccattcatcaccaataaaatcgacttaaagcattgcgtacttgggagtcggccat

SEQ ID NO: 429452 - DNA, 140 bp, Artificial Sequence
  Synthetic
atggccgactcccaagtacgcaatgctttaagtcgattttattggtgatgaatgggaataagctgatgggaaagtactcccattacaagagcaagtgtttgaactttaaatttgatacagggagacccagcatggcgtat

SEQ ID NO: 429453 - DNA, 140 bp, Artificial Sequence
  Synthetic
aggccctggctgctgatatgatacaaatcattgaactcattgagtaattgactcttctcgacctttaggaactgactctctatctccccttttctcaacctgtttctgaacacttggtacgaccttttgggacagcggtg

SEQ ID NO: 429454 - DNA, 140 bp, Artificial Sequence
  Synthetic
caccgctgtcccaaaaggtcgtaccaagtgttcagaaacaggttgagaaaaggggagatagagagtcagttcctaaaggtcgagaagagtcaattactcaatgagttcaatgatttgtatcatatcagcagccagggcct

SEQ ID NO: 429455 - DNA, 140 bp, Artificial Sequence
  Synthetic
atacgccatgctgggtctccaaaaaccttcttgcattatgaaccatttcagcaagctcttcctccgatgcatcatcctttgggttcacactcacatgtccaaattctaatttgggttcaacgtacttgggagtcggccat

SEQ ID NO: 429456 - DNA, 140 bp, Artificial Sequence
  Synthetic
atggccgactcccaagtacgttgaacccaaattagaatttggacatgtgagtgtgaacccaaaggatgatgcatcggaggaagagcttgctgaaatggttcataatgcaagaaggtttttggagacccagcatggcgtat

SEQ ID NO: 429457 - DNA, 140 bp, Artificial Sequence
  Synthetic
aggccctggctgctgatatgtatttcctttgaggcactcatcgccagattgttgtgttgaatgcacgcaacaaaagctgagactatctgccaaagtgataaaagcaaagcgcaatccaatgaccttttgggacagcggtg

SEQ ID NO: 429458 - DNA, 140 bp, Artificial Sequence
  Synthetic
caccgctgtcccaaaaggtcattggattgcgctttgcttttatcactttggcagatagtctcagcttttgttgcgtgcattcaacacaacaatctggcgatgagtgcctcaaaggaaatacatatcagcagccagggcct

SEQ ID NO: 429459 - DNA, 140 bp, Artificial Sequence
  Synthetic
atacgccatgctgggtctccttattgaaactagacacaaggagtgagacaaactttctggaaacaccaggctttttatatctaactttttccgcatctgcacaacattctttgcttagaacgtacttgggagtcggccat

SEQ ID NO: 429460 - DNA, 140 bp, Artificial Sequence
  Synthetic
atggccgactcccaagtacgttctaagcaaagaatgttgtgcagatgcggaaaaagttagatataaaaagcctggtgtttccagaaagtttgtctcactccttgtgtctagtttcaataaggagacccagcatggcgtat

SEQ ID NO: 429461 - DNA, 140 bp, Artificial Sequence
  Synthetic
atacgccatgctgggtctccaattccataagagttagtttctatgccaacctccctcaaagcattagtggctcgagttagtactctgttaatgatggcaaggagctcacaatttcgttctcgtacttgggagtcggccat

SEQ ID NO: 429462 - DNA, 140 bp, Artificial Sequence
  Synthetic
atggccgactcccaagtacgagaacgaaattgtgagctccttgccatcattaacagagtactaactcgagccactaatgctttgagggaggttggcatagaaactaactcttatggaattggagacccagcatggcgtat

SEQ ID NO: 429463 - DNA, 140 bp, Artificial Sequence
  Synthetic
aggccctggctgctgatatggcagccctttcttcaccagaatccaagtctgcatacaagaacttaagaactggagaggctcttcggaactggaatgttaactgttcaatgttgtcatcacgaccttttgggacagcggtg

SEQ ID NO: 429464 - DNA, 140 bp, Artificial Sequence
  Synthetic
caccgctgtcccaaaaggtcgtgatgacaacattgaacagttaacattccagttccgaagagcctctccagttcttaagttcttgtatgcagacttggattctggtgaagaaagggctgccatatcagcagccagggcct

SEQ ID NO: 429465 - DNA, 140 bp, Artificial Sequence
  Synthetic
aggccctggctgctgatatgtggagaggctcttcggaactggaatgttaactgttcaatgttgtcatcacaggtgtctattttatcactatatagctttctgaagtcctctaataacttcgaccttttgggacagcggtg

SEQ ID NO: 429466 - DNA, 140 bp, Artificial Sequence
  Synthetic
caccgctgtcccaaaaggtcgaagttattagaggacttcagaaagctatatagtgataaaatagacacctgtgatgacaacattgaacagttaacattccagttccgaagagcctctccacatatcagcagccagggcct

SEQ ID NO: 429467 - DNA, 140 bp, Artificial Sequence
  Synthetic
atacgccatgctgggtctccaccttatcagtcttaacaaattgattttctatgtccccttgccttagtttgttcctgaagatttgatactcctcctcaattaaactcttgacttcatgagcgtacttgggagtcggccat

SEQ ID NO: 429468 - DNA, 140 bp, Artificial Sequence
  Synthetic
atggccgactcccaagtacgctcatgaagtcaagagtttaattgaggaggagtatcaaatcttcaggaacaaactaaggcaaggggacatagaaaatcaatttgttaagactgataaggtggagacccagcatggcgtat

SEQ ID NO: 429469 - DNA, 140 bp, Artificial Sequence
  Synthetic
aggccctggctgctgatatggttcctgaagatttgatactcctcctcaattaaactcttgacttcatgagaggtgagcttgttattaatgccctgatgacaactagaaattatttcctcagaccttttgggacagcggtg

SEQ ID NO: 429470 - DNA, 140 bp, Artificial Sequence
  Synthetic
caccgctgtcccaaaaggtctgaggaaataatttctagttgtcatcagggcattaataacaagctcacctctcatgaagtcaagagtttaattgaggaggagtatcaaatcttcaggaaccatatcagcagccagggcct

SEQ ID NO: 429471 - DNA, 140 bp, Artificial Sequence
  Synthetic
atacgccatgctgggtctcctgtccatgataatatcataaacatcacaatcaaggatctttaaatcaattccataagagttgatttctatgccaacctcccttagagcattagtagctcgcgtacttgggagtcggccat

SEQ ID NO: 429472 - DNA, 140 bp, Artificial Sequence
  Synthetic
atggccgactcccaagtacgcgagctactaatgctctaagggaggttggcatagaaatcaactcttatggaattgatttaaagatccttgattgtgatgtttatgatattatcatggacaggagacccagcatggcgtat

SEQ ID NO: 429473 - DNA, 140 bp, Artificial Sequence
  Synthetic
aggccctggctgctgatatgccataagagttgatttctatgccaacctcccttagagcattagtagctcgggttaaaactctgttgatgatggcaaggagctcacaattccgatcttcttgaccttttgggacagcggtg

SEQ ID NO: 429474 - DNA, 140 bp, Artificial Sequence
  Synthetic
caccgctgtcccaaaaggtcaagaagatcggaattgtgagctccttgccatcatcaacagagttttaacccgagctactaatgctctaagggaggttggcatagaaatcaactcttatggcatatcagcagccagggcct

SEQ ID NO: 429475 - DNA, 140 bp, Artificial Sequence
  Synthetic
atacgccatgctgggtctccatccaccgttttaagtctctttttgttgattccaatgaaactaatctatcattaacactcacaaaacaagaacccagccaaccagcaaggaacctgtcaccgtacttgggagtcggccat

SEQ ID NO: 429476 - DNA, 140 bp, Artificial Sequence
  Synthetic
atggccgactcccaagtacggtgacaggttccttgctggttggctgggttcttgttttgtgagtgttaatgatagattagtttcattggaatcaacaaaaagagacttaaaacggtggatggagacccagcatggcgtat

SEQ ID NO: 429477 - DNA, 140 bp, Artificial Sequence
  Synthetic
aggccctggctgctgatatgattaacactcacaaaacaagaacccagccaaccagcaaggaacctgtcaccatgcctcatgcaatccagccggctagcaagaagaatcagaacgtcaaaagaccttttgggacagcggtg

SEQ ID NO: 429478 - DNA, 140 bp, Artificial Sequence
  Synthetic
caccgctgtcccaaaaggtcttttgacgttctgattcttcttgctagccggctggattgcatgaggcatggtgacaggttccttgctggttggctgggttcttgttttgtgagtgttaatcatatcagcagccagggcct

SEQ ID NO: 429479 - DNA, 140 bp, Artificial Sequence
  Synthetic
atacgccatgctgggtctccattcagaaaagatctccagcgttgcatctgttcaccttgagagtcagtagccccttcctcaccatgacccaaatctgcatacaagaacctaaggaccggacgtacttgggagtcggccat

SEQ ID NO: 429480 - DNA, 140 bp, Artificial Sequence
  Synthetic
atggccgactcccaagtacgtccggtccttaggttcttgtatgcagatttgggtcatggtgaggaaggggctactgactctcaaggtgaacagatgcaacgctggagatcttttctgaatggagacccagcatggcgtat

SEQ ID NO: 429481 - DNA, 140 bp, Artificial Sequence
  Synthetic
aggccctggctgctgatatgccccttcctcaccatgacccaaatctgcatacaagaacctaaggaccggagaggctcttcggaactggaatgctaactgttcaatgttgtcatcataggtgaccttttgggacagcggtg

SEQ ID NO: 429482 - DNA, 140 bp, Artificial Sequence
  Synthetic
caccgctgtcccaaaaggtcacctatgatgacaacattgaacagttagcattccagttccgaagagcctctccggtccttaggttcttgtatgcagatttgggtcatggtgaggaaggggcatatcagcagccagggcct

SEQ ID NO: 429483 - DNA, 140 bp, Artificial Sequence
  Synthetic
atacgccatgctgggtctcctggcacctgtgttgagtttaggcttgtgcctatatggcttgcaggtcagctagtggtgcccaaaaaactcccacagaaatgagagacaatatgcctaggacgtacttgggagtcggccat

SEQ ID NO: 429484 - DNA, 140 bp, Artificial Sequence
  Synthetic
atggccgactcccaagtacgtcctaggcatattgtctctcatttctgtgggagttttttgggcaccactagctgacctgcaagccatataggcacaagcctaaactcaacacaggtgccaggagacccagcatggcgtat

SEQ ID NO: 429485 - DNA, 140 bp, Artificial Sequence
  Synthetic
aggccctggctgctgatatgatcctaggcatttaggattgcgcttttagagatctttgtgtgaataggcttcattaagccatgggacaaatcataacatttttccaggaagtacctcatggaccttttgggacagcggtg

SEQ ID NO: 429486 - DNA, 140 bp, Artificial Sequence
  Synthetic
caccgctgtcccaaaaggtccatgaggtacttcctggaaaaatgttatgatttgtcccatggcttaatgaagcctattcacacaaagatctctaaaagcgcaatcctaaatgcctaggatcatatcagcagccagggcct

SEQ ID NO: 429487 - DNA, 140 bp, Artificial Sequence
  Synthetic
aggccctggctgctgatatgtttatgagctacaaactctagagctggacatggcaagccttaatatgacaatgcccttatcttgcacgaagaacaacagccaccattacatcatggtcgggaccttttgggacagcggtg

SEQ ID NO: 429488 - DNA, 140 bp, Artificial Sequence
  Synthetic
caccgctgtcccaaaaggtcccgaccatgatgtaatggtggctgttgttcttcgtgcaagataagggcattgtcatattaaggcttgccatgtccagctctagagtttgtagctcataaacatatcagcagccagggcct

SEQ ID NO: 429489 - DNA, 140 bp, Artificial Sequence
  Synthetic
atacgccatgctgggtctccttcaccaggggtgtctgagatgaacatcccaagagccttcttgacctttaagatggatttgaggataccatccattgtctgaggtgacaccttgattgtccgtacttgggagtcggccat

SEQ ID NO: 429490 - DNA, 140 bp, Artificial Sequence
  Synthetic
atggccgactcccaagtacggacaatcaaggtgtcacctcagacaatggatggtatcctcaaatccatcttaaaggtcaagaaggctcttgggatgttcatctcagacacccctggtgaaggagacccagcatggcgtat

SEQ ID NO: 429491 - DNA, 140 bp, Artificial Sequence
  Synthetic
aggccctggctgctgatatgagacaaagaaaattttagtctaccagtgtcagggccagttgaattataagattgaggtgattcctgactgtaaaaacacaggttttttaacattgctgtagaccttttgggacagcggtg

SEQ ID NO: 429492 - DNA, 140 bp, Artificial Sequence
  Synthetic
caccgctgtcccaaaaggtctacagcaatgttaaaaaacctgtgtttttacagtcaggaatcacctcaatcttataattcaactggccctgacactggtagactaaaattttctttgtctcatatcagcagccagggcct

SEQ ID NO: 429493 - DNA, 140 bp, Artificial Sequence
  Synthetic
atacgccatgctgggtctccacctgtattgggtttaggcctgtgcctgtatggcttgcaagccagtcagtgatgccccacaaaagctcctatagaaatgagagacaatatgcctaggatccgtacttgggagtcggccat

SEQ ID NO: 429494 - DNA, 140 bp, Artificial Sequence
  Synthetic
atggccgactcccaagtacggatcctaggcatattgtctctcatttctataggagcttttgtggggcatcactgactggcttgcaagccatacaggcacaggcctaaacccaatacaggtggagacccagcatggcgtat

SEQ ID NO: 429495 - DNA, 140 bp, Artificial Sequence
  Synthetic
atacgccatgctgggtctccatcaccagattgttgtgctgtatgcacgcagcagaaatctgaagctgtctgccaaaatgataaaagcaaagcgcaatcctatagcctaggatccactgtgcgtacttgggagtcggccat

SEQ ID NO: 429496 - DNA, 140 bp, Artificial Sequence
  Synthetic
atggccgactcccaagtacgcacagtggatcctaggctataggattgcgctttgcttttatcattttggcagacagcttcagatttctgctgcgtgcatacagcacaacaatctggtgatggagacccagcatggcgtat

SEQ ID NO: 429497 - DNA, 140 bp, Artificial Sequence
  Synthetic
atacgccatgctgggtctcctcaactgtgtgacagccaaagctgtaagcttattgaagtcataatccagaatgcgagacccatctgtatatttgttcacaacaacactcttattgctggccgtacttgggagtcggccat

SEQ ID NO: 429498 - DNA, 140 bp, Artificial Sequence
  Synthetic
atggccgactcccaagtacggccagcaataagagtgttgttgtgaacaaatatacagatgggtctcgcattctggattatgacttcaataagcttacagctttggctgtcacacagttgaggagacccagcatggcgtat

SEQ ID NO: 429499 - DNA, 140 bp, Artificial Sequence
  Synthetic
aggccctggctgctgatatgcaatatctgataatccaaaatacaacctgggaagatcactgccaattctcgagaccatctcccatcggttatctcgggctcctctcacaaaggaccagaggaccttttgggacagcggtg

SEQ ID NO: 429500 - DNA, 140 bp, Artificial Sequence
  Synthetic
caccgctgtcccaaaaggtcctctggtcctttgtgagaggagcccgagataaccgatgggagatggtctcgagaattggcagtgatcttcccaggttgtattttggattatcagatattgcatatcagcagccagggcct

SEQ ID NO: 429501 - DNA, 140 bp, Artificial Sequence
  Synthetic
aggccctggctgctgatatgaagagctgctggttcgaaaccaagggcctggttgagtgcaacaaccactatctatgtctcaattgcctcactttacttctaagtgtcagcaataggtgccgaccttttgggacagcggtg

SEQ ID NO: 429502 - DNA, 140 bp, Artificial Sequence
  Synthetic
caccgctgtcccaaaaggtcggcacctattgctgacacttagaagtaaagtgaggcaattgagacatagatagtggttgttgcactcaaccaggcccttggtttcgaaccagcagctcttcatatcagcagccagggcct

SEQ ID NO: 429503 - DNA, 140 bp, Artificial Sequence
  Synthetic
aggccctggctgctgatatgaaaccatttcagcaagctcttcctccgatgcatcatcctttgggttcacactcacatgtccaaattctaatttgggttcaaggaatttttcaaagcatttgaccttttgggacagcggtg

SEQ ID NO: 429504 - DNA, 140 bp, Artificial Sequence
  Synthetic
caccgctgtcccaaaaggtcaaatgctttgaaaaattccttgaacccaaattagaatttggacatgtgagtgtgaacccaaaggatgatgcatcggaggaagagcttgctgaaatggtttcatatcagcagccagggcct

SEQ ID NO: 429505 - DNA, 140 bp, Artificial Sequence
  Synthetic
aggccctggctgctgatatgtccctgaatccccaccgactcccaccaccctcacctccccccgacaccccccggggggaccccccgccgggggcccccccgggggagccaaccatctccagaccttttgggacagcggtg

SEQ ID NO: 429506 - DNA, 140 bp, Artificial Sequence
  Synthetic
caccgctgtcccaaaaggtctggagatggttggctcccccgggggggcccccggcggggggtccccccggggggtgtcggggggaggtgagggtggtgggagtcggtggggattcagggacatatcagcagccagggcct

SEQ ID NO: 429507 - DNA, 140 bp, Artificial Sequence
  Synthetic
aggccctggctgctgatatgacatgttctgcccttcagtctcaatttgccactgcttgactgtaccatcaccttcccctttgacttactataacagagagcataacccttgaattccaccgaccttttgggacagcggtg

SEQ ID NO: 429508 - DNA, 140 bp, Artificial Sequence
  Synthetic
caccgctgtcccaaaaggtcggtggaattcaagggttatgctctctgttatagtaagtcaaaggggaaggtgatggtacagtcaagcagtggcaaattgagactgaagggcagaacatgtcatatcagcagccagggcct

SEQ ID NO: 429509 - DNA, 140 bp, Artificial Sequence
  Synthetic
atacgccatgctgggtctccccttgacagtttctcgttgtcagctaagtactttgatactaaatctttgacataggccatgtcttcctccatgcttgactgcagatgaggtgatcacagccgtacttgggagtcggccat

SEQ ID NO: 429510 - DNA, 140 bp, Artificial Sequence
  Synthetic
atggccgactcccaagtacggctgtgatcacctcatctgcagtcaagcatggaggaagacatggcctatgtcaaagatttagtatcaaagtacttagctgacaacgagaaactgtcaaggggagacccagcatggcgtat

SEQ ID NO: 429511 - DNA, 140 bp, Artificial Sequence
  Synthetic
aggccctggctgctgatatgaatcattttggttaacaatttaatagtgatcaattgttcagacaactctgtgcattcttctatccagctgaccataacatcgactactttctgcaacacagaccttttgggacagcggtg

SEQ ID NO: 429512 - DNA, 140 bp, Artificial Sequence
  Synthetic
caccgctgtcccaaaaggtctgtgttgcagaaagtagtcgatgttatggtcagctggatagaagaatgcacagagttgtctgaacaattgatcactattaaattgttaaccaaaatgattcatatcagcagccagggcct

SEQ ID NO: 429513 - DNA, 140 bp, Artificial Sequence
  Synthetic
aggccctggctgctgatatgaaataccaactcataggcatattgtaggcaagccgtgtcccaaacctcacaggttgaatcatatgggcatttgttcctgtggactctataaacagcctgggaccttttgggacagcggtg

SEQ ID NO: 429514 - DNA, 140 bp, Artificial Sequence
  Synthetic
caccgctgtcccaaaaggtcccaggctgtttatagagtccacaggaacaaatgcccatatgattcaacctgtgaggtttgggacacggcttgcctacaatatgcctatgagttggtatttcatatcagcagccagggcct

SEQ ID NO: 429515 - DNA, 140 bp, Artificial Sequence
  Synthetic
aggccctggctgctgatatgcttttactgcagctcctaagctgaagttgtaaccagaaatgttcaaggagctcttcttagtgtccaccatattcagtatgggatggctttgagaaagtctgaccttttgggacagcggtg

SEQ ID NO: 429516 - DNA, 140 bp, Artificial Sequence
  Synthetic
caccgctgtcccaaaaggtcagactttctcaaagccatcccatactgaatatggtggacactaagaagagctccttgaacatttctggttacaacttcagcttaggagctgcagtaaaagcatatcagcagccagggcct

SEQ ID NO: 429517 - DNA, 140 bp, Artificial Sequence
  Synthetic
atacgccatgctgggtctcctcaacctaatgtagaacttatttgagacaacctcatctagatcatttactgatggctggccatcaccattagggcctgggcctagcttgacaggttccctcgtacttgggagtcggccat

SEQ ID NO: 429518 - DNA, 140 bp, Artificial Sequence
  Synthetic
atggccgactcccaagtacgagggaacctgtcaagctaggcccaggccctaatggtgatggccagccatcagtaaatgatctagatgaggttgtctcaaataagttctacattaggttgaggagacccagcatggcgtat

SEQ ID NO: 429519 - DNA, 140 bp, Artificial Sequence
  Synthetic
aggccctggctgctgatatgtgaatgatgtggctcataccaaccctgtcctctagcagtttcgaaacagtgggtctcaaggggaagtaatcacaaggattatgtttaaaaaagtccaagagaccttttgggacagcggtg

SEQ ID NO: 429520 - DNA, 140 bp, Artificial Sequence
  Synthetic
caccgctgtcccaaaaggtctcttggacttttttaaacataatccttgtgattacttccccttgagacccactgtttcgaaactgctagaggacagggttggtatgagccacatcattcacatatcagcagccagggcct

SEQ ID NO: 429521 - DNA, 140 bp, Artificial Sequence
  Synthetic
aggccctggctgctgatatgacagttcactatagaatgaggtcccgtagggggcacagaagacacaagagtcaattaaagacaattaaattagatagccttaatgcctaggatcctcggcgaccttttgggacagcggtg

SEQ ID NO: 429522 - DNA, 140 bp, Artificial Sequence
  Synthetic
caccgctgtcccaaaaggtcgccgaggatcctaggcattaaggctatctaatttaattgtctttaattgactcttgtgtcttctgtgccccctacgggacctcattctatagtgaactgtcatatcagcagccagggcct

SEQ ID NO: 429523 - DNA, 140 bp, Artificial Sequence
  Synthetic
aggccctggctgctgatatgtccactggatcttcaggtcttccttcaatgtccatccaggtcttagcatttgggtcaagttgcagcattgcatccttgagggtcatcagctgagaatagggaccttttgggacagcggtg

SEQ ID NO: 429524 - DNA, 140 bp, Artificial Sequence
  Synthetic
caccgctgtcccaaaaggtccctattctcagctgatgaccctcaaggatgcaatgctgcaacttgacccaaatgctaagacctggatggacattgaaggaagacctgaagatccagtggacatatcagcagccagggcct

SEQ ID NO: 429525 - DNA, 140 bp, Artificial Sequence
  Synthetic
aggccctggctgctgatatgcctctagtgaatgtcgatgacagcctattttgcaaggtttttactattgtagggaccttttcatcttccagattcacagcaccagaatagattatcttttgaccttttgggacagcggtg

SEQ ID NO: 429526 - DNA, 140 bp, Artificial Sequence
  Synthetic
caccgctgtcccaaaaggtcaaaagataatctattctggtgctgtgaatctggaagatgaaaaggtccctacaatagtaaaaaccttgcaaaataggctgtcatcgacattcactagaggcatatcagcagccagggcct

SEQ ID NO: 429527 - DNA, 140 bp, Artificial Sequence
  Synthetic
aggccctggctgctgatatgaagctccctcctcaatgactgtgtccagagaaatgacttcacttccttagaagcactcatcttggtctggacacttggggatttactggttgaaagtatcgaccttttgggacagcggtg

SEQ ID NO: 429528 - DNA, 140 bp, Artificial Sequence
  Synthetic
caccgctgtcccaaaaggtcgatactttcaaccagtaaatccccaagtgtccagaccaagatgagtgcttctaaggaagtgaagtcatttctctggacacagtcattgaggagggagcttcatatcagcagccagggcct

SEQ ID NO: 429529 - DNA, 140 bp, Artificial Sequence
  Synthetic
aggccctggctgctgatatgttccttagaagcactcatcttggtctggacacttggggatttactggttgaaagtatcactcagtaagtcaatgaaaagcgcaatccaatagcctaggatgaccttttgggacagcggtg

SEQ ID NO: 429530 - DNA, 140 bp, Artificial Sequence
  Synthetic
caccgctgtcccaaaaggtcatcctaggctattggattgcgcttttcattgacttactgagtgatactttcaaccagtaaatccccaagtgtccagaccaagatgagtgcttctaaggaacatatcagcagccagggcct

SEQ ID NO: 429531 - DNA, 140 bp, Artificial Sequence
  Synthetic
aggccctggctgctgatatgtgattgacaagtcctgtcatgttgagatggatggaaaaagtctctttaaaactagcatcctgactcttgattttatacctaattgtctggtaaaactgaagaccttttgggacagcggtg

SEQ ID NO: 429532 - DNA, 140 bp, Artificial Sequence
  Synthetic
caccgctgtcccaaaaggtcttcagttttaccagacaattaggtataaaatcaagagtcaggatgctagttttaaagagactttttccatccatctcaacatgacaggacttgtcaatcacatatcagcagccagggcct

SEQ ID NO: 429533 - DNA, 140 bp, Artificial Sequence
  Synthetic
atacgccatgctgggtctccctcagaacatgtggtctgctggaacaacagttcactttaagacaaggtcccgtaggaggcacagaagacacaagaggtaattaaagacaattaattagatcgtacttgggagtcggccat

SEQ ID NO: 429534 - DNA, 140 bp, Artificial Sequence
  Synthetic
atggccgactcccaagtacgatctaattaattgtctttaattacctcttgtgtcttctgtgcctcctacgggaccttgtcttaaagtgaactgttgttccagcagaccacatgttctgagggagacccagcatggcgtat

SEQ ID NO: 429535 - DNA, 140 bp, Artificial Sequence
  Synthetic
atacgccatgctgggtctccacagattctccttatttggtcctcgaacacatttgctaccaagtgttctgcataaccccacaaagccagatgcaatggaactttggaatgcagatttgttcgtacttgggagtcggccat

SEQ ID NO: 429536 - DNA, 140 bp, Artificial Sequence
  Synthetic
atggccgactcccaagtacgaacaaatctgcattccaaagttccattgcatctggctttgtggggttatgcagaacacttggtagcaaatgtgttcgaggaccaaataaggagaatctgtggagacccagcatggcgtat

SEQ ID NO: 429537 - DNA, 140 bp, Artificial Sequence
  Synthetic
aggccctggctgctgatatgtgattttaattcaacaagattgttgactgcttgatttaggtccctcaaccgtttcaaatcattgtcatcccttctctccttgcgcatcaaccgttgaacagaccttttgggacagcggtg

SEQ ID NO: 429538 - DNA, 140 bp, Artificial Sequence
  Synthetic
caccgctgtcccaaaaggtctgttcaacggttgatgcgcaaggagagaagggatgacaatgatttgaaacggttgagggacctaaatcaagcagtcaacaatcttgttgaattaaaatcacatatcagcagccagggcct

SEQ ID NO: 429539 - DNA, 140 bp, Artificial Sequence
  Synthetic
aggccctggctgctgatatgctctgttttgtgaggattgagacaatgtccacacctgtccattgaattctttgtttcaatctatcagacatcattgatttcaatgcaccaactaaaaggtgaccttttgggacagcggtg

SEQ ID NO: 429540 - DNA, 140 bp, Artificial Sequence
  Synthetic
caccgctgtcccaaaaggtcaccttttagttggtgcattgaaatcaatgatgtctgatagattgaaacaaagaattcaatggacaggtgtggacattgtctcaatcctcacaaaacagagcatatcagcagccagggcct

SEQ ID NO: 429541 - DNA, 140 bp, Artificial Sequence
  Synthetic
aggccctggctgctgatatgtgggtttcattaagccatggggcaaatcataacatttttccaggaagtgcctcatgtcattgaggaggtgatgaacattgtcttaattgctctcagccttgaccttttgggacagcggtg

SEQ ID NO: 429542 - DNA, 140 bp, Artificial Sequence
  Synthetic
caccgctgtcccaaaaggtcaaggctgagagcaattaagacaatgttcatcacctcctcaatgacatgaggcacttcctggaaaaatgttatgatttgccccatggcttaatgaaacccacatatcagcagccagggcct

SEQ ID NO: 429543 - DNA, 140 bp, Artificial Sequence
  Synthetic
aggccctggctgctgatatgtcaactcctcacatgttctgcccttcagtctcaatttaccaccacttgactgtaccatcaccttcccctttgacttactataacagagagcataacctttgaccttttgggacagcggtg

SEQ ID NO: 429544 - DNA, 140 bp, Artificial Sequence
  Synthetic
caccgctgtcccaaaaggtcaaaggttatgctctctgttatagtaagtcaaaggggaaggtgatggtacagtcaagtggtggtaaattgagactgaagggcagaacatgtgaggagttgacatatcagcagccagggcct

SEQ ID NO: 429545 - DNA, 140 bp, Artificial Sequence
  Synthetic
aggccctggctgctgatatgcattgcacccttaaccccagcctatctatcatcatgtcactcaatgccccaatcagcaggtcagacgaagtgtccccaacctctctcacaaatacttcaagaccttttgggacagcggtg

SEQ ID NO: 429546 - DNA, 140 bp, Artificial Sequence
  Synthetic
caccgctgtcccaaaaggtcttgaagtatttgtgagagaggttggggacacttcgtctgacctgctgattggggcattgagtgacatgatgatagataggctggggttaagggtgcaatgcatatcagcagccagggcct

SEQ ID NO: 429547 - DNA, 140 bp, Artificial Sequence
  Synthetic
atacgccatgctgggtctcctaactcttcacatgttctgcccttcagtctcaacttgccactacttgattgtatcatcaccttcccttttgacttactataacagagagcataacccttgcgtacttgggagtcggccat

SEQ ID NO: 429548 - DNA, 140 bp, Artificial Sequence
  Synthetic
atggccgactcccaagtacgcaagggttatgctctctgttatagtaagtcaaaagggaaggtgatgatacaatcaagtagtggcaagttgagactgaagggcagaacatgtgaagagttaggagacccagcatggcgtat

SEQ ID NO: 429549 - DNA, 140 bp, Artificial Sequence
  Synthetic
aggccctggctgctgatatgttaccaccacttgactgcaccatcaccttcccctttgacttactataacagagagcataacctttgaactccacccagttgtccactgcctcaagaaccggaccttttgggacagcggtg

SEQ ID NO: 429550 - DNA, 140 bp, Artificial Sequence
  Synthetic
caccgctgtcccaaaaggtccggttcttgaggcagtggacaactgggtggagttcaaaggttatgctctctgttatagtaagtcaaaggggaaggtgatggtgcagtcaagtggtggtaacatatcagcagccagggcct

SEQ ID NO: 429551 - DNA, 140 bp, Artificial Sequence
  Synthetic
aggccctggctgctgatatgttggtgtcaccactccctcctttggaccccaaaacaagattactcattgcttgctgtatcttgtaatcataatcctgcttattgagcaagaatttgccttgaccttttgggacagcggtg

SEQ ID NO: 429552 - DNA, 140 bp, Artificial Sequence
  Synthetic
caccgctgtcccaaaaggtcaaggcaaattcttgctcaataagcaggattatgattacaagatacagcaagcaatgagtaatcttgttttggggtccaaaggagggagtggtgacaccaacatatcagcagccagggcct

SEQ ID NO: 429553 - DNA, 140 bp, Artificial Sequence
  Synthetic
aggccctggctgctgatatgtgttgattcattgagccaacatactcaaggtggatggcaaagctttccttaaaactagcatcttgactcttaatacggaacctcactgtctgactcagttgaccttttgggacagcggtg

SEQ ID NO: 429554 - DNA, 140 bp, Artificial Sequence
  Synthetic
caccgctgtcccaaaaggtcaactgagtcagacagtgaggttccgtattaagagtcaagatgctagttttaaggaaagctttgccatccaccttgagtatgttggctcaatgaatcaacacatatcagcagccagggcct

SEQ ID NO: 429555 - DNA, 140 bp, Artificial Sequence
  Synthetic
aggccctggctgctgatatgaccctacaaacccagatgctatagaactttggaaagctgatttatttattgcttcagacagtagcttctgagctcctctagtgaatgtcgatgacaacctgaccttttgggacagcggtg

SEQ ID NO: 429556 - DNA, 140 bp, Artificial Sequence
  Synthetic
caccgctgtcccaaaaggtcaggttgtcatcgacattcactagaggagctcagaagctactgtctgaagcaataaataaatcagctttccaaagttctatagcatctgggtttgtagggtcatatcagcagccagggcct

SEQ ID NO: 429557 - DNA, 140 bp, Artificial Sequence
  Synthetic
atacgccatgctgggtctcccctctcttttccatttcactatatgtgagacaagagacaaggcttcacagttaacatccaacgctacacagagatctagaaattttattctaggtgaccacgtacttgggagtcggccat

SEQ ID NO: 429558 - DNA, 140 bp, Artificial Sequence
  Synthetic
atggccgactcccaagtacgtggtcacctagaataaaatttctagatctctgtgtagcgttggatgttaactgtgaagccttgtctcttgtctcacatatagtgaaatggaaaagagaggggagacccagcatggcgtat

SEQ ID NO: 429559 - DNA, 140 bp, Artificial Sequence
  Synthetic
aggccctggctgctgatatgcaaacactgatgggtacagccttctcaaagaatgaatgatgtgattcaaaccaaccctatcctccaatagttttgatgcagttggctttaagggaaaatagaccttttgggacagcggtg

SEQ ID NO: 429560 - DNA, 140 bp, Artificial Sequence
  Synthetic
caccgctgtcccaaaaggtctattttcccttaaagccaactgcatcaaaactattggaggatagggttggtttgaatcacatcattcattctttgagaaggctgtacccatcagtgtttgcatatcagcagccagggcct

SEQ ID NO: 429561 - DNA, 140 bp, Artificial Sequence
  Synthetic
atacgccatgctgggtctccatctgatctgtcagtctatctggtgtttccttcgtgatgaaatggcacatgtaagaaatattcaaaataaacttaaatctattagtcatcatgctcttcacgtacttgggagtcggccat

SEQ ID NO: 429562 - DNA, 140 bp, Artificial Sequence
  Synthetic
atggccgactcccaagtacgtgaagagcatgatgactaatagatttaagtttattttgaatatttcttacatgtgccatttcatcacgaaggaaacaccagatagactgacagatcagatggagacccagcatggcgtat

SEQ ID NO: 429563 - DNA, 140 bp, Artificial Sequence
  Synthetic
aggccctggctgctgatatgaggaactcaacatcagtaattaattcttcctttattttgtcaataaggtccttatggtgataatctgacacataagccattacaaagtacctaagattttgaccttttgggacagcggtg

SEQ ID NO: 429564 - DNA, 140 bp, Artificial Sequence
  Synthetic
caccgctgtcccaaaaggtcaaaatcttaggtactttgtaatggcttatgtgtcagattatcaccataaggaccttattgacaaaataaaggaagaattaattactgatgttgagttcctcatatcagcagccagggcct

SEQ ID NO: 429565 - DNA, 140 bp, Artificial Sequence
  Synthetic
aggccctggctgctgatatgagaaaggtgctcactagacaaatagtttgttgtgaactcttcatggagttgaccagtcttcaacctattgtatagctttctcaacatagatctaatcttggaccttttgggacagcggtg

SEQ ID NO: 429566 - DNA, 140 bp, Artificial Sequence
  Synthetic
caccgctgtcccaaaaggtccaagattagatctatgttgagaaagctatacaataggttgaagactggtcaactccatgaagagttcacaacaaactatttgtctagtgagcacctttctcatatcagcagccagggcct

SEQ ID NO: 429567 - DNA, 140 bp, Artificial Sequence
  Synthetic
atacgccatgctgggtctccatgggtcaatagggtatcttgcatattgtaatagacttaaggttcttttctgtattagattgcataagtgaacagggacaccattcgcaaccgactgatccgtacttgggagtcggccat

SEQ ID NO: 429568 - DNA, 140 bp, Artificial Sequence
  Synthetic
atggccgactcccaagtacggatcagtcggttgcgaatggtgtccctgttcacttatgcaatctaatacagaaaagaaccttaagtctattacaatatgcaagataccctattgacccatggagacccagcatggcgtat

SEQ ID NO: 429569 - DNA, 140 bp, Artificial Sequence
  Synthetic
aggccctggctgctgatatgtttgtctcatgaagttatccactgcatcagcagtactaaccaccctttcttccatcatgggctcatgtgtgcgagagtgtgagtttctcagttcagaagcgaccttttgggacagcggtg

SEQ ID NO: 429570 - DNA, 140 bp, Artificial Sequence
  Synthetic
caccgctgtcccaaaaggtcgcttctgaactgagaaactcacactctcgcacacatgagcccatgatggaagaaagggtggttagtactgctgatgcagtggataacttcatgagacaaacatatcagcagccagggcct

SEQ ID NO: 429571 - DNA, 140 bp, Artificial Sequence
  Synthetic
aggccctggctgctgatatggattcttgactgtaaaaacacaggttttttaacattgctgtagtacagttagttagggacaaggccttgctaagtgcttcagaattactctcacgttcacgaccttttgggacagcggtg

SEQ ID NO: 429572 - DNA, 140 bp, Artificial Sequence
  Synthetic
caccgctgtcccaaaaggtcgtgaacgtgagagtaattctgaagcacttagcaaggccttgtccctaactaactgtactacagcaatgttaaaaaacctgtgtttttacagtcaagaatccatatcagcagccagggcct

SEQ ID NO: 429573 - DNA, 140 bp, Artificial Sequence
  Synthetic
aggccctggctgctgatatggtaaaagaaatcttctgttattgactgtttggttttcttccttaaccctagttgagctttaatgaaggacttcatcatagctgtcaccacattaaaaggtgaccttttgggacagcggtg

SEQ ID NO: 429574 - DNA, 140 bp, Artificial Sequence
  Synthetic
caccgctgtcccaaaaggtcaccttttaatgtggtgacagctatgatgaagtccttcattaaagctcaactagggttaaggaagaaaaccaaacagtcaataacagaagatttcttttaccatatcagcagccagggcct

SEQ ID NO: 429575 - DNA, 140 bp, Artificial Sequence
  Synthetic
atacgccatgctgggtctccattgccagattatggtgttggatgcacacaacaaaaactgagactatctgccaaagtgataaaagcaaagcgcaatccaatagcctaggatccactgtgccgtacttgggagtcggccat

SEQ ID NO: 429576 - DNA, 140 bp, Artificial Sequence
  Synthetic
atggccgactcccaagtacggcacagtggatcctaggctattggattgcgctttgcttttatcactttggcagatagtctcagtttttgttgtgtgcatccaacaccataatctggcaatggagacccagcatggcgtat

SEQ ID NO: 429577 - DNA, 140 bp, Artificial Sequence
  Synthetic
aggccctggctgctgatatgcagtccgaacccaaccaagtgcacccccactcaaccagggcaacactcaatcctccccgcccccctacagcccctaactctcccaagacgggcccgcaccgaccttttgggacagcggtg

SEQ ID NO: 429578 - DNA, 140 bp, Artificial Sequence
  Synthetic
caccgctgtcccaaaaggtcggtgcgggcccgtcttgggagagttaggggctgtaggggggcggggaggattgagtgttgccctggttgagtgggggtgcacttggttgggttcggactgcatatcagcagccagggcct

SEQ ID NO: 429579 - DNA, 140 bp, Artificial Sequence
  Synthetic
atacgccatgctgggtctccagaacatgtggtctgctggagtaacagctcactttaagacaaggtcccgtaggaggcacagaagtaacaagaggtaattaaagacaattaaattagatagcgtacttgggagtcggccat

SEQ ID NO: 429580 - DNA, 140 bp, Artificial Sequence
  Synthetic
atggccgactcccaagtacgctatctaatttaattgtctttaattacctcttgttacttctgtgcctcctacgggaccttgtcttaaagtgagctgttactccagcagaccacatgttctggagacccagcatggcgtat

SEQ ID NO: 429581 - DNA, 140 bp, Artificial Sequence
  Synthetic
aggccctggctgctgatatgagcattttcaaattccttttcattgttcaggcaactccctgataactgtaggcttagggcttcaaagtaatcttctataagtctagtaaacatcttcgtcgaccttttgggacagcggtg

SEQ ID NO: 429582 - DNA, 140 bp, Artificial Sequence
  Synthetic
caccgctgtcccaaaaggtcgacgaagatgtttactagacttatagaagattactttgaagccctaagcctacagttatcagggagttgcctgaacaatgaaaaggaatttgaaaatgctcatatcagcagccagggcct

SEQ ID NO: 429583 - DNA, 140 bp, Artificial Sequence
  Synthetic
aggccctggctgctgatatgctccaactacattgttgttaatagcataacactttgagcattcacctgtcttttgatataatagtttgaatcccatcctattgatgaagaactcttggcagaccttttgggacagcggtg

SEQ ID NO: 429584 - DNA, 140 bp, Artificial Sequence
  Synthetic
caccgctgtcccaaaaggtctgccaagagttcttcatcaataggatgggattcaaactattatatcaaaagacaggtgaatgctcaaagtgttatgctattaacaacaatgtagttggagcatatcagcagccagggcct

SEQ ID NO: 429585 - DNA, 140 bp, Artificial Sequence
  Synthetic
atacgccatgctgggtctcctctcctgcacaaagaacaacagtcatcattacataatggtgggtaatgagacaggactggaactgaccttgaccaatacgagcattattaatcataaattcgtacttgggagtcggccat

SEQ ID NO: 429586 - DNA, 140 bp, Artificial Sequence
  Synthetic
atggccgactcccaagtacgaatttatgattaataatgctcgtattggtcaaggtcagttccagtcctgtctcattacccaccattatgtaatgatgactgttgttctttgtgcaggagaggagacccagcatggcgtat

SEQ ID NO: 429587 - DNA, 140 bp, Artificial Sequence
  Synthetic
aggccctggctgctgatatgtcttgatagcttctcattatctgcaaggtattttgagataagatctttagcattggcaatgtcttcctccatcgccggttatggcacctgtgttgagtttgaccttttgggacagcggtg

SEQ ID NO: 429588 - DNA, 140 bp, Artificial Sequence
  Synthetic
caccgctgtcccaaaaggtcaaactcaacacaggtgccataaccggcgatggaggaagacattgccaatgctaaagatcttatctcaaaataccttgcagataatgagaagctatcaagacatatcagcagccagggcct

SEQ ID NO: 429589 - DNA, 140 bp, Artificial Sequence
  Synthetic
atacgccatgctgggtctccaaaacattttatctgatctgtcaatctatctggtgtttctttcgtaatgaagtggcacatgtaggaaacattcaaaatgaacttgaacctattagtcatccgtacttgggagtcggccat

SEQ ID NO: 429590 - DNA, 140 bp, Artificial Sequence
  Synthetic
atggccgactcccaagtacggatgactaataggttcaagttcattttgaatgtttcctacatgtgccacttcattacgaaagaaacaccagatagattgacagatcagataaaatgttttggagacccagcatggcgtat

SEQ ID NO: 429591 - DNA, 140 bp, Artificial Sequence
  Synthetic
aggccctggctgctgatatgagtggcacatgtaggaaacattcaaaatgaacttgaacctattagtcatcatgctcttcacatcctcagataaaaccagattcattaatgtccttattaagaccttttgggacagcggtg

SEQ ID NO: 429592 - DNA, 140 bp, Artificial Sequence
  Synthetic
caccgctgtcccaaaaggtcttaataaggacattaatgaatctggttttatctgaggatgtgaagagcatgatgactaataggttcaagttcattttgaatgtttcctacatgtgccactcatatcagcagccagggcct

SEQ ID NO: 429593 - DNA, 140 bp, Artificial Sequence
  Synthetic
atacgccatgctgggtctcccctatagagaaggaattcaatatcagtgattaactcttcccttattttgtcaatgaggtccttatgatgataatctgacacataagccattacaaagtaccgtacttgggagtcggccat

SEQ ID NO: 429594 - DNA, 140 bp, Artificial Sequence
  Synthetic
atggccgactcccaagtacggtactttgtaatggcttatgtgtcagattatcatcataaggacctcattgacaaaataagggaagagttaatcactgatattgaattccttctctataggggagacccagcatggcgtat

SEQ ID NO: 429595 - DNA, 140 bp, Artificial Sequence
  Synthetic
aggccctggctgctgatatgtgtaaaacctcagctgaaaatattgctggaaaatatcttttaggatcagcataaaatgagcacacctcaccaactttgttatcattaatagcatagcactgaccttttgggacagcggtg

SEQ ID NO: 429596 - DNA, 140 bp, Artificial Sequence
  Synthetic
caccgctgtcccaaaaggtcagtgctatgctattaatgataacaaagttggtgaggtgtgctcattttatgctgatcctaaaagatattttccagcaatattttcagctgaggttttacacatatcagcagccagggcct

SEQ ID NO: 429597 - DNA, 140 bp, Artificial Sequence
  Synthetic
aggccctggctgctgatatgatgaagaaccatctacgggacatcatgggaattccatactgtaattacagcaagtattggtacctcaaccacacaactactgggaaaacatcactgcccagaccttttgggacagcggtg

SEQ ID NO: 429598 - DNA, 140 bp, Artificial Sequence
  Synthetic
caccgctgtcccaaaaggtctgggcagtgatgttttcccagtagttgtgtggttgaggtaccaatacttgctgtaattacagtatggaattcccatgatgtcccgtagatggttcttcatcatatcagcagccagggcct

SEQ ID NO: 429599 - DNA, 140 bp, Artificial Sequence
  Synthetic
aggccctggctgctgatatggtttgtatggatctaatgtaaagattctccttgttaggccctctgacgcacttgctacctagtgttctgcacaaccctacaaacccagatgctatagaacgaccttttgggacagcggtg

SEQ ID NO: 429600 - DNA, 140 bp, Artificial Sequence
  Synthetic
caccgctgtcccaaaaggtcgttctatagcatctgggtttgtagggttgtgcagaacactaggtagcaagtgcgtcagagggcctaacaaggagaatctttacattagatccatacaaaccatatcagcagccagggcct

SEQ ID NO: 429601 - DNA, 140 bp, Artificial Sequence
  Synthetic
aggccctggctgctgatatgttcacaaagtcttgaatactcagactcttcgaacaatgcattactttcttgtgaatattttaacaaggtgaataaggtgtccctgagtttgtcattcaccgaccttttgggacagcggtg

SEQ ID NO: 429602 - DNA, 140 bp, Artificial Sequence
  Synthetic
caccgctgtcccaaaaggtcggtgaatgacaaactcagggacaccttattcaccttgttaaaatattcacaagaaagtaatgcattgttcgaagagtctgagtattcaagactttgtgaacatatcagcagccagggcct

SEQ ID NO: 429603 - DNA, 140 bp, Artificial Sequence
  Synthetic
aggccctggctgctgatatgtctccagcattggacctgacattctccagtagtttgggtttcccttttttcattcccctcatcaatatttgcatacaaaaatctcaatattggtgatgctgaccttttgggacagcggtg

SEQ ID NO: 429604 - DNA, 140 bp, Artificial Sequence
  Synthetic
caccgctgtcccaaaaggtcagcatcaccaatattgagatttttgtatgcaaatattgatgaggggaatgaaaaaagggaaacccaaactactggagaatgtcaggtccaatgctggagacatatcagcagccagggcct

SEQ ID NO: 429605 - DNA, 140 bp, Artificial Sequence
  Synthetic
aggccctggctgctgatatgatgtcttcctccatcgccaattggggcacctgtatagggtttgggtttatgctggaatggcctgtggttcaattgatggtgccccacagaagatcctatagaccttttgggacagcggtg

SEQ ID NO: 429606 - DNA, 140 bp, Artificial Sequence
  Synthetic
caccgctgtcccaaaaggtctataggatcttctgtggggcaccatcaattgaaccacaggccattccagcataaacccaaaccctatacaggtgccccaattggcgatggaggaagacatcatatcagcagccagggcct

SEQ ID NO: 429607 - DNA, 140 bp, Artificial Sequence
  Synthetic
atacgccatgctgggtctccgggatcctaggcaatttggttgttctttctttttaagctttgtgcgctgaactcctccaaatgggaaacaagcaagccaaagccccagaaccaaaggacacgtacttgggagtcggccat

SEQ ID NO: 429608 - DNA, 140 bp, Artificial Sequence
  Synthetic
atggccgactcccaagtacgtgtcctttggttctggggctttggcttgcttgtttcccatttggaggagttcagcgcacaaagcttaaaaagaaagaacaaccaaattgcctaggatcccggagacccagcatggcgtat

SEQ ID NO: 429609 - DNA, 140 bp, Artificial Sequence
  Synthetic
aggccctggctgctgatatggcgcttttagagatttttgtgtgagtggccttcatcaagccatgggacaaattataacattctttcaagaagtacctcatgtcatagaggaagtgatgaagaccttttgggacagcggtg

SEQ ID NO: 429610 - DNA, 140 bp, Artificial Sequence
  Synthetic
caccgctgtcccaaaaggtcttcatcacttcctctatgacatgaggtacttcttgaaagaatgttataatttgtcccatggcttgatgaaggccactcacacaaaaatctctaaaagcgccatatcagcagccagggcct

SEQ ID NO: 429611 - DNA, 140 bp, Artificial Sequence
  Synthetic
atacgccatgctgggtctccctatttgtgtctcaactgcctcaccctactcttgagtgtcagcaacaggtgccccatttgcaagatgcccctccccacgaaactgagaccatcagttgctcgtacttgggagtcggccat

SEQ ID NO: 429612 - DNA, 140 bp, Artificial Sequence
  Synthetic
atggccgactcccaagtacgagcaactgatggtctcagtttcgtggggaggggcatcttgcaaatggggcacctgttgctgacactcaagagtagggtgaggcagttgagacacaaatagggagacccagcatggcgtat

SEQ ID NO: 429613 - DNA, 140 bp, Artificial Sequence
  Synthetic
atacgccatgctgggtctcccaatcatgtttaggatggggtgactttgagtcagcctatctaagtctgaagtattgggatactttgctgtgtagatcagacccaaatctgtcaatgcttgcgtacttgggagtcggccat

SEQ ID NO: 429614 - DNA, 140 bp, Artificial Sequence
  Synthetic
atggccgactcccaagtacgcaagcattgacagatttgggtctgatctacacagcaaagtatcccaatacttcagacttagataggctgactcaaagtcaccccatcctaaacatgattgggagacccagcatggcgtat

SEQ ID NO: 429615 - DNA, 140 bp, Artificial Sequence
  Synthetic
atacgccatgctgggtctccttaggttttgaattattgttagaaacaagaaaggacacatcatagggccccacttactgtgatccatactatatgatacatgtgccgatgagacattcaacgtacttgggagtcggccat

SEQ ID NO: 429616 - DNA, 140 bp, Artificial Sequence
  Synthetic
atggccgactcccaagtacgttgaatgtctcatcggcacatgtatcatatagtatggatcacagtaagtggggccctatgatgtgtcctttcttgtttctaacaataattcaaaacctaaggagacccagcatggcgtat

SEQ ID NO: 429617 - DNA, 140 bp, Artificial Sequence
  Synthetic
aggccctggctgctgatatgctatcggttatctggggctactgtcacaaaggaccagggacatttacatcagtcgaagacttcttgggacttttacttggactctctctgattctgaagggaccttttgggacagcggtg

SEQ ID NO: 429618 - DNA, 140 bp, Artificial Sequence
  Synthetic
caccgctgtcccaaaaggtcccttcagaatcagagagagtccaagtaaaagtcccaagaagtcttcgactgatgtaaatgtccctggtcctttgtgacagtagccccagataaccgatagcatatcagcagccagggcct

SEQ ID NO: 429619 - DNA, 140 bp, Artificial Sequence
  Synthetic
aggccctggctgctgatatgcaagcctcccctatgcacaaccagaggggctggttcagtgcaaggacccaccaatacaaagtcatactccgtaaactgcagcttttccatatcaacaacagaccttttgggacagcggtg

SEQ ID NO: 429620 - DNA, 140 bp, Artificial Sequence
  Synthetic
caccgctgtcccaaaaggtctgttgttgatatggaaaagctgcagtttacggagtatgactttgtattggtgggtccttgcactgaaccagcccctctggttgtgcataggggaggcttgcatatcagcagccagggcct

SEQ ID NO: 429621 - DNA, 140 bp, Artificial Sequence
  Synthetic
atacgccatgctgggtctccaacagttcactatggaatgaggtcccgtaaggggcacaagggacacaagagtcaattaaaagcaattaaattagatggccttaatgcctaggatcctcggcgtacttgggagtcggccat

SEQ ID NO: 429622 - DNA, 140 bp, Artificial Sequence
  Synthetic
atggccgactcccaagtacgccgaggatcctaggcattaaggccatctaatttaattgcttttaattgactcttgtgtcccttgtgccccttacgggacctcattccatagtgaactgttggagacccagcatggcgtat

SEQ ID NO: 429623 - DNA, 140 bp, Artificial Sequence
  Synthetic
atacgccatgctgggtctcccggggatcctaggcatttttggttgcgcaatccaagcatcccattcaaaatgggacaaatagtgacatttttccaggaagtgcctcatgttatagaagaacgtacttgggagtcggccat

SEQ ID NO: 429624 - DNA, 140 bp, Artificial Sequence
  Synthetic
atggccgactcccaagtacgttcttctataacatgaggcacttcctggaaaaatgtcactatttgtcccattttgaatgggatgcttggattgcgcaaccaaaaatgcctaggatccccgggagacccagcatggcgtat

SEQ ID NO: 429625 - DNA, 140 bp, Artificial Sequence
  Synthetic
aggccctggctgctgatatgtgttgtgtggcaggtcttgcacaaccagtctttacaaaggggtttatgagcttcagactctggagttaaacatggagacactcaacatgaccatgcctctgaccttttgggacagcggtg

SEQ ID NO: 429626 - DNA, 140 bp, Artificial Sequence
  Synthetic
caccgctgtcccaaaaggtcagaggcatggtcatgttgagtgtctccatgtttaactccagagtctgaagctcataaacccctttgtaaagactggttgtgcaagacctgccacacaacacatatcagcagccagggcct

SEQ ID NO: 429627 - DNA, 140 bp, Artificial Sequence
  Synthetic
atacgccatgctgggtctccccagagatgtttatatcagtagaagactgctaggcacattcacatggacactgtcagattctgaaggcaaggacacaccaggagggtactgtctgaccagcgtacttgggagtcggccat

SEQ ID NO: 429628 - DNA, 140 bp, Artificial Sequence
  Synthetic
atggccgactcccaagtacgctggtcagacagtaccctcctggtgtgtccttgccttcagaatctgacagtgtccatgtgaatgtgcctagcagtcttctactgatataaacatctctggggagacccagcatggcgtat

SEQ ID NO: 429629 - DNA, 140 bp, Artificial Sequence
  Synthetic
aggccctggctgctgatatgtagctggctcaatatcaaagtctatccaagcataacccatcatcagatcatgtttaaacattggcctttcaacacctttgtgaataactttctctacaaagaccttttgggacagcggtg

SEQ ID NO: 429630 - DNA, 140 bp, Artificial Sequence
  Synthetic
caccgctgtcccaaaaggtctttgtagagaaagttattcacaaaggtgttgaaaggccaatgtttaaacatgatctgatgatgggttatgcttggatagactttgatattgagccagctacatatcagcagccagggcct

SEQ ID NO: 429631 - DNA, 140 bp, Artificial Sequence
  Synthetic
atacgccatgctgggtctcctgtgtcagtatcaaaactaaaatcattttggttaacaattttatagtgatcaattgttcagataactctgtgcactcttctatccagctgaccataacatcgtacttgggagtcggccat

SEQ ID NO: 429632 - DNA, 140 bp, Artificial Sequence
  Synthetic
atggccgactcccaagtacgatgttatggtcagctggatagaagagtgcacagagttatctgaacaattgatcactataaaattgttaaccaaaatgattttagttttgatactgacacaggagacccagcatggcgtat

SEQ ID NO: 429633 - DNA, 140 bp, Artificial Sequence
  Synthetic
aggccctggctgctgatatgggcaccacagccctcagcgtggagacaatgtccacccctgaccactgcatcctcaaccccagcctgtctaccatcatatcactcagtgccccaatcagcagaccttttgggacagcggtg

SEQ ID NO: 429634 - DNA, 140 bp, Artificial Sequence
  Synthetic
caccgctgtcccaaaaggtctgctgattggggcactgagtgatatgatggtagacaggctggggttgaggatgcagtggtcaggggtggacattgtctccacgctgagggctgtggtgcccatatcagcagccagggcct

SEQ ID NO: 429635 - DNA, 140 bp, Artificial Sequence
  Synthetic
aggccctggctgctgatatgaagaagtgtatgtaacagcccgacataggttgataaagagctatttccacagggtcttctggacgaccttcaatgtctatccaggttttggcacttgggtgaccttttgggacagcggtg

SEQ ID NO: 429636 - DNA, 140 bp, Artificial Sequence
  Synthetic
caccgctgtcccaaaaggtcacccaagtgccaaaacctggatagacattgaaggtcgtccagaagaccctgtggaaatagctctttatcaacctatgtcgggctgttacatacacttcttcatatcagcagccagggcct

SEQ ID NO: 429637 - DNA, 140 bp, Artificial Sequence
  Synthetic
aggccctggctgctgatatgctccatcaagcaaaatttcgtccaggtcagcttcatcagcatcacttttgtgctgcccagatcctagtaccagattgctcattgcctgttgcactttgtagaccttttgggacagcggtg

SEQ ID NO: 429638 - DNA, 140 bp, Artificial Sequence
  Synthetic
caccgctgtcccaaaaggtctacaaagtgcaacaggcaatgagcaatctggtactaggatctgggcagcacaaaagtgatgctgatgaagctgacctggacgaaattttgcttgatggagcatatcagcagccagggcct

SEQ ID NO: 429639 - DNA, 140 bp, Artificial Sequence
  Synthetic
aggccctggctgctgatatgtcaacaggggtcacatgccctagttgatttgtgtcaattaaaaactcattaataatctcggtgtcaacataccatgctgatttgcccttaaaagtgggtcgaccttttgggacagcggtg

SEQ ID NO: 429640 - DNA, 140 bp, Artificial Sequence
  Synthetic
caccgctgtcccaaaaggtcgacccacttttaagggcaaatcagcatggtatgttgacaccgagattattaatgagtttttaattgacacaaatcaactagggcatgtgacccctgttgacatatcagcagccagggcct

SEQ ID NO: 429641 - DNA, 140 bp, Artificial Sequence
  Synthetic
aggccctggctgctgatatgctgacaaaaccagtctccagcagtctgacaaaacacacggactcactgcacctgagtacataacggatacatcatgtactaaatacttggcctgttgattgaccttttgggacagcggtg

SEQ ID NO: 429642 - DNA, 140 bp, Artificial Sequence
  Synthetic
caccgctgtcccaaaaggtcaatcaacaggccaagtatttagtacatgatgtatccgttatgtactcaggtgcagtgagtccgtgtgttttgtcagactgctggagactggttttgtcagcatatcagcagccagggcct

SEQ ID NO: 429643 - DNA, 140 bp, Artificial Sequence
  Synthetic
aggccctggctgctgatatgctcatgtcatagaggaagtgatgaacattgtcctaatcacccttagccttctggcaatactgaaagggatctacaatgttgctacctgtggcctttttgggaccttttgggacagcggtg

SEQ ID NO: 429644 - DNA, 140 bp, Artificial Sequence
  Synthetic
caccgctgtcccaaaaggtcccaaaaaggccacaggtagcaacattgtagatccctttcagtattgccagaaggctaagggtgattaggacaatgttcatcacttcctctatgacatgagcatatcagcagccagggcct

SEQ ID NO: 429645 - DNA, 140 bp, Artificial Sequence
  Synthetic
aggccctggctgctgatatgcagactgcattctcatacttcctggaatcagttttgctgagggcaatgtcaattaatttgatgtccttcctcccttgtgattcaaggagtttccttatatgaccttttgggacagcggtg

SEQ ID NO: 429646 - DNA, 140 bp, Artificial Sequence
  Synthetic
caccgctgtcccaaaaggtcatataaggaaactccttgaatcacaagggaggaaggacatcaaattaattgacattgccctcagcaaaactgattccaggaagtatgagaatgcagtctgcatatcagcagccagggcct

SEQ ID NO: 429647 - DNA, 140 bp, Artificial Sequence
  Synthetic
aggccctggctgctgatatgtccactgggtcttcaggtcttccttcaatgtccatccaggtcttagcatttggatcaagttgcagcattgcatccttgagggtcatgagctgagaataaggaccttttgggacagcggtg

SEQ ID NO: 429648 - DNA, 140 bp, Artificial Sequence
  Synthetic
caccgctgtcccaaaaggtccttattctcagctcatgaccctcaaggatgcaatgctgcaacttgatccaaatgctaagacctggatggacattgaaggaagacctgaagacccagtggacatatcagcagccagggcct

SEQ ID NO: 429649 - DNA, 140 bp, Artificial Sequence
  Synthetic
aggccctggctgctgatatgagtttcctccttgtgttcaatatcctcaaagattttactttatttaggaatgacttccagcattgcacctgacattctccaatggtttggttttccccttgaccttttgggacagcggtg

SEQ ID NO: 429650 - DNA, 140 bp, Artificial Sequence
  Synthetic
caccgctgtcccaaaaggtcaaggggaaaaccaaaccattggagaatgtcaggtgcaatgctggaagtcattcctaaataaagtaaaatctttgaggatattgaacacaaggaggaaactcatatcagcagccagggcct

SEQ ID NO: 429651 - DNA, 140 bp, Artificial Sequence
  Synthetic
atacgccatgctgggtctccccttttagtggatccttgaatcaaagtgcccagtgatgggcaacagacaggctaaatcgacaaaagttgatgaacatcaaagagctcatctagtgccagacgtacttgggagtcggccat

SEQ ID NO: 429652 - DNA, 140 bp, Artificial Sequence
  Synthetic
atggccgactcccaagtacgtctggcactagatgagctctttgatgttcatcaacttttgtcgatttagcctgtctgttgcccatcactgggcactttgattcaaggatccactaaaaggggagacccagcatggcgtat

SEQ ID NO: 429653 - DNA, 140 bp, Artificial Sequence
  Synthetic
aggccctggctgctgatatgaacaatttaattcctttgacatcagaaatcagagactgaatggacttgatatacagattctctttgtttggtccccgaacacatttgctacccaatgttcgaccttttgggacagcggtg

SEQ ID NO: 429654 - DNA, 140 bp, Artificial Sequence
  Synthetic
caccgctgtcccaaaaggtcgaacattgggtagcaaatgtgttcggggaccaaacaaagagaatctgtatatcaagtccattcagtctctgatttctgatgtcaaaggaattaaattgttcatatcagcagccagggcct

SEQ ID NO: 429655 - DNA, 140 bp, Artificial Sequence
  Synthetic
aggccctggctgctgatatgatacagattctctttgtttggtccccgaacacatttgctacccaatgttctgcataatcccacaaagccagatgcaatggaactttggaatgcagatttggaccttttgggacagcggtg

SEQ ID NO: 429656 - DNA, 140 bp, Artificial Sequence
  Synthetic
caccgctgtcccaaaaggtccaaatctgcattccaaagttccattgcatctggctttgtgggattatgcagaacattgggtagcaaatgtgttcggggaccaaacaaagagaatctgtatcatatcagcagccagggcct

SEQ ID NO: 429657 - DNA, 140 bp, Artificial Sequence
  Synthetic
aggccctggctgctgatatggggaccccccgccgggggcccccccggggggctcagaggctggcatcactcaatgtcctctacctgcaccagtgtgtcgaacaatttaatgcacgtccttgaccttttgggacagcggtg

SEQ ID NO: 429658 - DNA, 140 bp, Artificial Sequence
  Synthetic
caccgctgtcccaaaaggtcaaggacgtgcattaaattgttcgacacactggtgcaggtagaggacattgagtgatgccagcctctgagccccccgggggggcccccggcggggggtccccatatcagcagccagggcct

SEQ ID NO: 429659 - DNA, 140 bp, Artificial Sequence
  Synthetic
aggccctggctgctgatatgctgtgagctcaaattgcccatatagacacctgcactcaatggcctttctgtcctggtcacttttgatttcaacttctctagatcagcagctaagattaatgaccttttgggacagcggtg

SEQ ID NO: 429660 - DNA, 140 bp, Artificial Sequence
  Synthetic
caccgctgtcccaaaaggtcattaatcttagctgctgatctagagaagttgaaatcaaaagtgaccaggacagaaaggccattgagtgcaggtgtctatatgggcaatttgagctcacagcatatcagcagccagggcct

SEQ ID NO: 429661 - DNA, 140 bp, Artificial Sequence
  Synthetic
atacgccatgctgggtctccaagtcatctgaggttagggtcccaactctcagtacactcttctgttgagttgattttaactcaacgagattgttgaccgcttgatttaggtccctcagcccgtacttgggagtcggccat

SEQ ID NO: 429662 - DNA, 140 bp, Artificial Sequence
  Synthetic
atggccgactcccaagtacgggctgagggacctaaatcaagcggtcaacaatctcgttgagttaaaatcaactcaacagaagagtgtactgagagttgggaccctaacctcagatgacttggagacccagcatggcgtat

SEQ ID NO: 429663 - DNA, 140 bp, Artificial Sequence
  Synthetic
atacgccatgctgggtctcctcattaccaaattgctgtgttggatatacgcagcgaaaagctgagactatctcccaaaatgacaaaagcaaagcgcaatccaatagcctaggatccactgcgtacttgggagtcggccat

SEQ ID NO: 429664 - DNA, 140 bp, Artificial Sequence
  Synthetic
atggccgactcccaagtacgcagtggatcctaggctattggattgcgctttgcttttgtcattttgggagatagtctcagcttttcgctgcgtatatccaacacagcaatttggtaatgaggagacccagcatggcgtat

SEQ ID NO: 429665 - DNA, 140 bp, Artificial Sequence
  Synthetic
aggccctggctgctgatatgcggggatcctaggcaatttggttgttctttcttgaggccttgtgtgctgaactcctccaaatgggaaataagcaagccaaaaccccagaaacaaaagacagaccttttgggacagcggtg

SEQ ID NO: 429666 - DNA, 140 bp, Artificial Sequence
  Synthetic
caccgctgtcccaaaaggtctgtcttttgtttctggggttttggcttgcttatttcccatttggaggagttcagcacacaaggcctcaagaaagaacaaccaaattgcctaggatccccgcatatcagcagccagggcct

SEQ ID NO: 429667 - DNA, 140 bp, Artificial Sequence
  Synthetic
aggccctggctgctgatatggtcccatttgcaagatgcctctccccacaaaactgagaccatcagtagccccaacagcacccccagccggagcagcggacaacaccagacccccaccctagaccttttgggacagcggtg

SEQ ID NO: 429668 - DNA, 140 bp, Artificial Sequence
  Synthetic
caccgctgtcccaaaaggtctagggtgggggtctggtgttgtccgctgctccggctgggggtgctgttggggctactgatggtctcagttttgtggggagaggcatcttgcaaatgggaccatatcagcagccagggcct

SEQ ID NO: 429669 - DNA, 140 bp, Artificial Sequence
  Synthetic
aggccctggctgctgatatggcaataagctggttcaagtttatctgagctggttctatgtcaaagtctatccatgcatagcccatcattagatcaaacttaaacataggtctctctatccgaccttttgggacagcggtg

SEQ ID NO: 429670 - DNA, 140 bp, Artificial Sequence
  Synthetic
caccgctgtcccaaaaggtcggatagagagacctatgtttaagtttgatctaatgatgggctatgcatggatagactttgacatagaaccagctcagataaacttgaaccagcttattgccatatcagcagccagggcct

SEQ ID NO: 429671 - DNA, 140 bp, Artificial Sequence
  Synthetic
aggccctggctgctgatatgccatgcatagcccatcattagatcaaacttaaacataggtctctctatccctttataaatagctttctcaatgaatgaagagaagggacccagtcgctgcgaccttttgggacagcggtg

SEQ ID NO: 429672 - DNA, 140 bp, Artificial Sequence
  Synthetic
caccgctgtcccaaaaggtcgcagcgactgggtcccttctcttcattcattgagaaagctatttataaagggatagagagacctatgtttaagtttgatctaatgatgggctatgcatggcatatcagcagccagggcct

SEQ ID NO: 429673 - DNA, 140 bp, Artificial Sequence
  Synthetic
aggccctggctgctgatatgaccccccggggggaccccccgccgggggcccccccgggggagccagccatctccgaaaactattcaatgtcctcgatgtattcatctttcccagtcaactgaccttttgggacagcggtg

SEQ ID NO: 429674 - DNA, 140 bp, Artificial Sequence
  Synthetic
caccgctgtcccaaaaggtcagttgactgggaaagatgaatacatcgaggacattgaatagttttcggagatggctggctcccccgggggggcccccggcggggggtccccccggggggtcatatcagcagccagggcct

SEQ ID NO: 429675 - DNA, 140 bp, Artificial Sequence
  Synthetic
aggccctggctgctgatatgcctcacatgttctgcccttcagtctcaacctaccactgcttgattgtatcatcacctttccccttgacttgctataacagagagcataacccttgaactcgaccttttgggacagcggtg

SEQ ID NO: 429676 - DNA, 140 bp, Artificial Sequence
  Synthetic
caccgctgtcccaaaaggtcgagttcaagggttatgctctctgttatagcaagtcaaggggaaaggtgatgatacaatcaagcagtggtaggttgagactgaagggcagaacatgtgaggcatatcagcagccagggcct

SEQ ID NO: 429677 - DNA, 140 bp, Artificial Sequence
  Synthetic
atacgccatgctgggtctcctacaacttaagccacagctatgctgtggatgcagccaaccattgtggcacagttgcaaatggtgtcctacagactttcatgaggatggcctggggtgggacgtacttgggagtcggccat

SEQ ID NO: 429678 - DNA, 140 bp, Artificial Sequence
  Synthetic
atggccgactcccaagtacgtcccaccccaggccatcctcatgaaagtctgtaggacaccatttgcaactgtgccacaatggttggctgcatccacagcatagctgtggcttaagttgtaggagacccagcatggcgtat

SEQ ID NO: 429679 - DNA, 140 bp, Artificial Sequence
  Synthetic
aggccctggctgctgatatggttctcaagaccatctcccatcggctatcttgggcttctctcacaaaggaccagagacatttacattagtagaagactactgggcacattcacatggacagaccttttgggacagcggtg

SEQ ID NO: 429680 - DNA, 140 bp, Artificial Sequence
  Synthetic
caccgctgtcccaaaaggtctgtccatgtgaatgtgcccagtagtcttctactaatgtaaatgtctctggtcctttgtgagagaagcccaagatagccgatgggagatggtcttgagaaccatatcagcagccagggcct

SEQ ID NO: 429681 - DNA, 140 bp, Artificial Sequence
  Synthetic
atacgccatgctgggtctccttcaccaaagcgaggctcaatgaagaaagtctctctaagtcagtggttcccagtagttccacatcccccatcacataagggaatgtttcttcctctgttccgtacttgggagtcggccat

SEQ ID NO: 429682 - DNA, 140 bp, Artificial Sequence
  Synthetic
atggccgactcccaagtacggaacagaggaagaaacattcccttatgtgatgggggatgtggaactactgggaaccactgacttagagagactttcttcattgagcctcgctttggtgaaggagacccagcatggcgtat

SEQ ID NO: 429683 - DNA, 140 bp, Artificial Sequence
  Synthetic
atacgccatgctgggtctccaccctgaaggtagtgaagctacagcatcaaagaaatcctccaatgagtcaaacttgagatcaaccaaacctgatgcgatcaattgattgtgattgaatctcgtacttgggagtcggccat

SEQ ID NO: 429684 - DNA, 140 bp, Artificial Sequence
  Synthetic
atggccgactcccaagtacgagattcaatcacaatcaattgatcgcatcaggtttggttgatctcaagtttgactcattggaggatttctttgatgctgtagcttcactaccttcagggtggagacccagcatggcgtat

SEQ ID NO: 429685 - DNA, 140 bp, Artificial Sequence
  Synthetic
aggccctggctgctgatatggcagttcaaaaggaatggatcaataggatacttggcataacataacaaactcaaagtcctcttctgaatttgattgcacagatcaactgggacaccattagaccttttgggacagcggtg

SEQ ID NO: 429686 - DNA, 140 bp, Artificial Sequence
  Synthetic
caccgctgtcccaaaaggtctaatggtgtcccagttgatctgtgcaatcaaattcagaagaggactttgagtttgttatgttatgccaagtatcctattgatccattccttttgaactgccatatcagcagccagggcct

SEQ ID NO: 429687 - DNA, 140 bp, Artificial Sequence
  Synthetic
atacgccatgctgggtctcctgccttggtggcatgaggcaatcacttcctcataatgattagagcgattgtccatcagaacatttaaactctccacccctgataatctacccgaagtcatcgtacttgggagtcggccat

SEQ ID NO: 429688 - DNA, 140 bp, Artificial Sequence
  Synthetic
atggccgactcccaagtacgatgacttcgggtagattatcaggggtggagagtttaaatgttctgatggacaatcgctctaatcattatgaggaagtgattgcctcatgccaccaaggcaggagacccagcatggcgtat

SEQ ID NO: 429689 - DNA, 140 bp, Artificial Sequence
  Synthetic
aggccctggctgctgatatgtaatctgatctgttaatctatctggtgtttcttttgtaataaaatgacacatgtaggaaacattcaaaatgaatttgaacctattagtcatcatgctcttgaccttttgggacagcggtg

SEQ ID NO: 429690 - DNA, 140 bp, Artificial Sequence
  Synthetic
caccgctgtcccaaaaggtcaagagcatgatgactaataggttcaaattcattttgaatgtttcctacatgtgtcattttattacaaaagaaacaccagatagattaacagatcagattacatatcagcagccagggcct

SEQ ID NO: 429691 - DNA, 140 bp, Artificial Sequence
  Synthetic
atacgccatgctgggtctccatttctaagttccagcggaacttgccaatattgaatgccattagaatttgtcaacaatttgattcccttgacatcagaaattagggattgaatggatttacgtacttgggagtcggccat

SEQ ID NO: 429692 - DNA, 140 bp, Artificial Sequence
  Synthetic
atggccgactcccaagtacgtaaatccattcaatccctaatttctgatgtcaagggaatcaaattgttgacaaattctaatggcattcaatattggcaagttccgctggaacttagaaatggagacccagcatggcgtat

SEQ ID NO: 429693 - DNA, 140 bp, Artificial Sequence
  Synthetic
aggccctggctgctgatatggctctaattttttgaagtcctcaatgtacttttgctcaaagttagcaggagatgatctaacaaaacactctaacagtattagaacattgcccgtcagcttgaccttttgggacagcggtg

SEQ ID NO: 429694 - DNA, 140 bp, Artificial Sequence
  Synthetic
caccgctgtcccaaaaggtcaagctgacgggcaatgttctaatactgttagagtgttttgttagatcatctcctgctaactttgagcaaaagtacattgaggacttcaaaaaattagagccatatcagcagccagggcct

SEQ ID NO: 429695 - DNA, 140 bp, Artificial Sequence
  Synthetic
aggccctggctgctgatatggtcttgacaatctctcgttatccactaggtactttgatactaaatctttgacacaggctatgtcttcctccatgttcagctgcaggtatgatggtcagatgaccttttgggacagcggtg

SEQ ID NO: 429696 - DNA, 140 bp, Artificial Sequence
  Synthetic
caccgctgtcccaaaaggtcatctgaccatcatacctgcagctgaacatggaggaagacatagcctgtgtcaaagatttagtatcaaagtacctagtggataacgagagattgtcaagaccatatcagcagccagggcct

SEQ ID NO: 429697 - DNA, 140 bp, Artificial Sequence
  Synthetic
aggccctggctgctgatatggcactaggaatcaacccctctatttgcctcataatcctgtaactacggttgccatccacccagtctctgacatctgtctcgcagttcagcaagaatgggtgaccttttgggacagcggtg

SEQ ID NO: 429698 - DNA, 140 bp, Artificial Sequence
  Synthetic
caccgctgtcccaaaaggtcacccattcttgctgaactgcgagacagatgtcagagactgggtggatggcaaccgtagttacaggattatgaggcaaatagaggggttgattcctagtgccatatcagcagccagggcct

SEQ ID NO: 429699 - DNA, 140 bp, Artificial Sequence
  Synthetic
aggccctggctgctgatatgtagttccacatcccccatcacataagggaatgtttcttcctctgttctctgataactgattgtagggacaactccagagacatcaaagtccataatcaaagaccttttgggacagcggtg

SEQ ID NO: 429700 - DNA, 140 bp, Artificial Sequence
  Synthetic
caccgctgtcccaaaaggtctttgattatggactttgatgtctctggagttgtccctacaatcagttatcagagaacagaggaagaaacattcccttatgtgatgggggatgtggaactacatatcagcagccagggcct

SEQ ID NO: 429701 - DNA, 140 bp, Artificial Sequence
  Synthetic
aggccctggctgctgatatgcactggaaatattcttggtccaaaaaagtcctagtcaccactgcttttgtcagctcactaataggacatgaattcattggccctacataaaaatatttacgaccttttgggacagcggtg

SEQ ID NO: 429702 - DNA, 140 bp, Artificial Sequence
  Synthetic
caccgctgtcccaaaaggtcgtaaatatttttatgtagggccaatgaattcatgtcctattagtgagctgacaaaagcagtggtgactaggacttttttggaccaagaatatttccagtgcatatcagcagccagggcct

SEQ ID NO: 429703 - DNA, 140 bp, Artificial Sequence
  Synthetic
aggccctggctgctgatatgttaggcctttcttagaccctttgtgctgaactccaccagatggggaacaagcaagtcaaagctcctgaagcaaggaacagtccgagggccagcctgatccgaccttttgggacagcggtg

SEQ ID NO: 429704 - DNA, 140 bp, Artificial Sequence
  Synthetic
caccgctgtcccaaaaggtcggatcaggctggccctcggactgttccttgcttcaggagctttgacttgcttgttccccatctggtggagttcagcacaaagggtctaagaaaggcctaacatatcagcagccagggcct

SEQ ID NO: 429705 - DNA, 140 bp, Artificial Sequence
  Synthetic
aggccctggctgctgatatgtgttgaagtcataatccagaatacgggacccatctgtatacttattcacaacaacactcttattactggccaagtccaaagctgttgcacagccgcttgtgaccttttgggacagcggtg

SEQ ID NO: 429706 - DNA, 140 bp, Artificial Sequence
  Synthetic
caccgctgtcccaaaaggtcacaagcggctgtgcaacagctttggacttggccagtaataagagtgttgttgtgaataagtatacagatgggtcccgtattctggattatgacttcaacacatatcagcagccagggcct

SEQ ID NO: 429707 - DNA, 140 bp, Artificial Sequence
  Synthetic
atacgccatgctgggtctccacaacactcttattactggccaagtccaaagctgttgcacagccgcttgtaataagagggtctcgcagtgtcttctttacttccttttctttaaacaatgcgtacttgggagtcggccat

SEQ ID NO: 429708 - DNA, 140 bp, Artificial Sequence
  Synthetic
atggccgactcccaagtacgcattgtttaaagaaaaggaagtaaagaagacactgcgagaccctcttattacaagcggctgtgcaacagctttggacttggccagtaataagagtgttgtggagacccagcatggcgtat

SEQ ID NO: 429709 - DNA, 140 bp, Artificial Sequence
  Synthetic
aggccctggctgctgatatgtgtatcaaatttaaagttcagacacctacttttataatgagagtatctccccattagcttattcccattcattattaataaaattgacttaaagcactgggaccttttgggacagcggtg

SEQ ID NO: 429710 - DNA, 140 bp, Artificial Sequence
  Synthetic
caccgctgtcccaaaaggtcccagtgctttaagtcaattttattaataatgaatgggaataagctaatggggagatactctcattataaaagtaggtgtctgaactttaaatttgatacacatatcagcagccagggcct

SEQ ID NO: 429711 - DNA, 140 bp, Artificial Sequence
  Synthetic
aggccctggctgctgatatgcattaatagcatcctgggctctgtctgcacaagaaatgccaacttctgtcttgataatctctcgttgtccactaggtactttgatactaagtctttgacagaccttttgggacagcggtg

SEQ ID NO: 429712 - DNA, 140 bp, Artificial Sequence
  Synthetic
caccgctgtcccaaaaggtctgtcaaagacttagtatcaaagtacctagtggacaacgagagattatcaagacagaagttggcatttcttgtgcagacagagcccaggatgctattaatgcatatcagcagccagggcct

SEQ ID NO: 429713 - DNA, 140 bp, Artificial Sequence
  Synthetic
aggccctggctgctgatatgatcaaagtcctcaaccatgtgattagacaattcacccttaatcagcctaatataaaacttatttgagacaatctcatctagatcatttattgatggctgggaccttttgggacagcggtg

SEQ ID NO: 429714 - DNA, 140 bp, Artificial Sequence
  Synthetic
caccgctgtcccaaaaggtcccagccatcaataaatgatctagatgagattgtctcaaataagttttatattaggctgattaagggtgaattgtctaatcacatggttgaggactttgatcatatcagcagccagggcct

SEQ ID NO: 429715 - DNA, 140 bp, Artificial Sequence
  Synthetic
atacgccatgctgggtctccacaaaacatgtggtctgctagagcaatgattcactataggacaaggtcctgtaggaggcacaggagacacaagaggtaataaaagacaataaaattagatcgtacttgggagtcggccat

SEQ ID NO: 429716 - DNA, 140 bp, Artificial Sequence
  Synthetic
atggccgactcccaagtacgatctaattttattgtcttttattacctcttgtgtctcctgtgcctcctacaggaccttgtcctatagtgaatcattgctctagcagaccacatgttttgtggagacccagcatggcgtat

SEQ ID NO: 429717 - DNA, 140 bp, Artificial Sequence
  Synthetic
aggccctggctgctgatatgtccaccagatggggaacaagcaagccaaaaccccagaagcaagggacagcccgagagccagtctgatcccagatgctacacacctagggccacagttctggaccttttgggacagcggtg

SEQ ID NO: 429718 - DNA, 140 bp, Artificial Sequence
  Synthetic
caccgctgtcccaaaaggtccagaactgtggccctaggtgtgtagcatctgggatcagactggctctcgggctgtcccttgcttctggggttttggcttgcttgttccccatctggtggacatatcagcagccagggcct

SEQ ID NO: 429719 - DNA, 140 bp, Artificial Sequence
  Synthetic
atacgccatgctgggtctccatcctaggcatttaggattgcgcttttagagatctttgtgtgagtgggcttcattaagccatggggcaaatcataacatttttccaggaagtgcctcatgcgtacttgggagtcggccat

SEQ ID NO: 429720 - DNA, 140 bp, Artificial Sequence
  Synthetic
atggccgactcccaagtacgcatgaggcacttcctggaaaaatgttatgatttgccccatggcttaatgaagcccactcacacaaagatctctaaaagcgcaatcctaaatgcctaggatggagacccagcatggcgtat

SEQ ID NO: 429721 - DNA, 140 bp, Artificial Sequence
  Synthetic
atacgccatgctgggtctccggatcctaggcatttttggttgcgcaattcaagtgtcctatttcaaaatgggacagatagtgacattcttccaggaagtacctcatgtaatagaagaggtcgtacttgggagtcggccat

SEQ ID NO: 429722 - DNA, 140 bp, Artificial Sequence
  Synthetic
atggccgactcccaagtacgacctcttctattacatgaggtacttcctggaagaatgtcactatctgtcccattttgaaataggacacttgaattgcgcaaccaaaaatgcctaggatccggagacccagcatggcgtat

SEQ ID NO: 429723 - DNA, 140 bp, Artificial Sequence
  Synthetic
atacgccatgctgggtctcctgtagaccatgtcgtctaattcttcctccgtggctgtatctgcagggttagtgctcacatgaccaaatctcacctttggttccagaaacttttcaaaacacgtacttgggagtcggccat

SEQ ID NO: 429724 - DNA, 140 bp, Artificial Sequence
  Synthetic
atggccgactcccaagtacgtgttttgaaaagtttctggaaccaaaggtgagatttggtcatgtgagcactaaccctgcagatacagccacggaggaagaattagacgacatggtctacaggagacccagcatggcgtat

SEQ ID NO: 429725 - DNA, 140 bp, Artificial Sequence
  Synthetic
aggccctggctgctgatatgggtctttatgatgataatctgatacataagccattacaaagtacctaagattttggaggagcttttgagaacgtttactagggtgagctaaaattaaaacgaccttttgggacagcggtg

SEQ ID NO: 429726 - DNA, 140 bp, Artificial Sequence
  Synthetic
caccgctgtcccaaaaggtcgttttaattttagctcaccctagtaaacgttctcaaaagctcctccaaaatcttaggtactttgtaatggcttatgtatcagattatcatcataaagacccatatcagcagccagggcct

SEQ ID NO: 429727 - DNA, 140 bp, Artificial Sequence
  Synthetic
atacgccatgctgggtctccactcccctgtcttttgatagatcaattgaaattcagtgttacccaacaagaactcttgacaatatgcttctttgcatctgaccacttgataccttgcgggcgtacttgggagtcggccat

SEQ ID NO: 429728 - DNA, 140 bp, Artificial Sequence
  Synthetic
atggccgactcccaagtacgcccgcaaggtatcaagtggtcagatgcaaagaagcatattgtcaagagttcttgttgggtaacactgaatttcaattgatctatcaaaagacaggggagtggagacccagcatggcgtat

SEQ ID NO: 429729 - DNA, 140 bp, Artificial Sequence
  Synthetic
aggccctggctgctgatatgaactcttgacaatatgcttctttgcatctgaccacttgataccttgcgggtccaaactcattctgtctcaacttcacggtagaagaagttttcatagagtgaccttttgggacagcggtg

SEQ ID NO: 429730 - DNA, 140 bp, Artificial Sequence
  Synthetic
caccgctgtcccaaaaggtcactctatgaaaacttcttctaccgtgaagttgagacagaatgagtttggacccgcaaggtatcaagtggtcagatgcaaagaagcatattgtcaagagttcatatcagcagccagggcct

SEQ ID NO: 429731 - DNA, 140 bp, Artificial Sequence
  Synthetic
aggccctggctgctgatatgctgcttcaagaagccgaacaagaattggtctttgcaattctaacacagtcttcttcaacacagaaacaatgtcgacatccacccagtgcttcttgagcttgaccttttgggacagcggtg

SEQ ID NO: 429732 - DNA, 140 bp, Artificial Sequence
  Synthetic
caccgctgtcccaaaaggtcaagctcaagaagcactgggtggatgtcgacattgtttctgtgttgaagaagactgtgttagaattgcaaagaccaattcttgttcggcttcttgaagcagcatatcagcagccagggcct

SEQ ID NO: 429733 - DNA, 140 bp, Artificial Sequence
  Synthetic
aggccctggctgctgatatgtaaggtatccctgagtttgtcattcacccaatcaggtatctgttcattgtaaaatgttgtcctaccgtctatgagagggataagattgatgccaacagatgaccttttgggacagcggtg

SEQ ID NO: 429734 - DNA, 140 bp, Artificial Sequence
  Synthetic
caccgctgtcccaaaaggtcatctgttggcatcaatcttatccctctcatagacggtaggacaacattttacaatgaacagatacctgattgggtgaatgacaaactcagggataccttacatatcagcagccagggcct

SEQ ID NO: 429735 - DNA, 140 bp, Artificial Sequence
  Synthetic
aggccctggctgctgatatggtgtgtttctagatctttcagcctgttgcctccgctcaacccatttctcaagatccctttttgttgactccaaagaaactaatctatcattgacacttatgaccttttgggacagcggtg

SEQ ID NO: 429736 - DNA, 140 bp, Artificial Sequence
  Synthetic
caccgctgtcccaaaaggtcataagtgtcaatgatagattagtttctttggagtcaacaaaaagggatcttgagaaatgggttgagcggaggcaacaggctgaaagatctagaaacacaccatatcagcagccagggcct

SEQ ID NO: 429737 - DNA, 140 bp, Artificial Sequence
  Synthetic
atacgccatgctgggtctccagatccctttttgttgactccaaagaaactaatctatcattgacacttataaagcaggaccctaaccaccctctcaaacatttttgtctcatcaggtcatcgtacttgggagtcggccat

SEQ ID NO: 429738 - DNA, 140 bp, Artificial Sequence
  Synthetic
atggccgactcccaagtacgatgacctgatgagacaaaaatgtttgagagggtggttagggtcctgctttataagtgtcaatgatagattagtttctttggagtcaacaaaaagggatctggagacccagcatggcgtat

SEQ ID NO: 429739 - DNA, 140 bp, Artificial Sequence
  Synthetic
aggccctggctgctgatatgtgcaaatggatgtgagcacaatagtgaagataagtctgtcgagaaaatccttcatgaatatggtatcttgaccccatctctatgttttgtggtgccggacgaccttttgggacagcggtg

SEQ ID NO: 429740 - DNA, 140 bp, Artificial Sequence
  Synthetic
caccgctgtcccaaaaggtcgtccggcaccacaaaacatagagatggggtcaagataccatattcatgaaggattttctcgacagacttatcttcactattgtgctcacatccatttgcacatatcagcagccagggcct

SEQ ID NO: 429741 - DNA, 140 bp, Artificial Sequence
  Synthetic
aggccctggctgctgatatgactgaccttctatctctcctttcctcaatctgttcctaaacacttggtattcttcttcgatctgcagctttacttcatgagctgttaacttattattgatgaccttttgggacagcggtg

SEQ ID NO: 429742 - DNA, 140 bp, Artificial Sequence
  Synthetic
caccgctgtcccaaaaggtcatcaataataagttaacagctcatgaagtaaagctgcagatcgaagaagaataccaagtgtttaggaacagattgaggaaaggagagatagaaggtcagtcatatcagcagccagggcct

SEQ ID NO: 429743 - DNA, 140 bp, Artificial Sequence
  Synthetic
aggccctggctgctgatatgctttgagataagatctttggcattagcaatgtcttcctccatcgccaattgtggcacctgtattgagtttgggtttatgccagaatggcttgtgggtcaagaccttttgggacagcggtg

SEQ ID NO: 429744 - DNA, 140 bp, Artificial Sequence
  Synthetic
caccgctgtcccaaaaggtcttgacccacaagccattctggcataaacccaaactcaatacaggtgccacaattggcgatggaggaagacattgctaatgccaaagatcttatctcaaagcatatcagcagccagggcct

SEQ ID NO: 429745 - DNA, 140 bp, Artificial Sequence
  Synthetic
aggccctggctgctgatatgcattgacccaatcaggtatttgttcattgtagaatgatgttctcccgtctataagtggtattaaattgatatcgacactctttaagtcttctttcagctggaccttttgggacagcggtg

SEQ ID NO: 429746 - DNA, 140 bp, Artificial Sequence
  Synthetic
caccgctgtcccaaaaggtccagctgaaagaagacttaaagagtgtcgatatcaatttaataccacttatagacgggagaacatcattctacaatgaacaaatacctgattgggtcaatgcatatcagcagccagggcct

SEQ ID NO: 429747 - DNA, 140 bp, Artificial Sequence
  Synthetic
atacgccatgctgggtctcccatcttatcagttttaacaaattgactttctatgtccccttgcctcagtttgttcctgaagatttgatactcctcctcaattaaactcttgacttcgtgacgtacttgggagtcggccat

SEQ ID NO: 429748 - DNA, 140 bp, Artificial Sequence
  Synthetic
atggccgactcccaagtacgtcacgaagtcaagagtttaattgaggaggagtatcaaatcttcaggaacaaactgaggcaaggggacatagaaagtcaatttgttaaaactgataagatgggagacccagcatggcgtat

SEQ ID NO: 429749 - DNA, 140 bp, Artificial Sequence
  Synthetic
aggccctggctgctgatatgcgcaggctatgtcttcctccatgtttgactgcaggtatgatgatcggaacccttagggcatgtggtctgctggagcaacagtccactataagacaaaatcgaccttttgggacagcggtg

SEQ ID NO: 429750 - DNA, 140 bp, Artificial Sequence
  Synthetic
caccgctgtcccaaaaggtcgattttgtcttatagtggactgttgctccagcagaccacatgccctaagggttccgatcatcatacctgcagtcaaacatggaggaagacatagcctgcgcatatcagcagccagggcct

SEQ ID NO: 429751 - DNA, 140 bp, Artificial Sequence
  Synthetic
atacgccatgctgggtctccccttagggcatgtggtctgctggagcaacagtccactataagacaaaatcttgtaaaaggcacagaagaaacagaaggcaattaaagacaattaaaatagcgtacttgggagtcggccat

SEQ ID NO: 429752 - DNA, 140 bp, Artificial Sequence
  Synthetic
atggccgactcccaagtacgctattttaattgtctttaattgccttctgtttcttctgtgccttttacaagattttgtcttatagtggactgttgctccagcagaccacatgccctaaggggagacccagcatggcgtat

SEQ ID NO: 429753 - DNA, 140 bp, Artificial Sequence
  Synthetic
aggccctggctgctgatatgcagcattacagaatttttcataaaattcacctggtaagacatcatgatcaaagtcctcaaccatgtgattagacaattcacccttaatcagcctaatatagaccttttgggacagcggtg

SEQ ID NO: 429754 - DNA, 140 bp, Artificial Sequence
  Synthetic
caccgctgtcccaaaaggtctatattaggctgattaagggtgaattgtctaatcacatggttgaggactttgatcatgatgtcttaccaggtgaattttatgaaaaattctgtaatgctgcatatcagcagccagggcct

SEQ ID NO: 429755 - DNA, 140 bp, Artificial Sequence
  Synthetic
atacgccatgctgggtctccttcttgagaagacttcagtgagctgtgacacggctagtgctgtgagcttattgaaatcatagtttaatattctagaaccatctgtgtatttgttgacgaccgtacttgggagtcggccat

SEQ ID NO: 429756 - DNA, 140 bp, Artificial Sequence
  Synthetic
atggccgactcccaagtacggtcgtcaacaaatacacagatggttctagaatattaaactatgatttcaataagctcacagcactagccgtgtcacagctcactgaagtcttctcaagaaggagacccagcatggcgtat

SEQ ID NO: 429757 - DNA, 140 bp, Artificial Sequence
  Synthetic
aggccctggctgctgatatggcatcaaaaattaatagaagttttcttctcgtgttcaatatccttagagattttactttatttaggaatgatctccagcattgcacctgacactctccaggaccttttgggacagcggtg

SEQ ID NO: 429758 - DNA, 140 bp, Artificial Sequence
  Synthetic
caccgctgtcccaaaaggtcctggagagtgtcaggtgcaatgctggagatcattcctaaataaagtaaaatctctaaggatattgaacacgagaagaaaacttctattaatttttgatgccatatcagcagccagggcct

SEQ ID NO: 429759 - DNA, 140 bp, Artificial Sequence
  Synthetic
atacgccatgctgggtctccctcttttgttgtgttgatttgagttccacaagattgttgacagcctgattcagatctctgagacgtttcagatcactatcatcccttttttgtttgcgcacgtacttgggagtcggccat

SEQ ID NO: 429760 - DNA, 140 bp, Artificial Sequence
  Synthetic
atggccgactcccaagtacgtgcgcaaacaaaaaagggatgatagtgatctgaaacgtctcagagatctgaatcaggctgtcaacaatcttgtggaactcaaatcaacacaacaaaagagggagacccagcatggcgtat

SEQ ID NO: 429761 - DNA, 140 bp, Artificial Sequence
  Synthetic
aggccctggctgctgatatgtattattgatgccttggtggcatgaggcaatcacttcctcataatgattagagcggttatccatcagaacatttaaactttccactcctgacaatcttccgaccttttgggacagcggtg

SEQ ID NO: 429762 - DNA, 140 bp, Artificial Sequence
  Synthetic
caccgctgtcccaaaaggtcggaagattgtcaggagtggaaagtttaaatgttctgatggataaccgctctaatcattatgaggaagtgattgcctcatgccaccaaggcatcaataatacatatcagcagccagggcct

SEQ ID NO: 429763 - DNA, 140 bp, Artificial Sequence
  Synthetic
aggccctggctgctgatatgcttctttcgaagcactcattgttgttgttggattgtgggccttttgcacacttgatcttacaaggatgattagcacttgaagcgcaatcaaatagcctaggaccttttgggacagcggtg

SEQ ID NO: 429764 - DNA, 140 bp, Artificial Sequence
  Synthetic
caccgctgtcccaaaaggtcctaggctatttgattgcgcttcaagtgctaatcatccttgtaagatcaagtgtgcaaaaggcccacaatccaacaacaacaatgagtgcttcgaaagaagcatatcagcagccagggcct

SEQ ID NO: 429765 - DNA, 140 bp, Artificial Sequence
  Synthetic
aggccctggctgctgatatgtcatcaagccatgggacaaatcataacatttttccaggaagtacctcatgtcatagaggaagtgatgaacattgtcctgattgctctcagccttctggcagaccttttgggacagcggtg

SEQ ID NO: 429766 - DNA, 140 bp, Artificial Sequence
  Synthetic
caccgctgtcccaaaaggtctgccagaaggctgagagcaatcaggacaatgttcatcacttcctctatgacatgaggtacttcctggaaaaatgttatgatttgtcccatggcttgatgacatatcagcagccagggcct

SEQ ID NO: 429767 - DNA, 140 bp, Artificial Sequence
  Synthetic
atacgccatgctgggtctccccggggatcctaggcaatttagctggacttcagtggtaaagctcattctagtgaatccctgaatcaagtgcccagccgagatgggcaacagacaggctaacgtacttgggagtcggccat

SEQ ID NO: 429768 - DNA, 140 bp, Artificial Sequence
  Synthetic
atggccgactcccaagtacgttagcctgtctgttgcccatctcggctgggcacttgattcagggattcactagaatgagctttaccactgaagtccagctaaattgcctaggatccccggggagacccagcatggcgtat

SEQ ID NO: 429769 - DNA, 140 bp, Artificial Sequence
  Synthetic
aggccctggctgctgatatgatgcccttgtcttgcacgaagaacaactcccaccattacatcatggtcggaaatgagactggcctggagctgactttaacaaatacaagcatcatcaaccgaccttttgggacagcggtg

SEQ ID NO: 429770 - DNA, 140 bp, Artificial Sequence
  Synthetic
caccgctgtcccaaaaggtcggttgatgatgcttgtatttgttaaagtcagctccaggccagtctcatttccgaccatgatgtaatggtgggagttgttcttcgtgcaagacaagggcatcatatcagcagccagggcct

SEQ ID NO: 429771 - DNA, 140 bp, Artificial Sequence
  Synthetic
atacgccatgctgggtctccaacacagcacctccaccgtatgccccatgatcccaagaccaacactcccatctccgtcacccaccccccacccccggggggaccccccgccgggggcccccgtacttgggagtcggccat

SEQ ID NO: 429772 - DNA, 140 bp, Artificial Sequence
  Synthetic
atggccgactcccaagtacgggggcccccggcggggggtccccccgggggtggggggtgggtgacggagatgggagtgttggtcttgggatcatggggcatacggtggaggtgctgtgttggagacccagcatggcgtat

SEQ ID NO: 429773 - DNA, 140 bp, Artificial Sequence
  Synthetic
atacgccatgctgggtctcctcttctcaacaacgacacctgtgtgcatgtggcataagtctttatactgatcccagactgcattttcatacttcctggaatcagttttgctgagggcaatcgtacttgggagtcggccat

SEQ ID NO: 429774 - DNA, 140 bp, Artificial Sequence
  Synthetic
atggccgactcccaagtacgattgccctcagcaaaactgattccaggaagtatgaaaatgcagtctgggatcagtataaagacttatgccacatgcacacaggtgtcgttgttgagaagaggagacccagcatggcgtat

SEQ ID NO: 429775 - DNA, 140 bp, Artificial Sequence
  Synthetic
aggccctggctgctgatatgtcgagatccacagtagtattctcccaagctctacccacaatagaagtccttgaagctatgtagggccagccgtcaccggaaagacagatcttgtaaagtagaccttttgggacagcggtg

SEQ ID NO: 429776 - DNA, 140 bp, Artificial Sequence
  Synthetic
caccgctgtcccaaaaggtctactttacaagatctgtctttccggtgacggctggccctacatagcttcaaggacttctattgtgggtagagcttgggagaatactactgtggatctcgacatatcagcagccagggcct

SEQ ID NO: 429777 - DNA, 140 bp, Artificial Sequence
  Synthetic
aggccctggctgctgatatgaaatcttcaagggagtctagcctcaactcctctgtcaggcctgaagcaataagctggttcaaatttatctgggctggttctatgtcgaagtctatccatggaccttttgggacagcggtg

SEQ ID NO: 429778 - DNA, 140 bp, Artificial Sequence
  Synthetic
caccgctgtcccaaaaggtccatggatagacttcgacatagaaccagcccagataaatttgaaccagcttattgcttcaggcctgacagaggagttgaggctagactcccttgaagatttcatatcagcagccagggcct

SEQ ID NO: 429779 - DNA, 140 bp, Artificial Sequence
  Synthetic
aggccctggctgctgatatgtcctccatcgccaattgtggcacctgtattgagtttgggtttatgccagaatggcttgtgggtcaacaggtggtgccccacaaaagctcctacagaaatggaccttttgggacagcggtg

SEQ ID NO: 429780 - DNA, 140 bp, Artificial Sequence
  Synthetic
caccgctgtcccaaaaggtccatttctgtaggagcttttgtggggcaccacctgttgacccacaagccattctggcataaacccaaactcaatacaggtgccacaattggcgatggaggacatatcagcagccagggcct

SEQ ID NO: 429781 - DNA, 140 bp, Artificial Sequence
  Synthetic
aggccctggctgctgatatggaagggcttcaatgactgcactggttaaaccaggttgagcagggaaaagatctgccacatcaatcccatgagaatatttggcatcttgcttgaactgtttgaccttttgggacagcggtg

SEQ ID NO: 429782 - DNA, 140 bp, Artificial Sequence
  Synthetic
caccgctgtcccaaaaggtcaaacagttcaagcaagatgccaaatattctcatgggattgatgtggcagatcttttccctgctcaacctggtttaaccagtgcagtcattgaagcccttccatatcagcagccagggcct

SEQ ID NO: 429783 - DNA, 140 bp, Artificial Sequence
  Synthetic
atacgccatgctgggtctcctctgccacatcaatcccatgagaatatttggcatcttgcttgaactgttttaaatctgttggttctctgaagaagtgtatgtaacagcctgacataggttcgtacttgggagtcggccat

SEQ ID NO: 429784 - DNA, 140 bp, Artificial Sequence
  Synthetic
atggccgactcccaagtacgaacctatgtcaggctgttacatacacttcttcagagaaccaacagatttaaaacagttcaagcaagatgccaaatattctcatgggattgatgtggcagaggagacccagcatggcgtat

SEQ ID NO: 429785 - DNA, 140 bp, Artificial Sequence
  Synthetic
atacgccatgctgggtctcctcagtagtcttcaacagatccacatcccccatgatataaggaaacgcttcttcctctgatctctgataactaattgtgggggtcactccagatacatcgacgtacttgggagtcggccat

SEQ ID NO: 429786 - DNA, 140 bp, Artificial Sequence
  Synthetic
atggccgactcccaagtacgtcgatgtatctggagtgacccccacaattagttatcagagatcagaggaagaagcgtttccttatatcatgggggatgtggatctgttgaagactactgaggagacccagcatggcgtat

SEQ ID NO: 429787 - DNA, 140 bp, Artificial Sequence
  Synthetic
atacgccatgctgggtctccagtccataatcaagtcataaccgtcggggcagatcacttccatatcaatcttatagtggtccacactaattccaacatccctcaaagcagtggtggctttcgtacttgggagtcggccat

SEQ ID NO: 429788 - DNA, 140 bp, Artificial Sequence
  Synthetic
atggccgactcccaagtacgaaagccaccactgctttgagggatgttggaattagtgtggaccactataagattgatatggaagtgatctgccccgacggttatgacttgattatggactggagacccagcatggcgtat

SEQ ID NO: 429789 - DNA, 140 bp, Artificial Sequence
  Synthetic
aggccctggctgctgatatgaccccccgccgggggcccccccgggggggcaggcagcccagctctactcaatgtcctcgatacacttctccggcccaaacaactctgaacatgtccttccgaccttttgggacagcggtg

SEQ ID NO: 429790 - DNA, 140 bp, Artificial Sequence
  Synthetic
caccgctgtcccaaaaggtcggaaggacatgttcagagttgtttgggccggagaagtgtatcgaggacattgagtagagctgggctgcctgcccccccgggggggcccccggcggggggtcatatcagcagccagggcct

SEQ ID NO: 429791 - DNA, 140 bp, Artificial Sequence
  Synthetic
atacgccatgctgggtctcccggggatcctaggcaattcagctggacttcagtggtaaagctcatttcagtgaattcctgaatcaaagtgcctagtcattatgggcaacagacaggccaacgtacttgggagtcggccat

SEQ ID NO: 429792 - DNA, 140 bp, Artificial Sequence
  Synthetic
atggccgactcccaagtacgttggcctgtctgttgcccataatgactaggcactttgattcaggaattcactgaaatgagctttaccactgaagtccagctgaattgcctaggatccccgggagacccagcatggcgtat

SEQ ID NO: 429793 - DNA, 140 bp, Artificial Sequence
  Synthetic
aggccctggctgctgatatgctgttagtgctaagacagcatcattcaaatcaacttgaccttgtttggtgagacatgctaatgtcagactaggcatggtgccgaactgattgttcaaaaggaccttttgggacagcggtg

SEQ ID NO: 429794 - DNA, 140 bp, Artificial Sequence
  Synthetic
caccgctgtcccaaaaggtccttttgaacaatcagttcggcaccatgcctagtctgacattagcatgtctcaccaaacaaggtcaagttgatttgaatgatgctgtcttagcactaacagcatatcagcagccagggcct

SEQ ID NO: 429795 - DNA, 140 bp, Artificial Sequence
  Synthetic
aggccctggctgctgatatgtttcaccacctgtagtttgatgttggagcagtaaccagacaattccctccttaatgattgtgtccacagaaaggactttatttcctttgaagcactcattgaccttttgggacagcggtg

SEQ ID NO: 429796 - DNA, 140 bp, Artificial Sequence
  Synthetic
caccgctgtcccaaaaggtcaatgagtgcttcaaaggaaataaagtcctttctgtggacacaatcattaaggagggaattgtctggttactgctccaacatcaaactacaggtggtgaaacatatcagcagccagggcct

SEQ ID NO: 429797 - DNA, 140 bp, Artificial Sequence
  Synthetic
atacgccatgctgggtctccggctaaaggcagcgacacagcccagcgcaccatcaaccgaggcaacccaaaacacaacacccccaccgtacaccccataatcccggggtcaacactcccacgtacttgggagtcggccat

SEQ ID NO: 429798 - DNA, 140 bp, Artificial Sequence
  Synthetic
atggccgactcccaagtacgtgggagtgttgaccccgggattatggggtgtacggtgggggtgttgtgttttgggttgcctcggttgatggtgcgctgggctgtgtcgctgcctttagccggagacccagcatggcgtat

SEQ ID NO: 429799 - DNA, 140 bp, Artificial Sequence
  Synthetic
atacgccatgctgggtctccaaagagtgaattactttcctgagcgtactttaatagtgaaaaaagtgtatccctcagcttatcattaacccaatcaggtatttgctcattataaaatgatcgtacttgggagtcggccat

SEQ ID NO: 429800 - DNA, 140 bp, Artificial Sequence
  Synthetic
atggccgactcccaagtacgatcattttataatgagcaaatacctgattgggttaatgataagctgagggatacacttttttcactattaaagtacgctcaggaaagtaattcactctttggagacccagcatggcgtat

SEQ ID NO: 429801 - DNA, 140 bp, Artificial Sequence
  Synthetic
aggccctggctgctgatatgtttcaatgcaccaaccaaaaggtgcggggaactatcaccaatctcccttacaaacatttccagatcttgatcttggatagatggtgtaaatgcagccaccgaccttttgggacagcggtg

SEQ ID NO: 429802 - DNA, 140 bp, Artificial Sequence
  Synthetic
caccgctgtcccaaaaggtcggtggctgcatttacaccatctatccaagatcaagatctggaaatgtttgtaagggagattggtgatagttccccgcaccttttggttggtgcattgaaacatatcagcagccagggcct

SEQ ID NO: 429803 - DNA, 140 bp, Artificial Sequence
  Synthetic
aggccctggctgctgatatgtcatggtcggaaatgagactggtctggagctgactttaacaaatacaagcatcatcaaccacaagttttgtaacctttctgatgcacataaaaagaatctgaccttttgggacagcggtg

SEQ ID NO: 429804 - DNA, 140 bp, Artificial Sequence
  Synthetic
caccgctgtcccaaaaggtcagattctttttatgtgcatcagaaaggttacaaaacttgtggttgatgatgcttgtatttgttaaagtcagctccagaccagtctcatttccgaccatgacatatcagcagccagggcct

SEQ ID NO: 429805 - DNA, 140 bp, Artificial Sequence
  Synthetic
atacgccatgctgggtctcctcctaggcaatttagctggacttcagtagtgaggcttatttcagtgaatccctgaatcagagtacctagtaaaatgggcaataaacaggccaaatcgacacgtacttgggagtcggccat

SEQ ID NO: 429806 - DNA, 140 bp, Artificial Sequence
  Synthetic
atggccgactcccaagtacgtgtcgatttggcctgtttattgcccattttactaggtactctgattcagggattcactgaaataagcctcactactgaagtccagctaaattgcctaggaggagacccagcatggcgtat

SEQ ID NO: 429807 - DNA, 140 bp, Artificial Sequence
  Synthetic
aggccctggctgctgatatgccactgtgggaccattgccaatggcgtgcttcagacttttatgaggatggcttggggtggcagttacatagcacttgattccggaaaggggaattgggatgaccttttgggacagcggtg

SEQ ID NO: 429808 - DNA, 140 bp, Artificial Sequence
  Synthetic
caccgctgtcccaaaaggtcatcccaattcccctttccggaatcaagtgctatgtaactgccaccccaagccatcctcataaaagtctgaagcacgccattggcaatggtcccacagtggcatatcagcagccagggcct

SEQ ID NO: 429809 - DNA, 140 bp, Artificial Sequence
  Synthetic
aggccctggctgctgatatggagtaacggttcactatgggataaggtcccataggagatgcaaagacacagctggttaattaaagacaattaaattggatatccttaatgcctaggatccgaccttttgggacagcggtg

SEQ ID NO: 429810 - DNA, 140 bp, Artificial Sequence
  Synthetic
caccgctgtcccaaaaggtcggatcctaggcattaaggatatccaatttaattgtctttaattaaccagctgtgtctttgcatctcctatgggaccttatcccatagtgaaccgttactccatatcagcagccagggcct

SEQ ID NO: 429811 - DNA, 140 bp, Artificial Sequence
  Synthetic
atacgccatgctgggtctcccaccggggatcctaggcatttttggttgcgcaatccaagtatcccattcaaaatgggacagatagtgacattcttccaggaagtgcctcatgtaatagaacgtacttgggagtcggccat

SEQ ID NO: 429812 - DNA, 140 bp, Artificial Sequence
  Synthetic
atggccgactcccaagtacgttctattacatgaggcacttcctggaagaatgtcactatctgtcccattttgaatgggatacttggattgcgcaaccaaaaatgcctaggatccccggtgggagacccagcatggcgtat

SEQ ID NO: 429813 - DNA, 140 bp, Artificial Sequence
  Synthetic
atacgccatgctgggtctcccacccaccccccacccccggggggaccccccgccgggggcccccccggggggcagacaacccagctctactcaatgtcctcaatacacttctccggcccacgtacttgggagtcggccat

SEQ ID NO: 429814 - DNA, 140 bp, Artificial Sequence
  Synthetic
atggccgactcccaagtacgtgggccggagaagtgtattgaggacattgagtagagctgggttgtctgccccccgggggggcccccggcggggggtccccccgggggtggggggtgggtgggagacccagcatggcgtat

SEQ ID NO: 429815 - DNA, 140 bp, Artificial Sequence
  Synthetic
aggccctggctgctgatatggcatgatccacaggtctctgttttgtgaggattgagacaatgtcaacacccgtccattgaatcctttgtttcaatctatcagacatcattgattttaatggaccttttgggacagcggtg

SEQ ID NO: 429816 - DNA, 140 bp, Artificial Sequence
  Synthetic
caccgctgtcccaaaaggtccattaaaatcaatgatgtctgatagattgaaacaaaggattcaatggacgggtgttgacattgtctcaatcctcacaaaacagagacctgtggatcatgccatatcagcagccagggcct

SEQ ID NO: 429817 - DNA, 140 bp, Artificial Sequence
  Synthetic
atacgccatgctgggtctccctggacttcagtggtaagactcatcttagtgaatccccgaatcaaagtgctagtcaaaatgggcaacagacaggccaaatcggcaaaagtcgatgaacatcgtacttgggagtcggccat

SEQ ID NO: 429818 - DNA, 140 bp, Artificial Sequence
  Synthetic
atggccgactcccaagtacgatgttcatcgacttttgccgatttggcctgtctgttgcccattttgactagcactttgattcggggattcactaagatgagtcttaccactgaagtccagggagacccagcatggcgtat

SEQ ID NO: 429819 - DNA, 140 bp, Artificial Sequence
  Synthetic
aggccctggctgctgatatgttaataatcagcttcatgggtataacatcccccaactgctgtgtatcttttaagaattcatttaccacatctgattcaacaaaccaggctgacctaccttgaccttttgggacagcggtg

SEQ ID NO: 429820 - DNA, 140 bp, Artificial Sequence
  Synthetic
caccgctgtcccaaaaggtcaaggtaggtcagcctggtttgttgaatcagatgtggtaaatgaattcttaaaagatacacagcagttgggggatgttatacccatgaagctgattattaacatatcagcagccagggcct

SEQ ID NO: 429821 - DNA, 140 bp, Artificial Sequence
  Synthetic
aggccctggctgctgatatgtcttcctccacctggttaaaatcccaacccacagacatgtcatagggaaaccctgccctaaaccacacagactcaaccacatgggcatatgctcatgtgggaccttttgggacagcggtg

SEQ ID NO: 429822 - DNA, 140 bp, Artificial Sequence
  Synthetic
caccgctgtcccaaaaggtcccacatgagcatatgcccatgtggttgagtctgtgtggtttagggcagggtttccctatgacatgtctgtgggttgggattttaaccaggtggaggaagacatatcagcagccagggcct

SEQ ID NO: 429823 - DNA, 140 bp, Artificial Sequence
  Synthetic
aggccctggctgctgatatgccctgccctaaaccacacagactcaaccacatgggcatatgctcatgtggtctgtacaaacatcctggtgtaccagtcaagtggaaaagataggagacaggaccttttgggacagcggtg

SEQ ID NO: 429824 - DNA, 140 bp, Artificial Sequence
  Synthetic
caccgctgtcccaaaaggtcctgtctcctatcttttccacttgactggtacaccaggatgtttgtacagaccacatgagcatatgcccatgtggttgagtctgtgtggtttagggcagggcatatcagcagccagggcct

SEQ ID NO: 429825 - DNA, 140 bp, Artificial Sequence
  Synthetic
aggccctggctgctgatatggggctcacagacccagaatatagtgcctgtacatcattcactacaaactcaccacattgattaacaagtcctgtcatgttgagatggatagaaaaagtctgaccttttgggacagcggtg

SEQ ID NO: 429826 - DNA, 140 bp, Artificial Sequence
  Synthetic
caccgctgtcccaaaaggtcagactttttctatccatctcaacatgacaggacttgttaatcaatgtggtgagtttgtagtgaatgatgtacaggcactatattctgggtctgtgagccccatatcagcagccagggcct

SEQ ID NO: 429827 - DNA, 140 bp, Artificial Sequence
  Synthetic
aggccctggctgctgatatggctggggtaaaagtagcaagtctgctgtcacattcccaaagggctcctctactgatcactaatggtacaggttcaatttcaggccccaccagtgtgaaatgaccttttgggacagcggtg

SEQ ID NO: 429828 - DNA, 140 bp, Artificial Sequence
  Synthetic
caccgctgtcccaaaaggtcatttcacactggtggggcctgaaattgaacctgtaccattagtgatcagtagaggagccctttgggaatgtgacagcagacttgctacttttaccccagccatatcagcagccagggcct

SEQ ID NO: 429829 - DNA, 140 bp, Artificial Sequence
  Synthetic
atacgccatgctgggtctccgttggcttgtgtcaaatggctcatacttaaacgagacccacttttctgatgatattgagcaacaagctgacaacatgatcactgagatgttacagaaggacgtacttgggagtcggccat

SEQ ID NO: 429830 - DNA, 140 bp, Artificial Sequence
  Synthetic
atggccgactcccaagtacgtccttctgtaacatctcagtgatcatgttgtcagcttgttgctcaatatcatcagaaaagtgggtctcgtttaagtatgagccatttgacacaagccaacggagacccagcatggcgtat

SEQ ID NO: 429831 - DNA, 140 bp, Artificial Sequence
  Synthetic
aggccctggctgctgatatggggttgtgcttgaaaaaatccaacaccttaattgtcttaggttcccctaagacccatgcacccagttctattgcagttgataaggagatgcacatataatgaccttttgggacagcggtg

SEQ ID NO: 429832 - DNA, 140 bp, Artificial Sequence
  Synthetic
caccgctgtcccaaaaggtcattatatgtgcatctccttatcaactgcaatagaactgggtgcatgggtcttaggggaacctaagacaattaaggtgttggattttttcaagcacaaccccatatcagcagccagggcct

SEQ ID NO: 429833 - DNA, 140 bp, Artificial Sequence
  Synthetic
aggccctggctgctgatatgtctgaggtgtaaccttgatggtctccaacatgttccccccatcaagcatacaagctccagctttcactgcagctcctaagctgaagttgtaaccagaaatgaccttttgggacagcggtg

SEQ ID NO: 429834 - DNA, 140 bp, Artificial Sequence
  Synthetic
caccgctgtcccaaaaggtcatttctggttacaacttcagcttaggagctgcagtgaaagctggagcttgtatgcttgatggggggaacatgttggagaccatcaaggttacacctcagacatatcagcagccagggcct

SEQ ID NO: 429835 - DNA, 140 bp, Artificial Sequence
  Synthetic
aggccctggctgctgatatgactgtaccatcaccttcccccttgacttactataacaaagagcataacccctgaactccacccagctgtccgctgcctcaagaaccgcactcaagatcccgaccttttgggacagcggtg

SEQ ID NO: 429836 - DNA, 140 bp, Artificial Sequence
  Synthetic
caccgctgtcccaaaaggtcgggatcttgagtgcggttcttgaggcagcggacagctgggtggagttcaggggttatgctctttgttatagtaagtcaagggggaaggtgatggtacagtcatatcagcagccagggcct

SEQ ID NO: 429837 - DNA, 140 bp, Artificial Sequence
  Synthetic
aggccctggctgctgatatgatccaccgttttaaatccctttttgttgattccaatgaaaccaatctatcgttaacactcacaaaacaggagcccagccaaccagcaaggagcctatcacgaccttttgggacagcggtg

SEQ ID NO: 429838 - DNA, 140 bp, Artificial Sequence
  Synthetic
caccgctgtcccaaaaggtcgtgataggctccttgctggttggctgggctcctgttttgtgagtgttaacgatagattggtttcattggaatcaacaaaaagggatttaaaacggtggatcatatcagcagccagggcct

SEQ ID NO: 429839 - DNA, 140 bp, Artificial Sequence
  Synthetic
aggccctggctgctgatatgcctaaaacccatgcgcccaattctattgcagttgacaaagaaatacacatataatcccacaatagaggcctgaagtaactgatcacaccttcacctccacgaccttttgggacagcggtg

SEQ ID NO: 429840 - DNA, 140 bp, Artificial Sequence
  Synthetic
caccgctgtcccaaaaggtcgtggaggtgaaggtgtgatcagttacttcaggcctctattgtgggattatatgtgtatttctttgtcaactgcaatagaattgggcgcatgggttttaggcatatcagcagccagggcct

SEQ ID NO: 429841 - DNA, 140 bp, Artificial Sequence
  Synthetic
aggccctggctgctgatatgagcattgcaaaattcctcataaaatttgtctggtaagacatcatgatcaaagtcttcaaccatgtggttagacaattcacccttaatcaacctaatataggaccttttgggacagcggtg

SEQ ID NO: 429842 - DNA, 140 bp, Artificial Sequence
  Synthetic
caccgctgtcccaaaaggtcctatattaggttgattaagggtgaattgtctaaccacatggttgaagactttgatcatgatgtcttaccagacaaattttatgaggaattttgcaatgctcatatcagcagccagggcct

SEQ ID NO: 429843 - DNA, 140 bp, Artificial Sequence
  Synthetic
aggccctggctgctgatatgtctcttgaactgataaattaaatgctcaatattatcttctgcagctaccttatcagtgtacaaattattaagttcattgagtaatcggctcttatcgaccgaccttttgggacagcggtg

SEQ ID NO: 429844 - DNA, 140 bp, Artificial Sequence
  Synthetic
caccgctgtcccaaaaggtcggtcgataagagccgattactcaatgaacttaataatttgtacactgataaggtagctgcagaagataatattgagcatttaatttatcagttcaagagacatatcagcagccagggcct

SEQ ID NO: 429845 - DNA, 140 bp, Artificial Sequence
  Synthetic
aggccctggctgctgatatggagggtctcgcagtgtcttctttacttccttttctttgaacaatgaaccattattaaaactagacacaaggagtgaaataaatttcttggaaacaccagggaccttttgggacagcggtg

SEQ ID NO: 429846 - DNA, 140 bp, Artificial Sequence
  Synthetic
caccgctgtcccaaaaggtccctggtgtttccaagaaatttatttcactccttgtgtctagttttaataatggttcattgttcaaagaaaaggaagtaaagaagacactgcgagaccctccatatcagcagccagggcct

SEQ ID NO: 429847 - DNA, 140 bp, Artificial Sequence
  Synthetic
aggccctggctgctgatatgccttctatcagattcccacaatgctcccctacatacaaccaatggcactggttcgttgtcaggtccgaccttggagaagtcaaactcactgaactgcaatgaccttttgggacagcggtg

SEQ ID NO: 429848 - DNA, 140 bp, Artificial Sequence
  Synthetic
caccgctgtcccaaaaggtcattgcagttcagtgagtttgacttctccaaggtcggacctgacaacgaaccagtgccattggttgtatgtaggggagcattgtgggaatctgatagaaggcatatcagcagccagggcct

SEQ ID NO: 429849 - DNA, 140 bp, Artificial Sequence
  Synthetic
aggccctggctgctgatatggcctgctatactctgattcttcaaaaagtgaattgctctcctgagcatattttagaagtgaaaagagcgtatcccttagcttgtcattgacccaatcagggaccttttgggacagcggtg

SEQ ID NO: 429850 - DNA, 140 bp, Artificial Sequence
  Synthetic
caccgctgtcccaaaaggtccctgattgggtcaatgacaagctaagggatacgctcttttcacttctaaaatatgctcaggagagcaattcactttttgaagaatcagagtatagcaggccatatcagcagccagggcct

SEQ ID NO: 429851 - DNA, 140 bp, Artificial Sequence
  Synthetic
aggccctggctgctgatatgtgataatgaaaaaccatctgcgggatatcatggggattccatactgtaattacagcaagtactggtatctcaacaacacagccactgggaaaacatcactgaccttttgggacagcggtg

SEQ ID NO: 429852 - DNA, 140 bp, Artificial Sequence
  Synthetic
caccgctgtcccaaaaggtcagtgatgttttcccagtggctgtgttgttgagataccagtacttgctgtaattacagtatggaatccccatgatatcccgcagatggtttttcattatcacatatcagcagccagggcct

SEQ ID NO: 429853 - DNA, 140 bp, Artificial Sequence
  Synthetic
aggccctggctgctgatatgtgtccatgatggcatcataaacatcacaatcaaggatcttgaaatcaattccataagagttggtttctatgccaacctccctcaaagcgttagtagctcggaccttttgggacagcggtg

SEQ ID NO: 429854 - DNA, 140 bp, Artificial Sequence
  Synthetic
caccgctgtcccaaaaggtccgagctactaacgctttgagggaggttggcatagaaaccaactcttatggaattgatttcaagatccttgattgtgatgtttatgatgccatcatggacacatatcagcagccagggcct

SEQ ID NO: 429855 - DNA, 140 bp, Artificial Sequence
  Synthetic
atacgccatgctgggtctccttattctaggtgaccatttcatctttgtggaagctaaatcactcataaatggcaatatatgcttctcaaacagagacggatataaacgtctcaaagaatgcgtacttgggagtcggccat

SEQ ID NO: 429856 - DNA, 140 bp, Artificial Sequence
  Synthetic
atggccgactcccaagtacgcattctttgagacgtttatatccgtctctgtttgagaagcatatattgccatttatgagtgatttagcttccacaaagatgaaatggtcacctagaataaggagacccagcatggcgtat

SEQ ID NO: 429857 - DNA, 140 bp, Artificial Sequence
  Synthetic
atacgccatgctgggtctccagcatttgatctggtcagtcagtctgtcaggtgtttcttttgtaatgaaatgacacatataagagatatttaaaacaaacttgaatctattggtcatcatcgtacttgggagtcggccat

SEQ ID NO: 429858 - DNA, 140 bp, Artificial Sequence
  Synthetic
atggccgactcccaagtacgatgatgaccaatagattcaagtttgttttaaatatctcttatatgtgtcatttcattacaaaagaaacacctgacagactgactgaccagatcaaatgctggagacccagcatggcgtat

SEQ ID NO: 429859 - DNA, 140 bp, Artificial Sequence
  Synthetic
aggccctggctgctgatatgactcctcacatgttctgcctttcaatctcaatttgccactgcttgactgcaccatcactctcctccttgacttactgtagcaaagggcataacccttgaagaccttttgggacagcggtg

SEQ ID NO: 429860 - DNA, 140 bp, Artificial Sequence
  Synthetic
caccgctgtcccaaaaggtcttcaagggttatgccctttgctacagtaagtcaaggaggagagtgatggtgcagtcaagcagtggcaaattgagattgaaaggcagaacatgtgaggagtcatatcagcagccagggcct

SEQ ID NO: 429861 - DNA, 140 bp, Artificial Sequence
  Synthetic
aggccctggctgctgatatggtctattttatcacaatatagctttctgaaatcctctaataacttcatcttatcagtcttaacaaattgactttctatgtccccttgccttagtttgttcgaccttttgggacagcggtg

SEQ ID NO: 429862 - DNA, 140 bp, Artificial Sequence
  Synthetic
caccgctgtcccaaaaggtcgaacaaactaaggcaaggggacatagaaagtcaatttgttaagactgataagatgaagttattagaggatttcagaaagctatattgtgataaaatagaccatatcagcagccagggcct

SEQ ID NO: 429863 - DNA, 140 bp, Artificial Sequence
  Synthetic
aggccctggctgctgatatgcctcacagattgaatcacatgggcatatgttcctgtggactctacaaacagcccggtgtgcctgtgagatggaagagatgagacccttgtcagggcccccgaccttttgggacagcggtg

SEQ ID NO: 429864 - DNA, 140 bp, Artificial Sequence
  Synthetic
caccgctgtcccaaaaggtcgggggccctgacaagggtctcatctcttccatctcacaggcacaccgggctgtttgtagagtccacaggaacatatgcccatgtgattcaatctgtgaggcatatcagcagccagggcct

SEQ ID NO: 429865 - DNA, 140 bp, Artificial Sequence
  Synthetic
atacgccatgctgggtctcctctgtaatgatgttgtgtgttcacctgataggtagttggtggtgaattcctcatgaagctcaccagtttttaatttattgaacaatatcctaagcattgacgtacttgggagtcggccat

SEQ ID NO: 429866 - DNA, 140 bp, Artificial Sequence
  Synthetic
atggccgactcccaagtacgtcaatgcttaggatattgttcaataaattaaaaactggtgagcttcatgaggaattcaccaccaactacctatcaggtgaacacacaacatcattacagaggagacccagcatggcgtat

SEQ ID NO: 429867 - DNA, 140 bp, Artificial Sequence
  Synthetic
aggccctggctgctgatatgtcatgaagctcaccagtttttaatttattgaacaatatcctaagcattgacctcatctttttgcatgcatcaggaattagcctctcaatttgcctcattagaccttttgggacagcggtg

SEQ ID NO: 429868 - DNA, 140 bp, Artificial Sequence
  Synthetic
caccgctgtcccaaaaggtctaatgaggcaaattgagaggctaattcctgatgcatgcaaaaagatgaggtcaatgcttaggatattgttcaataaattaaaaactggtgagcttcatgacatatcagcagccagggcct

SEQ ID NO: 429869 - DNA, 140 bp, Artificial Sequence
  Synthetic
atacgccatgctgggtctcccctcatctttttgcatgcatcaggaattagcctctcaatttgcctcattatcctataactacgattcccgtccacccaatctcttacatcagtctcgcagcgtacttgggagtcggccat

SEQ ID NO: 429870 - DNA, 140 bp, Artificial Sequence
  Synthetic
atggccgactcccaagtacgctgcgagactgatgtaagagattgggtggacgggaatcgtagttataggataatgaggcaaattgagaggctaattcctgatgcatgcaaaaagatgaggggagacccagcatggcgtat

SEQ ID NO: 429871 - DNA, 140 bp, Artificial Sequence
  Synthetic
atacgccatgctgggtctccgtcggtttctataccaacctccctcaaagcattagtcgctcgagttaaaactctgttaataatggcaaggagctcatagtttcgttcttctttaagtgatcgtacttgggagtcggccat

SEQ ID NO: 429872 - DNA, 140 bp, Artificial Sequence
  Synthetic
atggccgactcccaagtacgatcacttaaagaagaacgaaactatgagctccttgccattattaacagagttttaactcgagcgactaatgctttgagggaggttggtatagaaaccgacggagacccagcatggcgtat

SEQ ID NO: 429873 - DNA, 140 bp, Artificial Sequence
  Synthetic
aggccctggctgctgatatgcggtttggactaaaaaagctaacttctgtcttgacaacttctcattatctgcaaggtactttgagatgagatctttagcattagcaatgtcttcctccatgaccttttgggacagcggtg

SEQ ID NO: 429874 - DNA, 140 bp, Artificial Sequence
  Synthetic
caccgctgtcccaaaaggtcatggaggaagacattgctaatgctaaagatctcatctcaaagtaccttgcagataatgagaagttgtcaagacagaagttagcttttttagtccaaaccgcatatcagcagccagggcct

SEQ ID NO: 429875 - DNA, 140 bp, Artificial Sequence
  Synthetic
atacgccatgctgggtctccacctgaaagctccctcctcaatgattgtgtccagagaaatgacttcacttccttagaagagctcatcttggtttggacacccagggattcactggttggacgtacttgggagtcggccat

SEQ ID NO: 429876 - DNA, 140 bp, Artificial Sequence
  Synthetic
atggccgactcccaagtacgtccaaccagtgaatccctgggtgtccaaaccaagatgagctcttctaaggaagtgaagtcatttctctggacacaatcattgaggagggagctttcaggtggagacccagcatggcgtat

SEQ ID NO: 429877 - DNA, 140 bp, Artificial Sequence
  Synthetic
aggccctggctgctgatatgaagatctccaacactgcatttgttcactctgagagtcagcagccctttccttatcagaatccagatctgcatacaagaatttaaggactggagaggctctgaccttttgggacagcggtg

SEQ ID NO: 429878 - DNA, 140 bp, Artificial Sequence
  Synthetic
caccgctgtcccaaaaggtcagagcctctccagtccttaaattcttgtatgcagatctggattctgataaggaaagggctgctgactctcagagtgaacaaatgcagtgttggagatcttcatatcagcagccagggcct

SEQ ID NO: 429879 - DNA, 140 bp, Artificial Sequence
  Synthetic
aggccctggctgctgatatgctgtcccatatcaaggattgaactaatgtgtgaggggactgtgccaatttgaaagttggaattaaaaaagtcttcagtcattgattgagttgtcttcttcgaccttttgggacagcggtg

SEQ ID NO: 429880 - DNA, 140 bp, Artificial Sequence
  Synthetic
caccgctgtcccaaaaggtcgaagaagacaactcaatcaatgactgaagacttttttaattccaactttcaaattggcacagtcccctcacacattagttcaatccttgatatgggacagcatatcagcagccagggcct

SEQ ID NO: 429881 - DNA, 140 bp, Artificial Sequence
  Synthetic
aggccctggctgctgatatgttaacaaattgactttctatgtccccttgccttagtttgttcctgaagatttgatactcctcctcaattaaactcttgacttcatgagaggtgagcttgtgaccttttgggacagcggtg

SEQ ID NO: 429882 - DNA, 140 bp, Artificial Sequence
  Synthetic
caccgctgtcccaaaaggtcacaagctcacctctcatgaagtcaagagtttaattgaggaggagtatcaaatcttcaggaacaaactaaggcaaggggacatagaaagtcaatttgttaacatatcagcagccagggcct

SEQ ID NO: 429883 - DNA, 140 bp, Artificial Sequence
  Synthetic
aggccctggctgctgatatgccttagaagagctcatcttggtttggacacccagggattcactggttggaagtatcactcagtaagtcaatgaaaagcgcaatccaatagcctaggatccgaccttttgggacagcggtg

SEQ ID NO: 429884 - DNA, 140 bp, Artificial Sequence
  Synthetic
caccgctgtcccaaaaggtcggatcctaggctattggattgcgcttttcattgacttactgagtgatacttccaaccagtgaatccctgggtgtccaaaccaagatgagctcttctaaggcatatcagcagccagggcct

SEQ ID NO: 429885 - DNA, 140 bp, Artificial Sequence
  Synthetic
aggccctggctgctgatatgagttctgcaagagttgctggtttgagaacagagggttggtagagtgcaacaatcactacctgtgtctcaactgtctcagcctgctcctcagcgtcagcaggaccttttgggacagcggtg

SEQ ID NO: 429886 - DNA, 140 bp, Artificial Sequence
  Synthetic
caccgctgtcccaaaaggtcctgctgacgctgaggagcaggctgagacagttgagacacaggtagtgattgttgcactctaccaaccctctgttctcaaaccagcaactcttgcagaactcatatcagcagccagggcct

SEQ ID NO: 429887 - DNA, 140 bp, Artificial Sequence
  Synthetic
aggccctggctgctgatatgctttataaaggggtttatgagcttcagactctggaactaaatatggagacactcaatatgaccatgcctctctcctgcacaaagaacaacagtcatcattgaccttttgggacagcggtg

SEQ ID NO: 429888 - DNA, 140 bp, Artificial Sequence
  Synthetic
caccgctgtcccaaaaggtcaatgatgactgttgttctttgtgcaggagagaggcatggtcatattgagtgtctccatatttagttccagagtctgaagctcataaacccctttataaagcatatcagcagccagggcct

SEQ ID NO: 429889 - DNA, 140 bp, Artificial Sequence
  Synthetic
aggccctggctgctgatatgccttggaagcactcatcttggtctggacactttagggttcactggttgaaagtattactcagtgagtcaatgaaaagcgcaatccaatagcctaggatccgaccttttgggacagcggtg

SEQ ID NO: 429890 - DNA, 140 bp, Artificial Sequence
  Synthetic
caccgctgtcccaaaaggtcggatcctaggctattggattgcgcttttcattgactcactgagtaatactttcaaccagtgaaccctaaagtgtccagaccaagatgagtgcttccaaggcatatcagcagccagggcct

SEQ ID NO: 429891 - DNA, 140 bp, Artificial Sequence
  Synthetic
aggccctggctgctgatatgaagattagtgtgcagtacaacctgagtcacagctatgctggggatgcggccaaccactgtggcactgttgcaaatggtgtcttacagactttcatgaggagaccttttgggacagcggtg

SEQ ID NO: 429892 - DNA, 140 bp, Artificial Sequence
  Synthetic
caccgctgtcccaaaaggtctcctcatgaaagtctgtaagacaccatttgcaacagtgccacagtggttggccgcatccccagcatagctgtgactcaggttgtactgcacactaatcttcatatcagcagccagggcct

SEQ ID NO: 429893 - DNA, 140 bp, Artificial Sequence
  Synthetic
aggccctggctgctgatatggttcagataactctgtgcactcttctatccagctgaccatgacatcgaccactttctgcaacacatcactggagaaaactgaaggaaaaaaccgtttggggaccttttgggacagcggtg

SEQ ID NO: 429894 - DNA, 140 bp, Artificial Sequence
  Synthetic
caccgctgtcccaaaaggtccccaaacggttttttccttcagttttctccagtgatgtgttgcagaaagtggtcgatgtcatggtcagctggatagaagagtgcacagagttatctgaaccatatcagcagccagggcct

SEQ ID NO: 429895 - DNA, 140 bp, Artificial Sequence
  Synthetic
atacgccatgctgggtctcctctttagcattggcaatgtcttcctccatcaccaattgtggtacctgtgttgggtttgggtttgtgccaatgtggcttgtgggtcagctggtgatgcccccgtacttgggagtcggccat

SEQ ID NO: 429896 - DNA, 140 bp, Artificial Sequence
  Synthetic
atggccgactcccaagtacgggggcatcaccagctgacccacaagccacattggcacaaacccaaacccaacacaggtaccacaattggtgatggaggaagacattgccaatgctaaagaggagacccagcatggcgtat

SEQ ID NO: 429897 - DNA, 140 bp, Artificial Sequence
  Synthetic
atacgccatgctgggtctccgggatcctaggcaatttggttattctttctgtaaccttgtgcactgcacttctcctctaaatgggaaacaagcaggccaaagcctcagaagcaaaagacacgtacttgggagtcggccat

SEQ ID NO: 429898 - DNA, 140 bp, Artificial Sequence
  Synthetic
atggccgactcccaagtacgtgtcttttgcttctgaggctttggcctgcttgtttcccatttagaggagaagtgcagtgcacaaggttacagaaagaataaccaaattgcctaggatcccggagacccagcatggcgtat

SEQ ID NO: 429899 - DNA, 140 bp, Artificial Sequence
  Synthetic
aggccctggctgctgatatgaagttgctgtgagcttaggttgcccatatagacacctgcacttaatggcctttctgttctgatcacctttgactttaacttctctagatcagcggctaaggaccttttgggacagcggtg

SEQ ID NO: 429900 - DNA, 140 bp, Artificial Sequence
  Synthetic
caccgctgtcccaaaaggtccttagccgctgatctagagaagttaaagtcaaaggtgatcagaacagaaaggccattaagtgcaggtgtctatatgggcaacctaagctcacagcaacttcatatcagcagccagggcct

SEQ ID NO: 429901 - DNA, 140 bp, Artificial Sequence
  Synthetic
aggccctggctgctgatatgattccatactgtaattacagcaagtattggtacctcaaccacacaactactgggaaaacatcactgcccaaatgttggcttgtatcaaatggttcatactgaccttttgggacagcggtg

SEQ ID NO: 429902 - DNA, 140 bp, Artificial Sequence
  Synthetic
caccgctgtcccaaaaggtcagtatgaaccatttgatacaagccaacatttgggcagtgatgttttcccagtagttgtgtggttgaggtaccaatacttgctgtaattacagtatggaatcatatcagcagccagggcct

SEQ ID NO: 429903 - DNA, 140 bp, Artificial Sequence
  Synthetic
atacgccatgctgggtctccgccccatttgcaagatgcctcttcccacaaaactgagaccatcaactgctccaacagcacctcaaaccggagcagcggacagcatcagacccccaccctacgtacttgggagtcggccat

SEQ ID NO: 429904 - DNA, 140 bp, Artificial Sequence
  Synthetic
atggccgactcccaagtacgtagggtgggggtctgatgctgtccgctgctccggtttgaggtgctgttggagcagttgatggtctcagttttgtgggaagaggcatcttgcaaatggggcggagacccagcatggcgtat

SEQ ID NO: 429905 - DNA, 140 bp, Artificial Sequence
  Synthetic
aggccctggctgctgatatgtcctcacatgttctgcccttcagtctcaatttaccactacttgactgtaccatcaccttcccctttgacttactatagcagagggcataacccttaaattgaccttttgggacagcggtg

SEQ ID NO: 429906 - DNA, 140 bp, Artificial Sequence
  Synthetic
caccgctgtcccaaaaggtcaatttaagggttatgccctctgctatagtaagtcaaaggggaaggtgatggtacagtcaagtagtggtaaattgagactgaagggcagaacatgtgaggacatatcagcagccagggcct

SEQ ID NO: 429907 - DNA, 140 bp, Artificial Sequence
  Synthetic
aggccctggctgctgatatgagctccagacccagccgacagcaccaccagaaatcccaccatcccaaaatcccccaccctacagcccctgaggcagaactccgccccgaagcccctcccagaccttttgggacagcggtg

SEQ ID NO: 429908 - DNA, 140 bp, Artificial Sequence
  Synthetic
caccgctgtcccaaaaggtctgggaggggcttcggggcggagttctgcctcaggggctgtagggtgggggattttgggatggtgggatttctggtggtgctgtcggctgggtctggagctcatatcagcagccagggcct

SEQ ID NO: 429909 - DNA, 140 bp, Artificial Sequence
  Synthetic
aggccctggctgctgatatggaagaggtgatgaacattgttctcattgcactgtcaatattggcagtgctaaaaggtctgtataattttgctacatgtggcctcgttggtttggttacttgaccttttgggacagcggtg

SEQ ID NO: 429910 - DNA, 140 bp, Artificial Sequence
  Synthetic
caccgctgtcccaaaaggtcaagtaaccaaaccaacgaggccacatgtagcaaaattatacagaccttttagcactgccaatattgacagtgcaatgagaacaatgttcatcacctcttccatatcagcagccagggcct

SEQ ID NO: 429911 - DNA, 140 bp, Artificial Sequence
  Synthetic
aggccctggctgctgatatgtatgagcttcagactctggaactaaacatggagactctcaatatgactatgcctctctcttgcacaaagaacaatagtcatcattacataatggtgggcagaccttttgggacagcggtg

SEQ ID NO: 429912 - DNA, 140 bp, Artificial Sequence
  Synthetic
caccgctgtcccaaaaggtctgcccaccattatgtaatgatgactattgttctttgtgcaagagagaggcatagtcatattgagagtctccatgtttagttccagagtctgaagctcatacatatcagcagccagggcct

SEQ ID NO: 429913 - DNA, 140 bp, Artificial Sequence
  Synthetic
atacgccatgctgggtctcctatgttcacatccattggccttgcaagagtcaatctcaatgcaaagagatagtagtttcaatccttccatgagcaacattctaggttcggtttggaccaacgtacttgggagtcggccat

SEQ ID NO: 429914 - DNA, 140 bp, Artificial Sequence
  Synthetic
atggccgactcccaagtacgttggtccaaaccgaacctagaatgttgctcatggaaggattgaaactactatctctttgcattgagattgactcttgcaaggccaatggatgtgaacataggagacccagcatggcgtat

SEQ ID NO: 429915 - DNA, 140 bp, Artificial Sequence
  Synthetic
atacgccatgctgggtctccttaggtgatagggcacctgcatttctatccttagttctcttcctactgtttatccaccgctttaaatctctttttgttgattccaatgaaactaatctatcgtacttgggagtcggccat

SEQ ID NO: 429916 - DNA, 140 bp, Artificial Sequence
  Synthetic
atggccgactcccaagtacgatagattagtttcattggaatcaacaaaaagagatttaaagcggtggataaacagtaggaagagaactaaggatagaaatgcaggtgccctatcacctaaggagacccagcatggcgtat

SEQ ID NO: 429917 - DNA, 140 bp, Artificial Sequence
  Synthetic
aggccctggctgctgatatgcaaaatgcaatgagaaacatgacgaagaattctgtgatatgctgaggctgtttgacttcaacaaacaggccattcaaaggttaaaagccgaagcacaaatgaccttttgggacagcggtg

SEQ ID NO: 429918 - DNA, 140 bp, Artificial Sequence
  Synthetic
caccgctgtcccaaaaggtcatttgtgcttcggcttttaacctttgaatggcctgtttgttgaagtcaaacagcctcagcatatcacagaattcttcgtcatgtttctcattgcattttgcatatcagcagccagggcct

SEQ ID NO: 429919 - DNA, 140 bp, Artificial Sequence
  Synthetic
aggccctggctgctgatatgagctcgtctctggtcaagttgctgtgagctcaggttgcccatatagacacctgcactcaatggcctttctgtcctggtcacctttgatttcaacttctctgaccttttgggacagcggtg

SEQ ID NO: 429920 - DNA, 140 bp, Artificial Sequence
  Synthetic
caccgctgtcccaaaaggtcagagaagttgaaatcaaaggtgaccaggacagaaaggccattgagtgcaggtgtctatatgggcaacctgagctcacagcaacttgaccagagacgagctcatatcagcagccagggcct

SEQ ID NO: 429921 - DNA, 140 bp, Artificial Sequence
  Synthetic
atacgccatgctgggtctccaaccagatagttcccttctcaatgattgtgtccacagaaaggactttatttcctttgaggcactcatctccagattgttgtgctggatgcacgcagcagacgtacttgggagtcggccat

SEQ ID NO: 429922 - DNA, 140 bp, Artificial Sequence
  Synthetic
atggccgactcccaagtacgtctgctgcgtgcatccagcacaacaatctggagatgagtgcctcaaaggaaataaagtcctttctgtggacacaatcattgagaagggaactatctggttggagacccagcatggcgtat

SEQ ID NO: 429923 - DNA, 140 bp, Artificial Sequence
  Synthetic
aggccctggctgctgatatgtcagacatgccagtgtcaaacttggcatggtcccgaactgattgttaagcaactctgcatttttcacatcccaaactctcaccactccatctctcccagcgaccttttgggacagcggtg

SEQ ID NO: 429924 - DNA, 140 bp, Artificial Sequence
  Synthetic
caccgctgtcccaaaaggtcgctgggagagatggagtggtgagagtttgggatgtgaaaaatgcagagttgcttaacaatcagttcgggaccatgccaagtttgacactggcatgtctgacatatcagcagccagggcct

SEQ ID NO: 429925 - DNA, 140 bp, Artificial Sequence
  Synthetic
atacgccatgctgggtctccaaaggatgatgtgcagccaagtttaaccaagaatactcaaggtcagactcagatgggggctcaacatccaacagctcacaaagatttcttagtgaagagacgtacttgggagtcggccat

SEQ ID NO: 429926 - DNA, 140 bp, Artificial Sequence
  Synthetic
atggccgactcccaagtacgtctcttcactaagaaatctttgtgagctgttggatgttgagcccccatctgagtctgaccttgagtattcttggttaaacttggctgcacatcatcctttggagacccagcatggcgtat

SEQ ID NO: 429927 - DNA, 140 bp, Artificial Sequence
  Synthetic
atacgccatgctgggtctcccagaccctgaaggcaataatgctacagcatcaaagaaatcctccaatgaatcaaacttagaatcaatcaaacctgatgcaatcagttgattctgattgaacgtacttgggagtcggccat

SEQ ID NO: 429928 - DNA, 140 bp, Artificial Sequence
  Synthetic
atggccgactcccaagtacgttcaatcagaatcaactgattgcatcaggtttgattgattctaagtttgattcattggaggatttctttgatgctgtagcattattgccttcagggtctgggagacccagcatggcgtat

SEQ ID NO: 429929 - DNA, 140 bp, Artificial Sequence
  Synthetic
atacgccatgctgggtctccctcaaaactgatgtgttcagtcctcctgacactgctgcatcaaacatgatacaatccattagtgcacagtggggagttatttcctctttaccgcccttctcgtacttgggagtcggccat

SEQ ID NO: 429930 - DNA, 140 bp, Artificial Sequence
  Synthetic
atggccgactcccaagtacgagaagggcggtaaagaggaaataactccccactgtgcactaatggattgtatcatgtttgatgcagcagtgtcaggaggactgaacacatcagttttgagggagacccagcatggcgtat

SEQ ID NO: 429931 - DNA, 140 bp, Artificial Sequence
  Synthetic
aggccctggctgctgatatgaatatcaattagtttgatgtcttttcttccttgtgattcaaggagtttcctaatgtcttcggacccctgacaggtaataaccatgttccgggggagtgcagaccttttgggacagcggtg

SEQ ID NO: 429932 - DNA, 140 bp, Artificial Sequence
  Synthetic
caccgctgtcccaaaaggtctgcactcccccggaacatggttattacctgtcaggggtccgaagacattaggaaactccttgaatcacaaggaagaaaagacatcaaactaattgatattcatatcagcagccagggcct

SEQ ID NO: 429933 - DNA, 140 bp, Artificial Sequence
  Synthetic
atacgccatgctgggtctcccacctgtgttggctttgggcttgtgcctgtgtggcttgtaaatcagctagtggtgctccacaaaaaactcctacagaaatgagagacaatacgcctaggacgtacttgggagtcggccat

SEQ ID NO: 429934 - DNA, 140 bp, Artificial Sequence
  Synthetic
atggccgactcccaagtacgtcctaggcgtattgtctctcatttctgtaggagttttttgtggagcaccactagctgatttacaagccacacaggcacaagcccaaagccaacacaggtgggagacccagcatggcgtat

SEQ ID NO: 429935 - DNA, 140 bp, Artificial Sequence
  Synthetic
atacgccatgctgggtctccggcatttgggtcaagttgcagcattgcatccttgagggtcataagctgagaatatgttagcccagcagcaaaccctgccgactgtagggatttgttggaacgtacttgggagtcggccat

SEQ ID NO: 429936 - DNA, 140 bp, Artificial Sequence
  Synthetic
atggccgactcccaagtacgttccaacaaatccctacagtcggcagggtttgctgctgggctaacatattctcagcttatgaccctcaaggatgcaatgctgcaacttgacccaaatgccggagacccagcatggcgtat

SEQ ID NO: 429937 - DNA, 140 bp, Artificial Sequence
  Synthetic
aggccctggctgctgatatgttgatcaaagagggagatttgatcatcactggaggtataagcatctatcgtaccaccacatatacaactgatggcataattaatgaacctctctgaaatggaccttttgggacagcggtg

SEQ ID NO: 429938 - DNA, 140 bp, Artificial Sequence
  Synthetic
caccgctgtcccaaaaggtccatttcagagaggttcattaattatgccatcagttgtatatgtggtggtacgatagatgcttatacctccagtgatgatcaaatctccctctttgatcaacatatcagcagccagggcct

SEQ ID NO: 429939 - DNA, 140 bp, Artificial Sequence
  Synthetic
atacgccatgctgggtctccactgggaaaacatcactgcctagatgctggcttgtgtcaaatggctcatatctaaacgagacccacttctctgatgacattgaacaacaagctgacaacacgtacttgggagtcggccat

SEQ ID NO: 429940 - DNA, 140 bp, Artificial Sequence
  Synthetic
atggccgactcccaagtacgtgttgtcagcttgttgttcaatgtcatcagagaagtgggtctcgtttagatatgagccatttgacacaagccagcatctaggcagtgatgttttcccagtggagacccagcatggcgtat

SEQ ID NO: 429941 - DNA, 140 bp, Artificial Sequence
  Synthetic
atacgccatgctgggtctccccattaggtctggtcgacctctttgtgttcagcacaagtttttatctcattagtatcttccttcacctagtcaaaataccaactcatagacacattgtggcgtacttgggagtcggccat

SEQ ID NO: 429942 - DNA, 140 bp, Artificial Sequence
  Synthetic
atggccgactcccaagtacgccacaatgtgtctatgagttggtattttgactaggtgaaggaagatactaatgagataaaaacttgtgctgaacacaaagaggtcgaccagacctaatggggagacccagcatggcgtat

SEQ ID NO: 429943 - DNA, 140 bp, Artificial Sequence
  Synthetic
atacgccatgctgggtctccgctgcatcaaacatgatgcagtccattagagcacagtgaggggttatttcctctttaccacctcttttcttcttctcaacgacaacacctgtgtgcatatcgtacttgggagtcggccat

SEQ ID NO: 429944 - DNA, 140 bp, Artificial Sequence
  Synthetic
atggccgactcccaagtacgatatgcacacaggtgttgtcgttgagaagaagaaaagaggtggtaaagaggaaataacccctcactgtgctctaatggactgcatcatgtttgatgcagcggagacccagcatggcgtat

SEQ ID NO: 429945 - DNA, 140 bp, Artificial Sequence
  Synthetic
aggccctggctgctgatatgtcagttttactgagggcaatgtcaattagtttgatatcttttcttccctgtgattcaaggagtttccttatgtcatcagacccctggcaggtaatgaccagaccttttgggacagcggtg

SEQ ID NO: 429946 - DNA, 140 bp, Artificial Sequence
  Synthetic
caccgctgtcccaaaaggtctggtcattacctgccaggggtctgatgacataaggaaactccttgaatcacagggaagaaaagatatcaaactaattgacattgccctcagtaaaactgacatatcagcagccagggcct

SEQ ID NO: 429947 - DNA, 140 bp, Artificial Sequence
  Synthetic
aggccctggctgctgatatggtatcctttaagaactcactcaccacatctgatccaacaaaccaggctgacctacccttgaaagttggacccgacagagcaagtctccaacagtcagacagaccttttgggacagcggtg

SEQ ID NO: 429948 - DNA, 140 bp, Artificial Sequence
  Synthetic
caccgctgtcccaaaaggtctgtctgactgttggagacttgctctgtcgggtccaactttcaagggtaggtcagcctggtttgttggatcagatgtggtgagtgagttcttaaaggataccatatcagcagccagggcct

SEQ ID NO: 429949 - DNA, 140 bp, Artificial Sequence
  Synthetic
aggccctggctgctgatatggagagtcataagctgagaataggtaagcccggcagtgaaccctgttgactgtagggatttgttggaattgttgctcccagctttttgtggcttcccatctgaccttttgggacagcggtg

SEQ ID NO: 429950 - DNA, 140 bp, Artificial Sequence
  Synthetic
caccgctgtcccaaaaggtcagatgggaagccacaaaaagctgggagcaacaattccaacaaatccctacagtcaacagggttcactgccgggcttacctattctcagcttatgactctccatatcagcagccagggcct

SEQ ID NO: 429951 - DNA, 140 bp, Artificial Sequence
  Synthetic
atacgccatgctgggtctccccccggggggaccccccgccgggggcccccccgggggagccaaccatccctgaaagactactcaatgtcttcgatgtgtccatccttcccagtcaactcccgtacttgggagtcggccat

SEQ ID NO: 429952 - DNA, 140 bp, Artificial Sequence
  Synthetic
atggccgactcccaagtacgggagttgactgggaaggatggacacatcgaagacattgagtagtctttcagggatggttggctcccccgggggggcccccggcggggggtccccccggggggagacccagcatggcgtat

SEQ ID NO: 429953 - DNA, 140 bp, Artificial Sequence
  Synthetic
atacgccatgctgggtctcctcacatgttctgcccttcagtctcaatttaccactacttgattgtatcatcactttcccctttgacttactataacagagagcataacccttgaactccacgtacttgggagtcggccat

SEQ ID NO: 429954 - DNA, 140 bp, Artificial Sequence
  Synthetic
atggccgactcccaagtacgtggagttcaagggttatgctctctgttatagtaagtcaaaggggaaagtgatgatacaatcaagtagtggtaaattgagactgaagggcagaacatgtgaggagacccagcatggcgtat

SEQ ID NO: 429955 - DNA, 140 bp, Artificial Sequence
  Synthetic
atacgccatgctgggtctccatttagttggactttagtggtgaggcttatcctagtgaatccctgaatcaaagtgcccagtcaaaatgggcaacagacaggccaaaccaacaaaagttgacgtacttgggagtcggccat

SEQ ID NO: 429956 - DNA, 140 bp, Artificial Sequence
  Synthetic
atggccgactcccaagtacgtcaacttttgttggtttggcctgtctgttgcccattttgactgggcactttgattcagggattcactaggataagcctcaccactaaagtccaactaaatggagacccagcatggcgtat

SEQ ID NO: 429957 - DNA, 140 bp, Artificial Sequence
  Synthetic
atacgccatgctgggtctcctcttgtatgacaggtgtaaaggatgccaatttcctcccacattcccataagcctcccctatgcacaaccagagggactggctcaatgcaaggacccaccacgtacttgggagtcggccat

SEQ ID NO: 429958 - DNA, 140 bp, Artificial Sequence
  Synthetic
atggccgactcccaagtacgtggtgggtccttgcattgagccagtccctctggttgtgcataggggaggcttatgggaatgtgggaggaaattggcatcctttacacctgtcatacaagaggagacccagcatggcgtat

SEQ ID NO: 429959 - DNA, 140 bp, Artificial Sequence
  Synthetic
aggccctggctgctgatatggcctcccctatgcacaaccagagggactggctcaatgcaaggacccaccaacacaaagtcatattctgtaaactgcaacctttccatatcaacaacaactgaccttttgggacagcggtg

SEQ ID NO: 429960 - DNA, 140 bp, Artificial Sequence
  Synthetic
caccgctgtcccaaaaggtcagttgttgttgatatggaaaggttgcagtttacagaatatgactttgtgttggtgggtccttgcattgagccagtccctctggttgtgcataggggaggccatatcagcagccagggcct

SEQ ID NO: 429961 - DNA, 140 bp, Artificial Sequence
  Synthetic
atacgccatgctgggtctccacacaaagtcatattctgtaaactgcaacctttccatatcaacaacaacttcaacgggggtcacatgccctagttgatttgtgtcaattagaaactcattcgtacttgggagtcggccat

SEQ ID NO: 429962 - DNA, 140 bp, Artificial Sequence
  Synthetic
atggccgactcccaagtacgaatgagtttctaattgacacaaatcaactagggcatgtgacccccgttgaagttgttgttgatatggaaaggttgcagtttacagaatatgactttgtgtggagacccagcatggcgtat

SEQ ID NO: 429963 - DNA, 140 bp, Artificial Sequence
  Synthetic
atacgccatgctgggtctccctaggtcagcagccaaaattaacaagtcatctgaggtcaaagtcccaactctcaacacactcttttgttgagttgatttcaactcaacaaggttgttgaccgtacttgggagtcggccat

SEQ ID NO: 429964 - DNA, 140 bp, Artificial Sequence
  Synthetic
atggccgactcccaagtacggtcaacaaccttgttgagttgaaatcaactcaacaaaagagtgtgttgagagttgggactttgacctcagatgacttgttaattttggctgctgacctagggagacccagcatggcgtat

SEQ ID NO: 429965 - DNA, 140 bp, Artificial Sequence
  Synthetic
aggccctggctgctgatatgctggctcaatgtcaaaatctatccaggcataacccatcatcagatcatgtttaaacattggcctttcaacacctttgtgaataactttctctacaaatgagaccttttgggacagcggtg

SEQ ID NO: 429966 - DNA, 140 bp, Artificial Sequence
  Synthetic
caccgctgtcccaaaaggtctcatttgtagagaaagttattcacaaaggtgttgaaaggccaatgtttaaacatgatctgatgatgggttatgcctggatagattttgacattgagccagcatatcagcagccagggcct

SEQ ID NO: 429967 - DNA, 140 bp, Artificial Sequence
  Synthetic
aggccctggctgctgatatgtatctcctttgaggcactcattgtcgggttgttgtgttggacacacacagcaaagagtcaagactatctgctgaatgacaagagcaaagcgcaatccaatgaccttttgggacagcggtg

SEQ ID NO: 429968 - DNA, 140 bp, Artificial Sequence
  Synthetic
caccgctgtcccaaaaggtcattggattgcgctttgctcttgtcattcagcagatagtcttgactctttgctgtgtgtgtccaacacaacaacccgacaatgagtgcctcaaaggagatacatatcagcagccagggcct

SEQ ID NO: 429969 - DNA, 140 bp, Artificial Sequence
  Synthetic
atacgccatgctgggtctcctctggtaacttattgtagggacaactccagagacatcaaagtccataatcaaatcataactgttaagacaaatcacctccatatcaatcttatagtggtccgtacttgggagtcggccat

SEQ ID NO: 429970 - DNA, 140 bp, Artificial Sequence
  Synthetic
atggccgactcccaagtacggaccactataagattgatatggaggtgatttgtcttaacagttatgatttgattatggactttgatgtctctggagttgtccctacaataagttaccagaggagacccagcatggcgtat

SEQ ID NO: 429971 - DNA, 140 bp, Artificial Sequence
  Synthetic
aggccctggctgctgatatgtgtgagacaacctcaattcagatgataacacaatgtaatgttcctctcttttccattttactatatgtgagacaagggacaaagcctcacagttaacatcgaccttttgggacagcggtg

SEQ ID NO: 429972 - DNA, 140 bp, Artificial Sequence
  Synthetic
caccgctgtcccaaaaggtcgatgttaactgtgaggctttgtcccttgtctcacatatagtaaaatggaaaagagaggaacattacattgtgttatcatctgaattgaggttgtctcacacatatcagcagccagggcct

SEQ ID NO: 429973 - DNA, 140 bp, Artificial Sequence
  Synthetic
aggccctggctgctgatatgtcacccttctctttgatttactatagcagagagcataacctttgaattctacccaattgtccactgcctcaagaactgcactcaggaccttcgcaccaccgaccttttgggacagcggtg

SEQ ID NO: 429974 - DNA, 140 bp, Artificial Sequence
  Synthetic
caccgctgtcccaaaaggtcggtggtgcgaaggtcctgagtgcagttcttgaggcagtggacaattgggtagaattcaaaggttatgctctctgctatagtaaatcaaagagaagggtgacatatcagcagccagggcct

SEQ ID NO: 429975 - DNA, 140 bp, Artificial Sequence
  Synthetic
atacgccatgctgggtctccacccaattgtccactgcctcaagaactgcactcaggaccttcgcaccacctggtgccgcagccttcaacgtggagacaatgtccacccctgaccactgcacgtacttgggagtcggccat

SEQ ID NO: 429976 - DNA, 140 bp, Artificial Sequence
  Synthetic
atggccgactcccaagtacgtgcagtggtcaggggtggacattgtctccacgttgaaggctgcggcaccaggtggtgcgaaggtcctgagtgcagttcttgaggcagtggacaattgggtggagacccagcatggcgtat

SEQ ID NO: 429977 - DNA, 140 bp, Artificial Sequence
  Synthetic
aggccctggctgctgatatgacttaaggttcttttctgtattagattgcacaggtgaacagggacaccattcgcaaccgactgatcaatgattgtgtcaattgtttctgccagttgatgagaccttttgggacagcggtg

SEQ ID NO: 429978 - DNA, 140 bp, Artificial Sequence
  Synthetic
caccgctgtcccaaaaggtctcatcaactggcagaaacaattgacacaatcattgatcagtcggttgcgaatggtgtccctgttcacctgtgcaatctaatacagaaaagaaccttaagtcatatcagcagccagggcct

SEQ ID NO: 429979 - DNA, 140 bp, Artificial Sequence
  Synthetic
atacgccatgctgggtctccccataataagggtctgaagtaaccaaccacactctcacttccacttccattcctaagttctagcggaactcgccaatattgaatgccattggaatttgtccgtacttgggagtcggccat

SEQ ID NO: 429980 - DNA, 140 bp, Artificial Sequence
  Synthetic
atggccgactcccaagtacggacaaattccaatggcattcaatattggcgagttccgctagaacttaggaatggaagtggaagtgagagtgtggttggttacttcagacccttattatggggagacccagcatggcgtat

SEQ ID NO: 429981 - DNA, 140 bp, Artificial Sequence
  Synthetic
atacgccatgctgggtctccatcctaggcaattcagctggacttcagtggtaaggcttattttagtgaatccttgaaccaaagtgcctagtcaaaatgggcaacagacaggccaaatcgacgtacttgggagtcggccat

SEQ ID NO: 429982 - DNA, 140 bp, Artificial Sequence
  Synthetic
atggccgactcccaagtacgtcgatttggcctgtctgttgcccattttgactaggcactttggttcaaggattcactaaaataagccttaccactgaagtccagctgaattgcctaggatggagacccagcatggcgtat

SEQ ID NO: 429983 - DNA, 140 bp, Artificial Sequence
  Synthetic
atacgccatgctgggtctccatatagattctctttgtttggtccccgaacacatttgctgcccaatgttctacacaaccccacaaagccagatgctatggaactttggaatgcagatttgcgtacttgggagtcggccat

SEQ ID NO: 429984 - DNA, 140 bp, Artificial Sequence
  Synthetic
atggccgactcccaagtacgcaaatctgcattccaaagttccatagcatctggctttgtggggttgtgtagaacattgggcagcaaatgtgttcggggaccaaacaaagagaatctatatggagacccagcatggcgtat

SEQ ID NO: 429985 - DNA, 140 bp, Artificial Sequence
  Synthetic
aggccctggctgctgatatgggtttacagcacctgaatatattatcttttgtctcaacaccatccttaaaggatgatgcgcagctaagtttaaccaagaatactcaaggtcagactcagagaccttttgggacagcggtg

SEQ ID NO: 429986 - DNA, 140 bp, Artificial Sequence
  Synthetic
caccgctgtcccaaaaggtctctgagtctgaccttgagtattcttggttaaacttagctgcgcatcatcctttaaggatggtgttgagacaaaagataatatattcaggtgctgtaaacccatatcagcagccagggcct

SEQ ID NO: 429987 - DNA, 140 bp, Artificial Sequence
  Synthetic
atacgccatgctgggtctcctctaaggcaacacaaagatcaaggaactttattctgggtgaccatttcatctttgtggaagctagatcactcataaatggtaatatgtgcttttcaaacacgtacttgggagtcggccat

SEQ ID NO: 429988 - DNA, 140 bp, Artificial Sequence
  Synthetic
atggccgactcccaagtacgtgtttgaaaagcacatattaccatttatgagtgatctagcttccacaaagatgaaatggtcacccagaataaagttccttgatctttgtgttgccttagaggagacccagcatggcgtat

SEQ ID NO: 429989 - DNA, 140 bp, Artificial Sequence
  Synthetic
aggccctggctgctgatatgcgggggctcaacgtctaatagctcacaaagattccttagtgaagagaggtgctcactagacaaatagtttgttgtaaactcttcatggagttgcccagtcgaccttttgggacagcggtg

SEQ ID NO: 429990 - DNA, 140 bp, Artificial Sequence
  Synthetic
caccgctgtcccaaaaggtcgactgggcaactccatgaagagtttacaacaaactatttgtctagtgagcacctctcttcactaaggaatctttgtgagctattagacgttgagcccccgcatatcagcagccagggcct

SEQ ID NO: 429991 - DNA, 140 bp, Artificial Sequence
  Synthetic
aggccctggctgctgatatggtcttgatagtctctcattgtccactaggtactttgacactaagtctttgacataggctacatcttcctccatgtctagccacaggtgtgatgatcagaagaccttttgggacagcggtg

SEQ ID NO: 429992 - DNA, 140 bp, Artificial Sequence
  Synthetic
caccgctgtcccaaaaggtcttctgatcatcacacctgtggctagacatggaggaagatgtagcctatgtcaaagacttagtgtcaaagtacctagtggacaatgagagactatcaagaccatatcagcagccagggcct

SEQ ID NO: 429993 - DNA, 140 bp, Artificial Sequence
  Synthetic
atacgccatgctgggtctccccctcagaacatgtggtctgctaaagcaacagttaactataggacagggtctcgcgggaggcacaaaaggaacaagaggcaattaaagacaattaaaatacgtacttgggagtcggccat

SEQ ID NO: 429994 - DNA, 140 bp, Artificial Sequence
  Synthetic
atggccgactcccaagtacgtattttaattgtctttaattgcctcttgttccttttgtgcctcccgcgagaccctgtcctatagttaactgttgctttagcagaccacatgttctgagggggagacccagcatggcgtat

SEQ ID NO: 429995 - DNA, 140 bp, Artificial Sequence
  Synthetic
atacgccatgctgggtctccccccgggggggaccccccgccgggggcccccccgggggagccaaccatctctaggggactactcaatgtcctcgatgcattcatccttcctagtcagctccgtacttgggagtcggccat

SEQ ID NO: 429996 - DNA, 140 bp, Artificial Sequence
  Synthetic
atggccgactcccaagtacggagctgactaggaaggatgaatgcatcgaggacattgagtagtcccctagagatggttggctcccccgggggggcccccggcggggggtcccccccggggggagacccagcatggcgtat

SEQ ID NO: 429997 - DNA, 140 bp, Artificial Sequence
  Synthetic
atacgccatgctgggtctccaaaactgaacagagtccactggcattgtacttaacaaatcaaagaaatcttcaagggagtctaacctcaattcctctgtcaggcctgaagcaataagctgcgtacttgggagtcggccat

SEQ ID NO: 429998 - DNA, 140 bp, Artificial Sequence
  Synthetic
atggccgactcccaagtacgcagcttattgcttcaggcctgacagaggaattgaggttagactcccttgaagatttctttgatttgttaagtacaatgccagtggactctgttcagttttggagacccagcatggcgtat

SEQ ID NO: 429999 - DNA, 140 bp, Artificial Sequence
  Synthetic
aggccctggctgctgatatgaatcttctgttattgattgcttggttttcttccttaaccctagttgagctttaatgtaagacttcatcatagctgtcaccacattaaagggtatttccacgaccttttgggacagcggtg

SEQ ID NO: 430000 - DNA, 140 bp, Artificial Sequence
  Synthetic
caccgctgtcccaaaaggtcgtggaaataccctttaatgtggtgacagctatgatgaagtcttacattaaagctcaactagggttaaggaagaaaaccaagcaatcaataacagaagattcatatcagcagccagggcct

SEQ ID NO: 430001 - DNA, 140 bp, Artificial Sequence
  Synthetic
atacgccatgctgggtctccataaagaaaatttaagccttcctgtatcaggtcccactgagtcataagattgtggcgactcttggctataaaaacacaagttctttaacatagcagtggtcgtacttgggagtcggccat

SEQ ID NO: 430002 - DNA, 140 bp, Artificial Sequence
  Synthetic
atggccgactcccaagtacgaccactgctatgttaaagaacttgtgtttttatagccaagagtcgccacaatcttatgactcagtgggacctgatacaggaaggcttaaattttctttatggagacccagcatggcgtat

SEQ ID NO: 430003 - DNA, 140 bp, Artificial Sequence
  Synthetic
aggccctggctgctgatatgtgtggcgactcttggctataaaaacacaagttctttaacatagcagtggtacagtttgtcaatgacagagccttactgagtgcctctgaattgctttcccgaccttttgggacagcggtg

SEQ ID NO: 430004 - DNA, 140 bp, Artificial Sequence
  Synthetic
caccgctgtcccaaaaggtcgggaaagcaattcagaggcactcagtaaggctctgtcattgacaaactgtaccactgctatgttaaagaacttgtgtttttatagccaagagtcgccacacatatcagcagccagggcct

SEQ ID NO: 430005 - DNA, 140 bp, Artificial Sequence
  Synthetic
aggccctggctgctgatatgattcatgattaaaagtatggacttaaaacactgaaagtattcgtggttaaagtatgtccttgttgataccgcctttgtcaactctccaataggacactgtgaccttttgggacagcggtg

SEQ ID NO: 430006 - DNA, 140 bp, Artificial Sequence
  Synthetic
caccgctgtcccaaaaggtcacagtgtcctattggagagttgacaaaggcggtatcaacaaggacatactttaaccacgaatactttcagtgttttaagtccatacttttaatcatgaatcatatcagcagccagggcct

SEQ ID NO: 430007 - DNA, 140 bp, Artificial Sequence
  Synthetic
atacgccatgctgggtctcctgctgcaacaaattttgttaataatggcacttcatctccccagacaaagaatctagatttgaattctgcaacaaacctaccaataacacttttaggactccgtacttgggagtcggccat

SEQ ID NO: 430008 - DNA, 140 bp, Artificial Sequence
  Synthetic
atggccgactcccaagtacggagtcctaaaagtgttattggtaggtttgttgcagaattcaaatctagattctttgtctggggagatgaagtgccattattaacaaaatttgttgcagcaggagacccagcatggcgtat

SEQ ID NO: 430009 - DNA, 140 bp, Artificial Sequence
  Synthetic
aggccctggctgctgatatgcaaagtcttcaaccatgtggttggataattcacccttgatcagcctaatgtaaaacttatttgggacaatctcatctaaatcatttattgatggctggctgaccttttgggacagcggtg

SEQ ID NO: 430010 - DNA, 140 bp, Artificial Sequence
  Synthetic
caccgctgtcccaaaaggtcagccagccatcaataaatgatttagatgagattgtcccaaataagttttacattaggctgatcaagggtgaattatccaaccacatggttgaagactttgcatatcagcagccagggcct

SEQ ID NO: 430011 - DNA, 140 bp, Artificial Sequence
  Synthetic
aggccctggctgctgatatgcctctcatcctctaagaggtacctgctcacaagatctttgctctcggacagcaactcctccatcacacacagttacctaaactatagagagtcaaaatgcgaccttttgggacagcggtg

SEQ ID NO: 430012 - DNA, 140 bp, Artificial Sequence
  Synthetic
caccgctgtcccaaaaggtcgcattttgactctctatagtttaggtaactgtgtgtgatggaggagttgctgtccgagagcaaagatcttgtgagcaggtacctcttagaggatgagaggcatatcagcagccagggcct

SEQ ID NO: 430013 - DNA, 140 bp, Artificial Sequence
  Synthetic
atacgccatgctgggtctccttgtacagatcctagaaccagattgctcattacctgttgtactttgtattcataatcctgcttgttaagaaggtactttccctttcttgagaagacttcacgtacttgggagtcggccat

SEQ ID NO: 430014 - DNA, 140 bp, Artificial Sequence
  Synthetic
atggccgactcccaagtacgtgaagtcttctcaagaaagggaaagtaccttcttaacaagcaggattatgaatacaaagtacaacaggtaatgagcaatctggttctaggatctgtacaaggagacccagcatggcgtat

SEQ ID NO: 430015 - DNA, 140 bp, Artificial Sequence
  Synthetic
aggccctggctgctgatatgtgatggcttcagataataatttctgtgcaccccgggtgaaggtggaggataacttattctgaatcgtcttgacgatagtgggaatcttttcatcatccaggaccttttgggacagcggtg

SEQ ID NO: 430016 - DNA, 140 bp, Artificial Sequence
  Synthetic
caccgctgtcccaaaaggtcctggatgatgaaaagattcccactatcgtcaagacgattcagaataagttatcctccaccttcacccggggtgcacagaaattattatctgaagccatcacatatcagcagccagggcct

SEQ ID NO: 430017 - DNA, 140 bp, Artificial Sequence
  Synthetic
aggccctggctgctgatatgtagaccatgtcatctaattcttcctccgtggctgtatctgcaggattggtgctcacatgaccaaatctcacttttggttccagaaacttttcaaaacactgaccttttgggacagcggtg

SEQ ID NO: 430018 - DNA, 140 bp, Artificial Sequence
  Synthetic
caccgctgtcccaaaaggtcagtgttttgaaaagtttctggaaccaaaagtgagatttggtcatgtgagcaccaatcctgcagatacagccacggaggaagaattagatgacatggtctacatatcagcagccagggcct

SEQ ID NO: 430019 - DNA, 140 bp, Artificial Sequence
  Synthetic
atacgccatgctgggtctccttatctgatctgtcagcctatccggtgtttctttcgtgataaagtggcacatgtaagagatgttcaagacaaacttgaacctattagtcatcatgcttttcgtacttgggagtcggccat

SEQ ID NO: 430020 - DNA, 140 bp, Artificial Sequence
  Synthetic
atggccgactcccaagtacgaaaagcatgatgactaataggttcaagtttgtcttgaacatctcttacatgtgccactttatcacgaaagaaacaccggataggctgacagatcagataaggagacccagcatggcgtat

SEQ ID NO: 430021 - DNA, 140 bp, Artificial Sequence
  Synthetic
atacgccatgctgggtctccgcaggaattcaacgtcggtgattaattcttcccttatcttgtcaatgaggtctttatgatgataatctgacgtgtaagccattacgaaatacctaagattcgtacttgggagtcggccat

SEQ ID NO: 430022 - DNA, 140 bp, Artificial Sequence
  Synthetic
atggccgactcccaagtacgaatcttaggtatttcgtaatggcttacacgtcagattatcatcataaagacctcattgacaagataagggaagaattaatcaccgacgttgaattcctgcggagacccagcatggcgtat

SEQ ID NO: 430023 - DNA, 140 bp, Artificial Sequence
  Synthetic
atacgccatgctgggtctccctaattctcacatcatcagaaagcttacccatgtcaaacttaaaattaaggtttcttgacttataatgagtgtactttcccataagtgtatttgcattcacgtacttgggagtcggccat

SEQ ID NO: 430024 - DNA, 140 bp, Artificial Sequence
  Synthetic
atggccgactcccaagtacgtgaatgcaaatacacttatgggaaagtacactcattataagtcaagaaaccttaattttaagtttgacatgggtaagctttctgatgatgtgagaattagggagacccagcatggcgtat

SEQ ID NO: 430025 - DNA, 140 bp, Artificial Sequence
  Synthetic
atacgccatgctgggtctccttggaggaacttttgagagcgtttactagggtgagctaaaattaaaatcaagatcatctttgtcaaagatctgatgttatttaattgcccttccagctcacgtacttgggagtcggccat

SEQ ID NO: 430026 - DNA, 140 bp, Artificial Sequence
  Synthetic
atggccgactcccaagtacgtgagctggaagggcaattaaataacatcagatctttgacaaagatgatcttgattttaattttagctcaccctagtaaacgctctcaaaagttcctccaaggagacccagcatggcgtat

SEQ ID NO: 430027 - DNA, 140 bp, Artificial Sequence
  Synthetic
aggccctggctgctgatatgctcagctgaaaatattgctgggaaatatcttttagggtcagcataaaatgagcacacctcgccaactttgttatcattaatggcatagcactttgaacatgaccttttgggacagcggtg

SEQ ID NO: 430028 - DNA, 140 bp, Artificial Sequence
  Synthetic
caccgctgtcccaaaaggtcatgttcaaagtgctatgccattaatgataacaaagttggcgaggtgtgctcattttatgctgaccctaaaagatatttcccagcaatattttcagctgagcatatcagcagccagggcct

SEQ ID NO: 430029 - DNA, 140 bp, Artificial Sequence
  Synthetic
aggccctggctgctgatatgactaaggcgagacttaatgaagaaagtctctctaagtcagtggttcccagtaattctacatcccccaccacataagggaatgtttcttcctctgttctctgaccttttgggacagcggtg

SEQ ID NO: 430030 - DNA, 140 bp, Artificial Sequence
  Synthetic
caccgctgtcccaaaaggtcagagaacagaggaagaaacattcccttatgtggtgggggatgtagaattactgggaaccactgacttagagagactttcttcattaagtctcgccttagtcatatcagcagccagggcct

SEQ ID NO: 430031 - DNA, 140 bp, Artificial Sequence
  Synthetic
aggccctggctgctgatatgattgatcccaacatccttcaaggcagtagtggcttttaaaatggttttctgaaatattgaattaaggatttgattcttactcaagcactgagaggactgtgaccttttgggacagcggtg

SEQ ID NO: 430032 - DNA, 140 bp, Artificial Sequence
  Synthetic
caccgctgtcccaaaaggtcacagtcctctcagtgcttgagtaagaatcaaatccttaattcaatatttcagaaaaccattttaaaagccactactgccttgaaggatgttgggatcaatcatatcagcagccagggcct

SEQ ID NO: 430033 - DNA, 140 bp, Artificial Sequence
  Synthetic
atacgccatgctgggtctccttacttgcaaggagaattagtgcatcgaaaattaacagaagttttcttcttgtgttcaatatcctcagagattttaccttattcaggaatgatctccagccgtacttgggagtcggccat

SEQ ID NO: 430034 - DNA, 140 bp, Artificial Sequence
  Synthetic
atggccgactcccaagtacggctggagatcattcctgaataaggtaaaatctctgaggatattgaacacaagaagaaaacttctgttaattttcgatgcactaattctccttgcaagtaaggagacccagcatggcgtat

SEQ ID NO: 430035 - DNA, 140 bp, Artificial Sequence
  Synthetic
aggccctggctgctgatatggctgtcagctttctgtggcttcccatctgattccagatcaacaacagtgttttcccaggcccttcctgttattgaggttcttgatgcaatatatggccatgaccttttgggacagcggtg

SEQ ID NO: 430036 - DNA, 140 bp, Artificial Sequence
  Synthetic
caccgctgtcccaaaaggtcatggccatatattgcatcaagaacctcaataacaggaagggcctgggaaaacactgttgttgatctggaatcagatgggaagccacagaaagctgacagccatatcagcagccagggcct

SEQ ID NO: 430037 - DNA, 140 bp, Artificial Sequence
  Synthetic
atacgccatgctgggtctcctcaccaatatttgcatacaaaaatcttaatattggtgatgcccttttgaactgataaattaattgttcaatattgtcttttgcatctactttgtcagcgtcgtacttgggagtcggccat

SEQ ID NO: 430038 - DNA, 140 bp, Artificial Sequence
  Synthetic
atggccgactcccaagtacgacgctgacaaagtagatgcaaaagacaatattgaacaattaatttatcagttcaaaagggcatcaccaatattaagatttttgtatgcaaatattggtgaggagacccagcatggcgtat

SEQ ID NO: 430039 - DNA, 140 bp, Artificial Sequence
  Synthetic
aggccctggctgctgatatgctgataaattaattgttcaatattgtcttttgcatctactttgtcagcgtacaaattattaaattcactaagtaaccggcccttatcgacctttaaaaacgaccttttgggacagcggtg

SEQ ID NO: 430040 - DNA, 140 bp, Artificial Sequence
  Synthetic
caccgctgtcccaaaaggtcgtttttaaaggtcgataagggccggttacttagtgaatttaataatttgtacgctgacaaagtagatgcaaaagacaatattgaacaattaatttatcagcatatcagcagccagggcct

SEQ ID NO: 430041 - DNA, 140 bp, Artificial Sequence
  Synthetic
aggccctggctgctgatatgcttggtggcatgaggcaatcacttcctcataatgattagagcgattgtccgtcaggacatttaaactctccacacctgacaatcttcctgaggtcatggagaccttttgggacagcggtg

SEQ ID NO: 430042 - DNA, 140 bp, Artificial Sequence
  Synthetic
caccgctgtcccaaaaggtctccatgacctcaggaagattgtcaggtgtggagagtttaaatgtcctgacggacaatcgctctaatcattatgaggaagtgattgcctcatgccaccaagcatatcagcagccagggcct

SEQ ID NO: 430043 - DNA, 140 bp, Artificial Sequence
  Synthetic
atacgccatgctgggtctcccaccggggatcctaggcaatttggttgttcttccttttgaggctttgtacgctgaactcctccaaatgggaaacaagcaagccaaggcctcagaatcaaacgtacttgggagtcggccat

SEQ ID NO: 430044 - DNA, 140 bp, Artificial Sequence
  Synthetic
atggccgactcccaagtacgtttgattctgaggccttggcttgcttgtttcccatttggaggagttcagcgtacaaagcctcaaaaggaagaacaaccaaattgcctaggatccccggtgggagacccagcatggcgtat

SEQ ID NO: 430045 - DNA, 140 bp, Artificial Sequence
  Synthetic
atacgccatgctgggtctcctctcctgagcatattttagaagtgagaagagtgtatccctcagcttgtcattgacccagtcaggtatttgttcattgtagaatgatgttctcccgtctatcgtacttgggagtcggccat

SEQ ID NO: 430046 - DNA, 140 bp, Artificial Sequence
  Synthetic
atggccgactcccaagtacgatagacgggagaacatcattctacaatgaacaaatacctgactgggtcaatgacaagctgagggatacactcttctcacttctaaaatatgctcaggagaggagacccagcatggcgtat

SEQ ID NO: 430047 - DNA, 140 bp, Artificial Sequence
  Synthetic
atacgccatgctgggtctcccaggtgccccatctgcaagatgcctctccccacgaagctgagaccgtcggtcaccccaacagcgcccccaaccagaacagcagacaacaccagacccccacgtacttgggagtcggccat

SEQ ID NO: 430048 - DNA, 140 bp, Artificial Sequence
  Synthetic
atggccgactcccaagtacgtgggggtctggtgttgtctgctgttctggttgggggcgctgttggggtgaccgacggtctcagcttcgtggggagaggcatcttgcagatggggcacctgggagacccagcatggcgtat

SEQ ID NO: 430049 - DNA, 140 bp, Artificial Sequence
  Synthetic
atacgccatgctgggtctccccgacaccccccggggggaccccccgccgggggcccccccgggggagccaaccatcaccaaaagactactcaatgtcttcgatacattcatccctcctagcgtacttgggagtcggccat

SEQ ID NO: 430050 - DNA, 140 bp, Artificial Sequence
  Synthetic
atggccgactcccaagtacgctaggagggatgaatgtatcgaagacattgagtagtcttttggtgatggttggctcccccgggggggcccccggcggggggtccccccggggggtgtcggggagacccagcatggcgtat

SEQ ID NO: 430051 - DNA, 140 bp, Artificial Sequence
  Synthetic
aggccctggctgctgatatgcattaatagcatcctgggctctgtctgcacaagaaatgccagcttctgccttgataatctttcgttgtccactaggtactttgatactaagtctttgacggaccttttgggacagcggtg

SEQ ID NO: 430052 - DNA, 140 bp, Artificial Sequence
  Synthetic
caccgctgtcccaaaaggtccgtcaaagacttagtatcaaagtacctagtggacaacgaaagattatcaaggcagaagctggcatttcttgtgcagacagagcccaggatgctattaatgcatatcagcagccagggcct

SEQ ID NO: 430053 - DNA, 140 bp, Artificial Sequence
  Synthetic
aggccctggctgctgatatgaactcattaataatctcggtatcaacataccatgctgatttgcctctgaaagtgggacctgacaaaaccagtctccagcagtctgacaagacacacggatgaccttttgggacagcggtg

SEQ ID NO: 430054 - DNA, 140 bp, Artificial Sequence
  Synthetic
caccgctgtcccaaaaggtcatccgtgtgtcttgtcagactgctggagactggttttgtcaggtcccactttcagaggcaaatcagcatggtatgttgataccgagattattaatgagttcatatcagcagccagggcct

SEQ ID NO: 430055 - DNA, 140 bp, Artificial Sequence
  Synthetic
atacgccatgctgggtctcctggcatgaggcaatcacttcctcataatgattagagcggttgtccaataaaacattcaaactctccactcctgataatcttcctgaagtcatggatagagcgtacttgggagtcggccat

SEQ ID NO: 430056 - DNA, 140 bp, Artificial Sequence
  Synthetic
atggccgactcccaagtacgctctatccatgacttcaggaagattatcaggagtggagagtttgaatgttttattggacaaccgctctaatcattatgaggaagtgattgcctcatgccaggagacccagcatggcgtat

SEQ ID NO: 430057 - DNA, 140 bp, Artificial Sequence
  Synthetic
aggccctggctgctgatatggaccatgctttaatgagtatcatctcaaccttccacttatccattcccaacttcaatcagtatgaagcaatgagttgtgacttcaatggggggaagataagaccttttgggacagcggtg

SEQ ID NO: 430058 - DNA, 140 bp, Artificial Sequence
  Synthetic
caccgctgtcccaaaaggtcttatcttccccccattgaagtcacaactcattgcttcatactgattgaagttgggaatggataagtggaaggttgagatgatactcattaaagcatggtccatatcagcagccagggcct

SEQ ID NO: 430059 - DNA, 140 bp, Artificial Sequence
  Synthetic
atacgccatgctgggtctccatactgaaagggatttacaatgttgctacctgtggcctctttgggttggtgtcctttcttctcttatgtggaaggtcatgctcaacaacttacaagggtgcgtacttgggagtcggccat

SEQ ID NO: 430060 - DNA, 140 bp, Artificial Sequence
  Synthetic
atggccgactcccaagtacgcacccttgtaagttgttgagcatgaccttccacataagagaagaaaggacaccaacccaaagaggccacaggtagcaacattgtaaatccctttcagtatggagacccagcatggcgtat

SEQ ID NO: 430061 - DNA, 140 bp, Artificial Sequence
  Synthetic
atacgccatgctgggtctccaaatagtgaaccattgttaaaagaagacgtgaggagggataagtacttctttgaaacaccaggccttttatagtctggtccctcaacacttgtacacccacgtacttgggagtcggccat

SEQ ID NO: 430062 - DNA, 140 bp, Artificial Sequence
  Synthetic
atggccgactcccaagtacgtgggtgtacaagtgttgagggaccagactataaaaggcctggtgtttcaaagaagtacttatccctcctcacgtcttcttttaacaatggttcactatttggagacccagcatggcgtat

SEQ ID NO: 430063 - DNA, 140 bp, Artificial Sequence
  Synthetic
aggccctggctgctgatatggggctgcagcaacaaacttcgttaacaatggtacctcatctccccatacaaaaaatctagacttgaactctgcaacgaacctaccaatgacactcttggggaccttttgggacagcggtg

SEQ ID NO: 430064 - DNA, 140 bp, Artificial Sequence
  Synthetic
caccgctgtcccaaaaggtccccaagagtgtcattggtaggttcgttgcagagttcaagtctagattttttgtatggggagatgaggtaccattgttaacgaagtttgttgctgcagccccatatcagcagccagggcct

SEQ ID NO: 430065 - DNA, 140 bp, Artificial Sequence
  Synthetic
aggccctggctgctgatatgtcatcatactgacaacttcttcagacagaattatcttcaataagtgacgaacaagtctgtagagcagatattcgacttctgtgatcaaatcctccctgatgaccttttgggacagcggtg

SEQ ID NO: 430066 - DNA, 140 bp, Artificial Sequence
  Synthetic
caccgctgtcccaaaaggtcatcagggaggatttgatcacagaagtcgaatatctgctctacagacttgttcgtcacttattgaagataattctgtctgaagaagttgtcagtatgatgacatatcagcagccagggcct

SEQ ID NO: 430067 - DNA, 140 bp, Artificial Sequence
  Synthetic
atacgccatgctgggtctccaacctctcattgtctgctaggtactttgacactaaatctttgacacaagctatgtcttcctccatgcttgactacaggtgcagtgatcgagactcttggacgtacttgggagtcggccat

SEQ ID NO: 430068 - DNA, 140 bp, Artificial Sequence
  Synthetic
atggccgactcccaagtacgtccaagagtctcgatcactgcacctgtagtcaagcatggaggaagacatagcttgtgtcaaagatttagtgtcaaagtacctagcagacaatgagaggttggagacccagcatggcgtat

SEQ ID NO: 430069 - DNA, 140 bp, Artificial Sequence
  Synthetic
aggccctggctgctgatatgatttgatactcctcctcaattaaactcttgacttcatgagaggtgagcttgttattaatgccctgatgacaactagaaattatttcctcaaagtgttttggaccttttgggacagcggtg

SEQ ID NO: 430070 - DNA, 140 bp, Artificial Sequence
  Synthetic
caccgctgtcccaaaaggtccaaaacactttgaggaaataatttctagttgtcatcagggcattaataacaagctcacctctcatgaagtcaagagtttaattgaggaggagtatcaaatcatatcagcagccagggcct

SEQ ID NO: 430071 - DNA, 140 bp, Artificial Sequence
  Synthetic
aggccctggctgctgatatgctactcaatgtcctcaacgtgcctgtcctcctcagtcaactcctcacatgtcctgcctttcagccttaatctaccactacttgattgcaccatcacccttgaccttttgggacagcggtg

SEQ ID NO: 430072 - DNA, 140 bp, Artificial Sequence
  Synthetic
caccgctgtcccaaaaggtcaagggtgatggtgcaatcaagtagtggtagattaaggctgaaaggcaggacatgtgaggagttgactgaggaggacaggcacgttgaggacattgagtagcatatcagcagccagggcct

SEQ ID NO: 430073 - DNA, 140 bp, Artificial Sequence
  Synthetic
aggccctggctgctgatatgtggcacctgtgttgggtttggatttgtgtcaatatagtttgtaggtcagctggtgatgtctcaaaaaagctcctacagaaatgagagacaatatgcctaggaccttttgggacagcggtg

SEQ ID NO: 430074 - DNA, 140 bp, Artificial Sequence
  Synthetic
caccgctgtcccaaaaggtcctaggcatattgtctctcatttctgtaggagcttttttgagacatcaccagctgacctacaaactatattgacacaaatccaaacccaacacaggtgccacatatcagcagccagggcct

SEQ ID NO: 430075 - DNA, 140 bp, Artificial Sequence
  Synthetic
atacgccatgctgggtctcccccccggggggaccccccgccgggggcccccccggggggcaggcaacttagctctactcaatgtcctcaacacacttctccggcccgaacaactctaaaccgtacttgggagtcggccat

SEQ ID NO: 430076 - DNA, 140 bp, Artificial Sequence
  Synthetic
atggccgactcccaagtacggtttagagttgttcgggccggagaagtgtgttgaggacattgagtagagctaagttgcctgccccccgggggggcccccggcggggggtccccccgggggggagacccagcatggcgtat

SEQ ID NO: 430077 - DNA, 140 bp, Artificial Sequence
  Synthetic
aggccctggctgctgatatgctcagtgcaatgtcaataagctttatgtcccttcttccttgggaatctaagagtttcttaatatcgtctgaaccctgacaggtcagcaccatattgcgaggaccttttgggacagcggtg

SEQ ID NO: 430078 - DNA, 140 bp, Artificial Sequence
  Synthetic
caccgctgtcccaaaaggtcctcgcaatatggtgctgacctgtcagggttcagacgatattaagaaactcttagattcccaaggaagaagggacataaagcttattgacattgcactgagcatatcagcagccagggcct

SEQ ID NO: 430079 - DNA, 140 bp, Artificial Sequence
  Synthetic
aggccctggctgctgatatgccttagaagcgctcatcttgatctggatactttggggtttaccggttgagatttttactcagtaagttaatgaaaagcgcaatccaatagcctaggatccgaccttttgggacagcggtg

SEQ ID NO: 430080 - DNA, 140 bp, Artificial Sequence
  Synthetic
caccgctgtcccaaaaggtcggatcctaggctattggattgcgcttttcattaacttactgagtaaaaatctcaaccggtaaaccccaaagtatccagatcaagatgagcgcttctaaggcatatcagcagccagggcct

SEQ ID NO: 430081 - DNA, 140 bp, Artificial Sequence
  Synthetic
aggccctggctgctgatatggactttacttccttggaagcactcattctgatctagacactcagggacttgctggttgaaggtatcactcagtaagtcagtgaaatgcgcaatccaataggaccttttgggacagcggtg

SEQ ID NO: 430082 - DNA, 140 bp, Artificial Sequence
  Synthetic
caccgctgtcccaaaaggtcctattggattgcgcatttcactgacttactgagtgataccttcaaccagcaagtccctgagtgtctagatcagaatgagtgcttccaaggaagtaaagtccatatcagcagccagggcct

SEQ ID NO: 430083 - DNA, 140 bp, Artificial Sequence
  Synthetic
aggccctggctgctgatatgactcaatgtcctcaatgcacttctccggcccaaacaactctgaacatgttcttcccttcagtctcaggctgcccccacttgactgaatcataactctttggaccttttgggacagcggtg

SEQ ID NO: 430084 - DNA, 140 bp, Artificial Sequence
  Synthetic
caccgctgtcccaaaaggtccaaagagttatgattcagtcaagtgggggcagcctgagactgaagggaagaacatgttcagagttgtttgggccggagaagtgcattgaggacattgagtcatatcagcagccagggcct

SEQ ID NO: 430085 - DNA, 140 bp, Artificial Sequence
  Synthetic
aggccctggctgctgatatgttaagaatagaaatggacacatcattgggccccacttactgtgatccatgctgtaggaaacatgtgccagggagacatttagtttcatagaaaggatggcgaccttttgggacagcggtg

SEQ ID NO: 430086 - DNA, 140 bp, Artificial Sequence
  Synthetic
caccgctgtcccaaaaggtcgccatcctttctatgaaactaaatgtctccctggcacatgtttcctacagcatggatcacagtaagtggggcccaatgatgtgtccatttctattcttaacatatcagcagccagggcct

SEQ ID NO: 430087 - DNA, 140 bp, Artificial Sequence
  Synthetic
aggccctggctgctgatatgcttcacttccttggaagcactcatcttggtctggacacttaggggtttgctggttgaaagttctactcagcaagtcaatgaaaagcgcaatccaatagccgaccttttgggacagcggtg

SEQ ID NO: 430088 - DNA, 140 bp, Artificial Sequence
  Synthetic
caccgctgtcccaaaaggtcggctattggattgcgcttttcattgacttgctgagtagaactttcaaccagcaaacccctaagtgtccagaccaagatgagtgcttccaaggaagtgaagcatatcagcagccagggcct

SEQ ID NO: 430089 - DNA, 140 bp, Artificial Sequence
  Synthetic
atacgccatgctgggtctccccggggatcctaggcaatttggttgttcttttttgggggccttgtgcgctgagcttctccaaatgggaaacaagcaagccaagaccccagaaacaaaagacgtacttgggagtcggccat

SEQ ID NO: 430090 - DNA, 140 bp, Artificial Sequence
  Synthetic
atggccgactcccaagtacgtcttttgtttctggggtcttggcttgcttgtttcccatttggagaagctcagcgcacaaggcccccaaaaaagaacaaccaaattgcctaggatccccggggagacccagcatggcgtat

SEQ ID NO: 430091 - DNA, 140 bp, Artificial Sequence
  Synthetic
atacgccatgctgggtctccggttctctgataactgattgtagggataatcccggagacatcaaagtccataatcaaatcataactattaaggcaaatcacctccatatcaattttatagcgtacttgggagtcggccat

SEQ ID NO: 430092 - DNA, 140 bp, Artificial Sequence
  Synthetic
atggccgactcccaagtacgctataaaattgatatggaggtgatttgccttaatagttatgatttgattatggactttgatgtctccgggattatccctacaatcagttatcagagaaccggagacccagcatggcgtat

SEQ ID NO: 430093 - DNA, 140 bp, Artificial Sequence
  Synthetic
atacgccatgctgggtctccggtcttctggaatattgaattgaggatttgattcttactcaaccactgagaaggttgtgtgatcctagatctttcagcctgctgcctccgctcaacccatcgtacttgggagtcggccat

SEQ ID NO: 430094 - DNA, 140 bp, Artificial Sequence
  Synthetic
atggccgactcccaagtacgatgggttgagcggaggcagcaggctgaaagatctaggatcacacaaccttctcagtggttgagtaagaatcaaatcctcaattcaatattccagaagaccggagacccagcatggcgtat

SEQ ID NO: 430095 - DNA, 140 bp, Artificial Sequence
  Synthetic
aggccctggctgctgatatgatcgccagattgttgtgctggatgcacgcagcagaaagctgagactacctgccaaaatgacaaaagcaaagcgcaatccaatagcctaggatccactgtggaccttttgggacagcggtg

SEQ ID NO: 430096 - DNA, 140 bp, Artificial Sequence
  Synthetic
caccgctgtcccaaaaggtccacagtggatcctaggctattggattgcgctttgcttttgtcattttggcaggtagtctcagctttctgctgcgtgcatccagcacaacaatctggcgatcatatcagcagccagggcct

SEQ ID NO: 430097 - DNA, 140 bp, Artificial Sequence
  Synthetic
aggccctggctgctgatatgcattgaattctttgcttcaatctatcagacatcattgatttcagtgcaccaactaaaaggtgcggggaactatcaccaatctcccttacaaacatttccagaccttttgggacagcggtg

SEQ ID NO: 430098 - DNA, 140 bp, Artificial Sequence
  Synthetic
caccgctgtcccaaaaggtctggaaatgtttgtaagggagattggtgatagttccccgcaccttttagttggtgcactgaaatcaatgatgtctgatagattgaagcaaagaattcaatgcatatcagcagccagggcct

SEQ ID NO: 430099 - DNA, 140 bp, Artificial Sequence
  Synthetic
aggccctggctgctgatatggtagttacatagcacttgattccggaaaggggaattgggattgcattatgacttcctaccaatatttaataatccaaaataccacttgggaagatcactggaccttttgggacagcggtg

SEQ ID NO: 430100 - DNA, 140 bp, Artificial Sequence
  Synthetic
caccgctgtcccaaaaggtccagtgatcttcccaagtggtattttggattattaaatattggtaggaagtcataatgcaatcccaattcccctttccggaatcaagtgctatgtaactaccatatcagcagccagggcct

SEQ ID NO: 430101 - DNA, 140 bp, Artificial Sequence
  Synthetic
aggccctggctgctgatatgagtgcctcgcaattcacatctagggcaacacaaagatcaaggaactttattctaggtgaccatttcatctttgtggaagctaagtcactcataaatggcagaccttttgggacagcggtg

SEQ ID NO: 430102 - DNA, 140 bp, Artificial Sequence
  Synthetic
caccgctgtcccaaaaggtctgccatttatgagtgacttagcttccacaaagatgaaatggtcacctagaataaagttccttgatctttgtgttgccctagatgtgaattgcgaggcactcatatcagcagccagggcct

SEQ ID NO: 430103 - DNA, 140 bp, Artificial Sequence
  Synthetic
atacgccatgctgggtctccgttcactatgggttaaggtcccgtaggaggcacaaaggcacaagaggcaattaaaaacaattaaattagatagccttaatgcctaggatcctcggtgcgccgtacttgggagtcggccat

SEQ ID NO: 430104 - DNA, 140 bp, Artificial Sequence
  Synthetic
atggccgactcccaagtacggcgcaccgaggatcctaggcattaaggctatctaatttaattgtttttaattgcctcttgtgcctttgtgcctcctacgggaccttaacccatagtgaacggagacccagcatggcgtat

SEQ ID NO: 430105 - DNA, 140 bp, Artificial Sequence
  Synthetic
atacgccatgctgggtctccccggggatcctaggcatttaagattgcgcatttagagatctttgtgtgagtgggcctcatcaagccatggggcagatcgtaacatttttccaggaagtaccgtacttgggagtcggccat

SEQ ID NO: 430106 - DNA, 140 bp, Artificial Sequence
  Synthetic
atggccgactcccaagtacggtacttcctggaaaaatgttacgatctgccccatggcttgatgaggcccactcacacaaagatctctaaatgcgcaatcttaaatgcctaggatccccggggagacccagcatggcgtat

SEQ ID NO: 430107 - DNA, 140 bp, Artificial Sequence
  Synthetic
atacgccatgctgggtctcccaaatggtctcacataagactcaaaataaatttgcctcatgaaattgtcaatagcatcattagtgctcaccactctttcttccaccatgggttcatgtgtcgtacttgggagtcggccat

SEQ ID NO: 430108 - DNA, 140 bp, Artificial Sequence
  Synthetic
atggccgactcccaagtacgacacatgaacccatggtggaagaaagagtggtgagcactaatgatgctattgacaatttcatgaggcaaatttattttgagtcttatgtgagaccatttgggagacccagcatggcgtat

SEQ ID NO: 430109 - DNA, 140 bp, Artificial Sequence
  Synthetic
aggccctggctgctgatatgctcactaatcctgacatcatcagagagcttacccatatcgaatttgaaattgaggtttcttgatttataatgggtgtaccttcccatgagtgtatttgcagaccttttgggacagcggtg

SEQ ID NO: 430110 - DNA, 140 bp, Artificial Sequence
  Synthetic
caccgctgtcccaaaaggtctgcaaatacactcatgggaaggtacacccattataaatcaagaaacctcaatttcaaattcgatatgggtaagctctctgatgatgtcaggattagtgagcatatcagcagccagggcct

SEQ ID NO: 430111 - DNA, 140 bp, Artificial Sequence
  Synthetic
aggccctggctgctgatatgactccttctcattgtttagacagctgcccgctaattgtgatgtaagtgcttcaaagtaatcctcaataagccttgtgaacatctttgtcctcaaatctccgaccttttgggacagcggtg

SEQ ID NO: 430112 - DNA, 140 bp, Artificial Sequence
  Synthetic
caccgctgtcccaaaaggtcggagatttgaggacaaagatgttcacaaggcttattgaggattactttgaagcacttacatcacaattagcgggcagctgtctaaacaatgagaaggagtcatatcagcagccagggcct

SEQ ID NO: 430113 - DNA, 140 bp, Artificial Sequence
  Synthetic
aggccctggctgctgatatgccatcagcttatttccattcatcactaataaaattgacttgaagcactggaagtattcttggtccaaaaaagtcctagtcaccactgcttttgtcagttcgaccttttgggacagcggtg

SEQ ID NO: 430114 - DNA, 140 bp, Artificial Sequence
  Synthetic
caccgctgtcccaaaaggtcgaactgacaaaagcagtggtgactaggacttttttggaccaagaatacttccagtgcttcaagtcaattttattagtgatgaatggaaataagctgatggcatatcagcagccagggcct

SEQ ID NO: 430115 - DNA, 140 bp, Artificial Sequence
  Synthetic
aggccctggctgctgatatgctatactgactgacaatattgtcaacagtgcacctcagttggtcgaagtattctgatgctcctccatccaatagtatctcatctagatcagcattgttgggaccttttgggacagcggtg

SEQ ID NO: 430116 - DNA, 140 bp, Artificial Sequence
  Synthetic
caccgctgtcccaaaaggtcccaacaatgctgatctagatgagatactattggatggaggagcatcagaatacttcgaccaactgaggtgcactgttgacaatattgtcagtcagtatagcatatcagcagccagggcct

SEQ ID NO: 430117 - DNA, 140 bp, Artificial Sequence
  Synthetic
atacgccatgctgggtctccagtcataatccagaacacgagacccatctgtatacttgttcacaacaacactcttattactggccaagtccagagctgttgcacaaccgcttgtgataagcgtacttgggagtcggccat

SEQ ID NO: 430118 - DNA, 140 bp, Artificial Sequence
  Synthetic
atggccgactcccaagtacgcttatcacaagcggttgtgcaacagctctggacttggccagtaataagagtgttgttgtgaacaagtatacagatgggtctcgtgttctggattatgactggagacccagcatggcgtat

SEQ ID NO: 430119 - DNA, 140 bp, Artificial Sequence
  Synthetic
aggccctggctgctgatatgcaggatttctcgatcaaaatcttctatcatatggtttgaaagttcactctttatcaaccttattaagagtttttcttccaccaccttgtcaagatcagatgaccttttgggacagcggtg

SEQ ID NO: 430120 - DNA, 140 bp, Artificial Sequence
  Synthetic
caccgctgtcccaaaaggtcatctgatcttgacaaggtggtggaagaaaaactcttaataaggttgataaagagtgaactttcaaaccatatgatagaagattttgatcgagaaatcctgcatatcagcagccagggcct

SEQ ID NO: 430121 - DNA, 140 bp, Artificial Sequence
  Synthetic
atacgccatgctgggtctccccggggatcctaggcaattcagttggacttcagtggtgaggctcttcttagtgaatccctgaattaaaggacccagtaaaatgggtaacagacaggctaacgtacttgggagtcggccat

SEQ ID NO: 430122 - DNA, 140 bp, Artificial Sequence
  Synthetic
atggccgactcccaagtacgttagcctgtctgttacccattttactgggtcctttaattcagggattcactaagaagagcctcaccactgaagtccaactgaattgcctaggatccccggggagacccagcatggcgtat

SEQ ID NO: 430123 - DNA, 140 bp, Artificial Sequence
  Synthetic
atacgccatgctgggtctccctcaatgatgatagtctttctaagtctgttgcatctagaatgtcaatgacgccaagagtgtaagggaacatgtcttcctgagttttctggtaacttatagcgtacttgggagtcggccat

SEQ ID NO: 430124 - DNA, 140 bp, Artificial Sequence
  Synthetic
atggccgactcccaagtacgctataagttaccagaaaactcaggaagacatgttcccttacactcttggcgtcattgacattctagatgcaacagacttagaaagactatcatcattgagggagacccagcatggcgtat

SEQ ID NO: 430125 - DNA, 140 bp, Artificial Sequence
  Synthetic
aggccctggctgctgatatgccttggaagcactcatcctggtctggacactttggggtttactagttggaaatgtttctcagtaagtcaatgaaaagcgcaatccaatagcctaggatccgaccttttgggacagcggtg

SEQ ID NO: 430126 - DNA, 140 bp, Artificial Sequence
  Synthetic
caccgctgtcccaaaaggtcggatcctaggctattggattgcgcttttcattgacttactgagaaacatttccaactagtaaaccccaaagtgtccagaccaggatgagtgcttccaaggcatatcagcagccagggcct

SEQ ID NO: 430127 - DNA, 140 bp, Artificial Sequence
  Synthetic
atacgccatgctgggtctcccggggatcctaggcaatttagctggacttcagtggcaaggtttaccttagtgaatccttgaatcaagtgcctggtcaaaatgggcaacaaacaggccaaacgtacttgggagtcggccat

SEQ ID NO: 430128 - DNA, 140 bp, Artificial Sequence
  Synthetic
atggccgactcccaagtacgtttggcctgtttgttgcccattttgaccaggcacttgattcaaggattcactaaggtaaaccttgccactgaagtccagctaaattgcctaggatccccgggagacccagcatggcgtat

SEQ ID NO: 430129 - DNA, 140 bp, Artificial Sequence
  Synthetic
atacgccatgctgggtctccttatgctgtccagatcccaggaccagattactcattgcctgctgcaccttgtattcatagtcctgtttgttgagaagatactttccctttcttgagaagacgtacttgggagtcggccat

SEQ ID NO: 430130 - DNA, 140 bp, Artificial Sequence
  Synthetic
atggccgactcccaagtacgtcttctcaagaaagggaaagtatcttctcaacaaacaggactatgaatacaaggtgcagcaggcaatgagtaatctggtcctgggatctggacagcataaggagacccagcatggcgtat

SEQ ID NO: 430131 - DNA, 140 bp, Artificial Sequence
  Synthetic
aggccctggctgctgatatgttcagaaaagacctccaacattgcatctgatcactttgagagtcagcagccctttccttatcagaatccaaatctgcatacaagaacttaaggactggaggaccttttgggacagcggtg

SEQ ID NO: 430132 - DNA, 140 bp, Artificial Sequence
  Synthetic
caccgctgtcccaaaaggtcctccagtccttaagttcttgtatgcagatttggattctgataaggaaagggctgctgactctcaaagtgatcagatgcaatgttggaggtcttttctgaacatatcagcagccagggcct

SEQ ID NO: 430133 - DNA, 140 bp, Artificial Sequence
  Synthetic
aggccctggctgctgatatgccacacccgtccattgaattctttgtttcaatctatcagacatcattgatttcaatgcaccaactaaaagatgtggggaactatcaccaatctctcttacgaccttttgggacagcggtg

SEQ ID NO: 430134 - DNA, 140 bp, Artificial Sequence
  Synthetic
caccgctgtcccaaaaggtcgtaagagagattggtgatagttccccacatcttttagttggtgcattgaaatcaatgatgtctgatagattgaaacaaagaattcaatggacgggtgtggcatatcagcagccagggcct

SEQ ID NO: 430135 - DNA, 140 bp, Artificial Sequence
  Synthetic
aggccctggctgctgatatggtgttcacatccattagccttgcaagagtcaatctcaatacagagagacagtagtttcaatccctccatgagcaacattctaggttcagtttggaccagagaccttttgggacagcggtg

SEQ ID NO: 430136 - DNA, 140 bp, Artificial Sequence
  Synthetic
caccgctgtcccaaaaggtctctggtccaaactgaacctagaatgttgctcatggagggattgaaactactgtctctctgtattgagattgactcttgcaaggctaatggatgtgaacaccatatcagcagccagggcct

SEQ ID NO: 430137 - DNA, 140 bp, Artificial Sequence
  Synthetic
atacgccatgctgggtctcccctgtgttggacttgggcttgtacctgtatagcgtgtgggtcagctagtagtgccccacaaaagctcttacagaagtgagagacaatatgcctaggatcccgtacttgggagtcggccat

SEQ ID NO: 430138 - DNA, 140 bp, Artificial Sequence
  Synthetic
atggccgactcccaagtacgggatcctaggcatattgtctctcacttctgtaagagcttttgtggggcactactagctgacccacacgctatacaggtacaagcccaagtccaacacaggggagacccagcatggcgtat

SEQ ID NO: 430139 - DNA, 140 bp, Artificial Sequence
  Synthetic
atacgccatgctgggtctcccccttctatcagattcccacaatgctcccctacacacaaccaatggcactggttcactgtcaggcccgaccttggagaaatcaaattcactgaactgcagcgtacttgggagtcggccat

SEQ ID NO: 430140 - DNA, 140 bp, Artificial Sequence
  Synthetic
atggccgactcccaagtacgctgcagttcagtgaatttgatttctccaaggtcgggcctgacagtgaaccagtgccattggttgtgtgtaggggagcattgtgggaatctgatagaagggggagacccagcatggcgtat

SEQ ID NO: 430141 - DNA, 140 bp, Artificial Sequence
  Synthetic
aggccctggctgctgatatgttccttttctttaaataatgaaccattattgaaactagacacaaggagtgagataaattttttggaaacaccaggctttttatacctaactttttccgcagaccttttgggacagcggtg

SEQ ID NO: 430142 - DNA, 140 bp, Artificial Sequence
  Synthetic
caccgctgtcccaaaaggtctgcggaaaaagttaggtataaaaagcctggtgtttccaaaaaatttatctcactccttgtgtctagtttcaataatggttcattatttaaagaaaaggaacatatcagcagccagggcct

SEQ ID NO: 430143 - DNA, 140 bp, Artificial Sequence
  Synthetic
aggccctggctgctgatatgggtcggaaatgaaactggcttagagctaaccttaacaaatacaagtatcatcaaccacaagttctgcaacctttctgatgcacataaaaagaatctctatgaccttttgggacagcggtg

SEQ ID NO: 430144 - DNA, 140 bp, Artificial Sequence
  Synthetic
caccgctgtcccaaaaggtcatagagattctttttatgtgcatcagaaaggttgcagaacttgtggttgatgatacttgtatttgttaaggttagctctaagccagtttcatttccgacccatatcagcagccagggcct

SEQ ID NO: 430145 - DNA, 140 bp, Artificial Sequence
  Synthetic
aggccctggctgctgatatgatagtgttatgcacatataatcccacaggagaggtcttagataagtaacaacagtattatctctatctttgacttctggtgaaactttccatatctgaatgaccttttgggacagcggtg

SEQ ID NO: 430146 - DNA, 140 bp, Artificial Sequence
  Synthetic
caccgctgtcccaaaaggtcattcagatatggaaagtttcaccagaagtcaaagatagagataatactgttgttacttatctaagacctctcctgtgggattatatgtgcataacactatcatatcagcagccagggcct

SEQ ID NO: 430147 - DNA, 140 bp, Artificial Sequence
  Synthetic
atacgccatgctgggtctcccaaatctaaggctgtagcacagccactagtgataagaggatctttgatttccttcttcacttccctttctttaaacaatgatccattattaaaagaagatcgtacttgggagtcggccat

SEQ ID NO: 430148 - DNA, 140 bp, Artificial Sequence
  Synthetic
atggccgactcccaagtacgatcttcttttaataatggatcattgtttaaagaaagggaagtgaagaaggaaatcaaagatcctcttatcactagtggctgtgctacagccttagatttgggagacccagcatggcgtat

SEQ ID NO: 430149 - DNA, 140 bp, Artificial Sequence
  Synthetic
aggccctggctgctgatatgccttcttcacttccctttctttaaacaatgatccattattaaaagaagatgtgaggagggataagaatttctttgagacaccaggcctcttgtaatttgggaccttttgggacagcggtg

SEQ ID NO: 430150 - DNA, 140 bp, Artificial Sequence
  Synthetic
caccgctgtcccaaaaggtcccaaattacaagaggcctggtgtctcaaagaaattcttatccctcctcacatcttcttttaataatggatcattgtttaaagaaagggaagtgaagaaggcatatcagcagccagggcct

SEQ ID NO: 430151 - DNA, 140 bp, Artificial Sequence
  Synthetic
aggccctggctgctgatatgtatggacaaaataaaagagaaattgattactgagactgagtttctactttatagattaataagggctctaataaacctgattttacatgatgaggtgaaagaccttttgggacagcggtg

SEQ ID NO: 430152 - DNA, 140 bp, Artificial Sequence
  Synthetic
caccgctgtcccaaaaggtctttcacctcatcatgtaaaatcaggtttattagagcccttattaatctataaagtagaaactcagtctcagtaatcaatttctcttttattttgtccatacatatcagcagccagggcct

SEQ ID NO: 430153 - DNA, 140 bp, Artificial Sequence
  Synthetic
aggccctggctgctgatatgacatcgttgccaagatgctggcttgtgtcaaatggttcctacctgaatgaaacacatttttctgatgacattgaacaacaagcagacaacatgataacaggaccttttgggacagcggtg

SEQ ID NO: 430154 - DNA, 140 bp, Artificial Sequence
  Synthetic
caccgctgtcccaaaaggtcctgttatcatgttgtctgcttgttgttcaatgtcatcagaaaaatgtgtttcattcaggtaggaaccatttgacacaagccagcatcttggcaacgatgtcatatcagcagccagggcct

SEQ ID NO: 430155 - DNA, 140 bp, Artificial Sequence
  Synthetic
aggccctggctgctgatatggccctaagccacacagactcaaccacatgggcatatgctcatgtggtctgtacaaacatcctggtgtgccagttagatggaaaagatagaagacagacccgaccttttgggacagcggtg

SEQ ID NO: 430156 - DNA, 140 bp, Artificial Sequence
  Synthetic
caccgctgtcccaaaaggtcgggtctgtcttctatcttttccatctaactggcacaccaggatgtttgtacagaccacatgagcatatgcccatgtggttgagtctgtgtggcttagggccatatcagcagccagggcct

SEQ ID NO: 430157 - DNA, 140 bp, Artificial Sequence
  Synthetic
atacgccatgctgggtctccttcactaaagggcaaggtcccgtaggaggcaaaggagacacaagaggcaattgaagacaataaaagacaataaaattagatagccttaatgcctaggatccgtacttgggagtcggccat

SEQ ID NO: 430158 - DNA, 140 bp, Artificial Sequence
  Synthetic
atggccgactcccaagtacggatcctaggcattaaggctatctaattttattgtcttttattgtcttcaattgcctcttgtgtctcctttgcctcctacgggaccttgccctttagtgaaggagacccagcatggcgtat

SEQ ID NO: 430159 - DNA, 140 bp, Artificial Sequence
  Synthetic
atacgccatgctgggtctccccccccggggggaccccccgccgggggcccccccgggggagccaaccctctccaagagactactcaatgtcctcgatgcattcatccctcctggtcaactcgtacttgggagtcggccat

SEQ ID NO: 430160 - DNA, 140 bp, Artificial Sequence
  Synthetic
atggccgactcccaagtacgagttgaccaggagggatgaatgcatcgaggacattgagtagtctcttggagagggttggctcccccgggggggcccccggcggggggtccccccggggggggagacccagcatggcgtat

SEQ ID NO: 430161 - DNA, 140 bp, Artificial Sequence
  Synthetic
atacgccatgctgggtctccaagacttgttggacccagcagtgcccactttttgtggtttcccatctgactcgagatccacagtagtattctcccaagctctacccacaatagaagtcctcgtacttgggagtcggccat

SEQ ID NO: 430162 - DNA, 140 bp, Artificial Sequence
  Synthetic
atggccgactcccaagtacgaggacttctattgtgggtagagcttgggagaatactactgtggatctcgagtcagatgggaaaccacaaaaagtgggcactgctgggtccaacaagtcttggagacccagcatggcgtat

SEQ ID NO: 430163 - DNA, 140 bp, Artificial Sequence
  Synthetic
aggccctggctgctgatatgctcacatggccaaaccttatctttggttcaaggaacttttcaaaacattttatctgatctgtcaatctatctggtgtttcctttgtaataaagtggcacagaccttttgggacagcggtg

SEQ ID NO: 430164 - DNA, 140 bp, Artificial Sequence
  Synthetic
caccgctgtcccaaaaggtctgtgccactttattacaaaggaaacaccagatagattgacagatcagataaaatgttttgaaaagttccttgaaccaaagataaggtttggccatgtgagcatatcagcagccagggcct

SEQ ID NO: 430165 - DNA, 140 bp, Artificial Sequence
  Synthetic
atacgccatgctgggtctccgctcttctttgctcaagttgctgtgtactcaaatttcccatataaacacctgagcttagtggcctttctgttctgatgaccttcgacttaagtttctctacgtacttgggagtcggccat

SEQ ID NO: 430166 - DNA, 140 bp, Artificial Sequence
  Synthetic
atggccgactcccaagtacgtagagaaacttaagtcgaaggtcatcagaacagaaaggccactaagctcaggtgtttatatgggaaatttgagtacacagcaacttgagcaaagaagagcggagacccagcatggcgtat

SEQ ID NO: 430167 - DNA, 140 bp, Artificial Sequence
  Synthetic
atacgccatgctgggtctcccaggttgggtgccctgagccccaccaaccatgcctatcatgctcagtaatgctcttctttgctcaagctgctgtgcactcaaattccccatataaacacccgtacttgggagtcggccat

SEQ ID NO: 430168 - DNA, 140 bp, Artificial Sequence
  Synthetic
atggccgactcccaagtacgggtgtttatatggggaatttgagtgcacagcagcttgagcaaagaagagcattactgagcatgataggcatggttggtggggctcagggcacccaacctgggagacccagcatggcgtat

SEQ ID NO: 430169 - DNA, 140 bp, Artificial Sequence
  Synthetic
aggccctggctgctgatatgaggagagcctgagcatccttaacaacttgaagctttatgctggagcagtaacctgagagctccctcctcaatgactgtgtccaaaggaatgactttacttgaccttttgggacagcggtg

SEQ ID NO: 430170 - DNA, 140 bp, Artificial Sequence
  Synthetic
caccgctgtcccaaaaggtcaagtaaagtcattcctttggacacagtcattgaggagggagctctcaggttactgctccagcataaagcttcaagttgttaaggatgctcaggctctcctcatatcagcagccagggcct

SEQ ID NO: 430171 - DNA, 140 bp, Artificial Sequence
  Synthetic
aggccctggctgctgatatgagacttgttggacccagcagtacccactttttgcggttttccatctgactcgagatccacagtagtattctcccaagctctacccacaatagaagtccttgaccttttgggacagcggtg

SEQ ID NO: 430172 - DNA, 140 bp, Artificial Sequence
  Synthetic
caccgctgtcccaaaaggtcaaggacttctattgtgggtagagcttgggagaatactactgtggatctcgagtcagatggaaaaccgcaaaaagtgggtactgctgggtccaacaagtctcatatcagcagccagggcct

SEQ ID NO: 430173 - DNA, 140 bp, Artificial Sequence
  Synthetic
atacgccatgctgggtctccggggatcctaggcaatttagctggacttcagtggtaaagcccattttagtgaatccctgaatcaaagtgcccagccaaaatgggcaacaagcaggccaaacgtacttgggagtcggccat

SEQ ID NO: 430174 - DNA, 140 bp, Artificial Sequence
  Synthetic
atggccgactcccaagtacgtttggcctgcttgttgcccattttggctgggcactttgattcagggattcactaaaatgggctttaccactgaagtccagctaaattgcctaggatccccggagacccagcatggcgtat

SEQ ID NO: 430175 - DNA, 140 bp, Artificial Sequence
  Synthetic
aggccctggctgctgatatggaagctatgtagggccagccgtcaccggaaagacagatcttgtaaagtatgttctcataagggttcctctcaccaggtgtatctgaaacaaacattcccagaccttttgggacagcggtg

SEQ ID NO: 430176 - DNA, 140 bp, Artificial Sequence
  Synthetic
caccgctgtcccaaaaggtctgggaatgtttgtttcagatacacctggtgagaggaacccttatgagaacatactttacaagatctgtctttccggtgacggctggccctacatagcttccatatcagcagccagggcct

SEQ ID NO: 430177 - DNA, 140 bp, Artificial Sequence
  Synthetic
aggccctggctgctgatatgtaaaactctgttgatgatggtaaggagctcacaattccgttcttctttaggtgataggacacctgcatctctgtctctagctctcttcctgttgtccaccgaccttttgggacagcggtg

SEQ ID NO: 430178 - DNA, 140 bp, Artificial Sequence
  Synthetic
caccgctgtcccaaaaggtcggtggacaacaggaagagagctagagacagagatgcaggtgtcctatcacctaaagaagaacggaattgtgagctccttaccatcatcaacagagttttacatatcagcagccagggcct

SEQ ID NO: 430179 - DNA, 140 bp, Artificial Sequence
  Synthetic
aggccctggctgctgatatgtcctcagcgtcagcagcagatgcccgatctgcaagatgccccttcccaccaggctaaaggcagcagcacagccgagcgcaccctcaaccgaggcgacccagaccttttgggacagcggtg

SEQ ID NO: 430180 - DNA, 140 bp, Artificial Sequence
  Synthetic
caccgctgtcccaaaaggtctgggtcgcctcggttgagggtgcgctcggctgtgctgctgcctttagcctggtgggaaggggcatcttgcagatcgggcatctgctgctgacgctgaggacatatcagcagccagggcct

SEQ ID NO: 430181 - DNA, 140 bp, Artificial Sequence
  Synthetic
atacgccatgctgggtctcctatctggattgataatcagcttcatgggtataacatcccctaactgctgtgtatcctttaagaactcatttaccacatctgattcaacaaaccaggctgacgtacttgggagtcggccat

SEQ ID NO: 430182 - DNA, 140 bp, Artificial Sequence
  Synthetic
atggccgactcccaagtacgtcagcctggtttgttgaatcagatgtggtaaatgagttcttaaaggatacacagcagttaggggatgttatacccatgaagctgattatcaatccagataggagacccagcatggcgtat

SEQ ID NO: 430183 - DNA, 140 bp, Artificial Sequence
  Synthetic
atacgccatgctgggtctccattcagcactacagccctcagcgtggagacaatgtccacccctgaccactgcatcctcaaccccagcctgtctatcatcatatcactcaatgctccaatccgtacttgggagtcggccat

SEQ ID NO: 430184 - DNA, 140 bp, Artificial Sequence
  Synthetic
atggccgactcccaagtacggattggagcattgagtgatatgatgatagacaggctggggttgaggatgcagtggtcaggggtggacattgtctccacgctgagggctgtagtgctgaatggagacccagcatggcgtat

SEQ ID NO: 430185 - DNA, 140 bp, Artificial Sequence
  Synthetic
atacgccatgctgggtctcccaggttgggtgccctgagccccaccaaccatgcctatcatgttcagcaatgctcttctttgctcaagctgctgtgtactcaaattccccatataaacacccgtacttgggagtcggccat

SEQ ID NO: 430186 - DNA, 140 bp, Artificial Sequence
  Synthetic
atggccgactcccaagtacgggtgtttatatggggaatttgagtacacagcagcttgagcaaagaagagcattgctgaacatgataggcatggttggtggggctcagggcacccaacctgggagacccagcatggcgtat

SEQ ID NO: 430187 - DNA, 140 bp, Artificial Sequence
  Synthetic
aggccctggctgctgatatgttcagaaaagatctccaacattgcatctgttcactttgagagtcagaggccctttccttatcagaatctaaatctgcatacaagaacttaaggactggaggaccttttgggacagcggtg

SEQ ID NO: 430188 - DNA, 140 bp, Artificial Sequence
  Synthetic
caccgctgtcccaaaaggtcctccagtccttaagttcttgtatgcagatttagattctgataaggaaagggcctctgactctcaaagtgaacagatgcaatgttggagatcttttctgaacatatcagcagccagggcct

SEQ ID NO: 430189 - DNA, 140 bp, Artificial Sequence
  Synthetic
atacgccatgctgggtctccccggggatcctaggcaatttagctggactttagtggtaaagcttatttttagtgaattcctgaatcaaagtgcctagtcaaaatgggcaatagacaggtccgtacttgggagtcggccat

SEQ ID NO: 430190 - DNA, 140 bp, Artificial Sequence
  Synthetic
atggccgactcccaagtacggacctgtctattgcccattttgactaggcactttgattcaggaattcactaaaaataagctttaccactaaagtccagctaaattgcctaggatccccggggagacccagcatggcgtat

SEQ ID NO: 430191 - DNA, 140 bp, Artificial Sequence
  Synthetic
atacgccatgctgggtctcccctgtgttgggtttgggcttgtgcctgtgtggcgtgtgggccagctggcagtaccccacaaaagctcttacagaaatgagagacaatatgcctaggatcccgtacttgggagtcggccat

SEQ ID NO: 430192 - DNA, 140 bp, Artificial Sequence
  Synthetic
atggccgactcccaagtacgggatcctaggcatattgtctctcatttctgtaagagcttttgtggggtactgccagctggcccacacgccacacaggcacaagcccaaacccaacacaggggagacccagcatggcgtat

SEQ ID NO: 430193 - DNA, 140 bp, Artificial Sequence
  Synthetic
atacgccatgctgggtctcctcgctgcaaaccctcaccctctggtattgaggttttatgagggaaccaagtaaatgatccaagtgtccttgttgttgcaacaaaagaacggacatatgatcgtacttgggagtcggccat

SEQ ID NO: 430194 - DNA, 140 bp, Artificial Sequence
  Synthetic
atggccgactcccaagtacgatcatatgtccgttcttttgttgcaacaacaaggacacttggatcatttacttggttccctcataaaacctcaataccagagggtgagggtttgcagcgaggagacccagcatggcgtat

SEQ ID NO: 430195 - DNA, 140 bp, Artificial Sequence
  Synthetic
aggccctggctgctgatatgcatgggctcacagacccagaatacagtgcctgtacatcatccaccacaaactcaccacattggttaacaagccctgtcatgttgagatggatagaaaagggaccttttgggacagcggtg

SEQ ID NO: 430196 - DNA, 140 bp, Artificial Sequence
  Synthetic
caccgctgtcccaaaaggtcccttttctatccatctcaacatgacagggcttgttaaccaatgtggtgagtttgtggtggatgatgtacaggcactgtattctgggtctgtgagcccatgcatatcagcagccagggcct

SEQ ID NO: 430197 - DNA, 140 bp, Artificial Sequence
  Synthetic
atacgccatgctgggtctccacggtttcacgccctcttgaactctctcttcaaagttcttttcaacttttcccttacggtacttgttgactatcggtctcgtgccggtatttagccttagcgtacttgggagtcggccat

SEQ ID NO: 430198 - DNA, 140 bp, Artificial Sequence
  Synthetic
atggccgactcccaagtacgctaaggctaaataccggcacgagaccgatagtcaacaagtaccgtaagggaaaagttgaaaagaactttgaagagagagttcaagagggcgtgaaaccgtggagacccagcatggcgtat

SEQ ID NO: 430199 - DNA, 140 bp, Artificial Sequence
  Synthetic
aggccctggctgctgatatgcccttacggtacttgttgactatcggtctcgtgccggtatttagccttagatggagtttaccacccgcttttgggctgcattcccaagcaacccgactccgaccttttgggacagcggtg

SEQ ID NO: 430200 - DNA, 140 bp, Artificial Sequence
  Synthetic
caccgctgtcccaaaaggtcggagtcgggttgcttgggaatgcagcccaaaagcgggtggtaaactccatctaaggctaaataccggcacgagaccgatagtcaacaagtaccgtaagggcatatcagcagccagggcct

SEQ ID NO: 430201 - DNA, 140 bp, Artificial Sequence
  Synthetic
atacgccatgctgggtctccatggagtttaccacccgcttttgggctgcattcccaagcaacccgactccgggaagacccgggcccggcgcaccggggatcctaggcatttttggctgcgcgtacttgggagtcggccat

SEQ ID NO: 430202 - DNA, 140 bp, Artificial Sequence
  Synthetic
atggccgactcccaagtacgcgcagccaaaaatgcctaggatccccggtgcgccgggcccgggtcttcccggagtcgggttgcttgggaatgcagcccaaaagcgggtggtaaactccatggagacccagcatggcgtat

SEQ ID NO: 430203 - DNA, 140 bp, Artificial Sequence
  Synthetic
atacgccatgctgggtctccaagaagtgcctcatgtaatagaagaagtgatgaacatcgtccttatagcattgtccatattggcagtgttaaagggtttgtacaacattgctacatgtggcgtacttgggagtcggccat

SEQ ID NO: 430204 - DNA, 140 bp, Artificial Sequence
  Synthetic
atggccgactcccaagtacgccacatgtagcaatgttgtacaaaccctttaacactgccaatatggacaatgctataaggacgatgttcatcacttcttctattacatgaggcacttcttggagacccagcatggcgtat

SEQ ID NO: 430205 - DNA, 140 bp, Artificial Sequence
  Synthetic
aggccctggctgctgatatgttgtccatattggcagtgttaaagggtttgtacaacattgctacatgtggtctcattggcttggtcaccttcttcctactgtgtggtagatcctgctcctgaccttttgggacagcggtg

SEQ ID NO: 430206 - DNA, 140 bp, Artificial Sequence
  Synthetic
caccgctgtcccaaaaggtcaggagcaggatctaccacacagtaggaagaaggtgaccaagccaatgagaccacatgtagcaatgttgtacaaaccctttaacactgccaatatggacaacatatcagcagccagggcct

SEQ ID NO: 430207 - DNA, 140 bp, Artificial Sequence
  Synthetic
atacgccatgctgggtctccgagacactcaacatgactatgcccctctcttgcaccaaaaacaacagtcatcattacataagagttggcaatgagacagggctggaactgaccttaaccacgtacttgggagtcggccat

SEQ ID NO: 430208 - DNA, 140 bp, Artificial Sequence
  Synthetic
atggccgactcccaagtacgtggttaaggtcagttccagccctgtctcattgccaactcttatgtaatgatgactgttgtttttggtgcaagagaggggcatagtcatgttgagtgtctcggagacccagcatggcgtat

SEQ ID NO: 430209 - DNA, 140 bp, Artificial Sequence
  Synthetic
aggccctggctgctgatatgtcattacataagagttggcaatgagacagggctggaactgaccttaaccaacacaagtttgcttgatcataagttctgtaacctgtcggatgcccacaaggaccttttgggacagcggtg

SEQ ID NO: 430210 - DNA, 140 bp, Artificial Sequence
  Synthetic
caccgctgtcccaaaaggtccttgtgggcatccgacaggttacagaacttatgatcaagcaaacttgtgttggttaaggtcagttccagccctgtctcattgccaactcttatgtaatgacatatcagcagccagggcct

SEQ ID NO: 430211 - DNA, 140 bp, Artificial Sequence
  Synthetic
atacgccatgctgggtctccatctatacccaacttcaaccaatatgaagcaatgagctgtgactttaatgggggcaaaatcactgtccagtacaacctaagccactcttatgcaggggatcgtacttgggagtcggccat

SEQ ID NO: 430212 - DNA, 140 bp, Artificial Sequence
  Synthetic
atggccgactcccaagtacgatcccctgcataagagtggcttaggttgtactggacagtgattttgcccccattaaagtcacagctcattgcttcatattggttgaagttgggtatagatggagacccagcatggcgtat

SEQ ID NO: 430213 - DNA, 140 bp, Artificial Sequence
  Synthetic
aggccctggctgctgatatgggggcaaaatcactgtccagtacaacctaagccactcttatgcaggggatgcagccaggcactgcggcacaattgcaaatggcgtcctgcagactttcatgaccttttgggacagcggtg

SEQ ID NO: 430214 - DNA, 140 bp, Artificial Sequence
  Synthetic
caccgctgtcccaaaaggtcatgaaagtctgcaggacgccatttgcaattgtgccgcagtgcctggctgcatcccctgcataagagtggcttaggttgtactggacagtgattttgcccccatatcagcagccagggcct

SEQ ID NO: 430215 - DNA, 140 bp, Artificial Sequence
  Synthetic
atacgccatgctgggtctccactgggactgcatcatgaccagttatcaatacctgataatccaaaacacaacctgggaagaccattgtcagttctcaagaccatctcccatcggctacctcgtacttgggagtcggccat

SEQ ID NO: 430216 - DNA, 140 bp, Artificial Sequence
  Synthetic
atggccgactcccaagtacgaggtagccgatgggagatggtcttgagaactgacaatggtcttcccaggttgtgttttggattatcaggtattgataactggtcatgatgcagtcccagtggagacccagcatggcgtat

SEQ ID NO: 430217 - DNA, 140 bp, Artificial Sequence
  Synthetic
aggccctggctgctgatatgacctgggaagaccattgtcagttctcaagaccatctcccatcggctaccttagtctcctctcacagagaaccagagatatctacattagcagaaggttgtgaccttttgggacagcggtg

SEQ ID NO: 430218 - DNA, 140 bp, Artificial Sequence
  Synthetic
caccgctgtcccaaaaggtcacaaccttctgctaatgtagatatctctggttctctgtgagaggagactaaggtagccgatgggagatggtcttgagaactgacaatggtcttcccaggtcatatcagcagccagggcct

SEQ ID NO: 430219 - DNA, 140 bp, Artificial Sequence
  Synthetic
atacgccatgctgggtctccggaggttactgcttaaccaggtggatgttgattgaggctgaattaaaatgctttggcaacacagcagtggcaaagtgcaatgaaaagcatgatgaggaatcgtacttgggagtcggccat

SEQ ID NO: 430220 - DNA, 140 bp, Artificial Sequence
  Synthetic
atggccgactcccaagtacgattcctcatcatgcttttcattgcactttgccactgctgtgttgccaaagcattttaattcagcctcaatcaacatccacctggttaagcagtaacctccggagacccagcatggcgtat

SEQ ID NO: 430221 - DNA, 140 bp, Artificial Sequence
  Synthetic
aggccctggctgctgatatgctttggcaacacagcagtggcaaagtgcaatgaaaagcatgatgaggaattctgtgacatgctcagactgtttgatttcaacaagcaggccataagcagagaccttttgggacagcggtg

SEQ ID NO: 430222 - DNA, 140 bp, Artificial Sequence
  Synthetic
caccgctgtcccaaaaggtctctgcttatggcctgcttgttgaaatcaaacagtctgagcatgtcacagaattcctcatcatgcttttcattgcactttgccactgctgtgttgccaaagcatatcagcagccagggcct

SEQ ID NO: 430223 - DNA, 140 bp, Artificial Sequence
  Synthetic
atacgccatgctgggtctcctgccttaattaatgatcagttgattatgaaaaaccatttgcgagacattatggggatcccatattgcaattacagcaaatactggtatcttaaccacacacgtacttgggagtcggccat

SEQ ID NO: 430224 - DNA, 140 bp, Artificial Sequence
  Synthetic
atggccgactcccaagtacgtgtgtggttaagataccagtatttgctgtaattgcaatatgggatccccataatgtctcgcaaatggtttttcataatcaactgatcattaattaaggcaggagacccagcatggcgtat

SEQ ID NO: 430225 - DNA, 140 bp, Artificial Sequence
  Synthetic
aggccctggctgctgatatgtggggatcccatattgcaattacagcaaatactggtatcttaaccacacagtcactggtagaacctcactacctaagtgttggcttgtgtccaatggctcgaccttttgggacagcggtg

SEQ ID NO: 430226 - DNA, 140 bp, Artificial Sequence
  Synthetic
caccgctgtcccaaaaggtcgagccattggacacaagccaacacttaggtagtgaggttctaccagtgactgtgtggttaagataccagtatttgctgtaattgcaatatgggatccccacatatcagcagccagggcct

SEQ ID NO: 430227 - DNA, 140 bp, Artificial Sequence
  Synthetic
atacgccatgctgggtctccacatgatcacagagatgctacaaaaggaatacatggacaggcaaggaaaaacacctttgggcctggttgacttgtttgtgtttagcacaagtttttatctcgtacttgggagtcggccat

SEQ ID NO: 430228 - DNA, 140 bp, Artificial Sequence
  Synthetic
atggccgactcccaagtacgagataaaaacttgtgctaaacacaaacaagtcaaccaggcccaaaggtgtttttccttgcctgtccatgtattccttttgtagcatctctgtgatcatgtggagacccagcatggcgtat

SEQ ID NO: 430229 - DNA, 140 bp, Artificial Sequence
  Synthetic
aggccctggctgctgatatgacacctttgggcctggttgacttgtttgtgtttagcacaagtttttatctgattagcattttccttcatttagtcaaaataccgacccatagacacattggaccttttgggacagcggtg

SEQ ID NO: 430230 - DNA, 140 bp, Artificial Sequence
  Synthetic
caccgctgtcccaaaaggtccaatgtgtctatgggtcggtattttgactaaatgaaggaaaatgctaatcagataaaaacttgtgctaaacacaaacaagtcaaccaggcccaaaggtgtcatatcagcagccagggcct

SEQ ID NO: 430231 - DNA, 140 bp, Artificial Sequence
  Synthetic
atacgccatgctgggtctcctcttgtggtttgtacaagcaacctggcgtccctgttaaatggaagagatagatctccagcagaggcccccgtgacccaccgcctattggcggtgggtcaccgtacttgggagtcggccat

SEQ ID NO: 430232 - DNA, 140 bp, Artificial Sequence
  Synthetic
atggccgactcccaagtacggtgacccaccgccaataggcggtgggtcacgggggcctctgctggagatctatctcttccatttaacagggacgccaggttgcttgtacaaaccacaagaggagacccagcatggcgtat

SEQ ID NO: 430233 - DNA, 140 bp, Artificial Sequence
  Synthetic
atacgccatgctgggtctccagacaggatttctcgatcaaaatcttctatcatatgattggatagttcactctttattagcctcagtaagagtttttcttccaccaccttgtcaagatcacgtacttgggagtcggccat

SEQ ID NO: 430234 - DNA, 140 bp, Artificial Sequence
  Synthetic
atggccgactcccaagtacgtgatcttgacaaggtggtggaagaaaaactcttactgaggctaataaagagtgaactatccaatcatatgatagaagattttgatcgagaaatcctgtctggagacccagcatggcgtat

SEQ ID NO: 430235 - DNA, 140 bp, Artificial Sequence
  Synthetic
aggccctggctgctgatatgtctttattagcctcagtaagagtttttcttccaccaccttgtcaagatcagatattgagggtgcattgcagtctgcctgctgttgtctttccggttgctcgaccttttgggacagcggtg

SEQ ID NO: 430236 - DNA, 140 bp, Artificial Sequence
  Synthetic
caccgctgtcccaaaaggtcgagcaaccggaaagacaacagcaggcagactgcaatgcaccctcaatatctgatcttgacaaggtggtggaagaaaaactcttactgaggctaataaagacatatcagcagccagggcct

SEQ ID NO: 430237 - DNA, 140 bp, Artificial Sequence
  Synthetic
atacgccatgctgggtctccacagcagcatcaaacatgatgcagtccattagtgcacaatgaggggtaatttcttccttgccacctctcttcttcttctcaacgacaacacctgtgtgcacgtacttgggagtcggccat

SEQ ID NO: 430238 - DNA, 140 bp, Artificial Sequence
  Synthetic
atggccgactcccaagtacgtgcacacaggtgttgtcgttgagaagaagaagagaggtggcaaggaagaaattacccctcattgtgcactaatggactgcatcatgtttgatgctgctgtggagacccagcatggcgtat

SEQ ID NO: 430239 - DNA, 140 bp, Artificial Sequence
  Synthetic
aggccctggctgctgatatgcccaactctatcgctgttgataatgaaatgcacatataatcccataacaaagatctgaaataagataggacactcttcccttcagactcttctcttacccgaccttttgggacagcggtg

SEQ ID NO: 430240 - DNA, 140 bp, Artificial Sequence
  Synthetic
caccgctgtcccaaaaggtcgggtaagagaagagtctgaagggaagagtgtcctatcttatttcagatctttgttatgggattatatgtgcatttcattatcaacagcgatagagttgggcatatcagcagccagggcct

SEQ ID NO: 430241 - DNA, 140 bp, Artificial Sequence
  Synthetic
aggccctggctgctgatatgagtatcaaaactaaaatcattttggttaacaatttgatagtgatcaattgttcagataactctgtgcactcttctatccagctgaccataacatcgactagaccttttgggacagcggtg

SEQ ID NO: 430242 - DNA, 140 bp, Artificial Sequence
  Synthetic
caccgctgtcccaaaaggtctagtcgatgttatggtcagctggatagaagagtgcacagagttatctgaacaattgatcactatcaaattgttaaccaaaatgattttagttttgatactcatatcagcagccagggcct

SEQ ID NO: 430243 - DNA, 140 bp, Artificial Sequence
  Synthetic
aggccctggctgctgatatgacagattgatcaattatggtatcaattgtttctgccaattgatggggttctttgcactttatgttatgtaaagccgcagcaacaaattttgttagcaggggaccttttgggacagcggtg

SEQ ID NO: 430244 - DNA, 140 bp, Artificial Sequence
  Synthetic
caccgctgtcccaaaaggtcccctgctaacaaaatttgttgctgcggctttacataacataaagtgcaaagaaccccatcaattggcagaaacaattgataccataattgatcaatctgtcatatcagcagccagggcct

SEQ ID NO: 430245 - DNA, 140 bp, Artificial Sequence
  Synthetic
aggccctggctgctgatatgccatattccgaggaagtgcctcaataacagcactggtcagaccaggttgtgcagcaaacaaatctgtgacatcaattccatgagaatactttgcatcttggaccttttgggacagcggtg

SEQ ID NO: 430246 - DNA, 140 bp, Artificial Sequence
  Synthetic
caccgctgtcccaaaaggtccaagatgcaaagtattctcatggaattgatgtcacagatttgtttgctgcacaacctggtctgaccagtgctgttattgaggcacttcctcggaatatggcatatcagcagccagggcct

SEQ ID NO: 430247 - DNA, 140 bp, Artificial Sequence
  Synthetic
atacgccatgctgggtctcccagagttgggctgatagagggcaacttccaccgggtcctctggtctcccctctatgtccatccatgtcttggcatttgggtcaagctgcagcattgcatccgtacttgggagtcggccat

SEQ ID NO: 430248 - DNA, 140 bp, Artificial Sequence
  Synthetic
atggccgactcccaagtacggatgcaatgctgcagcttgacccaaatgccaagacatggatggacatagaggggagaccagaggacccggtggaagttgccctctatcagcccaactctgggagacccagcatggcgtat

SEQ ID NO: 430249 - DNA, 140 bp, Artificial Sequence
  Synthetic
aggccctggctgctgatatgtctatgtccatccatgtcttggcatttgggtcaagctgcagcattgcatctttaagagtcataagttgagagtaggtcagcccagctgggaagcctgcaggaccttttgggacagcggtg

SEQ ID NO: 430250 - DNA, 140 bp, Artificial Sequence
  Synthetic
caccgctgtcccaaaaggtcctgcaggcttcccagctgggctgacctactctcaacttatgactcttaaagatgcaatgctgcagcttgacccaaatgccaagacatggatggacatagacatatcagcagccagggcct

SEQ ID NO: 430251 - DNA, 140 bp, Artificial Sequence
  Synthetic
aggccctggctgctgatatgaatttggggcagctagatatcaggtggttaggtgcaaagaagcatactgtcaggaattctcactcagtggcatcaggtttcaattgatctatcaaaaaacgaccttttgggacagcggtg

SEQ ID NO: 430252 - DNA, 140 bp, Artificial Sequence
  Synthetic
caccgctgtcccaaaaggtcgttttttgatagatcaattgaaacctgatgccactgagtgagaattcctgacagtatgcttctttgcacctaaccacctgatatctagctgccccaaattcatatcagcagccagggcct

SEQ ID NO: 430253 - DNA, 140 bp, Artificial Sequence
  Synthetic
atacgccatgctgggtctcctctgcctcgaggtctaccacagtgttttcccaggccctccctactattgatgttctagatgcaatgtatggccacccatcacctgataagcaaattttatcgtacttgggagtcggccat

SEQ ID NO: 430254 - DNA, 140 bp, Artificial Sequence
  Synthetic
atggccgactcccaagtacgataaaatttgcttatcaggtgatgggtggccatacattgcatctagaacatcaatagtagggagggcctgggaaaacactgtggtagacctcgaggcagaggagacccagcatggcgtat

SEQ ID NO: 430255 - DNA, 140 bp, Artificial Sequence
  Synthetic
aggccctggctgctgatatgtgttctagatgcaatgtatggccacccatcacctgataagcaaattttatagagtatgttttcataagggttcctttcacccggagtgtctgaaacaaacgaccttttgggacagcggtg

SEQ ID NO: 430256 - DNA, 140 bp, Artificial Sequence
  Synthetic
caccgctgtcccaaaaggtcgtttgtttcagacactccgggtgaaaggaacccttatgaaaacatactctataaaatttgcttatcaggtgatgggtggccatacattgcatctagaacacatatcagcagccagggcct

SEQ ID NO: 430257 - DNA, 140 bp, Artificial Sequence
  Synthetic
atacgccatgctgggtctcctgattgaggtgaaactttgattgtttccaacatgttcccaccatccaacatacaggcacctgcttttactgcagcacccaaactaaagttataacctgagcgtacttgggagtcggccat

SEQ ID NO: 430258 - DNA, 140 bp, Artificial Sequence
  Synthetic
atggccgactcccaagtacgctcaggttataactttagtttgggtgctgcagtaaaagcaggtgcctgtatgttggatggtgggaacatgttggaaacaatcaaagtttcacctcaatcaggagacccagcatggcgtat

SEQ ID NO: 430259 - DNA, 140 bp, Artificial Sequence
  Synthetic
aggccctggctgctgatatgtacaggcacctgcttttactgcagcacccaaactaaagttataacctgagatgttcagggagctcttcttggtatcaatcatgtttaaaatggggtgactgaccttttgggacagcggtg

SEQ ID NO: 430260 - DNA, 140 bp, Artificial Sequence
  Synthetic
caccgctgtcccaaaaggtcagtcaccccattttaaacatgattgataccaagaagagctccctgaacatctcaggttataactttagtttgggtgctgcagtaaaagcaggtgcctgtacatatcagcagccagggcct

SEQ ID NO: 430261 - DNA, 140 bp, Artificial Sequence
  Synthetic
atacgccatgctgggtctccaataccatcaacagtgcacctcagttggtcgaagtattctgatgcccctccatccaatagtatctcatctaggtcagcactgttggtgtcaccaccccctcgtacttgggagtcggccat

SEQ ID NO: 430262 - DNA, 140 bp, Artificial Sequence
  Synthetic
atggccgactcccaagtacgagggggtggtgacaccaacagtgctgacctagatgagatactattggatggaggggcatcagaatacttcgaccaactgaggtgcactgttgatggtattggagacccagcatggcgtat

SEQ ID NO: 430263 - DNA, 140 bp, Artificial Sequence
  Synthetic
atacgccatgctgggtctcctcaagcccaaatctgtgagtgcttggaccacatcatttaaatcagcttgcccttgttttgttagacatgctaatgtcaagcttggcattgtaccaaattgcgtacttgggagtcggccat

SEQ ID NO: 430264 - DNA, 140 bp, Artificial Sequence
  Synthetic
atggccgactcccaagtacgcaatttggtacaatgccaagcttgacattagcatgtctaacaaaacaagggcaagctgatttaaatgatgtggtccaagcactcacagatttgggcttgaggagacccagcatggcgtat

SEQ ID NO: 430265 - DNA, 140 bp, Artificial Sequence
  Synthetic
aggccctggctgctgatatgccttgttttgttagacatgctaatgtcaagcttggcattgtaccaaattgattattcaataattctgcattttttacatcccagactctcaccaccccatgaccttttgggacagcggtg

SEQ ID NO: 430266 - DNA, 140 bp, Artificial Sequence
  Synthetic
caccgctgtcccaaaaggtcatggggtggtgagagtctgggatgtaaaaaatgcagaattattgaataatcaatttggtacaatgccaagcttgacattagcatgtctaacaaaacaaggcatatcagcagccagggcct

SEQ ID NO: 430267 - DNA, 140 bp, Artificial Sequence
  Synthetic
aggccctggctgctgatatgacctgtgctgggtttgggcctgtgcctgtgtggcttgcaggtcagctggtggtgccccacaaaaactcccacagaaatgagagacaatatgcctaggatcgaccttttgggacagcggtg

SEQ ID NO: 430268 - DNA, 140 bp, Artificial Sequence
  Synthetic
caccgctgtcccaaaaggtcgatcctaggcatattgtctctcatttctgtgggagtttttgtggggcaccaccagctgacctgcaagccacacaggcacaggcccaaacccagcacaggtcatatcagcagccagggcct

SEQ ID NO: 430269 - DNA, 140 bp, Artificial Sequence
  Synthetic
atacgccatgctgggtctccaggagtgccctcctctgatcaagctgctgtgaactcaggtttcccatgtagacacctgagctcaggggcctctctgttcttgtgactttagacttcagctcgtacttgggagtcggccat

SEQ ID NO: 430270 - DNA, 140 bp, Artificial Sequence
  Synthetic
atggccgactcccaagtacgagctgaagtctaaagtcacaagaacagagaggcccctgagctcaggtgtctacatgggaaacctgagttcacagcagcttgatcagaggagggcactcctggagacccagcatggcgtat

SEQ ID NO: 430271 - DNA, 140 bp, Artificial Sequence
  Synthetic
aggccctggctgctgatatggacacctgagctcaggggcctctctgttcttgtgactttagacttcagcttctctaaatcagctgctaaggtcaataagtcatctgagttcagggtcccagaccttttgggacagcggtg

SEQ ID NO: 430272 - DNA, 140 bp, Artificial Sequence
  Synthetic
caccgctgtcccaaaaggtctgggaccctgaactcagatgacttattgaccttagcagctgatttagagaagctgaagtctaaagtcacaagaacagagaggcccctgagctcaggtgtccatatcagcagccagggcct

SEQ ID NO: 430273 - DNA, 140 bp, Artificial Sequence
  Synthetic
aggccctggctgctgatatgctcatgtcatagaggaagtgatgaacattgtcctgattgctctcagccttctggcaatactgaaagggatctacaatgttgctacctgtggcctctttgggaccttttgggacagcggtg

SEQ ID NO: 430274 - DNA, 140 bp, Artificial Sequence
  Synthetic
caccgctgtcccaaaaggtcccaaagaggccacaggtagcaacattgtagatccctttcagtattgccagaaggctgagagcaatcaggacaatgttcatcacttcctctatgacatgagcatatcagcagccagggcct

SEQ ID NO: 430275 - DNA, 140 bp, Artificial Sequence
  Synthetic
atacgccatgctgggtctccgactgcctggtttaggtccctgagtcgttttagatcaccatcatccctcctctgcttgcgcatcagccgttggacattgctgacctctgaaaaatcaagtcgtacttgggagtcggccat

SEQ ID NO: 430276 - DNA, 140 bp, Artificial Sequence
  Synthetic
atggccgactcccaagtacgacttgatttttcagaggtcagcaatgtccaacggctgatgcgcaagcagaggagggatgatggtgatctaaaacgactcagggacctaaaccaggcagtcggagacccagcatggcgtat

SEQ ID NO: 430277 - DNA, 140 bp, Artificial Sequence
  Synthetic
aggccctggctgctgatatgtctgcttgcgcatcagccgttggacattgctgacctctgaaaaatcaagtccatgtagaagagcttgggcatccttcaccacctgcagcttgatgttggagaccttttgggacagcggtg

SEQ ID NO: 430278 - DNA, 140 bp, Artificial Sequence
  Synthetic
caccgctgtcccaaaaggtctccaacatcaagctgcaggtggtgaaggatgcccaagctcttctacatggacttgatttttcagaggtcagcaatgtccaacggctgatgcgcaagcagacatatcagcagccagggcct

SEQ ID NO: 430279 - DNA, 140 bp, Artificial Sequence
  Synthetic
atacgccatgctgggtctcctgagtgatagggcatctgcatttttgtctctagttcttttccggctgtctatccaccgttttaaatctctttttgttgattccaatgaaactaatctatccgtacttgggagtcggccat

SEQ ID NO: 430280 - DNA, 140 bp, Artificial Sequence
  Synthetic
atggccgactcccaagtacggatagattagtttcattggaatcaacaaaaagagatttaaaacggtggatagacagccggaaaagaactagagacaaaaatgcagatgccctatcactcaggagacccagcatggcgtat

SEQ ID NO: 430281 - DNA, 140 bp, Artificial Sequence
  Synthetic
atacgccatgctgggtctcctcacttctttagaagcactcattgctaagtcagtaagtgctgatcaaagctgttggaaatcactgatgtgattaatgcaaagcgcaatccaatagcctagcgtacttgggagtcggccat

SEQ ID NO: 430282 - DNA, 140 bp, Artificial Sequence
  Synthetic
atggccgactcccaagtacgctaggctattggattgcgctttgcattaatcacatcagtgatttccaacagctttgatcagcacttactgacttagcaatgagtgcttctaaagaagtgaggagacccagcatggcgtat

SEQ ID NO: 430283 - DNA, 140 bp, Artificial Sequence
  Synthetic
aggccctggctgctgatatggtatttagtatccttaaagatttaactttatttaggaatgatctccagcattgcacctggcattccccggtggtttgattcccctttttactaccctcctgaccttttgggacagcggtg

SEQ ID NO: 430284 - DNA, 140 bp, Artificial Sequence
  Synthetic
caccgctgtcccaaaaggtcaggagggtagtaaaaaggggaatcaaaccaccggggaatgccaggtgcaatgctggagatcattcctaaataaagttaaatctttaaggatactaaataccatatcagcagccagggcct

SEQ ID NO: 430285 - DNA, 140 bp, Artificial Sequence
  Synthetic
atacgccatgctgggtctcccatgtctcttgtagtccagccggctagcaagaagaatcagaacgtcaaaaataaggagaagtttccttctggtattgaggatcctcagagactttatcttcgtacttgggagtcggccat

SEQ ID NO: 430286 - DNA, 140 bp, Artificial Sequence
  Synthetic
atggccgactcccaagtacgaagataaagtctctgaggatcctcaataccagaaggaaacttctccttatttttgacgttctgattcttcttgctagccggctggactacaagagacatgggagacccagcatggcgtat

SEQ ID NO: 430287 - DNA, 140 bp, Artificial Sequence
  Synthetic
aggccctggctgctgatatgctaaggtcaagttctgtcatcttatagttgcagacttggtaagctttcccagacagtgatcctaacaactaagtatggaagaggacatagcttatgtaaagaccttttgggacagcggtg

SEQ ID NO: 430288 - DNA, 140 bp, Artificial Sequence
  Synthetic
caccgctgtcccaaaaggtctttacataagctatgtcctcttccatacttagttgttaggatcactgtctgggaaagcttaccaagtctgcaactataagatgacagaacttgaccttagcatatcagcagccagggcct

SEQ ID NO: 430289 - DNA, 140 bp, Artificial Sequence
  Synthetic
atacgccatgctgggtctccagacagtgatcctaacaactaagtatggaagaggacatagcttatgtaaaagacttaatctcaaagtacctggtggacaatgtgaaactctcaagacagacgtacttgggagtcggccat

SEQ ID NO: 430290 - DNA, 140 bp, Artificial Sequence
  Synthetic
atggccgactcccaagtacgtctgtcttgagagtttcacattgtccaccaggtactttgagattaagtcttttacataagctatgtcctcttccatacttagttgttaggatcactgtctggagacccagcatggcgtat

SEQ ID NO: 430291 - DNA, 140 bp, Artificial Sequence
  Synthetic
aggccctggctgctgatatgacgtgcaaacacttcagttaactgtgtgacagccaaagctgtaagcttgttgaagtcataatccagaatacgggacccatctgtatacttattcacaacagaccttttgggacagcggtg

SEQ ID NO: 430292 - DNA, 140 bp, Artificial Sequence
  Synthetic
caccgctgtcccaaaaggtctgttgtgaataagtatacagatgggtcccgtattctggattatgacttcaacaagcttacagctttggctgtcacacagttaactgaagtgtttgcacgtcatatcagcagccagggcct

SEQ ID NO: 430293 - DNA, 140 bp, Artificial Sequence
  Synthetic
atacgccatgctgggtctccttgaaacttctgtctctttgcattgaagttgattcatgcaatgcaaacggatgcgaacacaacagcgaggacaaatctgttgagaaaatccttcatgagtcgtacttgggagtcggccat

SEQ ID NO: 430294 - DNA, 140 bp, Artificial Sequence
  Synthetic
atggccgactcccaagtacgactcatgaaggattttctcaacagatttgtcctcgctgttgtgttcgcatccgtttgcattgcatgaatcaacttcaatgcaaagagacagaagtttcaaggagacccagcatggcgtat

SEQ ID NO: 430295 - DNA, 140 bp, Artificial Sequence
  Synthetic
aggccctggctgctgatatgatgcgaacacaacagcgaggacaaatctgttgagaaaatccttcatgagtatggcattttgaccccatctctttgttttgtagtgccagatgggtataaagaccttttgggacagcggtg

SEQ ID NO: 430296 - DNA, 140 bp, Artificial Sequence
  Synthetic
caccgctgtcccaaaaggtctttatacccatctggcactacaaaacaaagagatggggtcaaaatgccatactcatgaaggattttctcaacagatttgtcctcgctgttgtgttcgcatcatatcagcagccagggcct

SEQ ID NO: 430297 - DNA, 140 bp, Artificial Sequence
  Synthetic
atacgccatgctgggtctccagccaactttgagcaaaaatacatagaggatctgaaaaaactggaacagttaaaagaagacttaaaaagtgttgatattagccttattccactgatagaccgtacttgggagtcggccat

SEQ ID NO: 430298 - DNA, 140 bp, Artificial Sequence
  Synthetic
atggccgactcccaagtacggtctatcagtggaataaggctaatatcaacactttttaagtcttcttttaactgttccagttttttcagatcctctatgtatttttgctcaaagttggctggagacccagcatggcgtat

SEQ ID NO: 430299 - DNA, 140 bp, Artificial Sequence
  Synthetic
aggccctggctgctgatatgtaaaagaagacttaaaaagtgttgatattagccttattccactgatagacggcagaacatccttctacaacgagcaactacctgattgggtcaatgataagaccttttgggacagcggtg

SEQ ID NO: 430300 - DNA, 140 bp, Artificial Sequence
  Synthetic
caccgctgtcccaaaaggtcttatcattgacccaatcaggtagttgctcgttgtagaaggatgttctgccgtctatcagtggaataaggctaatatcaacactttttaagtcttcttttacatatcagcagccagggcct

SEQ ID NO: 430301 - DNA, 140 bp, Artificial Sequence
  Synthetic
atacgccatgctgggtctcccactttttgaggaatcagaatacagtaggctctgtgaatctttgtcgatgacctcagggagactttcaggaatcgagagtttaaacaccttgttagataacgtacttgggagtcggccat

SEQ ID NO: 430302 - DNA, 140 bp, Artificial Sequence
  Synthetic
atggccgactcccaagtacgttatctaacaaggtgtttaaactctcgattcctgaaagtctccctgaggtcatcgacaaagattcacagagcctactgtattctgattcctcaaaaagtgggagacccagcatggcgtat

SEQ ID NO: 430303 - DNA, 140 bp, Artificial Sequence
  Synthetic
aggccctggctgctgatatgacctcagggagactttcaggaatcgagagtttaaacaccttgttagataatcgctctaatcattatgaggaaatcattacactgtgccatcaaggcatcagaccttttgggacagcggtg

SEQ ID NO: 430304 - DNA, 140 bp, Artificial Sequence
  Synthetic
caccgctgtcccaaaaggtctgatgccttgatggcacagtgtaatgatttcctcataatgattagagcgattatctaacaaggtgtttaaactctcgattcctgaaagtctccctgaggtcatatcagcagccagggcct

SEQ ID NO: 430305 - DNA, 140 bp, Artificial Sequence
  Synthetic
aggccctggctgctgatatggtttcaatccctccataagcaacattctaggttcagtctggaccaaaaaagctaacttctgtcttgacagcttctcattatctgcaaggtactttgagatgaccttttgggacagcggtg

SEQ ID NO: 430306 - DNA, 140 bp, Artificial Sequence
  Synthetic
caccgctgtcccaaaaggtcatctcaaagtaccttgcagataatgagaagctgtcaagacagaagttagcttttttggtccagactgaacctagaatgttgcttatggagggattgaaaccatatcagcagccagggcct

SEQ ID NO: 430307 - DNA, 140 bp, Artificial Sequence
  Synthetic
atacgccatgctgggtctcccaagtttttagaaacagactgagaggaggggaaataaagtgtcagtttatgagagttgacaaaaattatttactcaatgagttcaacaaactatacactgcgtacttgggagtcggccat

SEQ ID NO: 430308 - DNA, 140 bp, Artificial Sequence
  Synthetic
atggccgactcccaagtacgcagtgtatagtttgttgaactcattgagtaaataatttttgtcaactctcataaactgacactttatttcccctcctctcagtctgtttctaaaaacttgggagacccagcatggcgtat

SEQ ID NO: 430309 - DNA, 140 bp, Artificial Sequence
  Synthetic
aggccctggctgctgatatggagagttgacaaaaattatttactcaatgagttcaacaaactatacactgatgatgcagtggttgttgaagatgacattgagcagctgatttatcaatttgaccttttgggacagcggtg

SEQ ID NO: 430310 - DNA, 140 bp, Artificial Sequence
  Synthetic
caccgctgtcccaaaaggtcaaattgataaatcagctgctcaatgtcatcttcaacaaccactgcatcatcagtgtatagtttgttgaactcattgagtaaataatttttgtcaactctccatatcagcagccagggcct

SEQ ID NO: 430311 - DNA, 140 bp, Artificial Sequence
  Synthetic
aggccctggctgctgatatgtaagagttggtttctatgccaacctccctcaaagcatcagtggctcgagttaaaactctgttgatgatggcaaggagctcacaatttcgttcctctccaagaccttttgggacagcggtg

SEQ ID NO: 430312 - DNA, 140 bp, Artificial Sequence
  Synthetic
caccgctgtcccaaaaggtcttggagaggaacgaaattgtgagctccttgccatcatcaacagagttttaactcgagccactgatgctttgagggaggttggcatagaaaccaactcttacatatcagcagccagggcct

SEQ ID NO: 430313 - DNA, 140 bp, Artificial Sequence
  Synthetic
atacgccatgctgggtctccggggaacaagaacaacaatcaggaaactaaagaatttcaaatgcaatgttggaggtcattcttgaacaaagttaagtctctaaggattctaaatacgagacgtacttgggagtcggccat

SEQ ID NO: 430314 - DNA, 140 bp, Artificial Sequence
  Synthetic
atggccgactcccaagtacgtctcgtatttagaatccttagagacttaactttgttcaagaatgacctccaacattgcatttgaaattctttagtttcctgattgttgttcttgttccccggagacccagcatggcgtat

SEQ ID NO: 430315 - DNA, 140 bp, Artificial Sequence
  Synthetic
aggccctggctgctgatatgggaggtcattcttgaacaaagttaagtctctaaggattctaaatacgagaaggaaactcttgttaatttttgacacactaattcttcttgcgagtagatagaccttttgggacagcggtg

SEQ ID NO: 430316 - DNA, 140 bp, Artificial Sequence
  Synthetic
caccgctgtcccaaaaggtctatctactcgcaagaagaattagtgtgtcaaaaattaacaagagtttccttctcgtatttagaatccttagagacttaactttgttcaagaatgacctcccatatcagcagccagggcct

SEQ ID NO: 430317 - DNA, 140 bp, Artificial Sequence
  Synthetic
aggccctggctgctgatatgcagattattaaactcactgagtaattgactcttctctacccttaagaactgactttctatctctccttttcttaatctatttctaaacacttgatactctgaccttttgggacagcggtg

SEQ ID NO: 430318 - DNA, 140 bp, Artificial Sequence
  Synthetic
caccgctgtcccaaaaggtcagagtatcaagtgtttagaaatagattaagaaaaggagagatagaaagtcagttcttaagggtagagaagagtcaattactcagtgagtttaataatctgcatatcagcagccagggcct

SEQ ID NO: 430319 - DNA, 140 bp, Artificial Sequence
  Synthetic
atacgccatgctgggtctcctcagtgtcaatgatagactagtttctttggagtcaaccaaaaaagaccttaagagatggatagaacggagacaacagattgaggcatcaaaatccgtaaccgtacttgggagtcggccat

SEQ ID NO: 430320 - DNA, 140 bp, Artificial Sequence
  Synthetic
atggccgactcccaagtacggttacggattttgatgcctcaatctgttgtctccgttctatccatctcttaaggtcttttttggttgactccaaagaaactagtctatcattgacactgaggagacccagcatggcgtat

SEQ ID NO: 430321 - DNA, 140 bp, Artificial Sequence
  Synthetic
aggccctggctgctgatatgaagagatggatagaacggagacaacagattgaggcatcaaaatccgtaacatcctcccaaaacccgtcaaataatcaaatcttaagctcaattattcagagaccttttgggacagcggtg

SEQ ID NO: 430322 - DNA, 140 bp, Artificial Sequence
  Synthetic
caccgctgtcccaaaaggtctctgaataattgagcttaagatttgattatttgacgggttttgggaggatgttacggattttgatgcctcaatctgttgtctccgttctatccatctcttcatatcagcagccagggcct

SEQ ID NO: 430323 - DNA, 140 bp, Artificial Sequence
  Synthetic
atacgccatgctgggtctccttccataagagttggtttctatgccaacctccctcaaagcattagtggctcgagttaaaactctgttgatgatggcaaggagctcacaatttcgttcttccgtacttgggagtcggccat

SEQ ID NO: 430324 - DNA, 140 bp, Artificial Sequence
  Synthetic
atggccgactcccaagtacggaagaacgaaattgtgagctccttgccatcatcaacagagttttaactcgagccactaatgctttgagggaggttggcatagaaaccaactcttatggaaggagacccagcatggcgtat

SEQ ID NO: 430325 - DNA, 140 bp, Artificial Sequence
  Synthetic
atacgccatgctgggtctccgaccaatttggcgtagacatgaacgtagtcagtcttgattgttatgattcaattatgaatttcgatgtcactggggtaacccccacaattagttaccagacgtacttgggagtcggccat

SEQ ID NO: 430326 - DNA, 140 bp, Artificial Sequence
  Synthetic
atggccgactcccaagtacgtctggtaactaattgtgggggttaccccagtgacatcgaaattcataattgaatcataacaatcaagactgactacgttcatgtctacgccaaattggtcggagacccagcatggcgtat

SEQ ID NO: 430327 - DNA, 140 bp, Artificial Sequence
  Synthetic
aggccctggctgctgatatgaattatgaatttcgatgtcactggggtaacccccacaattagttaccagaagtcacaagaggagattttcccatatgccatgggggtagttgaactgctggaccttttgggacagcggtg

SEQ ID NO: 430328 - DNA, 140 bp, Artificial Sequence
  Synthetic
caccgctgtcccaaaaggtccagcagttcaactacccccatggcatatgggaaaatctcctcttgtgacttctggtaactaattgtgggggttaccccagtgacatcgaaattcataattcatatcagcagccagggcct

SEQ ID NO: 430329 - DNA, 140 bp, Artificial Sequence
  Synthetic
atacgccatgctgggtctccctatccaccgttttagatctctttttgttgattccaatgaaactaatctatcgttaacactcacaaaacaggagcccagccaaccagtgaggagcttgtccgtacttgggagtcggccat

SEQ ID NO: 430330 - DNA, 140 bp, Artificial Sequence
  Synthetic
atggccgactcccaagtacggacaagctcctcactggttggctgggctcctgttttgtgagtgttaacgatagattagtttcattggaatcaacaaaaagagatctaaaacggtggatagggagacccagcatggcgtat

SEQ ID NO: 430331 - DNA, 140 bp, Artificial Sequence
  Synthetic
atacgccatgctgggtctccttcaatgaaaacttcatctactgtcaaactgagacaaaatgagttcggggcagcaagatatcaagtggttagatgcaaggaggcttactgtcaggaatttcgtacttgggagtcggccat

SEQ ID NO: 430332 - DNA, 140 bp, Artificial Sequence
  Synthetic
atggccgactcccaagtacgaaattcctgacagtaagcctccttgcatctaaccacttgatatcttgctgccccgaactcattttgtctcagtttgacagtagatgaagttttcattgaaggagacccagcatggcgtat

SEQ ID NO: 430333 - DNA, 140 bp, Artificial Sequence
  Synthetic
aggccctggctgctgatatgcagcaagatatcaagtggttagatgcaaggaggcttactgtcaggaatttatgctgaataacactaagtttcaactaatttatcaaaaaacaggagaatggaccttttgggacagcggtg

SEQ ID NO: 430334 - DNA, 140 bp, Artificial Sequence
  Synthetic
caccgctgtcccaaaaggtccattctcctgttttttgataaattagttgaaacttagtgttattcagcataaattcctgacagtaagcctccttgcatctaaccacttgatatcttgctgcatatcagcagccagggcct

SEQ ID NO: 430335 - DNA, 140 bp, Artificial Sequence
  Synthetic
atacgccatgctgggtctcctttatgctgaccctaagaggtactttcctgcaattttctcagctgaggttttgcaaacaacagtagatactatgatcacttggattgaagattgtagtgacgtacttgggagtcggccat

SEQ ID NO: 430336 - DNA, 140 bp, Artificial Sequence
  Synthetic
atggccgactcccaagtacgtcactacaatcttcaatccaagtgatcatagtatctactgttgtttgcaaaacctcagctgagaaaattgcaggaaagtacctcttagggtcagcataaaggagacccagcatggcgtat

SEQ ID NO: 430337 - DNA, 140 bp, Artificial Sequence
  Synthetic
aggccctggctgctgatatgttgcaaacaacagtagatactatgatcacttggattgaagattgtagtgaattagagaaggaattaattcacattaagctgttggcaaagatgattttgggaccttttgggacagcggtg

SEQ ID NO: 430338 - DNA, 140 bp, Artificial Sequence
  Synthetic
caccgctgtcccaaaaggtcccaaaatcatctttgccaacagcttaatgtgaattaattccttctctaattcactacaatcttcaatccaagtgatcatagtatctactgttgtttgcaacatatcagcagccagggcct

SEQ ID NO: 430339 - DNA, 140 bp, Artificial Sequence
  Synthetic
atacgccatgctgggtctcccttagatactttatcatggcttatgtatcagactaccaccatatagatcttatggacaaaataaaagagaaattgattactgagactgagtttctactttcgtacttgggagtcggccat

SEQ ID NO: 430340 - DNA, 140 bp, Artificial Sequence
  Synthetic
atggccgactcccaagtacgaaagtagaaactcagtctcagtaatcaatttctcttttattttgtccataagatctatatggtggtagtctgatacataagccatgataaagtatctaagggagacccagcatggcgtat

SEQ ID NO: 430341 - DNA, 140 bp, Artificial Sequence
  Synthetic
aggccctggctgctgatatgctgatcaacaattttttcaacagtctcctttagctgatcaaaataatcgcttgcacctccatcgagcaaaatttcgtctaggtcagccccatcagcatcagaccttttgggacagcggtg

SEQ ID NO: 430342 - DNA, 140 bp, Artificial Sequence
  Synthetic
caccgctgtcccaaaaggtctgatgctgatggggctgacctagacgaaattttgctcgatggaggtgcaagcgattattttgatcagctaaaggagactgttgaaaaaattgttgatcagcatatcagcagccagggcct

SEQ ID NO: 430343 - DNA, 140 bp, Artificial Sequence
  Synthetic
atacgccatgctgggtctcctcactttataacaaaagagacaccagatagactgacagatcagataaagtgttttgagaagtttcttgagcctaaaatagaatttggccatgtgagtgtgcgtacttgggagtcggccat

SEQ ID NO: 430344 - DNA, 140 bp, Artificial Sequence
  Synthetic
atggccgactcccaagtacgcacactcacatggccaaattctattttaggctcaagaaacttctcaaaacactttatctgatctgtcagtctatctggtgtctcttttgttataaagtgaggagacccagcatggcgtat

SEQ ID NO: 430345 - DNA, 140 bp, Artificial Sequence
  Synthetic
aggccctggctgctgatatggttttgagaagtttcttgagcctaaaatagaatttggccatgtgagtgtgaaccctgcagatacagctacagaggaggagttgatagacatggttcaccagaccttttgggacagcggtg

SEQ ID NO: 430346 - DNA, 140 bp, Artificial Sequence
  Synthetic
caccgctgtcccaaaaggtctggtgaaccatgtctatcaactcctcctctgtagctgtatctgcagggttcacactcacatggccaaattctattttaggctcaagaaacttctcaaaaccatatcagcagccagggcct

SEQ ID NO: 430347 - DNA, 140 bp, Artificial Sequence
  Synthetic
aggccctggctgctgatatggggatcctaggcaatttggttgttctttctgaggtattatgcgttgtactcctccaaatgggaaacaagcaagccaaagccccagaagcaaaagacagccgaccttttgggacagcggtg

SEQ ID NO: 430348 - DNA, 140 bp, Artificial Sequence
  Synthetic
caccgctgtcccaaaaggtcggctgtcttttgcttctggggctttggcttgcttgtttcccatttggaggagtacaacgcataatacctcagaaagaacaaccaaattgcctaggatccccatatcagcagccagggcct

SEQ ID NO: 430349 - DNA, 140 bp, Artificial Sequence
  Synthetic
atacgccatgctgggtctccaatataaaaagcctggagtctcgaggagattcctttcccttctcacatcttctttcaacaatggttctttgtttaaagaaaaggaagtaaaaaaggagttcgtacttgggagtcggccat

SEQ ID NO: 430350 - DNA, 140 bp, Artificial Sequence
  Synthetic
atggccgactcccaagtacgaactccttttttacttccttttctttaaacaaagaaccattgttgaaagaagatgtgagaagggaaaggaatctcctcgagactccaggctttttatattggagacccagcatggcgtat

SEQ ID NO: 430351 - DNA, 140 bp, Artificial Sequence
  Synthetic
aggccctggctgctgatatgtctttcaacaatggttctttgtttaaagaaaaggaagtaaaaaaggagttaaaggaccctctcataacaagtggttgtgccactgccttagatttagcaagaccttttgggacagcggtg

SEQ ID NO: 430352 - DNA, 140 bp, Artificial Sequence
  Synthetic
caccgctgtcccaaaaggtcttgctaaatctaaggcagtggcacaaccacttgttatgagagggtcctttaactccttttttacttccttttctttaaacaaagaaccattgttgaaagacatatcagcagccagggcct

SEQ ID NO: 430353 - DNA, 140 bp, Artificial Sequence
  Synthetic
atacgccatgctgggtctccaattatgacttcaacaaacttactgcattagctgtgacacagctgactgaagttttctccagaaaaggaaaacaccttcttaatagacaagactatgaatcgtacttgggagtcggccat

SEQ ID NO: 430354 - DNA, 140 bp, Artificial Sequence
  Synthetic
atggccgactcccaagtacgattcatagtcttgtctattaagaaggtgttttccttttctggagaaaacttcagtcagctgtgtcacagctaatgcagtaagtttgttgaagtcataattggagacccagcatggcgtat

SEQ ID NO: 430355 - DNA, 140 bp, Artificial Sequence
  Synthetic
aggccctggctgctgatatgagttttctccagaaaaggaaaacaccttcttaatagacaagactatgaatacaaggtacagcaggcaatgagcaacttagtgttgggatctcagcaacaagaccttttgggacagcggtg

SEQ ID NO: 430356 - DNA, 140 bp, Artificial Sequence
  Synthetic
caccgctgtcccaaaaggtcttgttgctgagatcccaacactaagttgctcattgcctgctgtaccttgtattcatagtcttgtctattaagaaggtgttttccttttctggagaaaactcatatcagcagccagggcct

SEQ ID NO: 430357 - DNA, 140 bp, Artificial Sequence
  Synthetic
atacgccatgctgggtctccgcacctgtgttgggtttgggtttgtgccagtatggcttgtgagtcagttagtagtgcccctcagaagctcccacagaaatgagagacaatatgcctaggacgtacttgggagtcggccat

SEQ ID NO: 430358 - DNA, 140 bp, Artificial Sequence
  Synthetic
atggccgactcccaagtacgtcctaggcatattgtctctcatttctgtgggagcttctgaggggcactactaactgactcacaagccatactggcacaaacccaaacccaacacaggtgcggagacccagcatggcgtat

SEQ ID NO: 430359 - DNA, 140 bp, Artificial Sequence
  Synthetic
atacgccatgctgggtctccctaagattttggaggagcttttgagaacgtttactggggtgagctaaaattaaaaccaggatcatctttgtcaaagatctgatattgttcaactgcccttcgtacttgggagtcggccat

SEQ ID NO: 430360 - DNA, 140 bp, Artificial Sequence
  Synthetic
atggccgactcccaagtacgaagggcagttgaacaatatcagatctttgacaaagatgatcctggttttaattttagctcaccccagtaaacgttctcaaaagctcctccaaaatcttagggagacccagcatggcgtat

SEQ ID NO: 430361 - DNA, 140 bp, Artificial Sequence
  Synthetic
atacgccatgctgggtctcccgcaaatgaatactttgatcagttaagagaaacagttgaaaatattgtggatcaatatagagaacctattagtctgagttcggtaaaaagaagtgatggtcgtacttgggagtcggccat

SEQ ID NO: 430362 - DNA, 140 bp, Artificial Sequence
  Synthetic
atggccgactcccaagtacgaccatcacttctttttaccgaactcagactaataggttctctatattgatccacaatattttcaactgtttctcttaactgatcaaagtattcatttgcgggagacccagcatggcgtat

SEQ ID NO: 430363 - DNA, 140 bp, Artificial Sequence
  Synthetic
aggccctggctgctgatatgatcaatatagagaacctattagtctgagttcggtaaaaagaagtgatggtcaaccatcaattaatgatctggatgaattgatttccaataaattctacatgaccttttgggacagcggtg

SEQ ID NO: 430364 - DNA, 140 bp, Artificial Sequence
  Synthetic
caccgctgtcccaaaaggtcatgtagaatttattggaaatcaattcatccagatcattaattgatggttgaccatcacttctttttaccgaactcagactaataggttctctatattgatcatatcagcagccagggcct

SEQ ID NO: 430365 - DNA, 140 bp, Artificial Sequence
  Synthetic
aggccctggctgctgatatgaatggcattgtcaaactccttctcattatttagacagctgcctgctaattgtgatgtgagtgcttcaaagtaatcctcaatgagccttgtgaacatctttgaccttttgggacagcggtg

SEQ ID NO: 430366 - DNA, 140 bp, Artificial Sequence
  Synthetic
caccgctgtcccaaaaggtcaaagatgttcacaaggctcattgaggattactttgaagcactcacatcacaattagcaggcagctgtctaaataatgagaaggagtttgacaatgccattcatatcagcagccagggcct

SEQ ID NO: 430367 - DNA, 140 bp, Artificial Sequence
  Synthetic
aggccctggctgctgatatgttggtagagtgcaacaatcactacctgtgtctcaactgtctcagcctgctcctcagcgtcagcagcagatgcccgatctgcaagatgccccttcccaccagaccttttgggacagcggtg

SEQ ID NO: 430368 - DNA, 140 bp, Artificial Sequence
  Synthetic
caccgctgtcccaaaaggtctggtgggaaggggcatcttgcagatcgggcatctgctgctgacgctgaggagcaggctgagacagttgagacacaggtagtgattgttgcactctaccaacatatcagcagccagggcct

SEQ ID NO: 430369 - DNA, 140 bp, Artificial Sequence
  Synthetic
atacgccatgctgggtctccatgaaattctgcctgatgatttttataaagaattctgtgacaatgtctacaatagtcacaagatgagagaaaaatatttttacagcggtcatatgtcccacgtacttgggagtcggccat

SEQ ID NO: 430370 - DNA, 140 bp, Artificial Sequence
  Synthetic
atggccgactcccaagtacgtgggacatatgaccgctgtaaaaatatttttctctcatcttgtgactattgtagacattgtcacagaattctttataaaaatcatcaggcagaatttcatggagacccagcatggcgtat

SEQ ID NO: 430371 - DNA, 140 bp, Artificial Sequence
  Synthetic
atacgccatgctgggtctccaatgaaaactcttgacagtatacttctttgcatctgaccacttgataccttgcgggtccaaactcattctgtctcaactttacagtagaagaagttttcacgtacttgggagtcggccat

SEQ ID NO: 430372 - DNA, 140 bp, Artificial Sequence
  Synthetic
atggccgactcccaagtacgtgaaaacttcttctactgtaaagttgagacagaatgagtttggacccgcaaggtatcaagtggtcagatgcaaagaagtatactgtcaagagttttcattggagacccagcatggcgtat

SEQ ID NO: 430373 - DNA, 140 bp, Artificial Sequence
  Synthetic
atacgccatgctgggtctccaataagctcatgggaagatatactcattataagtcaaggaatctaaactttaaattcgatataggcaagctctcagatgatgtcagaatcagtgaaagagcgtacttgggagtcggccat

SEQ ID NO: 430374 - DNA, 140 bp, Artificial Sequence
  Synthetic
atggccgactcccaagtacgctctttcactgattctgacatcatctgagagcttgcctatatcgaatttaaagtttagattccttgacttataatgagtatatcttcccatgagcttattggagacccagcatggcgtat

SEQ ID NO: 430375 - DNA, 140 bp, Artificial Sequence
  Synthetic
aggccctggctgctgatatgtaaattcgatataggcaagctctcagatgatgtcagaatcagtgaaagagaaagcaattctgaagcattaagcaaggccctgtcactaacaagttgcaccgaccttttgggacagcggtg

SEQ ID NO: 430376 - DNA, 140 bp, Artificial Sequence
  Synthetic
caccgctgtcccaaaaggtcggtgcaacttgttagtgacagggccttgcttaatgcttcagaattgctttctctttcactgattctgacatcatctgagagcttgcctatatcgaatttacatatcagcagccagggcct

SEQ ID NO: 430377 - DNA, 140 bp, Artificial Sequence
  Synthetic
aggccctggctgctgatatgcagtgtcaaacttggcatggtcccgaactgattattgagcaactctgcatttttcacatcccaaaccctgaccactccatctctcccagcctgagcccctgaccttttgggacagcggtg

SEQ ID NO: 430378 - DNA, 140 bp, Artificial Sequence
  Synthetic
caccgctgtcccaaaaggtcaggggctcaggctgggagagatggagtggtcagggtttgggatgtgaaaaatgcagagttgctcaataatcagttcgggaccatgccaagtttgacactgcatatcagcagccagggcct

SEQ ID NO: 430379 - DNA, 140 bp, Artificial Sequence
  Synthetic
atacgccatgctgggtctccttacaattcagtgggacctgacacagggcgattaaaattctctttgtcatataaagagcaggtaggtggtaacagggaattgtacattggtgatttaagacgtacttgggagtcggccat

SEQ ID NO: 430380 - DNA, 140 bp, Artificial Sequence
  Synthetic
atggccgactcccaagtacgtcttaaatcaccaatgtacaattccctgttaccacctacctgctctttatatgacaaagagaattttaatcgccctgtgtcaggtcccactgaattgtaaggagacccagcatggcgtat

SEQ ID NO: 430381 - DNA, 140 bp, Artificial Sequence
  Synthetic
aggccctggctgctgatatgataaagagcaggtaggtggtaacagggaattgtacattggtgatttaagaaccaagatgttcacaagattaattgaggattattttgaagcactgagtttgaccttttgggacagcggtg

SEQ ID NO: 430382 - DNA, 140 bp, Artificial Sequence
  Synthetic
caccgctgtcccaaaaggtcaaactcagtgcttcaaaataatcctcaattaatcttgtgaacatcttggttcttaaatcaccaatgtacaattccctgttaccacctacctgctctttatcatatcagcagccagggcct

SEQ ID NO: 430383 - DNA, 140 bp, Artificial Sequence
  Synthetic
aggccctggctgctgatatgagtggtattaaattaatgtcgacactctttaggtcttctttcagctgttctagtttcttgaagtcttcaatgtacttctgttcaaagttggcaggggatggaccttttgggacagcggtg

SEQ ID NO: 430384 - DNA, 140 bp, Artificial Sequence
  Synthetic
caccgctgtcccaaaaggtccatcccctgccaactttgaacagaagtacattgaagacttcaagaaactagaacagctgaaagaagacctaaagagtgtcgacattaatttaataccactcatatcagcagccagggcct

SEQ ID NO: 430385 - DNA, 140 bp, Artificial Sequence
  Synthetic
atacgccatgctgggtctccttttgtctatgaaactcaatgtctctttagcacacgtctcctacagtatggatcacagtaagtggggtccaatgatgtgtccatttttgtttttagctgtcgtacttgggagtcggccat

SEQ ID NO: 430386 - DNA, 140 bp, Artificial Sequence
  Synthetic
atggccgactcccaagtacgacagctaaaaacaaaaatggacacatcattggaccccacttactgtgatccatactgtaggagacgtgtgctaaagagacattgagtttcatagacaaaaggagacccagcatggcgtat

SEQ ID NO: 430387 - DNA, 140 bp, Artificial Sequence
  Synthetic
atacgccatgctgggtctccaagcctgcgatctactgtagcagagactatagcctttaaaatctgcccagaagtcaattccggagaacactctagtaaggaagttttcgtagccttcaggcgtacttgggagtcggccat

SEQ ID NO: 430388 - DNA, 140 bp, Artificial Sequence
  Synthetic
atggccgactcccaagtacgcctgaaggctacgaaaacttccttactagagtgttctccggaattgacttctgggcagattttaaaggctatagtctctgctacagtagatcgcaggcttggagacccagcatggcgtat

SEQ ID NO: 430389 - DNA, 140 bp, Artificial Sequence
  Synthetic
aggccctggctgctgatatgtcctcaaggattgtgtccacaaaaaggattttatttcctttgaggcactcatcaccagattattgcgttgaatgcacgcaacagaaagctgagactatctgaccttttgggacagcggtg

SEQ ID NO: 430390 - DNA, 140 bp, Artificial Sequence
  Synthetic
caccgctgtcccaaaaggtcagatagtctcagctttctgttgcgtgcattcaacgcaataatctggtgatgagtgcctcaaaggaaataaaatcctttttgtggacacaatccttgaggacatatcagcagccagggcct

SEQ ID NO: 430391 - DNA, 140 bp, Artificial Sequence
  Synthetic
aggccctggctgctgatatgccagttgggtttgagaaaaagcacctcacagtcgatgacggaggatttcttttactccaactttcagataggcgtggtaccctcccatatcagctctatagaccttttgggacagcggtg

SEQ ID NO: 430392 - DNA, 140 bp, Artificial Sequence
  Synthetic
caccgctgtcccaaaaggtctatagagctgatatgggagggtaccacgcctatctgaaagttggagtaaaagaaatcctccgtcatcgactgtgaggtgctttttctcaaacccaactggcatatcagcagccagggcct

SEQ ID NO: 430393 - DNA, 140 bp, Artificial Sequence
  Synthetic
aggccctggctgctgatatgctaggcaatttggttgttcttttttgagaccttgtgtgctgaactcctccaaatgggaaacaaacaagccaaggccccagaatcaaaagacagcccaagggaccttttgggacagcggtg

SEQ ID NO: 430394 - DNA, 140 bp, Artificial Sequence
  Synthetic
caccgctgtcccaaaaggtcccttgggctgtcttttgattctggggccttggcttgtttgtttcccatttggaggagttcagcacacaaggtctcaaaaaagaacaaccaaattgcctagcatatcagcagccagggcct

SEQ ID NO: 430395 - DNA, 140 bp, Artificial Sequence
  Synthetic
atacgccatgctgggtctcctatttcagagagatttattaattatgccattggcagtgtctgtgggggcacaatagatgcctacacttcgagtgatgaccaaatttccttatttgatcagcgtacttgggagtcggccat

SEQ ID NO: 430396 - DNA, 140 bp, Artificial Sequence
  Synthetic
atggccgactcccaagtacgctgatcaaataaggaaatttggtcatcactcgaagtgtaggcatctattgtgcccccacagacactgccaatggcataattaataaatctctctgaaataggagacccagcatggcgtat

SEQ ID NO: 430397 - DNA, 140 bp, Artificial Sequence
  Synthetic
aggccctggctgctgatatgcaatagatgcctacacttcgagtgatgaccaaatttccttatttgatcaggctttaactgaactcatgcaaagagacccggaagaattcaagacattgttgaccttttgggacagcggtg

SEQ ID NO: 430398 - DNA, 140 bp, Artificial Sequence
  Synthetic
caccgctgtcccaaaaggtcaacaatgtcttgaattcttccgggtctctttgcatgagttcagttaaagcctgatcaaataaggaaatttggtcatcactcgaagtgtaggcatctattgcatatcagcagccagggcct

SEQ ID NO: 430399 - DNA, 140 bp, Artificial Sequence
  Synthetic
aggccctggctgctgatatgtgcaagatgcctctccccacaaaactgagaccatcagccgctccaacagcacccccagccggggcagcagacagcatccgacccccaccctacagtccctgaccttttgggacagcggtg

SEQ ID NO: 430400 - DNA, 140 bp, Artificial Sequence
  Synthetic
caccgctgtcccaaaaggtcagggactgtagggtgggggtcggatgctgtctgctgccccggctgggggtgctgttggagcggctgatggtctcagttttgtggggagaggcatcttgcacatatcagcagccagggcct

SEQ ID NO: 430401 - DNA, 140 bp, Artificial Sequence
  Synthetic
atacgccatgctgggtctccaaagtgttgttggtaggtttgttgcagaatttaaatccagattttatgtgtggggggatgaggtccctttactaacaaaattcgttgctgcagccttacacgtacttgggagtcggccat

SEQ ID NO: 430402 - DNA, 140 bp, Artificial Sequence
  Synthetic
atggccgactcccaagtacgtgtaaggctgcagcaacgaattttgttagtaaagggacctcatccccccacacataaaatctggatttaaattctgcaacaaacctaccaacaacactttggagacccagcatggcgtat

SEQ ID NO: 430403 - DNA, 140 bp, Artificial Sequence
  Synthetic
aggccctggctgctgatatgtggggggatgaggtccctttactaacaaaattcgttgctgcagccttacacaatatcaaatgtaaggaaccccaccagttagcagagacaattgacacaagaccttttgggacagcggtg

SEQ ID NO: 430404 - DNA, 140 bp, Artificial Sequence
  Synthetic
caccgctgtcccaaaaggtcttgtgtcaattgtctctgctaactggtggggttccttacatttgatattgtgtaaggctgcagcaacgaattttgttagtaaagggacctcatccccccacatatcagcagccagggcct

SEQ ID NO: 430405 - DNA, 140 bp, Artificial Sequence
  Synthetic
atacgccatgctgggtctccattcagctaaggactttgagtctcctgcaatatgctaggtaccctatcgacccatttcttctaaactgtgaaacagacgttagagattgggtggatggtacgtacttgggagtcggccat

SEQ ID NO: 430406 - DNA, 140 bp, Artificial Sequence
  Synthetic
atggccgactcccaagtacgtaccatccacccaatctctaacgtctgtttcacagtttagaagaaatgggtcgatagggtacctagcatattgcaggagactcaaagtccttagctgaatggagacccagcatggcgtat

SEQ ID NO: 430407 - DNA, 140 bp, Artificial Sequence
  Synthetic
atacgccatgctgggtctcctgcagccctaagtgtggagacaatgtccacccctgaccattgcacccttaaccccagcctatctatcatcatgtcactcaatgccccaatcagcaggtcacgtacttgggagtcggccat

SEQ ID NO: 430408 - DNA, 140 bp, Artificial Sequence
  Synthetic
atggccgactcccaagtacgtgacctgctgattggggcattgagtgacatgatgatagataggctggggttaagggtgcaatggtcaggggtggacattgtctccacacttagggctgcaggagacccagcatggcgtat

SEQ ID NO: 430409 - DNA, 140 bp, Artificial Sequence
  Synthetic
aggccctggctgctgatatgaacccttccattaatagcatcctaggctctgtctgcacaagaaatgctaatttctgtcttgacaatctctcgttgtccgctaggtactttgatactaaatgaccttttgggacagcggtg

SEQ ID NO: 430410 - DNA, 140 bp, Artificial Sequence
  Synthetic
caccgctgtcccaaaaggtcatttagtatcaaagtacctagcggacaacgagagattgtcaagacagaaattagcatttcttgtgcagacagagcctaggatgctattaatggaagggttcatatcagcagccagggcct

SEQ ID NO: 430411 - DNA, 140 bp, Artificial Sequence
  Synthetic
atacgccatgctgggtctcccgggcaacttcatgaagagtttacaacaaactatctttctggtgaacatgcgtcctcacttaggaatttatgtaatatgttaggtgttgatcctccatcacgtacttgggagtcggccat

SEQ ID NO: 430412 - DNA, 140 bp, Artificial Sequence
  Synthetic
atggccgactcccaagtacgtgatggaggatcaacacctaacatattacataaattcctaagtgaggacgcatgttcaccagaaagatagtttgttgtaaactcttcatgaagttgcccgggagacccagcatggcgtat

SEQ ID NO: 430413 - DNA, 140 bp, Artificial Sequence
  Synthetic
aggccctggctgctgatatgcgtcctcacttaggaatttatgtaatatgttaggtgttgatcctccatcagaatctgatttagagttttcgtggttgaatctggctgcttaccaccctttgaccttttgggacagcggtg

SEQ ID NO: 430414 - DNA, 140 bp, Artificial Sequence
  Synthetic
caccgctgtcccaaaaggtcaaagggtggtaagcagccagattcaaccacgaaaactctaaatcagattctgatggaggatcaacacctaacatattacataaattcctaagtgaggacgcatatcagcagccagggcct

SEQ ID NO: 430415 - DNA, 140 bp, Artificial Sequence
  Synthetic
aggccctggctgctgatatggaggatcctttctacagacttatcttcactgttgtgttcacatccatttgcattgcaggagtcaacctcaatgcaaagggacaggagcttcaacccctccgaccttttgggacagcggtg

SEQ ID NO: 430416 - DNA, 140 bp, Artificial Sequence
  Synthetic
caccgctgtcccaaaaggtcggaggggttgaagctcctgtccctttgcattgaggttgactcctgcaatgcaaatggatgtgaacacaacagtgaagataagtctgtagaaaggatcctccatatcagcagccagggcct

SEQ ID NO: 430417 - DNA, 140 bp, Artificial Sequence
  Synthetic
atacgccatgctgggtctcctctcggtgtcaacataccatgctgatttgcccttgaaagtaggtcctgacaaaaccagtctccaacagtctgacaaaacacacggactcactgcacctgacgtacttgggagtcggccat

SEQ ID NO: 430418 - DNA, 140 bp, Artificial Sequence
  Synthetic
atggccgactcccaagtacgtcaggtgcagtgagtccgtgtgttttgtcagactgttggagactggttttgtcaggacctactttcaagggcaaatcagcatggtatgttgacaccgagaggagacccagcatggcgtat

SEQ ID NO: 430419 - DNA, 140 bp, Artificial Sequence
  Synthetic
aggccctggctgctgatatgtcaactttcactcgaggggcacagaaactgttatcagaagctataaataagtcagcattccagagctctattgcatctggctttgtgggcttgtgcaaaagaccttttgggacagcggtg

SEQ ID NO: 430420 - DNA, 140 bp, Artificial Sequence
  Synthetic
caccgctgtcccaaaaggtcttttgcacaagcccacaaagccagatgcaatagagctctggaatgctgacttatttatagcttctgataacagtttctgtgcccctcgagtgaaagttgacatatcagcagccagggcct

SEQ ID NO: 430421 - DNA, 140 bp, Artificial Sequence
  Synthetic
atacgccatgctgggtctccccggggatcctaggcatttttggttgcgcaattcaagtgtccttcctaacatgggacaaatagtgacatttttccaggaagtgcctcatgtgatagaggacgtacttgggagtcggccat

SEQ ID NO: 430422 - DNA, 140 bp, Artificial Sequence
  Synthetic
atggccgactcccaagtacgtcctctatcacatgaggcacttcctggaaaaatgtcactatttgtcccatgttaggaaggacacttgaattgcgcaaccaaaaatgcctaggatccccggggagacccagcatggcgtat

SEQ ID NO: 430423 - DNA, 140 bp, Artificial Sequence
  Synthetic
aggccctggctgctgatatgatgggacaaatagtgacatttttccaggaagtgcctcatgtgatagaggaggtgatgaacattgtactcatcgcactgtctatacttgcagtgctaaaaggaccttttgggacagcggtg

SEQ ID NO: 430424 - DNA, 140 bp, Artificial Sequence
  Synthetic
caccgctgtcccaaaaggtccttttagcactgcaagtatagacagtgcgatgagtacaatgttcatcacctcctctatcacatgaggcacttcctggaaaaatgtcactatttgtcccatcatatcagcagccagggcct

SEQ ID NO: 430425 - DNA, 140 bp, Artificial Sequence
  Synthetic
atacgccatgctgggtctccaagtccattcaatcattgatttctagcactcagggtattgagctcttaacgaacaattatgggatccagtattggagggttccatcaaaccttagaagggcgtacttgggagtcggccat

SEQ ID NO: 430426 - DNA, 140 bp, Artificial Sequence
  Synthetic
atggccgactcccaagtacgcccttctaaggtttgatggaaccctccaatactggatcccataattgttcgttaagagctcaataccctgagtgctagaaatcaatgattgaatggacttggagacccagcatggcgtat

SEQ ID NO: 430427 - DNA, 140 bp, Artificial Sequence
  Synthetic
aggccctggctgctgatatggaacaattatgggatccagtattggagggttccatcaaaccttagaagggaaaagaatagtgtggttggttattttagaccactgctatgggactatatggaccttttgggacagcggtg

SEQ ID NO: 430428 - DNA, 140 bp, Artificial Sequence
  Synthetic
caccgctgtcccaaaaggtccatatagtcccatagcagtggtctaaaataaccaaccacactattcttttcccttctaaggtttgatggaaccctccaatactggatcccataattgttccatatcagcagccagggcct

SEQ ID NO: 430429 - DNA, 140 bp, Artificial Sequence
  Synthetic
atacgccatgctgggtctcccaggcccaaacagctctgaacatgtccttccctttagtctcaggctgcccccacttgactgaatcataactctttgcttcgatttgctatagcaaagggccgtacttgggagtcggccat

SEQ ID NO: 430430 - DNA, 140 bp, Artificial Sequence
  Synthetic
atggccgactcccaagtacggccctttgctatagcaaatcgaagcaaagagttatgattcagtcaagtgggggcagcctgagactaaagggaaggacatgttcagagctgtttgggcctgggagacccagcatggcgtat

SEQ ID NO: 430431 - DNA, 140 bp, Artificial Sequence
  Synthetic
atacgccatgctgggtctccacctaaagcagccaaaccactggagtttttcaagcacaatccttgtgattatttccctttgaagccgactgcatcaaaactacttgaagacagggtgggtcgtacttgggagtcggccat

SEQ ID NO: 430432 - DNA, 140 bp, Artificial Sequence
  Synthetic
atggccgactcccaagtacgacccaccctgtcttcaagtagttttgatgcagtcggcttcaaagggaaataatcacaaggattgtgcttgaaaaactccagtggtttggctgctttaggtggagacccagcatggcgtat

SEQ ID NO: 430433 - DNA, 140 bp, Artificial Sequence
  Synthetic
aggccctggctgctgatatgatttccctttgaagccgactgcatcaaaactacttgaagacagggtgggtgttaatcatatcattcattctctaagaagactgtacccatcaatgtttgagaccttttgggacagcggtg

SEQ ID NO: 430434 - DNA, 140 bp, Artificial Sequence
  Synthetic
caccgctgtcccaaaaggtctcaaacattgatgggtacagtcttcttagagaatgaatgatatgattaacacccaccctgtcttcaagtagttttgatgcagtcggcttcaaagggaaatcatatcagcagccagggcct

SEQ ID NO: 430435 - DNA, 140 bp, Artificial Sequence
  Synthetic
atacgccatgctgggtctccggtcacccaggataaagtttctggatctttgtgtagcactagatgtgaactgtgaggctctatctcttgtgtcgcacatagtcaagtggaagagggaagacgtacttgggagtcggccat

SEQ ID NO: 430436 - DNA, 140 bp, Artificial Sequence
  Synthetic
atggccgactcccaagtacgtcttccctcttccacttgactatgtgcgacacaagagatagagcctcacagttcacatctagtgctacacaaagatccagaaactttatcctgggtgaccggagacccagcatggcgtat

SEQ ID NO: 430437 - DNA, 140 bp, Artificial Sequence
  Synthetic
aggccctggctgctgatatgtgtgaggctctatctcttgtgtcgcacatagtcaagtggaagagggaagaacattacatagtgttatcgtctgagttgaggttatctcatagcaggatccgaccttttgggacagcggtg

SEQ ID NO: 430438 - DNA, 140 bp, Artificial Sequence
  Synthetic
caccgctgtcccaaaaggtcggatcctgctatgagataacctcaactcagacgataacactatgtaatgttcttccctcttccacttgactatgtgcgacacaagagatagagcctcacacatatcagcagccagggcct

SEQ ID NO: 430439 - DNA, 140 bp, Artificial Sequence
  Synthetic
aggccctggctgctgatatggtcctcttctgaatttgattacacagatcaactgggacaccattagccacagattgatcaattatggtatcaattgtttctgccaattgatggggttcttgaccttttgggacagcggtg

SEQ ID NO: 430440 - DNA, 140 bp, Artificial Sequence
  Synthetic
caccgctgtcccaaaaggtcaagaaccccatcaattggcagaaacaattgataccataattgatcaatctgtggctaatggtgtcccagttgatctgtgtaatcaaattcagaagaggaccatatcagcagccagggcct

SEQ ID NO: 430441 - DNA, 140 bp, Artificial Sequence
  Synthetic
atacgccatgctgggtctccaacttcatgagacagatttattttgagtcttatgtgaggtcatttgtagctacaactagaactctaggatcctttacatggtttccacataagacaagcacgtacttgggagtcggccat

SEQ ID NO: 430442 - DNA, 140 bp, Artificial Sequence
  Synthetic
atggccgactcccaagtacgtgcttgtcttatgtggaaaccatgtaaaggatcctagagttctagttgtagctacaaatgacctcacataagactcaaaataaatctgtctcatgaagttggagacccagcatggcgtat

SEQ ID NO: 430443 - DNA, 140 bp, Artificial Sequence
  Synthetic
aggccctggctgctgatatgtacaactagaactctaggatcctttacatggtttccacataagacaagcatcccagagggtgaggggctacaaagactaggcccattttcttcatttgtggaccttttgggacagcggtg

SEQ ID NO: 430444 - DNA, 140 bp, Artificial Sequence
  Synthetic
caccgctgtcccaaaaggtccacaaatgaagaaaatgggcctagtctttgtagcccctcaccctctgggatgcttgtcttatgtggaaaccatgtaaaggatcctagagttctagttgtacatatcagcagccagggcct

SEQ ID NO: 430445 - DNA, 140 bp, Artificial Sequence
  Synthetic
atacgccatgctgggtctccaatgatgggctacgcttggatagatttcgatgttgaaccagctaagttcaatcaaaaccaattgattgcatcaggattggtcaattctaaatttgagtcacgtacttgggagtcggccat

SEQ ID NO: 430446 - DNA, 140 bp, Artificial Sequence
  Synthetic
atggccgactcccaagtacgtgactcaaatttagaattgaccaatcctgatgcaatcaattggttttgattgaacttagctggttcaacatcgaaatctatccaagcgtagcccatcattggagacccagcatggcgtat

SEQ ID NO: 430447 - DNA, 140 bp, Artificial Sequence
  Synthetic
aggccctggctgctgatatgatcaaaaccaattgattgcatcaggattggtcaattctaaatttgagtcacttgaagacttttttactgctattgaatcacttcctccaggttccgcaaagaccttttgggacagcggtg

SEQ ID NO: 430448 - DNA, 140 bp, Artificial Sequence
  Synthetic
caccgctgtcccaaaaggtctttgcggaacctggaggaagtgattcaatagcagtaaaaaagtcttcaagtgactcaaatttagaattgaccaatcctgatgcaatcaattggttttgatcatatcagcagccagggcct

SEQ ID NO: 430449 - DNA, 140 bp, Artificial Sequence
  Synthetic
aggccctggctgctgatatgtagggaccttttcatcctccagatttacagcaccagaatagattatcttctgtcgcaacaccattctgagcggatgatgggtagctaaattcaaccaatggaccttttgggacagcggtg

SEQ ID NO: 430450 - DNA, 140 bp, Artificial Sequence
  Synthetic
caccgctgtcccaaaaggtccattggttgaatttagctacccatcatccgctcagaatggtgttgcgacagaagataatctattctggtgctgtaaatctggaggatgaaaaggtccctacatatcagcagccagggcct

SEQ ID NO: 430451 - DNA, 140 bp, Artificial Sequence
  Synthetic
atacgccatgctgggtctccaagagaattttgccattcacctcaactttgttggctcaataaatgaacaaggaaaatatttggttcaagatgtggtagctatgtactctggtgcagtgaacgtacttgggagtcggccat

SEQ ID NO: 430452 - DNA, 140 bp, Artificial Sequence
  Synthetic
atggccgactcccaagtacgttcactgcaccagagtacatagctaccacatcttgaaccaaatattttccttgttcatttattgagccaacaaagttgaggtgaatggcaaaattctcttggagacccagcatggcgtat

SEQ ID NO: 430453 - DNA, 140 bp, Artificial Sequence
  Synthetic
aggccctggctgctgatatgggaaaatatttggttcaagatgtggtagctatgtactctggtgcagtgaactcctgtgttttatcagattgttggagattggtgctgtctggtccaacctgaccttttgggacagcggtg

SEQ ID NO: 430454 - DNA, 140 bp, Artificial Sequence
  Synthetic
caccgctgtcccaaaaggtcaggttggaccagacagcaccaatctccaacaatctgataaaacacaggagttcactgcaccagagtacatagctaccacatcttgaaccaaatattttcccatatcagcagccagggcct

SEQ ID NO: 430455 - DNA, 140 bp, Artificial Sequence
  Synthetic
atacgccatgctgggtctccatgaatgacacaaatcagttagggaaggtgacccctgttgaaattgtcattgatgccgatagattacaatttatggaacatgattttgttttggtgggcccgtacttgggagtcggccat

SEQ ID NO: 430456 - DNA, 140 bp, Artificial Sequence
  Synthetic
atggccgactcccaagtacgggcccaccaaaacaaaatcatgttccataaattgtaatctatcggcatcaatgacaatttcaacaggggtcaccttccctaactgatttgtgtcattcatggagacccagcatggcgtat

SEQ ID NO: 430457 - DNA, 140 bp, Artificial Sequence
  Synthetic
aggccctggctgctgatatgtgatgccgatagattacaatttatggaacatgattttgttttggtgggcccttgttctgaatcagttcctttggttgtacatagaggtgggttgtgggaggaccttttgggacagcggtg

SEQ ID NO: 430458 - DNA, 140 bp, Artificial Sequence
  Synthetic
caccgctgtcccaaaaggtcctcccacaacccacctctatgtacaaccaaaggaactgattcagaacaagggcccaccaaaacaaaatcatgttccataaattgtaatctatcggcatcacatatcagcagccagggcct

SEQ ID NO: 430459 - DNA, 140 bp, Artificial Sequence
  Synthetic
atacgccatgctgggtctcctgagttatttgtaaaagaagttggtgatacatctcctagcctgctgagtggggcattgagtgccatgatatcagatagattgaggttaagaatgcagtggcgtacttgggagtcggccat

SEQ ID NO: 430460 - DNA, 140 bp, Artificial Sequence
  Synthetic
atggccgactcccaagtacgccactgcattcttaacctcaatctatctgatatcatggcactcaatgccccactcagcaggctaggagatgtatcaccaacttcttttacaaataactcaggagacccagcatggcgtat

SEQ ID NO: 430461 - DNA, 140 bp, Artificial Sequence
  Synthetic
aggccctggctgctgatatggggcattgagtgccatgatatcagatagattgaggttaagaatgcagtggtcaggggtggacattgtctctgtattgaagagggtcatgcccaacaatgggaccttttgggacagcggtg

SEQ ID NO: 430462 - DNA, 140 bp, Artificial Sequence
  Synthetic
caccgctgtcccaaaaggtcccattgttgggcatgaccctcttcaatacagagacaatgtccacccctgaccactgcattcttaacctcaatctatctgatatcatggcactcaatgccccatatcagcagccagggcct

SEQ ID NO: 430463 - DNA, 140 bp, Artificial Sequence
  Synthetic
atacgccatgctgggtctccttaagggctatgcactatgcttcagtaagtcaaggagaagaattatgatacagtccagtagtggaaagttgaggttgaaaggcagaacatgtgaagagctcgtacttgggagtcggccat

SEQ ID NO: 430464 - DNA, 140 bp, Artificial Sequence
  Synthetic
atggccgactcccaagtacgagctcttcacatgttctgcctttcaacctcaactttccactactggactgtatcataattcttctccttgacttactgaagcatagtgcatagcccttaaggagacccagcatggcgtat

SEQ ID NO: 430465 - DNA, 140 bp, Artificial Sequence
  Synthetic
aggccctggctgctgatatgcagtccagtagtggaaagttgaggttgaaaggcagaacatgtgaagagcttctcagggaagaagaacaggtcgaagacatagaataactgcccgagcgtggaccttttgggacagcggtg

SEQ ID NO: 430466 - DNA, 140 bp, Artificial Sequence
  Synthetic
caccgctgtcccaaaaggtccacgctcgggcagttattctatgtcttcgacctgttcttcttccctgagaagctcttcacatgttctgcctttcaacctcaactttccactactggactgcatatcagcagccagggcct

SEQ ID NO: 430467 - DNA, 140 bp, Artificial Sequence
  Synthetic
atacgccatgctgggtctccggggggaaggggtgattgtgctgtgtgttgaacgggttagggtgtgtatggtgggggattggtgatgctctccctggtgatttgtggtgctgttggcgtgcgtacttgggagtcggccat

SEQ ID NO: 430468 - DNA, 140 bp, Artificial Sequence
  Synthetic
atggccgactcccaagtacgcacgccaacagcaccacaaatcaccagggagagcatcaccaatcccccaccatacacaccctaacccgttcaacacacagcacaatcaccccttccccccggagacccagcatggcgtat

SEQ ID NO: 430469 - DNA, 140 bp, Artificial Sequence
  Synthetic
aggccctggctgctgatatggtgggggattggtgatgctctccctggtgatttgtggtgctgttggcgtggttatcggcttgagcttcgtgggaagaggcatcttacagatagggcacctgaccttttgggacagcggtg

SEQ ID NO: 430470 - DNA, 140 bp, Artificial Sequence
  Synthetic
caccgctgtcccaaaaggtcaggtgccctatctgtaagatgcctcttcccacgaagctcaagccgataaccacgccaacagcaccacaaatcaccagggagagcatcaccaatcccccaccatatcagcagccagggcct

SEQ ID NO: 430471 - DNA, 140 bp, Artificial Sequence
  Synthetic
atacgccatgctgggtctcctgttacactcaactaaacctttgttttcaaaccaacaactcttgcaaaattgtggtccaaggtgcgtggcatccggaatgagactggcccttgggctgctcgtacttgggagtcggccat

SEQ ID NO: 430472 - DNA, 140 bp, Artificial Sequence
  Synthetic
atggccgactcccaagtacgagcagcccaagggccagtctcattccggatgccacgcaccttggaccacaattttgcaagagttgttggtttgaaaacaaaggtttagttgagtgtaacaggagacccagcatggcgtat

SEQ ID NO: 430473 - DNA, 140 bp, Artificial Sequence
  Synthetic
atacgccatgctgggtctccctctgtctttggatctttggcttgcttattccccatttgctgagcctaagttgtgaagctctgtagaggaacgatcaaattgcctaggatcccccggtgccgtacttgggagtcggccat

SEQ ID NO: 430474 - DNA, 140 bp, Artificial Sequence
  Synthetic
atggccgactcccaagtacggcaccgggggatcctaggcaatttgatcgttcctctacagagcttcacaacttaggctcagcaaatggggaataagcaagccaaagatccaaagacagagggagacccagcatggcgtat

SEQ ID NO: 430475 - DNA, 140 bp, Artificial Sequence
  Synthetic
aggccctggctgctgatatggagggtctcgcagtgtcttctttacttccttttctttaaacaatgaaccattattaaaactagacacaaggagtgaaataaatttcttggaaacaccagggaccttttgggacagcggtg

SEQ ID NO: 430476 - DNA, 140 bp, Artificial Sequence
  Synthetic
caccgctgtcccaaaaggtccctggtgtttccaagaaatttatttcactccttgtgtctagttttaataatggttcattgtttaaagaaaaggaagtaaagaagacactgcgagaccctccatatcagcagccagggcct

SEQ ID NO: 430477 - DNA, 140 bp, Artificial Sequence
  Synthetic
atacgccatgctgggtctccgaatggacttgaggatgccatccattgtctgaggcgacaccttgactgtctccagcatgttaccaccgtctagcatgcaagctcctgcctttacagctgccgtacttgggagtcggccat

SEQ ID NO: 430478 - DNA, 140 bp, Artificial Sequence
  Synthetic
atggccgactcccaagtacggcagctgtaaaggcaggagcttgcatgctagacggtggtaacatgctggagacagtcaaggtgtcgcctcagacaatggatggcatcctcaagtccattcggagacccagcatggcgtat

SEQ ID NO: 430479 - DNA, 140 bp, Artificial Sequence
  Synthetic
atacgccatgctgggtctccctatcatttttagaatggggtggctctgagccagtctgtctaagtctgaaatgttggggtattttgctgtgtagatcagacccaaatctgttagcgcttgcgtacttgggagtcggccat

SEQ ID NO: 430480 - DNA, 140 bp, Artificial Sequence
  Synthetic
atggccgactcccaagtacgcaagcgctaacagatttgggtctgatctacacagcaaaataccccaacatttcagacttagacagactggctcagagccaccccattctaaaaatgatagggagacccagcatggcgtat

SEQ ID NO: 430481 - DNA, 140 bp, Artificial Sequence
  Synthetic
aggccctggctgctgatatgcttcaatcagtatgaggcaatgagttgtgacttcaatggggggaagataagtgttcagtacaaccttagccacacttatgctgtagatgcagctaaccacgaccttttgggacagcggtg

SEQ ID NO: 430482 - DNA, 140 bp, Artificial Sequence
  Synthetic
caccgctgtcccaaaaggtcgtggttagctgcatctacagcataagtgtggctaaggttgtactgaacacttatcttccccccattgaagtcacaactcattgcctcatactgattgaagcatatcagcagccagggcct

SEQ ID NO: 430483 - DNA, 140 bp, Artificial Sequence
  Synthetic
atacgccatgctgggtctccttagacttggcatggtgccgaactgattgttaagcaagtccgcattttttacatcccaaattctcaccactccatctttcccggtccgagccccttgattcgtacttgggagtcggccat

SEQ ID NO: 430484 - DNA, 140 bp, Artificial Sequence
  Synthetic
atggccgactcccaagtacgaatcaaggggctcggaccgggaaagatggagtggtgagaatttgggatgtaaaaaatgcggacttgcttaacaatcagttcggcaccatgccaagtctaaggagacccagcatggcgtat

SEQ ID NO: 430485 - DNA, 140 bp, Artificial Sequence
  Synthetic
aggccctggctgctgatatgacatcccaaattctcaccactccatctttcccggtccgagccccttgattaccaccgctcattcctatcatgtttaggagagcccgtctctggtcaagttgaccttttgggacagcggtg

SEQ ID NO: 430486 - DNA, 140 bp, Artificial Sequence
  Synthetic
caccgctgtcccaaaaggtcaacttgaccagagacgggctctcctaaacatgataggaatgagcggtggtaatcaaggggctcggaccgggaaagatggagtggtgagaatttgggatgtcatatcagcagccagggcct

SEQ ID NO: 430487 - DNA, 140 bp, Artificial Sequence
  Synthetic
atacgccatgctgggtctccgttgtgaactcaagttgcccatataaactcctgcactcaatggcctttctgtcctggttacttttgatttaagtttctctaggtcagcagccaaagtcagcgtacttgggagtcggccat

SEQ ID NO: 430488 - DNA, 140 bp, Artificial Sequence
  Synthetic
atggccgactcccaagtacgctgactttggctgctgacctagagaaacttaaatcaaaagtaaccaggacagaaaggccattgagtgcaggagtttatatgggcaacttgagttcacaacggagacccagcatggcgtat

SEQ ID NO: 430489 - DNA, 140 bp, Artificial Sequence
  Synthetic
aggccctggctgctgatatggtccttgttgacactgcctttgtcaactctccaataggacactgtgacatatgtccacagtaaaaatacttctctttcaatctactattctcatagacaggaccttttgggacagcggtg

SEQ ID NO: 430490 - DNA, 140 bp, Artificial Sequence
  Synthetic
caccgctgtcccaaaaggtcctgtctatgagaatagtagattgaaagagaagtatttttactgtggacatatgtcacagtgtcctattggagagttgacaaaggcagtgtcaacaaggaccatatcagcagccagggcct

SEQ ID NO: 430491 - DNA, 140 bp, Artificial Sequence
  Synthetic
atacgccatgctgggtctcctcaccacctgtagtttaatattggaacaataaccagacagttccctcctcaaagattgtgtccacaagaaggactttatctcctttgaggcgctcattgtcgtacttgggagtcggccat

SEQ ID NO: 430492 - DNA, 140 bp, Artificial Sequence
  Synthetic
atggccgactcccaagtacgacaatgagcgcctcaaaggagataaagtccttcttgtggacacaatctttgaggagggaactgtctggttattgttccaatattaaactacaggtggtgaggagacccagcatggcgtat

SEQ ID NO: 430493 - DNA, 140 bp, Artificial Sequence
  Synthetic
aggccctggctgctgatatgttgtcaggttgttgtgttgagtgcacacagcaaagagtcaagactatctgctgaatgacaagagcaaagcgcaatccaatagcctaggatccactgtgcggaccttttgggacagcggtg

SEQ ID NO: 430494 - DNA, 140 bp, Artificial Sequence
  Synthetic
caccgctgtcccaaaaggtccgcacagtggatcctaggctattggattgcgctttgctcttgtcattcagcagatagtcttgactctttgctgtgtgcactcaacacaacaacctgacaacatatcagcagccagggcct

SEQ ID NO: 430495 - DNA, 140 bp, Artificial Sequence
  Synthetic
atacgccatgctgggtctccccggggatcctaggcaatttggttgttcttctttttaggtcatttttgccaaactccaccagatgggaaacaagcaagtcaagacctcagaggcaagggacgtacttgggagtcggccat

SEQ ID NO: 430496 - DNA, 140 bp, Artificial Sequence
  Synthetic
atggccgactcccaagtacgtcccttgcctctgaggtcttgacttgcttgtttcccatctggtggagtttggcaaaaatgacctaaaaagaagaacaaccaaattgcctaggatccccggggagacccagcatggcgtat

SEQ ID NO: 430497 - DNA, 140 bp, Artificial Sequence
  Synthetic
aggccctggctgctgatatgaaactccaccagatgggaaacaagcaagtcaagacctcagaggcaagggacagcccaagggccagtctgattccggacgctacagacctaggaccacagtgaccttttgggacagcggtg

SEQ ID NO: 430498 - DNA, 140 bp, Artificial Sequence
  Synthetic
caccgctgtcccaaaaggtcactgtggtcctaggtctgtagcgtccggaatcagactggcccttgggctgtcccttgcctctgaggtcttgacttgcttgtttcccatctggtggagtttcatatcagcagccagggcct

SEQ ID NO: 430499 - DNA, 140 bp, Artificial Sequence
  Synthetic
atacgccatgctgggtctcccagcccaagggccagtctgattccggacgctacagacctaggaccacagttctgtaagagctgctggttcgaaaacaagggtctggttgagtgtaacaatcgtacttgggagtcggccat

SEQ ID NO: 430500 - DNA, 140 bp, Artificial Sequence
  Synthetic
atggccgactcccaagtacgattgttacactcaaccagacccttgttttcgaaccagcagctcttacagaactgtggtcctaggtctgtagcgtccggaatcagactggcccttgggctgggagacccagcatggcgtat

SEQ ID NO: 430501 - DNA, 140 bp, Artificial Sequence
  Synthetic
atacgccatgctgggtctccgtgtcccatctgcaagatgccccttcccacaagactaaggccatcagccaacccaacagcacccccagccgaaacaggggacagcaccagacctccaccccgtacttgggagtcggccat

SEQ ID NO: 430502 - DNA, 140 bp, Artificial Sequence
  Synthetic
atggccgactcccaagtacggggtggaggtctggtgctgtcccctgtttcggctgggggtgctgttgggttggctgatggccttagtcttgtgggaaggggcatcttgcagatgggacacggagacccagcatggcgtat

SEQ ID NO: 430503 - DNA, 140 bp, Artificial Sequence
  Synthetic
aggccctggctgctgatatgacccaacagcacccccagccgaaacaggggacagcaccagacctccaccctacagcccctgaaccgcccaccaatccccaccactcctcccaccccccgagaccttttgggacagcggtg

SEQ ID NO: 430504 - DNA, 140 bp, Artificial Sequence
  Synthetic
caccgctgtcccaaaaggtctcggggggtgggaggagtggtggggattggtgggcggttcaggggctgtagggtggaggtctggtgctgtcccctgtttcggctgggggtgctgttgggtcatatcagcagccagggcct

SEQ ID NO: 430505 - DNA, 140 bp, Artificial Sequence
  Synthetic
atacgccatgctgggtctcccctccgaggaactactcaatgtcctcaacatactcatctttctcagttaactcctcacatgttctgccttttagccttaatcttccactgcttgattgcacgtacttgggagtcggccat

SEQ ID NO: 430506 - DNA, 140 bp, Artificial Sequence
  Synthetic
atggccgactcccaagtacgtgcaatcaagcagtggaagattaaggctaaaaggcagaacatgtgaggagttaactgagaaagatgagtatgttgaggacattgagtagttcctcggaggggagacccagcatggcgtat

SEQ ID NO: 430507 - DNA, 140 bp, Artificial Sequence
  Synthetic
aggccctggctgctgatatgctcctcacatgttctgccttttagccttaatcttccactgcttgattgcaccatcactttcttctttgatttgctgtagcagagagcataacctttaaatgaccttttgggacagcggtg

SEQ ID NO: 430508 - DNA, 140 bp, Artificial Sequence
  Synthetic
caccgctgtcccaaaaggtcatttaaaggttatgctctctgctacagcaaatcaaagaagaaagtgatggtgcaatcaagcagtggaagattaaggctaaaaggcagaacatgtgaggagcatatcagcagccagggcct

SEQ ID NO: 430509 - DNA, 140 bp, Artificial Sequence
  Synthetic
aggccctggctgctgatatgtcccttcagtcttaggctgcccccacttgactgaatcataactctttgctttgatttgctatagcaaagagcatagcctttgaaatcaatccattctccagaccttttgggacagcggtg

SEQ ID NO: 430510 - DNA, 140 bp, Artificial Sequence
  Synthetic
caccgctgtcccaaaaggtctggagaatggattgatttcaaaggctatgctctttgctatagcaaatcaaagcaaagagttatgattcagtcaagtgggggcagcctaagactgaagggacatatcagcagccagggcct

SEQ ID NO: 430511 - DNA, 140 bp, Artificial Sequence
  Synthetic
atacgccatgctgggtctccacttggtgctgcagccctcagcgtggaaacgatgtccacccctgaccactgcattctcaaccccagtctgtctgtgaccatatcacttaatgtcctgatccgtacttgggagtcggccat

SEQ ID NO: 430512 - DNA, 140 bp, Artificial Sequence
  Synthetic
atggccgactcccaagtacggatcaggacattaagtgatatggtcacagacagactggggttgagaatgcagtggtcaggggtggacatcgtttccacgctgagggctgcagcaccaagtggagacccagcatggcgtat

SEQ ID NO: 430513 - DNA, 140 bp, Artificial Sequence
  Synthetic
atacgccatgctgggtctccggggatcctaggcaatttagctggacttcagtggtgagactcattttagtgaatccctgaattaaagtgcctagtcaaaatgggcaacaggcaggccaaacgtacttgggagtcggccat

SEQ ID NO: 430514 - DNA, 140 bp, Artificial Sequence
  Synthetic
atggccgactcccaagtacgtttggcctgcctgttgcccattttgactaggcactttaattcagggattcactaaaatgagtctcaccactgaagtccagctaaattgcctaggatccccggagacccagcatggcgtat

SEQ ID NO: 430515 - DNA, 140 bp, Artificial Sequence
  Synthetic
atacgccatgctgggtctccatagacctcctctatgtacaaccagagggactggttcagtgcaagggcccaccaatacgaagtcatactctgtaaactgcagcttttccatgtcaacaaccgtacttgggagtcggccat

SEQ ID NO: 430516 - DNA, 140 bp, Artificial Sequence
  Synthetic
atggccgactcccaagtacggttgttgacatggaaaagctgcagtttacagagtatgacttcgtattggtgggcccttgcactgaaccagtccctctggttgtacatagaggaggtctatggagacccagcatggcgtat

SEQ ID NO: 430517 - DNA, 140 bp, Artificial Sequence
  Synthetic
aggccctggctgctgatatgaccaatacgaagtcatactctgtaaactgcagcttttccatgtcaacaacaacctcaacaggagtcacatgccccagttgatttgtgtcaaccaaaaactgaccttttgggacagcggtg

SEQ ID NO: 430518 - DNA, 140 bp, Artificial Sequence
  Synthetic
caccgctgtcccaaaaggtcagtttttggttgacacaaatcaactggggcatgtgactcctgttgaggttgttgttgacatggaaaagctgcagtttacagagtatgacttcgtattggtcatatcagcagccagggcct

SEQ ID NO: 430519 - DNA, 140 bp, Artificial Sequence
  Synthetic
atacgccatgctgggtctccggtcctgataaaaccaatctccaacagtctgacaagacacatgggcttactgcaccagaatacataacagttacatcgtgtaccaaatacttggcctgttcgtacttgggagtcggccat

SEQ ID NO: 430520 - DNA, 140 bp, Artificial Sequence
  Synthetic
atggccgactcccaagtacgaacaggccaagtatttggtacacgatgtaactgttatgtattctggtgcagtaagcccatgtgtcttgtcagactgttggagattggttttatcaggaccggagacccagcatggcgtat

SEQ ID NO: 430521 - DNA, 140 bp, Artificial Sequence
  Synthetic
aggccctggctgctgatatgtgcaccagaatacataacagttacatcgtgtaccaaatacttggcctgttgattcatagtgccagtgtaatcaaggtggatggcaaagctctccttaaaagaccttttgggacagcggtg

SEQ ID NO: 430522 - DNA, 140 bp, Artificial Sequence
  Synthetic
caccgctgtcccaaaaggtcttttaaggagagctttgccatccaccttgattacactggcactatgaatcaacaggccaagtatttggtacacgatgtaactgttatgtattctggtgcacatatcagcagccagggcct

SEQ ID NO: 430523 - DNA, 140 bp, Artificial Sequence
  Synthetic
atacgccatgctgggtctccagaccctgaaggtaatgatgcaacagcatcaaaaaaatcctctaatgagtcaaatctagaatcaaccaaacctgatgcaatcaattgattttgattaaaccgtacttgggagtcggccat

SEQ ID NO: 430524 - DNA, 140 bp, Artificial Sequence
  Synthetic
atggccgactcccaagtacggtttaatcaaaatcaattgattgcatcaggtttggttgattctagatttgactcattagaggatttttttgatgctgttgcatcattaccttcagggtctggagacccagcatggcgtat

SEQ ID NO: 430525 - DNA, 140 bp, Artificial Sequence
  Synthetic
aggccctggctgctgatatgcaaatctagaatcaaccaaacctgatgcaatcaattgattttgattaaaccttgctggctcaatgtcaaagtctatccaggcataacccatcatcaggtcgaccttttgggacagcggtg

SEQ ID NO: 430526 - DNA, 140 bp, Artificial Sequence
  Synthetic
caccgctgtcccaaaaggtcgacctgatgatgggttatgcctggatagactttgacattgagccagcaaggtttaatcaaaatcaattgattgcatcaggtttggttgattctagatttgcatatcagcagccagggcct

SEQ ID NO: 430527 - DNA, 140 bp, Artificial Sequence
  Synthetic
aggccctggctgctgatatgacctgtattgggtttgggtttatgccagaaaggcttgtaggacaactggcggtgccccacaaaagctcttacagaaatgagagacaatatgcctaggatcgaccttttgggacagcggtg

SEQ ID NO: 430528 - DNA, 140 bp, Artificial Sequence
  Synthetic
caccgctgtcccaaaaggtcgatcctaggcatattgtctctcatttctgtaagagcttttgtggggcaccgccagttgtcctacaagcctttctggcataaacccaaacccaatacaggtcatatcagcagccagggcct

SEQ ID NO: 430529 - DNA, 140 bp, Artificial Sequence
  Synthetic
atacgccatgctgggtctccatgaggaaaatggacccagtctatgcagtccttcaccctctggaatcgatgtcttatgtggaaaccaggtaaaggatcccaatgttcttgttgtcgcaaccgtacttgggagtcggccat

SEQ ID NO: 430530 - DNA, 140 bp, Artificial Sequence
  Synthetic
atggccgactcccaagtacggttgcgacaacaagaacattgggatcctttacctggtttccacataagacatcgattccagagggtgaaggactgcatagactgggtccattttcctcatggagacccagcatggcgtat

SEQ ID NO: 430531 - DNA, 140 bp, Artificial Sequence
  Synthetic
atacgccatgctgggtctcccagcatcactagtactcaccactctttcttccaccatgggttcgtgtgttctagtatgagacaacctcaattcagaagatagcacaatataatgttcctccgtacttgggagtcggccat

SEQ ID NO: 430532 - DNA, 140 bp, Artificial Sequence
  Synthetic
atggccgactcccaagtacggaggaacattatattgtgctatcttctgaattgaggttgtctcatactagaacacacgaacccatggtggaagaaagagtggtgagtactagtgatgctgggagacccagcatggcgtat

SEQ ID NO: 430533 - DNA, 140 bp, Artificial Sequence
  Synthetic
aggccctggctgctgatatgctagtatgagacaacctcaattcagaagatagcacaatataatgttcctctcttttccatttcactatgtgtgaaacaagagatagagcttcacagttgagaccttttgggacagcggtg

SEQ ID NO: 430534 - DNA, 140 bp, Artificial Sequence
  Synthetic
caccgctgtcccaaaaggtctcaactgtgaagctctatctcttgtttcacacatagtgaaatggaaaagagaggaacattatattgtgctatcttctgaattgaggttgtctcatactagcatatcagcagccagggcct

SEQ ID NO: 430535 - DNA, 140 bp, Artificial Sequence
  Synthetic
aggccctggctgctgatatgaatatttgcatacaaaaatctcaatattggtgatgctctcttgaactgataaattaagtgttcgatattgtcttctgcagctaccttatcagcgtacagagaccttttgggacagcggtg

SEQ ID NO: 430536 - DNA, 140 bp, Artificial Sequence
  Synthetic
caccgctgtcccaaaaggtctctgtacgctgataaggtagctgcagaagacaatatcgaacacttaatttatcagttcaagagagcatcaccaatattgagatttttgtatgcaaatattcatatcagcagccagggcct

SEQ ID NO: 430537 - DNA, 140 bp, Artificial Sequence
  Synthetic
aggccctggctgctgatatgaaattaagtgttcgatattgtcttctgcagctaccttatcagcgtacagattattaagttcattaagcaactggctcttatcaacctttaaaaactgaccgaccttttgggacagcggtg

SEQ ID NO: 430538 - DNA, 140 bp, Artificial Sequence
  Synthetic
caccgctgtcccaaaaggtcggtcagtttttaaaggttgataagagccagttgcttaatgaacttaataatctgtacgctgataaggtagctgcagaagacaatatcgaacacttaatttcatatcagcagccagggcct

SEQ ID NO: 430539 - DNA, 140 bp, Artificial Sequence
  Synthetic
atacgccatgctgggtctccaatagcattctcggctctgtctgaactaggaaggctagcttctgttttgaaagcctctcatcctctaagaggtacctgctcacaagatctttgctctcggcgtacttgggagtcggccat

SEQ ID NO: 430540 - DNA, 140 bp, Artificial Sequence
  Synthetic
atggccgactcccaagtacgccgagagcaaagatcttgtgagcaggtacctcttagaggatgagaggctttcaaaacagaagctagccttcctagttcagacagagccgagaatgctattggagacccagcatggcgtat

SEQ ID NO: 430541 - DNA, 140 bp, Artificial Sequence
  Synthetic
atacgccatgctgggtctcccaagggttatgcttgaagaaatctagtgccttagtcgtctttggttcacccaagacccatgcacctagttctattgcagtcgataaggaaatgcacatgtcgtacttgggagtcggccat

SEQ ID NO: 430542 - DNA, 140 bp, Artificial Sequence
  Synthetic
atggccgactcccaagtacgacatgtgcatttccttatcgactgcaatagaactaggtgcatgggtcttgggtgaaccaaagacgactaaggcactagatttcttcaagcataacccttgggagacccagcatggcgtat

SEQ ID NO: 430543 - DNA, 140 bp, Artificial Sequence
  Synthetic
aggccctggctgctgatatgcaagacccatgcacctagttctattgcagtcgataaggaaatgcacatgtagtcccataacagaggtctaaaataactaaccacagcttcacctctgtttgaccttttgggacagcggtg

SEQ ID NO: 430544 - DNA, 140 bp, Artificial Sequence
  Synthetic
caccgctgtcccaaaaggtcaaacagaggtgaagctgtggttagttattttagacctctgttatgggactacatgtgcatttccttatcgactgcaatagaactaggtgcatgggtcttgcatatcagcagccagggcct

SEQ ID NO: 430545 - DNA, 140 bp, Artificial Sequence
  Synthetic
atacgccatgctgggtctcccaattcgatcccctgagtaccagaaattgaagactgtatggatttaatatatagattctctttatttggcccccgaacacatttgctacccagtgttctacgtacttgggagtcggccat

SEQ ID NO: 430546 - DNA, 140 bp, Artificial Sequence
  Synthetic
atggccgactcccaagtacgtagaacactgggtagcaaatgtgttcgggggccaaataaagagaatctatatattaaatccatacagtcttcaatttctggtactcaggggatcgaattgggagacccagcatggcgtat

SEQ ID NO: 430547 - DNA, 140 bp, Artificial Sequence
  Synthetic
aggccctggctgctgatatgatagattctctttatttggcccccgaacacatttgctacccagtgttctacacagacccacaaagccagatgcaatagaactttgaaatgcagatttattgaccttttgggacagcggtg

SEQ ID NO: 430548 - DNA, 140 bp, Artificial Sequence
  Synthetic
caccgctgtcccaaaaggtcaataaatctgcatttcaaagttctattgcatctggctttgtgggtctgtgtagaacactgggtagcaaatgtgttcgggggccaaataaagagaatctatcatatcagcagccagggcct

SEQ ID NO: 430549 - DNA, 140 bp, Artificial Sequence
  Synthetic
atacgccatgctgggtctccgcttattctgaatagtcttaacaatagtgggtatcttctcatcatctaggttcacagcacctgaataaataattttttgcctcaacaccatccttaaaggcgtacttgggagtcggccat

SEQ ID NO: 430550 - DNA, 140 bp, Artificial Sequence
  Synthetic
atggccgactcccaagtacgcctttaaggatggtgttgaggcaaaaaattatttattcaggtgctgtgaacctagatgatgagaagatacccactattgttaagactattcagaataagcggagacccagcatggcgtat

SEQ ID NO: 430551 - DNA, 140 bp, Artificial Sequence
  Synthetic
aggccctggctgctgatatgttcacagcacctgaataaataattttttgcctcaacaccatccttaaagggtggtgtgcagctaaatttagccaagaatactcaaggtcagactcagatggaccttttgggacagcggtg

SEQ ID NO: 430552 - DNA, 140 bp, Artificial Sequence
  Synthetic
caccgctgtcccaaaaggtccatctgagtctgaccttgagtattcttggctaaatttagctgcacaccaccctttaaggatggtgttgaggcaaaaaattatttattcaggtgctgtgaacatatcagcagccagggcct

SEQ ID NO: 430553 - DNA, 140 bp, Artificial Sequence
  Synthetic
aggccctggctgctgatatggcaggagtcaacctcaatacagagggacaagagtttcaacccttccattaatagcattctaggctctgtctgcacaagaaatgccaacttctgtcttgacgaccttttgggacagcggtg

SEQ ID NO: 430554 - DNA, 140 bp, Artificial Sequence
  Synthetic
caccgctgtcccaaaaggtcgtcaagacagaagttggcatttcttgtgcagacagagcctagaatgctattaatggaagggttgaaactcttgtccctctgtattgaggttgactcctgccatatcagcagccagggcct

SEQ ID NO: 430555 - DNA, 140 bp, Artificial Sequence
  Synthetic
atacgccatgctgggtctcctcactagacagatagtttgttgtgaactcctcatggagttgcccggtctttaacctgttgtacagctttcttagcatagacctaatcttactgcaagcgtcgtacttgggagtcggccat

SEQ ID NO: 430556 - DNA, 140 bp, Artificial Sequence
  Synthetic
atggccgactcccaagtacgacgcttgcagtaagattaggtctatgctaagaaagctgtacaacaggttaaagaccgggcaactccatgaggagttcacaacaaactatctgtctagtgaggagacccagcatggcgtat

SEQ ID NO: 430557 - DNA, 140 bp, Artificial Sequence
  Synthetic
aggccctggctgctgatatgtaacctgttgtacagctttcttagcatagacctaatcttactgcaagcgtcaggaatcaacccctctatttgcctcataattctataactacggttgccagaccttttgggacagcggtg

SEQ ID NO: 430558 - DNA, 140 bp, Artificial Sequence
  Synthetic
caccgctgtcccaaaaggtctggcaaccgtagttatagaattatgaggcaaatagaggggttgattcctgacgcttgcagtaagattaggtctatgctaagaaagctgtacaacaggttacatatcagcagccagggcct

SEQ ID NO: 430559 - DNA, 140 bp, Artificial Sequence
  Synthetic
atacgccatgctgggtctccaacatgtggtttactggagcaacggttcactatggaatgaggacccgtagggggcacaaaagacacaagagtcaattaaaagcaattaaattagatagcccgtacttgggagtcggccat

SEQ ID NO: 430560 - DNA, 140 bp, Artificial Sequence
  Synthetic
atggccgactcccaagtacgggctatctaatttaattgcttttaattgactcttgtgtcttttgtgccccctacgggtcctcattccatagtgaaccgttgctccagtaaaccacatgttggagacccagcatggcgtat

SEQ ID NO: 430561 - DNA, 140 bp, Artificial Sequence
  Synthetic
atacgccatgctgggtctccagggtatctggcatattgtaaaagactcaaggtcctcatctgtattaagttgcataaatgaacagggacaccattcgcaactgattggtcaatgattgtgcgtacttgggagtcggccat

SEQ ID NO: 430562 - DNA, 140 bp, Artificial Sequence
  Synthetic
atggccgactcccaagtacgcacaatcattgaccaatcagttgcgaatggtgtccctgttcatttatgcaacttaatacagatgaggaccttgagtcttttacaatatgccagataccctggagacccagcatggcgtat

SEQ ID NO: 430563 - DNA, 140 bp, Artificial Sequence
  Synthetic
aggccctggctgctgatatgtgcataaatgaacagggacaccattcgcaactgattggtcaatgattgtgtcaattgtttctgccagctgatgtggctccttgcattttatgttgtggaggaccttttgggacagcggtg

SEQ ID NO: 430564 - DNA, 140 bp, Artificial Sequence
  Synthetic
caccgctgtcccaaaaggtcctccacaacataaaatgcaaggagccacatcagctggcagaaacaattgacacaatcattgaccaatcagttgcgaatggtgtccctgttcatttatgcacatatcagcagccagggcct

SEQ ID NO: 430565 - DNA, 140 bp, Artificial Sequence
  Synthetic
aggccctggctgctgatatgcgcaccggggatcctaggcatttttggttgcgcaattcaggtgtccatttcaatatggggcagatagtcacgtttttccaagaagtgcctcatgttataggaccttttgggacagcggtg

SEQ ID NO: 430566 - DNA, 140 bp, Artificial Sequence
  Synthetic
caccgctgtcccaaaaggtcctataacatgaggcacttcttggaaaaacgtgactatctgccccatattgaaatggacacctgaattgcgcaaccaaaaatgcctaggatccccggtgcgcatatcagcagccagggcct

SEQ ID NO: 430567 - DNA, 140 bp, Artificial Sequence
  Synthetic
atacgccatgctgggtctcccaatatggggcagatagtcacgtttttccaagaagtgcctcatgttatagaggaagtgatgaacattgtgctcattgcactgtctttgctagcagtgctgcgtacttgggagtcggccat

SEQ ID NO: 430568 - DNA, 140 bp, Artificial Sequence
  Synthetic
atggccgactcccaagtacgcagcactgctagcaaagacagtgcaatgagcacaatgttcatcacttcctctataacatgaggcacttcttggaaaaacgtgactatctgccccatattgggagacccagcatggcgtat

SEQ ID NO: 430569 - DNA, 140 bp, Artificial Sequence
  Synthetic
aggccctggctgctgatatgaggaagtgatgaacattgtgctcattgcactgtctttgctagcagtgctgaaaggcttgtacaatgttgcaacatgtggtctcattggtttgatcaccttgaccttttgggacagcggtg

SEQ ID NO: 430570 - DNA, 140 bp, Artificial Sequence
  Synthetic
caccgctgtcccaaaaggtcaaggtgatcaaaccaatgagaccacatgttgcaacattgtacaagcctttcagcactgctagcaaagacagtgcaatgagcacaatgttcatcacttcctcatatcagcagccagggcct

SEQ ID NO: 430571 - DNA, 140 bp, Artificial Sequence
  Synthetic
aggccctggctgctgatatggcatcatacattatgcagtccattaaagcacagtgtggggtaatttcttctttgcctcctcttttcttcttttcaacaaccactccagtatgcatatggcgaccttttgggacagcggtg

SEQ ID NO: 430572 - DNA, 140 bp, Artificial Sequence
  Synthetic
caccgctgtcccaaaaggtcgccatatgcatactggagtggttgttgaaaagaagaaaagaggaggcaaagaagaaattaccccacactgtgctttaatggactgcataatgtatgatgccatatcagcagccagggcct

SEQ ID NO: 430573 - DNA, 140 bp, Artificial Sequence
  Synthetic
aggccctggctgctgatatgatgagcttcaagccctggaattaaacatggagacgctcaacatgaccatgcctctctcctgcacaaagaacaatagtcaccactatataatggtaggcaagaccttttgggacagcggtg

SEQ ID NO: 430574 - DNA, 140 bp, Artificial Sequence
  Synthetic
caccgctgtcccaaaaggtcttgcctaccattatatagtggtgactattgttctttgtgcaggagagaggcatggtcatgttgagcgtctccatgtttaattccagggcttgaagctcatcatatcagcagccagggcct

SEQ ID NO: 430575 - DNA, 140 bp, Artificial Sequence
  Synthetic
atacgccatgctgggtctcccctctctcctgcacaaagaacaatagtcaccactatataatggtaggcaatgaaacaggattggagctgaccttaaccaacacaagcattatcaatcacacgtacttgggagtcggccat

SEQ ID NO: 430576 - DNA, 140 bp, Artificial Sequence
  Synthetic
atggccgactcccaagtacgtgtgattgataatgcttgtgttggttaaggtcagctccaatcctgtttcattgcctaccattatatagtggtgactattgttctttgtgcaggagagaggggagacccagcatggcgtat

SEQ ID NO: 430577 - DNA, 140 bp, Artificial Sequence
  Synthetic
atacgccatgctgggtctccaatgaatgatttcatcatagcagacactacattgaaaggtatctccaccattttgtgcatatgccacataagcaaggttgagaggtagtctcttccttttcgtacttgggagtcggccat

SEQ ID NO: 430578 - DNA, 140 bp, Artificial Sequence
  Synthetic
atggccgactcccaagtacgaaaaggaagagactacctctcaaccttgcttatgtggcatatgcacaaaatggtggagatacctttcaatgtagtgtctgctatgatgaaatcattcattggagacccagcatggcgtat

SEQ ID NO: 430579 - DNA, 140 bp, Artificial Sequence
  Synthetic
aggccctggctgctgatatgaaaagatctgctacatcaatcccatgagaatatttggcatcttgcttgaactgttttaagtctgttggttctctgaagaagtgtatgtaacagcccgacagaccttttgggacagcggtg

SEQ ID NO: 430580 - DNA, 140 bp, Artificial Sequence
  Synthetic
caccgctgtcccaaaaggtctgtcgggctgttacatacacttcttcagagaaccaacagacttaaaacagttcaagcaagatgccaaatattctcatgggattgatgtagcagatcttttcatatcagcagccagggcct

SEQ ID NO: 430581 - DNA, 140 bp, Artificial Sequence
  Synthetic
atacgccatgctgggtctcctataagagacatgtgccagggagacatttaatttcatggaaaggatggcattctcaaactctttttcgttgtttagacaactccctgataactgtaaactcgtacttgggagtcggccat

SEQ ID NO: 430582 - DNA, 140 bp, Artificial Sequence
  Synthetic
atggccgactcccaagtacgagtttacagttatcagggagttgtctaaacaacgaaaaagagtttgagaatgccatcctttccatgaaattaaatgtctccctggcacatgtctcttataggagacccagcatggcgtat

SEQ ID NO: 430583 - DNA, 140 bp, Artificial Sequence
  Synthetic
atacgccatgctgggtctccgttaccaatatctgataattcagaacacaacctgggaagatcactgccagttctcaagaccgtctcctatcggctacctcgggctcctttcacaaagaaccgtacttgggagtcggccat

SEQ ID NO: 430584 - DNA, 140 bp, Artificial Sequence
  Synthetic
atggccgactcccaagtacggttctttgtgaaaggagcccgaggtagccgataggagacggtcttgagaactggcagtgatcttcccaggttgtgttctgaattatcagatattggtaacggagacccagcatggcgtat

SEQ ID NO: 430585 - DNA, 140 bp, Artificial Sequence
  Synthetic
aggccctggctgctgatatgtgtcagattctgaaggcaaggatacaccaggggggtactgtctaactaggtggatgctgattgaagctgaattgaaatgctttggcaacacagctgtggcgaccttttgggacagcggtg

SEQ ID NO: 430586 - DNA, 140 bp, Artificial Sequence
  Synthetic
caccgctgtcccaaaaggtcgccacagctgtgttgccaaagcatttcaattcagcttcaatcagcatccacctagttagacagtacccccctggtgtatccttgccttcagaatctgacacatatcagcagccagggcct

SEQ ID NO: 430587 - DNA, 140 bp, Artificial Sequence
  Synthetic
atacgccatgctgggtctcctggatgctgattgaagctgaattgaaatgctttggcaacacagctgtggccaaatgtaatgaaaagcatgatgaggaattttgtgatatgttgagactgtcgtacttgggagtcggccat

SEQ ID NO: 430588 - DNA, 140 bp, Artificial Sequence
  Synthetic
atggccgactcccaagtacgacagtctcaacatatcacaaaattcctcatcatgcttttcattacatttggccacagctgtgttgccaaagcatttcaattcagcttcaatcagcatccaggagacccagcatggcgtat

SEQ ID NO: 430589 - DNA, 140 bp, Artificial Sequence
  Synthetic
aggccctggctgctgatatgagcatccagctgatcaataaagcggtaaatgccttgataaatgaccaactaataatgaaaaaccatctgcgagacattatggggattccatactgtaactgaccttttgggacagcggtg

SEQ ID NO: 430590 - DNA, 140 bp, Artificial Sequence
  Synthetic
caccgctgtcccaaaaggtcagttacagtatggaatccccataatgtctcgcagatggtttttcattattagttggtcatttatcaaggcatttaccgctttattgatcagctggatgctcatatcagcagccagggcct

SEQ ID NO: 430591 - DNA, 140 bp, Artificial Sequence
  Synthetic
atacgccatgctgggtctccaataatgaaaaaccatctgcgagacattatggggattccatactgtaactacagcaagtattggtatctcaaccacacagtcactgggaaaacatcgttgcgtacttgggagtcggccat

SEQ ID NO: 430592 - DNA, 140 bp, Artificial Sequence
  Synthetic
atggccgactcccaagtacgcaacgatgttttcccagtgactgtgtggttgagataccaatacttgctgtagttacagtatggaatccccataatgtctcgcagatggtttttcattattggagacccagcatggcgtat

SEQ ID NO: 430593 - DNA, 140 bp, Artificial Sequence
  Synthetic
atacgccatgctgggtctcccatatgcccacagtaaaaatacttgccccttaacttactattctcatagacagtgttgcagaattcctcataaaatttgtctggtaaaacatcatgatcacgtacttgggagtcggccat

SEQ ID NO: 430594 - DNA, 140 bp, Artificial Sequence
  Synthetic
atggccgactcccaagtacgtgatcatgatgttttaccagacaaattttatgaggaattctgcaacactgtctatgagaatagtaagttaaggggcaagtatttttactgtgggcatatgggagacccagcatggcgtat

SEQ ID NO: 430595 - DNA, 140 bp, Artificial Sequence
  Synthetic
aggccctggctgctgatatgctctgatgatattgagcaacaggccgacaacatgataactgagatgctgcagaaggaatacatggagaggcaggggaagacaccattaggcctggttgacgaccttttgggacagcggtg

SEQ ID NO: 430596 - DNA, 140 bp, Artificial Sequence
  Synthetic
caccgctgtcccaaaaggtcgtcaaccaggcctaatggtgtcttcccctgcctctccatgtattccttctgcagcatctcagttatcatgttgtcggcctgttgctcaatatcatcagagcatatcagcagccagggcct

SEQ ID NO: 430597 - DNA, 140 bp, Artificial Sequence
  Synthetic
atacgccatgctgggtctccagaaggaatacatggagaggcaggggaagacaccattaggcctggttgacctctttgtgttcagcacaagtttttatctcatcagtatcttccttcacctcgtacttgggagtcggccat

SEQ ID NO: 430598 - DNA, 140 bp, Artificial Sequence
  Synthetic
atggccgactcccaagtacgaggtgaaggaagatactgatgagataaaaacttgtgctgaacacaaagaggtcaaccaggcctaatggtgtcttcccctgcctctccatgtattccttctggagacccagcatggcgtat

SEQ ID NO: 430599 - DNA, 140 bp, Artificial Sequence
  Synthetic
atacgccatgctgggtctcccaccaccagggcttgagcctggtttagcaggctccctatactgatcaacaatcttctcaacggtctcctttagctgactgaaataaacacttgcacctcccgtacttgggagtcggccat

SEQ ID NO: 430600 - DNA, 140 bp, Artificial Sequence
  Synthetic
atggccgactcccaagtacgggaggtgcaagtgtttatttcagtcagctaaaggagaccgttgagaagattgttgatcagtatagggagcctgctaaaccaggctcaagccctggtggtgggagacccagcatggcgtat

SEQ ID NO: 430601 - DNA, 140 bp, Artificial Sequence
  Synthetic
aggccctggctgctgatatgctcacagactgaatcacatgggcatatgctcttgtgggctctacaagcaacctggtgtacctgtaagatggaagagatgagacccccattggggcccccggaccttttgggacagcggtg

SEQ ID NO: 430602 - DNA, 140 bp, Artificial Sequence
  Synthetic
caccgctgtcccaaaaggtccgggggccccaatgggggtctcatctcttccatcttacaggtacaccaggttgcttgtagagcccacaagagcatatgcccatgtgattcagtctgtgagcatatcagcagccagggcct

SEQ ID NO: 430603 - DNA, 140 bp, Artificial Sequence
  Synthetic
atacgccatgctgggtctcccctggtgtacctgtaagatggaagagatgagacccccattggggcccccgtgacccaccgcctgttggcggtgggtcacgggggcgcccgtttacaggaccgtacttgggagtcggccat

SEQ ID NO: 430604 - DNA, 140 bp, Artificial Sequence
  Synthetic
atggccgactcccaagtacggtcctgtaaacgggcgcccccgtgacccaccgccaacaggcggtgggtcacgggggccccaatgggggtctcatctcttccatcttacaggtacaccaggggagacccagcatggcgtat

SEQ ID NO: 430605 - DNA, 140 bp, Artificial Sequence
  Synthetic
atacgccatgctgggtctcctaatcctgcttattaagtaggtgttttcccttccttgagaagacttcagtgagctgtgagacagccaatgctgtaagtttgttaaagtcatagttcaaaacgtacttgggagtcggccat

SEQ ID NO: 430606 - DNA, 140 bp, Artificial Sequence
  Synthetic
atggccgactcccaagtacgttttgaactatgactttaacaaacttacagcattggctgtctcacagctcactgaagtcttctcaaggaagggaaaacacctacttaataagcaggattaggagacccagcatggcgtat

SEQ ID NO: 430607 - DNA, 140 bp, Artificial Sequence
  Synthetic
aggccctggctgctgatatgttaaaaccagtgtgttcagtcctcctgacactgctgcatcaaacatgatgcagtccattaaggcacaatgaggggttatttcttctttgccgcctctcttgaccttttgggacagcggtg

SEQ ID NO: 430608 - DNA, 140 bp, Artificial Sequence
  Synthetic
caccgctgtcccaaaaggtcaagagaggcggcaaagaagaaataacccctcattgtgccttaatggactgcatcatgtttgatgcagcagtgtcaggaggactgaacacactggttttaacatatcagcagccagggcct

SEQ ID NO: 430609 - DNA, 140 bp, Artificial Sequence
  Synthetic
atacgccatgctgggtctcccagtccattaaggcacaatgaggggttatttcttctttgccgcctctctttttcttctcaacaacaatacctgtgtgcatgtggcataagtctttgtactcgtacttgggagtcggccat

SEQ ID NO: 430610 - DNA, 140 bp, Artificial Sequence
  Synthetic
atggccgactcccaagtacgagtacaaagacttatgccacatgcacacaggtattgttgttgagaagaaaaagagaggcggcaaagaagaaataacccctcattgtgccttaatggactgggagacccagcatggcgtat

SEQ ID NO: 430611 - DNA, 140 bp, Artificial Sequence
  Synthetic
atacgccatgctgggtctcccttctttacttccctttctttaaataatgagccattgttgaaggaggatgtaagaagagataagaacttctttgagacaccaggctttttgtagttgggccgtacttgggagtcggccat

SEQ ID NO: 430612 - DNA, 140 bp, Artificial Sequence
  Synthetic
atggccgactcccaagtacggcccaactacaaaaagcctggtgtctcaaagaagttcttatctcttcttacatcctccttcaacaatggctcattatttaaagaaagggaagtaaagaagggagacccagcatggcgtat

SEQ ID NO: 430613 - DNA, 140 bp, Artificial Sequence
  Synthetic
aggccctggctgctgatatgatatcaatcagcttgatatcttttcttccctgtgattcaagaagttttcttatgtcatcagaaccctgacaggtgatgaccatgttccgggggagtgcttgaccttttgggacagcggtg

SEQ ID NO: 430614 - DNA, 140 bp, Artificial Sequence
  Synthetic
caccgctgtcccaaaaggtcaagcactcccccggaacatggtcatcacctgtcagggttctgatgacataagaaaacttcttgaatcacagggaagaaaagatatcaagctgattgatatcatatcagcagccagggcct

SEQ ID NO: 430615 - DNA, 140 bp, Artificial Sequence
  Synthetic
aggccctggctgctgatatgctattacagcactagttagtcctggctgtgcagcaaaaaggtctgtgacatcaattccatgtgaatacttagcatcttgtttaaactgttttaggtcagtgaccttttgggacagcggtg

SEQ ID NO: 430616 - DNA, 140 bp, Artificial Sequence
  Synthetic
caccgctgtcccaaaaggtcactgacctaaaacagtttaaacaagatgctaagtattcacatggaattgatgtcacagacctttttgctgcacagccaggactaactagtgctgtaatagcatatcagcagccagggcct

SEQ ID NO: 430617 - DNA, 140 bp, Artificial Sequence
  Synthetic
aggccctggctgctgatatgtcacgtggccaaatttcacttttggctcaagaaacttctcaaaacattttatctggtctgtcaacctatctggtgtttcttttgtaataaaatgacacatgaccttttgggacagcggtg

SEQ ID NO: 430618 - DNA, 140 bp, Artificial Sequence
  Synthetic
caccgctgtcccaaaaggtcatgtgtcattttattacaaaagaaacaccagataggttgacagaccagataaaatgttttgagaagtttcttgagccaaaagtgaaatttggccacgtgacatatcagcagccagggcct

SEQ ID NO: 430619 - DNA, 140 bp, Artificial Sequence
  Synthetic
atacgccatgctgggtctcccatcctcagacaaaatcaagtttattaatgctcttattaacttatagagcaagaactcaacatcagtgatcagttcctctctcactttgtcaatgagatccgtacttgggagtcggccat

SEQ ID NO: 430620 - DNA, 140 bp, Artificial Sequence
  Synthetic
atggccgactcccaagtacggatctcattgacaaagtgagagaggaactgatcactgatgttgagttcttgctctataagttaataagagcattaataaacttgattttgtctgaggatgggagacccagcatggcgtat

SEQ ID NO: 430621 - DNA, 140 bp, Artificial Sequence
  Synthetic
aggccctggctgctgatatgaagaactcaacatcagtgatcagttcctctctcactttgtcaatgagatccttgtggtgataatctgacacataggccattatgaagtacctaaggttttgaccttttgggacagcggtg

SEQ ID NO: 430622 - DNA, 140 bp, Artificial Sequence
  Synthetic
caccgctgtcccaaaaggtcaaaaccttaggtacttcataatggcctatgtgtcagattatcaccacaaggatctcattgacaaagtgagagaggaactgatcactgatgttgagttcttcatatcagcagccagggcct

SEQ ID NO: 430623 - DNA, 140 bp, Artificial Sequence
  Synthetic
aggccctggctgctgatatggtgttttcccaggcccttcctattattgaagtccttgatgcaatatatggccatccatcccctgacagacagattttgtagagtatattctcataagggtgaccttttgggacagcggtg

SEQ ID NO: 430624 - DNA, 140 bp, Artificial Sequence
  Synthetic
caccgctgtcccaaaaggtcacccttatgagaatatactctacaaaatctgtctgtcaggggatggatggccatatattgcatcaaggacttcaataataggaagggcctgggaaaacaccatatcagcagccagggcct

SEQ ID NO: 430625 - DNA, 140 bp, Artificial Sequence
  Synthetic
atacgccatgctgggtctccatcatctttgttaaagacctgatgttgtttagctgctcttccagctcactgcaatcttctatccaagagatcatagtgttcactgttgtctgtagaacttcgtacttgggagtcggccat

SEQ ID NO: 430626 - DNA, 140 bp, Artificial Sequence
  Synthetic
atggccgactcccaagtacgaagttctacagacaacagtgaacactatgatctcttggatagaagattgcagtgagctggaagagcagctaaacaacatcaggtctttaacaaagatgatggagacccagcatggcgtat

SEQ ID NO: 430627 - DNA, 140 bp, Artificial Sequence
  Synthetic
aggccctggctgctgatatggcaatcttctatccaagagatcatagtgttcactgttgtctgtagaacttcagatgagaatactgctggaaaatatcttttaggatcagcataaaatgaggaccttttgggacagcggtg

SEQ ID NO: 430628 - DNA, 140 bp, Artificial Sequence
  Synthetic
caccgctgtcccaaaaggtcctcattttatgctgatcctaaaagatattttccagcagtattctcatctgaagttctacagacaacagtgaacactatgatctcttggatagaagattgccatatcagcagccagggcct

SEQ ID NO: 430629 - DNA, 140 bp, Artificial Sequence
  Synthetic
atacgccatgctgggtctccgactttacttctttggaagcactcatcctgatctagacactcagggactcactggttgaaagtatcactcagtaagtcagtgaaatgcgcaatccaatagcgtacttgggagtcggccat

SEQ ID NO: 430630 - DNA, 140 bp, Artificial Sequence
  Synthetic
atggccgactcccaagtacgctattggattgcgcatttcactgacttactgagtgatactttcaaccagtgagtccctgagtgtctagatcaggatgagtgcttccaaagaagtaaagtcggagacccagcatggcgtat

SEQ ID NO: 430631 - DNA, 140 bp, Artificial Sequence
  Synthetic
atacgccatgctgggtctccccctgtcttttgataaatcaattgaaattcagtgtcacccagtgagaactcttggcaatatgcttctttgcatctcaccacttggtatcttgctggcccacgtacttgggagtcggccat

SEQ ID NO: 430632 - DNA, 140 bp, Artificial Sequence
  Synthetic
atggccgactcccaagtacgtgggccagcaagataccaagtggtgagatgcaaagaagcatattgccaagagttctcactgggtgacactgaatttcaattgatttatcaaaagacagggggagacccagcatggcgtat

SEQ ID NO: 430633 - DNA, 140 bp, Artificial Sequence
  Synthetic
aggccctggctgctgatatgcttggcaatatgcttctttgcatctcaccacttggtatcttgctggcccaaattcattctgcctcaatttcacagttgaagaggttttcatggagttcacgaccttttgggacagcggtg

SEQ ID NO: 430634 - DNA, 140 bp, Artificial Sequence
  Synthetic
caccgctgtcccaaaaggtcgtgaactccatgaaaacctcttcaactgtgaaattgaggcagaatgaatttgggccagcaagataccaagtggtgagatgcaaagaagcatattgccaagcatatcagcagccagggcct

SEQ ID NO: 430635 - DNA, 140 bp, Artificial Sequence
  Synthetic
aggccctggctgctgatatgcttgtactacatcatttaggtcaacctgcccttgttttgtcagacacgccaatgtcaggcttggcatggtcccaaactgattattaagtagatctgcattgaccttttgggacagcggtg

SEQ ID NO: 430636 - DNA, 140 bp, Artificial Sequence
  Synthetic
caccgctgtcccaaaaggtcaatgcagatctacttaataatcagtttgggaccatgccaagcctgacattggcgtgtctgacaaaacaagggcaggttgacctaaatgatgtagtacaagcatatcagcagccagggcct

SEQ ID NO: 430637 - DNA, 140 bp, Artificial Sequence
  Synthetic
atacgccatgctgggtctccggtctacatcccccatggtatagggaaatgttccctcctctgatctctggtaactaattgtgggggtaactccagaaacatcaaagtccataatcaagtccgtacttgggagtcggccat

SEQ ID NO: 430638 - DNA, 140 bp, Artificial Sequence
  Synthetic
atggccgactcccaagtacggacttgattatggactttgatgtttctggagttacccccacaattagttaccagagatcagaggagggaacatttccctataccatgggggatgtagaccggagacccagcatggcgtat

SEQ ID NO: 430639 - DNA, 140 bp, Artificial Sequence
  Synthetic
aggccctggctgctgatatgtaactaattgtgggggtaactccagaaacatcaaagtccataatcaagtcataaccattaggatgaaccacctccatatcaatcccataatggtccacacgaccttttgggacagcggtg

SEQ ID NO: 430640 - DNA, 140 bp, Artificial Sequence
  Synthetic
caccgctgtcccaaaaggtcgtgtggaccattatgggattgatatggaggtggttcatcctaatggttatgacttgattatggactttgatgtttctggagttacccccacaattagttacatatcagcagccagggcct

SEQ ID NO: 430641 - DNA, 140 bp, Artificial Sequence
  Synthetic
aggccctggctgctgatatgagttgctgtgagctcaagttgcccatataaatgcctgcgctcaatggtctttctgtcctgatcacctttgattttagtttctctaggtcagcagctaaaagaccttttgggacagcggtg

SEQ ID NO: 430642 - DNA, 140 bp, Artificial Sequence
  Synthetic
caccgctgtcccaaaaggtcttttagctgctgacctagagaaactaaaatcaaaggtgatcaggacagaaagaccattgagcgcaggcatttatatgggcaacttgagctcacagcaactcatatcagcagccagggcct

SEQ ID NO: 430643 - DNA, 140 bp, Artificial Sequence
  Synthetic
atacgccatgctgggtctccaatatagaattaagaatttgatttttgcttgaacattggaaagactgcagggttctagacctttcagcctgctgcctccgctcaacccatttctttaaatcgtacttgggagtcggccat

SEQ ID NO: 430644 - DNA, 140 bp, Artificial Sequence
  Synthetic
atggccgactcccaagtacgatttaaagaaatgggttgagcggaggcagcaggctgaaaggtctagaaccctgcagtctttccaatgttcaagcaaaaatcaaattcttaattctatattggagacccagcatggcgtat

SEQ ID NO: 430645 - DNA, 140 bp, Artificial Sequence
  Synthetic
aggccctggctgctgatatgggttctagacctttcagcctgctgcctccgctcaacccatttctttaaatccctctttgttgactctaaggagactagtctgtcattaacacttataaaggaccttttgggacagcggtg

SEQ ID NO: 430646 - DNA, 140 bp, Artificial Sequence
  Synthetic
caccgctgtcccaaaaggtcctttataagtgttaatgacagactagtctccttagagtcaacaaagagggatttaaagaaatgggttgagcggaggcagcaggctgaaaggtctagaacccatatcagcagccagggcct

SEQ ID NO: 430647 - DNA, 140 bp, Artificial Sequence
  Synthetic
aggccctggctgctgatatgcagtcgttttaggtcattatcatcccttctttgtttgcgcatcaaccgttggacattgctgacctcagagaagtcaagtccatgcagaagggcttgggcagaccttttgggacagcggtg

SEQ ID NO: 430648 - DNA, 140 bp, Artificial Sequence
  Synthetic
caccgctgtcccaaaaggtctgcccaagcccttctgcatggacttgacttctctgaggtcagcaatgtccaacggttgatgcgcaaacaaagaagggatgataatgacctaaaacgactgcatatcagcagccagggcct

SEQ ID NO: 430649 - DNA, 140 bp, Artificial Sequence
  Synthetic
atacgccatgctgggtctccactcgcaaggaggattaaagcatcaaaaatcaacagaagctttctccttgtgttcagtatcctcatagactttactttgtttaggaatgatctccagcaccgtacttgggagtcggccat

SEQ ID NO: 430650 - DNA, 140 bp, Artificial Sequence
  Synthetic
atggccgactcccaagtacggtgctggagatcattcctaaacaaagtaaagtctatgaggatactgaacacaaggagaaagcttctgttgatttttgatgctttaatcctccttgcgagtggagacccagcatggcgtat

SEQ ID NO: 430651 - DNA, 140 bp, Artificial Sequence
  Synthetic
aggccctggctgctgatatgtgttcagtatcctcatagactttactttgtttaggaatgatctccagcactgcatctgacattctccagtattttgattccctctattaccagtcctttcgaccttttgggacagcggtg

SEQ ID NO: 430652 - DNA, 140 bp, Artificial Sequence
  Synthetic
caccgctgtcccaaaaggtcgaaaggactggtaatagagggaatcaaaatactggagaatgtcagatgcagtgctggagatcattcctaaacaaagtaaagtctatgaggatactgaacacatatcagcagccagggcct

SEQ ID NO: 430653 - DNA, 140 bp, Artificial Sequence
  Synthetic
aggccctggctgctgatatgcctcagagactgtgtccacaagaaggactttatctcttttgaggcactcattgccaagttgttgtattgtatactcacagcagagagttgagacaatctggaccttttgggacagcggtg

SEQ ID NO: 430654 - DNA, 140 bp, Artificial Sequence
  Synthetic
caccgctgtcccaaaaggtccagattgtctcaactctctgctgtgagtatacaatacaacaacttggcaatgagtgcctcaaaagagataaagtccttcttgtggacacagtctctgaggcatatcagcagccagggcct

SEQ ID NO: 430655 - DNA, 140 bp, Artificial Sequence
  Synthetic
atacgccatgctgggtctccttgccaagttgttgtattgtatactcacagcagagagttgagacaatctgctgaaatgattaatgcaaagcgcaatccaatagcctaggatccactgtgccgtacttgggagtcggccat

SEQ ID NO: 430656 - DNA, 140 bp, Artificial Sequence
  Synthetic
atggccgactcccaagtacggcacagtggatcctaggctattggattgcgctttgcattaatcatttcagcagattgtctcaactctctgctgtgagtatacaatacaacaacttggcaaggagacccagcatggcgtat

SEQ ID NO: 430657 - DNA, 140 bp, Artificial Sequence
  Synthetic
atacgccatgctgggtctcccataaatcaaatgttcaacattgtcttttacagctactttgtcgacgtataaatcgttgaactccttaagcagctgacctctctcaacctttaagaattgcgtacttgggagtcggccat

SEQ ID NO: 430658 - DNA, 140 bp, Artificial Sequence
  Synthetic
atggccgactcccaagtacgcaattcttaaaggttgagagaggtcagctgcttaaggagttcaacgatttatacgtcgacaaagtagctgtaaaagacaatgttgaacatttgatttatgggagacccagcatggcgtat

SEQ ID NO: 430659 - DNA, 140 bp, Artificial Sequence
  Synthetic
aggccctggctgctgatatgcatctgattcaacaaaccaggctgacctacctttgaaagttggacccgacaaagcaagtctccaacaatcagacagaacacatgggctcacagacccagagaccttttgggacagcggtg

SEQ ID NO: 430660 - DNA, 140 bp, Artificial Sequence
  Synthetic
caccgctgtcccaaaaggtctctgggtctgtgagcccatgtgttctgtctgattgttggagacttgctttgtcgggtccaactttcaaaggtaggtcagcctggtttgttgaatcagatgcatatcagcagccagggcct

SEQ ID NO: 430661 - DNA, 140 bp, Artificial Sequence
  Synthetic
aggccctggctgctgatatgtagtccaacaaatggggaacaagcaaaccaaagctcccgaagccaaaggcagcccgagggccagtctgatcccagacgccacacacctggggccacagttgaccttttgggacagcggtg

SEQ ID NO: 430662 - DNA, 140 bp, Artificial Sequence
  Synthetic
caccgctgtcccaaaaggtcaactgtggccccaggtgtgtggcgtctgggatcagactggccctcgggctgcctttggcttcgggagctttggtttgcttgttccccatttgttggactacatatcagcagccagggcct

SEQ ID NO: 430663 - DNA, 140 bp, Artificial Sequence
  Synthetic
atacgccatgctgggtctccagcccgagggccagtctgatcccagacgccacacacctggggccacagttctgcaagagctgctggttcgaaaacaagggcttggttgagtgcaacaacccgtacttgggagtcggccat

SEQ ID NO: 430664 - DNA, 140 bp, Artificial Sequence
  Synthetic
atggccgactcccaagtacgggttgttgcactcaaccaagcccttgttttcgaaccagcagctcttgcagaactgtggccccaggtgtgtggcgtctgggatcagactggccctcgggctggagacccagcatggcgtat

SEQ ID NO: 430665 - DNA, 140 bp, Artificial Sequence
  Synthetic
atacgccatgctgggtctcctggtggcatgaggcaatcacttcctcataatggttggaacgattgtccaacaaaacattcaaactctccactcctgacaatcttcctgaagtcatggatacgtacttgggagtcggccat

SEQ ID NO: 430666 - DNA, 140 bp, Artificial Sequence
  Synthetic
atggccgactcccaagtacgtatccatgacttcaggaagattgtcaggagtggagagtttgaatgttttgttggacaatcgttccaaccattatgaggaagtgattgcctcatgccaccaggagacccagcatggcgtat

SEQ ID NO: 430667 - DNA, 140 bp, Artificial Sequence
  Synthetic
aggccctggctgctgatatgcaaaacattcaaactctccactcctgacaatcttcctgaagtcatggatagagactcacaaagtctactatactctgactcctcaaaaagtgaattacttgaccttttgggacagcggtg

SEQ ID NO: 430668 - DNA, 140 bp, Artificial Sequence
  Synthetic
caccgctgtcccaaaaggtcaagtaattcactttttgaggagtcagagtatagtagactttgtgagtctctatccatgacttcaggaagattgtcaggagtggagagtttgaatgttttgcatatcagcagccagggcct

SEQ ID NO: 430669 - DNA, 140 bp, Artificial Sequence
  Synthetic
atacgccatgctgggtctcctgtcccatttgcaagatgcccctcccaacaaaactaagaccatcagccgtcccaacagcgcccccaaccaaagcagaagacaacaccagacccccaccctcgtacttgggagtcggccat

SEQ ID NO: 430670 - DNA, 140 bp, Artificial Sequence
  Synthetic
atggccgactcccaagtacgagggtgggggtctggtgttgtcttctgctttggttgggggcgctgttgggacggctgatggtcttagttttgttgggaggggcatcttgcaaatgggacaggagacccagcatggcgtat

SEQ ID NO: 430671 - DNA, 140 bp, Artificial Sequence
  Synthetic
aggccctggctgctgatatgcccaacagcgcccccaaccaaagcagaagacaacaccagacccccaccctatagtccctgagccccccgcaagccccacaaccctctccaccccccgacagaccttttgggacagcggtg

SEQ ID NO: 430672 - DNA, 140 bp, Artificial Sequence
  Synthetic
caccgctgtcccaaaaggtctgtcggggggtggagagggttgtggggcttgcggggggctcagggactatagggtgggggtctggtgttgtcttctgctttggttgggggcgctgttgggcatatcagcagccagggcct

SEQ ID NO: 430673 - DNA, 140 bp, Artificial Sequence
  Synthetic
atacgccatgctgggtctccgacccaatcaggtatttgctcattgtaaaatgatgttctcccatctataagtggtatcagattgatgtcgatactctttaggtcttctttcagctgctctcgtacttgggagtcggccat

SEQ ID NO: 430674 - DNA, 140 bp, Artificial Sequence
  Synthetic
atggccgactcccaagtacgagagcagctgaaagaagacctaaagagtatcgacatcaatctgataccacttatagatgggagaacatcattttacaatgagcaaatacctgattgggtcggagacccagcatggcgtat

SEQ ID NO: 430675 - DNA, 140 bp, Artificial Sequence
  Synthetic
aggccctggctgctgatatggtggtatcagattgatgtcgatactctttaggtcttctttcagctgctctaattttttgaagtcttcgatatacttttgttcaaagttggcaggagatgagaccttttgggacagcggtg

SEQ ID NO: 430676 - DNA, 140 bp, Artificial Sequence
  Synthetic
caccgctgtcccaaaaggtctcatctcctgccaactttgaacaaaagtatatcgaagacttcaaaaaattagagcagctgaaagaagacctaaagagtatcgacatcaatctgataccaccatatcagcagccagggcct

SEQ ID NO: 430677 - DNA, 140 bp, Artificial Sequence
  Synthetic
atacgccatgctgggtctcctccagagatctactcgatctcctcaatgtgctcttccttttcagccaactcctcacatgttctaccctttagccttaatttaccaccacttgactgcacccgtacttgggagtcggccat

SEQ ID NO: 430678 - DNA, 140 bp, Artificial Sequence
  Synthetic
atggccgactcccaagtacgggtgcagtcaagtggtggtaaattaaggctaaagggtagaacatgtgaggagttggctgaaaaggaagagcacattgaggagatcgagtagatctctggaggagacccagcatggcgtat

SEQ ID NO: 430679 - DNA, 140 bp, Artificial Sequence
  Synthetic
aggccctggctgctgatatgcctcacatgttctaccctttagccttaatttaccaccacttgactgcaccatcactctctttcttgatttactataacagagggcataacctttgaattcgaccttttgggacagcggtg

SEQ ID NO: 430680 - DNA, 140 bp, Artificial Sequence
  Synthetic
caccgctgtcccaaaaggtcgaattcaaaggttatgccctctgttatagtaaatcaagaaagagagtgatggtgcagtcaagtggtggtaaattaaggctaaagggtagaacatgtgaggcatatcagcagccagggcct

SEQ ID NO: 430681 - DNA, 140 bp, Artificial Sequence
  Synthetic
atacgccatgctgggtctcccatctggtaccacaaagcacagtgagggagtcaaaaccccatggtcatgaagaattctttctacagatttgtcctcactattatgttcacaaccgtttgccgtacttgggagtcggccat

SEQ ID NO: 430682 - DNA, 140 bp, Artificial Sequence
  Synthetic
atggccgactcccaagtacggcaaacggttgtgaacataatagtgaggacaaatctgtagaaagaattcttcatgaccatggggttttgactccctcactgtgctttgtggtaccagatgggagacccagcatggcgtat

SEQ ID NO: 430683 - DNA, 140 bp, Artificial Sequence
  Synthetic
aggccctggctgctgatatgagaattctttctacagatttgtcctcactattatgttcacaaccgtttgcattgcaagagtcaacctcaatgcaaagggacagaagtttcaacccttccagaccttttgggacagcggtg

SEQ ID NO: 430684 - DNA, 140 bp, Artificial Sequence
  Synthetic
caccgctgtcccaaaaggtctggaagggttgaaacttctgtccctttgcattgaggttgactcttgcaatgcaaacggttgtgaacataatagtgaggacaaatctgtagaaagaattctcatatcagcagccagggcct

SEQ ID NO: 430685 - DNA, 140 bp, Artificial Sequence
  Synthetic
atacgccatgctgggtctccttggtgctgcagcccttaatatggagacaatgtctacccctgaccactgcatcctcaaccctagcctgtctagcatcatgttgcttaatgcctcgatcagcgtacttgggagtcggccat

SEQ ID NO: 430686 - DNA, 140 bp, Artificial Sequence
  Synthetic
atggccgactcccaagtacgctgatcgaggcattaagcaacatgatgctagacaggctagggttgaggatgcagtggtcaggggtagacattgtctccatattaagggctgcagcaccaaggagacccagcatggcgtat

SEQ ID NO: 430687 - DNA, 140 bp, Artificial Sequence
  Synthetic
aggccctggctgctgatatgatcctcaaccctagcctgtctagcatcatgttgcttaatgcctcgatcagtaggtcagatgaggtgtccccaacttctctcacaaatatctcaagatcctgaccttttgggacagcggtg

SEQ ID NO: 430688 - DNA, 140 bp, Artificial Sequence
  Synthetic
caccgctgtcccaaaaggtcaggatcttgagatatttgtgagagaagttggggacacctcatctgacctactgatcgaggcattaagcaacatgatgctagacaggctagggttgaggatcatatcagcagccagggcct

SEQ ID NO: 430689 - DNA, 140 bp, Artificial Sequence
  Synthetic
atacgccatgctgggtctccgacaacctctcattatctgccaaatactttgataccaaatctttgacacaggctatgtcttcctccatgcttgactgtgggtgtggtggtcagggttcttcgtacttgggagtcggccat

SEQ ID NO: 430690 - DNA, 140 bp, Artificial Sequence
  Synthetic
atggccgactcccaagtacgaagaaccctgaccaccacacccacagtcaagcatggaggaagacatagcctgtgtcaaagatttggtatcaaagtatttggcagataatgagaggttgtcggagacccagcatggcgtat

SEQ ID NO: 430691 - DNA, 140 bp, Artificial Sequence
  Synthetic
atacgccatgctgggtctccagaccccctctatgcacgaccagcgggactggctcagcacaagggcccaccaacacaaagtcatactctgtaaactgcagtttttctatgtcaacaacaacgtacttgggagtcggccat

SEQ ID NO: 430692 - DNA, 140 bp, Artificial Sequence
  Synthetic
atggccgactcccaagtacgttgttgttgacatagaaaaactgcagtttacagagtatgactttgtgttggtgggcccttgtgctgagccagtcccgctggtcgtgcatagagggggtctggagacccagcatggcgtat

SEQ ID NO: 430693 - DNA, 140 bp, Artificial Sequence
  Synthetic
aggccctggctgctgatatgcaacacaaagtcatactctgtaaactgcagtttttctatgtcaacaacaatctcaacaggagtcacacaccctagttggttcatgtcgactaaaaactcagaccttttgggacagcggtg

SEQ ID NO: 430694 - DNA, 140 bp, Artificial Sequence
  Synthetic
caccgctgtcccaaaaggtctgagtttttagtcgacatgaaccaactagggtgtgtgactcctgttgagattgttgttgacatagaaaaactgcagtttacagagtatgactttgtgttgcatatcagcagccagggcct

SEQ ID NO: 430695 - DNA, 140 bp, Artificial Sequence
  Synthetic
atacgccatgctgggtctccccctgacaaaaccaacctccaacagtctgacaagacgcaaggactcactgcaccagaatacatagcggtcacatcatgcactaagtacttggtctgttgacgtacttgggagtcggccat

SEQ ID NO: 430696 - DNA, 140 bp, Artificial Sequence
  Synthetic
atggccgactcccaagtacgtcaacagaccaagtacttagtgcatgatgtgaccgctatgtattctggtgcagtgagtccttgcgtcttgtcagactgttggaggttggttttgtcagggggagacccagcatggcgtat

SEQ ID NO: 430697 - DNA, 140 bp, Artificial Sequence
  Synthetic
aggccctggctgctgatatgcaccagaatacatagcggtcacatcatgcactaagtacttggtctgttgattcattgagccagtgtaattaaggtgaatagcaaagttttctttaaaactgaccttttgggacagcggtg

SEQ ID NO: 430698 - DNA, 140 bp, Artificial Sequence
  Synthetic
caccgctgtcccaaaaggtcagttttaaagaaaactttgctattcaccttaattacactggctcaatgaatcaacagaccaagtacttagtgcatgatgtgaccgctatgtattctggtgcatatcagcagccagggcct

SEQ ID NO: 430699 - DNA, 140 bp, Artificial Sequence
  Synthetic
atacgccatgctgggtctccaccctgagggtagtaaagcaacagcatcaaagaaatcctccagtgaattaaatttggaatcaactaaacccgaagcaaccagttgattctgattgaacttcgtacttgggagtcggccat

SEQ ID NO: 430700 - DNA, 140 bp, Artificial Sequence
  Synthetic
atggccgactcccaagtacgaagttcaatcagaatcaactggttgcttcgggtttagttgattccaaatttaattcactggaggatttctttgatgctgttgctttactaccctcagggtggagacccagcatggcgtat

SEQ ID NO: 430701 - DNA, 140 bp, Artificial Sequence
  Synthetic
aggccctggctgctgatatgaatttggaatcaactaaacccgaagcaaccagttgattctgattgaactttgctggttcaatatcaaagtctatccaggcataacccatcatcaaatcatgaccttttgggacagcggtg

SEQ ID NO: 430702 - DNA, 140 bp, Artificial Sequence
  Synthetic
caccgctgtcccaaaaggtcatgatttgatgatgggttatgcctggatagactttgatattgaaccagcaaagttcaatcagaatcaactggttgcttcgggtttagttgattccaaattcatatcagcagccagggcct

SEQ ID NO: 430703 - DNA, 140 bp, Artificial Sequence
  Synthetic
atacgccatgctgggtctccgaagaaaatggacccattctatgcaaaccttcaccctctgggactgatgatttatgtggaaaccatgtgaaagatcccagtgttcttgttgtagcaacaacgtacttgggagtcggccat

SEQ ID NO: 430704 - DNA, 140 bp, Artificial Sequence
  Synthetic
atggccgactcccaagtacgttgttgctacaacaagaacactgggatctttcacatggtttccacataaatcatcagtcccagagggtgaaggtttgcatagaatgggtccattttcttcggagacccagcatggcgtat

SEQ ID NO: 430705 - DNA, 140 bp, Artificial Sequence
  Synthetic
aggccctggctgctgatatgataagatctttagcattggcaatgtcttcctccatcgccaatcgtggcacctgtgttaggtttgggtttgtgccagtatggcttgtaggtcagctggtgggaccttttgggacagcggtg

SEQ ID NO: 430706 - DNA, 140 bp, Artificial Sequence
  Synthetic
caccgctgtcccaaaaggtcccaccagctgacctacaagccatactggcacaaacccaaacctaacacaggtgccacgattggcgatggaggaagacattgccaatgctaaagatcttatcatatcagcagccagggcct

SEQ ID NO: 430707 - DNA, 140 bp, Artificial Sequence
  Synthetic
aggccctggctgctgatatgcacctgtgttaggtttgggtttgtgccagtatggcttgtaggtcagctggtggtgcctcacggaaattctcacagaaatgagagacaatatgcctaggatgaccttttgggacagcggtg

SEQ ID NO: 430708 - DNA, 140 bp, Artificial Sequence
  Synthetic
caccgctgtcccaaaaggtcatcctaggcatattgtctctcatttctgtgagaatttccgtgaggcaccaccagctgacctacaagccatactggcacaaacccaaacctaacacaggtgcatatcagcagccagggcct

SEQ ID NO: 430709 - DNA, 140 bp, Artificial Sequence
  Synthetic
atacgccatgctgggtctccgcatcactagtgctcaccactctttcctccaccatgggctcatgtgttctagtgtgagacaatcttaattcagatgacagcacaatgtaatgttcttccccgtacttgggagtcggccat

SEQ ID NO: 430710 - DNA, 140 bp, Artificial Sequence
  Synthetic
atggccgactcccaagtacggggaagaacattacattgtgctgtcatctgaattaagattgtctcacactagaacacatgagcccatggtggaggaaagagtggtgagcactagtgatgcggagacccagcatggcgtat

SEQ ID NO: 430711 - DNA, 140 bp, Artificial Sequence
  Synthetic
atacgccatgctgggtctcctccaatgccacacagagatctaaaaattttatcctgggtgaccacttcattttggttgatgctaaatcgctcataaatggcaatatgtgtttctcaaatacgtacttgggagtcggccat

SEQ ID NO: 430712 - DNA, 140 bp, Artificial Sequence
  Synthetic
atggccgactcccaagtacgtatttgagaaacacatattgccatttatgagcgatttagcatcaaccaaaatgaagtggtcacccaggataaaatttttagatctctgtgtggcattggaggagacccagcatggcgtat

SEQ ID NO: 430713 - DNA, 140 bp, Artificial Sequence
  Synthetic
aggccctggctgctgatatgtttggttgatgctaaatcgctcataaatggcaatatgtgtttctcaaatacagatggatacaatcttcttagagaatgaatgatgtgatttaaaccgaccgaccttttgggacagcggtg

SEQ ID NO: 430714 - DNA, 140 bp, Artificial Sequence
  Synthetic
caccgctgtcccaaaaggtcggtcggtttaaatcacatcattcattctctaagaagattgtatccatctgtatttgagaaacacatattgccatttatgagcgatttagcatcaaccaaacatatcagcagccagggcct

SEQ ID NO: 430715 - DNA, 140 bp, Artificial Sequence
  Synthetic
atacgccatgctgggtctccagggttgtgtttgaaaaactctaatgccttaaccgtcttaggttctcccaagacccatgcacccagttctattgcagttgataaagaaatacacatatagcgtacttgggagtcggccat

SEQ ID NO: 430716 - DNA, 140 bp, Artificial Sequence
  Synthetic
atggccgactcccaagtacgctatatgtgtatttctttatcaactgcaatagaactgggtgcatgggtcttgggagaacctaagacggttaaggcattagagtttttcaaacacaaccctggagacccagcatggcgtat

SEQ ID NO: 430717 - DNA, 140 bp, Artificial Sequence
  Synthetic
aggccctggctgctgatatgagacccatgcacccagttctattgcagttgataaagaaatacacatatagtcccataacaaaggtctaaaatagctggtcacaccttcacttccacttccgaccttttgggacagcggtg

SEQ ID NO: 430718 - DNA, 140 bp, Artificial Sequence
  Synthetic
caccgctgtcccaaaaggtcggaagtggaagtgaaggtgtgaccagctattttagacctttgttatgggactatatgtgtatttctttatcaactgcaatagaactgggtgcatgggtctcatatcagcagccagggcct

SEQ ID NO: 430719 - DNA, 140 bp, Artificial Sequence
  Synthetic
atacgccatgctgggtctcctcagtaactcaaccccttgggtgctagagattagagactggatggacttaatgtacaaattctctttatttggccctcgaacacatttgctacctaatgtcgtacttgggagtcggccat

SEQ ID NO: 430720 - DNA, 140 bp, Artificial Sequence
  Synthetic
atggccgactcccaagtacgacattaggtagcaaatgtgttcgagggccaaataaagagaatttgtacattaagtccatccagtctctaatctctagcacccaaggggttgagttactgaggagacccagcatggcgtat

SEQ ID NO: 430721 - DNA, 140 bp, Artificial Sequence
  Synthetic
aggccctggctgctgatatgatgtacaaattctctttatttggccctcgaacacatttgctacctaatgttctacacaatccaacaaagccagatgcaatggaactttggaacgcagattgaccttttgggacagcggtg

SEQ ID NO: 430722 - DNA, 140 bp, Artificial Sequence
  Synthetic
caccgctgtcccaaaaggtcaatctgcgttccaaagttccattgcatctggctttgttggattgtgtagaacattaggtagcaaatgtgttcgagggccaaataaagagaatttgtacatcatatcagcagccagggcct

SEQ ID NO: 430723 - DNA, 140 bp, Artificial Sequence
  Synthetic
atacgccatgctgggtctccgacagcttgttttgaattgtcttgacaatagttggaatcttctcatcatccaagtttacagcacctgagtatattatcttttgtctcaataccatccttacgtacttgggagtcggccat

SEQ ID NO: 430724 - DNA, 140 bp, Artificial Sequence
  Synthetic
atggccgactcccaagtacgtaaggatggtattgagacaaaagataatatactcaggtgctgtaaacttggatgatgagaagattccaactattgtcaagacaattcaaaacaagctgtcggagacccagcatggcgtat

SEQ ID NO: 430725 - DNA, 140 bp, Artificial Sequence
  Synthetic
aggccctggctgctgatatgcaagtttacagcacctgagtatattatcttttgtctcaataccatccttaaagggtggtgcgcagccagatttaaccaagagtactcaaggtcagattcagaccttttgggacagcggtg

SEQ ID NO: 430726 - DNA, 140 bp, Artificial Sequence
  Synthetic
caccgctgtcccaaaaggtctgaatctgaccttgagtactcttggttaaatctggctgcgcaccaccctttaaggatggtattgagacaaaagataatatactcaggtgctgtaaacttgcatatcagcagccagggcct

SEQ ID NO: 430727 - DNA, 140 bp, Artificial Sequence
  Synthetic
atacgccatgctgggtctccgtgctcactagacaaatagttcgttgtgaattcttcatggagttgtcctgtctttaatctattatagagtcttcttaacatagatctaattttgctacaacgtacttgggagtcggccat

SEQ ID NO: 430728 - DNA, 140 bp, Artificial Sequence
  Synthetic
atggccgactcccaagtacgttgtagcaaaattagatctatgttaagaagactctataatagattaaagacaggacaactccatgaagaattcacaacgaactatttgtctagtgagcacggagacccagcatggcgtat

SEQ ID NO: 430729 - DNA, 140 bp, Artificial Sequence
  Synthetic
aggccctggctgctgatatgtctttaatctattatagagtcttcttaacatagatctaattttgctacaagcactaggaatcaatccttctatctgcctcatgatcctataactacggttgaccttttgggacagcggtg

SEQ ID NO: 430730 - DNA, 140 bp, Artificial Sequence
  Synthetic
caccgctgtcccaaaaggtcaaccgtagttataggatcatgaggcagatagaaggattgattcctagtgcttgtagcaaaattagatctatgttaagaagactctataatagattaaagacatatcagcagccagggcct

SEQ ID NO: 430731 - DNA, 140 bp, Artificial Sequence
  Synthetic
atacgccatgctgggtctcccaatggggtatctagcatattgcaaaaggttcaaggtccttatctgtatcaagttgcatagatggacaggaacaccatttgcgactgattgatcaataatcgtacttgggagtcggccat

SEQ ID NO: 430732 - DNA, 140 bp, Artificial Sequence
  Synthetic
atggccgactcccaagtacgattattgatcaatcagtcgcaaatggtgttcctgtccatctatgcaacttgatacagataaggaccttgaaccttttgcaatatgctagataccccattgggagacccagcatggcgtat

SEQ ID NO: 430733 - DNA, 140 bp, Artificial Sequence
  Synthetic
aggccctggctgctgatatgaagttgcatagatggacaggaacaccatttgcgactgattgatcaataattgtatcaattgtctctgctagttgatgtggctccttacactttatattatgaccttttgggacagcggtg

SEQ ID NO: 430734 - DNA, 140 bp, Artificial Sequence
  Synthetic
caccgctgtcccaaaaggtcataatataaagtgtaaggagccacatcaactagcagagacaattgatacaattattgatcaatcagtcgcaaatggtgttcctgtccatctatgcaacttcatatcagcagccagggcct

SEQ ID NO: 430735 - DNA, 140 bp, Artificial Sequence
  Synthetic
atacgccatgctgggtctccacaaaaaatctagatttgaactctgcaacaaatctgccgataacactcttagggctcacaaacttattgagttgatcactcatgtaatagtgaaactccacgtacttgggagtcggccat

SEQ ID NO: 430736 - DNA, 140 bp, Artificial Sequence
  Synthetic
atggccgactcccaagtacgtggagtttcactattacatgagtgatcaactcaataagtttgtgagccctaagagtgttatcggcagatttgttgcagagttcaaatctagattttttgtggagacccagcatggcgtat

SEQ ID NO: 430737 - DNA, 140 bp, Artificial Sequence
  Synthetic
aggccctggctgctgatatgagggctcacaaacttattgagttgatcactcatgtaatagtgaaactccattagggtcctaaactcttctgggtctctctgcaggagttccgttaaagtcgaccttttgggacagcggtg

SEQ ID NO: 430738 - DNA, 140 bp, Artificial Sequence
  Synthetic
caccgctgtcccaaaaggtcgactttaacggaactcctgcagagagacccagaagagtttaggaccctaatggagtttcactattacatgagtgatcaactcaataagtttgtgagccctcatatcagcagccagggcct

SEQ ID NO: 430739 - DNA, 140 bp, Artificial Sequence
  Synthetic
atacgccatgctgggtctccgccaccacatatgcaactgattgcataattaatgaacctttccgaaattagagcataaaagtctgatgtgttatgtaatattccctgacccatgtcaagtcgtacttgggagtcggccat

SEQ ID NO: 430740 - DNA, 140 bp, Artificial Sequence
  Synthetic
atggccgactcccaagtacgacttgacatgggtcagggaatattacataacacatcagacttttatgctctaatttcggaaaggttcattaattatgcaatcagttgcatatgtggtggcggagacccagcatggcgtat

SEQ ID NO: 430741 - DNA, 140 bp, Artificial Sequence
  Synthetic
aggccctggctgctgatatggagcataaaagtctgatgtgttatgtaatattccctgacccatgtcaagtattgaacttatatgagaaggcaccacaccgatttgaaagttagaataaaagaccttttgggacagcggtg

SEQ ID NO: 430742 - DNA, 140 bp, Artificial Sequence
  Synthetic
caccgctgtcccaaaaggtcttttattctaactttcaaatcggtgtggtgccttctcatataagttcaatacttgacatgggtcagggaatattacataacacatcagacttttatgctccatatcagcagccagggcct

SEQ ID NO: 430743 - DNA, 140 bp, Artificial Sequence
  Synthetic
aggccctggctgctgatatggctaaaggcagcaacacagccgagcgcaccctcaaccgaggcgacccagaacacaacacctccaccatacaccccgtgatcccaggaacaacactcccatgaccttttgggacagcggtg

SEQ ID NO: 430744 - DNA, 140 bp, Artificial Sequence
  Synthetic
caccgctgtcccaaaaggtcatgggagtgttgttcctgggatcacggggtgtatggtggaggtgttgtgttctgggtcgcctcggttgagggtgcgctcggctgtgttgctgcctttagccatatcagcagccagggcct

SEQ ID NO: 430745 - DNA, 140 bp, Artificial Sequence
  Synthetic
atacgccatgctgggtctcccttttataaatgacttcatcattgctgatactacattgaagggtatttctaccatcttgtgcatgtgccacataagcaaagttgagaggtagtctcttcccgtacttgggagtcggccat

SEQ ID NO: 430746 - DNA, 140 bp, Artificial Sequence
  Synthetic
atggccgactcccaagtacgggaagagactacctctcaactttgcttatgtggcacatgcacaagatggtagaaatacccttcaatgtagtatcagcaatgatgaagtcatttataaaagggagacccagcatggcgtat

SEQ ID NO: 430747 - DNA, 140 bp, Artificial Sequence
  Synthetic
aggccctggctgctgatatgcatataagagatatttaaaacaaacttgaatctattggtcatcatactgacaacttcttcagacagaattatctttaataagtgacgaacaagtctgtaggaccttttgggacagcggtg

SEQ ID NO: 430748 - DNA, 140 bp, Artificial Sequence
  Synthetic
caccgctgtcccaaaaggtcctacagacttgttcgtcacttattaaagataattctgtctgaagaagttgtcagtatgatgaccaatagattcaagtttgttttaaatatctcttatatgcatatcagcagccagggcct

SEQ ID NO: 430749 - DNA, 140 bp, Artificial Sequence
  Synthetic
atacgccatgctgggtctccatgctataagagacttgtgccaaggagacattcaatttcatggagaggatggcattttcaaactccttttcgttatttaagcaactccctgacaactgtacgtacttgggagtcggccat

SEQ ID NO: 430750 - DNA, 140 bp, Artificial Sequence
  Synthetic
atggccgactcccaagtacgtacagttgtcagggagttgcttaaataacgaaaaggagtttgaaaatgccatcctctccatgaaattgaatgtctccttggcacaagtctcttatagcatggagacccagcatggcgtat

SEQ ID NO: 430751 - DNA, 140 bp, Artificial Sequence
  Synthetic
aggccctggctgctgatatgggcattttcaaactccttttcgttatttaagcaactccctgacaactgtagactcagtgcttcaaagtaatcctctataagcctagtgaacatctttgtcgaccttttgggacagcggtg

SEQ ID NO: 430752 - DNA, 140 bp, Artificial Sequence
  Synthetic
caccgctgtcccaaaaggtcgacaaagatgttcactaggcttatagaggattactttgaagcactgagtctacagttgtcagggagttgcttaaataacgaaaaggagtttgaaaatgcccatatcagcagccagggcct

SEQ ID NO: 430753 - DNA, 140 bp, Artificial Sequence
  Synthetic
aggccctggctgctgatatgccttagaagcactcatcttggtctggacacttagggatttactggctggaagtatcacttagtaagtcaatggaaagcgcaatccaaaagcctaggatccgaccttttgggacagcggtg

SEQ ID NO: 430754 - DNA, 140 bp, Artificial Sequence
  Synthetic
caccgctgtcccaaaaggtcggatcctaggcttttggattgcgctttccattgacttactaagtgatacttccagccagtaaatccctaagtgtccagaccaagatgagtgcttctaaggcatatcagcagccagggcct

SEQ ID NO: 430755 - DNA, 140 bp, Artificial Sequence
  Synthetic
atacgccatgctgggtctcctgatagagagaacttgagtctccctgtgtcaggtcctattgagttgtaagattgtggtgactcttggctatagaaacacaagttcttcagcattgctgtgcgtacttgggagtcggccat

SEQ ID NO: 430756 - DNA, 140 bp, Artificial Sequence
  Synthetic
atggccgactcccaagtacgcacagcaatgctgaagaacttgtgtttctatagccaagagtcaccacaatcttacaactcaataggacctgacacagggagactcaagttctctctatcaggagacccagcatggcgtat

SEQ ID NO: 430757 - DNA, 140 bp, Artificial Sequence
  Synthetic
atacgccatgctgggtctcccctttcactaatcctgacatcatcagaaagcttacccatgtcaaacttaaaattaaggttccttgatctataatgggtgtacctacccataagtgtgtttcgtacttgggagtcggccat

SEQ ID NO: 430758 - DNA, 140 bp, Artificial Sequence
  Synthetic
atggccgactcccaagtacgaaacacacttatgggtaggtacacccattatagatcaaggaaccttaattttaagtttgacatgggtaagctttctgatgatgtcaggattagtgaaaggggagacccagcatggcgtat

SEQ ID NO: 430759 - DNA, 140 bp, Artificial Sequence
  Synthetic
atacgccatgctgggtctccttcaaatctctgagacgtttcagatcactgtcatcccttttttgtttgcgcattaagcgctgcacattgctgacttcagaaaagtcaagaccatgaaggacgtacttgggagtcggccat

SEQ ID NO: 430760 - DNA, 140 bp, Artificial Sequence
  Synthetic
atggccgactcccaagtacgtccttcatggtcttgacttttctgaagtcagcaatgtgcagcgcttaatgcgcaaacaaaaaagggatgacagtgatctgaaacgtctcagagatttgaaggagacccagcatggcgtat

SEQ ID NO: 430761 - DNA, 140 bp, Artificial Sequence
  Synthetic
aggccctggctgctgatatggtgacatatttccacagtaaaagtacttctccttcaacctaccattctcataaatggcatcacaaaattccttgtaaaaattgtccggtaagacatcctggaccttttgggacagcggtg

SEQ ID NO: 430762 - DNA, 140 bp, Artificial Sequence
  Synthetic
caccgctgtcccaaaaggtccaggatgtcttaccggacaatttttacaaggaattttgtgatgccatttatgagaatggtaggttgaaggagaagtacttttactgtggaaatatgtcaccatatcagcagccagggcct

SEQ ID NO: 430763 - DNA, 140 bp, Artificial Sequence
  Synthetic
atacgccatgctgggtctcctataaaatttgtttggaacaacttcgtccagatcattcactgatggctggctatcatcaaaaggacttgagcccagtttggcaggttccctatactggtccgtacttgggagtcggccat

SEQ ID NO: 430764 - DNA, 140 bp, Artificial Sequence
  Synthetic
atggccgactcccaagtacggaccagtatagggaacctgccaaactgggctcaagtccttttgatgatagccagccatcagtgaatgatctggacgaagttgttccaaacaaattttataggagacccagcatggcgtat

SEQ ID NO: 430765 - DNA, 140 bp, Artificial Sequence
  Synthetic
aggccctggctgctgatatgctatcatcaaaaggacttgagcccagtttggcaggttccctatactggtcaacaattttctcaacagtttctttcagctgattgaaataaacacttgcacgaccttttgggacagcggtg

SEQ ID NO: 430766 - DNA, 140 bp, Artificial Sequence
  Synthetic
caccgctgtcccaaaaggtcgtgcaagtgtttatttcaatcagctgaaagaaactgttgagaaaattgttgaccagtatagggaacctgccaaactgggctcaagtccttttgatgatagcatatcagcagccagggcct

SEQ ID NO: 430767 - DNA, 140 bp, Artificial Sequence
  Synthetic
atacgccatgctgggtctccccggggatcctaggcaatttagttggacttcagtggtaaggctcatttcagtgaatccccgaaccaaagtgcccagttaaaatgggcaacagacaggtcacgtacttgggagtcggccat

SEQ ID NO: 430768 - DNA, 140 bp, Artificial Sequence
  Synthetic
atggccgactcccaagtacgtgacctgtctgttgcccattttaactgggcactttggttcggggattcactgaaatgagccttaccactgaagtccaactaaattgcctaggatccccggggagacccagcatggcgtat

SEQ ID NO: 430769 - DNA, 140 bp, Artificial Sequence
  Synthetic
atacgccatgctgggtctccgtccagccggctagcaagaagaatcagaacgtcaaaaataaggagaagtttcctcctggtgttgaggatcctcatagactttatcttatttagaaaagatcgtacttgggagtcggccat

SEQ ID NO: 430770 - DNA, 140 bp, Artificial Sequence
  Synthetic
atggccgactcccaagtacgatcttttctaaataagataaagtctatgaggatcctcaacaccaggaggaaacttctccttatttttgacgttctgattcttcttgctagccggctggacggagacccagcatggcgtat

SEQ ID NO: 430771 - DNA, 140 bp, Artificial Sequence
  Synthetic
aggccctggctgctgatatgctcatagtcctgtttgttgagaaggtgcttcccttttcttgagaagacctcagtaagctgtgatacagccaatgctgtgagcttattaaagtcatagtttgaccttttgggacagcggtg

SEQ ID NO: 430772 - DNA, 140 bp, Artificial Sequence
  Synthetic
caccgctgtcccaaaaggtcaaactatgactttaataagctcacagcattggctgtatcacagcttactgaggtcttctcaagaaaagggaagcaccttctcaacaaacaggactatgagcatatcagcagccagggcct

SEQ ID NO: 430773 - DNA, 140 bp, Artificial Sequence
  Synthetic
aggccctggctgctgatatgcctttaaaatagacttcaagatgccatccattgtctgaggtgtaaccttgatggtctccaacatgttccccccatcaagcatacaagctccagctttcacgaccttttgggacagcggtg

SEQ ID NO: 430774 - DNA, 140 bp, Artificial Sequence
  Synthetic
caccgctgtcccaaaaggtcgtgaaagctggagcttgtatgcttgatggggggaacatgttggagaccatcaaggttacacctcagacaatggatggcatcttgaagtctattttaaaggcatatcagcagccagggcct

SEQ ID NO: 430775 - DNA, 140 bp, Artificial Sequence
  Synthetic
atacgccatgctgggtctccagccaaatccaaggctgtggcacagccactagtgataagagggtctttgatttccctctttacttctctttccttaaacagtgaaccattattgaaagagcgtacttgggagtcggccat

SEQ ID NO: 430776 - DNA, 140 bp, Artificial Sequence
  Synthetic
atggccgactcccaagtacgctctttcaataatggttcactgtttaaggaaagagaagtaaagagggaaatcaaagaccctcttatcactagtggctgtgccacagccttggatttggctggagacccagcatggcgtat

SEQ ID NO: 430777 - DNA, 140 bp, Artificial Sequence
  Synthetic
aggccctggctgctgatatgtttccctctttacttctctttccttaaacagtgaaccattattgaaagaggatgtaaggagggacaagaacttctttgaaacaccaggcctcttataactgaccttttgggacagcggtg

SEQ ID NO: 430778 - DNA, 140 bp, Artificial Sequence
  Synthetic
caccgctgtcccaaaaggtcagttataagaggcctggtgtttcaaagaagttcttgtccctccttacatcctctttcaataatggttcactgtttaaggaaagagaagtaaagagggaaacatatcagcagccagggcct

SEQ ID NO: 430779 - DNA, 140 bp, Artificial Sequence
  Synthetic
atacgccatgctgggtctcctatagatcatgtcatccagctcttcttccgtggctacatctccaggattagtactcacatggccgaatttaacttttggttcaaggaatttttcaaaacacgtacttgggagtcggccat

SEQ ID NO: 430780 - DNA, 140 bp, Artificial Sequence
  Synthetic
atggccgactcccaagtacgtgttttgaaaaattccttgaaccaaaagttaaattcggccatgtgagtactaatcctggagatgtagccacggaagaagagctggatgacatgatctataggagacccagcatggcgtat

SEQ ID NO: 430781 - DNA, 140 bp, Artificial Sequence
  Synthetic
aggccctggctgctgatatggtactcacatggccgaatttaacttttggttcaaggaatttttcaaaacattttatttgatctgtcaatctatctggtgtttcctttgtaataaagtgacgaccttttgggacagcggtg

SEQ ID NO: 430782 - DNA, 140 bp, Artificial Sequence
  Synthetic
caccgctgtcccaaaaggtcgtcactttattacaaaggaaacaccagatagattgacagatcaaataaaatgttttgaaaaattccttgaaccaaaagttaaattcggccatgtgagtaccatatcagcagccagggcct

SEQ ID NO: 430783 - DNA, 140 bp, Artificial Sequence
  Synthetic
atacgccatgctgggtctccttcacatctttagatagaatcaaattcattagtgcccttattaatctatagagtaagaactcaacatcagtaattagttcttctctaactttgtcaatgacgtacttgggagtcggccat

SEQ ID NO: 430784 - DNA, 140 bp, Artificial Sequence
  Synthetic
atggccgactcccaagtacgtcattgacaaagttagagaagaactaattactgatgttgagttcttactctatagattaataagggcactaatgaatttgattctatctaaagatgtgaaggagacccagcatggcgtat

SEQ ID NO: 430785 - DNA, 140 bp, Artificial Sequence
  Synthetic
aggccctggctgctgatatggagtaagaactcaacatcagtaattagttcttctctaactttgtcaatgaggtccttgtgataataatctgacacgtaagccattataaaatacctaagggaccttttgggacagcggtg

SEQ ID NO: 430786 - DNA, 140 bp, Artificial Sequence
  Synthetic
caccgctgtcccaaaaggtcccttaggtattttataatggcttacgtgtcagattattatcacaaggacctcattgacaaagttagagaagaactaattactgatgttgagttcttactccatatcagcagccagggcct

SEQ ID NO: 430787 - DNA, 140 bp, Artificial Sequence
  Synthetic
atacgccatgctgggtctccaaggatcatctttgtcaaagatctaatgtcgtctaattgctctaccagttcagtgcaatcttctatccaagaaatcatggtgttcactgttgtttgcagacgtacttgggagtcggccat

SEQ ID NO: 430788 - DNA, 140 bp, Artificial Sequence
  Synthetic
atggccgactcccaagtacgtctgcaaacaacagtgaacaccatgatttcttggatagaagattgcactgaactggtagagcaattagacgacattagatctttgacaaagatgatccttggagacccagcatggcgtat

SEQ ID NO: 430789 - DNA, 140 bp, Artificial Sequence
  Synthetic
aggccctggctgctgatatgcagtgcaatcttctatccaagaaatcatggtgttcactgttgtttgcagaacttcagctgaaaatattgccgggaagtatcttttaggatcagcataaaagaccttttgggacagcggtg

SEQ ID NO: 430790 - DNA, 140 bp, Artificial Sequence
  Synthetic
caccgctgtcccaaaaggtcttttatgctgatcctaaaagatacttcccggcaatattttcagctgaagttctgcaaacaacagtgaacaccatgatttcttggatagaagattgcactgcatatcagcagccagggcct

SEQ ID NO: 430791 - DNA, 140 bp, Artificial Sequence
  Synthetic
aggccctggctgctgatatgtgtcttgatagcttctcattgtctgcaaggtactttgagataagatctttagcattggcaatgtcttcctccatcgccaattgtggcacctgtgttgggtgaccttttgggacagcggtg

SEQ ID NO: 430792 - DNA, 140 bp, Artificial Sequence
  Synthetic
caccgctgtcccaaaaggtcacccaacacaggtgccacaattggcgatggaggaagacattgccaatgctaaagatcttatctcaaagtaccttgcagacaatgagaagctatcaagacacatatcagcagccagggcct

SEQ ID NO: 430793 - DNA, 140 bp, Artificial Sequence
  Synthetic
atacgccatgctgggtctccactctcctgtcttttgataaattaattgaaattcagtaccactcaatgagaactcttgacaataagcttctttacatctgaccacctgataccttgcaggcgtacttgggagtcggccat

SEQ ID NO: 430794 - DNA, 140 bp, Artificial Sequence
  Synthetic
atggccgactcccaagtacgcctgcaaggtatcaggtggtcagatgtaaagaagcttattgtcaagagttctcattgagtggtactgaatttcaattaatttatcaaaagacaggagagtggagacccagcatggcgtat

SEQ ID NO: 430795 - DNA, 140 bp, Artificial Sequence
  Synthetic
aggccctggctgctgatatgaactcttgacaataagcttctttacatctgaccacctgataccttgcaggcccaaattcattttgtctcaactttacagtggaagaagttttcatcgagtgaccttttgggacagcggtg

SEQ ID NO: 430796 - DNA, 140 bp, Artificial Sequence
  Synthetic
caccgctgtcccaaaaggtcactcgatgaaaacttcttccactgtaaagttgagacaaaatgaatttgggcctgcaaggtatcaggtggtcagatgtaaagaagcttattgtcaagagttcatatcagcagccagggcct

SEQ ID NO: 430797 - DNA, 140 bp, Artificial Sequence
  Synthetic
aggccctggctgctgatatgatcaggtatttgttcattgtaaaatgttgtcctgccgtctatgagagggatgagattgatgccaacagactccaaatcattctttaattgttctagtttcgaccttttgggacagcggtg

SEQ ID NO: 430798 - DNA, 140 bp, Artificial Sequence
  Synthetic
caccgctgtcccaaaaggtcgaaactagaacaattaaagaatgatttggagtctgttggcatcaatctcatccctctcatagacggcaggacaacattttacaatgaacaaatacctgatcatatcagcagccagggcct

SEQ ID NO: 430799 - DNA, 140 bp, Artificial Sequence
  Synthetic
atacgccatgctgggtctccaacagttccacatctcccatgatataaggaaacgtctcctcttctgatctttggtagctaattgtagggacaaccccagaaacaatgaagtccatgattacgtacttgggagtcggccat

SEQ ID NO: 430800 - DNA, 140 bp, Artificial Sequence
  Synthetic
atggccgactcccaagtacgtaatcatggacttcattgtttctggggttgtccctacaattagctaccaaagatcagaagaggagacgtttccttatatcatgggagatgtggaactgttggagacccagcatggcgtat

SEQ ID NO: 430801 - DNA, 140 bp, Artificial Sequence
  Synthetic
atacgccatgctgggtctccttgtgatcttctaaatacttctgttcaaaattggcgggggatgatctaacaaagcactcaagtaagattagaacattaccagtgagtttgtagccgtcagcgtacttgggagtcggccat

SEQ ID NO: 430802 - DNA, 140 bp, Artificial Sequence
  Synthetic
atggccgactcccaagtacgctgacggctacaaactcactggtaatgttctaatcttacttgagtgctttgttagatcatcccccgccaattttgaacagaagtatttagaagatcacaaggagacccagcatggcgtat

SEQ ID NO: 430803 - DNA, 140 bp, Artificial Sequence
  Synthetic
atacgccatgctgggtctccgtggaatattgagttgaggatttgattcttgttcgagcactgagagggttgcatgactctagacttttcagcttgttgcctccgttcaacccatttctctcgtacttgggagtcggccat

SEQ ID NO: 430804 - DNA, 140 bp, Artificial Sequence
  Synthetic
atggccgactcccaagtacgagagaaatgggttgaacggaggcaacaagctgaaaagtctagagtcatgcaaccctctcagtgctcgaacaagaatcaaatcctcaactcaatattccacggagacccagcatggcgtat

SEQ ID NO: 430805 - DNA, 140 bp, Artificial Sequence
  Synthetic
aggccctggctgctgatatggcatgactctagacttttcagcttgttgcctccgttcaacccatttctctaggtctctttttgttgactctaaggaaaccagcctatcattaacacttatgaccttttgggacagcggtg

SEQ ID NO: 430806 - DNA, 140 bp, Artificial Sequence
  Synthetic
caccgctgtcccaaaaggtcataagtgttaatgataggctggtttccttagagtcaacaaaaagagacctagagaaatgggttgaacggaggcaacaagctgaaaagtctagagtcatgccatatcagcagccagggcct

SEQ ID NO: 430807 - DNA, 140 bp, Artificial Sequence
  Synthetic
atacgccatgctgggtctccgtttgcttgcaaggagaaccagtgcatcaaaaattaacaagagttttctccttgtgttcaatatcctcaaagatttgactttgttcagaaatgatctccacgtacttgggagtcggccat

SEQ ID NO: 430808 - DNA, 140 bp, Artificial Sequence
  Synthetic
atggccgactcccaagtacgtggagatcatttctgaacaaagtcaaatctttgaggatattgaacacaaggagaaaactcttgttaatttttgatgcactggttctccttgcaagcaaacggagacccagcatggcgtat

SEQ ID NO: 430809 - DNA, 140 bp, Artificial Sequence
  Synthetic
aggccctggctgctgatatgcttgtgttcaatatcctcaaagatttgactttgttcagaaatgatctccagcactgcatctggcactcaccggtagtttgacttcctctttcccagttccgaccttttgggacagcggtg

SEQ ID NO: 430810 - DNA, 140 bp, Artificial Sequence
  Synthetic
caccgctgtcccaaaaggtcggaactgggaaagaggaagtcaaactaccggtgagtgccagatgcagtgctggagatcatttctgaacaaagtcaaatctttgaggatattgaacacaagcatatcagcagccagggcct

SEQ ID NO: 430811 - DNA, 140 bp, Artificial Sequence
  Synthetic
aggccctggctgctgatatggggtgggagctacattgctcttgactcaggccgtgacaggtgggactgtattatgactagttatcaatatctgataatccaaaatacaacctgggaagatgaccttttgggacagcggtg

SEQ ID NO: 430812 - DNA, 140 bp, Artificial Sequence
  Synthetic
caccgctgtcccaaaaggtcatcttcccaggttgtattttggattatcagatattgataactagtcataatacagtcccacctgtcacggcctgagtcaagagcaatgtagctcccaccccatatcagcagccagggcct

SEQ ID NO: 430813 - DNA, 140 bp, Artificial Sequence
  Synthetic
atacgccatgctgggtctccaattgataaatcaaactttcaacattgtcttttgtggtcactttatcagcatacaaatcattgaactcattgagtaattgactcttctcgacctttaggacgtacttgggagtcggccat

SEQ ID NO: 430814 - DNA, 140 bp, Artificial Sequence
  Synthetic
atggccgactcccaagtacgtcctaaaggtcgagaagagtcaattactcaatgagttcaatgatttgtatgctgataaagtgaccacaaaagacaatgttgaaagtttgatttatcaattggagacccagcatggcgtat

SEQ ID NO: 430815 - DNA, 140 bp, Artificial Sequence
  Synthetic
aggccctggctgctgatatgacaaaggaccagagatatttatattagtagaaggctactaggcacattcacatggacactgtcagattctgaaggcaaggacacaccagggggatattgtgaccttttgggacagcggtg

SEQ ID NO: 430816 - DNA, 140 bp, Artificial Sequence
  Synthetic
caccgctgtcccaaaaggtcacaatatccccctggtgtgtccttgccttcagaatctgacagtgtccatgtgaatgtgcctagtagccttctactaatataaatatctctggtcctttgtcatatcagcagccagggcct

SEQ ID NO: 430817 - DNA, 140 bp, Artificial Sequence
  Synthetic
aggccctggctgctgatatgggtcttagcatttgggtcaagttgcagcattgcatccttgagggtcatcagctgagaataggtaagcccagcggtaaaccctgccgactgcagggatttagaccttttgggacagcggtg

SEQ ID NO: 430818 - DNA, 140 bp, Artificial Sequence
  Synthetic
caccgctgtcccaaaaggtctaaatccctgcagtcggcagggtttaccgctgggcttacctattctcagctgatgaccctcaaggatgcaatgctgcaacttgacccaaatgctaagacccatatcagcagccagggcct

SEQ ID NO: 430819 - DNA, 140 bp, Artificial Sequence
  Synthetic
atacgccatgctgggtctccgccttggtggcatgaggttatcacttcctcataatggttggaacgattgtctaataaaacattcaagctctccacccctgatagcctccctgaagtcatacgtacttgggagtcggccat

SEQ ID NO: 430820 - DNA, 140 bp, Artificial Sequence
  Synthetic
atggccgactcccaagtacgtatgacttcagggaggctatcaggggtggagagcttgaatgttttattagacaatcgttccaaccattatgaggaagtgataacctcatgccaccaaggcggagacccagcatggcgtat

SEQ ID NO: 430821 - DNA, 140 bp, Artificial Sequence
  Synthetic
aggccctggctgctgatatgctaataaaacattcaagctctccacccctgatagcctccctgaagtcatagataaagactcacaaagcctactatattctgactcttcaaaaagtgaattgaccttttgggacagcggtg

SEQ ID NO: 430822 - DNA, 140 bp, Artificial Sequence
  Synthetic
caccgctgtcccaaaaggtcaattcactttttgaagagtcagaatatagtaggctttgtgagtctttatctatgacttcagggaggctatcaggggtggagagcttgaatgttttattagcatatcagcagccagggcct

SEQ ID NO: 430823 - DNA, 140 bp, Artificial Sequence
  Synthetic
atacgccatgctgggtctcccattaacccagtcaggtatttgttcattatagaatgatgttcttccgtctatgagtggtattagattgatgtcaacactcctcagatcttccttcaactgcgtacttgggagtcggccat

SEQ ID NO: 430824 - DNA, 140 bp, Artificial Sequence
  Synthetic
atggccgactcccaagtacgcagttgaaggaagatctgaggagtgttgacatcaatctaataccactcatagacggaagaacatcattctataatgaacaaatacctgactgggttaatgggagacccagcatggcgtat

SEQ ID NO: 430825 - DNA, 140 bp, Artificial Sequence
  Synthetic
aggccctggctgctgatatgatgagtggtattagattgatgtcaacactcctcagatcttccttcaactgctctaactttttgaagtcctcaatgtacttctgttcaaagttggcagggggaccttttgggacagcggtg

SEQ ID NO: 430826 - DNA, 140 bp, Artificial Sequence
  Synthetic
caccgctgtcccaaaaggtccccctgccaactttgaacagaagtacattgaggacttcaaaaagttagagcagttgaaggaagatctgaggagtgttgacatcaatctaataccactcatcatatcagcagccagggcct

SEQ ID NO: 430827 - DNA, 140 bp, Artificial Sequence
  Synthetic
atacgccatgctgggtctcctaaccgtctggtactacaaaacatagtgaaggggtcaagatcccatggtcatgaaggattctttctacagatttgtcctcgttgttgtgttcacacccatcgtacttgggagtcggccat

SEQ ID NO: 430828 - DNA, 140 bp, Artificial Sequence
  Synthetic
atggccgactcccaagtacgatgggtgtgaacacaacaacgaggacaaatctgtagaaagaatccttcatgaccatgggatcttgaccccttcactatgttttgtagtaccagacggttaggagacccagcatggcgtat

SEQ ID NO: 430829 - DNA, 140 bp, Artificial Sequence
  Synthetic
aggccctggctgctgatatgatgaaggattctttctacagatttgtcctcgttgttgtgttcacacccatttgcattgcaagaatcaacctcaatacaaagggacagaagtttcaaccccgaccttttgggacagcggtg

SEQ ID NO: 430830 - DNA, 140 bp, Artificial Sequence
  Synthetic
caccgctgtcccaaaaggtcggggttgaaacttctgtccctttgtattgaggttgattcttgcaatgcaaatgggtgtgaacacaacaacgaggacaaatctgtagaaagaatccttcatcatatcagcagccagggcct

SEQ ID NO: 430831 - DNA, 140 bp, Artificial Sequence
  Synthetic
aggccctggctgctgatatggggcccccgtgacccaccgcctgttggcggtgggtcacgggggcgtccatttacaggacgaccctaggtgtcgatgttctgaacaccatgtctctgggcagaccttttgggacagcggtg

SEQ ID NO: 430832 - DNA, 140 bp, Artificial Sequence
  Synthetic
caccgctgtcccaaaaggtctgcccagagacatggtgttcagaacatcgacacctagggtcgtcctgtaaatggacgcccccgtgacccaccgccaacaggcggtgggtcacgggggccccatatcagcagccagggcct

SEQ ID NO: 430833 - DNA, 140 bp, Artificial Sequence
  Synthetic
aggccctggctgctgatatgcataggccatgtcttcctccatgcttgactgcagatgaggtgatcacagctctcaaataagtggttaactgaggtggcagcttactgtggaatagggtttgaccttttgggacagcggtg

SEQ ID NO: 430834 - DNA, 140 bp, Artificial Sequence
  Synthetic
caccgctgtcccaaaaggtcaaaccctattccacagtaagctgccacctcagttaaccacttatttgagagctgtgatcacctcatctgcagtcaagcatggaggaagacatggcctatgcatatcagcagccagggcct

SEQ ID NO: 430835 - DNA, 140 bp, Artificial Sequence
  Synthetic
aggccctggctgctgatatggaagaggtgatgaacattgttctcattgcactgtccatactggcagtgctgaagggtctgtacaatcttgcaacgtgtggccttgttgggttagttacttgaccttttgggacagcggtg

SEQ ID NO: 430836 - DNA, 140 bp, Artificial Sequence
  Synthetic
caccgctgtcccaaaaggtcaagtaactaacccaacaaggccacacgttgcaagattgtacagacccttcagcactgccagtatggacagtgcaatgagaacaatgttcatcacctcttccatatcagcagccagggcct

SEQ ID NO: 430837 - DNA, 140 bp, Artificial Sequence
  Synthetic
atacgccatgctgggtctccggtccctcaaccgtttcaaatcattgtcatcccttctctccttgcgcatcaaccgttgaacattactgacttcggagaagtcaagtccatgtaaaagagccgtacttgggagtcggccat

SEQ ID NO: 430838 - DNA, 140 bp, Artificial Sequence
  Synthetic
atggccgactcccaagtacggctcttttacatggacttgacttctccgaagtcagtaatgttcaacggttgatgcgcaaggagagaagggatgacaatgatttgaaacggttgagggaccggagacccagcatggcgtat

SEQ ID NO: 430839 - DNA, 140 bp, Artificial Sequence
  Synthetic
atacgccatgctgggtctccctagagcaacagttcactatagggcaaggtcccgttggaggcacaagagacacaagaggcaattaaagacaataaaattagatagccttaatgcctaggacgtacttgggagtcggccat

SEQ ID NO: 430840 - DNA, 140 bp, Artificial Sequence
  Synthetic
atggccgactcccaagtacgtcctaggcattaaggctatctaattttattgtctttaattgcctcttgtgtctcttgtgcctccaacgggaccttgccctatagtgaactgttgctctagggagacccagcatggcgtat

SEQ ID NO: 430841 - DNA, 140 bp, Artificial Sequence
  Synthetic
aggccctggctgctgatatgtacaacctgagtcacagctatgctggggatgcggccaaccactgtggcactgttgcaaatggtgtcttacagactttcatgaggatggcttggggtgggagaccttttgggacagcggtg

SEQ ID NO: 430842 - DNA, 140 bp, Artificial Sequence
  Synthetic
caccgctgtcccaaaaggtctcccaccccaagccatcctcatgaaagtctgtaagacaccatttgcaacagtgccacagtggttggccgcatccccagcatagctgtgactcaggttgtacatatcagcagccagggcct

SEQ ID NO: 430843 - DNA, 140 bp, Artificial Sequence
  Synthetic
atacgccatgctgggtctccttaacatgggacaaatagtgacattctttcaggaagtgcctcatgtgatagaggaggtaatgaacattgtgctcattgcactatccatactggcagtgctcgtacttgggagtcggccat

SEQ ID NO: 430844 - DNA, 140 bp, Artificial Sequence
  Synthetic
atggccgactcccaagtacgagcactgccagtatggatagtgcaatgagcacaatgttcattacctcctctatcacatgaggcacttcctgaaagaatgtcactatttgtcccatgttaaggagacccagcatggcgtat

SEQ ID NO: 430845 - DNA, 140 bp, Artificial Sequence
  Synthetic
atacgccatgctgggtctccgaggaggtaatgaacattgtgctcattgcactatccatactggcagtgctgaagggtctatacaatgttgcaacatgcggcctgattggtttagtcacctcgtacttgggagtcggccat

SEQ ID NO: 430846 - DNA, 140 bp, Artificial Sequence
  Synthetic
atggccgactcccaagtacgaggtgactaaaccaatcaggccgcatgttgcaacattgtatagacccttcagcactgccagtatggatagtgcaatgagcacaatgttcattacctcctcggagacccagcatggcgtat

SEQ ID NO: 430847 - DNA, 140 bp, Artificial Sequence
  Synthetic
aggccctggctgctgatatgtacgaacttcagactctggaattaaacatggagacactcaatatgactatgcctctctcttgtacaaagaacaacagtcaccactatataagggtgggtagaccttttgggacagcggtg

SEQ ID NO: 430848 - DNA, 140 bp, Artificial Sequence
  Synthetic
caccgctgtcccaaaaggtctacccacccttatatagtggtgactgttgttctttgtacaagagagaggcatagtcatattgagtgtctccatgtttaattccagagtctgaagttcgtacatatcagcagccagggcct

SEQ ID NO: 430849 - DNA, 140 bp, Artificial Sequence
  Synthetic
atacgccatgctgggtctccgcctctctcttgtacaaagaacaacagtcaccactatataagggtgggtaatgagacaggactagagttgaccctgaccaacacaagcatcatcaatcaccgtacttgggagtcggccat

SEQ ID NO: 430850 - DNA, 140 bp, Artificial Sequence
  Synthetic
atggccgactcccaagtacggtgattgatgatgcttgtgttggtcagggtcaactctagtcctgtctcattacccacccttatatagtggtgactgttgttctttgtacaagagagaggcggagacccagcatggcgtat

SEQ ID NO: 430851 - DNA, 140 bp, Artificial Sequence
  Synthetic
aggccctggctgctgatatgattcaagtgtcctatttaaaatgggacagatagtgacattcttccaggaagtgcctcatgtaatagaagaggtgatgaacattgttctcattgcactgtcgaccttttgggacagcggtg

SEQ ID NO: 430852 - DNA, 140 bp, Artificial Sequence
  Synthetic
caccgctgtcccaaaaggtcgacagtgcaatgagaacaatgttcatcacctcttctattacatgaggcacttcctggaagaatgtcactatctgtcccattttaaataggacacttgaatcatatcagcagccagggcct

SEQ ID NO: 430853 - DNA, 140 bp, Artificial Sequence
  Synthetic
aggccctggctgctgatatgtttgatgagcataatctcgacttttcacttgtccattcccaacttcaaccaatatgaggcaatgagctgtgacttcaatggagggaagattagtgtgcaggaccttttgggacagcggtg

SEQ ID NO: 430854 - DNA, 140 bp, Artificial Sequence
  Synthetic
caccgctgtcccaaaaggtcctgcacactaatcttccctccattgaagtcacagctcattgcctcatattggttgaagttgggaatggacaagtgaaaagtcgagattatgctcatcaaacatatcagcagccagggcct

SEQ ID NO: 430855 - DNA, 140 bp, Artificial Sequence
  Synthetic
atacgccatgctgggtctcctcccatcagcttattcccattcattactaataaaattgatttaaagcactggaagtactcttggtccaaaaaagttctagttaccactgcttttgtcagccgtacttgggagtcggccat

SEQ ID NO: 430856 - DNA, 140 bp, Artificial Sequence
  Synthetic
atggccgactcccaagtacggctgacaaaagcagtggtaactagaacttttttggaccaagagtacttccagtgctttaaatcaattttattagtaatgaatgggaataagctgatgggaggagacccagcatggcgtat

SEQ ID NO: 430857 - DNA, 140 bp, Artificial Sequence
  Synthetic
aggccctggctgctgatatgctttggtcaagttgctgtgagcttaggttgcccatatagacacctgcactcaatggcctttctgttctggtcaccttcgacttcaacttctctagatcaggaccttttgggacagcggtg

SEQ ID NO: 430858 - DNA, 140 bp, Artificial Sequence
  Synthetic
caccgctgtcccaaaaggtcctgatctagagaagttgaagtcgaaggtgaccagaacagaaaggccattgagtgcaggtgtctatatgggcaacctaagctcacagcaacttgaccaaagcatatcagcagccagggcct

SEQ ID NO: 430859 - DNA, 140 bp, Artificial Sequence
  Synthetic
aggccctggctgctgatatgagttgcaaatggtgttttacaaaccttcatgaggatggcttggggtgggagttacatcgcccttgactcaggtcgtggcaattgggactgtattatgactgaccttttgggacagcggtg

SEQ ID NO: 430860 - DNA, 140 bp, Artificial Sequence
  Synthetic
caccgctgtcccaaaaggtcagtcataatacagtcccaattgccacgacctgagtcaagggcgatgtaactcccaccccaagccatcctcatgaaggtttgtaaaacaccatttgcaactcatatcagcagccagggcct

SEQ ID NO: 430861 - DNA, 140 bp, Artificial Sequence
  Synthetic
atacgccatgctgggtctcccctctttgtgttcagcacaagtttctatctcattagcatcttccttcacctagtcaaaataccaactcataggcatattgtaggcaagtcatgtcctaaacgtacttgggagtcggccat

SEQ ID NO: 430862 - DNA, 140 bp, Artificial Sequence
  Synthetic
atggccgactcccaagtacgtttaggacatgacttgcctacaatatgcctatgagttggtattttgactaggtgaaggaagatgctaatgagatagaaacttgtgctgaacacaaagaggggagacccagcatggcgtat

SEQ ID NO: 430863 - DNA, 140 bp, Artificial Sequence
  Synthetic
atacgccatgctgggtctcccctcacagattgaatcatatgggcatatgttcctgtggactctataaacagcccggtgtgcctgtgaaatggaagagatgagacccttatcagggccccccgtacttgggagtcggccat

SEQ ID NO: 430864 - DNA, 140 bp, Artificial Sequence
  Synthetic
atggccgactcccaagtacggggggccctgataagggtctcatctcttccatttcacaggcacaccgggctgtttatagagtccacaggaacatatgcccatatgattcaatctgtgaggggagacccagcatggcgtat

SEQ ID NO: 430865 - DNA, 140 bp, Artificial Sequence
  Synthetic
aggccctggctgctgatatggcccggtgtgcctgtgaaatggaagagatgagacccttatcagggcccccgtgacccaccgcctattggcggtgggtcacgggggcgtccatttacaggagaccttttgggacagcggtg

SEQ ID NO: 430866 - DNA, 140 bp, Artificial Sequence
  Synthetic
caccgctgtcccaaaaggtctcctgtaaatggacgcccccgtgacccaccgccaataggcggtgggtcacgggggccctgataagggtctcatctcttccatttcacaggcacaccgggccatatcagcagccagggcct

SEQ ID NO: 430867 - DNA, 140 bp, Artificial Sequence
  Synthetic
aggccctggctgctgatatgcaaaatgtaatgagaaacatgatgaagaattctgtgacatgctaaggctgtttgacttcaataaacaagctattcagaggttgaaagccgaagcacaaatgaccttttgggacagcggtg

SEQ ID NO: 430868 - DNA, 140 bp, Artificial Sequence
  Synthetic
caccgctgtcccaaaaggtcatttgtgcttcggctttcaacctctgaatagcttgtttattgaagtcaaacagccttagcatgtcacagaattcttcatcatgtttctcattacattttgcatatcagcagccagggcct

SEQ ID NO: 430869 - DNA, 140 bp, Artificial Sequence
  Synthetic
aggccctggctgctgatatgcgtgcaaacacttcagttaactgtgtgacagccaaagctgtaagcttgttgaagtcataatccagaacacgagacccatctgtatacttattcacaacaagaccttttgggacagcggtg

SEQ ID NO: 430870 - DNA, 140 bp, Artificial Sequence
  Synthetic
caccgctgtcccaaaaggtcttgttgtgaataagtatacagatgggtctcgtgttctggattatgacttcaacaagcttacagctttggctgtcacacagttaactgaagtgtttgcacgcatatcagcagccagggcct

SEQ ID NO: 430871 - DNA, 140 bp, Artificial Sequence
  Synthetic
aggccctggctgctgatatggcccaaatgttggcttatatcaaatggctcatatttgaacgaaactcacttctctgatgacattgaacaggaagctgacaatatgatcactgagatgttagaccttttgggacagcggtg

SEQ ID NO: 430872 - DNA, 140 bp, Artificial Sequence
  Synthetic
caccgctgtcccaaaaggtctaacatctcagtgatcatattgtcagcttcctgttcaatgtcatcagagaagtgagtttcgttcaaatatgagccatttgatataagccaacatttgggccatatcagcagccagggcct

SEQ ID NO: 430873 - DNA, 140 bp, Artificial Sequence
  Synthetic
atacgccatgctgggtctccggtcggaaatgagactggtttggagctgaccctgacaaatacaagtattatcaaccacaagttttgtaacctttctgatgcacacaggaagaacctttaccgtacttgggagtcggccat

SEQ ID NO: 430874 - DNA, 140 bp, Artificial Sequence
  Synthetic
atggccgactcccaagtacggtaaaggttcttcctgtgtgcatcagaaaggttacaaaacttgtggttgataatacttgtatttgtcagggtcagctccaaaccagtctcatttccgaccggagacccagcatggcgtat

SEQ ID NO: 430875 - DNA, 140 bp, Artificial Sequence
  Synthetic
aggccctggctgctgatatgaactttcttgcattataaaccatttcagcaagctcttcctccgatgcatcatccttcgggttcacactcacatgtccaaattccaatttaggctcaaggagaccttttgggacagcggtg

SEQ ID NO: 430876 - DNA, 140 bp, Artificial Sequence
  Synthetic
caccgctgtcccaaaaggtctccttgagcctaaattggaatttggacatgtgagtgtgaacccgaaggatgatgcatcggaggaagagcttgctgaaatggtttataatgcaagaaagttcatatcagcagccagggcct

SEQ ID NO: 430877 - DNA, 140 bp, Artificial Sequence
  Synthetic
aggccctggctgctgatatggcaatttccactggatcttcaggtcttccttcaatgtccatccaggtcttagcatttgggtcaagttgcaacattgcatccttgagggtcattagctgaggaccttttgggacagcggtg

SEQ ID NO: 430878 - DNA, 140 bp, Artificial Sequence
  Synthetic
caccgctgtcccaaaaggtcctcagctaatgaccctcaaggatgcaatgttgcaacttgacccaaatgctaagacctggatggacattgaaggaagacctgaagatccagtggaaattgccatatcagcagccagggcct

SEQ ID NO: 430879 - DNA, 140 bp, Artificial Sequence
  Synthetic
aggccctggctgctgatatggtaatgaaatgacacatataagagatatttaaaacaaacttgaatctgttggtcatcatactgacaacttcttcagacagaattatctttaataagtgacgaccttttgggacagcggtg

SEQ ID NO: 430880 - DNA, 140 bp, Artificial Sequence
  Synthetic
caccgctgtcccaaaaggtcgtcacttattaaagataattctgtctgaagaagttgtcagtatgatgaccaacagattcaagtttgttttaaatatctcttatatgtgtcatttcattaccatatcagcagccagggcct

SEQ ID NO: 430881 - DNA, 140 bp, Artificial Sequence
  Synthetic
atacgccatgctgggtctcccgactctgggtgtcgatgttctaaacaccatgtctctaggtagaaccgctctcaagaccaatgtgttcaatcctcctgacactgctgcgtcaaacataatcgtacttgggagtcggccat

SEQ ID NO: 430882 - DNA, 140 bp, Artificial Sequence
  Synthetic
atggccgactcccaagtacgattatgtttgacgcagcagtgtcaggaggattgaacacattggtcttgagagcggttctacctagagacatggtgtttagaacatcgacacccagagtcgggagacccagcatggcgtat

SEQ ID NO: 430883 - DNA, 140 bp, Artificial Sequence
  Synthetic
aggccctggctgctgatatgatcgccaattgtggcacctgtattaggtttgggtttgtgctagaatggcttgtgggtcagctgatggtgtctcacaaaagctcctacagaaatgagagacgaccttttgggacagcggtg

SEQ ID NO: 430884 - DNA, 140 bp, Artificial Sequence
  Synthetic
caccgctgtcccaaaaggtcgtctctcatttctgtaggagcttttgtgagacaccatcagctgacccacaagccattctagcacaaacccaaacctaatacaggtgccacaattggcgatcatatcagcagccagggcct

SEQ ID NO: 430885 - DNA, 140 bp, Artificial Sequence
  Synthetic
aggccctggctgctgatatggatgtcaattagtttgatatcctttcttccctgtgattcaaggagtttctttatgtcatcagatccctgacaggtgatgaccatgttccggggaagtgccgaccttttgggacagcggtg

SEQ ID NO: 430886 - DNA, 140 bp, Artificial Sequence
  Synthetic
caccgctgtcccaaaaggtcggcacttccccggaacatggtcatcacctgtcagggatctgatgacataaagaaactccttgaatcacagggaagaaaggatatcaaactaattgacatccatatcagcagccagggcct

SEQ ID NO: 430887 - DNA, 140 bp, Artificial Sequence
  Synthetic
aggccctggctgctgatatgagcattgggatcaagctgcagcattgcatctttgagggtcataagctgagaataagtgagcccagcggcaaagcctgctgactgcagggatttgttagaagaccttttgggacagcggtg

SEQ ID NO: 430888 - DNA, 140 bp, Artificial Sequence
  Synthetic
caccgctgtcccaaaaggtcttctaacaaatccctgcagtcagcaggctttgccgctgggctcacttattctcagcttatgaccctcaaagatgcaatgctgcagcttgatcccaatgctcatatcagcagccagggcct

SEQ ID NO: 430889 - DNA, 140 bp, Artificial Sequence
  Synthetic
aggccctggctgctgatatgaagttgctgtgagctcaggttgcccatatagacacctgcactcaatggcctttctgtcctggtcacctttgatttcaacttctctagatcagcggctaaggaccttttgggacagcggtg

SEQ ID NO: 430890 - DNA, 140 bp, Artificial Sequence
  Synthetic
caccgctgtcccaaaaggtccttagccgctgatctagagaagttgaaatcaaaggtgaccaggacagaaaggccattgagtgcaggtgtctatatgggcaacctgagctcacagcaacttcatatcagcagccagggcct

SEQ ID NO: 430891 - DNA, 140 bp, Artificial Sequence
  Synthetic
atacgccatgctgggtctccttgtctccaacatgttaccaccatccagcatgcaagctcctgccttcacagctgcacccagactgaagttgtaacctgagatatttagggaactttttttcgtacttgggagtcggccat

SEQ ID NO: 430892 - DNA, 140 bp, Artificial Sequence
  Synthetic
atggccgactcccaagtacgaaaaaaagttccctaaatatctcaggttacaacttcagtctgggtgcagctgtgaaggcaggagcttgcatgctggatggtggtaacatgttggagacaaggagacccagcatggcgtat

SEQ ID NO: 430893 - DNA, 140 bp, Artificial Sequence
  Synthetic
atacgccatgctgggtctcctcctcaatgactgtgtccacaaaaaggactttatttcctttgaggcactcatcgccagattgttgtgctggatgcacgtggcaggaagctgagattacctcgtacttgggagtcggccat

SEQ ID NO: 430894 - DNA, 140 bp, Artificial Sequence
  Synthetic
atggccgactcccaagtacgaggtaatctcagcttcctgccacgtgcatccagcacaacaatctggcgatgagtgcctcaaaggaaataaagtcctttttgtggacacagtcattgaggaggagacccagcatggcgtat

SEQ ID NO: 430895 - DNA, 140 bp, Artificial Sequence
  Synthetic
aggccctggctgctgatatgaggcactcatcgccagattgttgtgctggatgcacgtggcaggaagctgagattacctgccaaaaagacaaaagcaaagcgcaatccaatagcctaggatgaccttttgggacagcggtg

SEQ ID NO: 430896 - DNA, 140 bp, Artificial Sequence
  Synthetic
caccgctgtcccaaaaggtcatcctaggctattggattgcgctttgcttttgtctttttggcaggtaatctcagcttcctgccacgtgcatccagcacaacaatctggcgatgagtgcctcatatcagcagccagggcct

SEQ ID NO: 430897 - DNA, 140 bp, Artificial Sequence
  Synthetic
aggccctggctgctgatatgctgaggcattagggtactttgctgtataaatcaggcccagatctgtcagtgcctgcaccacatcattcaggtcaacctgtccttgttttgttaaacatgcgaccttttgggacagcggtg

SEQ ID NO: 430898 - DNA, 140 bp, Artificial Sequence
  Synthetic
caccgctgtcccaaaaggtcgcatgtttaacaaaacaaggacaggttgacctgaatgatgtggtgcaggcactgacagatctgggcctgatttatacagcaaagtaccctaatgcctcagcatatcagcagccagggcct

SEQ ID NO: 430899 - DNA, 140 bp, Artificial Sequence
  Synthetic
atacgccatgctgggtctccgcctgcaccacatcattcaggtcaacctgtccttgttttgttaaacatgccaatgtcagacttggcatagtgccgaactgattgttaagtaggtctgcatcgtacttgggagtcggccat

SEQ ID NO: 430900 - DNA, 140 bp, Artificial Sequence
  Synthetic
atggccgactcccaagtacgatgcagacctacttaacaatcagttcggcactatgccaagtctgacattggcatgtttaacaaaacaaggacaggttgacctgaatgatgtggtgcaggcggagacccagcatggcgtat

SEQ ID NO: 430901 - DNA, 140 bp, Artificial Sequence
  Synthetic
atacgccatgctgggtctccagaagctcttcggaactggaatgttaactgttcaatgttgtcatcacaggtgtctattttatcatcatataacttcttgaagtcctctaataacttcatccgtacttgggagtcggccat

SEQ ID NO: 430902 - DNA, 140 bp, Artificial Sequence
  Synthetic
atggccgactcccaagtacggatgaagttattagaggacttcaagaagttatatgatgataaaatagacacctgtgatgacaacattgaacagttaacattccagttccgaagagcttctggagacccagcatggcgtat

SEQ ID NO: 430903 - DNA, 140 bp, Artificial Sequence
  Synthetic
atacgccatgctgggtctcctagttgctgtgagctcaagttgcccatatagacacctgcgctcaatggcctttctgtcctgatcacttttgatttcagcttctccaggtcagcagccaaacgtacttgggagtcggccat

SEQ ID NO: 430904 - DNA, 140 bp, Artificial Sequence
  Synthetic
atggccgactcccaagtacgtttggctgctgacctggagaagctgaaatcaaaagtgatcaggacagaaaggccattgagcgcaggtgtctatatgggcaacttgagctcacagcaactaggagacccagcatggcgtat

SEQ ID NO: 430905 - DNA, 140 bp, Artificial Sequence
  Synthetic
aggccctggctgctgatatgttgggtagatttcagctcaacaaggttgttgactgcttgatttagatccctcagccgtttcaggtcattgtcatcccttctctgtttgcgcatcaaccgtgaccttttgggacagcggtg

SEQ ID NO: 430906 - DNA, 140 bp, Artificial Sequence
  Synthetic
caccgctgtcccaaaaggtcacggttgatgcgcaaacagagaagggatgacaatgacctgaaacggctgagggatctaaatcaagcagtcaacaaccttgttgagctgaaatctacccaacatatcagcagccagggcct

SEQ ID NO: 430907 - DNA, 140 bp, Artificial Sequence
  Synthetic
atacgccatgctgggtctcctcagccgtttcaggtcattgtcatcccttctctgtttgcgcatcaaccgttggacattgctgacctcagagaaatcaagtccatgcaaaagggcttgggccgtacttgggagtcggccat

SEQ ID NO: 430908 - DNA, 140 bp, Artificial Sequence
  Synthetic
atggccgactcccaagtacggcccaagcccttttgcatggacttgatttctctgaggtcagcaatgtccaacggttgatgcgcaaacagagaagggatgacaatgacctgaaacggctgaggagacccagcatggcgtat

SEQ ID NO: 430909 - DNA, 140 bp, Artificial Sequence
  Synthetic
aggccctggctgctgatatgtcctcagggattgtgtccacaagaaggactttacctcctttgaagcactcattgccaggttgtcgtgttgtatgtagacagcggagagctgaaactgtctgaccttttgggacagcggtg

SEQ ID NO: 430910 - DNA, 140 bp, Artificial Sequence
  Synthetic
caccgctgtcccaaaaggtcagacagtttcagctctccgctgtctacatacaacacgacaacctggcaatgagtgcttcaaaggaggtaaagtccttcttgtggacacaatccctgaggacatatcagcagccagggcct

SEQ ID NO: 430911 - DNA, 140 bp, Artificial Sequence
  Synthetic
atacgccatgctgggtctccattgccaggttgtcgtgttgtatgtagacagcggagagctgaaactgtctgctaaaatgacaagagcaaagcgcaatccaatagcctaggatccactgtgcgtacttgggagtcggccat

SEQ ID NO: 430912 - DNA, 140 bp, Artificial Sequence
  Synthetic
atggccgactcccaagtacgcacagtggatcctaggctattggattgcgctttgctcttgtcattttagcagacagtttcagctctccgctgtctacatacaacacgacaacctggcaatggagacccagcatggcgtat

SEQ ID NO: 430913 - DNA, 140 bp, Artificial Sequence
  Synthetic
atacgccatgctgggtctccgcaccggggatcctaggcaatttagttgttcttcttttggaaccttgcaccctggtacccagcagatggggaacaagcaagccaaagcttcagaagcaaacgtacttgggagtcggccat

SEQ ID NO: 430914 - DNA, 140 bp, Artificial Sequence
  Synthetic
atggccgactcccaagtacgtttgcttctgaagctttggcttgcttgttccccatctgctgggtaccagggtgcaaggttccaaaagaagaacaactaaattgcctaggatccccggtgcggagacccagcatggcgtat

SEQ ID NO: 430915 - DNA, 140 bp, Artificial Sequence
  Synthetic
aggccctggctgctgatatgcctggtacccagcagatggggaacaagcaagccaaagcttcagaagcaaaagacagcccgagggctagtctgattccagatgccacacacctaggaccacgaccttttgggacagcggtg

SEQ ID NO: 430916 - DNA, 140 bp, Artificial Sequence
  Synthetic
caccgctgtcccaaaaggtcgtggtcctaggtgtgtggcatctggaatcagactagccctcgggctgtcttttgcttctgaagctttggcttgcttgttccccatctgctgggtaccaggcatatcagcagccagggcct

SEQ ID NO: 430917 - DNA, 140 bp, Artificial Sequence
  Synthetic
atacgccatgctgggtctccagacagcccgagggctagtctgattccagatgccacacacctaggaccacagttctgtaagagctgttggtttgagaacaagggcctggttgaatgcaaccgtacttgggagtcggccat

SEQ ID NO: 430918 - DNA, 140 bp, Artificial Sequence
  Synthetic
atggccgactcccaagtacggttgcattcaaccaggcccttgttctcaaaccaacagctcttacagaactgtggtcctaggtgtgtggcatctggaatcagactagccctcgggctgtctggagacccagcatggcgtat

SEQ ID NO: 430919 - DNA, 140 bp, Artificial Sequence
  Synthetic
atacgccatgctgggtctcccaggtgccccatctgcaaaatgcccctcccgacaagactgaggccatcaacagccccaacagcacccccagccagagcaggggataacatcaaacccccacgtacttgggagtcggccat

SEQ ID NO: 430920 - DNA, 140 bp, Artificial Sequence
  Synthetic
atggccgactcccaagtacgtgggggtttgatgttatcccctgctctggctgggggtgctgttggggctgttgatggcctcagtcttgtcgggaggggcattttgcagatggggcacctgggagacccagcatggcgtat

SEQ ID NO: 430921 - DNA, 140 bp, Artificial Sequence
  Synthetic
aggccctggctgctgatatgcagccccaacagcacccccagccagagcaggggataacatcaaacccccaccctacagtccctgagcccccaccaaccccaccactcctcccaccccccggaccttttgggacagcggtg

SEQ ID NO: 430922 - DNA, 140 bp, Artificial Sequence
  Synthetic
caccgctgtcccaaaaggtccggggggtgggaggagtggtggggttggtgggggctcagggactgtagggtgggggtttgatgttatcccctgctctggctgggggtgctgttggggctgcatatcagcagccagggcct

SEQ ID NO: 430923 - DNA, 140 bp, Artificial Sequence
  Synthetic
atacgccatgctgggtctccatctccaaggatctactcaatgtcttcaatgtgttcatccctctcgattaactcctcacatgttctgcctttcaatctcaatttgccactgcttgactgccgtacttgggagtcggccat

SEQ ID NO: 430924 - DNA, 140 bp, Artificial Sequence
  Synthetic
atggccgactcccaagtacggcagtcaagcagtggcaaattgagattgaaaggcagaacatgtgaggagttaatcgagagggatgaacacattgaagacattgagtagatccttggagatggagacccagcatggcgtat

SEQ ID NO: 430925 - DNA, 140 bp, Artificial Sequence
  Synthetic
atacgccatgctgggtctcccccaccaacacaaagtcatactccgtaaactgcaatctttccatgtcaacaacaatttcaacaggggtcacatgccccagttgatttgtgtcagttaaaacgtacttgggagtcggccat

SEQ ID NO: 430926 - DNA, 140 bp, Artificial Sequence
  Synthetic
atggccgactcccaagtacgttttaactgacacaaatcaactggggcatgtgacccctgttgaaattgttgttgacatggaaagattgcagtttacggagtatgactttgtgttggtgggggagacccagcatggcgtat

SEQ ID NO: 430927 - DNA, 140 bp, Artificial Sequence
  Synthetic
atacgccatgctgggtctcctattcggcgccgcagcccccagagtggaaacaatgtccacccctgaccactgcattctcaacccaagcctatccaacatcatgttactcaatgcctcgatcgtacttgggagtcggccat

SEQ ID NO: 430928 - DNA, 140 bp, Artificial Sequence
  Synthetic
atggccgactcccaagtacgatcgaggcattgagtaacatgatgttggataggcttgggttgagaatgcagtggtcaggggtggacattgtttccactctgggggctgcggcgccgaataggagacccagcatggcgtat

SEQ ID NO: 430929 - DNA, 140 bp, Artificial Sequence
  Synthetic
aggccctggctgctgatatgtgcattctcaacccaagcctatccaacatcatgttactcaatgcctcgatcaacaaatcagatgaggtgtccccaacttccctcacaaacatctcgagatgaccttttgggacagcggtg

SEQ ID NO: 430930 - DNA, 140 bp, Artificial Sequence
  Synthetic
caccgctgtcccaaaaggtcatctcgagatgtttgtgagggaagttggggacacctcatctgatttgttgatcgaggcattgagtaacatgatgttggataggcttgggttgagaatgcacatatcagcagccagggcct

SEQ ID NO: 430931 - DNA, 140 bp, Artificial Sequence
  Synthetic
aggccctggctgctgatatgagcacaatgtagtgttcctcccttttccattttactatgtgtgacacaagagacaaggcttcacagttaacatccaatgccacacagaggtctagaaattgaccttttgggacagcggtg

SEQ ID NO: 430932 - DNA, 140 bp, Artificial Sequence
  Synthetic
caccgctgtcccaaaaggtcaatttctagacctctgtgtggcattggatgttaactgtgaagccttgtctcttgtgtcacacatagtaaaatggaaaagggaggaacactacattgtgctcatatcagcagccagggcct

SEQ ID NO: 430933 - DNA, 140 bp, Artificial Sequence
  Synthetic
atacgccatgctgggtctcccataaactccctctatgcacaaccaatgggactggttcagtacaggggcccaccaacacaaagtcatactctccaaactgcaacttctctatgtcaagaacgtacttgggagtcggccat

SEQ ID NO: 430934 - DNA, 140 bp, Artificial Sequence
  Synthetic
atggccgactcccaagtacgttcttgacatagagaagttgcagtttggagagtatgactttgtgttggtgggcccctgtactgaaccagtcccattggttgtgcatagagggagtttatgggagacccagcatggcgtat

SEQ ID NO: 430935 - DNA, 140 bp, Artificial Sequence
  Synthetic
aggccctggctgctgatatgcaccaacacaaagtcatactctccaaactgcaacttctctatgtcaagaacaatttcaacaggagtcacatggcctagctggtttgtgtcaaccaaaaacgaccttttgggacagcggtg

SEQ ID NO: 430936 - DNA, 140 bp, Artificial Sequence
  Synthetic
caccgctgtcccaaaaggtcgtttttggttgacacaaaccagctaggccatgtgactcctgttgaaattgttcttgacatagagaagttgcagtttggagagtatgactttgtgttggtgcatatcagcagccagggcct

SEQ ID NO: 430937 - DNA, 140 bp, Artificial Sequence
  Synthetic
aggccctggctgctgatatgtagtagagtgcaacaaccattacctgtgtctcaactgtctcagcctgctcctcagtgttagcagcagatgcccgatctgtaagatgccccttcctaccaagaccttttgggacagcggtg

SEQ ID NO: 430938 - DNA, 140 bp, Artificial Sequence
  Synthetic
caccgctgtcccaaaaggtcttggtaggaaggggcatcttacagatcgggcatctgctgctaacactgaggagcaggctgagacagttgagacacaggtaatggttgttgcactctactacatatcagcagccagggcct

SEQ ID NO: 430939 - DNA, 140 bp, Artificial Sequence
  Synthetic
atacgccatgctgggtctccaggtcccgacaaaactaacctccaacagtctgacaagacacatggactaactgcaccagaatacatggcagtcacatcatgcactaagtacttgttctgccgtacttgggagtcggccat

SEQ ID NO: 430940 - DNA, 140 bp, Artificial Sequence
  Synthetic
atggccgactcccaagtacggcagaacaagtacttagtgcatgatgtgactgccatgtattctggtgcagttagtccatgtgtcttgtcagactgttggaggttagttttgtcgggacctggagacccagcatggcgtat

SEQ ID NO: 430941 - DNA, 140 bp, Artificial Sequence
  Synthetic
aggccctggctgctgatatgctgcaccagaatacatggcagtcacatcatgcactaagtacttgttctgctggttcattgagccagtgtaatcaaggtggatggcaaagctttccttaaagaccttttgggacagcggtg

SEQ ID NO: 430942 - DNA, 140 bp, Artificial Sequence
  Synthetic
caccgctgtcccaaaaggtctttaaggaaagctttgccatccaccttgattacactggctcaatgaaccagcagaacaagtacttagtgcatgatgtgactgccatgtattctggtgcagcatatcagcagccagggcct

SEQ ID NO: 430943 - DNA, 140 bp, Artificial Sequence
  Synthetic
aggccctggctgctgatatgaatcagagattgaatggacttaatatacagattctctttgtttggtccccgaacacatttgctacccaatgttctgcataatcccacaaagccagatgcagaccttttgggacagcggtg

SEQ ID NO: 430944 - DNA, 140 bp, Artificial Sequence
  Synthetic
caccgctgtcccaaaaggtctgcatctggctttgtgggattatgcagaacattgggtagcaaatgtgttcggggaccaaacaaagagaatctgtatattaagtccattcaatctctgattcatatcagcagccagggcct

SEQ ID NO: 430945 - DNA, 140 bp, Artificial Sequence
  Synthetic
aggccctggctgctgatatgtcaaacttagaatcaatcaaacctgatgcaatcagttgattctgattgaacttggcaggctcaatgtcaaagtctatccaagcataacccatcattaaatgaccttttgggacagcggtg

SEQ ID NO: 430946 - DNA, 140 bp, Artificial Sequence
  Synthetic
caccgctgtcccaaaaggtcatttaatgatgggttatgcttggatagactttgacattgagcctgccaagttcaatcagaatcaactgattgcatcaggtttgattgattctaagtttgacatatcagcagccagggcct

SEQ ID NO: 430947 - DNA, 140 bp, Artificial Sequence
  Synthetic
atacgccatgctgggtctccaatgaagaaaatggacccatcctatgcaatccttcaccttctgggaccgacgtcttatgtgggaaccaagtgaaagaccccaatgttcttgttgtggcaacgtacttgggagtcggccat

SEQ ID NO: 430948 - DNA, 140 bp, Artificial Sequence
  Synthetic
atggccgactcccaagtacgttgccacaacaagaacattggggtctttcacttggttcccacataagacgtcggtcccagaaggtgaaggattgcataggatgggtccattttcttcattggagacccagcatggcgtat

SEQ ID NO: 430949 - DNA, 140 bp, Artificial Sequence
  Synthetic
aggccctggctgctgatatgcgtcttatgtgggaaccaagtgaaagaccccaatgttcttgttgtggcaacaaatggtctcacataagactcaaaatagacttgcctcatgaaattgtcagaccttttgggacagcggtg

SEQ ID NO: 430950 - DNA, 140 bp, Artificial Sequence
  Synthetic
caccgctgtcccaaaaggtctgacaatttcatgaggcaagtctattttgagtcttatgtgagaccatttgttgccacaacaagaacattggggtctttcacttggttcccacataagacgcatatcagcagccagggcct

SEQ ID NO: 430951 - DNA, 140 bp, Artificial Sequence
  Synthetic
atacgccatgctgggtctcctctagtatgagataatcttaattcagatgacaatacaatataatgctcttctctcttccacttaactatgtgtgaaacaagagacaaagcctcacaattacgtacttgggagtcggccat

SEQ ID NO: 430952 - DNA, 140 bp, Artificial Sequence
  Synthetic
atggccgactcccaagtacgtaattgtgaggctttgtctcttgtttcacacatagttaagtggaagagagaagagcattatattgtattgtcatctgaattaagattatctcatactagaggagacccagcatggcgtat

SEQ ID NO: 430953 - DNA, 140 bp, Artificial Sequence
  Synthetic
aggccctggctgctgatatgctctcttccacttaactatgtgtgaaacaagagacaaagcctcacaattaacatccaacgccacacaaagatccagaaattttattctaggtgaccacttgaccttttgggacagcggtg

SEQ ID NO: 430954 - DNA, 140 bp, Artificial Sequence
  Synthetic
caccgctgtcccaaaaggtcaagtggtcacctagaataaaatttctggatctttgtgtggcgttggatgttaattgtgaggctttgtctcttgtttcacacatagttaagtggaagagagcatatcagcagccagggcct

SEQ ID NO: 430955 - DNA, 140 bp, Artificial Sequence
  Synthetic
atacgccatgctgggtctccacacagatgggtataatctcctcagagaatgaatgatgtggtttaaaccgaccctatcctccaacagctttgatgcagttggtttcaaggggaaataatccgtacttgggagtcggccat

SEQ ID NO: 430956 - DNA, 140 bp, Artificial Sequence
  Synthetic
atggccgactcccaagtacggattatttccccttgaaaccaactgcatcaaagctgttggaggatagggtcggtttaaaccacatcattcattctctgaggagattatacccatctgtgtggagacccagcatggcgtat

SEQ ID NO: 430957 - DNA, 140 bp, Artificial Sequence
  Synthetic
aggccctggctgctgatatgaccctatcctccaacagctttgatgcagttggtttcaaggggaaataatcacatgggttgtgcttgaagaactccaatgccttaaccgttttaggttctcgaccttttgggacagcggtg

SEQ ID NO: 430958 - DNA, 140 bp, Artificial Sequence
  Synthetic
caccgctgtcccaaaaggtcgagaacctaaaacggttaaggcattggagttcttcaagcacaacccatgtgattatttccccttgaaaccaactgcatcaaagctgttggaggatagggtcatatcagcagccagggcct

SEQ ID NO: 430959 - DNA, 140 bp, Artificial Sequence
  Synthetic
aggccctggctgctgatatgaaagtctctttaaaactagcatcctgactcttgattttatacctaattgtctggtaaaactgaacagagtccactggcattgtacttaacaaatcaaagagaccttttgggacagcggtg

SEQ ID NO: 430960 - DNA, 140 bp, Artificial Sequence
  Synthetic
caccgctgtcccaaaaggtctctttgatttgttaagtacaatgccagtggactctgttcagttttaccagacaattaggtataaaatcaagagtcaggatgctagttttaaagagactttcatatcagcagccagggcct

SEQ ID NO: 430961 - DNA, 140 bp, Artificial Sequence
  Synthetic
atacgccatgctgggtctcctaatcccacaacaagggtctaaagtaactgatcacaccttcatttttactcctaaggtccaatggaactcgccaatattgaacaccattagaatttgttacgtacttgggagtcggccat

SEQ ID NO: 430962 - DNA, 140 bp, Artificial Sequence
  Synthetic
atggccgactcccaagtacgtaacaaattctaatggtgttcaatattggcgagttccattggaccttaggagtaaaaatgaaggtgtgatcagttactttagacccttgttgtgggattaggagacccagcatggcgtat

SEQ ID NO: 430963 - DNA, 140 bp, Artificial Sequence
  Synthetic
aggccctggctgctgatatgcctaaggtccaatggaactcgccaatattgaacaccattagaatttgttagtaattcaatcccctgagtaccagaaattagagactggatggatttaatggaccttttgggacagcggtg

SEQ ID NO: 430964 - DNA, 140 bp, Artificial Sequence
  Synthetic
caccgctgtcccaaaaggtccattaaatccatccagtctctaatttctggtactcaggggattgaattactaacaaattctaatggtgttcaatattggcgagttccattggaccttaggcatatcagcagccagggcct

SEQ ID NO: 430965 - DNA, 140 bp, Artificial Sequence
  Synthetic
atacgccatgctgggtctccgcacaatccaacaaagccagatgcaatagaactttgaaatgcagatttgttgatggcttcagataataatttctgtgcaccccgggtgaaggtggaggatcgtacttgggagtcggccat

SEQ ID NO: 430966 - DNA, 140 bp, Artificial Sequence
  Synthetic
atggccgactcccaagtacgatcctccaccttcacccggggtgcacagaaattattatctgaagccatcaacaaatctgcatttcaaagttctattgcatctggctttgttggattgtgcggagacccagcatggcgtat

SEQ ID NO: 430967 - DNA, 140 bp, Artificial Sequence
  Synthetic
aggccctggctgctgatatgtcaccctctggtattgaggttttatgagggaaccaagtgaatgacccaagtgttcttgttgttgctacaaaagagcggacatatgattcaaagtagatttgaccttttgggacagcggtg

SEQ ID NO: 430968 - DNA, 140 bp, Artificial Sequence
  Synthetic
caccgctgtcccaaaaggtcaaatctactttgaatcatatgtccgctcttttgtagcaacaacaagaacacttgggtcattcacttggttccctcataaaacctcaataccagagggtgacatatcagcagccagggcct

SEQ ID NO: 430969 - DNA, 140 bp, Artificial Sequence
  Synthetic
aggccctggctgctgatatgtttttccttaaccctagctgggctttaatgaaagacttcatcatagctgtcaccacattaaaaggtatttccaccattttgtgcatatgccacataagtagaccttttgggacagcggtg

SEQ ID NO: 430970 - DNA, 140 bp, Artificial Sequence
  Synthetic
caccgctgtcccaaaaggtctacttatgtggcatatgcacaaaatggtggaaataccttttaatgtggtgacagctatgatgaagtctttcattaaagcccagctagggttaaggaaaaacatatcagcagccagggcct

SEQ ID NO: 430971 - DNA, 140 bp, Artificial Sequence
  Synthetic
atacgccatgctgggtctccgatgatgtgcagccaagttcaaccaagaatactcaaggtcagattcagatgggggctcaacatccaacagttcgcataagtttctcaatgacgagatgtgcgtacttgggagtcggccat

SEQ ID NO: 430972 - DNA, 140 bp, Artificial Sequence
  Synthetic
atggccgactcccaagtacgcacatctcgtcattgagaaacttatgcgaactgttggatgttgagcccccatctgaatctgaccttgagtattcttggttgaacttggctgcacatcatcggagacccagcatggcgtat

SEQ ID NO: 430973 - DNA, 140 bp, Artificial Sequence
  Synthetic
aggccctggctgctgatatggggggctcaacatccaacagttcgcataagtttctcaatgacgagatgtgctcactagacaagtagtttgttgtgaattcctcatgaagttgtccagtctgaccttttgggacagcggtg

SEQ ID NO: 430974 - DNA, 140 bp, Artificial Sequence
  Synthetic
caccgctgtcccaaaaggtcagactggacaacttcatgaggaattcacaacaaactacttgtctagtgagcacatctcgtcattgagaaacttatgcgaactgttggatgttgagccccccatatcagcagccagggcct

SEQ ID NO: 430975 - DNA, 140 bp, Artificial Sequence
  Synthetic
aggccctggctgctgatatgaggaaaattaaattctgtaagacagtcaagaataaaaatggacacatcattgggccccacttgctatggtccatgctataagagacatgtgccaatgaaagaccttttgggacagcggtg

SEQ ID NO: 430976 - DNA, 140 bp, Artificial Sequence
  Synthetic
caccgctgtcccaaaaggtctttcattggcacatgtctcttatagcatggaccatagcaagtggggcccaatgatgtgtccatttttattcttgactgtcttacagaatttaattttcctcatatcagcagccagggcct

SEQ ID NO: 430977 - DNA, 140 bp, Artificial Sequence
  Synthetic
atacgccatgctgggtctcctcagggatcaatccttctatctgcctcatgattctgtaactgcggttgccatccacccagtccctaacatctgtctcgcaatttaacaagaatgggtcaacgtacttgggagtcggccat

SEQ ID NO: 430978 - DNA, 140 bp, Artificial Sequence
  Synthetic
atggccgactcccaagtacgttgacccattcttgttaaattgcgagacagatgttagggactgggtggatggcaaccgcagttacagaatcatgaggcagatagaaggattgatccctgaggagacccagcatggcgtat

SEQ ID NO: 430979 - DNA, 140 bp, Artificial Sequence
  Synthetic
aggccctggctgctgatatgatccacccagtccctaacatctgtctcgcaatttaacaagaatgggtcaatgggatatctagcgtattgcaagagactcaaggttctcatttgtatcagagaccttttgggacagcggtg

SEQ ID NO: 430980 - DNA, 140 bp, Artificial Sequence
  Synthetic
caccgctgtcccaaaaggtctctgatacaaatgagaaccttgagtctcttgcaatacgctagatatcccattgacccattcttgttaaattgcgagacagatgttagggactgggtggatcatatcagcagccagggcct

SEQ ID NO: 430981 - DNA, 140 bp, Artificial Sequence
  Synthetic
aggccctggctgctgatatgatagtgttatgcacatataatcccatagaagaggtcttaaataagtaacaacagtatcacctccatctttgacttctggtgaaactttccatatctggatgaccttttgggacagcggtg

SEQ ID NO: 430982 - DNA, 140 bp, Artificial Sequence
  Synthetic
caccgctgtcccaaaaggtcatccagatatggaaagtttcaccagaagtcaaagatggaggtgatactgttgttacttatttaagacctcttctatgggattatatgtgcataacactatcatatcagcagccagggcct

SEQ ID NO: 430983 - DNA, 140 bp, Artificial Sequence
  Synthetic
atacgccatgctgggtctccgtcaattgtttctgccagttggtgcggctctttgcactttatattgtggagggctgcagcaacaaacttcgttaacaatggtacctcatctccccatacacgtacttgggagtcggccat

SEQ ID NO: 430984 - DNA, 140 bp, Artificial Sequence
  Synthetic
atggccgactcccaagtacgtgtatggggagatgaggtaccattgttaacgaagtttgttgctgcagccctccacaatataaagtgcaaagagccgcaccaactggcagaaacaattgacggagacccagcatggcgtat

SEQ ID NO: 430985 - DNA, 140 bp, Artificial Sequence
  Synthetic
aggccctggctgctgatatgaaaaggattttatttcctttgaggcactcattgccagattgttgtattgagtgcacgtgataaaagctgaaactatttgccaaaatgacaaaagcaaagcgaccttttgggacagcggtg

SEQ ID NO: 430986 - DNA, 140 bp, Artificial Sequence
  Synthetic
caccgctgtcccaaaaggtcgctttgcttttgtcattttggcaaatagtttcagcttttatcacgtgcactcaatacaacaatctggcaatgagtgcctcaaaggaaataaaatccttttcatatcagcagccagggcct

SEQ ID NO: 430987 - DNA, 140 bp, Artificial Sequence
  Synthetic
atacgccatgctgggtctccgtgtcctaaattcttctgggtctctttctaaaagctctgtgagagtttgatcaaagagggagatttgatcatcactagaagtataagcatctatcatgcccgtacttgggagtcggccat

SEQ ID NO: 430988 - DNA, 140 bp, Artificial Sequence
  Synthetic
atggccgactcccaagtacgggcatgatagatgcttatacttctagtgatgatcaaatctccctctttgatcaaactctcacagagcttttagaaagagacccagaagaatttaggacacggagacccagcatggcgtat

SEQ ID NO: 430989 - DNA, 140 bp, Artificial Sequence
  Synthetic
aggccctggctgctgatatgtcaaagagggagatttgatcatcactagaagtataagcatctatcatgccaccacatatgcaactaatagcataattaatgaacctttccgaaatgaggggaccttttgggacagcggtg

SEQ ID NO: 430990 - DNA, 140 bp, Artificial Sequence
  Synthetic
caccgctgtcccaaaaggtcccctcatttcggaaaggttcattaattatgctattagttgcatatgtggtggcatgatagatgcttatacttctagtgatgatcaaatctccctctttgacatatcagcagccagggcct

SEQ ID NO: 430991 - DNA, 140 bp, Artificial Sequence
  Synthetic
atacgccatgctgggtctccgaactgatgtgagaaggcaccacaccaatttgaaaattggagtaaaagaagtcttctgtcattgattgtgtggttttcttcctcaatcccagttgagcctcgtacttgggagtcggccat

SEQ ID NO: 430992 - DNA, 140 bp, Artificial Sequence
  Synthetic
atggccgactcccaagtacgaggctcaactgggattgaggaagaaaaccacacaatcaatgacagaagacttcttttactccaattttcaaattggtgtggtgccttctcacatcagttcggagacccagcatggcgtat

SEQ ID NO: 430993 - DNA, 140 bp, Artificial Sequence
  Synthetic
aggccctggctgctgatatggtcttctgtcattgattgtgtggttttcttcctcaatcccagttgagccttaataaatgacttcatcatggctgacactacattgaaaggtatttccaccgaccttttgggacagcggtg

SEQ ID NO: 430994 - DNA, 140 bp, Artificial Sequence
  Synthetic
caccgctgtcccaaaaggtcggtggaaatacctttcaatgtagtgtcagccatgatgaagtcatttattaaggctcaactgggattgaggaagaaaaccacacaatcaatgacagaagaccatatcagcagccagggcct

SEQ ID NO: 430995 - DNA, 140 bp, Artificial Sequence
  Synthetic
atacgccatgctgggtctcctatgtcagcttgtaggtcttttgaaagaaagattaaattttgtagaacagttaagaatagaaatggacacatcattgggccccacttactgtgatccatgcgtacttgggagtcggccat

SEQ ID NO: 430996 - DNA, 140 bp, Artificial Sequence
  Synthetic
atggccgactcccaagtacgcatggatcacagtaagtggggcccaatgatgtgtccatttctattcttaactgttctacaaaatttaatctttctttcaaaagacctacaagctgacataggagacccagcatggcgtat

SEQ ID NO: 430997 - DNA, 140 bp, Artificial Sequence
  Synthetic
aggccctggctgctgatatggtcccaaacctcacagactgaatcacatgggcatttgttcctgtgggctttataaacagcctggtgtgcctgtaaaatggaagagatgaaacccttgtcagaccttttgggacagcggtg

SEQ ID NO: 430998 - DNA, 140 bp, Artificial Sequence
  Synthetic
caccgctgtcccaaaaggtctgacaagggtttcatctcttccattttacaggcacaccaggctgtttataaagcccacaggaacaaatgcccatgtgattcagtctgtgaggtttgggaccatatcagcagccagggcct

SEQ ID NO: 430999 - DNA, 140 bp, Artificial Sequence
  Synthetic
atacgccatgctgggtctcctcgccagattgttgtgtgtatgcacacaacaaagaactgagactatctgccaaaatgacaaaagcaaagcgcaatccaatagcctaggatccactgtgcgcgtacttgggagtcggccat

SEQ ID NO: 431000 - DNA, 140 bp, Artificial Sequence
  Synthetic
atggccgactcccaagtacgcgcacagtggatcctaggctattggattgcgctttgcttttgtcattttggcagatagtctcagttctttgttgtgtgcatacacacaacaatctggcgaggagacccagcatggcgtat

SEQ ID NO: 431001 - DNA, 140 bp, Artificial Sequence
  Synthetic
atacgccatgctgggtctccttaatgcttcaaagtaatcctccacaagcctagtaaacatctttgtcctaagatctccaatgtataactctctgttaccgccaacttgttccttgtatgacgtacttgggagtcggccat

SEQ ID NO: 431002 - DNA, 140 bp, Artificial Sequence
  Synthetic
atggccgactcccaagtacgtcatacaaggaacaagttggcggtaacagagagttatacattggagatcttaggacaaagatgtttactaggcttgtggaggattactttgaagcattaaggagacccagcatggcgtat

SEQ ID NO: 431003 - DNA, 140 bp, Artificial Sequence
  Synthetic
aggccctggctgctgatatgagatctccaatgtataactctctgttaccgccaacttgttccttgtatgacaaagagaacttaagccttcctgtgtcaggccctactgaatcataagactgaccttttgggacagcggtg

SEQ ID NO: 431004 - DNA, 140 bp, Artificial Sequence
  Synthetic
caccgctgtcccaaaaggtcagtcttatgattcagtagggcctgacacaggaaggcttaagttctctttgtcatacaaggaacaagttggcggtaacagagagttatacattggagatctcatatcagcagccagggcct

SEQ ID NO: 431005 - DNA, 140 bp, Artificial Sequence
  Synthetic
aggccctggctgctgatatgtaggaaggctagcttctgttttgaaagcctctcatcctctaagaggtacctgctcacaagatctttgctctcggacagcaactcctccatcaccacacacgaccttttgggacagcggtg

SEQ ID NO: 431006 - DNA, 140 bp, Artificial Sequence
  Synthetic
caccgctgtcccaaaaggtcgtgtgtggtgatggaggagttgctgtccgagagcaaagatcttgtgagcaggtacctcttagaggatgagaggctttcaaaacagaagctagccttcctacatatcagcagccagggcct

SEQ ID NO: 431007 - DNA, 140 bp, Artificial Sequence
  Synthetic
atacgccatgctgggtctcccagtttgtcaatgacagggctttactaagcgcctctgagttactctccctctcactaatcctgacatcatcagagagcttacccatatcgaatttgaaatcgtacttgggagtcggccat

SEQ ID NO: 431008 - DNA, 140 bp, Artificial Sequence
  Synthetic
atggccgactcccaagtacgatttcaaattcgatatgggtaagctctctgatgatgtcaggattagtgagagggagagtaactcagaggcgcttagtaaagccctgtcattgacaaactgggagacccagcatggcgtat

SEQ ID NO: 431009 - DNA, 140 bp, Artificial Sequence
  Synthetic
atacgccatgctgggtctccggagcacctactcaatgtcgaggggaggccccaccctcttcaaagaaggggcctgcacagcctccctcttaatctaaacttcccctctgaagactggatccgtacttgggagtcggccat

SEQ ID NO: 431010 - DNA, 140 bp, Artificial Sequence
  Synthetic
atggccgactcccaagtacggatccagtcttcagaggggaagtttagattaagagggaggctgtgcaggccccttctttgaagagggtggggcctcccctcgacattgagtaggtgctccggagacccagcatggcgtat

SEQ ID NO: 431011 - DNA, 140 bp, Artificial Sequence
  Synthetic
atacgccatgctgggtctccatatgttcttgttgacaccgcctttgtcaactctccaatggggcattgtgacatatgtccacaataaaagtacttcctcttcagcttgtcactctcatagcgtacttgggagtcggccat

SEQ ID NO: 431012 - DNA, 140 bp, Artificial Sequence
  Synthetic
atggccgactcccaagtacgctatgagagtgacaagctgaagaggaagtacttttattgtggacatatgtcacaatgccccattggagagttgacaaaggcggtgtcaacaagaacatatggagacccagcatggcgtat

SEQ ID NO: 431013 - DNA, 140 bp, Artificial Sequence
  Synthetic
aggccctggctgctgatatgacatatgtccacaataaaagtacttcctcttcagcttgtcactctcatagacggcattacagaactctttgtagaaattgtctggtaagacatcatgatcgaccttttgggacagcggtg

SEQ ID NO: 431014 - DNA, 140 bp, Artificial Sequence
  Synthetic
caccgctgtcccaaaaggtcgatcatgatgtcttaccagacaatttctacaaagagttctgtaatgccgtctatgagagtgacaagctgaagaggaagtacttttattgtggacatatgtcatatcagcagccagggcct

SEQ ID NO: 431015 - DNA, 140 bp, Artificial Sequence
  Synthetic
atacgccatgctgggtctccaaaatttgtttgagacaatctcatctaagtcattcactgatggctggctatcatcattggggctcaagcctggtttaacaggttccctgtactgatcaaccgtacttgggagtcggccat

SEQ ID NO: 431016 - DNA, 140 bp, Artificial Sequence
  Synthetic
atggccgactcccaagtacggttgatcagtacagggaacctgttaaaccaggcttgagccccaatgatgatagccagccatcagtgaatgacttagatgagattgtctcaaacaaattttggagacccagcatggcgtat

SEQ ID NO: 431017 - DNA, 140 bp, Artificial Sequence
  Synthetic
aggccctggctgctgatatgtcatcattggggctcaagcctggtttaacaggttccctgtactgatcaacaattttttcaacagtctccttcaattgattaaaataatcacttgcacctcgaccttttgggacagcggtg

SEQ ID NO: 431018 - DNA, 140 bp, Artificial Sequence
  Synthetic
caccgctgtcccaaaaggtcgaggtgcaagtgattattttaatcaattgaaggagactgttgaaaaaattgttgatcagtacagggaacctgttaaaccaggcttgagccccaatgatgacatatcagcagccagggcct

SEQ ID NO: 431019 - DNA, 140 bp, Artificial Sequence
  Synthetic
atacgccatgctgggtctcctgtcgagatcctagaactaagttgctcattgcctgttgcaccttgtactcatagtcctgcttattgagaagatgctttcccttccttgagaaaacctcggcgtacttgggagtcggccat

SEQ ID NO: 431020 - DNA, 140 bp, Artificial Sequence
  Synthetic
atggccgactcccaagtacgccgaggttttctcaaggaagggaaagcatcttctcaataagcaggactatgagtacaaggtgcaacaggcaatgagcaacttagttctaggatctcgacaggagacccagcatggcgtat

SEQ ID NO: 431021 - DNA, 140 bp, Artificial Sequence
  Synthetic
aggccctggctgctgatatgatagtcctgcttattgagaagatgctttcccttccttgagaaaacctcggtgagttgtgatacggccaatgctgtgagtttgttaaaatcataatttaatgaccttttgggacagcggtg

SEQ ID NO: 431022 - DNA, 140 bp, Artificial Sequence
  Synthetic
caccgctgtcccaaaaggtcattaaattatgattttaacaaactcacagcattggccgtatcacaactcaccgaggttttctcaaggaagggaaagcatcttctcaataagcaggactatcatatcagcagccagggcct

SEQ ID NO: 431023 - DNA, 140 bp, Artificial Sequence
  Synthetic
aggccctggctgctgatatggttatcaatatctgataatccaaaatacaacctgggaagatcactgccaattctcgagaccatctcccatcggttatctcgggctcctctcacaaaggacgaccttttgggacagcggtg

SEQ ID NO: 431024 - DNA, 140 bp, Artificial Sequence
  Synthetic
caccgctgtcccaaaaggtcgtcctttgtgagaggagcccgagataaccgatgggagatggtctcgagaattggcagtgatcttcccaggttgtattttggattatcagatattgataaccatatcagcagccagggcct

SEQ ID NO: 431025 - DNA, 140 bp, Artificial Sequence
  Synthetic
aggccctggctgctgatatgtctctctaagtcaatggttcccagtagttccacatcccccatcacataagggaatgtttcttcctctgttctctgataactgattgtagggacaactccagaccttttgggacagcggtg

SEQ ID NO: 431026 - DNA, 140 bp, Artificial Sequence
  Synthetic
caccgctgtcccaaaaggtctggagttgtccctacaatcagttatcagagaacagaggaagaaacattcccttatgtgatgggggatgtggaactactgggaaccattgacttagagagacatatcagcagccagggcct

SEQ ID NO: 431027 - DNA, 140 bp, Artificial Sequence
  Synthetic
atacgccatgctgggtctccagaccatgtcatccagttcctcttccgtggctgtgtctccaggattgatgctcacatggccaaaccttatctttggttcaaggaacttttcaaaacatttcgtacttgggagtcggccat

SEQ ID NO: 431028 - DNA, 140 bp, Artificial Sequence
  Synthetic
atggccgactcccaagtacgaaatgttttgaaaagttccttgaaccaaagataaggtttggccatgtgagcatcaatcctggagacacagccacggaagaggaactggatgacatggtctggagacccagcatggcgtat

SEQ ID NO: 431029 - DNA, 140 bp, Artificial Sequence
  Synthetic
atacgccatgctgggtctccatcattaacccagtcaggtatttgttcattgtagaatgatgttctcccatcaataagtggtattaaattgatgtcaacacttttcaagtcttctttcagccgtacttgggagtcggccat

SEQ ID NO: 431030 - DNA, 140 bp, Artificial Sequence
  Synthetic
atggccgactcccaagtacggctgaaagaagacttgaaaagtgttgacatcaatttaataccacttattgatgggagaacatcattctacaatgaacaaatacctgactgggttaatgatggagacccagcatggcgtat

SEQ ID NO: 431031 - DNA, 140 bp, Artificial Sequence
  Synthetic
aggccctggctgctgatatgcctccgctcaacccatttcttgagatccctttttgttgactccaaagaaactagtctatcattaacacttataaagcaagatcccaaccacccttttaaagaccttttgggacagcggtg

SEQ ID NO: 431032 - DNA, 140 bp, Artificial Sequence
  Synthetic
caccgctgtcccaaaaggtctttaaaagggtggttgggatcttgctttataagtgttaatgatagactagtttctttggagtcaacaaaaagggatctcaagaaatgggttgagcggaggcatatcagcagccagggcct

SEQ ID NO: 431033 - DNA, 140 bp, Artificial Sequence
  Synthetic
atacgccatgctgggtctccatatcctcagataaaactagattcattagtgatcttaccaatctatagagtaagaactcaacatcagtaatcaattcttctctcactttatcaatgaggtcgtacttgggagtcggccat

SEQ ID NO: 431034 - DNA, 140 bp, Artificial Sequence
  Synthetic
atggccgactcccaagtacgacctcattgataaagtgagagaagaattgattactgatgttgagttcttactctatagattggtaagatcactaatgaatctagttttatctgaggatatggagacccagcatggcgtat

SEQ ID NO: 431035 - DNA, 140 bp, Artificial Sequence
  Synthetic
aggccctggctgctgatatgtaagaactcaacatcagtaatcaattcttctctcactttatcaatgaggtccttgtgataataatctgatacataagccattaagaagtatctaaggtttgaccttttgggacagcggtg

SEQ ID NO: 431036 - DNA, 140 bp, Artificial Sequence
  Synthetic
caccgctgtcccaaaaggtcaaaccttagatacttcttaatggcttatgtatcagattattatcacaaggacctcattgataaagtgagagaagaattgattactgatgttgagttcttacatatcagcagccagggcct

SEQ ID NO: 431037 - DNA, 140 bp, Artificial Sequence
  Synthetic
atacgccatgctgggtctccgatcatctttgtcagagatttaatgttgttcagctgctctcccaactcattgcaatcctctatccaggaaatcattgtgttcactgttgtttccaaaactcgtacttgggagtcggccat

SEQ ID NO: 431038 - DNA, 140 bp, Artificial Sequence
  Synthetic
atggccgactcccaagtacgagttttggaaacaacagtgaacacaatgatttcctggatagaggattgcaatgagttgggagagcagctgaacaacattaaatctctgacaaagatgatcggagacccagcatggcgtat

SEQ ID NO: 431039 - DNA, 140 bp, Artificial Sequence
  Synthetic
aggccctggctgctgatatgtgcaatcctctatccaggaaatcattgtgttcactgttgtttccaaaacttcagccgaaaatatggccgggaaatatcttttaggatcagcataaaatgagaccttttgggacagcggtg

SEQ ID NO: 431040 - DNA, 140 bp, Artificial Sequence
  Synthetic
caccgctgtcccaaaaggtctcattttatgctgatcctaaaagatatttcccggccatattttcggctgaagttttggaaacaacagtgaacacaatgatttcctggatagaggattgcacatatcagcagccagggcct

SEQ ID NO: 431041 - DNA, 140 bp, Artificial Sequence
  Synthetic
atacgccatgctgggtctcccccctgtcttttgataaatcaattggtattcagcaccattcaatgagaactcttgacaatatgcttctttacatctgaccacctgatatcttgcaggtcccgtacttgggagtcggccat

SEQ ID NO: 431042 - DNA, 140 bp, Artificial Sequence
  Synthetic
atggccgactcccaagtacgggacctgcaagatatcaggtggtcagatgtaaagaagcatattgtcaagagttctcattgaatggtgctgaataccaattgatttatcaaaagacaggggggagacccagcatggcgtat

SEQ ID NO: 431043 - DNA, 140 bp, Artificial Sequence
  Synthetic
aggccctggctgctgatatgtcttgacaatatgcttctttacatctgaccacctgatatcttgcaggtccaaattcattttgtctcaacttcacagtggaagaagtcttcatcgaattcagaccttttgggacagcggtg

SEQ ID NO: 431044 - DNA, 140 bp, Artificial Sequence
  Synthetic
caccgctgtcccaaaaggtctgaattcgatgaagacttcttccactgtgaagttgagacaaaatgaatttggacctgcaagatatcaggtggtcagatgtaaagaagcatattgtcaagacatatcagcagccagggcct

SEQ ID NO: 431045 - DNA, 140 bp, Artificial Sequence
  Synthetic
atacgccatgctgggtctccttctcatagacagcattacagaattcttcataaaatttacctggtaagatatcatgatcaaagtcctcaaccatgtgattggataattcacccttgatcacgtacttgggagtcggccat

SEQ ID NO: 431046 - DNA, 140 bp, Artificial Sequence
  Synthetic
atggccgactcccaagtacgtgatcaagggtgaattatccaatcacatggttgaggactttgatcatgatatcttaccaggtaaattttatgaagaattctgtaatgctgtctatgagaaggagacccagcatggcgtat

SEQ ID NO: 431047 - DNA, 140 bp, Artificial Sequence
  Synthetic
atacgccatgctgggtctccagttccacatcccccgtgacataaggaaacttttcctcctctgatctttgataagtgattgtagggataactccagaaacatcgaagctcatgatcaagtcgtacttgggagtcggccat

SEQ ID NO: 431048 - DNA, 140 bp, Artificial Sequence
  Synthetic
atggccgactcccaagtacgacttgatcatgagcttcgatgtttctggagttatccctacaatcacttatcaaagatcagaggaggaaaagtttccttatgtcacgggggatgtggaactggagacccagcatggcgtat

SEQ ID NO: 431049 - DNA, 140 bp, Artificial Sequence
  Synthetic
aggccctggctgctgatatgataagtgattgtagggataactccagaaacatcgaagctcatgatcaagtcataactgttagaacaaatcactcccatgtcaactttatagtgatccacagaccttttgggacagcggtg

SEQ ID NO: 431050 - DNA, 140 bp, Artificial Sequence
  Synthetic
caccgctgtcccaaaaggtctgtggatcactataaagttgacatgggagtgatttgttctaacagttatgacttgatcatgagcttcgatgtttctggagttatccctacaatcacttatcatatcagcagccagggcct

SEQ ID NO: 431051 - DNA, 140 bp, Artificial Sequence
  Synthetic
atacgccatgctgggtctccgaatattgagttaaggatttggtttctgcttgagcactgagaaggctgcatgaccccagacttttcggcctgttgcctccgctcaacccacttctctaagcgtacttgggagtcggccat

SEQ ID NO: 431052 - DNA, 140 bp, Artificial Sequence
  Synthetic
atggccgactcccaagtacgcttagagaagtgggttgagcggaggcaacaggccgaaaagtctggggtcatgcagccttctcagtgctcaagcagaaaccaaatccttaactcaatattcggagacccagcatggcgtat

SEQ ID NO: 431053 - DNA, 140 bp, Artificial Sequence
  Synthetic
aggccctggctgctgatatgtgaccccagacttttcggcctgttgcctccgctcaacccacttctctaagtccctcttggttgattctagagacaccagtctatcattgacacttatgaagaccttttgggacagcggtg

SEQ ID NO: 431054 - DNA, 140 bp, Artificial Sequence
  Synthetic
caccgctgtcccaaaaggtcttcataagtgtcaatgatagactggtgtctctagaatcaaccaagagggacttagagaagtgggttgagcggaggcaacaggccgaaaagtctggggtcacatatcagcagccagggcct

SEQ ID NO: 431055 - DNA, 140 bp, Artificial Sequence
  Synthetic
atacgccatgctgggtctcctacttgcaaggagaatcagtgcgtcaaagatcaataagagttttctccttgtatttagtatccttaaagatttaactttatttaggaatgatctccagcacgtacttgggagtcggccat

SEQ ID NO: 431056 - DNA, 140 bp, Artificial Sequence
  Synthetic
atggccgactcccaagtacgtgctggagatcattcctaaataaagttaaatctttaaggatactaaatacaaggagaaaactcttattgatctttgacgcactgattctccttgcaagtaggagacccagcatggcgtat

SEQ ID NO: 431057 - DNA, 140 bp, Artificial Sequence
  Synthetic
aggccctggctgctgatatggcacaagaaatgccaacttctgtcttgataatctctcgttgtccactaggtactttgatactaaatctttgacataggctatgtcttcctccatgtttgggaccttttgggacagcggtg

SEQ ID NO: 431058 - DNA, 140 bp, Artificial Sequence
  Synthetic
caccgctgtcccaaaaggtcccaaacatggaggaagacatagcctatgtcaaagatttagtatcaaagtacctagtggacaacgagagattatcaagacagaagttggcatttcttgtgccatatcagcagccagggcct

SEQ ID NO: 431059 - DNA, 140 bp, Artificial Sequence
  Synthetic
atacgccatgctgggtctcctgataaatcaagtgttcgacattgtcttctgtagttatcttatcagtgtacagattattaaactcactgagtaattgactcttctctacccttaagaactcgtacttgggagtcggccat

SEQ ID NO: 431060 - DNA, 140 bp, Artificial Sequence
  Synthetic
atggccgactcccaagtacgagttcttaagggtagagaagagtcaattactcagtgagtttaataatctgtacactgataagataactacagaagacaatgtcgaacacttgatttatcaggagacccagcatggcgtat

SEQ ID NO: 431061 - DNA, 140 bp, Artificial Sequence
  Synthetic
atacgccatgctgggtctcctgcctcttcctacaaaactgagaccatcagccactccaacagcacctccaaccgaagcagcggacagcatcagacccccaccctaccgtccctgaatctccgtacttgggagtcggccat

SEQ ID NO: 431062 - DNA, 140 bp, Artificial Sequence
  Synthetic
atggccgactcccaagtacggagattcagggacggtagggtgggggtctgatgctgtccgctgcttcggttggaggtgctgttggagtggctgatggtctcagttttgtaggaagaggcaggagacccagcatggcgtat

SEQ ID NO: 431063 - DNA, 140 bp, Artificial Sequence
  Synthetic
atacgccatgctgggtctccttggtggcatgaggctatcacttcttcataatggttggaacggttgtccaacaaaacatttaaactctccactcctgacaatctccctgaggtcatggaccgtacttgggagtcggccat

SEQ ID NO: 431064 - DNA, 140 bp, Artificial Sequence
  Synthetic
atggccgactcccaagtacggtccatgacctcagggagattgtcaggagtggagagtttaaatgttttgttggacaaccgttccaaccattatgaagaagtgatagcctcatgccaccaaggagacccagcatggcgtat

SEQ ID NO: 431065 - DNA, 140 bp, Artificial Sequence
  Synthetic
aggccctggctgctgatatgacaaaacatttaaactctccactcctgacaatctccctgaggtcatggacagagattcacaaagcctactatactctgactcttcaaaaagtgaattactgaccttttgggacagcggtg

SEQ ID NO: 431066 - DNA, 140 bp, Artificial Sequence
  Synthetic
caccgctgtcccaaaaggtcagtaattcactttttgaagagtcagagtatagtaggctttgtgaatctctgtccatgacctcagggagattgtcaggagtggagagtttaaatgttttgtcatatcagcagccagggcct

SEQ ID NO: 431067 - DNA, 140 bp, Artificial Sequence
  Synthetic
atacgccatgctgggtctcctaacccaatcaggtatttgttcattataaaatgatgttctaccgtcaatgagtggtattaaattaatgtcgacactctttaggtcttctttcagctgttccgtacttgggagtcggccat

SEQ ID NO: 431068 - DNA, 140 bp, Artificial Sequence
  Synthetic
atggccgactcccaagtacggaacagctgaaagaagacctaaagagtgtcgacattaatttaataccactcattgacggtagaacatcattttataatgaacaaatacctgattgggttaggagacccagcatggcgtat

SEQ ID NO: 431069 - DNA, 140 bp, Artificial Sequence
  Synthetic
aggccctggctgctgatatgagtgtcagacttggcatggtcccgaactgattattgagcaactctgcatttttcacatcccaaactctcaccactccatctctcccagcccgagccccttgaccttttgggacagcggtg

SEQ ID NO: 431070 - DNA, 140 bp, Artificial Sequence
  Synthetic
caccgctgtcccaaaaggtcaaggggctcgggctgggagagatggagtggtgagagtttgggatgtgaaaaatgcagagttgctcaataatcagttcgggaccatgccaagtctgacactcatatcagcagccagggcct

SEQ ID NO: 431071 - DNA, 140 bp, Artificial Sequence
  Synthetic
aggccctggctgctgatatgcctttccttaccagaatccaaatctgcatacaagaacttaaggactggagaggctcttcggaattggaatgttaactgttcaatgttgtcatcacaggtggaccttttgggacagcggtg

SEQ ID NO: 431072 - DNA, 140 bp, Artificial Sequence
  Synthetic
caccgctgtcccaaaaggtccacctgtgatgacaacattgaacagttaacattccaattccgaagagcctctccagtccttaagttcttgtatgcagatttggattctggtaaggaaaggcatatcagcagccagggcct

SEQ ID NO: 431073 - DNA, 140 bp, Artificial Sequence
  Synthetic
atacgccatgctgggtctccccgtctggcaccacaaaacatagtgaaggagtcaggatcccatgatcatggaggatcctttctacagacttatcttcactgttgtgttcacatccatttgcgtacttgggagtcggccat

SEQ ID NO: 431074 - DNA, 140 bp, Artificial Sequence
  Synthetic
atggccgactcccaagtacgcaaatggatgtgaacacaacagtgaagataagtctgtagaaaggatcctccatgatcatgggatcctgactccttcactatgttttgtggtgccagacggggagacccagcatggcgtat

SEQ ID NO: 431075 - DNA, 140 bp, Artificial Sequence
  Synthetic
aggccctggctgctgatatgagtatgaggcaatgagctgcgattttaatgggggaaagattagtgtgcagtacaacctgagtcacagctatgctggggatgctgccaaccattgtggcacgaccttttgggacagcggtg

SEQ ID NO: 431076 - DNA, 140 bp, Artificial Sequence
  Synthetic
caccgctgtcccaaaaggtcgtgccacaatggttggcagcatccccagcatagctgtgactcaggttgtactgcacactaatctttcccccattaaaatcgcagctcattgcctcatactcatatcagcagccagggcct

SEQ ID NO: 431077 - DNA, 140 bp, Artificial Sequence
  Synthetic
atacgccatgctgggtctcctgacaatctctcgttgtctgctaaatattttgatactagatctttgacacaggctatgtcttcctccatgtctgactgcaagtgagccagtctcagccttcgtacttgggagtcggccat

SEQ ID NO: 431078 - DNA, 140 bp, Artificial Sequence
  Synthetic
atggccgactcccaagtacgaaggctgagactggctcacttgcagtcagacatggaggaagacatagcctgtgtcaaagatctagtatcaaaatatttagcagacaacgagagattgtcaggagacccagcatggcgtat

SEQ ID NO: 431079 - DNA, 140 bp, Artificial Sequence
  Synthetic
aggccctggctgctgatatgattctcaagaccatctcctatcggttatcttgggctcctctcacaaaggaccagagatatttatatcagtagaagactactaggcacattcacatggacagaccttttgggacagcggtg

SEQ ID NO: 431080 - DNA, 140 bp, Artificial Sequence
  Synthetic
caccgctgtcccaaaaggtctgtccatgtgaatgtgcctagtagtcttctactgatataaatatctctggtcctttgtgagaggagcccaagataaccgataggagatggtcttgagaatcatatcagcagccagggcct

SEQ ID NO: 431081 - DNA, 140 bp, Artificial Sequence
  Synthetic
atacgccatgctgggtctccgcggtcttataaaacaagtataaatgatgaatgacaaataacgatcaacaattaaagacaattaaagtagatagcctaaatgcctaggatcctcggtgcgcgtacttgggagtcggccat

SEQ ID NO: 431082 - DNA, 140 bp, Artificial Sequence
  Synthetic
atggccgactcccaagtacgcgcaccgaggatcctaggcatttaggctatctactttaattgtctttaattgttgatcgttatttgtcattcatcatttatacttgttttataagaccgcggagacccagcatggcgtat

SEQ ID NO: 431083 - DNA, 140 bp, Artificial Sequence
  Synthetic
aggccctggctgctgatatgagacagtccgagagccagcctgatcccagatgccacacatctagggccacagttctgtaagagctgctggttcgaaaacaagggcctggttgagtgcaacgaccttttgggacagcggtg

SEQ ID NO: 431084 - DNA, 140 bp, Artificial Sequence
  Synthetic
caccgctgtcccaaaaggtcgttgcactcaaccaggcccttgttttcgaaccagcagctcttacagaactgtggccctagatgtgtggcatctgggatcaggctggctctcggactgtctcatatcagcagccagggcct

SEQ ID NO: 431085 - DNA, 140 bp, Artificial Sequence
  Synthetic
aggccctggctgctgatatgagttctgtaagagctgctggttcgaaaacaagggcctggttgagtgcaacaaccactatctgtgtctcaactgcctcaccttacttctaagtgtcagcaagaccttttgggacagcggtg

SEQ ID NO: 431086 - DNA, 140 bp, Artificial Sequence
  Synthetic
caccgctgtcccaaaaggtcttgctgacacttagaagtaaggtgaggcagttgagacacagatagtggttgttgcactcaaccaggcccttgttttcgaaccagcagctcttacagaactcatatcagcagccagggcct

SEQ ID NO: 431087 - DNA, 140 bp, Artificial Sequence
  Synthetic
atacgccatgctgggtctcccctgtgttgggcctgggcttgtacctgtatggcgtgtgggtcagctggtggtgccccacaaaaactcttacagaaatgagagacaatatgcctaggatcccgtacttgggagtcggccat

SEQ ID NO: 431088 - DNA, 140 bp, Artificial Sequence
  Synthetic
atggccgactcccaagtacgggatcctaggcatattgtctctcatttctgtaagagtttttgtggggcaccaccagctgacccacacgccatacaggtacaagcccaggcccaacacaggggagacccagcatggcgtat

SEQ ID NO: 431089 - DNA, 140 bp, Artificial Sequence
  Synthetic
aggccctggctgctgatatgtgtaccatcacctttccccttgacttactataacagagagcataacccttgaactccacccagttgtccactgcctcaagaaccgcactcaagatcccctgaccttttgggacagcggtg

SEQ ID NO: 431090 - DNA, 140 bp, Artificial Sequence
  Synthetic
caccgctgtcccaaaaggtcaggggatcttgagtgcggttcttgaggcagtggacaactgggtggagttcaagggttatgctctctgttatagtaagtcaaggggaaaggtgatggtacacatatcagcagccagggcct

SEQ ID NO: 431091 - DNA, 140 bp, Artificial Sequence
  Synthetic
aggccctggctgctgatatgatcaatcccatgtgagtacttagcatcctgtttgaactgctttaaatcagtaggttcacgaaagaagtgaatgtaacagcctgaacttggctgatagagggaccttttgggacagcggtg

SEQ ID NO: 431092 - DNA, 140 bp, Artificial Sequence
  Synthetic
caccgctgtcccaaaaggtccctctatcagccaagttcaggctgttacattcacttctttcgtgaacctactgatttaaagcagttcaaacaggatgctaagtactcacatgggattgatcatatcagcagccagggcct

SEQ ID NO: 431093 - DNA, 140 bp, Artificial Sequence
  Synthetic
atacgccatgctgggtctcctgttgattcattgagccagtatactcaaggtggatggcaaagctttccttaaaactagcatcttgacttttaacacggaacctcactgtctgactcagttcgtacttgggagtcggccat

SEQ ID NO: 431094 - DNA, 140 bp, Artificial Sequence
  Synthetic
atggccgactcccaagtacgaactgagtcagacagtgaggttccgtgttaaaagtcaagatgctagttttaaggaaagctttgccatccaccttgagtatactggctcaatgaatcaacaggagacccagcatggcgtat

SEQ ID NO: 431095 - DNA, 140 bp, Artificial Sequence
  Synthetic
aggccctggctgctgatatgaaaactagcatcttgacttttaacacggaacctcactgtctgactcagttttgcagaccctggaggtagtgaagctacggcatcaaagaaatcctccaatgaccttttgggacagcggtg

SEQ ID NO: 431096 - DNA, 140 bp, Artificial Sequence
  Synthetic
caccgctgtcccaaaaggtcattggaggatttctttgatgccgtagcttcactacctccagggtctgcaaaactgagtcagacagtgaggttccgtgttaaaagtcaagatgctagttttcatatcagcagccagggcct

SEQ ID NO: 431097 - DNA, 140 bp, Artificial Sequence
  Synthetic
aggccctggctgctgatatgcggttatctcgggctcctctcacaaaggaccagagatatttatatcagtagaagactactaggcacattcacatggacattgtcagattctgaaggcaaggaccttttgggacagcggtg

SEQ ID NO: 431098 - DNA, 140 bp, Artificial Sequence
  Synthetic
caccgctgtcccaaaaggtccttgccttcagaatctgacaatgtccatgtgaatgtgcctagtagtcttctactgatataaatatctctggtcctttgtgagaggagcccgagataaccgcatatcagcagccagggcct

SEQ ID NO: 431099 - DNA, 140 bp, Artificial Sequence
  Synthetic
aggccctggctgctgatatgtcaacagcatcactagtgctcactactctttcttccaccatgggttcatgtgtcctactgtgagacaacctcaattcagatgataacacaatgtaatgttgaccttttgggacagcggtg

SEQ ID NO: 431100 - DNA, 140 bp, Artificial Sequence
  Synthetic
caccgctgtcccaaaaggtcaacattacattgtgttatcatctgaattgaggttgtctcacagtaggacacatgaacccatggtggaagaaagagtagtgagcactagtgatgctgttgacatatcagcagccagggcct

SEQ ID NO: 431101 - DNA, 140 bp, Artificial Sequence
  Synthetic
aggccctggctgctgatatgtgtcctactgtgagacaacctcaattcagatgataacacaatgtaatgttcctctcttttccattttactatgtgtgagacaagagacaaggcttcacaggaccttttgggacagcggtg

SEQ ID NO: 431102 - DNA, 140 bp, Artificial Sequence
  Synthetic
caccgctgtcccaaaaggtcctgtgaagccttgtctcttgtctcacacatagtaaaatggaaaagagaggaacattacattgtgttatcatctgaattgaggttgtctcacagtaggacacatatcagcagccagggcct

SEQ ID NO: 431103 - DNA, 140 bp, Artificial Sequence
  Synthetic
aggccctggctgctgatatgttaacatccaacgctacacagagatctagaaattttattctgggtgaccacttcattttggttgacgctagatcgctcatgaatggtaatatgtgtttctgaccttttgggacagcggtg

SEQ ID NO: 431104 - DNA, 140 bp, Artificial Sequence
  Synthetic
caccgctgtcccaaaaggtcagaaacacatattaccattcatgagcgatctagcgtcaaccaaaatgaagtggtcacccagaataaaatttctagatctctgtgtagcgttggatgttaacatatcagcagccagggcct

SEQ ID NO: 431105 - DNA, 140 bp, Artificial Sequence
  Synthetic
atacgccatgctgggtctcccttcattttggttgacgctagatcgctcatgaatggtaatatgtgtttctcaaacactgatgggtacagccttcttaaagaatgaatgatgtgattcaaacgtacttgggagtcggccat

SEQ ID NO: 431106 - DNA, 140 bp, Artificial Sequence
  Synthetic
atggccgactcccaagtacgtttgaatcacatcattcattctttaagaaggctgtacccatcagtgtttgagaaacacatattaccattcatgagcgatctagcgtcaaccaaaatgaagggagacccagcatggcgtat

SEQ ID NO: 431107 - DNA, 140 bp, Artificial Sequence
  Synthetic
atacgccatgctgggtctcctgattaccaccactcatccctatcatgctcagaagagctcgtctctggtcaagttgctgtgagctcaggttacccatgtagacacctgcactcaatggcccgtacttgggagtcggccat

SEQ ID NO: 431108 - DNA, 140 bp, Artificial Sequence
  Synthetic
atggccgactcccaagtacgggccattgagtgcaggtgtctacatgggtaacctgagctcacagcaacttgaccagagacgagctcttctgagcatgatagggatgagtggtggtaatcaggagacccagcatggcgtat

SEQ ID NO: 431109 - DNA, 140 bp, Artificial Sequence
  Synthetic
aggccctggctgctgatatgatataatcccataacaagggtctgaaataactgaccacactttcacttccacttccatttctaagttctagcggaacttgccaatattgaatgccattaggaccttttgggacagcggtg

SEQ ID NO: 431110 - DNA, 140 bp, Artificial Sequence
  Synthetic
caccgctgtcccaaaaggtcctaatggcattcaatattggcaagttccgctagaacttagaaatggaagtggaagtgaaagtgtggtcagttatttcagacccttgttatgggattatatcatatcagcagccagggcct

SEQ ID NO: 431111 - DNA, 140 bp, Artificial Sequence
  Synthetic
atacgccatgctgggtctccaatttgtcaacaatttgattcccttgacatcagaaatcagagactgaatggacttaatatacagattctctttatttggtccccgaacacatttgctacccgtacttgggagtcggccat

SEQ ID NO: 431112 - DNA, 140 bp, Artificial Sequence
  Synthetic
atggccgactcccaagtacgggtagcaaatgtgttcggggaccaaataaagagaatctgtatattaagtccattcagtctctgatttctgatgtcaagggaatcaaattgttgacaaattggagacccagcatggcgtat

SEQ ID NO: 431113 - DNA, 140 bp, Artificial Sequence
  Synthetic
aggccctggctgctgatatgttaccagtgagtttgtagccatcaggcaccacaaagcataaagctggagtgagaatcccatgatcactcagaatggattcaaccgttttgtcttcagtgtgaccttttgggacagcggtg

SEQ ID NO: 431114 - DNA, 140 bp, Artificial Sequence
  Synthetic
caccgctgtcccaaaaggtcacactgaagacaaaacggttgaatccattctgagtgatcatgggattctcactccagctttatgctttgtggtgcctgatggctacaaactcactggtaacatatcagcagccagggcct

SEQ ID NO: 431115 - DNA, 140 bp, Artificial Sequence
  Synthetic
aggccctggctgctgatatgtgagattatttgacttcaacaaacaagccataaggagactgaaaacagaggcacaaatgaatatccaactgataaacaaagcagtgaacgcactgattaagaccttttgggacagcggtg

SEQ ID NO: 431116 - DNA, 140 bp, Artificial Sequence
  Synthetic
caccgctgtcccaaaaggtcttaatcagtgcgttcactgctttgtttatcagttggatattcatttgtgcctctgttttcagtctccttatggcttgtttgttgaagtcaaataatctcacatatcagcagccagggcct

SEQ ID NO: 431117 - DNA, 140 bp, Artificial Sequence
  Synthetic
aggccctggctgctgatatgctaagctcctccaaatgggaaacaagcaagccaaagcctcagaagaaaaaaacagtccgagagccagcctgattccagatgccacacacctagggccacagaccttttgggacagcggtg

SEQ ID NO: 431118 - DNA, 140 bp, Artificial Sequence
  Synthetic
caccgctgtcccaaaaggtctgtggccctaggtgtgtggcatctggaatcaggctggctctcggactgtttttttcttctgaggctttggcttgcttgtttcccatttggaggagcttagcatatcagcagccagggcct

SEQ ID NO: 431119 - DNA, 140 bp, Artificial Sequence
  Synthetic
aggccctggctgctgatatgaatgattgtgtcaattgtttctgccagttggtgtggctctttacactttatattgtgaagagctgctgcaacgaactttgtcaataatggcacttcatctgaccttttgggacagcggtg

SEQ ID NO: 431120 - DNA, 140 bp, Artificial Sequence
  Synthetic
caccgctgtcccaaaaggtcagatgaagtgccattattgacaaagttcgttgcagcagctcttcacaatataaagtgtaaagagccacaccaactggcagaaacaattgacacaatcattcatatcagcagccagggcct

SEQ ID NO: 431121 - DNA, 140 bp, Artificial Sequence
  Synthetic
aggccctggctgctgatatggtatcatcaccttcccttttgacttactataacagagagcataacccttgaattccacccagctgtccactgcttcaaggaccgcacccaagatcccctcgaccttttgggacagcggtg

SEQ ID NO: 431122 - DNA, 140 bp, Artificial Sequence
  Synthetic
caccgctgtcccaaaaggtcgaggggatcttgggtgcggtccttgaagcagtggacagctgggtggaattcaagggttatgctctctgttatagtaagtcaaaagggaaggtgatgataccatatcagcagccagggcct

SEQ ID NO: 431123 - DNA, 140 bp, Artificial Sequence
  Synthetic
aggccctggctgctgatatgaaatgagggcataaaaatctgatgtgttgtgtaatattccttgacccatgtcaagtattgaactgatgtgagaaggcactacaccgacttggaaattagagaccttttgggacagcggtg

SEQ ID NO: 431124 - DNA, 140 bp, Artificial Sequence
  Synthetic
caccgctgtcccaaaaggtctctaatttccaagtcggtgtagtgccttctcacatcagttcaatacttgacatgggtcaaggaatattacacaacacatcagatttttatgccctcatttcatatcagcagccagggcct

SEQ ID NO: 431125 - DNA, 140 bp, Artificial Sequence
  Synthetic
aggccctggctgctgatatgtcaagtattgaactgatgtgagaaggcactacaccgacttggaaattagagtaaaagaaatcttctgttattgactgtttagttttcttccttaaccctagaccttttgggacagcggtg

SEQ ID NO: 431126 - DNA, 140 bp, Artificial Sequence
  Synthetic
caccgctgtcccaaaaggtctagggttaaggaagaaaactaaacagtcaataacagaagatttcttttactctaatttccaagtcggtgtagtgccttctcacatcagttcaatacttgacatatcagcagccagggcct

SEQ ID NO: 431127 - DNA, 140 bp, Artificial Sequence
  Synthetic
aggccctggctgctgatatgtgatccatgctataagacacatgtgccaatgaaacattcaatttcatggaaaggatagcattttcaaattccttctcgttgttcaggcaactccctgatagaccttttgggacagcggtg

SEQ ID NO: 431128 - DNA, 140 bp, Artificial Sequence
  Synthetic
caccgctgtcccaaaaggtctatcagggagttgcctgaacaacgagaaggaatttgaaaatgctatcctttccatgaaattgaatgtttcattggcacatgtgtcttatagcatggatcacatatcagcagccagggcct

SEQ ID NO: 431129 - DNA, 140 bp, Artificial Sequence
  Synthetic
aggccctggctgctgatatgtttgttctaagatcaccaatatataattctctgttaccacccacttgttctttatatgacaaagaaaacttaagccttcctgtatcaggtcccactgagtgaccttttgggacagcggtg

SEQ ID NO: 431130 - DNA, 140 bp, Artificial Sequence
  Synthetic
caccgctgtcccaaaaggtcactcagtgggacctgatacaggaaggcttaagttttctttgtcatataaagaacaagtgggtggtaacagagaattatatattggtgatcttagaacaaacatatcagcagccagggcct

SEQ ID NO: 431131 - DNA, 140 bp, Artificial Sequence
  Synthetic
aggccctggctgctgatatgcataagattgtggcgactcttggctataaaaacacaaattctttaacattgctgtggtacagtttgtcagtgacagagccttactaagtgcctctgaattgaccttttgggacagcggtg

SEQ ID NO: 431132 - DNA, 140 bp, Artificial Sequence
  Synthetic
caccgctgtcccaaaaggtcaattcagaggcacttagtaaggctctgtcactgacaaactgtaccacagcaatgttaaagaatttgtgtttttatagccaagagtcgccacaatcttatgcatatcagcagccagggcct

SEQ ID NO: 431133 - DNA, 140 bp, Artificial Sequence
  Synthetic
atacgccatgctgggtctccgctctccctttcactaattcttacatcatcagagagtttacccatatcaaacttgaaattaaggttccttgacttataatgagtgtacctccccataagtcgtacttgggagtcggccat

SEQ ID NO: 431134 - DNA, 140 bp, Artificial Sequence
  Synthetic
atggccgactcccaagtacgacttatggggaggtacactcattataagtcaaggaaccttaatttcaagtttgatatgggtaaactctctgatgatgtaagaattagtgaaagggagagcggagacccagcatggcgtat

SEQ ID NO: 431135 - DNA, 140 bp, Artificial Sequence
  Synthetic
atacgccatgctgggtctccgtattcgcattcatgatcaagagtatggacttaaaacactgaaagtattcatggttaaagtatgtccttgttgacactgcctttgtcaactctccaatagcgtacttgggagtcggccat

SEQ ID NO: 431136 - DNA, 140 bp, Artificial Sequence
  Synthetic
atggccgactcccaagtacgctattggagagttgacaaaggcagtgtcaacaaggacatactttaaccatgaatactttcagtgttttaagtccatactcttgatcatgaatgcgaatacggagacccagcatggcgtat

SEQ ID NO: 431137 - DNA, 140 bp, Artificial Sequence
  Synthetic
atacgccatgctgggtctccccctacagtccctgaacatcccaccgaccctcaccactcctatcctccccccgacaccccccggggggaccccccgccgggggcccccccgggggagccacgtacttgggagtcggccat

SEQ ID NO: 431138 - DNA, 140 bp, Artificial Sequence
  Synthetic
atggccgactcccaagtacgtggctcccccgggggggcccccggcggggggtccccccggggggtgtcggggggaggataggagtggtgagggtcggtgggatgttcagggactgtagggggagacccagcatggcgtat

SEQ ID NO: 431139 - DNA, 140 bp, Artificial Sequence
  Synthetic
aggccctggctgctgatatgaaacatgaccatgcccttatcatgcaccaagaacagcagtcatcattacataagagtgggcaatgagactggattagaattgactttaactaacaccagcgaccttttgggacagcggtg

SEQ ID NO: 431140 - DNA, 140 bp, Artificial Sequence
  Synthetic
caccgctgtcccaaaaggtcgctggtgttagttaaagtcaattctaatccagtctcattgcccactcttatgtaatgatgactgctgttcttggtgcatgataagggcatggtcatgtttcatatcagcagccagggcct

SEQ ID NO: 431141 - DNA, 140 bp, Artificial Sequence
  Synthetic
atacgccatgctgggtctcctagaagacaatttgttttgaattgttttgacaatggtagggattttctcatcatctaaattcacagcacctgaatatattatcttctgtctcagcaccatcgtacttgggagtcggccat

SEQ ID NO: 431142 - DNA, 140 bp, Artificial Sequence
  Synthetic
atggccgactcccaagtacgatggtgctgagacagaagataatatattcaggtgctgtgaatttagatgatgagaaaatccctaccattgtcaaaacaattcaaaacaaattgtcttctaggagacccagcatggcgtat

SEQ ID NO: 431143 - DNA, 140 bp, Artificial Sequence
  Synthetic
aggccctggctgctgatatgggattagtgctcacatgaccaaatctcacctttggttccagaaacttctcaaaacattttatctgatctgtcaatctatctggtgtttctttcgtaatgagaccttttgggacagcggtg

SEQ ID NO: 431144 - DNA, 140 bp, Artificial Sequence
  Synthetic
caccgctgtcccaaaaggtctcattacgaaagaaacaccagatagattgacagatcagataaaatgttttgagaagtttctggaaccaaaggtgagatttggtcatgtgagcactaatcccatatcagcagccagggcct

SEQ ID NO: 431145 - DNA, 140 bp, Artificial Sequence
  Synthetic
aggccctggctgctgatatgactcagatgggggctcaacatccaagagctcacaaaggttccttaatgaagagaggtgctcactagacaaatagtttgttgtgaactcttcatggagttggaccttttgggacagcggtg

SEQ ID NO: 431146 - DNA, 140 bp, Artificial Sequence
  Synthetic
caccgctgtcccaaaaggtccaactccatgaagagttcacaacaaactatttgtctagtgagcacctctcttcattaaggaacctttgtgagctcttggatgttgagcccccatctgagtcatatcagcagccagggcct

SEQ ID NO: 431147 - DNA, 140 bp, Artificial Sequence
  Synthetic
aggccctggctgctgatatgtcaaacttaggatcaactaaacctgatgcgatcaattgattttgattgaatctagctggctcaatatcaaagtctatccaagcataacccatcatcagatgaccttttgggacagcggtg

SEQ ID NO: 431148 - DNA, 140 bp, Artificial Sequence
  Synthetic
caccgctgtcccaaaaggtcatctgatgatgggttatgcttggatagactttgatattgagccagctagattcaatcaaaatcaattgatcgcatcaggtttagttgatcctaagtttgacatatcagcagccagggcct

SEQ ID NO: 431149 - DNA, 140 bp, Artificial Sequence
  Synthetic
atacgccatgctgggtctccgcagtccattagtgcacaggaggggttatttcctctttaccgcctcttttcttcttttcaacaacgacacctgtgtgcatgtggcataagtctttatactcgtacttgggagtcggccat

SEQ ID NO: 431150 - DNA, 140 bp, Artificial Sequence
  Synthetic
atggccgactcccaagtacgagtataaagacttatgccacatgcacacaggtgtcgttgttgaaaagaagaaaagaggcggtaaagaggaaataacccctcctgtgcactaatggactgcggagacccagcatggcgtat

SEQ ID NO: 431151 - DNA, 140 bp, Artificial Sequence
  Synthetic
aggccctggctgctgatatggagattgatcaaagagggaaatttgatcatcactagaggtataagcatctatcgtgccaccacatatgcaactgatagcataattaatgaacctctctgagaccttttgggacagcggtg

SEQ ID NO: 431152 - DNA, 140 bp, Artificial Sequence
  Synthetic
caccgctgtcccaaaaggtctcagagaggttcattaattatgctatcagttgcatatgtggtggcacgatagatgcttatacctctagtgatgatcaaatttccctctttgatcaatctccatatcagcagccagggcct

SEQ ID NO: 431153 - DNA, 140 bp, Artificial Sequence
  Synthetic
aggccctggctgctgatatgtggtccacactgatcccaacatcctttaaagcagtggtggccttcaaaatggttttctggaatattgaattgaggatttgattcttactcaaacactggggaccttttgggacagcggtg

SEQ ID NO: 431154 - DNA, 140 bp, Artificial Sequence
  Synthetic
caccgctgtcccaaaaggtccccagtgtttgagtaagaatcaaatcctcaattcaatattccagaaaaccattttgaaggccaccactgctttaaaggatgttgggatcagtgtggaccacatatcagcagccagggcct

SEQ ID NO: 431155 - DNA, 140 bp, Artificial Sequence
  Synthetic
aggccctggctgctgatatgggttttctggaatattgaattgaggatttgattcttactcaaacactgggaggactgtgtgattctagatctttcagcctgttgcctccgctcaacccatgaccttttgggacagcggtg

SEQ ID NO: 431156 - DNA, 140 bp, Artificial Sequence
  Synthetic
caccgctgtcccaaaaggtcatgggttgagcggaggcaacaggctgaaagatctagaatcacacagtcctcccagtgtttgagtaagaatcaaatcctcaattcaatattccagaaaacccatatcagcagccagggcct

SEQ ID NO: 431157 - DNA, 140 bp, Artificial Sequence
  Synthetic
atacgccatgctgggtctccgccggggatcctaggcaatttagacgttcttctttttgaagccttgtgtgctaagctcctccaaatgggaaacaagcaagccaaagcctcagaagaaaaacgtacttgggagtcggccat

SEQ ID NO: 431158 - DNA, 140 bp, Artificial Sequence
  Synthetic
atggccgactcccaagtacgtttttcttctgaggctttggcttgcttgtttcccatttggaggagcttagcacacaaggcttcaaaaagaagaacgtctaaattgcctaggatccccggcggagacccagcatggcgtat

SEQ ID NO: 431159 - DNA, 140 bp, Artificial Sequence
  Synthetic
aggccctggctgctgatatgttgggctttaatgaaggacttcatcatagctgtcaccacattaaaaggtatttctaccatcttgtgcatgtgccacataagtagggttgagagatagtccgaccttttgggacagcggtg

SEQ ID NO: 431160 - DNA, 140 bp, Artificial Sequence
  Synthetic
caccgctgtcccaaaaggtcggactatctctcaaccctacttatgtggcacatgcacaagatggtagaaataccttttaatgtggtgacagctatgatgaagtccttcattaaagcccaacatatcagcagccagggcct

SEQ ID NO: 431161 - DNA, 140 bp, Artificial Sequence
  Synthetic
aggccctggctgctgatatgggtcatgcttacttgcaaggagaattagtgcatcaaaaattaatagaagtttcctccttgtgttcaatatcctcaaagattttactttatttaggaatgagaccttttgggacagcggtg

SEQ ID NO: 431162 - DNA, 140 bp, Artificial Sequence
  Synthetic
caccgctgtcccaaaaggtctcattcctaaataaagtaaaatctttgaggatattgaacacaaggaggaaacttctattaatttttgatgcactaattctccttgcaagtaagcatgacccatatcagcagccagggcct

SEQ ID NO: 431163 - DNA, 140 bp, Artificial Sequence
  Synthetic
aggccctggctgctgatatgatcatctaggttcacagcacctgagtatattatcttttgtctcaacaccatccttaaaggatgatgcgcagccaaattcaaccaagaatactcaaggtcagaccttttgggacagcggtg

SEQ ID NO: 431164 - DNA, 140 bp, Artificial Sequence
  Synthetic
caccgctgtcccaaaaggtctgaccttgagtattcttggttgaatttggctgcgcatcatcctttaaggatggtgttgagacaaaagataatatactcaggtgctgtgaacctagatgatcatatcagcagccagggcct

SEQ ID NO: 431165 - DNA, 140 bp, Artificial Sequence
  Synthetic
atacgccatgctgggtctccttatatgataaagaaaacttaagccttcctgtgtcaggtcccactgaattataagattgtggcgattcttggctataaaaacacaagttcttcaacattgcgtacttgggagtcggccat

SEQ ID NO: 431166 - DNA, 140 bp, Artificial Sequence
  Synthetic
atggccgactcccaagtacgcaatgttgaagaacttgtgtttttatagccaagaatcgccacaatcttataattcagtgggacctgacacaggaaggcttaagttttctttatcatataaggagacccagcatggcgtat

SEQ ID NO: 431167 - DNA, 140 bp, Artificial Sequence
  Synthetic
aggccctggctgctgatatgacccttcagactagagctccagacccagccgacagcaccaccagaaatcccaccatcccaaaatccccaccctacagcccctgaggcagaactccgccccgaccttttgggacagcggtg

SEQ ID NO: 431168 - DNA, 140 bp, Artificial Sequence
  Synthetic
caccgctgtcccaaaaggtcggggcggagttctgcctcaggggctgtagggtggggattttgggatggtgggatttctggtggtgctgtcggctgggtctggagctctagtctgaagggtcatatcagcagccagggcct

SEQ ID NO: 431169 - DNA, 140 bp, Artificial Sequence
  Synthetic
atacgccatgctgggtctcccaggagatgatctaacaaaacactccagcagtattagaacattgcccgtcagtttgtaaccgtccggtaccacaaaacatagtgaaggtgtcaagattcccgtacttgggagtcggccat

SEQ ID NO: 431170 - DNA, 140 bp, Artificial Sequence
  Synthetic
atggccgactcccaagtacgggaatcttgacaccttcactatgttttgtggtaccggacggttacaaactgacgggcaatgttctaatactgctggagtgttttgttagatcatctcctgggagacccagcatggcgtat

SEQ ID NO: 431171 - DNA, 140 bp, Artificial Sequence
  Synthetic
atacgccatgctgggtctccaaccatttgcgttgcaagaatcaacctcaatacagagggacaagagtttcaacccttccattaatagcatcctaggctctgtctgcacaagaaatgctaacgtacttgggagtcggccat

SEQ ID NO: 431172 - DNA, 140 bp, Artificial Sequence
  Synthetic
atggccgactcccaagtacgttagcatttcttgtgcagacagagcctaggatgctattaatggaagggttgaaactcttgtccctctgtattgaggttgattcttgcaacgcaaatggttggagacccagcatggcgtat

SEQ ID NO: 431173 - DNA, 140 bp, Artificial Sequence
  Synthetic
aggccctggctgctgatatgtgtataatgaccagctaccagtacctgataattcaaaatacaacatgggaggaccactgccaattctcaagaccgtctcctatcgggtaccttggcctttgaccttttgggacagcggtg

SEQ ID NO: 431174 - DNA, 140 bp, Artificial Sequence
  Synthetic
caccgctgtcccaaaaggtcaaaggccaaggtacccgataggagacggtcttgagaattggcagtggtcctcccatgttgtattttgaattatcaggtactggtagctggtcattatacacatatcagcagccagggcct

SEQ ID NO: 431175 - DNA, 140 bp, Artificial Sequence
  Synthetic
aggccctggctgctgatatgtgatcaacaatcttttcaacagtttcctttagctgatcaaaatactcgcttgcacctccatcgagtaggatttcgtctaggtcagccccatcagcatcacgaccttttgggacagcggtg

SEQ ID NO: 431176 - DNA, 140 bp, Artificial Sequence
  Synthetic
caccgctgtcccaaaaggtcgtgatgctgatggggctgacctagacgaaatcctactcgatggaggtgcaagcgagtattttgatcagctaaaggaaactgttgaaaagattgttgatcacatatcagcagccagggcct

SEQ ID NO: 431177 - DNA, 140 bp, Artificial Sequence
  Synthetic
atacgccatgctgggtctcccagaaccctcagaacatgtggtctgctagagcaacagttcactatgggatagggtcccgtaggggcacagaagacacaagaggcaattaaagacaattaacgtacttgggagtcggccat

SEQ ID NO: 431178 - DNA, 140 bp, Artificial Sequence
  Synthetic
atggccgactcccaagtacgttaattgtctttaattgcctcttgtgtcttctgtgcccctacgggaccctatcccatagtgaactgttgctctagcagaccacatgttctgagggttctgggagacccagcatggcgtat

SEQ ID NO: 431179 - DNA, 140 bp, Artificial Sequence
  Synthetic
aggccctggctgctgatatgagttcactatgggatagggtcccgtaggggcacagaagacacaagaggcaattaaagacaattaaattagatagccttaatgcctaggatcctcggtgcggaccttttgggacagcggtg

SEQ ID NO: 431180 - DNA, 140 bp, Artificial Sequence
  Synthetic
caccgctgtcccaaaaggtccgcaccgaggatcctaggcattaaggctatctaatttaattgtctttaattgcctcttgtgtcttctgtgcccctacgggaccctatcccatagtgaactcatatcagcagccagggcct

SEQ ID NO: 431181 - DNA, 140 bp, Artificial Sequence
  Synthetic
atacgccatgctgggtctccatcctaggcatttttggttgcgcaattcaagtgtcctatttaaaatgggacaaatagtgacattcttccaggaagtgcctcatgtaatagaagaggtgatcgtacttgggagtcggccat

SEQ ID NO: 431182 - DNA, 140 bp, Artificial Sequence
  Synthetic
atggccgactcccaagtacgatcacctcttctattacatgaggcacttcctggaagaatgtcactatttgtcccattttaaataggacacttgaattgcgcaaccaaaaatgcctaggatggagacccagcatggcgtat

SEQ ID NO: 431183 - DNA, 140 bp, Artificial Sequence
  Synthetic
atacgccatgctgggtctcctttaatttcccttttcacctccttctctttaaatagtgaaccattgttaaaggaggacgtaaggagggataaatacttctttgaaacaccaggccttttacgtacttgggagtcggccat

SEQ ID NO: 431184 - DNA, 140 bp, Artificial Sequence
  Synthetic
atggccgactcccaagtacgtaaaaggcctggtgtttcaaagaagtatttatccctccttacgtcctcctttaacaatggttcactatttaaagagaaggaggtgaaaagggaaattaaaggagacccagcatggcgtat

SEQ ID NO: 431185 - DNA, 140 bp, Artificial Sequence
  Synthetic
aggccctggctgctgatatgtctgtctgatgcccacaaaaagaacctctatgaccacgctcttatgagcataatctcaactttccacttgtccatccccaacttcaatcagtatgaggcagaccttttgggacagcggtg

SEQ ID NO: 431186 - DNA, 140 bp, Artificial Sequence
  Synthetic
caccgctgtcccaaaaggtctgcctcatactgattgaagttggggatggacaagtggaaagttgagattatgctcataagagcgtggtcatagaggttctttttgtgggcatcagacagacatatcagcagccagggcct

SEQ ID NO: 431187 - DNA, 140 bp, Artificial Sequence
  Synthetic
aggccctggctgctgatatgaataaggtccttgtgatggtaatctgacacataagccatcacgaaatacctaagattttggaggagcttttgagaacgtttactggggtgagctaaaattgaccttttgggacagcggtg

SEQ ID NO: 431188 - DNA, 140 bp, Artificial Sequence
  Synthetic
caccgctgtcccaaaaggtcaattttagctcaccccagtaaacgttctcaaaagctcctccaaaatcttaggtatttcgtgatggcttatgtgtcagattaccatcacaaggaccttattcatatcagcagccagggcct

SEQ ID NO: 431189 - DNA, 140 bp, Artificial Sequence
  Synthetic
aggccctggctgctgatatgtaaaatgagcacacctcaccaactctgttgtcattaatagcatagcacttcgagcactcccctgttttttgataaattagttgaaatgcagtgtcacccagaccttttgggacagcggtg

SEQ ID NO: 431190 - DNA, 140 bp, Artificial Sequence
  Synthetic
caccgctgtcccaaaaggtctgggtgacactgcatttcaactaatttatcaaaaaacaggggagtgctcgaagtgctatgctattaatgacaacagagttggtgaggtgtgctcattttacatatcagcagccagggcct

SEQ ID NO: 431191 - DNA, 140 bp, Artificial Sequence
  Synthetic
aggccctggctgctgatatgtgttcagtcctcctgacactgctgcatcaaacatgatgcagtccattagtgcacagtgaggggttatttcctctttaccgcctcttttcttcttttcaacgaccttttgggacagcggtg

SEQ ID NO: 431192 - DNA, 140 bp, Artificial Sequence
  Synthetic
caccgctgtcccaaaaggtcgttgaaaagaagaaaagaggcggtaaagaggaaataacccctcactgtgcactaatggactgcatcatgtttgatgcagcagtgtcaggaggactgaacacatatcagcagccagggcct

SEQ ID NO: 431193 - DNA, 140 bp, Artificial Sequence
  Synthetic
aggccctggctgctgatatgaacaccattctaagcgggtgatgggtggctaagttcaaccaatgaaaccccaagtcagaatcagacaaaggctcaatgcctagaagtttaaataaattctgaccttttgggacagcggtg

SEQ ID NO: 431194 - DNA, 140 bp, Artificial Sequence
  Synthetic
caccgctgtcccaaaaggtcagaatttatttaaacttctaggcattgagcctttgtctgattctgacttggggtttcattggttgaacttagccacccatcacccgcttagaatggtgttcatatcagcagccagggcct

SEQ ID NO: 431195 - DNA, 140 bp, Artificial Sequence
  Synthetic
atacgccatgctgggtctcctaaaactctgttgatgatggcaagaagctcacaatttcgttcttctttaagtgataggacacctacattcctgtctttgattttcctcctgctgtctatccgtacttgggagtcggccat

SEQ ID NO: 431196 - DNA, 140 bp, Artificial Sequence
  Synthetic
atggccgactcccaagtacggatagacagcaggaggaaaatcaaagacaggaatgtaggtgtcctatcacttaaagaagaacgaaattgtgagcttcttgccatcatcaacagagttttaggagacccagcatggcgtat

SEQ ID NO: 431197 - DNA, 140 bp, Artificial Sequence
  Synthetic
aggccctggctgctgatatgattgtccatcagaacatttaaactctccacccctgataatttacctgaagtcatagataaagactcacagagtctgctatactctgactcttcaaaaagtgaccttttgggacagcggtg

SEQ ID NO: 431198 - DNA, 140 bp, Artificial Sequence
  Synthetic
caccgctgtcccaaaaggtcactttttgaagagtcagagtatagcagactctgtgagtctttatctatgacttcaggtaaattatcaggggtggagagtttaaatgttctgatggacaatcatatcagcagccagggcct

SEQ ID NO: 431199 - DNA, 140 bp, Artificial Sequence
  Synthetic
aggccctggctgctgatatgttgaggataccatccattgtctgaggtgacaccttgattgtctccaacatattgccaccatccagcatgcaagctcctgccttcacagctgcacccaagcgaccttttgggacagcggtg

SEQ ID NO: 431200 - DNA, 140 bp, Artificial Sequence
  Synthetic
caccgctgtcccaaaaggtcgcttgggtgcagctgtgaaggcaggagcttgcatgctggatggtggcaatatgttggagacaatcaaggtgtcacctcagacaatggatggtatcctcaacatatcagcagccagggcct

SEQ ID NO: 431201 - DNA, 140 bp, Artificial Sequence
  Synthetic
aggccctggctgctgatatgatactttgctgtgtagatcaaacccaaatctgtcaatgcttgtactgcatcattcaagtcaacctgcccctgttttgtcagacatgccagtgtcagacttgaccttttgggacagcggtg

SEQ ID NO: 431202 - DNA, 140 bp, Artificial Sequence
  Synthetic
caccgctgtcccaaaaggtcaagtctgacactggcatgtctgacaaaacaggggcaggttgacttgaatgatgcagtacaagcattgacagatttgggtttgatctacacagcaaagtatcatatcagcagccagggcct

SEQ ID NO: 431203 - DNA, 140 bp, Artificial Sequence
  Synthetic
aggccctggctgctgatatgactgtgtgattctagatctttcagcctgctgcctccgctcaacccatttctcgagatccctttttgttgactccagagaaactagtctatcattaacactgaccttttgggacagcggtg

SEQ ID NO: 431204 - DNA, 140 bp, Artificial Sequence
  Synthetic
caccgctgtcccaaaaggtcagtgttaatgatagactagtttctctggagtcaacaaaaagggatctcgagaaatgggttgagcggaggcagcaggctgaaagatctagaatcacacagtcatatcagcagccagggcct

SEQ ID NO: 431205 - DNA, 140 bp, Artificial Sequence
  Synthetic
atacgccatgctgggtctccctgtaagtatgatggtcagaaccctcagaacatgtggtctgctggaacagcaattggctgtgggacaaggtcccgtggggggcgcagagtacacagagggcgtacttgggagtcggccat

SEQ ID NO: 431206 - DNA, 140 bp, Artificial Sequence
  Synthetic
atggccgactcccaagtacgccctctgtgtactctgcgccccccacgggaccttgtcccacagccaattgctgttccagcagaccacatgttctgagggttctgaccatcatacttacagggagacccagcatggcgtat

SEQ ID NO: 431207 - DNA, 140 bp, Artificial Sequence
  Synthetic
aggccctggctgctgatatgcatttcaagtgtccttcttaacatgggacaaatagtgacatttttccaggaagtgcctcatgtgatagaggaagtgatgaacattgtactcatcgcactggaccttttgggacagcggtg

SEQ ID NO: 431208 - DNA, 140 bp, Artificial Sequence
  Synthetic
caccgctgtcccaaaaggtccagtgcgatgagtacaatgttcatcacttcctctatcacatgaggcacttcctggaaaaatgtcactatttgtcccatgttaagaaggacacttgaaatgcatatcagcagccagggcct

SEQ ID NO: 431209 - DNA, 140 bp, Artificial Sequence
  Synthetic
aggccctggctgctgatatgccgccgggggcccccccgggggagccaaccatcttcaaaagactactcaatgtcctcgatgcattcatccctcctagttaactcttcacatgttctgcccgaccttttgggacagcggtg

SEQ ID NO: 431210 - DNA, 140 bp, Artificial Sequence
  Synthetic
caccgctgtcccaaaaggtcgggcagaacatgtgaagagttaactaggagggatgaatgcatcgaggacattgagtagtcttttgaagatggttggctcccccgggggggcccccggcggcatatcagcagccagggcct

SEQ ID NO: 431211 - DNA, 140 bp, Artificial Sequence
  Synthetic
aggccctggctgctgatatgatcattgtcatcccttctctccttgcgcatcaaccgttgaacattactgacttcggagaagtcaagtccatgtaaaagagcctgggcatctttcaccaccgaccttttgggacagcggtg

SEQ ID NO: 431212 - DNA, 140 bp, Artificial Sequence
  Synthetic
caccgctgtcccaaaaggtcggtggtgaaagatgcccaggctcttttacatggacttgacttctccgaagtcagtaatgttcaacggttgatgcgcaaggagagaagggatgacaatgatcatatcagcagccagggcct

SEQ ID NO: 431213 - DNA, 140 bp, Artificial Sequence
  Synthetic
aggccctggctgctgatatgtctgttaagttctgatcaaataatgatatttgatcatcactggacgtgtaagcatcgatttgtcctccagacacacacctcaccgcaaaatttataaatcgaccttttgggacagcggtg

SEQ ID NO: 431214 - DNA, 140 bp, Artificial Sequence
  Synthetic
caccgctgtcccaaaaggtcgatttataaattttgcggtgaggtgtgtgtctggaggacaaatcgatgcttacacgtccagtgatgatcaaatatcattatttgatcagaacttaacagacatatcagcagccagggcct

SEQ ID NO: 431215 - DNA, 140 bp, Artificial Sequence
  Synthetic
aggccctggctgctgatatgtgtagtttgatgttggagcagtaaccagataattccctcctcaaagattgtgtccacaaaaaggattttatttcctttgaggcactcatcgccagattgtgaccttttgggacagcggtg

SEQ ID NO: 431216 - DNA, 140 bp, Artificial Sequence
  Synthetic
caccgctgtcccaaaaggtcacaatctggcgatgagtgcctcaaaggaaataaaatcctttttgtggacacaatctttgaggagggaattatctggttactgctccaacatcaaactacacatatcagcagccagggcct

SEQ ID NO: 431217 - DNA, 140 bp, Artificial Sequence
  Synthetic
aggccctggctgctgatatgtgatactcctcttcgatctgcagctttacttcatgagctgttaacttattattgatgccttggtggcatgaggcaatcacttcctcataatgattagagcgaccttttgggacagcggtg

SEQ ID NO: 431218 - DNA, 140 bp, Artificial Sequence
  Synthetic
caccgctgtcccaaaaggtcgctctaatcattatgaggaagtgattgcctcatgccaccaaggcatcaataataagttaacagctcatgaagtaaagctgcagatcgaagaggagtatcacatatcagcagccagggcct

SEQ ID NO: 431219 - DNA, 140 bp, Artificial Sequence
  Synthetic
atacgccatgctgggtctccctagttgacctctttgtgttcagcacaagtttctatcttattagcatcttccttcacctagtcaaataccaactcataggcatattgtaggcaagccgtgcgtacttgggagtcggccat

SEQ ID NO: 431220 - DNA, 140 bp, Artificial Sequence
  Synthetic
atggccgactcccaagtacgcacggcttgcctacaatatgcctatgagttggtatttgactaggtgaaggaagatgctaataagatagaaacttgtgctgaacacaaagaggtcaactagggagacccagcatggcgtat

SEQ ID NO: 431221 - DNA, 140 bp, Artificial Sequence
  Synthetic
atacgccatgctgggtctccgcctctctcttgcacaaagaacaatagtcaccactatataagggtgggtaatgagacaggactagaactaaccctgaccaacacaagcatcatcgatcatcgtacttgggagtcggccat

SEQ ID NO: 431222 - DNA, 140 bp, Artificial Sequence
  Synthetic
atggccgactcccaagtacgatgatcgatgatgcttgtgttggtcagggttagttctagtcctgtctcattacccacccttatatagtggtgactattgttctttgtgcaagagagaggcggagacccagcatggcgtat

SEQ ID NO: 431223 - DNA, 140 bp, Artificial Sequence
  Synthetic
aggccctggctgctgatatgatgagacaggactagaactaaccctgaccaacacaagcatcatcgatcataagttttgcaacttgtctgatgcccacaaaaagaacctttatgatcatgcgaccttttgggacagcggtg

SEQ ID NO: 431224 - DNA, 140 bp, Artificial Sequence
  Synthetic
caccgctgtcccaaaaggtcgcatgatcataaaggttctttttgtgggcatcagacaagttgcaaaacttatgatcgatgatgcttgtgttggtcagggttagttctagtcctgtctcatcatatcagcagccagggcct

SEQ ID NO: 431225 - DNA, 140 bp, Artificial Sequence
  Synthetic
aggccctggctgctgatatgaatatgaagcaatgagttgtgactttaatggagggaaaattagtgtgcagtacaacctaagtcacagctatgctggagatgcagccaaccattgtggcacgaccttttgggacagcggtg

SEQ ID NO: 431226 - DNA, 140 bp, Artificial Sequence
  Synthetic
caccgctgtcccaaaaggtcgtgccacaatggttggctgcatctccagcatagctgtgacttaggttgtactgcacactaattttccctccattaaagtcacaactcattgcttcatattcatatcagcagccagggcct

SEQ ID NO: 431227 - DNA, 140 bp, Artificial Sequence
  Synthetic
atacgccatgctgggtctcctacaacctaagtcacagctatgctggagatgcagccaaccattgtggcacagttgcaaatggcgttttgcagaccttcatgaggatggcctggggtgggacgtacttgggagtcggccat

SEQ ID NO: 431228 - DNA, 140 bp, Artificial Sequence
  Synthetic
atggccgactcccaagtacgtcccaccccaggccatcctcatgaaggtctgcaaaacgccatttgcaactgtgccacaatggttggctgcatctccagcatagctgtgacttaggttgtaggagacccagcatggcgtat

SEQ ID NO: 431229 - DNA, 140 bp, Artificial Sequence
  Synthetic
atacgccatgctgggtctccagttatcaatatctgataattcagaatacaacctgggacgatcactgccaattctcaagaccatctcccattggttaccttgggctcctctcacaaagaacgtacttgggagtcggccat

SEQ ID NO: 431230 - DNA, 140 bp, Artificial Sequence
  Synthetic
atggccgactcccaagtacgttctttgtgagaggagcccaaggtaaccaatgggagatggtcttgagaattggcagtgatcgtcccaggttgtattctgaattatcagatattgataactggagacccagcatggcgtat

SEQ ID NO: 431231 - DNA, 140 bp, Artificial Sequence
  Synthetic
aggccctggctgctgatatgattctcaagaccatctcccattggttaccttgggctcctctcacaaagaaccagagacatctacattagcaggagactgttgggcacattcacatggacagaccttttgggacagcggtg

SEQ ID NO: 431232 - DNA, 140 bp, Artificial Sequence
  Synthetic
caccgctgtcccaaaaggtctgtccatgtgaatgtgcccaacagtctcctgctaatgtagatgtctctggttctttgtgagaggagcccaaggtaaccaatgggagatggtcttgagaatcatatcagcagccagggcct

SEQ ID NO: 431233 - DNA, 140 bp, Artificial Sequence
  Synthetic
atacgccatgctgggtctccgagaatcccatgatcactcagaatagattcaaccgttttgtcttcagtgttatgttcacatccattagccctgcaagagtcaatttcaatacagagagatcgtacttgggagtcggccat

SEQ ID NO: 431234 - DNA, 140 bp, Artificial Sequence
  Synthetic
atggccgactcccaagtacgatctctctgtattgaaattgactcttgcagggctaatggatgtgaacataacactgaagacaaaacggttgaatctattctgagtgatcatgggattctcggagacccagcatggcgtat

SEQ ID NO: 431235 - DNA, 140 bp, Artificial Sequence
  Synthetic
aggccctggctgctgatatgatggatgctaattgaggctgaacttaaatgtttcggcaacacagctgtggccaaatgtaatgagaagcatgatgaagaattctgtgacatgctgaggctagaccttttgggacagcggtg

SEQ ID NO: 431236 - DNA, 140 bp, Artificial Sequence
  Synthetic
caccgctgtcccaaaaggtctagcctcagcatgtcacagaattcttcatcatgcttctcattacatttggccacagctgtgttgccgaaacatttaagttcagcctcaattagcatccatcatatcagcagccagggcct

SEQ ID NO: 431237 - DNA, 140 bp, Artificial Sequence
  Synthetic
aggccctggctgctgatatgcaaaactgagatcatcagccgctccaacagcacccccaaccggagcagcggacagcaccaaacccccaccctacagcccctgatcgacccaccgaccctcgaccttttgggacagcggtg

SEQ ID NO: 431238 - DNA, 140 bp, Artificial Sequence
  Synthetic
caccgctgtcccaaaaggtcgagggtcggtgggtcgatcaggggctgtagggtgggggtttggtgctgtccgctgctccggttgggggtgctgttggagcggctgatgatctcagttttgcatatcagcagccagggcct

SEQ ID NO: 431239 - DNA, 140 bp, Artificial Sequence
  Synthetic
atacgccatgctgggtctccgctcactatagaatagggtcccgtagggggcacagaaggcacaagagtcaattaaaggcaacaaaattagatagccttaatgcctaggatcctcggtgcgcgtacttgggagtcggccat

SEQ ID NO: 431240 - DNA, 140 bp, Artificial Sequence
  Synthetic
atggccgactcccaagtacgcgcaccgaggatcctaggcattaaggctatctaattttgttgcctttaattgactcttgtgccttctgtgccccctacgggaccctattctatagtgagcggagacccagcatggcgtat

SEQ ID NO: 431241 - DNA, 140 bp, Artificial Sequence
  Synthetic
atacgccatgctgggtctccgagcattcagttgatcaacaaggctgtgaacgctttaataaatgatcaactgataatgaaaaaccatctgcgggatatcatggggattccatactgtaatcgtacttgggagtcggccat

SEQ ID NO: 431242 - DNA, 140 bp, Artificial Sequence
  Synthetic
atggccgactcccaagtacgattacagtatggaatccccatgatatcccgcagatggtttttcattatcagttgatcatttattaaagcgttcacagccttgttgatcaactgaatgctcggagacccagcatggcgtat

SEQ ID NO: 431243 - DNA, 140 bp, Artificial Sequence
  Synthetic
aggccctggctgctgatatgttaaaatgggacaaatagtgacattcttccaggaagtaccccatgtaatagaagaggtgatgaacattgttctcattgcactgtctatactagcagtgttgaccttttgggacagcggtg

SEQ ID NO: 431244 - DNA, 140 bp, Artificial Sequence
  Synthetic
caccgctgtcccaaaaggtcaacactgctagtatagacagtgcaatgagaacaatgttcatcacctcttctattacatggggtacttcctggaagaatgtcactatttgtcccattttaacatatcagcagccagggcct

SEQ ID NO: 431245 - DNA, 140 bp, Artificial Sequence
  Synthetic
aggccctggctgctgatatgcctctttgtgttcagcacaagtttttatcttattagtatcttccttcacctagtcaaaataccaactcatagacacattgtgggcaaaccgtgtcccaaagaccttttgggacagcggtg

SEQ ID NO: 431246 - DNA, 140 bp, Artificial Sequence
  Synthetic
caccgctgtcccaaaaggtctttgggacacggtttgcccacaatgtgtctatgagttggtattttgactaggtgaaggaagatactaataagataaaaacttgtgctgaacacaaagaggcatatcagcagccagggcct

SEQ ID NO: 431247 - DNA, 140 bp, Artificial Sequence
  Synthetic
atacgccatgctgggtctccacctggtgtacctgtaaaatggaagagataagactcccatcagggcccccgtgacccaccgcctattggcggtgggtcacgggggcgtccatttacaggacgtacttgggagtcggccat

SEQ ID NO: 431248 - DNA, 140 bp, Artificial Sequence
  Synthetic
atggccgactcccaagtacgtcctgtaaatggacgcccccgtgacccaccgccaataggcggtgggtcacgggggccctgatgggagtcttatctcttccattttacaggtacaccaggtggagacccagcatggcgtat

SEQ ID NO: 431249 - DNA, 140 bp, Artificial Sequence
  Synthetic
aggccctggctgctgatatggtgacccaccgcctattggcggtgggtcacgggggcgtccatttacaggacgactctaggtgtcgatgttctaaacaccatatctctaggtagcacagctgaccttttgggacagcggtg

SEQ ID NO: 431250 - DNA, 140 bp, Artificial Sequence
  Synthetic
caccgctgtcccaaaaggtcagctgtgctacctagagatatggtgtttagaacatcgacacctagagtcgtcctgtaaatggacgcccccgtgacccaccgccaataggcggtgggtcaccatatcagcagccagggcct

SEQ ID NO: 431251 - DNA, 140 bp, Artificial Sequence
  Synthetic
atacgccatgctgggtctcctctatgacagcactagttaagcctggttgtgcagcaaagaggtctgtcacatcaatcccatgtgagtacttagcatcttgcttgaactgctttaaatcagcgtacttgggagtcggccat

SEQ ID NO: 431252 - DNA, 140 bp, Artificial Sequence
  Synthetic
atggccgactcccaagtacgctgatttaaagcagttcaagcaagatgctaagtactcacatgggattgatgtgacagacctctttgctgcacaaccaggcttaactagtgctgtcatagaggagacccagcatggcgtat

SEQ ID NO: 431253 - DNA, 140 bp, Artificial Sequence
  Synthetic
atacgccatgctgggtctccttgttgctcccagctttttgtggcttctcatctgattctagatcaacgacagtgttttcccaggcccttcctgttattgaagttcttgatgcaatgtacgcgtacttgggagtcggccat

SEQ ID NO: 431254 - DNA, 140 bp, Artificial Sequence
  Synthetic
atggccgactcccaagtacgcgtacattgcatcaagaacttcaataacaggaagggcctgggaaaacactgtcgttgatctagaatcagatgagaagccacaaaaagctgggagcaacaaggagacccagcatggcgtat

SEQ ID NO: 431255 - DNA, 140 bp, Artificial Sequence
  Synthetic
atacgccatgctgggtctccttcctttcgccaggggtgtctgatatgaacatcccaagactctttttaacctttagaatggacttgaggatgccatccattgtctgaggtgacaccttgacgtacttgggagtcggccat

SEQ ID NO: 431256 - DNA, 140 bp, Artificial Sequence
  Synthetic
atggccgactcccaagtacgtcaaggtgtcacctcagacaatggatggcatcctcaagtccattctaaaggttaaaaagagtcttgggatgttcatatcagacacccctggcgaaaggaaggagacccagcatggcgtat

SEQ ID NO: 431257 - DNA, 140 bp, Artificial Sequence
  Synthetic
atacgccatgctgggtctccttgtctccagcatattaccaccatctagcatgcaagctcctgccttaacagctgcacccagactaaaattgtaaccagagatgttcagggagctcttgttcgtacttgggagtcggccat

SEQ ID NO: 431258 - DNA, 140 bp, Artificial Sequence
  Synthetic
atggccgactcccaagtacgaacaagagctccctgaacatctctggttacaattttagtctgggtgcagctgttaaggcaggagcttgcatgctagatggtggtaatatgctggagacaaggagacccagcatggcgtat

SEQ ID NO: 431259 - DNA, 140 bp, Artificial Sequence
  Synthetic
atacgccatgctgggtctccccgaagtgttgggatattttgctgtgtagatcaaacccaaatctgttagcgcttgcacaacatcattcaggtcaacctgcccttgttttgttagacatgccgtacttgggagtcggccat

SEQ ID NO: 431260 - DNA, 140 bp, Artificial Sequence
  Synthetic
atggccgactcccaagtacggcatgtctaacaaaacaagggcaggttgacctgaatgatgttgtgcaagcgctaacagatttgggtttgatctacacagcaaaatatcccaacacttcggggagacccagcatggcgtat

SEQ ID NO: 431261 - DNA, 140 bp, Artificial Sequence
  Synthetic
aggccctggctgctgatatgcgattaccaccactcattcctatcatgtttaagagagcccgtctctggtcaagttgttgtgaactcaggttacccatataaacacctgcactcaacggccgaccttttgggacagcggtg

SEQ ID NO: 431262 - DNA, 140 bp, Artificial Sequence
  Synthetic
caccgctgtcccaaaaggtcggccgttgagtgcaggtgtttatatgggtaacctgagttcacaacaacttgaccagagacgggctctcttaaacatgataggaatgagtggtggtaatcgcatatcagcagccagggcct

SEQ ID NO: 431263 - DNA, 140 bp, Artificial Sequence
  Synthetic
aggccctggctgctgatatgttgagttgatttcaactcaacaaggttgttgactgcttgattaagatcccttaaccgttttagatcaccatcatcccttctctgtttgcgcatcaatcgcgaccttttgggacagcggtg

SEQ ID NO: 431264 - DNA, 140 bp, Artificial Sequence
  Synthetic
caccgctgtcccaaaaggtcgcgattgatgcgcaaacagagaagggatgatggtgatctaaaacggttaagggatcttaatcaagcagtcaacaaccttgttgagttgaaatcaactcaacatatcagcagccagggcct

SEQ ID NO: 431265 - DNA, 140 bp, Artificial Sequence
  Synthetic
atacgccatgctgggtctcccaggggatcctaggcaatttggttgttctttttgagggcttttgtgtcaaactccaccagatggggaacaagcaagccaaagtcccagaagtaagggacacgtacttgggagtcggccat

SEQ ID NO: 431266 - DNA, 140 bp, Artificial Sequence
  Synthetic
atggccgactcccaagtacgtgtcccttacttctgggactttggcttgcttgttccccatctggtggagtttgacacaaaagccctcaaaaagaacaaccaaattgcctaggatcccctgggagacccagcatggcgtat

SEQ ID NO: 431267 - DNA, 140 bp, Artificial Sequence
  Synthetic
aggccctggctgctgatatggcccgagagccagtctgatcccagatgccacacacctagggccacagttctgtaagagctgttggttcgaaaacaaaggcctggtcgagtgcaacaatcagaccttttgggacagcggtg

SEQ ID NO: 431268 - DNA, 140 bp, Artificial Sequence
  Synthetic
caccgctgtcccaaaaggtctgattgttgcactcgaccaggcctttgttttcgaaccaacagctcttacagaactgtggccctaggtgtgtggcatctgggatcagactggctctcgggccatatcagcagccagggcct

SEQ ID NO: 431269 - DNA, 140 bp, Artificial Sequence
  Synthetic
aggccctggctgctgatatgttcaaaagatccggattcttaacatcccacaccctaacaactccgtctcttccaggttgggtgccctgagccccaccaaccatgcctatcatgttcagcagaccttttgggacagcggtg

SEQ ID NO: 431270 - DNA, 140 bp, Artificial Sequence
  Synthetic
caccgctgtcccaaaaggtctgctgaacatgataggcatggttggtggggctcagggcacccaacctggaagagacggagttgttagggtgtgggatgttaagaatccggatcttttgaacatatcagcagccagggcct

SEQ ID NO: 431271 - DNA, 140 bp, Artificial Sequence
  Synthetic
aggccctggctgctgatatgtcctcacatgtcctgcctttcagccttaatctaccaccacttgattgcaccatcacccttctctttgatttactatagcagagagcataacctttgaattgaccttttgggacagcggtg

SEQ ID NO: 431272 - DNA, 140 bp, Artificial Sequence
  Synthetic
caccgctgtcccaaaaggtcaattcaaaggttatgctctctgctatagtaaatcaaagagaagggtgatggtgcaatcaagtggtggtagattaaggctgaaaggcaggacatgtgaggacatatcagcagccagggcct

SEQ ID NO: 431273 - DNA, 140 bp, Artificial Sequence
  Synthetic
aggccctggctgctgatatgccacccaattgtccactgcctcaagaactgcactcaggaccttcgcattatctggtgctgcagccttcaatgtggagacaatgtccacccctgaccactggaccttttgggacagcggtg

SEQ ID NO: 431274 - DNA, 140 bp, Artificial Sequence
  Synthetic
caccgctgtcccaaaaggtccagtggtcaggggtggacattgtctccacattgaaggctgcagcaccagataatgcgaaggtcctgagtgcagttcttgaggcagtggacaattgggtggcatatcagcagccagggcct

SEQ ID NO: 431275 - DNA, 140 bp, Artificial Sequence
  Synthetic
atacgccatgctgggtctccgcagatcagatgaggtgtccccaacttctctcacaaacatctcaagatcctggtcctgtataacaggtgtgaaagatgccaatttcctctcacattcccacgtacttgggagtcggccat

SEQ ID NO: 431276 - DNA, 140 bp, Artificial Sequence
  Synthetic
atggccgactcccaagtacgtgggaatgtgagaggaaattggcatctttcacacctgttatacaggaccaggatcttgagatgtttgtgagagaagttggggacacctcatctgatctgcggagacccagcatggcgtat

SEQ ID NO: 431277 - DNA, 140 bp, Artificial Sequence
  Synthetic
aggccctggctgctgatatgtggtcctgtataacaggtgtgaaagatgccaatttcctctcacattcccacaggcttcctctatgcacaaccaaagggactggttcagtacaagggcccagaccttttgggacagcggtg

SEQ ID NO: 431278 - DNA, 140 bp, Artificial Sequence
  Synthetic
caccgctgtcccaaaaggtctgggcccttgtactgaaccagtccctttggttgtgcatagaggaagcctgtgggaatgtgagaggaaattggcatctttcacacctgttatacaggaccacatatcagcagccagggcct

SEQ ID NO: 431279 - DNA, 140 bp, Artificial Sequence
  Synthetic
aggccctggctgctgatatgctccttagaagcgctcatcttcgtctgggcactcagagattcactagttgaaagcttcactcagttagtcaataaaaaagcgcaatccaatagcctaggagaccttttgggacagcggtg

SEQ ID NO: 431280 - DNA, 140 bp, Artificial Sequence
  Synthetic
caccgctgtcccaaaaggtctcctaggctattggattgcgcttttttattgactaactgagtgaagctttcaactagtgaatctctgagtgcccagacgaagatgagcgcttctaaggagcatatcagcagccagggcct

SEQ ID NO: 431281 - DNA, 140 bp, Artificial Sequence
  Synthetic
atacgccatgctgggtctccacctcaacaggagttacatgccctagttgatttgtatcaaccaaaaactcgttgatgacctcagtgtcaacataccatgctgatttgcccttaaaggtagcgtacttgggagtcggccat

SEQ ID NO: 431282 - DNA, 140 bp, Artificial Sequence
  Synthetic
atggccgactcccaagtacgctacctttaagggcaaatcagcatggtatgttgacactgaggtcatcaacgagtttttggttgatacaaatcaactagggcatgtaactcctgttgaggtggagacccagcatggcgtat

SEQ ID NO: 431283 - DNA, 140 bp, Artificial Sequence
  Synthetic
aggccctggctgctgatatggttgatgacctcagtgtcaacataccatgctgatttgcccttaaaggtaggtcctgacaaaaccagcctccagcagtctgacaaaacacatggattcactgaccttttgggacagcggtg

SEQ ID NO: 431284 - DNA, 140 bp, Artificial Sequence
  Synthetic
caccgctgtcccaaaaggtcagtgaatccatgtgttttgtcagactgctggaggctggttttgtcaggacctacctttaagggcaaatcagcatggtatgttgacactgaggtcatcaaccatatcagcagccagggcct

SEQ ID NO: 431285 - DNA, 140 bp, Artificial Sequence
  Synthetic
atacgccatgctgggtctccactcattgaaccaatgtagtcaaggtgaatggcaaagctctccttaaaactagcatcttgacttttaatgcggaatcttactgtctggcttagttttgcacgtacttgggagtcggccat

SEQ ID NO: 431286 - DNA, 140 bp, Artificial Sequence
  Synthetic
atggccgactcccaagtacgtgcaaaactaagccagacagtaagattccgcattaaaagtcaagatgctagttttaaggagagctttgccattcaccttgactacattggttcaatgagtggagacccagcatggcgtat

SEQ ID NO: 431287 - DNA, 140 bp, Artificial Sequence
  Synthetic
aggccctggctgctgatatgtagcatcttgacttttaatgcggaatcttactgtctggcttagttttgcagaccccgaaggtagtgatgcaacagcatcgaagaaatcctccagtgaatcgaccttttgggacagcggtg

SEQ ID NO: 431288 - DNA, 140 bp, Artificial Sequence
  Synthetic
caccgctgtcccaaaaggtcgattcactggaggatttcttcgatgctgttgcatcactaccttcggggtctgcaaaactaagccagacagtaagattccgcattaaaagtcaagatgctacatatcagcagccagggcct

SEQ ID NO: 431289 - DNA, 140 bp, Artificial Sequence
  Synthetic
aggccctggctgctgatatgcctataactacgattcccgtccacccaatctcttacatcagtctcgcagttcaacaggaatgggtcaataggatatttggcataacacagcagactcaaagaccttttgggacagcggtg

SEQ ID NO: 431290 - DNA, 140 bp, Artificial Sequence
  Synthetic
caccgctgtcccaaaaggtctttgagtctgctgtgttatgccaaatatcctattgacccattcctgttgaactgcgagactgatgtaagagattgggtggacgggaatcgtagttataggcatatcagcagccagggcct

SEQ ID NO: 431291 - DNA, 140 bp, Artificial Sequence
  Synthetic
atacgccatgctgggtctcctggctggctcaatgtcaaagtctatccaggcataacccatcattagatcatgtttaaacattggtctttcaacacctttgtgaatgactttctccacgaacgtacttgggagtcggccat

SEQ ID NO: 431292 - DNA, 140 bp, Artificial Sequence
  Synthetic
atggccgactcccaagtacgttcgtggagaaagtcattcacaaaggtgttgaaagaccaatgtttaaacatgatctaatgatgggttatgcctggatagactttgacattgagccagccaggagacccagcatggcgtat

SEQ ID NO: 431293 - DNA, 140 bp, Artificial Sequence
  Synthetic
aggccctggctgctgatatgtgtttaaacattggtctttcaacacctttgtgaatgactttctccacgaatgaggaaaatggacccatcctatgcaatccttcaccctctggaaccgacggaccttttgggacagcggtg

SEQ ID NO: 431294 - DNA, 140 bp, Artificial Sequence
  Synthetic
caccgctgtcccaaaaggtccgtcggttccagagggtgaaggattgcataggatgggtccattttcctcattcgtggagaaagtcattcacaaaggtgttgaaagaccaatgtttaaacacatatcagcagccagggcct

SEQ ID NO: 431295 - DNA, 140 bp, Artificial Sequence
  Synthetic
atacgccatgctgggtctccaatggtctcacataggattcaaagtagatttgcctcatgaagttgtcaacagcatcactagtgctcaccactctttcctccaccatgggctcgtgtgttccgtacttgggagtcggccat

SEQ ID NO: 431296 - DNA, 140 bp, Artificial Sequence
  Synthetic
atggccgactcccaagtacggaacacacgagcccatggtggaggaaagagtggtgagcactagtgatgctgttgacaacttcatgaggcaaatctactttgaatcctatgtgagaccattggagacccagcatggcgtat

SEQ ID NO: 431297 - DNA, 140 bp, Artificial Sequence
  Synthetic
aggccctggctgctgatatgagcatcactagtgctcaccactctttcctccaccatgggctcgtgtgttctagtgtgagacaaccttaattcagatgataacacaatgtaatgctcttctgaccttttgggacagcggtg

SEQ ID NO: 431298 - DNA, 140 bp, Artificial Sequence
  Synthetic
caccgctgtcccaaaaggtcagaagagcattacattgtgttatcatctgaattaaggttgtctcacactagaacacacgagcccatggtggaggaaagagtggtgagcactagtgatgctcatatcagcagccagggcct

SEQ ID NO: 431299 - DNA, 140 bp, Artificial Sequence
  Synthetic
aggccctggctgctgatatgtcttggttgatgctaaatcgctcataaatggtaatatgtgtttctcaaatacagttgggtacagccttcttaaggaatgaataatatgatttaacccaacgaccttttgggacagcggtg

SEQ ID NO: 431300 - DNA, 140 bp, Artificial Sequence
  Synthetic
caccgctgtcccaaaaggtcgttgggttaaatcatattattcattccttaagaaggctgtacccaactgtatttgagaaacacatattaccatttatgagcgatttagcatcaaccaagacatatcagcagccagggcct

SEQ ID NO: 431301 - DNA, 140 bp, Artificial Sequence
  Synthetic
atacgccatgctgggtctccaaggattgtgcttgaaaaaatccagtgcctcagtcatctttggttcacccaagacccatgcacccagttctattgcagttgataaggaaatgcacatatacgtacttgggagtcggccat

SEQ ID NO: 431302 - DNA, 140 bp, Artificial Sequence
  Synthetic
atggccgactcccaagtacgtatatgtgcatttccttatcaactgcaatagaactgggtgcatgggtcttgggtgaaccaaagatgactgaggcactggattttttcaagcacaatccttggagacccagcatggcgtat

SEQ ID NO: 431303 - DNA, 140 bp, Artificial Sequence
  Synthetic
aggccctggctgctgatatgaagacccatgcacccagttctattgcagttgataaggaaatgcacatataatcccataataagggtctgaaataaccaaccacaccttcacatccacttcgaccttttgggacagcggtg

SEQ ID NO: 431304 - DNA, 140 bp, Artificial Sequence
  Synthetic
caccgctgtcccaaaaggtcgaagtggatgtgaaggtgtggttggttatttcagacccttattatgggattatatgtgcatttccttatcaactgcaatagaactgggtgcatgggtcttcatatcagcagccagggcct

SEQ ID NO: 431305 - DNA, 140 bp, Artificial Sequence
  Synthetic
atacgccatgctgggtctccagttcgatccccttggtatcagtgaccagagattgtatggacttaatatacagattttccttatttggccctcgaacacacttgctacccaatgttctgccgtacttgggagtcggccat

SEQ ID NO: 431306 - DNA, 140 bp, Artificial Sequence
  Synthetic
atggccgactcccaagtacggcagaacattgggtagcaagtgtgttcgagggccaaataaggaaaatctgtatattaagtccatacaatctctggtcactgataccaaggggatcgaactggagacccagcatggcgtat

SEQ ID NO: 431307 - DNA, 140 bp, Artificial Sequence
  Synthetic
aggccctggctgctgatatgcagattttccttatttggccctcgaacacacttgctacccaatgttctgcataaacccacaaagccagatgcaatagaactttgaaatgcagacttattggaccttttgggacagcggtg

SEQ ID NO: 431308 - DNA, 140 bp, Artificial Sequence
  Synthetic
caccgctgtcccaaaaggtccaataagtctgcatttcaaagttctattgcatctggctttgtgggtttatgcagaacattgggtagcaagtgtgttcgagggccaaataaggaaaatctgcatatcagcagccagggcct

SEQ ID NO: 431309 - DNA, 140 bp, Artificial Sequence
  Synthetic
atacgccatgctgggtctcccttattctggatcgttttgacaatagtgggaatcttctcatcatctaggtttacagcacctgaatatataatcttctgtctcaataccatccttagaggacgtacttgggagtcggccat

SEQ ID NO: 431310 - DNA, 140 bp, Artificial Sequence
  Synthetic
atggccgactcccaagtacgtcctctaaggatggtattgagacagaagattatatattcaggtgctgtaaacctagatgatgagaagattcccactattgtcaaaacgatccagaataagggagacccagcatggcgtat

SEQ ID NO: 431311 - DNA, 140 bp, Artificial Sequence
  Synthetic
aggccctggctgctgatatgttacagcacctgaatatataatcttctgtctcaataccatccttagaggatgatgtgcagccaaatttaaccaagaatactcaaggtcagactcagatgggaccttttgggacagcggtg

SEQ ID NO: 431312 - DNA, 140 bp, Artificial Sequence
  Synthetic
caccgctgtcccaaaaggtcccatctgagtctgaccttgagtattcttggttaaatttggctgcacatcatcctctaaggatggtattgagacagaagattatatattcaggtgctgtaacatatcagcagccagggcct

SEQ ID NO: 431313 - DNA, 140 bp, Artificial Sequence
  Synthetic
atacgccatgctgggtctcccactagataagtagtttgttgtaaactcttcatgaagctgtccagtcttcaacctgttgtacagctttcttagcatagatctaatcttgctacaagcatccgtacttgggagtcggccat

SEQ ID NO: 431314 - DNA, 140 bp, Artificial Sequence
  Synthetic
atggccgactcccaagtacggatgcttgtagcaagattagatctatgctaagaaagctgtacaacaggttgaagactggacagcttcatgaagagtttacaacaaactacttatctagtgggagacccagcatggcgtat

SEQ ID NO: 431315 - DNA, 140 bp, Artificial Sequence
  Synthetic
aggccctggctgctgatatgaacctgttgtacagctttcttagcatagatctaatcttgctacaagcatcagggatcaacccctcaatttgcctcataatcctgtaactgcggttaccatgaccttttgggacagcggtg

SEQ ID NO: 431316 - DNA, 140 bp, Artificial Sequence
  Synthetic
caccgctgtcccaaaaggtcatggtaaccgcagttacaggattatgaggcaaattgaggggttgatccctgatgcttgtagcaagattagatctatgctaagaaagctgtacaacaggttcatatcagcagccagggcct

SEQ ID NO: 431317 - DNA, 140 bp, Artificial Sequence
  Synthetic
atacgccatgctgggtctccatagatctttgcactgatcccaaacagcattttcaaatctcctagagtcagccttgctcagtgcaatgtcaataagctttatgtcccttcttccttgggacgtacttgggagtcggccat

SEQ ID NO: 431318 - DNA, 140 bp, Artificial Sequence
  Synthetic
atggccgactcccaagtacgtcccaaggaagaagggacataaagcttattgacattgcactgagcaaggctgactctaggagatttgaaaatgctgtttgggatcagtgcaaagatctatggagacccagcatggcgtat

SEQ ID NO: 431319 - DNA, 140 bp, Artificial Sequence
  Synthetic
atacgccatgctgggtctccgggtatctagcatactgtaaaagactcaaggtcctcatctgtattaagttgcacagatgaacagggacaccatttgcaactgactgatcaataattgtgtcgtacttgggagtcggccat

SEQ ID NO: 431320 - DNA, 140 bp, Artificial Sequence
  Synthetic
atggccgactcccaagtacgacacaattattgatcagtcagttgcaaatggtgtccctgttcatctgtgcaacttaatacagatgaggaccttgagtcttttacagtatgctagatacccggagacccagcatggcgtat

SEQ ID NO: 431321 - DNA, 140 bp, Artificial Sequence
  Synthetic
aggccctggctgctgatatgagtctgtatggatctaatgtaaagattctccttgttggggcctctgacacacttgctacctagtgttctacacaaccctacaaacccagatgctatagaagaccttttgggacagcggtg

SEQ ID NO: 431322 - DNA, 140 bp, Artificial Sequence
  Synthetic
caccgctgtcccaaaaggtcttctatagcatctgggtttgtagggttgtgtagaacactaggtagcaagtgtgtcagaggccccaacaaggagaatctttacattagatccatacagactcatatcagcagccagggcct

SEQ ID NO: 431323 - DNA, 140 bp, Artificial Sequence
  Synthetic
aggccctggctgctgatatggaatctagatttgaattctgcaacaaacctgccaataacacttttaggactcacaaatttattgagttgatcactcatgtaataatggaactccatcagagaccttttgggacagcggtg

SEQ ID NO: 431324 - DNA, 140 bp, Artificial Sequence
  Synthetic
caccgctgtcccaaaaggtctctgatggagttccattattacatgagtgatcaactcaataaatttgtgagtcctaaaagtgttattggcaggtttgttgcagaattcaaatctagattccatatcagcagccagggcct

SEQ ID NO: 431325 - DNA, 140 bp, Artificial Sequence
  Synthetic
aggccctggctgctgatatgaaaaagggagatttgatcatcactggaggtataggcatctattgtgccaccacatatacaagtaatggcataattaataaacctttctgaaatgagggcagaccttttgggacagcggtg

SEQ ID NO: 431326 - DNA, 140 bp, Artificial Sequence
  Synthetic
caccgctgtcccaaaaggtctgccctcatttcagaaaggtttattaattatgccattacttgtatatgtggtggcacaatagatgcctatacctccagtgatgatcaaatctccctttttcatatcagcagccagggcct

SEQ ID NO: 431327 - DNA, 140 bp, Artificial Sequence
  Synthetic
atacgccatgctgggtctccactaacatgagaaggcaccacaccgatttgaaaattggagtaaaagaaatcttctgttattgactgtttagtcttcttccttaaccctagttgagctttacgtacttgggagtcggccat

SEQ ID NO: 431328 - DNA, 140 bp, Artificial Sequence
  Synthetic
atggccgactcccaagtacgtaaagctcaactagggttaaggaagaagactaaacagtcaataacagaagatttcttttactccaattttcaaatcggtgtggtgccttctcatgttagtggagacccagcatggcgtat

SEQ ID NO: 431329 - DNA, 140 bp, Artificial Sequence
  Synthetic
aggccctggctgctgatatgcttctgttattgactgtttagtcttcttccttaaccctagttgagctttaataaatgacttcatcatagctgacaccacattgaaaggtatctccaccatgaccttttgggacagcggtg

SEQ ID NO: 431330 - DNA, 140 bp, Artificial Sequence
  Synthetic
caccgctgtcccaaaaggtcatggtggagatacctttcaatgtggtgtcagctatgatgaagtcatttattaaagctcaactagggttaaggaagaagactaaacagtcaataacagaagcatatcagcagccagggcct

SEQ ID NO: 431331 - DNA, 140 bp, Artificial Sequence
  Synthetic
atacgccatgctgggtctcctgtcagcttgcaagtcctttgagagaaatattaggttctgcagaacagtcagaaacaaaaatgggcacatcatcgggccccacttactatgatccatgctcgtacttgggagtcggccat

SEQ ID NO: 431332 - DNA, 140 bp, Artificial Sequence
  Synthetic
atggccgactcccaagtacgagcatggatcatagtaagtggggcccgatgatgtgcccatttttgtttctgactgttctgcagaacctaatatttctctcaaaggacttgcaagctgacaggagacccagcatggcgtat

SEQ ID NO: 431333 - DNA, 140 bp, Artificial Sequence
  Synthetic
atacgccatgctgggtctccataagagacatgtgccaaggagacattcaatttcatagaaaggatggcattctcaaattctttttcattgttcagacagctccctgacaactgtgaacttcgtacttgggagtcggccat

SEQ ID NO: 431334 - DNA, 140 bp, Artificial Sequence
  Synthetic
atggccgactcccaagtacgaagttcacagttgtcagggagctgtctgaacaatgaaaaagaatttgagaatgccatcctttctatgaaattgaatgtctccttggcacatgtctcttatggagacccagcatggcgtat

SEQ ID NO: 431335 - DNA, 140 bp, Artificial Sequence
  Synthetic
atacgccatgctgggtctccatcaccaatgtataactctctgttgcctccaacttgttccttgtaagataaagaaaatttgagcctccctgtatcaggtcctactgagtcataggactgtcgtacttgggagtcggccat

SEQ ID NO: 431336 - DNA, 140 bp, Artificial Sequence
  Synthetic
atggccgactcccaagtacgacagtcctatgactcagtaggacctgatacagggaggctcaaattttctttatcttacaaggaacaagttggaggcaacagagagttatacattggtgatggagacccagcatggcgtat

SEQ ID NO: 431337 - DNA, 140 bp, Artificial Sequence
  Synthetic
aggccctggctgctgatatgaagaaaatttgagcctccctgtatcaggtcctactgagtcataggactgtggtgattcttggctataaaaacataggttcttcaacattgctgttgtgcagaccttttgggacagcggtg

SEQ ID NO: 431338 - DNA, 140 bp, Artificial Sequence
  Synthetic
caccgctgtcccaaaaggtctgcacaacagcaatgttgaagaacctatgtttttatagccaagaatcaccacagtcctatgactcagtaggacctgatacagggaggctcaaattttcttcatatcagcagccagggcct

SEQ ID NO: 431339 - DNA, 140 bp, Artificial Sequence
  Synthetic
aggccctggctgctgatatgaggtttcttgacttataatgagtgtaccttcccataagtgtatttgcattcataatcaaaagtatagacttaaaacactggaagtactcatgatcaaaatgaccttttgggacagcggtg

SEQ ID NO: 431340 - DNA, 140 bp, Artificial Sequence
  Synthetic
caccgctgtcccaaaaggtcattttgatcatgagtacttccagtgttttaagtctatacttttgattatgaatgcaaatacacttatgggaaggtacactcattataagtcaagaaacctcatatcagcagccagggcct

SEQ ID NO: 431341 - DNA, 140 bp, Artificial Sequence
  Synthetic
aggccctggctgctgatatgccttagaagcactcatcttgatctggatactttggggtttactggctgaaagtatcactcagtaagtcaaagaaaagcgcaatccaatagcctaggatccgaccttttgggacagcggtg

SEQ ID NO: 431342 - DNA, 140 bp, Artificial Sequence
  Synthetic
caccgctgtcccaaaaggtcggatcctaggctattggattgcgcttttctttgacttactgagtgatactttcagccagtaaaccccaaagtatccagatcaagatgagtgcttctaaggcatatcagcagccagggcct

SEQ ID NO: 431343 - DNA, 140 bp, Artificial Sequence
  Synthetic
atacgccatgctgggtctccatgtgtccacagtaaaaatatttccctttcaacctactattctcatagacagcattgcaaaattcctcataaaatttgtctggtaagacatcatgatcaacgtacttgggagtcggccat

SEQ ID NO: 431344 - DNA, 140 bp, Artificial Sequence
  Synthetic
atggccgactcccaagtacgttgatcatgatgtcttaccagacaaattttatgaggaattttgcaatgctgtctatgagaatagtaggttgaaagggaaatatttttactgtggacacatggagacccagcatggcgtat

SEQ ID NO: 431345 - DNA, 140 bp, Artificial Sequence
  Synthetic
atacgccatgctgggtctccggggatcctaggcaatttagctggacttcagtggtaaggctcattttagtgaatccctgaatcaagtgcccagccgaaatgggcaacagacagaccaaatcgtacttgggagtcggccat

SEQ ID NO: 431346 - DNA, 140 bp, Artificial Sequence
  Synthetic
atggccgactcccaagtacgatttggtctgtctgttgcccatttcggctgggcacttgattcagggattcactaaaatgagccttaccactgaagtccagctaaattgcctaggatccccggagacccagcatggcgtat

SEQ ID NO: 431347 - DNA, 140 bp, Artificial Sequence
  Synthetic
aggccctggctgctgatatggaatccctgaatcaagtgcccagccgaaatgggcaacagacagaccaaatcaacaaaagtcgatgagcatcaaagagctcatctagtgccagatgcatccgaccttttgggacagcggtg

SEQ ID NO: 431348 - DNA, 140 bp, Artificial Sequence
  Synthetic
caccgctgtcccaaaaggtcggatgcatctggcactagatgagctctttgatgctcatcgacttttgttgatttggtctgtctgttgcccatttcggctgggcacttgattcagggattccatatcagcagccagggcct

SEQ ID NO: 431349 - DNA, 140 bp, Artificial Sequence
  Synthetic
atacgccatgctgggtctcctgatcttttgaccttcagaatagatttcaaaataccgtccattgtttgtggtgacacttttattgtttccaacatgttgcccccatcaagcatgcaagcacgtacttgggagtcggccat

SEQ ID NO: 431350 - DNA, 140 bp, Artificial Sequence
  Synthetic
atggccgactcccaagtacgtgcttgcatgcttgatgggggcaacatgttggaaacaataaaagtgtcaccacaaacaatggacggtattttgaaatctattctgaaggtcaaaagatcaggagacccagcatggcgtat

SEQ ID NO: 431351 - DNA, 140 bp, Artificial Sequence
  Synthetic
atacgccatgctgggtctccatcagtagaatttgaacctattttgacaggttccctatactgatcaacaatcctttcaacagtctccctcagctgattgaaataaatgcttgcacccccacgtacttgggagtcggccat

SEQ ID NO: 431352 - DNA, 140 bp, Artificial Sequence
  Synthetic
atggccgactcccaagtacgtgggggtgcaagcatttatttcaatcagctgagggagactgttgaaaggattgttgatcagtatagggaacctgtcaaaataggttcaaattctactgatggagacccagcatggcgtat

SEQ ID NO: 431353 - DNA, 140 bp, Artificial Sequence
  Synthetic
atacgccatgctgggtctcctccagatcctaaaactagattgctcattgcctgttgtaccttatattcatagtcctgcttgttgagaaggtgttttcctttccttgagaagacctcagtgcgtacttgggagtcggccat

SEQ ID NO: 431354 - DNA, 140 bp, Artificial Sequence
  Synthetic
atggccgactcccaagtacgcactgaggtcttctcaaggaaaggaaaacaccttctcaacaagcaggactatgaatataaggtacaacaggcaatgagcaatctagttttaggatctggaggagacccagcatggcgtat

SEQ ID NO: 431355 - DNA, 140 bp, Artificial Sequence
  Synthetic
aggccctggctgctgatatgcctgtatcaaatttaaagttcagacacttactcttataatgagagtatcttcccatcagcttattcccattcatcactaataaaattgacttaaagcactgaccttttgggacagcggtg

SEQ ID NO: 431356 - DNA, 140 bp, Artificial Sequence
  Synthetic
caccgctgtcccaaaaggtcagtgctttaagtcaattttattagtgatgaatgggaataagctgatgggaagatactctcattataagagtaagtgtctgaactttaaatttgatacaggcatatcagcagccagggcct

SEQ ID NO: 431357 - DNA, 140 bp, Artificial Sequence
  Synthetic
aggccctggctgctgatatgttcttcacttctcttcccttaaatagtgaaccattgttaaaagaggatgtgagaagggacaagaatttctttgagacaccaggccttttgtagtttggccgaccttttgggacagcggtg

SEQ ID NO: 431358 - DNA, 140 bp, Artificial Sequence
  Synthetic
caccgctgtcccaaaaggtcggccaaactacaaaaggcctggtgtctcaaagaaattcttgtcccttctcacatcctcttttaacaatggttcactatttaagggaagagaagtgaagaacatatcagcagccagggcct

SEQ ID NO: 431359 - DNA, 140 bp, Artificial Sequence
  Synthetic
atacgccatgctgggtctccaccatgtcatccagttcctcctctgtggccgtgtctgcagggttgatgctcacatgaccaaatttcacctttggttcaaggaacttttcaaaacactttacgtacttgggagtcggccat

SEQ ID NO: 431360 - DNA, 140 bp, Artificial Sequence
  Synthetic
atggccgactcccaagtacgtaaagtgttttgaaaagttccttgaaccaaaggtgaaatttggtcatgtgagcatcaaccctgcagacacggccacagaggaggaactggatgacatggtggagacccagcatggcgtat

SEQ ID NO: 431361 - DNA, 140 bp, Artificial Sequence
  Synthetic
aggccctggctgctgatatgcacatgaccaaatttcacctttggttcaaggaacttttcaaaacactttatctggtctgtcagcctatctggtgtttcctttgtaatgaaatggcacatggaccttttgggacagcggtg

SEQ ID NO: 431362 - DNA, 140 bp, Artificial Sequence
  Synthetic
caccgctgtcccaaaaggtccatgtgccatttcattacaaaggaaacaccagataggctgacagaccagataaagtgttttgaaaagttccttgaaccaaaggtgaaatttggtcatgtgcatatcagcagccagggcct

SEQ ID NO: 431363 - DNA, 140 bp, Artificial Sequence
  Synthetic
atacgccatgctgggtctcccattcccctcatcaatatttgcatacaaaaatctcaatattggtgatgctctcttgaattgataaattaagtgttcgatattgtcttctgcagccaccttcgtacttgggagtcggccat

SEQ ID NO: 431364 - DNA, 140 bp, Artificial Sequence
  Synthetic
atggccgactcccaagtacgaaggtggctgcagaagacaatatcgaacacttaatttatcaattcaagagagcatcaccaatattgagatttttgtatgcaaatattgatgaggggaatgggagacccagcatggcgtat

SEQ ID NO: 431365 - DNA, 140 bp, Artificial Sequence
  Synthetic
atacgccatgctgggtctccatcctcagataaaatcaagctcattaatgtccttattaatctgtaaagtaagaattcaacatcagtgatcaattcttctctcactttgtcaatgaggtcccgtacttgggagtcggccat

SEQ ID NO: 431366 - DNA, 140 bp, Artificial Sequence
  Synthetic
atggccgactcccaagtacgggacctcattgacaaagtgagagaagaattgatcactgatgttgaattcttactttacagattaataaggacattaatgagcttgattttatctgaggatggagacccagcatggcgtat

SEQ ID NO: 431367 - DNA, 140 bp, Artificial Sequence
  Synthetic
aggccctggctgctgatatgagaattcaacatcagtgatcaattcttctctcactttgtcaatgaggtccttatgatgataatctgacacataggccattatgaaatacctaaggttttggaccttttgggacagcggtg

SEQ ID NO: 431368 - DNA, 140 bp, Artificial Sequence
  Synthetic
caccgctgtcccaaaaggtccaaaaccttaggtatttcataatggcctatgtgtcagattatcatcataaggacctcattgacaaagtgagagaagaattgatcactgatgttgaattctcatatcagcagccagggcct

SEQ ID NO: 431369 - DNA, 140 bp, Artificial Sequence
  Synthetic
atacgccatgctgggtctcctcatctttgtcaaagacctaatattgtttagttgctcttccagttcattgcaatcttttatccaagaaatcatagtgctcactgttgtttgcaaaacttccgtacttgggagtcggccat

SEQ ID NO: 431370 - DNA, 140 bp, Artificial Sequence
  Synthetic
atggccgactcccaagtacggaagttttgcaaacaacagtgagcactatgatttcttggataaaagattgcaatgaactggaagagcaactaaacaatattaggtctttgacaaagatgaggagacccagcatggcgtat

SEQ ID NO: 431371 - DNA, 140 bp, Artificial Sequence
  Synthetic
aggccctggctgctgatatgcaatcttttatccaagaaatcatagtgctcactgttgtttgcaaaacttcagctgaaaatattgctggaaaatatcttttagggtcagcataaaatgagcgaccttttgggacagcggtg

SEQ ID NO: 431372 - DNA, 140 bp, Artificial Sequence
  Synthetic
caccgctgtcccaaaaggtcgctcattttatgctgaccctaaaagatattttccagcaatattttcagctgaagttttgcaaacaacagtgagcactatgatttcttggataaaagattgcatatcagcagccagggcct

SEQ ID NO: 431373 - DNA, 140 bp, Artificial Sequence
  Synthetic
atacgccatgctgggtctcccctgtcttttgataaatcaattgaaactcaatgtcacctaaggagaactcttgacaatatgcttctttgcacctcaccacttggtatcttgctgacccaacgtacttgggagtcggccat

SEQ ID NO: 431374 - DNA, 140 bp, Artificial Sequence
  Synthetic
atggccgactcccaagtacgttgggtcagcaagataccaagtggtgaggtgcaaagaagcatattgtcaagagttctccttaggtgacattgagtttcaattgatttatcaaaagacaggggagacccagcatggcgtat

SEQ ID NO: 431375 - DNA, 140 bp, Artificial Sequence
  Synthetic
aggccctggctgctgatatgttgacaatatgcttctttgcacctcaccacttggtatcttgctgacccaaattcattctgtctcagttttacggtagaggaggttttcatggagttaaccgaccttttgggacagcggtg

SEQ ID NO: 431376 - DNA, 140 bp, Artificial Sequence
  Synthetic
caccgctgtcccaaaaggtcggttaactccatgaaaacctcctctaccgtaaaactgagacagaatgaatttgggtcagcaagataccaagtggtgaggtgcaaagaagcatattgtcaacatatcagcagccagggcct

SEQ ID NO: 431377 - DNA, 140 bp, Artificial Sequence
  Synthetic
atacgccatgctgggtctccatccacatcccccataatataaggaaatgtttcttcctctgatctctggtaactgattgtgggggtaactccagacacatcgaagtccataatcaagtcacgtacttgggagtcggccat

SEQ ID NO: 431378 - DNA, 140 bp, Artificial Sequence
  Synthetic
atggccgactcccaagtacgtgacttgattatggacttcgatgtgtctggagttacccccacaatcagttaccagagatcagaggaagaaacatttccttatattatgggggatgtggatggagacccagcatggcgtat

SEQ ID NO: 431379 - DNA, 140 bp, Artificial Sequence
  Synthetic
aggccctggctgctgatatgaactgattgtgggggtaactccagacacatcgaagtccataatcaagtcataactattagggcgaatcacctccatatctatcttatagtggtccacactgaccttttgggacagcggtg

SEQ ID NO: 431380 - DNA, 140 bp, Artificial Sequence
  Synthetic
caccgctgtcccaaaaggtcagtgtggaccactataagatagatatggaggtgattcgccctaatagttatgacttgattatggacttcgatgtgtctggagttacccccacaatcagttcatatcagcagccagggcct

SEQ ID NO: 431381 - DNA, 140 bp, Artificial Sequence
  Synthetic
aggccctggctgctgatatgaaatctgttaaagcttgcacagcatcattgaggtccacttgcccttgtttggtgaggcacgccaaggtgaggcttggcatggttccaaattggttattgagaccttttgggacagcggtg

SEQ ID NO: 431382 - DNA, 140 bp, Artificial Sequence
  Synthetic
caccgctgtcccaaaaggtctcaataaccaatttggaaccatgccaagcctcaccttggcgtgcctcaccaaacaagggcaagtggacctcaatgatgctgtgcaagctttaacagatttcatatcagcagccagggcct

SEQ ID NO: 431383 - DNA, 140 bp, Artificial Sequence
  Synthetic
atacgccatgctgggtctccataatgaattgaggatttgattcttacttgagcattgggaagactgcatggttctagatctttcagcctgctgcctccgctcaacccatttttttagatccgtacttgggagtcggccat

SEQ ID NO: 431384 - DNA, 140 bp, Artificial Sequence
  Synthetic
atggccgactcccaagtacggatctaaaaaaatgggttgagcggaggcagcaggctgaaagatctagaaccatgcagtcttcccaatgctcaagtaagaatcaaatcctcaattcattatggagacccagcatggcgtat

SEQ ID NO: 431385 - DNA, 140 bp, Artificial Sequence
  Synthetic
atacgccatgctgggtctccgaatgaggtcccgtagggggcacagaggacacaagagtcaattgaagtcaattaaaggcaattaaattagatagccttaatgcctaggatcctcggtgcgcgtacttgggagtcggccat

SEQ ID NO: 431386 - DNA, 140 bp, Artificial Sequence
  Synthetic
atggccgactcccaagtacgcgcaccgaggatcctaggcattaaggctatctaatttaattgcctttaattgacttcaattgactcttgtgtcctctgtgccccctacgggacctcattcggagacccagcatggcgtat

SEQ ID NO: 431387 - DNA, 140 bp, Artificial Sequence
  Synthetic
atacgccatgctgggtctcccttgcaaggagaatcagcgcatcaaagattagcaaaagttttctccttgtgttcaatatcctcatagatttaactttgtttaggaatgatctccagcattcgtacttgggagtcggccat

SEQ ID NO: 431388 - DNA, 140 bp, Artificial Sequence
  Synthetic
atggccgactcccaagtacgaatgctggagatcattcctaaacaaagttaaatctatgaggatattgaacacaaggagaaaacttttgctaatctttgatgcgctgattctccttgcaagggagacccagcatggcgtat

SEQ ID NO: 431389 - DNA, 140 bp, Artificial Sequence
  Synthetic
atacgccatgctgggtctccgcgcctgacattctccagtagattgatttcctttaccaccatttccttcgccaacattcgcatacagaaacctcaatattggtgatgctctcatgaattgcgtacttgggagtcggccat

SEQ ID NO: 431390 - DNA, 140 bp, Artificial Sequence
  Synthetic
atggccgactcccaagtacgcaattcatgagagcatcaccaatattgaggtttctgtatgcgaatgttggcgaaggaaatggtggtaaaggaaatcaatctactggagaatgtcaggcgcggagacccagcatggcgtat

SEQ ID NO: 431391 - DNA, 140 bp, Artificial Sequence
  Synthetic
atacgccatgctgggtctccagttgttgaactcattaagtaactgattcttatcaacttttagaaactgaccttctatctctcctttcctcaacctatttctaaacacttgatactcttccgtacttgggagtcggccat

SEQ ID NO: 431392 - DNA, 140 bp, Artificial Sequence
  Synthetic
atggccgactcccaagtacggaagagtatcaagtgtttagaaataggttgaggaaaggagagatagaaggtcagtttctaaaagttgataagaatcagttacttaatgagttcaacaactggagacccagcatggcgtat

SEQ ID NO: 431393 - DNA, 140 bp, Artificial Sequence
  Synthetic
atacgccatgctgggtctccgaattgaccttgaccaacacaagcatcatcaaccacaagttttgcaatctgtctgatgctcacaaaaagaatctctatgatcacacccttatgagcataacgtacttgggagtcggccat

SEQ ID NO: 431394 - DNA, 140 bp, Artificial Sequence
  Synthetic
atggccgactcccaagtacgttatgctcataagggtgtgatcatagagattctttttgtgagcatcagacagattgcaaaacttgtggttgatgatgcttgtgttggtcaaggtcaattcggagacccagcatggcgtat

SEQ ID NO: 431395 - DNA, 140 bp, Artificial Sequence
  Synthetic
aggccctggctgctgatatgcagccgacagcaccaccagaaatcccaccatcccaaaatcccccaccctacagcccctgaggcagaactccgccccgaagcccctcaaacacccctccccgaccttttgggacagcggtg

SEQ ID NO: 431396 - DNA, 140 bp, Artificial Sequence
  Synthetic
caccgctgtcccaaaaggtcggggaggggtgtttgaggggcttcggggcggagttctgcctcaggggctgtagggtgggggattttgggatggtgggatttctggtggtgctgtcggctgcatatcagcagccagggcct

SEQ ID NO: 431397 - DNA, 140 bp, Artificial Sequence
  Synthetic
aggccctggctgctgatatgcctgagcatactttaatagtgaaaaaagtgtatctctcagcttatcattaacccaatcaggtatttgctcattataaaatgatgttctcccatctataaggaccttttgggacagcggtg

SEQ ID NO: 431398 - DNA, 140 bp, Artificial Sequence
  Synthetic
caccgctgtcccaaaaggtccttatagatgggagaacatcattttataatgagcaaatacctgattgggttaatgataagctgagagatacacttttttcactattaaagtatgctcaggcatatcagcagccagggcct

SEQ ID NO: 431399 - DNA, 140 bp, Artificial Sequence
  Synthetic
atacgccatgctgggtctccattttttaaagtcttctatgtacttttgttcaaagttggcaggagatgacctaacaaaacactccaacagtattaggacattgcctgttagtttgtaacccgtacttgggagtcggccat

SEQ ID NO: 431400 - DNA, 140 bp, Artificial Sequence
  Synthetic
atggccgactcccaagtacgggttacaaactaacaggcaatgtcctaatactgttggagtgttttgttaggtcatctcctgccaactttgaacaaaagtacatagaagactttaaaaaatggagacccagcatggcgtat

SEQ ID NO: 431401 - DNA, 140 bp, Artificial Sequence
  Synthetic
aggccctggctgctgatatgctaacaaaacactccaacagtattaggacattgcctgttagtttgtaaccgtctggcaccacaaaacatagtgaaggagttaagatcccatgatcatggagaccttttgggacagcggtg

SEQ ID NO: 431402 - DNA, 140 bp, Artificial Sequence
  Synthetic
caccgctgtcccaaaaggtctccatgatcatgggatcttaactccttcactatgttttgtggtgccagacggttacaaactaacaggcaatgtcctaatactgttggagtgttttgttagcatatcagcagccagggcct

SEQ ID NO: 431403 - DNA, 140 bp, Artificial Sequence
  Synthetic
atacgccatgctgggtctccttgcaagaatcaacctcaatgcagagggacagaagtttcaacccttccattaaaagcatcctaggttctgtttgcacaagaaatgccagtttctgccttgcgtacttgggagtcggccat

SEQ ID NO: 431404 - DNA, 140 bp, Artificial Sequence
  Synthetic
atggccgactcccaagtacgcaaggcagaaactggcatttcttgtgcaaacagaacctaggatgcttttaatggaagggttgaaacttctgtccctctgcattgaggttgattcttgcaaggagacccagcatggcgtat

SEQ ID NO: 431405 - DNA, 140 bp, Artificial Sequence
  Synthetic
aggccctggctgctgatatgtaaaagcatcctaggttctgtttgcacaagaaatgccagtttctgccttgataacctctcattgtctgctaggtactttgacaccaaatctttaacgcaagaccttttgggacagcggtg

SEQ ID NO: 431406 - DNA, 140 bp, Artificial Sequence
  Synthetic
caccgctgtcccaaaaggtcttgcgttaaagatttggtgtcaaagtacctagcagacaatgagaggttatcaaggcagaaactggcatttcttgtgcaaacagaacctaggatgcttttacatatcagcagccagggcct

SEQ ID NO: 431407 - DNA, 140 bp, Artificial Sequence
  Synthetic
atacgccatgctgggtctccgagtgtgtggttagctggagtggcagttcgctatgggataaagtcccataagaggcacaagaagcacagtcagtcaaataaagacaattgaattggatatcgtacttgggagtcggccat

SEQ ID NO: 431408 - DNA, 140 bp, Artificial Sequence
  Synthetic
atggccgactcccaagtacgatatccaattcaattgtctttatttgactgactgtgcttcttgtgcctcttatgggactttatcccatagcgaactgccactccagctaaccacacactcggagacccagcatggcgtat

SEQ ID NO: 431409 - DNA, 140 bp, Artificial Sequence
  Synthetic
atacgccatgctgggtctcccaagatgcccctccccacaaaactgagaccatcagccaccccaactgcacccccagccggagcaggagatggcaccagacccccaccctacagtccctaacgtacttgggagtcggccat

SEQ ID NO: 431410 - DNA, 140 bp, Artificial Sequence
  Synthetic
atggccgactcccaagtacgttagggactgtagggtgggggtctggtgccatctcctgctccggctgggggtgcagttggggtggctgatggtctcagttttgtggggaggggcatcttgggagacccagcatggcgtat

SEQ ID NO: 431411 - DNA, 140 bp, Artificial Sequence
  Synthetic
atacgccatgctgggtctccccggggggaccccccgccgggggcccccccgggggagccgaccacttctgaaaaactactcaatgtcctcaacgtgcctgtcctcctcagtcaactcctccgtacttgggagtcggccat

SEQ ID NO: 431412 - DNA, 140 bp, Artificial Sequence
  Synthetic
atggccgactcccaagtacggaggagttgactgaggaggacaggcacgttgaggacattgagtagtttttcagaagtggtcggctcccccgggggggcccccggcggggggtccccccggggagacccagcatggcgtat

SEQ ID NO: 431413 - DNA, 140 bp, Artificial Sequence
  Synthetic
atacgccatgctgggtctccaatgcaaagcgcaatcctaggcatttttggttgcgcaattcaggtttctttctcaaaatggggcagatagtgacattctttcaagaagtgccccatgttacgtacttgggagtcggccat

SEQ ID NO: 431414 - DNA, 140 bp, Artificial Sequence
  Synthetic
atggccgactcccaagtacgtaacatggggcacttcttgaaagaatgtcactatctgccccattttgagaaagaaacctgaattgcgcaaccaaaaatgcctaggattgcgctttgcattggagacccagcatggcgtat

SEQ ID NO: 431415 - DNA, 140 bp, Artificial Sequence
  Synthetic
aggccctggctgctgatatgtctcaaaatggggcagatagtgacattctttcaagaagtgccccatgttatagaggaagtgatgaacattgttctcatagcactgtctatattggcagtggaccttttgggacagcggtg

SEQ ID NO: 431416 - DNA, 140 bp, Artificial Sequence
  Synthetic
caccgctgtcccaaaaggtccactgccaatatagacagtgctatgagaacaatgttcatcacttcctctataacatggggcacttcttgaaagaatgtcactatctgccccattttgagacatatcagcagccagggcct

SEQ ID NO: 431417 - DNA, 140 bp, Artificial Sequence
  Synthetic
atacgccatgctgggtctcctagaggaagtgatgaacattgttctcatagcactgtctatattggcagtgctgaaaggcctgtacaacattgccacatgtggtctgattggcctggtcaccgtacttgggagtcggccat

SEQ ID NO: 431418 - DNA, 140 bp, Artificial Sequence
  Synthetic
atggccgactcccaagtacggtgaccaggccaatcagaccacatgtggcaatgttgtacaggcctttcagcactgccaatatagacagtgctatgagaacaatgttcatcacttcctctaggagacccagcatggcgtat

SEQ ID NO: 431419 - DNA, 140 bp, Artificial Sequence
  Synthetic
atacgccatgctgggtctcctttatgagctccaatctctggacctgaacatggaaacactcaacatgactatgcctctctcttgcaccaagaacaacagtcaccattatataagagctggcgtacttgggagtcggccat

SEQ ID NO: 431420 - DNA, 140 bp, Artificial Sequence
  Synthetic
atggccgactcccaagtacgccagctcttatataatggtgactgttgttcttggtgcaagagagaggcatagtcatgttgagtgtttccatgttcaggtccagagattggagctcataaaggagacccagcatggcgtat

SEQ ID NO: 431421 - DNA, 140 bp, Artificial Sequence
  Synthetic
aggccctggctgctgatatgatgcctctctcttgcaccaagaacaacagtcaccattatataagagctggtaatgagacagggctggagctgaccttgaccaacactagcttgattaatcgaccttttgggacagcggtg

SEQ ID NO: 431422 - DNA, 140 bp, Artificial Sequence
  Synthetic
caccgctgtcccaaaaggtcgattaatcaagctagtgttggtcaaggtcagctccagccctgtctcattaccagctcttatataatggtgactgttgttcttggtgcaagagagaggcatcatatcagcagccagggcct

SEQ ID NO: 431423 - DNA, 140 bp, Artificial Sequence
  Synthetic
aggccctggctgctgatatgcacagtgaggggttatctcctctttaccacctcttttcttcttctcaacaacgacacctgtgtgcatgtggcataagtctttgtactgatcccagactgcgaccttttgggacagcggtg

SEQ ID NO: 431424 - DNA, 140 bp, Artificial Sequence
  Synthetic
caccgctgtcccaaaaggtcgcagtctgggatcagtacaaagacttatgccacatgcacacaggtgtcgttgttgagaagaagaaaagaggtggtaaagaggagataacccctcactgtgcatatcagcagccagggcct

SEQ ID NO: 431425 - DNA, 140 bp, Artificial Sequence
  Synthetic
atacgccatgctgggtctccacactcatgagcataatttcaactttccacctatctatacccaactttaatcagtatgaagcaatgagttgtgattttaatgggggcaagattagtgtgccgtacttgggagtcggccat

SEQ ID NO: 431426 - DNA, 140 bp, Artificial Sequence
  Synthetic
atggccgactcccaagtacggcacactaatcttgcccccattaaaatcacaactcattgcttcatactgattaaagttgggtatagataggtggaaagttgaaattatgctcatgagtgtggagacccagcatggcgtat

SEQ ID NO: 431427 - DNA, 140 bp, Artificial Sequence
  Synthetic
aggccctggctgctgatatgtcagtatgaagcaatgagttgtgattttaatgggggcaagattagtgtgcaatacaatctaagccatgcttatgctatagatgcagccgagcactgtggcgaccttttgggacagcggtg

SEQ ID NO: 431428 - DNA, 140 bp, Artificial Sequence
  Synthetic
caccgctgtcccaaaaggtcgccacagtgctcggctgcatctatagcataagcatggcttagattgtattgcacactaatcttgcccccattaaaatcacaactcattgcttcatactgacatatcagcagccagggcct

SEQ ID NO: 431429 - DNA, 140 bp, Artificial Sequence
  Synthetic
atacgccatgctgggtctcccttctggcgatactgaaggggatctacaatgttgctacctgtggcctctttgggctggtgtcctttctcctcttatgtgggagatcatgttcaacaatttcgtacttgggagtcggccat

SEQ ID NO: 431430 - DNA, 140 bp, Artificial Sequence
  Synthetic
atggccgactcccaagtacgaaattgttgaacatgatctcccacataagaggagaaaggacaccagcccaaagaggccacaggtagcaacattgtagatccccttcagtatcgccagaagggagacccagcatggcgtat

SEQ ID NO: 431431 - DNA, 140 bp, Artificial Sequence
  Synthetic
atacgccatgctgggtctccaagctacattgctcttgactcaggccgtgggaactgggactgtatcatgaccagttatcagtatctgataattcagaacacaacttgggaagatcactgtcgtacttgggagtcggccat

SEQ ID NO: 431432 - DNA, 140 bp, Artificial Sequence
  Synthetic
atggccgactcccaagtacgacagtgatcttcccaagttgtgttctgaattatcagatactgataactggtcatgatacagtcccagttcccacggcctgagtcaagagcaatgtagcttggagacccagcatggcgtat

SEQ ID NO: 431433 - DNA, 140 bp, Artificial Sequence
  Synthetic
aggccctggctgctgatatgccagttatcagtatctgataattcagaacacaacttgggaagatcactgtcagttttcaagaccatctcccattggttatctcggactcctctcacagaggaccttttgggacagcggtg

SEQ ID NO: 431434 - DNA, 140 bp, Artificial Sequence
  Synthetic
caccgctgtcccaaaaggtcctctgtgagaggagtccgagataaccaatgggagatggtcttgaaaactgacagtgatcttcccaagttgtgttctgaattatcagatactgataactggcatatcagcagccagggcct

SEQ ID NO: 431435 - DNA, 140 bp, Artificial Sequence
  Synthetic
aggccctggctgctgatatggattcagatccctcagtcgctttaggtctgcatcatctctcttctgcttgcgcatcagcctctgcacattgctgacctcagaaaagtcaaggccatgcaggaccttttgggacagcggtg

SEQ ID NO: 431436 - DNA, 140 bp, Artificial Sequence
  Synthetic
caccgctgtcccaaaaggtcctgcatggccttgacttttctgaggtcagcaatgtgcagaggctgatgcgcaagcagaagagagatgatgcagacctaaagcgactgagggatctgaatccatatcagcagccagggcct

SEQ ID NO: 431437 - DNA, 140 bp, Artificial Sequence
  Synthetic
atacgccatgctgggtctcccactgtcagactccgagggtaacgctacaccagggggttattgcctaactaggtggatgttaatcgaggctgaattgaaatgctttggaaatacagcggtcgtacttgggagtcggccat

SEQ ID NO: 431438 - DNA, 140 bp, Artificial Sequence
  Synthetic
atggccgactcccaagtacgaccgctgtatttccaaagcatttcaattcagcctcgattaacatccacctagttaggcaataaccccctggtgtagcgttaccctcggagtctgacagtgggagacccagcatggcgtat

SEQ ID NO: 431439 - DNA, 140 bp, Artificial Sequence
  Synthetic
aggccctggctgctgatatgaggtggatgttaatcgaggctgaattgaaatgctttggaaatacagcggtagcaaagtgcaatgagaagcatgatgaagaattctgtgacatgctcagacgaccttttgggacagcggtg

SEQ ID NO: 431440 - DNA, 140 bp, Artificial Sequence
  Synthetic
caccgctgtcccaaaaggtcgtctgagcatgtcacagaattcttcatcatgcttctcattgcactttgctaccgctgtatttccaaagcatttcaattcagcctcgattaacatccacctcatatcagcagccagggcct

SEQ ID NO: 431441 - DNA, 140 bp, Artificial Sequence
  Synthetic
atacgccatgctgggtctccatgagcattcaactgatcaacaaagcagtaaatgctttgatcaatgatcaattgattatgaaaaaccatttacgggacataatggggattccatattgtacgtacttgggagtcggccat

SEQ ID NO: 431442 - DNA, 140 bp, Artificial Sequence
  Synthetic
atggccgactcccaagtacgtacaatatggaatccccattatgtcccgtaaatggtttttcataatcaattgatcattgatcaaagcatttactgctttgttgatcagttgaatgctcatggagacccagcatggcgtat

SEQ ID NO: 431443 - DNA, 140 bp, Artificial Sequence
  Synthetic
aggccctggctgctgatatgattgattatgaaaaaccatttacgggacataatggggattccatattgtaattacagcaaatattggtacctcaaccatacaattactggcagaacttcagaccttttgggacagcggtg

SEQ ID NO: 431444 - DNA, 140 bp, Artificial Sequence
  Synthetic
caccgctgtcccaaaaggtctgaagttctgccagtaattgtatggttgaggtaccaatatttgctgtaattacaatatggaatccccattatgtcccgtaaatggtttttcataatcaatcatatcagcagccagggcct

SEQ ID NO: 431445 - DNA, 140 bp, Artificial Sequence
  Synthetic
atacgccatgctgggtctcccttctctgatgatatagagcaacaagctgacaacatgatcacagagatgctacaaaaggaatatatggaaaggcaggggaagacgcccttgggcttagtccgtacttgggagtcggccat

SEQ ID NO: 431446 - DNA, 140 bp, Artificial Sequence
  Synthetic
atggccgactcccaagtacggactaagcccaagggcgtcttcccctgcctttccatatattccttttgtagcatctctgtgatcatgttgtcagcttgttgctctatatcatcagagaagggagacccagcatggcgtat

SEQ ID NO: 431447 - DNA, 140 bp, Artificial Sequence
  Synthetic
aggccctggctgctgatatgtacaaaaggaatatatggaaaggcaggggaagacgcccttgggcttagtcgacttgtttgtcttcagcacaagcttttatctgatcagtatcttcctccagaccttttgggacagcggtg

SEQ ID NO: 431448 - DNA, 140 bp, Artificial Sequence
  Synthetic
caccgctgtcccaaaaggtctggaggaagatactgatcagataaaagcttgtgctgaagacaaacaagtcgactaagcccaagggcgtcttcccctgcctttccatatattccttttgtacatatcagcagccagggcct

SEQ ID NO: 431449 - DNA, 140 bp, Artificial Sequence
  Synthetic
atacgccatgctgggtctccagccccacaggctgaaccacatgggtatctgttcctgtggtttatacaagcaacctggtgtccccctcaagtggaagagataagcctccggtaggagccccgtacttgggagtcggccat

SEQ ID NO: 431450 - DNA, 140 bp, Artificial Sequence
  Synthetic
atggccgactcccaagtacggggctcctaccggaggcttatctcttccacttgagggggacaccaggttgcttgtataaaccacaggaacagatacccatgtggttcagcctgtggggctggagacccagcatggcgtat

SEQ ID NO: 431451 - DNA, 140 bp, Artificial Sequence
  Synthetic
aggccctggctgctgatatgcaacctggtgtccccctcaagtggaagagataagcctccggtaggagcccccgtgacccaccgccttttggcggtgggtcacgggggcgtccatttacaggaccttttgggacagcggtg

SEQ ID NO: 431452 - DNA, 140 bp, Artificial Sequence
  Synthetic
caccgctgtcccaaaaggtcctgtaaatggacgcccccgtgacccaccgccaaaaggcggtgggtcacgggggctcctaccggaggcttatctcttccacttgagggggacaccaggttgcatatcagcagccagggcct

SEQ ID NO: 431453 - DNA, 140 bp, Artificial Sequence
  Synthetic
atacgccatgctgggtctccccctgagaaccgatgcatttagtcctcctgacacagcagcatcgaacatgatgcaatccattagcgcacaatgaggggtaatttcttccttgccacctctcgtacttgggagtcggccat

SEQ ID NO: 431454 - DNA, 140 bp, Artificial Sequence
  Synthetic
atggccgactcccaagtacgagaggtggcaaggaagaaattacccctcattgtgcgctaatggattgcatcatgttcgatgctgctgtgtcaggaggactaaatgcatcggttctcagggggagacccagcatggcgtat

SEQ ID NO: 431455 - DNA, 140 bp, Artificial Sequence
  Synthetic
aggccctggctgctgatatgatgcaatccattagcgcacaatgaggggtaatttcttccttgccacctctcttcttcttttcaacaacaacacctgtgtgcatgtgacacaaatctttgtgaccttttgggacagcggtg

SEQ ID NO: 431456 - DNA, 140 bp, Artificial Sequence
  Synthetic
caccgctgtcccaaaaggtcacaaagatttgtgtcacatgcacacaggtgttgttgttgaaaagaagaagagaggtggcaaggaagaaattacccctcattgtgcgctaatggattgcatcatatcagcagccagggcct

SEQ ID NO: 431457 - DNA, 140 bp, Artificial Sequence
  Synthetic
atacgccatgctgggtctccgcaatgtcaatcaattttatgtcctttcttccttgtgattcaagaagcttctttatgtcttcagacccttggcaggtgataaccatatttcgggggagtgcgtacttgggagtcggccat

SEQ ID NO: 431458 - DNA, 140 bp, Artificial Sequence
  Synthetic
atggccgactcccaagtacgcactcccccgaaatatggttatcacctgccaagggtctgaagacataaagaagcttcttgaatcacaaggaagaaaggacataaaattgattgacattgcggagacccagcatggcgtat

SEQ ID NO: 431459 - DNA, 140 bp, Artificial Sequence
  Synthetic
atacgccatgctgggtctccgtagtttgatgttagagcagtaaccagacaattccctcctcaaagattgtgtccacaggaaggactttatctcctttgaggcactcattgccaagttgttcgtacttgggagtcggccat

SEQ ID NO: 431460 - DNA, 140 bp, Artificial Sequence
  Synthetic
atggccgactcccaagtacgaacaacttggcaatgagtgcctcaaaggagataaagtccttcctgtggacacaatctttgaggagggaattgtctggttactgctctaacatcaaactacggagacccagcatggcgtat

SEQ ID NO: 431461 - DNA, 140 bp, Artificial Sequence
  Synthetic
aggccctggctgctgatatggtccacaggaaggactttatctcctttgaggcactcattgccaagttgttgtgttgaacacacacagcagagaactaagactatctgctgaattgataaagaccttttgggacagcggtg

SEQ ID NO: 431462 - DNA, 140 bp, Artificial Sequence
  Synthetic
caccgctgtcccaaaaggtctttatcaattcagcagatagtcttagttctctgctgtgtgtgttcaacacaacaacttggcaatgagtgcctcaaaggagataaagtccttcctgtggaccatatcagcagccagggcct

SEQ ID NO: 431463 - DNA, 140 bp, Artificial Sequence
  Synthetic
aggccctggctgctgatatgttggagttgctcattgctgatgtgcttggagcaacctaaaggtggagtgacaagtggttctgtaagagtcactttactctgcacaattatcacaaagcgcgaccttttgggacagcggtg

SEQ ID NO: 431464 - DNA, 140 bp, Artificial Sequence
  Synthetic
caccgctgtcccaaaaggtcgcgctttgtgataattgtgcagagtaaagtgactcttacagaaccacttgtcactccacctttaggttgctccaagcacatcagcaatgagcaactccaacatatcagcagccagggcct

SEQ ID NO: 431465 - DNA, 140 bp, Artificial Sequence
  Synthetic
atacgccatgctgggtctccagtgggctctcggaagaagtgtatgtaacacccagagctaggctgatatagggcaacttccaccgggtcttccggcctcccctctatatccatccatgtccgtacttgggagtcggccat

SEQ ID NO: 431466 - DNA, 140 bp, Artificial Sequence
  Synthetic
atggccgactcccaagtacggacatggatggatatagaggggaggccggaagacccggtggaagttgccctatatcagcctagctctgggtgttacatacacttcttccgagagcccactggagacccagcatggcgtat

SEQ ID NO: 431467 - DNA, 140 bp, Artificial Sequence
  Synthetic
aggccctggctgctgatatgtacctaatgttttgtaaaagtttttgacaccttttactaggatgagttaatatcaaaactaaaatcatcttagttaataacctgatggtgatcaattgttgaccttttgggacagcggtg

SEQ ID NO: 431468 - DNA, 140 bp, Artificial Sequence
  Synthetic
caccgctgtcccaaaaggtcaacaattgatcaccatcaggttattaactaagatgattttagttttgatattaactcatcctagtaaaaggtgtcaaaaacttttacaaaacattaggtacatatcagcagccagggcct

SEQ ID NO: 431469 - DNA, 140 bp, Artificial Sequence
  Synthetic
atacgccatgctgggtctccagctaccactgtttggtttttgtggtttcccatctgcttctaagtccaccacagtgttttcccaggcccttcccactattgatgttctggatgcaatgtacgtacttgggagtcggccat

SEQ ID NO: 431470 - DNA, 140 bp, Artificial Sequence
  Synthetic
atggccgactcccaagtacgtacattgcatccagaacatcaatagtgggaagggcctgggaaaacactgtggtggacttagaagcagatgggaaaccacaaaaaccaaacagtggtagctggagacccagcatggcgtat

SEQ ID NO: 431471 - DNA, 140 bp, Artificial Sequence
  Synthetic
aggccctggctgctgatatgacagtgttttcccaggcccttcccactattgatgttctggatgcaatgtatggccacccatcacctgacaggcagattttatagagtatgttttcatagggaccttttgggacagcggtg

SEQ ID NO: 431472 - DNA, 140 bp, Artificial Sequence
  Synthetic
caccgctgtcccaaaaggtccctatgaaaacatactctataaaatctgcctgtcaggtgatgggtggccatacattgcatccagaacatcaatagtgggaagggcctgggaaaacactgtcatatcagcagccagggcct

SEQ ID NO: 431473 - DNA, 140 bp, Artificial Sequence
  Synthetic
atacgccatgctgggtctccaccttcaagatggatttcaaaatgccatccacagattgaggtgaaattttgattgtttctagcatgttgccaccatccaacatacaggcacctgctttcacgtacttgggagtcggccat

SEQ ID NO: 431474 - DNA, 140 bp, Artificial Sequence
  Synthetic
atggccgactcccaagtacgtgaaagcaggtgcctgtatgttggatggtggcaacatgctagaaacaatcaaaatttcacctcaatctgtggatggcattttgaaatccatcttgaaggtggagacccagcatggcgtat

SEQ ID NO: 431475 - DNA, 140 bp, Artificial Sequence
  Synthetic
aggccctggctgctgatatggattgtttctagcatgttgccaccatccaacatacaggcacctgctttcactgcagcacccagactgaaattgtaacctgagatgttcagggagctcttcgaccttttgggacagcggtg

SEQ ID NO: 431476 - DNA, 140 bp, Artificial Sequence
  Synthetic
caccgctgtcccaaaaggtcgaagagctccctgaacatctcaggttacaatttcagtctgggtgctgcagtgaaagcaggtgcctgtatgttggatggtggcaacatgctagaaacaatccatatcagcagccagggcct

SEQ ID NO: 431477 - DNA, 140 bp, Artificial Sequence
  Synthetic
aggccctggctgctgatatgcccatgatggcatcataaacatcacaatcaaggattttgaaatcaattccataagagttggtttctatgccaacctcctttaaggcattagtggctcgaggaccttttgggacagcggtg

SEQ ID NO: 431478 - DNA, 140 bp, Artificial Sequence
  Synthetic
caccgctgtcccaaaaggtcctcgagccactaatgccttaaaggaggttggcatagaaaccaactcttatggaattgatttcaaaatccttgattgtgatgtttatgatgccatcatgggcatatcagcagccagggcct

SEQ ID NO: 431479 - DNA, 140 bp, Artificial Sequence
  Synthetic
atacgccatgctgggtctccgtctgaagtattggggtatttggcagtataaatcaaacccagatctgtgagtgcttgaaccacatcattcaggtcgacttgcccctgttttgttagacatcgtacttgggagtcggccat

SEQ ID NO: 431480 - DNA, 140 bp, Artificial Sequence
  Synthetic
atggccgactcccaagtacgatgtctaacaaaacaggggcaagtcgacctgaatgatgtggttcaagcactcacagatctgggtttgatttatactgccaaataccccaatacttcagacggagacccagcatggcgtat

SEQ ID NO: 431481 - DNA, 140 bp, Artificial Sequence
  Synthetic
aggccctggctgctgatatggtgcttgaaccacatcattcaggtcgacttgcccctgttttgttagacatgctagtgtcaaactcggcattgtcccaaattggttgtttaacaactccgcgaccttttgggacagcggtg

SEQ ID NO: 431482 - DNA, 140 bp, Artificial Sequence
  Synthetic
caccgctgtcccaaaaggtcgcggagttgttaaacaaccaatttgggacaatgccgagtttgacactagcatgtctaacaaaacaggggcaagtcgacctgaatgatgtggttcaagcaccatatcagcagccagggcct

SEQ ID NO: 431483 - DNA, 140 bp, Artificial Sequence
  Synthetic
atacgccatgctgggtctcccttgattgccacctgtcattcctatcatgtttaggagtgccctcctctgatcaagctgttgtgagcttaagtttcccatgtagacgcctgagctcaaaggcgtacttgggagtcggccat

SEQ ID NO: 431484 - DNA, 140 bp, Artificial Sequence
  Synthetic
atggccgactcccaagtacgcctttgagctcaggcgtctacatgggaaacttaagctcacaacagcttgatcagaggagggcactcctaaacatgataggaatgacaggtggcaatcaagggagacccagcatggcgtat

SEQ ID NO: 431485 - DNA, 140 bp, Artificial Sequence
  Synthetic
aggccctggctgctgatatgtcaagctgttgtgagcttaagtttcccatgtagacgcctgagctcaaaggtctctctgttcttgtgacctttgatttcagtttctcaagatcagccgccagaccttttgggacagcggtg

SEQ ID NO: 431486 - DNA, 140 bp, Artificial Sequence
  Synthetic
caccgctgtcccaaaaggtctggcggctgatcttgagaaactgaaatcaaaggtcacaagaacagagagacctttgagctcaggcgtctacatgggaaacttaagctcacaacagcttgacatatcagcagccagggcct

SEQ ID NO: 431487 - DNA, 140 bp, Artificial Sequence
  Synthetic
atacgccatgctgggtctcctgttgtgttgattttaattcaacaagattattgactgcctgattcaggtctctaagtcgcttcagatcaccatcatctcttctttgtttgcgcatcagtccgtacttgggagtcggccat

SEQ ID NO: 431488 - DNA, 140 bp, Artificial Sequence
  Synthetic
atggccgactcccaagtacggactgatgcgcaaacaaagaagagatgatggtgatctgaagcgacttagagacctgaatcaggcagtcaataatcttgttgaattaaaatcaacacaacaggagacccagcatggcgtat

SEQ ID NO: 431489 - DNA, 140 bp, Artificial Sequence
  Synthetic
atacgccatgctgggtctccctattttgtcactatataactttctgaaatcctctaataacttcatcttatcagttttaacaaattgactttctatatccccctgcctcagtttgttcctcgtacttgggagtcggccat

SEQ ID NO: 431490 - DNA, 140 bp, Artificial Sequence
  Synthetic
atggccgactcccaagtacgaggaacaaactgaggcagggggatatagaaagtcaatttgttaaaactgataagatgaagttattagaggatttcagaaagttatatagtgacaaaatagggagacccagcatggcgtat

SEQ ID NO: 431491 - DNA, 140 bp, Artificial Sequence
  Synthetic
aggccctggctgctgatatgcagcaaggagcctgtcaccatgtcttatgcagtccagccggctagcaagaagaatcagaacgtcaaaaataaggagaagtttcctcctggtgttgaggatgaccttttgggacagcggtg

SEQ ID NO: 431492 - DNA, 140 bp, Artificial Sequence
  Synthetic
caccgctgtcccaaaaggtcatcctcaacaccaggaggaaacttctccttatttttgacgttctgattcttcttgctagccggctggactgcataagacatggtgacaggctccttgctgcatatcagcagccagggcct

SEQ ID NO: 431493 - DNA, 140 bp, Artificial Sequence
  Synthetic
atacgccatgctgggtctcctctccttaaagactgtgtccataagaaggacctcacttccttagaggcactcattattgagctgatagatgttgttcaaagctgtgagaaaccactaaggcgtacttgggagtcggccat

SEQ ID NO: 431494 - DNA, 140 bp, Artificial Sequence
  Synthetic
atggccgactcccaagtacgccttagtggtttctcacagctttgaacaacatctatcagctcaataatgagtgcctctaaggaagtgaggtccttcttatggacacagtctttaaggagaggagacccagcatggcgtat

SEQ ID NO: 431495 - DNA, 140 bp, Artificial Sequence
  Synthetic
atacgccatgctgggtctccggattgcatcatgttcgatgctgctgtgtcaggaggactaaatgcatcggttctcagggctgtattgcccagggacatggtgtttagaacatcaacaccacgtacttgggagtcggccat

SEQ ID NO: 431496 - DNA, 140 bp, Artificial Sequence
  Synthetic
atggccgactcccaagtacgtggtgttgatgttctaaacaccatgtccctgggcaatacagccctgagaaccgatgcatttagtcctcctgacacagcagcatcgaacatgatgcaatccggagacccagcatggcgtat

SEQ ID NO: 431497 - DNA, 140 bp, Artificial Sequence
  Synthetic
aggccctggctgctgatatgttctcagggctgtattgcccagggacatggtgtttagaacatcaacaccaaaagtcgtcctgtaaatggacgcccccgtgacccaccgccaaaaggcggtgaccttttgggacagcggtg

SEQ ID NO: 431498 - DNA, 140 bp, Artificial Sequence
  Synthetic
caccgctgtcccaaaaggtcaccgccttttggcggtgggtcacgggggcgtccatttacaggacgacttttggtgttgatgttctaaacaccatgtccctgggcaatacagccctgagaacatatcagcagccagggcct

SEQ ID NO: 431499 - DNA, 140 bp, Artificial Sequence
  Synthetic
atacgccatgctgggtctcccagtaggtctctggcaccgaggatcctaggcattttgactgtcttataggattatcttatttaagatctagctgcttttcctatggtcaccaatctggcacgtacttgggagtcggccat

SEQ ID NO: 431500 - DNA, 140 bp, Artificial Sequence
  Synthetic
atggccgactcccaagtacgtgccagattggtgaccataggaaaagcagctagatcttaaataagataatcctataagacagtcaaaatgcctaggatcctcggtgccagagacctactgggagacccagcatggcgtat

SEQ ID NO: 431501 - DNA, 140 bp, Artificial Sequence
  Synthetic
aggccctggctgctgatatgattatcttatttaagatctagctgcttttcctatggtcaccaatctggcaggccttcccagacggtaaccctcacaactgaccatggaagaggacatagcgaccttttgggacagcggtg

SEQ ID NO: 431502 - DNA, 140 bp, Artificial Sequence
  Synthetic
caccgctgtcccaaaaggtcgctatgtcctcttccatggtcagttgtgagggttaccgtctgggaaggcctgccagattggtgaccataggaaaagcagctagatcttaaataagataatcatatcagcagccagggcct

SEQ ID NO: 431503 - DNA, 140 bp, Artificial Sequence
  Synthetic
atacgccatgctgggtctccggccttcccagacggtaaccctcacaactgaccatggaagaggacatagcctatgtgaaggatctggtctcaaaatacctggtggacaatgaaagactctcgtacttgggagtcggccat

SEQ ID NO: 431504 - DNA, 140 bp, Artificial Sequence
  Synthetic
atggccgactcccaagtacgagagtctttcattgtccaccaggtattttgagaccagatccttcacataggctatgtcctcttccatggtcagttgtgagggttaccgtctgggaaggccggagacccagcatggcgtat

SEQ ID NO: 431505 - DNA, 140 bp, Artificial Sequence
  Synthetic
atacgccatgctgggtctccatggaggggctaaagcttctgtccctttgtatagaagttgactcatgcaatgcaaatggatgtgagcacaatagtgaagataagtctgtcgagaaaatcccgtacttgggagtcggccat

SEQ ID NO: 431506 - DNA, 140 bp, Artificial Sequence
  Synthetic
atggccgactcccaagtacgggattttctcgacagacttatcttcactattgtgctcacatccatttgcattgcatgagtcaacttctatacaaagggacagaagctttagcccctccatggagacccagcatggcgtat

SEQ ID NO: 431507 - DNA, 140 bp, Artificial Sequence
  Synthetic
atacgccatgctgggtctccgcgcaccggggatcctaggcaatttggttggactttagtggtaagacttattttagtgaattcctaatttaaagtgcctagttaaaatgggcaatagacacgtacttgggagtcggccat

SEQ ID NO: 431508 - DNA, 140 bp, Artificial Sequence
  Synthetic
atggccgactcccaagtacgtgtctattgcccattttaactaggcactttaaattaggaattcactaaaataagtcttaccactaaagtccaaccaaattgcctaggatccccggtgcgcggagacccagcatggcgtat

SEQ ID NO: 431509 - DNA, 140 bp, Artificial Sequence
  Synthetic
atacgccatgctgggtctccatggcacctgtgttgggcttggacttgtacctgtatggcgtgtgggtcagctggtagtgccccacaaaagctcttacagaaatgagagacaatatgccaacgtacttgggagtcggccat

SEQ ID NO: 431510 - DNA, 140 bp, Artificial Sequence
  Synthetic
atggccgactcccaagtacgttggcatattgtctctcatttctgtaagagcttttgtggggcactaccagctgacccacacgccatacaggtacaagtccaagcccaacacaggtgccatggagacccagcatggcgtat

SEQ ID NO: 431511 - DNA, 140 bp, Artificial Sequence
  Synthetic
atacgccatgctgggtctccatcatctccggctaactttgaacaaaaatacatggaagacttaaaaaagttggaacagttaaaggaagacttaaagagtgttgacattaatctaataccacgtacttgggagtcggccat

SEQ ID NO: 431512 - DNA, 140 bp, Artificial Sequence
  Synthetic
atggccgactcccaagtacgtggtattagattaatgtcaacactctttaagtcttcctttaactgttccaacttttttaagtcttccatgtatttttgttcaaagttagccggagatgatggagacccagcatggcgtat

SEQ ID NO: 431513 - DNA, 140 bp, Artificial Sequence
  Synthetic
aggccctggctgctgatatgtggaacagttaaaggaagacttaaagagtgttgacattaatctaataccacttatagacggcaggacatctttttataatgaacagctgccagattgggtgaccttttgggacagcggtg

SEQ ID NO: 431514 - DNA, 140 bp, Artificial Sequence
  Synthetic
caccgctgtcccaaaaggtcacccaatctggcagctgttcattataaaaagatgtcctgccgtctataagtggtattagattaatgtcaacactctttaagtcttcctttaactgttccacatatcagcagccagggcct

SEQ ID NO: 431515 - DNA, 140 bp, Artificial Sequence
  Synthetic
aggccctggctgctgatatggatatacagattctctttatttggcccccgaacacatttactacccaaagttctgcacaaacctacaaagccagacgcaatagagctctgaaatgcagatgaccttttgggacagcggtg

SEQ ID NO: 431516 - DNA, 140 bp, Artificial Sequence
  Synthetic
caccgctgtcccaaaaggtcatctgcatttcagagctctattgcgtctggctttgtaggtttgtgcagaactttgggtagtaaatgtgttcgggggccaaataaagagaatctgtatatccatatcagcagccagggcct

SEQ ID NO: 431517 - DNA, 140 bp, Artificial Sequence
  Synthetic
atacgccatgctgggtctccaaagcaattcactctttgaggaatcagaatatagtaggctttgcgagtctttgtcgatgagttcagggagactttcaggaatagaaagtttgaacaccttcgtacttgggagtcggccat

SEQ ID NO: 431518 - DNA, 140 bp, Artificial Sequence
  Synthetic
atggccgactcccaagtacgaaggtgttcaaactttctattcctgaaagtctccctgaactcatcgacaaagactcgcaaagcctactatattctgattcctcaaagagtgaattgctttggagacccagcatggcgtat

SEQ ID NO: 431519 - DNA, 140 bp, Artificial Sequence
  Synthetic
aggccctggctgctgatatgttgtcgatgagttcagggagactttcaggaatagaaagtttgaacaccttattagacaatcgctctggtcattatgaggaaatcattgcactatgccaccgaccttttgggacagcggtg

SEQ ID NO: 431520 - DNA, 140 bp, Artificial Sequence
  Synthetic
caccgctgtcccaaaaggtcggtggcatagtgcaatgatttcctcataatgaccagagcgattgtctaataaggtgttcaaactttctattcctgaaagtctccctgaactcatcgacaacatatcagcagccagggcct

SEQ ID NO: 431521 - DNA, 140 bp, Artificial Sequence
  Synthetic
atacgccatgctgggtctccgaagaatatcaggttttcaggaacagattgaggggaggggagataaagtgtcagttcatgaaagttgataaaagctatctactcagtgagttcagtaaatcgtacttgggagtcggccat

SEQ ID NO: 431522 - DNA, 140 bp, Artificial Sequence
  Synthetic
atggccgactcccaagtacgatttactgaactcactgagtagatagcttttatcaactttcatgaactgacactttatctcccctcccctcaatctgttcctgaaaacctgatattcttcggagacccagcatggcgtat

SEQ ID NO: 431523 - DNA, 140 bp, Artificial Sequence
  Synthetic
aggccctggctgctgatatgtcagttcatgaaagttgataaaagctatctactcagtgagttcagtaaattatacactgatgatgcagtggttgctgaagatgacattgagcaattgattgaccttttgggacagcggtg

SEQ ID NO: 431524 - DNA, 140 bp, Artificial Sequence
  Synthetic
caccgctgtcccaaaaggtcaatcaattgctcaatgtcatcttcagcaaccactgcatcatcagtgtataatttactgaactcactgagtagatagcttttatcaactttcatgaactgacatatcagcagccagggcct

SEQ ID NO: 431525 - DNA, 140 bp, Artificial Sequence
  Synthetic
atacgccatgctgggtctcctgagggagaagaagacaggaaaaatgttcaggtagtcaaagagcttcaaatgcagtgttggaggtcatttctaaacaaagtcaaatctttaagaattctacgtacttgggagtcggccat

SEQ ID NO: 431526 - DNA, 140 bp, Artificial Sequence
  Synthetic
atggccgactcccaagtacgtagaattcttaaagatttgactttgtttagaaatgacctccaacactgcatttgaagctctttgactacctgaacatttttcctgtcttcttctccctcaggagacccagcatggcgtat

SEQ ID NO: 431527 - DNA, 140 bp, Artificial Sequence
  Synthetic
aggccctggctgctgatatgtgcagtgttggaggtcatttctaaacaaagtcaaatctttaagaattctaaacacaaggagaaaacttctactaatttttgacacactgatcctccttgcgaccttttgggacagcggtg

SEQ ID NO: 431528 - DNA, 140 bp, Artificial Sequence
  Synthetic
caccgctgtcccaaaaggtcgcaaggaggatcagtgtgtcaaaaattagtagaagttttctccttgtgtttagaattcttaaagatttgactttgtttagaaatgacctccaacactgcacatatcagcagccagggcct

SEQ ID NO: 431529 - DNA, 140 bp, Artificial Sequence
  Synthetic
atacgccatgctgggtctcccctgttttgttagtgttaatgatagattagtttccttggagtcaaccaaaagagatctcaagaaatggattgagcggaggcaacagattgagaattctaacgtacttgggagtcggccat

SEQ ID NO: 431530 - DNA, 140 bp, Artificial Sequence
  Synthetic
atggccgactcccaagtacgttagaattctcaatctgttgcctccgctcaatccatttcttgagatctcttttggttgactccaaggaaactaatctatcattaacactaacaaaacaggggagacccagcatggcgtat

SEQ ID NO: 431531 - DNA, 140 bp, Artificial Sequence
  Synthetic
aggccctggctgctgatatgagagatctcaagaaatggattgagcggaggcaacagattgagaattctaagtccacaacaccctcacaaaatctgtcaaagaatcaaatcttaaactcaagaccttttgggacagcggtg

SEQ ID NO: 431532 - DNA, 140 bp, Artificial Sequence
  Synthetic
caccgctgtcccaaaaggtcttgagtttaagatttgattctttgacagattttgtgagggtgttgtggacttagaattctcaatctgttgcctccgctcaatccatttcttgagatctctcatatcagcagccagggcct

SEQ ID NO: 431533 - DNA, 140 bp, Artificial Sequence
  Synthetic
aggccctggctgctgatatgcagcagttgcgaaatgcaatgagaaacatgatgaagagttttgtgacatgttaagattgtttgactttaacaaacaagctataaggaggctgaagacagagaccttttgggacagcggtg

SEQ ID NO: 431534 - DNA, 140 bp, Artificial Sequence
  Synthetic
caccgctgtcccaaaaggtctctgtcttcagcctccttatagcttgtttgttaaagtcaaacaatcttaacatgtcacaaaactcttcatcatgtttctcattgcatttcgcaactgctgcatatcagcagccagggcct

SEQ ID NO: 431535 - DNA, 140 bp, Artificial Sequence
  Synthetic
atacgccatgctgggtctccataaacattaatcagtttggtatagatatgagtgttgttggccttgattgctatgattcaattatgaactatgatgtcactggggtgactcctacaattacgtacttgggagtcggccat

SEQ ID NO: 431536 - DNA, 140 bp, Artificial Sequence
  Synthetic
atggccgactcccaagtacgtaattgtaggagtcaccccagtgacatcatagttcataattgaatcatagcaatcaaggccaacaacactcatatctataccaaactgattaatgtttatggagacccagcatggcgtat

SEQ ID NO: 431537 - DNA, 140 bp, Artificial Sequence
  Synthetic
aggccctggctgctgatatgctatgattcaattatgaactatgatgtcactggggtgactcctacaattagttatcaaaaatcacaagaagagactttcccatataccatgggggtaattgaccttttgggacagcggtg

SEQ ID NO: 431538 - DNA, 140 bp, Artificial Sequence
  Synthetic
caccgctgtcccaaaaggtcaattacccccatggtatatgggaaagtctcttcttgtgatttttgataactaattgtaggagtcaccccagtgacatcatagttcataattgaatcatagcatatcagcagccagggcct

SEQ ID NO: 431539 - DNA, 140 bp, Artificial Sequence
  Synthetic
atacgccatgctgggtctcccttgatcaattcaatgaaaacttcatccactgtcaaactgaggcagaatgaatttggggcagctagatatcaggtggttaggtgcaaagaagcatactgtcgtacttgggagtcggccat

SEQ ID NO: 431540 - DNA, 140 bp, Artificial Sequence
  Synthetic
atggccgactcccaagtacgacagtatgcttctttgcacctaaccacctgatatctagctgccccaaattcattctgcctcagtttgacagtggatgaagttttcattgaattgatcaagggagacccagcatggcgtat

SEQ ID NO: 431541 - DNA, 140 bp, Artificial Sequence
  Synthetic
atacgccatgctgggtctccgctttaatgaatgacttcatcatagctgacaccacattgaaaggtatttccaccattttgtgcatgtgccacataagcagggttgagagatagtccctcccgtacttgggagtcggccat

SEQ ID NO: 431542 - DNA, 140 bp, Artificial Sequence
  Synthetic
atggccgactcccaagtacgggagggactatctctcaaccctgcttatgtggcacatgcacaaaatggtggaaatacctttcaatgtggtgtcagctatgatgaagtcattcattaaagcggagacccagcatggcgtat

SEQ ID NO: 431543 - DNA, 140 bp, Artificial Sequence
  Synthetic
atacgccatgctgggtctcctctgttcttttaatgctgaccccaagaggtacttccctgcagtcttttcagcagaggttttacaagccacagtagacacaatgatcacctggattgaagacgtacttgggagtcggccat

SEQ ID NO: 431544 - DNA, 140 bp, Artificial Sequence
  Synthetic
atggccgactcccaagtacgtcttcaatccaggtgatcattgtgtctactgtggcttgtaaaacctctgctgaaaagactgcagggaagtacctcttggggtcagcattaaaagaacagaggagacccagcatggcgtat

SEQ ID NO: 431545 - DNA, 140 bp, Artificial Sequence
  Synthetic
aggccctggctgctgatatggcagaggttttacaagccacagtagacacaatgatcacctggattgaagattgtagtgaattagagaaagaattaactcacatcaagttattaacaaagagaccttttgggacagcggtg

SEQ ID NO: 431546 - DNA, 140 bp, Artificial Sequence
  Synthetic
caccgctgtcccaaaaggtctctttgttaataacttgatgtgagttaattctttctctaattcactacaatcttcaatccaggtgatcattgtgtctactgtggcttgtaaaacctctgccatatcagcagccagggcct

SEQ ID NO: 431547 - DNA, 140 bp, Artificial Sequence
  Synthetic
atacgccatgctgggtctccctccagaacctcagatacttcattatggcttatgtgtcagattaccaccacgtggacctcatggataagtttaaggagaaactgatcactgagactgagtcgtacttgggagtcggccat

SEQ ID NO: 431548 - DNA, 140 bp, Artificial Sequence
  Synthetic
atggccgactcccaagtacgactcagtctcagtgatcagtttctccttaaacttatccatgaggtccacgtggtggtaatctgacacataagccataatgaagtatctgaggttctggagggagacccagcatggcgtat

SEQ ID NO: 431549 - DNA, 140 bp, Artificial Sequence
  Synthetic
aggccctggctgctgatatgcgtggacctcatggataagtttaaggagaaactgatcactgagactgagtttcttctttataaactagtgaagactctggtaaatctgattttatgtgatgaccttttgggacagcggtg

SEQ ID NO: 431550 - DNA, 140 bp, Artificial Sequence
  Synthetic
caccgctgtcccaaaaggtcatcacataaaatcagatttaccagagtcttcactagtttataaagaagaaactcagtctcagtgatcagtttctccttaaacttatccatgaggtccacgcatatcagcagccagggcct

SEQ ID NO: 431551 - DNA, 140 bp, Artificial Sequence
  Synthetic
aggccctggctgctgatatgtaaatggcaatatgtgcttctcaaatagagacggatataaacgtctcaaagaatgaatgatgtggctcatgccaaccctgtcctctagcagtttcgaaacgaccttttgggacagcggtg

SEQ ID NO: 431552 - DNA, 140 bp, Artificial Sequence
  Synthetic
caccgctgtcccaaaaggtcgtttcgaaactgctagaggacagggttggcatgagccacatcattcattctttgagacgtttatatccgtctctatttgagaagcacatattgccatttacatatcagcagccagggcct

SEQ ID NO: 431553 - DNA, 140 bp, Artificial Sequence
  Synthetic
atacgccatgctgggtctccatatatgtgccatttcataacaaaagagacaccagatagactgacagatcagataaagtgttttgagaagtttctcgaacctaaattagagtttggccatcgtacttgggagtcggccat

SEQ ID NO: 431554 - DNA, 140 bp, Artificial Sequence
  Synthetic
atggccgactcccaagtacgatggccaaactctaatttaggttcgagaaacttctcaaaacactttatctgatctgtcagtctatctggtgtctcttttgttatgaaatggcacatatatggagacccagcatggcgtat

SEQ ID NO: 431555 - DNA, 140 bp, Artificial Sequence
  Synthetic
aggccctggctgctgatatgagataaagtgttttgagaagtttctcgaacctaaattagagtttggccatgtgagtgtaaaccctgtagacatagccacagaagaagagttgatggatatgaccttttgggacagcggtg

SEQ ID NO: 431556 - DNA, 140 bp, Artificial Sequence
  Synthetic
caccgctgtcccaaaaggtcatatccatcaactcttcttctgtggctatgtctacagggtttacactcacatggccaaactctaatttaggttcgagaaacttctcaaaacactttatctcatatcagcagccagggcct

SEQ ID NO: 431557 - DNA, 140 bp, Artificial Sequence
  Synthetic
atacgccatgctgggtctccggggaccagaatacaaaaaacctggagtttcgaggaaatacctttctctcctcacatcctcctttaacaatggttctttattcaaggaaagagaggtaaacgtacttgggagtcggccat

SEQ ID NO: 431558 - DNA, 140 bp, Artificial Sequence
  Synthetic
atggccgactcccaagtacgtttacctctctttccttgaataaagaaccattgttaaaggaggatgtgaggagagaaaggtatttcctcgaaactccaggttttttgtattctggtccccggagacccagcatggcgtat

SEQ ID NO: 431559 - DNA, 140 bp, Artificial Sequence
  Synthetic
aggccctggctgctgatatgctcacatcctcctttaacaatggttctttattcaaggaaagagaggtaaaaaaggagttaaaggatcctctcataacaagtggttgtgccactgccctgggaccttttgggacagcggtg

SEQ ID NO: 431560 - DNA, 140 bp, Artificial Sequence
  Synthetic
caccgctgtcccaaaaggtcccagggcagtggcacaaccacttgttatgagaggatcctttaactccttttttacctctctttccttgaataaagaaccattgttaaaggaggatgtgagcatatcagcagccagggcct

SEQ ID NO: 431561 - DNA, 140 bp, Artificial Sequence
  Synthetic
atacgccatgctgggtctccagagtgcttaattatgattttaataaactcacagcactagctgttgcacagttaactgaagttttttccagaaaagggaagtatcttctcaatagacaagcgtacttgggagtcggccat

SEQ ID NO: 431562 - DNA, 140 bp, Artificial Sequence
  Synthetic
atggccgactcccaagtacgcttgtctattgagaagatacttcccttttctggaaaaaacttcagttaactgtgcaacagctagtgctgtgagtttattaaaatcataattaagcactctggagacccagcatggcgtat

SEQ ID NO: 431563 - DNA, 140 bp, Artificial Sequence
  Synthetic
aggccctggctgctgatatggttaactgaagttttttccagaaaagggaagtatcttctcaatagacaagattatgaatacaagatccagcaggcaatgagcaacttagttttaggatctgaccttttgggacagcggtg

SEQ ID NO: 431564 - DNA, 140 bp, Artificial Sequence
  Synthetic
caccgctgtcccaaaaggtcagatcctaaaactaagttgctcattgcctgctggatcttgtattcataatcttgtctattgagaagatacttcccttttctggaaaaaacttcagttaaccatatcagcagccagggcct

SEQ ID NO: 431565 - DNA, 140 bp, Artificial Sequence
  Synthetic
atacgccatgctgggtctccagaagggggtgcaagcatatattttgaccagctgagagaaacagttggaaagattgtggatcaatatagggaacctactagtttgggttcaatgagaggacgtacttgggagtcggccat

SEQ ID NO: 431566 - DNA, 140 bp, Artificial Sequence
  Synthetic
atggccgactcccaagtacgtcctctcattgaacccaaactagtaggttccctatattgatccacaatctttccaactgtttctctcagctggtcaaaatatatgcttgcacccccttctggagacccagcatggcgtat

SEQ ID NO: 431567 - DNA, 140 bp, Artificial Sequence
  Synthetic
aggccctggctgctgatatgagattgtggatcaatatagggaacctactagtttgggttcaatgagaggaggggatggccaaccatcagttggtgatttagatgaattaatctctaataagaccttttgggacagcggtg

SEQ ID NO: 431568 - DNA, 140 bp, Artificial Sequence
  Synthetic
caccgctgtcccaaaaggtcttattagagattaattcatctaaatcaccaactgatggttggccatcccctcctctcattgaacccaaactagtaggttccctatattgatccacaatctcatatcagcagccagggcct

SEQ ID NO: 431569 - DNA, 140 bp, Artificial Sequence
  Synthetic
atacgccatgctgggtctccattttgattatgaaattctacctgaaggtttttataaagaattctgcgacaatgtctacaatagtcacaagatgagagataaatacttttattgtggccacgtacttgggagtcggccat

SEQ ID NO: 431570 - DNA, 140 bp, Artificial Sequence
  Synthetic
atggccgactcccaagtacgtggccacaataaaagtatttatctctcatcttgtgactattgtagacattgtcgcagaattctttataaaaaccttcaggtagaatttcataatcaaaatggagacccagcatggcgtat

SEQ ID NO: 431571 - DNA, 140 bp, Artificial Sequence
  Synthetic
aggccctggctgctgatatgaatgtctacaatagtcacaagatgagagataaatacttttattgtggccatatgtcccagtgtccaattggagaactgattaaagctgtgacaacaagaagaccttttgggacagcggtg

SEQ ID NO: 431572 - DNA, 140 bp, Artificial Sequence
  Synthetic
caccgctgtcccaaaaggtcttcttgttgtcacagctttaatcagttctccaattggacactgggacatatggccacaataaaagtatttatctctcatcttgtgactattgtagacattcatatcagcagccagggcct

SEQ ID NO: 431573 - DNA, 140 bp, Artificial Sequence
  Synthetic
atacgccatgctgggtctccatgaatgccaataaacttatggggaaatactctcactacaaatcaagaaatttgaacttcaaatttgatacaggtaagctttcagatgacgttagaattacgtacttgggagtcggccat

SEQ ID NO: 431574 - DNA, 140 bp, Artificial Sequence
  Synthetic
atggccgactcccaagtacgtaattctaacgtcatctgaaagcttacctgtatcaaatttgaagttcaaatttcttgatttgtagtgagagtatttccccataagtttattggcattcatggagacccagcatggcgtat

SEQ ID NO: 431575 - DNA, 140 bp, Artificial Sequence
  Synthetic
aggccctggctgctgatatgtttgaacttcaaatttgatacaggtaagctttcagatgacgttagaattagtgagagagaaagtaattctgaagcactaagcaaggctttgtcgctaacagaccttttgggacagcggtg

SEQ ID NO: 431576 - DNA, 140 bp, Artificial Sequence
  Synthetic
caccgctgtcccaaaaggtctgttagcgacaaagccttgcttagtgcttcagaattactttctctctcactaattctaacgtcatctgaaagcttacctgtatcaaatttgaagttcaaacatatcagcagccagggcct

SEQ ID NO: 431577 - DNA, 140 bp, Artificial Sequence
  Synthetic
atacgccatgctgggtctccaccacaatcttatgactcagtagggcctgatacaggtcggttgaaattctctttgtcatataaggaacaagttggtgggaatagggaattgtatattggtcgtacttgggagtcggccat

SEQ ID NO: 431578 - DNA, 140 bp, Artificial Sequence
  Synthetic
atggccgactcccaagtacgaccaatatacaattccctattcccaccaacttgttccttatatgacaaagagaatttcaaccgacctgtatcaggccctactgagtcataagattgtggtggagacccagcatggcgtat

SEQ ID NO: 431579 - DNA, 140 bp, Artificial Sequence
  Synthetic
aggccctggctgctgatatgctttgtcatataaggaacaagttggtgggaatagggaattgtatattggtgacctaaggaccaagatgttcacaagattaattgaagattattttgaggcgaccttttgggacagcggtg

SEQ ID NO: 431580 - DNA, 140 bp, Artificial Sequence
  Synthetic
caccgctgtcccaaaaggtcgcctcaaaataatcttcaattaatcttgtgaacatcttggtccttaggtcaccaatatacaattccctattcccaccaacttgttccttatatgacaaagcatatcagcagccagggcct

SEQ ID NO: 431581 - DNA, 140 bp, Artificial Sequence
  Synthetic
atacgccatgctgggtctccagaatgccatcttatctatgaaacttaatgtctctttagcacacgtctcctatagtatggatcacagcaaatggggtccaatgatgtgtccattcttgttcgtacttgggagtcggccat

SEQ ID NO: 431582 - DNA, 140 bp, Artificial Sequence
  Synthetic
atggccgactcccaagtacgaacaagaatggacacatcattggaccccatttgctgtgatccatactataggagacgtgtgctaaagagacattaagtttcatagataagatggcattctggagacccagcatggcgtat

SEQ ID NO: 431583 - DNA, 140 bp, Artificial Sequence
  Synthetic
aggccctggctgctgatatgtatagtatggatcacagcaaatggggtccaatgatgtgtccattcttgttcttagctgttcttcaaaatcttatctttctctctaaagatttgcaggctggaccttttgggacagcggtg

SEQ ID NO: 431584 - DNA, 140 bp, Artificial Sequence
  Synthetic
caccgctgtcccaaaaggtccagcctgcaaatctttagagagaaagataagattttgaagaacagctaagaacaagaatggacacatcattggaccccatttgctgtgatccatactatacatatcagcagccagggcct

SEQ ID NO: 431585 - DNA, 140 bp, Artificial Sequence
  Synthetic
atacgccatgctgggtctccaaaatggttgagattccctttaatgttgtatcagctatgatgaaatcattcataaaagctcaattgggtttgagggaaagcacttcacgatcgataacagcgtacttgggagtcggccat

SEQ ID NO: 431586 - DNA, 140 bp, Artificial Sequence
  Synthetic
atggccgactcccaagtacgctgttatcgatcgtgaagtgctttccctcaaacccaattgagcttttatgaatgatttcatcatagctgatacaacattaaagggaatctcaaccattttggagacccagcatggcgtat

SEQ ID NO: 431587 - DNA, 140 bp, Artificial Sequence
  Synthetic
aggccctggctgctgatatgcataaaagctcaattgggtttgagggaaagcacttcacgatcgataacagaggatttcttttactctaactaccagaatggtgtagtaccctctcacatcgaccttttgggacagcggtg

SEQ ID NO: 431588 - DNA, 140 bp, Artificial Sequence
  Synthetic
caccgctgtcccaaaaggtcgatgtgagagggtactacaccattctggtagttagagtaaaagaaatcctctgttatcgatcgtgaagtgctttccctcaaacccaattgagcttttatgcatatcagcagccagggcct

SEQ ID NO: 431589 - DNA, 140 bp, Artificial Sequence
  Synthetic
atacgccatgctgggtctccctatgctctcatctcagagagatttattaattatgccattggcagtgtctgtgggggtacaatagatgcttatacttcaagtgatgatcaaatttcccttcgtacttgggagtcggccat

SEQ ID NO: 431590 - DNA, 140 bp, Artificial Sequence
  Synthetic
atggccgactcccaagtacgaagggaaatttgatcatcacttgaagtataagcatctattgtacccccacagacactgccaatggcataattaataaatctctctgagatgagagcatagggagacccagcatggcgtat

SEQ ID NO: 431591 - DNA, 140 bp, Artificial Sequence
  Synthetic
atacgccatgctgggtctccgctaaaggcagcagcacagccaagcgcaccatcagccgaggcaatccagaaaacaacacctccaccgtacaccccataatcccagaaccaacactcccaccgtacttgggagtcggccat

SEQ ID NO: 431592 - DNA, 140 bp, Artificial Sequence
  Synthetic
atggccgactcccaagtacggtgggagtgttggttctgggattatggggtgtacggtggaggtgttgttttctggattgcctcggctgatggtgcgcttggctgtgctgctgcctttagcggagacccagcatggcgtat

SEQ ID NO: 431593 - DNA, 140 bp, Artificial Sequence
  Synthetic
atacgccatgctgggtctccaaccatccctaacctcccttatgaacaactccaagtcttgatcgtgaattgctggggtaaaagtagcaagtctgctgtcacattcccaaagggctcctctcgtacttgggagtcggccat

SEQ ID NO: 431594 - DNA, 140 bp, Artificial Sequence
  Synthetic
atggccgactcccaagtacgagaggagccctttgggaatgtgacagcagacttgctacttttaccccagcaattcacgatcaagacttggagttgttcataagggaggttagggatggttggagacccagcatggcgtat

SEQ ID NO: 431595 - DNA, 140 bp, Artificial Sequence
  Synthetic
aggccctggctgctgatatgaagtgcttcagaattactctcacgttcacttatcctgacatcatcagccaatcttcctgtatcaaatttaaagttcagacacttactcttataatgagaggaccttttgggacagcggtg

SEQ ID NO: 431596 - DNA, 140 bp, Artificial Sequence
  Synthetic
caccgctgtcccaaaaggtcctctcattataagagtaagtgtctgaactttaaatttgatacaggaagattggctgatgatgtcaggataagtgaacgtgagagtaattctgaagcacttcatatcagcagccagggcct

SEQ ID NO: 431597 - DNA, 140 bp, Artificial Sequence
  Synthetic
atacgccatgctgggtctcctcagccctaaaagtgttattggcagatttgttgcagagtttaaatccagattttatgtatggggagatgaggttcctctattgacaaagttcgttgccgccgtacttgggagtcggccat

SEQ ID NO: 431598 - DNA, 140 bp, Artificial Sequence
  Synthetic
atggccgactcccaagtacggcggcaacgaactttgtcaatagaggaacctcatctccccatacataaaatctggatttaaactctgcaacaaatctgccaataacacttttagggctgaggagacccagcatggcgtat

SEQ ID NO: 431599 - DNA, 140 bp, Artificial Sequence
  Synthetic
aggccctggctgctgatatgttttatgtatggggagatgaggttcctctattgacaaagttcgttgccgcagctttacacaacataaagtgtaaagaaccccaccagctggcagaaacaagaccttttgggacagcggtg

SEQ ID NO: 431600 - DNA, 140 bp, Artificial Sequence
  Synthetic
caccgctgtcccaaaaggtcttgtttctgccagctggtggggttctttacactttatgttgtgtaaagctgcggcaacgaactttgtcaatagaggaacctcatctccccatacataaaacatatcagcagccagggcct

SEQ ID NO: 431601 - DNA, 140 bp, Artificial Sequence
  Synthetic
atacgccatgctgggtctcctgtaacctggttcagctgagaaccttaagtctcttgcagtatgccagataccctattgacccattccttttgaactgcgaaacagatgttagagactgggcgtacttgggagtcggccat

SEQ ID NO: 431602 - DNA, 140 bp, Artificial Sequence
  Synthetic
atggccgactcccaagtacgcccagtctctaacatctgtttcgcagttcaaaaggaatgggtcaatagggtatctggcatactgcaagagacttaaggttctcagctgaaccaggttacaggagacccagcatggcgtat

SEQ ID NO: 431603 - DNA, 140 bp, Artificial Sequence
  Synthetic
aggccctggctgctgatatgccctattgacccattccttttgaactgcgaaacagatgttagagactgggtggatggtaaccgtagttacagaatcatgagacagatagagggcttgattgaccttttgggacagcggtg

SEQ ID NO: 431604 - DNA, 140 bp, Artificial Sequence
  Synthetic
caccgctgtcccaaaaggtcaatcaagccctctatctgtctcatgattctgtaactacggttaccatccacccagtctctaacatctgtttcgcagttcaaaaggaatgggtcaatagggcatatcagcagccagggcct

SEQ ID NO: 431605 - DNA, 140 bp, Artificial Sequence
  Synthetic
atacgccatgctgggtctccattcactttttatcaaccttattaagagtttctcttccactactttgtcaagatcagatattgagggtgcattgcagtctgcttgctgctgtctttctgtcgtacttgggagtcggccat

SEQ ID NO: 431606 - DNA, 140 bp, Artificial Sequence
  Synthetic
atggccgactcccaagtacgacagaaagacagcagcaagcagactgcaatgcaccctcaatatctgatcttgacaaagtagtggaagagaaactcttaataaggttgataaaaagtgaatggagacccagcatggcgtat

SEQ ID NO: 431607 - DNA, 140 bp, Artificial Sequence
  Synthetic
atacgccatgctgggtctccgttgaagacagggcaacttcatgaagagttcacaacaaactatttatctggtgaacatgtttcatcacttaaaaatttatgcagtatgttgggtgttgatcgtacttgggagtcggccat

SEQ ID NO: 431608 - DNA, 140 bp, Artificial Sequence
  Synthetic
atggccgactcccaagtacgatcaacacccaacatactgcataaatttttaagtgatgaaacatgttcaccagataaatagtttgttgtgaactcttcatgaagttgccctgtcttcaacggagacccagcatggcgtat

SEQ ID NO: 431609 - DNA, 140 bp, Artificial Sequence
  Synthetic
aggccctggctgctgatatggtgaacatgtttcatcacttaaaaatttatgcagtatgttgggtgttgatcctccatcagaatctgacttagagttttcatggttgaatctgtctgcttagaccttttgggacagcggtg

SEQ ID NO: 431610 - DNA, 140 bp, Artificial Sequence
  Synthetic
caccgctgtcccaaaaggtctaagcagacagattcaaccatgaaaactctaagtcagattctgatggaggatcaacacccaacatactgcataaatttttaagtgatgaaacatgttcaccatatcagcagccagggcct

SEQ ID NO: 431611 - DNA, 140 bp, Artificial Sequence
  Synthetic
atacgccatgctgggtctcctaaatcttgatgatgataagatccctacaattgttaagacaattcaaaataagctatcatcaacttttactcggggggcacagaagttgttatcagaagccgtacttgggagtcggccat

SEQ ID NO: 431612 - DNA, 140 bp, Artificial Sequence
  Synthetic
atggccgactcccaagtacggcttctgataacaacttctgtgccccccgagtaaaagttgatgatagcttattttgaattgtcttaacaattgtagggatcttatcatcatcaagatttaggagacccagcatggcgtat

SEQ ID NO: 431613 - DNA, 140 bp, Artificial Sequence
  Synthetic
aggccctggctgctgatatgaagctatcatcaacttttactcggggggcacagaagttgttatcagaagccataaacaaatcagcattccagagttccattgcatcaggctttgtgggctgaccttttgggacagcggtg

SEQ ID NO: 431614 - DNA, 140 bp, Artificial Sequence
  Synthetic
caccgctgtcccaaaaggtcagcccacaaagcctgatgcaatggaactctggaatgctgatttgtttatggcttctgataacaacttctgtgccccccgagtaaaagttgatgatagcttcatatcagcagccagggcct

SEQ ID NO: 431615 - DNA, 140 bp, Artificial Sequence
  Synthetic
aggccctggctgctgatatggaaccattgttaaaactggacacaaggagtgaaataaatttcttggaaacaccaggctttttatacctaactttttccgcatctgcacaacattctttgcgaccttttgggacagcggtg

SEQ ID NO: 431616 - DNA, 140 bp, Artificial Sequence
  Synthetic
caccgctgtcccaaaaggtcgcaaagaatgttgtgcagatgcggaaaaagttaggtataaaaagcctggtgtttccaagaaatttatttcactccttgtgtccagttttaacaatggttccatatcagcagccagggcct

SEQ ID NO: 431617 - DNA, 140 bp, Artificial Sequence
  Synthetic
aggccctggctgctgatatgaccaggctttttatacctaactttttccgcatctgcacaacattctttgcctagaaactttcttgcattataaaccatttcagcaagctcttcctccgatgaccttttgggacagcggtg

SEQ ID NO: 431618 - DNA, 140 bp, Artificial Sequence
  Synthetic
caccgctgtcccaaaaggtcatcggaggaagagcttgctgaaatggtttataatgcaagaaagtttctaggcaaagaatgttgtgcagatgcggaaaaagttaggtataaaaagcctggtcatatcagcagccagggcct

SEQ ID NO: 431619 - DNA, 140 bp, Artificial Sequence
  Synthetic
atacgccatgctgggtctcctttgggggaacctaaggcagccaaaccactggagtttttcagacataacccttgtgattattttcctctaaagccaactgcatcaaaattacttgaagatcgtacttgggagtcggccat

SEQ ID NO: 431620 - DNA, 140 bp, Artificial Sequence
  Synthetic
atggccgactcccaagtacgatcttcaagtaattttgatgcagttggctttagaggaaaataatcacaagggttatgtctgaaaaactccagtggtttggctgccttaggttcccccaaaggagacccagcatggcgtat

SEQ ID NO: 431621 - DNA, 140 bp, Artificial Sequence
  Synthetic
aggccctggctgctgatatgcttgtgattattttcctctaaagccaactgcatcaaaattacttgaagatagggtgggtgttaaccacatcattcattccttaagaagattatacccatcgaccttttgggacagcggtg

SEQ ID NO: 431622 - DNA, 140 bp, Artificial Sequence
  Synthetic
caccgctgtcccaaaaggtcgatgggtataatcttcttaaggaatgaatgatgtggttaacacccaccctatcttcaagtaattttgatgcagttggctttagaggaaaataatcacaagcatatcagcagccagggcct

SEQ ID NO: 431623 - DNA, 140 bp, Artificial Sequence
  Synthetic
aggccctggctgctgatatggtgaactcttcgtgaagatcaccagtttttagtttattaaatagaatcctgagcattgatctcatccttttgcacgcatcaggaatcagcctctcaatctgaccttttgggacagcggtg

SEQ ID NO: 431624 - DNA, 140 bp, Artificial Sequence
  Synthetic
caccgctgtcccaaaaggtcagattgagaggctgattcctgatgcgtgcaaaaggatgagatcaatgctcaggattctatttaataaactaaaaactggtgatcttcacgaagagttcaccatatcagcagccagggcct

SEQ ID NO: 431625 - DNA, 140 bp, Artificial Sequence
  Synthetic
atacgccatgctgggtctccagatgaaatggtcacccaggataaagttcttagatctctgtgtagcactagatgtgaattgtgaggctttgtctcttgtgtcgcacatagtcaagtggaacgtacttgggagtcggccat

SEQ ID NO: 431626 - DNA, 140 bp, Artificial Sequence
  Synthetic
atggccgactcccaagtacgttccacttgactatgtgcgacacaagagacaaagcctcacaattcacatctagtgctacacagagatctaagaactttatcctgggtgaccatttcatctggagacccagcatggcgtat

SEQ ID NO: 431627 - DNA, 140 bp, Artificial Sequence
  Synthetic
aggccctggctgctgatatggatgtgaattgtgaggctttgtctcttgtgtcgcacatagtcaagtggaaaagggaagaacattacatagtgttgtcatctgagctaaggttgtctcatagaccttttgggacagcggtg

SEQ ID NO: 431628 - DNA, 140 bp, Artificial Sequence
  Synthetic
caccgctgtcccaaaaggtctatgagacaaccttagctcagatgacaacactatgtaatgttcttcccttttccacttgactatgtgcgacacaagagacaaagcctcacaattcacatccatatcagcagccagggcct

SEQ ID NO: 431629 - DNA, 140 bp, Artificial Sequence
  Synthetic
atacgccatgctgggtctccagatgcccctcccaacaagactgagaccatcagccgccccgacggcgcccctggctgaagcaggagacaacaccagacccccaccctacagtccctgaaccgtacttgggagtcggccat

SEQ ID NO: 431630 - DNA, 140 bp, Artificial Sequence
  Synthetic
atggccgactcccaagtacggttcagggactgtagggtgggggtctggtgttgtctcctgcttcagccaggggcgccgtcggggcggctgatggtctcagtcttgttgggaggggcatctggagacccagcatggcgtat

SEQ ID NO: 431631 - DNA, 140 bp, Artificial Sequence
  Synthetic
aggccctggctgctgatatggggcccccccgggggagccagccacctccaaaaactactcaatgtcctcaacatgttcgtccccctcagtcaactcctcgcatgttctgcctttcagtctgaccttttgggacagcggtg

SEQ ID NO: 431632 - DNA, 140 bp, Artificial Sequence
  Synthetic
caccgctgtcccaaaaggtcagactgaaaggcagaacatgcgaggagttgactgagggggacgaacatgttgaggacattgagtagtttttggaggtggctggctcccccgggggggccccatatcagcagccagggcct

SEQ ID NO: 431633 - DNA, 140 bp, Artificial Sequence
  Synthetic
atacgccatgctgggtctccgcagttgacaactttatgagacagatctactttgaatcttatgtcagatcatttgtggctacaactagaactttggggtctttcacatggttcccacatacgtacttgggagtcggccat

SEQ ID NO: 431634 - DNA, 140 bp, Artificial Sequence
  Synthetic
atggccgactcccaagtacgtatgtgggaaccatgtgaaagaccccaaagttctagttgtagccacaaatgatctgacataagattcaaagtagatctgtctcataaagttgtcaactgcggagacccagcatggcgtat

SEQ ID NO: 431635 - DNA, 140 bp, Artificial Sequence
  Synthetic
aggccctggctgctgatatgatttgtggctacaactagaactttggggtctttcacatggttcccacataagacaagtatcccagagggtgaggggctacaaagactgggtccgttttccgaccttttgggacagcggtg

SEQ ID NO: 431636 - DNA, 140 bp, Artificial Sequence
  Synthetic
caccgctgtcccaaaaggtcggaaaacggacccagtctttgtagcccctcaccctctgggatacttgtcttatgtgggaaccatgtgaaagaccccaaagttctagttgtagccacaaatcatatcagcagccagggcct

SEQ ID NO: 431637 - DNA, 140 bp, Artificial Sequence
  Synthetic
atacgccatgctgggtctccgtatgacttgatgatgggttatgcttggatagattttgatgttgagccagccaagtttgaccagaacaaattgatcgcatcaggattagtcaattctaaacgtacttgggagtcggccat

SEQ ID NO: 431638 - DNA, 140 bp, Artificial Sequence
  Synthetic
atggccgactcccaagtacgtttagaattgactaatcctgatgcgatcaatttgttctggtcaaacttggctggctcaacatcaaaatctatccaagcataacccatcatcaagtcatacggagacccagcatggcgtat

SEQ ID NO: 431639 - DNA, 140 bp, Artificial Sequence
  Synthetic
aggccctggctgctgatatgaagacgttttcattgagttgatcagagccaggctcaatgatgatagtctttctaagtctgttgcatctagaatgtcaataacgccaagagtgtaagggaagaccttttgggacagcggtg

SEQ ID NO: 431640 - DNA, 140 bp, Artificial Sequence
  Synthetic
caccgctgtcccaaaaggtcttcccttacactcttggcgttattgacattctagatgcaacagacttagaaagactatcatcattgagcctggctctgatcaactcaatgaaaacgtcttcatatcagcagccagggcct

SEQ ID NO: 431641 - DNA, 140 bp, Artificial Sequence
  Synthetic
atacgccatgctgggtctccctagcttcaaggagaagttcgctatccaccttgactttgtcggttcgatgaatggacagggcaaatatttagttcaagatgtagtggctatgtactctggcgtacttgggagtcggccat

SEQ ID NO: 431642 - DNA, 140 bp, Artificial Sequence
  Synthetic
atggccgactcccaagtacgccagagtacatagccactacatcttgaactaaatatttgccctgtccattcatcgaaccgacaaagtcaaggtggatagcgaacttctccttgaagctagggagacccagcatggcgtat

SEQ ID NO: 431643 - DNA, 140 bp, Artificial Sequence
  Synthetic
aggccctggctgctgatatgaatggacagggcaaatatttagttcaagatgtagtggctatgtactctggtgcagtgagcccctgtgtattgtcagattgttggagattggtgttgtctggaccttttgggacagcggtg

SEQ ID NO: 431644 - DNA, 140 bp, Artificial Sequence
  Synthetic
caccgctgtcccaaaaggtccagacaacaccaatctccaacaatctgacaatacacaggggctcactgcaccagagtacatagccactacatcttgaactaaatatttgccctgtccattcatatcagcagccagggcct

SEQ ID NO: 431645 - DNA, 140 bp, Artificial Sequence
  Synthetic
atacgccatgctgggtctccaatgagttcatgaatgacacaaatcagctggggaaagtgacccctgttgagattgtcatcgatgctgatagattacagtttgtagaacatgattttgtcccgtacttgggagtcggccat

SEQ ID NO: 431646 - DNA, 140 bp, Artificial Sequence
  Synthetic
atggccgactcccaagtacgggacaaaatcatgttctacaaactgtaatctatcagcatcgatgacaatctcaacaggggtcactttccccagctgatttgtgtcattcatgaactcattggagacccagcatggcgtat

SEQ ID NO: 431647 - DNA, 140 bp, Artificial Sequence
  Synthetic
atacgccatgctgggtctcccctgggaggaccactgccaattctcaagaccctctcccatcggttatctcggtctcctttcacaaaggaccagagatatttatatcagcagaagactactcgtacttgggagtcggccat

SEQ ID NO: 431648 - DNA, 140 bp, Artificial Sequence
  Synthetic
atggccgactcccaagtacgagtagtcttctgctgatataaatatctctggtcctttgtgaaaggagaccgagataaccgatgggagagggtcttgagaattggcagtggtcctcccaggggagacccagcatggcgtat

SEQ ID NO: 431649 - DNA, 140 bp, Artificial Sequence
  Synthetic
atacgccatgctgggtctccccaagaccttgaattgtttgtgagagaagttggtgagacatctcctgatttgctgagcggagcgttgagtgccatgatgcttgataggttgaagttgaggcgtacttgggagtcggccat

SEQ ID NO: 431650 - DNA, 140 bp, Artificial Sequence
  Synthetic
atggccgactcccaagtacgcctcaacttcaacctatcaagcatcatggcactcaacgctccgctcagcaaatcaggagatgtctcaccaacttctctcacaaacaattcaaggtcttggggagacccagcatggcgtat

SEQ ID NO: 431651 - DNA, 140 bp, Artificial Sequence
  Synthetic
aggccctggctgctgatatgtgctgagcggagcgttgagtgccatgatgcttgataggttgaagttgaggatgcaatggtcaggggtggacattgtctctgtgttgaagagggtcatgccgaccttttgggacagcggtg

SEQ ID NO: 431652 - DNA, 140 bp, Artificial Sequence
  Synthetic
caccgctgtcccaaaaggtcggcatgaccctcttcaacacagagacaatgtccacccctgaccattgcatcctcaacttcaacctatcaagcatcatggcactcaacgctccgctcagcacatatcagcagccagggcct

SEQ ID NO: 431653 - DNA, 140 bp, Artificial Sequence
  Synthetic
aggccctggctgctgatatggacaaaaccagtctccaacagtctgacaaaacacacggactcactgcacctgagtacataacggttacatcatgtactaaatacttggcctgttgattcagaccttttgggacagcggtg

SEQ ID NO: 431654 - DNA, 140 bp, Artificial Sequence
  Synthetic
caccgctgtcccaaaaggtctgaatcaacaggccaagtatttagtacatgatgtaaccgttatgtactcaggtgcagtgagtccgtgtgttttgtcagactgttggagactggttttgtccatatcagcagccagggcct

SEQ ID NO: 431655 - DNA, 140 bp, Artificial Sequence
  Synthetic
atacgccatgctgggtctccgggttgaatttaaaggctatgcattgtgcttcagcaggtcaaagaggagagtcatgatacagtctagtggtgggaaattgaggctgaaaggcaggacatgcgtacttgggagtcggccat

SEQ ID NO: 431656 - DNA, 140 bp, Artificial Sequence
  Synthetic
atggccgactcccaagtacgcatgtcctgcctttcagcctcaatttcccaccactagactgtatcatgactctcctctttgacctgctgaagcacaatgcatagcctttaaattcaacccggagacccagcatggcgtat

SEQ ID NO: 431657 - DNA, 140 bp, Artificial Sequence
  Synthetic
aggccctggctgctgatatggtcatgatacagtctagtggtgggaaattgaggctgaaaggcaggacatgtgaagaactacctgaagaagaagaacaggttgaggatattgagtagttgcgaccttttgggacagcggtg

SEQ ID NO: 431658 - DNA, 140 bp, Artificial Sequence
  Synthetic
caccgctgtcccaaaaggtcgcaactactcaatatcctcaacctgttcttcttcttcaggtagttcttcacatgtcctgcctttcagcctcaatttcccaccactagactgtatcatgaccatatcagcagccagggcct

SEQ ID NO: 431659 - DNA, 140 bp, Artificial Sequence
  Synthetic
aggccctggctgctgatatgcccatttcttctaaactgtgaaacagacgttagagattgggtggatggtaaccgcagctacagaatcatgagacagatagagagcttaatccctgaagcagaccttttgggacagcggtg

SEQ ID NO: 431660 - DNA, 140 bp, Artificial Sequence
  Synthetic
caccgctgtcccaaaaggtctgcttcagggattaagctctctatctgtctcatgattctgtagctgcggttaccatccacccaatctctaacgtctgtttcacagtttagaagaaatgggcatatcagcagccagggcct

SEQ ID NO: 431661 - DNA, 140 bp, Artificial Sequence
  Synthetic
atacgccatgctgggtctccggggtgtcggggggaagggattggttgcggtctgtgttgggtggattagggtgtgtatggtggaggattggtggtgccttctttgatgatttgtggtgctcgtacttgggagtcggccat

SEQ ID NO: 431662 - DNA, 140 bp, Artificial Sequence
  Synthetic
atggccgactcccaagtacgagcaccacaaatcatcaaagaaggcaccaccaatcctccaccatacacaccctaatccacccaacacagaccgcaaccaatcccttccccccgacaccccggagacccagcatggcgtat

SEQ ID NO: 431663 - DNA, 140 bp, Artificial Sequence
  Synthetic
aggccctggctgctgatatggtgtgtatggtggaggattggtggtgccttctttgatgatttgtggtgctgtcggcatggttgttggtcttagcctcgtgggcaggggcatcttacagatgaccttttgggacagcggtg

SEQ ID NO: 431664 - DNA, 140 bp, Artificial Sequence
  Synthetic
caccgctgtcccaaaaggtcatctgtaagatgcccctgcccacgaggctaagaccaacaaccatgccgacagcaccacaaatcatcaaagaaggcaccaccaatcctccaccatacacaccatatcagcagccagggcct

SEQ ID NO: 431665 - DNA, 140 bp, Artificial Sequence
  Synthetic
atacgccatgctgggtctccggtagtggttgttacactcaactaggcccttattttcaaaccaacagctcttgcagaattgcggtccaaggtgcgtggcatctggaatcagactggccctcgtacttgggagtcggccat

SEQ ID NO: 431666 - DNA, 140 bp, Artificial Sequence
  Synthetic
atggccgactcccaagtacgagggccagtctgattccagatgccacgcaccttggaccgcaattctgcaagagctgttggtttgaaaataagggcctagttgagtgtaacaaccactaccggagacccagcatggcgtat

SEQ ID NO: 431667 - DNA, 140 bp, Artificial Sequence
  Synthetic
atacgccatgctgggtctccgtctgttccccattgcactgagcttaagttgtgaagctctacagtagaataaccaaattgcctaggatccccggtgcgcgagacctactgggaaacggcgcgtacttgggagtcggccat

SEQ ID NO: 431668 - DNA, 140 bp, Artificial Sequence
  Synthetic
atggccgactcccaagtacgcgccgtttcccagtaggtctcgcgcaccggggatcctaggcaatttggttattctactgtagagcttcacaacttaagctcagtgcaatggggaacagacggagacccagcatggcgtat

SEQ ID NO: 431669 - DNA, 140 bp, Artificial Sequence
  Synthetic
atacgccatgctgggtctcccacctttgactttaacttctctagatcagcggctaagattaataagtcatctgaggttagagtcccaactctcagtatactcttttgttgagttgattttcgtacttgggagtcggccat

SEQ ID NO: 431670 - DNA, 140 bp, Artificial Sequence
  Synthetic
atggccgactcccaagtacgaaaatcaactcaacaaaagagtatactgagagttgggactctaacctcagatgacttattaatcttagccgctgatctagagaagttaaagtcaaaggtgggagacccagcatggcgtat

SEQ ID NO: 431671 - DNA, 140 bp, Artificial Sequence
  Synthetic
aggccctggctgctgatatggatgggtacagtcttcttagagaatgaatgatgtgattcaaaccaaccttgtcttccaatagttttgatgcagttggcttcaagggaaagtagtcacaaggaccttttgggacagcggtg

SEQ ID NO: 431672 - DNA, 140 bp, Artificial Sequence
  Synthetic
caccgctgtcccaaaaggtccttgtgactactttcccttgaagccaactgcatcaaaactattggaagacaaggttggtttgaatcacatcattcattctctaagaagactgtacccatccatatcagcagccagggcct

SEQ ID NO: 431673 - DNA, 140 bp, Artificial Sequence
  Synthetic
atacgccatgctgggtctccactttgagataagatctttagcacttgcaatgtcttcctccatcgccaattgtagcacctgtgttggatttgggtttgtgccagtatggcttgtagatcacgtacttgggagtcggccat

SEQ ID NO: 431674 - DNA, 140 bp, Artificial Sequence
  Synthetic
atggccgactcccaagtacgtgatctacaagccatactggcacaaacccaaatccaacacaggtgctacaattggcgatggaggaagacattgcaagtgctaaagatcttatctcaaagtggagacccagcatggcgtat

SEQ ID NO: 431675 - DNA, 140 bp, Artificial Sequence
  Synthetic
aggccctggctgctgatatgtgtagcacctgtgttggatttgggtttgtgccagtatggcttgtagatcaaccggtggtgccccacaaaagctcccacagaaatgagagacaatatgcctgaccttttgggacagcggtg

SEQ ID NO: 431676 - DNA, 140 bp, Artificial Sequence
  Synthetic
caccgctgtcccaaaaggtcaggcatattgtctctcatttctgtgggagcttttgtggggcaccaccggttgatctacaagccatactggcacaaacccaaatccaacacaggtgctacacatatcagcagccagggcct

SEQ ID NO: 431677 - DNA, 140 bp, Artificial Sequence
  Synthetic
aggccctggctgctgatatggcatagaagtctgatgtattatgtagtattccctgacccatgtcaagtatcgaactgatatgagagggcaccactccgatttggaaattagagtaaaagagaccttttgggacagcggtg

SEQ ID NO: 431678 - DNA, 140 bp, Artificial Sequence
  Synthetic
caccgctgtcccaaaaggtctcttttactctaatttccaaatcggagtggtgccctctcatatcagttcgatacttgacatgggtcagggaatactacataatacatcagacttctatgccatatcagcagccagggcct

SEQ ID NO: 431679 - DNA, 140 bp, Artificial Sequence
  Synthetic
atacgccatgctgggtctccaacctctatgatcatgctcttatgagtataatctcaactttccacttgtccattcccaactttaatcagtatgaagcaatgagttgtgactttaatggagcgtacttgggagtcggccat

SEQ ID NO: 431680 - DNA, 140 bp, Artificial Sequence
  Synthetic
atggccgactcccaagtacgctccattaaagtcacaactcattgcttcatactgattaaagttgggaatggacaagtggaaagttgagattatactcataagagcatgatcatagaggttggagacccagcatggcgtat

SEQ ID NO: 431681 - DNA, 140 bp, Artificial Sequence
  Synthetic
aggccctggctgctgatatgtgggaagatcactgccagttctcaagaccatctcccattggctaccttgggctcctctcacaaaggaccagagacatttacattagtagaagactgctgggaccttttgggacagcggtg

SEQ ID NO: 431682 - DNA, 140 bp, Artificial Sequence
  Synthetic
caccgctgtcccaaaaggtcccagcagtcttctactaatgtaaatgtctctggtcctttgtgagaggagcccaaggtagccaatgggagatggtcttgagaactggcagtgatcttcccacatatcagcagccagggcct

SEQ ID NO: 431683 - DNA, 140 bp, Artificial Sequence
  Synthetic
atacgccatgctgggtctccgcacattcacatggacactgtcagattctgaaggcaaagatacaccaggggggtactgtctgactagatggatgctaattgaggctgaactgaaatgtttcgtacttgggagtcggccat

SEQ ID NO: 431684 - DNA, 140 bp, Artificial Sequence
  Synthetic
atggccgactcccaagtacgaaacatttcagttcagcctcaattagcatccatctagtcagacagtacccccctggtgtatctttgccttcagaatctgacagtgtccatgtgaatgtgcggagacccagcatggcgtat

SEQ ID NO: 431685 - DNA, 140 bp, Artificial Sequence
  Synthetic
aggccctggctgctgatatgttaatatgggacaaatagtgacatttttccaggaagtgcctcatgtgatagaggaagtgatgaacattgtactcatcgcactgtctattcttgcagtgttgaccttttgggacagcggtg

SEQ ID NO: 431686 - DNA, 140 bp, Artificial Sequence
  Synthetic
caccgctgtcccaaaaggtcaacactgcaagaatagacagtgcgatgagtacaatgttcatcacttcctctatcacatgaggcacttcctggaaaaatgtcactatttgtcccatattaacatatcagcagccagggcct

SEQ ID NO: 431687 - DNA, 140 bp, Artificial Sequence
  Synthetic
atacgccatgctgggtctccgttacattgctcttgattctggccatggagggtgggactgcataatgaccagttatcaatatttgataatccaaaacacaacctgggaagatcactgccacgtacttgggagtcggccat

SEQ ID NO: 431688 - DNA, 140 bp, Artificial Sequence
  Synthetic
atggccgactcccaagtacgtggcagtgatcttcccaggttgtgttttggattatcaaatattgataactggtcattatgcagtcccaccctccatggccagaatcaagagcaatgtaacggagacccagcatggcgtat

SEQ ID NO: 431689 - DNA, 140 bp, Artificial Sequence
  Synthetic
atacgccatgctgggtctccgtcctggtcacctttgatttcagcttctctagatcagcagctaagattagtaagtcatctgaggttaaggtcccaactctcaatatgctcttttgttgagcgtacttgggagtcggccat

SEQ ID NO: 431690 - DNA, 140 bp, Artificial Sequence
  Synthetic
atggccgactcccaagtacgctcaacaaaagagcatattgagagttgggaccttaacctcagatgacttactaatcttagctgctgatctagagaagctgaaatcaaaggtgaccaggacggagacccagcatggcgtat

SEQ ID NO: 431691 - DNA, 140 bp, Artificial Sequence
  Synthetic
atacgccatgctgggtctccccagagatatttatattagtaggagactactgggcacattcacatggacattgtcagattctgaaggcaaggacacaccaggggggtattgtctgaccagcgtacttgggagtcggccat

SEQ ID NO: 431692 - DNA, 140 bp, Artificial Sequence
  Synthetic
atggccgactcccaagtacgctggtcagacaatacccccctggtgtgtccttgccttcagaatctgacaatgtccatgtgaatgtgcccagtagtctcctactaatataaatatctctggggagacccagcatggcgtat

SEQ ID NO: 431693 - DNA, 140 bp, Artificial Sequence
  Synthetic
aggccctggctgctgatatgtccttagaagcactcatcttggtctggacacttagggatttactggttgaaagttttactcagtaagtcaatgaaaagcgcaatccaatagcctaggatcgaccttttgggacagcggtg

SEQ ID NO: 431694 - DNA, 140 bp, Artificial Sequence
  Synthetic
caccgctgtcccaaaaggtcgatcctaggctattggattgcgcttttcattgacttactgagtaaaactttcaaccagtaaatccctaagtgtccagaccaagatgagtgcttctaaggacatatcagcagccagggcct

SEQ ID NO: 431695 - DNA, 140 bp, Artificial Sequence
  Synthetic
aggccctggctgctgatatgactcatcgccagattgttgtgctggatgcacgcaataaaaagctgagactatctgccaaaatgacaaaagcaaagcgcaatccaatagcctaggatccacgaccttttgggacagcggtg

SEQ ID NO: 431696 - DNA, 140 bp, Artificial Sequence
  Synthetic
caccgctgtcccaaaaggtcgtggatcctaggctattggattgcgctttgcttttgtcattttggcagatagtctcagctttttattgcgtgcatccagcacaacaatctggcgatgagtcatatcagcagccagggcct

SEQ ID NO: 431697 - DNA, 140 bp, Artificial Sequence
  Synthetic
aggccctggctgctgatatgcagaaagagtacatggaaaggcaggggaagacaccattgggtctagttgacctctttgtgttcagcacaagtttctatctcattagcatcttccttcattgaccttttgggacagcggtg

SEQ ID NO: 431698 - DNA, 140 bp, Artificial Sequence
  Synthetic
caccgctgtcccaaaaggtcaatgaaggaagatgctaatgagatagaaacttgtgctgaacacaaagaggtcaactagacccaatggtgtcttcccctgcctttccatgtactctttctgcatatcagcagccagggcct

SEQ ID NO: 431699 - DNA, 140 bp, Artificial Sequence
  Synthetic
atacgccatgctgggtctccttcttttactgtgtggtagatcttgcacaaccactctgtacaaaggagtctatgaacttcaggccctggaattaaacatggagacactcaatatgaccatcgtacttgggagtcggccat

SEQ ID NO: 431700 - DNA, 140 bp, Artificial Sequence
  Synthetic
atggccgactcccaagtacgatggtcatattgagtgtctccatgtttaattccagggcctgaagttcatagactcctttgtacagagtggttgtgcaagatctaccacacagtaaaagaaggagacccagcatggcgtat

SEQ ID NO: 431701 - DNA, 140 bp, Artificial Sequence
  Synthetic
atacgccatgctgggtctccgcgaagaggtctgtcacatcaataccatgtgagtacttagcatcttgcttaaactgctttaagtcagtaggctcacggaagaagtgaatgtagcagcctgcgtacttgggagtcggccat

SEQ ID NO: 431702 - DNA, 140 bp, Artificial Sequence
  Synthetic
atggccgactcccaagtacgcaggctgctacattcacttcttccgtgagcctactgacttaaagcagtttaagcaagatgctaagtactcacatggtattgatgtgacagacctcttcgcggagacccagcatggcgtat

SEQ ID NO: 431703 - DNA, 140 bp, Artificial Sequence
  Synthetic
aggccctggctgctgatatgctgaggtgacaccttgattgtctccaacatgttaccaccatctagcatgcaagctcctgcttttacagctgcacccagactaaaattataacctgagatggaccttttgggacagcggtg

SEQ ID NO: 431704 - DNA, 140 bp, Artificial Sequence
  Synthetic
caccgctgtcccaaaaggtccatctcaggttataattttagtctgggtgcagctgtaaaagcaggagcttgcatgctagatggtggtaacatgttggagacaatcaaggtgtcacctcagcatatcagcagccagggcct

SEQ ID NO: 431705 - DNA, 140 bp, Artificial Sequence
  Synthetic
atacgccatgctgggtctccagtcagcctgtctaagtctgaagtgttagggtattttgctgtgtaaatcagacccaaatctgttagcgcctgcacaacatcatttaggtcaacctgcccccgtacttgggagtcggccat

SEQ ID NO: 431706 - DNA, 140 bp, Artificial Sequence
  Synthetic
atggccgactcccaagtacgggggcaggttgacctaaatgatgttgtgcaggcgctaacagatttgggtctgatttacacagcaaaataccctaacacttcagacttagacaggctgactggagacccagcatggcgtat

SEQ ID NO: 431707 - DNA, 140 bp, Artificial Sequence
  Synthetic
aggccctggctgctgatatgtcccggtccgagccccttgattgccactgctcattcctatcatgtttaagagagcccgtctctgttcaagttgttgtgaactcaggttacccatataaacgaccttttgggacagcggtg

SEQ ID NO: 431708 - DNA, 140 bp, Artificial Sequence
  Synthetic
caccgctgtcccaaaaggtcgtttatatgggtaacctgagttcacaacaacttgaacagagacgggctctcttaaacatgataggaatgagcagtggcaatcaaggggctcggaccgggacatatcagcagccagggcct

SEQ ID NO: 431709 - DNA, 140 bp, Artificial Sequence
  Synthetic
aggccctggctgctgatatgtgctcaccactctttcttccaccatgggttcatgtgtcctactgtgagacaacctcagctcagatgataatacaatgtaatgttcctctcttttccatttgaccttttgggacagcggtg

SEQ ID NO: 431710 - DNA, 140 bp, Artificial Sequence
  Synthetic
caccgctgtcccaaaaggtcaaatggaaaagagaggaacattacattgtattatcatctgagctgaggttgtctcacagtaggacacatgaacccatggtggaagaaagagtggtgagcacatatcagcagccagggcct

SEQ ID NO: 431711 - DNA, 140 bp, Artificial Sequence
  Synthetic
atacgccatgctgggtctccgcttgttattaatgccctgatgacaactagaaattatttcctcaaagtgttttgcacgcttgtcagttagaacattgatgctttcaattcctgagagcctcgtacttgggagtcggccat

SEQ ID NO: 431712 - DNA, 140 bp, Artificial Sequence
  Synthetic
atggccgactcccaagtacgaggctctcaggaattgaaagcatcaatgttctaactgacaagcgtgcaaaacactttgaggaaataatttctagttgtcatcagggcattaataacaagcggagacccagcatggcgtat

SEQ ID NO: 431713 - DNA, 140 bp, Artificial Sequence
  Synthetic
aggccctggctgctgatatgacaggtgccccatctgcaagatgcctcttcccacaaaactgagaccatcaaccactccaacagcaccttcaactggagcagcggacagcatcagacccccgaccttttgggacagcggtg

SEQ ID NO: 431714 - DNA, 140 bp, Artificial Sequence
  Synthetic
caccgctgtcccaaaaggtcgggggtctgatgctgtccgctgctccagttgaaggtgctgttggagtggttgatggtctcagttttgtgggaagaggcatcttgcagatggggcacctgtcatatcagcagccagggcct

SEQ ID NO: 431715 - DNA, 140 bp, Artificial Sequence
  Synthetic
aggccctggctgctgatatggaaggactttatctcctttgaggcactcattgtcaggttgttatgttggatacacgcagcaaagagtcgagactttccgctgaatgacaagagcaaagcggaccttttgggacagcggtg

SEQ ID NO: 431716 - DNA, 140 bp, Artificial Sequence
  Synthetic
caccgctgtcccaaaaggtccgctttgctcttgtcattcagcggaaagtctcgactctttgctgcgtgtatccaacataacaacctgacaatgagtgcctcaaaggagataaagtccttccatatcagcagccagggcct

SEQ ID NO: 431717 - DNA, 140 bp, Artificial Sequence
  Synthetic
aggccctggctgctgatatgaaggcagcaacacagccgagcgcaccatcaaccgaggcgacccagaacacaacacccccaccatacaccccatgatcccaggaccaacgccctcaccctcgaccttttgggacagcggtg

SEQ ID NO: 431718 - DNA, 140 bp, Artificial Sequence
  Synthetic
caccgctgtcccaaaaggtcgagggtgagggcgttggtcctgggatcatggggtgtatggtgggggtgttgtgttctgggtcgcctcggttgatggtgcgctcggctgtgttgctgccttcatatcagcagccagggcct

SEQ ID NO: 431719 - DNA, 140 bp, Artificial Sequence
  Synthetic
aggccctggctgctgatatgtctctttgtttggtccccgaacacatttgctgcctaatgttctacataatcccacaaagccagatgcaatggaactttggaatgcagatttgttgatagcgaccttttgggacagcggtg

SEQ ID NO: 431720 - DNA, 140 bp, Artificial Sequence
  Synthetic
caccgctgtcccaaaaggtcgctatcaacaaatctgcattccaaagttccattgcatctggctttgtgggattatgtagaacattaggcagcaaatgtgttcggggaccaaacaaagagacatatcagcagccagggcct

SEQ ID NO: 431721 - DNA, 140 bp, Artificial Sequence
  Synthetic
aggccctggctgctgatatgcatcgccgagttgctgtattggagacacgcagcaaaaagctgaaactatctgccaaaatgacaaaagcaaagcgcaatccaatagcctaggatccactgtgaccttttgggacagcggtg

SEQ ID NO: 431722 - DNA, 140 bp, Artificial Sequence
  Synthetic
caccgctgtcccaaaaggtcacagtggatcctaggctattggattgcgctttgcttttgtcattttggcagatagtttcagctttttgctgcgtgtctccaatacagcaactcggcgatgcatatcagcagccagggcct

SEQ ID NO: 431723 - DNA, 140 bp, Artificial Sequence
  Synthetic
atacgccatgctgggtctcccgcaccggggatcctaggcaatttggttgtttcttttttgtggccttgtgtgctgaactcctccaaatgggaaacaagcaagccaaaaccccagaaataacgtacttgggagtcggccat

SEQ ID NO: 431724 - DNA, 140 bp, Artificial Sequence
  Synthetic
atggccgactcccaagtacgttatttctggggttttggcttgcttgtttcccatttggaggagttcagcacacaaggccacaaaaaagaaacaaccaaattgcctaggatccccggtgcgggagacccagcatggcgtat

SEQ ID NO: 431725 - DNA, 140 bp, Artificial Sequence
  Synthetic
atacgccatgctgggtctccatgagatctttagcattagcaatgtcttcctccatcgccaattgtggcgcctgtgttagatttgggtttgtgctagaatgacttgtgggtcaactggtggcgtacttgggagtcggccat

SEQ ID NO: 431726 - DNA, 140 bp, Artificial Sequence
  Synthetic
atggccgactcccaagtacgccaccagttgacccacaagtcattctagcacaaacccaaatctaacacaggcgccacaattggcgatggaggaagacattgctaatgctaaagatctcatggagacccagcatggcgtat

SEQ ID NO: 431727 - DNA, 140 bp, Artificial Sequence
  Synthetic
aggccctggctgctgatatgctgtgttagatttgggtttgtgctagaatgacttgtgggtcaactggtggtgccccacaaaagctcctacagaaatgagagacaatatgcctaggatcctgaccttttgggacagcggtg

SEQ ID NO: 431728 - DNA, 140 bp, Artificial Sequence
  Synthetic
caccgctgtcccaaaaggtcaggatcctaggcatattgtctctcatttctgtaggagcttttgtggggcaccaccagttgacccacaagtcattctagcacaaacccaaatctaacacagcatatcagcagccagggcct

SEQ ID NO: 431729 - DNA, 140 bp, Artificial Sequence
  Synthetic
aggccctggctgctgatatggctttaatgagtatcatttcaaccttccacttatccattcctaactttaatcagtatgaagcaatgagttgtgacttcaatggggggaagataagtgttcgaccttttgggacagcggtg

SEQ ID NO: 431730 - DNA, 140 bp, Artificial Sequence
  Synthetic
caccgctgtcccaaaaggtcgaacacttatcttccccccattgaagtcacaactcattgcttcatactgattaaagttaggaatggataagtggaaggttgaaatgatactcattaaagccatatcagcagccagggcct

SEQ ID NO: 431731 - DNA, 140 bp, Artificial Sequence
  Synthetic
atacgccatgctgggtctcctcagtatgaagcaatgagttgtgacttcaatggggggaagataagtgttcagtacaaccttagccacacttatgctgtagatgcagccaaccactgtgggcgtacttgggagtcggccat

SEQ ID NO: 431732 - DNA, 140 bp, Artificial Sequence
  Synthetic
atggccgactcccaagtacgcccacagtggttggctgcatctacagcataagtgtggctaaggttgtactgaacacttatcttccccccattgaagtcacaactcattgcttcatactgaggagacccagcatggcgtat

SEQ ID NO: 431733 - DNA, 140 bp, Artificial Sequence
  Synthetic
aggccctggctgctgatatgcagttatatagcacttgattccggaaagggaagttgggactgtataatgacttcctaccaatatttgataatccaaaacaccacttgggaagatcactgcgaccttttgggacagcggtg

SEQ ID NO: 431734 - DNA, 140 bp, Artificial Sequence
  Synthetic
caccgctgtcccaaaaggtcgcagtgatcttcccaagtggtgttttggattatcaaatattggtaggaagtcattatacagtcccaacttccctttccggaatcaagtgctatataactgcatatcagcagccagggcct

SEQ ID NO: 431735 - DNA, 140 bp, Artificial Sequence
  Synthetic
aggccctggctgctgatatgggtgaacagggacaccattcgcaaccgactgatcaatgattgtgtcaattgtttctgccagctggtgtggctctttacactttatattgtgaagagctgcgaccttttgggacagcggtg

SEQ ID NO: 431736 - DNA, 140 bp, Artificial Sequence
  Synthetic
caccgctgtcccaaaaggtcgcagctcttcacaatataaagtgtaaagagccacaccagctggcagaaacaattgacacaatcattgatcagtcggttgcgaatggtgtccctgttcacccatatcagcagccagggcct

SEQ ID NO: 431737 - DNA, 140 bp, Artificial Sequence
  Synthetic
aggccctggctgctgatatgttcccacaagcctcccctatgcacaaccagagggactggttcaatacagggacccaccaacacaaagtcatactctgtaaactgcaacttttccacatcagaccttttgggacagcggtg

SEQ ID NO: 431738 - DNA, 140 bp, Artificial Sequence
  Synthetic
caccgctgtcccaaaaggtctgatgtggaaaagttgcagtttacagagtatgactttgtgttggtgggtccctgtattgaaccagtccctctggttgtgcataggggaggcttgtgggaacatatcagcagccagggcct

SEQ ID NO: 431739 - DNA, 140 bp, Artificial Sequence
  Synthetic
atacgccatgctgggtctccgagatatatatattagtaggagactactgggcacatttacatggacattgtcagattctgaaggtaaggacacaccaggagggtattgtctaaccagatgcgtacttgggagtcggccat

SEQ ID NO: 431740 - DNA, 140 bp, Artificial Sequence
  Synthetic
atggccgactcccaagtacgcatctggttagacaataccctcctggtgtgtccttaccttcagaatctgacaatgtccatgtaaatgtgcccagtagtctcctactaatatatatatctcggagacccagcatggcgtat

SEQ ID NO: 431741 - DNA, 140 bp, Artificial Sequence
  Synthetic
atacgccatgctgggtctccaaactcattaataacctcggtgtcaacaaaccatgctgatgtgcccttaaaagtaggtcctgacaagaccaacctccagcagtctgacaaaacacacggacgtacttgggagtcggccat

SEQ ID NO: 431742 - DNA, 140 bp, Artificial Sequence
  Synthetic
atggccgactcccaagtacgtccgtgtgttttgtcagactgctggaggttggtcttgtcaggacctacttttaagggcacatcagcatggtttgttgacaccgaggttattaatgagtttggagacccagcatggcgtat

SEQ ID NO: 431743 - DNA, 140 bp, Artificial Sequence
  Synthetic
aggccctggctgctgatatgaaatccctgaatcaaagcacctagtcaaaatgggcaacagacaggccaaatcgacaaaagtcgatgaacatcaaagagctcatctagtgccagatgcatcgaccttttgggacagcggtg

SEQ ID NO: 431744 - DNA, 140 bp, Artificial Sequence
  Synthetic
caccgctgtcccaaaaggtcgatgcatctggcactagatgagctctttgatgttcatcgacttttgtcgatttggcctgtctgttgcccattttgactaggtgctttgattcagggatttcatatcagcagccagggcct

SEQ ID NO: 431745 - DNA, 140 bp, Artificial Sequence
  Synthetic
aggccctggctgctgatatgccttcagactagagctccagacccagccgacagcaccaccagaaatcccaccatcccaaaatcccccaccctacagcccctgaggcagaactccgccccggaccttttgggacagcggtg

SEQ ID NO: 431746 - DNA, 140 bp, Artificial Sequence
  Synthetic
caccgctgtcccaaaaggtccggggcggagttctgcctcaggggctgtagggtgggggattttgggatggtgggatttctggtggtgctgtcggctgggtctggagctctagtctgaaggcatatcagcagccagggcct

SEQ ID NO: 431747 - DNA, 140 bp, Artificial Sequence
  Synthetic
aggccctggctgctgatatggcatgcatcgtcccacaacccctataatatcaagttgtagccagtgtagtccttggtccattctggatctcagcatcttgctcaaagatctctccaagatgaccttttgggacagcggtg

SEQ ID NO: 431748 - DNA, 140 bp, Artificial Sequence
  Synthetic
caccgctgtcccaaaaggtcatcttggagagatctttgagcaagatgctgagatccagaatggaccaaggactacactggctacaacttgatattataggggttgtgggacgatgcatgccatatcagcagccagggcct

SEQ ID NO: 431749 - DNA, 140 bp, Artificial Sequence
  Synthetic
aggccctggctgctgatatgcttgttgacactgcctttgtcaactctccaataggacattgtgacatatgtccacagtaaaaatacttctccttcaacctactattctcatagacagcatgaccttttgggacagcggtg

SEQ ID NO: 431750 - DNA, 140 bp, Artificial Sequence
  Synthetic
caccgctgtcccaaaaggtcatgctgtctatgagaatagtaggttgaaggagaagtatttttactgtggacatatgtcacaatgtcctattggagagttgacaaaggcagtgtcaacaagcatatcagcagccagggcct

SEQ ID NO: 431751 - DNA, 140 bp, Artificial Sequence
  Synthetic
aggccctggctgctgatatgtagggcctgagcccagcttgacaggttccctatactgatcaacaatcttttcaacagtttcctttagctgatcaaaatactcgcttgcacctccatcgaggaccttttgggacagcggtg

SEQ ID NO: 431752 - DNA, 140 bp, Artificial Sequence
  Synthetic
caccgctgtcccaaaaggtcctcgatggaggtgcaagcgagtattttgatcagctaaaggaaactgttgaaaagattgttgatcagtatagggaacctgtcaagctgggctcaggccctacatatcagcagccagggcct

SEQ ID NO: 431753 - DNA, 140 bp, Artificial Sequence
  Synthetic
aggccctggctgctgatatgaagagaggtgctcactagacagatagtttgttgtaaactcttcatggagttgcccagtcttcaacctgttgtacaatttcctcaacatagatctgatcttgaccttttgggacagcggtg

SEQ ID NO: 431754 - DNA, 140 bp, Artificial Sequence
  Synthetic
caccgctgtcccaaaaggtcaagatcagatctatgttgaggaaattgtacaacaggttgaagactgggcaactccatgaagagtttacaacaaactatctgtctagtgagcacctctcttcatatcagcagccagggcct

SEQ ID NO: 431755 - DNA, 140 bp, Artificial Sequence
  Synthetic
aggccctggctgctgatatgactactcaatgtcctcaatgcattcatccttcctagttaactcctcacatgttctgcccttcagtctcaatctgccaccacttgactgtaccatcaccttgaccttttgggacagcggtg

SEQ ID NO: 431756 - DNA, 140 bp, Artificial Sequence
  Synthetic
caccgctgtcccaaaaggtcaaggtgatggtacagtcaagtggtggcagattgagactgaagggcagaacatgtgaggagttaactaggaaggatgaatgcattgaggacattgagtagtcatatcagcagccagggcct

SEQ ID NO: 431757 - DNA, 140 bp, Artificial Sequence
  Synthetic
aggccctggctgctgatatgctccaccacccaccccccacccccggggggaccccccgccgggggcccccccgggggggcaggcagcccagctctactcaatgtcctcaatacacttctcgaccttttgggacagcggtg

SEQ ID NO: 431758 - DNA, 140 bp, Artificial Sequence
  Synthetic
caccgctgtcccaaaaggtcgagaagtgtattgaggacattgagtagagctgggctgcctgcccccccgggggggcccccggcggggggtccccccgggggtggggggtgggtggtggagcatatcagcagccagggcct

SEQ ID NO: 431759 - DNA, 140 bp, Artificial Sequence
  Synthetic
aggccctggctgctgatatgctccaccatacaccccataatcccaggaccaacactcccacctccatcacccaccccccacccccggggggaccccccgccgggggcccccccggggggcgaccttttgggacagcggtg

SEQ ID NO: 431760 - DNA, 140 bp, Artificial Sequence
  Synthetic
caccgctgtcccaaaaggtcgccccccgggggggcccccggcggggggtccccccgggggtggggggtgggtgatggaggtgggagtgttggtcctgggattatggggtgtatggtggagcatatcagcagccagggcct

SEQ ID NO: 431761 - DNA, 140 bp, Artificial Sequence
  Synthetic
atacgccatgctgggtctccatcctaggcaattcagctggacttcagtggtagggcttatcttagtgaatccctgaatcaaagtgcctagccaaaatgggcaacagacaagccaaatcgacgtacttgggagtcggccat

SEQ ID NO: 431762 - DNA, 140 bp, Artificial Sequence
  Synthetic
atggccgactcccaagtacgtcgatttggcttgtctgttgcccattttggctaggcactttgattcagggattcactaagataagccctaccactgaagtccagctgaattgcctaggatggagacccagcatggcgtat

SEQ ID NO: 431763 - DNA, 140 bp, Artificial Sequence
  Synthetic
aggccctggctgctgatatgaggcaacccagccctactcaatgtcctcaatgcacttctccggcccaaacaactctgaacatgtccttcccttcagtcttaggctgcccccacttgactggaccttttgggacagcggtg

SEQ ID NO: 431764 - DNA, 140 bp, Artificial Sequence
  Synthetic
caccgctgtcccaaaaggtccagtcaagtgggggcagcctaagactgaagggaaggacatgttcagagttgtttgggccggagaagtgcattgaggacattgagtagggctgggttgcctcatatcagcagccagggcct

SEQ ID NO: 431765 - DNA, 140 bp, Artificial Sequence
  Synthetic
aggccctggctgctgatatgctttatatgataaagaaaatttaagccttcctgtgtcaggtcccacagagtcataagattgtggcgactcttggctgtaaaaacacaagttctttaacatgaccttttgggacagcggtg

SEQ ID NO: 431766 - DNA, 140 bp, Artificial Sequence
  Synthetic
caccgctgtcccaaaaggtcatgttaaagaacttgtgtttttacagccaagagtcgccacaatcttatgactctgtgggacctgacacaggaaggcttaaattttctttatcatataaagcatatcagcagccagggcct

SEQ ID NO: 431767 - DNA, 140 bp, Artificial Sequence
  Synthetic
aggccctggctgctgatatggcgtcagcagcagatgcccgatctgcaagatgccccttcccaccaagctaaaggcagcaacacagccgagcgcaccatcaactgaggcgacccagaacacgaccttttgggacagcggtg

SEQ ID NO: 431768 - DNA, 140 bp, Artificial Sequence
  Synthetic
caccgctgtcccaaaaggtcgtgttctgggtcgcctcagttgatggtgcgctcggctgtgttgctgcctttagcttggtgggaaggggcatcttgcagatcgggcatctgctgctgacgccatatcagcagccagggcct

SEQ ID NO: 431769 - DNA, 140 bp, Artificial Sequence
  Synthetic
atacgccatgctgggtctccaaatcttgatcttggatagatggtgtgaatgtagctacctttctatcagattcccacagtgcccctctacatacaaccaatggcactggttcgttgtcagcgtacttgggagtcggccat

SEQ ID NO: 431770 - DNA, 140 bp, Artificial Sequence
  Synthetic
atggccgactcccaagtacgctgacaacgaaccagtgccattggttgtatgtagaggggcactgtgggaatctgatagaaaggtagctacattcacaccatctatccaagatcaagatttggagacccagcatggcgtat

SEQ ID NO: 431771 - DNA, 140 bp, Artificial Sequence
  Synthetic
aggccctggctgctgatatgctttgtattcatagtcctgtttgttgagaagatactttccctttcttgagaagacttcagtgagctgcgacacggccagtgctgtgagcttattgaaatcgaccttttgggacagcggtg

SEQ ID NO: 431772 - DNA, 140 bp, Artificial Sequence
  Synthetic
caccgctgtcccaaaaggtcgatttcaataagctcacagcactggccgtgtcgcagctcactgaagtcttctcaagaaagggaaagtatcttctcaacaaacaggactatgaatacaaagcatatcagcagccagggcct

SEQ ID NO: 431773 - DNA, 140 bp, Artificial Sequence
  Synthetic
aggccctggctgctgatatgtctttgatttccctttttacttccctttccttaaatagtgaaccattattgaaagaggacgtaagaagggataaatacttctttgaaacaccaggcttttgaccttttgggacagcggtg

SEQ ID NO: 431774 - DNA, 140 bp, Artificial Sequence
  Synthetic
caccgctgtcccaaaaggtcaaaagcctggtgtttcaaagaagtatttatcccttcttacgtcctctttcaataatggttcactatttaaggaaagggaagtaaaaagggaaatcaaagacatatcagcagccagggcct

SEQ ID NO: 431775 - DNA, 140 bp, Artificial Sequence
  Synthetic
aggccctggctgctgatatggcatcctaggctctgtctgcacaagaaatgccaacttctgtcttgataacctctcattatccactaggtactttgatactaagtctttgacataggctatgaccttttgggacagcggtg

SEQ ID NO: 431776 - DNA, 140 bp, Artificial Sequence
  Synthetic
caccgctgtcccaaaaggtcatagcctatgtcaaagacttagtatcaaagtacctagtggataatgagaggttatcaagacagaagttggcatttcttgtgcagacagagcctaggatgccatatcagcagccagggcct

SEQ ID NO: 431777 - DNA, 140 bp, Artificial Sequence
  Synthetic
aggccctggctgctgatatgaagtggcacatgtaggagatgttcaagatgaacttgaacctattagtcatcatgctcttcacatcctcagataaaactaaattcatcaatgtccttatcagaccttttgggacagcggtg

SEQ ID NO: 431778 - DNA, 140 bp, Artificial Sequence
  Synthetic
caccgctgtcccaaaaggtctgataaggacattgatgaatttagttttatctgaggatgtgaagagcatgatgactaataggttcaagttcatcttgaacatctcctacatgtgccacttcatatcagcagccagggcct

SEQ ID NO: 431779 - DNA, 140 bp, Artificial Sequence
  Synthetic
aggccctggctgctgatatgatcgccagattgttgtgttaaatgcacgcaacaagaggctgagaatgtctgctgaaatgacaaaagcaaagcgcaatccaatagcctaggatccactgtggaccttttgggacagcggtg

SEQ ID NO: 431780 - DNA, 140 bp, Artificial Sequence
  Synthetic
caccgctgtcccaaaaggtccacagtggatcctaggctattggattgcgctttgcttttgtcatttcagcagacattctcagcctcttgttgcgtgcatttaacacaacaatctggcgatcatatcagcagccagggcct

SEQ ID NO: 431781 - DNA, 140 bp, Artificial Sequence
  Synthetic
atacgccatgctgggtctccatttaggattgcgctttttggagacctttgtgtgagtgggcttcatcaagccatgggacaaatcataacatttttccaggaagtacctcatgttatagagcgtacttgggagtcggccat

SEQ ID NO: 431782 - DNA, 140 bp, Artificial Sequence
  Synthetic
atggccgactcccaagtacgctctataacatgaggtacttcctggaaaaatgttatgatttgtcccatggcttgatgaagcccactcacacaaaggtctccaaaaagcgcaatcctaaatggagacccagcatggcgtat

SEQ ID NO: 431783 - DNA, 140 bp, Artificial Sequence
  Synthetic
atacgccatgctgggtctccgatcctaggcaatttagctagacttcagtggtaaggctcatttttagtgaatccctgaatcaagtgcccagccgaaatgggcaacagacagaccaaaccacgtacttgggagtcggccat

SEQ ID NO: 431784 - DNA, 140 bp, Artificial Sequence
  Synthetic
atggccgactcccaagtacgtggtttggtctgtctgttgcccatttcggctgggcacttgattcagggattcactaaaaatgagccttaccactgaagtctagctaaattgcctaggatcggagacccagcatggcgtat

SEQ ID NO: 431785 - DNA, 140 bp, Artificial Sequence
  Synthetic
aggccctggctgctgatatgagtacaaccttagccacacttatgctgtagatgcagctaaccactgtgggactattgccaatggcgttcttcagactttcatgaggatggcttggggtgggaccttttgggacagcggtg

SEQ ID NO: 431786 - DNA, 140 bp, Artificial Sequence
  Synthetic
caccgctgtcccaaaaggtcccaccccaagccatcctcatgaaagtctgaagaacgccattggcaatagtcccacagtggttagctgcatctacagcataagtgtggctaaggttgtactcatatcagcagccagggcct

SEQ ID NO: 431787 - DNA, 140 bp, Artificial Sequence
  Synthetic
aggccctggctgctgatatgccagtttttaatttattgaacaatatcctaagcattgacctcatctttttgcatgcatcaggaatcagcctctcaatttgcctcattatcctataactacgaccttttgggacagcggtg

SEQ ID NO: 431788 - DNA, 140 bp, Artificial Sequence
  Synthetic
caccgctgtcccaaaaggtcgtagttataggataatgaggcaaattgagaggctgattcctgatgcatgcaaaaagatgaggtcaatgcttaggatattgttcaataaattaaaaactggcatatcagcagccagggcct

SEQ ID NO: 431789 - DNA, 140 bp, Artificial Sequence
  Synthetic
aggccctggctgctgatatggtcagaatcagacaaaggttcaatgcctaaaagtttaaacaaattctgtaatgatgttgtgtgttcacctgataggtagttggtagtgaattcctcatgagaccttttgggacagcggtg

SEQ ID NO: 431790 - DNA, 140 bp, Artificial Sequence
  Synthetic
caccgctgtcccaaaaggtctcatgaggaattcactaccaactacctatcaggtgaacacacaacatcattacagaatttgtttaaacttttaggcattgaacctttgtctgattctgaccatatcagcagccagggcct

SEQ ID NO: 431791 - DNA, 140 bp, Artificial Sequence
  Synthetic
aggccctggctgctgatatgtttcctccttgtgttcaatatcctcagagatttcactttatttagaaatgatctccagcattgcacctgacactctccagtagtttggttttccccttctgaccttttgggacagcggtg

SEQ ID NO: 431792 - DNA, 140 bp, Artificial Sequence
  Synthetic
caccgctgtcccaaaaggtcagaaggggaaaaccaaactactggagagtgtcaggtgcaatgctggagatcatttctaaataaagtgaaatctctgaggatattgaacacaaggaggaaacatatcagcagccagggcct

SEQ ID NO: 431793 - DNA, 140 bp, Artificial Sequence
  Synthetic
aggccctggctgctgatatgccaaacatagaaccttgatttgaactctgcaacaaacctgccaattgcactctttggactcacaaatttatttagctgatcactcatgtagtaatggaatgaccttttgggacagcggtg

SEQ ID NO: 431794 - DNA, 140 bp, Artificial Sequence
  Synthetic
caccgctgtcccaaaaggtcattccattactacatgagtgatcagctaaataaatttgtgagtccaaagagtgcaattggcaggtttgttgcagagttcaaatcaaggttctatgtttggcatatcagcagccagggcct

SEQ ID NO: 431795 - DNA, 140 bp, Artificial Sequence
  Synthetic
atacgccatgctgggtctcctctcttgaactgatagattaaatgttcaatgtcatcctctgcagctactttatcagtgtacaagttattaagctcattaagtaatcggctcttgtcgacccgtacttgggagtcggccat

SEQ ID NO: 431796 - DNA, 140 bp, Artificial Sequence
  Synthetic
atggccgactcccaagtacgggtcgacaagagccgattacttaatgagcttaataacttgtacactgataaagtagctgcagaggatgacattgaacatttaatctatcagttcaagagaggagacccagcatggcgtat

SEQ ID NO: 431797 - DNA, 140 bp, Artificial Sequence
  Synthetic
aggccctggctgctgatatgatccatactatatgatacatgtgccgatgagacattcagcttcattgacaaaatggcattgtcaaactccttctcattgtttagacagctgcctgctaatgaccttttgggacagcggtg

SEQ ID NO: 431798 - DNA, 140 bp, Artificial Sequence
  Synthetic
caccgctgtcccaaaaggtcattagcaggcagctgtctaaacaatgagaaggagtttgacaatgccattttgtcaatgaagctgaatgtctcatcggcacatgtatcatatagtatggatcatatcagcagccagggcct

SEQ ID NO: 431799 - DNA, 140 bp, Artificial Sequence
  Synthetic
atacgccatgctgggtctccgcaggagatgatctgacaaagcactccagtaatattaggacattgcccgtcagtttgtaaccgtccggtaccacaaaacacaatgaaggggtcaagactccgtacttgggagtcggccat

SEQ ID NO: 431800 - DNA, 140 bp, Artificial Sequence
  Synthetic
atggccgactcccaagtacggagtcttgaccccttcattgtgttttgtggtaccggacggttacaaactgacgggcaatgtcctaatattactggagtgctttgtcagatcatctcctgcggagacccagcatggcgtat

SEQ ID NO: 431801 - DNA, 140 bp, Artificial Sequence
  Synthetic
aggccctggctgctgatatgcaacccttccattaatagcatcctaggctctgtctgtacaagaaatgccaacttctgtcttgacaacctctcgttgtccactaggtacttcgatactagagaccttttgggacagcggtg

SEQ ID NO: 431802 - DNA, 140 bp, Artificial Sequence
  Synthetic
caccgctgtcccaaaaggtctctagtatcgaagtacctagtggacaacgagaggttgtcaagacagaagttggcatttcttgtacagacagagcctaggatgctattaatggaagggttgcatatcagcagccagggcct

SEQ ID NO: 431803 - DNA, 140 bp, Artificial Sequence
  Synthetic
atacgccatgctgggtctcctcgaaaccctcagggcatatggtctgccagaacaacagttcactataggacaaaatcctgtaaaaggcacagaagaaacaaaaggcaattaaagacaattcgtacttgggagtcggccat

SEQ ID NO: 431804 - DNA, 140 bp, Artificial Sequence
  Synthetic
atggccgactcccaagtacgaattgtctttaattgccttttgtttcttctgtgccttttacaggattttgtcctatagtgaactgttgttctggcagaccatatgccctgagggtttcgaggagacccagcatggcgtat

SEQ ID NO: 431805 - DNA, 140 bp, Artificial Sequence
  Synthetic
atacgccatgctgggtctcccatcagccgccccgacggcacccccagccggagcagcagacatcaccagacccccaccctacagtccctgaacctgccatcgacccccaccacctccacccgtacttgggagtcggccat

SEQ ID NO: 431806 - DNA, 140 bp, Artificial Sequence
  Synthetic
atggccgactcccaagtacgggtggaggtggtgggggtcgatggcaggttcagggactgtagggtgggggtctggtgatgtctgctgctccggctgggggtgccgtcggggcggctgatgggagacccagcatggcgtat

SEQ ID NO: 431807 - DNA, 140 bp, Artificial Sequence
  Synthetic
  misc_feature (22)..(22): n is a, c, g, or t
atacgccatgctgggtctccgngccaaccacctccaagaaactattcaatgtcctcgatgcattcatccttcgcagttaactcctcacatgttctgcccttcaatctcaatctaccactgcgtacttgggagtcggccat

SEQ ID NO: 431808 - DNA, 140 bp, Artificial Sequence
  Synthetic
  misc_feature (119)..(119): n is a, c, g, or t
atggccgactcccaagtacgcagtggtagattgagattgaagggcagaacatgtgaggagttaactgcgaaggatgaatgcatcgaggacattgaatagtttcttggaggtggttggcncggagacccagcatggcgtat

SEQ ID NO: 431809 - DNA, 140 bp, Artificial Sequence
  Synthetic
aggccctggctgctgatatgctcgatcaaaatcttctatcatatggtttgaaagttcactttttatcaaccttattaagagtttttcttccaccaccttgtcaagatcagatattgaggggaccttttgggacagcggtg

SEQ ID NO: 431810 - DNA, 140 bp, Artificial Sequence
  Synthetic
caccgctgtcccaaaaggtcccctcaatatctgatcttgacaaggtggtggaagaaaaactcttaataaggttgataaaaagtgaactttcaaaccatatgatagaagattttgatcgagcatatcagcagccagggcct

SEQ ID NO: 431811 - DNA, 140 bp, Artificial Sequence
  Synthetic
atacgccatgctgggtctcccttattaagagtttttcttccaccaccttgtcaagatcagatattgagggtgcattgcagtctgcctgctgctgtctttctggttgctccctatactgaccgtacttgggagtcggccat

SEQ ID NO: 431812 - DNA, 140 bp, Artificial Sequence
  Synthetic
atggccgactcccaagtacggtcagtatagggagcaaccagaaagacagcagcaggcagactgcaatgcaccctcaatatctgatcttgacaaggtggtggaagaaaaactcttaataagggagacccagcatggcgtat

SEQ ID NO: 431813 - DNA, 140 bp, Artificial Sequence
  Synthetic
aggccctggctgctgatatgatataagatctttggcattggcaatatcttcctccatcaccagttacagtatctgaactaggttcaaacttgtgtttgtatggcttgtagatcagccaatgaccttttgggacagcggtg

SEQ ID NO: 431814 - DNA, 140 bp, Artificial Sequence
  Synthetic
caccgctgtcccaaaaggtcattggctgatctacaagccatacaaacacaagtttgaacctagttcagatactgtaactggtgatggaggaagatattgccaatgccaaagatcttatatcatatcagcagccagggcct

SEQ ID NO: 431815 - DNA, 140 bp, Artificial Sequence
  Synthetic
atacgccatgctgggtctcctatacctaactttttccgcatctgcacaacattctttacttagaaactttcttgcattataaaccatttcagcaagctcttcctccgatgcatcatccttcgtacttgggagtcggccat

SEQ ID NO: 431816 - DNA, 140 bp, Artificial Sequence
  Synthetic
atggccgactcccaagtacgaaggatgatgcatcggaggaagagcttgctgaaatggtttataatgcaagaaagtttctaagtaaagaatgttgtgcagatgcggaaaaagttaggtataggagacccagcatggcgtat

SEQ ID NO: 431817 - DNA, 140 bp, Artificial Sequence
  Synthetic
aggccctggctgctgatatgatcctaggcaatttagctggacttcagtggtaaaactcattttggtgaatccctgaatcaagtgcccagttagaatgggtaacagacaggccaaatcaacgaccttttgggacagcggtg

SEQ ID NO: 431818 - DNA, 140 bp, Artificial Sequence
  Synthetic
caccgctgtcccaaaaggtcgttgatttggcctgtctgttacccattctaactgggcacttgattcagggattcaccaaaatgagttttaccactgaagtccagctaaattgcctaggatcatatcagcagccagggcct

SEQ ID NO: 431819 - DNA, 140 bp, Artificial Sequence
  Synthetic
aggccctggctgctgatatggcacctccaccgtatgccccatgatcccaggaccaacactctcttctctatcaccctccccccacccccggggggaccccccgccgggggcccccccggggaccttttgggacagcggtg

SEQ ID NO: 431820 - DNA, 140 bp, Artificial Sequence
  Synthetic
caccgctgtcccaaaaggtccccgggggggcccccggcggggggtccccccgggggtggggggagggtgatagagaagagagtgttggtcctgggatcatggggcatacggtggaggtgccatatcagcagccagggcct

SEQ ID NO: 431821 - DNA, 140 bp, Artificial Sequence
  Synthetic
atacgccatgctgggtctccaccgatgtgctcagtcctcctgacactgctgcatcatacatgatgcagtccattagtgcgcagtggggagttatttcctctttaccacctcgcttcttctcgtacttgggagtcggccat

SEQ ID NO: 431822 - DNA, 140 bp, Artificial Sequence
  Synthetic
atggccgactcccaagtacgagaagaagcgaggtggtaaagaggaaataactccccactgcgcactaatggactgcatcatgtatgatgcagcagtgtcaggaggactgagcacatcggtggagacccagcatggcgtat

SEQ ID NO: 431823 - DNA, 140 bp, Artificial Sequence
  Synthetic
aggccctggctgctgatatgtgttgatgatggcaaggagctcacaatttcgttcttctttaagtgataggacacctgcattcctgtctttagttctcttcctgctgtctatccaccgtttgaccttttgggacagcggtg

SEQ ID NO: 431824 - DNA, 140 bp, Artificial Sequence
  Synthetic
caccgctgtcccaaaaggtcaaacggtggatagacagcaggaagagaactaaagacaggaatgcaggtgtcctatcacttaaagaagaacgaaattgtgagctccttgccatcatcaacacatatcagcagccagggcct

SEQ ID NO: 431825 - DNA, 140 bp, Artificial Sequence
  Synthetic
aggccctggctgctgatatgtagatctctttttgttgaatccaatgaaactaatctatcgttaacactcacaaaacaggagcccagccaaccagcaaggggcttgtcaccatgccttatggaccttttgggacagcggtg

SEQ ID NO: 431826 - DNA, 140 bp, Artificial Sequence
  Synthetic
caccgctgtcccaaaaggtccataaggcatggtgacaagccccttgctggttggctgggctcctgttttgtgagtgttaacgatagattagtttcattggattcaacaaaaagagatctacatatcagcagccagggcct

SEQ ID NO: 431827 - DNA, 140 bp, Artificial Sequence
  Synthetic
aggccctggctgctgatatgcaaaacaggagcccagccaaccagcaaggggcttgtcaccatgccttatgcagtccagccggctagcaagaagaatcagaacgtcaaaaataaggagaaggaccttttgggacagcggtg

SEQ ID NO: 431828 - DNA, 140 bp, Artificial Sequence
  Synthetic
caccgctgtcccaaaaggtccttctccttatttttgacgttctgattcttcttgctagccggctggactgcataaggcatggtgacaagccccttgctggttggctgggctcctgttttgcatatcagcagccagggcct

SEQ ID NO: 431829 - DNA, 140 bp, Artificial Sequence
  Synthetic
aggccctggctgctgatatgaccactgcatccttaatcccagcctatctatcatcatatcactcagtgccccaatcagcaggtcagacgaagtgtccccaacctctctcacaaacacctcgaccttttgggacagcggtg

SEQ ID NO: 431830 - DNA, 140 bp, Artificial Sequence
  Synthetic
caccgctgtcccaaaaggtcgaggtgtttgtgagagaggttggggacacttcgtctgacctgctgattggggcactgagtgatatgatgatagataggctgggattaaggatgcagtggtcatatcagcagccagggcct

SEQ ID NO: 431831 - DNA, 140 bp, Artificial Sequence
  Synthetic
aggccctggctgctgatatgccagaatccagatctgcatacaagaacttaaggactggagaggctcttcggaactggaatgttaactgttcaatattgtcatcacaggtgtctattttatgaccttttgggacagcggtg

SEQ ID NO: 431832 - DNA, 140 bp, Artificial Sequence
  Synthetic
caccgctgtcccaaaaggtcataaaatagacacctgtgatgacaatattgaacagttaacattccagttccgaagagcctctccagtccttaagttcttgtatgcagatctggattctggcatatcagcagccagggcct

SEQ ID NO: 431833 - DNA, 140 bp, Artificial Sequence
  Synthetic
atacgccatgctgggtctccgcccagagcacagcacctccaccgtatgccccatgatcttaggaccaacactcccatctctgtcaccctccccccacccccagggggaccccccgccgggcgtacttgggagtcggccat

SEQ ID NO: 431834 - DNA, 140 bp, Artificial Sequence
  Synthetic
atggccgactcccaagtacgcccggcggggggtccccctgggggtggggggagggtgacagagatgggagtgttggtcctaagatcatggggcatacggtggaggtgctgtgctctgggcggagacccagcatggcgtat

SEQ ID NO: 431835 - DNA, 140 bp, Artificial Sequence
  Synthetic
atacgccatgctgggtctccttttgtgcatatgccacataagtagggttgagagatagtccctccctttaatgtcagcctgcaggtcctttgaaaggaaaattaaattctgcaagacagtcgtacttgggagtcggccat

SEQ ID NO: 431836 - DNA, 140 bp, Artificial Sequence
  Synthetic
atggccgactcccaagtacgactgtcttgcagaatttaattttcctttcaaaggacctgcaggctgacattaaagggagggactatctctcaaccctacttatgtggcatatgcacaaaaggagacccagcatggcgtat

SEQ ID NO: 431837 - DNA, 140 bp, Artificial Sequence
  Synthetic
aggccctggctgctgatatgacaatgcattactttcttgtgaatattttaacaaggtgaataaggtgtccctgagtttgtcattcacccaatcaggtatctgttcattgtaaaatgttgtgaccttttgggacagcggtg

SEQ ID NO: 431838 - DNA, 140 bp, Artificial Sequence
  Synthetic
caccgctgtcccaaaaggtcacaacattttacaatgaacagatacctgattgggtgaatgacaaactcagggacaccttattcaccttgttaaaatattcacaagaaagtaatgcattgtcatatcagcagccagggcct

SEQ ID NO: 431839 - DNA, 140 bp, Artificial Sequence
  Synthetic
aggccctggctgctgatatgccattggccttgcaagaatcaatctcaatgcaaagggatagtagtttcaatccttccatgagcaacattctaggttcggtttggaccaaaaaggctaactgaccttttgggacagcggtg

SEQ ID NO: 431840 - DNA, 140 bp, Artificial Sequence
  Synthetic
caccgctgtcccaaaaggtcagttagcctttttggtccaaaccgaacctagaatgttgctcatggaaggattgaaactactatccctttgcattgagattgattcttgcaaggccaatggcatatcagcagccagggcct

SEQ ID NO: 431841 - DNA, 140 bp, Artificial Sequence
  Synthetic
aggccctggctgctgatatgttagcattagcaatgtcttcctccatcaccaattgtggtgcctgtattgggtttgagtttgtaccagaatggcttgtgggtcaactggtgatgccccacagaccttttgggacagcggtg

SEQ ID NO: 431842 - DNA, 140 bp, Artificial Sequence
  Synthetic
caccgctgtcccaaaaggtctgtggggcatcaccagttgacccacaagccattctggtacaaactcaaacccaatacaggcaccacaattggtgatggaggaagacattgctaatgctaacatatcagcagccagggcct

SEQ ID NO: 431843 - DNA, 140 bp, Artificial Sequence
  Synthetic
atacgccatgctgggtctcctgactttagctcaacaaggttgttgactgcttgatttaagtccctcaaccgtttcaagtcattgtcatcccttctctccttgcgcatcaaccgttgaacacgtacttgggagtcggccat

SEQ ID NO: 431844 - DNA, 140 bp, Artificial Sequence
  Synthetic
atggccgactcccaagtacgtgttcaacggttgatgcgcaaggagagaagggatgacaatgacttgaaacggttgagggacttaaatcaagcagtcaacaaccttgttgagctaaagtcaggagacccagcatggcgtat

SEQ ID NO: 431845 - DNA, 140 bp, Artificial Sequence
  Synthetic
atacgccatgctgggtctccgggaagtaatcacaaggattatgtttaaaaaagtccaagatctgagcttgttttggttccccgagcacccatgctccaagttctatagctgtagatagtgcgtacttgggagtcggccat

SEQ ID NO: 431846 - DNA, 140 bp, Artificial Sequence
  Synthetic
atggccgactcccaagtacgcactatctacagctatagaacttggagcatgggtgctcggggaaccaaaacaagctcagatcttggacttttttaaacataatccttgtgattacttcccggagacccagcatggcgtat

SEQ ID NO: 431847 - DNA, 140 bp, Artificial Sequence
  Synthetic
aggccctggctgctgatatgactcatcgccagattgttgtgctggatgtgcacagcagaaagctaagattatctgccaaaatgacaaaagcaaagcgcaatccaatagcctaggatccacgaccttttgggacagcggtg

SEQ ID NO: 431848 - DNA, 140 bp, Artificial Sequence
  Synthetic
caccgctgtcccaaaaggtcgtggatcctaggctattggattgcgctttgcttttgtcattttggcagataatcttagctttctgctgtgcacatccagcacaacaatctggcgatgagtcatatcagcagccagggcct

SEQ ID NO: 431849 - DNA, 140 bp, Artificial Sequence
  Synthetic
atacgccatgctgggtctcccacctgtgttggatttgggcttatgccaatatggcttgtaggtcagctggtgatgccctacaaaaactcctacagaaatgagagacaatatgcctaggatcgtacttgggagtcggccat

SEQ ID NO: 431850 - DNA, 140 bp, Artificial Sequence
  Synthetic
atggccgactcccaagtacgatcctaggcatattgtctctcatttctgtaggagtttttgtagggcatcaccagctgacctacaagccatattggcataagcccaaatccaacacaggtgggagacccagcatggcgtat

SEQ ID NO: 431851 - DNA, 140 bp, Artificial Sequence
  Synthetic
aggccctggctgctgatatgtgaactcctccaaatgggaaacaagcaaaccaaagccccagaagtgaaaggcagtccgagagccagcctgattccagatgctacacacctaggaccacaagaccttttgggacagcggtg

SEQ ID NO: 431852 - DNA, 140 bp, Artificial Sequence
  Synthetic
caccgctgtcccaaaaggtcttgtggtcctaggtgtgtagcatctggaatcaggctggctctcggactgcctttcacttctggggctttggtttgcttgtttcccatttggaggagttcacatatcagcagccagggcct

SEQ ID NO: 431853 - DNA, 140 bp, Artificial Sequence
  Synthetic
atacgccatgctgggtctccgcagtccgagagccagcctgattccagatgctacacacctaggaccacaattctgcaagagctgttggttcgaaaacaagggactggttgagtgtaacaacgtacttgggagtcggccat

SEQ ID NO: 431854 - DNA, 140 bp, Artificial Sequence
  Synthetic
atggccgactcccaagtacgttgttacactcaaccagtcccttgttttcgaaccaacagctcttgcagaattgtggtcctaggtgtgtagcatctggaatcaggctggctctcggactgcggagacccagcatggcgtat

SEQ ID NO: 431855 - DNA, 140 bp, Artificial Sequence
  Synthetic
atacgccatgctgggtctccggtgccccatttgcaagatgccccttcccacaaaactgaaaccatcaaccacaccaacagcacccccaaccggagcagcggacagcatcagacctccacccgtacttgggagtcggccat

SEQ ID NO: 431856 - DNA, 140 bp, Artificial Sequence
  Synthetic
atggccgactcccaagtacgggtggaggtctgatgctgtccgctgctccggttgggggtgctgttggtgtggttgatggtttcagttttgtgggaaggggcatcttgcaaatggggcaccggagacccagcatggcgtat

SEQ ID NO: 431857 - DNA, 140 bp, Artificial Sequence
  Synthetic
atacgccatgctgggtctccctacagtccctgaacctcccaccgaccccaaccactcccactctccccccgacaccccccggggggaccccccgccgggggcccccccgggggagccggccgtacttgggagtcggccat

SEQ ID NO: 431858 - DNA, 140 bp, Artificial Sequence
  Synthetic
atggccgactcccaagtacggccggctcccccgggggggcccccggcggggggtccccccggggggtgtcggggggagagtgggagtggttggggtcggtgggaggttcagggactgtagggagacccagcatggcgtat

SEQ ID NO: 431859 - DNA, 140 bp, Artificial Sequence
  Synthetic
aggccctggctgctgatatgctcattaataatctcggtgtcaacataccatgctgatttgcccttgaaagtaggtcctgacaaaaccagtctccaacagtctgacaagacacacggactcgaccttttgggacagcggtg

SEQ ID NO: 431860 - DNA, 140 bp, Artificial Sequence
  Synthetic
caccgctgtcccaaaaggtcgagtccgtgtgtcttgtcagactgttggagactggttttgtcaggacctactttcaagggcaaatcagcatggtatgttgacaccgagattattaatgagcatatcagcagccagggcct

SEQ ID NO: 431861 - DNA, 140 bp, Artificial Sequence
  Synthetic
aggccctggctgctgatatggacagaatggcattgtcaaactccttctcattatttagacagctgcccgctaattgtgatgtgagcgcttcaaagtaatcctcgatgagccttgtgaacagaccttttgggacagcggtg

SEQ ID NO: 431862 - DNA, 140 bp, Artificial Sequence
  Synthetic
caccgctgtcccaaaaggtctgttcacaaggctcatcgaggattactttgaagcgctcacatcacaattagcgggcagctgtctaaataatgagaaggagtttgacaatgccattctgtccatatcagcagccagggcct

SEQ ID NO: 431863 - DNA, 140 bp, Artificial Sequence
  Synthetic
atacgccatgctgggtctccgatttgttgatagcctcagatagcaatttctgcgcacctcgagtgaaagttgaagacaatttattttggactgttttaacaatggtagggatcttctcatcgtacttgggagtcggccat

SEQ ID NO: 431864 - DNA, 140 bp, Artificial Sequence
  Synthetic
atggccgactcccaagtacgatgagaagatccctaccattgttaaaacagtccaaaataaattgtcttcaactttcactcgaggtgcgcagaaattgctatctgaggctatcaacaaatcggagacccagcatggcgtat

SEQ ID NO: 431865 - DNA, 140 bp, Artificial Sequence
  Synthetic
aggccctggctgctgatatgatagtgttatgcacatataatcccatagaagaggtcttaagtaagagacagcagtatcacctctatctttgacttctggtgaaattttccatatctggatgaccttttgggacagcggtg

SEQ ID NO: 431866 - DNA, 140 bp, Artificial Sequence
  Synthetic
caccgctgtcccaaaaggtcatccagatatggaaaatttcaccagaagtcaaagatagaggtgatactgctgtctcttacttaagacctcttctatgggattatatgtgcataacactatcatatcagcagccagggcct

SEQ ID NO: 431867 - DNA, 140 bp, Artificial Sequence
  Synthetic
aggccctggctgctgatatgttgtaatcataatcctgtttattaagcaaaaatttgcctttacgtgcaaacacttcagtcaactgtgtgacagccaaagctgtaagcttgttaaagtcatgaccttttgggacagcggtg

SEQ ID NO: 431868 - DNA, 140 bp, Artificial Sequence
  Synthetic
caccgctgtcccaaaaggtcatgactttaacaagcttacagctttggctgtcacacagttgactgaagtgtttgcacgtaaaggcaaatttttgcttaataaacaggattatgattacaacatatcagcagccagggcct

SEQ ID NO: 431869 - DNA, 140 bp, Artificial Sequence
  Synthetic
aggccctggctgctgatatgccagtcttcaacctattgtacagtttccttaacatagatctaatcttgctgcaggcagtaggaatcaatccctctatttgtctcataattctataactacgaccttttgggacagcggtg

SEQ ID NO: 431870 - DNA, 140 bp, Artificial Sequence
  Synthetic
caccgctgtcccaaaaggtcgtagttatagaattatgagacaaatagagggattgattcctactgcctgcagcaagattagatctatgttaaggaaactgtacaataggttgaagactggcatatcagcagccagggcct

SEQ ID NO: 431871 - DNA, 140 bp, Artificial Sequence
  Synthetic
aggccctggctgctgatatgtgaagaactcttggcagtaggcctctttgcacctcacaacctggtatctagagggtccaaattcattttgccttagtttcactgtggaagacgttttcatgaccttttgggacagcggtg

SEQ ID NO: 431872 - DNA, 140 bp, Artificial Sequence
  Synthetic
caccgctgtcccaaaaggtcatgaaaacgtcttccacagtgaaactaaggcaaaatgaatttggaccctctagataccaggttgtgaggtgcaaagaggcctactgccaagagttcttcacatatcagcagccagggcct

SEQ ID NO: 431873 - DNA, 140 bp, Artificial Sequence
  Synthetic
atacgccatgctgggtctccctgagcatccttaacaacttgaagttttatgctggagcaataacctgaaagctccctcctcaatgactgtgtccagagaaatgacttcacttccttggaacgtacttgggagtcggccat

SEQ ID NO: 431874 - DNA, 140 bp, Artificial Sequence
  Synthetic
atggccgactcccaagtacgttccaaggaagtgaagtcatttctctggacacagtcattgaggagggagctttcaggttattgctccagcataaaacttcaagttgttaaggatgctcagggagacccagcatggcgtat

SEQ ID NO: 431875 - DNA, 140 bp, Artificial Sequence
  Synthetic
aggccctggctgctgatatggttttctggtaacttatagtgggtgtgataccggagatctcaatgtccatgatggcatcataaacatcacaatcaaggatcttgaaatcaattccataaggaccttttgggacagcggtg

SEQ ID NO: 431876 - DNA, 140 bp, Artificial Sequence
  Synthetic
caccgctgtcccaaaaggtccttatggaattgatttcaagatccttgattgtgatgtttatgatgccatcatggacattgagatctccggtatcacacccactataagttaccagaaaaccatatcagcagccagggcct

SEQ ID NO: 431877 - DNA, 140 bp, Artificial Sequence
  Synthetic
aggccctggctgctgatatgcaaaagtcgatgaacatcaaagagctcatctagtgccagatgcatcccatctaggcccccagttctgcaagagttgctggtttgagaacagagggttggtgaccttttgggacagcggtg

SEQ ID NO: 431878 - DNA, 140 bp, Artificial Sequence
  Synthetic
caccgctgtcccaaaaggtcaccaaccctctgttctcaaaccagcaactcttgcagaactgggggcctagatgggatgcatctggcactagatgagctctttgatgttcatcgacttttgcatatcagcagccagggcct

SEQ ID NO: 431879 - DNA, 140 bp, Artificial Sequence
  Synthetic
aggccctggctgctgatatgtgtggtacagtttgtcagtgacagagccttactaagtgcctctgaattgctctccctttcactgattctcacatcatcagagagcttacccatatcaaacgaccttttgggacagcggtg

SEQ ID NO: 431880 - DNA, 140 bp, Artificial Sequence
  Synthetic
caccgctgtcccaaaaggtcgtttgatatgggtaagctctctgatgatgtgagaatcagtgaaagggagagcaattcagaggcacttagtaaggctctgtcactgacaaactgtaccacacatatcagcagccagggcct

SEQ ID NO: 431881 - DNA, 140 bp, Artificial Sequence
  Synthetic
atacgccatgctgggtctcccatgatcaaagtcctcaaccatgtgatttgataattcagctttaatcaacctaatgtaaaacttatttgagacaacttcatctaggtcatttactgatggcgtacttgggagtcggccat

SEQ ID NO: 431882 - DNA, 140 bp, Artificial Sequence
  Synthetic
atggccgactcccaagtacgccatcagtaaatgacctagatgaagttgtctcaaataagttttacattaggttgattaaagctgaattatcaaatcacatggttgaggactttgatcatgggagacccagcatggcgtat

SEQ ID NO: 431883 - DNA, 140 bp, Artificial Sequence
  Synthetic
aggccctggctgctgatatggcacctccatcgagcaaaatctcgtccaggtcagccccatcagcatcacctttgtgctgtccagatcccagaaccagattgctcattgcctgctgtacttgaccttttgggacagcggtg

SEQ ID NO: 431884 - DNA, 140 bp, Artificial Sequence
  Synthetic
caccgctgtcccaaaaggtcaagtacagcaggcaatgagcaatctggttctgggatctggacagcacaaaggtgatgctgatggggctgacctggacgagattttgctcgatggaggtgccatatcagcagccagggcct

SEQ ID NO: 431885 - DNA, 140 bp, Artificial Sequence
  Synthetic
aggccctggctgctgatatgctcaccacattgattaacaagtcctgtcatgttgagatggatagaaaaagtctctttaaaactagcatcctgactcttgattttatacctaattgtctgggaccttttgggacagcggtg

SEQ ID NO: 431886 - DNA, 140 bp, Artificial Sequence
  Synthetic
caccgctgtcccaaaaggtcccagacaattaggtataaaatcaagagtcaggatgctagttttaaagagactttttctatccatctcaacatgacaggacttgttaatcaatgtggtgagcatatcagcagccagggcct

SEQ ID NO: 431887 - DNA, 140 bp, Artificial Sequence
  Synthetic
aggccctggctgctgatatgaatatctcatccaggtcggccctgtctgtttctacatctttcccttgagaccccaaaaccaaattgctcatagcctgctggactttgtactcatagtcttgaccttttgggacagcggtg

SEQ ID NO: 431888 - DNA, 140 bp, Artificial Sequence
  Synthetic
caccgctgtcccaaaaggtcaagactatgagtacaaagtccagcaggctatgagcaatttggttttggggtctcaagggaaagatgtagaaacagacagggccgacctggatgagatattcatatcagcagccagggcct

SEQ ID NO: 431889 - DNA, 140 bp, Artificial Sequence
  Synthetic
atacgccatgctgggtctccgcacctatgttgggcttgggcttgtacctgtatggtgtgtgggtcagctggcagtgccccacaaaagctcttacagaaatgagagtcaatatgcctaggacgtacttgggagtcggccat

SEQ ID NO: 431890 - DNA, 140 bp, Artificial Sequence
  Synthetic
atggccgactcccaagtacgtcctaggcatattgactctcatttctgtaagagcttttgtggggcactgccagctgacccacacaccatacaggtacaagcccaagcccaacataggtgcggagacccagcatggcgtat

SEQ ID NO: 431891 - DNA, 140 bp, Artificial Sequence
  Synthetic
aggccctggctgctgatatgaaaatgagcacacctcaccaactttattgtcattaatagcatagcacttcgagcactcccctgtcttttgataaaccagttgaaacacagtgtcacccaagaccttttgggacagcggtg

SEQ ID NO: 431892 - DNA, 140 bp, Artificial Sequence
  Synthetic
caccgctgtcccaaaaggtcttgggtgacactgtgtttcaactggtttatcaaaagacaggggagtgctcgaagtgctatgctattaatgacaataaagttggtgaggtgtgctcattttcatatcagcagccagggcct

SEQ ID NO: 431893 - DNA, 140 bp, Artificial Sequence
  Synthetic
aggccctggctgctgatatgcgccaaattgctgtgttggagacacgcagcagaaagttgggactatctgccaaaatgacaaaagcaaagcgcaatccaatagcctaggatccactgtgcggaccttttgggacagcggtg

SEQ ID NO: 431894 - DNA, 140 bp, Artificial Sequence
  Synthetic
caccgctgtcccaaaaggtccgcacagtggatcctaggctattggattgcgctttgcttttgtcattttggcagatagtcccaactttctgctgcgtgtctccaacacagcaatttggcgcatatcagcagccagggcct

SEQ ID NO: 431895 - DNA, 140 bp, Artificial Sequence
  Synthetic
atacgccatgctgggtctccatcaaatcataactgttaaggcaaatcacctccatatcaatcttgtagtgctctacactgattccaacatcctttaaagcagcggtggccttcaaaatggcgtacttgggagtcggccat

SEQ ID NO: 431896 - DNA, 140 bp, Artificial Sequence
  Synthetic
atggccgactcccaagtacgccattttgaaggccaccgctgctttaaaggatgttggaatcagtgtagagcactacaagattgatatggaggtgatttgccttaacagttatgatttgatggagacccagcatggcgtat

SEQ ID NO: 431897 - DNA, 140 bp, Artificial Sequence
  Synthetic
atacgccatgctgggtctccttcccctcaccaacatttgcatacaagaatctcaatattggtgatgctctcttgaactgatgaatcaaatgttcaatattgtcttctgcagccatcctatcgtacttgggagtcggccat

SEQ ID NO: 431898 - DNA, 140 bp, Artificial Sequence
  Synthetic
atggccgactcccaagtacgataggatggctgcagaagacaatattgaacatttgattcatcagttcaagagagcatcaccaatattgagattcttgtatgcaaatgttggtgaggggaaggagacccagcatggcgtat

SEQ ID NO: 431899 - DNA, 140 bp, Artificial Sequence
  Synthetic
aggccctggctgctgatatgagctacgattcccgtccacccaatctcttacatcagtctcgcagttcaaaaggaatggatcaataggatacttggcataacataacaaactcaaagtcctgaccttttgggacagcggtg

SEQ ID NO: 431900 - DNA, 140 bp, Artificial Sequence
  Synthetic
caccgctgtcccaaaaggtcaggactttgagtttgttatgttatgccaagtatcctattgatccattccttttgaactgcgagactgatgtaagagattgggtggacgggaatcgtagctcatatcagcagccagggcct

SEQ ID NO: 431901 - DNA, 140 bp, Artificial Sequence
  Synthetic
aggccctggctgctgatatgaaacaacacctccaccgtacaccccataatcccagaaccaacactcccacctccatcacccaccccccacccccggggggaccccccgccgggggcccccgaccttttgggacagcggtg

SEQ ID NO: 431902 - DNA, 140 bp, Artificial Sequence
  Synthetic
caccgctgtcccaaaaggtcgggggcccccggcggggggtccccccgggggtggggggtgggtgatggaggtgggagtgttggttctgggattatggggtgtacggtggaggtgttgtttcatatcagcagccagggcct

SEQ ID NO: 431903 - DNA, 140 bp, Artificial Sequence
  Synthetic
atacgccatgctgggtctccatagttcactatgggataaggtcctgtaggaggcacaggggacacaagaggtaaataaagacaattaaaatagatagccttaatgcctaggatcctcggtcgtacttgggagtcggccat

SEQ ID NO: 431904 - DNA, 140 bp, Artificial Sequence
  Synthetic
atggccgactcccaagtacgaccgaggatcctaggcattaaggctatctattttaattgtctttatttacctcttgtgtcccctgtgcctcctacaggaccttatcccatagtgaactatggagacccagcatggcgtat

SEQ ID NO: 431905 - DNA, 140 bp, Artificial Sequence
  Synthetic
aggccctggctgctgatatgattccacacagcattccttacctaagaactttttagcgttgtacaccatttcactcaactcatccgactctgcatgatccagaggattgacgctaacatggaccttttgggacagcggtg

SEQ ID NO: 431906 - DNA, 140 bp, Artificial Sequence
  Synthetic
caccgctgtcccaaaaggtccatgttagcgtcaatcctctggatcatgcagagtcggatgagttgagtgaaatggtgtacaacgctaaaaagttcttaggtaaggaatgctgtgtggaatcatatcagcagccagggcct

SEQ ID NO: 431907 - DNA, 140 bp, Artificial Sequence
  Synthetic
aggccctggctgctgatatgatgggttcatgtgtcctgctgtgagacaatctcagttcagatgataacacaatgtaatgttcctctcttttccattttactatgtgtgagacaagagacagaccttttgggacagcggtg

SEQ ID NO: 431908 - DNA, 140 bp, Artificial Sequence
  Synthetic
caccgctgtcccaaaaggtctgtctcttgtctcacacatagtaaaatggaaaagagaggaacattacattgtgttatcatctgaactgagattgtctcacagcaggacacatgaacccatcatatcagcagccagggcct

SEQ ID NO: 431909 - DNA, 140 bp, Artificial Sequence
  Synthetic
aggccctggctgctgatatgatgggaaacaaacaagccaaggtcccagaatcaaaagacagcccgagagccagcctaatcccagatgccacacatttagggccgcaattctgtaagagttgaccttttgggacagcggtg

SEQ ID NO: 431910 - DNA, 140 bp, Artificial Sequence
  Synthetic
caccgctgtcccaaaaggtcaactcttacagaattgcggccctaaatgtgtggcatctgggattaggctggctctcgggctgtcttttgattctgggaccttggcttgtttgtttcccatcatatcagcagccagggcct

SEQ ID NO: 431911 - DNA, 140 bp, Artificial Sequence
  Synthetic
aggccctggctgctgatatgtgagcttcagactctggaactaaacatggagacactcaatatgaccatgcctctctcctgcacaaagaacaacagtcatcattatataatggtgggcaatgaccttttgggacagcggtg

SEQ ID NO: 431912 - DNA, 140 bp, Artificial Sequence
  Synthetic
caccgctgtcccaaaaggtcattgcccaccattatataatgatgactgttgttctttgtgcaggagagaggcatggtcatattgagtgtctccatgtttagttccagagtctgaagctcacatatcagcagccagggcct

SEQ ID NO: 431913 - DNA, 140 bp, Artificial Sequence
  Synthetic
atacgccatgctgggtctccttcccattagcttattcccattcatcactaataagattgacttaaagcactggaaatattcctggtctaaaaaagtcctagtcactaccgcctttgtcagcgtacttgggagtcggccat

SEQ ID NO: 431914 - DNA, 140 bp, Artificial Sequence
  Synthetic
atggccgactcccaagtacgctgacaaaggcggtagtgactaggacttttttagaccaggaatatttccagtgctttaagtcaatcttattagtgatgaatgggaataagctaatgggaaggagacccagcatggcgtat

SEQ ID NO: 431915 - DNA, 140 bp, Artificial Sequence
  Synthetic
aggccctggctgctgatatgaaatgtaatgagaagcatgatgaggaattttgtgacatgctgaggctgtttgacttcaacaaacaagccattcaaaggttgaaagctgaagcacaaatgagaccttttgggacagcggtg

SEQ ID NO: 431916 - DNA, 140 bp, Artificial Sequence
  Synthetic
caccgctgtcccaaaaggtctcatttgtgcttcagctttcaacctttgaatggcttgtttgttgaagtcaaacagcctcagcatgtcacaaaattcctcatcatgcttctcattacatttcatatcagcagccagggcct

SEQ ID NO: 431917 - DNA, 140 bp, Artificial Sequence
  Synthetic
aggccctggctgctgatatgtctcgcagtgtcttttttacctccttttctttgaacaatgaaccattgttaaaactggacacaaggagtgaaataaatttcttggaaacaccaggcttttgaccttttgggacagcggtg

SEQ ID NO: 431918 - DNA, 140 bp, Artificial Sequence
  Synthetic
caccgctgtcccaaaaggtcaaaagcctggtgtttccaagaaatttatttcactccttgtgtccagttttaacaatggttcattgttcaaagaaaaggaggtaaaaaagacactgcgagacatatcagcagccagggcct

SEQ ID NO: 431919 - DNA, 140 bp, Artificial Sequence
  Synthetic
atacgccatgctgggtctcctgaacgagacccacttttctgatgatattgaacaacaagctgacaacatgatcactgagatgttacagaaggagtatatggagaggcaggggaagacacccgtacttgggagtcggccat

SEQ ID NO: 431920 - DNA, 140 bp, Artificial Sequence
  Synthetic
atggccgactcccaagtacgggtgtcttcccctgcctctccatatactccttctgtaacatctcagtgatcatgttgtcagcttgttgttcaatatcatcagaaaagtgggtctcgttcaggagacccagcatggcgtat

SEQ ID NO: 431921 - DNA, 140 bp, Artificial Sequence
  Synthetic
aggccctggctgctgatatgtctccaacatattgccaccatccagcatgcaagctcctgccttcacagctgcacccaagctaaaattataacctgagatattcaaagagcttttcttggtgaccttttgggacagcggtg

SEQ ID NO: 431922 - DNA, 140 bp, Artificial Sequence
  Synthetic
caccgctgtcccaaaaggtcaccaagaaaagctctttgaatatctcaggttataattttagcttgggtgcagctgtgaaggcaggagcttgcatgctggatggtggcaatatgttggagacatatcagcagccagggcct

SEQ ID NO: 431923 - DNA, 140 bp, Artificial Sequence
  Synthetic
atacgccatgctgggtctccgctcctgccttcacagctgcacccaagctaaaattataacctgagatattcaaagagctttttttggtgtcaatcatattcaggatggggtgactttgagcgtacttgggagtcggccat

SEQ ID NO: 431924 - DNA, 140 bp, Artificial Sequence
  Synthetic
atggccgactcccaagtacgctcaaagtcaccccatcctgaatatgattgacaccaaaaaaagctctttgaatatctcaggttataattttagcttgggtgcagctgtgaaggcaggagcggagacccagcatggcgtat

SEQ ID NO: 431925 - DNA, 140 bp, Artificial Sequence
  Synthetic
aggccctggctgctgatatgtcacgggggcgtccatttacagaacgactctaggtgtcgatgttctgaacaccatatctctgggcagcactgctctcaaaaccgatgtgttcagtcctccgaccttttgggacagcggtg

SEQ ID NO: 431926 - DNA, 140 bp, Artificial Sequence
  Synthetic
caccgctgtcccaaaaggtcggaggactgaacacatcggttttgagagcagtgctgcccagagatatggtgttcagaacatcgacacctagagtcgttctgtaaatggacgcccccgtgacatatcagcagccagggcct

SEQ ID NO: 431927 - DNA, 140 bp, Artificial Sequence
  Synthetic
atacgccatgctgggtctccacctgtgttgggtttgggtttatgccaatatggcttgtgggtcggctggtgatgtcctaaagaagctcctacagaaatgagagacaatatgcctaggatccgtacttgggagtcggccat

SEQ ID NO: 431928 - DNA, 140 bp, Artificial Sequence
  Synthetic
atggccgactcccaagtacggatcctaggcatattgtctctcatttctgtaggagcttctttaggacatcaccagccgacccacaagccatattggcataaacccaaacccaacacaggtggagacccagcatggcgtat

SEQ ID NO: 431929 - DNA, 140 bp, Artificial Sequence
  Synthetic
aggccctggctgctgatatgcaccaactaagttgttgtttaccgcataacattttgaacactcgcccgttttttgataaagtaagctatattccactccatctatgaagaactgttgacagaccttttgggacagcggtg

SEQ ID NO: 431930 - DNA, 140 bp, Artificial Sequence
  Synthetic
caccgctgtcccaaaaggtctgtcaacagttcttcatagatggagtggaatatagcttactttatcaaaaaacgggcgagtgttcaaaatgttatgcggtaaacaacaacttagttggtgcatatcagcagccagggcct

SEQ ID NO: 431931 - DNA, 140 bp, Artificial Sequence
  Synthetic
aggccctggctgctgatatgtccttgacttgtaatgagtgtacctccccataagtgtattcgcattcatgatcaagagtatggacttaaaacactgaaaatactcatggtcaaagtatgtgaccttttgggacagcggtg

SEQ ID NO: 431932 - DNA, 140 bp, Artificial Sequence
  Synthetic
caccgctgtcccaaaaggtcacatactttgaccatgagtattttcagtgttttaagtccatactcttgatcatgaatgcgaatacacttatggggaggtacactcattacaagtcaaggacatatcagcagccagggcct

SEQ ID NO: 431933 - DNA, 140 bp, Artificial Sequence
  Synthetic
aggccctggctgctgatatgatagcacttgattctggaaagggaagctgggattgcataatgacttcctaccaatatttgataatccaaaacaccacttgggaagatcactgccagttttgaccttttgggacagcggtg

SEQ ID NO: 431934 - DNA, 140 bp, Artificial Sequence
  Synthetic
caccgctgtcccaaaaggtcaaaactggcagtgatcttcccaagtggtgttttggattatcaaatattggtaggaagtcattatgcaatcccagcttccctttccagaatcaagtgctatcatatcagcagccagggcct

SEQ ID NO: 431935 - DNA, 140 bp, Artificial Sequence
  Synthetic
atacgccatgctgggtctcctatttgggacaatctcatctaaatcatttattgatggttggccatcaccattgaggcctgagcctagcttgactggttccctatactgatcaacaattttcgtacttgggagtcggccat

SEQ ID NO: 431936 - DNA, 140 bp, Artificial Sequence
  Synthetic
atggccgactcccaagtacgaaaattgttgatcagtatagggaaccagtcaagctaggctcaggcctcaatggtgatggccaaccatcaataaatgatttagatgagattgtcccaaataggagacccagcatggcgtat

SEQ ID NO: 431937 - DNA, 140 bp, Artificial Sequence
  Synthetic
aggccctggctgctgatatggatgataatctgacacataagccattacaaagtacctaagattttggaggagcttttgagaacgtttactggggtgagctaaaattaaaaccaggatcatgaccttttgggacagcggtg

SEQ ID NO: 431938 - DNA, 140 bp, Artificial Sequence
  Synthetic
caccgctgtcccaaaaggtcatgatcctggttttaattttagctcaccccagtaaacgttctcaaaagctcctccaaaatcttaggtactttgtaatggcttatgtgtcagattatcatccatatcagcagccagggcct

SEQ ID NO: 431939 - DNA, 140 bp, Artificial Sequence
  Synthetic
atacgccatgctgggtctcctgcccatccagaattgttagatcaaccccataggtgtccacatttacatttaggtctttgagggcacttattgctttggtaacagttttctgcaacatgccgtacttgggagtcggccat

SEQ ID NO: 431940 - DNA, 140 bp, Artificial Sequence
  Synthetic
atggccgactcccaagtacggcatgttgcagaaaactgttaccaaagcaataagtgccctcaaagacctaaatgtaaatgtggacacctatggggttgatctaacaattctggatgggcaggagacccagcatggcgtat

SEQ ID NO: 431941 - DNA, 140 bp, Artificial Sequence
  Synthetic
aggccctggctgctgatatggcctaccagacgttaaggctaaagactcacaaagtcttgaatactcagactcttcaaacaatgcattactttcttgtgaatattttaacagggtgaataagaccttttgggacagcggtg

SEQ ID NO: 431942 - DNA, 140 bp, Artificial Sequence
  Synthetic
caccgctgtcccaaaaggtcttattcaccctgttaaaatattcacaagaaagtaatgcattgtttgaagagtctgagtattcaagactttgtgagtctttagccttaacgtctggtaggccatatcagcagccagggcct

SEQ ID NO: 431943 - DNA, 140 bp, Artificial Sequence
  Synthetic
atacgccatgctgggtctccatcgccagattgttgcgctaaatgcacgcaacaaacactgagactatctgctaaaatgacaaaagcaaagcgcaatccaatagcctaggatccactgtgccgtacttgggagtcggccat

SEQ ID NO: 431944 - DNA, 140 bp, Artificial Sequence
  Synthetic
atggccgactcccaagtacggcacagtggatcctaggctattggattgcgctttgcttttgtcattttagcagatagtctcagtgtttgttgcgtgcatttagcgcaacaatctggcgatggagacccagcatggcgtat

SEQ ID NO: 431945 - DNA, 140 bp, Artificial Sequence
  Synthetic
atacgccatgctgggtctccaggcaattcagctggactttagtggtaaggctcattttggtgaatctctgaatcaaagtgtctagtcaaaatgggtaacagacaggccaaaccgacaaaacgtacttgggagtcggccat

SEQ ID NO: 431946 - DNA, 140 bp, Artificial Sequence
  Synthetic
atggccgactcccaagtacgttttgtcggtttggcctgtctgttacccattttgactagacactttgattcagagattcaccaaaatgagccttaccactaaagtccagctgaattgcctggagacccagcatggcgtat

SEQ ID NO: 431947 - DNA, 140 bp, Artificial Sequence
  Synthetic
aggccctggctgctgatatgagcattctaggctctgtctgcacaagaaatgctaacttctgtcttgacaatctctcgttgtccgctaggtactttgatactaagtctttgacacaggctagaccttttgggacagcggtg

SEQ ID NO: 431948 - DNA, 140 bp, Artificial Sequence
  Synthetic
caccgctgtcccaaaaggtctagcctgtgtcaaagacttagtatcaaagtacctagcggacaacgagagattgtcaagacagaagttagcatttcttgtgcagacagagcctagaatgctcatatcagcagccagggcct

SEQ ID NO: 431949 - DNA, 140 bp, Artificial Sequence
  Synthetic
atacgccatgctgggtctccagcagcagatgcccgatctgcaagatgcctcttcccaccaggctaaaagcagcagcacagccgagcgcaccatcaaccgaagagacccagaacacaacaccgtacttgggagtcggccat

SEQ ID NO: 431950 - DNA, 140 bp, Artificial Sequence
  Synthetic
atggccgactcccaagtacggtgttgtgttctgggtctcttcggttgatggtgcgctcggctgtgctgctgcttttagcctggtgggaagaggcatcttgcagatcgggcatctgctgctggagacccagcatggcgtat

SEQ ID NO: 431951 - DNA, 140 bp, Artificial Sequence
  Synthetic
aggccctggctgctgatatggagcaacaattcactatggaatgaggtcccgtagggggcacagaagacacaagagtcaattaaaagcaattaaattagatggccttaatgcctaggatccgaccttttgggacagcggtg

SEQ ID NO: 431952 - DNA, 140 bp, Artificial Sequence
  Synthetic
caccgctgtcccaaaaggtcggatcctaggcattaaggccatctaatttaattgcttttaattgactcttgtgtcttctgtgccccctacgggacctcattccatagtgaattgttgctccatatcagcagccagggcct

SEQ ID NO: 431953 - DNA, 140 bp, Artificial Sequence
  Synthetic
aggccctggctgctgatatggttgagtgcaacaaccactatctgtgtctcaactgcctcaccttacttttaagtgtcagcaacaggtgccccatttgcaagatgcctctccccacaaaacgaccttttgggacagcggtg

SEQ ID NO: 431954 - DNA, 140 bp, Artificial Sequence
  Synthetic
caccgctgtcccaaaaggtcgttttgtggggagaggcatcttgcaaatggggcacctgttgctgacacttaaaagtaaggtgaggcagttgagacacagatagtggttgttgcactcaaccatatcagcagccagggcct

SEQ ID NO: 431955 - DNA, 140 bp, Artificial Sequence
  Synthetic
atacgccatgctgggtctccgctcccccggggggaccccccgccaggggcccccccgggggagccaaccatcaccaggagactactcaatgtcttcgatgcattcatccttcctaatcaacgtacttgggagtcggccat

SEQ ID NO: 431956 - DNA, 140 bp, Artificial Sequence
  Synthetic
atggccgactcccaagtacgttgattaggaaggatgaatgcatcgaagacattgagtagtctcctggtgatggttggctcccccgggggggcccctggcggggggtccccccgggggagcggagacccagcatggcgtat

SEQ ID NO: 431957 - DNA, 140 bp, Artificial Sequence
  Synthetic
aggccctggctgctgatatggaattcatttaccacatctgattcaacaaaccaggctgacctacctttgaaagttggacccgacaaagcaagtctccaacagtcagacagaacacatggggaccttttgggacagcggtg

SEQ ID NO: 431958 - DNA, 140 bp, Artificial Sequence
  Synthetic
caccgctgtcccaaaaggtccccatgtgttctgtctgactgttggagacttgctttgtcgggtccaactttcaaaggtaggtcagcctggtttgttgaatcagatgtggtaaatgaattccatatcagcagccagggcct

SEQ ID NO: 431959 - DNA, 140 bp, Artificial Sequence
  Synthetic
atacgccatgctgggtctccaacaatgcatctgactgctgtttgtgggtgatgatctatcaaccccattggttaaatctgcatacaagaatttcaacacaggagaggctcttttaaaggacgtacttgggagtcggccat

SEQ ID NO: 431960 - DNA, 140 bp, Artificial Sequence
  Synthetic
atggccgactcccaagtacgtcctttaaaagagcctctcctgtgttgaaattcttgtatgcagatttaaccaatggggttgatagatcatcacccacaaacagcagtcagatgcattgttggagacccagcatggcgtat

SEQ ID NO: 431961 - DNA, 140 bp, Artificial Sequence
  Synthetic
atacgccatgctgggtctccctaattttttgaagtcctcaatgtacttctgctcaaagttagcaggagatgacctaacaaaacattccagcagtatcagaacattgcctgttagtttgtacgtacttgggagtcggccat

SEQ ID NO: 431962 - DNA, 140 bp, Artificial Sequence
  Synthetic
atggccgactcccaagtacgtacaaactaacaggcaatgttctgatactgctggaatgttttgttaggtcatctcctgctaactttgagcagaagtacattgaggacttcaaaaaattagggagacccagcatggcgtat

SEQ ID NO: 431963 - DNA, 140 bp, Artificial Sequence
  Synthetic
atacgccatgctgggtctcccttcagtggtgaggctcattttagtgaatccttgaatcaaagtgcccagttaaaatgggcaacagacaggccaaatcgacaaaagtcgatgaacatcaaacgtacttgggagtcggccat

SEQ ID NO: 431964 - DNA, 140 bp, Artificial Sequence
  Synthetic
atggccgactcccaagtacgtttgatgttcatcgacttttgtcgatttggcctgtctgttgcccattttaactgggcactttgattcaaggattcactaaaatgagcctcaccactgaagggagacccagcatggcgtat

SEQ ID NO: 431965 - DNA, 140 bp, Artificial Sequence
  Synthetic
aggccctggctgctgatatgtaaaatgggcaacagacaggccaaatcgacaaaagtcgatgaacatcaaagagctcatctagtgccagatgcatcccatctaggcccccaattctgcaaggaccttttgggacagcggtg

SEQ ID NO: 431966 - DNA, 140 bp, Artificial Sequence
  Synthetic
caccgctgtcccaaaaggtccttgcagaattgggggcctagatgggatgcatctggcactagatgagctctttgatgttcatcgacttttgtcgatttggcctgtctgttgcccattttacatatcagcagccagggcct

SEQ ID NO: 431967 - DNA, 140 bp, Artificial Sequence
  Synthetic
atacgccatgctgggtctcctctgcaagatgccccttcccaccaagctaaaggcagcagcacagccgagcgcaccatcaaccgaggcgatccagaacacaacacctccaccttacacccccgtacttgggagtcggccat

SEQ ID NO: 431968 - DNA, 140 bp, Artificial Sequence
  Synthetic
atggccgactcccaagtacgggggtgtaaggtggaggtgttgtgttctggatcgcctcggttgatggtgcgctcggctgtgctgctgcctttagcttggtgggaaggggcatcttgcagaggagacccagcatggcgtat

SEQ ID NO: 431969 - DNA, 140 bp, Artificial Sequence
  Synthetic
aggccctggctgctgatatgctaggaaggctagcttctgttttgaaagcctctcatcctctaagaggtacctgctcacaagatctttgctctcggacagcaactcctccatcaaacacacgaccttttgggacagcggtg

SEQ ID NO: 431970 - DNA, 140 bp, Artificial Sequence
  Synthetic
caccgctgtcccaaaaggtcgtgtgtttgatggaggagttgctgtccgagagcaaagatcttgtgagcaggtacctcttagaggatgagaggctttcaaaacagaagctagccttcctagcatatcagcagccagggcct

SEQ ID NO: 431971 - DNA, 140 bp, Artificial Sequence
  Synthetic
aggccctggctgctgatatgccagacccagccgacagcaccaccagaaatcccaccatcccaaaatcccccaccctacagcccctgaggcagaactccgccccgaagccctctcaaacacgaccttttgggacagcggtg

SEQ ID NO: 431972 - DNA, 140 bp, Artificial Sequence
  Synthetic
caccgctgtcccaaaaggtcgtgtttgagagggcttcggggcggagttctgcctcaggggctgtagggtgggggattttgggatggtgggatttctggtggtgctgtcggctgggtctggcatatcagcagccagggcct

SEQ ID NO: 431973 - DNA, 140 bp, Artificial Sequence
  Synthetic
atacgccatgctgggtctccgcagtcctcagtgtagagacaatgtccactcctgaccactgcatcttcaaccctagcctgtctatcatcatgtcactcaatgccccaatcagcaggtcagcgtacttgggagtcggccat

SEQ ID NO: 431974 - DNA, 140 bp, Artificial Sequence
  Synthetic
atggccgactcccaagtacgctgacctgctgattggggcattgagtgacatgatgatagacaggctagggttgaagatgcagtggtcaggagtggacattgtctctacactgaggactgcggagacccagcatggcgtat

SEQ ID NO: 431975 - DNA, 140 bp, Artificial Sequence
  Synthetic
aggccctggctgctgatatgagaccaacctccagcagtctgacaaaacacacggactcactgcacctgagtacatagctgtcacatcatgtactatgtatttagcctgttgattcattgagaccttttgggacagcggtg

SEQ ID NO: 431976 - DNA, 140 bp, Artificial Sequence
  Synthetic
caccgctgtcccaaaaggtctcaatgaatcaacaggctaaatacatagtacatgatgtgacagctatgtactcaggtgcagtgagtccgtgtgttttgtcagactgctggaggttggtctcatatcagcagccagggcct

SEQ ID NO: 431977 - DNA, 140 bp, Artificial Sequence
  Synthetic
atacgccatgctgggtctcctgtttgactttaacaaacaagctataaggaggctgaagacagaagcacagatgagtatccaactgataaacaaagcagtaaacgcactgatcaatgaccacgtacttgggagtcggccat

SEQ ID NO: 431978 - DNA, 140 bp, Artificial Sequence
  Synthetic
atggccgactcccaagtacgtggtcattgatcagtgcgtttactgctttgtttatcagttggatactcatctgtgcttctgtcttcagcctccttatagcttgtttgttaaagtcaaacaggagacccagcatggcgtat

SEQ ID NO: 431979 - DNA, 140 bp, Artificial Sequence
  Synthetic
atacgccatgctgggtctcctggcagttacatagcacttgattccggaaagggaaactgggattgtataatgacttcctatcaatacttgataattcaaaacaccacttgggaggatcaccgtacttgggagtcggccat

SEQ ID NO: 431980 - DNA, 140 bp, Artificial Sequence
  Synthetic
atggccgactcccaagtacggtgatcctcccaagtggtgttttgaattatcaagtattgataggaagtcattatacaatcccagtttccctttccggaatcaagtgctatgtaactgccaggagacccagcatggcgtat

SEQ ID NO: 431981 - DNA, 140 bp, Artificial Sequence
  Synthetic
aggccctggctgctgatatggtggtattaagttgatgtcgacactcttcaagtcttctttcaactgctccaattttttgaaatcttcaatgtatttttgctcaaagttagcaggagatgagaccttttgggacagcggtg

SEQ ID NO: 431982 - DNA, 140 bp, Artificial Sequence
  Synthetic
caccgctgtcccaaaaggtctcatctcctgctaactttgagcaaaaatacattgaagatttcaaaaaattggagcagttgaaagaagacttgaagagtgtcgacatcaacttaataccaccatatcagcagccagggcct

SEQ ID NO: 431983 - DNA, 140 bp, Artificial Sequence
  Synthetic
aggccctggctgctgatatgttaagatggatttgaggatgccgtccatcgtctgaggtgacaccttaattgtctctagcatgttgccgccatctagcatgcaagctcctgccttcacagcgaccttttgggacagcggtg

SEQ ID NO: 431984 - DNA, 140 bp, Artificial Sequence
  Synthetic
caccgctgtcccaaaaggtcgctgtgaaggcaggagcttgcatgctagatggcggcaacatgctagagacaattaaggtgtcacctcagacgatggacggcatcctcaaatccatcttaacatatcagcagccagggcct

SEQ ID NO: 431985 - DNA, 140 bp, Artificial Sequence
  Synthetic
atacgccatgctgggtctccacacccacattcctgtctctagttctcttcctgctgtttatccaccgttttatatctctctttgttgattccaatgaaactaatctatcattaacactcacgtacttgggagtcggccat

SEQ ID NO: 431986 - DNA, 140 bp, Artificial Sequence
  Synthetic
atggccgactcccaagtacgtgagtgttaatgatagattagtttcattggaatcaacaaagagagatataaaacggtggataaacagcaggaagagaactagagacaggaatgtgggtgtggagacccagcatggcgtat

SEQ ID NO: 431987 - DNA, 140 bp, Artificial Sequence
  Synthetic
atacgccatgctgggtctccccagagtccaaatctgcatacaagaacttaaggactggggaggctcttcggaactggaatattaactgctcaatgttgtcatcataggtgtctattttatcgtacttgggagtcggccat

SEQ ID NO: 431988 - DNA, 140 bp, Artificial Sequence
  Synthetic
atggccgactcccaagtacgataaaatagacacctatgatgacaacattgagcagttaatattccagttccgaagagcctccccagtccttaagttcttgtatgcagatttggactctggggagacccagcatggcgtat

SEQ ID NO: 431989 - DNA, 140 bp, Artificial Sequence
  Synthetic
aggccctggctgctgatatgcatccggtaccacaaagcatagtgaaggtgtcaagattccatgatcatggagaattctttccacagatttgtcctcactgttgtgctcgcatccatttgcgaccttttgggacagcggtg

SEQ ID NO: 431990 - DNA, 140 bp, Artificial Sequence
  Synthetic
caccgctgtcccaaaaggtcgcaaatggatgcgagcacaacagtgaggacaaatctgtggaaagaattctccatgatcatggaatcttgacaccttcactatgctttgtggtaccggatgcatatcagcagccagggcct

SEQ ID NO: 431991 - DNA, 140 bp, Artificial Sequence
  Synthetic
aggccctggctgctgatatgccccaaacaaaaaatctagatttaaactctgcaacaaacctaccaatgacactcttagggctcacaaacttattgagttgatcactcatataatagtggagaccttttgggacagcggtg

SEQ ID NO: 431992 - DNA, 140 bp, Artificial Sequence
  Synthetic
caccgctgtcccaaaaggtctccactattatatgagtgatcaactcaataagtttgtgagccctaagagtgtcattggtaggtttgttgcagagtttaaatctagattttttgtttggggcatatcagcagccagggcct

SEQ ID NO: 431993 - DNA, 140 bp, Artificial Sequence
  Synthetic
aggccctggctgctgatatgctcaatgattgtgtccagagaaaggactttatttcctttgaggcactcatcgccagattgttgtgctggatgcacgcagcagaaagctgagactacctgcgaccttttgggacagcggtg

SEQ ID NO: 431994 - DNA, 140 bp, Artificial Sequence
  Synthetic
caccgctgtcccaaaaggtcgcaggtagtctcagctttctgctgcgtgcatccagcacaacaatctggcgatgagtgcctcaaaggaaataaagtcctttctctggacacaatcattgagcatatcagcagccagggcct

SEQ ID NO: 431995 - DNA, 140 bp, Artificial Sequence
  Synthetic
aggccctggctgctgatatgcagatgagtattcagctgataaacaaggcagtgaatgcattaatcaatgaccaattaatcatgaaaaaccacttaagggacatcatgggaattccttattgaccttttgggacagcggtg

SEQ ID NO: 431996 - DNA, 140 bp, Artificial Sequence
  Synthetic
caccgctgtcccaaaaggtcaataaggaattcccatgatgtcccttaagtggtttttcatgattaattggtcattgattaatgcattcactgccttgtttatcagctgaatactcatctgcatatcagcagccagggcct

SEQ ID NO: 431997 - DNA, 140 bp, Artificial Sequence
  Synthetic
atacgccatgctgggtctccttccttgatttataatgagtgtacctccccataagtgtgtttgcattcatgattaaaagtatggacttaaaacactgaaagtattcgtggttaaagtatgcgtacttgggagtcggccat

SEQ ID NO: 431998 - DNA, 140 bp, Artificial Sequence
  Synthetic
atggccgactcccaagtacgcatactttaaccacgaatactttcagtgttttaagtccatacttttaatcatgaatgcaaacacacttatggggaggtacactcattataaatcaaggaaggagacccagcatggcgtat

SEQ ID NO: 431999 - DNA, 140 bp, Artificial Sequence
  Synthetic
aggccctggctgctgatatgttgtggcacctgtgttgggtttgggtttgtgccagtatggcttgtgggtcaactgatggtgctccacaaaggctcctacagaaatgagagacaatatgccgaccttttgggacagcggtg

SEQ ID NO: 432000 - DNA, 140 bp, Artificial Sequence
  Synthetic
caccgctgtcccaaaaggtcggcatattgtctctcatttctgtaggagcctttgtggagcaccatcagttgacccacaagccatactggcacaaacccaaacccaacacaggtgccacaacatatcagcagccagggcct

SEQ ID NO: 432001 - DNA, 140 bp, Artificial Sequence
  Synthetic
aggccctggctgctgatatgtgatataatagtttgaatcccatcctattgatgaagaactcttggcaataggcctctttgcacctcacaacctggtatctagagggtccaaattcattttgaccttttgggacagcggtg

SEQ ID NO: 432002 - DNA, 140 bp, Artificial Sequence
  Synthetic
caccgctgtcccaaaaggtcaaaatgaatttggaccctctagataccaggttgtgaggtgcaaagaggcctattgccaagagttcttcatcaataggatgggattcaaactattatatcacatatcagcagccagggcct

SEQ ID NO: 432003 - DNA, 140 bp, Artificial Sequence
  Synthetic
  misc_feature (25)..(25): n is a, c, g, or t
aggccctggctgctgatatgccccnggggggaccccccgccgggggcccccccggggggcaggcagccaagctctactcaatgtcctcaacacacttctccggcccaaacaagtctgaacgaccttttgggacagcggtg

SEQ ID NO: 432004 - DNA, 140 bp, Artificial Sequence
  Synthetic
  misc_feature (116)..(116): n is a, c, g, or t
caccgctgtcccaaaaggtcgttcagacttgtttgggccggagaagtgtgttgaggacattgagtagagcttggctgcctgccccccgggggggcccccggcggggggtccccccnggggcatatcagcagccagggcct

SEQ ID NO: 432005 - DNA, 140 bp, Artificial Sequence
  Synthetic
aggccctggctgctgatatggccaagagtataagggaacatgtcttcctgagttttctggtaacttatagtgggtgtgataccggagatctcaatgtccatgatggcatcataaacatcagaccttttgggacagcggtg

SEQ ID NO: 432006 - DNA, 140 bp, Artificial Sequence
  Synthetic
caccgctgtcccaaaaggtctgatgtttatgatgccatcatggacattgagatctccggtatcacacccactataagttaccagaaaactcaggaagacatgttcccttatactcttggccatatcagcagccagggcct

SEQ ID NO: 432007 - DNA, 140 bp, Artificial Sequence
  Synthetic
atacgccatgctgggtctccagatccatctgtgtatttgttgacaacaacactcttattgctggctagatccaaagctgtagcgcagccactggtgataagggggtctttaatttcccttcgtacttgggagtcggccat

SEQ ID NO: 432008 - DNA, 140 bp, Artificial Sequence
  Synthetic
atggccgactcccaagtacgaagggaaattaaagacccccttatcaccagtggctgcgctacagctttggatctagccagcaataagagtgttgttgtcaacaaatacacagatggatctggagacccagcatggcgtat

SEQ ID NO: 432009 - DNA, 140 bp, Artificial Sequence
  Synthetic
aggccctggctgctgatatgacagacctcctctatgcacaaccagaggggctggttcagtgcagggacctactagtacaaagtcatactctgtaaactgtaatctttccatatcaacaacgaccttttgggacagcggtg

SEQ ID NO: 432010 - DNA, 140 bp, Artificial Sequence
  Synthetic
caccgctgtcccaaaaggtcgttgttgatatggaaagattacagtttacagagtatgactttgtactagtaggtccctgcactgaaccagcccctctggttgtgcatagaggaggtctgtcatatcagcagccagggcct

SEQ ID NO: 432011 - DNA, 140 bp, Artificial Sequence
  Synthetic
atacgccatgctgggtctccacaatatgcctctttgcatctgaccacttgataccttgcgggtccaaattcattctgtctcaactttacagtggaagaagtcttcatagagttcactaagcgtacttgggagtcggccat

SEQ ID NO: 432012 - DNA, 140 bp, Artificial Sequence
  Synthetic
atggccgactcccaagtacgcttagtgaactctatgaagacttcttccactgtaaagttgagacagaatgaatttggacccgcaaggtatcaagtggtcagatgcaaagaggcatattgtggagacccagcatggcgtat

SEQ ID NO: 432013 - DNA, 140 bp, Artificial Sequence
  Synthetic
aggccctggctgctgatatgtccctccatgagcaacattctaggttcggtttggaccaaaaaagctaacttctgtcttgatagcttctcattatctgcaaggtactttgagataagatctgaccttttgggacagcggtg

SEQ ID NO: 432014 - DNA, 140 bp, Artificial Sequence
  Synthetic
caccgctgtcccaaaaggtcagatcttatctcaaagtaccttgcagataatgagaagctatcaagacagaagttagcttttttggtccaaaccgaacctagaatgttgctcatggagggacatatcagcagccagggcct

SEQ ID NO: 432015 - DNA, 140 bp, Artificial Sequence
  Synthetic
aggccctggctgctgatatgcaccaagctaaaggcagcagcacagccgagcgcaccatcaaccgaggcgatccagaacacaacacctccaccttacaccccataatcccaggaccaacacgaccttttgggacagcggtg

SEQ ID NO: 432016 - DNA, 140 bp, Artificial Sequence
  Synthetic
caccgctgtcccaaaaggtcgtgttggtcctgggattatggggtgtaaggtggaggtgttgtgttctggatcgcctcggttgatggtgcgctcggctgtgctgctgcctttagcttggtgcatatcagcagccagggcct

SEQ ID NO: 432017 - DNA, 140 bp, Artificial Sequence
  Synthetic
aggccctggctgctgatatgagacactcaatatgaccatgcctctctcttgcacaaagaacaatagtcatcattacataatggtgggcaatgagacagggctggaactaaccttgaccaagaccttttgggacagcggtg

SEQ ID NO: 432018 - DNA, 140 bp, Artificial Sequence
  Synthetic
caccgctgtcccaaaaggtcttggtcaaggttagttccagccctgtctcattgcccaccattatgtaatgatgactattgttctttgtgcaagagagaggcatggtcatattgagtgtctcatatcagcagccagggcct

SEQ ID NO: 432019 - DNA, 140 bp, Artificial Sequence
  Synthetic
aggccctggctgctgatatgaagacaacttattttggattgttttgacaatggtgggaatcttctcatcatctaggttcacagcacctgaatatattatcttttgtctcaacaccattctgaccttttgggacagcggtg

SEQ ID NO: 432020 - DNA, 140 bp, Artificial Sequence
  Synthetic
caccgctgtcccaaaaggtcagaatggtgttgagacaaaagataatatattcaggtgctgtgaacctagatgatgagaagattcccaccattgtcaaaacaatccaaaataagttgtcttcatatcagcagccagggcct

SEQ ID NO: 432021 - DNA, 140 bp, Artificial Sequence
  Synthetic
aggccctggctgctgatatgtctaggttcacagcacctgaatatattatcttttgtctcaacaccattcttaaaggatgatgcgcagccaagtttaaccaagaatactcaaggtcagactgaccttttgggacagcggtg

SEQ ID NO: 432022 - DNA, 140 bp, Artificial Sequence
  Synthetic
caccgctgtcccaaaaggtcagtctgaccttgagtattcttggttaaacttggctgcgcatcatcctttaagaatggtgttgagacaaaagataatatattcaggtgctgtgaacctagacatatcagcagccagggcct

SEQ ID NO: 432023 - DNA, 140 bp, Artificial Sequence
  Synthetic
aggccctggctgctgatatgataacatttttccaggaagtacctcatgtcatagaggaagtgatgaacattgtcctgattgctctcagccttctggcaatactgaaagggatctacaatggaccttttgggacagcggtg

SEQ ID NO: 432024 - DNA, 140 bp, Artificial Sequence
  Synthetic
caccgctgtcccaaaaggtccattgtagatccctttcagtattgccagaaggctgagagcaatcaggacaatgttcatcacttcctctatgacatgaggtacttcctggaaaaatgttatcatatcagcagccagggcct

SEQ ID NO: 432025 - DNA, 140 bp, Artificial Sequence
  Synthetic
atacgccatgctgggtctccccaatatctaataattcaaaatacaacctgggaagatcactgccagttctcaagaccatctcccatcggctatcttgggctcctctcacaaaggaccagacgtacttgggagtcggccat

SEQ ID NO: 432026 - DNA, 140 bp, Artificial Sequence
  Synthetic
atggccgactcccaagtacgtctggtcctttgtgagaggagcccaagatagccgatgggagatggtcttgagaactggcagtgatcttcccaggttgtattttgaattattagatattggggagacccagcatggcgtat

SEQ ID NO: 432027 - DNA, 140 bp, Artificial Sequence
  Synthetic
aggccctggctgctgatatggagctatttgggtacttagctgtgtatattagacccaggtctgttagtgctaagacggcatcattcaaatcaacttgaccttgtttggtgagacatgctagaccttttgggacagcggtg

SEQ ID NO: 432028 - DNA, 140 bp, Artificial Sequence
  Synthetic
caccgctgtcccaaaaggtctagcatgtctcaccaaacaaggtcaagttgatttgaatgatgccgtcttagcactaacagacctgggtctaatatacacagctaagtacccaaatagctccatatcagcagccagggcct

SEQ ID NO: 432029 - DNA, 140 bp, Artificial Sequence
  Synthetic
aggccctggctgctgatatgccaccgcctgttggcggtgggtcacgggggcgtccatttacaggacgactttgggtgtcgatgttctaaacaccatgtctctgggtagcactgctctcaggaccttttgggacagcggtg

SEQ ID NO: 432030 - DNA, 140 bp, Artificial Sequence
  Synthetic
caccgctgtcccaaaaggtcctgagagcagtgctacccagagacatggtgtttagaacatcgacacccaaagtcgtcctgtaaatggacgcccccgtgacccaccgccaacaggcggtggcatatcagcagccagggcct

SEQ ID NO: 432031 - DNA, 140 bp, Artificial Sequence
  Synthetic
aggccctggctgctgatatgtgtgtccagagaaatgacttcacttccttagaagcactcatcttggtctggacacttggggatttactggttgaaagtatcactcagtaagtcaatgaaagaccttttgggacagcggtg

SEQ ID NO: 432032 - DNA, 140 bp, Artificial Sequence
  Synthetic
caccgctgtcccaaaaggtctttcattgacttactgagtgatactttcaaccagtaaatccccaagtgtccagaccaagatgagtgcttctaaggaagtgaagtcatttctctggacacacatatcagcagccagggcct

SEQ ID NO: 432033 - DNA, 140 bp, Artificial Sequence
  Synthetic
aggccctggctgctgatatgtttcccaagccctccctgttattgaggttcttgatgcaatatatggccacccatctcctgacaaacaaatcttgtagagtatgttctcataaggattcctgaccttttgggacagcggtg

SEQ ID NO: 432034 - DNA, 140 bp, Artificial Sequence
  Synthetic
caccgctgtcccaaaaggtcaggaatccttatgagaacatactctacaagatttgtttgtcaggagatgggtggccatatattgcatcaagaacctcaataacagggagggcttgggaaacatatcagcagccagggcct

SEQ ID NO: 432035 - DNA, 140 bp, Artificial Sequence
  Synthetic
aggccctggctgctgatatgattcctctgtcaggcctgaagcaataagctggttcaagtttatctgagctggttctatgtcaaagtctatccatgcatagcccatcattagatcaaacttgaccttttgggacagcggtg

SEQ ID NO: 432036 - DNA, 140 bp, Artificial Sequence
  Synthetic
caccgctgtcccaaaaggtcaagtttgatctaatgatgggctatgcatggatagactttgacatagaaccagctcagataaacttgaaccagcttattgcttcaggcctgacagaggaatcatatcagcagccagggcct

SEQ ID NO: 432037 - DNA, 140 bp, Artificial Sequence
  Synthetic
atacgccatgctgggtctcccacccgtattaggtctgggttcgcgccagaatggcctgtgggtcagctggtggtgccccacaaaagcttctacagaaatgagagacaatatgcctaggatcgtacttgggagtcggccat

SEQ ID NO: 432038 - DNA, 140 bp, Artificial Sequence
  Synthetic
atggccgactcccaagtacgatcctaggcatattgtctctcatttctgtagaagcttttgtggggcaccaccagctgacccacaggccattctggcgcgaacccagacctaatacgggtgggagacccagcatggcgtat

SEQ ID NO: 432039 - DNA, 140 bp, Artificial Sequence
  Synthetic
atacgccatgctgggtctccccggggatcctaggcaatttggttgttcatttcttttgaggcctcatttaggtctttcttagaccctctgtgctgaactccaccagatggggaacaagcacgtacttgggagtcggccat

SEQ ID NO: 432040 - DNA, 140 bp, Artificial Sequence
  Synthetic
atggccgactcccaagtacgtgcttgttccccatctggtggagttcagcacagagggtctaagaaagacctaaatgaggcctcaaaagaaatgaacaaccaaattgcctaggatccccggggagacccagcatggcgtat

SEQ ID NO: 432041 - DNA, 140 bp, Artificial Sequence
  Synthetic
atacgccatgctgggtctcccccacccctccctcccccccccgaccccccccggggggaccccccgccgggggcccccccgggggagccaatcacttccaaaaactactcaatgtcctcacgtacttgggagtcggccat

SEQ ID NO: 432042 - DNA, 140 bp, Artificial Sequence
  Synthetic
atggccgactcccaagtacgtgaggacattgagtagtttttggaagtgattggctcccccgggggggcccccggcggggggtccccccggggggggtcgggggggggagggaggggtgggggagacccagcatggcgtat

SEQ ID NO: 432043 - DNA, 140 bp, Artificial Sequence
  Synthetic
atacgccatgctgggtctccatactggtttgcccttaaaagtgggtcctgacaaaaccaacctccaacagtctgacaaaacacatgggctcactgcaccagagtacatggcagtcacatccgtacttgggagtcggccat

SEQ ID NO: 432044 - DNA, 140 bp, Artificial Sequence
  Synthetic
atggccgactcccaagtacggatgtgactgccatgtactctggtgcagtgagcccatgtgttttgtcagactgttggaggttggttttgtcaggacccacttttaagggcaaaccagtatggagacccagcatggcgtat

SEQ ID NO: 432045 - DNA, 140 bp, Artificial Sequence
  Synthetic
atacgccatgctgggtctccgaatagcaaaactctctctaaaactagcatcctgactcttgatgcggaatctcactgtctgacttagttttgcagaccctgtaggtaatgacgcaacagccgtacttgggagtcggccat

SEQ ID NO: 432046 - DNA, 140 bp, Artificial Sequence
  Synthetic
atggccgactcccaagtacggctgttgcgtcattacctacagggtctgcaaaactaagtcagacagtgagattccgcatcaagagtcaggatgctagttttagagagagttttgctattcggagacccagcatggcgtat

SEQ ID NO: 432047 - DNA, 140 bp, Artificial Sequence
  Synthetic
aggccctggctgctgatatgtatgacaatgcccttatcttgcacgaagaacaacagccatcattacatcatggtcggaaatgagactggcttagagctgactttaacaaatacaagtatcgaccttttgggacagcggtg

SEQ ID NO: 432048 - DNA, 140 bp, Artificial Sequence
  Synthetic
caccgctgtcccaaaaggtcgatacttgtatttgttaaagtcagctctaagccagtctcatttccgaccatgatgtaatgatggctgttgttcttcgtgcaagataagggcattgtcatacatatcagcagccagggcct

SEQ ID NO: 432049 - DNA, 140 bp, Artificial Sequence
  Synthetic
aggccctggctgctgatatgggggtggcagttacatagcacttgattctggaaaggggagttgggattgtataatgacttcctaccaatatttgataatccaaaacaccacttgggaagagaccttttgggacagcggtg

SEQ ID NO: 432050 - DNA, 140 bp, Artificial Sequence
  Synthetic
caccgctgtcccaaaaggtctcttcccaagtggtgttttggattatcaaatattggtaggaagtcattatacaatcccaactcccctttccagaatcaagtgctatgtaactgccacccccatatcagcagccagggcct

SEQ ID NO: 432051 - DNA, 140 bp, Artificial Sequence
  Synthetic
atacgccatgctgggtctcctgaacaccaatggaatttgtcaacaattcgatcccttgggtgccagtgatcagagactgtatagacttgatatacagattctctttatttggcccccgaacgtacttgggagtcggccat

SEQ ID NO: 432052 - DNA, 140 bp, Artificial Sequence
  Synthetic
atggccgactcccaagtacgttcgggggccaaataaagagaatctgtatatcaagtctatacagtctctgatcactggcacccaagggatcgaattgttgacaaattccattggtgttcaggagacccagcatggcgtat

SEQ ID NO: 432053 - DNA, 140 bp, Artificial Sequence
  Synthetic
aggccctggctgctgatatgtcagtatgaagcaatgagttgtgacttcaatggggggaagataagtgttcagtacaaccttagccacgcttatgctatagatgcagctgaccactgtggggaccttttgggacagcggtg

SEQ ID NO: 432054 - DNA, 140 bp, Artificial Sequence
  Synthetic
caccgctgtcccaaaaggtccccacagtggtcagctgcatctatagcataagcgtggctaaggttgtactgaacacttatcttccccccattgaagtcacaactcattgcttcatactgacatatcagcagccagggcct

SEQ ID NO: 432055 - DNA, 140 bp, Artificial Sequence
  Synthetic
atacgccatgctgggtctcccagttttctcgcccatcccccatcggttatctggggctgctgtcacaaaggaccagggacatttacatcagtcgaagactccttgggacttttacttggacgtacttgggagtcggccat

SEQ ID NO: 432056 - DNA, 140 bp, Artificial Sequence
  Synthetic
atggccgactcccaagtacgtccaagtaaaagtcccaaggagtcttcgactgatgtaaatgtccctggtcctttgtgacagcagccccagataaccgatgggggatgggcgagaaaactgggagacccagcatggcgtat

SEQ ID NO: 432057 - DNA, 140 bp, Artificial Sequence
  Synthetic
aggccctggctgctgatatgtcctcaaggattgtgtccacaaaaaggattttatttcctttgaggcactcattgccagattatagtgttgaatgcacacaacaaagaactgagactatctgaccttttgggacagcggtg

SEQ ID NO: 432058 - DNA, 140 bp, Artificial Sequence
  Synthetic
caccgctgtcccaaaaggtcagatagtctcagttctttgttgtgtgcattcaacactataatctggcaatgagtgcctcaaaggaaataaaatcctttttgtggacacaatccttgaggacatatcagcagccagggcct

SEQ ID NO: 432059 - DNA, 140 bp, Artificial Sequence
  Synthetic
aggccctggctgctgatatgattacagcaagtattggtatttaaatcacactgtaacagggaagacatcgttgccaagatgctggcttgtgtcaaatggttcctacctgaatgagacacagaccttttgggacagcggtg

SEQ ID NO: 432060 - DNA, 140 bp, Artificial Sequence
  Synthetic
caccgctgtcccaaaaggtctgtgtctcattcaggtaggaaccatttgacacaagccagcatcttggcaacgatgtcttccctgttacagtgtgatttaaataccaatacttgctgtaatcatatcagcagccagggcct

SEQ ID NO: 432061 - DNA, 140 bp, Artificial Sequence
  Synthetic
aggccctggctgctgatatgattagcatcttccttcatttggtcaaaatacctactcataggcatattgtgggcaagtcgtgcccaaaacctcataggttgaatcacatgggtatatgttgaccttttgggacagcggtg

SEQ ID NO: 432062 - DNA, 140 bp, Artificial Sequence
  Synthetic
caccgctgtcccaaaaggtcaacatatacccatgtgattcaacctatgaggttttgggcacgacttgcccacaatatgcctatgagtaggtattttgaccaaatgaaggaagatgctaatcatatcagcagccagggcct

SEQ ID NO: 432063 - DNA, 140 bp, Artificial Sequence
  Synthetic
aggccctggctgctgatatgttgaagctatatagggccaaccgtcaccagaaagacagatcttgtaaagtatattctcataagggttcctttcaccaggtgtatctgaaacaaacattccgaccttttgggacagcggtg

SEQ ID NO: 432064 - DNA, 140 bp, Artificial Sequence
  Synthetic
caccgctgtcccaaaaggtcggaatgtttgtttcagatacacctggtgaaaggaacccttatgagaatatactttacaagatctgtctttctggtgacggttggccctatatagcttcaacatatcagcagccagggcct

SEQ ID NO: 432065 - DNA, 140 bp, Artificial Sequence
  Synthetic
atacgccatgctgggtctccgggatcctaggcaatttggttgttctttctgaggttttgtgcgctgaacttctctaaatgggaaacaagcaagccaaagccccggaagcaaaagacagtccgtacttgggagtcggccat

SEQ ID NO: 432066 - DNA, 140 bp, Artificial Sequence
  Synthetic
atggccgactcccaagtacggactgtcttttgcttccggggctttggcttgcttgtttcccatttagagaagttcagcgcacaaaacctcagaaagaacaaccaaattgcctaggatcccggagacccagcatggcgtat

SEQ ID NO: 432067 - DNA, 140 bp, Artificial Sequence
  Synthetic
atacgccatgctgggtctcccgggggatcctaggcaattcagctggacttcagtggtgagactcattttagtgaatccttgaatcagaatacccagtcaaaatgggcaacagacaggccacgtacttgggagtcggccat

SEQ ID NO: 432068 - DNA, 140 bp, Artificial Sequence
  Synthetic
atggccgactcccaagtacgtggcctgtctgttgcccattttgactgggtattctgattcaaggattcactaaaatgagtctcaccactgaagtccagctgaattgcctaggatcccccgggagacccagcatggcgtat

SEQ ID NO: 432069 - DNA, 140 bp, Artificial Sequence
  Synthetic
aggccctggctgctgatatgctgccaatgtcagcaggtcatctgaggtcaaggtcccaactctcaagatactcttttgttgtgttgatttgagttctacaagattgttgacagcctgattgaccttttgggacagcggtg

SEQ ID NO: 432070 - DNA, 140 bp, Artificial Sequence
  Synthetic
caccgctgtcccaaaaggtcaatcaggctgtcaacaatcttgtagaactcaaatcaacacaacaaaagagtatcttgagagttgggaccttgacctcagatgacctgctgacattggcagcatatcagcagccagggcct

SEQ ID NO: 432071 - DNA, 140 bp, Artificial Sequence
  Synthetic
aggccctggctgctgatatgaagctccctcctcaatgactgtgtccagaggaatgacttcacttccttagaagcactcatcttgatctggatacttttgaggtttactgattgaaagtatgaccttttgggacagcggtg

SEQ ID NO: 432072 - DNA, 140 bp, Artificial Sequence
  Synthetic
caccgctgtcccaaaaggtcatactttcaatcagtaaacctcaaaagtatccagatcaagatgagtgcttctaaggaagtgaagtcattcctctggacacagtcattgaggagggagcttcatatcagcagccagggcct

SEQ ID NO: 432073 - DNA, 140 bp, Artificial Sequence
  Synthetic
aggccctggctgctgatatgtccttagaagcactcatcttgatctggatacttttgaggtttactgattgaaagtattactcagtaagtcagtgaaaagcgcaatccaatagcctaggatgaccttttgggacagcggtg

SEQ ID NO: 432074 - DNA, 140 bp, Artificial Sequence
  Synthetic
caccgctgtcccaaaaggtcatcctaggctattggattgcgcttttcactgacttactgagtaatactttcaatcagtaaacctcaaaagtatccagatcaagatgagtgcttctaaggacatatcagcagccagggcct

SEQ ID NO: 432075 - DNA, 140 bp, Artificial Sequence
  Synthetic
aggccctggctgctgatatggattcaaccgttttgtcttcagtgttatgttcacatccattggccttgcaagagtcaatctcaatgcaaagagatagtagtttcaatccctccatgagcagaccttttgggacagcggtg

SEQ ID NO: 432076 - DNA, 140 bp, Artificial Sequence
  Synthetic
caccgctgtcccaaaaggtctgctcatggagggattgaaactactatctctttgcattgagattgactcttgcaaggccaatggatgtgaacataacactgaagacaaaacggttgaatccatatcagcagccagggcct

SEQ ID NO: 432077 - DNA, 140 bp, Artificial Sequence
  Synthetic
aggccctggctgctgatatgttctcattatctgcaaggtactttgagataagatctttagcattagcaatgtcttcctccatcgccaattgtggcacctgtattgggtttgggtttatgcgaccttttgggacagcggtg

SEQ ID NO: 432078 - DNA, 140 bp, Artificial Sequence
  Synthetic
caccgctgtcccaaaaggtcgcataaacccaaacccaatacaggtgccacaattggcgatggaggaagacattgctaatgctaaagatcttatctcaaagtaccttgcagataatgagaacatatcagcagccagggcct

SEQ ID NO: 432079 - DNA, 140 bp, Artificial Sequence
  Synthetic
aggccctggctgctgatatgaagcactcatcttgatctggacacttagagatttactgattgaaattttctattcagtaagtcaataaaaggcgcaatccaatagcctaggatccactgtgaccttttgggacagcggtg

SEQ ID NO: 432080 - DNA, 140 bp, Artificial Sequence
  Synthetic
caccgctgtcccaaaaggtcacagtggatcctaggctattggattgcgccttttattgacttactgaatagaaaatttcaatcagtaaatctctaagtgtccagatcaagatgagtgcttcatatcagcagccagggcct

SEQ ID NO: 432081 - DNA, 140 bp, Artificial Sequence
  Synthetic
aggccctggctgctgatatgcaagatgccccttcccaccaagctaaaggcagcagcacagccgagcgcaccatcaaccgagacgatccagaacacaacacctccaccgtacaccccataagaccttttgggacagcggtg

SEQ ID NO: 432082 - DNA, 140 bp, Artificial Sequence
  Synthetic
caccgctgtcccaaaaggtcttatggggtgtacggtggaggtgttgtgttctggatcgtctcggttgatggtgcgctcggctgtgctgctgcctttagcttggtgggaaggggcatcttgcatatcagcagccagggcct

SEQ ID NO: 432083 - DNA, 140 bp, Artificial Sequence
  Synthetic
aggccctggctgctgatatgcccgggggggcaggcagcccagctctactcaatgtcctcgacacacctctctggcccaaacaactccgaacatgtccttcccttcagtctcaggctgcccgaccttttgggacagcggtg

SEQ ID NO: 432084 - DNA, 140 bp, Artificial Sequence
  Synthetic
caccgctgtcccaaaaggtcgggcagcctgagactgaagggaaggacatgttcggagttgtttgggccagagaggtgtgtcgaggacattgagtagagctgggctgcctgcccccccgggcatatcagcagccagggcct

SEQ ID NO: 432085 - DNA, 140 bp, Artificial Sequence
  Synthetic
aggccctggctgctgatatgagagctccagacccagccgacagcaccaccagaaatcccaccatcccaaaatcccccaccctacagcccctgaggcagaactccgccccgaagcccctccgaccttttgggacagcggtg

SEQ ID NO: 432086 - DNA, 140 bp, Artificial Sequence
  Synthetic
caccgctgtcccaaaaggtcggaggggcttcggggcggagttctgcctcaggggctgtagggtgggggattttgggatggtgggatttctggtggtgctgtcggctgggtctggagctctcatatcagcagccagggcct

SEQ ID NO: 432087 - DNA, 140 bp, Artificial Sequence
  Synthetic
aggccctggctgctgatatgttaaaatgggacaaatagtgacattcttccaggaagtgcctcatgtaatagaagaggtgatgaacattgttctcattgcactgtctatactagcagtgctgaccttttgggacagcggtg

SEQ ID NO: 432088 - DNA, 140 bp, Artificial Sequence
  Synthetic
caccgctgtcccaaaaggtcagcactgctagtatagacagtgcaatgagaacaatgttcatcacctcttctattacatgaggcacttcctggaagaatgtcactatttgtcccattttaacatatcagcagccagggcct

SEQ ID NO: 432089 - DNA, 140 bp, Artificial Sequence
  Synthetic
aggccctggctgctgatatggaagaggtgatgaacattgttctcattgcactgtctatactagcagtgctgaaaggtctgtacaatcttgcaacatgtggcctcgttggtttggtcacttgaccttttgggacagcggtg

SEQ ID NO: 432090 - DNA, 140 bp, Artificial Sequence
  Synthetic
caccgctgtcccaaaaggtcaagtgaccaaaccaacgaggccacatgttgcaagattgtacagacctttcagcactgctagtatagacagtgcaatgagaacaatgttcatcacctcttccatatcagcagccagggcct

SEQ ID NO: 432091 - DNA, 140 bp, Artificial Sequence
  Synthetic
atacgccatgctgggtctcccatgggctcacagacccagaatacagtgcttgtacatgattcaccacaaactcaccacattgattaacaagtcctgtcatgttgagatggatggaaaaggcgtacttgggagtcggccat

SEQ ID NO: 432092 - DNA, 140 bp, Artificial Sequence
  Synthetic
atggccgactcccaagtacgccttttccatccatctcaacatgacaggacttgttaatcaatgtggtgagtttgtggtgaatcatgtacaagcactgtattctgggtctgtgagcccatgggagacccagcatggcgtat

SEQ ID NO: 432093 - DNA, 140 bp, Artificial Sequence
  Synthetic
aggccctggctgctgatatgatacaacataatgttcctccctcttccacttaacaatgtgtgaaacaagtgaaagtgcctcgcaattcacatctagggcaacacaaagatcaaggaacttgaccttttgggacagcggtg

SEQ ID NO: 432094 - DNA, 140 bp, Artificial Sequence
  Synthetic
caccgctgtcccaaaaggtcaagttccttgatctttgtgttgccctagatgtgaattgcgaggcactttcacttgtttcacacattgttaagtggaagagggaggaacattatgttgtatcatatcagcagccagggcct

SEQ ID NO: 432095 - DNA, 140 bp, Artificial Sequence
  Synthetic
aggccctggctgctgatatgcttgttgttgctacaaaagagcggacatatgattcaaagtagatttgtctcataaagttatccactgcatcagcagtactaaccaccctttcttccatcagaccttttgggacagcggtg

SEQ ID NO: 432096 - DNA, 140 bp, Artificial Sequence
  Synthetic
caccgctgtcccaaaaggtctgatggaagaaagggtggttagtactgctgatgcagtggataactttatgagacaaatctactttgaatcatatgtccgctcttttgtagcaacaacaagcatatcagcagccagggcct

SEQ ID NO: 432097 - DNA, 140 bp, Artificial Sequence
  Synthetic
atacgccatgctgggtctccttcactatgggacagggtcccataggagatgcaagagacacagctggttaattaaagacaattaaattggatatccttaatgcctaggatcctcggtgcgcgtacttgggagtcggccat

SEQ ID NO: 432098 - DNA, 140 bp, Artificial Sequence
  Synthetic
atggccgactcccaagtacgcgcaccgaggatcctaggcattaaggatatccaatttaattgtctttaattaaccagctgtgtctcttgcatctcctatgggaccctgtcccatagtgaaggagacccagcatggcgtat

SEQ ID NO: 432099 - DNA, 140 bp, Artificial Sequence
  Synthetic
aggccctggctgctgatatgttgtcccccattactacttcaacaccttgagtccccagtagctgagtctgtatagatctgatgtaaagattctccttgttagggcccctgacgcacttgcgaccttttgggacagcggtg

SEQ ID NO: 432100 - DNA, 140 bp, Artificial Sequence
  Synthetic
caccgctgtcccaaaaggtcgcaagtgcgtcaggggccctaacaaggagaatctttacatcagatctatacagactcagctactggggactcaaggtgttgaagtagtaatgggggacaacatatcagcagccagggcct

SEQ ID NO: 432101 - DNA, 140 bp, Artificial Sequence
  Synthetic
atacgccatgctgggtctcctcagcgtcagcagcaggtgcccgatctgtaagatgccccttcccaccaagctaaaggcagcaacacagccgagtgcaccctcaactgaagcgacccagaacgtacttgggagtcggccat

SEQ ID NO: 432102 - DNA, 140 bp, Artificial Sequence
  Synthetic
atggccgactcccaagtacgttctgggtcgcttcagttgagggtgcactcggctgtgttgctgcctttagcttggtgggaaggggcatcttacagatcgggcacctgctgctgacgctgaggagacccagcatggcgtat

SEQ ID NO: 432103 - DNA, 140 bp, Artificial Sequence
  Synthetic
aggccctggctgctgatatgaatatcaattagtttgatgtcttttcttccttgtgattcaaggagtttccttatgtcatcggacccctgacaggtaatgaccatattccgggggagtgcagaccttttgggacagcggtg

SEQ ID NO: 432104 - DNA, 140 bp, Artificial Sequence
  Synthetic
caccgctgtcccaaaaggtctgcactcccccggaatatggtcattacctgtcaggggtccgatgacataaggaaactccttgaatcacaaggaagaaaagacatcaaactaattgatattcatatcagcagccagggcct

SEQ ID NO: 432105 - DNA, 140 bp, Artificial Sequence
  Synthetic
aggccctggctgctgatatgccttagaagcactcatcttagtctagacactcagggatttgctggttgaaagtatcactcagtgaatcaatggaaaggcgcaatccaatagcctaggatcgaccttttgggacagcggtg

SEQ ID NO: 432106 - DNA, 140 bp, Artificial Sequence
  Synthetic
caccgctgtcccaaaaggtcgatcctaggctattggattgcgcctttccattgattcactgagtgatactttcaaccagcaaatccctgagtgtctagactaagatgagtgcttctaaggcatatcagcagccagggcct

SEQ ID NO: 432107 - DNA, 140 bp, Artificial Sequence
  Synthetic
atacgccatgctgggtctcccttcattgacaaaatggcattgtcaaactccttctcattgtttagacagctgcccgctaattgtgatgtgagcgcttcaaagtaatcctcaatgagccttcgtacttgggagtcggccat

SEQ ID NO: 432108 - DNA, 140 bp, Artificial Sequence
  Synthetic
atggccgactcccaagtacgaaggctcattgaggattactttgaagcgctcacatcacaattagcgggcagctgtctaaacaatgagaaggagtttgacaatgccattttgtcaatgaagggagacccagcatggcgtat

SEQ ID NO: 432109 - DNA, 140 bp, Artificial Sequence
  Synthetic
aggccctggctgctgatatgacttgactgaatcataaccctttgctttgatttactgtagcaaagggcatagcctttgaaatcaatccattctccaagagattcaagaagttcactcagtgaccttttgggacagcggtg

SEQ ID NO: 432110 - DNA, 140 bp, Artificial Sequence
  Synthetic
caccgctgtcccaaaaggtcactgagtgaacttcttgaatctcttggagaatggattgatttcaaaggctatgccctttgctacagtaaatcaaagcaaagggttatgattcagtcaagtcatatcagcagccagggcct

SEQ ID NO: 432111 - DNA, 140 bp, Artificial Sequence
  Synthetic
aggccctggctgctgatatggactactttctgcaatacattgctggaaaaaactgaaggaaaaaaccgtttaggatcagcataaaaggaacaaacttctccaactgtattgttgttgatagaccttttgggacagcggtg

SEQ ID NO: 432112 - DNA, 140 bp, Artificial Sequence
  Synthetic
caccgctgtcccaaaaggtctatcaacaacaatacagttggagaagtttgttccttttatgctgatcctaaacggttttttccttcagttttttccagcaatgtattgcagaaagtagtccatatcagcagccagggcct

SEQ ID NO: 432113 - DNA, 140 bp, Artificial Sequence
  Synthetic
aggccctggctgctgatatgaaatcttctatcatgtggtttgaaagttcactttttatcaaccttattaagagtttttcttccaccaccttgtcaagatcagatattgagggtgtattgcgaccttttgggacagcggtg

SEQ ID NO: 432114 - DNA, 140 bp, Artificial Sequence
  Synthetic
caccgctgtcccaaaaggtcgcaatacaccctcaatatctgatcttgacaaggtggtggaagaaaaactcttaataaggttgataaaaagtgaactttcaaaccacatgatagaagatttcatatcagcagccagggcct

SEQ ID NO: 432115 - DNA, 140 bp, Artificial Sequence
  Synthetic
aggccctggctgctgatatgctcatcaccagattgttgtgttgagtgcacgtaacaaaaaactgagactgtttgccaaaatgacaagagcaaagcgcaatccaatagcctaggatccactgaccttttgggacagcggtg

SEQ ID NO: 432116 - DNA, 140 bp, Artificial Sequence
  Synthetic
caccgctgtcccaaaaggtcagtggatcctaggctattggattgcgctttgctcttgtcattttggcaaacagtctcagttttttgttacgtgcactcaacacaacaatctggtgatgagcatatcagcagccagggcct

SEQ ID NO: 432117 - DNA, 140 bp, Artificial Sequence
  Synthetic
atacgccatgctgggtctcccgcaccggggatcctaggcaatttggttgttcttctcttttgaggccttgtgcgctgaactcctccaaatgggaaacaagcaagccaaagccccagaatccgtacttgggagtcggccat

SEQ ID NO: 432118 - DNA, 140 bp, Artificial Sequence
  Synthetic
atggccgactcccaagtacggattctggggctttggcttgcttgtttcccatttggaggagttcagcgcacaaggcctcaaaagagaagaacaaccaaattgcctaggatccccggtgcgggagacccagcatggcgtat

SEQ ID NO: 432119 - DNA, 140 bp, Artificial Sequence
  Synthetic
aggccctggctgctgatatggttgaccatcacaaagagactactcaatgtcttcaatgcactcatccttcctggttagctcctcacatgttctgcccttcagtctcagtttgccaccactgaccttttgggacagcggtg

SEQ ID NO: 432120 - DNA, 140 bp, Artificial Sequence
  Synthetic
caccgctgtcccaaaaggtcagtggtggcaaactgagactgaagggcagaacatgtgaggagctaaccaggaaggatgagtgcattgaagacattgagtagtctctttgtgatggtcaaccatatcagcagccagggcct

SEQ ID NO: 432121 - DNA, 140 bp, Artificial Sequence
  Synthetic
aggccctggctgctgatatgcacactcgtccattgaactctttgttttaatctatcagacatcattgatttcaatgcaccaactaaaagatgtggggaactatcaccaatctctcttacagaccttttgggacagcggtg

SEQ ID NO: 432122 - DNA, 140 bp, Artificial Sequence
  Synthetic
caccgctgtcccaaaaggtctgtaagagagattggtgatagttccccacatcttttagttggtgcattgaaatcaatgatgtctgatagattaaaacaaagagttcaatggacgagtgtgcatatcagcagccagggcct

SEQ ID NO: 432123 - DNA, 140 bp, Artificial Sequence
  Synthetic
atacgccatgctgggtctccccctgaactccacccagctgtccactgcctcaagaaccgcacctaagatcccctcacaacccggtgctgcagtcctaagcacggagacaatgtccacccccgtacttgggagtcggccat

SEQ ID NO: 432124 - DNA, 140 bp, Artificial Sequence
  Synthetic
atggccgactcccaagtacgggggtggacattgtctccgtgcttaggactgcagcaccgggttgtgaggggatcttaggtgcggttcttgaggcagtggacagctgggtggagttcagggggagacccagcatggcgtat

SEQ ID NO: 432125 - DNA, 140 bp, Artificial Sequence
  Synthetic
aggccctggctgctgatatgggactcactgcacctgagtacataacggttacatcatgtattaaatacttggcctgttgattcattgagccagtatactcaaggtgaatggcaaagctttgaccttttgggacagcggtg

SEQ ID NO: 432126 - DNA, 140 bp, Artificial Sequence
  Synthetic
caccgctgtcccaaaaggtcaaagctttgccattcaccttgagtatactggctcaatgaatcaacaggccaagtatttaatacatgatgtaaccgttatgtactcaggtgcagtgagtcccatatcagcagccagggcct

SEQ ID NO: 432127 - DNA, 140 bp, Artificial Sequence
  Synthetic
atacgccatgctgggtctccggcctgttgattcattgagccagtatactcaaggtgaatggcaaagctttccttaaaactagcatcttgacttttaatgcggaacctcactgtctgactccgtacttgggagtcggccat

SEQ ID NO: 432128 - DNA, 140 bp, Artificial Sequence
  Synthetic
atggccgactcccaagtacggagtcagacagtgaggttccgcattaaaagtcaagatgctagttttaaggaaagctttgccattcaccttgagtatactggctcaatgaatcaacaggccggagacccagcatggcgtat

SEQ ID NO: 432129 - DNA, 140 bp, Artificial Sequence
  Synthetic
aggccctggctgctgatatgatcagatcatgcttaaacattggcctttcaacacctttgtaaataactttctctacaaatgaagaaaatggacccattctatgcaacccttcaccctctggaccttttgggacagcggtg

SEQ ID NO: 432130 - DNA, 140 bp, Artificial Sequence
  Synthetic
caccgctgtcccaaaaggtccagagggtgaagggttgcatagaatgggtccattttcttcatttgtagagaaagttatttacaaaggtgttgaaaggccaatgtttaagcatgatctgatcatatcagcagccagggcct

SEQ ID NO: 432131 - DNA, 140 bp, Artificial Sequence
  Synthetic
atacgccatgctgggtctccctctacaaatgaagaaaatggacccattctatgcaacccttcaccctctggaactgatgtcttgtgtggaaaccacgtgaaggaccccaatgttcttgtacgtacttgggagtcggccat

SEQ ID NO: 432132 - DNA, 140 bp, Artificial Sequence
  Synthetic
atggccgactcccaagtacgtacaagaacattggggtccttcacgtggtttccacacaagacatcagttccagagggtgaagggttgcatagaatgggtccattttcttcatttgtagagggagacccagcatggcgtat

SEQ ID NO: 432133 - DNA, 140 bp, Artificial Sequence
  Synthetic
aggccctggctgctgatatgtcaatcaaatccttgtgataaaagtcagacacaaaggccatcacaaaatacctaatgttttgtaaaaatttttgacaccttttactgggatgtgttagtagaccttttgggacagcggtg

SEQ ID NO: 432134 - DNA, 140 bp, Artificial Sequence
  Synthetic
caccgctgtcccaaaaggtctactaacacatcccagtaaaaggtgtcaaaaatttttacaaaacattaggtattttgtgatggcctttgtgtctgacttttatcacaaggatttgattgacatatcagcagccagggcct

SEQ ID NO: 432135 - DNA, 140 bp, Artificial Sequence
  Synthetic
aggccctggctgctgatatgcctaatgttttgtaaaaatttttgacaccttttactgggatgtgttagtatcaaaactaggatcattttggttaacaatttgatggtgatcaattgttcggaccttttgggacagcggtg

SEQ ID NO: 432136 - DNA, 140 bp, Artificial Sequence
  Synthetic
caccgctgtcccaaaaggtccgaacaattgatcaccatcaaattgttaaccaaaatgatcctagttttgatactaacacatcccagtaaaaggtgtcaaaaatttttacaaaacattaggcatatcagcagccagggcct

SEQ ID NO: 432137 - DNA, 140 bp, Artificial Sequence
  Synthetic
atacgccatgctgggtctcctaagtgatggggtacctgcatttctgtctctagttctcttccggctgtctatccaccgttttaaatctctttttgttgattccaatgaaactaatctatccgtacttgggagtcggccat

SEQ ID NO: 432138 - DNA, 140 bp, Artificial Sequence
  Synthetic
atggccgactcccaagtacggatagattagtttcattggaatcaacaaaaagagatttaaaacggtggatagacagccggaagagaactagagacagaaatgcaggtaccccatcacttaggagacccagcatggcgtat

SEQ ID NO: 432139 - DNA, 140 bp, Artificial Sequence
  Synthetic
atacgccatgctgggtctccccggggatcctaggcaattcagctggacttcagtggtaaggctcattttagtaaatccctgaatcaaagtactcagttaaaatgggcaacagacaagccacgtacttgggagtcggccat

SEQ ID NO: 432140 - DNA, 140 bp, Artificial Sequence
  Synthetic
atggccgactcccaagtacgtggcttgtctgttgcccattttaactgagtactttgattcagggatttactaaaatgagccttaccactgaagtccagctgaattgcctaggatccccggggagacccagcatggcgtat

SEQ ID NO: 432141 - DNA, 140 bp, Artificial Sequence
  Synthetic
aggccctggctgctgatatgtagagggtccaaattcattttgccttagtttcactgtggaagacgttttcattgagttgatcaaagccaagctcaatgatgatagtctttctaagtctgtgaccttttgggacagcggtg

SEQ ID NO: 432142 - DNA, 140 bp, Artificial Sequence
  Synthetic
caccgctgtcccaaaaggtcacagacttagaaagactatcatcattgagcttggctttgatcaactcaatgaaaacgtcttccacagtgaaactaaggcaaaatgaatttggaccctctacatatcagcagccagggcct

SEQ ID NO: 432143 - DNA, 140 bp, Artificial Sequence
  Synthetic
aggccctggctgctgatatgggttcccctaagacccatgcacccagttctattgcagttgataaggagatgcacatataatcccataacaagggtctaaaataactgaccacactctcacgaccttttgggacagcggtg

SEQ ID NO: 432144 - DNA, 140 bp, Artificial Sequence
  Synthetic
caccgctgtcccaaaaggtcgtgagagtgtggtcagttattttagacccttgttatgggattatatgtgcatctccttatcaactgcaatagaactgggtgcatgggtcttaggggaacccatatcagcagccagggcct

SEQ ID NO: 432145 - DNA, 140 bp, Artificial Sequence
  Synthetic
atacgccatgctgggtctccgtgttcagtacaacctcagccatgcttatgctgtgaatgcagctaaccactgtgggaccattgccaatggtgttctacagacttttatgaggatggcttgcgtacttgggagtcggccat

SEQ ID NO: 432146 - DNA, 140 bp, Artificial Sequence
  Synthetic
atggccgactcccaagtacgcaagccatcctcataaaagtctgtagaacaccattggcaatggtcccacagtggttagctgcattcacagcataagcatggctgaggttgtactgaacacggagacccagcatggcgtat

SEQ ID NO: 432147 - DNA, 140 bp, Artificial Sequence
  Synthetic
aggccctggctgctgatatgcactcacaaaacaggagcccagccaaccagcagggagcctatcaccatgctttatgcagtccagccggctagcaagaagaatcagaacgtcaaaaacaaggaccttttgggacagcggtg

SEQ ID NO: 432148 - DNA, 140 bp, Artificial Sequence
  Synthetic
caccgctgtcccaaaaggtccttgtttttgacgttctgattcttcttgctagccggctggactgcataaagcatggtgataggctccctgctggttggctgggctcctgttttgtgagtgcatatcagcagccagggcct

SEQ ID NO: 432149 - DNA, 140 bp, Artificial Sequence
  Synthetic
aggccctggctgctgatatggaaaagacctccaacattgcatctgatcactttgagagtcagcagccctttcctcaccagaatccaaatctgcatacaagaacttaaggactggagaggcgaccttttgggacagcggtg

SEQ ID NO: 432150 - DNA, 140 bp, Artificial Sequence
  Synthetic
caccgctgtcccaaaaggtcgcctctccagtccttaagttcttgtatgcagatttggattctggtgaggaaagggctgctgactctcaaagtgatcagatgcaatgttggaggtcttttccatatcagcagccagggcct

SEQ ID NO: 432151 - DNA, 140 bp, Artificial Sequence
  Synthetic
atacgccatgctgggtctcccttgctgcaagcattaggaatcaatccctctatttgcctcataattctataactacggttgccatctacccagtctctgacatctgtctcgcaattcaatcgtacttgggagtcggccat

SEQ ID NO: 432152 - DNA, 140 bp, Artificial Sequence
  Synthetic
atggccgactcccaagtacgattgaattgcgagacagatgtcagagactgggtagatggcaaccgtagttatagaattatgaggcaaatagagggattgattcctaatgcttgcagcaagggagacccagcatggcgtat

SEQ ID NO: 432153 - DNA, 140 bp, Artificial Sequence
  Synthetic
aggccctggctgctgatatgtgttattaataccctgatgacaactagaaattatttcctcaaaatgttttgcacgcttgtcagttagaacattgatgctttcaattcctgagagcctcccgaccttttgggacagcggtg

SEQ ID NO: 432154 - DNA, 140 bp, Artificial Sequence
  Synthetic
caccgctgtcccaaaaggtcgggaggctctcaggaattgaaagcatcaatgttctaactgacaagcgtgcaaaacattttgaggaaataatttctagttgtcatcagggtattaataacacatatcagcagccagggcct

SEQ ID NO: 432155 - DNA, 140 bp, Artificial Sequence
  Synthetic
atacgccatgctgggtctccacttgtgttgagtttgggtttgtaccagtatggcttgtgaatcggctggtggtgcctcacaggagatcctaaagaaatgagagacaatatgcctaggatccgtacttgggagtcggccat

SEQ ID NO: 432156 - DNA, 140 bp, Artificial Sequence
  Synthetic
atggccgactcccaagtacggatcctaggcatattgtctctcatttctttaggatctcctgtgaggcaccaccagccgattcacaagccatactggtacaaacccaaactcaacacaagtggagacccagcatggcgtat

SEQ ID NO: 432157 - DNA, 140 bp, Artificial Sequence
  Synthetic
aggccctggctgctgatatgaaaaagtctctttaaaactagcatcctgactcttgattttatatcttattgtctggtaaaactgaacagagtccactggcattgtacttaacaaatcaaagaccttttgggacagcggtg

SEQ ID NO: 432158 - DNA, 140 bp, Artificial Sequence
  Synthetic
caccgctgtcccaaaaggtctttgatttgttaagtacaatgccagtggactctgttcagttttaccagacaataagatataaaatcaagagtcaggatgctagttttaaagagactttttcatatcagcagccagggcct

SEQ ID NO: 432159 - DNA, 140 bp, Artificial Sequence
  Synthetic
aggccctggctgctgatatgcacctgtgttgggcttggacttgtacctgtatggcgtgtgggtcaactggtagtgccccacaaaagctcttacagaaatgagagacaatatgcctaggatgaccttttgggacagcggtg

SEQ ID NO: 432160 - DNA, 140 bp, Artificial Sequence
  Synthetic
caccgctgtcccaaaaggtcatcctaggcatattgtctctcatttctgtaagagcttttgtggggcactaccagttgacccacacgccatacaggtacaagtccaagcccaacacaggtgcatatcagcagccagggcct

SEQ ID NO: 432161 - DNA, 140 bp, Artificial Sequence
  Synthetic
aggccctggctgctgatatggtgagtgggcttcattaagccatgggacaaatcataacatttttccaggaagtacctcatgtcatagaggaagtgatgaacattgtcctgattgccctcagaccttttgggacagcggtg

SEQ ID NO: 432162 - DNA, 140 bp, Artificial Sequence
  Synthetic
caccgctgtcccaaaaggtctgagggcaatcaggacaatgttcatcacttcctctatgacatgaggtacttcctggaaaaatgttatgatttgtcccatggcttaatgaagcccactcaccatatcagcagccagggcct

SEQ ID NO: 432163 - DNA, 140 bp, Artificial Sequence
  Synthetic
atacgccatgctgggtctccttaatatgacaatgcccttatcttgcacgaagaacaacagccaccattacatcatggtcggaaatgagactggcttggagctgactttaacaaatacaagcgtacttgggagtcggccat

SEQ ID NO: 432164 - DNA, 140 bp, Artificial Sequence
  Synthetic
atggccgactcccaagtacgcttgtatttgttaaagtcagctccaagccagtctcatttccgaccatgatgtaatggtggctgttgttcttcgtgcaagataagggcattgtcatattaaggagacccagcatggcgtat

SEQ ID NO: 432165 - DNA, 140 bp, Artificial Sequence
  Synthetic
atacgccatgctgggtctcctgtatcatgactagttatcaatatctgataattcagaatacaacctgggaagatcactgccagttctcaagaccatctcccatcggttatcttggactcccgtacttgggagtcggccat

SEQ ID NO: 432166 - DNA, 140 bp, Artificial Sequence
  Synthetic
atggccgactcccaagtacgggagtccaagataaccgatgggagatggtcttgagaactggcagtgatcttcccaggttgtattctgaattatcagatattgataactagtcatgatacaggagacccagcatggcgtat

SEQ ID NO: 432167 - DNA, 140 bp, Artificial Sequence
  Synthetic
aggccctggctgctgatatgctgtcacaaaggaccagggacatttacatcagtcgaagacttcttgggacttttacttggactctctctgattctgaaggtaatgaaacaccgggtgggtgaccttttgggacagcggtg

SEQ ID NO: 432168 - DNA, 140 bp, Artificial Sequence
  Synthetic
caccgctgtcccaaaaggtcacccacccggtgtttcattaccttcagaatcagagagagtccaagtaaaagtcccaagaagtcttcgactgatgtaaatgtccctggtcctttgtgacagcatatcagcagccagggcct

SEQ ID NO: 432169 - DNA, 140 bp, Artificial Sequence
  Synthetic
atacgccatgctgggtctccttttgttgctggctaaatccaaggctgtagcacaaccactggtgatgagaggatctttaatttccctttttacctccctctccttaaatagtgaaccattcgtacttgggagtcggccat

SEQ ID NO: 432170 - DNA, 140 bp, Artificial Sequence
  Synthetic
atggccgactcccaagtacgaatggttcactatttaaggagagggaggtaaaaagggaaattaaagatcctctcatcaccagtggttgtgctacagccttggatttagccagcaacaaaaggagacccagcatggcgtat

SEQ ID NO: 432171 - DNA, 140 bp, Artificial Sequence
  Synthetic
aggccctggctgctgatatgttttcccaggcccttcctgttattgaggttcttgatgcaatatatggccatccatctcctgacaaacagatcttgtagagtatgttttcataaggattccgaccttttgggacagcggtg

SEQ ID NO: 432172 - DNA, 140 bp, Artificial Sequence
  Synthetic
caccgctgtcccaaaaggtcggaatccttatgaaaacatactctacaagatctgtttgtcaggagatggatggccatatattgcatcaagaacctcaataacaggaagggcctgggaaaacatatcagcagccagggcct

SEQ ID NO: 432173 - DNA, 140 bp, Artificial Sequence
  Synthetic
atacgccatgctgggtctcccggggatcctaggcaatttggttgttctttctgaggcattgtgcactgtactcctccaaatgggaaacaagcaagccaaagccccagaagcaaaagacagcgtacttgggagtcggccat

SEQ ID NO: 432174 - DNA, 140 bp, Artificial Sequence
  Synthetic
atggccgactcccaagtacgctgtcttttgcttctggggctttggcttgcttgtttcccatttggaggagtacagtgcacaatgcctcagaaagaacaaccaaattgcctaggatccccgggagacccagcatggcgtat

SEQ ID NO: 432175 - DNA, 140 bp, Artificial Sequence
  Synthetic
aggccctggctgctgatatgctcctccaaatgggaaacaagcaagccaaagccccagaagcaaaagacagcccgagagccagcctgatcccagatgccacacatctagggccacagttctgaccttttgggacagcggtg

SEQ ID NO: 432176 - DNA, 140 bp, Artificial Sequence
  Synthetic
caccgctgtcccaaaaggtcagaactgtggccctagatgtgtggcatctgggatcaggctggctctcgggctgtcttttgcttctggggctttggcttgcttgtttcccatttggaggagcatatcagcagccagggcct

SEQ ID NO: 432177 - DNA, 140 bp, Artificial Sequence
  Synthetic
aggccctggctgctgatatggttctagatctttcagcctgctgcctccgctcaacccatttttttagatccctctttgttgactccaaggaaactagtctgtcattaacactcatgaaacgaccttttgggacagcggtg

SEQ ID NO: 432178 - DNA, 140 bp, Artificial Sequence
  Synthetic
caccgctgtcccaaaaggtcgtttcatgagtgttaatgacagactagtttccttggagtcaacaaagagggatctaaaaaaatgggttgagcggaggcagcaggctgaaagatctagaaccatatcagcagccagggcct

SEQ ID NO: 432179 - DNA, 140 bp, Artificial Sequence
  Synthetic
aggccctggctgctgatatgcacttccttagaagcactcatcttggtctggacacttgggatttactggttgaaagtatcactcagtaagtcaatgaaaagcgcaatccaatagcctagggaccttttgggacagcggtg

SEQ ID NO: 432180 - DNA, 140 bp, Artificial Sequence
  Synthetic
caccgctgtcccaaaaggtccctaggctattggattgcgcttttcattgacttactgagtgatactttcaaccagtaaatcccaagtgtccagaccaagatgagtgcttctaaggaagtgcatatcagcagccagggcct

SEQ ID NO: 432181 - DNA, 140 bp, Artificial Sequence
  Synthetic
aggccctggctgctgatatggcaacaattcactataggataggatctcgtaggaggcacagaagacacaagaggaaattaaagacaatttaattagatagccttaatgcctaggatcctcgaccttttgggacagcggtg

SEQ ID NO: 432182 - DNA, 140 bp, Artificial Sequence
  Synthetic
caccgctgtcccaaaaggtcgaggatcctaggcattaaggctatctaattaaattgtctttaatttcctcttgtgtcttctgtgcctcctacgagatcctatcctatagtgaattgttgccatatcagcagccagggcct

SEQ ID NO: 432183 - DNA, 140 bp, Artificial Sequence
  Synthetic
atacgccatgctgggtctcccccacaaaactgagatcatcggtcgctccaacagcacctccaaccagagcagcagacagcaccagacccccaccctacagtccctgaacgacccaccgaccgtacttgggagtcggccat

SEQ ID NO: 432184 - DNA, 140 bp, Artificial Sequence
  Synthetic
atggccgactcccaagtacggtcggtgggtcgttcagggactgtagggtgggggtctggtgctgtctgctgctctggttggaggtgctgttggagcgaccgatgatctcagttttgtgggggagacccagcatggcgtat

SEQ ID NO: 432185 - DNA, 140 bp, Artificial Sequence
  Synthetic
atacgccatgctgggtctccccccccggggggaccccccgccgggggcccccccggggggggttgaccatcacaaagagactactcaatgtcttcaatgcactcatccttcctggttagccgtacttgggagtcggccat

SEQ ID NO: 432186 - DNA, 140 bp, Artificial Sequence
  Synthetic
atggccgactcccaagtacggctaaccaggaaggatgagtgcattgaagacattgagtagtctctttgtgatggtcaaccccccccgggggggcccccggcggggggtccccccggggggggagacccagcatggcgtat

SEQ ID NO: 432187 - DNA, 140 bp, Artificial Sequence
  Synthetic
aggccctggctgctgatatgcccccacttgactgaatcataactctttgctttgatttgctatagcaaagagcatagcctttgaaatcaatccattctccaagagattcaagaagttcacgaccttttgggacagcggtg

SEQ ID NO: 432188 - DNA, 140 bp, Artificial Sequence
  Synthetic
caccgctgtcccaaaaggtcgtgaacttcttgaatctcttggagaatggattgatttcaaaggctatgctctttgctatagcaaatcaaagcaaagagttatgattcagtcaagtgggggcatatcagcagccagggcct

SEQ ID NO: 432189 - DNA, 140 bp, Artificial Sequence
  Synthetic
aggccctggctgctgatatgctaggcattttggattgcgcaatttgaatgcccttgttgacatgggacaaatagtaactttcttccaggaggtgcctcatgtgatagaggaggtgatgaagaccttttgggacagcggtg

SEQ ID NO: 432190 - DNA, 140 bp, Artificial Sequence
  Synthetic
caccgctgtcccaaaaggtcttcatcacctcctctatcacatgaggcacctcctggaagaaagttactatttgtcccatgtcaacaagggcattcaaattgcgcaatccaaaatgcctagcatatcagcagccagggcct

SEQ ID NO: 432191 - DNA, 140 bp, Artificial Sequence
  Synthetic
  misc_feature (29)..(29): n is a, c, g, or t
aggccctggctgctgatatgggcaacccngctctactcaatgtcctcgacgcacctctctggcccaaacaactccgaacatgtccttcccttcagtctcaggctgcccccacttgactgagaccttttgggacagcggtg

SEQ ID NO: 432192 - DNA, 140 bp, Artificial Sequence
  Synthetic
  misc_feature (112)..(112): n is a, c, g, or t
caccgctgtcccaaaaggtctcagtcaagtgggggcagcctgagactgaagggaaggacatgttcggagttgtttgggccagagaggtgcgtcgaggacattgagtagagcngggttgcccatatcagcagccagggcct

SEQ ID NO: 432193 - DNA, 140 bp, Artificial Sequence
  Synthetic
atacgccatgctgggtctcccattaacactcataaaacaggagcccagccaaccagcagggagcttgtcaccatgtcttgtgcagtccagccggctagcaagaagaatcaggacgtcaaacgtacttgggagtcggccat

SEQ ID NO: 432194 - DNA, 140 bp, Artificial Sequence
  Synthetic
atggccgactcccaagtacgtttgacgtcctgattcttcttgctagccggctggactgcacaagacatggtgacaagctccctgctggttggctgggctcctgttttatgagtgttaatgggagacccagcatggcgtat

SEQ ID NO: 432195 - DNA, 140 bp, Artificial Sequence
  Synthetic
aggccctggctgctgatatgccatgtcttgtgcagtccagccggctagcaagaagaatcaggacgtcaaaaacaaggaggagtttcctcctggtgttgaggattcttagagactttatctgaccttttgggacagcggtg

SEQ ID NO: 432196 - DNA, 140 bp, Artificial Sequence
  Synthetic
caccgctgtcccaaaaggtcagataaagtctctaagaatcctcaacaccaggaggaaactcctccttgtttttgacgtcctgattcttcttgctagccggctggactgcacaagacatggcatatcagcagccagggcct

SEQ ID NO: 432197 - DNA, 140 bp, Artificial Sequence
  Synthetic
atacgccatgctgggtctccgccctttccttgccagaattcaaatctgcatacaagaacttaaggactggggaggctcttcgaaactggaatgttaactgttcaatgtcgtcgtcacaggcgtacttgggagtcggccat

SEQ ID NO: 432198 - DNA, 140 bp, Artificial Sequence
  Synthetic
atggccgactcccaagtacgcctgtgacgacgacattgaacagttaacattccagtttcgaagagcctccccagtccttaagttcttgtatgcagatttgaattctggcaaggaaagggcggagacccagcatggcgtat

SEQ ID NO: 432199 - DNA, 140 bp, Artificial Sequence
  Synthetic
aggccctggctgctgatatgggaggctcttcgaaactggaatgttaactgttcaatgtcgtcgtcacaggtgtctattttatcactgtatagctttctgaaatcctctaataacttcatcgaccttttgggacagcggtg

SEQ ID NO: 432200 - DNA, 140 bp, Artificial Sequence
  Synthetic
caccgctgtcccaaaaggtcgatgaagttattagaggatttcagaaagctatacagtgataaaatagacacctgtgacgacgacattgaacagttaacattccagtttcgaagagcctcccatatcagcagccagggcct

SEQ ID NO: 432201 - DNA, 140 bp, Artificial Sequence
  Synthetic
aggccctggctgctgatatgcaaaaggagtacatggacaggcaagggaaaacacccttagggttagtagatctttttgtcttcagcaccagcttttatctcattagcatcttcctccaccgaccttttgggacagcggtg

SEQ ID NO: 432202 - DNA, 140 bp, Artificial Sequence
  Synthetic
caccgctgtcccaaaaggtcggtggaggaagatgctaatgagataaaagctggtgctgaagacaaaaagatctactaaccctaagggtgttttcccttgcctgtccatgtactccttttgcatatcagcagccagggcct

SEQ ID NO: 432203 - DNA, 140 bp, Artificial Sequence
  Synthetic
aggccctggctgctgatatgcaattttccaccacttgattgtatcatcaccttcccctttgacttactataacagagagcataacccttgaactccacccaattgtctactgcttcaagagaccttttgggacagcggtg

SEQ ID NO: 432204 - DNA, 140 bp, Artificial Sequence
  Synthetic
caccgctgtcccaaaaggtctcttgaagcagtagacaattgggtggagttcaagggttatgctctctgttatagtaagtcaaaggggaaggtgatgatacaatcaagtggtggaaaattgcatatcagcagccagggcct

SEQ ID NO: 432205 - DNA, 140 bp, Artificial Sequence
  Synthetic
atacgccatgctgggtctccgagataagatctttggcattggcaatgtcttcctccattgcctattgtaacacctgtattgggtttgggtttgtgccagaatggcttgtgggtcagctgccgtacttgggagtcggccat

SEQ ID NO: 432206 - DNA, 140 bp, Artificial Sequence
  Synthetic
atggccgactcccaagtacggcagctgacccacaagccattctggcacaaacccaaacccaatacaggtgttacaataggcaatggaggaagacattgccaatgccaaagatcttatctcggagacccagcatggcgtat

SEQ ID NO: 432207 - DNA, 140 bp, Artificial Sequence
  Synthetic
aggccctggctgctgatatgcacctgtattgggtttgggtttgtgccagaatggcttgtgggtcagctgctggcaccctacaaaagctcctacaaaaatgagagacaatatgcctaggatgaccttttgggacagcggtg

SEQ ID NO: 432208 - DNA, 140 bp, Artificial Sequence
  Synthetic
caccgctgtcccaaaaggtcatcctaggcatattgtctctcatttttgtaggagcttttgtagggtgccagcagctgacccacaagccattctggcacaaacccaaacccaatacaggtgcatatcagcagccagggcct

SEQ ID NO: 432209 - DNA, 140 bp, Artificial Sequence
  Synthetic
atacgccatgctgggtctccccattgtcccccatcactgcttcaacaccttgagtccccagtagctgagtctgtatggatctaatgtaaagattctccttgttagggcctctgacgcactcgtacttgggagtcggccat

SEQ ID NO: 432210 - DNA, 140 bp, Artificial Sequence
  Synthetic
atggccgactcccaagtacgagtgcgtcagaggccctaacaaggagaatctttacattagatccatacagactcagctactggggactcaaggtgttgaagcagtgatgggggacaatggggagacccagcatggcgtat

SEQ ID NO: 432211 - DNA, 140 bp, Artificial Sequence
  Synthetic
atacgccatgctgggtctccgagttaaaactctgttgatgatggcaaagagctcacaattccgttcttctttgagtgataggataccagcattcctgtctttagtcctcttcctgctgtccgtacttgggagtcggccat

SEQ ID NO: 432212 - DNA, 140 bp, Artificial Sequence
  Synthetic
atggccgactcccaagtacggacagcaggaagaggactaaagacaggaatgctggtatcctatcactcaaagaagaacggaattgtgagctctttgccatcatcaacagagttttaactcggagacccagcatggcgtat

SEQ ID NO: 432213 - DNA, 140 bp, Artificial Sequence
  Synthetic
atacgccatgctgggtctcctaaagagctatttccacagggtcttctggacgaccttcaatgtctatccaggttttggcacttgggtcaagctgcatcattgagtctttaagtgtcatcacgtacttgggagtcggccat

SEQ ID NO: 432214 - DNA, 140 bp, Artificial Sequence
  Synthetic
atggccgactcccaagtacgtgatgacacttaaagactcaatgatgcagcttgacccaagtgccaaaacctggatagacattgaaggtcgtccagaagaccctgtggaaatagctctttaggagacccagcatggcgtat

SEQ ID NO: 432215 - DNA, 140 bp, Artificial Sequence
  Synthetic
atacgccatgctgggtctccgatgcgcgagctgttctcgagcacctactcaatgtcgaggggaggccccacctcttcaaagaggggcctgcacagcctccctcttaatctaaacttcccccgtacttgggagtcggccat

SEQ ID NO: 432216 - DNA, 140 bp, Artificial Sequence
  Synthetic
atggccgactcccaagtacgggggaagtttagattaagagggaggctgtgcaggcccctctttgaagaggtggggcctcccctcgacattgagtaggtgctcgagaacagctcgcgcatcggagacccagcatggcgtat

SEQ ID NO: 432217 - DNA, 140 bp, Artificial Sequence
  Synthetic
aggccctggctgctgatatggatcctaggcaatttagctggacttcagtggtaaagttcattctagtgaatccctgaatcaaagtgcccagtcaaaatgggcaacaaacaggcaaaatcggaccttttgggacagcggtg

SEQ ID NO: 432218 - DNA, 140 bp, Artificial Sequence
  Synthetic
caccgctgtcccaaaaggtccgattttgcctgtttgttgcccattttgactgggcactttgattcagggattcactagaatgaactttaccactgaagtccagctaaattgcctaggatccatatcagcagccagggcct

SEQ ID NO: 432219 - DNA, 140 bp, Artificial Sequence
  Synthetic
aggccctggctgctgatatgaaagtcctcttctgaatttgattacacagatcaactgggacaccattagccacagattgatcaattatggtatcaattgtttctgccaactgatggggttgaccttttgggacagcggtg

SEQ ID NO: 432220 - DNA, 140 bp, Artificial Sequence
  Synthetic
caccgctgtcccaaaaggtcaaccccatcagttggcagaaacaattgataccataattgatcaatctgtggctaatggtgtcccagttgatctgtgtaatcaaattcagaagaggactttcatatcagcagccagggcct

SEQ ID NO: 432221 - DNA, 140 bp, Artificial Sequence
  Synthetic
aggccctggctgctgatatgtcatgtcactcaatgctccaatcagcaggtcagatgaagtgtccccaacttcttttacaaagatctcaagatcttggtcttgtatgacaggtgtaaaggagaccttttgggacagcggtg

SEQ ID NO: 432222 - DNA, 140 bp, Artificial Sequence
  Synthetic
caccgctgtcccaaaaggtctcctttacacctgtcatacaagaccaagatcttgagatctttgtaaaagaagttggggacacttcatctgacctgctgattggagcattgagtgacatgacatatcagcagccagggcct

SEQ ID NO: 432223 - DNA, 140 bp, Artificial Sequence
  Synthetic
aggccctggctgctgatatgattcctgtctttagtcttcttcctgctgtctatccaccgtcttagatctctttttgttgattccaatgaaactaatctatcattaacgctcacaaaacaggaccttttgggacagcggtg

SEQ ID NO: 432224 - DNA, 140 bp, Artificial Sequence
  Synthetic
caccgctgtcccaaaaggtcctgttttgtgagcgttaatgatagattagtttcattggaatcaacaaaaagagatctaagacggtggatagacagcaggaagaagactaaagacaggaatcatatcagcagccagggcct

SEQ ID NO: 432225 - DNA, 140 bp, Artificial Sequence
  Synthetic
aggccctggctgctgatatggtctatccaggttttagcacttgggtcaagttgcatcattgagtctttaagtgtcatcaactgagaataggtcaaccctgttggaaaccctgctgactgtgaccttttgggacagcggtg

SEQ ID NO: 432226 - DNA, 140 bp, Artificial Sequence
  Synthetic
caccgctgtcccaaaaggtcacagtcagcagggtttccaacagggttgacctattctcagttgatgacacttaaagactcaatgatgcaacttgacccaagtgctaaaacctggatagaccatatcagcagccagggcct

SEQ ID NO: 432227 - DNA, 140 bp, Artificial Sequence
  Synthetic
atacgccatgctgggtctcccaggagatgacctgacaaagcactccagcagtattaagacattgcccgtcagtttgtaaccgtccggtaccacaaaacataatgaaggggtcaagactcccgtacttgggagtcggccat

SEQ ID NO: 432228 - DNA, 140 bp, Artificial Sequence
  Synthetic
atggccgactcccaagtacgggagtcttgaccccttcattatgttttgtggtaccggacggttacaaactgacgggcaatgtcttaatactgctggagtgctttgtcaggtcatctcctgggagacccagcatggcgtat

SEQ ID NO: 432229 - DNA, 140 bp, Artificial Sequence
  Synthetic
atacgccatgctgggtctccacgaacaagtctgtagagtagatattcaacttctgtgatcaaatcctccctgattttctcaatcaaatccttgtgataaaaatcggacacaaaggccatccgtacttgggagtcggccat

SEQ ID NO: 432230 - DNA, 140 bp, Artificial Sequence
  Synthetic
atggccgactcccaagtacggatggcctttgtgtccgatttttatcacaaggatttgattgagaaaatcagggaggatttgatcacagaagttgaatatctactctacagacttgttcgtggagacccagcatggcgtat

SEQ ID NO: 432231 - DNA, 140 bp, Artificial Sequence
  Synthetic
aggccctggctgctgatatgtaaaggcagcagcacagccgagcgcaccatcaaccgagacgatccagaacacaacacctccaccgtacaccccataaccccaggaccaacactcccctctgaccttttgggacagcggtg

SEQ ID NO: 432232 - DNA, 140 bp, Artificial Sequence
  Synthetic
caccgctgtcccaaaaggtcagaggggagtgttggtcctggggttatggggtgtacggtggaggtgttgtgttctggatcgtctcggttgatggtgcgctcggctgtgctgctgcctttacatatcagcagccagggcct

SEQ ID NO: 432233 - DNA, 140 bp, Artificial Sequence
  Synthetic
atacgccatgctgggtctccatctccatcgcccaccccccacccccggggggaccccccgccgggggcccccccggggggcaggcagcccaactctactcaatgtcttcaatacacctctcgtacttgggagtcggccat

SEQ ID NO: 432234 - DNA, 140 bp, Artificial Sequence
  Synthetic
atggccgactcccaagtacgagaggtgtattgaagacattgagtagagttgggctgcctgccccccgggggggcccccggcggggggtccccccgggggtggggggtgggcgatggagatggagacccagcatggcgtat

SEQ ID NO: 432235 - DNA, 140 bp, Artificial Sequence
  Synthetic
aggccctggctgctgatatgcaagatgcctcttcccacaaaactgagaccatcagccactccaacagcacccccaaccgaagcagcagacagcatcagacccccaccctaccgcccctaagaccttttgggacagcggtg

SEQ ID NO: 432236 - DNA, 140 bp, Artificial Sequence
  Synthetic
caccgctgtcccaaaaggtcttaggggcggtagggtgggggtctgatgctgtctgctgcttcggttgggggtgctgttggagtggctgatggtctcagttttgtgggaagaggcatcttgcatatcagcagccagggcct

SEQ ID NO: 432237 - DNA, 140 bp, Artificial Sequence
  Synthetic
aggccctggctgctgatatgctccgggggagccaaccctctccaagagactactcaatgtcctcgatgcattcatccctcctggtcaactcctcacatgttctgcccttcaatctcaattgaccttttgggacagcggtg

SEQ ID NO: 432238 - DNA, 140 bp, Artificial Sequence
  Synthetic
caccgctgtcccaaaaggtcaattgagattgaagggcagaacatgtgaggagttgaccaggagggatgaatgcatcgaggacattgagtagtctcttggagagggttggctcccccggagcatatcagcagccagggcct

SEQ ID NO: 432239 - DNA, 140 bp, Artificial Sequence
  Synthetic
atacgccatgctgggtctcccagaaccctcagggcatgtggtctactggagcaacagtttagtacaggacaaattcttgtaaaggcatagaagaaacaaaaggcaatcaaagacaatcaacgtacttgggagtcggccat

SEQ ID NO: 432240 - DNA, 140 bp, Artificial Sequence
  Synthetic
atggccgactcccaagtacgttgattgtctttgattgccttttgtttcttctatgcctttacaagaatttgtcctgtactaaactgttgctccagtagaccacatgccctgagggttctgggagacccagcatggcgtat

SEQ ID NO: 432241 - DNA, 140 bp, Artificial Sequence
  Synthetic
atacgccatgctgggtctccactctttttgaccttcagtatagacttgaggatgccatccattgtctgaggtgataccttgattgtctccagcatgttgccaccatctagcatacaggctcgtacttgggagtcggccat

SEQ ID NO: 432242 - DNA, 140 bp, Artificial Sequence
  Synthetic
atggccgactcccaagtacgagcctgtatgctagatggtggcaacatgctggagacaatcaaggtatcacctcagacaatggatggcatcctcaagtctatactgaaggtcaaaaagagtggagacccagcatggcgtat

SEQ ID NO: 432243 - DNA, 140 bp, Artificial Sequence
  Synthetic
atacgccatgctgggtctccccggggatcctaggcatttttggttgcgcaatttgaatgtccttgttgacatgggacaaatagtgactttctttcaggaagtgcctcatgtgatagaggacgtacttgggagtcggccat

SEQ ID NO: 432244 - DNA, 140 bp, Artificial Sequence
  Synthetic
atggccgactcccaagtacgtcctctatcacatgaggcacttcctgaaagaaagtcactatttgtcccatgtcaacaaggacattcaaattgcgcaaccaaaaatgcctaggatccccggggagacccagcatggcgtat

SEQ ID NO: 432245 - DNA, 140 bp, Artificial Sequence
  Synthetic
aggccctggctgctgatatgatgggacaaatagtgactttctttcaggaagtgcctcatgtgatagaggaggtgatgaacattgtgctcatcgcattgtctctactggcagtgttgaaaggaccttttgggacagcggtg

SEQ ID NO: 432246 - DNA, 140 bp, Artificial Sequence
  Synthetic
caccgctgtcccaaaaggtcctttcaacactgccagtagagacaatgcgatgagcacaatgttcatcacctcctctatcacatgaggcacttcctgaaagaaagtcactatttgtcccatcatatcagcagccagggcct

SEQ ID NO: 432247 - DNA, 140 bp, Artificial Sequence
  Synthetic
atacgccatgctgggtctcccagctatcaatacctgataatccaaaatacaacctgggacgatcattgccagttctcgagaccatctcccatcggttatctcggtctcctttcgcaaaggcgtacttgggagtcggccat

SEQ ID NO: 432248 - DNA, 140 bp, Artificial Sequence
  Synthetic
atggccgactcccaagtacgcctttgcgaaaggagaccgagataaccgatgggagatggtctcgagaactggcaatgatcgtcccaggttgtattttggattatcaggtattgatagctgggagacccagcatggcgtat

SEQ ID NO: 432249 - DNA, 140 bp, Artificial Sequence
  Synthetic
atacgccatgctgggtctccttactgtgtggtagatcctgcacaaccaatctttacaaaggagtctatgagcttcagactctggaactaaacatggagacactcaatatgaccatgcctccgtacttgggagtcggccat

SEQ ID NO: 432250 - DNA, 140 bp, Artificial Sequence
  Synthetic
atggccgactcccaagtacggaggcatggtcatattgagtgtctccatgtttagttccagagtctgaagctcatagactcctttgtaaagattggttgtgcaggatctaccacacagtaaggagacccagcatggcgtat

SEQ ID NO: 432251 - DNA, 140 bp, Artificial Sequence
  Synthetic
aggccctggctgctgatatgttgtaatctgtctgatgctcacaaaaagaatctctatgatcacacccttatgagcataatttcgacttttcacctgtccattcccaacttcaatcagtatgaccttttgggacagcggtg

SEQ ID NO: 432252 - DNA, 140 bp, Artificial Sequence
  Synthetic
caccgctgtcccaaaaggtcatactgattgaagttgggaatggacaggtgaaaagtcgaaattatgctcataagggtgtgatcatagagattctttttgtgagcatcagacagattacaacatatcagcagccagggcct

SEQ ID NO: 432253 - DNA, 140 bp, Artificial Sequence
  Synthetic
aggccctggctgctgatatgttttctcaatcaaatccttgtgataaaaatcggacacaaaggccatcacaaagtacctaatgttttgtaaaaatttttgacaccttttactaggatgtgtgaccttttgggacagcggtg

SEQ ID NO: 432254 - DNA, 140 bp, Artificial Sequence
  Synthetic
caccgctgtcccaaaaggtcacacatcctagtaaaaggtgtcaaaaatttttacaaaacattaggtactttgtgatggcctttgtgtccgatttttatcacaaggatttgattgagaaaacatatcagcagccagggcct

SEQ ID NO: 432255 - DNA, 140 bp, Artificial Sequence
  Synthetic
atacgccatgctgggtctcctgttaattgaggctgagctgaaatgcttcggtaatacagctgtggccaaatgcaatgaaaaacatgatgaagaattctgtgacatgctgagactgtttgacgtacttgggagtcggccat

SEQ ID NO: 432256 - DNA, 140 bp, Artificial Sequence
  Synthetic
atggccgactcccaagtacgtcaaacagtctcagcatgtcacagaattcttcatcatgtttttcattgcatttggccacagctgtattaccgaagcatttcagctcagcctcaattaacaggagacccagcatggcgtat

SEQ ID NO: 432257 - DNA, 140 bp, Artificial Sequence
  Synthetic
aggccctggctgctgatatgtgcaatgaaaaacatgatgaagaattctgtgacatgctgagactgtttgactttaacaaacaagccattcaaagattaaaggctgaggcacaaatgagtagaccttttgggacagcggtg

SEQ ID NO: 432258 - DNA, 140 bp, Artificial Sequence
  Synthetic
caccgctgtcccaaaaggtctactcatttgtgcctcagcctttaatctttgaatggcttgtttgttaaagtcaaacagtctcagcatgtcacagaattcttcatcatgtttttcattgcacatatcagcagccagggcct

SEQ ID NO: 432259 - DNA, 140 bp, Artificial Sequence
  Synthetic
atacgccatgctgggtctccatgaaaaaccatctacgggacatcatggggattccatactgtaactatagtaagtattggtatctcaaccacacaaccactggaaaaacatcgttgcccacgtacttgggagtcggccat

SEQ ID NO: 432260 - DNA, 140 bp, Artificial Sequence
  Synthetic
atggccgactcccaagtacgtgggcaacgatgtttttccagtggttgtgtggttgagataccaatacttactatagttacagtatggaatccccatgatgtcccgtagatggtttttcatggagacccagcatggcgtat

SEQ ID NO: 432261 - DNA, 140 bp, Artificial Sequence
  Synthetic
aggccctggctgctgatatgtaagtattggtatctcaaccacacaaccactggaaaaacatcgttgcccaaatgctggcttgtatctaatggttcatatctaaacgagacccacttttctgaccttttgggacagcggtg

SEQ ID NO: 432262 - DNA, 140 bp, Artificial Sequence
  Synthetic
caccgctgtcccaaaaggtcagaaaagtgggtctcgtttagatatgaaccattagatacaagccagcatttgggcaacgatgtttttccagtggttgtgtggttgagataccaatacttacatatcagcagccagggcct

SEQ ID NO: 432263 - DNA, 140 bp, Artificial Sequence
  Synthetic
atacgccatgctgggtctccaaaataccaacacataggcacattgttggcaaaccgtgtccgaaacctcacaggctgaatcacatgggcatatgttcttgtggactctacaaacaacctgcgtacttgggagtcggccat

SEQ ID NO: 432264 - DNA, 140 bp, Artificial Sequence
  Synthetic
atggccgactcccaagtacgcaggttgtttgtagagtccacaagaacatatgcccatgtgattcagcctgtgaggtttcggacacggtttgccaacaatgtgcctatgtgttggtattttggagacccagcatggcgtat

SEQ ID NO: 432265 - DNA, 140 bp, Artificial Sequence
  Synthetic
aggccctggctgctgatatgcaggctgaatcacatgggcatatgttcttgtggactctacaaacaacctggtgtacctgtgagatggaagagataagacccccgtcggggcccccgtgacgaccttttgggacagcggtg

SEQ ID NO: 432266 - DNA, 140 bp, Artificial Sequence
  Synthetic
caccgctgtcccaaaaggtcgtcacgggggccccgacgggggtcttatctcttccatctcacaggtacaccaggttgtttgtagagtccacaagaacatatgcccatgtgattcagcctgcatatcagcagccagggcct

SEQ ID NO: 432267 - DNA, 140 bp, Artificial Sequence
  Synthetic
aggccctggctgctgatatgttctcaacaacgacacctgtgtgcatatggcataaatctttgtactgatcccagactgcattctcatacttcctggaatcagttttgttgagagcaatgtgaccttttgggacagcggtg

SEQ ID NO: 432268 - DNA, 140 bp, Artificial Sequence
  Synthetic
caccgctgtcccaaaaggtcacattgctctcaacaaaactgattccaggaagtatgagaatgcagtctgggatcagtacaaagatttatgccatatgcacacaggtgtcgttgttgagaacatatcagcagccagggcct

SEQ ID NO: 432269 - DNA, 140 bp, Artificial Sequence
  Synthetic
aggccctggctgctgatatgaacagcactggtcaaacctggctgtgcagcgaagaggtctgtgacatcaattccatgtgaatacttagcatcttgcttaaactgcttcaagtcagtaggcgaccttttgggacagcggtg

SEQ ID NO: 432270 - DNA, 140 bp, Artificial Sequence
  Synthetic
caccgctgtcccaaaaggtcgcctactgacttgaagcagtttaagcaagatgctaagtattcacatggaattgatgtcacagacctcttcgctgcacagccaggtttgaccagtgctgttcatatcagcagccagggcct

SEQ ID NO: 432271 - DNA, 140 bp, Artificial Sequence
  Synthetic
aggccctggctgctgatatgagcaacattctgggttcagtttggactagaaaagccaatttctgtcttgacagcttctcgttgtctgcaaggtactttgagatgaggtctttggcgttgggaccttttgggacagcggtg

SEQ ID NO: 432272 - DNA, 140 bp, Artificial Sequence
  Synthetic
caccgctgtcccaaaaggtcccaacgccaaagacctcatctcaaagtaccttgcagacaacgagaagctgtcaagacagaaattggcttttctagtccaaactgaacccagaatgttgctcatatcagcagccagggcct

SEQ ID NO: 432273 - DNA, 140 bp, Artificial Sequence
  Synthetic
atacgccatgctgggtctccctccaccggatcctcaggtcttccctcaatgtccatccaggtcttagcatttggatcaagctgcagcattgaatctttgagggtcatgagctgagaatagcgtacttgggagtcggccat

SEQ ID NO: 432274 - DNA, 140 bp, Artificial Sequence
  Synthetic
atggccgactcccaagtacgctattctcagctcatgaccctcaaagattcaatgctgcagcttgatccaaatgctaagacctggatggacattgagggaagacctgaggatccggtggagggagacccagcatggcgtat

SEQ ID NO: 432275 - DNA, 140 bp, Artificial Sequence
  Synthetic
aggccctggctgctgatatgttggatcaagctgcagcattgaatctttgagggtcatgagctgagaataggtaagcccggcggtgaatcctgccgactgcagggacttattggaattattgaccttttgggacagcggtg

SEQ ID NO: 432276 - DNA, 140 bp, Artificial Sequence
  Synthetic
caccgctgtcccaaaaggtcaataattccaataagtccctgcagtcggcaggattcaccgccgggcttacctattctcagctcatgaccctcaaagattcaatgctgcagcttgatccaacatatcagcagccagggcct

SEQ ID NO: 432277 - DNA, 140 bp, Artificial Sequence
  Synthetic
aggccctggctgctgatatgtgcttgcacgacatcatttaagtcaacctgcccttgttttgtcaaacatgccagtgtcagacttggcatggtcccgaactgattattaagcaactctgcagaccttttgggacagcggtg

SEQ ID NO: 432278 - DNA, 140 bp, Artificial Sequence
  Synthetic
caccgctgtcccaaaaggtctgcagagttgcttaataatcagttcgggaccatgccaagtctgacactggcatgtttgacaaaacaagggcaggttgacttaaatgatgtcgtgcaagcacatatcagcagccagggcct

SEQ ID NO: 432279 - DNA, 140 bp, Artificial Sequence
  Synthetic
atacgccatgctgggtctccccggggatcctaggcaattcagctggacttcagtagtaaggctcttttcagtgaatccccgagtcaaagcacccagcaaaatgggcaacaaacaggctaacgtacttgggagtcggccat

SEQ ID NO: 432280 - DNA, 140 bp, Artificial Sequence
  Synthetic
atggccgactcccaagtacgttagcctgtttgttgcccattttgctgggtgctttgactcggggattcactgaaaagagccttactactgaagtccagctgaattgcctaggatccccggggagacccagcatggcgtat

SEQ ID NO: 432281 - DNA, 140 bp, Artificial Sequence
  Synthetic
aggccctggctgctgatatgcaaacatttctaaatcttgatcttggatagatggtgtgaatgtagccacccttctatcagattcccatagtgctcccctacatacaaccaatggcactgggaccttttgggacagcggtg

SEQ ID NO: 432282 - DNA, 140 bp, Artificial Sequence
  Synthetic
caccgctgtcccaaaaggtcccagtgccattggttgtatgtaggggagcactatgggaatctgatagaagggtggctacattcacaccatctatccaagatcaagatttagaaatgtttgcatatcagcagccagggcct

SEQ ID NO: 432283 - DNA, 140 bp, Artificial Sequence
  Synthetic
aggccctggctgctgatatgccatcccctgacaagcaaatcttgtagagtatgttctcataaggattcctttcgccaggggtttcagatatgaacatcccaagagcctttttcactttcagaccttttgggacagcggtg

SEQ ID NO: 432284 - DNA, 140 bp, Artificial Sequence
  Synthetic
caccgctgtcccaaaaggtctgaaagtgaaaaaggctcttgggatgttcatatctgaaacccctggcgaaaggaatccttatgagaacatactctacaagatttgcttgtcaggggatggcatatcagcagccagggcct

SEQ ID NO: 432285 - DNA, 140 bp, Artificial Sequence
  Synthetic
atacgccatgctgggtctcctctaacatgttgccaccatccagcatgcaggctcctgccttcacagctgcgcccaagctaaaattgtaacctgagatgttcagggagctttttttggtgtcgtacttgggagtcggccat

SEQ ID NO: 432286 - DNA, 140 bp, Artificial Sequence
  Synthetic
atggccgactcccaagtacgacaccaaaaaaagctccctgaacatctcaggttacaattttagcttgggcgcagctgtgaaggcaggagcctgcatgctggatggtggcaacatgttagaggagacccagcatggcgtat

SEQ ID NO: 432287 - DNA, 140 bp, Artificial Sequence
  Synthetic
aggccctggctgctgatatggcccaagctaaaattgtaacctgagatgttcagggagctttttttggtgtctatcatgtttaaaatagggtggctctgagccaatctgtccaagtctgaagaccttttgggacagcggtg

SEQ ID NO: 432288 - DNA, 140 bp, Artificial Sequence
  Synthetic
caccgctgtcccaaaaggtcttcagacttggacagattggctcagagccaccctattttaaacatgatagacaccaaaaaaagctccctgaacatctcaggttacaattttagcttgggccatatcagcagccagggcct

SEQ ID NO: 432289 - DNA, 140 bp, Artificial Sequence
  Synthetic
atacgccatgctgggtctcccactacatcattcaagtcaacctgcccttgttttgttaaacatgccagtgtcagacttggcatggtgccaaactgattgttgagcagatctgcattctttcgtacttgggagtcggccat

SEQ ID NO: 432290 - DNA, 140 bp, Artificial Sequence
  Synthetic
atggccgactcccaagtacgaaagaatgcagatctgctcaacaatcagtttggcaccatgccaagtctgacactggcatgtttaacaaaacaagggcaggttgacttgaatgatgtagtgggagacccagcatggcgtat

SEQ ID NO: 432291 - DNA, 140 bp, Artificial Sequence
  Synthetic
atacgccatgctgggtctccgccaccactcattcctatcatattcaggagagctcgtctttggtcaagttgttgcgaactcaggttgcccatataaacacctgagctcagtggtctttctcgtacttgggagtcggccat

SEQ ID NO: 432292 - DNA, 140 bp, Artificial Sequence
  Synthetic
atggccgactcccaagtacgagaaagaccactgagctcaggtgtttatatgggcaacctgagttcgcaacaacttgaccaaagacgagctctcctgaatatgataggaatgagtggtggcggagacccagcatggcgtat

SEQ ID NO: 432293 - DNA, 140 bp, Artificial Sequence
  Synthetic
atacgccatgctgggtctcccaagtcatctgaggttagagtcccaactctcagtacactcttctgttgagttgatttcagctcgacaagattgttaacggcttgatttaaatccctcaatcgtacttgggagtcggccat

SEQ ID NO: 432294 - DNA, 140 bp, Artificial Sequence
  Synthetic
atggccgactcccaagtacgattgagggatttaaatcaagccgttaacaatcttgtcgagctgaaatcaactcaacagaagagtgtactgagagttgggactctaacctcagatgacttgggagacccagcatggcgtat

SEQ ID NO: 432295 - DNA, 140 bp, Artificial Sequence
  Synthetic
aggccctggctgctgatatgttgatttcagctcgacaagattgttaacggcttgatttaaatccctcaatcgttttagatcactgtcatctctcctctgtttacgcatcaaccgctgaacgaccttttgggacagcggtg

SEQ ID NO: 432296 - DNA, 140 bp, Artificial Sequence
  Synthetic
caccgctgtcccaaaaggtcgttcagcggttgatgcgtaaacagaggagagatgacagtgatctaaaacgattgagggatttaaatcaagccgttaacaatcttgtcgagctgaaatcaacatatcagcagccagggcct

SEQ ID NO: 432297 - DNA, 140 bp, Artificial Sequence
  Synthetic
aggccctggctgctgatatgcaactcctcacatgttctgcccttcagtctcaatttaccactacttgattgtatcatcaccttcccctttgacttactataacagagagcataacccttggaccttttgggacagcggtg

SEQ ID NO: 432298 - DNA, 140 bp, Artificial Sequence
  Synthetic
caccgctgtcccaaaaggtccaagggttatgctctctgttatagtaagtcaaaggggaaggtgatgatacaatcaagtagtggtaaattgagactgaagggcagaacatgtgaggagttgcatatcagcagccagggcct

SEQ ID NO: 432299 - DNA, 140 bp, Artificial Sequence
  Synthetic
aggccctggctgctgatatgattgccaagttgttgtgttgaacacacacagcagagagctaagactatctgctgaattgataaaagcaaagcgcaatccaatagcctaggatccactgtggaccttttgggacagcggtg

SEQ ID NO: 432300 - DNA, 140 bp, Artificial Sequence
  Synthetic
caccgctgtcccaaaaggtccacagtggatcctaggctattggattgcgctttgcttttatcaattcagcagatagtcttagctctctgctgtgtgtgttcaacacaacaacttggcaatcatatcagcagccagggcct

SEQ ID NO: 432301 - DNA, 140 bp, Artificial Sequence
  Synthetic
aggccctggctgctgatatgttacaggacgactttaggtgtcgatgttctgaacaccatgtctctgggtagcactgctctcagaaccagtgttttcagtccacctgacactgctgcgtcagaccttttgggacagcggtg

SEQ ID NO: 432302 - DNA, 140 bp, Artificial Sequence
  Synthetic
caccgctgtcccaaaaggtctgacgcagcagtgtcaggtggactgaaaacactggttctgagagcagtgctacccagagacatggtgttcagaacatcgacacctaaagtcgtcctgtaacatatcagcagccagggcct

SEQ ID NO: 432303 - DNA, 140 bp, Artificial Sequence
  Synthetic
atacgccatgctgggtctccccggggatcctaggcatttttggttgcgcaattgaagcgtctttcccaaaatggggcaaatagtaacatttttccaggaagttcctcatgtgatagaggacgtacttgggagtcggccat

SEQ ID NO: 432304 - DNA, 140 bp, Artificial Sequence
  Synthetic
atggccgactcccaagtacgtcctctatcacatgaggaacttcctggaaaaatgttactatttgccccattttgggaaagacgcttcaattgcgcaaccaaaaatgcctaggatccccggggagacccagcatggcgtat

SEQ ID NO: 432305 - DNA, 140 bp, Artificial Sequence
  Synthetic
aggccctggctgctgatatgtgggactgttgccaatggcgttcttcagactttcatgaggatggcttggggtggcagttatatagcacttgattccggaagagggaattgggattgtatagaccttttgggacagcggtg

SEQ ID NO: 432306 - DNA, 140 bp, Artificial Sequence
  Synthetic
caccgctgtcccaaaaggtctatacaatcccaattccctcttccggaatcaagtgctatataactgccaccccaagccatcctcatgaaagtctgaagaacgccattggcaacagtcccacatatcagcagccagggcct

SEQ ID NO: 432307 - DNA, 140 bp, Artificial Sequence
  Synthetic
atacgccatgctgggtctccctgccagttttctcgtccatcccctattggctatctagggctactgtcacaaagaaccagggacatttatatcagtcgaagacttcttgggacttttacccgtacttgggagtcggccat

SEQ ID NO: 432308 - DNA, 140 bp, Artificial Sequence
  Synthetic
atggccgactcccaagtacgggtaaaagtcccaagaagtcttcgactgatataaatgtccctggttctttgtgacagtagccctagatagccaataggggatggacgagaaaactggcagggagacccagcatggcgtat

SEQ ID NO: 432309 - DNA, 140 bp, Artificial Sequence
  Synthetic
aggccctggctgctgatatgttcattttgattgacgctagatcactcatgaatggtaatatgtgtttctcaaacactgatgggtacagtcttcttagagaatgaataatgtgattcaaacgaccttttgggacagcggtg

SEQ ID NO: 432310 - DNA, 140 bp, Artificial Sequence
  Synthetic
caccgctgtcccaaaaggtcgtttgaatcacattattcattctctaagaagactgtacccatcagtgtttgagaaacacatattaccattcatgagtgatctagcgtcaatcaaaatgaacatatcagcagccagggcct

SEQ ID NO: 432311 - DNA, 140 bp, Artificial Sequence
  Synthetic
aggccctggctgctgatatgcagataattctctcctcaaggattgtgtccataggaaggactttatctcctttgaggcactcattgtcaagttgttgtgtactgttcaaatagcagaaaagaccttttgggacagcggtg

SEQ ID NO: 432312 - DNA, 140 bp, Artificial Sequence
  Synthetic
caccgctgtcccaaaaggtcttttctgctatttgaacagtacacaacaacttgacaatgagtgcctcaaaggagataaagtccttcctatggacacaatccttgaggagagaattatctgcatatcagcagccagggcct

SEQ ID NO: 432313 - DNA, 140 bp, Artificial Sequence
  Synthetic
atacgccatgctgggtctccccggggatcctaggcaatttagctggacttcagtgataaggcttattttagtgaatccctgaatcaaagtgcctagccagaatgggcaacagacaggccacgtacttgggagtcggccat

SEQ ID NO: 432314 - DNA, 140 bp, Artificial Sequence
  Synthetic
atggccgactcccaagtacgtggcctgtctgttgcccattctggctaggcactttgattcagggattcactaaaataagccttatcactgaagtccagctaaattgcctaggatccccggggagacccagcatggcgtat

SEQ ID NO: 432315 - DNA, 140 bp, Artificial Sequence
  Synthetic
aggccctggctgctgatatggtgaatccctgaatcaaagtgcctagccagaatgggcaacagacaggccaaacagaccaaagtcgacgaacatcaaagggctcacctagtaccggacgcagaccttttgggacagcggtg

SEQ ID NO: 432316 - DNA, 140 bp, Artificial Sequence
  Synthetic
caccgctgtcccaaaaggtctgcgtccggtactaggtgagccctttgatgttcgtcgactttggtctgtttggcctgtctgttgcccattctggctaggcactttgattcagggattcaccatatcagcagccagggcct

SEQ ID NO: 432317 - DNA, 140 bp, Artificial Sequence
  Synthetic
aggccctggctgctgatatgaggtgtaaccttaatggtctccaacatgttccccccatcaagcatacaagctccagctttcactgcagcccctaagctgaagttgtaaccagaaatgttcgaccttttgggacagcggtg

SEQ ID NO: 432318 - DNA, 140 bp, Artificial Sequence
  Synthetic
caccgctgtcccaaaaggtcgaacatttctggttacaacttcagcttaggggctgcagtgaaagctggagcttgtatgcttgatggggggaacatgttggagaccattaaggttacacctcatatcagcagccagggcct

SEQ ID NO: 432319 - DNA, 140 bp, Artificial Sequence
  Synthetic
aggccctggctgctgatatggctttaatgaaagacttcatcatagctgtcaccacattaaaaggtatttccaccattttgtgcatatgccacataagtagggttgaaaggtagtccctccgaccttttgggacagcggtg

SEQ ID NO: 432320 - DNA, 140 bp, Artificial Sequence
  Synthetic
caccgctgtcccaaaaggtcggagggactacctttcaaccctacttatgtggcatatgcacaaaatggtggaaataccttttaatgtggtgacagctatgatgaagtctttcattaaagccatatcagcagccagggcct

SEQ ID NO: 432321 - DNA, 140 bp, Artificial Sequence
  Synthetic
aggccctggctgctgatatgtgagcataatttcaactttccacttgtccatccccaatttcaatcagtatgaggctatgagctgtgacttcaatggggggaagattagtgtgcaatacaagaccttttgggacagcggtg

SEQ ID NO: 432322 - DNA, 140 bp, Artificial Sequence
  Synthetic
caccgctgtcccaaaaggtcttgtattgcacactaatcttccccccattgaagtcacagctcatagcctcatactgattgaaattggggatggacaagtggaaagttgaaattatgctcacatatcagcagccagggcct

SEQ ID NO: 432323 - DNA, 140 bp, Artificial Sequence
  Synthetic
atacgccatgctgggtctcccactcccctgtcttttgataaattagttgaaatacagtgtcacccaatgaaaactcttgacaatatgcttctttgcatctgaccacatgataccttgcggcgtacttgggagtcggccat

SEQ ID NO: 432324 - DNA, 140 bp, Artificial Sequence
  Synthetic
atggccgactcccaagtacgccgcaaggtatcatgtggtcagatgcaaagaagcatattgtcaagagttttcattgggtgacactgtatttcaactaatttatcaaaagacaggggagtgggagacccagcatggcgtat

SEQ ID NO: 432325 - DNA, 140 bp, Artificial Sequence
  Synthetic
aggccctggctgctgatatgatcaattccatgtgaatacttagcatcttgtttgaactgctttaaatcagtgggttcacggaagaagtgaatgtaacaacctgaacttggctgatagagggaccttttgggacagcggtg

SEQ ID NO: 432326 - DNA, 140 bp, Artificial Sequence
  Synthetic
caccgctgtcccaaaaggtccctctatcagccaagttcaggttgttacattcacttcttccgtgaacccactgatttaaagcagttcaaacaagatgctaagtattcacatggaattgatcatatcagcagccagggcct

SEQ ID NO: 432327 - DNA, 140 bp, Artificial Sequence
  Synthetic
atacgccatgctgggtctccatcctaggcaatttaactggacttcagtggtaaaactcattctggtgaatctcagaatcaaagtacctagtcaaaatgggcaatagaccggcgaaatcgacgtacttgggagtcggccat

SEQ ID NO: 432328 - DNA, 140 bp, Artificial Sequence
  Synthetic
atggccgactcccaagtacgtcgatttcgccggtctattgcccattttgactaggtactttgattctgagattcaccagaatgagttttaccactgaagtccagttaaattgcctaggatggagacccagcatggcgtat

SEQ ID NO: 432329 - DNA, 140 bp, Artificial Sequence
  Synthetic
atacgccatgctgggtctccatgcaccaaccaaaagatgcggggaactatcaccaatctcttttacaaacatttccaaatcttgatcttgaataggtggtgtaaatgaagctacccttctcgtacttgggagtcggccat

SEQ ID NO: 432330 - DNA, 140 bp, Artificial Sequence
  Synthetic
atggccgactcccaagtacgagaagggtagcttcatttacaccacctattcaagatcaagatttggaaatgtttgtaaaagagattggtgatagttccccgcatcttttggttggtgcatggagacccagcatggcgtat

SEQ ID NO: 432331 - DNA, 140 bp, Artificial Sequence
  Synthetic
aggccctggctgctgatatgtgtcaggtccgaccttggaaaagtcaaactcaccaaactgcagtttatctggattaataatcagcttcatgggtataacatcccccaactgctgtgtatcgaccttttgggacagcggtg

SEQ ID NO: 432332 - DNA, 140 bp, Artificial Sequence
  Synthetic
caccgctgtcccaaaaggtcgatacacagcagttgggggatgttatacccatgaagctgattattaatccagataaactgcagtttggtgagtttgacttttccaaggtcggacctgacacatatcagcagccagggcct

SEQ ID NO: 432333 - DNA, 140 bp, Artificial Sequence
  Synthetic
aggccctggctgctgatatgtagcctttgaaatcaatccattctccaagagattcaagaagctcactcaatatatcagcatgatccacaggtctctgttttgtgaggattgagacaatgtgaccttttgggacagcggtg

SEQ ID NO: 432334 - DNA, 140 bp, Artificial Sequence
  Synthetic
caccgctgtcccaaaaggtcacattgtctcaatcctcacaaaacagagacctgtggatcatgctgatatattgagtgagcttcttgaatctcttggagaatggattgatttcaaaggctacatatcagcagccagggcct

SEQ ID NO: 432335 - DNA, 140 bp, Artificial Sequence
  Synthetic
atacgccatgctgggtctccaagaggacgtaaggagggataaatacttctttgaaacaccaggccttttatagtctggtccctcaacacttgtacacccatctttacttaagaactttttcgtacttgggagtcggccat

SEQ ID NO: 432336 - DNA, 140 bp, Artificial Sequence
  Synthetic
atggccgactcccaagtacgaaaaagttcttaagtaaagatgggtgtacaagtgttgagggaccagactataaaaggcctggtgtttcaaagaagtatttatccctccttacgtcctcttggagacccagcatggcgtat

SEQ ID NO: 432337 - DNA, 140 bp, Artificial Sequence
  Synthetic
aggccctggctgctgatatgaaacatctccaaatcttgatcttggatagatggtgcaaacgtagctactcttctatcagattcccagagtgctcccctacatacaaccaatggcactggtgaccttttgggacagcggtg

SEQ ID NO: 432338 - DNA, 140 bp, Artificial Sequence
  Synthetic
caccgctgtcccaaaaggtcaccagtgccattggttgtatgtaggggagcactctgggaatctgatagaagagtagctacgtttgcaccatctatccaagatcaagatttggagatgtttcatatcagcagccagggcct

SEQ ID NO: 432339 - DNA, 140 bp, Artificial Sequence
  Synthetic
aggccctggctgctgatatgtgttttggttccccaagtacccatgctccaagttctatagctgtagataatgttatgcacatataatcccacagaagaggccttaagtaagtgagaacaggaccttttgggacagcggtg

SEQ ID NO: 432340 - DNA, 140 bp, Artificial Sequence
  Synthetic
caccgctgtcccaaaaggtcctgttctcacttacttaaggcctcttctgtgggattatatgtgcataacattatctacagctatagaacttggagcatgggtacttggggaaccaaaacacatatcagcagccagggcct

SEQ ID NO: 432341 - DNA, 140 bp, Artificial Sequence
  Synthetic
atacgccatgctgggtctccattctaggtgaccatttcatctttgtggaggctaaatcactcatgaatggcagtatatgcttttcaaataaagacggatataaacgtctcaaagagtgaacgtacttgggagtcggccat

SEQ ID NO: 432342 - DNA, 140 bp, Artificial Sequence
  Synthetic
atggccgactcccaagtacgttcactctttgagacgtttatatccgtctttatttgaaaagcatatactgccattcatgagtgatttagcctccacaaagatgaaatggtcacctagaatggagacccagcatggcgtat

SEQ ID NO: 432343 - DNA, 140 bp, Artificial Sequence
  Synthetic
aggccctggctgctgatatgaccattctaagcgggtgatgggtggctaagttcaaccaatgaaaccccaagtcagaatcagacaaaggttcaatgcctagaagtttaaacaaattctgtagaccttttgggacagcggtg

SEQ ID NO: 432344 - DNA, 140 bp, Artificial Sequence
  Synthetic
caccgctgtcccaaaaggtctacagaatttgtttaaacttctaggcattgaacctttgtctgattctgacttggggtttcattggttgaacttagccacccatcacccgcttagaatggtcatatcagcagccagggcct

SEQ ID NO: 432345 - DNA, 140 bp, Artificial Sequence
  Synthetic
aggccctggctgctgatatgaactacgattcccgtccacccaatctcttacatcagtctcacagttcaaaaggaatgggtcaatgggatacttggcataacataacaaactcaaagtcctgaccttttgggacagcggtg

SEQ ID NO: 432346 - DNA, 140 bp, Artificial Sequence
  Synthetic
caccgctgtcccaaaaggtcaggactttgagtttgttatgttatgccaagtatcccattgacccattccttttgaactgtgagactgatgtaagagattgggtggacgggaatcgtagttcatatcagcagccagggcct

SEQ ID NO: 432347 - DNA, 140 bp, Artificial Sequence
  Synthetic
aggccctggctgctgatatgcttgtcattgacccagtcaggtatttgttcattgtagaatgatgttctcccgtctataagtggtattaaattgatatcgacactcttcaagtcttctttcgaccttttgggacagcggtg

SEQ ID NO: 432348 - DNA, 140 bp, Artificial Sequence
  Synthetic
caccgctgtcccaaaaggtcgaaagaagacttgaagagtgtcgatatcaatttaataccacttatagacgggagaacatcattctacaatgaacaaatacctgactgggtcaatgacaagcatatcagcagccagggcct

SEQ ID NO: 432349 - DNA, 140 bp, Artificial Sequence
  Synthetic
aggccctggctgctgatatgcgtctataagtggtattaaattgatatcgacactcttcaagtcttctttcagctgctctaattttttgaagtcctcaatgtacttctgctcaaagttagcgaccttttgggacagcggtg

SEQ ID NO: 432350 - DNA, 140 bp, Artificial Sequence
  Synthetic
caccgctgtcccaaaaggtcgctaactttgagcagaagtacattgaggacttcaaaaaattagagcagctgaaagaagacttgaagagtgtcgatatcaatttaataccacttatagacgcatatcagcagccagggcct

SEQ ID NO: 432351 - DNA, 140 bp, Artificial Sequence
  Synthetic
aggccctggctgctgatatgccttagaagcactcatcttgatctggatacttttggggtttgctgattgaaagttttactcagcaagtcaatgaaaagcgcaatccaatagcctaggatcgaccttttgggacagcggtg

SEQ ID NO: 432352 - DNA, 140 bp, Artificial Sequence
  Synthetic
caccgctgtcccaaaaggtcgatcctaggctattggattgcgcttttcattgacttgctgagtaaaactttcaatcagcaaaccccaaaagtatccagatcaagatgagtgcttctaaggcatatcagcagccagggcct

SEQ ID NO: 432353 - DNA, 140 bp, Artificial Sequence
  Synthetic
aggccctggctgctgatatgccggggatcctaggcaatttagctggacttcagtggtaagactcattttagtgaacccctgattcaagtgcctagctgaaatgggcaacagacaggccaagaccttttgggacagcggtg

SEQ ID NO: 432354 - DNA, 140 bp, Artificial Sequence
  Synthetic
caccgctgtcccaaaaggtcttggcctgtctgttgcccatttcagctaggcacttgaatcaggggttcactaaaatgagtcttaccactgaagtccagctaaattgcctaggatccccggcatatcagcagccagggcct

SEQ ID NO: 432355 - DNA, 140 bp, Artificial Sequence
  Synthetic
aggccctggctgctgatatggattgtcatcgatgctgatagattacagtttgtagaacatgattttgtcctagtgggcccttgctctgaagcagtccctctggttgtacataggggtggagaccttttgggacagcggtg

SEQ ID NO: 432356 - DNA, 140 bp, Artificial Sequence
  Synthetic
caccgctgtcccaaaaggtctccacccctatgtacaaccagagggactgcttcagagcaagggcccactaggacaaaatcatgttctacaaactgtaatctatcagcatcgatgacaatccatatcagcagccagggcct

SEQ ID NO: 432357 - DNA, 140 bp, Artificial Sequence
  Synthetic
aggccctggctgctgatatgaattactctcacgttcacttatcctgacatcatcagccaatcttcctgtatcaaatttaaagttcagacacttactcttataatgagagtaccttcccatgaccttttgggacagcggtg

SEQ ID NO: 432358 - DNA, 140 bp, Artificial Sequence
  Synthetic
caccgctgtcccaaaaggtcatgggaaggtactctcattataagagtaagtgtctgaactttaaatttgatacaggaagattggctgatgatgtcaggataagtgaacgtgagagtaattcatatcagcagccagggcct

SEQ ID NO: 432359 - DNA, 140 bp, Artificial Sequence
  Synthetic
atacgccatgctgggtctccgcgcaccggggatcctaggcaatttagctggacttcagtggtaaagctcattttggtgaatccctgaatcaagtgcccagttaaaatgggtaacagacagcgtacttgggagtcggccat

SEQ ID NO: 432360 - DNA, 140 bp, Artificial Sequence
  Synthetic
atggccgactcccaagtacgctgtctgttacccattttaactgggcacttgattcagggattcaccaaaatgagctttaccactgaagtccagctaaattgcctaggatccccggtgcgcggagacccagcatggcgtat

SEQ ID NO: 432361 - DNA, 140 bp, Artificial Sequence
  Synthetic
atacgccatgctgggtctcctgggagagtctgtccaggtcagagctgtttggatacttggctgtgtatattagacctaagtctgttagtgccaagacggcatcattcaaatcaacttgaccgtacttgggagtcggccat

SEQ ID NO: 432362 - DNA, 140 bp, Artificial Sequence
  Synthetic
atggccgactcccaagtacggtcaagttgatttgaatgatgccgtcttggcactaacagacttaggtctaatatacacagccaagtatccaaacagctctgacctggacagactctcccaggagacccagcatggcgtat

SEQ ID NO: 432363 - DNA, 140 bp, Artificial Sequence
  Synthetic
aggccctggctgctgatatggcttgcaccacatcattcaagtcaacctgcccctgcttcgttaaacatgccagtgtcagacttggcatggtgccaaattgattattaagtaggtcggcatgaccttttgggacagcggtg

SEQ ID NO: 432364 - DNA, 140 bp, Artificial Sequence
  Synthetic
caccgctgtcccaaaaggtcatgccgacctacttaataatcaatttggcaccatgccaagtctgacactggcatgtttaacgaagcaggggcaggttgacttgaatgatgtggtgcaagccatatcagcagccagggcct

SEQ ID NO: 432365 - DNA, 140 bp, Artificial Sequence
  Synthetic
atacgccatgctgggtctcctcttgtagtcataatcctgtttgttaagcaagaatttgcctttacgcgcaaagacttcagttaactgtgtaacagccaaagctgtaagtttgttaaagtccgtacttgggagtcggccat

SEQ ID NO: 432366 - DNA, 140 bp, Artificial Sequence
  Synthetic
atggccgactcccaagtacggactttaacaaacttacagctttggctgttacacagttaactgaagtctttgcgcgtaaaggcaaattcttgcttaacaaacaggattatgactacaagaggagacccagcatggcgtat

SEQ ID NO: 432367 - DNA, 140 bp, Artificial Sequence
  Synthetic
atacgccatgctgggtctccgttctcaagaccatctcccatcggctatctcgggctcctctcacaaagaaccagagatatttacattagcagaagattgctgggcacattcacatggacacgtacttgggagtcggccat

SEQ ID NO: 432368 - DNA, 140 bp, Artificial Sequence
  Synthetic
atggccgactcccaagtacgtgtccatgtgaatgtgcccagcaatcttctgctaatgtaaatatctctggttctttgtgagaggagcccgagatagccgatgggagatggtcttgagaacggagacccagcatggcgtat

SEQ ID NO: 432369 - DNA, 140 bp, Artificial Sequence
  Synthetic
atacgccatgctgggtctcctggtcaaaataccaactcatagacatattgtaggcaagacatgccccaaacctcacaggttgaatcacatgggcatatgttcctgcggactctataaacacgtacttgggagtcggccat

SEQ ID NO: 432370 - DNA, 140 bp, Artificial Sequence
  Synthetic
atggccgactcccaagtacgtgtttatagagtccgcaggaacatatgcccatgtgattcaacctgtgaggtttggggcatgtcttgcctacaatatgtctatgagttggtattttgaccaggagacccagcatggcgtat

SEQ ID NO: 432371 - DNA, 140 bp, Artificial Sequence
  Synthetic
atacgccatgctgggtctccgaaatgacacatataagaaatatttaaaatgaacttgaatctattggtcatcatgctgacaacttcttcagacagaattatcttcaataagtggcgaatacgtacttgggagtcggccat

SEQ ID NO: 432372 - DNA, 140 bp, Artificial Sequence
  Synthetic
atggccgactcccaagtacgtattcgccacttattgaagataattctgtctgaagaagttgtcagcatgatgaccaatagattcaagttcattttaaatatttcttatatgtgtcatttcggagacccagcatggcgtat

SEQ ID NO: 432373 - DNA, 140 bp, Artificial Sequence
  Synthetic
aggccctggctgctgatatggtgacccaccgcctgttggcggtgggtcacgggggcgtccatttacaggacgactctaggtgtcgatgttctgaacaccatgtctctgggtagcactgctgaccttttgggacagcggtg

SEQ ID NO: 432374 - DNA, 140 bp, Artificial Sequence
  Synthetic
caccgctgtcccaaaaggtcagcagtgctacccagagacatggtgttcagaacatcgacacctagagtcgtcctgtaaatggacgcccccgtgacccaccgccaacaggcggtgggtcaccatatcagcagccagggcct

SEQ ID NO: 432375 - DNA, 140 bp, Artificial Sequence
  Synthetic
aggccctggctgctgatatggcaatttccactggatcttcaggtcttccttcaatgtccatccaggttttagcatttggatcaagttgtagcattgcatccttgagggtcatgagttgaggaccttttgggacagcggtg

SEQ ID NO: 432376 - DNA, 140 bp, Artificial Sequence
  Synthetic
caccgctgtcccaaaaggtcctcaactcatgaccctcaaggatgcaatgctacaacttgatccaaatgctaaaacctggatggacattgaaggaagacctgaagatccagtggaaattgccatatcagcagccagggcct

SEQ ID NO: 432377 - DNA, 140 bp, Artificial Sequence
  Synthetic
aggccctggctgctgatatggagaagtttcctcctggtgttgaggatcctcagagactttatcttattcagaaaagatctccaacattgcatctgttcactttgagagtcagcaacccttgaccttttgggacagcggtg

SEQ ID NO: 432378 - DNA, 140 bp, Artificial Sequence
  Synthetic
caccgctgtcccaaaaggtcaagggttgctgactctcaaagtgaacagatgcaatgttggagatcttttctgaataagataaagtctctgaggatcctcaacaccaggaggaaacttctccatatcagcagccagggcct

SEQ ID NO: 432379 - DNA, 140 bp, Artificial Sequence
  Synthetic
atacgccatgctgggtctcctcctcactagaatctaaatctgcatacaagaacttaagaactggagaggcccttcggaactggaatgttaattgttcaatgtcgtcatcacaggtgtctacgtacttgggagtcggccat

SEQ ID NO: 432380 - DNA, 140 bp, Artificial Sequence
  Synthetic
atggccgactcccaagtacgtagacacctgtgatgacgacattgaacaattaacattccagttccgaagggcctctccagttcttaagttcttgtatgcagatttagattctagtgaggaggagacccagcatggcgtat

SEQ ID NO: 432381 - DNA, 140 bp, Artificial Sequence
  Synthetic
aggccctggctgctgatatgctttaaaatggacttaaggatgccatccattgtctgaggtgacaccttgattgtctctaacatgttgccaccatctagcatgcaagctcctgctttcacagaccttttgggacagcggtg

SEQ ID NO: 432382 - DNA, 140 bp, Artificial Sequence
  Synthetic
caccgctgtcccaaaaggtctgtgaaagcaggagcttgcatgctagatggtggcaacatgttagagacaatcaaggtgtcacctcagacaatggatggcatccttaagtccattttaaagcatatcagcagccagggcct

SEQ ID NO: 432383 - DNA, 140 bp, Artificial Sequence
  Synthetic
aggccctggctgctgatatgttgtctctaacatgttgccaccatctagcatgcaagctcctgctttcacagctgcacccaaactgaaattataacccgagatattcaaggagcttttcttgaccttttgggacagcggtg

SEQ ID NO: 432384 - DNA, 140 bp, Artificial Sequence
  Synthetic
caccgctgtcccaaaaggtcaagaaaagctccttgaatatctcgggttataatttcagtttgggtgcagctgtgaaagcaggagcttgcatgctagatggtggcaacatgttagagacaacatatcagcagccagggcct

SEQ ID NO: 432385 - DNA, 140 bp, Artificial Sequence
  Synthetic
atacgccatgctgggtctccctgaagcattgggatactttactgtgtagatcagacccaaatctgtcaatgcttgcactgcatcgttcaagtcaacctgcccttgttttgtcaaacatgccgtacttgggagtcggccat

SEQ ID NO: 432386 - DNA, 140 bp, Artificial Sequence
  Synthetic
atggccgactcccaagtacggcatgtttgacaaaacaagggcaggttgacttgaacgatgcagtgcaagcattgacagatttgggtctgatctacacagtaaagtatcccaatgcttcagggagacccagcatggcgtat

SEQ ID NO: 432387 - DNA, 140 bp, Artificial Sequence
  Synthetic
aggccctggctgctgatatgctttatgtcttcagacccttggcaggtgataaccatatttcgggggagtgcctcaataacagcactggtcaaacctggttgtgcagcaaacagatctgtggaccttttgggacagcggtg

SEQ ID NO: 432388 - DNA, 140 bp, Artificial Sequence
  Synthetic
caccgctgtcccaaaaggtccacagatctgtttgctgcacaaccaggtttgaccagtgctgttattgaggcactcccccgaaatatggttatcacctgccaagggtctgaagacataaagcatatcagcagccagggcct

SEQ ID NO: 432389 - DNA, 140 bp, Artificial Sequence
  Synthetic
atacgccatgctgggtctcctttttacatcccaaactctcaccactccgtctctcccagcctgagccctttgattaccaccactcattcctatcatactcaggagagctcgtctttggtccgtacttgggagtcggccat

SEQ ID NO: 432390 - DNA, 140 bp, Artificial Sequence
  Synthetic
atggccgactcccaagtacggaccaaagacgagctctcctgagtatgataggaatgagtggtggtaatcaaagggctcaggctgggagagacggagtggtgagagtttgggatgtaaaaaggagacccagcatggcgtat

SEQ ID NO: 432391 - DNA, 140 bp, Artificial Sequence
  Synthetic
atacgccatgctgggtctccatccccagattgttgtgttggatgcacgtagcagaaagctgaaactttctactgaagtgacaaaagcaaagcgcaatccaatagcctaggatccactgtgcgtacttgggagtcggccat

SEQ ID NO: 432392 - DNA, 140 bp, Artificial Sequence
  Synthetic
atggccgactcccaagtacgcacagtggatcctaggctattggattgcgctttgcttttgtcacttcagtagaaagtttcagctttctgctacgtgcatccaacacaacaatctggggatggagacccagcatggcgtat

SEQ ID NO: 432393 - DNA, 140 bp, Artificial Sequence
  Synthetic
atacgccatgctgggtctccctgtgttggattcggactaatgcctgtgtggcttgtgggtcagctaatggtgccccacaaaagctcctacagaaatgagagacaatatgcctaggatcctcgtacttgggagtcggccat

SEQ ID NO: 432394 - DNA, 140 bp, Artificial Sequence
  Synthetic
atggccgactcccaagtacgaggatcctaggcatattgtctctcatttctgtaggagcttttgtggggcaccattagctgacccacaagccacacaggcattagtccgaatccaacacagggagacccagcatggcgtat

SEQ ID NO: 432395 - DNA, 140 bp, Artificial Sequence
  Synthetic
atacgccatgctgggtctccgccggggatcctaggcaatttggttgttcttttcggagaccttgtgttaaactcccccaaaatggggaacaagcaagccaaagccccagaggcaaaagaccgtacttgggagtcggccat

SEQ ID NO: 432396 - DNA, 140 bp, Artificial Sequence
  Synthetic
atggccgactcccaagtacggtcttttgcctctggggctttggcttgcttgttccccattttgggggagtttaacacaaggtctccgaaaagaacaaccaaattgcctaggatccccggcggagacccagcatggcgtat

SEQ ID NO: 432397 - DNA, 140 bp, Artificial Sequence
  Synthetic
aggccctggctgctgatatgactcccccaaaatggggaacaagcaagccaaagccccagaggcaaaagacagtccgagagccagcctgatcccagatgccacacatctagggccacaattgaccttttgggacagcggtg

SEQ ID NO: 432398 - DNA, 140 bp, Artificial Sequence
  Synthetic
caccgctgtcccaaaaggtcaattgtggccctagatgtgtggcatctgggatcaggctggctctcggactgtcttttgcctctggggctttggcttgcttgttccccattttgggggagtcatatcagcagccagggcct

SEQ ID NO: 432399 - DNA, 140 bp, Artificial Sequence
  Synthetic
aggccctggctgctgatatgactatctgtgtctcaactgtcttaccctacttctaagtgtcagcaacaggtgccccatctgcaaaatgccccttcccacaaaactgagaccatcaaccgcgaccttttgggacagcggtg

SEQ ID NO: 432400 - DNA, 140 bp, Artificial Sequence
  Synthetic
caccgctgtcccaaaaggtcgcggttgatggtctcagttttgtgggaaggggcattttgcagatggggcacctgttgctgacacttagaagtagggtaagacagttgagacacagatagtcatatcagcagccagggcct

SEQ ID NO: 432401 - DNA, 140 bp, Artificial Sequence
  Synthetic
aggccctggctgctgatatgtgccccatctgcaaaatgccccttcccacaaaactgagaccatcaaccgcaccaacggcacccccagctggagcagcagacagcaccaggcccccaccctgaccttttgggacagcggtg

SEQ ID NO: 432402 - DNA, 140 bp, Artificial Sequence
  Synthetic
caccgctgtcccaaaaggtcagggtgggggcctggtgctgtctgctgctccagctgggggtgccgttggtgcggttgatggtctcagttttgtgggaaggggcattttgcagatggggcacatatcagcagccagggcct

SEQ ID NO: 432403 - DNA, 140 bp, Artificial Sequence
  Synthetic
aggccctggctgctgatatgaaatgagactggcttggagctgactttaacaaacacaagtatcatcaaccataagttttgcaacctttctgatgcacataaaaagaatctctatgaccatgaccttttgggacagcggtg

SEQ ID NO: 432404 - DNA, 140 bp, Artificial Sequence
  Synthetic
caccgctgtcccaaaaggtcatggtcatagagattctttttatgtgcatcagaaaggttgcaaaacttatggttgatgatacttgtgtttgttaaagtcagctccaagccagtctcatttcatatcagcagccagggcct

SEQ ID NO: 432405 - DNA, 140 bp, Artificial Sequence
  Synthetic
aggccctggctgctgatatggggcaacttccaccgggtcttccggcctcccctctatatccatccatgtcttggcatttggatcaagttgcaacattgcatctttgagagtcatgagttggaccttttgggacagcggtg

SEQ ID NO: 432406 - DNA, 140 bp, Artificial Sequence
  Synthetic
caccgctgtcccaaaaggtccaactcatgactctcaaagatgcaatgttgcaacttgatccaaatgccaagacatggatggatatagaggggaggccggaagacccggtggaagttgccccatatcagcagccagggcct

SEQ ID NO: 432407 - DNA, 140 bp, Artificial Sequence
  Synthetic
aggccctggctgctgatatgcacccagttgtccactgcctcaagaaccgcactcaagaccccctcataattcgacactgcagtcttcagcgtggagacaatgtccacccctgaccactgcgaccttttgggacagcggtg

SEQ ID NO: 432408 - DNA, 140 bp, Artificial Sequence
  Synthetic
caccgctgtcccaaaaggtcgcagtggtcaggggtggacattgtctccacgctgaagactgcagtgtcgaattatgagggggtcttgagtgcggttcttgaggcagtggacaactgggtgcatatcagcagccagggcct

SEQ ID NO: 432409 - DNA, 140 bp, Artificial Sequence
  Synthetic
atacgccatgctgggtctcccaggtgagttgaggtgtccccaacttctctcacaaacatctcaaggtcttggtcctgtataacaggtgtgaaggatgccaacttccttccacattcccatcgtacttgggagtcggccat

SEQ ID NO: 432410 - DNA, 140 bp, Artificial Sequence
  Synthetic
atggccgactcccaagtacgatgggaatgtggaaggaagttggcatccttcacacctgttatacaggaccaagaccttgagatgtttgtgagagaagttggggacacctcaactcacctgggagacccagcatggcgtat

SEQ ID NO: 432411 - DNA, 140 bp, Artificial Sequence
  Synthetic
aggccctggctgctgatatgggtcctgtataacaggtgtgaaggatgccaacttccttccacattcccataagccccccctatgcacaaccagagggactggctcagtacaaggacccacgaccttttgggacagcggtg

SEQ ID NO: 432412 - DNA, 140 bp, Artificial Sequence
  Synthetic
caccgctgtcccaaaaggtcgtgggtccttgtactgagccagtccctctggttgtgcatagggggggcttatgggaatgtggaaggaagttggcatccttcacacctgttatacaggacccatatcagcagccagggcct

SEQ ID NO: 432413 - DNA, 140 bp, Artificial Sequence
  Synthetic
atacgccatgctgggtctcctttcgacaggagttacatgccccagttgatttgtgtcaattaaaaactcattaatgatttcggtgtcaacataccatgctgatttgcccttaaaagtaggcgtacttgggagtcggccat

SEQ ID NO: 432414 - DNA, 140 bp, Artificial Sequence
  Synthetic
atggccgactcccaagtacgcctacttttaagggcaaatcagcatggtatgttgacaccgaaatcattaatgagtttttaattgacacaaatcaactggggcatgtaactcctgtcgaaaggagacccagcatggcgtat

SEQ ID NO: 432415 - DNA, 140 bp, Artificial Sequence
  Synthetic
aggccctggctgctgatatgttaatgatttcggtgtcaacataccatgctgatttgcccttaaaagtaggccctgacatgaccagtctccagcagtctgacaagacgcacggactcactggaccttttgggacagcggtg

SEQ ID NO: 432416 - DNA, 140 bp, Artificial Sequence
  Synthetic
caccgctgtcccaaaaggtccagtgagtccgtgcgtcttgtcagactgctggagactggtcatgtcagggcctacttttaagggcaaatcagcatggtatgttgacaccgaaatcattaacatatcagcagccagggcct

SEQ ID NO: 432417 - DNA, 140 bp, Artificial Sequence
  Synthetic
aggccctggctgctgatatgtgagaggtgctcactagacaaatagtttgttgtgaactcttcatggagttgcccagtcttcaacctattgtacagttttcttaacatagatctaatcttggaccttttgggacagcggtg

SEQ ID NO: 432418 - DNA, 140 bp, Artificial Sequence
  Synthetic
caccgctgtcccaaaaggtccaagattagatctatgttaagaaaactgtacaataggttgaagactgggcaactccatgaagagttcacaacaaactatttgtctagtgagcacctctcacatatcagcagccagggcct

SEQ ID NO: 432419 - DNA, 140 bp, Artificial Sequence
  Synthetic
aggccctggctgctgatatgagcatcttgacttttaatacggaacctaactgtctgacttaattttgcagaccctggaggtagtgaagccacagcgtcaaagaagtcctccaatgagtcagaccttttgggacagcggtg

SEQ ID NO: 432420 - DNA, 140 bp, Artificial Sequence
  Synthetic
caccgctgtcccaaaaggtctgactcattggaggacttctttgacgctgtggcttcactacctccagggtctgcaaaattaagtcagacagttaggttccgtattaaaagtcaagatgctcatatcagcagccagggcct

SEQ ID NO: 432421 - DNA, 140 bp, Artificial Sequence
  Synthetic
aggccctggctgctgatatgaaatacctaatgttttgtaaaaatttctgacaccttttactgggatgtgttagtatcaaaactaaaatcattttggttaacaatttgatagtgatcaattgaccttttgggacagcggtg

SEQ ID NO: 432422 - DNA, 140 bp, Artificial Sequence
  Synthetic
caccgctgtcccaaaaggtcaattgatcactatcaaattgttaaccaaaatgattttagttttgatactaacacatcccagtaaaaggtgtcagaaatttttacaaaacattaggtatttcatatcagcagccagggcct

SEQ ID NO: 432423 - DNA, 140 bp, Artificial Sequence
  Synthetic
atacgccatgctgggtctccacgtcactagtgctcaccactctctcttccaccatgggttcatgtgtcctactgtgggataacctcaattcagatgataacacaatgtaatgttcttctccgtacttgggagtcggccat

SEQ ID NO: 432424 - DNA, 140 bp, Artificial Sequence
  Synthetic
atggccgactcccaagtacggagaagaacattacattgtgttatcatctgaattgaggttatcccacagtaggacacatgaacccatggtggaagagagagtggtgagcactagtgacgtggagacccagcatggcgtat

SEQ ID NO: 432425 - DNA, 140 bp, Artificial Sequence
  Synthetic
aggccctggctgctgatatgactgtgggataacctcaattcagatgataacacaatgtaatgttcttctcttttccactttactatgtgtgaaacaagagacaaagcctcacagttgacagaccttttgggacagcggtg

SEQ ID NO: 432426 - DNA, 140 bp, Artificial Sequence
  Synthetic
caccgctgtcccaaaaggtctgtcaactgtgaggctttgtctcttgtttcacacatagtaaagtggaaaagagaagaacattacattgtgttatcatctgaattgaggttatcccacagtcatatcagcagccagggcct

SEQ ID NO: 432427 - DNA, 140 bp, Artificial Sequence
  Synthetic
atacgccatgctgggtctcctttagtcgatgctagatcactcatgaatggcaatatgtgtttctcaaacactgatggatacagccttcttagagaatgaataatatgattcaaaccaactcgtacttgggagtcggccat

SEQ ID NO: 432428 - DNA, 140 bp, Artificial Sequence
  Synthetic
atggccgactcccaagtacgagttggtttgaatcatattattcattctctaagaaggctgtatccatcagtgtttgagaaacacatattgccattcatgagtgatctagcatcgactaaaggagacccagcatggcgtat

SEQ ID NO: 432429 - DNA, 140 bp, Artificial Sequence
  Synthetic
aggccctggctgctgatatgctgatggatacagccttcttagagaatgaataatatgattcaaaccaactctatcctccaatagttttgatgcagttggcttcaagggaaaatagtcgcagaccttttgggacagcggtg

SEQ ID NO: 432430 - DNA, 140 bp, Artificial Sequence
  Synthetic
caccgctgtcccaaaaggtctgcgactattttcccttgaagccaactgcatcaaaactattggaggatagagttggtttgaatcatattattcattctctaagaaggctgtatccatcagcatatcagcagccagggcct

SEQ ID NO: 432431 - DNA, 140 bp, Artificial Sequence
  Synthetic
atacgccatgctgggtctccaggacagcccgagggccagtctgatcccagatgctacacacctagggccacagttctgcaagagctgctggttcgaaaataaaggcctagtagagtgcaacgtacttgggagtcggccat

SEQ ID NO: 432432 - DNA, 140 bp, Artificial Sequence
  Synthetic
atggccgactcccaagtacgttgcactctactaggcctttattttcgaaccagcagctcttgcagaactgtggccctaggtgtgtagcatctgggatcagactggccctcgggctgtcctggagacccagcatggcgtat

SEQ ID NO: 432433 - DNA, 140 bp, Artificial Sequence
  Synthetic
aggccctggctgctgatatggatctcacaaagcactcaaggagtatgaggacattcccattcaatttgaagccatcaggcacaacaaagcataatgatggtgttaaaatccctaattcatgaccttttgggacagcggtg

SEQ ID NO: 432434 - DNA, 140 bp, Artificial Sequence
  Synthetic
caccgctgtcccaaaaggtcatgaattagggattttaacaccatcattatgctttgttgtgcctgatggcttcaaattgaatgggaatgtcctcatactccttgagtgctttgtgagatccatatcagcagccagggcct

SEQ ID NO: 432435 - DNA, 140 bp, Artificial Sequence
  Synthetic
aggccctggctgctgatatggttaacactcacaaaacaggagcccagccaaccagcagggagcttatcaccatgccttatgcagtccagccggctagcaagaagaatcagaatgtcaaaagaccttttgggacagcggtg

SEQ ID NO: 432436 - DNA, 140 bp, Artificial Sequence
  Synthetic
caccgctgtcccaaaaggtcttttgacattctgattcttcttgctagccggctggactgcataaggcatggtgataagctccctgctggttggctgggctcctgttttgtgagtgttaaccatatcagcagccagggcct

SEQ ID NO: 432437 - DNA, 140 bp, Artificial Sequence
  Synthetic
atacgccatgctgggtctccatatatagattctctttattgggcccccgaacacatttactgcctaatgttctacatagtcccacaaagccagatgcaatggaactttggaatgcagattcgtacttgggagtcggccat

SEQ ID NO: 432438 - DNA, 140 bp, Artificial Sequence
  Synthetic
atggccgactcccaagtacgaatctgcattccaaagttccattgcatctggctttgtgggactatgtagaacattaggcagtaaatgtgttcgggggcccaataaagagaatctatatatggagacccagcatggcgtat

SEQ ID NO: 432439 - DNA, 140 bp, Artificial Sequence
  Synthetic
aggccctggctgctgatatgccacccccggggggaccccccgccgggggcccccccgggggggcaggcagcatagctctactcaatgtcctcaatgcacttctccggcccaaacagttctgaccttttgggacagcggtg

SEQ ID NO: 432440 - DNA, 140 bp, Artificial Sequence
  Synthetic
caccgctgtcccaaaaggtcagaactgtttgggccggagaagtgcattgaggacattgagtagagctatgctgcctgcccccccgggggggcccccggcggggggtccccccgggggtggcatatcagcagccagggcct

SEQ ID NO: 432441 - DNA, 140 bp, Artificial Sequence
  Synthetic
aggccctggctgctgatatgttaccagtgagtttgtaaccgtcaggtactacaaagcataaagctggggttagaatcccatgatcacttagaatggattcaaccgttttgtcctcagtgtgaccttttgggacagcggtg

SEQ ID NO: 432442 - DNA, 140 bp, Artificial Sequence
  Synthetic
caccgctgtcccaaaaggtcacactgaggacaaaacggttgaatccattctaagtgatcatgggattctaaccccagctttatgctttgtagtacctgacggttacaaactcactggtaacatatcagcagccagggcct

SEQ ID NO: 432443 - DNA, 140 bp, Artificial Sequence
  Synthetic
atacgccatgctgggtctccttaaggtcttaaactcttctgggtctctttctaaaagctctgtgagagattgatcaaaaagagagatttgatcatcactagaggtataagcatctatcgtcgtacttgggagtcggccat

SEQ ID NO: 432444 - DNA, 140 bp, Artificial Sequence
  Synthetic
atggccgactcccaagtacgacgatagatgcttatacctctagtgatgatcaaatctctctttttgatcaatctctcacagagcttttagaaagagacccagaagagtttaagaccttaaggagacccagcatggcgtat

SEQ ID NO: 432445 - DNA, 140 bp, Artificial Sequence
  Synthetic
aggccctggctgctgatatgaaaagttacttggtaagatatcatgatcaaagtcctcaaccatgtgattggataattcacccttgatcagcctgatgtaaaacttatttgagacaatctcgaccttttgggacagcggtg

SEQ ID NO: 432446 - DNA, 140 bp, Artificial Sequence
  Synthetic
caccgctgtcccaaaaggtcgagattgtctcaaataagttttacatcaggctgatcaagggtgaattatccaatcacatggttgaggactttgatcatgatatcttaccaagtaacttttcatatcagcagccagggcct

SEQ ID NO: 432447 - DNA, 140 bp, Artificial Sequence
  Synthetic
atacgccatgctgggtctccgccaccacatatgcagctaatagcataattgatgaacctctctgaaatgagggcataaaaatctgatgtgttatgtaatatcccttggcccatgtcgagtcgtacttgggagtcggccat

SEQ ID NO: 432448 - DNA, 140 bp, Artificial Sequence
  Synthetic
atggccgactcccaagtacgactcgacatgggccaagggatattacataacacatcagatttttatgccctcatttcagagaggttcatcaattatgctattagctgcatatgtggtggcggagacccagcatggcgtat

SEQ ID NO: 432449 - DNA, 140 bp, Artificial Sequence
  Synthetic
atacgccatgctgggtctccacctgtgttggacttgggcttgtgcctgtatggcgtgtgggtcagttggtagtgccccacaaaagctcttacagaaatgagagacaatatgcctaggatccgtacttgggagtcggccat

SEQ ID NO: 432450 - DNA, 140 bp, Artificial Sequence
  Synthetic
atggccgactcccaagtacggatcctaggcatattgtctctcatttctgtaagagcttttgtggggcactaccaactgacccacacgccatacaggcacaagcccaagtccaacacaggtggagacccagcatggcgtat

SEQ ID NO: 432451 - DNA, 140 bp, Artificial Sequence
  Synthetic
aggccctggctgctgatatggaaatcctctgttactgactgtttagttttcttccttaaccctagttgagctttaataaaagacttcatcatagctgttaccacattgaaaggtatttccgaccttttgggacagcggtg

SEQ ID NO: 432452 - DNA, 140 bp, Artificial Sequence
  Synthetic
caccgctgtcccaaaaggtcggaaatacctttcaatgtggtaacagctatgatgaagtcttttattaaagctcaactagggttaaggaagaaaactaaacagtcagtaacagaggatttccatatcagcagccagggcct

SEQ ID NO: 432453 - DNA, 140 bp, Artificial Sequence
  Synthetic
atacgccatgctgggtctccttttatgtcagcttgcaggtcctttgagagaaaaatcaaattctgtaagacagccaagaataaaaatggacacatcattgggccccatttactgtgatcccgtacttgggagtcggccat

SEQ ID NO: 432454 - DNA, 140 bp, Artificial Sequence
  Synthetic
atggccgactcccaagtacgggatcacagtaaatggggcccaatgatgtgtccatttttattcttggctgtcttacagaatttgatttttctctcaaaggacctgcaagctgacataaaaggagacccagcatggcgtat

SEQ ID NO: 432455 - DNA, 140 bp, Artificial Sequence
  Synthetic
atacgccatgctgggtctccagtgtcagcggcaggtgtccgatctgcaaaatgccccttcccaccaagctaaaagcaacagcacaaccgagtgcaccctcaaccgaggcgacccagaacacgtacttgggagtcggccat

SEQ ID NO: 432456 - DNA, 140 bp, Artificial Sequence
  Synthetic
atggccgactcccaagtacgtgttctgggtcgcctcggttgagggtgcactcggttgtgctgttgcttttagcttggtgggaaggggcattttgcagatcggacacctgccgctgacactggagacccagcatggcgtat

SEQ ID NO: 432457 - DNA, 140 bp, Artificial Sequence
  Synthetic
atacgccatgctgggtctccggcattttcaaattccttctcgttattcaggcaactccctgatagttgtaggcttagagcttcaaagtaatcttctataagtctagtgaacatctttgtccgtacttgggagtcggccat

SEQ ID NO: 432458 - DNA, 140 bp, Artificial Sequence
  Synthetic
atggccgactcccaagtacggacaaagatgttcactagacttatagaagattactttgaagctctaagcctacaactatcagggagttgcctgaataacgagaaggaatttgaaaatgccggagacccagcatggcgtat

SEQ ID NO: 432459 - DNA, 140 bp, Artificial Sequence
  Synthetic
atacgccatgctgggtctccacaagttttgtaacctttctgatgcacataaaaagaatctttatgaccatgctttaatgagtatcatctcaaccttccacttatccattcctaactttaacgtacttgggagtcggccat

SEQ ID NO: 432460 - DNA, 140 bp, Artificial Sequence
  Synthetic
atggccgactcccaagtacgttaaagttaggaatggataagtggaaggttgagatgatactcattaaagcatggtcataaagattctttttatgtgcatcagaaaggttacaaaacttgtggagacccagcatggcgtat

SEQ ID NO: 432461 - DNA, 140 bp, Artificial Sequence
  Synthetic
aggccctggctgctgatatgactgtggcgactcttggctataaaagcacaagttctttaacattgctgtggtgcaatttgtcagtgacagagccttactaagtgcctctgaattgctctcgaccttttgggacagcggtg

SEQ ID NO: 432462 - DNA, 140 bp, Artificial Sequence
  Synthetic
caccgctgtcccaaaaggtcgagagcaattcagaggcacttagtaaggctctgtcactgacaaattgcaccacagcaatgttaaagaacttgtgcttttatagccaagagtcgccacagtcatatcagcagccagggcct

SEQ ID NO: 432463 - DNA, 140 bp, Artificial Sequence
  Synthetic
atacgccatgctgggtctccccggggatcctaggcatttcagctggacttcagtggtgagactcatcttagtgaatccttgaatcaaagtacctagtcaaaatgggcaacagacaggccacgtacttgggagtcggccat

SEQ ID NO: 432464 - DNA, 140 bp, Artificial Sequence
  Synthetic
atggccgactcccaagtacgtggcctgtctgttgcccattttgactaggtactttgattcaaggattcactaagatgagtctcaccactgaagtccagctgaaatgcctaggatccccggggagacccagcatggcgtat

SEQ ID NO: 432465 - DNA, 140 bp, Artificial Sequence
  Synthetic
aggccctggctgctgatatggtgaatccttgaatcaaagtacctagtcaaaatgggcaacagacaggccaaatcgacaagagtcgatgaacatcaaagagcccatctagtgccagatgcagaccttttgggacagcggtg

SEQ ID NO: 432466 - DNA, 140 bp, Artificial Sequence
  Synthetic
caccgctgtcccaaaaggtctgcatctggcactagatgggctctttgatgttcatcgactcttgtcgatttggcctgtctgttgcccattttgactaggtactttgattcaaggattcaccatatcagcagccagggcct

SEQ ID NO: 432467 - DNA, 140 bp, Artificial Sequence
  Synthetic
atacgccatgctgggtctccaatcgacaagagtcgatgaacatcaaagagcccatctagtgccagatgcatcccatctaggtcctcagttctgcaagagctgttggtttgaaaacagaggcgtacttgggagtcggccat

SEQ ID NO: 432468 - DNA, 140 bp, Artificial Sequence
  Synthetic
atggccgactcccaagtacgcctctgttttcaaaccaacagctcttgcagaactgaggacctagatgggatgcatctggcactagatgggctctttgatgttcatcgactcttgtcgattggagacccagcatggcgtat

SEQ ID NO: 432469 - DNA, 140 bp, Artificial Sequence
  Synthetic
atacgccatgctgggtctccgtttaacaggttctctatactgatcaacaattttttcaacagtctcctttagctgaccaaaataatcgcttgcacctccatcaagcaaaatttcgtctagcgtacttgggagtcggccat

SEQ ID NO: 432470 - DNA, 140 bp, Artificial Sequence
  Synthetic
atggccgactcccaagtacgctagacgaaattttgcttgatggaggtgcaagcgattattttggtcagctaaaggagactgttgaaaaaattgttgatcagtatagagaacctgttaaacggagacccagcatggcgtat

SEQ ID NO: 432471 - DNA, 140 bp, Artificial Sequence
  Synthetic
atacgccatgctgggtctcctccttagcgtcagcagcagatgcccgatctgcaagatgccccttcctaccaggctaagggcagcagtacagccgagcgcaccctcaaccgagacaacccacgtacttgggagtcggccat

SEQ ID NO: 432472 - DNA, 140 bp, Artificial Sequence
  Synthetic
atggccgactcccaagtacgtgggttgtctcggttgagggtgcgctcggctgtactgctgcccttagcctggtaggaaggggcatcttgcagatcgggcatctgctgctgacgctaaggaggagacccagcatggcgtat

SEQ ID NO: 432473 - DNA, 140 bp, Artificial Sequence
  Synthetic
atacgccatgctgggtctccatcaaagtcttcaaccatgtgattggataactcacctttaatcagcctaatgtaaaacttatttgaaacaatttcatctagatcatttattgatggctggcgtacttgggagtcggccat

SEQ ID NO: 432474 - DNA, 140 bp, Artificial Sequence
  Synthetic
atggccgactcccaagtacgccagccatcaataaatgatctagatgaaattgtttcaaataagttttacattaggctgattaaaggtgagttatccaatcacatggttgaagactttgatggagacccagcatggcgtat

SEQ ID NO: 432475 - DNA, 140 bp, Artificial Sequence
  Synthetic
aggccctggctgctgatatgatctccttcacccaccccccacccccggggggaccccccgccgggggccccccgggggggcaggcagcccaactctactcaatgtcctcaatgcacctctgaccttttgggacagcggtg

SEQ ID NO: 432476 - DNA, 140 bp, Artificial Sequence
  Synthetic
caccgctgtcccaaaaggtcagaggtgcattgaggacattgagtagagttgggctgcctgcccccccggggggcccccggcggggggtccccccgggggtggggggtgggtgaaggagatcatatcagcagccagggcct

SEQ ID NO: 432477 - DNA, 140 bp, Artificial Sequence
  Synthetic
atacgccatgctgggtctccccacttgactgaatcatgactccctgtcttgatttactatagcaaagagcataacctttaaaatcaatccattctccaagagattcaagaagttcactgacgtacttgggagtcggccat

SEQ ID NO: 432478 - DNA, 140 bp, Artificial Sequence
  Synthetic
atggccgactcccaagtacgtcagtgaacttcttgaatctcttggagaatggattgattttaaaggttatgctctttgctatagtaaatcaagacagggagtcatgattcagtcaagtggggagacccagcatggcgtat

SEQ ID NO: 432479 - DNA, 140 bp, Artificial Sequence
  Synthetic
atacgccatgctgggtctcccagtaagctgcgacacggctagtgctgtgagcttattgaaatcataattcagtattctagaaccatctgtgtacttgttgacaacaacactcttgttactcgtacttgggagtcggccat

SEQ ID NO: 432480 - DNA, 140 bp, Artificial Sequence
  Synthetic
atggccgactcccaagtacgagtaacaagagtgttgttgtcaacaagtacacagatggttctagaatactgaattatgatttcaataagctcacagcactagccgtgtcgcagcttactgggagacccagcatggcgtat

SEQ ID NO: 432481 - DNA, 140 bp, Artificial Sequence
  Synthetic
aggccctggctgctgatatgagtattctagaaccatctgtgtacttgttgacaacaacactcttgttactagctagatccaaggctgtagcacagccactggtgatgagggggtctttgagaccttttgggacagcggtg

SEQ ID NO: 432482 - DNA, 140 bp, Artificial Sequence
  Synthetic
caccgctgtcccaaaaggtctcaaagaccccctcatcaccagtggctgtgctacagccttggatctagctagtaacaagagtgttgttgtcaacaagtacacagatggttctagaatactcatatcagcagccagggcct

SEQ ID NO: 432483 - DNA, 140 bp, Artificial Sequence
  Synthetic
atacgccatgctgggtctccgacgtgaggagggataagtacttttttgaaacaccaggctttttatagtctggtcccttgacacttgtacatccatccttacttaaaaacctttttgcatcgtacttgggagtcggccat

SEQ ID NO: 432484 - DNA, 140 bp, Artificial Sequence
  Synthetic
atggccgactcccaagtacgatgcaaaaaggtttttaagtaaggatggatgtacaagtgtcaagggaccagactataaaaagcctggtgtttcaaaaaagtacttatccctcctcacgtcggagacccagcatggcgtat

SEQ ID NO: 432485 - DNA, 140 bp, Artificial Sequence
  Synthetic
atacgccatgctgggtctcctgtagaccatgtcgaccaattcttcctccgtggctgtgtctgcaggattagtactcacgtgaccaaatctcacttttggttccagaaacttttcaaaacacgtacttgggagtcggccat

SEQ ID NO: 432486 - DNA, 140 bp, Artificial Sequence
  Synthetic
atggccgactcccaagtacgtgttttgaaaagtttctggaaccaaaagtgagatttggtcacgtgagtactaatcctgcagacacagccacggaggaagaattggtcgacatggtctacaggagacccagcatggcgtat

SEQ ID NO: 432487 - DNA, 140 bp, Artificial Sequence
  Synthetic
atacgccatgctgggtctccggtccttatgataataatctgatacataggccattataaagtacctaagattttggaggagcttttgagaacgtttactaggatgagctaagattaaaatcgtacttgggagtcggccat

SEQ ID NO: 432488 - DNA, 140 bp, Artificial Sequence
  Synthetic
atggccgactcccaagtacgattttaatcttagctcatcctagtaaacgttctcaaaagctcctccaaaatcttaggtactttataatggcctatgtatcagattattatcataaggaccggagacccagcatggcgtat

SEQ ID NO: 432489 - DNA, 140 bp, Artificial Sequence
  Synthetic
aggccctggctgctgatatgacctcagctgaaaatattgctggaaaatatcttttaggatcagcataaaatgagcacacctcaccaactctgttatcattgatagcataacacttcgagcgaccttttgggacagcggtg

SEQ ID NO: 432490 - DNA, 140 bp, Artificial Sequence
  Synthetic
caccgctgtcccaaaaggtcgctcgaagtgttatgctatcaatgataacagagttggtgaggtgtgctcattttatgctgatcctaaaagatattttccagcaatattttcagctgaggtcatatcagcagccagggcct

SEQ ID NO: 432491 - DNA, 140 bp, Artificial Sequence
  Synthetic
aggccctggctgctgatatgcaggttttggcacttgggtcaagctgcatcattgagtctttaagtgtcatcaactgagaataggtcagccctgttggaaaccccgctgactgtaaagactgaccttttgggacagcggtg

SEQ ID NO: 432492 - DNA, 140 bp, Artificial Sequence
  Synthetic
caccgctgtcccaaaaggtcagtctttacagtcagcggggtttccaacagggctgacctattctcagttgatgacacttaaagactcaatgatgcagcttgacccaagtgccaaaacctgcatatcagcagccagggcct

SEQ ID NO: 432493 - DNA, 140 bp, Artificial Sequence
  Synthetic
aggccctggctgctgatatgaaagctgatttatttattgcttcagacagcagcttctgagctcctctagtgaatgtcgatgacaacctattttgcagggtttttactattgtagggacctgaccttttgggacagcggtg

SEQ ID NO: 432494 - DNA, 140 bp, Artificial Sequence
  Synthetic
caccgctgtcccaaaaggtcaggtccctacaatagtaaaaaccctgcaaaataggttgtcatcgacattcactagaggagctcagaagctgctgtctgaagcaataaataaatcagctttcatatcagcagccagggcct

SEQ ID NO: 432495 - DNA, 140 bp, Artificial Sequence
  Synthetic
aggccctggctgctgatatggaccttttcatcctccagattcacagcaccagagtagattatcttctgtcgcaacaccattctaagcgggtgatgggtagctaagttcagccaatgatacgaccttttgggacagcggtg

SEQ ID NO: 432496 - DNA, 140 bp, Artificial Sequence
  Synthetic
caccgctgtcccaaaaggtcgtatcattggctgaacttagctacccatcacccgcttagaatggtgttgcgacagaagataatctactctggtgctgtgaatctggaggatgaaaaggtccatatcagcagccagggcct

SEQ ID NO: 432497 - DNA, 140 bp, Artificial Sequence
  Synthetic
atacgccatgctgggtctccgtgtgattctagatctttcggcctgttgccttcgctcaacccatttcccgagatccctttttgttgactctaaagagactagtctatcattaacactaatcgtacttgggagtcggccat

SEQ ID NO: 432498 - DNA, 140 bp, Artificial Sequence
  Synthetic
atggccgactcccaagtacgattagtgttaatgatagactagtctctttagagtcaacaaaaagggatctcgggaaatgggttgagcgaaggcaacaggccgaaagatctagaatcacacggagacccagcatggcgtat

SEQ ID NO: 432499 - DNA, 140 bp, Artificial Sequence
  Synthetic
aggccctggctgctgatatgaactgataaattaaatgttcgatattatcttctgcagctaccttatcagagtacaaattattgagctcattaagtaactggctcttatcgacctttaaaagaccttttgggacagcggtg

SEQ ID NO: 432500 - DNA, 140 bp, Artificial Sequence
  Synthetic
caccgctgtcccaaaaggtcttttaaaggtcgataagagccagttacttaatgagctcaataatttgtactctgataaggtagctgcagaagataatatcgaacatttaatttatcagttcatatcagcagccagggcct

SEQ ID NO: 432501 - DNA, 140 bp, Artificial Sequence
  Synthetic
atacgccatgctgggtctcctcctcttcgatctgcagctttacctcatgggctgttagcttgttattgacaccctggtgacatgaggcaatcacttcctcataatgattagagcgattgtcgtacttgggagtcggccat

SEQ ID NO: 432502 - DNA, 140 bp, Artificial Sequence
  Synthetic
atggccgactcccaagtacgacaatcgctctaatcattatgaggaagtgattgcctcatgtcaccagggtgtcaataacaagctaacagcccatgaggtaaagctgcagatcgaagaggaggagacccagcatggcgtat

SEQ ID NO: 432503 - DNA, 140 bp, Artificial Sequence
  Synthetic
aggccctggctgctgatatgtctaagtcgcttcagatcaccatcatctcttctttgtttgcgcatcagtcgctgaacattgctgacctcggagaaatcaagcccatgtagaagggcttgagaccttttgggacagcggtg

SEQ ID NO: 432504 - DNA, 140 bp, Artificial Sequence
  Synthetic
caccgctgtcccaaaaggtctcaagcccttctacatgggcttgatttctccgaggtcagcaatgttcagcgactgatgcgcaaacaaagaagagatgatggtgatctgaagcgacttagacatatcagcagccagggcct

SEQ ID NO: 432505 - DNA, 140 bp, Artificial Sequence
  Synthetic
atacgccatgctgggtctccgataaggattcgcagagtctgctatattctgactcttcaaaaagtgcgttactctcttgggcatattttaaaagtgagaaaagcgtgttcctcagcttatcgtacttgggagtcggccat

SEQ ID NO: 432506 - DNA, 140 bp, Artificial Sequence
  Synthetic
atggccgactcccaagtacgataagctgaggaacacgcttttctcacttttaaaatatgcccaagagagtaacgcactttttgaagagtcagaatatagcagactctgcgaatccttatcggagacccagcatggcgtat

SEQ ID NO: 432507 - DNA, 140 bp, Artificial Sequence
  Synthetic
atacgccatgctgggtctccgccggggatcctaggcatttaggattgcgcttttagagatctttgtgtgagtgagcttatcaagccatgggacaaatcataacatttttccaagaagtaccgtacttgggagtcggccat

SEQ ID NO: 432508 - DNA, 140 bp, Artificial Sequence
  Synthetic
atggccgactcccaagtacggtacttcttggaaaaatgttatgatttgtcccatggcttgataagctcactcacacaaagatctctaaaagcgcaatcctaaatgcctaggatccccggcggagacccagcatggcgtat

SEQ ID NO: 432509 - DNA, 140 bp, Artificial Sequence
  Synthetic
aggccctggctgctgatatgctccaattttttgaagtcctcaatgtacttttgctcaaagttagctggagatgacctgacaaaacactccaataatattagaacattgcccgccagtttagaccttttgggacagcggtg

SEQ ID NO: 432510 - DNA, 140 bp, Artificial Sequence
  Synthetic
caccgctgtcccaaaaggtctaaactggcgggcaatgttctaatattattggagtgttttgtcaggtcatctccagctaactttgagcaaaagtacattgaggacttcaaaaaattggagcatatcagcagccagggcct

SEQ ID NO: 432511 - DNA, 140 bp, Artificial Sequence
  Synthetic
aggccctggctgctgatatgagggtgtttatgagctacagactctagagctagacatggcaagccttaatatgacaatgcccttatcttgcacgaagaacaacagccatcattacatcatgaccttttgggacagcggtg

SEQ ID NO: 432512 - DNA, 140 bp, Artificial Sequence
  Synthetic
caccgctgtcccaaaaggtcatgatgtaatgatggctgttgttcttcgtgcaagataagggcattgtcatattaaggcttgccatgtctagctctagagtctgtagctcataaacaccctcatatcagcagccagggcct

SEQ ID NO: 432513 - DNA, 140 bp, Artificial Sequence
  Synthetic
atacgccatgctgggtctccccttgataatctctcattgtccattaggtactttgacactaaatctttgacacaagctatgtcttcctccatattcggctgcaggtgtgaatgtcagaaccgtacttgggagtcggccat

SEQ ID NO: 432514 - DNA, 140 bp, Artificial Sequence
  Synthetic
atggccgactcccaagtacggttctgacattcacacctgcagccgaatatggaggaagacatagcttgtgtcaaagatttagtgtcaaagtacctaatggacaatgagagattatcaaggggagacccagcatggcgtat

SEQ ID NO: 432515 - DNA, 140 bp, Artificial Sequence
  Synthetic
aggccctggctgctgatatgcacaagctatgtcttcctccatattcggctgcaggtgtgaatgtcagaacccttgggacatgtggtccgctagagtagcagtttattataagataaggttgaccttttgggacagcggtg

SEQ ID NO: 432516 - DNA, 140 bp, Artificial Sequence
  Synthetic
caccgctgtcccaaaaggtcaaccttatcttataataaactgctactctagcggaccacatgtcccaagggttctgacattcacacctgcagccgaatatggaggaagacatagcttgtgcatatcagcagccagggcct

SEQ ID NO: 432517 - DNA, 140 bp, Artificial Sequence
  Synthetic
aggccctggctgctgatatgagcatcattgtagatattctcacaaattttgatgtattgatcctcagacaggatttctcgatcaaaatcttctatcatatggtttgaaagttcactttttgaccttttgggacagcggtg

SEQ ID NO: 432518 - DNA, 140 bp, Artificial Sequence
  Synthetic
caccgctgtcccaaaaggtcaaaaagtgaactttcaaaccatatgatagaagattttgatcgagaaatcctgtctgaggatcaatacatcaaaatttgtgagaatatctacaatgatgctcatatcagcagccagggcct

SEQ ID NO: 432519 - DNA, 140 bp, Artificial Sequence
  Synthetic
aggccctggctgctgatatgttaggttttgaattattgttaaaaacaagaaaggacacatcatagggccccacttactgtgatccatactatatgatacatgtgctgaggagacattcaggaccttttgggacagcggtg

SEQ ID NO: 432520 - DNA, 140 bp, Artificial Sequence
  Synthetic
caccgctgtcccaaaaggtcctgaatgtctcctcagcacatgtatcatatagtatggatcacagtaagtggggccctatgatgtgtcctttcttgtttttaacaataattcaaaacctaacatatcagcagccagggcct

SEQ ID NO: 432521 - DNA, 140 bp, Artificial Sequence
  Synthetic
aggccctggctgctgatatgtcagaaggaatgggtcaatgggatacttggcataacataacaaactcaaagttctcttctgaattctattacacagatcaactgggacaccattagccacgaccttttgggacagcggtg

SEQ ID NO: 432522 - DNA, 140 bp, Artificial Sequence
  Synthetic
caccgctgtcccaaaaggtcgtggctaatggtgtcccagttgatctgtgtaatagaattcagaagagaactttgagtttgttatgttatgccaagtatcccattgacccattccttctgacatatcagcagccagggcct

SEQ ID NO: 432523 - DNA, 140 bp, Artificial Sequence
  Synthetic
atacgccatgctgggtctccgtctgtagagcagatattcaacttctgtgatcaaatcctccctaattttctcaatcaaatccttgtgataaaaatcggatacaaaggccatcacaaaatacgtacttgggagtcggccat

SEQ ID NO: 432524 - DNA, 140 bp, Artificial Sequence
  Synthetic
atggccgactcccaagtacgtattttgtgatggcctttgtatccgatttttatcacaaggatttgattgagaaaattagggaggatttgatcacagaagttgaatatctgctctacagacggagacccagcatggcgtat

SEQ ID NO: 432525 - DNA, 140 bp, Artificial Sequence
  Synthetic
atacgccatgctgggtctcccagctgcatcatacattatgcagtccattaaagcacagtgcggggtgatttcttctttgcctcctcttttcttcttttcgacaaccactccagtgtgcatcgtacttgggagtcggccat

SEQ ID NO: 432526 - DNA, 140 bp, Artificial Sequence
  Synthetic
atggccgactcccaagtacgatgcacactggagtggttgtcgaaaagaagaaaagaggaggcaaagaagaaatcaccccgcactgtgctttaatggactgcataatgtatgatgcagctgggagacccagcatggcgtat

SEQ ID NO: 432527 - DNA, 140 bp, Artificial Sequence
  Synthetic
atacgccatgctgggtctccaccggggatcctaggcaatttggttgttcttctcttttgaggcctcttttaggcctttcttaaactctttgtgctgaactccaccagatggggaacaagccgtacttgggagtcggccat

SEQ ID NO: 432528 - DNA, 140 bp, Artificial Sequence
  Synthetic
atggccgactcccaagtacggcttgttccccatctggtggagttcagcacaaagagtttaagaaaggcctaaaagaggcctcaaaagagaagaacaaccaaattgcctaggatccccggtggagacccagcatggcgtat

SEQ ID NO: 432529 - DNA, 140 bp, Artificial Sequence
  Synthetic
atacgccatgctgggtctccaagtcaaagctcctgaagcaaggaatagtccgagggccagtctgatcccagacgccacacacctagggccacagttctgcaagagctgctggttcgagaacgtacttgggagtcggccat

SEQ ID NO: 432530 - DNA, 140 bp, Artificial Sequence
  Synthetic
atggccgactcccaagtacgttctcgaaccagcagctcttgcagaactgtggccctaggtgtgtggcgtctgggatcagactggccctcggactattccttgcttcaggagctttgacttggagacccagcatggcgtat

SEQ ID NO: 432531 - DNA, 140 bp, Artificial Sequence
  Synthetic
aggccctggctgctgatatggacgccacacacctagggccacagttctgcaagagctgctggttcgagaacaagggcctggtcgagtgcaacaatcactacctgtgcctcaactgtctaagaccttttgggacagcggtg

SEQ ID NO: 432532 - DNA, 140 bp, Artificial Sequence
  Synthetic
caccgctgtcccaaaaggtcttagacagttgaggcacaggtagtgattgttgcactcgaccaggcccttgttctcgaaccagcagctcttgcagaactgtggccctaggtgtgtggcgtccatatcagcagccagggcct

SEQ ID NO: 432533 - DNA, 140 bp, Artificial Sequence
  Synthetic
aggccctggctgctgatatgcccacaagactgagaccatcagccaccccaacggcgcccccagccggagcaggagacaacaccagacccccaccctacagtccctgaacagctcaccaacgaccttttgggacagcggtg

SEQ ID NO: 432534 - DNA, 140 bp, Artificial Sequence
  Synthetic
caccgctgtcccaaaaggtcgttggtgagctgttcagggactgtagggtgggggtctggtgttgtctcctgctccggctgggggcgccgttggggtggctgatggtctcagtcttgtgggcatatcagcagccagggcct

SEQ ID NO: 432535 - DNA, 140 bp, Artificial Sequence
  Synthetic
aggccctggctgctgatatgtactagggtgagctaaaattaaaatcaatatcatctttgtcaaagacctgatattatttaattgcccttctagctcactgcaatcttccacccaagagacgaccttttgggacagcggtg

SEQ ID NO: 432536 - DNA, 140 bp, Artificial Sequence
  Synthetic
caccgctgtcccaaaaggtcgtctcttgggtggaagattgcagtgagctagaagggcaattaaataatatcaggtctttgacaaagatgatattgattttaattttagctcaccctagtacatatcagcagccagggcct

SEQ ID NO: 432537 - DNA, 140 bp, Artificial Sequence
  Synthetic
atacgccatgctgggtctccttaatttgccactacttgattgtaccatcaccttcccccttgatttgctgtagcagagagcatagcccttgaattccacccaattgtctaccacctcaagcgtacttgggagtcggccat

SEQ ID NO: 432538 - DNA, 140 bp, Artificial Sequence
  Synthetic
atggccgactcccaagtacgcttgaggtggtagacaattgggtggaattcaagggctatgctctctgctacagcaaatcaagggggaaggtgatggtacaatcaagtagtggcaaattaaggagacccagcatggcgtat

SEQ ID NO: 432539 - DNA, 140 bp, Artificial Sequence
  Synthetic
aggccctggctgctgatatgttcttgagttttttggtaacttatagtgggtgtgataccggagatctcaacgtccatgatggcatcataaacatcacagtcaaggatcttgtaatcaattgaccttttgggacagcggtg

SEQ ID NO: 432540 - DNA, 140 bp, Artificial Sequence
  Synthetic
caccgctgtcccaaaaggtcaattgattacaagatccttgactgtgatgtttatgatgccatcatggacgttgagatctccggtatcacacccactataagttaccaaaaaactcaagaacatatcagcagccagggcct

SEQ ID NO: 432541 - DNA, 140 bp, Artificial Sequence
  Synthetic
atacgccatgctgggtctccagacaatgtccacccctgaccattgcattctcaaccccagcctgtctgtaatcatgtcacttaacgccctgatcaacagatcagatgaagtgtctccaaccgtacttgggagtcggccat

SEQ ID NO: 432542 - DNA, 140 bp, Artificial Sequence
  Synthetic
atggccgactcccaagtacggttggagacacttcatctgatctgttgatcagggcgttaagtgacatgattacagacaggctggggttgagaatgcaatggtcaggggtggacattgtctggagacccagcatggcgtat

SEQ ID NO: 432543 - DNA, 140 bp, Artificial Sequence
  Synthetic
aggccctggctgctgatatgatcatgtcacttaacgccctgatcaacagatcagatgaagtgtctccaacttctctcacaaacatctcaagatcctgatcctgtataacaggtgtgaaaggaccttttgggacagcggtg

SEQ ID NO: 432544 - DNA, 140 bp, Artificial Sequence
  Synthetic
caccgctgtcccaaaaggtcctttcacacctgttatacaggatcaggatcttgagatgtttgtgagagaagttggagacacttcatctgatctgttgatcagggcgttaagtgacatgatcatatcagcagccagggcct

SEQ ID NO: 432545 - DNA, 140 bp, Artificial Sequence
  Synthetic
atacgccatgctgggtctccttctctcacaaacatctcaagatcctgatcctgtataacaggtgtgaaagatgccaatttcttttcacattcccacaggcctcccctacgcacaactagacgtacttgggagtcggccat

SEQ ID NO: 432546 - DNA, 140 bp, Artificial Sequence
  Synthetic
atggccgactcccaagtacgtctagttgtgcgtaggggaggcctgtgggaatgtgaaaagaaattggcatctttcacacctgttatacaggatcaggatcttgagatgtttgtgagagaaggagacccagcatggcgtat

SEQ ID NO: 432547 - DNA, 140 bp, Artificial Sequence
  Synthetic
atacgccatgctgggtctccccggggatcctaggcaattcagctgaacttcagtggtaagactcattttagtgaatctctggatcaaggtgcctagtcaaaatgggcaacagacaggccacgtacttgggagtcggccat

SEQ ID NO: 432548 - DNA, 140 bp, Artificial Sequence
  Synthetic
atggccgactcccaagtacgtggcctgtctgttgcccattttgactaggcaccttgatccagagattcactaaaatgagtcttaccactgaagttcagctgaattgcctaggatccccggggagacccagcatggcgtat

SEQ ID NO: 432549 - DNA, 140 bp, Artificial Sequence
  Synthetic
atacgccatgctgggtctccctgcagcttttccatatcaacaacaacctcaacaggagtcacatgccctagttgatttgtgtcaactaaaaactcgttaatgacctcagtatcaacataccgtacttgggagtcggccat

SEQ ID NO: 432550 - DNA, 140 bp, Artificial Sequence
  Synthetic
atggccgactcccaagtacggtatgttgatactgaggtcattaacgagtttttagttgacacaaatcaactagggcatgtgactcctgttgaggttgttgttgatatggaaaagctgcagggagacccagcatggcgtat

SEQ ID NO: 432551 - DNA, 140 bp, Artificial Sequence
  Synthetic
atacgccatgctgggtctcctcctaggcaatttggttgttctttttgggagcttttgctataaagaccactaaatggggaacaagcaagccaaaactccagaaacaaaagacagcccgagcgtacttgggagtcggccat

SEQ ID NO: 432552 - DNA, 140 bp, Artificial Sequence
  Synthetic
atggccgactcccaagtacgctcgggctgtcttttgtttctggagttttggcttgcttgttccccatttagtggtctttatagcaaaagctcccaaaaagaacaaccaaattgcctaggaggagacccagcatggcgtat

SEQ ID NO: 432553 - DNA, 140 bp, Artificial Sequence
  Synthetic
aggccctggctgctgatatgtttcaatccctccatgagcaacattctaggttcagtttggaccagaaaagctaacttctgtcttgatagcttctcattgtctgcaaggtattttgagatagaccttttgggacagcggtg

SEQ ID NO: 432554 - DNA, 140 bp, Artificial Sequence
  Synthetic
caccgctgtcccaaaaggtctatctcaaaataccttgcagacaatgagaagctatcaagacagaagttagcttttctggtccaaactgaacctagaatgttgctcatggagggattgaaacatatcagcagccagggcct

SEQ ID NO: 432555 - DNA, 140 bp, Artificial Sequence
  Synthetic
atacgccatgctgggtctccgcaatcaattgattctgattaaacctagctggttcaatgtcaaagtctatccaggcataacccatcatcagatcatgtttgaacattggtctctcaacaccgtacttgggagtcggccat

SEQ ID NO: 432556 - DNA, 140 bp, Artificial Sequence
  Synthetic
atggccgactcccaagtacggtgttgagagaccaatgttcaaacatgatctgatgatgggttatgcctggatagactttgacattgaaccagctaggtttaatcagaatcaattgattgcggagacccagcatggcgtat

SEQ ID NO: 432557 - DNA, 140 bp, Artificial Sequence
  Synthetic
aggccctggctgctgatatgccaggcataacccatcatcagatcatgtttgaacattggtctctcaacacctttgtgaatgactttctctacgaatgaagaaaatggtcccaatctatgcgaccttttgggacagcggtg

SEQ ID NO: 432558 - DNA, 140 bp, Artificial Sequence
  Synthetic
caccgctgtcccaaaaggtcgcatagattgggaccattttcttcattcgtagagaaagtcattcacaaaggtgttgagagaccaatgttcaaacatgatctgatgatgggttatgcctggcatatcagcagccagggcct

SEQ ID NO: 432559 - DNA, 140 bp, Artificial Sequence
  Synthetic
atacgccatgctgggtctccccctaacgttcttgtggttgcaacaaatggtctcacataggactcaaaatagatttgcctcatgaaattgtcaacagcatcactagtacttaccactcttcgtacttgggagtcggccat

SEQ ID NO: 432560 - DNA, 140 bp, Artificial Sequence
  Synthetic
atggccgactcccaagtacgaagagtggtaagtactagtgatgctgttgacaatttcatgaggcaaatctattttgagtcctatgtgagaccatttgttgcaaccacaagaacgttagggggagacccagcatggcgtat

SEQ ID NO: 432561 - DNA, 140 bp, Artificial Sequence
  Synthetic
atacgccatgctgggtctcctcctccaccatgggttcatgtgttctagtgtgagaaaaccttaattcagatgataacacaatgtaatgctcctctcttttccattttactatgtgtgaaacgtacttgggagtcggccat

SEQ ID NO: 432562 - DNA, 140 bp, Artificial Sequence
  Synthetic
atggccgactcccaagtacgtttcacacatagtaaaatggaaaagagaggagcattacattgtgttatcatctgaattaaggttttctcacactagaacacatgaacccatggtggaggaggagacccagcatggcgtat

SEQ ID NO: 432563 - DNA, 140 bp, Artificial Sequence
  Synthetic
atacgccatgctgggtctccaattttatcctgggtgaccacttcattttggttgatgctaaatcgctcatgaatggtaatatgtgtttctcaaacacagatgggtacagccttctcaaagcgtacttgggagtcggccat

SEQ ID NO: 432564 - DNA, 140 bp, Artificial Sequence
  Synthetic
atggccgactcccaagtacgctttgagaaggctgtacccatctgtgtttgagaaacacatattaccattcatgagcgatttagcatcaaccaaaatgaagtggtcacccaggataaaattggagacccagcatggcgtat

SEQ ID NO: 432565 - DNA, 140 bp, Artificial Sequence
  Synthetic
aggccctggctgctgatatggaatggtaatatgtgtttctcaaacacagatgggtacagccttctcaaagaatgaatgatatgattcaacccaaccctgtcttctaacaactttgatgcagaccttttgggacagcggtg

SEQ ID NO: 432566 - DNA, 140 bp, Artificial Sequence
  Synthetic
caccgctgtcccaaaaggtctgcatcaaagttgttagaagacagggttgggttgaatcatatcattcattctttgagaaggctgtacccatctgtgtttgagaaacacatattaccattccatatcagcagccagggcct

SEQ ID NO: 432567 - DNA, 140 bp, Artificial Sequence
  Synthetic
atacgccatgctgggtctcctgctttagttgtcttcggctcacccagaacccatgcacccagttctattgcagtcgatagagagatgcacatatagtcccataataagggtctaaagtaacgtacttgggagtcggccat

SEQ ID NO: 432568 - DNA, 140 bp, Artificial Sequence
  Synthetic
atggccgactcccaagtacgttactttagacccttattatgggactatatgtgcatctctctatcgactgcaatagaactgggtgcatgggttctgggtgagccgaagacaactaaagcaggagacccagcatggcgtat

SEQ ID NO: 432569 - DNA, 140 bp, Artificial Sequence
  Synthetic
atacgccatgctgggtctccacctgtgttgggttcgggtttgtgtcagtatggtttgtaaatcagctggtggtgccccacgaaagctttcacagaaatgagagacaataagcctaggatccgtacttgggagtcggccat

SEQ ID NO: 432570 - DNA, 140 bp, Artificial Sequence
  Synthetic
atggccgactcccaagtacggatcctaggcttattgtctctcatttctgtgaaagctttcgtggggcaccaccagctgatttacaaaccatactgacacaaacccgaacccaacacaggtggagacccagcatggcgtat

SEQ ID NO: 432571 - DNA, 140 bp, Artificial Sequence
  Synthetic
atacgccatgctgggtctcccacctcgagtgaaagtggaagatagtttattctggattgtcttgacaatagtgggaattttctcatcatctaggttcacagcacctgaatatatgatcttcgtacttgggagtcggccat

SEQ ID NO: 432572 - DNA, 140 bp, Artificial Sequence
  Synthetic
atggccgactcccaagtacgaagatcatatattcaggtgctgtgaacctagatgatgagaaaattcccactattgtcaagacaatccagaataaactatcttccactttcactcgaggtgggagacccagcatggcgtat

SEQ ID NO: 432573 - DNA, 140 bp, Artificial Sequence
  Synthetic
aggccctggctgctgatatggtgggaattttctcatcatctaggttcacagcacctgaatatatgatcttttgccttaataccatccttagagggtgatgtgcagccaaattcaaccaaggaccttttgggacagcggtg

SEQ ID NO: 432574 - DNA, 140 bp, Artificial Sequence
  Synthetic
caccgctgtcccaaaaggtccttggttgaatttggctgcacatcaccctctaaggatggtattaaggcaaaagatcatatattcaggtgctgtgaacctagatgatgagaaaattcccaccatatcagcagccagggcct

SEQ ID NO: 432575 - DNA, 140 bp, Artificial Sequence
  Synthetic
atacgccatgctgggtctccagatttttcagtgaagagaggtgttcactagacaggtagtttgttgtaaactcctcatggagctgcccagtcttcaacctgttgtacaacctccttaacacgtacttgggagtcggccat

SEQ ID NO: 432576 - DNA, 140 bp, Artificial Sequence
  Synthetic
atggccgactcccaagtacgtgttaaggaggttgtacaacaggttgaagactgggcagctccatgaggagtttacaacaaactacctgtctagtgaacacctctcttcactgaaaaatctggagacccagcatggcgtat

SEQ ID NO: 432577 - DNA, 140 bp, Artificial Sequence
  Synthetic
atacgccatgctgggtctcctagatctaatcttgctgcaagcgtcaggaattaacccctctatctgcctcataatcctgtaactgcggttaccatccacccaatctctgacatctgtctccgtacttgggagtcggccat

SEQ ID NO: 432578 - DNA, 140 bp, Artificial Sequence
  Synthetic
atggccgactcccaagtacggagacagatgtcagagattgggtggatggtaaccgcagttacaggattatgaggcagatagaggggttaattcctgacgcttgcagcaagattagatctaggagacccagcatggcgtat

SEQ ID NO: 432579 - DNA, 140 bp, Artificial Sequence
  Synthetic
atacgccatgctgggtctccaaagagtacatggagagacaggggaagacaccattaggtctggttgacctctttgtgttcagcacaagtttctacctcattagcatttttcttcacctagcgtacttgggagtcggccat

SEQ ID NO: 432580 - DNA, 140 bp, Artificial Sequence
  Synthetic
atggccgactcccaagtacgctaggtgaagaaaaatgctaatgaggtagaaacttgtgctgaacacaaagaggtcaaccagacctaatggtgtcttcccctgtctctccatgtactctttggagacccagcatggcgtat

SEQ ID NO: 432581 - DNA, 140 bp, Artificial Sequence
  Synthetic
aggccctggctgctgatatgatcttctatccaagaaatcattgtgcttactgttgtttgtaaaacctcagctgaaaatattgctggaaaatatcttttaggatcagcataaaatgagcacgaccttttgggacagcggtg

SEQ ID NO: 432582 - DNA, 140 bp, Artificial Sequence
  Synthetic
caccgctgtcccaaaaggtcgtgctcattttatgctgatcctaaaagatattttccagcaatattttcagctgaggttttacaaacaacagtaagcacaatgatttcttggatagaagatcatatcagcagccagggcct

SEQ ID NO: 432583 - DNA, 140 bp, Artificial Sequence
  Synthetic
atacgccatgctgggtctccttaaggttcttatttgtattagattacacaggtgaacagggacaccattcgcaactgactgatcaacaattgtgtcgattgtctctgccaattggtgtggcgtacttgggagtcggccat

SEQ ID NO: 432584 - DNA, 140 bp, Artificial Sequence
  Synthetic
atggccgactcccaagtacgccacaccaattggcagagacaatcgacacaattgttgatcagtcagttgcgaatggtgtccctgttcacctgtgtaatctaatacaaataagaaccttaaggagacccagcatggcgtat

SEQ ID NO: 432585 - DNA, 140 bp, Artificial Sequence
  Synthetic
atacgccatgctgggtctccatggcacctcatctccccaaacaaagaacctagatttgaattctgcaacaaatctgccaatgacacttttaggactcacaaatttattgagttgatcactcgtacttgggagtcggccat

SEQ ID NO: 432586 - DNA, 140 bp, Artificial Sequence
  Synthetic
atggccgactcccaagtacgagtgatcaactcaataaatttgtgagtcctaaaagtgtcattggcagatttgttgcagaattcaaatctaggttctttgtttggggagatgaggtgccatggagacccagcatggcgtat

SEQ ID NO: 432587 - DNA, 140 bp, Artificial Sequence
  Synthetic
atacgccatgctgggtctccgcaacaattctgtcagagtttgatcaaaaagggagatttgatcatcactagaggtgtaagcatctattgtgccaccacatatacaactaatggcataattcgtacttgggagtcggccat

SEQ ID NO: 432588 - DNA, 140 bp, Artificial Sequence
  Synthetic
atggccgactcccaagtacgaattatgccattagttgtatatgtggtggcacaatagatgcttacacctctagtgatgatcaaatctccctttttgatcaaactctgacagaattgttgcggagacccagcatggcgtat

SEQ ID NO: 432589 - DNA, 140 bp, Artificial Sequence
  Synthetic
atacgccatgctgggtctcctcattttggttgatgctaaatcgctcatgaatggtagtatgtgtttctcaaacacagatgggtacaaccttctcaaggaatgaatgatatggttcaaacccgtacttgggagtcggccat

SEQ ID NO: 432590 - DNA, 140 bp, Artificial Sequence
  Synthetic
atggccgactcccaagtacgggtttgaaccatatcattcattccttgagaaggttgtacccatctgtgtttgagaaacacatactaccattcatgagcgatttagcatcaaccaaaatgaggagacccagcatggcgtat

SEQ ID NO: 432591 - DNA, 140 bp, Artificial Sequence
  Synthetic
atacgccatgctgggtctccttccttggcccatgtcaagtattgaactaatatgagagggtactacaccgatttgaaaattggagtaaaagaaatcttctgttattgactgtttagttttcgtacttgggagtcggccat

SEQ ID NO: 432592 - DNA, 140 bp, Artificial Sequence
  Synthetic
atggccgactcccaagtacgaaaactaaacagtcaataacagaagatttcttttactccaattttcaaatcggtgtagtaccctctcatattagttcaatacttgacatgggccaaggaaggagacccagcatggcgtat

SEQ ID NO: 432593 - DNA, 140 bp, Artificial Sequence
  Synthetic
atacgccatgctgggtctcctgtcatcagatccctgacaggtgatgaccatgttccgaggaagtgcctctataacagcactggtcaaacctggctgtgcagcgaagaggtctgtgacatccgtacttgggagtcggccat

SEQ ID NO: 432594 - DNA, 140 bp, Artificial Sequence
  Synthetic
atggccgactcccaagtacggatgtcacagacctcttcgctgcacagccaggtttgaccagtgctgttatagaggcacttcctcggaacatggtcatcacctgtcagggatctgatgacaggagacccagcatggcgtat

SEQ ID NO: 432595 - DNA, 140 bp, Artificial Sequence
  Synthetic
aggccctggctgctgatatgccacattgaaaggtatttccaccattttgtgcatgtgccacataagcagggttgagaggtagtccctcccttttacatcagcttgcagatcctttgaaaggaccttttgggacagcggtg

SEQ ID NO: 432596 - DNA, 140 bp, Artificial Sequence
  Synthetic
caccgctgtcccaaaaggtcctttcaaaggatctgcaagctgatgtaaaagggagggactacctctcaaccctgcttatgtggcacatgcacaaaatggtggaaatacctttcaatgtggcatatcagcagccagggcct

SEQ ID NO: 432597 - DNA, 140 bp, Artificial Sequence
  Synthetic
aggccctggctgctgatatgccagagatatcgaagtccataatcaagtcataactgtcaaggcaaattaccttcatatcaattttatagtagtctacattgatcccaacatcctttaagggaccttttgggacagcggtg

SEQ ID NO: 432598 - DNA, 140 bp, Artificial Sequence
  Synthetic
caccgctgtcccaaaaggtcccttaaaggatgttgggatcaatgtagactactataaaattgatatgaaggtaatttgccttgacagttatgacttgattatggacttcgatatctctggcatatcagcagccagggcct

SEQ ID NO: 432599 - DNA, 140 bp, Artificial Sequence
  Synthetic
atacgccatgctgggtctccggccccacttactatgatccatgctgtaagagacatgtgccatggaaacatttaatttcatggaaagaatagcattttcaaactccttttcgttgttcaacgtacttgggagtcggccat

SEQ ID NO: 432600 - DNA, 140 bp, Artificial Sequence
  Synthetic
atggccgactcccaagtacgttgaacaacgaaaaggagtttgaaaatgctattctttccatgaaattaaatgtttccatggcacatgtctcttacagcatggatcatagtaagtggggccggagacccagcatggcgtat

SEQ ID NO: 432601 - DNA, 140 bp, Artificial Sequence
  Synthetic
aggccctggctgctgatatgtttaatttcatggaaagaatagcattttcaaactccttttcgttgttcaaacaactccctgaaagctgtgaacttagagcctcaaagtaatcctctatgagaccttttgggacagcggtg

SEQ ID NO: 432602 - DNA, 140 bp, Artificial Sequence
  Synthetic
caccgctgtcccaaaaggtctcatagaggattactttgaggctctaagttcacagctttcagggagttgtttgaacaacgaaaaggagtttgaaaatgctattctttccatgaaattaaacatatcagcagccagggcct

SEQ ID NO: 432603 - DNA, 140 bp, Artificial Sequence
  Synthetic
aggccctggctgctgatatgtccacagatttatcctcactgttatgctcacaaccatttgcattgcaggaatcaatttcaatacagagggacaggagtttcagcccttctaccaagagcagaccttttgggacagcggtg

SEQ ID NO: 432604 - DNA, 140 bp, Artificial Sequence
  Synthetic
caccgctgtcccaaaaggtctgctcttggtagaagggctgaaactcctgtccctctgtattgaaattgattcctgcaatgcaaatggttgtgagcataacagtgaggataaatctgtggacatatcagcagccagggcct

SEQ ID NO: 432605 - DNA, 140 bp, Artificial Sequence
  Synthetic
atacgccatgctgggtctccccgccaacttgttctttgtatgataaggaaaatttgagcctccctgtgtcaggtcccactgagttatacgactgtggtgactcttgactataaaaacacacgtacttgggagtcggccat

SEQ ID NO: 432606 - DNA, 140 bp, Artificial Sequence
  Synthetic
atggccgactcccaagtacgtgtgtttttatagtcaagagtcaccacagtcgtataactcagtgggacctgacacagggaggctcaaattttccttatcatacaaagaacaagttggcggggagacccagcatggcgtat

SEQ ID NO: 432607 - DNA, 140 bp, Artificial Sequence
  Synthetic
aggccctggctgctgatatgaggtcccactgagttatacgactgtggtgactcttgactataaaaacacaagttcttcaacattgctgtggtgcagttagtcagtgatagagctttactagaccttttgggacagcggtg

SEQ ID NO: 432608 - DNA, 140 bp, Artificial Sequence
  Synthetic
caccgctgtcccaaaaggtctagtaaagctctatcactgactaactgcaccacagcaatgttgaagaacttgtgtttttatagtcaagagtcaccacagtcgtataactcagtgggacctcatatcagcagccagggcct

SEQ ID NO: 432609 - DNA, 140 bp, Artificial Sequence
  Synthetic
atacgccatgctgggtctcctttacccatgtcaaacttaaagttgagatttcttgacttataatgagtgtacttgcccatgagtgcatttgcattcatgatcaaaagtatagacttaaaacgtacttgggagtcggccat

SEQ ID NO: 432610 - DNA, 140 bp, Artificial Sequence
  Synthetic
atggccgactcccaagtacgttttaagtctatacttttgatcatgaatgcaaatgcactcatgggcaagtacactcattataagtcaagaaatctcaactttaagtttgacatgggtaaaggagacccagcatggcgtat

SEQ ID NO: 432611 - DNA, 140 bp, Artificial Sequence
  Synthetic
aggccctggctgctgatatgacttgcccatgagtgcatttgcattcatgatcaaaagtatagacttaaaacactggaagtactcgtgatcaagatatgttcgtgttgacactgcctttgtgaccttttgggacagcggtg

SEQ ID NO: 432612 - DNA, 140 bp, Artificial Sequence
  Synthetic
caccgctgtcccaaaaggtcacaaaggcagtgtcaacacgaacatatcttgatcacgagtacttccagtgttttaagtctatacttttgatcatgaatgcaaatgcactcatgggcaagtcatatcagcagccagggcct

SEQ ID NO: 432613 - DNA, 140 bp, Artificial Sequence
  Synthetic
atacgccatgctgggtctccccttcaacctgctgttctcatagacggcatcacagaattcctcataaaatttgtctggcaagacatcatgatcaaaatcctcaaccatgtggtttgacaacgtacttgggagtcggccat

SEQ ID NO: 432614 - DNA, 140 bp, Artificial Sequence
  Synthetic
atggccgactcccaagtacgttgtcaaaccacatggttgaggattttgatcatgatgtcttgccagacaaattttatgaggaattctgtgatgccgtctatgagaacagcaggttgaaggggagacccagcatggcgtat

SEQ ID NO: 432615 - DNA, 140 bp, Artificial Sequence
  Synthetic
aggccctggctgctgatatgttgtctggcaagacatcatgatcaaaatcctcaaccatgtggtttgacaactcacccttaatcaacctaatgtaaaacttgtttgagacaatttcatctagaccttttgggacagcggtg

SEQ ID NO: 432616 - DNA, 140 bp, Artificial Sequence
  Synthetic
caccgctgtcccaaaaggtctagatgaaattgtctcaaacaagttttacattaggttgattaagggtgagttgtcaaaccacatggttgaggattttgatcatgatgtcttgccagacaacatatcagcagccagggcct

SEQ ID NO: 432617 - DNA, 140 bp, Artificial Sequence
  Synthetic
atacgccatgctgggtctccacaggttccttatattgatcaacaatcttttcaacagtctccttcagttgattaaaataggtgctagcacctccatcaagtagaatttcgtctaggtcagcgtacttgggagtcggccat

SEQ ID NO: 432618 - DNA, 140 bp, Artificial Sequence
  Synthetic
atggccgactcccaagtacgctgacctagacgaaattctacttgatggaggtgctagcacctattttaatcaactgaaggagactgttgaaaagattgttgatcaatataaggaacctgtggagacccagcatggcgtat

SEQ ID NO: 432619 - DNA, 140 bp, Artificial Sequence
  Synthetic
atacgccatgctgggtctcccttcatcaacatcaccctcatgctgtttagatcctagaaccaggttgctcatcgcctgttgcaccttatactcataatcctgtttgttgagaaggtgcttcgtacttgggagtcggccat

SEQ ID NO: 432620 - DNA, 140 bp, Artificial Sequence
  Synthetic
atggccgactcccaagtacgaagcaccttctcaacaaacaggattatgagtataaggtgcaacaggcgatgagcaacctggttctaggatctaaacagcatgagggtgatgttgatgaagggagacccagcatggcgtat

SEQ ID NO: 432621 - DNA, 140 bp, Artificial Sequence
  Synthetic
atacgccatgctgggtctccccccttccttgagaaaacttcagtgagctgtgacacagctaatgctgtgagcttgttgaagtcatagttcaatactctagaaccatctgtgtatttattgcgtacttgggagtcggccat

SEQ ID NO: 432622 - DNA, 140 bp, Artificial Sequence
  Synthetic
atggccgactcccaagtacgcaataaatacacagatggttctagagtattgaactatgacttcaacaagctcacagcattagctgtgtcacagctcactgaagttttctcaaggaaggggggagacccagcatggcgtat

SEQ ID NO: 432623 - DNA, 140 bp, Artificial Sequence
  Synthetic
atacgccatgctgggtctccactcaaaaacttttttgcattgtagaccatatcatccagttcttcctccgtggctgtatctgcaggattgatgctcacgtggccaaatttcacttttggccgtacttgggagtcggccat

SEQ ID NO: 432624 - DNA, 140 bp, Artificial Sequence
  Synthetic
atggccgactcccaagtacggccaaaagtgaaatttggccacgtgagcatcaatcctgcagatacagccacggaggaagaactggatgatatggtctacaatgcaaaaaagtttttgagtggagacccagcatggcgtat

SEQ ID NO: 432625 - DNA, 140 bp, Artificial Sequence
  Synthetic
atacgccatgctgggtctccacctgttggtcatcatgctcttcacatcctcagataaaaccaaactcattaatgttcttaataatctatagagtaagaactcgacatcagtgatcagttccgtacttgggagtcggccat

SEQ ID NO: 432626 - DNA, 140 bp, Artificial Sequence
  Synthetic
atggccgactcccaagtacggaactgatcactgatgtcgagttcttactctatagattattaagaacattaatgagtttggttttatctgaggatgtgaagagcatgatgaccaacaggtggagacccagcatggcgtat

SEQ ID NO: 432627 - DNA, 140 bp, Artificial Sequence
  Synthetic
aggccctggctgctgatatgccattatgaagtacctaaggttttggaggagtttttgtgaacgtttgctggggtgagctagaattaaaattagaatcatctttgttaaagacctaattttgaccttttgggacagcggtg

SEQ ID NO: 432628 - DNA, 140 bp, Artificial Sequence
  Synthetic
caccgctgtcccaaaaggtcaaaattaggtctttaacaaagatgattctaattttaattctagctcaccccagcaaacgttcacaaaaactcctccaaaaccttaggtacttcataatggcatatcagcagccagggcct

SEQ ID NO: 432629 - DNA, 140 bp, Artificial Sequence
  Synthetic
aggccctggctgctgatatggggtgagctagaattaaaattagaatcatctttgttaaagacctaattttgtctaattgctcttccaactcactacaatcttctatccacgaaatcataggaccttttgggacagcggtg

SEQ ID NO: 432630 - DNA, 140 bp, Artificial Sequence
  Synthetic
caccgctgtcccaaaaggtcctatgatttcgtggatagaagattgtagtgagttggaagagcaattagacaaaattaggtctttaacaaagatgattctaattttaattctagctcaccccatatcagcagccagggcct

SEQ ID NO: 432631 - DNA, 140 bp, Artificial Sequence
  Synthetic
atacgccatgctgggtctccgctgtatcttgtaatcataatcctgtttattaagcaagaatttgcctttacgtgcaaacacttcagttaactgtgtgacagccaaagctgtaagcttgttcgtacttgggagtcggccat

SEQ ID NO: 432632 - DNA, 140 bp, Artificial Sequence
  Synthetic
atggccgactcccaagtacgaacaagcttacagctttggctgtcacacagttaactgaagtgtttgcacgtaaaggcaaattcttgcttaataaacaggattatgattacaagatacagcggagacccagcatggcgtat

SEQ ID NO: 432633 - DNA, 140 bp, Artificial Sequence
  Synthetic
aggccctggctgctgatatgcttttcggatcagcataaaatgagcatacctcgccaaccctgttgtcattaatggcataacactttgaacactcccctgtcttttgataaattaattgaagaccttttgggacagcggtg

SEQ ID NO: 432634 - DNA, 140 bp, Artificial Sequence
  Synthetic
caccgctgtcccaaaaggtcttcaattaatttatcaaaagacaggggagtgttcaaagtgttatgccattaatgacaacagggttggcgaggtatgctcattttatgctgatccgaaaagcatatcagcagccagggcct

SEQ ID NO: 432635 - DNA, 140 bp, Artificial Sequence
  Synthetic
aggccctggctgctgatatgcttttgaggcactcatcgccaaattgttgtgctggatacacgcagcagaaagctgagactatctgctaaaatgacaaaagcaaagcgcaatccaatagccgaccttttgggacagcggtg

SEQ ID NO: 432636 - DNA, 140 bp, Artificial Sequence
  Synthetic
caccgctgtcccaaaaggtcggctattggattgcgctttgcttttgtcattttagcagatagtctcagctttctgctgcgtgtatccagcacaacaatttggcgatgagtgcctcaaaagcatatcagcagccagggcct

SEQ ID NO: 432637 - DNA, 140 bp, Artificial Sequence
  Synthetic
atacgccatgctgggtctccaccacttggtatcttgctggtccaaactcattctgtctcagcttcacagtagaagaagttttcatggaattcaccaaggcaaggctcagtgaagaaagcccgtacttgggagtcggccat

SEQ ID NO: 432638 - DNA, 140 bp, Artificial Sequence
  Synthetic
atggccgactcccaagtacgggctttcttcactgagccttgccttggtgaattccatgaaaacttcttctactgtgaagctgagacagaatgagtttggaccagcaagataccaagtggtggagacccagcatggcgtat

SEQ ID NO: 432639 - DNA, 140 bp, Artificial Sequence
  Synthetic
atacgccatgctgggtctccgcttggacattggaaagactgcatagttctagacctctcaacctgctgtctccgctcaacccatttctttagatccctttttgttgactctaaagaaactcgtacttgggagtcggccat

SEQ ID NO: 432640 - DNA, 140 bp, Artificial Sequence
  Synthetic
atggccgactcccaagtacgagtttctttagagtcaacaaaaagggatctaaagaaatgggttgagcggagacagcaggttgagaggtctagaactatgcagtctttccaatgtccaagcggagacccagcatggcgtat

SEQ ID NO: 432641 - DNA, 140 bp, Artificial Sequence
  Synthetic
aggccctggctgctgatatgtccgctcaacccatttctttagatccctttttgttgactctaaagaaactaacctgtcattaacactcacaaaacaggttcccagccaccctcttaaagggaccttttgggacagcggtg

SEQ ID NO: 432642 - DNA, 140 bp, Artificial Sequence
  Synthetic
caccgctgtcccaaaaggtccctttaagagggtggctgggaacctgttttgtgagtgttaatgacaggttagtttctttagagtcaacaaaaagggatctaaagaaatgggttgagcggacatatcagcagccagggcct

SEQ ID NO: 432643 - DNA, 140 bp, Artificial Sequence
  Synthetic
atacgccatgctgggtctccaaattagtaaaagtttcctccttgtgttcagtatcctcatagacttcactttgtttaggaatgacctccagcattgcatctggcattctccaataatcagcgtacttgggagtcggccat

SEQ ID NO: 432644 - DNA, 140 bp, Artificial Sequence
  Synthetic
atggccgactcccaagtacgctgattattggagaatgccagatgcaatgctggaggtcattcctaaacaaagtgaagtctatgaggatactgaacacaaggaggaaacttttactaatttggagacccagcatggcgtat

SEQ ID NO: 432645 - DNA, 140 bp, Artificial Sequence
  Synthetic
aggccctggctgctgatatgttttcagccaccttgtcagcgtacaaattgttgaactcattaagtaactgattcttttcaacctttaaaaactgaccttctatttctccttttctcaatcgaccttttgggacagcggtg

SEQ ID NO: 432646 - DNA, 140 bp, Artificial Sequence
  Synthetic
caccgctgtcccaaaaggtcgattgagaaaaggagaaatagaaggtcagtttttaaaggttgaaaagaatcagttacttaatgagttcaacaatttgtacgctgacaaggtggctgaaaacatatcagcagccagggcct

SEQ ID NO: 432647 - DNA, 140 bp, Artificial Sequence
  Synthetic
atacgccatgctgggtctccgctgtcagcttgttgttgatgccttggtggcatgaagcaatcacttcctcataatggttagagcgattatctaacaaaacattcaagctctccactcctgcgtacttgggagtcggccat

SEQ ID NO: 432648 - DNA, 140 bp, Artificial Sequence
  Synthetic
atggccgactcccaagtacgcaggagtggagagcttgaatgttttgttagataatcgctctaaccattatgaggaagtgattgcttcatgccaccaaggcatcaacaacaagctgacagcggagacccagcatggcgtat

SEQ ID NO: 432649 - DNA, 140 bp, Artificial Sequence
  Synthetic
aggccctggctgctgatatgaagtcatactcagtaaactgcaatttttctatgtcaacgacaatctcaacaggagtcacatgccctagttgattcgtatcaaccaaaaattcattaataagaccttttgggacagcggtg

SEQ ID NO: 432650 - DNA, 140 bp, Artificial Sequence
  Synthetic
caccgctgtcccaaaaggtcttattaatgaatttttggttgatacgaatcaactagggcatgtgactcctgttgagattgtcgttgacatagaaaaattgcagtttactgagtatgacttcatatcagcagccagggcct

SEQ ID NO: 432651 - DNA, 140 bp, Artificial Sequence
  Synthetic
atacgccatgctgggtctccttcaggtcttctttcagctgctctaactttttgaagtcttcgacatacttttgttcaaaattagcaggagaagacctaacaaaacactccaataatattacgtacttgggagtcggccat

SEQ ID NO: 432652 - DNA, 140 bp, Artificial Sequence
  Synthetic
atggccgactcccaagtacgtaatattattggagtgttttgttaggtcttctcctgctaattttgaacaaaagtatgtcgaagacttcaaaaagttagagcagctgaaagaagacctgaaggagacccagcatggcgtat

SEQ ID NO: 432653 - DNA, 140 bp, Artificial Sequence
  Synthetic
atacgccatgctgggtctccggggttaagaccccatggtcatgaagaattctttcaacagatttatcttcactattgtgctcacagccatttgcattacaagaatcaacctcaatgcaaacgtacttgggagtcggccat

SEQ ID NO: 432654 - DNA, 140 bp, Artificial Sequence
  Synthetic
atggccgactcccaagtacgtttgcattgaggttgattcttgtaatgcaaatggctgtgagcacaatagtgaagataaatctgttgaaagaattcttcatgaccatggggtcttaaccccggagacccagcatggcgtat

SEQ ID NO: 432655 - DNA, 140 bp, Artificial Sequence
  Synthetic
aggccctggctgctgatatgactattgtgctcacagccatttgcattacaagaatcaacctcaatgcaaagggacagaagtttcaatccttccattaaaagcatcctgggttccgtttgcgaccttttgggacagcggtg

SEQ ID NO: 432656 - DNA, 140 bp, Artificial Sequence
  Synthetic
caccgctgtcccaaaaggtcgcaaacggaacccaggatgcttttaatggaaggattgaaacttctgtccctttgcattgaggttgattcttgtaatgcaaatggctgtgagcacaatagtcatatcagcagccagggcct

SEQ ID NO: 432657 - DNA, 140 bp, Artificial Sequence
  Synthetic
atacgccatgctgggtctccctttgatactaaatctttaacacaagctatgtcttcctccatgtttggctgcaagtatggtaatcgaaactcttggaatatgtggtcagctagagtaacgcgtacttgggagtcggccat

SEQ ID NO: 432658 - DNA, 140 bp, Artificial Sequence
  Synthetic
atggccgactcccaagtacgcgttactctagctgaccacatattccaagagtttcgattaccatacttgcagccaaacatggaggaagacatagcttgtgttaaagatttagtatcaaagggagacccagcatggcgtat

SEQ ID NO: 432659 - DNA, 140 bp, Artificial Sequence
  Synthetic
aggccctggctgctgatatgctaaatctttaacacaagctatgtcttcctccatgtttggctgcaagtatggtaatcgaaactcttggaatatgtggtcagctagagtaacggttcactagaccttttgggacagcggtg

SEQ ID NO: 432660 - DNA, 140 bp, Artificial Sequence
  Synthetic
caccgctgtcccaaaaggtctagtgaaccgttactctagctgaccacatattccaagagtttcgattaccatacttgcagccaaacatggaggaagacatagcttgtgttaaagatttagcatatcagcagccagggcct

SEQ ID NO: 432661 - DNA, 140 bp, Artificial Sequence
  Synthetic
aggccctggctgctgatatgtgatcccagactgcattttcatacttcctggaatcagtcttgctgagggcaatgtcaattagtttgatgtcttttcttccttgtgattcaaggagtttccgaccttttgggacagcggtg

SEQ ID NO: 432662 - DNA, 140 bp, Artificial Sequence
  Synthetic
caccgctgtcccaaaaggtcggaaactccttgaatcacaaggaagaaaagacatcaaactaattgacattgccctcagcaagactgattccaggaagtatgaaaatgcagtctgggatcacatatcagcagccagggcct

SEQ ID NO: 432663 - DNA, 140 bp, Artificial Sequence
  Synthetic
aggccctggctgctgatatgaatgtcaattagtttgatgtcttttcttccttgtgattcaaggagtttccttatatcatcagacccctggcaggtgatgaccaaattccgggggagtgcagaccttttgggacagcggtg

SEQ ID NO: 432664 - DNA, 140 bp, Artificial Sequence
  Synthetic
caccgctgtcccaaaaggtctgcactcccccggaatttggtcatcacctgccaggggtctgatgatataaggaaactccttgaatcacaaggaagaaaagacatcaaactaattgacattcatatcagcagccagggcct

SEQ ID NO: 432665 - DNA, 140 bp, Artificial Sequence
  Synthetic
atacgccatgctgggtctcctgagcataatttcaactttccacttgtccatccccaacttcaatcagtatgaagcaatgagctgtgatttcaatgggggaaagattagtgtgcagtacaacgtacttgggagtcggccat

SEQ ID NO: 432666 - DNA, 140 bp, Artificial Sequence
  Synthetic
atggccgactcccaagtacgttgtactgcacactaatctttcccccattgaaatcacagctcattgcttcatactgattgaagttggggatggacaagtggaaagttgaaattatgctcaggagacccagcatggcgtat

SEQ ID NO: 432667 - DNA, 140 bp, Artificial Sequence
  Synthetic
atacgccatgctgggtctcccacctgtgttgggtttgggtttgtgccagtatggcttgtaggtcggttgttgatgccccacagaagctcctgcagaaatgagagacaatatgcctaggatcgtacttgggagtcggccat

SEQ ID NO: 432668 - DNA, 140 bp, Artificial Sequence
  Synthetic
atggccgactcccaagtacgatcctaggcatattgtctctcatttctgcaggagcttctgtggggcatcaacaaccgacctacaagccatactggcacaaacccaaacccaacacaggtgggagacccagcatggcgtat

SEQ ID NO: 432669 - DNA, 140 bp, Artificial Sequence
  Synthetic
atacgccatgctgggtctcctcattgtctgctaagtactttgaaaccaagtctttgacacaggctatgtcttcctccatgtttggctgtgggtgcagtaaccgagactctcggagtatgtcgtacttgggagtcggccat

SEQ ID NO: 432670 - DNA, 140 bp, Artificial Sequence
  Synthetic
atggccgactcccaagtacgacatactccgagagtctcggttactgcacccacagccaaacatggaggaagacatagcctgtgtcaaagacttggtttcaaagtacttagcagacaatgaggagacccagcatggcgtat

SEQ ID NO: 432671 - DNA, 140 bp, Artificial Sequence
  Synthetic
aggccctggctgctgatatgacctgacaatcttcctgaggtcatggataaagattcacagagcctgctatactctgattcttcaaaaagtgagttactctcctgagcatactttagaagtgaccttttgggacagcggtg

SEQ ID NO: 432672 - DNA, 140 bp, Artificial Sequence
  Synthetic
caccgctgtcccaaaaggtcacttctaaagtatgctcaggagagtaactcactttttgaagaatcagagtatagcaggctctgtgaatctttatccatgacctcaggaagattgtcaggtcatatcagcagccagggcct

SEQ ID NO: 432673 - DNA, 140 bp, Artificial Sequence
  Synthetic
aggccctggctgctgatatgaggcaccccagagcacaacgcccccaccatacaccccgtaaactccgaacccacacctccacctccacaacccaccccccacccccggggggaccccccggaccttttgggacagcggtg

SEQ ID NO: 432674 - DNA, 140 bp, Artificial Sequence
  Synthetic
caccgctgtcccaaaaggtccggggggtccccccgggggtggggggtgggttgtggaggtggaggtgtgggttcggagtttacggggtgtatggtgggggcgttgtgctctggggtgcctcatatcagcagccagggcct

SEQ ID NO: 432675 - DNA, 140 bp, Artificial Sequence
  Synthetic
atacgccatgctgggtctcccgcaccggggatcctaggcaatttggttgttcttggttgttcttctcttttttgaggccttgtgcgctgaactcctccaaatgggaaacaagcaagccaacgtacttgggagtcggccat

SEQ ID NO: 432676 - DNA, 140 bp, Artificial Sequence
  Synthetic
atggccgactcccaagtacgttggcttgcttgtttcccatttggaggagttcagcgcacaaggcctcaaaaaagagaagaacaaccaagaacaaccaaattgcctaggatccccggtgcgggagacccagcatggcgtat

SEQ ID NO: 432677 - DNA, 140 bp, Artificial Sequence
  Synthetic
aggccctggctgctgatatgaactgagaccatcagccgctccgacagcacccccagccggagcagtggacagcaccagacctccaccctacagtccctgaacatcccaccgaccctcaccgaccttttgggacagcggtg

SEQ ID NO: 432678 - DNA, 140 bp, Artificial Sequence
  Synthetic
caccgctgtcccaaaaggtcggtgagggtcggtgggatgttcagggactgtagggtggaggtctggtgctgtccactgctccggctgggggtgctgtcggagcggctgatggtctcagttcatatcagcagccagggcct

SEQ ID NO: 432679 - DNA, 140 bp, Artificial Sequence
  Synthetic
aggccctggctgctgatatgatccagttcttcctccgtggctgtatctgcaggattgatgctcacgtggccaaatttcacttttggctcaagaaacttttcaaagcattttatctggtctgaccttttgggacagcggtg

SEQ ID NO: 432680 - DNA, 140 bp, Artificial Sequence
  Synthetic
caccgctgtcccaaaaggtcagaccagataaaatgctttgaaaagtttcttgagccaaaagtgaaatttggccacgtgagcatcaatcctgcagatacagccacggaggaagaactggatcatatcagcagccagggcct

SEQ ID NO: 432681 - DNA, 140 bp, Artificial Sequence
  Synthetic
aggccctggctgctgatatgaaactagcatcttgacttttaatacggaatctcactgtctgactcagttttgcagaccctggaggtagtgaagccacagcatcaaagaaatcctccaatggaccttttgggacagcggtg

SEQ ID NO: 432682 - DNA, 140 bp, Artificial Sequence
  Synthetic
caccgctgtcccaaaaggtccattggaggatttctttgatgctgtggcttcactacctccagggtctgcaaaactgagtcagacagtgagattccgtattaaaagtcaagatgctagtttcatatcagcagccagggcct

SEQ ID NO: 432683 - DNA, 140 bp, Artificial Sequence
  Synthetic
aggccctggctgctgatatgatgtccacccctgaccactgcacccttaaccccagcctgtctatcatcatatcactcaatgccccaatcagcaggtcagacgaagtgtccccaacctctcgaccttttgggacagcggtg

SEQ ID NO: 432684 - DNA, 140 bp, Artificial Sequence
  Synthetic
caccgctgtcccaaaaggtcgagaggttggggacacttcgtctgacctgctgattggggcattgagtgatatgatgatagacaggctggggttaagggtgcagtggtcaggggtggacatcatatcagcagccagggcct

SEQ ID NO: 432685 - DNA, 140 bp, Artificial Sequence
  Synthetic
aggccctggctgctgatatgcattggcctttcgacacctttgtaaataactttctccacaaatgaagaaaatggacccattctctgcaatccctcaccttctggaaccgatgtcttatgtgaccttttgggacagcggtg

SEQ ID NO: 432686 - DNA, 140 bp, Artificial Sequence
  Synthetic
caccgctgtcccaaaaggtcacataagacatcggttccagaaggtgagggattgcagagaatgggtccattttcttcatttgtggagaaagttatttacaaaggtgtcgaaaggccaatgcatatcagcagccagggcct

SEQ ID NO: 432687 - DNA, 140 bp, Artificial Sequence
  Synthetic
aggccctggctgctgatatgaatttctttccacattcccacaagcctcccctatgcacaaccagaggggctggttcagtgcaaggacccaccaatacaaagtcatactccgtaaactgcagaccttttgggacagcggtg

SEQ ID NO: 432688 - DNA, 140 bp, Artificial Sequence
  Synthetic
caccgctgtcccaaaaggtctgcagtttacggagtatgactttgtattggtgggtccttgcactgaaccagcccctctggttgtgcataggggaggcttgtgggaatgtggaaagaaattcatatcagcagccagggcct

SEQ ID NO: 432689 - DNA, 140 bp, Artificial Sequence
  Synthetic
aggccctggctgctgatatggtgggggtcactccagatacatcgaagtccataatcaagttataagcgtcggggcagatcacttccatatcaatcttatagtggtccacactaattccaagaccttttgggacagcggtg

SEQ ID NO: 432690 - DNA, 140 bp, Artificial Sequence
  Synthetic
caccgctgtcccaaaaggtcttggaattagtgtggaccactataagattgatatggaagtgatctgccccgacgcttataacttgattatggacttcgatgtatctggagtgacccccaccatatcagcagccagggcct

SEQ ID NO: 432691 - DNA, 140 bp, Artificial Sequence
  Synthetic
atacgccatgctgggtctcctgcatacaaaaatctcagtattggtgatgctctcttgaattgatgaatcaagtgttcaacactgtctttttcagccacctcatcagcgtacaaattgttgcgtacttgggagtcggccat

SEQ ID NO: 432692 - DNA, 140 bp, Artificial Sequence
  Synthetic
atggccgactcccaagtacgcaacaatttgtacgctgatgaggtggctgaaaaagacagtgttgaacacttgattcatcaattcaagagagcatcaccaatactgagatttttgtatgcaggagacccagcatggcgtat

SEQ ID NO: 432693 - DNA, 140 bp, Artificial Sequence
  Synthetic
atacgccatgctgggtctcccacataagactcgaaatagatttgcctcataaagttgtcaacagcgtcactggtgctcaccaccctttcttcgaccatgggttcatgtgttctagtgtgacgtacttgggagtcggccat

SEQ ID NO: 432694 - DNA, 140 bp, Artificial Sequence
  Synthetic
atggccgactcccaagtacgtcacactagaacacatgaacccatggtcgaagaaagggtggtgagcaccagtgacgctgttgacaactttatgaggcaaatctatttcgagtcttatgtgggagacccagcatggcgtat

SEQ ID NO: 432695 - DNA, 140 bp, Artificial Sequence
  Synthetic
aggccctggctgctgatatgtggtgctcaccaccctttcttcgaccatgggttcatgtgttctagtgtgagacaaccttaattcagacgacagcacaatgtaatgttcttccctcttccagaccttttgggacagcggtg

SEQ ID NO: 432696 - DNA, 140 bp, Artificial Sequence
  Synthetic
caccgctgtcccaaaaggtctggaagagggaagaacattacattgtgctgtcgtctgaattaaggttgtctcacactagaacacatgaacccatggtcgaagaaagggtggtgagcaccacatatcagcagccagggcct

SEQ ID NO: 432697 - DNA, 140 bp, Artificial Sequence
  Synthetic
aggccctggctgctgatatgatgggaaacaagcaagccaaagcctcagaagaaaaaaacagtccgagagccagcctgattccagatgccacacacctagggccacaattttgcaagagctgaccttttgggacagcggtg

SEQ ID NO: 432698 - DNA, 140 bp, Artificial Sequence
  Synthetic
caccgctgtcccaaaaggtcagctcttgcaaaattgtggccctaggtgtgtggcatctggaatcaggctggctctcggactgtttttttcttctgaggctttggcttgcttgtttcccatcatatcagcagccagggcct

SEQ ID NO: 432699 - DNA, 140 bp, Artificial Sequence
  Synthetic
aggccctggctgctgatatggcattctcaaccccagtctgtctgtgaccatatcacttaatgtcctgatcaacaggtcaggtgaagtgtccccaacctctttcacaaacatctcaagatcgaccttttgggacagcggtg

SEQ ID NO: 432700 - DNA, 140 bp, Artificial Sequence
  Synthetic
caccgctgtcccaaaaggtcgatcttgagatgtttgtgaaagaggttggggacacttcacctgacctgttgatcaggacattaagtgatatggtcacagacagactggggttgagaatgccatatcagcagccagggcct

SEQ ID NO: 432701 - DNA, 140 bp, Artificial Sequence
  Synthetic
atacgccatgctgggtctccgcacctcgagtgaaagtggaagacaacttattttggattgttttgacaatggtaggaatcttctcatcatctaggttcacagcacctgagtatattatctcgtacttgggagtcggccat

SEQ ID NO: 432702 - DNA, 140 bp, Artificial Sequence
  Synthetic
atggccgactcccaagtacgagataatatactcaggtgctgtgaacctagatgatgagaagattcctaccattgtcaaaacaatccaaaataagttgtcttccactttcactcgaggtgcggagacccagcatggcgtat

SEQ ID NO: 432703 - DNA, 140 bp, Artificial Sequence
  Synthetic
atacgccatgctgggtctcccagccttcaacgtggagacaatgtccacccctgaccactgcatccttaaccccagcctgtctatcatcatatcactcaatgccccaatcagcaggtcagacgtacttgggagtcggccat

SEQ ID NO: 432704 - DNA, 140 bp, Artificial Sequence
  Synthetic
atggccgactcccaagtacgtctgacctgctgattggggcattgagtgatatgatgatagacaggctggggttaaggatgcagtggtcaggggtggacattgtctccacgttgaaggctgggagacccagcatggcgtat

SEQ ID NO: 432705 - DNA, 140 bp, Artificial Sequence
  Synthetic
aggccctggctgctgatatgcccagcctgtctatcatcatatcactcaatgccccaatcagcaggtcagatgaagtgtccccaacctctctcacaaatatctcaagatcctggtcttgtagaccttttgggacagcggtg

SEQ ID NO: 432706 - DNA, 140 bp, Artificial Sequence
  Synthetic
caccgctgtcccaaaaggtctacaagaccaggatcttgagatatttgtgagagaggttggggacacttcatctgacctgctgattggggcattgagtgatatgatgatagacaggctgggcatatcagcagccagggcct

SEQ ID NO: 432707 - DNA, 140 bp, Artificial Sequence
  Synthetic
aggccctggctgctgatatggtgcttcagaattactctcacgttcacttatcctgacatcatcagccaatcttcctgtatcaaatttgaagttcagacacttactcttataatgagagtagaccttttgggacagcggtg

SEQ ID NO: 432708 - DNA, 140 bp, Artificial Sequence
  Synthetic
caccgctgtcccaaaaggtctactctcattataagagtaagtgtctgaacttcaaatttgatacaggaagattggctgatgatgtcaggataagtgaacgtgagagtaattctgaagcaccatatcagcagccagggcct

SEQ ID NO: 432709 - DNA, 140 bp, Artificial Sequence
  Synthetic
atacgccatgctgggtctccccggggatcctaggcaatttagttggacttcagtggtgaggctcatttcagtgaatccctgaatcagagcgcccagtcaaaatgggcaacagacaggccacgtacttgggagtcggccat

SEQ ID NO: 432710 - DNA, 140 bp, Artificial Sequence
  Synthetic
atggccgactcccaagtacgtggcctgtctgttgcccattttgactgggcgctctgattcagggattcactgaaatgagcctcaccactgaagtccaactaaattgcctaggatccccggggagacccagcatggcgtat

SEQ ID NO: 432711 - DNA, 140 bp, Artificial Sequence
  Synthetic
atacgccatgctgggtctccgatgcccctccccacaagactgaggccatcagccgccccaacggcgcccccagctggagcaggagacaacaccagacccccaccctacagtccctgaacacgtacttgggagtcggccat

SEQ ID NO: 432712 - DNA, 140 bp, Artificial Sequence
  Synthetic
atggccgactcccaagtacgtgttcagggactgtagggtgggggtctggtgttgtctcctgctccagctgggggcgccgttggggcggctgatggcctcagtcttgtggggaggggcatcggagacccagcatggcgtat

SEQ ID NO: 432713 - DNA, 140 bp, Artificial Sequence
  Synthetic
atacgccatgctgggtctccggggggaccccccgccgggggccccccgggggagccagccacctccaagattactcaatgtcctcaacaagttcgtccccctcagtcaactcttcgcatgcgtacttgggagtcggccat

SEQ ID NO: 432714 - DNA, 140 bp, Artificial Sequence
  Synthetic
atggccgactcccaagtacgcatgcgaagagttgactgagggggacgaacttgttgaggacattgagtaatcttggaggtggctggctcccccggggggcccccggcggggggtccccccggagacccagcatggcgtat

SEQ ID NO: 432715 - DNA, 140 bp, Artificial Sequence
  Synthetic
atacgccatgctgggtctcccactagtgataagggggtctttgatctccttcttcacttctctttctttaaatagtgagccattgttaaaagaagatgtaagaagggacaagtacttcttcgtacttgggagtcggccat

SEQ ID NO: 432716 - DNA, 140 bp, Artificial Sequence
  Synthetic
atggccgactcccaagtacgaagaagtacttgtcccttcttacatcttcttttaacaatggctcactatttaaagaaagagaagtgaagaaggagatcaaagacccccttatcactagtgggagacccagcatggcgtat

SEQ ID NO: 432717 - DNA, 140 bp, Artificial Sequence
  Synthetic
aggccctggctgctgatatgtttcacttttggctcaagaaacttttcaaagcattttatctggtctgtcagtctatctggtgtttcctttgtgatgaaatggcacatgtaagaaatgtttgaccttttgggacagcggtg

SEQ ID NO: 432718 - DNA, 140 bp, Artificial Sequence
  Synthetic
caccgctgtcccaaaaggtcaaacatttcttacatgtgccatttcatcacaaaggaaacaccagatagactgacagaccagataaaatgctttgaaaagtttcttgagccaaaagtgaaacatatcagcagccagggcct

SEQ ID NO: 432719 - DNA, 140 bp, Artificial Sequence
  Synthetic
atacgccatgctgggtctccgccattatgaagtatctaaggttttggaggagtttttgtgaacgtttgctggggtgagccagaatcaaaattagaatcatttttgttaaagacctaatttcgtacttgggagtcggccat

SEQ ID NO: 432720 - DNA, 140 bp, Artificial Sequence
  Synthetic
atggccgactcccaagtacgaaattaggtctttaacaaaaatgattctaattttgattctggctcaccccagcaaacgttcacaaaaactcctccaaaaccttagatacttcataatggcggagacccagcatggcgtat

SEQ ID NO: 432721 - DNA, 140 bp, Artificial Sequence
  Synthetic
atacgccatgctgggtctccacggcacaggttcgttatcaggaccgatcttggagaagtcaaactcagtaaactgtagcttttcttgatcaacaactaatttcataggtacaacatttcccgtacttgggagtcggccat

SEQ ID NO: 432722 - DNA, 140 bp, Artificial Sequence
  Synthetic
atggccgactcccaagtacgggaaatgttgtacctatgaaattagttgttgatcaagaaaagctacagtttactgagtttgacttctccaagatcggtcctgataacgaacctgtgccgtggagacccagcatggcgtat

SEQ ID NO: 432723 - DNA, 140 bp, Artificial Sequence
  Synthetic
aggccctggctgctgatatggatgaacattgttctcattgcactgtctatactagcagtgctgaaaggtctgtataattttgcaacatgtggcctcgttggtctactcaccttcctcctagaccttttgggacagcggtg

SEQ ID NO: 432724 - DNA, 140 bp, Artificial Sequence
  Synthetic
caccgctgtcccaaaaggtctaggaggaaggtgagtagaccaacgaggccacatgttgcaaaattatacagacctttcagcactgctagtatagacagtgcaatgagaacaatgttcatccatatcagcagccagggcct

SEQ ID NO: 432725 - DNA, 140 bp, Artificial Sequence
  Synthetic
aggccctggctgctgatatgtgcaaaagttctgtgagagattgatcaaagagagaaatttgatcatcactagaggtataagcatctatcgtaccaccacatatgcaactgatagcataatgaccttttgggacagcggtg

SEQ ID NO: 432726 - DNA, 140 bp, Artificial Sequence
  Synthetic
caccgctgtcccaaaaggtcattatgctatcagttgcatatgtggtggtacgatagatgcttatacctctagtgatgatcaaatttctctctttgatcaatctctcacagaacttttgcacatatcagcagccagggcct

SEQ ID NO: 432727 - DNA, 140 bp, Artificial Sequence
  Synthetic
aggccctggctgctgatatggacgccaaatcactcataaatggtagtatgtgtttttcaaatacagatgggtacagtcttcttaaggaatgaataatgtgattcaaacctaccctatcctgaccttttgggacagcggtg

SEQ ID NO: 432728 - DNA, 140 bp, Artificial Sequence
  Synthetic
caccgctgtcccaaaaggtcaggatagggtaggtttgaatcacattattcattccttaagaagactgtacccatctgtatttgaaaaacacatactaccatttatgagtgatttggcgtccatatcagcagccagggcct

SEQ ID NO: 432729 - DNA, 140 bp, Artificial Sequence
  Synthetic
atacgccatgctgggtctcccccacaaaactgagaccatcaaccgctccaacagcacccccagccggaacaatggacagcaccaggcccccgccctacagtccctgaatcccccaccgaccgtacttgggagtcggccat

SEQ ID NO: 432730 - DNA, 140 bp, Artificial Sequence
  Synthetic
atggccgactcccaagtacggtcggtgggggattcagggactgtagggcgggggcctggtgctgtccattgttccggctgggggtgctgttggagcggttgatggtctcagttttgtgggggagacccagcatggcgtat

SEQ ID NO: 432731 - DNA, 140 bp, Artificial Sequence
  Synthetic
aggccctggctgctgatatgatggtgtcttgcagactttcatgaggatggcctggggtgggagctacattgctcttgactcaggtcgtggcaggtgggactgtattatgactagttatcagaccttttgggacagcggtg

SEQ ID NO: 432732 - DNA, 140 bp, Artificial Sequence
  Synthetic
caccgctgtcccaaaaggtctgataactagtcataatacagtcccacctgccacgacctgagtcaagagcaatgtagctcccaccccaggccatcctcatgaaagtctgcaagacaccatcatatcagcagccagggcct

SEQ ID NO: 432733 - DNA, 140 bp, Artificial Sequence
  Synthetic
atacgccatgctgggtctccggcggggggtccccccccggggggagccaaccatctccgaaagactactcaatgtcctcgatgtgttcatccctcccagtcaactcctcacatgttctgccgtacttgggagtcggccat

SEQ ID NO: 432734 - DNA, 140 bp, Artificial Sequence
  Synthetic
atggccgactcccaagtacggcagaacatgtgaggagttgactgggagggatgaacacatcgaggacattgagtagtctttcggagatggttggctccccccggggggggaccccccgccggagacccagcatggcgtat

SEQ ID NO: 432735 - DNA, 140 bp, Artificial Sequence
  Synthetic
atacgccatgctgggtctccttctagcggaacttgccaatattgaataccattagaatttgtcaataatttgattcccttgacatcagaaatcagagactgaatggacttaatatacagacgtacttgggagtcggccat

SEQ ID NO: 432736 - DNA, 140 bp, Artificial Sequence
  Synthetic
atggccgactcccaagtacgtctgtatattaagtccattcagtctctgatttctgatgtcaagggaatcaaattattgacaaattctaatggtattcaatattggcaagttccgctagaaggagacccagcatggcgtat

SEQ ID NO: 432737 - DNA, 140 bp, Artificial Sequence
  Synthetic
atacgccatgctgggtctcccttcaccctctggtattgaggtcttatgagggaaccaagtgaatgacccaagtgtccttgttgttgctacaaaggagcggacatatgattcaaagtagatcgtacttgggagtcggccat

SEQ ID NO: 432738 - DNA, 140 bp, Artificial Sequence
  Synthetic
atggccgactcccaagtacgatctactttgaatcatatgtccgctcctttgtagcaacaacaaggacacttgggtcattcacttggttccctcataagacctcaataccagagggtgaagggagacccagcatggcgtat

SEQ ID NO: 432739 - DNA, 140 bp, Artificial Sequence
  Synthetic
atacgccatgctgggtctcccagtcaggtaggacacatgggctcacagatccagaatatagtgcttgcacatcactcactacgaactcaccacattgattgacaagtcctctcatgttgacgtacttgggagtcggccat

SEQ ID NO: 432740 - DNA, 140 bp, Artificial Sequence
  Synthetic
atggccgactcccaagtacgtcaacatgagaggacttgtcaatcaatgtggtgagttcgtagtgagtgatgtgcaagcactatattctggatctgtgagcccatgtgtcctacctgactgggagacccagcatggcgtat

SEQ ID NO: 432741 - DNA, 140 bp, Artificial Sequence
  Synthetic
aggccctggctgctgatatgtgcacccagttctattgcagttgacaaggaaatgcacatataatcccataataggggtctgaagtaactaattacaccttcatttccattcctaaggcctgaccttttgggacagcggtg

SEQ ID NO: 432742 - DNA, 140 bp, Artificial Sequence
  Synthetic
caccgctgtcccaaaaggtcaggccttaggaatggaaatgaaggtgtaattagttacttcagacccctattatgggattatatgtgcatttccttgtcaactgcaatagaactgggtgcacatatcagcagccagggcct

SEQ ID NO: 432743 - DNA, 140 bp, Artificial Sequence
  Synthetic
atacgccatgctgggtctccttccttttcttgagaagacttcagtgagctgcgatacggccagtgctgtgagcttgttgaagtcatagtttaatattctagaaccatctgtgtatttattcgtacttgggagtcggccat

SEQ ID NO: 432744 - DNA, 140 bp, Artificial Sequence
  Synthetic
atggccgactcccaagtacgaataaatacacagatggttctagaatattaaactatgacttcaacaagctcacagcactggccgtatcgcagctcactgaagtcttctcaagaaaaggaaggagacccagcatggcgtat

SEQ ID NO: 432745 - DNA, 140 bp, Artificial Sequence
  Synthetic
atacgccatgctgggtctcctggtgatgagaggatccttgatttccctttttacttctctctccttaaatagtgaaccattgttaaaagaggacgtaagaagagataaatacttctttgacgtacttgggagtcggccat

SEQ ID NO: 432746 - DNA, 140 bp, Artificial Sequence
  Synthetic
atggccgactcccaagtacgtcaaagaagtatttatctcttcttacgtcctcttttaacaatggttcactatttaaggagagagaagtaaaaagggaaatcaaggatcctctcatcaccaggagacccagcatggcgtat

SEQ ID NO: 432747 - DNA, 140 bp, Artificial Sequence
  Synthetic
atacgccatgctgggtctcctcggacccctgacaggtaatgaccatattccgggggagtgcatctatgacagcactggtcaagcccggttgtgcagcgaagaggtctgtaacatcaatcccgtacttgggagtcggccat

SEQ ID NO: 432748 - DNA, 140 bp, Artificial Sequence
  Synthetic
atggccgactcccaagtacgggattgatgttacagacctcttcgctgcacaaccgggcttgaccagtgctgtcatagatgcactcccccggaatatggtcattacctgtcaggggtccgaggagacccagcatggcgtat

SEQ ID NO: 432749 - DNA, 140 bp, Artificial Sequence
  Synthetic
aggccctggctgctgatatgggtcaagctgcagcatcgcatccttgagggtcatcagctgagaataggtaagcccagcggtaaaccctgccgactgcagggatttattggaattgttgctgaccttttgggacagcggtg

SEQ ID NO: 432750 - DNA, 140 bp, Artificial Sequence
  Synthetic
caccgctgtcccaaaaggtcagcaacaattccaataaatccctgcagtcggcagggtttaccgctgggcttacctattctcagctgatgaccctcaaggatgcgatgctgcagcttgacccatatcagcagccagggcct

SEQ ID NO: 432751 - DNA, 140 bp, Artificial Sequence
  Synthetic
aggccctggctgctgatatggccagctttctgtggcttcccatctgattctaggtcaacgacagtgttttcccaggctcttcctgttattgaagttcttgatgcaatatatggccatccagaccttttgggacagcggtg

SEQ ID NO: 432752 - DNA, 140 bp, Artificial Sequence
  Synthetic
caccgctgtcccaaaaggtctggatggccatatattgcatcaagaacttcaataacaggaagagcctgggaaaacactgtcgttgacctagaatcagatgggaagccacagaaagctggccatatcagcagccagggcct

SEQ ID NO: 432753 - DNA, 140 bp, Artificial Sequence
  Synthetic
atacgccatgctgggtctcccccttggataccagaaatcagagactgtatagacttgatatacaaattctctttatttggtccccgaacacacttgctacctaatgttctgcatagacctcgtacttgggagtcggccat

SEQ ID NO: 432754 - DNA, 140 bp, Artificial Sequence
  Synthetic
atggccgactcccaagtacgaggtctatgcagaacattaggtagcaagtgtgttcggggaccaaataaagagaatttgtatatcaagtctatacagtctctgatttctggtatccaagggggagacccagcatggcgtat

SEQ ID NO: 432755 - DNA, 140 bp, Artificial Sequence
  Synthetic
atacgccatgctgggtctccaccactcattcctatcatactcagaagagcccgtctttggtcaagttgctgtgagctcaagttgcccatatagacacctgcactcaatggcctttctgtccgtacttgggagtcggccat

SEQ ID NO: 432756 - DNA, 140 bp, Artificial Sequence
  Synthetic
atggccgactcccaagtacggacagaaaggccattgagtgcaggtgtctatatgggcaacttgagctcacagcaacttgaccaaagacgggctcttctgagtatgataggaatgagtggtggagacccagcatggcgtat

SEQ ID NO: 432757 - DNA, 140 bp, Artificial Sequence
  Synthetic
aggccctggctgctgatatggtccacagtaaaaatacttctccttcaacctactattctcatagacagcattacaaaattcttcgtaaaatttacctggcaagatgtcatgatcaaagtcgaccttttgggacagcggtg

SEQ ID NO: 432758 - DNA, 140 bp, Artificial Sequence
  Synthetic
caccgctgtcccaaaaggtcgactttgatcatgacatcttgccaggtaaattttacgaagaattttgtaatgctgtctatgagaatagtaggttgaaggagaagtatttttactgtggaccatatcagcagccagggcct

SEQ ID NO: 432759 - DNA, 140 bp, Artificial Sequence
  Synthetic
aggccctggctgctgatatggtcatctgaggttagagtcccaactctcagtatactcttttgttgagttgattttaactcaacaaggttgttgaccgcttgatttaggtccctcaaccgtgaccttttgggacagcggtg

SEQ ID NO: 432760 - DNA, 140 bp, Artificial Sequence
  Synthetic
caccgctgtcccaaaaggtcacggttgagggacctaaatcaagcggtcaacaaccttgttgagttaaaatcaactcaacaaaagagtatactgagagttgggactctaacctcagatgaccatatcagcagccagggcct

SEQ ID NO: 432761 - DNA, 140 bp, Artificial Sequence
  Synthetic
aggccctggctgctgatatgtttatttaggaatgatctccagcattggacctgacattctccagtagtttggttttcccctttttcattcctcttttcaatatttgcatacaaaaatcttgaccttttgggacagcggtg

SEQ ID NO: 432762 - DNA, 140 bp, Artificial Sequence
  Synthetic
caccgctgtcccaaaaggtcaagatttttgtatgcaaatattgaaaagaggaatgaaaaaggggaaaaccaaactactggagaatgtcaggtccaatgctggagatcattcctaaataaacatatcagcagccagggcct

SEQ ID NO: 432763 - DNA, 140 bp, Artificial Sequence
  Synthetic
atacgccatgctgggtctcccaccagattgttgtgctggatgcacgcagcagaaagcaaaaactatctgccaaaatgataaaagcaaagcgcaatccaatagcctaggatccactgtgcgcgtacttgggagtcggccat

SEQ ID NO: 432764 - DNA, 140 bp, Artificial Sequence
  Synthetic
atggccgactcccaagtacgcgcacagtggatcctaggctattggattgcgctttgcttttatcattttggcagatagtttttgctttctgctgcgtgcatccagcacaacaatctggtgggagacccagcatggcgtat

SEQ ID NO: 432765 - DNA, 140 bp, Artificial Sequence
  Synthetic
atacgccatgctgggtctccggatcctaggcaatttggttgttctcttttgggttttgtgtgctgaactcctccagatgggaaacaagcaagtcaaaaccccggaagcaaaagacagtcccgtacttgggagtcggccat

SEQ ID NO: 432766 - DNA, 140 bp, Artificial Sequence
  Synthetic
atggccgactcccaagtacgggactgtcttttgcttccggggttttgacttgcttgtttcccatctggaggagttcagcacacaaaacccaaaagagaacaaccaaattgcctaggatccggagacccagcatggcgtat

SEQ ID NO: 432767 - DNA, 140 bp, Artificial Sequence
  Synthetic
aggccctggctgctgatatgttctgcagctaccttatcagcgtacagattgttaagttcattaagcaactggctcttatcaacctttaaaaactgaccttctatctctcctttcctcaatgaccttttgggacagcggtg

SEQ ID NO: 432768 - DNA, 140 bp, Artificial Sequence
  Synthetic
caccgctgtcccaaaaggtcattgaggaaaggagagatagaaggtcagtttttaaaggttgataagagccagttgcttaatgaacttaacaatctgtacgctgataaggtagctgcagaacatatcagcagccagggcct

SEQ ID NO: 432769 - DNA, 140 bp, Artificial Sequence
  Synthetic
atacgccatgctgggtctccgagagccagcctgatcccagatgccacacacctagggccacagttctgcaagagctgctggttcgaaaacaagggcctggttgagtgcaacaaccactatcgtacttgggagtcggccat

SEQ ID NO: 432770 - DNA, 140 bp, Artificial Sequence
  Synthetic
atggccgactcccaagtacgatagtggttgttgcactcaaccaggcccttgttttcgaaccagcagctcttgcagaactgtggccctaggtgtgtggcatctgggatcaggctggctctcggagacccagcatggcgtat

SEQ ID NO: 432771 - DNA, 140 bp, Artificial Sequence
  Synthetic
atacgccatgctgggtctcccagcacccccaaccagagcagcggacagcatcggacccccaccctacagtccctgaacccccatcgacccccaccactctcaccctccccccgacacccccgtacttgggagtcggccat

SEQ ID NO: 432772 - DNA, 140 bp, Artificial Sequence
  Synthetic
atggccgactcccaagtacgggggtgtcggggggagggtgagagtggtgggggtcgatgggggttcagggactgtagggtgggggtccgatgctgtccgctgctctggttgggggtgctgggagacccagcatggcgtat

SEQ ID NO: 432773 - DNA, 140 bp, Artificial Sequence
  Synthetic
aggccctggctgctgatatgccctgaacccccatcgacccccaccactctcaccctccccccgacaccccccggggggaccccccgccgggggcccccccgggggagccagccatctccagaccttttgggacagcggtg

SEQ ID NO: 432774 - DNA, 140 bp, Artificial Sequence
  Synthetic
caccgctgtcccaaaaggtctggagatggctggctcccccgggggggcccccggcggggggtccccccggggggtgtcggggggagggtgagagtggtgggggtcgatgggggttcagggcatatcagcagccagggcct

SEQ ID NO: 432775 - DNA, 140 bp, Artificial Sequence
  Synthetic
atacgccatgctgggtctccctcaacatcagtgattaattcttcccttattttgtcaataaggtccttatgatggtaatctgacacataagccatcacaaaatacctaagattttggaggcgtacttgggagtcggccat

SEQ ID NO: 432776 - DNA, 140 bp, Artificial Sequence
  Synthetic
atggccgactcccaagtacgcctccaaaatcttaggtattttgtgatggcttatgtgtcagattaccatcataaggaccttattgacaaaataagggaagaattaatcactgatgttgagggagacccagcatggcgtat

SEQ ID NO: 432777 - DNA, 140 bp, Artificial Sequence
  Synthetic
aggccctggctgctgatatgcgtgcaaacacttcagttaactgtgtgacagccaaagctgtgagcttgttgaagtcataatccagaatacgggacccatctgtatatttatttacaacaagaccttttgggacagcggtg

SEQ ID NO: 432778 - DNA, 140 bp, Artificial Sequence
  Synthetic
caccgctgtcccaaaaggtcttgttgtaaataaatatacagatgggtcccgtattctggattatgacttcaacaagctcacagctttggctgtcacacagttaactgaagtgtttgcacgcatatcagcagccagggcct

SEQ ID NO: 432779 - DNA, 140 bp, Artificial Sequence
  Synthetic
aggccctggctgctgatatgcacaagaaatgctaacttctgtcttgacaatctctcgttgtccgctaggtactttgacaccaaatctttgacacaggctatgtcttcctccatgtttagcgaccttttgggacagcggtg

SEQ ID NO: 432780 - DNA, 140 bp, Artificial Sequence
  Synthetic
caccgctgtcccaaaaggtcgctaaacatggaggaagacatagcctgtgtcaaagatttggtgtcaaagtacctagcggacaacgagagattgtcaagacagaagttagcatttcttgtgcatatcagcagccagggcct

SEQ ID NO: 432781 - DNA, 140 bp, Artificial Sequence
  Synthetic
aggccctggctgctgatatgagttcactatagaatgaggtcccgtagagggcacagaagacacaagagtcaattaaaggcaattaaattagatagccttaatgcctaggatcctcggtgcgaccttttgggacagcggtg

SEQ ID NO: 432782 - DNA, 140 bp, Artificial Sequence
  Synthetic
caccgctgtcccaaaaggtcgcaccgaggatcctaggcattaaggctatctaatttaattgcctttaattgactcttgtgtcttctgtgccctctacgggacctcattctatagtgaactcatatcagcagccagggcct

SEQ ID NO: 432783 - DNA, 140 bp, Artificial Sequence
  Synthetic
aggccctggctgctgatatgtgtcctttcttctcttatgtggaagatcatgctcaacaacttacaagggtgtttatgagctacaaactctagagctagacatggcaaaccttaatatgacgaccttttgggacagcggtg

SEQ ID NO: 432784 - DNA, 140 bp, Artificial Sequence
  Synthetic
caccgctgtcccaaaaggtcgtcatattaaggtttgccatgtctagctctagagtttgtagctcataaacacccttgtaagttgttgagcatgatcttccacataagagaagaaaggacacatatcagcagccagggcct

SEQ ID NO: 432785 - DNA, 140 bp, Artificial Sequence
  Synthetic
aggccctggctgctgatatgcaaggagaattagtgcatcaaaaattaatagaagtttcctccttgtgttcaatatcctcaaagatttcactttatttaggaatgatctccagcattgcacgaccttttgggacagcggtg

SEQ ID NO: 432786 - DNA, 140 bp, Artificial Sequence
  Synthetic
caccgctgtcccaaaaggtcgtgcaatgctggagatcattcctaaataaagtgaaatctttgaggatattgaacacaaggaggaaacttctattaatttttgatgcactaattctccttgcatatcagcagccagggcct

SEQ ID NO: 432787 - DNA, 140 bp, Artificial Sequence
  Synthetic
aggccctggctgctgatatgccattttactatgtgtgagacaagagacaaggcttcacaattaacatccaatgctacacagagatctagaaattttattctgggtgaccacttcattttggaccttttgggacagcggtg

SEQ ID NO: 432788 - DNA, 140 bp, Artificial Sequence
  Synthetic
caccgctgtcccaaaaggtccaaaatgaagtggtcacccagaataaaatttctagatctctgtgtagcattggatgttaattgtgaagccttgtctcttgtctcacacatagtaaaatggcatatcagcagccagggcct

SEQ ID NO: 432789 - DNA, 140 bp, Artificial Sequence
  Synthetic
aggccctggctgctgatatgccatgccttatgcagtccagccggctagcaagaagaatcagaacgtcaaaaatgaggagaagtttcctcctggtgttaaggatcctcagagactttatctgaccttttgggacagcggtg

SEQ ID NO: 432790 - DNA, 140 bp, Artificial Sequence
  Synthetic
caccgctgtcccaaaaggtcagataaagtctctgaggatccttaacaccaggaggaaacttctcctcatttttgacgttctgattcttcttgctagccggctggactgcataaggcatggcatatcagcagccagggcct

SEQ ID NO: 432791 - DNA, 140 bp, Artificial Sequence
  Synthetic
atacgccatgctgggtctccatatggtctgttggagcagcaattcgctgtgggacgggatcccgtggggggcacagaaaacacaaaaggcaatcgaagacaattaaattagacaatcaaacgtacttgggagtcggccat

SEQ ID NO: 432792 - DNA, 140 bp, Artificial Sequence
  Synthetic
atggccgactcccaagtacgtttgattgtctaatttaattgtcttcgattgccttttgtgttttctgtgccccccacgggatcccgtcccacagcgaattgctgctccaacagaccatatggagacccagcatggcgtat

SEQ ID NO: 432793 - DNA, 140 bp, Artificial Sequence
  Synthetic
atacgccatgctgggtctcccaaccactccaacagcacctccaaccggagcagcagacagcatcagacccccaccttacagtccctgaaactcccaccaaccttcaccactcctatcccccgtacttgggagtcggccat

SEQ ID NO: 432794 - DNA, 140 bp, Artificial Sequence
  Synthetic
atggccgactcccaagtacgggggataggagtggtgaaggttggtgggagtttcagggactgtaaggtgggggtctgatgctgtctgctgctccggttggaggtgctgttggagtggttgggagacccagcatggcgtat

SEQ ID NO: 432795 - DNA, 140 bp, Artificial Sequence
  Synthetic
atacgccatgctgggtctcctaaatatcatcaccttcccttttgacttactataacagagagcataacccttgaattccacccagctgtccactgcctcaaggaccgcacccaagatccccgtacttgggagtcggccat

SEQ ID NO: 432796 - DNA, 140 bp, Artificial Sequence
  Synthetic
atggccgactcccaagtacggggatcttgggtgcggtccttgaggcagtggacagctgggtggaattcaagggttatgctctctgttatagtaagtcaaaagggaaggtgatgatatttaggagacccagcatggcgtat

SEQ ID NO: 432797 - DNA, 140 bp, Artificial Sequence
  Synthetic
aggccctggctgctgatatggaacagggacaccattggcaactgattgatcgatgattgtgtcaattgtctccgccagttgatgtggttccttacactttatattatgaagggctgcagcgaccttttgggacagcggtg

SEQ ID NO: 432798 - DNA, 140 bp, Artificial Sequence
  Synthetic
caccgctgtcccaaaaggtcgctgcagcccttcataatataaagtgtaaggaaccacatcaactggcggagacaattgacacaatcatcgatcaatcagttgccaatggtgtccctgttccatatcagcagccagggcct

SEQ ID NO: 432799 - DNA, 140 bp, Artificial Sequence
  Synthetic
atacgccatgctgggtctccccacatatacaactgatagcataattaatgaacctctctgaaatgagggcataaaaatctgatgtgttgtgtaatattccttgacccatgtcaagtattgcgtacttgggagtcggccat

SEQ ID NO: 432800 - DNA, 140 bp, Artificial Sequence
  Synthetic
atggccgactcccaagtacgcaatacttgacatgggtcaaggaatattacacaacacatcagatttttatgccctcatttcagagaggttcattaattatgctatcagttgtatatgtggggagacccagcatggcgtat

SEQ ID NO: 432801 - DNA, 140 bp, Artificial Sequence
  Synthetic
aggccctggctgctgatatggaaaagctaacttctgtcttgacagcttctcattatctgcaaggtactttgagatgagatctttagcattagcaatgtcttcctccatcgccaattgtgggaccttttgggacagcggtg

SEQ ID NO: 432802 - DNA, 140 bp, Artificial Sequence
  Synthetic
caccgctgtcccaaaaggtcccacaattggcgatggaggaagacattgctaatgctaaagatctcatctcaaagtaccttgcagataatgagaagctgtcaagacagaagttagcttttccatatcagcagccagggcct

SEQ ID NO: 432803 - DNA, 140 bp, Artificial Sequence
  Synthetic
atacgccatgctgggtctcccacctgtgttgagtatgggtttgtgccaatgtggcttgtaggtcagctgatgatgccccacaaaagctcctacagaaatgagagacaatatgcctaggatcgtacttgggagtcggccat

SEQ ID NO: 432804 - DNA, 140 bp, Artificial Sequence
  Synthetic
atggccgactcccaagtacgatcctaggcatattgtctctcatttctgtaggagcttttgtggggcatcatcagctgacctacaagccacattggcacaaacccatactcaacacaggtgggagacccagcatggcgtat

SEQ ID NO: 432805 - DNA, 140 bp, Artificial Sequence
  Synthetic
atacgccatgctgggtctccgccaaccattgtggcactgttgcaaatggtgtattacagactttcatgaggatggcttggggtgggagctacattgctcttgactcaggccgtgacaggtcgtacttgggagtcggccat

SEQ ID NO: 432806 - DNA, 140 bp, Artificial Sequence
  Synthetic
atggccgactcccaagtacgacctgtcacggcctgagtcaagagcaatgtagctcccaccccaagccatcctcatgaaagtctgtaatacaccatttgcaacagtgccacaatggttggcggagacccagcatggcgtat

SEQ ID NO: 432807 - DNA, 140 bp, Artificial Sequence
  Synthetic
aggccctggctgctgatatggtgacatgctgaggctgtttgactttaacaaacaagccattcaaaggttgaaagctgaagcacaaatgagcattcagttgatcaacaaggcagtaaatgcgaccttttgggacagcggtg

SEQ ID NO: 432808 - DNA, 140 bp, Artificial Sequence
  Synthetic
caccgctgtcccaaaaggtcgcatttactgccttgttgatcaactgaatgctcatttgtgcttcagctttcaacctttgaatggcttgtttgttaaagtcaaacagcctcagcatgtcaccatatcagcagccagggcct

SEQ ID NO: 432809 - DNA, 140 bp, Artificial Sequence
  Synthetic
atacgccatgctgggtctcccatatttggatcccactgtccttcaccactgcttcaatgccctgagtttccaacaagtgagactgcacagacctaatgtaaaggttctccttattgggaccgtacttgggagtcggccat

SEQ ID NO: 432810 - DNA, 140 bp, Artificial Sequence
  Synthetic
atggccgactcccaagtacggtcccaataaggagaacctttacattaggtctgtgcagtctcacttgttggaaactcagggcattgaagcagtggtgaaggacagtgggatccaaatatgggagacccagcatggcgtat

SEQ ID NO: 432811 - DNA, 140 bp, Artificial Sequence
  Synthetic
atacgccatgctgggtctccaagtcttcaaccatgtgattggataattcagctttgatcaacctaatgtaaaacttatttgatacaatctcatctagatcatttatagatggctggccatcgtacttgggagtcggccat

SEQ ID NO: 432812 - DNA, 140 bp, Artificial Sequence
  Synthetic
atggccgactcccaagtacgatggccagccatctataaatgatctagatgagattgtatcaaataagttttacattaggttgatcaaagctgaattatccaatcacatggttgaagacttggagacccagcatggcgtat

SEQ ID NO: 432813 - DNA, 140 bp, Artificial Sequence
  Synthetic
atacgccatgctgggtctccgaagcactcatcctggtctgaagactcagggacttgctggttgaaagtgtcactcagtaagtcaatgaaaagcgcaatccaatagcctaggatccactgtcgtacttgggagtcggccat

SEQ ID NO: 432814 - DNA, 140 bp, Artificial Sequence
  Synthetic
atggccgactcccaagtacgacagtggatcctaggctattggattgcgcttttcattgacttactgagtgacactttcaaccagcaagtccctgagtcttcagaccaggatgagtgcttcggagacccagcatggcgtat

SEQ ID NO: 432815 - DNA, 140 bp, Artificial Sequence
  Synthetic
atacgccatgctgggtctccccggggatcctaggcaatttaactgtacttcagtggtaaagcttttctagtgaatccctgaatcaaagtgtgcagtcaaaatgggcaacagacaggccaacgtacttgggagtcggccat

SEQ ID NO: 432816 - DNA, 140 bp, Artificial Sequence
  Synthetic
atggccgactcccaagtacgttggcctgtctgttgcccattttgactgcacactttgattcagggattcactagaaaagctttaccactgaagtacagttaaattgcctaggatccccggggagacccagcatggcgtat

SEQ ID NO: 432817 - DNA, 140 bp, Artificial Sequence
  Synthetic
aggccctggctgctgatatgttggtggagtgcaacaaccactacttgtgtctcaactgtctcagtctgctcctcagcgttagcagtagatgcccgatttgcaagatgcccctccccaccagaccttttgggacagcggtg

SEQ ID NO: 432818 - DNA, 140 bp, Artificial Sequence
  Synthetic
caccgctgtcccaaaaggtctggtggggaggggcatcttgcaaatcgggcatctactgctaacgctgaggagcagactgagacagttgagacacaagtagtggttgttgcactccaccaacatatcagcagccagggcct

SEQ ID NO: 432819 - DNA, 140 bp, Artificial Sequence
  Synthetic
aggccctggctgctgatatgtactctagaaccatctgtgtatttgttgacaacaacacttttattgctagccaaatccaaagctgtggcacagccgctagtgatgagggggtctctaattgaccttttgggacagcggtg

SEQ ID NO: 432820 - DNA, 140 bp, Artificial Sequence
  Synthetic
caccgctgtcccaaaaggtcaattagagaccccctcatcactagcggctgtgccacagctttggatttggctagcaataaaagtgttgttgtcaacaaatacacagatggttctagagtacatatcagcagccagggcct

SEQ ID NO: 432821 - DNA, 140 bp, Artificial Sequence
  Synthetic
aggccctggctgctgatatggtatatcaacataatccataggtctctgttttgtgaggattgagacaatgtccacacctgtccattggactctttgtttcattctatcagacatcattgagaccttttgggacagcggtg

SEQ ID NO: 432822 - DNA, 140 bp, Artificial Sequence
  Synthetic
caccgctgtcccaaaaggtctcaatgatgtctgatagaatgaaacaaagagtccaatggacaggtgtggacattgtctcaatcctcacaaaacagagacctatggattatgttgatataccatatcagcagccagggcct

SEQ ID NO: 432823 - DNA, 140 bp, Artificial Sequence
  Synthetic
aggccctggctgctgatatgggaggagcttttgagaacgtttacttgggtgagctaaaattaaaaccaggatcatctttgtcaaagatctgatgttgttcaactgcccttccagctcactgaccttttgggacagcggtg

SEQ ID NO: 432824 - DNA, 140 bp, Artificial Sequence
  Synthetic
caccgctgtcccaaaaggtcagtgagctggaagggcagttgaacaacatcagatctttgacaaagatgatcctggttttaattttagctcacccaagtaaacgttctcaaaagctcctcccatatcagcagccagggcct

SEQ ID NO: 432825 - DNA, 140 bp, Artificial Sequence
  Synthetic
aggccctggctgctgatatggagaatcccatgatcactcagaatggattcaactgttttgtcttcagtgttatgttcacatccattggccttgcaagagtcaatctcaatgcaaagagatgaccttttgggacagcggtg

SEQ ID NO: 432826 - DNA, 140 bp, Artificial Sequence
  Synthetic
caccgctgtcccaaaaggtcatctctttgcattgagattgactcttgcaaggccaatggatgtgaacataacactgaagacaaaacagttgaatccattctgagtgatcatgggattctccatatcagcagccagggcct

SEQ ID NO: 432827 - DNA, 140 bp, Artificial Sequence
  Synthetic
atacgccatgctgggtctccgtatcctttaggaactcatttaccacatctgaatcaacaaaccaggctgacctacccttaaaagttggaccggacaaagcaagtctccagcagtcacacacgtacttgggagtcggccat

SEQ ID NO: 432828 - DNA, 140 bp, Artificial Sequence
  Synthetic
atggccgactcccaagtacgtgtgtgactgctggagacttgctttgtccggtccaacttttaagggtaggtcagcctggtttgttgattcagatgtggtaaatgagttcctaaaggatacggagacccagcatggcgtat

SEQ ID NO: 432829 - DNA, 140 bp, Artificial Sequence
  Synthetic
atacgccatgctgggtctcccttgacaatatgcttctttgcatctgaccacttgataccttgcaggtccaaattcattctgtctcaactttacggtcgatgaggttttcatggagttcaccgtacttgggagtcggccat

SEQ ID NO: 432830 - DNA, 140 bp, Artificial Sequence
  Synthetic
atggccgactcccaagtacggtgaactccatgaaaacctcatcgaccgtaaagttgagacagaatgaatttggacctgcaaggtatcaagtggtcagatgcaaagaagcatattgtcaagggagacccagcatggcgtat

SEQ ID NO: 432831 - DNA, 140 bp, Artificial Sequence
  Synthetic
aggccctggctgctgatatgaagctggttcaagtttatctgggctggttctatgtcaaagtctatccatgcatagcccatcattagatcaaacttaaacataggtctctctatccctttggaccttttgggacagcggtg

SEQ ID NO: 432832 - DNA, 140 bp, Artificial Sequence
  Synthetic
caccgctgtcccaaaaggtccaaagggatagagagacctatgtttaagtttgatctaatgatgggctatgcatggatagactttgacatagaaccagcccagataaacttgaaccagcttcatatcagcagccagggcct

SEQ ID NO: 432833 - DNA, 140 bp, Artificial Sequence
  Synthetic
aggccctggctgctgatatgtgcctgtattgggtttgagtttgtaccagaatggcttgtgggtcaactggtgatgccccacaaaagctcctacagaaatgagagacaatatgcctaggatgaccttttgggacagcggtg

SEQ ID NO: 432834 - DNA, 140 bp, Artificial Sequence
  Synthetic
caccgctgtcccaaaaggtcatcctaggcatattgtctctcatttctgtaggagcttttgtggggcatcaccagttgacccacaagccattctggtacaaactcaaacccaatacaggcacatatcagcagccagggcct

SEQ ID NO: 432835 - DNA, 140 bp, Artificial Sequence
  Synthetic
aggccctggctgctgatatggataaattaagtgttcaatattgtcttccgcagctaccttttcagcgtacaagttattgagttcattaagtaactggttcttgttaacctttaaaaactggaccttttgggacagcggtg

SEQ ID NO: 432836 - DNA, 140 bp, Artificial Sequence
  Synthetic
caccgctgtcccaaaaggtccagtttttaaaggttaacaagaaccagttacttaatgaactcaataacttgtacgctgaaaaggtagctgcggaagacaatattgaacacttaatttatccatatcagcagccagggcct

SEQ ID NO: 432837 - DNA, 140 bp, Artificial Sequence
  Synthetic
atacgccatgctgggtctcctcctgcgcatactttaaaagtgagaagagcgtatccctcagcttatcattgacccagtcaggtatttgttcattgtagaatgatgttctcccgtctataacgtacttgggagtcggccat

SEQ ID NO: 432838 - DNA, 140 bp, Artificial Sequence
  Synthetic
atggccgactcccaagtacgttatagacgggagaacatcattctacaatgaacaaatacctgactgggtcaatgataagctgagggatacgctcttctcacttttaaagtatgcgcaggaggagacccagcatggcgtat

SEQ ID NO: 432839 - DNA, 140 bp, Artificial Sequence
  Synthetic
aggccctggctgctgatatgtttggaaagctgatttatttattgcttcagatagtagcttctgagcccctctagtgaatgttgatgacaacctattttgcaaggtctttactattgtggggaccttttgggacagcggtg

SEQ ID NO: 432840 - DNA, 140 bp, Artificial Sequence
  Synthetic
caccgctgtcccaaaaggtccccacaatagtaaagaccttgcaaaataggttgtcatcaacattcactagaggggctcagaagctactatctgaagcaataaataaatcagctttccaaacatatcagcagccagggcct

SEQ ID NO: 432841 - DNA, 140 bp, Artificial Sequence
  Synthetic
aggccctggctgctgatatgcctaacaaaacactccagcaatattagaacattgcccgtcaatttgtaaccgtccggtaccacaaaacatagtgaaggagtcaagattccatggtcatgggaccttttgggacagcggtg

SEQ ID NO: 432842 - DNA, 140 bp, Artificial Sequence
  Synthetic
caccgctgtcccaaaaggtcccatgaccatggaatcttgactccttcactatgttttgtggtaccggacggttacaaattgacgggcaatgttctaatattgctggagtgttttgttaggcatatcagcagccagggcct

SEQ ID NO: 432843 - DNA, 140 bp, Artificial Sequence
  Synthetic
aggccctggctgctgatatgcgtccggtaccacaaaacatagtgaaggagtcaagattccatggtcatggagaattctttccacagatttgtcctcactgttatgttcacaaccatttgcgaccttttgggacagcggtg

SEQ ID NO: 432844 - DNA, 140 bp, Artificial Sequence
  Synthetic
caccgctgtcccaaaaggtcgcaaatggttgtgaacataacagtgaggacaaatctgtggaaagaattctccatgaccatggaatcttgactccttcactatgttttgtggtaccggacgcatatcagcagccagggcct

SEQ ID NO: 432845 - DNA, 140 bp, Artificial Sequence
  Synthetic
atacgccatgctgggtctccagaacatgtgctctgctagagtaacagttcactttgagacaggttctcgtaggaggcacataaaaacaagaggtaagaggtaattaaagacaatttaatacgtacttgggagtcggccat

SEQ ID NO: 432846 - DNA, 140 bp, Artificial Sequence
  Synthetic
atggccgactcccaagtacgtattaaattgtctttaattacctcttacctcttgtttttatgtgcctcctacgagaacctgtctcaaagtgaactgttactctagcagagcacatgttctggagacccagcatggcgtat

SEQ ID NO: 432847 - DNA, 140 bp, Artificial Sequence
  Synthetic
aggccctggctgctgatatgatcgccagattgtagtgtcgaatgcacgttacaaaaactgtgactatctgccaaagtgataaaagcaaagcgcaatccaatagcctaggatccactgtgcgaccttttgggacagcggtg

SEQ ID NO: 432848 - DNA, 140 bp, Artificial Sequence
  Synthetic
caccgctgtcccaaaaggtcgcacagtggatcctaggctattggattgcgctttgcttttatcactttggcagatagtcacagtttttgtaacgtgcattcgacactacaatctggcgatcatatcagcagccagggcct

SEQ ID NO: 432849 - DNA, 140 bp, Artificial Sequence
  Synthetic
atacgccatgctgggtctcctgtataactctctgttaccaccaacttgttccttatatgataaagagaatttaagtctccctgtatcaggccctactgaatcataggactgtggtgactccgtacttgggagtcggccat

SEQ ID NO: 432850 - DNA, 140 bp, Artificial Sequence
  Synthetic
atggccgactcccaagtacggagtcaccacagtcctatgattcagtagggcctgatacagggagacttaaattctctttatcatataaggaacaagttggtggtaacagagagttatacaggagacccagcatggcgtat

SEQ ID NO: 432851 - DNA, 140 bp, Artificial Sequence
  Synthetic
atacgccatgctgggtctccctgagtctgtatggatctaatgtaaagattctccttgttagggcctctgacgcacttgctacccagtgttctgcacaaccctacaaacccagatgctatacgtacttgggagtcggccat

SEQ ID NO: 432852 - DNA, 140 bp, Artificial Sequence
  Synthetic
atggccgactcccaagtacgtatagcatctgggtttgtagggttgtgcagaacactgggtagcaagtgcgtcagaggccctaacaaggagaatctttacattagatccatacagactcagggagacccagcatggcgtat

SEQ ID NO: 432853 - DNA, 140 bp, Artificial Sequence
  Synthetic
aggccctggctgctgatatgtcctttgggttcacactcacatgtccaaattccaatttgggctcaaggaatttttcaaagcatttgatctgatcagtcagtctgtcaggtgtttcttttggaccttttgggacagcggtg

SEQ ID NO: 432854 - DNA, 140 bp, Artificial Sequence
  Synthetic
caccgctgtcccaaaaggtccaaaagaaacacctgacagactgactgatcagatcaaatgctttgaaaaattccttgagcccaaattggaatttggacatgtgagtgtgaacccaaaggacatatcagcagccagggcct

SEQ ID NO: 432855 - DNA, 140 bp, Artificial Sequence
  Synthetic
aggccctggctgctgatatgatatctgatcgtcactggacgtgtaagcatcgatttgtcctccagacacacacctcaccgcaaaatttataaatctttcagaaatcaacgcataaaagtcgaccttttgggacagcggtg

SEQ ID NO: 432856 - DNA, 140 bp, Artificial Sequence
  Synthetic
caccgctgtcccaaaaggtcgacttttatgcgttgatttctgaaagatttataaattttgcggtgaggtgtgtgtctggaggacaaatcgatgcttacacgtccagtgacgatcagatatcatatcagcagccagggcct

SEQ ID NO: 432857 - DNA, 140 bp, Artificial Sequence
  Synthetic
aggccctggctgctgatatgagcatacctcgccaaccctgttatcattaatggcataacactttgaacattcccctgttttttgataaattaattgaaactcagtgacacccagtgaaaagaccttttgggacagcggtg

SEQ ID NO: 432858 - DNA, 140 bp, Artificial Sequence
  Synthetic
caccgctgtcccaaaaggtcttttcactgggtgtcactgagtttcaattaatttatcaaaaaacaggggaatgttcaaagtgttatgccattaatgataacagggttggcgaggtatgctcatatcagcagccagggcct

SEQ ID NO: 432859 - DNA, 140 bp, Artificial Sequence
  Synthetic
aggccctggctgctgatatgtgacttataatgagtgtaccttcccataagtgtgtttgcgttcataatcaagagtatagacttaaaacactggaagtattcatggtcaaagtatgtcctcgaccttttgggacagcggtg

SEQ ID NO: 432860 - DNA, 140 bp, Artificial Sequence
  Synthetic
caccgctgtcccaaaaggtcgaggacatactttgaccatgaatacttccagtgttttaagtctatactcttgattatgaacgcaaacacacttatgggaaggtacactcattataagtcacatatcagcagccagggcct

SEQ ID NO: 432861 - DNA, 140 bp, Artificial Sequence
  Synthetic
aggccctggctgctgatatgataaatctttcagaaatcaacgcataaaagtctgaggtgttgtgcagaataccctgtcccatatcaaggattgaactaatgtgtgaggggactgtgccaagaccttttgggacagcggtg

SEQ ID NO: 432862 - DNA, 140 bp, Artificial Sequence
  Synthetic
caccgctgtcccaaaaggtcttggcacagtcccctcacacattagttcaatccttgatatgggacagggtattctgcacaacacctcagacttttatgcgttgatttctgaaagatttatcatatcagcagccagggcct

SEQ ID NO: 432863 - DNA, 140 bp, Artificial Sequence
  Synthetic
aggccctggctgctgatatggcataatctcaactttccacttgtccatccccaacttcaatcagtatgaggcaatgagctgcgatttcaatgggggaaagattagtgtgcagtacaacctgaccttttgggacagcggtg

SEQ ID NO: 432864 - DNA, 140 bp, Artificial Sequence
  Synthetic
caccgctgtcccaaaaggtcaggttgtactgcacactaatctttcccccattgaaatcgcagctcattgcctcatactgattgaagttggggatggacaagtggaaagttgagattatgccatatcagcagccagggcct

SEQ ID NO: 432865 - DNA, 140 bp, Artificial Sequence
  Synthetic
aggccctggctgctgatatgtgactttacttccttagaagcactcattttggtctagacactcagggatttactggttgaaagttttttactcagtgagtcaatgaaaagcgcaatccaagaccttttgggacagcggtg

SEQ ID NO: 432866 - DNA, 140 bp, Artificial Sequence
  Synthetic
caccgctgtcccaaaaggtcttggattgcgcttttcattgactcactgagtaaaaaactttcaaccagtaaatccctgagtgtctagaccaaaatgagtgcttctaaggaagtaaagtcacatatcagcagccagggcct

SEQ ID NO: 432867 - DNA, 140 bp, Artificial Sequence
  Synthetic
atacgccatgctgggtctcctcccataacaagggcctgaaataattgaccacactttcacttccactcccgttcctaagttctagtggaacttgccaatattgaatgccattagagtttgcgtacttgggagtcggccat

SEQ ID NO: 432868 - DNA, 140 bp, Artificial Sequence
  Synthetic
atggccgactcccaagtacgcaaactctaatggcattcaatattggcaagttccactagaacttaggaacgggagtggaagtgaaagtgtggtcaattatttcaggcccttgttatgggaggagacccagcatggcgtat

SEQ ID NO: 432869 - DNA, 140 bp, Artificial Sequence
  Synthetic
atacgccatgctgggtctccacagtaaaaatatttctcctttaacttactactctcataaactgcattgcagaattcctcataaaaattgtctggtaggacatcatgatcaaaatcctcacgtacttgggagtcggccat

SEQ ID NO: 432870 - DNA, 140 bp, Artificial Sequence
  Synthetic
atggccgactcccaagtacgtgaggattttgatcatgatgtcctaccagacaatttttatgaggaattctgcaatgcagtttatgagagtagtaagttaaaggagaaatatttttactgtggagacccagcatggcgtat

SEQ ID NO: 432871 - DNA, 140 bp, Artificial Sequence
  Synthetic
aggccctggctgctgatatgccttcccaccaagctaaaggcagcaacactgccgagcgcaccatcaaccgaagtgacccagaacacaacacctccaccacactccccatgattccaggacgaccttttgggacagcggtg

SEQ ID NO: 432872 - DNA, 140 bp, Artificial Sequence
  Synthetic
caccgctgtcccaaaaggtcgtcctggaatcatggggagtgtggtggaggtgttgtgttctgggtcacttcggttgatggtgcgctcggcagtgttgctgcctttagcttggtgggaaggcatatcagcagccagggcct

SEQ ID NO: 432873 - DNA, 140 bp, Artificial Sequence
  Synthetic
aggccctggctgctgatatgatcatattcagaagagctcttctttggtcaagttgctgtgagcttaggttgcccatatagacacctgcactcagtggcctttctgttctggtcacctttggaccttttgggacagcggtg

SEQ ID NO: 432874 - DNA, 140 bp, Artificial Sequence
  Synthetic
caccgctgtcccaaaaggtccaaaggtgaccagaacagaaaggccactgagtgcaggtgtctatatgggcaacctaagctcacagcaacttgaccaaagaagagctcttctgaatatgatcatatcagcagccagggcct

SEQ ID NO: 432875 - DNA, 140 bp, Artificial Sequence
  Synthetic
atacgccatgctgggtctccccctcagaacatgtggtttgctggagcaacagtttactgtagaatgaggtcctgtggggggcacaaaggacacaggagtcaattgaaatcaattaaaggccgtacttgggagtcggccat

SEQ ID NO: 432876 - DNA, 140 bp, Artificial Sequence
  Synthetic
atggccgactcccaagtacggcctttaattgatttcaattgactcctgtgtcctttgtgccccccacaggacctcattctacagtaaactgttgctccagcaaaccacatgttctgagggggagacccagcatggcgtat

SEQ ID NO: 432877 - DNA, 140 bp, Artificial Sequence
  Synthetic
atacgccatgctgggtctccacctgtgttgggtttgggcttatgcctgtatggcttgtgagtcagctagtggtgcttcacaaaaattcctacagaaatgagagacaatatgcctaggatccgtacttgggagtcggccat

SEQ ID NO: 432878 - DNA, 140 bp, Artificial Sequence
  Synthetic
atggccgactcccaagtacggatcctaggcatattgtctctcatttctgtaggaatttttgtgaagcaccactagctgactcacaagccatacaggcataagcccaaacccaacacaggtggagacccagcatggcgtat

SEQ ID NO: 432879 - DNA, 140 bp, Artificial Sequence
  Synthetic
atacgccatgctgggtctcccggggatcctaggcaatttggttgttcttctttttggcctttacaccttgtagtccaacaaatggggaacaagcaaaccaaagctcccgaagccaaaggccgtacttgggagtcggccat

SEQ ID NO: 432880 - DNA, 140 bp, Artificial Sequence
  Synthetic
atggccgactcccaagtacggcctttggcttcgggagctttggtttgcttgttccccatttgttggactacaaggtgtaaaggccaaaaagaagaacaaccaaattgcctaggatccccgggagacccagcatggcgtat

SEQ ID NO: 432881 - DNA, 140 bp, Artificial Sequence
  Synthetic
aggccctggctgctgatatgggcgagctgttctcggagcacctactcaatgtcgaggggaggccccacctcttcaaagaggggcctgcacagcctccctcttaatctaaacttcccctctgaccttttgggacagcggtg

SEQ ID NO: 432882 - DNA, 140 bp, Artificial Sequence
  Synthetic
caccgctgtcccaaaaggtcagaggggaagtttagattaagagggaggctgtgcaggcccctctttgaagaggtggggcctcccctcgacattgagtaggtgctccgagaacagctcgcccatatcagcagccagggcct

SEQ ID NO: 432883 - DNA, 140 bp, Artificial Sequence
  Synthetic
aggccctggctgctgatatggcataacactttgagcattcacctgtcttttgatataatagtttgaatcccattttattgatgaagaactcttggcaataggcctctttgcacctcacaagaccttttgggacagcggtg

SEQ ID NO: 432884 - DNA, 140 bp, Artificial Sequence
  Synthetic
caccgctgtcccaaaaggtcttgtgaggtgcaaagaggcctattgccaagagttcttcatcaataaaatgggattcaaactattatatcaaaagacaggtgaatgctcaaagtgttatgccatatcagcagccagggcct

SEQ ID NO: 432885 - DNA, 140 bp, Artificial Sequence
  Synthetic
aggccctggctgctgatatgaggcactcatcgccagattgttgtattgaatgcacgtgataaaaagctgagactatttgccaaaatgacaaaagcaaagcgcaatccaatagcctaggatgaccttttgggacagcggtg

SEQ ID NO: 432886 - DNA, 140 bp, Artificial Sequence
  Synthetic
caccgctgtcccaaaaggtcatcctaggctattggattgcgctttgcttttgtcattttggcaaatagtctcagctttttatcacgtgcattcaatacaacaatctggcgatgagtgcctcatatcagcagccagggcct

SEQ ID NO: 432887 - DNA, 140 bp, Artificial Sequence
  Synthetic
aggccctggctgctgatatgagacatttagcttcattgataagatggcattatcgaattccttctcattgttcagacaactacctgctaattgtgatgtgagtgcctcaaagtaatcttcgaccttttgggacagcggtg

SEQ ID NO: 432888 - DNA, 140 bp, Artificial Sequence
  Synthetic
caccgctgtcccaaaaggtcgaagattactttgaggcactcacatcacaattagcaggtagttgtctgaacaatgagaaggaattcgataatgccatcttatcaatgaagctaaatgtctcatatcagcagccagggcct

SEQ ID NO: 432889 - DNA, 140 bp, Artificial Sequence
  Synthetic
aggccctggctgctgatatgtgtttgagcacctactcaatgtcgaggggaggccccacctcttcaaagaggggcctgcacagcctccctcttaatctaaacttcccctctgaagactggagaccttttgggacagcggtg

SEQ ID NO: 432890 - DNA, 140 bp, Artificial Sequence
  Synthetic
caccgctgtcccaaaaggtctccagtcttcagaggggaagtttagattaagagggaggctgtgcaggcccctctttgaagaggtggggcctcccctcgacattgagtaggtgctcaaacacatatcagcagccagggcct

SEQ ID NO: 432891 - DNA, 140 bp, Artificial Sequence
  Synthetic
atacgccatgctgggtctcctattgcctcccacctgctccttgtaagacagagaaaatttcagtctgccagtgtcagggccagttgaattgtaagactgaggtgattcttgactataaaacgtacttgggagtcggccat

SEQ ID NO: 432892 - DNA, 140 bp, Artificial Sequence
  Synthetic
atggccgactcccaagtacgttttatagtcaagaatcacctcagtcttacaattcaactggccctgacactggcagactgaaattttctctgtcttacaaggagcaggtgggaggcaataggagacccagcatggcgtat

SEQ ID NO: 432893 - DNA, 140 bp, Artificial Sequence
  Synthetic
aggccctggctgctgatatggctgtggcacaaccactagtgatgagggggtctctgatttccttcttcacttccttttccttgaatagtgagccattgttgaaagaagatgtgagaagaggaccttttgggacagcggtg

SEQ ID NO: 432894 - DNA, 140 bp, Artificial Sequence
  Synthetic
caccgctgtcccaaaaggtcctcttctcacatcttctttcaacaatggctcactattcaaggaaaaggaagtgaagaaggaaatcagagaccccctcatcactagtggttgtgccacagccatatcagcagccagggcct

SEQ ID NO: 432895 - DNA, 140 bp, Artificial Sequence
  Synthetic
atacgccatgctgggtctcctttacgaactacaaacccttgagctagacatggcaagccttaatatgacaatgcccctgtcttgcacgaagaacaattcccaccattacatcatggtcggcgtacttgggagtcggccat

SEQ ID NO: 432896 - DNA, 140 bp, Artificial Sequence
  Synthetic
atggccgactcccaagtacgccgaccatgatgtaatggtgggaattgttcttcgtgcaagacaggggcattgtcatattaaggcttgccatgtctagctcaagggtttgtagttcgtaaaggagacccagcatggcgtat

SEQ ID NO: 432897 - DNA, 140 bp, Artificial Sequence
  Synthetic
aggccctggctgctgatatgcgagatccacagtagtattttcccaagctctacccacaatagaagtccttgaagctatgtagggccagccgtcaccagaaagacagattttgtaaagtatgaccttttgggacagcggtg

SEQ ID NO: 432898 - DNA, 140 bp, Artificial Sequence
  Synthetic
caccgctgtcccaaaaggtcatactttacaaaatctgtctttctggtgacggctggccctacatagcttcaaggacttctattgtgggtagagcttgggaaaatactactgtggatctcgcatatcagcagccagggcct

SEQ ID NO: 432899 - DNA, 140 bp, Artificial Sequence
  Synthetic
atacgccatgctgggtctcccttgtgcatccatccttacccaaaaacttctttgcattgtaggccatgtcatccaattcttcttccgtggctgtgtctgctggattgacactcacatgaccgtacttgggagtcggccat

SEQ ID NO: 432900 - DNA, 140 bp, Artificial Sequence
  Synthetic
atggccgactcccaagtacggtcatgtgagtgtcaatccagcagacacagccacggaagaagaattggatgacatggcctacaatgcaaagaagtttttgggtaaggatggatgcacaagggagacccagcatggcgtat

SEQ ID NO: 432901 - DNA, 140 bp, Artificial Sequence
  Synthetic
aggccctggctgctgatatgagtgttttcccaggcccttcctgttattgaagttcttgatgcaatatatggccatccatcccctgacaaacaaatcttgtagagtatgttttcataaggagaccttttgggacagcggtg

SEQ ID NO: 432902 - DNA, 140 bp, Artificial Sequence
  Synthetic
caccgctgtcccaaaaggtctccttatgaaaacatactctacaagatttgtttgtcaggggatggatggccatatattgcatcaagaacttcaataacaggaagggcctgggaaaacactcatatcagcagccagggcct

SEQ ID NO: 432903 - DNA, 140 bp, Artificial Sequence
  Synthetic
aggccctggctgctgatatgcctgaaagctccctcctcaatgactgtgtccagagaaatgacttcacttccttagaagcactcatcttggtctggacacttagggatttactggttgaaagaccttttgggacagcggtg

SEQ ID NO: 432904 - DNA, 140 bp, Artificial Sequence
  Synthetic
caccgctgtcccaaaaggtctttcaaccagtaaatccctaagtgtccagaccaagatgagtgcttctaaggaagtgaagtcatttctctggacacagtcattgaggagggagctttcaggcatatcagcagccagggcct

SEQ ID NO: 432905 - DNA, 140 bp, Artificial Sequence
  Synthetic
aggccctggctgctgatatgtttgagatgagatccttggcattggcaatgtcttcctccatcgtcaattgtggcacctatattgggcttgggcttgtacctatgtggtgtgtgggtcagcgaccttttgggacagcggtg

SEQ ID NO: 432906 - DNA, 140 bp, Artificial Sequence
  Synthetic
caccgctgtcccaaaaggtcgctgacccacacaccacataggtacaagcccaagcccaatataggtgccacaattgacgatggaggaagacattgccaatgccaaggatctcatctcaaacatatcagcagccagggcct

SEQ ID NO: 432907 - DNA, 140 bp, Artificial Sequence
  Synthetic
atacgccatgctgggtctccggggatcctaggcaattcagctggacttcagtggtaaggctcaattcagcaaatccctgaatcaaagcacctagtcaaaatgggcaacagacaggccaaacgtacttgggagtcggccat

SEQ ID NO: 432908 - DNA, 140 bp, Artificial Sequence
  Synthetic
atggccgactcccaagtacgtttggcctgtctgttgcccattttgactaggtgctttgattcagggatttgctgaattgagccttaccactgaagtccagctgaattgcctaggatccccggagacccagcatggcgtat

SEQ ID NO: 432909 - DNA, 140 bp, Artificial Sequence
  Synthetic
atacgccatgctgggtctccctatatattaagtccattcaatcactgatttctagcactcagggcattgagctcctaacaaacaattacggggtccaatattggagggtcccatcaaacccgtacttgggagtcggccat

SEQ ID NO: 432910 - DNA, 140 bp, Artificial Sequence
  Synthetic
atggccgactcccaagtacgggtttgatgggaccctccaatattggaccccgtaattgtttgttaggagctcaatgccctgagtgctagaaatcagtgattgaatggacttaatatatagggagacccagcatggcgtat

SEQ ID NO: 432911 - DNA, 140 bp, Artificial Sequence
  Synthetic
aggccctggctgctgatatgtggcacctatattgggcttgggcttgtacctatgtggtgtgtgggtcagctggtagtaccccacaaaagctcttacagaaatgagagtcaatatgcctaggaccttttgggacagcggtg

SEQ ID NO: 432912 - DNA, 140 bp, Artificial Sequence
  Synthetic
caccgctgtcccaaaaggtcctaggcatattgactctcatttctgtaagagcttttgtggggtactaccagctgacccacacaccacataggtacaagcccaagcccaatataggtgccacatatcagcagccagggcct

SEQ ID NO: 432913 - DNA, 140 bp, Artificial Sequence
  Synthetic
aggccctggctgctgatatggctcctaacaaacaattacggggtccaatattggagggtcccatcaaaccttagaggggaaaagaatgacgtggttggttatttcagaccactactatgggaccttttgggacagcggtg

SEQ ID NO: 432914 - DNA, 140 bp, Artificial Sequence
  Synthetic
caccgctgtcccaaaaggtcccatagtagtggtctgaaataaccaaccacgtcattcttttcccctctaaggtttgatgggaccctccaatattggaccccgtaattgtttgttaggagccatatcagcagccagggcct

SEQ ID NO: 432915 - DNA, 140 bp, Artificial Sequence
  Synthetic
atacgccatgctgggtctccgagtctcttaatatcatctgaaccttgacaggtcagcaccatattgcgagggagggcttcaatgactgcactggtcaaaccaggttgagcagggaaaagacgtacttgggagtcggccat

SEQ ID NO: 432916 - DNA, 140 bp, Artificial Sequence
  Synthetic
atggccgactcccaagtacgtcttttccctgctcaacctggtttgaccagtgcagtcattgaagccctccctcgcaatatggtgctgacctgtcaaggttcagatgatattaagagactcggagacccagcatggcgtat

SEQ ID NO: 432917 - DNA, 140 bp, Artificial Sequence
  Synthetic
aggccctggctgctgatatgccttagaagcactcatcttggtctggacactcagggacttactggttgaaagtatcactcagtaagtcaatgaaaagcgcaatccaatagcctaggatccgaccttttgggacagcggtg

SEQ ID NO: 432918 - DNA, 140 bp, Artificial Sequence
  Synthetic
caccgctgtcccaaaaggtcggatcctaggctattggattgcgcttttcattgacttactgagtgatactttcaaccagtaagtccctgagtgtccagaccaagatgagtgcttctaaggcatatcagcagccagggcct

SEQ ID NO: 432919 - DNA, 140 bp, Artificial Sequence
  Synthetic
aggccctggctgctgatatgcggcccaaacaactctgaacatgtccttcccttcagtcttaggctgcccccacttgactgaatcataactctttgctttgatttactatagcaaagagcagaccttttgggacagcggtg

SEQ ID NO: 432920 - DNA, 140 bp, Artificial Sequence
  Synthetic
caccgctgtcccaaaaggtctgctctttgctatagtaaatcaaagcaaagagttatgattcagtcaagtgggggcagcctaagactgaagggaaggacatgttcagagttgtttgggccgcatatcagcagccagggcct

SEQ ID NO: 432921 - DNA, 140 bp, Artificial Sequence
  Synthetic
aggccctggctgctgatatgcacttgactgaatcataactctttgctttgatttactatagcaaagagcatagcctttgaaatcaatccattctccaagagattcaagaagttcactcaggaccttttgggacagcggtg

SEQ ID NO: 432922 - DNA, 140 bp, Artificial Sequence
  Synthetic
caccgctgtcccaaaaggtcctgagtgaacttcttgaatctcttggagaatggattgatttcaaaggctatgctctttgctatagtaaatcaaagcaaagagttatgattcagtcaagtgcatatcagcagccagggcct

SEQ ID NO: 432923 - DNA, 140 bp, Artificial Sequence
  Synthetic
aggccctggctgctgatatgccacacccgtccattgaatcctttgtttcaatctatcagacatcattgatttcaatgcaccaactaaaaggtgcggggaactatcaccaatctcccttacgaccttttgggacagcggtg

SEQ ID NO: 432924 - DNA, 140 bp, Artificial Sequence
  Synthetic
caccgctgtcccaaaaggtcgtaagggagattggtgatagttccccgcaccttttagttggtgcattgaaatcaatgatgtctgatagattgaaacaaaggattcaatggacgggtgtggcatatcagcagccagggcct

SEQ ID NO: 432925 - DNA, 140 bp, Artificial Sequence
  Synthetic
atacgccatgctgggtctcccgcaccggggatcctaggcaatttggttgttcttctttttgaggctttgtacgctgaactcttccaaatgggaaacaagcaatccaaagccccagaatcacgtacttgggagtcggccat

SEQ ID NO: 432926 - DNA, 140 bp, Artificial Sequence
  Synthetic
atggccgactcccaagtacgtgattctggggctttggattgcttgtttcccatttggaagagttcagcgtacaaagcctcaaaaagaagaacaaccaaattgcctaggatccccggtgcgggagacccagcatggcgtat

SEQ ID NO: 432927 - DNA, 140 bp, Artificial Sequence
  Synthetic
aggccctggctgctgatatgtccaccgttttagatctctttttgttgattccaatgaaactaatctatcgttaacactcacaaaacaggagcccagccaaccagtaaggagcttgtcaccgaccttttgggacagcggtg

SEQ ID NO: 432928 - DNA, 140 bp, Artificial Sequence
  Synthetic
caccgctgtcccaaaaggtcggtgacaagctccttactggttggctgggctcctgttttgtgagtgttaacgatagattagtttcattggaatcaacaaaaagagatctaaaacggtggacatatcagcagccagggcct

SEQ ID NO: 432929 - DNA, 140 bp, Artificial Sequence
  Synthetic
aggccctggctgctgatatgaacaggtgccccatttgcaagatgcctctccccacaaagctgagaccatcagccactccaacagcacctccaactagagcagcagacagcatcagaccccgaccttttgggacagcggtg

SEQ ID NO: 432930 - DNA, 140 bp, Artificial Sequence
  Synthetic
caccgctgtcccaaaaggtcggggtctgatgctgtctgctgctctagttggaggtgctgttggagtggctgatggtctcagctttgtggggagaggcatcttgcaaatggggcacctgttcatatcagcagccagggcct

SEQ ID NO: 432931 - DNA, 140 bp, Artificial Sequence
  Synthetic
atacgccatgctgggtctcctagtggcctttctgttctaatgaccttcgactttagtttctctaagtcagctgccaatgtcagcaggtcatctgaagtcaaggtcccaactctcaagatgcgtacttgggagtcggccat

SEQ ID NO: 432932 - DNA, 140 bp, Artificial Sequence
  Synthetic
atggccgactcccaagtacgcatcttgagagttgggaccttgacttcagatgacctgctgacattggcagctgacttagagaaactaaagtcgaaggtcattagaacagaaaggccactaggagacccagcatggcgtat

SEQ ID NO: 432933 - DNA, 140 bp, Artificial Sequence
  Synthetic
aggccctggctgctgatatgattctaggtgaccatttcatctttgtggaagctaaatcactcataaatggcaatatgtgcttctcaaatagagacggatataaacgtctcaaagagtgaagaccttttgggacagcggtg

SEQ ID NO: 432934 - DNA, 140 bp, Artificial Sequence
  Synthetic
caccgctgtcccaaaaggtcttcactctttgagacgtttatatccgtctctatttgagaagcacatattgccatttatgagtgatttagcttccacaaagatgaaatggtcacctagaatcatatcagcagccagggcct

SEQ ID NO: 432935 - DNA, 140 bp, Artificial Sequence
  Synthetic
atacgccatgctgggtctccaggcaattcagctgaacttcagtagtggggctcatcttagtgaatccctgaatcaaagtgcctagtcaaaatgggcaacagacaggccaaatcgacaaagcgtacttgggagtcggccat

SEQ ID NO: 432936 - DNA, 140 bp, Artificial Sequence
  Synthetic
atggccgactcccaagtacgctttgtcgatttggcctgtctgttgcccattttgactaggcactttgattcagggattcactaagatgagccccactactgaagttcagctgaattgcctggagacccagcatggcgtat

SEQ ID NO: 432937 - DNA, 140 bp, Artificial Sequence
  Synthetic
aggccctggctgctgatatgttgaaactagcatcttgacttttgacacggaacctcactgtctgactcaattttgcagaccctgaaggtagtgaagctacggcatcaaagaaatcctccagaccttttgggacagcggtg

SEQ ID NO: 432938 - DNA, 140 bp, Artificial Sequence
  Synthetic
caccgctgtcccaaaaggtctggaggatttctttgatgccgtagcttcactaccttcagggtctgcaaaattgagtcagacagtgaggttccgtgtcaaaagtcaagatgctagtttcaacatatcagcagccagggcct

SEQ ID NO: 432939 - DNA, 140 bp, Artificial Sequence
  Synthetic
atacgccatgctgggtctccaaagccaacttctgccttgacagcctctcattatctgcaaggtactttgagatgagatctttagcattggcaatgtcttcctccattaccatttgtggcacgtacttgggagtcggccat

SEQ ID NO: 432940 - DNA, 140 bp, Artificial Sequence
  Synthetic
atggccgactcccaagtacgtgccacaaatggtaatggaggaagacattgccaatgctaaagatctcatctcaaagtaccttgcagataatgagaggctgtcaaggcagaagttggctttggagacccagcatggcgtat

SEQ ID NO: 432941 - DNA, 140 bp, Artificial Sequence
  Synthetic
aggccctggctgctgatatgccatttgtggcacctgtgtttagtttgggtttgtgccgatgtgacttatgggtcagctggtgatgccccacagaagctcctacagaaatgagaatcaatagaccttttgggacagcggtg

SEQ ID NO: 432942 - DNA, 140 bp, Artificial Sequence
  Synthetic
caccgctgtcccaaaaggtctattgattctcatttctgtaggagcttctgtggggcatcaccagctgacccataagtcacatcggcacaaacccaaactaaacacaggtgccacaaatggcatatcagcagccagggcct

SEQ ID NO: 432943 - DNA, 140 bp, Artificial Sequence
  Synthetic
aggccctggctgctgatatgtaggattgcgcttttagagatctttgtgtgagtgggcttcatcaagccatgggacaaatcataacatttttccaggaagtacctcatgtcatagaggaaggaccttttgggacagcggtg

SEQ ID NO: 432944 - DNA, 140 bp, Artificial Sequence
  Synthetic
caccgctgtcccaaaaggtccttcctctatgacatgaggtacttcctggaaaaatgttatgatttgtcccatggcttgatgaagcccactcacacaaagatctctaaaagcgcaatcctacatatcagcagccagggcct

SEQ ID NO: 432945 - DNA, 140 bp, Artificial Sequence
  Synthetic
atacgccatgctgggtctcccgcaacaaatggcctcacataagactcaaaataaatttgcctcatgaaattgtcaacagcatcgctagtgctcactactctttcttccaccataggctcacgtacttgggagtcggccat

SEQ ID NO: 432946 - DNA, 140 bp, Artificial Sequence
  Synthetic
atggccgactcccaagtacgtgagcctatggtggaagaaagagtagtgagcactagcgatgctgttgacaatttcatgaggcaaatttattttgagtcttatgtgaggccatttgttgcgggagacccagcatggcgtat

SEQ ID NO: 432947 - DNA, 140 bp, Artificial Sequence
  Synthetic
aggccctggctgctgatatgtatccaagtaatcatagtgctcactgttgtttgcaaaacctcagctgaaaatattgctgggaaatatcttttaggatcagcataaaatgagcacacttcagaccttttgggacagcggtg

SEQ ID NO: 432948 - DNA, 140 bp, Artificial Sequence
  Synthetic
caccgctgtcccaaaaggtctgaagtgtgctcattttatgctgatcctaaaagatatttcccagcaatattttcagctgaggttttgcaaacaacagtgagcactatgattacttggatacatatcagcagccagggcct

SEQ ID NO: 432949 - DNA, 140 bp, Artificial Sequence
  Synthetic
atacgccatgctgggtctccggcgttcttcagacttttatgaggatggcttggggtggcagttacatagcacttgattccggaaaggggagttgggattgtataatgacttcctaccaatcgtacttgggagtcggccat

SEQ ID NO: 432950 - DNA, 140 bp, Artificial Sequence
  Synthetic
atggccgactcccaagtacgattggtaggaagtcattatacaatcccaactcccctttccggaatcaagtgctatgtaactgccaccccaagccatcctcataaaagtctgaagaacgccggagacccagcatggcgtat

SEQ ID NO: 432951 - DNA, 140 bp, Artificial Sequence
  Synthetic
aggccctggctgctgatatgactctgttaaattctgatcaaataatgatatctgatcgtcactggacgtgtaagcatcgatttgtcccccagacacacacctcaccgcaaaatttataaagaccttttgggacagcggtg

SEQ ID NO: 432952 - DNA, 140 bp, Artificial Sequence
  Synthetic
caccgctgtcccaaaaggtctttataaattttgcggtgaggtgtgtgtctgggggacaaatcgatgcttacacgtccagtgacgatcagatatcattatttgatcagaatttaacagagtcatatcagcagccagggcct

SEQ ID NO: 432953 - DNA, 140 bp, Artificial Sequence
  Synthetic
aggccctggctgctgatatggaagagaggtgctcactagacaaatagtttgttgtaaactcttcatggagttgcccagtcttcaacctattgtacagttttcttaacatagatctaatctgaccttttgggacagcggtg

SEQ ID NO: 432954 - DNA, 140 bp, Artificial Sequence
  Synthetic
caccgctgtcccaaaaggtcagattagatctatgttaagaaaactgtacaataggttgaagactgggcaactccatgaagagtttacaacaaactatttgtctagtgagcacctctcttccatatcagcagccagggcct

SEQ ID NO: 432955 - DNA, 140 bp, Artificial Sequence
  Synthetic
aggccctggctgctgatatgtcaattgttcagataactctgtgcactcttctatccagctgaccataacatcgactactttctgcaacacatcactggagaaaactgaaggaaaaaaccggaccttttgggacagcggtg

SEQ ID NO: 432956 - DNA, 140 bp, Artificial Sequence
  Synthetic
caccgctgtcccaaaaggtccggttttttccttcagttttctccagtgatgtgttgcagaaagtagtcgatgttatggtcagctggatagaagagtgcacagagttatctgaacaattgacatatcagcagccagggcct

SEQ ID NO: 432957 - DNA, 140 bp, Artificial Sequence
  Synthetic
aggccctggctgctgatatggtcaaaataccaactcataggcatattgtaggcaagtcgtgtcctaaacctcacagattgaatcacatgggcatatgttcctgtggactctacaaacagcgaccttttgggacagcggtg

SEQ ID NO: 432958 - DNA, 140 bp, Artificial Sequence
  Synthetic
caccgctgtcccaaaaggtcgctgtttgtagagtccacaggaacatatgcccatgtgattcaatctgtgaggtttaggacacgacttgcctacaatatgcctatgagttggtattttgaccatatcagcagccagggcct

SEQ ID NO: 432959 - DNA, 140 bp, Artificial Sequence
  Synthetic
aggccctggctgctgatatgatgcctctttgcatctgaccacttgatatcttgctggaccaaattcattctgtctcagttttacggtggaagaagttttcatggagttcaccaaggcaaggaccttttgggacagcggtg

SEQ ID NO: 432960 - DNA, 140 bp, Artificial Sequence
  Synthetic
caccgctgtcccaaaaggtccttgccttggtgaactccatgaaaacttcttccaccgtaaaactgagacagaatgaatttggtccagcaagatatcaagtggtcagatgcaaagaggcatcatatcagcagccagggcct

SEQ ID NO: 432961 - DNA, 140 bp, Artificial Sequence
  Synthetic
aggccctggctgctgatatgtaagcatcaatttgtcctccagacacacacttcaccgcaaaatttataaatctttcagaaatcaatgcataaaagtctgaggtgttgtgcaggataccctgaccttttgggacagcggtg

SEQ ID NO: 432962 - DNA, 140 bp, Artificial Sequence
  Synthetic
caccgctgtcccaaaaggtcagggtatcctgcacaacacctcagacttttatgcattgatttctgaaagatttataaattttgcggtgaagtgtgtgtctggaggacaaattgatgcttacatatcagcagccagggcct

SEQ ID NO: 432963 - DNA, 140 bp, Artificial Sequence
  Synthetic
atacgccatgctgggtctcctccccatggtgtaagggaacatttcctcctctgatctctggtaactgattgtagggatagccccagagacatcaaaatccattatcaagtcataaccattcgtacttgggagtcggccat

SEQ ID NO: 432964 - DNA, 140 bp, Artificial Sequence
  Synthetic
atggccgactcccaagtacgaatggttatgacttgataatggattttgatgtctctggggctatccctacaatcagttaccagagatcagaggaggaaatgttcccttacaccatggggaggagacccagcatggcgtat

SEQ ID NO: 432965 - DNA, 140 bp, Artificial Sequence
  Synthetic
aggccctggctgctgatatggtagggatagccccagagacatcaaaatccattatcaagtcataaccattagggcaaaccacctccatatcaatcttatagtggtctacactgatcccaagaccttttgggacagcggtg

SEQ ID NO: 432966 - DNA, 140 bp, Artificial Sequence
  Synthetic
caccgctgtcccaaaaggtcttgggatcagtgtagaccactataagattgatatggaggtggtttgccctaatggttatgacttgataatggattttgatgtctctggggctatccctaccatatcagcagccagggcct

SEQ ID NO: 432967 - DNA, 140 bp, Artificial Sequence
  Synthetic
aggccctggctgctgatatgtactgatcgacaattttttcaacagtctcttttagctgatcaaaataatcgcttgcacctccatcgagcaaaatttcatctaggtcagctccatcaacatgaccttttgggacagcggtg

SEQ ID NO: 432968 - DNA, 140 bp, Artificial Sequence
  Synthetic
caccgctgtcccaaaaggtcatgttgatggagctgacctagatgaaattttgctcgatggaggtgcaagcgattattttgatcagctaaaagagactgttgaaaaaattgtcgatcagtacatatcagcagccagggcct

SEQ ID NO: 432969 - DNA, 140 bp, Artificial Sequence
  Synthetic
aggccctggctgctgatatgactttgtattcatagtcctgcttgttgagaaggtactttccttttcttgagaagacttcagtgagctgcgacacggccagtgctgtgagcttattgaagtgaccttttgggacagcggtg

SEQ ID NO: 432970 - DNA, 140 bp, Artificial Sequence
  Synthetic
caccgctgtcccaaaaggtcacttcaataagctcacagcactggccgtgtcgcagctcactgaagtcttctcaagaaaaggaaagtaccttctcaacaagcaggactatgaatacaaagtcatatcagcagccagggcct

SEQ ID NO: 432971 - DNA, 140 bp, Artificial Sequence
  Synthetic
aggccctggctgctgatatgccaagtttgaccagaacaaattgatcgcatcaggattagtcaattctaaatatgactcacttgaggacttctttgacgccatagaatcactgcctccagggaccttttgggacagcggtg

SEQ ID NO: 432972 - DNA, 140 bp, Artificial Sequence
  Synthetic
caccgctgtcccaaaaggtccctggaggcagtgattctatggcgtcaaagaagtcctcaagtgagtcatatttagaattgactaatcctgatgcgatcaatttgttctggtcaaacttggcatatcagcagccagggcct

SEQ ID NO: 432973 - DNA, 140 bp, Artificial Sequence
  Synthetic
aggccctggctgctgatatgtgtgatgtgagtgcttcaaagtaatcctcaatgagccttgtgaacatctttgtccttaaatctccgatgtacaactctctattgcctcccacttgttcctgaccttttgggacagcggtg

SEQ ID NO: 432974 - DNA, 140 bp, Artificial Sequence
  Synthetic
caccgctgtcccaaaaggtcaggaacaagtgggaggcaatagagagttgtacatcggagatttaaggacaaagatgttcacaaggctcattgaggattactttgaagcactcacatcacacatatcagcagccagggcct

SEQ ID NO: 432975 - DNA, 140 bp, Artificial Sequence
  Synthetic
aggccctggctgctgatatgtttctgatgacattgaacaacaagcagacaacatgataacagaaatgttgcaaaaggagtacatagataggcaagggaaaacacccttagggttagtagagaccttttgggacagcggtg

SEQ ID NO: 432976 - DNA, 140 bp, Artificial Sequence
  Synthetic
caccgctgtcccaaaaggtctctactaaccctaagggtgttttcccttgcctatctatgtactccttttgcaacatttctgttatcatgttgtctgcttgttgttcaatgtcatcagaaacatatcagcagccagggcct

SEQ ID NO: 432977 - DNA, 140 bp, Artificial Sequence
  Synthetic
atacgccatgctgggtctcccttcagtggtgaggcttttcttagtgaatccccaaatcaaagtacccagtaagatgggcaacagacaggctaaatcgacaaaagtcgatgaacatcaaagcgtacttgggagtcggccat

SEQ ID NO: 432978 - DNA, 140 bp, Artificial Sequence
  Synthetic
atggccgactcccaagtacgctttgatgttcatcgacttttgtcgatttagcctgtctgttgcccatcttactgggtactttgatttggggattcactaagaaaagcctcaccactgaagggagacccagcatggcgtat

SEQ ID NO: 432979 - DNA, 140 bp, Artificial Sequence
  Synthetic
atacgccatgctgggtctccgtctcttttgtaataaaatgacacatgtaagagatgtttaaaacaaatttaaacctattggtcatcatactaacaacttcatcagacaaaattattcttacgtacttgggagtcggccat

SEQ ID NO: 432980 - DNA, 140 bp, Artificial Sequence
  Synthetic
atggccgactcccaagtacgtaagaataattttgtctgatgaagttgttagtatgatgaccaataggtttaaatttgttttaaacatctcttacatgtgtcattttattacaaaagagacggagacccagcatggcgtat

SEQ ID NO: 432981 - DNA, 140 bp, Artificial Sequence
  Synthetic
aggccctggctgctgatatgggggaccccccgccgggggcccccccgggggggcaggcaacccagctctactcaatgtcctcgacacacctctctggcccaaacaactccgaacatgtccgaccttttgggacagcggtg

SEQ ID NO: 432982 - DNA, 140 bp, Artificial Sequence
  Synthetic
caccgctgtcccaaaaggtcggacatgttcggagttgtttgggccagagaggtgtgtcgaggacattgagtagagctgggttgcctgcccccccgggggggcccccggcggggggtcccccatatcagcagccagggcct

SEQ ID NO: 432983 - DNA, 140 bp, Artificial Sequence
  Synthetic
aggccctggctgctgatatgcctttcaacctgctgccttcgctcaacccatttctttagatccctttttgttgattctagcgaaaccagtctgtcattaacactcatgaagcaggatcccgaccttttgggacagcggtg

SEQ ID NO: 432984 - DNA, 140 bp, Artificial Sequence
  Synthetic
caccgctgtcccaaaaggtcgggatcctgcttcatgagtgttaatgacagactggtttcgctagaatcaacaaaaagggatctaaagaaatgggttgagcgaaggcagcaggttgaaaggcatatcagcagccagggcct

SEQ ID NO: 432985 - DNA, 140 bp, Artificial Sequence
  Synthetic
aggccctggctgctgatatgcctttccttgccagaatccaaatctgcatacaagaacttaaggactggagaggctcttcggaactggaatgttaactgttcaatgttgtcatcacaggtggaccttttgggacagcggtg

SEQ ID NO: 432986 - DNA, 140 bp, Artificial Sequence
  Synthetic
caccgctgtcccaaaaggtccacctgtgatgacaacattgaacagttaacattccagttccgaagagcctctccagtccttaagttcttgtatgcagatttggattctggcaaggaaaggcatatcagcagccagggcct

SEQ ID NO: 432987 - DNA, 140 bp, Artificial Sequence
  Synthetic
aggccctggctgctgatatgtggtgtcctttcttctcttatgtggaagatcatgttcaacaacttacaagggtgtttatgagctacaaactctggagctggacatggcaagccttaatatgaccttttgggacagcggtg

SEQ ID NO: 432988 - DNA, 140 bp, Artificial Sequence
  Synthetic
caccgctgtcccaaaaggtcatattaaggcttgccatgtccagctccagagtttgtagctcataaacacccttgtaagttgttgaacatgatcttccacataagagaagaaaggacaccacatatcagcagccagggcct

SEQ ID NO: 432989 - DNA, 140 bp, Artificial Sequence
  Synthetic
atacgccatgctgggtctcctctgttctctgataactgattgtgggaacaattccggagacatcaaaatccataatcaaatcataactattaaggcaaaccacctccatgtcaattttatcgtacttgggagtcggccat

SEQ ID NO: 432990 - DNA, 140 bp, Artificial Sequence
  Synthetic
atggccgactcccaagtacgataaaattgacatggaggtggtttgccttaatagttatgatttgattatggattttgatgtctccggaattgttcccacaatcagttatcagagaacagaggagacccagcatggcgtat

SEQ ID NO: 432991 - DNA, 140 bp, Artificial Sequence
  Synthetic
aggccctggctgctgatatgcttagaagcactcatcttggtctggacacttggaatttactgattgattgaaagtatcactcagtaagtcaatgaaaggcgcaatccaatagcctaggatgaccttttgggacagcggtg

SEQ ID NO: 432992 - DNA, 140 bp, Artificial Sequence
  Synthetic
caccgctgtcccaaaaggtcatcctaggctattggattgcgcctttcattgacttactgagtgatactttcaatcaatcagtaaattccaagtgtccagaccaagatgagtgcttctaagcatatcagcagccagggcct

SEQ ID NO: 432993 - DNA, 140 bp, Artificial Sequence
  Synthetic
aggccctggctgctgatatgtcctttgaggcactcattgccagattgttgtgctggatgcacgcagcggaaaactgagactatctgccaaaatgacaaaagcaaagcgcaatccaatagcgaccttttgggacagcggtg

SEQ ID NO: 432994 - DNA, 140 bp, Artificial Sequence
  Synthetic
caccgctgtcccaaaaggtcgctattggattgcgctttgcttttgtcattttggcagatagtctcagttttccgctgcgtgcatccagcacaacaatctggcaatgagtgcctcaaaggacatatcagcagccagggcct

SEQ ID NO: 432995 - DNA, 140 bp, Artificial Sequence
  Synthetic
atacgccatgctgggtctccggccatcatgaaatatctaatattctgtagaaatttctgacaccttttactaggatgtgttaatatcaaaactaagatcattttggtcagtaacttaatacgtacttgggagtcggccat

SEQ ID NO: 432996 - DNA, 140 bp, Artificial Sequence
  Synthetic
atggccgactcccaagtacgtattaagttactgaccaaaatgatcttagttttgatattaacacatcctagtaaaaggtgtcagaaatttctacagaatattagatatttcatgatggccggagacccagcatggcgtat

SEQ ID NO: 432997 - DNA, 140 bp, Artificial Sequence
  Synthetic
atacgccatgctgggtctcccctgtgttgggtctgggtttgtgccaatgtgacttgtgggtcaagtggtgatgccccacaaaagttcctacagaaatgagagacaatatgcctaggatcccgtacttgggagtcggccat

SEQ ID NO: 432998 - DNA, 140 bp, Artificial Sequence
  Synthetic
atggccgactcccaagtacgggatcctaggcatattgtctctcatttctgtaggaacttttgtggggcatcaccacttgacccacaagtcacattggcacaaacccagacccaacacaggggagacccagcatggcgtat

SEQ ID NO: 432999 - DNA, 140 bp, Artificial Sequence
  Synthetic
aggccctggctgctgatatgtcctcaaagacttcactttgtttaggaatgatctccagcattgcatctgacactcagcagcagtttggttccttttcttaccatccccctcaccaaaatcgaccttttgggacagcggtg

SEQ ID NO: 433000 - DNA, 140 bp, Artificial Sequence
  Synthetic
caccgctgtcccaaaaggtcgattttggtgagggggatggtaagaaaaggaaccaaactgctgctgagtgtcagatgcaatgctggagatcattcctaaacaaagtgaagtctttgaggacatatcagcagccagggcct

SEQ ID NO: 433001 - DNA, 140 bp, Artificial Sequence
  Synthetic
atacgccatgctgggtctccttcaattgctctaattttttgaagtcctcaatgtacttctgctcaaagttagcaggagatgacctaacaaaacactccagcagtattagaacattgcccgcgtacttgggagtcggccat

SEQ ID NO: 433002 - DNA, 140 bp, Artificial Sequence
  Synthetic
atggccgactcccaagtacgcgggcaatgttctaatactgctggagtgttttgttaggtcatctcctgctaactttgagcagaagtacattgaggacttcaaaaaattagagcaattgaaggagacccagcatggcgtat

SEQ ID NO: 433003 - DNA, 140 bp, Artificial Sequence
  Synthetic
aggccctggctgctgatatgccatggtcatggagaattctttccacagatttgtcctcactattatgctcgcaaccatttgcgttgcaagaatcaacctcaatacagagggacaagagttgaccttttgggacagcggtg

SEQ ID NO: 433004 - DNA, 140 bp, Artificial Sequence
  Synthetic
caccgctgtcccaaaaggtcaactcttgtccctctgtattgaggttgattcttgcaacgcaaatggttgcgagcataatagtgaggacaaatctgtggaaagaattctccatgaccatggcatatcagcagccagggcct

SEQ ID NO: 433005 - DNA, 140 bp, Artificial Sequence
  Synthetic
aggccctggctgctgatatgtggtgaaactttccatatctggattccattgtcccccatcactgcctcaacaccttgaatccctaatagctgagtctgtatggatctaatgtaaagattcgaccttttgggacagcggtg

SEQ ID NO: 433006 - DNA, 140 bp, Artificial Sequence
  Synthetic
caccgctgtcccaaaaggtcgaatctttacattagatccatacagactcagctattagggattcaaggtgttgaggcagtgatgggggacaatggaatccagatatggaaagtttcaccacatatcagcagccagggcct

SEQ ID NO: 433007 - DNA, 140 bp, Artificial Sequence
  Synthetic
aggccctggctgctgatatgtcaacccttccattagtagcatcctaggctctgtctgtacaagaaatgctaacttctgtctagataatctctcattgtccactagatactttgatactaagaccttttgggacagcggtg

SEQ ID NO: 433008 - DNA, 140 bp, Artificial Sequence
  Synthetic
caccgctgtcccaaaaggtcttagtatcaaagtatctagtggacaatgagagattatctagacagaagttagcatttcttgtacagacagagcctaggatgctactaatggaagggttgacatatcagcagccagggcct

SEQ ID NO: 433009 - DNA, 140 bp, Artificial Sequence
  Synthetic
atacgccatgctgggtctccgaccatgctttaatgagtatcatctcaacctttcatttatccattcccaactttaaccagtatgaagcaatgagttgtgacttcaatgggggaaagataacgtacttgggagtcggccat

SEQ ID NO: 433010 - DNA, 140 bp, Artificial Sequence
  Synthetic
atggccgactcccaagtacgttatctttcccccattgaagtcacaactcattgcttcatactggttaaagttgggaatggataaatgaaaggttgagatgatactcattaaagcatggtcggagacccagcatggcgtat

SEQ ID NO: 433011 - DNA, 140 bp, Artificial Sequence
  Synthetic
aggccctggctgctgatatgatctccaacattgcatctgttcactttgagagtcagcagccctttctttaccagaatccaaatctgcatacaagaacttaaggactggagaggctcttcggaccttttgggacagcggtg

SEQ ID NO: 433012 - DNA, 140 bp, Artificial Sequence
  Synthetic
caccgctgtcccaaaaggtccgaagagcctctccagtccttaagttcttgtatgcagatttggattctggtaaagaaagggctgctgactctcaaagtgaacagatgcaatgttggagatcatatcagcagccagggcct

SEQ ID NO: 433013 - DNA, 140 bp, Artificial Sequence
  Synthetic
atacgccatgctgggtctccgtcagaaccctcaaaacatgtgatctgctagagcaacagttcaccacaggccagggtcccgtggggggcacaagggatacaagaggcaattaaagacaatcgtacttgggagtcggccat

SEQ ID NO: 433014 - DNA, 140 bp, Artificial Sequence
  Synthetic
atggccgactcccaagtacgattgtctttaattgcctcttgtatcccttgtgccccccacgggaccctggcctgtggtgaactgttgctctagcagatcacatgttttgagggttctgacggagacccagcatggcgtat

SEQ ID NO: 433015 - DNA, 140 bp, Artificial Sequence
  Synthetic
aggccctggctgctgatatggttcaccacaggccagggtcccgtggggggcacaagggatacaagaggcaattaaagacaattaaattagatagccttaatgcctaggatcctcggtgcggaccttttgggacagcggtg

SEQ ID NO: 433016 - DNA, 140 bp, Artificial Sequence
  Synthetic
caccgctgtcccaaaaggtccgcaccgaggatcctaggcattaaggctatctaatttaattgtctttaattgcctcttgtatcccttgtgccccccacgggaccctggcctgtggtgaaccatatcagcagccagggcct

SEQ ID NO: 433017 - DNA, 140 bp, Artificial Sequence
  Synthetic
aggccctggctgctgatatgccccccggggggaccccccgccgggggcccccccgggggagccaaccatcaccaaaagactactcaatgtcctcgatacattcatctttcctagtcaactgaccttttgggacagcggtg

SEQ ID NO: 433018 - DNA, 140 bp, Artificial Sequence
  Synthetic
caccgctgtcccaaaaggtcagttgactaggaaagatgaatgtatcgaggacattgagtagtcttttggtgatggttggctcccccgggggggcccccggcggggggtccccccggggggcatatcagcagccagggcct

SEQ ID NO: 433019 - DNA, 140 bp, Artificial Sequence
  Synthetic
atacgccatgctgggtctccggtgttccatgctgtctttcgcagccatcttgtcagcgtacaggttgttaaactcattgagtaactggctcttctcagccctcaaaaattgactttctatcgtacttgggagtcggccat

SEQ ID NO: 433020 - DNA, 140 bp, Artificial Sequence
  Synthetic
atggccgactcccaagtacgatagaaagtcaatttttgagggctgagaagagccagttactcaatgagtttaacaacctgtacgctgacaagatggctgcgaaagacagcatggaacaccggagacccagcatggcgtat

SEQ ID NO: 433021 - DNA, 140 bp, Artificial Sequence
  Synthetic
atacgccatgctgggtctcctaagattgtttgactttaacaaacaagctataaggaggttgaagacagaagcacagatgagcatccaactgataaacaaagcagtgaacgcactaattaacgtacttgggagtcggccat

SEQ ID NO: 433022 - DNA, 140 bp, Artificial Sequence
  Synthetic
atggccgactcccaagtacgttaattagtgcgttcactgctttgtttatcagttggatgctcatctgtgcttctgtcttcaacctccttatagcttgtttgttaaagtcaaacaatcttaggagacccagcatggcgtat

SEQ ID NO: 433023 - DNA, 140 bp, Artificial Sequence
  Synthetic
aggccctggctgctgatatgaactcattgagtaactggctcttctcagccctcaaaaattgactttctatttctcctttccttagtctattcctaaacacttgatactcttcttcaatctgaccttttgggacagcggtg

SEQ ID NO: 433024 - DNA, 140 bp, Artificial Sequence
  Synthetic
caccgctgtcccaaaaggtcagattgaagaagagtatcaagtgtttaggaatagactaaggaaaggagaaatagaaagtcaatttttgagggctgagaagagccagttactcaatgagttcatatcagcagccagggcct

SEQ ID NO: 433025 - DNA, 140 bp, Artificial Sequence
  Synthetic
aggccctggctgctgatatgggcacctgtgttggatttggatttgtgccaatatggcttgcgggtcagctggtgatgctccacaaaagctcccacagaaatgagagacaatatgcctagggaccttttgggacagcggtg

SEQ ID NO: 433026 - DNA, 140 bp, Artificial Sequence
  Synthetic
caccgctgtcccaaaaggtccctaggcatattgtctctcatttctgtgggagcttttgtggagcatcaccagctgacccgcaagccatattggcacaaatccaaatccaacacaggtgcccatatcagcagccagggcct

SEQ ID NO: 433027 - DNA, 140 bp, Artificial Sequence
  Synthetic
atacgccatgctgggtctcctcttcccaccaagctagaggcaacgacacagccgagcgcaccatcaaccgaggagacccagagcacaacacctccaccgtacaccccgtgatcccaggaccgtacttgggagtcggccat

SEQ ID NO: 433028 - DNA, 140 bp, Artificial Sequence
  Synthetic
atggccgactcccaagtacggtcctgggatcacggggtgtacggtggaggtgttgtgctctgggtctcctcggttgatggtgcgctcggctgtgtcgttgcctctagcttggtgggaagaggagacccagcatggcgtat

SEQ ID NO: 433029 - DNA, 140 bp, Artificial Sequence
  Synthetic
aggccctggctgctgatatgcccccggggggaccccccgccgggggcccccccggggggcgggcaacccagctctattcaatgtcttcaacacacctctccggcccaaacaactctgaacgaccttttgggacagcggtg

SEQ ID NO: 433030 - DNA, 140 bp, Artificial Sequence
  Synthetic
caccgctgtcccaaaaggtcgttcagagttgtttgggccggagaggtgtgttgaagacattgaatagagctgggttgcccgccccccgggggggcccccggcggggggtccccccgggggcatatcagcagccagggcct

SEQ ID NO: 433031 - DNA, 140 bp, Artificial Sequence
  Synthetic
aggccctggctgctgatatgtagggagaaccgctcttaaaactggtatgttgagtcctcctgacacagctgcatcatacataatgcagtccattaaagcgcaatgtggtgtgatttcttcgaccttttgggacagcggtg

SEQ ID NO: 433032 - DNA, 140 bp, Artificial Sequence
  Synthetic
caccgctgtcccaaaaggtcgaagaaatcacaccacattgcgctttaatggactgcattatgtatgatgcagctgtgtcaggaggactcaacataccagttttaagagcggttctccctacatatcagcagccagggcct

SEQ ID NO: 433033 - DNA, 140 bp, Artificial Sequence
  Synthetic
aggccctggctgctgatatgtccaactgataaacaaagcagtgaacgcactgatcaatgaccagctgattatgaagaatcatttgagagatatcatgggaattccttactgcaattacaggaccttttgggacagcggtg

SEQ ID NO: 433034 - DNA, 140 bp, Artificial Sequence
  Synthetic
caccgctgtcccaaaaggtcctgtaattgcagtaaggaattcccatgatatctctcaaatgattcttcataatcagctggtcattgatcagtgcgttcactgctttgtttatcagttggacatatcagcagccagggcct

SEQ ID NO: 433035 - DNA, 140 bp, Artificial Sequence
  Synthetic
aggccctggctgctgatatggccttgcttagtgcaatatcgataagctttatgtctcttctcccttgagaatccaaaagtttcttaatgtcatctgagccttgacaggtcagcaccatatgaccttttgggacagcggtg

SEQ ID NO: 433036 - DNA, 140 bp, Artificial Sequence
  Synthetic
caccgctgtcccaaaaggtcatatggtgctgacctgtcaaggctcagatgacattaagaaacttttggattctcaagggagaagagacataaagcttatcgatattgcactaagcaaggccatatcagcagccagggcct

SEQ ID NO: 433037 - DNA, 140 bp, Artificial Sequence
  Synthetic
atacgccatgctgggtctcctcaatatgacaatgcccttatcctgcacgaagaataacagccaccactacattatggttggaaatgagactggcttggagctaactttaacaaacacaagcgtacttgggagtcggccat

SEQ ID NO: 433038 - DNA, 140 bp, Artificial Sequence
  Synthetic
atggccgactcccaagtacgcttgtgtttgttaaagttagctccaagccagtctcatttccaaccataatgtagtggtggctgttattcttcgtgcaggataagggcattgtcatattgaggagacccagcatggcgtat

SEQ ID NO: 433039 - DNA, 140 bp, Artificial Sequence
  Synthetic
atacgccatgctgggtctccgaagcaatcacttcttcataatggttagagcgattgtctaacaaaacattcagactctccactcctgacagtcttcctaaggtcatggataaagattcaccgtacttgggagtcggccat

SEQ ID NO: 433040 - DNA, 140 bp, Artificial Sequence
  Synthetic
atggccgactcccaagtacggtgaatctttatccatgaccttaggaagactgtcaggagtggagagtctgaatgttttgttagacaatcgctctaaccattatgaagaagtgattgcttcggagacccagcatggcgtat

SEQ ID NO: 433041 - DNA, 140 bp, Artificial Sequence
  Synthetic
aggccctggctgctgatatgtgttctcataagggttcctctcaccaggtgtatctgaaacaaacattcccaaagatcttttcacctttaaaatagacttcaagatgccatccattgtctggaccttttgggacagcggtg

SEQ ID NO: 433042 - DNA, 140 bp, Artificial Sequence
  Synthetic
caccgctgtcccaaaaggtccagacaatggatggcatcttgaagtctattttaaaggtgaaaagatctttgggaatgtttgtttcagatacacctggtgagaggaacccttatgagaacacatatcagcagccagggcct

SEQ ID NO: 433043 - DNA, 140 bp, Artificial Sequence
  Synthetic
aggccctggctgctgatatgcagactctccactcctgacagtcttcctaaggtcatggataaagattcacaaagcctactatactctgactcctcaaaaagggaattgctctcctgagcagaccttttgggacagcggtg

SEQ ID NO: 433044 - DNA, 140 bp, Artificial Sequence
  Synthetic
caccgctgtcccaaaaggtctgctcaggagagcaattccctttttgaggagtcagagtatagtaggctttgtgaatctttatccatgaccttaggaagactgtcaggagtggagagtctgcatatcagcagccagggcct

SEQ ID NO: 433045 - DNA, 140 bp, Artificial Sequence
  Synthetic
aggccctggctgctgatatgttattgagttgatcactcatgtaataatggaattctattagagtcttaaattcttccggatctctttgcaggagttctgtgagagtttgatcaaagagaggaccttttgggacagcggtg

SEQ ID NO: 433046 - DNA, 140 bp, Artificial Sequence
  Synthetic
caccgctgtcccaaaaggtcctctctttgatcaaactctcacagaactcctgcaaagagatccggaagaatttaagactctaatagaattccattattacatgagtgatcaactcaataacatatcagcagccagggcct

SEQ ID NO: 433047 - DNA, 140 bp, Artificial Sequence
  Synthetic
atacgccatgctgggtctccctttggaagcactcatcttgatcttgacactctgggatttactggtagaaagtatcacccaataagtcaatgaaaagcgcaatccaatagcctaggatcccgtacttgggagtcggccat

SEQ ID NO: 433048 - DNA, 140 bp, Artificial Sequence
  Synthetic
atggccgactcccaagtacgggatcctaggctattggattgcgcttttcattgacttattgggtgatactttctaccagtaaatcccagagtgtcaagatcaagatgagtgcttccaaagggagacccagcatggcgtat

SEQ ID NO: 433049 - DNA, 140 bp, Artificial Sequence
  Synthetic
atacgccatgctgggtctccaggtatttgctcattataaaatgatgttctcccgtctatgagtggtattaaattgatgtcgacactcttcaaatcttcctttagctgctctaacttcttgcgtacttgggagtcggccat

SEQ ID NO: 433050 - DNA, 140 bp, Artificial Sequence
  Synthetic
atggccgactcccaagtacgcaagaagttagagcagctaaaggaagatttgaagagtgtcgacatcaatttaataccactcatagacgggagaacatcattttataatgagcaaatacctggagacccagcatggcgtat

SEQ ID NO: 433051 - DNA, 140 bp, Artificial Sequence
  Synthetic
aggccctggctgctgatatgaatcggacacaaaggccatcacaaagtacctaatgttttgtaaaaatttttgacaccttttactaggatgtgtcagtatcaaaactaaaatcattttggtgaccttttgggacagcggtg

SEQ ID NO: 433052 - DNA, 140 bp, Artificial Sequence
  Synthetic
caccgctgtcccaaaaggtcaccaaaatgattttagttttgatactgacacatcctagtaaaaggtgtcaaaaatttttacaaaacattaggtactttgtgatggcctttgtgtccgattcatatcagcagccagggcct

SEQ ID NO: 433053 - DNA, 140 bp, Artificial Sequence
  Synthetic
atacgccatgctgggtctccgtggcatagatctttgcattgatcccaaacaacattttcaaatttcctggagtcagctttgcttagtgcaatgtcgataagctttatgtctcttctccctcgtacttgggagtcggccat

SEQ ID NO: 433054 - DNA, 140 bp, Artificial Sequence
  Synthetic
atggccgactcccaagtacgagggagaagagacataaagcttatcgacattgcactaagcaaagctgactccaggaaatttgaaaatgttgtttgggatcaatgcaaagatctatgccacggagacccagcatggcgtat

SEQ ID NO: 433055 - DNA, 140 bp, Artificial Sequence
  Synthetic
atacgccatgctgggtctcctcccatctgggcccccaattctgcaagagttgctggtttgagaacagagggttggtggagtgcaacaaccactacttatgtctcaactgtctcagcttaccgtacttgggagtcggccat

SEQ ID NO: 433056 - DNA, 140 bp, Artificial Sequence
  Synthetic
atggccgactcccaagtacggtaagctgagacagttgagacataagtagtggttgttgcactccaccaaccctctgttctcaaaccagcaactcttgcagaattgggggcccagatgggaggagacccagcatggcgtat

SEQ ID NO: 433057 - DNA, 140 bp, Artificial Sequence
  Synthetic
aggccctggctgctgatatggttggtggagtgcaacaaccactacttatgtctcaactgtctcagcttactcctcagcgtcagtagcaggtgccccatttgcaaaatgcctcttcccactgaccttttgggacagcggtg

SEQ ID NO: 433058 - DNA, 140 bp, Artificial Sequence
  Synthetic
caccgctgtcccaaaaggtcagtgggaagaggcattttgcaaatggggcacctgctactgacgctgaggagtaagctgagacagttgagacataagtagtggttgttgcactccaccaaccatatcagcagccagggcct

SEQ ID NO: 433059 - DNA, 140 bp, Artificial Sequence
  Synthetic
atacgccatgctgggtctccgaacacaacacctccaccatacaccccatgatcccaagaccaacactcccatcctcacctcccaccccccacccccggggggaccccccgccgggggccccgtacttgggagtcggccat

SEQ ID NO: 433060 - DNA, 140 bp, Artificial Sequence
  Synthetic
atggccgactcccaagtacggggcccccggcggggggtccccccgggggtggggggtgggaggtgaggatgggagtgttggtcttgggatcatggggtgtatggtggaggtgttgtgttcggagacccagcatggcgtat

SEQ ID NO: 433061 - DNA, 140 bp, Artificial Sequence
  Synthetic
aggccctggctgctgatatgctgagacgtttcagatcactgtcatcccttttttgtttgcgcattaagcgctgcacattgctgacttcagaaaagtcaagaccatgaaggagagcctgaggaccttttgggacagcggtg

SEQ ID NO: 433062 - DNA, 140 bp, Artificial Sequence
  Synthetic
caccgctgtcccaaaaggtcctcaggctctccttcatggtcttgacttttctgaagtcagcaatgtgcagcgcttaatgcgcaaacaaaaaagggatgacagtgatctgaaacgtctcagcatatcagcagccagggcct

SEQ ID NO: 433063 - DNA, 140 bp, Artificial Sequence
  Synthetic
atacgccatgctgggtctccccccggggggcgggcagctcggctctactcgatatcctcaatacacctctccggcccaaacaattccgaacatgtcctcccctttagtcttaggctgcctcgtacttgggagtcggccat

SEQ ID NO: 433064 - DNA, 140 bp, Artificial Sequence
  Synthetic
atggccgactcccaagtacgaggcagcctaagactaaaggggaggacatgttcggaattgtttgggccggagaggtgtattgaggatatcgagtagagccgagctgcccgccccccggggggagacccagcatggcgtat

SEQ ID NO: 433065 - DNA, 140 bp, Artificial Sequence
  Synthetic
aggccctggctgctgatatgcatccttaacaacttgaagttttatgttggagcagtaacctgaaagctccctcctcaatgactgtgtccagaggaatgacttcacttccttagaagcactgaccttttgggacagcggtg

SEQ ID NO: 433066 - DNA, 140 bp, Artificial Sequence
  Synthetic
caccgctgtcccaaaaggtcagtgcttctaaggaagtgaagtcattcctctggacacagtcattgaggagggagctttcaggttactgctccaacataaaacttcaagttgttaaggatgcatatcagcagccagggcct

SEQ ID NO: 433067 - DNA, 140 bp, Artificial Sequence
  Synthetic
aggccctggctgctgatatgtcctaggcatttaggattgcgcttttagagatctttgtgtgagtgggcttcattaagccatgggacaaatcataacatttttccaggaagtacctcatgtgaccttttgggacagcggtg

SEQ ID NO: 433068 - DNA, 140 bp, Artificial Sequence
  Synthetic
caccgctgtcccaaaaggtcacatgaggtacttcctggaaaaatgttatgatttgtcccatggcttaatgaagcccactcacacaaagatctctaaaagcgcaatcctaaatgcctaggacatatcagcagccagggcct

SEQ ID NO: 433069 - DNA, 140 bp, Artificial Sequence
  Synthetic
atacgccatgctgggtctcccttctatcagattcccacagtgctcccctgcacacaactaatggcactggttcatcatcaggtccgaccttggagaagtcaaactcagtaaattgcagttcgtacttgggagtcggccat

SEQ ID NO: 433070 - DNA, 140 bp, Artificial Sequence
  Synthetic
atggccgactcccaagtacgaactgcaatttactgagtttgacttctccaaggtcggacctgatgatgaaccagtgccattagttgtgtgcaggggagcactgtgggaatctgatagaagggagacccagcatggcgtat

SEQ ID NO: 433071 - DNA, 140 bp, Artificial Sequence
  Synthetic
aggccctggctgctgatatgcaagaagaatcagaacgtcaaaaataaggagaagtttcctcctggtgttgaggatcctcagagactttatcttatttagaaaagatctccaacactgcatgaccttttgggacagcggtg

SEQ ID NO: 433072 - DNA, 140 bp, Artificial Sequence
  Synthetic
caccgctgtcccaaaaggtcatgcagtgttggagatcttttctaaataagataaagtctctgaggatcctcaacaccaggaggaaacttctccttatttttgacgttctgattcttcttgcatatcagcagccagggcct

SEQ ID NO: 433073 - DNA, 140 bp, Artificial Sequence
  Synthetic
atacgccatgctgggtctccgtatcctttaagaactcatttactacatctgattcaacaaaccaagccgatctgcctttgaaagttggacctgacaaagcaagtctccaacagtcagacacgtacttgggagtcggccat

SEQ ID NO: 433074 - DNA, 140 bp, Artificial Sequence
  Synthetic
atggccgactcccaagtacgtgtctgactgttggagacttgctttgtcaggtccaactttcaaaggcagatcggcttggtttgttgaatcagatgtagtaaatgagttcttaaaggatacggagacccagcatggcgtat

SEQ ID NO: 433075 - DNA, 140 bp, Artificial Sequence
  Synthetic
aggccctggctgctgatatgaaaagtctccttaaaactagcatcctgacttttgattttatacctaattgtctggtggaactgaacagagtctattggcattgcacttaacaaatcaaaggaccttttgggacagcggtg

SEQ ID NO: 433076 - DNA, 140 bp, Artificial Sequence
  Synthetic
caccgctgtcccaaaaggtcctttgatttgttaagtgcaatgccaatagactctgttcagttccaccagacaattaggtataaaatcaaaagtcaggatgctagttttaaggagacttttcatatcagcagccagggcct

SEQ ID NO: 433077 - DNA, 140 bp, Artificial Sequence
  Synthetic
atacgccatgctgggtctccaaatcttcaagggaatctaactttgattcctcagtcaggcctgaagcaataagctggttcaaatttatctgggctggctctatgtcaaagtctatccatgcgtacttgggagtcggccat

SEQ ID NO: 433078 - DNA, 140 bp, Artificial Sequence
  Synthetic
atggccgactcccaagtacgcatggatagactttgacatagagccagcccagataaatttgaaccagcttattgcttcaggcctgactgaggaatcaaagttagattcccttgaagatttggagacccagcatggcgtat

SEQ ID NO: 433079 - DNA, 140 bp, Artificial Sequence
  Synthetic
atacgccatgctgggtctccccggggatcctaggcaatttggttgttcttttttgaggccttgtgcgctaaactcctccaaatgggaaacaagcaagccaaagccctagaatcaaaaaaccgtacttgggagtcggccat

SEQ ID NO: 433080 - DNA, 140 bp, Artificial Sequence
  Synthetic
atggccgactcccaagtacggttttttgattctagggctttggcttgcttgtttcccatttggaggagtttagcgcacaaggcctcaaaaaagaacaaccaaattgcctaggatccccggggagacccagcatggcgtat

SEQ ID NO: 433081 - DNA, 140 bp, Artificial Sequence
  Synthetic
atacgccatgctgggtctcccatcataggctcatgtgtgcgggagtgtgagttccttagttcagaagccaacacaacatagtgctcctccctcttccacttgacaatatgtgaaacaagtcgtacttgggagtcggccat

SEQ ID NO: 433082 - DNA, 140 bp, Artificial Sequence
  Synthetic
atggccgactcccaagtacgacttgtttcacatattgtcaagtggaagagggaggagcactatgttgtgttggcttctgaactaaggaactcacactcccgcacacatgagcctatgatgggagacccagcatggcgtat

SEQ ID NO: 433083 - DNA, 140 bp, Artificial Sequence
  Synthetic
aggccctggctgctgatatggagggttggtagagtgcaacaaccattacctatgtctcaactgtctcagcttacttctcagcatcagcagcaggtgccccatctgcaaaatgcctcttccgaccttttgggacagcggtg

SEQ ID NO: 433084 - DNA, 140 bp, Artificial Sequence
  Synthetic
caccgctgtcccaaaaggtcggaagaggcattttgcagatggggcacctgctgctgatgctgagaagtaagctgagacagttgagacataggtaatggttgttgcactctaccaaccctccatatcagcagccagggcct

SEQ ID NO: 433085 - DNA, 140 bp, Artificial Sequence
  Synthetic
atacgccatgctgggtctcctctcaaagggaagtagtcacaaggattatgcctaaaaaagtccaagatctgagcttgttttggttccccaagcacccatgctccaagttctatagctgtacgtacttgggagtcggccat

SEQ ID NO: 433086 - DNA, 140 bp, Artificial Sequence
  Synthetic
atggccgactcccaagtacgtacagctatagaacttggagcatgggtgcttggggaaccaaaacaagctcagatcttggacttttttaggcataatccttgtgactacttccctttgagaggagacccagcatggcgtat

SEQ ID NO: 433087 - DNA, 140 bp, Artificial Sequence
  Synthetic
aggccctggctgctgatatgtaatgacttcctaccagtatttgataatccaaaacaccacttgggaagatcactgccagttttctcgcccgtcccctatcggttatctggggctactatcgaccttttgggacagcggtg

SEQ ID NO: 433088 - DNA, 140 bp, Artificial Sequence
  Synthetic
caccgctgtcccaaaaggtcgatagtagccccagataaccgataggggacgggcgagaaaactggcagtgatcttcccaagtggtgttttggattatcaaatactggtaggaagtcattacatatcagcagccagggcct

SEQ ID NO: 433089 - DNA, 140 bp, Artificial Sequence
  Synthetic
atacgccatgctgggtctccgacagtgttatgcacatataatcccacaggagaggtcttaaataagaaacaacagtatcaccaccatctttggctttcgatgaaactttccatatctggacgtacttgggagtcggccat

SEQ ID NO: 433090 - DNA, 140 bp, Artificial Sequence
  Synthetic
atggccgactcccaagtacgtccagatatggaaagtttcatcgaaagccaaagatggtggtgatactgttgtttcttatttaagacctctcctgtgggattatatgtgcataacactgtcggagacccagcatggcgtat

SEQ ID NO: 433091 - DNA, 140 bp, Artificial Sequence
  Synthetic
aggccctggctgctgatatgatctttttgtcttcagcaccagcttttatctcattagcatcttcctccacctggttaaaatcccaacccacagacatgtcataggaaaaccctgccctaagaccttttgggacagcggtg

SEQ ID NO: 433092 - DNA, 140 bp, Artificial Sequence
  Synthetic
caccgctgtcccaaaaggtcttagggcagggttttcctatgacatgtctgtgggttgggattttaaccaggtggaggaagatgctaatgagataaaagctggtgctgaagacaaaaagatcatatcagcagccagggcct

SEQ ID NO: 433093 - DNA, 140 bp, Artificial Sequence
  Synthetic
aggccctggctgctgatatggcccccccggggggcgggcggctcggctctactcgatgtcctcaacatgcctctcctgcccaaacagttccgaacatgtcctcccctttagtcttaggctgaccttttgggacagcggtg

SEQ ID NO: 433094 - DNA, 140 bp, Artificial Sequence
  Synthetic
caccgctgtcccaaaaggtcagcctaagactaaaggggaggacatgttcggaactgtttgggcaggagaggcatgttgaggacatcgagtagagccgagccgcccgccccccgggggggccatatcagcagccagggcct

SEQ ID NO: 433095 - DNA, 140 bp, Artificial Sequence
  Synthetic
atacgccatgctgggtctccgggcatagcctttaaaatcaatccattctccaagagactcaagaagttcatccagtatgtcggcatagtctacaggtctttgttttgtgaggattgaaaccgtacttgggagtcggccat

SEQ ID NO: 433096 - DNA, 140 bp, Artificial Sequence
  Synthetic
atggccgactcccaagtacggtttcaatcctcacaaaacaaagacctgtagactatgccgacatactggatgaacttcttgagtctcttggagaatggattgattttaaaggctatgcccggagacccagcatggcgtat

SEQ ID NO: 433097 - DNA, 140 bp, Artificial Sequence
  Synthetic
aggccctggctgctgatatgctagtgaatgttgatgacaacctattttgcaaggttttaactatcgtagggaccttttcatcctccagattcacagcaccagagtagattatcttctgtcgaccttttgggacagcggtg

SEQ ID NO: 433098 - DNA, 140 bp, Artificial Sequence
  Synthetic
caccgctgtcccaaaaggtcgacagaagataatctactctggtgctgtgaatctggaggatgaaaaggtccctacgatagttaaaaccttgcaaaataggttgtcatcaacattcactagcatatcagcagccagggcct

SEQ ID NO: 433099 - DNA, 140 bp, Artificial Sequence
  Synthetic
aggccctggctgctgatatgctttaatgaaggacttcatcatagctgtcaccacattaaaaggtatttccaccattttgtgcatatgccacataagtagggttgagagatagtccctcccgaccttttgggacagcggtg

SEQ ID NO: 433100 - DNA, 140 bp, Artificial Sequence
  Synthetic
caccgctgtcccaaaaggtcgggagggactatctctcaaccctacttatgtggcatatgcacaaaatggtggaaataccttttaatgtggtgacagctatgatgaagtccttcattaaagcatatcagcagccagggcct

SEQ ID NO: 433101 - DNA, 140 bp, Artificial Sequence
  Synthetic
atacgccatgctgggtctccctgtagtgatgttgtgtgttcacctgataagtagttggtggtgaactcctcatgaagttcaccagtttttaacttattaaacagtattctaagcattgaccgtacttgggagtcggccat

SEQ ID NO: 433102 - DNA, 140 bp, Artificial Sequence
  Synthetic
atggccgactcccaagtacggtcaatgcttagaatactgtttaataagttaaaaactggtgaacttcatgaggagttcaccaccaactacttatcaggtgaacacacaacatcactacagggagacccagcatggcgtat

SEQ ID NO: 433103 - DNA, 140 bp, Artificial Sequence
  Synthetic
aggccctggctgctgatatgctgatctgcctttgaaagttggacctgacaaagcaagtctccaacagtcagacagaacacatggactcacagatccagaatatagtgcctgtacatcattgaccttttgggacagcggtg

SEQ ID NO: 433104 - DNA, 140 bp, Artificial Sequence
  Synthetic
caccgctgtcccaaaaggtcaatgatgtacaggcactatattctggatctgtgagtccatgtgttctgtctgactgttggagacttgctttgtcaggtccaactttcaaaggcagatcagcatatcagcagccagggcct

SEQ ID NO: 433105 - DNA, 140 bp, Artificial Sequence
  Synthetic
aggccctggctgctgatatgtgcactttatattgtgtaaagccgcagcaacaaattttgttaacaggggcacttcgtcaccccatacatagaatcttgatttgaactctgcaacaaatctgaccttttgggacagcggtg

SEQ ID NO: 433106 - DNA, 140 bp, Artificial Sequence
  Synthetic
caccgctgtcccaaaaggtcagatttgttgcagagttcaaatcaagattctatgtatggggtgacgaagtgcccctgttaacaaaatttgttgctgcggctttacacaatataaagtgcacatatcagcagccagggcct

SEQ ID NO: 433107 - DNA, 140 bp, Artificial Sequence
  Synthetic
atacgccatgctgggtctccccggggatcctaggcaatttggttgttcttcttttgaggccttgtgtgctaaacttctccaaatgggaaacaagcaaaccaaagccccagaatcaaaaaacgtacttgggagtcggccat

SEQ ID NO: 433108 - DNA, 140 bp, Artificial Sequence
  Synthetic
atggccgactcccaagtacgttttttgattctggggctttggtttgcttgtttcccatttggagaagtttagcacacaaggcctcaaaagaagaacaaccaaattgcctaggatccccggggagacccagcatggcgtat

SEQ ID NO: 433109 - DNA, 140 bp, Artificial Sequence
  Synthetic
aggccctggctgctgatatgaataatggaattccaacaatgttttgaattcctctgcatctcttgagagtaactctgtcaagttctgatcaaacagtgatatctgatcgtcactggacgtgaccttttgggacagcggtg

SEQ ID NO: 433110 - DNA, 140 bp, Artificial Sequence
  Synthetic
caccgctgtcccaaaaggtcacgtccagtgacgatcagatatcactgtttgatcagaacttgacagagttactctcaagagatgcagaggaattcaaaacattgttggaattccattattcatatcagcagccagggcct

SEQ ID NO: 433111 - DNA, 140 bp, Artificial Sequence
  Synthetic
atacgccatgctgggtctcctttttacctttaaaatagacttcaagatgccatccattgtctgaggtgtaaccttgatggtctccaacatgttccccccatcaagcatacaggctccagccgtacttgggagtcggccat

SEQ ID NO: 433112 - DNA, 140 bp, Artificial Sequence
  Synthetic
atggccgactcccaagtacggctggagcctgtatgcttgatggggggaacatgttggagaccatcaaggttacacctcagacaatggatggcatcttgaagtctattttaaaggtaaaaaggagacccagcatggcgtat

SEQ ID NO: 433113 - DNA, 140 bp, Artificial Sequence
  Synthetic
aggccctggctgctgatatgcacttactgtgatccatactatatgatacatgtgctgacgagacattcaacttcattgacaagatggcattgtcaaactccttctcattattcagacaacgaccttttgggacagcggtg

SEQ ID NO: 433114 - DNA, 140 bp, Artificial Sequence
  Synthetic
caccgctgtcccaaaaggtcgttgtctgaataatgagaaggagtttgacaatgccatcttgtcaatgaagttgaatgtctcgtcagcacatgtatcatatagtatggatcacagtaagtgcatatcagcagccagggcct

SEQ ID NO: 433115 - DNA, 140 bp, Artificial Sequence
  Synthetic
aggccctggctgctgatatggtgaacatctttgttcttaaatctccgatgtacaactctctattgcctcccacttgttctttgtaggacaaagaaaattttaatctacctgtatcagggcgaccttttgggacagcggtg

SEQ ID NO: 433116 - DNA, 140 bp, Artificial Sequence
  Synthetic
caccgctgtcccaaaaggtcgccctgatacaggtagattaaaattttctttgtcctacaaagaacaagtgggaggcaatagagagttgtacatcggagatttaagaacaaagatgttcaccatatcagcagccagggcct

SEQ ID NO: 433117 - DNA, 140 bp, Artificial Sequence
  Synthetic
atacgccatgctgggtctcctttaacattgctgtagtgcagttagttaaagataaggccttgctaagtgcttcagaattgctctcacgttcacttattctaacatcatcagccaaccttccgtacttgggagtcggccat

SEQ ID NO: 433118 - DNA, 140 bp, Artificial Sequence
  Synthetic
atggccgactcccaagtacggaaggttggctgatgatgttagaataagtgaacgtgagagcaattctgaagcacttagcaaggccttatctttaactaactgcactacagcaatgttaaaggagacccagcatggcgtat

SEQ ID NO: 433119 - DNA, 140 bp, Artificial Sequence
  Synthetic
aggccctggctgctgatatgttcagaattgctctcacgttcacttattctaacatcatcagccaaccttcctgtatcaaatttaaagttcaggcacttactcttataatgagagtatcttgaccttttgggacagcggtg

SEQ ID NO: 433120 - DNA, 140 bp, Artificial Sequence
  Synthetic
caccgctgtcccaaaaggtcaagatactctcattataagagtaagtgcctgaactttaaatttgatacaggaaggttggctgatgatgttagaataagtgaacgtgagagcaattctgaacatatcagcagccagggcct

SEQ ID NO: 433121 - DNA, 140 bp, Artificial Sequence
  Synthetic
aggccctggctgctgatatgtcagtggtaaggctcattttagtgaatccctgaatcaaagtgcccagttaaaatgggcaacagacatgccaaatcgacaaaagtcgatgaacatcaaagagaccttttgggacagcggtg

SEQ ID NO: 433122 - DNA, 140 bp, Artificial Sequence
  Synthetic
caccgctgtcccaaaaggtctctttgatgttcatcgacttttgtcgatttggcatgtctgttgcccattttaactgggcactttgattcagggattcactaaaatgagccttaccactgacatatcagcagccagggcct

SEQ ID NO: 433123 - DNA, 140 bp, Artificial Sequence
  Synthetic
aggccctggctgctgatatgaaagcagcatcattgtagatattctcacaaattttggtgtactgatcctcagataggatttctcgatcaaaatcttctatcatatggtttgaaagttcacgaccttttgggacagcggtg

SEQ ID NO: 433124 - DNA, 140 bp, Artificial Sequence
  Synthetic
caccgctgtcccaaaaggtcgtgaactttcaaaccatatgatagaagattttgatcgagaaatcctatctgaggatcagtacaccaaaatttgtgagaatatctacaatgatgctgctttcatatcagcagccagggcct

SEQ ID NO: 433125 - DNA, 140 bp, Artificial Sequence
  Synthetic
aggccctggctgctgatatgtgcaagatgccccttcccaccaagctaaaggcagcaacacagccgagtgcaccatcaaccgaggcgatccagaacacaacacctccaccatacaccccatgaccttttgggacagcggtg

SEQ ID NO: 433126 - DNA, 140 bp, Artificial Sequence
  Synthetic
caccgctgtcccaaaaggtcatggggtgtatggtggaggtgttgtgttctggatcgcctcggttgatggtgcactcggctgtgttgctgcctttagcttggtgggaaggggcatcttgcacatatcagcagccagggcct

SEQ ID NO: 433127 - DNA, 140 bp, Artificial Sequence
  Synthetic
aggccctggctgctgatatggtgtcactactccctcctttggatcccagaacaagattactcattgcttgctgtatcttgtaatcataatcctgtttgttaagcaagaatttacctttacgaccttttgggacagcggtg

SEQ ID NO: 433128 - DNA, 140 bp, Artificial Sequence
  Synthetic
caccgctgtcccaaaaggtcgtaaaggtaaattcttgcttaacaaacaggattatgattacaagatacagcaagcaatgagtaatcttgttctgggatccaaaggagggagtagtgacaccatatcagcagccagggcct

SEQ ID NO: 433129 - DNA, 140 bp, Artificial Sequence
  Synthetic
atacgccatgctgggtctcctcatagaagaagtgatgaacattgtcctgattgccctcagccttctggcaattttgaaagggatctacaatgttgctacctgtggcctctttggattggtcgtacttgggagtcggccat

SEQ ID NO: 433130 - DNA, 140 bp, Artificial Sequence
  Synthetic
atggccgactcccaagtacgaccaatccaaagaggccacaggtagcaacattgtagatccctttcaaaattgccagaaggctgagggcaatcaggacaatgttcatcacttcttctatgaggagacccagcatggcgtat

SEQ ID NO: 433131 - DNA, 140 bp, Artificial Sequence
  Synthetic
atacgccatgctgggtctccaaatcataatccaaaacacgggatccatctgtatacttattcacaacaacactcttattactggccaaatccaaagctgttgcacagccacttgtgataacgtacttgggagtcggccat

SEQ ID NO: 433132 - DNA, 140 bp, Artificial Sequence
  Synthetic
atggccgactcccaagtacgttatcacaagtggctgtgcaacagctttggatttggccagtaataagagtgttgttgtgaataagtatacagatggatcccgtgttttggattatgatttggagacccagcatggcgtat

SEQ ID NO: 433133 - DNA, 140 bp, Artificial Sequence
  Synthetic
aggccctggctgctgatatgtacatacaaccaatggcactggttcgttgtcaggtccaaccttggagaagtcaaactcactgaactgcagtttatctggattaataatcagcttcatggggaccttttgggacagcggtg

SEQ ID NO: 433134 - DNA, 140 bp, Artificial Sequence
  Synthetic
caccgctgtcccaaaaggtccccatgaagctgattattaatccagataaactgcagttcagtgagtttgacttctccaaggttggacctgacaacgaaccagtgccattggttgtatgtacatatcagcagccagggcct

SEQ ID NO: 433135 - DNA, 140 bp, Artificial Sequence
  Synthetic
atacgccatgctgggtctccaacaagtctatagagcaaatactcaacttctgtaattaaatcctctttaattttctcaatcaaatccttgtgatagaagtcggatacaaaggccatcacacgtacttgggagtcggccat

SEQ ID NO: 433136 - DNA, 140 bp, Artificial Sequence
  Synthetic
atggccgactcccaagtacgtgtgatggcctttgtatccgacttctatcacaaggatttgattgagaaaattaaagaggatttaattacagaagttgagtatttgctctatagacttgttggagacccagcatggcgtat

SEQ ID NO: 433137 - DNA, 140 bp, Artificial Sequence
  Synthetic
atacgccatgctgggtctcctccgttgcatctagaatatcaacaacaccaagagtataagggaacatgtcttcctgagttctctggtaactcatagtgggtgtgacaccggaaatctcaacgtacttgggagtcggccat

SEQ ID NO: 433138 - DNA, 140 bp, Artificial Sequence
  Synthetic
atggccgactcccaagtacgttgagatttccggtgtcacacccactatgagttaccagagaactcaggaagacatgttcccttatactcttggtgttgttgatattctagatgcaacggaggagacccagcatggcgtat

SEQ ID NO: 433139 - DNA, 140 bp, Artificial Sequence
  Synthetic
atacgccatgctgggtctccactgaaaatattcttggtccaaaaaagtccttgttaccactgcttttgtcagctcacttatgggacatgagttcattggtcccacataaaaatatttactcgtacttgggagtcggccat

SEQ ID NO: 433140 - DNA, 140 bp, Artificial Sequence
  Synthetic
atggccgactcccaagtacgagtaaatatttttatgtgggaccaatgaactcatgtcccataagtgagctgacaaaagcagtggtaacaaggacttttttggaccaagaatattttcagtggagacccagcatggcgtat

SEQ ID NO: 433141 - DNA, 140 bp, Artificial Sequence
  Synthetic
atacgccatgctgggtctccccataagagttagtttctataccaacctcccttagagcattggtggctcgagtcaaaactctgttaataattgcaaggagctcactattccgttcttcttcgtacttgggagtcggccat

SEQ ID NO: 433142 - DNA, 140 bp, Artificial Sequence
  Synthetic
atggccgactcccaagtacgaagaagaacggaatagtgagctccttgcaattattaacagagttttgactcgagccaccaatgctctaagggaggttggtatagaaactaactcttatggggagacccagcatggcgtat

SEQ ID NO: 433143 - DNA, 140 bp, Artificial Sequence
  Synthetic
aggccctggctgctgatatgagtcaaaactctgttaataattgcaaggagctcactattccgttcttctttgggtgatgaagcacctgtatttttgtctttagttctttttctgctgtctgaccttttgggacagcggtg

SEQ ID NO: 433144 - DNA, 140 bp, Artificial Sequence
  Synthetic
caccgctgtcccaaaaggtcagacagcagaaaaagaactaaagacaaaaatacaggtgcttcatcacccaaagaagaacggaatagtgagctccttgcaattattaacagagttttgactcatatcagcagccagggcct

SEQ ID NO: 433145 - DNA, 140 bp, Artificial Sequence
  Synthetic
atacgccatgctgggtctccgttaacactcacaaaacaggagcccagccaaccagcagggcaactatcaccatgtcttatgccatccaatcggctagcaagaagaattagaacgtcaaaacgtacttgggagtcggccat

SEQ ID NO: 433146 - DNA, 140 bp, Artificial Sequence
  Synthetic
atggccgactcccaagtacgttttgacgttctaattcttcttgctagccgattggatggcataagacatggtgatagttgccctgctggttggctgggctcctgttttgtgagtgttaacggagacccagcatggcgtat

SEQ ID NO: 433147 - DNA, 140 bp, Artificial Sequence
  Synthetic
aggccctggctgctgatatgcatgtcttatgccatccaatcggctagcaagaagaattagaacgtcaaaaacaaggaggagtttcctcctggtgttaaggatcctcagagactttatcttgaccttttgggacagcggtg

SEQ ID NO: 433148 - DNA, 140 bp, Artificial Sequence
  Synthetic
caccgctgtcccaaaaggtcaagataaagtctctgaggatccttaacaccaggaggaaactcctccttgtttttgacgttctaattcttcttgctagccgattggatggcataagacatgcatatcagcagccagggcct

SEQ ID NO: 433149 - DNA, 140 bp, Artificial Sequence
  Synthetic
aggccctggctgctgatatgccctttcctcactagaatccagatctgcatacaagaacttaaggacaggagaagctcttcgaaactggtatgttaactgttcaatgttgtcattacaggtgaccttttgggacagcggtg

SEQ ID NO: 433150 - DNA, 140 bp, Artificial Sequence
  Synthetic
caccgctgtcccaaaaggtcacctgtaatgacaacattgaacagttaacataccagtttcgaagagcttctcctgtccttaagttcttgtatgcagatctggattctagtgaggaaagggcatatcagcagccagggcct

SEQ ID NO: 433151 - DNA, 140 bp, Artificial Sequence
  Synthetic
aggccctggctgctgatatggtgggggtacaatagatgcttatacttcaagtgatgatcaaatttcccttttcgatcaggccttaacagatctcatgcaaagagacccggaagagttcaagaccttttgggacagcggtg

SEQ ID NO: 433152 - DNA, 140 bp, Artificial Sequence
  Synthetic
caccgctgtcccaaaaggtcttgaactcttccgggtctctttgcatgagatctgttaaggcctgatcgaaaagggaaatttgatcatcacttgaagtataagcatctattgtacccccaccatatcagcagccagggcct

SEQ ID NO: 433153 - DNA, 140 bp, Artificial Sequence
  Synthetic
atacgccatgctgggtctccaccattattaaagctagacacaagaagtgagataaatttcttagaaacaccaggccttttatacctaactttttctgcgtctgcacaacactctttacttcgtacttgggagtcggccat

SEQ ID NO: 433154 - DNA, 140 bp, Artificial Sequence
  Synthetic
atggccgactcccaagtacgaagtaaagagtgttgtgcagacgcagaaaaagttaggtataaaaggcctggtgtttctaagaaatttatctcacttcttgtgtctagctttaataatggtggagacccagcatggcgtat

SEQ ID NO: 433155 - DNA, 140 bp, Artificial Sequence
  Synthetic
aggccctggctgctgatatgcagcaagtactggtacctcaaccacacaactactgggaaaacatcactgcccaaatgttggcttgtatcaaatggatcatatttgaacgagacccactttgaccttttgggacagcggtg

SEQ ID NO: 433156 - DNA, 140 bp, Artificial Sequence
  Synthetic
caccgctgtcccaaaaggtcaaagtgggtctcgttcaaatatgatccatttgatacaagccaacatttgggcagtgatgttttcccagtagttgtgtggttgaggtaccagtacttgctgcatatcagcagccagggcct

SEQ ID NO: 433157 - DNA, 140 bp, Artificial Sequence
  Synthetic
atacgccatgctgggtctccggcataacataacaaactcaaagtcctcttctgaatttgattacacagatcaactgggacaccattagccacagattgatcaattatggtatcaattgttcgtacttgggagtcggccat

SEQ ID NO: 433158 - DNA, 140 bp, Artificial Sequence
  Synthetic
atggccgactcccaagtacgaacaattgataccataattgatcaatctgtggctaatggtgtcccagttgatctgtgtaatcaaattcagaagaggactttgagtttgttatgttatgccggagacccagcatggcgtat

SEQ ID NO: 433159 - DNA, 140 bp, Artificial Sequence
  Synthetic
aggccctggctgctgatatgatcattcttcaattgttctagtttcttgtgatcttctagatacttttgttcaaaattagcaggggatgatctaacaaagcactcaagtaagattagaacagaccttttgggacagcggtg

SEQ ID NO: 433160 - DNA, 140 bp, Artificial Sequence
  Synthetic
caccgctgtcccaaaaggtctgttctaatcttacttgagtgctttgttagatcatcccctgctaattttgaacaaaagtatctagaagatcacaagaaactagaacaattgaagaatgatcatatcagcagccagggcct

SEQ ID NO: 433161 - DNA, 140 bp, Artificial Sequence
  Synthetic
atacgccatgctgggtctccttgccagtgagtttataaccgtcaggaactacaaaacataaagcgggagtgagaatcccatggtcactcagaatagattcaaccgttttatcttcagtgtcgtacttgggagtcggccat

SEQ ID NO: 433162 - DNA, 140 bp, Artificial Sequence
  Synthetic
atggccgactcccaagtacgacactgaagataaaacggttgaatctattctgagtgaccatgggattctcactcccgctttatgttttgtagttcctgacggttataaactcactggcaaggagacccagcatggcgtat

SEQ ID NO: 433163 - DNA, 140 bp, Artificial Sequence
  Synthetic
aggccctggctgctgatatgaaaagccaacttctgtcttgatagcttctcattatctgcaaggtattttgatataagatctttggcattggcaatatcttcctccatcaccagttacagtgaccttttgggacagcggtg

SEQ ID NO: 433164 - DNA, 140 bp, Artificial Sequence
  Synthetic
caccgctgtcccaaaaggtcactgtaactggtgatggaggaagatattgccaatgccaaagatcttatatcaaaataccttgcagataatgagaagctatcaagacagaagttggcttttcatatcagcagccagggcct

SEQ ID NO: 433165 - DNA, 140 bp, Artificial Sequence
  Synthetic
atacgccatgctgggtctcccacctcaccgcaaaatttataaatctttcagaaatcaacgcataaaagtctgaggtgttgtgcaggataccctgtcccatatcaaggattgaactaatgtcgtacttgggagtcggccat

SEQ ID NO: 433166 - DNA, 140 bp, Artificial Sequence
  Synthetic
atggccgactcccaagtacgacattagttcaatccttgatatgggacagggtatcctgcacaacacctcagacttttatgcgttgatttctgaaagatttataaattttgcggtgaggtgggagacccagcatggcgtat

SEQ ID NO: 433167 - DNA, 140 bp, Artificial Sequence
  Synthetic
aggccctggctgctgatatgtatcctattgatagagaactcttggcagtaagcctctttgcacctcacaacctggtatctagaggctccaaattcattttgcctaagcttcactgtggaggaccttttgggacagcggtg

SEQ ID NO: 433168 - DNA, 140 bp, Artificial Sequence
  Synthetic
caccgctgtcccaaaaggtcctccacagtgaagcttaggcaaaatgaatttggagcctctagataccaggttgtgaggtgcaaagaggcttactgccaagagttctctatcaataggatacatatcagcagccagggcct

SEQ ID NO: 433169 - DNA, 140 bp, Artificial Sequence
  Synthetic
aggccctggctgctgatatgagtatgaagcaatgagctgtgattttaatgggggaaagatcagtgtacagtacaatcttagtcacagctatgctgtggatgcagccagccattgtggcacgaccttttgggacagcggtg

SEQ ID NO: 433170 - DNA, 140 bp, Artificial Sequence
  Synthetic
caccgctgtcccaaaaggtcgtgccacaatggctggctgcatccacagcatagctgtgactaagattgtactgtacactgatctttcccccattaaaatcacagctcattgcttcatactcatatcagcagccagggcct

SEQ ID NO: 433171 - DNA, 140 bp, Artificial Sequence
  Synthetic
aggccctggctgctgatatgctcgagtcaaaactctgtcaatgattgcaaggagctcactattccgttcttctttgagtgataaagcacctgtacttttatctctagttcttttcctgctgaccttttgggacagcggtg

SEQ ID NO: 433172 - DNA, 140 bp, Artificial Sequence
  Synthetic
caccgctgtcccaaaaggtcagcaggaaaagaactagagataaaagtacaggtgctttatcactcaaagaagaacggaatagtgagctccttgcaatcattgacagagttttgactcgagcatatcagcagccagggcct

SEQ ID NO: 433173 - DNA, 140 bp, Artificial Sequence
  Synthetic
atacgccatgctgggtctccacaaccctttcctcactagaatccaaatctgcatacaagaacttaaggacaggagaagctcttcgaaattggtatgtcaactgttcaatgttgtcattaccgtacttgggagtcggccat

SEQ ID NO: 433174 - DNA, 140 bp, Artificial Sequence
  Synthetic
atggccgactcccaagtacggtaatgacaacattgaacagttgacataccaatttcgaagagcttctcctgtccttaagttcttgtatgcagatttggattctagtgaggaaagggttgtggagacccagcatggcgtat

SEQ ID NO: 433175 - DNA, 140 bp, Artificial Sequence
  Synthetic
aggccctggctgctgatatgtgtcaatcatatttaggatggggtgactttgagtcagcctgtccaagtctgaagtgttggggtactttgctgtgtagatcaaacccaaatctgtcaatgcgaccttttgggacagcggtg

SEQ ID NO: 433176 - DNA, 140 bp, Artificial Sequence
  Synthetic
caccgctgtcccaaaaggtcgcattgacagatttgggtttgatctacacagcaaagtaccccaacacttcagacttggacaggctgactcaaagtcaccccatcctaaatatgattgacacatatcagcagccagggcct

SEQ ID NO: 433177 - DNA, 140 bp, Artificial Sequence
  Synthetic
aggccctggctgctgatatggtcagattctgaaggcaaggacacaccagggggatattgtctgaccagatggatgctgattgaagctgaattaaaatgcttcgggaacacagctgtagcagaccttttgggacagcggtg

SEQ ID NO: 433178 - DNA, 140 bp, Artificial Sequence
  Synthetic
caccgctgtcccaaaaggtctgctacagctgtgttcccgaagcattttaattcagcttcaatcagcatccatctggtcagacaatatccccctggtgtgtccttgccttcagaatctgaccatatcagcagccagggcct

SEQ ID NO: 433179 - DNA, 140 bp, Artificial Sequence
  Synthetic
aggccctggctgctgatatgttagaagcactcattttggtctggacactcagagattcactggttgaaagttctgctcagtgagtcaatgaaaagcgcaatccaatagcctaggatccacgaccttttgggacagcggtg

SEQ ID NO: 433180 - DNA, 140 bp, Artificial Sequence
  Synthetic
caccgctgtcccaaaaggtcgtggatcctaggctattggattgcgcttttcattgactcactgagcagaactttcaaccagtgaatctctgagtgtccagaccaaaatgagtgcttctaacatatcagcagccagggcct

SEQ ID NO: 433181 - DNA, 140 bp, Artificial Sequence
  Synthetic
atacgccatgctgggtctccgggtgagaatcccatgatcattcagaatagattcaaccgttttatcttcagtattatgttcacaaccattagctttacaagaatcaatctcaatacagagcgtacttgggagtcggccat

SEQ ID NO: 433182 - DNA, 140 bp, Artificial Sequence
  Synthetic
atggccgactcccaagtacgctctgtattgagattgattcttgtaaagctaatggttgtgaacataatactgaagataaaacggttgaatctattctgaatgatcatgggattctcacccggagacccagcatggcgtat

SEQ ID NO: 433183 - DNA, 140 bp, Artificial Sequence
  Synthetic
aggccctggctgctgatatgagataagatctttagcattagcaatgtcttcctccatcaccaattgtggtacctgtattgggtttgggtttgtgccagaatggcttgtgggtcagctggtgaccttttgggacagcggtg

SEQ ID NO: 433184 - DNA, 140 bp, Artificial Sequence
  Synthetic
caccgctgtcccaaaaggtcaccagctgacccacaagccattctggcacaaacccaaacccaatacaggtaccacaattggtgatggaggaagacattgctaatgctaaagatcttatctcatatcagcagccagggcct

SEQ ID NO: 433185 - DNA, 140 bp, Artificial Sequence
  Synthetic
aggccctggctgctgatatgatcactaattgcagtacctgtgctgggcttaaacttgtgtttgtgtggctcgtagatcagtcaatggtgccccaaaaaaagcctccacagaaatgagagagaccttttgggacagcggtg

SEQ ID NO: 433186 - DNA, 140 bp, Artificial Sequence
  Synthetic
caccgctgtcccaaaaggtctctctcatttctgtggaggctttttttggggcaccattgactgatctacgagccacacaaacacaagtttaagcccagcacaggtactgcaattagtgatcatatcagcagccagggcct

SEQ ID NO: 433187 - DNA, 140 bp, Artificial Sequence
  Synthetic
aggccctggctgctgatatgggtgtgataccggagatctcaatgtccatgatggcatcataaacatcacaatcaaggatcttgagatcaattccataagagttggtttctatgccaacctgaccttttgggacagcggtg

SEQ ID NO: 433188 - DNA, 140 bp, Artificial Sequence
  Synthetic
caccgctgtcccaaaaggtcaggttggcatagaaaccaactcttatggaattgatctcaagatccttgattgtgatgtttatgatgccatcatggacattgagatctccggtatcacacccatatcagcagccagggcct

SEQ ID NO: 433189 - DNA, 140 bp, Artificial Sequence
  Synthetic
aggccctggctgctgatatgttaaaactagcatcttgacttttaatacggaacctcactgtctgactcatctttgcagatcctgggggcaatgaagctacagcatcaaagaaatcctccagaccttttgggacagcggtg

SEQ ID NO: 433190 - DNA, 140 bp, Artificial Sequence
  Synthetic
caccgctgtcccaaaaggtctggaggatttctttgatgctgtagcttcattgcccccaggatctgcaaagatgagtcagacagtgaggttccgtattaaaagtcaagatgctagttttaacatatcagcagccagggcct

SEQ ID NO: 433191 - DNA, 140 bp, Artificial Sequence
  Synthetic
aggccctggctgctgatatggtttcttttgtaataaagtgacacatgtaggaaatgttcagaataaacttaaacctattagtcatcatgctcttcacatcctcggataaaaccagattcagaccttttgggacagcggtg

SEQ ID NO: 433192 - DNA, 140 bp, Artificial Sequence
  Synthetic
caccgctgtcccaaaaggtctgaatctggttttatccgaggatgtgaagagcatgatgactaataggtttaagtttattctgaacatttcctacatgtgtcactttattacaaaagaaaccatatcagcagccagggcct

SEQ ID NO: 433193 - DNA, 140 bp, Artificial Sequence
  Synthetic
aggccctggctgctgatatgaacattgctgacttcggagaagtcaagcccatgcaaaagagcctgggcatctttcaccacctgtagtttgatgttggaacagtaaccagataattccctcgaccttttgggacagcggtg

SEQ ID NO: 433194 - DNA, 140 bp, Artificial Sequence
  Synthetic
caccgctgtcccaaaaggtcgagggaattatctggttactgttccaacatcaaactacaggtggtgaaagatgcccaggctcttttgcatgggcttgacttctccgaagtcagcaatgttcatatcagcagccagggcct

SEQ ID NO: 433195 - DNA, 140 bp, Artificial Sequence
  Synthetic
atacgccatgctgggtctccgtgccccatttgcaagatgcctctccccacaaaactgagatcatcagccgctccaacagcacccccaaccggagcagcggacagcaccaaacccccaccccgtacttgggagtcggccat

SEQ ID NO: 433196 - DNA, 140 bp, Artificial Sequence
  Synthetic
atggccgactcccaagtacggggtgggggtttggtgctgtccgctgctccggttgggggtgctgttggagcggctgatgatctcagttttgtggggagaggcatcttgcaaatggggcacggagacccagcatggcgtat

SEQ ID NO: 433197 - DNA, 140 bp, Artificial Sequence
  Synthetic
atacgccatgctgggtctccccggggatcctaggcaatttggacgttcttctttctgaagccttgtgtgctgaactcctccaaatgggaaacaagcaagctaaagcctcagaagaaaaaacgtacttgggagtcggccat

SEQ ID NO: 433198 - DNA, 140 bp, Artificial Sequence
  Synthetic
atggccgactcccaagtacgttttttcttctgaggctttagcttgcttgtttcccatttggaggagttcagcacacaaggcttcagaaagaagaacgtccaaattgcctaggatccccggggagacccagcatggcgtat

SEQ ID NO: 433199 - DNA, 140 bp, Artificial Sequence
  Synthetic
atacgccatgctgggtctccttgctgccagctttctgtggcttcccatctgattccagatcaacaacagtgttttcccaggcccttcctgttattgaggttcttgatgcaatgtatggcccgtacttgggagtcggccat

SEQ ID NO: 433200 - DNA, 140 bp, Artificial Sequence
  Synthetic
atggccgactcccaagtacgggccatacattgcatcaagaacctcaataacaggaagggcctgggaaaacactgttgttgatctggaatcagatgggaagccacagaaagctggcagcaaggagacccagcatggcgtat

SEQ ID NO: 433201 - DNA, 140 bp, Artificial Sequence
  Synthetic
aggccctggctgctgatatgcatcaccttcccttttgacttactataacagagagcataacctttgaattctacccagctgtccactgcctcaaggaccgcacccaagatcccctcataggaccttttgggacagcggtg

SEQ ID NO: 433202 - DNA, 140 bp, Artificial Sequence
  Synthetic
caccgctgtcccaaaaggtcctatgaggggatcttgggtgcggtccttgaggcagtggacagctgggtagaattcaaaggttatgctctctgttatagtaagtcaaaagggaaggtgatgcatatcagcagccagggcct

SEQ ID NO: 433203 - DNA, 140 bp, Artificial Sequence
  Synthetic
atacgccatgctgggtctccccggggatcctaggcatttaggattgcgctttaaagagatctttgtgtgactgagcttcatcaagccatgggacaaataataacattctttcaggaggttcgtacttgggagtcggccat

SEQ ID NO: 433204 - DNA, 140 bp, Artificial Sequence
  Synthetic
atggccgactcccaagtacgaacctcctgaaagaatgttattatttgtcccatggcttgatgaagctcagtcacacaaagatctctttaaagcgcaatcctaaatgcctaggatccccggggagacccagcatggcgtat

SEQ ID NO: 433205 - DNA, 140 bp, Artificial Sequence
  Synthetic
aggccctggctgctgatatgctgagcttcatcaagccatgggacaaataataacattctttcaggaggttcctcatgttatagaagaggtgatgaatattgtcctgattgctctcagcctgaccttttgggacagcggtg

SEQ ID NO: 433206 - DNA, 140 bp, Artificial Sequence
  Synthetic
caccgctgtcccaaaaggtcaggctgagagcaatcaggacaatattcatcacctcttctataacatgaggaacctcctgaaagaatgttattatttgtcccatggcttgatgaagctcagcatatcagcagccagggcct

SEQ ID NO: 433207 - DNA, 140 bp, Artificial Sequence
  Synthetic
atacgccatgctgggtctcccctcatgttatagaagaggtgatgaatattgtcctgattgctctcagcctcctggcaatactgaaggggatttacaatattgccacttgtggcctctttgcgtacttgggagtcggccat

SEQ ID NO: 433208 - DNA, 140 bp, Artificial Sequence
  Synthetic
atggccgactcccaagtacgcaaagaggccacaagtggcaatattgtaaatccccttcagtattgccaggaggctgagagcaatcaggacaatattcatcacctcttctataacatgaggggagacccagcatggcgtat

SEQ ID NO: 433209 - DNA, 140 bp, Artificial Sequence
  Synthetic
aggccctggctgctgatatgccaacacaaagtcatactccataaactgcagtctttccatgtcgataacaatctcaactggggtcacatgccccagttgatttgtgtcaattaaaaactcgaccttttgggacagcggtg

SEQ ID NO: 433210 - DNA, 140 bp, Artificial Sequence
  Synthetic
caccgctgtcccaaaaggtcgagtttttaattgacacaaatcaactggggcatgtgaccccagttgagattgttatcgacatggaaagactgcagtttatggagtatgactttgtgttggcatatcagcagccagggcct

SEQ ID NO: 433211 - DNA, 140 bp, Artificial Sequence
  Synthetic
atacgccatgctgggtctccaaaggtgtctatgagctacaaaccctggagctggatatggcaaacctcaacatgaccatgcctctatcttgcacaaaaaacaacagccatcactatatcacgtacttgggagtcggccat

SEQ ID NO: 433212 - DNA, 140 bp, Artificial Sequence
  Synthetic
atggccgactcccaagtacgtgatatagtgatggctgttgttttttgtgcaagatagaggcatggtcatgttgaggtttgccatatccagctccagggtttgtagctcatagacacctttggagacccagcatggcgtat

SEQ ID NO: 433213 - DNA, 140 bp, Artificial Sequence
  Synthetic
aggccctggctgctgatatgcatgaccatgcctctatcttgcacaaaaaacaacagccatcactatatcatggttgggaatgagacaggcctagaactgaccttaacaaacacaagtatagaccttttgggacagcggtg

SEQ ID NO: 433214 - DNA, 140 bp, Artificial Sequence
  Synthetic
caccgctgtcccaaaaggtctatacttgtgtttgttaaggtcagttctaggcctgtctcattcccaaccatgatatagtgatggctgttgttttttgtgcaagatagaggcatggtcatgcatatcagcagccagggcct

SEQ ID NO: 433215 - DNA, 140 bp, Artificial Sequence
  Synthetic
atacgccatgctgggtctcctgatcatgccttgatgagcatcatttcaactttccacttatccattccgaacttcaatcagtatgaagcaatgagttgtgactttaatgaagggaaaatacgtacttgggagtcggccat

SEQ ID NO: 433216 - DNA, 140 bp, Artificial Sequence
  Synthetic
atggccgactcccaagtacgtattttcccttcattaaagtcacaactcattgcttcatactgattgaagttcggaatggataagtggaaagttgaaatgatgctcatcaaggcatgatcaggagacccagcatggcgtat

SEQ ID NO: 433217 - DNA, 140 bp, Artificial Sequence
  Synthetic
aggccctggctgctgatatggacacacaaaaacaagagatgatgattttgtgtatcatataaataaagaagaatattaacattgacattgagacttgtcagtctgttaatattcttgaaagaccttttgggacagcggtg

SEQ ID NO: 433218 - DNA, 140 bp, Artificial Sequence
  Synthetic
caccgctgtcccaaaaggtctttcaagaatattaacagactgacaagtctcaatgtcaatgttaatattcttctttatttatatgatacacaaaatcatcatctcttgtttttgtgtgtccatatcagcagccagggcct

SEQ ID NO: 433219 - DNA, 140 bp, Artificial Sequence
  Synthetic
aggccctggctgctgatatggaatattaacattgacattgagacttgtcagtctgttaatattcttgaaaagatggatttacatagcttgttagagttgggtacaaaacccactgcccctgaccttttgggacagcggtg

SEQ ID NO: 433220 - DNA, 140 bp, Artificial Sequence
  Synthetic
caccgctgtcccaaaaggtcaggggcagtgggttttgtacccaactctaacaagctatgtaaatccatcttttcaagaatattaacagactgacaagtctcaatgtcaatgttaatattccatatcagcagccagggcct

SEQ ID NO: 433221 - DNA, 140 bp, Artificial Sequence
  Synthetic
atacgccatgctgggtctccacctcattacaccaatcatcatccacgtgcaagatcgatgagctcaacccgtagtagtgcagaaagtagtcccactaatcatattccccgtgctcgaccacgtacttgggagtcggccat

SEQ ID NO: 433222 - DNA, 140 bp, Artificial Sequence
  Synthetic
atggccgactcccaagtacgtggtcgagcacggggaatatgattagtgggactactttctgcactactacgggttgagctcatcgatcttgcacgtggatgatgattggtgtaatgaggtggagacccagcatggcgtat

SEQ ID NO: 433223 - DNA, 140 bp, Artificial Sequence
  Synthetic
atacgccatgctgggtctcccatgttcgtaataagaaggtgatattatttgacacaaatcatcaggttagtatctgtaatcagataatagatgcaataaactcagggattgatcttggagcgtacttgggagtcggccat

SEQ ID NO: 433224 - DNA, 140 bp, Artificial Sequence
  Synthetic
atggccgactcccaagtacgctccaagatcaatccctgagtttattgcatctattatctgattacagatactaacctgatgatttgtgtcaaataatatcaccttcttattacgaacatgggagacccagcatggcgtat

SEQ ID NO: 433225 - DNA, 140 bp, Artificial Sequence
  Synthetic
atacgccatgctgggtctcccggaacaagatccagccaaaagttatttgctgttagagaacactagattcagggataatcagaaaatattaagacatgatcagaacgctgagaggggtgacgtacttgggagtcggccat

SEQ ID NO: 433226 - DNA, 140 bp, Artificial Sequence
  Synthetic
atggccgactcccaagtacgtcacccctctcagcgttctgatcatgtcttaatattttctgattatccctgaatctagtgttctctaacagcaaataacttttggctggatcttgttccgggagacccagcatggcgtat

SEQ ID NO: 433227 - DNA, 140 bp, Artificial Sequence
  Synthetic
atacgccatgctgggtctccatcttctagaagggggtttgctgacgttgtgtgttgaacattactataattccgataaagataaattcaacacaagtcctatcgcaaaatacttgcgtgacgtacttgggagtcggccat

SEQ ID NO: 433228 - DNA, 140 bp, Artificial Sequence
  Synthetic
atggccgactcccaagtacgtcacgcaagtattttgcgataggacttgtgttgaatttatctttatcggaattatagtaatgttcaacacacaacgtcagcaaacccccttctagaagatggagacccagcatggcgtat

SEQ ID NO: 433229 - DNA, 140 bp, Artificial Sequence
  Synthetic
atacgccatgctgggtctcctatgcatttggagctaacttaatagtagaaagtttaagtctaaataggatcaaatcaatcaagaacctctcagatttaacattccttatatcatccacaacgtacttgggagtcggccat

SEQ ID NO: 433230 - DNA, 140 bp, Artificial Sequence
  Synthetic
atggccgactcccaagtacgttgtggatgatataaggaatgttaaatctgagaggttcttgattgatttgatcctatttagacttaaactttctactattaagttagctccaaatgcataggagacccagcatggcgtat

SEQ ID NO: 433231 - DNA, 140 bp, Artificial Sequence
  Synthetic
atacgccatgctgggtctcctggatgtgattcctaacgaacctcattacagtcctttaattttggcccttaagacattggaaagtactgaatctcagagggggagaattgggctctttttcgtacttgggagtcggccat

SEQ ID NO: 433232 - DNA, 140 bp, Artificial Sequence
  Synthetic
atggccgactcccaagtacgaaaaagagcccaattctccccctctgagattcagtactttccaatgtcttaagggccaaaattaaaggactgtaatgaggttcgttaggaatcacatccaggagacccagcatggcgtat

SEQ ID NO: 433233 - DNA, 140 bp, Artificial Sequence
  Synthetic
aggccctggctgctgatatgcacagatcagaaattgggaaattggatgagacatcactccgtgcagcattaagtttgacgtgtgctggaattcgaaagacgaatagatccttgatcaacagaccttttgggacagcggtg

SEQ ID NO: 433234 - DNA, 140 bp, Artificial Sequence
  Synthetic
caccgctgtcccaaaaggtctgttgatcaaggatctattcgtctttcgaattccagcacacgtcaaacttaatgctgcacggagtgatgtctcatccaatttcccaatttctgatctgtgcatatcagcagccagggcct

SEQ ID NO: 433235 - DNA, 140 bp, Artificial Sequence
  Synthetic
atacgccatgctgggtctccgtcattttgcagtctttttctcccgaaacttgttgtcggagatcgggctagtatcgaaaaggctttaagacaagtaacagtacatcaagaacaggggatccgtacttgggagtcggccat

SEQ ID NO: 433236 - DNA, 140 bp, Artificial Sequence
  Synthetic
atggccgactcccaagtacggatcccctgttcttgatgtactgttacttgtcttaaagccttttcgatactagcccgatctccgacaacaagtttcgggagaaaaagactgcaaaatgacggagacccagcatggcgtat

SEQ ID NO: 433237 - DNA, 140 bp, Artificial Sequence
  Synthetic
atacgccatgctgggtctcccagaatatgtctgatcagaatcaagttcaaatgttaatcaatacctacaaacgtgatttacatgcttgttttgatagcaatcaattctgtcggtttacagcgtacttgggagtcggccat

SEQ ID NO: 433238 - DNA, 140 bp, Artificial Sequence
  Synthetic
atggccgactcccaagtacgctgtaaaccgacagaattgattgctatcaaaacaagcatgtaaatcacgtttgtaggtattgattaacatttgaacttgattctgatcagacatattctgggagacccagcatggcgtat

SEQ ID NO: 433239 - DNA, 140 bp, Artificial Sequence
  Synthetic
aggccctggctgctgatatgatgcgaatccaacgctcagtgccgtttgaaataatgctcaaatgagacaggagtccatctgcataagaagcatggcctaaatgggtgtctgttaagttctgaccttttgggacagcggtg

SEQ ID NO: 433240 - DNA, 140 bp, Artificial Sequence
  Synthetic
caccgctgtcccaaaaggtcagaacttaacagacacccatttaggccatgcttcttatgcagatggactcctgtctcatttgagcattatttcaaacggcactgagcgttggattcgcatcatatcagcagccagggcct

SEQ ID NO: 433241 - DNA, 140 bp, Artificial Sequence
  Synthetic
aggccctggctgctgatatgtggcagaattatcaacgcgttacaacttgcctgcaaatgttacggaaaatagtataaatcttgaccttaattccacagcacgatggataaaagaacccaggaccttttgggacagcggtg

SEQ ID NO: 433242 - DNA, 140 bp, Artificial Sequence
  Synthetic
caccgctgtcccaaaaggtcctgggttcttttatccatcgtgctgtggaattaaggtcaagatttatactattttccgtaacatttgcaggcaagttgtaacgcgttgataattctgccacatatcagcagccagggcct

SEQ ID NO: 433243 - DNA, 140 bp, Artificial Sequence
  Synthetic
atacgccatgctgggtctcctcagtaggtcaaactagattctcaggacttcttattgtgaaaacagttcttgagttcatcttgcaaaaaactgattcaggggtgacactacatcctttggcgtacttgggagtcggccat

SEQ ID NO: 433244 - DNA, 140 bp, Artificial Sequence
  Synthetic
atggccgactcccaagtacgccaaaggatgtagtgtcacccctgaatcagttttttgcaagatgaactcaagaactgttttcacaataagaagtcctgagaatctagtttgacctactgaggagacccagcatggcgtat

SEQ ID NO: 433245 - DNA, 140 bp, Artificial Sequence; identical to SEQ ID NO: 377691
  Synthetic

SEQ ID NO: 433246 - DNA, 140 bp, Artificial Sequence; identical to SEQ ID NO: 377692
  Synthetic

SEQ ID NO: 433247 - DNA, 140 bp, Artificial Sequence
  Synthetic
atacgccatgctgggtctcctttatcagggattaacaacctcgaacatggactctatcctcagctttcagcgattgcgctgggtgttgcaacagcacacggcagtacattggctggtgtccgtacttgggagtcggccat

SEQ ID NO: 433248 - DNA, 140 bp, Artificial Sequence
  Synthetic
atggccgactcccaagtacggacaccagccaatgtactgccgtgtgctgttgcaacacccagcgcaatcgctgaaagctgaggatagagtccatgttcgaggttgttaatccctgataaaggagacccagcatggcgtat

SEQ ID NO: 433249 - DNA, 140 bp, Artificial Sequence
  Synthetic
atacgccatgctgggtctccaatgttggcgaacagtatcaacagctacgagaggcggcacatgatgcggaaataaaactacaaaggcgacatgaacatcaggaaattcaagctattgcagcgtacttgggagtcggccat

SEQ ID NO: 433250 - DNA, 140 bp, Artificial Sequence
  Synthetic
atggccgactcccaagtacgctgcaatagcttgaatttcctgatgttcatgtcgcctttgtagttttatttccgcatcatgtgccgcctctcgtagctgttgatactgttcgccaacattggagacccagcatggcgtat

SEQ ID NO: 433251 - DNA, 140 bp, Artificial Sequence
  Synthetic
aggccctggctgctgatatgtcacataccagttcagtctcttctaatcaacatgtgaccaattcaaaatatattgttcatccagaagagattcctgaaataaatacaaagactaaattgagaccttttgggacagcggtg

SEQ ID NO: 433252 - DNA, 140 bp, Artificial Sequence
  Synthetic
caccgctgtcccaaaaggtctcaatttagtctttgtatttatttcaggaatctcttctggatgaacaatatattttgaattggtcacatgttgattagaagagactgaactggtatgtgacatatcagcagccagggcct

SEQ ID NO: 433253 - DNA, 140 bp, Artificial Sequence
  Synthetic
atacgccatgctgggtctccaggatgatgaggagaggaagatattagaacaattccaccttcagaaaactgaaatcacacacagtcagacactagccgtcctcagccagaaacgagaaaacgtacttgggagtcggccat

SEQ ID NO: 433254 - DNA, 140 bp, Artificial Sequence
  Synthetic
atggccgactcccaagtacgttttctcgtttctggctgaggacggctagtgtctgactgtgtgtgatttcagttttctgaaggtggaattgttctaatatcttcctctcctcatcatcctggagacccagcatggcgtat

SEQ ID NO: 433255 - DNA, 140 bp, Artificial Sequence
  Synthetic
atacgccatgctgggtctcctagaatatggatcaacagctctacagaggatggatatcaagatgccaccctcggagcagaatctgggcgaaaattgtcgaccatcaaaggacatcagattcgtacttgggagtcggccat

SEQ ID NO: 433256 - DNA, 140 bp, Artificial Sequence
  Synthetic
atggccgactcccaagtacgaatctgatgtcctttgatggtcgacaattttcgcccagattctgctccgagggtggcatcttgatatccatcctctgtagagctgttgatccatattctaggagacccagcatggcgtat

SEQ ID NO: 433257 - DNA, 140 bp, Artificial Sequence
  Synthetic
atacgccatgctgggtctcccaagggcaatcaaaaaataacaaaacatgaccagagatacgagaagaaagaatcctcattacaacaaatgtcccctgaagacaacatgcagactcttgcgcgtacttgggagtcggccat

SEQ ID NO: 433258 - DNA, 140 bp, Artificial Sequence
  Synthetic
atggccgactcccaagtacgcgcaagagtctgcatgttgtcttcaggggacatttgttgtaatgaggattctttcttctcgtatctctggtcatgttttgttattttttgattgcccttgggagacccagcatggcgtat

SEQ ID NO: 433259 - DNA, 140 bp, Artificial Sequence
  Synthetic
atacgccatgctgggtctcctctgcctcccccagttgacaacaaaattgagcacgaatctacagaagatagctcttcttcaagcagctttgttgatcttaatgatccatttgcgctgctgcgtacttgggagtcggccat

SEQ ID NO: 433260 - DNA, 140 bp, Artificial Sequence
  Synthetic
atggccgactcccaagtacgcagcagcgcaaatggatcattaagatcaacaaagctgcttgaagaagagctatcttctgtagattcgtgctcaattttgttgtcaactgggggaggcagaggagacccagcatggcgtat

SEQ ID NO: 433261 - DNA, 140 bp, Artificial Sequence
  Synthetic
atacgccatgctgggtctcctatcatcaaaccctgtaatgagccgatttgctgctgacatcttttcaagaacacctagtggaaaacggcttcaagtcttaggctatctagaaggaacaagcgtacttgggagtcggccat

SEQ ID NO: 433262 - DNA, 140 bp, Artificial Sequence
  Synthetic
atggccgactcccaagtacgcttgttccttctagatagcctaagacttgaagccgttttccactaggtgttcttgaaaagatgtcagcagcaaatcggctcattacagggtttgatgataggagacccagcatggcgtat

SEQ ID NO: 433263 - DNA, 140 bp, Artificial Sequence
  Synthetic
atacgccatgctgggtctccaatgaggacgaagacactcttgacgacagtgtcatgatcccgagcacaacatcgagagaatttcaagggattccagcaccaccaagacaatctcaggacccgtacttgggagtcggccat

SEQ ID NO: 433264 - DNA, 140 bp, Artificial Sequence
  Synthetic
atggccgactcccaagtacgggtcctgagattgtcttggtggtgctggaatcccttgaaattctctcgatgttgtgctcgggatcatgacactgtcgtcaagagtgtcttcgtcctcattggagacccagcatggcgtat

SEQ ID NO: 433265 - DNA, 140 bp, Artificial Sequence
  Synthetic
aggccctggctgctgatatgatcatgaccttgataatctaacaaatcgtgaacttttgctattgatggcccgaaaaatgctccccaatacagacaagacttttagaagtctgcaggactggaccttttgggacagcggtg

SEQ ID NO: 433266 - DNA, 140 bp, Artificial Sequence
  Synthetic
caccgctgtcccaaaaggtccagtcctgcagacttctaaaagtcttgtctgtattggggagcatttttcgggccatcaatagcaaaagttcacgatttgttagattatcaaggtcatgatcatatcagcagccagggcct

SEQ ID NO: 433267 - DNA, 140 bp, Artificial Sequence
  Synthetic
atacgccatgctgggtctcctcaacaacagccaaggaaagcaggaagatgaatcaacaaatccgattaagaaacagtttctgagatatcaagaactgcctccggttcaagaggatgatgacgtacttgggagtcggccat

SEQ ID NO: 433268 - DNA, 140 bp, Artificial Sequence
  Synthetic
atggccgactcccaagtacgtcatcatcctcttgaaccggaggcagttcttgatatctcagaaactgtttcttaatcggatttgttgattcatcttcctgctttccttggctgttgttgaggagacccagcatggcgtat

SEQ ID NO: 433269 - DNA, 140 bp, Artificial Sequence
  Synthetic
atacgccatgctgggtctcccagtcaaatggagaagggccaacccctcaatctgacacagtacatgaacagcaaaattgctatataagtggcttaaattagtatggaaattcatagttcacgtacttgggagtcggccat

SEQ ID NO: 433270 - DNA, 140 bp, Artificial Sequence
  Synthetic
atggccgactcccaagtacgtgaactatgaatttccatactaatttaagccacttatatagcaattttgctgttcatgtactgtgtcagattgaggggttggcccttctccatttgactgggagacccagcatggcgtat

SEQ ID NO: 433271 - DNA, 140 bp, Artificial Sequence
  Synthetic
aggccctggctgctgatatgtaacctgtctccagaatcagaattaactataaatttgttgccgtatgactgcaaggaactgcgactcggagggagcaatgacacagagttaaattatgtcgaccttttgggacagcggtg

SEQ ID NO: 433272 - DNA, 140 bp, Artificial Sequence
  Synthetic
caccgctgtcccaaaaggtcgacataatttaactctgtgtcattgctccctccgagtcgcagttccttgcagtcatacggcaacaaatttatagttaattctgattctggagacaggttacatatcagcagccagggcct

SEQ ID NO: 433273 - DNA, 140 bp, Artificial Sequence
  Synthetic
aggccctggctgctgatatgattgtgagattataaacttgtagaattaccgtgggtcacaactgttgcatatcttccaaaatatatcttttgcaagcgatgtgtgcttgaatacgtcgatgaccttttgggacagcggtg

SEQ ID NO: 433274 - DNA, 140 bp, Artificial Sequence
  Synthetic
caccgctgtcccaaaaggtcatcgacgtattcaagcacacatcgcttgcaaaagatatattttggaagatatgcaacagttgtgacccacggtaattctacaagtttataatctcacaatcatatcagcagccagggcct

SEQ ID NO: 433275 - DNA, 140 bp, Artificial Sequence
  Synthetic
atacgccatgctgggtctccataatacatactaataacgattgattaagaaaaaccaatgatggatattaaatatccatcaagcaggtgtcgcaaaataccaggggtttcacatgctgcccgtacttgggagtcggccat

SEQ ID NO: 433276 - DNA, 140 bp, Artificial Sequence
  Synthetic
atggccgactcccaagtacgggcagcatgtgaaacccctggtattttgcgacacctgcttgatggatatttaatatccatcattggtttttcttaatcaatcgttattagtatgtattatggagacccagcatggcgtat

SEQ ID NO: 433277 - DNA, 140 bp, Artificial Sequence
  Synthetic
aggccctggctgctgatatgacaaagagtggtgacaaagaagggtaggactttcctttatcctaatgatcttctgcagacaaatcctccagaatcacttataacagccctcgtagaggaagaccttttgggacagcggtg

SEQ ID NO: 433278 - DNA, 140 bp, Artificial Sequence
  Synthetic
caccgctgtcccaaaaggtcttcctctacgagggctgttataagtgattctggaggatttgtctgcagaagatcattaggataaaggaaagtcctacccttctttgtcaccactctttgtcatatcagcagccagggcct

SEQ ID NO: 433279 - DNA, 140 bp, Artificial Sequence
  Synthetic
atacgccatgctgggtctccactaatattgaacaatttaactattcaaattacagatattacaaatccattatggctagattctgtaatacaatatttacccgaagatagtgacattcttcgtacttgggagtcggccat

SEQ ID NO: 433280 - DNA, 140 bp, Artificial Sequence
  Synthetic
atggccgactcccaagtacgaagaatgtcactatcttcgggtaaatattgtattacagaatctagccataatggatttgtaatatctgtaatttgaatagttaaattgttcaatattagtggagacccagcatggcgtat

SEQ ID NO: 433281 - DNA, 140 bp, Artificial Sequence
  Synthetic
aggccctggctgctgatatgtatggctagattctgtaatacaatatttacccgaagatagtgacattcttacaatggacgcagagaccactaaggatgaaacaagggaacagctttacaagaccttttgggacagcggtg

SEQ ID NO: 433282 - DNA, 140 bp, Artificial Sequence
  Synthetic
caccgctgtcccaaaaggtcttgtaaagctgttcccttgtttcatccttagtggtctctgcgtccattgtaagaatgtcactatcttcgggtaaatattgtattacagaatctagccatacatatcagcagccagggcct

SEQ ID NO: 433283 - DNA, 140 bp, Artificial Sequence
  Synthetic
atacgccatgctgggtctccaactattgtgaatatttggacacgtacttctcctaatattccaaaaattagcatcatcaaggtgtttttattagactatgaagggactttattcttaatgcgtacttgggagtcggccat

SEQ ID NO: 433284 - DNA, 140 bp, Artificial Sequence
  Synthetic
atggccgactcccaagtacgcattaagaataaagtcccttcatagtctaataaaaacaccttgatgatgctaatttttggaatattaggagaagtacgtgtccaaatattcacaatagttggagacccagcatggcgtat

SEQ ID NO: 433285 - DNA, 140 bp, Artificial Sequence
  Synthetic
atacgccatgctgggtctccagaaatgccattcaatattatgggcaagttcaactcaagaaaccatatagctcaaatgcaaaaaactcagaatggtacttgtgttgcagtaaacgaagaacgtacttgggagtcggccat

SEQ ID NO: 433286 - DNA, 140 bp, Artificial Sequence
  Synthetic
atggccgactcccaagtacgttcttcgtttactgcaacacaagtaccattctgagttttttgcatttgagctatatggtttcttgagttgaacttgcccataatattgaatggcatttctggagacccagcatggcgtat

SEQ ID NO: 433287 - DNA, 140 bp, Artificial Sequence
  Synthetic
aggccctggctgctgatatgctcaaatgcaaaaaactcagaatggtacttgtgttgcagtaaacgaagaattcaacgactccaaattgattttccagaccaggtgggaatttttctgattgaccttttgggacagcggtg

SEQ ID NO: 433288 - DNA, 140 bp, Artificial Sequence
  Synthetic
caccgctgtcccaaaaggtcaatcagaaaaattcccacctggtctggaaaatcaatttggagtcgttgaattcttcgtttactgcaacacaagtaccattctgagttttttgcatttgagcatatcagcagccagggcct

SEQ ID NO: 433289 - DNA, 140 bp, Artificial Sequence
  Synthetic
atacgccatgctgggtctccattcttctttcaactgctataatgatacaaccacgaacctccatacatttgccgcaatactgtaatcaacactgctgtatctctccctcaagccatctgacgtacttgggagtcggccat

SEQ ID NO: 433290 - DNA, 140 bp, Artificial Sequence
  Synthetic
atggccgactcccaagtacgtcagatggcttgagggagagatacagcagtgttgattacagtattgcggcaaatgtatggaggttcgtggttgtatcattatagcagttgaaagaagaatggagacccagcatggcgtat

SEQ ID NO: 433291 - DNA, 140 bp, Artificial Sequence
  Synthetic
aggccctggctgctgatatgtttttctgatgagtcttctcaaagtacagatccgataagttcaggttgcacaaaaacttttgtcacacattttcttgtgtacccagttgagagtatttttgaccttttgggacagcggtg

SEQ ID NO: 433292 - DNA, 140 bp, Artificial Sequence
  Synthetic
caccgctgtcccaaaaggtcaaaaatactctcaactgggtacacaagaaaatgtgtgacaaaagtttttgtgcaacctgaacttatcggatctgtactttgagaagactcatcagaaaaacatatcagcagccagggcct

SEQ ID NO: 433293 - DNA, 140 bp, Artificial Sequence
  Synthetic
atacgccatgctgggtctcctgattgagcttctcaaatggtgcaccatcccactgttttgctcagcctagtatactgtaacacataagtggactctccacctctcctctcgagcattccccgtacttgggagtcggccat

SEQ ID NO: 433294 - DNA, 140 bp, Artificial Sequence
  Synthetic
atggccgactcccaagtacggggaatgctcgagaggagaggtggagagtccacttatgtgttacagtatactaggctgagcaaaacagtgggatggtgcaccatttgagaagctcaatcaggagacccagcatggcgtat

SEQ ID NO: 433295 - DNA, 140 bp, Artificial Sequence
  Synthetic
aggccctggctgctgatatgatttataggaacagatttggagctgtttggaatagcagattttattatttttaaagttccagtaaaaacaataatccgaaatgctgtaagcttacaagctgaccttttgggacagcggtg

SEQ ID NO: 433296 - DNA, 140 bp, Artificial Sequence
  Synthetic
caccgctgtcccaaaaggtcagcttgtaagcttacagcatttcggattattgtttttactggaactttaaaaataataaaatctgctattccaaacagctccaaatctgttcctataaatcatatcagcagccagggcct

SEQ ID NO: 433297 - DNA, 140 bp, Artificial Sequence
  Synthetic
atacgccatgctgggtctcccataagtgatccacttgacagaatgtcaagtccactggcctggagcctccctactctaatgattgtaataattaactgttggcctagatgacaacagacacgtacttgggagtcggccat

SEQ ID NO: 433298 - DNA, 140 bp, Artificial Sequence
  Synthetic
atggccgactcccaagtacgtgtctgttgtcatctaggccaacagttaattattacaatcattagagtagggaggctccaggccagtggacttgacattctgtcaagtggatcacttatgggagacccagcatggcgtat

SEQ ID NO: 433299 - DNA, 140 bp, Artificial Sequence
  Synthetic
atacgccatgctgggtctcctcaaaaccagggttgagagtatggtaccgtgaccaaaacctgaccccttatctatgcgacgatgagtttattgtaagcgtcgctagttatgaatgttttacgtacttgggagtcggccat

SEQ ID NO: 433300 - DNA, 140 bp, Artificial Sequence
  Synthetic
atggccgactcccaagtacgtaaaacattcataactagcgacgcttacaataaactcatcgtcgcatagataaggggtcaggttttggtcacggtaccatactctcaaccctggttttgaggagacccagcatggcgtat

SEQ ID NO: 433301 - DNA, 140 bp, Artificial Sequence
  Synthetic
atacgccatgctgggtctcccgaggctatacaatcactcatagtacaaagtataattcttgcctctgtctcttctgttttctccttcctctgtaatatgccaatcaagaaaaactaaaaacgtacttgggagtcggccat

SEQ ID NO: 433302 - DNA, 140 bp, Artificial Sequence
  Synthetic
atggccgactcccaagtacgtttttagtttttcttgattggcatattacagaggaaggagaaaacagaagagacagaggcaagaattatactttgtactatgagtgattgtatagcctcgggagacccagcatggcgtat

SEQ ID NO: 433303 - DNA, 140 bp, Artificial Sequence; identical to SEQ ID NO: 377483
  Synthetic

SEQ ID NO: 433304 - DNA, 140 bp, Artificial Sequence; identical to SEQ ID NO: 377484
  Synthetic

SEQ ID NO: 433305 - DNA, 140 bp, Artificial Sequence
  Synthetic
atacgccatgctgggtctccactacttaatagagtaatcgggtatatcctattctttccgttcggtttgtttaaatctagatcattaagggcataactttaacaaagagaacttcatttacgtacttgggagtcggccat

SEQ ID NO: 433306 - DNA, 140 bp, Artificial Sequence
  Synthetic
atggccgactcccaagtacgtaaatgaagttctctttgttaaagttatgcccttaatgatctagatttaaacaaaccgaacggaaagaataggatatacccgattactctattaagtagtggagacccagcatggcgtat

SEQ ID NO: 433307 - DNA, 140 bp, Artificial Sequence
  Synthetic
aggccctggctgctgatatgcccatagatcaagtgtttggtgccaatcccttagagaagttatacaagagaaggaaaccaaaaggcacagttggactacaatgtagcccttgtctaatgtgaccttttgggacagcggtg

SEQ ID NO: 433308 - DNA, 140 bp, Artificial Sequence
  Synthetic
caccgctgtcccaaaaggtcacattagacaagggctacattgtagtccaactgtgccttttggtttccttctcttgtataacttctctaagggattggcaccaaacacttgatctatgggcatatcagcagccagggcct

SEQ ID NO: 433309 - DNA, 140 bp, Artificial Sequence
  Synthetic
atacgccatgctgggtctccaaggaaaccaaaaggcacagttggactacaatgtagcccttgtctaatgtcaaaggcgacaagcactgatgatattgtttgggaccaactgatcgtgaagcgtacttgggagtcggccat

SEQ ID NO: 433310 - DNA, 140 bp, Artificial Sequence
  Synthetic
atggccgactcccaagtacgcttcacgatcagttggtcccaaacaatatcatcagtgcttgtcgcctttgacattagacaagggctacattgtagtccaactgtgccttttggtttccttggagacccagcatggcgtat

SEQ ID NO: 433311 - DNA, 140 bp, Artificial Sequence
  Synthetic
aggccctggctgctgatatgtgtatgagaaataataaagtaaacaagaaaaagagaaaaatattagacagtttgcttgacacaagataatcttgtatcaccttaagcctcacacaagtgagaccttttgggacagcggtg

SEQ ID NO: 433312 - DNA, 140 bp, Artificial Sequence
  Synthetic
caccgctgtcccaaaaggtctcacttgtgtgaggcttaaggtgatacaagattatcttgtgtcaagcaaactgtctaatatttttctctttttcttgtttactttattatttctcatacacatatcagcagccagggcct

SEQ ID NO: 433313 - DNA, 140 bp, Artificial Sequence
  Synthetic
atacgccatgctgggtctccaaaacactagctgatctacttataccgataaataggcagatatcggacattcaaagcactctaaacgaagtaacaacaagagtccatgaaattgagcggccgtacttgggagtcggccat

SEQ ID NO: 433314 - DNA, 140 bp, Artificial Sequence
  Synthetic
atggccgactcccaagtacggccgctcaatttcatggactcttgttgttacttcgtttagagtgctttgaatgtccgatatctgcctatttatcggtataagtagatcagctagtgttttggagacccagcatggcgtat

SEQ ID NO: 433315 - DNA, 140 bp, Artificial Sequence
  Synthetic
aggccctggctgctgatatgtcaaagcactctaaacgaagtaacaacaagagtccatgaaattgagcggcaattacatgagataaccccagtgttaaaaatgggaaggacactggaagcagaccttttgggacagcggtg

SEQ ID NO: 433316 - DNA, 140 bp, Artificial Sequence
  Synthetic
caccgctgtcccaaaaggtctgcttccagtgtccttcccatttttaacactggggttatctcatgtaattgccgctcaatttcatggactcttgttgttacttcgtttagagtgctttgacatatcagcagccagggcct

SEQ ID NO: 433317 - DNA, 140 bp, Artificial Sequence
  Synthetic
aggccctggctgctgatatgttaatattggtacattgggtgaatccttgagctttatcctttatatgatgtaaaagattaaggaaatacgaagatagactagttaaattgagttataacagaccttttgggacagcggtg

SEQ ID NO: 433318 - DNA, 140 bp, Artificial Sequence
  Synthetic
caccgctgtcccaaaaggtctgttataactcaatttaactagtctatcttcgtatttccttaatcttttacatcatataaaggataaagctcaaggattcacccaatgtaccaatattaacatatcagcagccagggcct

SEQ ID NO: 433319 - DNA, 140 bp, Artificial Sequence
  Synthetic
atacgccatgctgggtctcctaaaagattaaggaaatacgaagatagactagttaaattgagttataacataccatatatcaaagatacagaagaactgtttgctgtgagctctaagcatcgtacttgggagtcggccat

SEQ ID NO: 433320 - DNA, 140 bp, Artificial Sequence
  Synthetic
atggccgactcccaagtacgatgcttagagctcacagcaaacagttcttctgtatctttgatatatggtatgttataactcaatttaactagtctatcttcgtatttccttaatcttttaggagacccagcatggcgtat

SEQ ID NO: 433321 - DNA, 140 bp, Artificial Sequence
  Synthetic
aggccctggctgctgatatgtaccatatatcaaagatacagaagaactgtttgctgtgagctctaagcatttcttttaaacacattggggaaagagctaggttaccattgagatcaagaagaccttttgggacagcggtg

SEQ ID NO: 433322 - DNA, 140 bp, Artificial Sequence
  Synthetic
caccgctgtcccaaaaggtcttcttgatctcaatggtaacctagctctttccccaatgtgtttaaaagaaatgcttagagctcacagcaaacagttcttctgtatctttgatatatggtacatatcagcagccagggcct

SEQ ID NO: 433323 - DNA, 140 bp, Artificial Sequence
  Synthetic
atacgccatgctgggtctccttcttttaaacacattggggaaagagctaggttaccattgagatcaagaaaactacgttatgttttctttgatgacaagtgataaaactttgtagttacacgtacttgggagtcggccat

SEQ ID NO: 433324 - DNA, 140 bp, Artificial Sequence
  Synthetic
atggccgactcccaagtacgtgtaactacaaagttttatcacttgtcatcaaagaaaacataacgtagttttcttgatctcaatggtaacctagctctttccccaatgtgtttaaaagaaggagacccagcatggcgtat

SEQ ID NO: 433325 - DNA, 140 bp, Artificial Sequence
  Synthetic
aggccctggctgctgatatgagatgcagccgacaagatgtcgaaagttcttgaactcagtgaggagacgttctccaagccaaatctttcagctaaggatttagcccttttgttgtttaccgaccttttgggacagcggtg

SEQ ID NO: 433326 - DNA, 140 bp, Artificial Sequence
  Synthetic
caccgctgtcccaaaaggtcggtaaacaacaaaagggctaaatccttagctgaaagatttggcttggagaacgtctcctcactgagttcaagaactttcgacatcttgtcggctgcatctcatatcagcagccagggcct

SEQ ID NO: 433327 - DNA, 140 bp, Artificial Sequence
  Synthetic
atacgccatgctgggtctccgttccagaatgtcaatgtgaatgtgaattaagaaaaactaatatataaaattaaaaaactgaaaagctttgatacaagtaacacaaaacatttttcatctcgtacttgggagtcggccat

SEQ ID NO: 433328 - DNA, 140 bp, Artificial Sequence
  Synthetic
atggccgactcccaagtacgagatgaaaaatgttttgtgttacttgtatcaaagcttttcagttttttaattttatatattagtttttcttaattcacattcacattgacattctggaacggagacccagcatggcgtat

SEQ ID NO: 433329 - DNA, 140 bp, Artificial Sequence
  Synthetic
aggccctggctgctgatatgatgtgaatgtgaattaagaaaaactaatatataaaattaaaaaactgaaaagctttgatacaagtaacacaaaacatttttcatctttttagtgtgtccagaccttttgggacagcggtg

SEQ ID NO: 433330 - DNA, 140 bp, Artificial Sequence
  Synthetic
caccgctgtcccaaaaggtctggacacactaaaaagatgaaaaatgttttgtgttacttgtatcaaagcttttcagttttttaattttatatattagtttttcttaattcacattcacatcatatcagcagccagggcct

SEQ ID NO: 433331 - DNA, 140 bp, Artificial Sequence
  Synthetic
atacgccatgctgggtctccagacacacaaaaacaagagatgatgattttgtgtatcatataaataaagaagaatattaacattgacattaagactagtcattttgttaatattctttaacgtacttgggagtcggccat

SEQ ID NO: 433332 - DNA, 140 bp, Artificial Sequence
  Synthetic
atggccgactcccaagtacgttaaagaatattaacaaaatgactagtcttaatgtcaatgttaatattcttctttatttatatgatacacaaaatcatcatctcttgtttttgtgtgtctggagacccagcatggcgtat

SEQ ID NO: 433333 - DNA, 140 bp, Artificial Sequence
  Synthetic
atacgccatgctgggtctccaccagattctaagtgaaggagagaatgctcaggcagcattgactcgactaagcagaacatttgatgctttcctcggagtagttcctccagtgataagagtcgtacttgggagtcggccat

SEQ ID NO: 433334 - DNA, 140 bp, Artificial Sequence
  Synthetic
atggccgactcccaagtacgactcttatcactggaggaactactccgaggaaagcatcaaatgttctgcttagtcgagtcaatgctgcctgagcattctctccttcacttagaatctggtggagacccagcatggcgtat

SEQ ID NO: 433335 - DNA, 140 bp, Artificial Sequence
  Synthetic
atacgccatgctgggtctccaagatggatttacatagtttgctagaattaggtacaaaacccacagcccctcatgttcgtaataagaaggtgatattgtttgatacaaaccatcaggttacgtacttgggagtcggccat

SEQ ID NO: 433336 - DNA, 140 bp, Artificial Sequence
  Synthetic
atggccgactcccaagtacgtaacctgatggtttgtatcaaacaatatcaccttcttattacgaacatgaggggctgtgggttttgtacctaattctagcaaactatgtaaatccatcttggagacccagcatggcgtat

SEQ ID NO: 433337 - DNA, 140 bp, Artificial Sequence
  Synthetic
atacgccatgctgggtctcccaaaaacttccaaacagtccctcgcccatgtcaaaaaagtcttcgggctgttcctcccaacccaacaattgacaaaggatgggtctgtgtttattcatctcgtacttgggagtcggccat

SEQ ID NO: 433338 - DNA, 140 bp, Artificial Sequence
  Synthetic
atggccgactcccaagtacgagatgaataaacacagacccatcctttgtcaattgttgggttgggaggaacagcccgaagacttttttgacatgggcgagggactgtttggaagtttttgggagacccagcatggcgtat

SEQ ID NO: 433339 - DNA, 140 bp, Artificial Sequence
  Synthetic
atacgccatgctgggtctccgtatctgtaaccagataatagatgcaataaactcagggatcgatttaggagatcttttggaaggcggcttgttgacattatgtgttgaacattattacaacgtacttgggagtcggccat

SEQ ID NO: 433340 - DNA, 140 bp, Artificial Sequence
  Synthetic
atggccgactcccaagtacgttgtaataatgttcaacacataatgtcaacaagccgccttccaaaagatctcctaaatcgatccctgagtttattgcatctattatctggttacagatacggagacccagcatggcgtat

SEQ ID NO: 433341 - DNA, 140 bp, Artificial Sequence
  Synthetic
atacgccatgctgggtctccttctgacaaagataaattcaatacaagtcctattgcaaaatatctgcgggacgcgggctatgagtttgatgtcatcaagaatcctgatgcaactcgctttcgtacttgggagtcggccat

SEQ ID NO: 433342 - DNA, 140 bp, Artificial Sequence
  Synthetic
atggccgactcccaagtacgaaagcgagttgcatcaggattcttgatgacatcaaactcatagcccgcgtcccgcagatattttgcaataggacttgtattgaatttatctttgtcagaaggagacccagcatggcgtat

SEQ ID NO: 433343 - DNA, 140 bp, Artificial Sequence
  Synthetic
atacgccatgctgggtctcccaatacctcaacggtgttcaattgccacaatcattgaaaacaatggcaagatgtggacccttatctgactctatttttgatgatcttcaaggttccttagcgtacttgggagtcggccat

SEQ ID NO: 433344 - DNA, 140 bp, Artificial Sequence
  Synthetic
atggccgactcccaagtacgctaaggaaccttgaagatcatcaaaaatagagtcagataagggtccacatcttgccattgttttcaatgattgtggcaattgaacaccgttgaggtattgggagacccagcatggcgtat

SEQ ID NO: 433345 - DNA, 140 bp, Artificial Sequence
  Synthetic
atacgccatgctgggtctccctagaggttattcccaatgaacctcattacagccctttgattttggctctcaaaaccttagaaagcactgaatctcaaagggggaggattgggctctttccgtacttgggagtcggccat

SEQ ID NO: 433346 - DNA, 140 bp, Artificial Sequence
  Synthetic
atggccgactcccaagtacggaaagagcccaatcctccccctttgagattcagtgctttctaaggttttgagagccaaaatcaaagggctgtaatgaggttcattgggaataacctctagggagacccagcatggcgtat

SEQ ID NO: 433347 - DNA, 140 bp, Artificial Sequence
  Synthetic
atacgccatgctgggtctcctgtcattttgcagtctttttctcccgaaactcgttgtcggagaccgagctagcatcgaaaaggccctgagacaagtaacagtgcatcaggaacaagggatcgtacttgggagtcggccat

SEQ ID NO: 433348 - DNA, 140 bp, Artificial Sequence
  Synthetic
atggccgactcccaagtacgatcccttgttcctgatgcactgttacttgtctcagggccttttcgatgctagctcggtctccgacaacgagtttcgggagaaaaagactgcaaaatgacaggagacccagcatggcgtat

SEQ ID NO: 433349 - DNA, 140 bp, Artificial Sequence
  Synthetic
atacgccatgctgggtctcctgtaacataccccaatcattggctcactacaggtcacatgaaagtaatctttgggattttaagatctagcttcattttaaagtttgtcttaatccatcagcgtacttgggagtcggccat

SEQ ID NO: 433350 - DNA, 140 bp, Artificial Sequence
  Synthetic
atggccgactcccaagtacgctgatggattaagacaaactttaaaatgaagctagatcttaaaatcccaaagattactttcatgtgacctgtagtgagccaatgattggggtatgttacaggagacccagcatggcgtat

SEQ ID NO: 433351 - DNA, 140 bp, Artificial Sequence
  Synthetic
aggccctggctgctgatatgataactccaaattatgtgggcgatttaaacttagatgaccagtttaaagggaatgtctgccacgctttcactttagaggcgataattgacatatctgcgtgaccttttgggacagcggtg

SEQ ID NO: 433352 - DNA, 140 bp, Artificial Sequence
  Synthetic
caccgctgtcccaaaaggtcacgcagatatgtcaattatcgcctctaaagtgaaagcgtggcagacattccctttaaactggtcatctaagtttaaatcgcccacataatttggagttatcatatcagcagccagggcct

SEQ ID NO: 433353 - DNA, 140 bp, Artificial Sequence
  Synthetic
atacgccatgctgggtctccttataagtttaagatatcttaaattatacccacaagagatactgttttaattaagaaaaactatgaagaacattaagaagatctttctctcgtagtgttccgtacttgggagtcggccat

SEQ ID NO: 433354 - DNA, 140 bp, Artificial Sequence
  Synthetic
atggccgactcccaagtacggaacactacgagagaaagatcttcttaatgttcttcatagtttttcttaattaaaacagtatctcttgtgggtataatttaagatatcttaaacttataaggagacccagcatggcgtat

SEQ ID NO: 433355 - DNA, 140 bp, Artificial Sequence
  Synthetic
atacgccatgctgggtctcctttcacataggttctgatttagaggaccaaagggtgtgtgagtggcttttatcatcaaaccccgtaatgagccgatttgctgctgacatcttttcaagaacgtacttgggagtcggccat

SEQ ID NO: 433356 - DNA, 140 bp, Artificial Sequence
  Synthetic
atggccgactcccaagtacgttcttgaaaagatgtcagcagcaaatcggctcattacggggtttgatgataaaagccactcacacaccctttggtcctctaaatcagaacctatgtgaaaggagacccagcatggcgtat

SEQ ID NO: 433357 - DNA, 140 bp, Artificial Sequence
  Synthetic
atacgccatgctgggtctcctagagttcatcctacaaaaaactgattcaggggtggcattgcatccacttgtgcggacctcaaaagtaaaaaatgaagttgcaagcttcaaacaggcattcgtacttgggagtcggccat

SEQ ID NO: 433358 - DNA, 140 bp, Artificial Sequence
  Synthetic
atggccgactcccaagtacgaatgcctgtttgaagcttgcaacttcattttttacttttgaggtccgcacaagtggatgcaatgccacccctgaatcagttttttgtaggatgaactctaggagacccagcatggcgtat

SEQ ID NO: 433359 - DNA, 140 bp, Artificial Sequence
  Synthetic
atacgccatgctgggtctcccaatacttgaacccccctccttatgctgatcacggtgcaaaccagttgatcccggcggatcagctatcaaatcagcagggtataactccaaattatgtggcgtacttgggagtcggccat

SEQ ID NO: 433360 - DNA, 140 bp, Artificial Sequence
  Synthetic
atggccgactcccaagtacgccacataatttggagttataccctgctgatttgatagctgatccgccgggatcaactggtttgcaccgtgatcagcataaggaggggggttcaagtattgggagacccagcatggcgtat

SEQ ID NO: 433361 - DNA, 140 bp, Artificial Sequence
  Synthetic
atacgccatgctgggtctccgagtaacttagctcgtcatggagagtacgcaccatttgcacgggttttgaatttatcagggatcaataaccttgagcatgggctctatcctcagctttcacgtacttgggagtcggccat

SEQ ID NO: 433362 - DNA, 140 bp, Artificial Sequence
  Synthetic
atggccgactcccaagtacgtgaaagctgaggatagagcccatgctcaaggttattgatccctgataaattcaaaacccgtgcaaatggtgcgtactctccatgacgagctaagttactcggagacccagcatggcgtat

SEQ ID NO: 433363 - DNA, 140 bp, Artificial Sequence
  Synthetic
atacgccatgctgggtctccatattgatgcattggacgatgatttatctgagtccttagaaaaattcacatgtactgtcgatgtagctaatttcttgagggcatactcatggtctgacgtcgtacttgggagtcggccat

SEQ ID NO: 433364 - DNA, 140 bp, Artificial Sequence
  Synthetic
atggccgactcccaagtacgacgtcagaccatgagtatgccctcaagaaattagctacatcgacagtacatgtgaatttttctaaggactcagataaatcatcgtccaatgcatcaatatggagacccagcatggcgtat

SEQ ID NO: 433365 - DNA, 140 bp, Artificial Sequence
  Synthetic
aggccctggctgctgatatgcccggcggatcagctatcaaatcagcagggtataactccaaattatgtgggtgacttaaacctagatgatcagttcaaagggaatgtctgccatgctttcgaccttttgggacagcggtg

SEQ ID NO: 433366 - DNA, 140 bp, Artificial Sequence
  Synthetic
caccgctgtcccaaaaggtcgaaagcatggcagacattccctttgaactgatcatctaggtttaagtcacccacataatttggagttataccctgctgatttgatagctgatccgccgggcatatcagcagccagggcct

SEQ ID NO: 433367 - DNA, 140 bp, Artificial Sequence
  Synthetic
atacgccatgctgggtctccaagtaaaattacaaaggcgacatgaacaccaggaaattcaggccatcgccgaggatgacgaagagagaaaaatattagaacagttccatctccagaagaccgtacttgggagtcggccat

SEQ ID NO: 433368 - DNA, 140 bp, Artificial Sequence
  Synthetic
atggccgactcccaagtacggtcttctggagatggaactgttctaatatttttctctcttcgtcatcctcggcgatggcctgaatttcctggtgttcatgtcgcctttgtaattttacttggagacccagcatggcgtat

SEQ ID NO: 433369 - DNA, 140 bp, Artificial Sequence
  Synthetic
atacgccatgctgggtctcctgagattacacacagtcagacattggccgtcctcagccagaaacgagagaaactagctcgtcttgctgcagaaattgaaaacaacattgcagaggatcagcgtacttgggagtcggccat

SEQ ID NO: 433370 - DNA, 140 bp, Artificial Sequence
  Synthetic
atggccgactcccaagtacgctgatcctctgcaatgttgttttcaatttctgcagcaagacgagctagtttctctcgtttctggctgaggacggccaatgtctgactgtgtgtaatctcaggagacccagcatggcgtat

SEQ ID NO: 433371 - DNA, 140 bp, Artificial Sequence
  Synthetic
atacgccatgctgggtctccaggaatcccagcacacccactcagaatgttgcgtgaaggaaatcaagcttttattcagaatatggtgatccccagaaatttttccactaatcaattcacccgtacttgggagtcggccat

SEQ ID NO: 433372 - DNA, 140 bp, Artificial Sequence
  Synthetic
atggccgactcccaagtacgggtgaattgattagtggaaaaatttctggggatcaccatattctgaataaaagcttgatttccttcacgcaacattctgagtgggtgtgctgggattcctggagacccagcatggcgtat

SEQ ID NO: 433373 - DNA, 140 bp, Artificial Sequence
  Synthetic
atacgccatgctgggtctccccctgccccccccagtcgacaacaaaattgagcatgaaactgaagaggacagctcctcatcaagtagttttgttgacttgaatgatccatttgcactgctcgtacttgggagtcggccat

SEQ ID NO: 433374 - DNA, 140 bp, Artificial Sequence
  Synthetic
atggccgactcccaagtacgagcagtgcaaatggatcattcaagtcaacaaaactacttgatgaggagctgtcctcttcagtttcatgctcaattttgttgtcgactggggggggcagggggagacccagcatggcgtat

SEQ ID NO: 433375 - DNA, 140 bp, Artificial Sequence
  Synthetic
atacgccatgctgggtctcctcaacaccacagacccaaacagcgatgatgaggacctcacaacatccggctcagggtccggagaacaggaaccccacacaacttccgatgcagtcactaacgtacttgggagtcggccat

SEQ ID NO: 433376 - DNA, 140 bp, Artificial Sequence
  Synthetic
atggccgactcccaagtacgttagtgactgcatcggaagttgtgtggggttcctgttctccggaccctgagccggatgttgtgaggtcctcatcatcgctgtttgggtctgtggtgttgaggagacccagcatggcgtat

SEQ ID NO: 433377 - DNA, 140 bp, Artificial Sequence
  Synthetic
atacgccatgctgggtctcctctccatacacccgaatttgccacccattgttctaccaacagtcaagaagcaggcttatcgtcagcataaaaatcccaacaatggaccactgctggccatcgtacttgggagtcggccat

SEQ ID NO: 433378 - DNA, 140 bp, Artificial Sequence
  Synthetic
atggccgactcccaagtacgatggccagcagtggtccattgttgggatttttatgctgacgataagcctgcttcttgactgttggtagaacaatgggtggcaaattcgggtgtatggagaggagacccagcatggcgtat

SEQ ID NO: 433379 - DNA, 140 bp, Artificial Sequence
  Synthetic
atacgccatgctgggtctcccttgatattagccaaaagaaacagggaaatgaatcaacagatccagcaagaaaacaattcttgcgatatcaagaattacctcctgttcaagaagacgatgcgtacttgggagtcggccat

SEQ ID NO: 433380 - DNA, 140 bp, Artificial Sequence
  Synthetic
atggccgactcccaagtacgcatcgtcttcttgaacaggaggtaattcttgatatcgcaagaattgttttcttgctggatctgttgattcatttccctgtttcttttggctaatatcaagggagacccagcatggcgtat

SEQ ID NO: 433381 - DNA, 140 bp, Artificial Sequence
  Synthetic
atacgccatgctgggtctccgcctgtttaggatttcacttcctgccgatatgttctcagtaaaagaaggtatgatgaagaaaaggggagaaaattccccggtggtttattttcaagcacccgtacttgggagtcggccat

SEQ ID NO: 433382 - DNA, 140 bp, Artificial Sequence
  Synthetic
atggccgactcccaagtacgggtgcttgaaaataaaccaccggggaattttctccccttttcttcatcataccttcttttactgagaacatatcggcaggaagtgaaatcctaaacaggcggagacccagcatggcgtat

SEQ ID NO: 433383 - DNA, 140 bp, Artificial Sequence
  Synthetic
atacgccatgctgggtctccaatcagaatacacaactgattctcaggaaagtgacgatcaaccaggatctgataatgaacaaggtgttgatctcccaccacctccattatatgctcaggacgtacttgggagtcggccat

SEQ ID NO: 433384 - DNA, 140 bp, Artificial Sequence
  Synthetic
atggccgactcccaagtacgtcctgagcatataatggaggtggtgggagatcaacaccttgttcattatcagatcctggttgatcgtcactttcctgagaatcagttgtgtattctgattggagacccagcatggcgtat

SEQ ID NO: 433385 - DNA, 140 bp, Artificial Sequence
  Synthetic
atacgccatgctgggtctcctgttccagagtggcaacaaacaaggaatctattctcccacctctttaaaaacccaaagtcaacaattatagaaccgttcttggctttgaggatcttgcttcgtacttgggagtcggccat

SEQ ID NO: 433386 - DNA, 140 bp, Artificial Sequence
  Synthetic
atggccgactcccaagtacgaagcaagatcctcaaagccaagaacggttctataattgttgactttgggtttttaaagaggtgggagaatagattccttgtttgttgccactctggaacaggagacccagcatggcgtat

SEQ ID NO: 433387 - DNA, 140 bp, Artificial Sequence
  Synthetic
atacgccatgctgggtctccaaagagacaggatcccatacagcatccagccgtgagctcccaagatccctttggcagtattggagatgtagatggtgatattttggaacctataagatcgcgtacttgggagtcggccat

SEQ ID NO: 433388 - DNA, 140 bp, Artificial Sequence
  Synthetic
atggccgactcccaagtacgcgatcttataggttccaaaatatcaccatctacatctccaatactgccaaagggatcttgggagctcacggctggatgctgtatgggatcctgtctctttggagacccagcatggcgtat

SEQ ID NO: 433389 - DNA, 140 bp, Artificial Sequence
  Synthetic
atacgccatgctgggtctccccttcctcaccgtctgctcctcaggaggacacaaggatgggagaagcctatgaattatcacctgattttacaagctatgaggataatcagcagaattggccgtacttgggagtcggccat

SEQ ID NO: 433390 - DNA, 140 bp, Artificial Sequence
  Synthetic
atggccgactcccaagtacggccaattctgctgattatcctcatagcttgtaaaatcaggtgataattcataggcttctcccatccttgtgtcctcctgaggagcagacggtgaggaaggggagacccagcatggcgtat

SEQ ID NO: 433391 - DNA, 140 bp, Artificial Sequence
  Synthetic
aggccctggctgctgatatggctttaaatggttaattaagctgatcagcttgcaagatgtaatctcttttgggtcatcagatctataatgggtttactagattatataaaagaaatagtagaccttttgggacagcggtg

SEQ ID NO: 433392 - DNA, 140 bp, Artificial Sequence
  Synthetic
caccgctgtcccaaaaggtctactatttcttttatataatctagtaaacccattatagatctgatgacccaaaagagattacatcttgcaagctgatcagcttaattaaccatttaaagccatatcagcagccagggcct

SEQ ID NO: 433393 - DNA, 140 bp, Artificial Sequence
  Synthetic
atacgccatgctgggtctcccacagagagtggtaacaaagaaaggcaggaccttcctttatcctaatgaccttttacagacgagtcctccagagtcattaataacagcccttgttgaagacgtacttgggagtcggccat

SEQ ID NO: 433394 - DNA, 140 bp, Artificial Sequence
  Synthetic
atggccgactcccaagtacgtcttcaacaagggctgttattaatgactctggaggactcgtctgtaaaaggtcattaggataaaggaaggtcctgcctttctttgttaccactctctgtgggagacccagcatggcgtat

SEQ ID NO: 433395 - DNA, 140 bp, Artificial Sequence
  Synthetic
atacgccatgctgggtctccgtaccaaaaccctgtctcagcaaaagagcttcaagcggattggcctgacatgtcatttgatgagaggagacatgttgctatgaacttataatttcgacaacgtacttgggagtcggccat

SEQ ID NO: 433396 - DNA, 140 bp, Artificial Sequence
  Synthetic
atggccgactcccaagtacgttgtcgaaattataagttcatagcaacatgtctcctctcatcaaatgacatgtcaggccaatccgcttgaagctcttttgctgagacagggttttggtacggagacccagcatggcgtat

SEQ ID NO: 433397 - DNA, 140 bp, Artificial Sequence
  Synthetic
aggccctggctgctgatatgtctgaaatagtaagaaaaactaatgaagaacattaattgccgggtaagagtgattaagttctttaaatttgaccaaagtaatgttttgttagtgaatacagaccttttgggacagcggtg

SEQ ID NO: 433398 - DNA, 140 bp, Artificial Sequence
  Synthetic
caccgctgtcccaaaaggtctgtattcactaacaaaacattactttggtcaaatttaaagaacttaatcactcttacccggcaattaatgttcttcattagtttttcttactatttcagacatatcagcagccagggcct

SEQ ID NO: 433399 - DNA, 140 bp, Artificial Sequence
  Synthetic
atacgccatgctgggtctcccacagcacgactactcatttatttacttcaatatattttacctccgaaacataatagtcaaatttatttaaatatctagaccactttcaaataccttgttcgtacttgggagtcggccat

SEQ ID NO: 433400 - DNA, 140 bp, Artificial Sequence
  Synthetic
atggccgactcccaagtacgaacaaggtatttgaaagtggtctagatatttaaataaatttgactattatgtttcggaggtaaaatatattgaagtaaataaatgagtagtcgtgctgtgggagacccagcatggcgtat

SEQ ID NO: 433401 - DNA, 140 bp, Artificial Sequence
  Synthetic
atacgccatgctgggtctccttcttatattgcttgattaaaaacaagaaattatcctaacatgaagaccacatgtctctttatcagtcttatcttaatccaagggataaaaactctccctcgtacttgggagtcggccat

SEQ ID NO: 433402 - DNA, 140 bp, Artificial Sequence
  Synthetic
atggccgactcccaagtacgagggagagtttttatcccttggattaagataagactgataaagagacatgtggtcttcatgttaggataatttcttgtttttaatcaagcaatataagaaggagacccagcatggcgtat

SEQ ID NO: 433403 - DNA, 140 bp, Artificial Sequence
  Synthetic
atacgccatgctgggtctccatatatcactgttatgtgagatggtgcaaaccttagaatgataaccaaaggtaggaactggttatatgacagtacctcgaaggtgttatttaatggtttacgtacttgggagtcggccat

SEQ ID NO: 433404 - DNA, 140 bp, Artificial Sequence
  Synthetic
atggccgactcccaagtacgtaaaccattaaataacaccttcgaggtactgtcatataaccagttcctacctttggttatcattctaaggtttgcaccatctcacataacagtgatatatggagacccagcatggcgtat

SEQ ID NO: 433405 - DNA, 140 bp, Artificial Sequence
  Synthetic
atacgccatgctgggtctccattttagagatagctagtaacaatcaaccccaaaatgtggattcggtatgctccggaactctccagaagacagaagatgtccatctgatgggattcacaccgtacttgggagtcggccat

SEQ ID NO: 433406 - DNA, 140 bp, Artificial Sequence
  Synthetic
atggccgactcccaagtacggtgtgaatcccatcagatggacatcttctgtcttctggagagttccggagcataccgaatccacattttggggttgattgttactagctatctctaaaatggagacccagcatggcgtat

SEQ ID NO: 433407 - DNA, 140 bp, Artificial Sequence
  Synthetic
atacgccatgctgggtctccgatctctcctctaattgctacgataatacaactacaaacctctttaccttggttacaatactgtaatagatatgattgtattgctttcttaaatcatctgcgtacttgggagtcggccat

SEQ ID NO: 433408 - DNA, 140 bp, Artificial Sequence
  Synthetic
atggccgactcccaagtacgcagatgatttaagaaagcaatacaatcatatctattacagtattgtaaccaaggtaaagaggtttgtagttgtattatcgtagcaattagaggagagatcggagacccagcatggcgtat

SEQ ID NO: 433409 - DNA, 140 bp, Artificial Sequence
  Synthetic
aggccctggctgctgatatggctttcaggacaggtgtacctcccaagaatgttgagtatacagaaggggaggaagccaaaacatgctacaatataagtgtaacggatccctctggaaaatgaccttttgggacagcggtg

SEQ ID NO: 433410 - DNA, 140 bp, Artificial Sequence
  Synthetic
caccgctgtcccaaaaggtcattttccagagggatccgttacacttatattgtagcatgttttggcttcctccccttctgtatactcaacattcttgggaggtacacctgtcctgaaagccatatcagcagccagggcct

SEQ ID NO: 433411 - DNA, 140 bp, Artificial Sequence
  Synthetic
atacgccatgctgggtctcccatcattaacgacttgtcttaattcaatcttttggatgcaaaccataaggaaaaatgagccactttccctctactctgagctaaggaaatttctcttatccgtacttgggagtcggccat

SEQ ID NO: 433412 - DNA, 140 bp, Artificial Sequence
  Synthetic
atggccgactcccaagtacggataagagaaatttccttagctcagagtagagggaaagtggctcatttttccttatggtttgcatccaaaagattgaattaagacaagtcgttaatgatgggagacccagcatggcgtat

SEQ ID NO: 433413 - DNA, 140 bp, Artificial Sequence
  Synthetic
atacgccatgctgggtctccttatatagtagcatattaatggatcctttacctctcctcctatgctcttcttataagtcactcaaccggtgaaacgccgagtttgttggcttagagttttcgtacttgggagtcggccat

SEQ ID NO: 433414 - DNA, 140 bp, Artificial Sequence
  Synthetic
atggccgactcccaagtacgaaaactctaagccaacaaactcggcgtttcaccggttgagtgacttataagaagagcataggaggagaggtaaaggatccattaatatgctactatataaggagacccagcatggcgtat

SEQ ID NO: 433415 - DNA, 140 bp, Artificial Sequence
  Synthetic
atacgccatgctgggtctccccttaaccttacggattgtacgcttaatacaaagtcattgacaactcctaccgggatagaaagtttaggtataagtccgttacgatcctctagatattcacgtacttgggagtcggccat

SEQ ID NO: 433416 - DNA, 140 bp, Artificial Sequence
  Synthetic
atggccgactcccaagtacgtgaatatctagaggatcgtaacggacttatacctaaactttctatcccggtaggagttgtcaatgactttgtattaagcgtacaatccgtaaggttaaggggagacccagcatggcgtat

SEQ ID NO: 433417 - DNA, 140 bp, Artificial Sequence
  Synthetic
atacgccatgctgggtctcccctgttttactgaatgtagtaattaatgattgacttgagtgttgatggaatcaagatagtgcgatgattcatattataaggtacaatttccatttctgttcgtacttgggagtcggccat

SEQ ID NO: 433418 - DNA, 140 bp, Artificial Sequence
  Synthetic
atggccgactcccaagtacgaacagaaatggaaattgtaccttataatatgaatcatcgcactatcttgattccatcaacactcaagtcaatcattaattactacattcagtaaaacaggggagacccagcatggcgtat

SEQ ID NO: 433419 - DNA, 140 bp, Artificial Sequence
  Synthetic
aggccctggctgctgatatgaataagacagtgcacaaaatgattttctcgaggcaaggacaggggtaccgtcacatgaatctgacttctactaataaatattggacaagtaacaatggaagaccttttgggacagcggtg

SEQ ID NO: 433420 - DNA, 140 bp, Artificial Sequence
  Synthetic
caccgctgtcccaaaaggtcttccattgttacttgtccaatatttattagtagaagtcagattcatgtgacggtacccctgtccttgcctcgagaaaatcattttgtgcactgtcttattcatatcagcagccagggcct

SEQ ID NO: 433421 - DNA, 140 bp, Artificial Sequence
  Synthetic
aggccctggctgctgatatggtcgaagaatattaaagattctctttaatattcaaaaacagttcttaattcttttcctttcctttattaatataatatatcgataaatcttacaatgtgggaccttttgggacagcggtg

SEQ ID NO: 433422 - DNA, 140 bp, Artificial Sequence
  Synthetic
caccgctgtcccaaaaggtcccacattgtaagatttatcgatatattatattaataaaggaaaggaaaagaattaagaactgtttttgaatattaaagagaatctttaatattcttcgaccatatcagcagccagggcct

SEQ ID NO: 433423 - DNA, 140 bp, Artificial Sequence
  Synthetic
atacgccatgctgggtctcccttttcctttcctttattaatataatatatcgataaatcttacaatgtgggactcgtcatacatgcaacaagtgagtgagggactgatgactgggaaagtcgtacttgggagtcggccat

SEQ ID NO: 433424 - DNA, 140 bp, Artificial Sequence
  Synthetic
atggccgactcccaagtacgactttcccagtcatcagtccctcactcacttgttgcatgtatgacgagtcccacattgtaagatttatcgatatattatattaataaaggaaaggaaaagggagacccagcatggcgtat

SEQ ID NO: 433425 - DNA, 140 bp, Artificial Sequence
  Synthetic
aggccctggctgctgatatggactcgtcatacatgcaacaagtgagtgagggactgatgactgggaaagttccaatagatcaagtgttcggcactaatcccttagaaaagttatataagagaccttttgggacagcggtg

SEQ ID NO: 433426 - DNA, 140 bp, Artificial Sequence
  Synthetic
caccgctgtcccaaaaggtctcttatataacttttctaagggattagtgccgaacacttgatctattggaactttcccagtcatcagtccctcactcacttgttgcatgtatgacgagtccatatcagcagccagggcct

SEQ ID NO: 433427 - DNA, 140 bp, Artificial Sequence
  Synthetic
atacgccatgctgggtctcctccaatagatcaagtgttcggcactaatcccttagaaaagttatataagagaagaaagccgaaagggacagtgggattacaatgtagtccttgcttaatacgtacttgggagtcggccat

SEQ ID NO: 433428 - DNA, 140 bp, Artificial Sequence
  Synthetic
atggccgactcccaagtacgtattaagcaaggactacattgtaatcccactgtccctttcggctttcttctcttatataacttttctaagggattagtgccgaacacttgatctattggaggagacccagcatggcgtat

SEQ ID NO: 433429 - DNA, 140 bp, Artificial Sequence
  Synthetic
aggccctggctgctgatatgtcaacaccacagacccaaacaatgatgatgaggacctcataacatccggttcagggtccggagaacaggaaccctatacaacttcagatgcggtcactaagaccttttgggacagcggtg

SEQ ID NO: 433430 - DNA, 140 bp, Artificial Sequence
  Synthetic
caccgctgtcccaaaaggtcttagtgaccgcatctgaagttgtatagggttcctgttctccggaccctgaaccggatgttatgaggtcctcatcatcattgtttgggtctgtggtgttgacatatcagcagccagggcct

SEQ ID NO: 433431 - DNA, 140 bp, Artificial Sequence
  Synthetic
atacgccatgctgggtctcctcaaaatcaacaagtactgacgacattgtttgggatcagctaatcgtaaagaaaacattggctgacttgctcatacctataaataggcaaatgtcggacacgtacttgggagtcggccat

SEQ ID NO: 433432 - DNA, 140 bp, Artificial Sequence
  Synthetic
atggccgactcccaagtacgtgtccgacatttgcctatttataggtatgagcaagtcagccaatgttttctttacgattagctgatcccaaacaatgtcgtcagtacttgttgattttgaggagacccagcatggcgtat

SEQ ID NO: 433433 - DNA, 140 bp, Artificial Sequence
  Synthetic
aggccctggctgctgatatggaatgttatataacatagataagttaaatgctttgcttgaatcaagaagactaatattgaacaacctaactatccaaattacagatattacaaatccattgaccttttgggacagcggtg

SEQ ID NO: 433434 - DNA, 140 bp, Artificial Sequence
  Synthetic
caccgctgtcccaaaaggtcaatggatttgtaatatctgtaatttggatagttaggttgttcaatattagtcttcttgattcaagcaaagcatttaacttatctatgttatataacattccatatcagcagccagggcct

SEQ ID NO: 433435 - DNA, 140 bp, Artificial Sequence
  Synthetic
atacgccatgctgggtctccttcaaagcaccctaagcgaaatgacaacaaaaatccatgagatcgagcgtcaactacatgatatcaccccagttgtaaaaatgggaaaaacgctagaagccgtacttgggagtcggccat

SEQ ID NO: 433436 - DNA, 140 bp, Artificial Sequence
  Synthetic
atggccgactcccaagtacggcttctagcgtttttcccatttttacaactggggtgatatcatgtagttgacgctcgatctcatggatttttgttgtcatttcgcttagggtgctttgaaggagacccagcatggcgtat

SEQ ID NO: 433437 - DNA, 140 bp, Artificial Sequence
  Synthetic
aggccctggctgctgatatgactattgtgaatatttggacacgtacttctcctaatattccaaaaattagcatcatcaaggtgtttttattagactatgaagggactttgttcttaatgagaccttttgggacagcggtg

SEQ ID NO: 433438 - DNA, 140 bp, Artificial Sequence
  Synthetic
caccgctgtcccaaaaggtctcattaagaacaaagtcccttcatagtctaataaaaacaccttgatgatgctaatttttggaatattaggagaagtacgtgtccaaatattcacaatagtcatatcagcagccagggcct

SEQ ID NO: 433439 - DNA, 140 bp, Artificial Sequence
  Synthetic
atacgccatgctgggtctccaatttccaaaggaatgtcagagatgctagctaagtacgatcatctcgtgatttcaactggaagaaccaccgcaccagctgctgcctttgatgcttacttacgtacttgggagtcggccat

SEQ ID NO: 433440 - DNA, 140 bp, Artificial Sequence
  Synthetic
atggccgactcccaagtacgtaagtaagcatcaaaggcagcagctggtgcggtggttcttccagttgaaatcacgagatgatcgtacttagctagcatctctgacattcctttggaaattggagacccagcatggcgtat

SEQ ID NO: 433441 - DNA, 140 bp, Artificial Sequence
  Synthetic
atacgccatgctgggtctcctctctgtatcactacaaaacaccaccaattacgacacacagagcacagccactgaaaatgaacaaaccagtgccccctcgaaaacaaccctgcccccaaccgtacttgggagtcggccat

SEQ ID NO: 433442 - DNA, 140 bp, Artificial Sequence
  Synthetic
atggccgactcccaagtacggttgggggcagggttgttttcgagggggcactggtttgttcattttcagtggctgtgctctgtgtgtcgtaattggtggtgttttgtagtgatacagagaggagacccagcatggcgtat

SEQ ID NO: 433443 - DNA, 140 bp, Artificial Sequence
  Synthetic
atacgccatgctgggtctccaacgagcatggagtccccccccctcagcctgcaatcttcaaagatcttggagttgcccaacaagcctacagtcaaaagactatggtcaaaaaccaaacaacgtacttgggagtcggccat

SEQ ID NO: 433444 - DNA, 140 bp, Artificial Sequence
  Synthetic
atggccgactcccaagtacgttgtttggtttttgaccatagtcttttgactgtaggcttgttgggcaactccaagatctttgaagattgcaggctgagggggggggactccatgctcgttggagacccagcatggcgtat

SEQ ID NO: 433445 - DNA, 140 bp, Artificial Sequence
  Synthetic
atacgccatgctgggtctcccagatgcagctgacaaaatgtcaaaggttctggaactcagtgaagaaacattttccaagccaaacctttcagctaaggatttagctctattattatttaccgtacttgggagtcggccat

SEQ ID NO: 433446 - DNA, 140 bp, Artificial Sequence
  Synthetic
atggccgactcccaagtacggtaaataataatagagctaaatccttagctgaaaggtttggcttggaaaatgtttcttcactgagttccagaacctttgacattttgtcagctgcatctgggagacccagcatggcgtat

SEQ ID NO: 433447 - DNA, 140 bp, Artificial Sequence
  Synthetic
atacgccatgctgggtctcctcatctccctggcaacaacactccattccacatactcgcccaagtcctttcaaaaattgcttacaaatcaggaaagtctggagcattcttggatgcattccgtacttgggagtcggccat

SEQ ID NO: 433448 - DNA, 140 bp, Artificial Sequence
  Synthetic
atggccgactcccaagtacggaatgcatccaagaatgctccagactttcctgatttgtaagcaatttttgaaaggacttgggcgagtatgtggaatggagtgttgttgccagggagatgaggagacccagcatggcgtat

SEQ ID NO: 433449 - DNA, 140 bp, Artificial Sequence
  Synthetic
aggccctggctgctgatatgctccaattgattttgatccagttccaaatacaaagacgatctttgatgaatcttctagttctggtgcttcggctgaggaagatcaacatgcctcccccaagaccttttgggacagcggtg

SEQ ID NO: 433450 - DNA, 140 bp, Artificial Sequence
  Synthetic
caccgctgtcccaaaaggtcttgggggaggcatgttgatcttcctcagccgaagcaccagaactagaagattcatcaaagatcgtctttgtatttggaactggatcaaaatcaattggagcatatcagcagccagggcct

SEQ ID NO: 433451 - DNA, 140 bp, Artificial Sequence
  Synthetic
atacgccatgctgggtctcccatcagattttaagcgaaggggagaatgctcaggctgcattaactcgattaagcagaacattcgatgctttccttggagcagttcctccagtaataaaagcgtacttgggagtcggccat

SEQ ID NO: 433452 - DNA, 140 bp, Artificial Sequence
  Synthetic
atggccgactcccaagtacgcttttattactggaggaactgctccaaggaaagcatcgaatgttctgcttaatcgagttaatgcagcctgagcattctccccttcgcttaaaatctgatgggagacccagcatggcgtat

SEQ ID NO: 433453 - DNA, 140 bp, Artificial Sequence
  Synthetic
aggccctggctgctgatatgtactactcaaattggattttattagaaacacaaagatcgcagaacaaaaattacttaatagagtaatcgggtatattctattctttccgttcggtctgttgaccttttgggacagcggtg

SEQ ID NO: 433454 - DNA, 140 bp, Artificial Sequence
  Synthetic
caccgctgtcccaaaaggtcaacagaccgaacggaaagaatagaatatacccgattactctattaagtaatttttgttctgcgatctttgtgtttctaataaaatccaatttgagtagtacatatcagcagccagggcct

SEQ ID NO: 433455 - DNA, 140 bp, Artificial Sequence
  Synthetic
atacgccatgctgggtctccactctggagaaaatgagaacgattgtgatgcagagttaagaatttggagcgttcaggaggatgacctggcagcagggctcagttggataccgttttttggcgtacttgggagtcggccat

SEQ ID NO: 433456 - DNA, 140 bp, Artificial Sequence
  Synthetic
atggccgactcccaagtacgccaaaaaacggtatccaactgagccctgctgccaggtcatcctcctgaacgctccaaattcttaactctgcatcacaatcgttctcattttctccagagtggagacccagcatggcgtat

SEQ ID NO: 433457 - DNA, 140 bp, Artificial Sequence
  Synthetic
aggccctggctgctgatatgaaatatccatcaagcaggtgtcgcaaaataccaggggtttcatatgctgccatatttactaaatcttacataggattatataattctcttcgatacacgtgaccttttgggacagcggtg

SEQ ID NO: 433458 - DNA, 140 bp, Artificial Sequence
  Synthetic
caccgctgtcccaaaaggtcacgtgtatcgaagagaattatataatcctatgtaagatttagtaaatatggcagcatatgaaacccctggtattttgcgacacctgcttgatggatatttcatatcagcagccagggcct

SEQ ID NO: 433459 - DNA, 140 bp, Artificial Sequence
  Synthetic
atacgccatgctgggtctcctgaacagggtgaaacccgggctcttaaaatctaatccttgcgattcattcttgaacaaagaatgatctttctaggttaatacaaaaacactaaacatttccgtacttgggagtcggccat

SEQ ID NO: 433460 - DNA, 140 bp, Artificial Sequence
  Synthetic
atggccgactcccaagtacggaaatgtttagtgtttttgtattaacctagaaagatcattctttgttcaagaatgaatcgcaaggattagattttaagagcccgggtttcaccctgttcaggagacccagcatggcgtat

SEQ ID NO: 433461 - DNA, 140 bp, Artificial Sequence
  Synthetic
aggccctggctgctgatatggtatgagaaatcataaaataaacaagaagaagaaaaaactattagacagcttactttacacaagataatcttatatcgctttaagccttacataagtgaggaccttttgggacagcggtg

SEQ ID NO: 433462 - DNA, 140 bp, Artificial Sequence
  Synthetic
caccgctgtcccaaaaggtcctcacttatgtaaggcttaaagcgatataagattatcttgtgtaaagtaagctgtctaatagttttttcttcttcttgtttattttatgatttctcataccatatcagcagccagggcct

SEQ ID NO: 433463 - DNA, 140 bp, Artificial Sequence
  Synthetic
atacgccatgctgggtctccaagagtttgtggatgatttaagcatatttgggtaaatttaatcagggtagtagtttaaatttgttttaagcgtgattttcattaagagagggttaattagcgtacttgggagtcggccat

SEQ ID NO: 433464 - DNA, 140 bp, Artificial Sequence
  Synthetic
atggccgactcccaagtacgctaattaaccctctcttaatgaaaatcacgcttaaaacaaatttaaactactaccctgattaaatttacccaaatatgcttaaatcatccacaaactcttggagacccagcatggcgtat

SEQ ID NO: 433465 - DNA, 140 bp, Artificial Sequence
  Synthetic
atacgccatgctgggtctccaaaatcacgtgcacagattaacttgtgattaaacattcggtcacaccggtggtaactttttaatgttagttattcaaatattattgctcataattggtaccgtacttgggagtcggccat

SEQ ID NO: 433466 - DNA, 140 bp, Artificial Sequence
  Synthetic
atggccgactcccaagtacggtaccaattatgagcaataatatttgaataactaacattaaaaagttaccaccggtgtgaccgaatgtttaatcacaagttaatctgtgcacgtgattttggagacccagcatggcgtat

SEQ ID NO: 433467 - DNA, 140 bp, Artificial Sequence
  Synthetic
atacgccatgctgggtctcctgcttggacctgattgttgcattggaatagaagacttgtccaggaatatttcggaacaaattgaccaaatcaaaaaagatgaacaaaaagaggggactggcgtacttgggagtcggccat

SEQ ID NO: 433468 - DNA, 140 bp, Artificial Sequence
  Synthetic
atggccgactcccaagtacgccagtcccctctttttgttcatcttttttgatttggtcaatttgttccgaaatattcctggacaagtcttctattccaatgcaacaatcaggtccaagcaggagacccagcatggcgtat

SEQ ID NO: 433469 - DNA, 140 bp, Artificial Sequence
  Synthetic
atacgccatgctgggtctcctttttagtttcaactcttattgcgagatttgaacacaattctactaactgcaataagtgaccccgaattcaagtttactgaaaactacgatgataataatcgtacttgggagtcggccat

SEQ ID NO: 433470 - DNA, 140 bp, Artificial Sequence
  Synthetic
atggccgactcccaagtacgattattatcatcgtagttttcagtaaacttgaattcggggtcacttattgcagttagtagaattgtgttcaaatctcgcaataagagttgaaactaaaaaggagacccagcatggcgtat

SEQ ID NO: 433471 - DNA, 140 bp, Artificial Sequence
  Synthetic
atacgccatgctgggtctcctatctcaaaagccaaataattgacttcttactctttgggaatttactaacaatataggaaagatatttattcttacgtaatccttggcccaacggaaactcgtacttgggagtcggccat

SEQ ID NO: 433472 - DNA, 140 bp, Artificial Sequence
  Synthetic
atggccgactcccaagtacgagtttccgttgggccaaggattacgtaagaataaatatctttcctatattgttagtaaattcccaaagagtaagaagtcaattatttggcttttgagataggagacccagcatggcgtat

SEQ ID NO: 433473 - DNA, 140 bp, Artificial Sequence
  Synthetic
aggccctggctgctgatatgacttgggcattttgctactattatccatagctgtcttgattgctctatcctgtatttgtcgtatctttaccaaatatatcgggtaatattaagtgtgtaagaccttttgggacagcggtg

SEQ ID NO: 433474 - DNA, 140 bp, Artificial Sequence
  Synthetic
caccgctgtcccaaaaggtcttacacacttaatattacccgatatatttggtaaagatacgacaaatacaggatagagcaatcaagacagctatggataatagtagcaaaatgcccaagtcatatcagcagccagggcct

SEQ ID NO: 433475 - DNA, 140 bp, Artificial Sequence
  Synthetic
aggccctggctgctgatatgtcttttacatacattggggaaagaactaggttatcgttgagattagaaggactacgtcatgttttctctgatgacaagtggcaaaatttcgtagttaaatgaccttttgggacagcggtg

SEQ ID NO: 433476 - DNA, 140 bp, Artificial Sequence
  Synthetic
caccgctgtcccaaaaggtcatttaactacgaaattttgccacttgtcatcagagaaaacatgacgtagtccttctaatctcaacgataacctagttctttccccaatgtatgtaaaagacatatcagcagccagggcct

SEQ ID NO: 433477 - DNA, 140 bp, Artificial Sequence
  Synthetic
atacgccatgctgggtctccataagtgctgcacacggcatgtaccatctgaatatctattttttgataaacctttagatgtagatttgaacaagtatatggacaatgaattggtttatgacgtacttgggagtcggccat

SEQ ID NO: 433478 - DNA, 140 bp, Artificial Sequence
  Synthetic
atggccgactcccaagtacgtcataaaccaattcattgtccatatacttgttcaaatctacatctaaaggtttatcaaaaaatagatattcagatggtacatgccgtgtgcagcacttatggagacccagcatggcgtat

SEQ ID NO: 433479 - DNA, 140 bp, Artificial Sequence
  Synthetic
atacgccatgctgggtctccttttacaaagcaaggtttttaaattcaagtagatcaagtctactcttgctgaacttacttctttaaaaattaatttacactaaacaattcgtttttgttgcgtacttgggagtcggccat

SEQ ID NO: 433480 - DNA, 140 bp, Artificial Sequence
  Synthetic
atggccgactcccaagtacgcaacaaaaacgaattgtttagtgtaaattaatttttaaagaagtaagttcagcaagagtagacttgatctacttgaatttaaaaaccttgctttgtaaaaggagacccagcatggcgtat

SEQ ID NO: 433481 - DNA, 140 bp, Artificial Sequence
  Synthetic
atacgccatgctgggtctccagacacacaaaaacaagagatgatgattttgtgtatcatataaataaagaagaatattaacattgacattgagacttgtcagtcgtgtaatattcttgaacgtacttgggagtcggccat

SEQ ID NO: 433482 - DNA, 140 bp, Artificial Sequence
  Synthetic
atggccgactcccaagtacgttcaagaatattacacgactgacaagtctcaatgtcaatgttaatattcttctttatttatatgatacacaaaatcatcatctcttgtttttgtgtgtctggagacccagcatggcgtat

SEQ ID NO: 433483 - DNA, 140 bp, Artificial Sequence
  Synthetic
atacgccatgctgggtctccacggaacaaattcagatatggccagttccagcaattataatacgtatatgcaatacctgaaccctcccccttatgctgatcatggtgcaaatcagttaatcgtacttgggagtcggccat

SEQ ID NO: 433484 - DNA, 140 bp, Artificial Sequence
  Synthetic
atggccgactcccaagtacgattaactgatttgcaccatgatcagcataagggggagggttcaggtattgcatatacgtattataattgctggaactggccatatctgaatttgttccgtggagacccagcatggcgtat

SEQ ID NO: 433485 - DNA, 140 bp, Artificial Sequence
  Synthetic
aggccctggctgctgatatgtataattcaggcgaaattgactcctcaacaatactgtgaattattctctctacaaaagcattggggtcaccccgttttatataatgatgttgcactagatgaccttttgggacagcggtg

SEQ ID NO: 433486 - DNA, 140 bp, Artificial Sequence
  Synthetic
caccgctgtcccaaaaggtcatctagtgcaacatcattatataaaacggggtgaccccaatgcttttgtagagagaataattcacagtattgttgaggagtcaatttcgcctgaattatacatatcagcagccagggcct

SEQ ID NO: 433487 - DNA, 140 bp, Artificial Sequence
  Synthetic
atacgccatgctgggtctccactttggaagcaataattgatatatctgcttataatgagcggacggtcaaaggagtcccagcgtggctgcctcttgggatcatgagcaattttgaatacccgtacttgggagtcggccat

SEQ ID NO: 433488 - DNA, 140 bp, Artificial Sequence
  Synthetic
atggccgactcccaagtacgggtattcaaaattgctcatgatcccaagaggcagccacgctgggactcctttgaccgtccgctcattataagcagatatatcaattattgcttccaaagtggagacccagcatggcgtat

SEQ ID NO: 433489 - DNA, 140 bp, Artificial Sequence
  Synthetic
atacgccatgctgggtctccctttagcccacactgttgctgcattgcttacagggagctacacgattacccaattcacgcacaatgggcaaaaatttgttcgtgttaatcgacttgggaccgtacttgggagtcggccat

SEQ ID NO: 433490 - DNA, 140 bp, Artificial Sequence
  Synthetic
atggccgactcccaagtacggtcccaagtcgattaacacgaacaaatttttgcccattgtgcgtgaattgggtaatcgtgtagctccctgtaagcaatgcagcaacagtgtgggctaaagggagacccagcatggcgtat

SEQ ID NO: 433491 - DNA, 140 bp, Artificial Sequence
  Synthetic
atacgccatgctgggtctcctcttagacaacatattgtgtcaaattcatttccgtcacaagccgaaatttatcagcatctttgggagtggtatttcgtggagcatgaacctcttttctcacgtacttgggagtcggccat

SEQ ID NO: 433492 - DNA, 140 bp, Artificial Sequence
  Synthetic
atggccgactcccaagtacgtgagaaaagaggttcatgctccacgaaataccactcccaaagatgctgataaatttcggcttgtgacggaaatgaatttgacacaatatgttgtctaagaggagacccagcatggcgtat

SEQ ID NO: 433493 - DNA, 140 bp, Artificial Sequence
  Synthetic
atacgccatgctgggtctccaggaatcccagcacatccactcagaatgctgcgggaaggaaaccaagcttttgtccaaaacatggtgattcccaggaacttttctacaaatcagtttacgcgtacttgggagtcggccat

SEQ ID NO: 433494 - DNA, 140 bp, Artificial Sequence
  Synthetic
atggccgactcccaagtacgcgtaaactgatttgtagaaaagttcctgggaatcaccatgttttggacaaaagcttggtttccttcccgcagcattctgagtggatgtgctgggattcctggagacccagcatggcgtat

SEQ ID NO: 433495 - DNA, 140 bp, Artificial Sequence
  Synthetic
atacgccatgctgggtctccttatcctttattaagaaaaagatagacagaacacaaagaattgataaaattttactttgatcaattttgcgaggaattataaaaatcttgagggacaaatcgtacttgggagtcggccat

SEQ ID NO: 433496 - DNA, 140 bp, Artificial Sequence
  Synthetic
atggccgactcccaagtacgatttgtccctcaagatttttataattcctcgcaaaattgatcaaagtaaaattttatcaattctttgtgttctgtctatctttttcttaataaaggataaggagacccagcatggcgtat

SEQ ID NO: 433497 - DNA, 140 bp, Artificial Sequence
  Synthetic
atacgccatgctgggtctcctacaatcttactaatctagtattgagcgtgcaaaagcttcctgatgatgcttggcgcccgtccaaagacaaattaatcggaaacaccatgcaccctgcggcgtacttgggagtcggccat

SEQ ID NO: 433498 - DNA, 140 bp, Artificial Sequence
  Synthetic
atggccgactcccaagtacgccgcagggtgcatggtgtttccgattaatttgtctttggacgggcgccaagcatcatcaggaagcttttgcacgctcaatactagattagtaagattgtaggagacccagcatggcgtat

SEQ ID NO: 433499 - DNA, 140 bp, Artificial Sequence
  Synthetic
atacgccatgctgggtctcctttctgtacacccaaacctgccgcctattgtcctaccaacagttaaaaaacaagcctatcgtcagcataagaatcctaacaatggaccactgctggccatcgtacttgggagtcggccat

SEQ ID NO: 433500 - DNA, 140 bp, Artificial Sequence
  Synthetic
atggccgactcccaagtacgatggccagcagtggtccattgttaggattcttatgctgacgataggcttgttttttaactgttggtaggacaataggcggcaggtttgggtgtacagaaaggagacccagcatggcgtat

SEQ ID NO: 433501 - DNA, 140 bp, Artificial Sequence
  Synthetic
aggccctggctgctgatatgtgagcaaggtgagacacgggccctgaaaatctaattctcattgttaacagttgcaaggggagtgatctttccgagttgatacaaagacactaaacatttcgaccttttgggacagcggtg

SEQ ID NO: 433502 - DNA, 140 bp, Artificial Sequence
  Synthetic
caccgctgtcccaaaaggtcgaaatgtttagtgtctttgtatcaactcggaaagatcactccccttgcaactgttaacaatgagaattagattttcagggcccgtgtctcaccttgctcacatatcagcagccagggcct

SEQ ID NO: 433503 - DNA, 140 bp, Artificial Sequence
  Synthetic
atacgccatgctgggtctccatctggcatccttcatcaactgagggttgaaaaagtcccagagaagacgagcttattcaggatttcacttcctgccgacatgttctcagtaaaagagggccgtacttgggagtcggccat

SEQ ID NO: 433504 - DNA, 140 bp, Artificial Sequence
  Synthetic
atggccgactcccaagtacggccctcttttactgagaacatgtcggcaggaagtgaaatcctgaataagctcgtcttctctgggactttttcaaccctcagttgatgaaggatgccagatggagacccagcatggcgtat

SEQ ID NO: 433505 - DNA, 140 bp, Artificial Sequence
  Synthetic
aggccctggctgctgatatgtgtatgagaaataataaaataaacaagaagaagaaaaaactattagacagcttgctttacacaagataatcttatatcgtctcaagccgtacataagtgggaccttttgggacagcggtg

SEQ ID NO: 433506 - DNA, 140 bp, Artificial Sequence
  Synthetic
caccgctgtcccaaaaggtcccacttatgtacggcttgagacgatataagattatcttgtgtaaagcaagctgtctaatagttttttcttcttcttgtttattttattatttctcatacacatatcagcagccagggcct

SEQ ID NO: 433507 - DNA, 140 bp, Artificial Sequence
  Synthetic
atacgccatgctgggtctccatgatgaagaaaagaggagaaggttctccggtagtttatttccaagcgcctgagaattttcctttgaatggcttcaacaaccggcaagttgtgctagcatcgtacttgggagtcggccat

SEQ ID NO: 433508 - DNA, 140 bp, Artificial Sequence
  Synthetic
atggccgactcccaagtacgatgctagcacaacttgccggttgttgaagccattcaaaggaaaattctcaggcgcttggaaataaactaccggagaaccttctcctcttttcttcatcatggagacccagcatggcgtat

SEQ ID NO: 433509 - DNA, 140 bp, Artificial Sequence
  Synthetic
aggccctggctgctgatatgacccccaacattcaacttatcgaaaccccctcctcctccaaaagacatgtgtaggaacatgaaaattggattgccgtgcactgatcccacttgtaatagagaccttttgggacagcggtg

SEQ ID NO: 433510 - DNA, 140 bp, Artificial Sequence
  Synthetic
caccgctgtcccaaaaggtctctattacaagtgggatcagtgcacggcaatccaattttcatgttcctacacatgtcttttggaggaggagggggtttcgataagttgaatgttgggggtcatatcagcagccagggcct

SEQ ID NO: 433511 - DNA, 140 bp, Artificial Sequence
  Synthetic
atacgccatgctgggtctccgtaggaacatgaaaattggattgccgtgcactgatcccacttgtaatagagatcatgaccttgataatctaacaaatcgtgaacttttgctattgatggccgtacttgggagtcggccat

SEQ ID NO: 433512 - DNA, 140 bp, Artificial Sequence
  Synthetic
atggccgactcccaagtacggccatcaatagcaaaagttcacgatttgttagattatcaaggtcatgatctctattacaagtgggatcagtgcacggcaatccaattttcatgttcctacggagacccagcatggcgtat

SEQ ID NO: 433513 - DNA, 140 bp, Artificial Sequence
  Synthetic
aggccctggctgctgatatggatcatgaccttgataatctaacaaatcgtgaacttttgctattgatggcccgaaaaatgctccccaatacagacaagacttttagaagtctgcaggattgaccttttgggacagcggtg

SEQ ID NO: 433514 - DNA, 140 bp, Artificial Sequence
  Synthetic
caccgctgtcccaaaaggtcaatcctgcagacttctaaaagtcttgtctgtattggggagcatttttcgggccatcaatagcaaaagttcacgatttgttagattatcaaggtcatgatccatatcagcagccagggcct

SEQ ID NO: 433515 - DNA, 140 bp, Artificial Sequence
  Synthetic
atacgccatgctgggtctcctgcaggatcattttaagttgattttaatagtgcttgaacccttcactgctaccctaaaggattgattgagctgattaacctataatgtataacttcttttcgtacttgggagtcggccat

SEQ ID NO: 433516 - DNA, 140 bp, Artificial Sequence
  Synthetic
atggccgactcccaagtacgaaaagaagttatacattataggttaatcagctcaatcaatcctttagggtagcagtgaagggttcaagcactattaaaatcaacttaaaatgatcctgcaggagacccagcatggcgtat

SEQ ID NO: 433517 - DNA, 140 bp, Artificial Sequence
  Synthetic
atacgccatgctgggtctccaaaccgctaaatcaatcataagtttgtcagatcatataggatgaatgttaatacgtgataaatggttcctattcagttttactttaacttcatagtaaatcgtacttgggagtcggccat

SEQ ID NO: 433518 - DNA, 140 bp, Artificial Sequence
  Synthetic
atggccgactcccaagtacgatttactatgaagttaaagtaaaactgaataggaaccatttatcacgtattaacattcatcctatatgatctgacaaacttatgattgatttagcggtttggagacccagcatggcgtat

SEQ ID NO: 433519 - DNA, 140 bp, Artificial Sequence
  Synthetic
aggccctggctgctgatatgaccgggacagaatttttagatacaagcccattacaatcctctaggtattcatcaactcctagggaacggtctctactatctagagaacaagcctcatattgaccttttgggacagcggtg

SEQ ID NO: 433520 - DNA, 140 bp, Artificial Sequence
  Synthetic
caccgctgtcccaaaaggtcaatatgaggcttgttctctagatagtagagaccgttccctaggagttgatgaatacctagaggattgtaatgggcttgtatctaaaaattctgtcccggtcatatcagcagccagggcct

SEQ ID NO: 433521 - DNA, 140 bp, Artificial Sequence
  Synthetic
atacgccatgctgggtctcccttataagactactcatcttcaagttgatcaattcaaagataatttcccttctaaaataataagaaaaactaatgaagaacattaattgctaggtaaaggcgtacttgggagtcggccat

SEQ ID NO: 433522 - DNA, 140 bp, Artificial Sequence
  Synthetic
atggccgactcccaagtacgcctttacctagcaattaatgttcttcattagtttttcttattattttagaagggaaattatctttgaattgatcaacttgaagatgagtagtcttataagggagacccagcatggcgtat

SEQ ID NO: 433523 - DNA, 140 bp, Artificial Sequence
  Synthetic
atacgccatgctgggtctccaccatgaccgaattacacattaaccatgaaaatctcccgcaagaccaaaacggtgttatcaaacagacatatacaggtattcaccttgacaaaggaggtccgtacttgggagtcggccat

SEQ ID NO: 433524 - DNA, 140 bp, Artificial Sequence
  Synthetic
atggccgactcccaagtacggacctcctttgtcaaggtgaatacctgtatatgtctgtttgataacaccgttttggtcttgcgggagattttcatggttaatgtgtaattcggtcatggtggagacccagcatggcgtat

SEQ ID NO: 433525 - DNA, 140 bp, Artificial Sequence
  Synthetic
atacgccatgctgggtctcccaattaagttctttgaactttgcaaaagtaaggtctcactagtgagtaaattcctgtattagtagattaaaaccaaggaagcaccccgacatgaagaccacgtacttgggagtcggccat

SEQ ID NO: 433526 - DNA, 140 bp, Artificial Sequence
  Synthetic
atggccgactcccaagtacgtggtcttcatgtcggggtgcttccttggttttaatctactaatacaggaatttactcactagtgagaccttacttttgcaaagttcaaagaacttaattgggagacccagcatggcgtat

SEQ ID NO: 433527 - DNA, 140 bp, Artificial Sequence
  Synthetic
atacgccatgctgggtctccgaaaatcacgcgcacaaattaacttgtgattgaacgttcggtcacaccagtggtaacttttcaatgttagttactcaaatattattgctcataattggtacgtacttgggagtcggccat

SEQ ID NO: 433528 - DNA, 140 bp, Artificial Sequence
  Synthetic
atggccgactcccaagtacgtaccaattatgagcaataatatttgagtaactaacattgaaaagttaccactggtgtgaccgaacgttcaatcacaagttaatttgtgcgcgtgattttcggagacccagcatggcgtat

SEQ ID NO: 433529 - DNA, 140 bp, Artificial Sequence
  Synthetic
atacgccatgctgggtctcctatattttctaattagtctcattttaatccaaagtataaaaactctccctgttttagaaattgctagtaacagccaacctcaagatgtagattcagtgtgcgtacttgggagtcggccat

SEQ ID NO: 433530 - DNA, 140 bp, Artificial Sequence
  Synthetic
atggccgactcccaagtacgcacactgaatctacatcttgaggttggctgttactagcaatttctaaaacagggagagtttttatactttggattaaaatgagactaattagaaaatataggagacccagcatggcgtat

SEQ ID NO: 433531 - DNA, 140 bp, Artificial Sequence
  Synthetic
atacgccatgctgggtctccctccggaaccctccaaaagacagaagatgttcatctgatgggatttacactgagtgggcaaaaagttgctgattcccctttggaagcatctaaacgatggcgtacttgggagtcggccat

SEQ ID NO: 433532 - DNA, 140 bp, Artificial Sequence
  Synthetic
atggccgactcccaagtacgccatcgtttagatgcttccaaaggggaatcagcaactttttgcccactcagtgtaaatcccatcagatgaacatcttctgtcttttggagggttccggagggagacccagcatggcgtat

SEQ ID NO: 433533 - DNA, 140 bp, Artificial Sequence
  Synthetic
atacgccatgctgggtctcctttttagtttcaactcttattgcgagacttgaacacaattctactaacttcaataagtgaccccaaattcaagtttactgaagactacgacgataataatcgtacttgggagtcggccat

SEQ ID NO: 433534 - DNA, 140 bp, Artificial Sequence
  Synthetic
atggccgactcccaagtacgattattatcgtcgtagtcttcagtaaacttgaatttggggtcacttattgaagttagtagaattgtgttcaagtctcgcaataagagttgaaactaaaaaggagacccagcatggcgtat

SEQ ID NO: 433535 - DNA, 140 bp, Artificial Sequence
  Synthetic
atacgccatgctgggtctccgctttcaggacaggtgttcctcccaagaacgttgagtatacggaaggagaagaagctaaaacatgttacaatataagtgtaacagacccttctggaaaatcgtacttgggagtcggccat

SEQ ID NO: 433536 - DNA, 140 bp, Artificial Sequence
  Synthetic
atggccgactcccaagtacgattttccagaagggtctgttacacttatattgtaacatgttttagcttcttctccttccgtatactcaacgttcttgggaggaacacctgtcctgaaagcggagacccagcatggcgtat

SEQ ID NO: 433537 - DNA, 140 bp, Artificial Sequence
  Synthetic
atacgccatgctgggtctccatatatcactgttatgtgagatggtgcaaaccttagaatgataaccaaaagtaggaactggctatataacagtacctcgaaggtgttattcaatggtttacgtacttgggagtcggccat

SEQ ID NO: 433538 - DNA, 140 bp, Artificial Sequence
  Synthetic
atggccgactcccaagtacgtaaaccattgaataacaccttcgaggtactgttatatagccagttcctacttttggttatcattctaaggtttgcaccatctcacataacagtgatatatggagacccagcatggcgtat

SEQ ID NO: 433539 - DNA, 140 bp, Artificial Sequence
  Synthetic
atacgccatgctgggtctccccttgctgctggatcctcccagtaatatccgcgattaccctaaatgtaaaactgttcatcatattcaaggtcaaaaccctcatgcacaagggattgccctcgtacttgggagtcggccat

SEQ ID NO: 433540 - DNA, 140 bp, Artificial Sequence
  Synthetic
atggccgactcccaagtacgagggcaatcccttgtgcatgagggttttgaccttgaatatgatgaacagttttacatttagggtaatcgcggatattactgggaggatccagcagcaaggggagacccagcatggcgtat

SEQ ID NO: 433541 - DNA, 140 bp, Artificial Sequence
  Synthetic
atacgccatgctgggtctccccatttgtggggggcatttttcttgtatgatcgcgttgcctctacaacaatgtaccgaggcaaggtcttcactgaaggaaatatagcagctatgattgttcgtacttgggagtcggccat

SEQ ID NO: 433542 - DNA, 140 bp, Artificial Sequence
  Synthetic
atggccgactcccaagtacgaacaatcatagctgctatatttccttcagtgaagaccttgcctcggtacattgttgtagaggcaacgcgatcatacaagaaaaatgccccccacaaatggggagacccagcatggcgtat

SEQ ID NO: 433543 - DNA, 140 bp, Artificial Sequence
  Synthetic
atacgccatgctgggtctcctgatagattaatccttgaagttactcttctatatattatggaggaattaatattactaacaaaaggggtctacctaacaggtatgattgagtgatcagtacgtacttgggagtcggccat

SEQ ID NO: 433544 - DNA, 140 bp, Artificial Sequence
  Synthetic
atggccgactcccaagtacgtactgatcactcaatcatacctgttaggtagaccccttttgttagtaatattaattcctccataatatatagaagagtaacttcaaggattaatctatcaggagacccagcatggcgtat

SEQ ID NO: 433545 - DNA, 140 bp, Artificial Sequence
  Synthetic
atacgccatgctgggtctccaataagacagttcacagaatgattttttctaggcaaggacaaggttatcgtcacatgaacttgacctccaccaataaatattggacaagcagcaatgaaacgtacttgggagtcggccat

SEQ ID NO: 433546 - DNA, 140 bp, Artificial Sequence
  Synthetic
atggccgactcccaagtacgtttcattgctgcttgtccaatatttattggtggaggtcaagttcatgtgacgataaccttgtccttgcctagaaaaaatcattctgtgaactgtcttattggagacccagcatggcgtat

SEQ ID NO: 433547 - DNA, 140 bp, Artificial Sequence
  Synthetic
aggccctggctgctgatatgtcacatgaacttgacctccaccaataaatattggacaagcagcaatgaaacgcggagaaatgatacgggatgttttggcatcctccaagaatacaactccgaccttttgggacagcggtg

SEQ ID NO: 433548 - DNA, 140 bp, Artificial Sequence
  Synthetic
caccgctgtcccaaaaggtcggagttgtattcttggaggatgccaaaacatcccgtatcatttctccgcgtttcattgctgcttgtccaatatttattggtggaggtcaagttcatgtgacatatcagcagccagggcct

SEQ ID NO: 433549 - DNA, 140 bp, Artificial Sequence
  Synthetic
atacgccatgctgggtctccccaaacatggcagaattatcaacgcgttacaacttgcctgcaaatgttacggaaaaaagcataaatcttgaccttaattccacagcacgatggataaaagcgtacttgggagtcggccat

SEQ ID NO: 433550 - DNA, 140 bp, Artificial Sequence
  Synthetic
atggccgactcccaagtacgcttttatccatcgtgctgtggaattaaggtcaagatttatgcttttttccgtaacatttgcaggcaagttgtaacgcgttgataattctgccatgtttggggagacccagcatggcgtat

SEQ ID NO: 433551 - DNA, 140 bp, Artificial Sequence
  Synthetic
atacgccatgctgggtctccacaaacaatcaaacatgctctccatctcttaaacctccatccctgcccacagtaactccgagcattcactctacaaatactcaaattaatactgctaaatcgtacttgggagtcggccat

SEQ ID NO: 433552 - DNA, 140 bp, Artificial Sequence
  Synthetic
atggccgactcccaagtacgatttagcagtattaatttgagtatttgtagagtgaatgctcggagttactgtgggcagggatggaggtttaagagatggagagcatgtttgattgtttgtggagacccagcatggcgtat

SEQ ID NO: 433553 - DNA, 140 bp, Artificial Sequence
  Synthetic
aggccctggctgctgatatgaacccagtgttgggggctggacagtgaagtggggaaactttgttttccacataccaaatactgggatgacattgttgcatcatttaaagtctaacttcgtgaccttttgggacagcggtg

SEQ ID NO: 433554 - DNA, 140 bp, Artificial Sequence
  Synthetic
caccgctgtcccaaaaggtcacgaagttagactttaaatgatgcaacaatgtcatcccagtatttggtatgtggaaaacaaagtttccccacttcactgtccagcccccaacactgggttcatatcagcagccagggcct

SEQ ID NO: 433555 - DNA, 140 bp, Artificial Sequence
  Synthetic
atacgccatgctgggtctcctcaggatctggagaacaggggccccacacaactcttaatgtagtcactgaacagaaacaatcgtcaacaatattgtccactccttcactacatctaagcacgtacttgggagtcggccat

SEQ ID NO: 433556 - DNA, 140 bp, Artificial Sequence
  Synthetic
atggccgactcccaagtacgtgcttagatgtagtgaaggagtggacaatattgttgacgattgtttctgttcagtgactacattaagagttgtgtggggcccctgttctccagatcctgaggagacccagcatggcgtat

SEQ ID NO: 433557 - DNA, 140 bp, Artificial Sequence
  Synthetic
atacgccatgctgggtctcccctcacaacatgagcaaaacagtacgaatccttcccgacatgctgtaactgagcacaatggaaccgacccaacaacacaaccagcaacgctcctcaacaacgtacttgggagtcggccat

SEQ ID NO: 433558 - DNA, 140 bp, Artificial Sequence
  Synthetic
atggccgactcccaagtacgttgttgaggagcgttgctggttgtgttgttgggtcggttccattgtgctcagttacagcatgtcgggaaggattcgtactgttttgctcatgttgtgaggggagacccagcatggcgtat

SEQ ID NO: 433559 - DNA, 140 bp, Artificial Sequence
  Synthetic
aggccctggctgctgatatgtagatctattgttcatatgctttcagaatggttgctcctagaggtaacgtcggcaatccatattagccccaatctgttgggaatctatttgacctcagacgaccttttgggacagcggtg

SEQ ID NO: 433560 - DNA, 140 bp, Artificial Sequence
  Synthetic
caccgctgtcccaaaaggtcgtctgaggtcaaatagattcccaacagattggggctaatatggattgccgacgttacctctaggagcaaccattctgaaagcatatgaacaatagatctacatatcagcagccagggcct

SEQ ID NO: 433561 - DNA, 140 bp, Artificial Sequence
  Synthetic
aggccctggctgctgatatgatgtttaagattctgatggcaggtgtgaaaaatttctttaataagatgttcactcttcatgttgtaaatgaccacggaaaacccagcagtattgaaataagaccttttgggacagcggtg

SEQ ID NO: 433562 - DNA, 140 bp, Artificial Sequence
  Synthetic
caccgctgtcccaaaaggtcttatttcaatactgctgggttttccgtggtcatttacaacatgaagagtgaacatcttattaaagaaatttttcacacctgccatcagaatcttaaacatcatatcagcagccagggcct

SEQ ID NO: 433563 - DNA, 140 bp, Artificial Sequence
  Synthetic
atacgccatgctgggtctcccactcttcatgttgtaaatgaccacggaaaacccagcagtattgaaataaagttaactggacaacagatcattatcactcgtgttaatatggggtttctacgtacttgggagtcggccat

SEQ ID NO: 433564 - DNA, 140 bp, Artificial Sequence
  Synthetic
atggccgactcccaagtacgtagaaaccccatattaacacgagtgataatgatctgttgtccagttaactttatttcaatactgctgggttttccgtggtcatttacaacatgaagagtgggagacccagcatggcgtat

SEQ ID NO: 433565 - DNA, 140 bp, Artificial Sequence
  Synthetic
atacgccatgctgggtctcctgacgacatcagatataacaagcaaacaccccacaaattcttcttcggattctagtccgacaacccgccctcctatatattttagaaagaaacgaagcatcgtacttgggagtcggccat

SEQ ID NO: 433566 - DNA, 140 bp, Artificial Sequence
  Synthetic
atggccgactcccaagtacgatgcttcgtttctttctaaaatatataggagggcgggttgtcggactagaatccgaagaagaatttgtggggtgtttgcttgttatatctgatgtcgtcaggagacccagcatggcgtat

SEQ ID NO: 433567 - DNA, 140 bp, Artificial Sequence
  Synthetic
aggccctggctgctgatatgctcagaatcagttgtttttgggctagtggctgaggcagttctaagagaacacagtcaaatggagaagggccaacccctcaatctgacacaatacatgaacgaccttttgggacagcggtg

SEQ ID NO: 433568 - DNA, 140 bp, Artificial Sequence
  Synthetic
caccgctgtcccaaaaggtcgttcatgtattgtgtcagattgaggggttggcccttctccatttgactgtgttctcttagaactgcctcagccactagcccaaaaacaactgattctgagcatatcagcagccagggcct

SEQ ID NO: 433569 - DNA, 140 bp, Artificial Sequence
  Synthetic
atacgccatgctgggtctcctttctggaaagaaggtgatatattcccgtttttagatgggttaataagtactgaaattgattttgatccaatcccaaacacagaaacaatctttgatgaacgtacttgggagtcggccat

SEQ ID NO: 433570 - DNA, 140 bp, Artificial Sequence
  Synthetic
atggccgactcccaagtacgttcatcaaagattgtttctgtgtttgggattggatcaaaatcaatttcagtacttattaacccatctaaaaacgggaatatatcaccttctttccagaaaggagacccagcatggcgtat

SEQ ID NO: 433571 - DNA, 140 bp, Artificial Sequence
  Synthetic
atacgccatgctgggtctccaacatagaaaacatatttatccttgtgtaatcctcggctcagttggaattaacttttgttgtaattcaagacgcttattcatagtagattatatgattttcgtacttgggagtcggccat

SEQ ID NO: 433572 - DNA, 140 bp, Artificial Sequence
  Synthetic
atggccgactcccaagtacgaaaatcatataatctactatgaataagcgtcttgaattacaacaaaagttaattccaactgagccgaggattacacaaggataaatatgttttctatgttggagacccagcatggcgtat

SEQ ID NO: 433573 - DNA, 140 bp, Artificial Sequence
  Synthetic
atacgccatgctgggtctcctcccccagctttaatacttcaactaatgaggaacaacacactcccccgaatatcagtttaactttctcttattttcctgataaaaatggagatactgcctcgtacttgggagtcggccat

SEQ ID NO: 433574 - DNA, 140 bp, Artificial Sequence
  Synthetic
atggccgactcccaagtacgaggcagtatctccatttttatcaggaaaataagagaaagttaaactgatattcgggggagtgtgttgttcctcattagttgaagtattaaagctgggggaggagacccagcatggcgtat

SEQ ID NO: 433575 - DNA, 140 bp, Artificial Sequence
  Synthetic
atacgccatgctgggtctccaatgttagggggctctgcaggagagaagagttcatcagatgctgttcggctatttcttacagcaagttatcagaattttatcaataatttcagttgtctgcgtacttgggagtcggccat

SEQ ID NO: 433576 - DNA, 140 bp, Artificial Sequence
  Synthetic
atggccgactcccaagtacgcagacaactgaaattattgataaaattctgataacttgctgtaagaaatagccgaacagcatctgatgaactcttctctcctgcagagccccctaacattggagacccagcatggcgtat

SEQ ID NO: 433577 - DNA, 140 bp, Artificial Sequence
  Synthetic
atacgccatgctgggtctccactctggggaaaacgagaatgattgtgatgcagagttgaggatttggagtgtgcaggaggacgatttggcggcagggcttagctggataccattttttggcgtacttgggagtcggccat

SEQ ID NO: 433578 - DNA, 140 bp, Artificial Sequence
  Synthetic
atggccgactcccaagtacgccaaaaaatggtatccagctaagccctgccgccaaatcgtcctcctgcacactccaaatcctcaactctgcatcacaatcattctcgttttccccagagtggagacccagcatggcgtat

SEQ ID NO: 433579 - DNA, 140 bp, Artificial Sequence
  Synthetic
atacgccatgctgggtctccgcatcatcttattaaatagttgtcatataacaggctgttcctataatctgattgtgagattataaacttgtagaattaccgtgggtcacaactgttgcatcgtacttgggagtcggccat

SEQ ID NO: 433580 - DNA, 140 bp, Artificial Sequence
  Synthetic
atggccgactcccaagtacgatgcaacagttgtgacccacggtaattctacaagtttataatctcacaatcagattataggaacagcctgttatatgacaactatttaataagatgatgcggagacccagcatggcgtat

SEQ ID NO: 433581 - DNA, 140 bp, Artificial Sequence
  Synthetic
atacgccatgctgggtctccccctggaatcgaaggactctatactgccggtttaatcaaaaatcagaacaatttagtttgtaggttgaggcgcttagctaatcaaactgctaaatccttgcgtacttgggagtcggccat

SEQ ID NO: 433582 - DNA, 140 bp, Artificial Sequence
  Synthetic
atggccgactcccaagtacgcaaggatttagcagtttgattagctaagcgcctcaacctacaaactaaattgttctgatttttgattaaaccggcagtatagagtccttcgattccagggggagacccagcatggcgtat

SEQ ID NO: 433583 - DNA, 140 bp, Artificial Sequence
  Synthetic
aggccctggctgctgatatgtttcaactggaagaaccactgcaccagctgctgcctttgatgcctacttaaatgagcatggtgtccctccccctcaacccgcgattttcaaagatcttgggaccttttgggacagcggtg

SEQ ID NO: 433584 - DNA, 140 bp, Artificial Sequence
  Synthetic
caccgctgtcccaaaaggtcccaagatctttgaaaatcgcgggttgagggggagggacaccatgctcatttaagtaggcatcaaaggcagcagctggtgcagtggttcttccagttgaaacatatcagcagccagggcct

SEQ ID NO: 433585 - DNA, 140 bp, Artificial Sequence
  Synthetic
atacgccatgctgggtctcctaggcatgcaattgactttttgcttacgaggtggggcggaacatgcaaggtgctaggacctgattgttgcatagggatagaagatctatctaaaaatatccgtacttgggagtcggccat

SEQ ID NO: 433586 - DNA, 140 bp, Artificial Sequence
  Synthetic
atggccgactcccaagtacggatatttttagatagatcttctatccctatgcaacaatcaggtcctagcaccttgcatgttccgccccacctcgtaagcaaaaagtcaattgcatgcctaggagacccagcatggcgtat

SEQ ID NO: 433587 - DNA, 140 bp, Artificial Sequence
  Synthetic
atacgccatgctgggtctcctatatctttagcaaagtaatgaaaatagccttgtcatgttagacgccagttatccatcttaagtgaatcctttcttcaatatgcagcatccaactcaatacgtacttgggagtcggccat

SEQ ID NO: 433588 - DNA, 140 bp, Artificial Sequence
  Synthetic
atggccgactcccaagtacgtattgagttggatgctgcatattgaagaaaggattcacttaagatggataactggcgtctaacatgacaaggctattttcattactttgctaaagatataggagacccagcatggcgtat

SEQ ID NO: 433589 - DNA, 140 bp, Artificial Sequence
  Synthetic
atacgccatgctgggtctcctcagaacaaattgacaaaatcagaaaggatgaacaaaaggaggaaactggctggggtctaggtggcaaatggtggacatctgactggggtgttctcaccacgtacttgggagtcggccat

SEQ ID NO: 433590 - DNA, 140 bp, Artificial Sequence
  Synthetic
atggccgactcccaagtacgtggtgagaacaccccagtcagatgtccaccatttgccacctagaccccagccagtttcctccttttgttcatcctttctgattttgtcaatttgttctgaggagacccagcatggcgtat

SEQ ID NO: 433591 - DNA, 140 bp, Artificial Sequence
  Synthetic
atacgccatgctgggtctcctcctgatgcaaggttgtcctcccctataatcctagaccagtgtgacttattagccagaagtttagggttgtatagtcattattcacataatccgaaattgcgtacttgggagtcggccat

SEQ ID NO: 433592 - DNA, 140 bp, Artificial Sequence
  Synthetic
atggccgactcccaagtacgcaatttcggattatgtgaataatgactatacaaccctaaacttctggctaataagtcacactggtctaggattataggggaggacaaccttgcatcaggaggagacccagcatggcgtat

SEQ ID NO: 433593 - DNA, 140 bp, Artificial Sequence
  Synthetic
atacgccatgctgggtctccatttgggcatcctgctactattatctatagctgttctgattgctctgtcctgtatctgtcgtatcttcactaaatacattggatgatataaagtttacaacgtacttgggagtcggccat

SEQ ID NO: 433594 - DNA, 140 bp, Artificial Sequence
  Synthetic
atggccgactcccaagtacgttgtaaactttatatcatccaatgtatttagtgaagatacgacagatacaggacagagcaatcagaacagctatagataatagtagcaggatgcccaaatggagacccagcatggcgtat

SEQ ID NO: 433595 - DNA, 140 bp, Artificial Sequence
  Synthetic
atacgccatgctgggtctcccgtaattgtaggattccacatcatatttaccgtttaaggaattcgacagcattaaaaacatttcttcagaactgttcaatactcaccgtcccttttcattcgtacttgggagtcggccat

SEQ ID NO: 433596 - DNA, 140 bp, Artificial Sequence
  Synthetic
atggccgactcccaagtacgaatgaaaagggacggtgagtattgaacagttctgaagaaatgtttttaatgctgtcgaattccttaaacggtaaatatgatgtggaatcctacaattacgggagacccagcatggcgtat

SEQ ID NO: 433597 - DNA, 140 bp, Artificial Sequence
  Synthetic
atacgccatgctgggtctcctggttagagctttaggaaagttgctgctgagccctttgtctaatctactgaaatcgacttaaagaatcctcagggagcttataactcaatgtgaatcgatcgtacttgggagtcggccat

SEQ ID NO: 433598 - DNA, 140 bp, Artificial Sequence
  Synthetic
atggccgactcccaagtacgatcgattcacattgagttataagctccctgaggattctttaagtcgatttcagtagattagacaaagggctcagcagcaactttcctaaagctctaaccaggagacccagcatggcgtat

SEQ ID NO: 433599 - DNA, 140 bp, Artificial Sequence
  Synthetic
aggccctggctgctgatatgaaatcgacttaaagaatcctcagggagcttataactcaatgtgaatcgattccctatatattgttgatcgtgatgatatagcagtcaagtgtcaccatcagaccttttgggacagcggtg

SEQ ID NO: 433600 - DNA, 140 bp, Artificial Sequence
  Synthetic
caccgctgtcccaaaaggtctgatggtgacacttgactgctatatcatcacgatcaacaatatatagggaatcgattcacattgagttataagctccctgaggattctttaagtcgatttcatatcagcagccagggcct

SEQ ID NO: 433601 - DNA, 140 bp, Artificial Sequence
  Synthetic
aggccctggctgctgatatgttaggagcaattcttctgatccaatgcatagaagtcactaattactactaaaatccttatctttaatccgaatattcacatagaaatcaattttgggaaagaccttttgggacagcggtg

SEQ ID NO: 433602 - DNA, 140 bp, Artificial Sequence
  Synthetic
caccgctgtcccaaaaggtctttcccaaaattgatttctatgtgaatattcggattaaagataaggattttagtagtaattagtgacttctatgcattggatcagaagaattgctcctaacatatcagcagccagggcct

SEQ ID NO: 433603 - DNA, 140 bp, Artificial Sequence
  Synthetic
atacgccatgctgggtctccaccatgtttttccagcttctgcaaggtcacaatgtgaggatttttctcctaaggaaaatccttattattgggggatgctgttactcgtgcatttatctcacgtacttgggagtcggccat

SEQ ID NO: 433604 - DNA, 140 bp, Artificial Sequence
  Synthetic
atggccgactcccaagtacgtgagataaatgcacgagtaacagcatcccccaataataaggattttccttaggagaaaaatcctcacattgtgaccttgcagaagctggaaaaacatggtggagacccagcatggcgtat

SEQ ID NO: 433605 - DNA, 140 bp, Artificial Sequence
  Synthetic
atacgccatgctgggtctccattccagtagcgcgtcttttcatgtcacttctctgaacctaagaccataataaatattggttaatgaggtcagctggtcaatcttctattttcatattaacgtacttgggagtcggccat

SEQ ID NO: 433606 - DNA, 140 bp, Artificial Sequence
  Synthetic
atggccgactcccaagtacgttaatatgaaaatagaagattgaccagctgacctcattaaccaatatttattatggtcttaggttcagagaagtgacatgaaaagacgcgctactggaatggagacccagcatggcgtat

SEQ ID NO: 433607 - DNA, 140 bp, Artificial Sequence
  Synthetic
aggccctggctgctgatatgatgtgaatgtaaattaagaaaaaccaatatataaaattaaaaaattaaaaaactttgatataagtaacacaaaacattcttcatctttttggtgtgtccagaccttttgggacagcggtg

SEQ ID NO: 433608 - DNA, 140 bp, Artificial Sequence
  Synthetic
caccgctgtcccaaaaggtctggacacaccaaaaagatgaagaatgttttgtgttacttatatcaaagttttttaattttttaattttatatattggtttttcttaatttacattcacatcatatcagcagccagggcct

SEQ ID NO: 433609 - DNA, 140 bp, Artificial Sequence
  Synthetic
atacgccatgctgggtctccagatatactgctcagaaactcctagtttgcaacccaatcttggaaaaataaacctcctcttttgatcataactatctctatcaatgtcttgaacacttaacgtacttgggagtcggccat

SEQ ID NO: 433610 - DNA, 140 bp, Artificial Sequence
  Synthetic
atggccgactcccaagtacgttaagtgttcaagacattgatagagatagttatgatcaaaagaggaggtttatttttccaagattgggttgcaaactaggagtttctgagcagtatatctggagacccagcatggcgtat

SEQ ID NO: 433611 - DNA, 140 bp, Artificial Sequence
  Synthetic
aggccctggctgctgatatgcaatattgtggaagatcagggatttaaacaatcacagaatcgggtgtcacagtcatttttgaatgaccctacacctgttgaagtaacggttcaagccagagaccttttgggacagcggtg

SEQ ID NO: 433612 - DNA, 140 bp, Artificial Sequence
  Synthetic
caccgctgtcccaaaaggtctctggcttgaaccgttacttcaacaggtgtagggtcattcaaaaatgactgtgacacccgattctgtgattgtttaaatccctgatcttccacaatattgcatatcagcagccagggcct

SEQ ID NO: 433613 - DNA, 140 bp, Artificial Sequence
  Synthetic
atacgccatgctgggtctccagcctacattttaatttaccaggtgataaacttttggtaatttaccttaacataggtgctgataagatgattggatgataacacatttaccgagatttaacgtacttgggagtcggccat

SEQ ID NO: 433614 - DNA, 140 bp, Artificial Sequence
  Synthetic
atggccgactcccaagtacgttaaatctcggtaaatgtgttatcatccaatcatcttatcagcacctatgttaaggtaaattaccaaaagtttatcacctggtaaattaaaatgtaggctggagacccagcatggcgtat

SEQ ID NO: 433615 - DNA, 140 bp, Artificial Sequence
  Synthetic
aggccctggctgctgatatgtgcccgcgcctggctcgaagacagtgatggagctgattatcctcctcttgatgtgttaggtgagttatacaaccagggagaccaaattattgccatgtacgaccttttgggacagcggtg

SEQ ID NO: 433616 - DNA, 140 bp, Artificial Sequence
  Synthetic
caccgctgtcccaaaaggtcgtacatggcaataatttggtctccctggttgtataactcacctaacacatcaagaggaggataatcagctccatcactgtcttcgagccaggcgcgggcacatatcagcagccagggcct

SEQ ID NO: 433617 - DNA, 140 bp, Artificial Sequence
  Synthetic
atacgccatgctgggtctcctcgtatctcattaagaaaaagataattagaacactggaaattgataaacttctattttgatcaatgtagaaaagaattataaaaatcttagtaaataaatcgtacttgggagtcggccat

SEQ ID NO: 433618 - DNA, 140 bp, Artificial Sequence
  Synthetic
atggccgactcccaagtacgatttatttactaagatttttataattcttttctacattgatcaaaatagaagtttatcaatttccagtgttctaattatctttttcttaatgagatacgaggagacccagcatggcgtat

SEQ ID NO: 433619 - DNA, 140 bp, Artificial Sequence
  Synthetic
atacgccatgctgggtctcctactgcaaagtaaaaacgaagaacattaagtgttctttattaaaattgttcatcctttttgcttttgattatatttgatcaaatacaacttcatttggtacgtacttgggagtcggccat

SEQ ID NO: 433620 - DNA, 140 bp, Artificial Sequence
  Synthetic
atggccgactcccaagtacgtaccaaatgaagttgtatttgatcaaatataatcaaaagcaaaaaggatgaacaattttaataaagaacacttaatgttcttcgtttttactttgcagtaggagacccagcatggcgtat

SEQ ID NO: 433621 - DNA, 140 bp, Artificial Sequence
  Synthetic
aggccctggctgctgatatgtaagtcattctttttaaaattaattcacacaaggtagtttaaatttgtatctaaaacaaattttaatatggccagttccagcaattataacacatacatggaccttttgggacagcggtg

SEQ ID NO: 433622 - DNA, 140 bp, Artificial Sequence
  Synthetic
caccgctgtcccaaaaggtccatgtatgtgttataattgctggaactggccatattaaaatttgttttagatacaaatttaaactaccttgtgtgaattaattttaaaaagaatgacttacatatcagcagccagggcct

SEQ ID NO: 433623 - DNA, 140 bp, Artificial Sequence
  Synthetic
atacgccatgctgggtctccttcattccaagattcagaatgcaacagcctcgtgggagaagccgaaatcgtagccaccaagttgcactatccacataccatgaaaatcaattaccctctacgtacttgggagtcggccat

SEQ ID NO: 433624 - DNA, 140 bp, Artificial Sequence
  Synthetic
atggccgactcccaagtacgtagagggtaattgattttcatggtatgtggatagtgcaacttggtggctacgatttcggcttctcccacgaggctgttgcattctgaatcttggaatgaaggagacccagcatggcgtat

SEQ ID NO: 433625 - DNA, 140 bp, Artificial Sequence
  Synthetic
atacgccatgctgggtctcctgtccaattggcagcttttgggtctatccaagcaagtccacaaggactaaccattattatgcaagccttaattattggagagacaaagctaataaggttacgtacttgggagtcggccat

SEQ ID NO: 433626 - DNA, 140 bp, Artificial Sequence
  Synthetic
atggccgactcccaagtacgtaaccttattagctttgtctctccaataattaaggcttgcataataatggttagtccttgtggacttgcttggatagacccaaaagctgccaattggacaggagacccagcatggcgtat

SEQ ID NO: 433627 - DNA, 140 bp, Artificial Sequence
  Synthetic
atacgccatgctgggtctccaacctcagtacattaaccatcatccacgtgcaagatcaatgagttcaacccgtagtagtacagaaggtagccctactaatcatgcttcccgtgctcgacccgtacttgggagtcggccat

SEQ ID NO: 433628 - DNA, 140 bp, Artificial Sequence
  Synthetic
atggccgactcccaagtacgggtcgagcacgggaagcatgattagtagggctaccttctgtactactacgggttgaactcattgatcttgcacgtggatgatggttaatgtactgaggttggagacccagcatggcgtat

SEQ ID NO: 433629 - DNA, 140 bp, Artificial Sequence
  Synthetic
atacgccatgctgggtctccatatcttcagcaaagtaataaaaatagccttgtcatgttatacgccagttatccatcttaagtgaatcctttcttcaatatgcagcatccaactcaatatcgtacttgggagtcggccat

SEQ ID NO: 433630 - DNA, 140 bp, Artificial Sequence
  Synthetic
atggccgactcccaagtacgatattgagttggatgctgcatattgaagaaaggattcacttaagatggataactggcgtataacatgacaaggctatttttattactttgctgaagatatggagacccagcatggcgtat

SEQ ID NO: 433631 - DNA, 140 bp, Artificial Sequence
  Synthetic
atacgccatgctgggtctccactttcaacatttaatctatcgaaacctcctccccccccgaaagacatgtgcaggaacatgaaaattgggttaccctgtactgaccccgcttgcaacaggcgtacttgggagtcggccat

SEQ ID NO: 433632 - DNA, 140 bp, Artificial Sequence
  Synthetic
atggccgactcccaagtacgcctgttgcaagcggggtcagtacagggtaacccaattttcatgttcctgcacatgtctttcggggggggaggaggtttcgatagattaaatgttgaaagtggagacccagcatggcgtat

SEQ ID NO: 433633 - DNA, 140 bp, Artificial Sequence
  Synthetic
atacgccatgctgggtctccgatcatgaccttgataatctaacaaatcgtgaacttttgctgttgatggcacggaagttgctccccaatacagataaggctttcaaaagtcagcaggactcgtacttgggagtcggccat

SEQ ID NO: 433634 - DNA, 140 bp, Artificial Sequence
  Synthetic
atggccgactcccaagtacgagtcctgctgacttttgaaagccttatctgtattggggagcaacttccgtgccatcaacagcaaaagttcacgatttgttagattatcaaggtcatgatcggagacccagcatggcgtat

SEQ ID NO: 433635 - DNA, 140 bp, Artificial Sequence
  Synthetic
aggccctggctgctgatatgttatcagcatctttgggagtggtatttcgtggagcatgaacctcttttctcaactaaaataataagtgatttaagtatttttataaaagacagggctactgaccttttgggacagcggtg

SEQ ID NO: 433636 - DNA, 140 bp, Artificial Sequence
  Synthetic
caccgctgtcccaaaaggtcagtagccctgtcttttataaaaatacttaaatcacttattattttagttgagaaaagaggttcatgctccacgaaataccactcccaaagatgctgataacatatcagcagccagggcct

SEQ ID NO: 433637 - DNA, 140 bp, Artificial Sequence
  Synthetic
atacgccatgctgggtctccgtggatcgccatctctttctaaagggctttcaaaggacaagcaggaacaagcaaaggatgtactgactttggaaaatctagggcacatattgaattatctcgtacttgggagtcggccat

SEQ ID NO: 433638 - DNA, 140 bp, Artificial Sequence
  Synthetic
atggccgactcccaagtacgagataattcaatatgtgccctagattttccaaagtcagtacatcctttgcttgttcctgcttgtcctttgaaagccctttagaaagagatggcgatccacggagacccagcatggcgtat

SEQ ID NO: 433639 - DNA, 140 bp, Artificial Sequence
  Synthetic
atacgccatgctgggtctcctcatagatcagaaatcggaaaattggacgagacatcactccgtgcagcattgagtttaacatgtgccggaatccgaaagacaaataggtctttgattaatcgtacttgggagtcggccat

SEQ ID NO: 433640 - DNA, 140 bp, Artificial Sequence
  Synthetic
atggccgactcccaagtacgattaatcaaagacctatttgtctttcggattccggcacatgttaaactcaatgctgcacggagtgatgtctcgtccaattttccgatttctgatctatgaggagacccagcatggcgtat

SEQ ID NO: 433641 - DNA, 140 bp, Artificial Sequence
  Synthetic
aggccctggctgctgatatgtgggccaagcagacttttccttgaatcaaatattggattttgctgaaaagttagaatatttggctccttcttataggaatttttccttctcattaaaagagaccttttgggacagcggtg

SEQ ID NO: 433642 - DNA, 140 bp, Artificial Sequence
  Synthetic
caccgctgtcccaaaaggtctcttttaatgagaaggaaaaattcctataagaaggagccaaatattctaacttttcagcaaaatccaatatttgattcaaggaaaagtctgcttggcccacatatcagcagccagggcct

SEQ ID NO: 433643 - DNA, 140 bp, Artificial Sequence
  Synthetic
atacgccatgctgggtctccactatgacagaattgcatatcaaccatgagaatcttccgcaggaccaaaatggtgttattaagcagacatatacaggtattcatcttgacaaagggggtccgtacttgggagtcggccat

SEQ ID NO: 433644 - DNA, 140 bp, Artificial Sequence
  Synthetic
atggccgactcccaagtacggaccccctttgtcaagatgaatacctgtatatgtctgcttaataacaccattttggtcctgcggaagattctcatggttgatatgcaattctgtcatagtggagacccagcatggcgtat

SEQ ID NO: 433645 - DNA, 140 bp, Artificial Sequence
  Synthetic
atacgccatgctgggtctccagaatactcctttttcacacttgataaattgttcatttcctgaattttcttcacataccagttcagtctcctctaatcaacaagtgaccaattcgaagtacgtacttgggagtcggccat

SEQ ID NO: 433646 - DNA, 140 bp, Artificial Sequence
  Synthetic
atggccgactcccaagtacgtacttcgaattggtcacttgttgattagaggagactgaactggtatgtgaagaaaattcaggaaatgaacaatttatcaagtgtgaaaaaggagtattctggagacccagcatggcgtat

SEQ ID NO: 433647 - DNA, 140 bp, Artificial Sequence
  Synthetic
atacgccatgctgggtctccaatttgaagctgccttatggcagggctgggacaagaagtcaatatctttgtttgtgcaagctgcattatatgtgatgaataatatcccctgtgaatcgtccgtacttgggagtcggccat

SEQ ID NO: 433648 - DNA, 140 bp, Artificial Sequence
  Synthetic
atggccgactcccaagtacggacgattcacaggggatattattcatcacatataatgcagcttgcacaaacaaagatattgacttcttgtcccagccctgccataaggcagcttcaaattggagacccagcatggcgtat

SEQ ID NO: 433649 - DNA, 140 bp, Artificial Sequence
  Synthetic
atacgccatgctgggtctccgcattccctagcaacatgatggttgttactgagagggaacagaaagaagcattattgcatcaggcttcttggcaccacaattcagcaagcataggggaaacgtacttgggagtcggccat

SEQ ID NO: 433650 - DNA, 140 bp, Artificial Sequence
  Synthetic
atggccgactcccaagtacgtttcccctatgcttgctgaattgtggtgccaagaagcctgatgcaataatgcttctttctgttccctctcagtaacaaccatcatgttgctagggaatgcggagacccagcatggcgtat

SEQ ID NO: 433651 - DNA, 140 bp, Artificial Sequence
  Synthetic
atacgccatgctgggtctcccatcagtgtgcaggcctcatatgatcactttattctccctcgaaatcagggtgaaagacaatgattgtcatttcaaaatcaacgatataattattgttaacgtacttgggagtcggccat

SEQ ID NO: 433652 - DNA, 140 bp, Artificial Sequence
  Synthetic
atggccgactcccaagtacgttaacaataattatatcgttgattttgaaatgacaatcattgtctttcaccctgatttcgagggagaataaagtgatcatatgaggcctgcacactgatgggagacccagcatggcgtat

SEQ ID NO: 433653 - DNA, 140 bp, Artificial Sequence
  Synthetic
atacgccatgctgggtctccacgctatagtaaggggtgcaagttttgttactgatcttgagaaatacaaccttgccttccgatatgaatttacacgacatttcatagactactgtaatcgcgtacttgggagtcggccat

SEQ ID NO: 433654 - DNA, 140 bp, Artificial Sequence
  Synthetic
atggccgactcccaagtacgcgattacagtagtctatgaaatgtcgtgtaaattcatatcggaaggcaaggttgtatttctcaagatcagtaacaaaacttgcaccccttactatagcgtggagacccagcatggcgtat

SEQ ID NO: 433655 - DNA, 140 bp, Artificial Sequence
  Synthetic
aggccctggctgctgatatggaagataaccgaaataacccaccggattgtgctaatgcttatcattatcacttagggggtatagagggacttcaacagaaattgtggacatgtatatcatgaccttttgggacagcggtg

SEQ ID NO: 433656 - DNA, 140 bp, Artificial Sequence
  Synthetic
caccgctgtcccaaaaggtcatgatatacatgtccacaatttctgttgaagtccctctataccccctaagtgataatgataagcattagcacaatccggtgggttatttcggttatcttccatatcagcagccagggcct

SEQ ID NO: 433657 - DNA, 140 bp, Artificial Sequence
  Synthetic
atacgccatgctgggtctcccaacatacaagtgtctgacgaacaacctgtgtttctatggaaaaacatgaagaacattaagaaaaaggatgttcttgtatttcaaccaaggttgtatatacgtacttgggagtcggccat

SEQ ID NO: 433658 - DNA, 140 bp, Artificial Sequence
  Synthetic
atggccgactcccaagtacgtatatacaaccttggttgaaatacaagaacatcctttttcttaatgttcttcatgtttttccatagaaacacaggttgttcgtcagacacttgtatgttgggagacccagcatggcgtat

SEQ ID NO: 433659 - DNA, 140 bp, Artificial Sequence
  Synthetic
atacgccatgctgggtctccgtgacttaaacctagatgatcagttcaaagggaacgtctgtcatgctttcactttagaggcaataattgacatatctgcgtataatgaacgaacagtcaacgtacttgggagtcggccat

SEQ ID NO: 433660 - DNA, 140 bp, Artificial Sequence
  Synthetic
atggccgactcccaagtacgttgactgttcgttcattatacgcagatatgtcaattattgcctctaaagtgaaagcatgacagacgttccctttgaactgatcatctaggtttaagtcacggagacccagcatggcgtat

SEQ ID NO: 433661 - DNA, 140 bp, Artificial Sequence
  Synthetic
atacgccatgctgggtctcctttggccgatatcctcggagaataattgtcaatatctgacaattgatcatacacattccaataatacattatagactttttatcagatatagaactgggacgtacttgggagtcggccat

SEQ ID NO: 433662 - DNA, 140 bp, Artificial Sequence
  Synthetic
atggccgactcccaagtacgtcccagttctatatctgataaaaagtctataatgtattattggaatgtgtatgatcaattgtcagatattgacaattattctccgaggatatcggccaaaggagacccagcatggcgtat

SEQ ID NO: 433663 - DNA, 140 bp, Artificial Sequence
  Synthetic
atacgccatgctgggtctcctattgtttatccagaaaatatcactgaaataaatgcaagaaccagattaataaattatggatcaacagctctacaggggatggacaccaagatgccactccgtacttgggagtcggccat

SEQ ID NO: 433664 - DNA, 140 bp, Artificial Sequence
  Synthetic
atggccgactcccaagtacggagtggcatcttggtgtccatcccctgtagagctgttgatccataatttattaatctggttcttgcatttatttcagtgatattttctggataaacaataggagacccagcatggcgtat

SEQ ID NO: 433665 - DNA, 140 bp, Artificial Sequence
  Synthetic
atacgccatgctgggtctccttctaatagttctacttcttagtgcagtacaggtttttgcaaagaaacttctgagtatggcagaactgtcaacacgttacaacttaccaacaaatattaccgtacttgggagtcggccat

SEQ ID NO: 433666 - DNA, 140 bp, Artificial Sequence
  Synthetic
atggccgactcccaagtacggtaatatttgttggtaagttgtaacgtgttgacagttctgccatactcagaagtttctttgcaaaaacctgtactgcactaagaagtagaactattagaaggagacccagcatggcgtat

SEQ ID NO: 433667 - DNA, 140 bp, Artificial Sequence
  Synthetic
atacgccatgctgggtctcccttgttactattgtgtgagacaacacaagccatcaaataacaatcacgggcaagaaccgggcacaccatggtgatgcgagggcaccattcagtgctacaacgtacttgggagtcggccat

SEQ ID NO: 433668 - DNA, 140 bp, Artificial Sequence
  Synthetic
atggccgactcccaagtacgttgtagcactgaatggtgccctcgcatcaccatggtgtgcccggttcttgcccgtgattgttatttgatggcttgtgttgtctcacacaatagtaacaagggagacccagcatggcgtat

SEQ ID NO: 433669 - DNA, 140 bp, Artificial Sequence
  Synthetic
atacgccatgctgggtctccagagaagagcataaatcttgatctcaattctactgcacggtgggtaaaagagcccagtgttgggggctggacagtgaaatgggggaattttatctttcaccgtacttgggagtcggccat

SEQ ID NO: 433670 - DNA, 140 bp, Artificial Sequence
  Synthetic
atggccgactcccaagtacggtgaaagataaaattcccccatttcactgtccagcccccaacactgggctcttttacccaccgtgcagtagaattgagatcaagatttatgctcttctctggagacccagcatggcgtat

SEQ ID NO: 433671 - DNA, 140 bp, Artificial Sequence
  Synthetic
aggccctggctgctgatatgactttagaggcaataattgacatatctgcgtataatgaacgaacagtcaaaggtgttccagcatggctgcctcttgggattatgagcaattttgaatatcgaccttttgggacagcggtg

SEQ ID NO: 433672 - DNA, 140 bp, Artificial Sequence
  Synthetic
caccgctgtcccaaaaggtcgatattcaaaattgctcataatcccaagaggcagccatgctggaacacctttgactgttcgttcattatacgcagatatgtcaattattgcctctaaagtcatatcagcagccagggcct

SEQ ID NO: 433673 - DNA, 140 bp, Artificial Sequence
  Synthetic
atacgccatgctgggtctccgccagtattggtacatcctttgagagaggaacaagtgagacacggcacatttttccgagtcgttggatagcttcatttcattcaatgttagcaataaattcgtacttgggagtcggccat

SEQ ID NO: 433674 - DNA, 140 bp, Artificial Sequence
  Synthetic
atggccgactcccaagtacgaatttattgctaacattgaatgaaatgaagctatccaacgactcggaaaaatgtgccgtgtctcacttgttcctctctcaaaggatgtaccaatactggcggagacccagcatggcgtat

SEQ ID NO: 433675 - DNA, 140 bp, Artificial Sequence
  Synthetic
aggccctggctgctgatatgttttccgagtcgttggatagcttcatttcattcaatgttagcaataaatttattaaatcagaatcaccttgggtttcccctagggttcagtattgatattgaccttttgggacagcggtg

SEQ ID NO: 433676 - DNA, 140 bp, Artificial Sequence
  Synthetic
caccgctgtcccaaaaggtcaatatcaatactgaaccctaggggaaacccaaggtgattctgatttaataaatttattgctaacattgaatgaaatgaagctatccaacgactcggaaaacatatcagcagccagggcct

SEQ ID NO: 433677 - DNA, 140 bp, Artificial Sequence
  Synthetic
atacgccatgctgggtctccacccaaaatcaaccatcatggagcctttcttggctttgaggatcttacttggcgttgctttgaaagatcaagaattgcagcaatcattgattcctggattcgtacttgggagtcggccat

SEQ ID NO: 433678 - DNA, 140 bp, Artificial Sequence
  Synthetic
atggccgactcccaagtacgaatccaggaatcaatgattgctgcaattcttgatctttcaaagcaacgccaagtaagatcctcaaagccaagaaaggctccatgatggttgattttgggtggagacccagcatggcgtat

SEQ ID NO: 433679 - DNA, 140 bp, Artificial Sequence
  Synthetic
atacgccatgctgggtctcctcttgtttcaaaaagcctcttaccttttcggaaaaattaattgctcttataacgccccaagttctaggagggttatcatttttgaatccggagaaattgtcgtacttgggagtcggccat

SEQ ID NO: 433680 - DNA, 140 bp, Artificial Sequence
  Synthetic
atggccgactcccaagtacgacaatttctccggattcaaaaatgataaccctcctagaacttggggcgttataagagcaattaatttttccgaaaaggtaagaggctttttgaaacaagaggagacccagcatggcgtat

SEQ ID NO: 433681 - DNA, 140 bp, Artificial Sequence
  Synthetic
atacgccatgctgggtctcctagatccattgtgcatatgctttcagaatggctgcttttagaagttacgtcagctatccatatcagtcctaacctgttggggatctatttgacctcagaccgtacttgggagtcggccat

SEQ ID NO: 433682 - DNA, 140 bp, Artificial Sequence
  Synthetic
atggccgactcccaagtacggtctgaggtcaaatagatccccaacaggttaggactgatatggatagctgacgtaacttctaaaagcagccattctgaaagcatatgcacaatggatctaggagacccagcatggcgtat

SEQ ID NO: 433683 - DNA, 140 bp, Artificial Sequence
  Synthetic
atacgccatgctgggtctccatgtttaaaatcctaatggcaggtgtgaaaaacttttttaataagctgtttaccctccatgttgtaaatgatcatggaaaacctagcagtattgaaataacgtacttgggagtcggccat

SEQ ID NO: 433684 - DNA, 140 bp, Artificial Sequence
  Synthetic
atggccgactcccaagtacgttatttcaatactgctaggttttccatgatcatttacaacatggagggtaaacagcttattaaaaaagtttttcacacctgccattaggattttaaacatggagacccagcatggcgtat

SEQ ID NO: 433685 - DNA, 140 bp, Artificial Sequence
  Synthetic
aggccctggctgctgatatgtaaaaaacctggtttagcagatgcctcagatttcgtcatgaatccattaggcttaaatgtaccaggatcaagggaaataataacgttccttagacaaacagaccttttgggacagcggtg

SEQ ID NO: 433686 - DNA, 140 bp, Artificial Sequence
  Synthetic
caccgctgtcccaaaaggtctgtttgtctaaggaacgttattatttcccttgatcctggtacatttaagcctaatggattcatgacgaaatctgaggcatctgctaaaccaggttttttacatatcagcagccagggcct

SEQ ID NO: 433687 - DNA, 140 bp, Artificial Sequence
  Synthetic
atacgccatgctgggtctccaattaaccggacaacagatcataatcactcgagttaacatggggttcttagtagaagttaggaggattgacattgaaccttgctgcggcgagactgtcctcgtacttgggagtcggccat

SEQ ID NO: 433688 - DNA, 140 bp, Artificial Sequence
  Synthetic
atggccgactcccaagtacgaggacagtctcgccgcagcaaggttcaatgtcaatcctcctaacttctactaagaaccccatgttaactcgagtgattatgatctgttgtccggttaattggagacccagcatggcgtat

SEQ ID NO: 433689 - DNA, 140 bp, Artificial Sequence
  Synthetic
atacgccatgctgggtctccctcagaatcagttgtgtttgggctagtagctgaagcagtcctaagggaacacagccagattgagagaggtcaacctcttaatttgacacaatacatgaaccgtacttgggagtcggccat

SEQ ID NO: 433690 - DNA, 140 bp, Artificial Sequence
  Synthetic
atggccgactcccaagtacggttcatgtattgtgtcaaattaagaggttgacctctctcaatctggctgtgttcccttaggactgcttcagctactagcccaaacacaactgattctgagggagacccagcatggcgtat

SEQ ID NO: 433691 - DNA, 140 bp, Artificial Sequence
  Synthetic
atacgccatgctgggtctccagcaaaattgctatttagacagcttgattcggcatctaaagctttaattcagctgtataaggatattgagaagacagtggatcataatcaattgccctttcgtacttgggagtcggccat

SEQ ID NO: 433692 - DNA, 140 bp, Artificial Sequence
  Synthetic
atggccgactcccaagtacgaaagggcaattgattatgatccactgtcttctcaatatccttatacagctgaattaaagctttagatgccgaatcaagctgtctaaatagcaattttgctggagacccagcatggcgtat

SEQ ID NO: 433693 - DNA, 140 bp, Artificial Sequence
  Synthetic
atacgccatgctgggtctccaacattactagcttctcggacaataagtttaactacagaagggacaatgttgatgaaattaagggaattaacaagaaaccgatggaaaagctggttttctcgtacttgggagtcggccat

SEQ ID NO: 433694 - DNA, 140 bp, Artificial Sequence
  Synthetic
atggccgactcccaagtacgagaaaaccagcttttccatcggtttcttgttaattcccttaatttcatcaacattgtcccttctgtagttaaacttattgtccgagaagctagtaatgttggagacccagcatggcgtat

SEQ ID NO: 433695 - DNA, 140 bp, Artificial Sequence
  Synthetic
aggccctggctgctgatatgagtattatcacactagatagtcatcacataataagttgtttctatgaattaatcatgatagtagaatcttgtagaattactatgggttctatatacggcagaccttttgggacagcggtg

SEQ ID NO: 433696 - DNA, 140 bp, Artificial Sequence
  Synthetic
caccgctgtcccaaaaggtctgccgtatatagaacccatagtaattctacaagattctactatcatgattaattcatagaaacaacttattatgtgatgactatctagtgtgataatactcatatcagcagccagggcct

SEQ ID NO: 433697 - DNA, 140 bp, Artificial Sequence
  Synthetic
aggccctggctgctgatatgaggagtgaccttttctatttgatgcattaatgttttaaactacctcttaagcctttgagggcgtcccaatatgtgcgtaggggttaatttaaagggatttgaccttttgggacagcggtg

SEQ ID NO: 433698 - DNA, 140 bp, Artificial Sequence
  Synthetic
caccgctgtcccaaaaggtcaaatccctttaaattaacccctacgcacatattgggacgccctcaaaggcttaagaggtagtttaaaacattaatgcatcaaatagaaaaggtcactcctcatatcagcagccagggcct

SEQ ID NO: 433699 - DNA, 140 bp, Artificial Sequence
  Synthetic
atacgccatgctgggtctcctttattccggactgtatcctttgtaaacaatgcatgcttaagtattctcatatcatacatgttatcactgcctgattaagaaaaaccaatgatggatattcgtacttgggagtcggccat

SEQ ID NO: 433700 - DNA, 140 bp, Artificial Sequence
  Synthetic
atggccgactcccaagtacgaatatccatcattggtttttcttaatcaggcagtgataacatgtatgatatgagaatacttaagcatgcattgtttacaaaggatacagtccggaataaaggagacccagcatggcgtat

SEQ ID NO: 433701 - DNA, 140 bp, Artificial Sequence
  Synthetic
aggccctggctgctgatatgtatcatacatgttatcactgcctgattaagaaaaaccaatgatggatattaaacatccttcagttgactgttttgagactttaaaatcttacaggctgtcgaccttttgggacagcggtg

SEQ ID NO: 433702 - DNA, 140 bp, Artificial Sequence
  Synthetic
caccgctgtcccaaaaggtcgacagcctgtaagattttaaagtctcaaaacagtcaactgaaggatgtttaatatccatcattggtttttcttaatcaggcagtgataacatgtatgatacatatcagcagccagggcct

SEQ ID NO: 433703 - DNA, 140 bp, Artificial Sequence
  Synthetic
atacgccatgctgggtctcctaatatgtcttcagaatcagaatcaactataaatttattgccgtatgactgcaaggaactgcgacttggaagaagcaatgacacagagttaaactatgtccgtacttgggagtcggccat

SEQ ID NO: 433704 - DNA, 140 bp, Artificial Sequence
  Synthetic
atggccgactcccaagtacggacatagtttaactctgtgtcattgcttcttccaagtcgcagttccttgcagtcatacggcaataaatttatagttgattctgattctgaagacatattaggagacccagcatggcgtat

SEQ ID NO: 433705 - DNA, 140 bp, Artificial Sequence
  Synthetic
atacgccatgctgggtctccttgatctttaaattctctacgggattatacagtcacctttagcatacattatgcctctcgcgaaataatataagtgactctatgacattccgagccaggtcgtacttgggagtcggccat

SEQ ID NO: 433706 - DNA, 140 bp, Artificial Sequence
  Synthetic
atggccgactcccaagtacgacctggctcggaatgtcatagagtcacttatattatttcgcgagaggcataatgtatgctaaaggtgactgtataatcccgtagagaatttaaagatcaaggagacccagcatggcgtat

SEQ ID NO: 433707 - DNA, 140 bp, Artificial Sequence
  Synthetic
atacgccatgctgggtctccagttgtgctctcgaccggaaagttgtccagaaacatccctctgttaatcgtctggcttggacaataggaaatcgagcaccgtatataggatcacggacagcgtacttgggagtcggccat

SEQ ID NO: 433708 - DNA, 140 bp, Artificial Sequence
  Synthetic
atggccgactcccaagtacgctgtccgtgatcctatatacggtgctcgatttcctattgtccaagccagacgattaacagagggatgtttctggacaactttccggtcgagagcacaactggagacccagcatggcgtat

SEQ ID NO: 433709 - DNA, 140 bp, Artificial Sequence
  Synthetic
atacgccatgctgggtctccctttatcttgaattaaccctctttttggtatgcaacacccgactcaatatccagatgcaagattatcttctcccataattttagatcagtgtgatttattcgtacttgggagtcggccat

SEQ ID NO: 433710 - DNA, 140 bp, Artificial Sequence
  Synthetic
atggccgactcccaagtacgaataaatcacactgatctaaaattatgggagaagataatcttgcatctggatattgagtcgggtgttgcataccaaaaagagggttaattcaagataaagggagacccagcatggcgtat

SEQ ID NO: 433711 - DNA, 140 bp, Artificial Sequence
  Synthetic
aggccctggctgctgatatgaagacaagatcggttatcctcccttaagagtaaattgtccatcagcggcacttaaagaagccattgagatggtttctagattattatgggtgactcaagggaccttttgggacagcggtg

SEQ ID NO: 433712 - DNA, 140 bp, Artificial Sequence
  Synthetic
caccgctgtcccaaaaggtcccttgagtcacccataataatctagaaaccatctcaatggcttctttaagtgccgctgatggacaatttactcttaagggaggataaccgatcttgtcttcatatcagcagccagggcct

SEQ ID NO: 433713 - DNA, 140 bp, Artificial Sequence
  Synthetic
atacgccatgctgggtctccgaccagaagtctagggttgtatagtcattactcacacaatccaaaactacgtaattgtaggattccataccacatttatcgcttgaggaattctacagcacgtacttgggagtcggccat

SEQ ID NO: 433714 - DNA, 140 bp, Artificial Sequence
  Synthetic
atggccgactcccaagtacgtgctgtagaattcctcaagcgataaatgtggtatggaatcctacaattacgtagttttggattgtgtgagtaatgactatacaaccctagacttctggtcggagacccagcatggcgtat

SEQ ID NO: 433715 - DNA, 140 bp, Artificial Sequence
  Synthetic
atacgccatgctgggtctccttaaagacatttcttcagaactgttcgatactcacagttccttttcactcaatttgggatcacatcataacttcaattcaacacgatgcaattaatcatacgtacttgggagtcggccat

SEQ ID NO: 433716 - DNA, 140 bp, Artificial Sequence
  Synthetic
atggccgactcccaagtacgtatgattaattgcatcgtgttgaattgaagttatgatgtgatcccaaattgagtgaaaaggaactgtgagtatcgaacagttctgaagaaatgtctttaaggagacccagcatggcgtat

SEQ ID NO: 433717 - DNA, 140 bp, Artificial Sequence
  Synthetic
atacgccatgctgggtctcctcaatgatttcaaatacctattaccatcagaactcataaagtatgctaattgggacaatgagttcttaagagtattccttaacaagatcttgagactcgacgtacttgggagtcggccat

SEQ ID NO: 433718 - DNA, 140 bp, Artificial Sequence
  Synthetic
atggccgactcccaagtacgtcgagtctcaagatcttgttaaggaatactcttaagaactcattgtcccaattagcatactttatgagttctgatggtaataggtatttgaaatcattgaggagacccagcatggcgtat

SEQ ID NO: 433719 - DNA, 140 bp, Artificial Sequence
  Synthetic
atacgccatgctgggtctcctcatgcttttacaaattctgcaaagttacaatgtgaggatttctctcccaaagagaatccttattattgggggatgttattgctcgtgcatttatctcaacgtacttgggagtcggccat

SEQ ID NO: 433720 - DNA, 140 bp, Artificial Sequence
  Synthetic
atggccgactcccaagtacgttgagataaatgcacgagcaataacatcccccaataataaggattctctttgggagagaaatcctcacattgtaactttgcagaatttgtaaaagcatgaggagacccagcatggcgtat

SEQ ID NO: 433721 - DNA, 140 bp, Artificial Sequence
  Synthetic
atacgccatgctgggtctcccttgccagaaggattaagggacaaagagggtctttaaggagcaactggaagtttataggagttgatttggaactatttggaatagcagattttgttatttcgtacttgggagtcggccat

SEQ ID NO: 433722 - DNA, 140 bp, Artificial Sequence
  Synthetic
atggccgactcccaagtacgaaataacaaaatctgctattccaaatagttccaaatcaactcctataaacttccagttgctccttaaagaccctctttgtcccttaatccttctggcaagggagacccagcatggcgtat

SEQ ID NO: 433723 - DNA, 140 bp, Artificial Sequence
  Synthetic
atacgccatgctgggtctccttaaagttccgataaaagcaataattcggaatgctacaagtttacaggcctcaaaaccagggttaaagacatggtaccgtgatcaaaacttaactccctacgtacttgggagtcggccat

SEQ ID NO: 433724 - DNA, 140 bp, Artificial Sequence
  Synthetic
atggccgactcccaagtacgtagggagttaagttttgatcacggtaccatgtctttaaccctggttttgaggcctgtaaacttgtagcattccgaattattgcttttatcggaactttaaggagacccagcatggcgtat

SEQ ID NO: 433725 - DNA, 140 bp, Artificial Sequence
  Synthetic
atacgccatgctgggtctcctttccaactattgctgcatggacactaggagaaactatagtcggaagcattttttctgatgagtcttctcaaagtacagatccaataagttcaggttgcacgtacttgggagtcggccat

SEQ ID NO: 433726 - DNA, 140 bp, Artificial Sequence
  Synthetic
atggccgactcccaagtacgtgcaacctgaacttattggatctgtactttgagaagactcatcagaaaaaatgcttccgactatagtttctcctagtgtccatgcagcaatagttggaaaggagacccagcatggcgtat

SEQ ID NO: 433727 - DNA, 140 bp, Artificial Sequence
  Synthetic
aggccctggctgctgatatgtatgcattcggggctaacttaatagtagaaagtttaagtctaagtaggatcaaatcaattaagaacctctcagatttgacattccttatatcatccacaagaccttttgggacagcggtg

SEQ ID NO: 433728 - DNA, 140 bp, Artificial Sequence
  Synthetic
caccgctgtcccaaaaggtcttgtggatgatataaggaatgtcaaatctgagaggttcttaattgatttgatcctacttagacttaaactttctactattaagttagccccgaatgcatacatatcagcagccagggcct

SEQ ID NO: 433729 - DNA, 140 bp, Artificial Sequence
  Synthetic
atacgccatgctgggtctcctgtatacaaacgtacggtatttttacgccgaggaagtactggtttcaatctcagatgattaaatcatattatgacgaacttcaaagtcttaacctaaaaccgtacttgggagtcggccat

SEQ ID NO: 433730 - DNA, 140 bp, Artificial Sequence
  Synthetic
atggccgactcccaagtacggttttaggttaagactttgaagttcgtcataatatgatttaatcatctgagattgaaaccagtacttcctcggcgtaaaaataccgtacgtttgtatacaggagacccagcatggcgtat

SEQ ID NO: 433731 - DNA, 140 bp, Artificial Sequence
  Synthetic
atacgccatgctgggtctccttcagattccggataataggactgaatgtgcacagaactttattaaaaccataattcaggcaaaactgactcctcaacaatactgtgaattgttctctttcgtacttgggagtcggccat

SEQ ID NO: 433732 - DNA, 140 bp, Artificial Sequence
  Synthetic
atggccgactcccaagtacgaaagagaacaattcacagtattgttgaggagtcagttttgcctgaattatggttttaataaagttctgtgcacattcagtcctattatccggaatctgaaggagacccagcatggcgtat

SEQ ID NO: 433733 - DNA, 140 bp, Artificial Sequence
  Synthetic
atacgccatgctgggtctcctcttctagttctggtgcttcggctgaggaagatcaacatgcctcccccaatatcagtttaactttatcctattttcctaatataaatgaaaacactgcctcgtacttgggagtcggccat

SEQ ID NO: 433734 - DNA, 140 bp, Artificial Sequence
  Synthetic
atggccgactcccaagtacgaggcagtgttttcatttatattaggaaaataggataaagttaaactgatattgggggaggcatgttgatcttcctcagccgaagcaccagaactagaagaggagacccagcatggcgtat

SEQ ID NO: 433735 - DNA, 140 bp, Artificial Sequence
  Synthetic
atacgccatgctgggtctccacaaaaacattggggtcacccagttttatacaatgatgttgcactagacaaagtgaagaaacatgcccaatcaacaaaaattttaaaacctaaggtcatgcgtacttgggagtcggccat

SEQ ID NO: 433736 - DNA, 140 bp, Artificial Sequence
  Synthetic
atggccgactcccaagtacgcatgaccttaggttttaaaatttttgttgattgggcatgtttcttcactttgtctagtgcaacatcattgtataaaactgggtgaccccaatgtttttgtggagacccagcatggcgtat

SEQ ID NO: 433737 - DNA, 140 bp, Artificial Sequence
  Synthetic
atacgccatgctgggtctcctttgaaactttttgtgtctttaagtttatagtggcaaaaaatcattatcactctcaaggatcgtggtacaaaaccacacatgatctacatttgaccccatcgtacttgggagtcggccat

SEQ ID NO: 433738 - DNA, 140 bp, Artificial Sequence
  Synthetic
atggccgactcccaagtacgatggggtcaaatgtagatcatgtgtggttttgtaccacgatccttgagagtgataatgattttttgccactataaacttaaagacacaaaaagtttcaaaggagacccagcatggcgtat

SEQ ID NO: 433739 - DNA, 140 bp, Artificial Sequence
  Synthetic
aggccctggctgctgatatgtttcaacccttatcgcgagacttgaatacaatcctactaacttcaataagtgaccccaaattcaagtttgctgaaacgatagatgacaatgatcactagtgaccttttgggacagcggtg

SEQ ID NO: 433740 - DNA, 140 bp, Artificial Sequence
  Synthetic
caccgctgtcccaaaaggtcactagtgatcattgtcatctatcgtttcagcaaacttgaatttggggtcacttattgaagttagtaggattgtattcaagtctcgcgataagggttgaaacatatcagcagccagggcct

SEQ ID NO: 433741 - DNA, 140 bp, Artificial Sequence
  Synthetic
atacgccatgctgggtctccatctacggcagcacattgtgtcaaattcatttccatcgcaagccgagatttatcagcacctctgggaatggtactttgtagagcatgaacctcttttttccgtacttgggagtcggccat

SEQ ID NO: 433742 - DNA, 140 bp, Artificial Sequence
  Synthetic
atggccgactcccaagtacggaaaaaagaggttcatgctctacaaagtaccattcccagaggtgctgataaatctcggcttgcgatggaaatgaatttgacacaatgtgctgccgtagatggagacccagcatggcgtat

SEQ ID NO: 433743 - DNA, 140 bp, Artificial Sequence
  Synthetic
atacgccatgctgggtctcctacaaaaataataagtgatttgagtattttcataaaagatagagctactgctgtaaatcgagagtgttgggacagcgtttttgataggagtgtgttaggacgtacttgggagtcggccat

SEQ ID NO: 433744 - DNA, 140 bp, Artificial Sequence
  Synthetic
atggccgactcccaagtacgtcctaacacactcctatcaaaaacgctgtcccaacactctcgatttacagcagtagctctatcttttatgaaaatactcaaatcacttattatttttgtaggagacccagcatggcgtat

SEQ ID NO: 433745 - DNA, 140 bp, Artificial Sequence
  Synthetic
atacgccatgctgggtctcctacaatccccctgtcagatttcaatcaaagagggtacctgagcaattcttaggtcaagcagatttctctttaaatcaaatattggattttgctgagaaatcgtacttgggagtcggccat

SEQ ID NO: 433746 - DNA, 140 bp, Artificial Sequence
  Synthetic
atggccgactcccaagtacgatttctcagcaaaatccaatatttgatttaaagagaaatctgcttgacctaagaattgctcaggtaccctctttgattgaaatctgacagggggattgtaggagacccagcatggcgtat

SEQ ID NO: 433747 - DNA, 140 bp, Artificial Sequence
  Synthetic
atacgccatgctgggtctcctagagtatctagctccttcatatagaaacttttccttttcattaaaggaaaaagaattgaatattgggagaacattcgggaagttgccctatcgtgtcagcgtacttgggagtcggccat

SEQ ID NO: 433748 - DNA, 140 bp, Artificial Sequence
  Synthetic
atggccgactcccaagtacgctgacacgatagggcaacttcccgaatgttctcccaatattcaattctttttcctttaatgaaaaggaaaagtttctatatgaaggagctagatactctaggagacccagcatggcgtat

SEQ ID NO: 433749 - DNA, 140 bp, Artificial Sequence
  Synthetic
atacgccatgctgggtctccaaatgtccaaacacttgcagaagccttattagcagatggactagcgaaggcattcccgagtaatatgatggttgttactgagagagagcagaaagaagctcgtacttgggagtcggccat

SEQ ID NO: 433750 - DNA, 140 bp, Artificial Sequence
  Synthetic
atggccgactcccaagtacgagcttctttctgctctctctcagtaacaaccatcatattactcgggaatgccttcgctagtccatctgctaataaggcttctgcaagtgtttggacatttggagacccagcatggcgtat

SEQ ID NO: 433751 - DNA, 140 bp, Artificial Sequence
  Synthetic
aggccctggctgctgatatgacatgaggactttgatgcctcgaaggtaatcttaaattctgaaataaataaccttaaccttacggattgtacgcttaatacaaagtcattgacaactcctgaccttttgggacagcggtg

SEQ ID NO: 433752 - DNA, 140 bp, Artificial Sequence
  Synthetic
caccgctgtcccaaaaggtcaggagttgtcaatgactttgtattaagcgtacaatccgtaaggttaaggttatttatttcagaatttaagattaccttcgaggcatcaaagtcctcatgtcatatcagcagccagggcct

SEQ ID NO: 433753 - DNA, 140 bp, Artificial Sequence
  Synthetic
atacgccatgctgggtctccctattgcatcaagcctcttggcaccataattcagcaagtataggggagaatgccatagtaagaggtgcaagttttgttactgatcttgagaaatacaatccgtacttgggagtcggccat

SEQ ID NO: 433754 - DNA, 140 bp, Artificial Sequence
  Synthetic
atggccgactcccaagtacggattgtatttctcaagatcagtaacaaaacttgcacctcttactatggcattctcccctatacttgctgaattatggtgccaagaggcttgatgcaatagggagacccagcatggcgtat

SEQ ID NO: 433755 - DNA, 140 bp, Artificial Sequence
  Synthetic
aggccctggctgctgatatgatactggaatgacattgttgcatcatttaaagtctaacttcgttgttccagagtggcaacaaacaaggaatctattctcccacctctttaaaaacccaaagaccttttgggacagcggtg

SEQ ID NO: 433756 - DNA, 140 bp, Artificial Sequence
  Synthetic
caccgctgtcccaaaaggtctttgggtttttaaagaggtgggagaatagattccttgtttgttgccactctggaacaacgaagttagactttaaatgatgcaacaatgtcattccagtatcatatcagcagccagggcct

SEQ ID NO: 433757 - DNA, 140 bp, Artificial Sequence
  Synthetic
atacgccatgctgggtctccttgcctttagatatgagtttacacgacatttcatagactactgtaatagatgttacggtgttaaaaatttattcgactggatgcatttcttaataccactcgtacttgggagtcggccat

SEQ ID NO: 433758 - DNA, 140 bp, Artificial Sequence
  Synthetic
atggccgactcccaagtacgagtggtattaagaaatgcatccagtcgaataaatttttaacaccgtaacatctattacagtagtctatgaaatgtcgtgtaaactcatatctaaaggcaaggagacccagcatggcgtat

SEQ ID NO: 433759 - DNA, 140 bp, Artificial Sequence
  Synthetic
atacgccatgctgggtctccatgctatatgcatgtcagtgacttttatagccctcctcactgcgtgacagaaaataaccgaaataacccacctgattgtgccaatgcttatcattatcatcgtacttgggagtcggccat

SEQ ID NO: 433760 - DNA, 140 bp, Artificial Sequence
  Synthetic
atggccgactcccaagtacgatgataatgataagcattggcacaatcaggtgggttatttcggttattttctgtcacgcagtgaggagggctataaaagtcactgacatgcatatagcatggagacccagcatggcgtat

SEQ ID NO: 433761 - DNA, 140 bp, Artificial Sequence
  Synthetic
aggccctggctgctgatatgacgtgatttacatgcttgttttgatagcaatcaattctgtcggtttacaggggtagtctcatcaatgcattacaagctttatgatctcttgcctccaggtgaccttttgggacagcggtg

SEQ ID NO: 433762 - DNA, 140 bp, Artificial Sequence
  Synthetic
caccgctgtcccaaaaggtcacctggaggcaagagatcataaagcttgtaatgcattgatgagactacccctgtaaaccgacagaattgattgctatcaaaacaagcatgtaaatcacgtcatatcagcagccagggcct

SEQ ID NO: 433763 - DNA, 140 bp, Artificial Sequence
  Synthetic
atacgccatgctgggtctccttaggaggtatagaaggactacaacagaaattgtggacatgtatatcatgtgctcaaatcacgcttgtagaactgaaaactaagttaaaattgaaatccacgtacttgggagtcggccat

SEQ ID NO: 433764 - DNA, 140 bp, Artificial Sequence
  Synthetic
atggccgactcccaagtacgtggatttcaattttaacttagttttcagttctacaagcgtgatttgagcacatgatatacatgtccacaatttctgttgtagtccttctatacctcctaaggagacccagcatggcgtat

SEQ ID NO: 433765 - DNA, 140 bp, Artificial Sequence
  Synthetic
atacgccatgctgggtctccgaattgagaaaggcaatttgcttggccgaaggagaaggaagtggtgctcggttacttttgaagtggaagaagacggattatttatttttcaacactttggcgtacttgggagtcggccat

SEQ ID NO: 433766 - DNA, 140 bp, Artificial Sequence
  Synthetic
atggccgactcccaagtacgccaaagtgttgaaaaataaataatccgtcttcttccacttcaaaagtaaccgagcaccacttccttctccttcggccaagcaaattgcctttctcaattcggagacccagcatggcgtat

SEQ ID NO: 433767 - DNA, 140 bp, Artificial Sequence
  Synthetic
atacgccatgctgggtctccgtgtcatgggtgataatcaatgtataacaactctaagtcttttccctattgatgctcccaatgattatcaagaaaatgaggcagaattaaatgctgcacgcgtacttgggagtcggccat

SEQ ID NO: 433768 - DNA, 140 bp, Artificial Sequence
  Synthetic
atggccgactcccaagtacgcgtgcagcatttaattctgcctcattttcttgataatcattgggagcatcaatagggaaaagacttagagttgttatacattgattatcacccatgacacggagacccagcatggcgtat

SEQ ID NO: 433769 - DNA, 140 bp, Artificial Sequence
  Synthetic
atacgccatgctgggtctccctacagattcacagcaagaagcagagattttaagtggccgggtaataccgagaatgttatataacatagataggttaaatgctttgcttgaatcaagaagcgtacttgggagtcggccat

SEQ ID NO: 433770 - DNA, 140 bp, Artificial Sequence
  Synthetic
atggccgactcccaagtacgcttcttgattcaagcaaagcatttaacctatctatgttatataacattctcggtattacccggccacttaaaatctctgcttcttgctgtgaatctgtagggagacccagcatggcgtat

SEQ ID NO: 433771 - DNA, 140 bp, Artificial Sequence
  Synthetic
atacgccatgctgggtctccagttgctgttgaattagctattactacaggctatagtgggatattcttaaaacctgaagagacatttgtgcattcagggtttatttactttggtaaaaagcgtacttgggagtcggccat

SEQ ID NO: 433772 - DNA, 140 bp, Artificial Sequence
  Synthetic
atggccgactcccaagtacgctttttaccaaagtaaataaaccctgaatgcacaaatgtctcttcaggttttaagaatatcccactatagcctgtagtaatagctaattcaacagcaactggagacccagcatggcgtat

SEQ ID NO: 433773 - DNA, 140 bp, Artificial Sequence
  Synthetic
aggccctggctgctgatatgtcagttgtttttggactagtggctgaggcagttctaagagaacacagtcaaatggagaagggccaacctctcaatctgacacaatacatgaacagcaaaagaccttttgggacagcggtg

SEQ ID NO: 433774 - DNA, 140 bp, Artificial Sequence
  Synthetic
caccgctgtcccaaaaggtcttttgctgttcatgtattgtgtcagattgagaggttggcccttctccatttgactgtgttctcttagaactgcctcagccactagtccaaaaacaactgacatatcagcagccagggcct

SEQ ID NO: 433775 - DNA, 140 bp, Artificial Sequence
  Synthetic
atacgccatgctgggtctcccaatacctaaatggtgttcaattaccacaatcattgaagacaatggcaaggtgtggacctttatcagattccatttttgatgatcttcaaggttcactagcgtacttgggagtcggccat

SEQ ID NO: 433776 - DNA, 140 bp, Artificial Sequence
  Synthetic
atggccgactcccaagtacgctagtgaaccttgaagatcatcaaaaatggaatctgataaaggtccacaccttgccattgtcttcaatgattgtggtaattgaacaccatttaggtattgggagacccagcatggcgtat

SEQ ID NO: 433777 - DNA, 140 bp, Artificial Sequence
  Synthetic
atacgccatgctgggtctccccagtattggcacatcatttgagagaggggcgagcgagacacggcatatttttccaagtcgttggatagctgcatttcattccatgttagccgtaaatttcgtacttgggagtcggccat

SEQ ID NO: 433778 - DNA, 140 bp, Artificial Sequence
  Synthetic
atggccgactcccaagtacgaaatttacggctaacatggaatgaaatgcagctatccaacgacttggaaaaatatgccgtgtctcgctcgcccctctctcaaatgatgtgccaatactggggagacccagcatggcgtat

SEQ ID NO: 433779 - DNA, 140 bp, Artificial Sequence
  Synthetic
atacgccatgctgggtctccgttaaatcagaatcacctcggatttcccctaggatttagtattgatgtatcttgttttaaaaagcctcttactttctcggagaaattaattgctttgatccgtacttgggagtcggccat

SEQ ID NO: 433780 - DNA, 140 bp, Artificial Sequence
  Synthetic
atggccgactcccaagtacggatcaaagcaattaatttctccgagaaagtaagaggctttttaaaacaagatacatcaatactaaatcctaggggaaatccgaggtgattctgatttaacggagacccagcatggcgtat

SEQ ID NO: 433781 - DNA, 140 bp, Artificial Sequence
  Synthetic
atacgccatgctgggtctccacacctcaagtgctagggggattatctttcttaaacccggagaaattattctatcggaacatcagtgatcctcttacttcaggattatttcaactcaggacgtacttgggagtcggccat

SEQ ID NO: 433782 - DNA, 140 bp, Artificial Sequence
  Synthetic
atggccgactcccaagtacgtcctgagttgaaataatcctgaagtaagaggatcactgatgttccgatagaataatttctccgggtttaagaaagataatccccctagcacttgaggtgtggagacccagcatggcgtat

SEQ ID NO: 433783 - DNA, 140 bp, Artificial Sequence
  Synthetic
atacgccatgctgggtctccatgcattagagttccttagaaaggaagagttgttctacatcttgattgctaaaaaacccggtttagctgatgcttcagatttcgttatgaatccattaggcgtacttgggagtcggccat

SEQ ID NO: 433784 - DNA, 140 bp, Artificial Sequence
  Synthetic
atggccgactcccaagtacgcctaatggattcataacgaaatctgaagcatcagctaaaccgggttttttagcaatcaagatgtagaacaactcttcctttctaaggaactctaatgcatggagacccagcatggcgtat

SEQ ID NO: 433785 - DNA, 140 bp, Artificial Sequence
  Synthetic
atacgccatgctgggtctcctttaaatgtgccaggatctagggaaataataacgtttctcaggcaaacagttcgtgaaaacataacaattacatcacaaaatagaataataaattctcttcgtacttgggagtcggccat

SEQ ID NO: 433786 - DNA, 140 bp, Artificial Sequence
  Synthetic
atggccgactcccaagtacgaagagaatttattattctattttgtgatgtaattgttatgttttcacgaactgtttgcctgagaaacgttattatttccctagatcctggcacatttaaaggagacccagcatggcgtat

SEQ ID NO: 433787 - DNA, 140 bp, Artificial Sequence
  Synthetic
aggccctggctgctgatatggagaacactagctgatctacttataccgataaataggcagatatcagacattcaaagcactctaagcgaagtaacaacaagagtccatgaaattgagcgggaccttttgggacagcggtg

SEQ ID NO: 433788 - DNA, 140 bp, Artificial Sequence
  Synthetic
caccgctgtcccaaaaggtcccgctcaatttcatggactcttgttgttacttcgcttagagtgctttgaatgtctgatatctgcctatttatcggtataagtagatcagctagtgttctccatatcagcagccagggcct

SEQ ID NO: 433789 - DNA, 140 bp, Artificial Sequence
  Synthetic
atacgccatgctgggtctcctttcacataggttccgacttagaggatcaaagagtatgtgaatggcttttatcatcaaaccccgtaatgagccgatttgctgctgatattttttcacgaacgtacttgggagtcggccat

SEQ ID NO: 433790 - DNA, 140 bp, Artificial Sequence
  Synthetic
atggccgactcccaagtacgttcgtgaaaaaatatcagcagcaaatcggctcattacggggtttgatgataaaagccattcacatactctttgatcctctaagtcggaacctatgtgaaaggagacccagcatggcgtat

SEQ ID NO: 433791 - DNA, 140 bp, Artificial Sequence
  Synthetic
atacgccatgctgggtctcccttattgtacagttttctgtattacttatttgggcttgaagacatagttaagatttgccgaaatgctctccagtcaattccatcccctctcagaaaagaccgtacttgggagtcggccat

SEQ ID NO: 433792 - DNA, 140 bp, Artificial Sequence
  Synthetic
atggccgactcccaagtacggtcttttctgagaggggatggaattgactggagagcatttcggcaaatcttaactatgtcttcaagcccaaataagtaatacagaaaactgtacaataagggagacccagcatggcgtat

SEQ ID NO: 433793 - DNA, 140 bp, Artificial Sequence
  Synthetic
atacgccatgctgggtctcccacctagtggaaaaagacttcaagttttaggttacttggaaggaaccagaacgttattagcttcccgcacgatcagtttaaccactgagggtacaatgttcgtacttgggagtcggccat

SEQ ID NO: 433794 - DNA, 140 bp, Artificial Sequence
  Synthetic
atggccgactcccaagtacgaacattgtaccctcagtggttaaactgatcgtgcgggaagctaataacgttctggttccttccaagtaacctaaaacttgaagtctttttccactaggtgggagacccagcatggcgtat

SEQ ID NO: 433795 - DNA, 140 bp, Artificial Sequence
  Synthetic
atacgccatgctgggtctcccagtctgcatagtacacgtggatcatgagtgctttggatgtgagaaacggttactactcaaattggattttattagaaacacaaagatcgcagaacaaaacgtacttgggagtcggccat

SEQ ID NO: 433796 - DNA, 140 bp, Artificial Sequence
  Synthetic
atggccgactcccaagtacgttttgttctgcgatctttgtgtttctaataaaatccaatttgagtagtaaccgtttctcacatccaaagcactcatgatccacgtgtactatgcagactgggagacccagcatggcgtat

SEQ ID NO: 433797 - DNA, 140 bp, Artificial Sequence
  Synthetic
atacgccatgctgggtctccgatgagattaagagagttaactaagagtcgatggaggagttggttttcttacattgatgcattagatgatgatttgtctgagtctcttgaaaagttcatacgtacttgggagtcggccat

SEQ ID NO: 433798 - DNA, 140 bp, Artificial Sequence
  Synthetic
atggccgactcccaagtacgtatgaacttttcaagagactcagacaaatcatcatctaatgcatcaatgtaagaaaaccaactcctccatcgactcttagttaactctcttaatctcatcggagacccagcatggcgtat

SEQ ID NO: 433799 - DNA, 140 bp, Artificial Sequence
  Synthetic
atacgccatgctgggtctccattacttaatagagtaatcgggtatattttattctttccgttcggtctgtttaaatctgaatcattaacagcataactttaacaaagagaacttcatttacgtacttgggagtcggccat

SEQ ID NO: 433800 - DNA, 140 bp, Artificial Sequence
  Synthetic
atggccgactcccaagtacgtaaatgaagttctctttgttaaagttatgctgttaatgattcagatttaaacagaccgaacggaaagaataaaatatacccgattactctattaagtaatggagacccagcatggcgtat

SEQ ID NO: 433801 - DNA, 140 bp, Artificial Sequence
  Synthetic
atacgccatgctgggtctccattcacgaaaataatctatttaaaaatgagggttacattttctagagtattgtatgagaaataataaaataaacaagaagaagaaaaaactattagacagcgtacttgggagtcggccat

SEQ ID NO: 433802 - DNA, 140 bp, Artificial Sequence
  Synthetic
atggccgactcccaagtacgctgtctaatagttttttcttcttcttgtttattttattatttctcatacaatactctagaaaatgtaaccctcatttttaaatagattattttcgtgaatggagacccagcatggcgtat

SEQ ID NO: 433803 - DNA, 140 bp, Artificial Sequence
  Synthetic
atacgccatgctgggtctccagttcaatgtaaagtgggtcaacttgtctgaagacttaaaggagcaatttaagctatcttcagatctgggatcacctacggatttattgcagtacgattgcgtacttgggagtcggccat

SEQ ID NO: 433804 - DNA, 140 bp, Artificial Sequence
  Synthetic
atggccgactcccaagtacgcaatcgtactgcaataaatccgtaggtgatcccagatctgaagatagcttaaattgctcctttaagtcttcagacaagttgacccactttacattgaactggagacccagcatggcgtat

SEQ ID NO: 433805 - DNA, 140 bp, Artificial Sequence
  Synthetic
atacgccatgctgggtctcccaatggactgcattcaaagggggccgataacgcagaattaaattatgtgagttgtgcccttgaccggaaaattgttcaaaagcatccatctgacaatcgccgtacttgggagtcggccat

SEQ ID NO: 433806 - DNA, 140 bp, Artificial Sequence
  Synthetic
atggccgactcccaagtacggcgattgtcagatggatgcttttgaacaattttccggtcaagggcacaactcacataatttaattctgcgttatcggccccctttgaatgcagtccattgggagacccagcatggcgtat

SEQ ID NO: 433807 - DNA, 140 bp, Artificial Sequence
  Synthetic
aggccctggctgctgatatgtggtaacttttcaatgttagttactcaaatattattgctcataattggtattgatattggtacattgggtgagtccttgagctttatccttaatataatggaccttttgggacagcggtg

SEQ ID NO: 433808 - DNA, 140 bp, Artificial Sequence
  Synthetic
caccgctgtcccaaaaggtccattatattaaggataaagctcaaggactcacccaatgtaccaatatcaataccaattatgagcaataatatttgagtaactaacattgaaaagttaccacatatcagcagccagggcct

SEQ ID NO: 433809 - DNA, 140 bp, Artificial Sequence
  Synthetic
atacgccatgctgggtctccctggcatggacaataggaaatcgagcaccgtatatagggtcacgaacagaagataaaattggttaccctcctttaagagtaaactgcccatcggcagccccgtacttgggagtcggccat

SEQ ID NO: 433810 - DNA, 140 bp, Artificial Sequence
  Synthetic
atggccgactcccaagtacggggctgccgatgggcagtttactcttaaaggagggtaaccaattttatcttctgttcgtgaccctatatacggtgctcgatttcctattgtccatgccagggagacccagcatggcgtat

SEQ ID NO: 433811 - DNA, 140 bp, Artificial Sequence
  Synthetic
atacgccatgctgggtctcctaagaaattagggaaatactgagatatactagttgaattgagttatgacataccatatatcataaatataaaagaacgatctgctgtaatctataagcatcgtacttgggagtcggccat

SEQ ID NO: 433812 - DNA, 140 bp, Artificial Sequence
  Synthetic
atggccgactcccaagtacgatgcttatagattacagcagatcgttcttttatatttatgatatatggtatgtcataactcaattcaactagtatatctcagtatttccctaatttcttaggagacccagcatggcgtat

SEQ ID NO: 433813 - DNA, 140 bp, Artificial Sequence
  Synthetic
atacgccatgctgggtctccttaaagaagctattgaaatggtctctagactattgtgggtgactcaaggcaccgcagatcgagaaaaattgctcattcctcttctcaattcaagagttaacgtacttgggagtcggccat

SEQ ID NO: 433814 - DNA, 140 bp, Artificial Sequence
  Synthetic
atggccgactcccaagtacgttaactcttgaattgagaagaggaatgagcaatttttctcgatctgcggtgccttgagtcacccacaatagtctagagaccatttcaatagcttctttaaggagacccagcatggcgtat

SEQ ID NO: 433815 - DNA, 140 bp, Artificial Sequence
  Synthetic
atacgccatgctgggtctccctcttttacatacattggggaaagaactaggttatcgttgagattaaaaagactacgttacgttttctctgatgacaagtgacaaaatttcgtagttaaacgtacttgggagtcggccat

SEQ ID NO: 433816 - DNA, 140 bp, Artificial Sequence
  Synthetic
atggccgactcccaagtacgtttaactacgaaattttgtcacttgtcatcagagaaaacgtaacgtagtctttttaatctcaacgataacctagttctttccccaatgtatgtaaaagagggagacccagcatggcgtat

SEQ ID NO: 433817 - DNA, 140 bp, Artificial Sequence
  Synthetic
atacgccatgctgggtctcctttagactatcagacagtgctcaacttcctgcccactcactactcaggcaatatagttcacagatacaatgatcaatatggacaacactcctttatggcacgtacttgggagtcggccat

SEQ ID NO: 433818 - DNA, 140 bp, Artificial Sequence
  Synthetic
atggccgactcccaagtacgtgccataaaggagtgttgtccatattgatcattgtatctgtgaactatattgcctgagtagtgagtgggcaggaagttgagcactgtctgatagtctaaaggagacccagcatggcgtat

SEQ ID NO: 433819 - DNA, 140 bp, Artificial Sequence
  Synthetic
atacgccatgctgggtctcctttctagaatgtcaatgtgaatgtaaattaagaaaaaccaatatataaaattaaaaaattaaaaaactttgatataagtaacacaaaacattcttcatctcgtacttgggagtcggccat

SEQ ID NO: 433820 - DNA, 140 bp, Artificial Sequence
  Synthetic
atggccgactcccaagtacgagatgaagaatgttttgtgttacttatatcaaagttttttaattttttaattttatatattggtttttcttaatttacattcacattgacattctagaaaggagacccagcatggcgtat

SEQ ID NO: 433821 - DNA, 140 bp, Artificial Sequence
  Synthetic
atacgccatgctgggtctccaatagaatgagcaatacatccactcgtgcaatcatatcaactaacacactagggaaatatgctggagggggtcaagctgctgttgatagtaatataatctcgtacttgggagtcggccat

SEQ ID NO: 433822 - DNA, 140 bp, Artificial Sequence
  Synthetic
atggccgactcccaagtacgagattatattactatcaacagcagcttgaccccctccagcatatttccctagtgtgttagttgatatgattgcacgagtggatgtattgctcattctattggagacccagcatggcgtat

SEQ ID NO: 433823 - DNA, 140 bp, Artificial Sequence
  Synthetic
atacgccatgctgggtctcctccagaacactattaatttaggtgttgcagttttggacattacattgtctctttctaaattgtcatcaacatcaaatgtttctttccgtttaatgttaagcgtacttgggagtcggccat

SEQ ID NO: 433824 - DNA, 140 bp, Artificial Sequence
  Synthetic
atggccgactcccaagtacgcttaacattaaacggaaagaaacatttgatgttgatgacaatttagaaagagacaatgtaatgtccaaaactgcaacacctaaattaatagtgttctggaggagacccagcatggcgtat

SEQ ID NO: 433825 - DNA, 140 bp, Artificial Sequence
  Synthetic
atacgccatgctgggtctcctaaatgttgcacacggcatgtaccgtctgagtatttattctttgataaacctttagatgtggatttgaacaagtacatggataacgagttagtttacgatcgtacttgggagtcggccat

SEQ ID NO: 433826 - DNA, 140 bp, Artificial Sequence
  Synthetic
atggccgactcccaagtacgatcgtaaactaactcgttatccatgtacttgttcaaatccacatctaaaggtttatcaaagaataaatactcagacggtacatgccgtgtgcaacatttaggagacccagcatggcgtat

SEQ ID NO: 433827 - DNA, 140 bp, Artificial Sequence
  Synthetic
atacgccatgctgggtctccaatgatcctctctgtagtggaataaagggaagattaggtagagtatcaagatcaacactctcattgagtctaaatgtaagcgatattggatcttatgactcgtacttgggagtcggccat

SEQ ID NO: 433828 - DNA, 140 bp, Artificial Sequence
  Synthetic
atggccgactcccaagtacgagtcataagatccaatatcgcttacatttagactcaatgagagtgttgatcttgatactctacctaatcttccctttattccactacagagaggatcattggagacccagcatggcgtat

SEQ ID NO: 433829 - DNA, 140 bp, Artificial Sequence
  Synthetic
aggccctggctgctgatatgaggatcatggtataaaaccacacatgatttgcatttgactccatatcttagacaacatattgtgtcaaattcatttccatcacaagccgaaatttatcaggaccttttgggacagcggtg

SEQ ID NO: 433830 - DNA, 140 bp, Artificial Sequence
  Synthetic
caccgctgtcccaaaaggtcctgataaatttcggcttgtgatggaaatgaatttgacacaatatgttgtctaagatatggagtcaaatgcaaatcatgtgtggttttataccatgatcctcatatcagcagccagggcct

SEQ ID NO: 433831 - DNA, 140 bp, Artificial Sequence
  Synthetic
atacgccatgctgggtctccttccgactattgctgcgtggactttaggagagacaattattggaagtattttttctgatgaatcttctcaaagtacagaccctataagttcgggctgtaccgtacttgggagtcggccat

SEQ ID NO: 433832 - DNA, 140 bp, Artificial Sequence
  Synthetic
atggccgactcccaagtacggtacagcccgaacttatagggtctgtactttgagaagattcatcagaaaaaatacttccaataattgtctctcctaaagtccacgcagcaatagtcggaaggagacccagcatggcgtat

SEQ ID NO: 433833 - DNA, 140 bp, Artificial Sequence
  Synthetic
aggccctggctgctgatatgaatttatttctgtcttaagtgtgattttcaccttgaaagagttaaatggtgatagattaatccttgaagtaacttttttatatattatagaggaactaatgaccttttgggacagcggtg

SEQ ID NO: 433834 - DNA, 140 bp, Artificial Sequence
  Synthetic
caccgctgtcccaaaaggtcattagttcctctataatatataaaaaagttacttcaaggattaatctatcaccatttaactctttcaaggtgaaaatcacacttaagacagaaataaattcatatcagcagccagggcct

SEQ ID NO: 433835 - DNA, 140 bp, Artificial Sequence
  Synthetic
atacgccatgctgggtctccaaaaacttttgtaacacactttcttgtgtatccagttgagagtatcttttatgcctttggagctaatctaatagtggaaagtttaagtttaagcaggatccgtacttgggagtcggccat

SEQ ID NO: 433836 - DNA, 140 bp, Artificial Sequence
  Synthetic
atggccgactcccaagtacggatcctgcttaaacttaaactttccactattagattagctccaaaggcataaaagatactctcaactggatacacaagaaagtgtgttacaaaagtttttggagacccagcatggcgtat

SEQ ID NO: 433837 - DNA, 140 bp, Artificial Sequence
  Synthetic
aggccctggctgctgatatgtggcagtattggtgatgtaaatggtgatatcttagaacccataagatcaccttcttcaccatctgctcctcaggaagacacaagggcaagagaagcctatgaccttttgggacagcggtg

SEQ ID NO: 433838 - DNA, 140 bp, Artificial Sequence
  Synthetic
caccgctgtcccaaaaggtcataggcttctcttgcccttgtgtcttcctgaggagcagatggtgaagaaggtgatcttatgggttctaagatatcaccatttacatcaccaatactgccacatatcagcagccagggcct

SEQ ID NO: 433839 - DNA, 140 bp, Artificial Sequence
  Synthetic
atacgccatgctgggtctccaattcaatcaagagcctctcagatttaacatttcttatatcatccacaatcagaaatttgtcgcacagatcacttcgaattcttcaatctactttccgaccgtacttgggagtcggccat

SEQ ID NO: 433840 - DNA, 140 bp, Artificial Sequence
  Synthetic
atggccgactcccaagtacggtcggaaagtagattgaagaattcgaagtgatctgtgcgacaaatttctgattgtggatgatataagaaatgttaaatctgagaggctcttgattgaattggagacccagcatggcgtat

SEQ ID NO: 433841 - DNA, 140 bp, Artificial Sequence
  Synthetic
atacgccatgctgggtctccatgaattggtattaactagactagctcatcatataccattgatttccttaatgctaggaggttctgcgggtgagaaaagttcgtcggatgctgtccgactcgtacttgggagtcggccat

SEQ ID NO: 433842 - DNA, 140 bp, Artificial Sequence
  Synthetic
atggccgactcccaagtacgagtcggacagcatccgacgaacttttctcacccgcagaacctcctagcattaaggaaatcaatggtatatgatgagctagtctagttaataccaattcatggagacccagcatggcgtat

SEQ ID NO: 433843 - DNA, 140 bp, Artificial Sequence
  Synthetic
atacgccatgctgggtctccatttcttacggcaagttatcaaaattttatcaataatttcagttgtttgatgagaaagaaccaatcaccattaccagtttggctttatttccctagtgaacgtacttgggagtcggccat

SEQ ID NO: 433844 - DNA, 140 bp, Artificial Sequence
  Synthetic
atggccgactcccaagtacgttcactagggaaataaagccaaactggtaatggtgattggttctttctcatcaaacaactgaaattattgataaaattttgataacttgccgtaagaaatggagacccagcatggcgtat

SEQ ID NO: 433845 - DNA, 140 bp, Artificial Sequence
  Synthetic
atacgccatgctgggtctccttttgactgataatttttgggtctatccaagcaaatcaacgagaactaatcattattatgcaagtcttaattattggagagacaaagctaataagattaacgtacttgggagtcggccat

SEQ ID NO: 433846 - DNA, 140 bp, Artificial Sequence
  Synthetic
atggccgactcccaagtacgttaatcttattagctttgtctctccaataattaagacttgcataataatgattagttctcgttgatttgcttggatagacccaaaaattatcagtcaaaaggagacccagcatggcgtat

SEQ ID NO: 433847 - DNA, 140 bp, Artificial Sequence
  Synthetic
atacgccatgctgggtctccgaatacttcattttcacatttgataaactattcattttctgaaccctctctacatgcgagctctatctcttctagtcaagaagtggtcaatttaaaacaccgtacttgggagtcggccat

SEQ ID NO: 433848 - DNA, 140 bp, Artificial Sequence
  Synthetic
atggccgactcccaagtacggtgttttaaattgaccacttcttgactagaagagatagagctcgcatgtagagagggttcagaaaatgaatagtttatcaaatgtgaaaatgaagtattcggagacccagcatggcgtat

SEQ ID NO: 433849 - DNA, 140 bp, Artificial Sequence
  Synthetic
atacgccatgctgggtctccactagtcgtttagatgaaacacctaatatgagtgaaagggctcaatcaacaaatcatgagccaacagctttacaagaggtgtgcactgagatacccttctcgtacttgggagtcggccat

SEQ ID NO: 433850 - DNA, 140 bp, Artificial Sequence
  Synthetic
atggccgactcccaagtacgagaagggtatctcagtgcacacctcttgtaaagctgttggctcatgatttgttgattgagccctttcactcatattaggtgtttcatctaaacgactagtggagacccagcatggcgtat

SEQ ID NO: 433851 - DNA, 140 bp, Artificial Sequence
  Synthetic
atacgccatgctgggtctcctgatgaagaaaaggggagaaaattccccggtggtttattttcaagcacctgagaacttccctttgaatggcttcaacaacagacaagttgtactagcgtacgtacttgggagtcggccat

SEQ ID NO: 433852 - DNA, 140 bp, Artificial Sequence
  Synthetic
atggccgactcccaagtacgtacgctagtacaacttgtctgttgttgaagccattcaaagggaagttctcaggtgcttgaaaataaaccaccggggaattttctccccttttcttcatcaggagacccagcatggcgtat

SEQ ID NO: 433853 - DNA, 140 bp, Artificial Sequence
  Synthetic
atacgccatgctgggtctccacagtcaaatggagaagggccaacccctcaatctgacacaatacatgaacagcaaaattgctatataagtggcttaaattagcatggatattcatagtttcgtacttgggagtcggccat

SEQ ID NO: 433854 - DNA, 140 bp, Artificial Sequence
  Synthetic
atggccgactcccaagtacgaaactatgaatatccatgctaatttaagccacttatatagcaattttgctgttcatgtattgtgtcagattgaggggttggcccttctccatttgactgtggagacccagcatggcgtat

SEQ ID NO: 433855 - DNA, 140 bp, Artificial Sequence
  Synthetic
atacgccatgctgggtctccacctctttcattgcaagtgtcttctaagggttgcctgcaggctcttacttgccctcatcacccctccccatctcaaaccaccacagaaccactaagcatgcgtacttgggagtcggccat

SEQ ID NO: 433856 - DNA, 140 bp, Artificial Sequence
  Synthetic
atggccgactcccaagtacgcatgcttagtggttctgtggtggtttgagatggggaggggtgatgagggcaagtaagagcctgcaggcaacccttagaagacacttgcaatgaaagaggtggagacccagcatggcgtat

SEQ ID NO: 433857 - DNA, 140 bp, Artificial Sequence
  Synthetic
aggccctggctgctgatatggccctcatcacccctccccatctcaaaccaccacagaaccactaagcatgcttagaaattgtgacgccataaaagcaaccttacgttctgagacgaatgagaccttttgggacagcggtg

SEQ ID NO: 433858 - DNA, 140 bp, Artificial Sequence
  Synthetic
caccgctgtcccaaaaggtctcattcgtctcagaacgtaaggttgcttttatggcgtcacaatttctaagcatgcttagtggttctgtggtggtttgagatggggaggggtgatgagggccatatcagcagccagggcct

SEQ ID NO: 433859 - DNA, 140 bp, Artificial Sequence
  Synthetic
atacgccatgctgggtctccttcttatattgcttgattaaaaacaagaaattatcctaacatgaagaccacatgtctctttatcggtcttatcttgatccaaaggataaaaactcttcctcgtacttgggagtcggccat

SEQ ID NO: 433860 - DNA, 140 bp, Artificial Sequence
  Synthetic
atggccgactcccaagtacgaggaagagtttttatcctttggatcaagataagaccgataaagagacatgtggtcttcatgttaggataatttcttgtttttaatcaagcaatataagaaggagacccagcatggcgtat

SEQ ID NO: 433861 - DNA, 140 bp, Artificial Sequence
  Synthetic
atacgccatgctgggtctcctccccgtcttatgagcagtatccttgatatgagatcattgaaaactcccatgagaatagaatctcgaaacacgagtctattgcaaccttctgagtgtctgcgtacttgggagtcggccat

SEQ ID NO: 433862 - DNA, 140 bp, Artificial Sequence
  Synthetic
atggccgactcccaagtacgcagacactcagaaggttgcaatagactcgtgtttcgagattctattctcatgggagttttcaatgatctcatatcaaggatactgctcataagacggggaggagacccagcatggcgtat

SEQ ID NO: 433863 - DNA, 140 bp, Artificial Sequence
  Synthetic
atacgccatgctgggtctcctcaacttctaagggaaaatctgtactgtctagagaacaggcttcatacctgtatgttgattgcagtaatatctcttctatttctctggattcaggttttccgtacttgggagtcggccat

SEQ ID NO: 433864 - DNA, 140 bp, Artificial Sequence
  Synthetic
atggccgactcccaagtacggaaaacctgaatccagagaaatagaagagatattactgcaatcaacatacaggtatgaagcctgttctctagacagtacagattttcccttagaagttgaggagacccagcatggcgtat

SEQ ID NO: 433865 - DNA, 140 bp, Artificial Sequence
  Synthetic
aggccctggctgctgatatggttgctcaacaagcttgtagtaaggggaccatggttaaaaatgaaacaacagatgcagccgacaagatgtcgaaagttcttgaactcagtgaggagacgtgaccttttgggacagcggtg

SEQ ID NO: 433866 - DNA, 140 bp, Artificial Sequence
  Synthetic
caccgctgtcccaaaaggtcacgtctcctcactgagttcaagaactttcgacatcttgtcggctgcatctgttgtttcatttttaaccatggtccccttactacaagcttgttgagcaaccatatcagcagccagggcct

SEQ ID NO: 433867 - DNA, 140 bp, Artificial Sequence
  Synthetic
atacgccatgctgggtctccgaaatatgtctgatagaaatcaagtccaaatgctaataaatacttacaaacgcgacttatacacttgttttgatagtaaccaattctgcaggtttacaggcgtacttgggagtcggccat

SEQ ID NO: 433868 - DNA, 140 bp, Artificial Sequence
  Synthetic
atggccgactcccaagtacgcctgtaaacctgcagaattggttactatcaaaacaagtgtataagtcgcgtttgtaagtatttattagcatttggacttgatttctatcagacatatttcggagacccagcatggcgtat

SEQ ID NO: 433869 - DNA, 140 bp, Artificial Sequence
  Synthetic
atacgccatgctgggtctccggtcgtttcatcaatgcattataagctttatgatcttttgccagcaggcaaactcggaaaggcaatctgcctagccgaaggggaagggagtggcgctcgacgtacttgggagtcggccat

SEQ ID NO: 433870 - DNA, 140 bp, Artificial Sequence
  Synthetic
atggccgactcccaagtacgtcgagcgccactcccttccccttcggctaggcagattgcctttccgagtttgcctgctggcaaaagatcataaagcttataatgcattgatgaaacgaccggagacccagcatggcgtat

SEQ ID NO: 433871 - DNA, 140 bp, Artificial Sequence
  Synthetic
atacgccatgctgggtctccctactcttgaagtggaaggagacagattatttattcttcaacactttggccacagattcacaacaggaagcagaaattttgagtggtcgagttattccaacgtacttgggagtcggccat

SEQ ID NO: 433872 - DNA, 140 bp, Artificial Sequence
  Synthetic
atggccgactcccaagtacgttggaataactcgaccactcaaaatttctgcttcctgttgtgaatctgtggccaaagtgttgaagaataaataatctgtctccttccacttcaagagtagggagacccagcatggcgtat

SEQ ID NO: 433873 - DNA, 140 bp, Artificial Sequence
  Synthetic
atacgccatgctgggtctccggatgttgtataacatagataagctaagtgttttacttgaatccagaaaattaatcttgaataatctaactattcaaatcacggatattacaaacccactcgtacttgggagtcggccat

SEQ ID NO: 433874 - DNA, 140 bp, Artificial Sequence
  Synthetic
atggccgactcccaagtacgagtgggtttgtaatatccgtgatttgaatagttagattattcaagattaattttctggattcaagtaaaacacttagcttatctatgttatacaacatccggagacccagcatggcgtat

SEQ ID NO: 433875 - DNA, 140 bp, Artificial Sequence
  Synthetic
atacgccatgctgggtctccatggctggactctgtcatacaatacctacctgaagatagtgacattctaacaatggatgcagagaccactaaagaagagacaagagagcaactctataaacgtacttgggagtcggccat

SEQ ID NO: 433876 - DNA, 140 bp, Artificial Sequence
  Synthetic
atggccgactcccaagtacgtttatagagttgctctcttgtctcttctttagtggtctctgcatccattgttagaatgtcactatcttcaggtaggtattgtatgacagagtccagccatggagacccagcatggcgtat

SEQ ID NO: 433877 - DNA, 140 bp, Artificial Sequence
  Synthetic
atacgccatgctgggtctccactatcataaatatttgggcacgtacttctcctaatatccctaaaaccagcatcattaaagtgtttttattagattatgggggaaccttgttcttaatgacgtacttgggagtcggccat

SEQ ID NO: 433878 - DNA, 140 bp, Artificial Sequence
  Synthetic
atggccgactcccaagtacgtcattaagaacaaggttcccccataatctaataaaaacactttaatgatgctggttttagggatattaggagaagtacgtgcccaaatatttatgatagtggagacccagcatggcgtat

SEQ ID NO: 433879 - DNA, 140 bp, Artificial Sequence
  Synthetic
atacgccatgctgggtctccagaatgctattcaatattatggacaagttcaacttaagaaaccatatagttcaaatgcaaaaaattcagaatggtacttatgttgtggaaaacgaagagtcgtacttgggagtcggccat

SEQ ID NO: 433880 - DNA, 140 bp, Artificial Sequence
  Synthetic
atggccgactcccaagtacgactcttcgttttccacaacataagtaccattctgaattttttgcatttgaactatatggtttcttaagttgaacttgtccataatattgaatagcattctggagacccagcatggcgtat

SEQ ID NO: 433881 - DNA, 140 bp, Artificial Sequence
  Synthetic
atacgccatgctgggtctcctcaacgactccgagttgattttccagaccaagtaggaatattcttgatctgtaaagcaatgtcacgtcagaggcaagcaattccttactggctaaagcaccgtacttgggagtcggccat

SEQ ID NO: 433882 - DNA, 140 bp, Artificial Sequence
  Synthetic
atggccgactcccaagtacggtgctttagccagtaaggaattgcttgcctctgacgtgacattgctttacagatcaagaatattcctacttggtctggaaaatcaactcggagtcgttgaggagacccagcatggcgtat

SEQ ID NO: 433883 - DNA, 140 bp, Artificial Sequence
  Synthetic
atacgccatgctgggtctccatagaaaagaattaccctgcttcattgcacgagttctttataactttgggttttccttctttagagtcatctttctgccatcgctacaccattccgttcacgtacttgggagtcggccat

SEQ ID NO: 433884 - DNA, 140 bp, Artificial Sequence
  Synthetic
atggccgactcccaagtacgtgaacggaatggtgtagcgatggcagaaagatgactctaaagaaggaaaacccaaagttataaagaactcgtgcaatgaagcagggtaattcttttctatggagacccagcatggcgtat

SEQ ID NO: 433885 - DNA, 140 bp, Artificial Sequence
  Synthetic
atacgccatgctgggtctccctgagggaacagctctctttcacaaggtccagtcttatgtccgacaaggtagacaacacctacactctcttatgttagattacgaaaataattcacccctcgtacttgggagtcggccat

SEQ ID NO: 433886 - DNA, 140 bp, Artificial Sequence
  Synthetic
atggccgactcccaagtacgaggggtgaattattttcgtaatctaacataagagagtgtaggtgttgtctaccttgtcggacataagactggaccttgtgaaagagagctgttccctcagggagacccagcatggcgtat

SEQ ID NO: 433887 - DNA, 140 bp, Artificial Sequence
  Synthetic
atacgccatgctgggtctcccctagatctgagaaatcacttcatatgctcattgaggggaaagataaccaagtattacaatgacatattgaaattaaatttagtagtgagagcagtagaacgtacttgggagtcggccat

SEQ ID NO: 433888 - DNA, 140 bp, Artificial Sequence
  Synthetic
atggccgactcccaagtacgttctactgctctcactactaaatttaatttcaatatgtcattgtaatacttggttatctttcccctcaatgagcatatgaagtgatttctcagatctaggggagacccagcatggcgtat

SEQ ID NO: 433889 - DNA, 140 bp, Artificial Sequence
  Synthetic
atacgccatgctgggtctccagagggaaaaattggtcgcaactcgttgagtcccttcctaatatgcactcagtatgcataacacatgttgatcacgaatgtattggctgtgagagacggtcgtacttgggagtcggccat

SEQ ID NO: 433890 - DNA, 140 bp, Artificial Sequence
  Synthetic
atggccgactcccaagtacgaccgtctctcacagccaatacattcgtgatcaacatgtgttatgcatactgagtgcatattaggaagggactcaacgagttgcgaccaatttttccctctggagacccagcatggcgtat

SEQ ID NO: 433891 - DNA, 140 bp, Artificial Sequence
  Synthetic
atacgccatgctgggtctcctattacttaaattggactttgtcagaaatacaaagatagcagaacaaaagttactcaatagggtaattgggtatattctattcttcccttttggtttctccgtacttgggagtcggccat

SEQ ID NO: 433892 - DNA, 140 bp, Artificial Sequence
  Synthetic
atggccgactcccaagtacggagaaaccaaaagggaagaatagaatatacccaattaccctattgagtaacttttgttctgctatctttgtatttctgacaaagtccaatttaagtaataggagacccagcatggcgtat

SEQ ID NO: 433893 - DNA, 140 bp, Artificial Sequence
  Synthetic
aggccctggctgctgatatgatactattaatttaggagttgcagttttagatattgcattgtctcttgctaaattgtcgtcagcatcaaatgtcactttccgtttaatgttaaataagtggaccttttgggacagcggtg

SEQ ID NO: 433894 - DNA, 140 bp, Artificial Sequence
  Synthetic
caccgctgtcccaaaaggtccacttatttaacattaaacggaaagtgacatttgatgctgacgacaatttagcaagagacaatgcaatatctaaaactgcaactcctaaattaatagtatcatatcagcagccagggcct

SEQ ID NO: 433895 - DNA, 140 bp, Artificial Sequence
  Synthetic
atacgccatgctgggtctcctgtataaaaaactgcaagacaaataataaggaaaggatactactgtataacttgttatatccaaaaggatcttgggtcattttaagcatgatgcaaataacgtacttgggagtcggccat

SEQ ID NO: 433896 - DNA, 140 bp, Artificial Sequence
  Synthetic
atggccgactcccaagtacgttatttgcatcatgcttaaaatgacccaagatccttttggatataacaagttatacagtagtatcctttccttattatttgtcttgcagttttttatacaggagacccagcatggcgtat

SEQ ID NO: 433897 - DNA, 140 bp, Artificial Sequence
  Synthetic
atacgccatgctgggtctccaaaatcgtctacatagccgaactgaccgctcagtacttattcacaatcatgctaacttttagtttttaattgtgcaaaaattactaagaataattaatatcgtacttgggagtcggccat

SEQ ID NO: 433898 - DNA, 140 bp, Artificial Sequence
  Synthetic
atggccgactcccaagtacgatattaattattcttagtaatttttgcacaattaaaaactaaaagttagcatgattgtgaataagtactgagcggtcagttcggctatgtagacgattttggagacccagcatggcgtat

SEQ ID NO: 433899 - DNA, 140 bp, Artificial Sequence
  Synthetic
atacgccatgctgggtctcccataatgcatcatgaatacaaagagaaaaattgttgcaattcaggaatatcttatttaaatgtattagagagaaagtcagattattatcaaaatcaagcacgtacttgggagtcggccat

SEQ ID NO: 433900 - DNA, 140 bp, Artificial Sequence
  Synthetic
atggccgactcccaagtacgtgcttgattttgataataatctgactttctctctaatacatttaaataagatattcctgaattgcaacaatttttctctttgtattcatgatgcattatgggagacccagcatggcgtat

SEQ ID NO: 433901 - DNA, 140 bp, Artificial Sequence
  Synthetic
atacgccatgctgggtctccaaatacaataggttttttcaaagaataggtggtaaagccttatggttattttttaaagatgtcaatgtgaatttttattaagaaaaagtaatgcatgaaacgtacttgggagtcggccat

SEQ ID NO: 433902 - DNA, 140 bp, Artificial Sequence
  Synthetic
atggccgactcccaagtacgtttcatgcattactttttcttaataaaaattcacattgacatctttaaaaaataaccataaggctttaccacctattctttgaaaaaacctattgtatttggagacccagcatggcgtat

SEQ ID NO: 433903 - DNA, 140 bp, Artificial Sequence
  Synthetic
aggccctggctgctgatatgatgtgaatttttattaagaaaaagtaatgcatgaaattaaaaaattaaagaactttgatataagtaacacaaaacactcttcatctttttagtgtgtccagaccttttgggacagcggtg

SEQ ID NO: 433904 - DNA, 140 bp, Artificial Sequence
  Synthetic
caccgctgtcccaaaaggtctggacacactaaaaagatgaagagtgttttgtgttacttatatcaaagttctttaattttttaatttcatgcattactttttcttaataaaaattcacatcatatcagcagccagggcct

SEQ ID NO: 433905 - DNA, 140 bp, Artificial Sequence
  Synthetic
aggccctggctgctgatatgtggggtctaggtggtaaatggtggacatccgactggggtgttcttactaacttgggcattttgctactattatccatagctgtcttgattgctctatcctgaccttttgggacagcggtg

SEQ ID NO: 433906 - DNA, 140 bp, Artificial Sequence
  Synthetic
caccgctgtcccaaaaggtcaggatagagcaatcaagacagctatggataatagtagcaaaatgcccaagttagtaagaacaccccagtcggatgtccaccatttaccacctagaccccacatatcagcagccagggcct

SEQ ID NO: 433907 - DNA, 140 bp, Artificial Sequence
  Synthetic
atacgccatgctgggtctccagggtcagtcatcgctaccggtttggctttactttcctagtgaagggcaacaattaaagcctatattaaaaatcttacagagattatcagacttgttatccgtacttgggagtcggccat

SEQ ID NO: 433908 - DNA, 140 bp, Artificial Sequence
  Synthetic
atggccgactcccaagtacggataacaagtctgataatctctgtaagatttttaatataggctttaattgttgcccttcactaggaaagtaaagccaaaccggtagcgatgactgaccctggagacccagcatggcgtat

SEQ ID NO: 433909 - DNA, 140 bp, Artificial Sequence
  Synthetic
aggccctggctgctgatatgaatataggaaagatatttattcttacgtaatccttggcccaacggaaactaacctccatggtcattcaatatgcttgctcatgatatatccagagattttgaccttttgggacagcggtg

SEQ ID NO: 433910 - DNA, 140 bp, Artificial Sequence
  Synthetic
caccgctgtcccaaaaggtcaaaatctctggatatatcatgagcaagcatattgaatgaccatggaggttagtttccgttgggccaaggattacgtaagaataaatatctttcctatattcatatcagcagccagggcct

SEQ ID NO: 433911 - DNA, 140 bp, Artificial Sequence
  Synthetic
aggccctggctgctgatatggaacataagtgatcctctcacttcaggtctatttcaactcaagaatgcattggaatttcttgaaaaggaagaattattctatatcttgatttctaaaaaagaccttttgggacagcggtg

SEQ ID NO: 433912 - DNA, 140 bp, Artificial Sequence
  Synthetic
caccgctgtcccaaaaggtcttttttagaaatcaagatatagaataattcttccttttcaagaaattccaatgcattcttgagttgaaatagacctgaagtgagaggatcacttatgttccatatcagcagccagggcct

SEQ ID NO: 433913 - DNA, 140 bp, Artificial Sequence
  Synthetic
atacgccatgctgggtctcccgtaattgtaggattccacatcacatttaccgtttaaggaattcgacagcattaaagacatttcttcagaattgttcgatactcaccgttccttttcattcgtacttgggagtcggccat

SEQ ID NO: 433914 - DNA, 140 bp, Artificial Sequence
  Synthetic
atggccgactcccaagtacgaatgaaaaggaacggtgagtatcgaacaattctgaagaaatgtctttaatgctgtcgaattccttaaacggtaaatgtgatgtggaatcctacaattacgggagacccagcatggcgtat

SEQ ID NO: 433915 - DNA, 140 bp, Artificial Sequence
  Synthetic
aggccctggctgctgatatgttcttgttgcacagttttttgtattacttacttgggcttgaagacatagttaagactggccgaaaatgctctccagtcaactccattccccctcagaagagaccttttgggacagcggtg

SEQ ID NO: 433916 - DNA, 140 bp, Artificial Sequence
  Synthetic
caccgctgtcccaaaaggtctcttctgagggggaatggagttgactggagagcattttcggccagtcttaactatgtcttcaagcccaagtaagtaatacaaaaaactgtgcaacaagaacatatcagcagccagggcct

SEQ ID NO: 433917 - DNA, 140 bp, Artificial Sequence
  Synthetic
aggccctggctgctgatatgagtatcgaaaaggctttaagacaagtaacagtacatcaagaacaagggattgtcacataccctaatcactggcttactacaggccatatgaaagtaatttgaccttttgggacagcggtg

SEQ ID NO: 433918 - DNA, 140 bp, Artificial Sequence
  Synthetic
caccgctgtcccaaaaggtcaaattactttcatatggcctgtagtaagccagtgattagggtatgtgacaatcccttgttcttgatgtactgttacttgtcttaaagccttttcgatactcatatcagcagccagggcct

SEQ ID NO: 433919 - DNA, 140 bp, Artificial Sequence
  Synthetic
atacgccatgctgggtctccgcaattgcgctgggtgtggcaacagcacacggcagcacattggctggtgtcaatgtcggcgaacaatatcaacagctacgagaggcggcacatgatgcagcgtacttgggagtcggccat

SEQ ID NO: 433920 - DNA, 140 bp, Artificial Sequence
  Synthetic
atggccgactcccaagtacgctgcatcatgtgccgcctctcgtagctgttgatattgttcgccgacattgacaccagccaatgtgctgccgtgtgctgttgccacacccagcgcaattgcggagacccagcatggcgtat

SEQ ID NO: 433921 - DNA, 140 bp, Artificial Sequence
  Synthetic
aggccctggctgctgatatgagctcttcttcaagtagctttgttgacttgaatgatccatttgcactgctgaatgaggacgaagacactcttgatgacagtgtcatgatcccgagcacaagaccttttgggacagcggtg

SEQ ID NO: 433922 - DNA, 140 bp, Artificial Sequence
  Synthetic
caccgctgtcccaaaaggtcttgtgctcgggatcatgacactgtcatcaagagtgtcttcgtcctcattcagcagtgcaaatggatcattcaagtcaacaaagctacttgaagaagagctcatatcagcagccagggcct

SEQ ID NO: 433923 - DNA, 140 bp, Artificial Sequence; identical to SEQ ID NO: 377767
  Synthetic

SEQ ID NO: 433924 - DNA, 140 bp, Artificial Sequence; identical to SEQ ID NO: 377768
  Synthetic

SEQ ID NO: 433925 - DNA, 140 bp, Artificial Sequence
  Synthetic
aggccctggctgctgatatgttactttgatcaattttgcgaggaattataaaaatcttgagggacaaattattgtaacgtagagtcgaagaacattaagtgttctttgttagaattattcgaccttttgggacagcggtg

SEQ ID NO: 433926 - DNA, 140 bp, Artificial Sequence
  Synthetic
caccgctgtcccaaaaggtcgaataattctaacaaagaacacttaatgttcttcgactctacgttacaataatttgtccctcaagatttttataattcctcgcaaaattgatcaaagtaacatatcagcagccagggcct

SEQ ID NO: 433927 - DNA, 140 bp, Artificial Sequence
  Synthetic
atacgccatgctgggtctccactttagaggcaataattgacatatctgcatataacgagcgaacagtcaaaggcgttccggcatggctgcctcttgggattatgagcaattttgaatatccgtacttgggagtcggccat

SEQ ID NO: 433928 - DNA, 140 bp, Artificial Sequence
  Synthetic
atggccgactcccaagtacggatattcaaaattgctcataatcccaagaggcagccatgccggaacgcctttgactgttcgctcgttatatgcagatatgtcaattattgcctctaaagtggagacccagcatggcgtat

SEQ ID NO: 433929 - DNA, 140 bp, Artificial Sequence
  Synthetic
atacgccatgctgggtctccatggcaatcaaatctatctgaatattcaaaccactttttaatatcctattacttgttactattgtgtgagacaacataagctatcaaataacaatcacggcgtacttgggagtcggccat

SEQ ID NO: 433930 - DNA, 140 bp, Artificial Sequence
  Synthetic
atggccgactcccaagtacgccgtgattgttatttgatagcttatgttgtctcacacaatagtaacaagtaataggatattaaaaagtggtttgaatattcagatagatttgattgccatggagacccagcatggcgtat

SEQ ID NO: 433931 - DNA, 140 bp, Artificial Sequence
  Synthetic
aggccctggctgctgatatgacttgttactattgtgtgagacaacataagctatcaaataacaatcacgggcaagaactgggcacatgatggtgatttgagagcgctgcctagtgctacagaccttttgggacagcggtg

SEQ ID NO: 433932 - DNA, 140 bp, Artificial Sequence
  Synthetic
caccgctgtcccaaaaggtctgtagcactaggcagcgctctcaaatcaccatcatgtgcccagttcttgcccgtgattgttatttgatagcttatgttgtctcacacaatagtaacaagtcatatcagcagccagggcct

SEQ ID NO: 433933 - DNA, 140 bp, Artificial Sequence
  Synthetic
atacgccatgctgggtctccttattacttaaattggattttatcagaaatacaaagatcgcagaacaaaaattacttaacagagtaatcgggtatatcctattctttccattcggtctgtcgtacttgggagtcggccat

SEQ ID NO: 433934 - DNA, 140 bp, Artificial Sequence
  Synthetic
atggccgactcccaagtacgacagaccgaatggaaagaataggatatacccgattactctgttaagtaatttttgttctgcgatctttgtatttctgataaaatccaatttaagtaataaggagacccagcatggcgtat

SEQ ID NO: 433935 - DNA, 140 bp, Artificial Sequence
  Synthetic
aggccctggctgctgatatgttcaacgactcaaaattgatttctcagaccaggtaggaatttttctgatttgtaaagcaatgtcgcgtcaaagacaagcaattccttactggttaaaacagaccttttgggacagcggtg

SEQ ID NO: 433936 - DNA, 140 bp, Artificial Sequence
  Synthetic
caccgctgtcccaaaaggtctgttttaaccagtaaggaattgcttgtctttgacgcgacattgctttacaaatcagaaaaattcctacctggtctgagaaatcaattttgagtcgttgaacatatcagcagccagggcct

SEQ ID NO: 433937 - DNA, 140 bp, Artificial Sequence
  Synthetic
atacgccatgctgggtctccacagcacggttacctacttatctactttgatccgattcgtcctcagatcacagtaatcaaatttatttgaatattcaaactactctttaggatcccatcacgtacttgggagtcggccat

SEQ ID NO: 433938 - DNA, 140 bp, Artificial Sequence
  Synthetic
atggccgactcccaagtacgtgatgggatcctaaagagtagtttgaatattcaaataaatttgattactgtgatctgaggacgaatcggatcaaagtagataagtaggtaaccgtgctgtggagacccagcatggcgtat

SEQ ID NO: 433939 - DNA, 140 bp, Artificial Sequence
  Synthetic
atacgccatgctgggtctccacgctatagtgagaggtgcgagtttcgtcactgatcttgagaaatacaaccttgccttccgatatgaatttacgcggcatttcatagactactgtaatcgcgtacttgggagtcggccat

SEQ ID NO: 433940 - DNA, 140 bp, Artificial Sequence
  Synthetic
atggccgactcccaagtacgcgattacagtagtctatgaaatgccgcgtaaattcatatcggaaggcaaggttgtatttctcaagatcagtgacgaaactcgcacctctcactatagcgtggagacccagcatggcgtat

SEQ ID NO: 433941 - DNA, 140 bp, Artificial Sequence; identical to SEQ ID NO: 377771
  Synthetic

SEQ ID NO: 433942 - DNA, 140 bp, Artificial Sequence; identical to SEQ ID NO: 377772
  Synthetic

SEQ ID NO: 433943 - DNA, 140 bp, Artificial Sequence
  Synthetic
aggccctggctgctgatatgataacaaagaatatacctaccctgatttatatttactggtataaaatagtggtatcatcttattaaatagttgtcatataacaggctgttcctataatctgaccttttgggacagcggtg

SEQ ID NO: 433944 - DNA, 140 bp, Artificial Sequence
  Synthetic
caccgctgtcccaaaaggtcagattataggaacagcctgttatatgacaactatttaataagatgataccactattttataccagtaaatataaatcagggtaggtatattctttgttatcatatcagcagccagggcct

SEQ ID NO: 433945 - DNA, 140 bp, Artificial Sequence
  Synthetic
atacgccatgctgggtctccattactaacaaaaggggtctacctaacaggtatgactgagtgatcagtatattttataaaccaagcaattgacttctcactttttaagaatcaactaacacgtacttgggagtcggccat

SEQ ID NO: 433946 - DNA, 140 bp, Artificial Sequence
  Synthetic
atggccgactcccaagtacgtgttagttgattcttaaaaagtgagaagtcaattgcttggtttataaaatatactgatcactcagtcatacctgttaggtagaccccttttgttagtaatggagacccagcatggcgtat

SEQ ID NO: 433947 - DNA, 140 bp, Artificial Sequence
  Synthetic
atacgccatgctgggtctccgaaaaaagcataaatcttgaccttaattccacagcacgatggataaaagaacccagtgttgggggctggacagtgaagtggggaaactttgttttccacacgtacttgggagtcggccat

SEQ ID NO: 433948 - DNA, 140 bp, Artificial Sequence
  Synthetic
atggccgactcccaagtacgtgtggaaaacaaagtttccccacttcactgtccagcccccaacactgggttcttttatccatcgtgctgtggaattaaggtcaagatttatgcttttttcggagacccagcatggcgtat

SEQ ID NO: 433949 - DNA, 140 bp, Artificial Sequence
  Synthetic
atacgccatgctgggtctccctcccaagacgctacaactgaacttgataacaccaacacaactgcacaaccgcccacgccctcccacaacaccaccacaatctccaccaacaacacctcccgtacttgggagtcggccat

SEQ ID NO: 433950 - DNA, 140 bp, Artificial Sequence
  Synthetic
atggccgactcccaagtacgggaggtgttgttggtggagattgtggtggtgttgtgggagggcgtgggcggttgtgcagttgtgttggtgttatcaagttcagttgtagcgtcttgggagggagacccagcatggcgtat

SEQ ID NO: 433951 - DNA, 140 bp, Artificial Sequence
  Synthetic
aggccctggctgctgatatgcgaagaatcaaacatgtgctccgtccaaaataccttcaccactgcccacaacccgtccagagaacaaacccacaagcaccccaactgatgccaccgcactgaccttttgggacagcggtg

SEQ ID NO: 433952 - DNA, 140 bp, Artificial Sequence
  Synthetic
caccgctgtcccaaaaggtcagtgcggtggcatcagttggggtgcttgtgggtttgttctctggacgggttgtgggcagtggtgaaggtattttggacggagcacatgtttgattcttcgcatatcagcagccagggcct

SEQ ID NO: 433953 - DNA, 140 bp, Artificial Sequence
  Synthetic
atacgccatgctgggtctccctatccatcatattcaaggtcaaaaccctcatgcacaagggatcgccctccatttgtggggagcatttttcctgtatgatcgcattgcctccacaacaatcgtacttgggagtcggccat

SEQ ID NO: 433954 - DNA, 140 bp, Artificial Sequence
  Synthetic
atggccgactcccaagtacgattgttgtggaggcaatgcgatcatacaggaaaaatgctccccacaaatggagggcgatcccttgtgcatgagggttttgaccttgaatatgatggatagggagacccagcatggcgtat

SEQ ID NO: 433955 - DNA, 140 bp, Artificial Sequence
  Synthetic
atacgccatgctgggtctccacatagaaaacatatttatccttgtgtaattctcggcttagttggaattaacttttgttgcaattcaagacgcttattcatagtagattatatgatttttcgtacttgggagtcggccat

SEQ ID NO: 433956 - DNA, 140 bp, Artificial Sequence
  Synthetic
atggccgactcccaagtacgaaaaatcatataatctactatgaataagcgtcttgaattgcaacaaaagttaattccaactaagccgagaattacacaaggataaatatgttttctatgtggagacccagcatggcgtat

SEQ ID NO: 433957 - DNA, 140 bp, Artificial Sequence
  Synthetic
atacgccatgctgggtctccttacttaatagagtaatcgggtatattctattctttccgttcggtctgtttaaatctgaatcattaagagcataaccttaacaaagagaacttcatttaacgtacttgggagtcggccat

SEQ ID NO: 433958 - DNA, 140 bp, Artificial Sequence
  Synthetic
atggccgactcccaagtacgttaaatgaagttctctttgttaaggttatgctcttaatgattcagatttaaacagaccgaacggaaagaatagaatatacccgattactctattaagtaaggagacccagcatggcgtat

SEQ ID NO: 433959 - DNA, 140 bp, Artificial Sequence
  Synthetic
aggccctggctgctgatatggctttaaatgattgatcaagctgattaacttgtaatatgtaacctcttttgggccatcaaagctataataggtttactagattatataaaagaaatagtagaccttttgggacagcggtg

SEQ ID NO: 433960 - DNA, 140 bp, Artificial Sequence
  Synthetic
caccgctgtcccaaaaggtctactatttcttttatataatctagtaaacctattatagctttgatggcccaaaagaggttacatattacaagttaatcagcttgatcaatcatttaaagccatatcagcagccagggcct

SEQ ID NO: 433961 - DNA, 140 bp, Artificial Sequence
  Synthetic
aggccctggctgctgatatgcttattttatacaagataatcttatatcgctttaggcctcacacaagtgagaaaattacgcgcacagattaactagtgattagtgtttggtcacaccagagaccttttgggacagcggtg

SEQ ID NO: 433962 - DNA, 140 bp, Artificial Sequence
  Synthetic
caccgctgtcccaaaaggtctctggtgtgaccaaacactaatcactagttaatctgtgcgcgtaattttctcacttgtgtgaggcctaaagcgatataagattatcttgtataaaataagcatatcagcagccagggcct

SEQ ID NO: 433963 - DNA, 140 bp, Artificial Sequence
  Synthetic
atacgccatgctgggtctcccctgttgtactgaatgtagtaattaatgattgacttgagtgttgatggaatcaagatagtgcgatgattcatattataaggcacaacttccacttctgttcgtacttgggagtcggccat

SEQ ID NO: 433964 - DNA, 140 bp, Artificial Sequence
  Synthetic
atggccgactcccaagtacgaacagaagtggaagttgtgccttataatatgaatcatcgcactatcttgattccatcaacactcaagtcaatcattaattactacattcagtacaacaggggagacccagcatggcgtat

SEQ ID NO: 433965 - DNA, 140 bp, Artificial Sequence
  Synthetic
atacgccatgctgggtctccggacccaacaaaaccaacgcaactgcacaaccatccatgcccccccacaacaccactgcaatctctactaacaacacctccaagagcaacttcagcaccccgtacttgggagtcggccat

SEQ ID NO: 433966 - DNA, 140 bp, Artificial Sequence
  Synthetic
atggccgactcccaagtacggggtgctgaagttgctcttggaggtgttgttagtagagattgcagtggtgttgtgggggggcatggatggttgtgcagttgcgttggttttgttgggtccggagacccagcatggcgtat

SEQ ID NO: 433967 - DNA, 140 bp, Artificial Sequence
  Synthetic
atacgccatgctgggtctccggaagccaaaacatgctacaatataagtgtaacggatccctctggaaaatccttgctgttagatcctcccaccaacgtccgtgactatcctaaatgcaaacgtacttgggagtcggccat

SEQ ID NO: 433968 - DNA, 140 bp, Artificial Sequence
  Synthetic
atggccgactcccaagtacgtttgcatttaggatagtcacggacgttggtgggaggatctaacagcaaggattttccagagggatccgttacacttatattgtagcatgttttggcttccggagacccagcatggcgtat

SEQ ID NO: 433969 - DNA, 140 bp, Artificial Sequence
  Synthetic
atacgccatgctgggtctcccccagcagaccagccatcaaatcaacatggtataactccgaattatgtgggcgacttgaatctagatgatcagtccaaagggaatgtttgtcacgccttccgtacttgggagtcggccat

SEQ ID NO: 433970 - DNA, 140 bp, Artificial Sequence
  Synthetic
atggccgactcccaagtacggaaggcgtgacaaacattccctttggactgatcatctagattcaagtcgcccacataattcggagttataccatgttgatttgatggctggtctgctgggggagacccagcatggcgtat

SEQ ID NO: 433971 - DNA, 140 bp, Artificial Sequence
  Synthetic
aggccctggctgctgatatgcgccacagcaaggaggaaacaacacaaaccactcccaagacgctgcaactgaacttgacaacaccaatacaactgcacaaccgcccacgccctcccacaagaccttttgggacagcggtg

SEQ ID NO: 433972 - DNA, 140 bp, Artificial Sequence
  Synthetic
caccgctgtcccaaaaggtcttgtgggagggcgtgggcggttgtgcagttgtattggtgttgtcaagttcagttgcagcgtcttgggagtggtttgtgttgtttcctccttgctgtggcgcatatcagcagccagggcct

SEQ ID NO: 433973 - DNA, 140 bp, Artificial Sequence
  Synthetic
aggccctggctgctgatatgttaagaaaaactatgaagaacattaagaagatctttctctcgtagtgttcttttactggaaggagtatcccaatctcagcttgttgaattaattgttactgaccttttgggacagcggtg

SEQ ID NO: 433974 - DNA, 140 bp, Artificial Sequence
  Synthetic
caccgctgtcccaaaaggtcagtaacaattaattcaacaagctgagattgggatactccttccagtaaaagaacactacgagagaaagatcttcttaatgttcttcatagtttttcttaacatatcagcagccagggcct

SEQ ID NO: 433975 - DNA, 140 bp, Artificial Sequence
  Synthetic
atacgccatgctgggtctccgcagaaagcgaacaaaccaatgctcagttgaacacaactctagatccaacagaaaatcccaccacagcacaagacaccaacagcacaaccaacatcatcacgtacttgggagtcggccat

SEQ ID NO: 433976 - DNA, 140 bp, Artificial Sequence
  Synthetic
atggccgactcccaagtacgtgatgatgttggttgtgctgttggtgtcttgtgctgtggtgggattttctgttggatctagagttgtgttcaactgagcattggtttgttcgctttctgcggagacccagcatggcgtat

SEQ ID NO: 433977 - DNA, 140 bp, Artificial Sequence
  Synthetic
atacgccatgctgggtctccttttactggaaggagtatcccaatctcagcttgttgaattaattgttacttaagtcattctttttaaaattaattcacacaaggtagtttaaatttgtatcgtacttgggagtcggccat

SEQ ID NO: 433978 - DNA, 140 bp, Artificial Sequence
  Synthetic
atggccgactcccaagtacgatacaaatttaaactaccttgtgtgaattaattttaaaaagaatgacttaagtaacaattaattcaacaagctgagattgggatactccttccagtaaaaggagacccagcatggcgtat

SEQ ID NO: 433979 - DNA, 140 bp, Artificial Sequence; identical to SEQ ID NO: 377499
  Synthetic

SEQ ID NO: 433980 - DNA, 140 bp, Artificial Sequence; identical to SEQ ID NO: 377500
  Synthetic

SEQ ID NO: 433981 - DNA, 140 bp, Artificial Sequence
  Synthetic
atacgccatgctgggtctccaagaaattaaggaaatactgagatacactagttgaattgaattatgacataccatatatcataaatataaaaaagtgtctgctgtaatctacaagcacctcgtacttgggagtcggccat

SEQ ID NO: 433982 - DNA, 140 bp, Artificial Sequence
  Synthetic
atggccgactcccaagtacgaggtgcttgtagattacagcagacacttttttatatttatgatatatggtatgtcataattcaattcaactagtgtatctcagtatttccttaatttcttggagacccagcatggcgtat

SEQ ID NO: 433983 - DNA, 140 bp, Artificial Sequence
  Synthetic
aggccctggctgctgatatgtaagtcattctttttaaaattaattcacacaaggtagtttaaatttgtatctagaacaaattttaatatggccagttccagcaattacaacacatacatggaccttttgggacagcggtg

SEQ ID NO: 433984 - DNA, 140 bp, Artificial Sequence
  Synthetic
caccgctgtcccaaaaggtccatgtatgtgttgtaattgctggaactggccatattaaaatttgttctagatacaaatttaaactaccttgtgtgaattaattttaaaaagaatgacttacatatcagcagccagggcct

SEQ ID NO: 433985 - DNA, 140 bp, Artificial Sequence
  Synthetic
aggccctggctgctgatatgtaaatctgaatcattaagagcataaccttaacaaagagaacttcatttaattcacaaagataatctatttaaaaatgagggctacattttctaaagtattgaccttttgggacagcggtg

SEQ ID NO: 433986 - DNA, 140 bp, Artificial Sequence
  Synthetic
caccgctgtcccaaaaggtcaatactttagaaaatgtagccctcatttttaaatagattatctttgtgaattaaatgaagttctctttgttaaggttatgctcttaatgattcagatttacatatcagcagccagggcct

SEQ ID NO: 433987 - DNA, 140 bp, Artificial Sequence
  Synthetic
atacgccatgctgggtctcctgtatgagaagtaataaaataaataagaaaacgaaaagactattagacagcttattttatacaagataatcttatatcgctttaggcctcacacaagtgacgtacttgggagtcggccat

SEQ ID NO: 433988 - DNA, 140 bp, Artificial Sequence
  Synthetic
atggccgactcccaagtacgtcacttgtgtgaggcctaaagcgatataagattatcttgtataaaataagctgtctaatagtcttttcgttttcttatttattttattacttctcatacaggagacccagcatggcgtat

SEQ ID NO: 433989 - DNA, 140 bp, Artificial Sequence
  Synthetic
atacgccatgctgggtctcccatcattaacgacttgtcttaattcaatttttcggatgtaaactataagaaaaaatgagccactttccctctactctgaactgaggaaatttcccttatccgtacttgggagtcggccat

SEQ ID NO: 433990 - DNA, 140 bp, Artificial Sequence
  Synthetic
atggccgactcccaagtacggataagggaaatttcctcagttcagagtagagggaaagtggctcattttttcttatagtttacatccgaaaaattgaattaagacaagtcgttaatgatgggagacccagcatggcgtat

SEQ ID NO: 433991 - DNA, 140 bp, Artificial Sequence
  Synthetic
aggccctggctgctgatatgaaaaatgagccactttccctctactctgaactgaggaaatttcccttatcagcttaaaatctgatccgttaagtcatgggcccttaataatctgtttgaggaccttttgggacagcggtg

SEQ ID NO: 433992 - DNA, 140 bp, Artificial Sequence
  Synthetic
caccgctgtcccaaaaggtcctcaaacagattattaagggcccatgacttaacggatcagattttaagctgataagggaaatttcctcagttcagagtagagggaaagtggctcatttttcatatcagcagccagggcct

SEQ ID NO: 433993 - DNA, 140 bp, Artificial Sequence
  Synthetic
atacgccatgctgggtctcctatagaaaagaattatcctgcttcattacataagtttttcctaactttgggtttcccttctttagagtcatctttctgccatcgttatactattccattccgtacttgggagtcggccat

SEQ ID NO: 433994 - DNA, 140 bp, Artificial Sequence
  Synthetic
atggccgactcccaagtacggaatggaatagtataacgatggcagaaagatgactctaaagaagggaaacccaaagttaggaaaaacttatgtaatgaagcaggataattcttttctataggagacccagcatggcgtat

SEQ ID NO: 433995 - DNA, 140 bp, Artificial Sequence
  Synthetic
atacgccatgctgggtctcccttttaaatacattaggaaaagaattaagttaccgttgagatcaaaaaaaccacgtcatgttttctctgatgacaagtgataaaacttcgtagttaaattcgtacttgggagtcggccat

SEQ ID NO: 433996 - DNA, 140 bp, Artificial Sequence
  Synthetic
atggccgactcccaagtacgaatttaactacgaagttttatcacttgtcatcagagaaaacatgacgtggtttttttgatctcaacggtaacttaattcttttcctaatgtatttaaaagggagacccagcatggcgtat

SEQ ID NO: 433997 - DNA, 140 bp, Artificial Sequence
  Synthetic
atacgccatgctgggtctccacggaacaaattcagacatggccagttccagcaatcacaatacgtatatgcaatacctgaaccctcccccccacgccgaccacggcgcaaatcagtcaatcgtacttgggagtcggccat

SEQ ID NO: 433998 - DNA, 140 bp, Artificial Sequence
  Synthetic
atggccgactcccaagtacgattgactgatttgcgccgtggtcggcgtgggggggagggttcaggtattgcatatacgtattgtgattgctggaactggccatgtctgaatttgttccgtggagacccagcatggcgtat

SEQ ID NO: 433999 - DNA, 140 bp, Artificial Sequence
  Synthetic
atacgccatgctgggtctccgcaattgcactgggcgttgcaacagcacatggcagtacattggctggtgttaacgttggcgaacaataccaacaactgcgagaagcagcacatgatgcagcgtacttgggagtcggccat

SEQ ID NO: 434000 - DNA, 140 bp, Artificial Sequence
  Synthetic
atggccgactcccaagtacgctgcatcatgtgctgcttctcgcagttgttggtattgttcgccaacgttaacaccagccaatgtactgccatgtgctgttgcaacgcccagtgcaattgcggagacccagcatggcgtat

SEQ ID NO: 434001 - DNA, 140 bp, Artificial Sequence
  Synthetic
atacgccatgctgggtctccggagtaaacttggtgacaggtcatgatgcccacgacagcatcatcagtaattcagtaggacaaactagattctcagggcttcttattgtgaaaacagttccgtacttgggagtcggccat

SEQ ID NO: 434002 - DNA, 140 bp, Artificial Sequence
  Synthetic
atggccgactcccaagtacggaactgttttcacaataagaagccctgagaatctagtttgtcctactgaattactgatgatgctgtcgtgggcatcatgacctgtcaccaagtttactccggagacccagcatggcgtat

SEQ ID NO: 434003 - DNA, 140 bp, Artificial Sequence
  Synthetic
atacgccatgctgggtctcctccaatagatcaagtgttcggcactaatcccttagaaaagttacataagagaagaaagccgaaagggacagcgggaccacaacgcagtccttgcttaatacgtacttgggagtcggccat

SEQ ID NO: 434004 - DNA, 140 bp, Artificial Sequence
  Synthetic
atggccgactcccaagtacgtattaagcaaggactgcgttgtggtcccgctgtccctttcggctttcttctcttatgtaacttttctaagggattagtgccgaacacttgatctattggaggagacccagcatggcgtat

SEQ ID NO: 434005 - DNA, 140 bp, Artificial Sequence
  Synthetic
atacgccatgctgggtctccagagggaaaaattggtcgcaactcgttgagtcccttcctaatatgcactcagtatgcataacacatgttgacaacgaatgtactggctgtgagagacggtcgtacttgggagtcggccat

SEQ ID NO: 434006 - DNA, 140 bp, Artificial Sequence
  Synthetic
atggccgactcccaagtacgaccgtctctcacagccagtacattcgttgtcaacatgtgttatgcatactgagtgcatattaggaagggactcaacgagttgcgaccaatttttccctctggagacccagcatggcgtat

SEQ ID NO: 434007 - DNA, 140 bp, Artificial Sequence
  Synthetic
atacgccatgctgggtctccgatgtgaatgtaaattaagaaaaaccaatatataaaattaaaaaattaaaaagctttgatataagtaacacaaaacattcttcatcttttttgtgtgtcccgtacttgggagtcggccat

SEQ ID NO: 434008 - DNA, 140 bp, Artificial Sequence
  Synthetic
atggccgactcccaagtacgggacacacaaaaaagatgaagaatgttttgtgttacttatatcaaagctttttaattttttaattttatatattggtttttcttaatttacattcacatcggagacccagcatggcgtat

SEQ ID NO: 434009 - DNA, 140 bp, Artificial Sequence
  Synthetic
atacgccatgctgggtctccttatagattgatctttagtgtactccatacgcacaatacagagaaattaatattaccaacaaaaagggttttccaaacggatttgatcaatagatcagtacgtacttgggagtcggccat

SEQ ID NO: 434010 - DNA, 140 bp, Artificial Sequence
  Synthetic
atggccgactcccaagtacgtactgatctattgatcaaatccgtttggaaaaccctttttgttggtaatattaatttctctgtattgtgcgtatggagtacactaaagatcaatctataaggagacccagcatggcgtat

SEQ ID NO: 434011 - DNA, 140 bp, Artificial Sequence
  Synthetic
atacgccatgctgggtctccagcgtcatcttattaaataattgtcatacaataggctgttcctataatctgattgtgagagtataaacttgtagaattaccgtgagtcacaactgttgcacgtacttgggagtcggccat

SEQ ID NO: 434012 - DNA, 140 bp, Artificial Sequence
  Synthetic
atggccgactcccaagtacgtgcaacagttgtgactcacggtaattctacaagtttatactctcacaatcagattataggaacagcctattgtatgacaattatttaataagatgacgctggagacccagcatggcgtat

SEQ ID NO: 434013 - DNA, 140 bp, Artificial Sequence
  Synthetic
atacgccatgctgggtctccacggaacaaattcagatatggccagttccagcaatcacaatacgtatatgcaatacctgaaccctcccccccatgccgaccatggtgcaaatcagttaatcgtacttgggagtcggccat

SEQ ID NO: 434014 - DNA, 140 bp, Artificial Sequence
  Synthetic
atggccgactcccaagtacgattaactgatttgcaccatggtcggcatgggggggagggttcaggtattgcatatacgtattgtgattgctggaactggccatatctgaatttgttccgtggagacccagcatggcgtat

SEQ ID NO: 434015 - DNA, 140 bp, Artificial Sequence
  Synthetic
atacgccatgctgggtctcctgtacttattaaattttacataggattatataattctcttcgatacacatcatatctttagcaaagtaacgaaaacaactttatcatgttagacgccagtcgtacttgggagtcggccat

SEQ ID NO: 434016 - DNA, 140 bp, Artificial Sequence
  Synthetic
atggccgactcccaagtacgactggcgtctaacatgataaagttgttttcgttactttgctaaagatatgatgtgtatcgaagagaattatataatcctatgtaaaatttaataagtacaggagacccagcatggcgtat

SEQ ID NO: 434017 - DNA, 140 bp, Artificial Sequence
  Synthetic
atacgccatgctgggtctcctacaatcttgctaatctagtattgagcgtgcaaaagcttcctgatgatgcttggcgcccgtccaaaaacaaattaatcggaagcgccatgcaccctgcggcgtacttgggagtcggccat

SEQ ID NO: 434018 - DNA, 140 bp, Artificial Sequence
  Synthetic
atggccgactcccaagtacgccgcagggtgcatggcgcttccgattaatttgtttttggacgggcgccaagcatcatcaggaagcttttgcacgctcaatactagattagcaagattgtaggagacccagcatggcgtat

SEQ ID NO: 434019 - DNA, 140 bp, Artificial Sequence
  Synthetic
atacgccatgctgggtctccattccagtagtgcgtctcttcatgtcacttctccgaacccaagaccacaacaaacaccggttaaagaggtcagctggtcaatcctccacccccatattaacgtacttgggagtcggccat

SEQ ID NO: 434020 - DNA, 140 bp, Artificial Sequence
  Synthetic
atggccgactcccaagtacgttaatatgggggtggaggattgaccagctgacctctttaaccggtgtttgttgtggtcttgggttcggagaagtgacatgaagagacgcactactggaatggagacccagcatggcgtat

SEQ ID NO: 434021 - DNA, 140 bp, Artificial Sequence
  Synthetic
atacgccatgctgggtctccagatatactgctcagaaactcctagcttgcaacccaatcccggaaaaacaaacctcctcccttgatcacaaccacctccatcaatgtctcgaacacccaacgtacttgggagtcggccat

SEQ ID NO: 434022 - DNA, 140 bp, Artificial Sequence
  Synthetic
atggccgactcccaagtacgttgggtgttcgagacattgatggaggtggttgtgatcaagggaggaggtttgtttttccgggattgggttgcaagctaggagtttctgagcagtatatctggagacccagcatggcgtat

SEQ ID NO: 434023 - DNA, 140 bp, Artificial Sequence
  Synthetic
atacgccatgctgggtctccgcattccctagtaacatgatggttgtcactgagagggaacagaaagaagctttattacatcaggcttcttggcaccacaattcagcaagcataggggaaacgtacttgggagtcggccat

SEQ ID NO: 434024 - DNA, 140 bp, Artificial Sequence
  Synthetic
atggccgactcccaagtacgtttcccctatgcttgctgaattgtggtgccaagaagcctgatgtaataaagcttctttctgttccctctcagtgacaaccatcatgttactagggaatgcggagacccagcatggcgtat

SEQ ID NO: 434025 - DNA, 140 bp, Artificial Sequence
  Synthetic
atacgccatgctgggtctccagacgtgctgttcaaagagtcttaatttataaccaactattgcaagaattaatttactttttccgttatacttagttacattaatcttttgactgttcagcgtacttgggagtcggccat

SEQ ID NO: 434026 - DNA, 140 bp, Artificial Sequence
  Synthetic
atggccgactcccaagtacgctgaacagtcaaaagattaatgtaactaagtataacggaaaaagtaaattaattcttgcaatagttggttataaattaagactctttgaacagcacgtctggagacccagcatggcgtat

SEQ ID NO: 434027 - DNA, 140 bp, Artificial Sequence
  Synthetic
aggccctggctgctgatatggagttgctgtcgaattagctattactacgggttatagtggtatatttttaaagcctgaagaaacatttgtccattcagggttcatttattttggtaaaaagaccttttgggacagcggtg

SEQ ID NO: 434028 - DNA, 140 bp, Artificial Sequence
  Synthetic
caccgctgtcccaaaaggtctttttaccaaaataaatgaaccctgaatggacaaatgtttcttcaggctttaaaaatataccactataacccgtagtaatagctaattcgacagcaactccatatcagcagccagggcct

SEQ ID NO: 434029 - DNA, 140 bp, Artificial Sequence
  Synthetic
atacgccatgctgggtctccgggttcaaacaatcgcagaatcaggtgtcacagtctttcttaaatgatcccacacctgtagaagtgacagtccaagccaggtctataaatcgaccaacagcgtacttgggagtcggccat

SEQ ID NO: 434030 - DNA, 140 bp, Artificial Sequence
  Synthetic
atggccgactcccaagtacgctgttggtcgatttatagacctggcttggactgtcacttctacaggtgtgggatcatttaagaaagactgtgacacctgattctgcgattgtttgaacccggagacccagcatggcgtat

SEQ ID NO: 434031 - DNA, 140 bp, Artificial Sequence
  Synthetic
atacgccatgctgggtctccctatatccaagtgtctaattaacaacttgtacctctaaggaaaaccatgaagaacattaagaaaaaggatgttctgattcttcaactgaacttgtatatccgtacttgggagtcggccat

SEQ ID NO: 434032 - DNA, 140 bp, Artificial Sequence
  Synthetic
atggccgactcccaagtacggatatacaagttcagttgaagaatcagaacatcctttttcttaatgttcttcatggttttccttagaggtacaagttgttaattagacacttggatatagggagacccagcatggcgtat

SEQ ID NO: 434033 - DNA, 140 bp, Artificial Sequence
  Synthetic
atacgccatgctgggtctcctgcttggacctgattgttgcatcggaatagaagacttgtccaagaatatttcagagcaaattgaccaaatcaaaaaagatgaacaaaaagaggggactggcgtacttgggagtcggccat

SEQ ID NO: 434034 - DNA, 140 bp, Artificial Sequence
  Synthetic
atggccgactcccaagtacgccagtcccctctttttgttcatcttttttgatttggtcaatttgctctgaaatattcttggacaagtcttctattccgatgcaacaatcaggtccaagcaggagacccagcatggcgtat

SEQ ID NO: 434035 - DNA, 140 bp, Artificial Sequence
  Synthetic
atacgccatgctgggtctcctattaaatcagaatcaccttgggtttcccttagggttcaatattgatatttcttgtttcaaaaagcctcttaccttctcggaaaaattaattgctctcatcgtacttgggagtcggccat

SEQ ID NO: 434036 - DNA, 140 bp, Artificial Sequence
  Synthetic
atggccgactcccaagtacgatgagagcaattaatttttccgagaaggtaagaggctttttgaaacaagaaatatcaatattgaaccctaagggaaacccaaggtgattctgatttaataggagacccagcatggcgtat

SEQ ID NO: 434037 - DNA, 140 bp, Artificial Sequence
  Synthetic
atacgccatgctgggtctcccacagcacggttactcacttatctattttgatatgactcatcctcagatcacagcaatcaaatttatttgaatatttgaaccaccttttagtatcctattcgtacttgggagtcggccat

SEQ ID NO: 434038 - DNA, 140 bp, Artificial Sequence
  Synthetic
atggccgactcccaagtacgaataggatactaaaaggtggttcaaatattcaaataaatttgattgctgtgatctgaggatgagtcatatcaaaatagataagtgagtaaccgtgctgtgggagacccagcatggcgtat

SEQ ID NO: 434039 - DNA, 140 bp, Artificial Sequence
  Synthetic
atacgccatgctgggtctcctgccgcaatactgtaattaacactgctgtatctcttcctcaagccatctgatttaactcaataaacatgacttgattcagagaatatgctgaaaatgttacgtacttgggagtcggccat

SEQ ID NO: 434040 - DNA, 140 bp, Artificial Sequence
  Synthetic
atggccgactcccaagtacgtaacattttcagcatattctctgaatcaagtcatgtttattgagttaaatcagatggcttgaggaagagatacagcagtgttaattacagtattgcggcaggagacccagcatggcgtat

SEQ ID NO: 434041 - DNA, 140 bp, Artificial Sequence
  Synthetic
aggccctggctgctgatatgtgtatgttgattgcagtaatattccttctatctctctagacccgggttttcggaatatgtctgatcaaaatcaaattcaaatgttaatcaatgcttacaagaccttttgggacagcggtg

SEQ ID NO: 434042 - DNA, 140 bp, Artificial Sequence
  Synthetic
caccgctgtcccaaaaggtcttgtaagcattgattaacatttgaatttgattttgatcagacatattccgaaaacccgggtctagagagatagaaggaatattactgcaatcaacatacacatatcagcagccagggcct

SEQ ID NO: 434043 - DNA, 140 bp, Artificial Sequence
  Synthetic
aggccctggctgctgatatgtcaggaatgaccttttttatttgttacattaacgttttaaactacctcttaagcctttgtagttggtctcaatatgcgcgcaggggttaatttaaagagagaccttttgggacagcggtg

SEQ ID NO: 434044 - DNA, 140 bp, Artificial Sequence
  Synthetic
caccgctgtcccaaaaggtctctctttaaattaacccctgcgcgcatattgagaccaactacaaaggcttaagaggtagtttaaaacgttaatgtaacaaataaaaaaggtcattcctgacatatcagcagccagggcct

SEQ ID NO: 434045 - DNA, 140 bp, Artificial Sequence
  Synthetic
aggccctggctgctgatatgaatcagtgtgcaagcctcatacgaccattttattcttcctcaaagtcaaggcaaaggacagtgattattgatcgaaggctgacaatcagatcaccttcaggaccttttgggacagcggtg

SEQ ID NO: 434046 - DNA, 140 bp, Artificial Sequence
  Synthetic
caccgctgtcccaaaaggtcctgaaggtgatctgattgtcagccttcgatcaataatcactgtcctttgccttgactttgaggaagaataaaatggtcgtatgaggcttgcacactgattcatatcagcagccagggcct

SEQ ID NO: 434047 - DNA, 140 bp, Artificial Sequence
  Synthetic
atacgccatgctgggtctcctttaacttaataaacatgacttgattcagagagtgtgctgaaaatgttattgattgagcttctcaaatggtgcactatcctactgttttgctcagcctagcgtacttgggagtcggccat

SEQ ID NO: 434048 - DNA, 140 bp, Artificial Sequence
  Synthetic
atggccgactcccaagtacgctaggctgagcaaaacagtaggatagtgcaccatttgagaagctcaatcaataacattttcagcacactctctgaatcaagtcatgtttattaagttaaaggagacccagcatggcgtat

SEQ ID NO: 434049 - DNA, 140 bp, Artificial Sequence
  Synthetic
atacgccatgctgggtctccgaattgagaaaggcgatttgcttggccgaaggggaaggaagtggtgctcggttactcctgaaatggaaagaaacggatcatttattcttcaacactctggcgtacttgggagtcggccat

SEQ ID NO: 434050 - DNA, 140 bp, Artificial Sequence
  Synthetic
atggccgactcccaagtacgccagagtgttgaagaataaatgatccgtttctttccatttcaggagtaaccgagcaccacttccttccccttcggccaagcaaatcgcctttctcaattcggagacccagcatggcgtat

SEQ ID NO: 434051 - DNA, 140 bp, Artificial Sequence
  Synthetic
aggccctggctgctgatatgcttgatgatgcagctctgtttcacctttctgttgatttcaatgttacagctatatctaagtgtctaattaacaacttgtacctctaaggaaaatcatgaagaccttttgggacagcggtg

SEQ ID NO: 434052 - DNA, 140 bp, Artificial Sequence
  Synthetic
caccgctgtcccaaaaggtcttcatgattttccttagaggtacaagttgttaattagacacttagatatagctgtaacattgaaatcaacagaaaggtgaaacagagctgcatcatcaagcatatcagcagccagggcct

SEQ ID NO: 434053 - DNA, 140 bp, Artificial Sequence
  Synthetic
atacgccatgctgggtctccctacggattcacaacaagaagcagagattttgagcggccgggtaataccaagaatgttgtataatatagacagattaagtgctttacttgaatcaagaagcgtacttgggagtcggccat

SEQ ID NO: 434054 - DNA, 140 bp, Artificial Sequence
  Synthetic
atggccgactcccaagtacgcttcttgattcaagtaaagcacttaatctgtctatattatacaacattcttggtattacccggccgctcaaaatctctgcttcttgttgtgaatccgtagggagacccagcatggcgtat

SEQ ID NO: 434055 - DNA, 140 bp, Artificial Sequence
  Synthetic
atacgccatgctgggtctccaagcttttgtggatggtttcaatgtgtgcgtagaggttaatttaaaaagatttcttgttgcacagttttttgtattgcttacttgggcttgaagacatagcgtacttgggagtcggccat

SEQ ID NO: 434056 - DNA, 140 bp, Artificial Sequence
  Synthetic
atggccgactcccaagtacgctatgtcttcaagcccaagtaagcaatacaaaaaactgtgcaacaagaaatctttttaaattaacctctacgcacacattgaaaccatccacaaaagcttggagacccagcatggcgtat

SEQ ID NO: 434057 - DNA, 140 bp, Artificial Sequence; identical to SEQ ID NO: 377451
  Synthetic

SEQ ID NO: 434058 - DNA, 140 bp, Artificial Sequence; identical to SEQ ID NO: 377452
  Synthetic

SEQ ID NO: 434059 - DNA, 140 bp, Artificial Sequence
  Synthetic
aggccctggctgctgatatgtttcttgttgcacagttttttgtattgcttacttgggcttgaagacatagttaaaactggccgaaaatgctctccaatcaactccattccccctcagaaggaccttttgggacagcggtg

SEQ ID NO: 434060 - DNA, 140 bp, Artificial Sequence
  Synthetic
caccgctgtcccaaaaggtccttctgagggggaatggagttgattggagagcattttcggccagttttaactatgtcttcaagcccaagtaagcaatacaaaaaactgtgcaacaagaaacatatcagcagccagggcct

SEQ ID NO: 434061 - DNA, 140 bp, Artificial Sequence
  Synthetic
atacgccatgctgggtctccattcacaaaaacaatctatttaaaagggagggtgacattttctagggtgttgtatgagaaataataaagtaaacaagaaaaagagaaaaatattagacagcgtacttgggagtcggccat

SEQ ID NO: 434062 - DNA, 140 bp, Artificial Sequence
  Synthetic
atggccgactcccaagtacgctgtctaatatttttctctttttcttgtttactttattatttctcatacaacaccctagaaaatgtcaccctcccttttaaatagattgtttttgtgaatggagacccagcatggcgtat

SEQ ID NO: 434063 - DNA, 140 bp, Artificial Sequence
  Synthetic
atacgccatgctgggtctcccaaagattgcttacaagtcagggaaatccggagcgtttttggatgcatttcaccagattctaagtgaaggagagaatgctcaggcggcactaactcgactcgtacttgggagtcggccat

SEQ ID NO: 434064 - DNA, 140 bp, Artificial Sequence
  Synthetic
atggccgactcccaagtacgagtcgagttagtgccgcctgagcattctctccttcacttagaatctggtgaaatgcatccaaaaacgctccggatttccctgacttgtaagcaatctttgggagacccagcatggcgtat

SEQ ID NO: 434065 - DNA, 140 bp, Artificial Sequence
  Synthetic
atacgccatgctgggtctcctgtcatttgacgaaaggagacatgttgctatgaacttgtagtccagataacacagtacggttacccacttatccactctgatacgaattatccccagatccgtacttgggagtcggccat

SEQ ID NO: 434066 - DNA, 140 bp, Artificial Sequence
  Synthetic
atggccgactcccaagtacggatctggggataattcgtatcagagtggataagtgggtaaccgtactgtgttatctggactacaagttcatagcaacatgtctcctttcgtcaaatgacaggagacccagcatggcgtat

SEQ ID NO: 434067 - DNA, 140 bp, Artificial Sequence
  Synthetic
atacgccatgctgggtctccctgtttgaatttctcaagtggtgcactatcctactgttttgctcagcttagtatattgtaatatgtaagtggactctccccttctcctctcgtgtattctcgtacttgggagtcggccat

SEQ ID NO: 434068 - DNA, 140 bp, Artificial Sequence
  Synthetic
atggccgactcccaagtacgagaatacacgagaggagaaggggagagtccacttacatattacaatatactaagctgagcaaaacagtaggatagtgcaccacttgagaaattcaaacagggagacccagcatggcgtat

SEQ ID NO: 434069 - DNA, 140 bp, Artificial Sequence
  Synthetic
atacgccatgctgggtctcctgaggagcaattcttctgatccaatgcattgaagtcactaattacttctaaaatccttatctttaatccgaatattcacatagaaatcaattttgggaaacgtacttgggagtcggccat

SEQ ID NO: 434070 - DNA, 140 bp, Artificial Sequence
  Synthetic
atggccgactcccaagtacgtttcccaaaattgatttctatgtgaatattcggattaaagataaggattttagaagtaattagtgacttcaatgcattggatcagaagaattgctcctcaggagacccagcatggcgtat

SEQ ID NO: 434071 - DNA, 140 bp, Artificial Sequence
  Synthetic
aggccctggctgctgatatgcgtcacataccctaatcactggcttactacaggccatatgaaagtaatttttgggattttgaggtctagctttattttaaaatttgtgttaattcatcaagaccttttgggacagcggtg

SEQ ID NO: 434072 - DNA, 140 bp, Artificial Sequence
  Synthetic
caccgctgtcccaaaaggtcttgatgaattaacacaaattttaaaataaagctagacctcaaaatcccaaaaattactttcatatggcctgtagtaagccagtgattagggtatgtgacgcatatcagcagccagggcct

SEQ ID NO: 434073 - DNA, 140 bp, Artificial Sequence
  Synthetic
aggccctggctgctgatatgggagtaaatttggtgacaggtcatgatgcctatgacagtatcattagtaattcagtaggtcaaactagattctcaggacttcttattgtgaaaacagttcgaccttttgggacagcggtg

SEQ ID NO: 434074 - DNA, 140 bp, Artificial Sequence
  Synthetic
caccgctgtcccaaaaggtcgaactgttttcacaataagaagtcctgagaatctagtttgacctactgaattactaatgatactgtcataggcatcatgacctgtcaccaaatttactcccatatcagcagccagggcct

SEQ ID NO: 434075 - DNA, 140 bp, Artificial Sequence
  Synthetic
aggccctggctgctgatatgatggctagattctgtaatacaatacttacctgaagatagcgacattcttacaatggacgcagagaccactaaagatgaaacaagggaacagctttataaggaccttttgggacagcggtg

SEQ ID NO: 434076 - DNA, 140 bp, Artificial Sequence
  Synthetic
caccgctgtcccaaaaggtccttataaagctgttcccttgtttcatctttagtggtctctgcgtccattgtaagaatgtcgctatcttcaggtaagtattgtattacagaatctagccatcatatcagcagccagggcct

SEQ ID NO: 434077 - DNA, 140 bp, Artificial Sequence; identical to SEQ ID NO: 377455
  Synthetic

SEQ ID NO: 434078 - DNA, 140 bp, Artificial Sequence; identical to SEQ ID NO: 377456
  Synthetic

SEQ ID NO: 434079 - DNA, 140 bp, Artificial Sequence
  Synthetic
atacgccatgctgggtctccttttctttgaacattcttgcgaggaattataaaaatctcgaaggacgaactattgtaaaacagagtcgaagaacattaagtgttctttgttgaaactattcgtacttgggagtcggccat

SEQ ID NO: 434080 - DNA, 140 bp, Artificial Sequence
  Synthetic
atggccgactcccaagtacgaatagtttcaacaaagaacacttaatgttcttcgactctgttttacaatagttcgtccttcgagatttttataattcctcgcaagaatgttcaaagaaaaggagacccagcatggcgtat

SEQ ID NO: 434081 - DNA, 140 bp, Artificial Sequence
  Synthetic
aggccctggctgctgatatgaagcctgaagaaacatttgtccattcagggttcatttattttggtaaaaagcaatacctcaacggtgttcaactgccacaatcattgaaaacaatggcaagaccttttgggacagcggtg

SEQ ID NO: 434082 - DNA, 140 bp, Artificial Sequence
  Synthetic
caccgctgtcccaaaaggtcttgccattgttttcaatgattgtggcagttgaacaccgttgaggtattgctttttaccaaaataaatgaaccctgaatggacaaatgtttcttcaggcttcatatcagcagccagggcct

SEQ ID NO: 434083 - DNA, 140 bp, Artificial Sequence
  Synthetic
aggccctggctgctgatatggaatgaggacgaagacactcttgacgacagtgtcatgattccgagtacaacatcgagagaatttcaaaggattccagaaccaccaagacaatctcaggacgaccttttgggacagcggtg

SEQ ID NO: 434084 - DNA, 140 bp, Artificial Sequence
  Synthetic
caccgctgtcccaaaaggtcgtcctgagattgtcttggtggttctggaatcctttgaaattctctcgatgttgtactcggaatcatgacactgtcgtcaagagtgtcttcgtcctcattccatatcagcagccagggcct

SEQ ID NO: 434085 - DNA, 140 bp, Artificial Sequence
  Synthetic
aggccctggctgctgatatgttcaacaacagccaaggaaagcaggaagatgaatctacaaatccgattaagaaacagtttctgagatatcaagaactgcctccggttcaagaggatgatggaccttttgggacagcggtg

SEQ ID NO: 434086 - DNA, 140 bp, Artificial Sequence
  Synthetic
caccgctgtcccaaaaggtccatcatcctcttgaaccggaggcagttcttgatatctcagaaactgtttcttaatcggatttgtagattcatcttcctgctttccttggctgttgttgaacatatcagcagccagggcct

SEQ ID NO: 434087 - DNA, 140 bp, Artificial Sequence
  Synthetic
atacgccatgctgggtctcccacaagattagtttgtattgatttcaataatgctttaaccttacattgctgctttaaatggttaattaagctgatcagcttgcaagatgtaatctcttttcgtacttgggagtcggccat

SEQ ID NO: 434088 - DNA, 140 bp, Artificial Sequence
  Synthetic
atggccgactcccaagtacgaaaagagattacatcttgcaagctgatcagcttaattaaccatttaaagcagcaatgtaaggttaaagcattattgaaatcaatacaaactaatcttgtgggagacccagcatggcgtat

SEQ ID NO: 434089 - DNA, 140 bp, Artificial Sequence
  Synthetic
aggccctggctgctgatatgaaaaagacaagacccaatacagcacccagcagtaagctctcaggatccctttggcagtattggtgatgtaaatggtgatatcttagaacccataagatcagaccttttgggacagcggtg

SEQ ID NO: 434090 - DNA, 140 bp, Artificial Sequence
  Synthetic
caccgctgtcccaaaaggtctgatcttatgggttctaagatatcaccatttacatcaccaatactgccaaagggatcctgagagcttactgctgggtgctgtattgggtcttgtctttttcatatcagcagccagggcct

SEQ ID NO: 434091 - DNA, 140 bp, Artificial Sequence
  Synthetic
aggccctggctgctgatatggaagataaccgaaataacccacctgattgtgctaatgcttatcattatcacttaggaggtatagagggacttcaacagaaattgtggacatgtatatcatgaccttttgggacagcggtg

SEQ ID NO: 434092 - DNA, 140 bp, Artificial Sequence
  Synthetic
caccgctgtcccaaaaggtcatgatatacatgtccacaatttctgttgaagtccctctatacctcctaagtgataatgataagcattagcacaatcaggtgggttatttcggttatcttccatatcagcagccagggcct

SEQ ID NO: 434093 - DNA, 140 bp, Artificial Sequence
  Synthetic
aggccctggctgctgatatgttgattcaagatttaaaatgcaacaaccccgtggaagaagtcgaactcgcaaccaccaagctacatcatctatatatcatgaaactcagttgccctccaagaccttttgggacagcggtg

SEQ ID NO: 434094 - DNA, 140 bp, Artificial Sequence
  Synthetic
caccgctgtcccaaaaggtcttggagggcaactgagtttcatgatatatagatgatgtagcttggtggttgcgagttcgacttcttccacggggttgttgcattttaaatcttgaatcaacatatcagcagccagggcct

SEQ ID NO: 434095 - DNA, 140 bp, Artificial Sequence
  Synthetic
atacgccatgctgggtctcctcttctttctttttgcaaacatattgaaataataattttcacaatgtgggactcttcatatatgcaacaagtcagcgagggattgatgactggaaaagttcgtacttgggagtcggccat

SEQ ID NO: 434096 - DNA, 140 bp, Artificial Sequence
  Synthetic
atggccgactcccaagtacgaacttttccagtcatcaatccctcgctgacttgttgcatatatgaagagtcccacattgtgaaaattattatttcaatatgtttgcaaaaagaaagaagaggagacccagcatggcgtat

SEQ ID NO: 434097 - DNA, 140 bp, Artificial Sequence
  Synthetic
aggccctggctgctgatatgccaagcatggcagaactatcaacgcgttacaacttgcctgtgaatgttacagaaaagagcataaatcttgacctcaattccacagcacgatggataaaaggaccttttgggacagcggtg

SEQ ID NO: 434098 - DNA, 140 bp, Artificial Sequence
  Synthetic
caccgctgtcccaaaaggtccttttatccatcgtgctgtggaattgaggtcaagatttatgctcttttctgtaacattcacaggcaagttgtaacgcgttgatagttctgccatgcttggcatatcagcagccagggcct

SEQ ID NO: 434099 - DNA, 140 bp, Artificial Sequence
  Synthetic
atacgccatgctgggtctccatcggaatacacaaccgactctcaggagagtatcgaccaaccaggatctgacaatgaacaaggagttgatcttccacctcctccattgtacgctcaggaacgtacttgggagtcggccat

SEQ ID NO: 434100 - DNA, 140 bp, Artificial Sequence
  Synthetic
atggccgactcccaagtacgttcctgagcgtacaatggaggaggtggaagatcaactccttgttcattgtcagatcctggttggtcgatactctcctgagagtcggttgtgtattccgatggagacccagcatggcgtat

SEQ ID NO: 434101 - DNA, 140 bp, Artificial Sequence
  Synthetic
aggccctggctgctgatatgtaccaaaatcctgtctcagctaaggagctccaagcagattggcccgacatgtcatttgatgaaaggagacatgttgctatgaacttgtagtccagataacgaccttttgggacagcggtg

SEQ ID NO: 434102 - DNA, 140 bp, Artificial Sequence
  Synthetic
caccgctgtcccaaaaggtcgttatctggactacaagttcatagcaacatgtctcctttcatcaaatgacatgtcgggccaatctgcttggagctccttagctgagacaggattttggtacatatcagcagccagggcct

SEQ ID NO: 434103 - DNA, 140 bp, Artificial Sequence
  Synthetic
aggccctggctgctgatatgatttaacttaatgaacatgacttgattcagagagtgtgctgaaaatgttactgattgagcttctcaaatggtgcactatcctactgttttactcagcctagaccttttgggacagcggtg

SEQ ID NO: 434104 - DNA, 140 bp, Artificial Sequence
  Synthetic
caccgctgtcccaaaaggtctaggctgagtaaaacagtaggatagtgcaccatttgagaagctcaatcagtaacattttcagcacactctctgaatcaagtcatgttcattaagttaaatcatatcagcagccagggcct

SEQ ID NO: 434105 - DNA, 140 bp, Artificial Sequence
  Synthetic
aggccctggctgctgatatggccgcaatactgtaatcaacactgctgtatctctccctcaagccatctgatttaacttaataaacatgacttgattcagagagtgtgccgaaaatgttatgaccttttgggacagcggtg

SEQ ID NO: 434106 - DNA, 140 bp, Artificial Sequence
  Synthetic
caccgctgtcccaaaaggtcataacattttcggcacactctctgaatcaagtcatgtttattaagttaaatcagatggcttgagggagagatacagcagtgttgattacagtattgcggccatatcagcagccagggcct

SEQ ID NO: 434107 - DNA, 140 bp, Artificial Sequence
  Synthetic
aggccctggctgctgatatggtatattgtaacatataagtggactctccacttctcttctcgagtattccctataagtgatttacttgatagaatgtcaagtccactggtttggagtttcgaccttttgggacagcggtg

SEQ ID NO: 434108 - DNA, 140 bp, Artificial Sequence
  Synthetic
caccgctgtcccaaaaggtcgaaactccaaaccagtggacttgacattctatcaagtaaatcacttatagggaatactcgagaagagaagtggagagtccacttatatgttacaatataccatatcagcagccagggcct

SEQ ID NO: 434109 - DNA, 140 bp, Artificial Sequence
  Synthetic
aggccctggctgctgatatgcgtgaaggaaatcaagcttttattcagaacatggtgatccccaggaatttttccaccaatcaattcacctacaatcttactaacttagtattgagtgtgcgaccttttgggacagcggtg

SEQ ID NO: 434110 - DNA, 140 bp, Artificial Sequence
  Synthetic
caccgctgtcccaaaaggtcgcacactcaatactaagttagtaagattgtaggtgaattgattggtggaaaaattcctggggatcaccatgttctgaataaaagcttgatttccttcacgcatatcagcagccagggcct

SEQ ID NO: 434111 - DNA, 140 bp, Artificial Sequence
  Synthetic
aggccctggctgctgatatgcttactctaatgattgtaataattaactgttggcttagatgataacagatatgaggttatataattactcatagtgtaaagtataattcttgcctctattgaccttttgggacagcggtg

SEQ ID NO: 434112 - DNA, 140 bp, Artificial Sequence
  Synthetic
caccgctgtcccaaaaggtcaatagaggcaagaattatactttacactatgagtaattatataacctcatatctgttatcatctaagccaacagttaattattacaatcattagagtaagcatatcagcagccagggcct

SEQ ID NO: 434113 - DNA, 140 bp, Artificial Sequence
  Synthetic
aggccctggctgctgatatgtggcgcccatccaaggacaaattaattgggaacaccatgcatcccgcagtctccatacacccgaatttgccacccattgttctaccaacagtcaagaagcgaccttttgggacagcggtg

SEQ ID NO: 434114 - DNA, 140 bp, Artificial Sequence
  Synthetic
caccgctgtcccaaaaggtcgcttcttgactgttggtagaacaatgggtggcaaattcgggtgtatggagactgcgggatgcatggtgttcccaattaatttgtccttggatgggcgccacatatcagcagccagggcct

SEQ ID NO: 434115 - DNA, 140 bp, Artificial Sequence
  Synthetic
aggccctggctgctgatatgcacacctgtggaagtaacggttcaagccaggcccataaatcgaccaactgctctgcctcctccagtcgacagcaaaatcgagcatgaatctacagaagatgaccttttgggacagcggtg

SEQ ID NO: 434116 - DNA, 140 bp, Artificial Sequence
  Synthetic
caccgctgtcccaaaaggtcatcttctgtagattcatgctcgattttgctgtcgactggaggaggcagagcagttggtcgatttatgggcctggcttgaaccgttacttccacaggtgtgcatatcagcagccagggcct

SEQ ID NO: 434117 - DNA, 140 bp, Artificial Sequence
  Synthetic
aggccctggctgctgatatgaggcttatcgtcagcataaaaatcccaacaatggaccactgctggccatatctggcatccttcaccaactgagggtcgagaaagtcccagagaagacaaggaccttttgggacagcggtg

SEQ ID NO: 434118 - DNA, 140 bp, Artificial Sequence
  Synthetic
caccgctgtcccaaaaggtccttgtcttctctgggactttctcgaccctcagttggtgaaggatgccagatatggccagcagtggtccattgttgggatttttatgctgacgataagcctcatatcagcagccagggcct

SEQ ID NO: 434119 - DNA, 140 bp, Artificial Sequence
  Synthetic
atacgccatgctgggtctccgactcatcatacatgcaacaagtcagcgaggggttgatgactggaaaagttcccatagatcaagtgtttggtgccaaccccttagagaagttatacaagacgtacttgggagtcggccat

SEQ ID NO: 434120 - DNA, 140 bp, Artificial Sequence
  Synthetic
atggccgactcccaagtacgtcttgtataacttctctaaggggttggcaccaaacacttgatctatgggaacttttccagtcatcaacccctcgctgacttgttgcatgtatgatgagtcggagacccagcatggcgtat

SEQ ID NO: 434121 - DNA, 140 bp, Artificial Sequence
  Synthetic
atacgccatgctgggtctccgaacattaagaaaaagggtgttcttattcttcaactaaacttgcatatcctttgttgatacccttgagagacaatttttgacactagatcacggatcaagcgtacttgggagtcggccat

SEQ ID NO: 434122 - DNA, 140 bp, Artificial Sequence
  Synthetic
atggccgactcccaagtacgcttgatccgtgatctagtgtcaaaaattgtctctcaagggtatcaacaaaggatatgcaagtttagttgaagaataagaacaccctttttcttaatgttcggagacccagcatggcgtat

SEQ ID NO: 434123 - DNA, 140 bp, Artificial Sequence
  Synthetic
aggccctggctgctgatatgtttactggaaggagtatcccaatctcagcttgttgaattaattgttacttaagtcattctttttaaaattaattcacacaaggtagtttgggtttatatcgaccttttgggacagcggtg

SEQ ID NO: 434124 - DNA, 140 bp, Artificial Sequence
  Synthetic
caccgctgtcccaaaaggtcgatataaacccaaactaccttgtgtgaattaattttaaaaagaatgacttaagtaacaattaattcaacaagctgagattgggatactccttccagtaaacatatcagcagccagggcct

SEQ ID NO: 434125 - DNA, 140 bp, Artificial Sequence
  Synthetic
aggccctggctgctgatatgattcttcctcaaagtcaaggtaaaggacagtgattattgttcgaaggttgacaatcagatcactttcagttttcagtttcaactcttattgtgagacttggaccttttgggacagcggtg

SEQ ID NO: 434126 - DNA, 140 bp, Artificial Sequence
  Synthetic
caccgctgtcccaaaaggtccaagtctcacaataagagttgaaactgaaaactgaaagtgatctgattgtcaaccttcgaacaataatcactgtcctttaccttgactttgaggaagaatcatatcagcagccagggcct

SEQ ID NO: 434127 - DNA, 140 bp, Artificial Sequence
  Synthetic
atacgccatgctgggtctccagacacacaaaaacaagagagacacacaaaaacaagagatgatgattttgtgtatcatataaataaagaagaatattaacattgacattgagacttgtcacgtacttgggagtcggccat

SEQ ID NO: 434128 - DNA, 140 bp, Artificial Sequence
  Synthetic
atggccgactcccaagtacgtgacaagtctcaatgtcaatgttaatattcttctttatttatatgatacacaaaatcatcatctcttgtttttgtgtgtctctcttgtttttgtgtgtctggagacccagcatggcgtat

SEQ ID NO: 434129 - DNA, 140 bp, Artificial Sequence
  Synthetic
aggccctggctgctgatatggtctgttaatattcttgaagagatggacttacatagtttgttagagttgggtacaaaacctactgcccctcatgttcgtaataagaaggtgatattatttgaccttttgggacagcggtg

SEQ ID NO: 434130 - DNA, 140 bp, Artificial Sequence
  Synthetic
caccgctgtcccaaaaggtcaaataatatcaccttcttattacgaacatgaggggcagtaggttttgtacccaactctaacaaactatgtaagtccatctcttcaagaatattaacagaccatatcagcagccagggcct

SEQ ID NO: 434131 - DNA, 140 bp, Artificial Sequence
  Synthetic
atacgccatgctgggtctccgttatcacctgacaaagttcaaaagcatcaaactttagctgacacctgctgtccaattgacagcttttgggtctatccaagcaagtccacaaggactaaccgtacttgggagtcggccat

SEQ ID NO: 434132 - DNA, 140 bp, Artificial Sequence
  Synthetic
atggccgactcccaagtacggttagtccttgtggacttgcttggatagacccaaaagctgtcaattggacagcaggtgtcagctaaagtttgatgcttttgaactttgtcaggtgataacggagacccagcatggcgtat

SEQ ID NO: 434133 - DNA, 140 bp, Artificial Sequence
  Synthetic
atacgccatgctgggtctccatcgcgaaatatttgcgtgatgcgggctatgaattcgatgtcatcaagaatgcagatgcaacccgctttctggatgtgattcccaatgaacctcattacacgtacttgggagtcggccat

SEQ ID NO: 434134 - DNA, 140 bp, Artificial Sequence
  Synthetic
atggccgactcccaagtacgtgtaatgaggttcattgggaatcacatccagaaagcgggttgcatctgcattcttgatgacatcgaattcatagcccgcatcacgcaaatatttcgcgatggagacccagcatggcgtat

SEQ ID NO: 434135 - DNA, 140 bp, Artificial Sequence
  Synthetic
aggccctggctgctgatatgtgcagatgcaacccgctttctggatgtgattcccaatgaacctcattacagccctttaattctagcccttaagacattagaaagtactgaatctcagagggaccttttgggacagcggtg

SEQ ID NO: 434136 - DNA, 140 bp, Artificial Sequence
  Synthetic
caccgctgtcccaaaaggtccctctgagattcagtactttctaatgtcttaagggctagaattaaagggctgtaatgaggttcattgggaatcacatccagaaagcgggttgcatctgcacatatcagcagccagggcct

SEQ ID NO: 434137 - DNA, 140 bp, Artificial Sequence
  Synthetic
atacgccatgctgggtctccgggagaattgggctcttcttatcattttgcagtctttttctcccaaaacttgtcgtcggagaccgggctagtatcgaaaaggctttaagacaagtaacagcgtacttgggagtcggccat

SEQ ID NO: 434138 - DNA, 140 bp, Artificial Sequence
  Synthetic
atggccgactcccaagtacgctgttacttgtcttaaagccttttcgatactagcccggtctccgacgacaagttttgggagaaaaagactgcaaaatgataagaagagcccaattctcccggagacccagcatggcgtat

SEQ ID NO: 434139 - DNA, 140 bp, Artificial Sequence
  Synthetic
aggccctggctgctgatatggaatactcctttttcgcatttgataaattgttcatttcttgaactttcttcacataccagttcagtctcttctaatcaacaagtgaccaattcgaaatatgaccttttgggacagcggtg

SEQ ID NO: 434140 - DNA, 140 bp, Artificial Sequence
  Synthetic
caccgctgtcccaaaaggtcatatttcgaattggtcacttgttgattagaagagactgaactggtatgtgaagaaagttcaagaaatgaacaatttatcaaatgcgaaaaaggagtattccatatcagcagccagggcct

SEQ ID NO: 434141 - DNA, 140 bp, Artificial Sequence
  Synthetic
aggccctggctgctgatatgtcaaaaacttccaaacagtccctcgcccatgtcaaaagagtcttcgggctgtccctcccaacccaacaattgacaaaggatgggtctgtgtttattcatcgaccttttgggacagcggtg

SEQ ID NO: 434142 - DNA, 140 bp, Artificial Sequence
  Synthetic
caccgctgtcccaaaaggtcgatgaataaacacagacccatcctttgtcaattgttgggttgggagggacagcccgaagactcttttgacatgggcgagggactgtttggaagtttttgacatatcagcagccagggcct

SEQ ID NO: 434143 - DNA, 140 bp, Artificial Sequence
  Synthetic
atacgccatgctgggtctcccgcctaaaatctgatctgttaggtcatgggtccttcataatctgtttgagcatgaatattgatcaaatgaccaaatgatagtgcatttgtatagactcaacgtacttgggagtcggccat

SEQ ID NO: 434144 - DNA, 140 bp, Artificial Sequence
  Synthetic
atggccgactcccaagtacgttgagtctatacaaatgcactatcatttggtcatttgatcaatattcatgctcaaacagattatgaaggacccatgacctaacagatcagattttaggcgggagacccagcatggcgtat

SEQ ID NO: 434145 - DNA, 140 bp, Artificial Sequence
  Synthetic
aggccctggctgctgatatgatgacagtatcatcagtaattcagtaggtcaaactagattctcaggacttcttattgtgaaaacagttctcgagttcatcttgcaaaaaactgattcagggaccttttgggacagcggtg

SEQ ID NO: 434146 - DNA, 140 bp, Artificial Sequence
  Synthetic
caccgctgtcccaaaaggtccctgaatcagttttttgcaagatgaactcgagaactgttttcacaataagaagtcctgagaatctagtttgacctactgaattactgatgatactgtcatcatatcagcagccagggcct

SEQ ID NO: 434147 - DNA, 140 bp, Artificial Sequence
  Synthetic
atacgccatgctgggtctccgaacgaagacgaggatactcttgaaaatagtgtcatggccccaagcactactttgagagaacccaaagaagtttccgaaccactaaggcaaactcaggaccgtacttgggagtcggccat

SEQ ID NO: 434148 - DNA, 140 bp, Artificial Sequence
  Synthetic
atggccgactcccaagtacggtcctgagtttgccttagtggttcggaaacttctttgggttctctcaaagtagtgcttggggccatgacactattttcaagagtatcctcgtcttcgttcggagacccagcatggcgtat

SEQ ID NO: 434149 - DNA, 140 bp, Artificial Sequence
  Synthetic
aggccctggctgctgatatgggtgacactacatcctttggtgcggacctccaaagtaaaaaatgaagttgctagtttcaagcaggcgttgagcaacctagcccgacatggagaatacgcagaccttttgggacagcggtg

SEQ ID NO: 434150 - DNA, 140 bp, Artificial Sequence
  Synthetic
caccgctgtcccaaaaggtctgcgtattctccatgtcgggctaggttgctcaacgcctgcttgaaactagcaacttcattttttactttggaggtccgcaccaaaggatgtagtgtcacccatatcagcagccagggcct

SEQ ID NO: 434151 - DNA, 140 bp, Artificial Sequence
  Synthetic
atacgccatgctgggtctcctgattaaagctttaggacaattgctactgagcccttcttctaatctactgaaatcaacttgggagatttttaagaagctgataatttaatgtgaatcagtcgtacttgggagtcggccat

SEQ ID NO: 434152 - DNA, 140 bp, Artificial Sequence
  Synthetic
atggccgactcccaagtacgactgattcacattaaattatcagcttcttaaaaatctcccaagttgatttcagtagattagaagaagggctcagtagcaattgtcctaaagctttaatcaggagacccagcatggcgtat

SEQ ID NO: 434153 - DNA, 140 bp, Artificial Sequence
  Synthetic
aggccctggctgctgatatgccatttgcacgggttctgaatttatcagggattaacaacctcgagcatggactctatcctcagctctcagcaattgcgctgggtgtggctacagcacacggaccttttgggacagcggtg

SEQ ID NO: 434154 - DNA, 140 bp, Artificial Sequence
  Synthetic
caccgctgtcccaaaaggtccgtgtgctgtagccacacccagcgcaattgctgagagctgaggatagagtccatgctcgaggttgttaatccctgataaattcagaacccgtgcaaatggcatatcagcagccagggcct

SEQ ID NO: 434155 - DNA, 140 bp, Artificial Sequence
  Synthetic
aggccctggctgctgatatggaggctgcacatgatgcagaggtaaaactacaaaggcgacatgaacatcaggaaattcaagctattgccgaagatgacgaggaaaggaagatattagaacgaccttttgggacagcggtg

SEQ ID NO: 434156 - DNA, 140 bp, Artificial Sequence
  Synthetic
caccgctgtcccaaaaggtcgttctaatatcttcctttcctcgtcatcttcggcaatagcttgaatttcctgatgttcatgtcgcctttgtagttttacctctgcatcatgtgcagcctccatatcagcagccagggcct

SEQ ID NO: 434157 - DNA, 140 bp, Artificial Sequence
  Synthetic
atacgccatgctgggtctccggaaattcaagctattgccgaagatgacgaggaaaggaagatattagaacagttccaccttcaaaaaactgaaattacacacagtcagacacttgccgtccgtacttgggagtcggccat

SEQ ID NO: 434158 - DNA, 140 bp, Artificial Sequence
  Synthetic
atggccgactcccaagtacggacggcaagtgtctgactgtgtgtaatttcagttttttgaaggtggaactgttctaatatcttcctttcctcgtcatcttcggcaatagcttgaatttccggagacccagcatggcgtat

SEQ ID NO: 434159 - DNA, 140 bp, Artificial Sequence
  Synthetic
atacgccatgctgggtctccattgttcatctagagaatatccctgaaataaatgcaagaatcaaattaataaattatggatcaacagctcaacaggggatggatatcaagatgccactctcgtacttgggagtcggccat

SEQ ID NO: 434160 - DNA, 140 bp, Artificial Sequence
  Synthetic
atggccgactcccaagtacgagagtggcatcttgatatccatcccctgttgagctgttgatccataatttattaatttgattcttgcatttatttcagggatattctctagatgaacaatggagacccagcatggcgtat

SEQ ID NO: 434161 - DNA, 140 bp, Artificial Sequence
  Synthetic
atacgccatgctgggtctccctcagccagaaacgagaaaaattagctcgtcttgctgcagaaattgaaaacaatattgtggaagatcagggatttaaacaatcacagaatcgggtgtcaccgtacttgggagtcggccat

SEQ ID NO: 434162 - DNA, 140 bp, Artificial Sequence
  Synthetic
atggccgactcccaagtacggtgacacccgattctgtgattgtttaaatccctgatcttccacaatattgttttcaatttctgcagcaagacgagctaatttttctcgtttctggctgagggagacccagcatggcgtat

SEQ ID NO: 434163 - DNA, 140 bp, Artificial Sequence
  Synthetic
atacgccatgctgggtctcccattctaccttggttcttattgtaagacttgtatactctcctatcaactgtgactactagttcaaaattaaaactcacaaaaattcaatcgcattgtaatcgtacttgggagtcggccat

SEQ ID NO: 434164 - DNA, 140 bp, Artificial Sequence
  Synthetic
atggccgactcccaagtacgattacaatgcgattgaatttttgtgagttttaattttgaactagtagtcacagttgataggagagtatacaagtcttacaataagaaccaaggtagaatgggagacccagcatggcgtat

SEQ ID NO: 434165 - DNA, 140 bp, Artificial Sequence
  Synthetic
atacgccatgctgggtctccagtcatttttgaatgaccctacacctgttgaagtaacggttcaagccagacctgtgaatcgaccaactgctctgcctcctccagttgatgacaaaattgacgtacttgggagtcggccat

SEQ ID NO: 434166 - DNA, 140 bp, Artificial Sequence
  Synthetic
atggccgactcccaagtacgtcaattttgtcatcaactggaggaggcagagcagttggtcgattcacaggtctggcttgaaccgttacttcaacaggtgtagggtcattcaaaaatgactggagacccagcatggcgtat

SEQ ID NO: 434167 - DNA, 140 bp, Artificial Sequence
  Synthetic
atacgccatgctgggtctccgcatgaatctacagaagatagctcttcttcaagtagctttgttgacttgaatgatccatttgcactgctgaatgaggacgaagacactcttgatgacagtcgtacttgggagtcggccat

SEQ ID NO: 434168 - DNA, 140 bp, Artificial Sequence
  Synthetic
atggccgactcccaagtacgactgtcatcaagagtgtcttcgtcctcattcagcagtgcaaatggatcattcaagtcaacaaagctacttgaagaagagctatcttctgtagattcatgcggagacccagcatggcgtat

SEQ ID NO: 434169 - DNA, 140 bp, Artificial Sequence
  Synthetic
aggccctggctgctgatatgctccggaactctccagaagacagaagatgtccatctgatgggattcacactgagtgggcaaaaagttgctgattcccctttggaggcatccaagcgatgggaccttttgggacagcggtg

SEQ ID NO: 434170 - DNA, 140 bp, Artificial Sequence
  Synthetic
caccgctgtcccaaaaggtcccatcgcttggatgcctccaaaggggaatcagcaactttttgcccactcagtgtgaatcccatcagatggacatcttctgtcttctggagagttccggagcatatcagcagccagggcct

SEQ ID NO: 434171 - DNA, 140 bp, Artificial Sequence
  Synthetic
atacgccatgctgggtctccgtcatgatcccgagcacaacatcgagagaatttcaagggattcctgaatcaccaggacaatctcaggacctcgataacagccaaggaaagcaggaagatgcgtacttgggagtcggccat

SEQ ID NO: 434172 - DNA, 140 bp, Artificial Sequence
  Synthetic
atggccgactcccaagtacgcatcttcctgctttccttggctgttatcgaggtcctgagattgtcctggtgattcaggaatcccttgaaattctctcgatgttgtgctcgggatcatgacggagacccagcatggcgtat

SEQ ID NO: 434173 - DNA, 140 bp, Artificial Sequence
  Synthetic
aggccctggctgctgatatgttaagaaaaactatgaagaacattaagaagatttttctctcgtagtgttcttctattggaaggagtatttcaatctcaacttgttggattaattataactgaccttttgggacagcggtg

SEQ ID NO: 434174 - DNA, 140 bp, Artificial Sequence
  Synthetic
caccgctgtcccaaaaggtcagttataattaatccaacaagttgagattgaaatactccttccaatagaagaacactacgagagaaaaatcttcttaatgttcttcatagtttttcttaacatatcagcagccagggcct

SEQ ID NO: 434175 - DNA, 140 bp, Artificial Sequence
  Synthetic
atacgccatgctgggtctccaatcaacaaacccgattaaaaaacagtttctgagatatcaagaacttcctcctgttcaagaagatgatgaatcggaatatacaactgactctcaggagagcgtacttgggagtcggccat

SEQ ID NO: 434176 - DNA, 140 bp, Artificial Sequence
  Synthetic
atggccgactcccaagtacgctctcctgagagtcagttgtatattccgattcatcatcttcttgaacaggaggaagttcttgatatctcagaaactgttttttaatcgggtttgttgattggagacccagcatggcgtat

SEQ ID NO: 434177 - DNA, 140 bp, Artificial Sequence
  Synthetic
aggccctggctgctgatatgctttagctcatactgtggctgcgttgctcacaggcagctatacaatcacccaatttactcataatgggcaaaaattcgtccgtgtcaatcgactcggtacgaccttttgggacagcggtg

SEQ ID NO: 434178 - DNA, 140 bp, Artificial Sequence
  Synthetic
caccgctgtcccaaaaggtcgtaccgagtcgattgacacggacgaatttttgcccattatgagtaaattgggtgattgtatagctgcctgtgagcaacgcagccacagtatgagctaaagcatatcagcagccagggcct

SEQ ID NO: 434179 - DNA, 140 bp, Artificial Sequence
  Synthetic
atacgccatgctgggtctcctatcgaccagccaggatccgacaatgaacaaggagttgatcttccacctcctccgttgtacactcaggaaaaaagacaggacccaatacagcacccggcacgtacttgggagtcggccat

SEQ ID NO: 434180 - DNA, 140 bp, Artificial Sequence
  Synthetic
atggccgactcccaagtacgtgccgggtgctgtattgggtcctgtcttttttcctgagtgtacaacggaggaggtggaagatcaactccttgttcattgtcggatcctggctggtcgataggagacccagcatggcgtat

SEQ ID NO: 434181 - DNA, 140 bp, Artificial Sequence
  Synthetic
aggccctggctgctgatatgctccgttgtacactcaggaaaaaagacaggacccaatacagcacccggcagcaagctctcaggatccctttggcagtattggtgatgtaaatggtgatatgaccttttgggacagcggtg

SEQ ID NO: 434182 - DNA, 140 bp, Artificial Sequence
  Synthetic
caccgctgtcccaaaaggtcatatcaccatttacatcaccaatactgccaaagggatcctgagagcttgctgccgggtgctgtattgggtcctgtcttttttcctgagtgtacaacggagcatatcagcagccagggcct

SEQ ID NO: 434183 - DNA, 140 bp, Artificial Sequence; identical to SEQ ID NO: 377643
  Synthetic

SEQ ID NO: 434184 - DNA, 140 bp, Artificial Sequence; identical to SEQ ID NO: 377644
  Synthetic

SEQ ID NO: 434185 - DNA, 140 bp, Artificial Sequence
  Synthetic
atacgccatgctgggtctccattcaacttgatagatataacttgattcagagaacattttgggaacgtcattaactaaattctctaaatgatgtactgtattactgtttcacccaactaacgtacttgggagtcggccat

SEQ ID NO: 434186 - DNA, 140 bp, Artificial Sequence
  Synthetic
atggccgactcccaagtacgttagttgggtgaaacagtaatacagtacatcatttagagaatttagttaatgacgttcccaaaatgttctctgaatcaagttatatctatcaagttgaatggagacccagcatggcgtat

SEQ ID NO: 434187 - DNA, 140 bp, Artificial Sequence
  Synthetic
atacgccatgctgggtctccgaacttgtagtccagataacacagtacggttacccacttatccaccctaatacgaattatcctcagatcatggcaatcaaatctatttgaatattcaaaccgtacttgggagtcggccat

SEQ ID NO: 434188 - DNA, 140 bp, Artificial Sequence
  Synthetic
atggccgactcccaagtacggtttgaatattcaaatagatttgattgccatgatctgaggataattcgtattagggtggataagtgggtaaccgtactgtgttatctggactacaagttcggagacccagcatggcgtat

SEQ ID NO: 434189 - DNA, 140 bp, Artificial Sequence
  Synthetic
aggccctggctgctgatatgatgcgaatccaacgctcagtgccgtttgaaatgatgctcaaatgagataggagtccatctgcataagaagcatggcttgaatgagtgtctgttaaattttgaccttttgggacagcggtg

SEQ ID NO: 434190 - DNA, 140 bp, Artificial Sequence
  Synthetic
caccgctgtcccaaaaggtcaaaatttaacagacactcattcaagccatgcttcttatgcagatggactcctatctcatttgagcatcatttcaaacggcactgagcgttggattcgcatcatatcagcagccagggcct

SEQ ID NO: 434191 - DNA, 140 bp, Artificial Sequence
  Synthetic
atacgccatgctgggtctccttatagattgatctttagtgtactccatacgcataatatagagaaattaatattactaacaaaaagggttttttaaacggatttgattaatagatcagtacgtacttgggagtcggccat

SEQ ID NO: 434192 - DNA, 140 bp, Artificial Sequence
  Synthetic
atggccgactcccaagtacgtactgatctattaatcaaatccgtttaaaaaaccctttttgttagtaatattaatttctctatattatgcgtatggagtacactaaagatcaatctataaggagacccagcatggcgtat

SEQ ID NO: 434193 - DNA, 140 bp, Artificial Sequence
  Synthetic
atacgccatgctgggtctcccacaagattagtttgtattgatttcaataatgctttaaccttacattgctgctttaaatggttaattaagctgatcagctggcaatatgtaatttcttttcgtacttgggagtcggccat

SEQ ID NO: 434194 - DNA, 140 bp, Artificial Sequence
  Synthetic
atggccgactcccaagtacgaaaagaaattacatattgccagctgatcagcttaattaaccatttaaagcagcaatgtaaggttaaagcattattgaaatcaatacaaactaatcttgtgggagacccagcatggcgtat

SEQ ID NO: 434195 - DNA, 140 bp, Artificial Sequence
  Synthetic
atacgccatgctgggtctccgggtcatcagatctataatgggtttactagattatataaaagaaatagtaatattttataaacaattcttgcttaattttactttgatctactaacatatcgtacttgggagtcggccat

SEQ ID NO: 434196 - DNA, 140 bp, Artificial Sequence
  Synthetic
atggccgactcccaagtacgatatgttagtagatcaaagtaaaattaagcaagaattgtttataaaatattactatttcttttatataatctagtaaacccattatagatctgatgacccggagacccagcatggcgtat

SEQ ID NO: 434197 - DNA, 140 bp, Artificial Sequence
  Synthetic
aggccctggctgctgatatgggttgcccaacaagcttgtagtaaggggaccatggttaaaaatgcaacaacagatgcagccgacaagatgtcgaaggttcttgaactcagtgaggaaacggaccttttgggacagcggtg

SEQ ID NO: 434198 - DNA, 140 bp, Artificial Sequence
  Synthetic
caccgctgtcccaaaaggtccgtttcctcactgagttcaagaaccttcgacatcttgtcggctgcatctgttgttgcatttttaaccatggtccccttactacaagcttgttgggcaacccatatcagcagccagggcct

SEQ ID NO: 434199 - DNA, 140 bp, Artificial Sequence
  Synthetic
aggccctggctgctgatatgtgtaattcttacctctgtttcttctgttttcccttctctttataatatgccaattaagaaaaactaaaaattgaagaatattaaagattttctttaatatgaccttttgggacagcggtg

SEQ ID NO: 434200 - DNA, 140 bp, Artificial Sequence
  Synthetic
caccgctgtcccaaaaggtcatattaaagaaaatctttaatattcttcaatttttagtttttcttaattggcatattataaagagaagggaaaacagaagaaacagaggtaagaattacacatatcagcagccagggcct

SEQ ID NO: 434201 - DNA, 140 bp, Artificial Sequence
  Synthetic
aggccctggctgctgatatgaataattctcacaatgtgggactcatcatatatgcaacaagtcagcgaggggttgatgactggaaaagttcccatagatcaagtgttcggtgccaaccccgaccttttgggacagcggtg

SEQ ID NO: 434202 - DNA, 140 bp, Artificial Sequence
  Synthetic
caccgctgtcccaaaaggtcggggttggcaccgaacacttgatctatgggaacttttccagtcatcaacccctcgctgacttgttgcatatatgatgagtcccacattgtgagaattattcatatcagcagccagggcct

SEQ ID NO: 434203 - DNA, 140 bp, Artificial Sequence
  Synthetic
atacgccatgctgggtctccttagagaagctatacaagagaagaaaaccaaaaggcacagttggactacaatgtagtccttgtctaatgtcaaaggcaacaagcactgatgatattatttcgtacttgggagtcggccat

SEQ ID NO: 434204 - DNA, 140 bp, Artificial Sequence
  Synthetic
atggccgactcccaagtacgaaataatatcatcagtgcttgttgcctttgacattagacaaggactacattgtagtccaactgtgccttttggttttcttctcttgtatagcttctctaaggagacccagcatggcgtat

SEQ ID NO: 434205 - DNA, 140 bp, Artificial Sequence
  Synthetic
aggccctggctgctgatatgatgtagtccttgtctaatgtcaaaggcaacaagcactgatgatattatttgggaccaactgatcgtgaagaaaacactagctgacctacttataccgatagaccttttgggacagcggtg

SEQ ID NO: 434206 - DNA, 140 bp, Artificial Sequence
  Synthetic
caccgctgtcccaaaaggtctatcggtataagtaggtcagctagtgttttcttcacgatcagttggtcccaaataatatcatcagtgcttgttgcctttgacattagacaaggactacatcatatcagcagccagggcct

SEQ ID NO: 434207 - DNA, 140 bp, Artificial Sequence
  Synthetic
atacgccatgctgggtctccgggaccaactgatcgtgaagaaaacactagctgacctacttataccgataaataggcagatctcagacattcaaagcactctaagcgaagtgacaacaagcgtacttgggagtcggccat

SEQ ID NO: 434208 - DNA, 140 bp, Artificial Sequence
  Synthetic
atggccgactcccaagtacgcttgttgtcacttcgcttagagtgctttgaatgtctgagatctgcctatttatcggtataagtaggtcagctagtgttttcttcacgatcagttggtcccggagacccagcatggcgtat

SEQ ID NO: 434209 - DNA, 140 bp, Artificial Sequence
  Synthetic
atacgccatgctgggtctccagttcatgaaattgagcggcaattacatgagattaccccagttttaaaaatgggaaggacactggaagcaatttccaaggggatgtcagaaatgttggcccgtacttgggagtcggccat

SEQ ID NO: 434210 - DNA, 140 bp, Artificial Sequence
  Synthetic
atggccgactcccaagtacgggccaacatttctgacatccccttggaaattgcttccagtgtccttcccatttttaaaactggggtaatctcatgtaattgccgctcaatttcatgaactggagacccagcatggcgtat

SEQ ID NO: 434211 - DNA, 140 bp, Artificial Sequence
  Synthetic
atacgccatgctgggtctccaaatacgatcaccttgtaatttcaactggaagaaccactgcaccagctgctgcctttgatgcttacttaaatgagcatggtgtccctccccctcaacccgcgtacttgggagtcggccat

SEQ ID NO: 434212 - DNA, 140 bp, Artificial Sequence
  Synthetic
atggccgactcccaagtacgcgggttgagggggagggacaccatgctcatttaagtaagcatcaaaggcagcagctggtgcagtggttcttccagttgaaattacaaggtgatcgtatttggagacccagcatggcgtat

SEQ ID NO: 434213 - DNA, 140 bp, Artificial Sequence
  Synthetic
atacgccatgctgggtctcctcaacatcacagacccaaacagtgatgatgaggacctcataacatccggttcagggtccgaagaacaggaaccttatacaacttccgatgcggtcactgacgtacttgggagtcggccat

SEQ ID NO: 434214 - DNA, 140 bp, Artificial Sequence
  Synthetic
atggccgactcccaagtacgtcagtgaccgcatcggaagttgtataaggttcctgttcttcggaccctgaaccggatgttatgaggtcctcatcatcactgtttgggtctgtgatgttgaggagacccagcatggcgtat

SEQ ID NO: 434215 - DNA, 140 bp, Artificial Sequence
  Synthetic
atacgccatgctgggtctcccaattttcaaagatctcggggttgcccaacaagcttgtagcaaggggaccatggttaaaaatgcaacaacagatgcagccgacaagatgtcgaaggttctcgtacttgggagtcggccat

SEQ ID NO: 434216 - DNA, 140 bp, Artificial Sequence
  Synthetic
atggccgactcccaagtacgagaaccttcgacatcttgtcggctgcatctgttgttgcatttttaaccatggtccccttgctacaagcttgttgggcaaccccgagatctttgaaaattgggagacccagcatggcgtat

SEQ ID NO: 434217 - DNA, 140 bp, Artificial Sequence
  Synthetic
aggccctggctgctgatatgatcattaacgacttgtcttaattcaatcttttggatgcaaaccataaggaaaaatgagccactttccctctactctgaactaaggaaatttctcttatcagaccttttgggacagcggtg

SEQ ID NO: 434218 - DNA, 140 bp, Artificial Sequence
  Synthetic
caccgctgtcccaaaaggtctgataagagaaatttccttagttcagagtagagggaaagtggctcatttttccttatggtttgcatccaaaagattgaattaagacaagtcgttaatgatcatatcagcagccagggcct

SEQ ID NO: 434219 - DNA, 140 bp, Artificial Sequence
  Synthetic
atacgccatgctgggtctcctgaactcagtgaggaaacgttctccaagccaaacctttcagctaaggatttagcccttttattgttcacccatctacccggcaataacactccattccatcgtacttgggagtcggccat

SEQ ID NO: 434220 - DNA, 140 bp, Artificial Sequence
  Synthetic
atggccgactcccaagtacgatggaatggagtgttattgccgggtagatgggtgaacaataaaagggctaaatccttagctgaaaggtttggcttggagaacgtttcctcactgagttcaggagacccagcatggcgtat

SEQ ID NO: 434221 - DNA, 140 bp, Artificial Sequence
  Synthetic
aggccctggctgctgatatgtagcccttttattgttcacccatctacccggcaataacactccattccatatattagctcaggtcctttcaaagattgcttacaagtcagggaaatccgggaccttttgggacagcggtg

SEQ ID NO: 434222 - DNA, 140 bp, Artificial Sequence
  Synthetic
caccgctgtcccaaaaggtcccggatttccctgacttgtaagcaatctttgaaaggacctgagctaatatatggaatggagtgttattgccgggtagatgggtgaacaataaaagggctacatatcagcagccagggcct

SEQ ID NO: 434223 - DNA, 140 bp, Artificial Sequence
  Synthetic
atacgccatgctgggtctccttatataaaagaaatagtaatattttataaacaatttttgctcagttttgctttgatttaataacatatatcattgtgcccttcattgccaagtcaactccgtacttgggagtcggccat

SEQ ID NO: 434224 - DNA, 140 bp, Artificial Sequence
  Synthetic
atggccgactcccaagtacggagttgacttggcaatgaagggcacaatgatatatgttattaaatcaaagcaaaactgagcaaaaattgtttataaaatattactatttcttttatataaggagacccagcatggcgtat

SEQ ID NO: 434225 - DNA, 140 bp, Artificial Sequence
  Synthetic
atacgccatgctgggtctcctactaatacaactcccacctataacactctcaagtacaacctcagtactccttcccctccaacccgcaacatcaccaataatgatacacaacgtgaactacgtacttgggagtcggccat

SEQ ID NO: 434226 - DNA, 140 bp, Artificial Sequence
  Synthetic
atggccgactcccaagtacgtagttcacgttgtgtatcattattggtgatgttgcgggttggaggggaaggagtactgaggttgtacttgagagtgttataggtgggagttgtattagtaggagacccagcatggcgtat

SEQ ID NO: 434227 - DNA, 140 bp, Artificial Sequence
  Synthetic
aggccctggctgctgatatgtcaaaaaagtcttcgggctgttcctccaaatccaacaattgacaaaggatgggtttgtgtttattcatctgagcaaggtgaaacacgggcccttaaaatcgaccttttgggacagcggtg

SEQ ID NO: 434228 - DNA, 140 bp, Artificial Sequence
  Synthetic
caccgctgtcccaaaaggtcgattttaagggcccgtgtttcaccttgctcagatgaataaacacaaacccatcctttgtcaattgttggatttggaggaacagcccgaagacttttttgacatatcagcagccagggcct

SEQ ID NO: 434229 - DNA, 140 bp, Artificial Sequence
  Synthetic
atacgccatgctgggtctccgggtttgtgtttattcatctgagcaaggtgaaacacgggcccttaaaatctaattcttattgttcacagttgcaagggaagtgatcttcccgagttaatacgtacttgggagtcggccat

SEQ ID NO: 434230 - DNA, 140 bp, Artificial Sequence
  Synthetic
atggccgactcccaagtacgtattaactcgggaagatcacttcccttgcaactgtgaacaataagaattagattttaagggcccgtgtttcaccttgctcagatgaataaacacaaacccggagacccagcatggcgtat

SEQ ID NO: 434231 - DNA, 140 bp, Artificial Sequence
  Synthetic
atacgccatgctgggtctcccaaagacactaaacatttcaaaagcatgtatgtgggcaaaacgtaactggatcatcttaattgaagtagtaatttatttctgttttaaatgtgattttaacgtacttgggagtcggccat

SEQ ID NO: 434232 - DNA, 140 bp, Artificial Sequence
  Synthetic
atggccgactcccaagtacgttaaaatcacatttaaaacagaaataaattactacttcaattaagatgatccagttacgttttgcccacatacatgcttttgaaatgtttagtgtctttgggagacccagcatggcgtat

SEQ ID NO: 434233 - DNA, 140 bp, Artificial Sequence
  Synthetic
aggccctggctgctgatatgatcatcttaattgaagtagtaatttatttctgttttaaatgtgattttaacttttaaagagttaaatggtgatagattaatccttgaagttactcatttagaccttttgggacagcggtg

SEQ ID NO: 434234 - DNA, 140 bp, Artificial Sequence
  Synthetic
caccgctgtcccaaaaggtctaaatgagtaacttcaaggattaatctatcaccatttaactctttaaaagttaaaatcacatttaaaacagaaataaattactacttcaattaagatgatcatatcagcagccagggcct

SEQ ID NO: 434235 - DNA, 140 bp, Artificial Sequence
  Synthetic
atacgccatgctgggtctcctatattatagggaaactaatgttactaacaaaaggggtctacctaacggatgtgattgagtgatcagtgtgtcttataaaccaaacaattgacttcttaccgtacttgggagtcggccat

SEQ ID NO: 434236 - DNA, 140 bp, Artificial Sequence
  Synthetic
atggccgactcccaagtacggtaagaagtcaattgtttggtttataagacacactgatcactcaatcacatccgttaggtagaccccttttgttagtaacattagtttccctataatataggagacccagcatggcgtat

SEQ ID NO: 434237 - DNA, 140 bp, Artificial Sequence
  Synthetic
aggccctggctgctgatatgatttagtttgtaggttgaggcgcttagctaatcaaactgctaaatccttggagctcttgttaagggtcacaaccgaggaaaggacattttccttaatcaagaccttttgggacagcggtg

SEQ ID NO: 434238 - DNA, 140 bp, Artificial Sequence
  Synthetic
caccgctgtcccaaaaggtcttgattaaggaaaatgtcctttcctcggttgtgacccttaacaagagctccaaggatttagcagtttgattagctaagcgcctcaacctacaaactaaatcatatcagcagccagggcct

SEQ ID NO: 434239 - DNA, 140 bp, Artificial Sequence
  Synthetic
atacgccatgctgggtctccttgttatgaatcaactaacaacatagaaaacacatttatccttatgtaatcctcggcttagctggaattaacttttgttgtaattcaatacgcttattcacgtacttgggagtcggccat

SEQ ID NO: 434240 - DNA, 140 bp, Artificial Sequence
  Synthetic
atggccgactcccaagtacgtgaataagcgtattgaattacaacaaaagttaattccagctaagccgaggattacataaggataaatgtgttttctatgttgttagttgattcataacaaggagacccagcatggcgtat

SEQ ID NO: 434241 - DNA, 140 bp, Artificial Sequence
  Synthetic
atacgccatgctgggtctcctagtatattatatgattttttataagtttaagatattttaaatcatacccacaaaagatattgttttaattaagaaaaactatgaagaacattaagaagacgtacttgggagtcggccat

SEQ ID NO: 434242 - DNA, 140 bp, Artificial Sequence
  Synthetic
atggccgactcccaagtacgtcttcttaatgttcttcatagtttttcttaattaaaacaatatcttttgtgggtatgatttaaaatatcttaaacttataaaaaatcatataatatactaggagacccagcatggcgtat

SEQ ID NO: 434243 - DNA, 140 bp, Artificial Sequence
  Synthetic
atacgccatgctgggtctccagtttatgtattgttgattgttatggtttgatattcaattgttatcatagtcaagagtaaccttttctatttgatgcattaatgttttaaactacctcttcgtacttgggagtcggccat

SEQ ID NO: 434244 - DNA, 140 bp, Artificial Sequence
  Synthetic
atggccgactcccaagtacgaagaggtagtttaaaacattaatgcatcaaatagaaaaggttactcttgactatgataacaattgaatatcaaaccataacaatcaacaatacataaactggagacccagcatggcgtat

SEQ ID NO: 434245 - DNA, 140 bp, Artificial Sequence
  Synthetic
atacgccatgctgggtctccgatttaaacaatcacagaatcaggtgtcacagtcgtttttgaatgaccctacacctgtggaagtaacggttcaagccaggcccataaatcgaccaactgccgtacttgggagtcggccat

SEQ ID NO: 434246 - DNA, 140 bp, Artificial Sequence
  Synthetic
atggccgactcccaagtacggcagttggtcgatttatgggcctggcttgaaccgttacttccacaggtgtagggtcattcaaaaacgactgtgacacctgattctgtgattgtttaaatcggagacccagcatggcgtat

SEQ ID NO: 434247 - DNA, 140 bp, Artificial Sequence
  Synthetic
atacgccatgctgggtctccaagcagaacatttgacgctttccttggagtggttcctccagtgataagagtcaaaaacttccaaacagtccctcgtccatgtcaaaaaagtcttcgggctcgtacttgggagtcggccat

SEQ ID NO: 434248 - DNA, 140 bp, Artificial Sequence
  Synthetic
atggccgactcccaagtacgagcccgaagacttttttgacatggacgagggactgtttggaagtttttgactcttatcactggaggaaccactccaaggaaagcgtcaaatgttctgcttggagacccagcatggcgtat

SEQ ID NO: 434249 - DNA, 140 bp, Artificial Sequence
  Synthetic
aggccctggctgctgatatgaggtagtttaaatttgtatctagaacagattttaatatggccagttctagcaattacaacacatacatgcaatacttgaaccctcctccttatgctgatcgaccttttgggacagcggtg

SEQ ID NO: 434250 - DNA, 140 bp, Artificial Sequence
  Synthetic
caccgctgtcccaaaaggtcgatcagcataaggaggagggttcaagtattgcatgtatgtgttgtaattgctagaactggccatattaaaatctgttctagatacaaatttaaactacctcatatcagcagccagggcct

SEQ ID NO: 434251 - DNA, 140 bp, Artificial Sequence
  Synthetic
atacgccatgctgggtctccacggtgcaaaccagttaatcccggcagaccagctatcaaatcagcatggtataactccaaattatgtgggcgatttaaacttagatgaccagtttaaaggcgtacttgggagtcggccat

SEQ ID NO: 434252 - DNA, 140 bp, Artificial Sequence
  Synthetic
atggccgactcccaagtacgcctttaaactggtcatctaagtttaaatcgcccacataatttggagttataccatgctgatttgatagctggtctgccgggattaactggtttgcaccgtggagacccagcatggcgtat

SEQ ID NO: 434253 - DNA, 140 bp, Artificial Sequence
  Synthetic
aggccctggctgctgatatgcctcactacaccaatcatcatccacgtgcaagatcgatgagctcaacccgcagtagtgcagaaagcagtcccaccaatcatattccccgtgctcgaccacgaccttttgggacagcggtg

SEQ ID NO: 434254 - DNA, 140 bp, Artificial Sequence
  Synthetic
caccgctgtcccaaaaggtcgtggtcgagcacggggaatatgattggtgggactgctttctgcactactgcgggttgagctcatcgatcttgcacgtggatgatgattggtgtagtgaggcatatcagcagccagggcct

SEQ ID NO: 434255 - DNA, 140 bp, Artificial Sequence
  Synthetic
atacgccatgctgggtctccgaatgtctgccacgctttcactttagaggcgataattgacatatctgcgtataacgagcgaacagtcaaaggtgttccagcatggctgcctcttgggattcgtacttgggagtcggccat

SEQ ID NO: 434256 - DNA, 140 bp, Artificial Sequence
  Synthetic
atggccgactcccaagtacgaatcccaagaggcagccatgctggaacacctttgactgttcgctcgttatacgcagatatgtcaattatcgcctctaaagtgaaagcgtggcagacattcggagacccagcatggcgtat

SEQ ID NO: 434257 - DNA, 140 bp, Artificial Sequence
  Synthetic
aggccctggctgctgatatgagcctaaaatctgatccgttgggtcatgggcccttcataatctgtttgagcatgaatgttgatcaaatgaccaagtaatagtgcatttgtatagattcaagaccttttgggacagcggtg

SEQ ID NO: 434258 - DNA, 140 bp, Artificial Sequence
  Synthetic
caccgctgtcccaaaaggtcttgaatctatacaaatgcactattacttggtcatttgatcaacattcatgctcaaacagattatgaagggcccatgacccaacggatcagattttaggctcatatcagcagccagggcct

SEQ ID NO: 434259 - DNA, 140 bp, Artificial Sequence
  Synthetic
atacgccatgctgggtctccatgagcaattttgaatatcctttagctcatactgtggctgcattgctcacaggcagctatacaatcacccaatttactcacaacgggcaaaaattcgtcccgtacttgggagtcggccat

SEQ ID NO: 434260 - DNA, 140 bp, Artificial Sequence
  Synthetic
atggccgactcccaagtacgggacgaatttttgcccgttgtgagtaaattgggtgattgtatagctgcctgtgagcaatgcagccacagtatgagctaaaggatattcaaaattgctcatggagacccagcatggcgtat

SEQ ID NO: 434261 - DNA, 140 bp, Artificial Sequence
  Synthetic
aggccctggctgctgatatgtattttgtcagtgaacacattcccacatcacttgatcaaaaacagggaattattccaacatgaggactacatgcctctttatcagtcttatcttaatccagaccttttgggacagcggtg

SEQ ID NO: 434262 - DNA, 140 bp, Artificial Sequence
  Synthetic
caccgctgtcccaaaaggtctggattaagataagactgataaagaggcatgtagtcctcatgttggaataattccctgtttttgatcaagtgatgtgggaatgtgttcactgacaaaatacatatcagcagccagggcct

SEQ ID NO: 434263 - DNA, 140 bp, Artificial Sequence
  Synthetic
atacgccatgctgggtctccgtgtcaatcgactcggtacaggaatcccggcacacccactcagaatgttgcgtgaaggaaatcaagcttttattcagaacatggtgatccccaggaatttcgtacttgggagtcggccat

SEQ ID NO: 434264 - DNA, 140 bp, Artificial Sequence
  Synthetic
atggccgactcccaagtacgaaattcctggggatcaccatgttctgaataaaagcttgatttccttcacgcaacattctgagtgggtgtgccgggattcctgtaccgagtcgattgacacggagacccagcatggcgtat

SEQ ID NO: 434265 - DNA, 140 bp, Artificial Sequence
  Synthetic
aggccctggctgctgatatgcatcgagagaatttcaagggattcctgaatcaccaggacaatctcagaacctcgatgacagccaaggaaaacaggaagatgaatcaacaaacccgattaagaccttttgggacagcggtg

SEQ ID NO: 434266 - DNA, 140 bp, Artificial Sequence
  Synthetic
caccgctgtcccaaaaggtcttaatcgggtttgttgattcatcttcctgttttccttggctgtcatcgaggttctgagattgtcctggtgattcaggaatcccttgaaattctctcgatgcatatcagcagccagggcct

SEQ ID NO: 434267 - DNA, 140 bp, Artificial Sequence
  Synthetic
atacgccatgctgggtctccttccaccaatcaattcacctacaatcttactaacttagtattgagtgtgcaaaaacttcctgatgatgcctggcgcccatccaaggacaaattaattgggcgtacttgggagtcggccat

SEQ ID NO: 434268 - DNA, 140 bp, Artificial Sequence
  Synthetic
atggccgactcccaagtacgcccaattaatttgtccttggatgggcgccaggcatcatcaggaagtttttgcacactcaatactaagttagtaagattgtaggtgaattgattggtggaaggagacccagcatggcgtat

SEQ ID NO: 434269 - DNA, 140 bp, Artificial Sequence
  Synthetic
atacgccatgctgggtctccagcccgtccagagatcaaacccacaagcaccccaactgatgccaccacactcaacaccacagacccaaacaatgatgatgaggacctcataacatccggtcgtacttgggagtcggccat

SEQ ID NO: 434270 - DNA, 140 bp, Artificial Sequence
  Synthetic
atggccgactcccaagtacgaccggatgttatgaggtcctcatcatcattgtttgggtctgtggtgttgagtgtggtggcatcagttggggtgcttgtgggtttgatctctggacgggctggagacccagcatggcgtat

SEQ ID NO: 434271 - DNA, 140 bp, Artificial Sequence
  Synthetic
atacgccatgctgggtctcctctaccaacagtcaagaagcaagcttatcgtcagcacaaaaatcccaacaatggaccactgctggccatatctggcatccttcatcaactgagggtcgaacgtacttgggagtcggccat

SEQ ID NO: 434272 - DNA, 140 bp, Artificial Sequence
  Synthetic
atggccgactcccaagtacgttcgaccctcagttgatgaaggatgccagatatggccagcagtggtccattgttgggatttttgtgctgacgataagcttgcttcttgactgttggtagaggagacccagcatggcgtat

SEQ ID NO: 434273 - DNA, 140 bp, Artificial Sequence
  Synthetic
atacgccatgctgggtctccaaagtcccagagaagacaagcctgtttaggatttcgcttcctgccgacatgttctcagtaaaagagggtatgatgaagaaaagaggagaaagttccccggcgtacttgggagtcggccat

SEQ ID NO: 434274 - DNA, 140 bp, Artificial Sequence
  Synthetic
atggccgactcccaagtacgccggggaactttctcctcttttcttcatcataccctcttttactgagaacatgtcggcaggaagcgaaatcctaaacaggcttgtcttctctgggactttggagacccagcatggcgtat

SEQ ID NO: 434275 - DNA, 140 bp, Artificial Sequence
  Synthetic
atacgccatgctgggtctcccaattatttatcatcgattgtttagtttgagggattccacatcatcttaaatccaataacacgattttgtttgatttttctcttaatttctacaccacaacgtacttgggagtcggccat

SEQ ID NO: 434276 - DNA, 140 bp, Artificial Sequence
  Synthetic
atggccgactcccaagtacgttgtggtgtagaaattaagagaaaaatcaaacaaaatcgtgttattggatttaagatgatgtggaatccctcaaactaaacaatcgatgataaataattgggagacccagcatggcgtat

SEQ ID NO: 434277 - DNA, 140 bp, Artificial Sequence
  Synthetic
aggccctggctgctgatatggctttaaccttacattgctgctttaaatgattgatcaagctgattaacttgtaatatgtaacctcttttgggccatcaaagctataataggtttactagagaccttttgggacagcggtg

SEQ ID NO: 434278 - DNA, 140 bp, Artificial Sequence
  Synthetic
caccgctgtcccaaaaggtctctagtaaacctattatagctttgatggcccaaaagaggttacatattacaagttaatcagcttgatcaatcatttaaagcagcaatgtaaggttaaagccatatcagcagccagggcct

SEQ ID NO: 434279 - DNA, 140 bp, Artificial Sequence
  Synthetic
atacgccatgctgggtctccgcaatacctcaacggtgttcaactgccacaatcattgaaaacaatggcaagatgtggacccttatctgactctatttttgatgatcttcaaggttccctgcgtacttgggagtcggccat

SEQ ID NO: 434280 - DNA, 140 bp, Artificial Sequence
  Synthetic
atggccgactcccaagtacgcagggaaccttgaagatcatcaaaaatagagtcagataagggtccacatcttgccattgttttcaatgattgtggcagttgaacaccgttgaggtattgcggagacccagcatggcgtat

SEQ ID NO: 434281 - DNA, 140 bp, Artificial Sequence
  Synthetic
aggccctggctgctgatatgctttgatttaataacatatatcattgtgcccttcattgccaagtcaactcaactgatgatgatattcttcctgaaatagtaagaaaaactaatgaagaacgaccttttgggacagcggtg

SEQ ID NO: 434282 - DNA, 140 bp, Artificial Sequence
  Synthetic
caccgctgtcccaaaaggtcgttcttcattagtttttcttactatttcaggaagaatatcatcatcagttgagttgacttggcaatgaagggcacaatgatatatgttattaaatcaaagcatatcagcagccagggcct

SEQ ID NO: 434283 - DNA, 140 bp, Artificial Sequence
  Synthetic
aggccctggctgctgatatgaataagacagtgcacaaaatgattttctcgcggcaaggacaagggtaccgtcatatgaatctgacttctactaataaatattggacaagtagtaacggaagaccttttgggacagcggtg

SEQ ID NO: 434284 - DNA, 140 bp, Artificial Sequence
  Synthetic
caccgctgtcccaaaaggtcttccgttactacttgtccaatatttattagtagaagtcagattcatatgacggtacccttgtccttgccgcgagaaaatcattttgtgcactgtcttattcatatcagcagccagggcct

SEQ ID NO: 434285 - DNA, 140 bp, Artificial Sequence
  Synthetic
atacgccatgctgggtctccaaccagtgtgcaagcctcatacgatcattttattcttcctcaaagtcaaagtaaaggacaatgattattgtttgaaagctgacaatcaaatcactttcagcgtacttgggagtcggccat

SEQ ID NO: 434286 - DNA, 140 bp, Artificial Sequence
  Synthetic
atggccgactcccaagtacgctgaaagtgatttgattgtcagctttcaaacaataatcattgtcctttactttgactttgaggaagaataaaatgatcgtatgaggcttgcacactggttggagacccagcatggcgtat

SEQ ID NO: 434287 - DNA, 140 bp, Artificial Sequence
  Synthetic
atacgccatgctgggtctccgcaagaactgggcatactatggtgatgcgagggcattattcagtgctacaaattcttttttcaatcgctataatgatacaactacgaacctccatacattcgtacttgggagtcggccat

SEQ ID NO: 434288 - DNA, 140 bp, Artificial Sequence
  Synthetic
atggccgactcccaagtacgaatgtatggaggttcgtagttgtatcattatagcgattgaaaaaagaatttgtagcactgaataatgccctcgcatcaccatagtatgcccagttcttgcggagacccagcatggcgtat

SEQ ID NO: 434289 - DNA, 140 bp, Artificial Sequence
  Synthetic
aggccctggctgctgatatgagggataaaaactctccctattttggagatagccagtaacgatcaaccccaaaatgtggattcggtatgctccggaactctccagaaaacagaagatgtcgaccttttgggacagcggtg

SEQ ID NO: 434290 - DNA, 140 bp, Artificial Sequence
  Synthetic
caccgctgtcccaaaaggtcgacatcttctgttttctggagagttccggagcataccgaatccacattttggggttgatcgttactggctatctccaaaatagggagagtttttatccctcatatcagcagccagggcct

SEQ ID NO: 434291 - DNA, 140 bp, Artificial Sequence
  Synthetic
atacgccatgctgggtctcccactaattcattgtaaattactcgattaaaatgttcttaagctatcttaaacttgatgatgcagctctgtttcacctttctgttgatttcaatgtcacagcgtacttgggagtcggccat

SEQ ID NO: 434292 - DNA, 140 bp, Artificial Sequence
  Synthetic
atggccgactcccaagtacgctgtgacattgaaatcaacagaaaggtgaaacagagctgcatcatcaagtttaagatagcttaagaacattttaatcgagtaatttacaatgaattagtgggagacccagcatggcgtat

SEQ ID NO: 434293 - DNA, 140 bp, Artificial Sequence
  Synthetic
atacgccatgctgggtctcccatctgatgggatttacactgagcgggcagaaagttgctgattcccctttggaggcatccaagcgatgggctttcaggacaggtgtacctcctaagaatgcgtacttgggagtcggccat

SEQ ID NO: 434294 - DNA, 140 bp, Artificial Sequence
  Synthetic
atggccgactcccaagtacgcattcttaggaggtacacctgtcctgaaagcccatcgcttggatgcctccaaaggggaatcagcaactttctgcccgctcagtgtaaatcccatcagatgggagacccagcatggcgtat

SEQ ID NO: 434295 - DNA, 140 bp, Artificial Sequence
  Synthetic
aggccctggctgctgatatgctttgttgatacccttgggagacaacttttgacactaggccacggatcaagcatatttcattcaaacatcccaaattttcaatcatacacataataaccagaccttttgggacagcggtg

SEQ ID NO: 434296 - DNA, 140 bp, Artificial Sequence
  Synthetic
caccgctgtcccaaaaggtctggttattatgtgtatgattgaaaatttgggatgtttgaatgaaatatgcttgatccgtggcctagtgtcaaaagttgtctcccaagggtatcaacaaagcatatcagcagccagggcct

SEQ ID NO: 434297 - DNA, 140 bp, Artificial Sequence
  Synthetic
aggccctggctgctgatatgtgactatcctaaatgcaaaactatccatcacattcaaggtcaaaaccctcatgcgcaggggatcgccctccatttgtggggagcatttttcctatatgatgaccttttgggacagcggtg

SEQ ID NO: 434298 - DNA, 140 bp, Artificial Sequence
  Synthetic
caccgctgtcccaaaaggtcatcatataggaaaaatgctccccacaaatggagggcgatcccctgcgcatgagggttttgaccttgaatgtgatggatagttttgcatttaggatagtcacatatcagcagccagggcct

SEQ ID NO: 434299 - DNA, 140 bp, Artificial Sequence
  Synthetic
atacgccatgctgggtctcccgcattgcctccacaacaatgtaccgaggcaaagtcttcactgaagggaacatagcagctatgattgtcaataagacagtgcacaaaatgattttctcgacgtacttgggagtcggccat

SEQ ID NO: 434300 - DNA, 140 bp, Artificial Sequence
  Synthetic
atggccgactcccaagtacgtcgagaaaatcattttgtgcactgtcttattgacaatcatagctgctatgttcccttcagtgaagactttgcctcggtacattgttgtggaggcaatgcgggagacccagcatggcgtat

SEQ ID NO: 434301 - DNA, 140 bp, Artificial Sequence
  Synthetic
aggccctggctgctgatatgcatagcagctatgattgtcaataagacagtgcacaaaatgattttctcgaggcaaggacaagggtaccgtcacatgaatctgacttctactaataaatatgaccttttgggacagcggtg

SEQ ID NO: 434302 - DNA, 140 bp, Artificial Sequence
  Synthetic
caccgctgtcccaaaaggtcatatttattagtagaagtcagattcatgtgacggtacccttgtccttgcctcgagaaaatcattttgtgcactgtcttattgacaatcatagctgctatgcatatcagcagccagggcct

SEQ ID NO: 434303 - DNA, 140 bp, Artificial Sequence
  Synthetic
atacgccatgctgggtctcctcatgattaaagatgtcttcatcgaaaggtacaacacatgggagatctgtgctcgcgcttgggtcgaagataatgaagaagctgattacccacctcttggcgtacttgggagtcggccat

SEQ ID NO: 434304 - DNA, 140 bp, Artificial Sequence
  Synthetic
atggccgactcccaagtacgccaagaggtgggtaatcagcttcttcattatcttcgacccaagcgcgagcacagatctcccatgtgttgtacctttcgatgaagacatctttaatcatgaggagacccagcatggcgtat

SEQ ID NO: 434305 - DNA, 140 bp, Artificial Sequence
  Synthetic
atacgccatgctgggtctccgaacccaacaaaaccaacacaactgcacaaccgtccatgcccccccacaacaccactgcaatctctactaacaacacctccaagaacaacttcagcaccccgtacttgggagtcggccat

SEQ ID NO: 434306 - DNA, 140 bp, Artificial Sequence
  Synthetic
atggccgactcccaagtacggggtgctgaagttgttcttggaggtgttgttagtagagattgcagtggtgttgtgggggggcatggacggttgtgcagttgtgttggttttgttgggttcggagacccagcatggcgtat

SEQ ID NO: 434307 - DNA, 140 bp, Artificial Sequence
  Synthetic
aggccctggctgctgatatgccaaccgatgccactagactcaacaccacaaacccaaacagtgatgatgaggatctcacaacatccggctcggggtctggggaacaggaactctatacgagaccttttgggacagcggtg

SEQ ID NO: 434308 - DNA, 140 bp, Artificial Sequence
  Synthetic
caccgctgtcccaaaaggtctcgtatagagttcctgttccccagaccccgagccggatgttgtgagatcctcatcatcactgtttgggtttgtggtgttgagtctagtggcatcggttggcatatcagcagccagggcct

SEQ ID NO: 434309 - DNA, 140 bp, Artificial Sequence
  Synthetic
atacgccatgctgggtctcccttctgatgcggtcactaagcaagggctttcatcaacaatgccacccactccctcaccgcaaccaggcacgccacagcaaggaggaaacaacacaaaccacgtacttgggagtcggccat

SEQ ID NO: 434310 - DNA, 140 bp, Artificial Sequence
  Synthetic
atggccgactcccaagtacgtggtttgtgttgtttcctccttgctgtggcgtgcctggttgcggtgagggagtgggtggcattgttgatgaaagcccttgcttagtgaccgcatcagaagggagacccagcatggcgtat

SEQ ID NO: 434311 - DNA, 140 bp, Artificial Sequence
  Synthetic
atacgccatgctgggtctcctgttactaacaaaaggggtctacctaacgcatatgattgagtaatccgtatattttataaaccaaacaattaacttcttactttttaagaatcaactaaccgtacttgggagtcggccat

SEQ ID NO: 434312 - DNA, 140 bp, Artificial Sequence
  Synthetic
atggccgactcccaagtacggttagttgattcttaaaaagtaagaagttaattgtttggtttataaaatatacggattactcaatcatatgcgttaggtagaccccttttgttagtaacaggagacccagcatggcgtat

SEQ ID NO: 434313 - DNA, 140 bp, Artificial Sequence
  Synthetic
aggccctggctgctgatatgaagtatccatcaagcaggtgtcgcaaaataccaggggtttcacatgctgccatatttaccaaatcttacataggattatatgattctcttcgatactcgtgaccttttgggacagcggtg

SEQ ID NO: 434314 - DNA, 140 bp, Artificial Sequence
  Synthetic
caccgctgtcccaaaaggtcacgagtatcgaagagaatcatataatcctatgtaagatttggtaaatatggcagcatgtgaaacccctggtattttgcgacacctgcttgatggatacttcatatcagcagccagggcct

SEQ ID NO: 434315 - DNA, 140 bp, Artificial Sequence
  Synthetic
atacgccatgctgggtctcccactagtccctcctccacccccaactcgactacacaacatcttatatatttcaggaggaaacgaagtatcctctggagggaaggcgacatgttcccttttcgtacttgggagtcggccat

SEQ ID NO: 434316 - DNA, 140 bp, Artificial Sequence
  Synthetic
atggccgactcccaagtacgaaaagggaacatgtcgccttccctccagaggatacttcgtttcctcctgaaatatataagatgttgtgtagtcgagttgggggtggaggagggactagtgggagacccagcatggcgtat

SEQ ID NO: 434317 - DNA, 140 bp, Artificial Sequence
  Synthetic
atacgccatgctgggtctcccaatttgggatcatattttaacttccattcaatatgatgcaattaatcatgttgatgactttaaatacctattgccctctgagctagtcaagtatgcaaacgtacttgggagtcggccat

SEQ ID NO: 434318 - DNA, 140 bp, Artificial Sequence
  Synthetic
atggccgactcccaagtacgtttgcatacttgactagctcagagggcaataggtatttaaagtcatcaacatgattaattgcatcatattgaatggaagttaaaatatgatcccaaattgggagacccagcatggcgtat

SEQ ID NO: 434319 - DNA, 140 bp, Artificial Sequence
  Synthetic
atacgccatgctgggtctccctagatgggttaataaatgctccaattgattttgatccagttccaaatacaaagacaatctttgatgaatcttctagttctggtgcttcaactgaggaagcgtacttgggagtcggccat

SEQ ID NO: 434320 - DNA, 140 bp, Artificial Sequence
  Synthetic
atggccgactcccaagtacgcttcctcagttgaagcaccagaactagaagattcatcaaagattgtctttgtatttggaactggatcaaaatcaattggagcatttattaacccatctagggagacccagcatggcgtat

SEQ ID NO: 434321 - DNA, 140 bp, Artificial Sequence
  Synthetic
aggccctggctgctgatatgaaagacaatctttgatgaatcttctagttctggtgcttcaactgaggaagatcaacatgcatcctccaatatcagtttaactttatcttatcttcctcatgaccttttgggacagcggtg

SEQ ID NO: 434322 - DNA, 140 bp, Artificial Sequence
  Synthetic
caccgctgtcccaaaaggtcatgaggaagataagataaagttaaactgatattggaggatgcatgttgatcttcctcagttgaagcaccagaactagaagattcatcaaagattgtctttcatatcagcagccagggcct

SEQ ID NO: 434323 - DNA, 140 bp, Artificial Sequence; identical to SEQ ID NO: 377487
  Synthetic

SEQ ID NO: 434324 - DNA, 140 bp, Artificial Sequence; identical to SEQ ID NO: 377488
  Synthetic

SEQ ID NO: 434325 - DNA, 140 bp, Artificial Sequence
  Synthetic
aggccctggctgctgatatggttggataccattttttggccctggaatcgaaggactttataccgcaggtttaattaaaaatcaaaacaatttggtctgcaggttgaggcgtctagccaagaccttttgggacagcggtg

SEQ ID NO: 434326 - DNA, 140 bp, Artificial Sequence
  Synthetic
caccgctgtcccaaaaggtcttggctagacgcctcaacctgcagaccaaattgttttgatttttaattaaacctgcggtataaagtccttcgattccagggccaaaaaatggtatccaaccatatcagcagccagggcct

SEQ ID NO: 434327 - DNA, 140 bp, Artificial Sequence
  Synthetic
atacgccatgctgggtctcctcaaactgcaaaatccttggaactcttactaagggtcacaaccgaggaaagaacattttccttaatcaatagacatgctattgactttctactcacaaggcgtacttgggagtcggccat

SEQ ID NO: 434328 - DNA, 140 bp, Artificial Sequence
  Synthetic
atggccgactcccaagtacgccttgtgagtagaaagtcaatagcatgtctattgattaaggaaaatgttctttcctcggttgtgacccttagtaagagttccaaggattttgcagtttgaggagacccagcatggcgtat

SEQ ID NO: 434329 - DNA, 140 bp, Artificial Sequence
  Synthetic
atacgccatgctgggtctcctggggaggaacatgcaaagtgcttggacctgattgttgcatcggaatagaagacttgtccagaaatatttcagaacagattgaccaaatcaagaaggacgcgtacttgggagtcggccat

SEQ ID NO: 434330 - DNA, 140 bp, Artificial Sequence
  Synthetic
atggccgactcccaagtacgcgtccttcttgatttggtcaatctgttctgaaatatttctggacaagtcttctattccgatgcaacaatcaggtccaagcactttgcatgttcctccccaggagacccagcatggcgtat

SEQ ID NO: 434331 - DNA, 140 bp, Artificial Sequence
  Synthetic
atacgccatgctgggtctccaacaaaaagaggggactggttggggtctgggtggtaaatggtggacatccgactggggtgttcttactaacttgggcattttactactattgtccatagccgtacttgggagtcggccat

SEQ ID NO: 434332 - DNA, 140 bp, Artificial Sequence
  Synthetic
atggccgactcccaagtacggctatggacaatagtagtaaaatgcccaagttagtaagaacaccccagtcggatgtccaccatttaccacccagaccccaaccagtcccctctttttgttggagacccagcatggcgtat

SEQ ID NO: 434333 - DNA, 140 bp, Artificial Sequence
  Synthetic
atacgccatgctgggtctcctgtcttgattgctctatcctgtatttgtcgtatctttactaaatatattggatagcgttaagtatgtaatgattagagctttaggacaattgctactgagcgtacttgggagtcggccat

SEQ ID NO: 434334 - DNA, 140 bp, Artificial Sequence
  Synthetic
atggccgactcccaagtacgctcagtagcaattgtcctaaagctctaatcattacatacttaacgctatccaatatatttagtaaagatacgacaaatacaggatagagcaatcaagacaggagacccagcatggcgtat

SEQ ID NO: 434335 - DNA, 140 bp, Artificial Sequence
  Synthetic
atacgccatgctgggtctcctacaatctcactaacttagtattgagtgtgcaaaagcttcctgatgatgcctggcgcccatccaagaacaaattaactgggaacaccatgcatcccgcagcgtacttgggagtcggccat

SEQ ID NO: 434336 - DNA, 140 bp, Artificial Sequence
  Synthetic
atggccgactcccaagtacgctgcgggatgcatggtgttcccagttaatttgttcttggatgggcgccaggcatcatcaggaagcttttgcacactcaatactaagttagtgagattgtaggagacccagcatggcgtat

SEQ ID NO: 434337 - DNA, 140 bp, Artificial Sequence
  Synthetic
atacgccatgctgggtctcctgggccaagcagacttttccttgaatcagatactggattttgctgaaaagttagaatatttggctccctcttataggaatttttccttttcattaaaagacgtacttgggagtcggccat

SEQ ID NO: 434338 - DNA, 140 bp, Artificial Sequence
  Synthetic
atggccgactcccaagtacgtcttttaatgaaaaggaaaaattcctataagagggagccaaatattctaacttttcagcaaaatccagtatctgattcaaggaaaagtctgcttggcccaggagacccagcatggcgtat

SEQ ID NO: 434339 - DNA, 140 bp, Artificial Sequence
  Synthetic
atacgccatgctgggtctccaccaaccattgcaagaattaatttacttttcccgttatacttatttacattaattctttgaatattcagcatcattaacgacttgtcttaattcaatcttcgtacttgggagtcggccat

SEQ ID NO: 434340 - DNA, 140 bp, Artificial Sequence
  Synthetic
atggccgactcccaagtacgaagattgaattaagacaagtcgttaatgatgctgaatattcaaagaattaatgtaaataagtataacgggaaaagtaaattaattcttgcaatggttggtggagacccagcatggcgtat

SEQ ID NO: 434341 - DNA, 140 bp, Artificial Sequence
  Synthetic
atacgccatgctgggtctccactagtcgtttagataaaacacttaatatgagtggaagggctcaatcaacaaatcatgagccaacagctttacaagagatgtgcactgagatacccttctcgtacttgggagtcggccat

SEQ ID NO: 434342 - DNA, 140 bp, Artificial Sequence
  Synthetic
atggccgactcccaagtacgagaagggtatctcagtgcacatctcttgtaaagctgttggctcatgatttgttgattgagcccttccactcatattaagtgttttatctaaacgactagtggagacccagcatggcgtat

SEQ ID NO: 434343 - DNA, 140 bp, Artificial Sequence
  Synthetic
aggccctggctgctgatatgagtgtcatgggtgataatcaatgtataacaaccctaagtctttttccaattgatgctcctgacgattatcaagagaacgaagctgaattaaatgcagcacgaccttttgggacagcggtg

SEQ ID NO: 434344 - DNA, 140 bp, Artificial Sequence
  Synthetic
caccgctgtcccaaaaggtcgtgctgcatttaattcagcttcgttctcttgataatcgtcaggagcatcaattggaaaaagacttagggttgttatacattgattatcacccatgacactcatatcagcagccagggcct

SEQ ID NO: 434345 - DNA, 140 bp, Artificial Sequence; identical to SEQ ID NO: 377491
  Synthetic

SEQ ID NO: 434346 - DNA, 140 bp, Artificial Sequence; identical to SEQ ID NO: 377492
  Synthetic

SEQ ID NO: 434347 - DNA, 140 bp, Artificial Sequence
  Synthetic
aggccctggctgctgatatgctagaacaaattttaatatggccagttccagcaattacaacacatacatgcaatacttgaacccccctccccatgctgatcacggtgcaaaccagttgatgaccttttgggacagcggtg

SEQ ID NO: 434348 - DNA, 140 bp, Artificial Sequence
  Synthetic
caccgctgtcccaaaaggtcatcaactggtttgcaccgtgatcagcatggggaggggggttcaagtattgcatgtatgtgttgtaattgctggaactggccatattaaaatttgttctagcatatcagcagccagggcct

SEQ ID NO: 434349 - DNA, 140 bp, Artificial Sequence
  Synthetic
aggccctggctgctgatatggaaactcaattgccctccaaacctaattacaccaatcatcatccacgtgcaagatctatgagctcaacccgtagtagtacagaaagtagtcccaccaatcgaccttttgggacagcggtg

SEQ ID NO: 434350 - DNA, 140 bp, Artificial Sequence
  Synthetic
caccgctgtcccaaaaggtcgattggtgggactactttctgtactactacgggttgagctcatagatcttgcacgtggatgatgattggtgtaattaggtttggagggcaattgagtttccatatcagcagccagggcct

SEQ ID NO: 434351 - DNA, 140 bp, Artificial Sequence
  Synthetic
atacgccatgctgggtctccaaacaacatttacattctcttatgttagattatgagaacaattcacctctactagacttgagaaatcactttatttgctcattgagaggaaagataactacgtacttgggagtcggccat

SEQ ID NO: 434352 - DNA, 140 bp, Artificial Sequence
  Synthetic
atggccgactcccaagtacgtagttatctttcctctcaatgagcaaataaagtgatttctcaagtctagtagaggtgaattgttctcataatctaacataagagaatgtaaatgttgtttggagacccagcatggcgtat

SEQ ID NO: 434353 - DNA, 140 bp, Artificial Sequence
  Synthetic
atacgccatgctgggtctccacattccccgtgctcgaccaccctcaacatttaacttatcaaaaccccctcctcctccaaaggacatgtgcaggaacatgaaaattggattgccatgcaccgtacttgggagtcggccat

SEQ ID NO: 434354 - DNA, 140 bp, Artificial Sequence
  Synthetic
atggccgactcccaagtacggtgcatggcaatccaattttcatgttcctgcacatgtcctttggaggaggagggggttttgataagttaaatgttgagggtggtcgagcacggggaatgtggagacccagcatggcgtat

SEQ ID NO: 434355 - DNA, 140 bp, Artificial Sequence
  Synthetic
atacgccatgctgggtctcctctaccggaacataagtgatccgctcacttcgggtctatttcaacttaagaatgcattggaatttcttgaaaaggaagaattattctatatcttgattgccgtacttgggagtcggccat

SEQ ID NO: 434356 - DNA, 140 bp, Artificial Sequence
  Synthetic
atggccgactcccaagtacggcaatcaagatatagaataattcttccttttcaagaaattccaatgcattcttaagttgaaatagacccgaagtgagcggatcacttatgttccggtagaggagacccagcatggcgtat

SEQ ID NO: 434357 - DNA, 140 bp, Artificial Sequence
  Synthetic
atacgccatgctgggtctcctgatctcacttgtaatagagatcatgaccttgataatctaacaaatcgtgaacttttgctactgatggctcgaaaaatgctccccaatacggacaaggttcgtacttgggagtcggccat

SEQ ID NO: 434358 - DNA, 140 bp, Artificial Sequence
  Synthetic
atggccgactcccaagtacgaaccttgtccgtattggggagcatttttcgagccatcagtagcaaaagttcacgatttgttagattatcaaggtcatgatctctattacaagtgagatcaggagacccagcatggcgtat

SEQ ID NO: 434359 - DNA, 140 bp, Artificial Sequence
  Synthetic
atacgccatgctgggtctccaaaagacaaacaggagcaaacaaaagatgtgttgaccttggaaaatctaggacatattctgaactatctccacagatcggaaattgggaaattggatgagcgtacttgggagtcggccat

SEQ ID NO: 434360 - DNA, 140 bp, Artificial Sequence
  Synthetic
atggccgactcccaagtacgctcatccaatttcccaatttccgatctgtggagatagttcagaatatgtcctagattttccaaggtcaacacatcttttgtttgctcctgtttgtcttttggagacccagcatggcgtat

SEQ ID NO: 434361 - DNA, 140 bp, Artificial Sequence
  Synthetic
atacgccatgctgggtctccacatcacttcgtgcagcattaagtttgacgtgtgccggaattcgaaagacaaatagatctttgatcaacactatgacagaattacacattaatcatgaaacgtacttgggagtcggccat

SEQ ID NO: 434362 - DNA, 140 bp, Artificial Sequence
  Synthetic
atggccgactcccaagtacgtttcatgattaatgtgtaattctgtcatagtgttgatcaaagatctatttgtctttcgaattccggcacacgtcaaacttaatgctgcacgaagtgatgtggagacccagcatggcgtat

SEQ ID NO: 434363 - DNA, 140 bp, Artificial Sequence
  Synthetic
atacgccatgctgggtctccacctcccgcaagaccaaaacggtgttatcaagcagacatatacaggtattcaccttgacaaaggaggtcaattcgaagccgccttatggcaaggttgggacgtacttgggagtcggccat

SEQ ID NO: 434364 - DNA, 140 bp, Artificial Sequence
  Synthetic
atggccgactcccaagtacgtcccaaccttgccataaggcggcttcgaattgacctcctttgtcaaggtgaatacctgtatatgtctgcttgataacaccgttttggtcttgcgggaggtggagacccagcatggcgtat

SEQ ID NO: 434365 - DNA, 140 bp, Artificial Sequence
  Synthetic
atacgccatgctgggtctccatgtactgttgatgtagctaatttcttgagggcatattcatggtctgacgtcttaaaagggaaaaggctaattggtgccacactgccatgtttactagagcgtacttgggagtcggccat

SEQ ID NO: 434366 - DNA, 140 bp, Artificial Sequence
  Synthetic
atggccgactcccaagtacgctctagtaaacatggcagtgtggcaccaattagccttttcccttttaagacgtcagaccatgaatatgccctcaagaaattagctacatcaacagtacatggagacccagcatggcgtat

SEQ ID NO: 434367 - DNA, 140 bp, Artificial Sequence
  Synthetic
aggccctggctgctgatatgtcttaaaagggaaaaggctaattggtgccacactgccatgtttactagagcaatttaaggtaaagtggattaatttatctgaggatttaagggaacaattgaccttttgggacagcggtg

SEQ ID NO: 434368 - DNA, 140 bp, Artificial Sequence
  Synthetic
caccgctgtcccaaaaggtcaattgttcccttaaatcctcagataaattaatccactttaccttaaattgctctagtaaacatggcagtgtggcaccaattagccttttcccttttaagacatatcagcagccagggcct

SEQ ID NO: 434369 - DNA, 140 bp, Artificial Sequence
  Synthetic
aggccctggctgctgatatgatatcccctgtgaatcatcaatcagtgtgcaagcctcatacgaccattttattcttcctcaaagtcaaggtaaaggacagtgattattgttcgaaggttggaccttttgggacagcggtg

SEQ ID NO: 434370 - DNA, 140 bp, Artificial Sequence
  Synthetic
caccgctgtcccaaaaggtccaaccttcgaacaataatcactgtcctttaccttgactttgaggaagaataaaatggtcgtatgaggcttgcacactgattgatgattcacaggggatatcatatcagcagccagggcct

SEQ ID NO: 434371 - DNA, 140 bp, Artificial Sequence
  Synthetic
atacgccatgctgggtctcccagacccaagtgactacagatatattcttcaataaaggaagctcagtctaactcacagaaataatctacttcaaaacaaggatcacccattttggaacatcgtacttgggagtcggccat

SEQ ID NO: 434372 - DNA, 140 bp, Artificial Sequence
  Synthetic
atggccgactcccaagtacgatgttccaaaatgggtgatccttgttttgaagtagattatttctgtgagttagactgagcttcctttattgaagaatatatctgtagtcacttgggtctgggagacccagcatggcgtat

SEQ ID NO: 434373 - DNA, 140 bp, Artificial Sequence
  Synthetic
atacgccatgctgggtctccttaaaaactttcaaacggtcccccgcccttgtcaaaaaagcctccgagctgttcccccaaatccaacaattgacaagggatgggtctgtgtctattcatccgtacttgggagtcggccat

SEQ ID NO: 434374 - DNA, 140 bp, Artificial Sequence
  Synthetic
atggccgactcccaagtacggatgaatagacacagacccatcccttgtcaattgttggatttgggggaacagctcggaggcttttttgacaagggcgggggaccgtttgaaagtttttaaggagacccagcatggcgtat

SEQ ID NO: 434375 - DNA, 140 bp, Artificial Sequence
  Synthetic
atacgccatgctgggtctcctgatattaaaacattaaatggacatttgagttttatgcctagaataatataaagaaatttaagagacatttagatatatcagttgaattgatttatgacacgtacttgggagtcggccat

SEQ ID NO: 434376 - DNA, 140 bp, Artificial Sequence
  Synthetic
atggccgactcccaagtacgtgtcataaatcaattcaactgatatatctaaatgtctcttaaatttctttatattattctaggcataaaactcaaatgtccatttaatgttttaatatcaggagacccagcatggcgtat

SEQ ID NO: 434377 - DNA, 140 bp, Artificial Sequence; identical to SEQ ID NO: 377511
  Synthetic

SEQ ID NO: 434378 - DNA, 140 bp, Artificial Sequence; identical to SEQ ID NO: 377512
  Synthetic

SEQ ID NO: 434379 - DNA, 140 bp, Artificial Sequence
  Synthetic
aggccctggctgctgatatgttaactaaacctgaatatcctttgttgatacctctgagggacaactcttgacaccagaccacggatcaaacatattttaatcaaacaccctaaatttttagaccttttgggacagcggtg

SEQ ID NO: 434380 - DNA, 140 bp, Artificial Sequence
  Synthetic
caccgctgtcccaaaaggtctaaaaatttagggtgtttgattaaaatatgtttgatccgtggtctggtgtcaagagttgtccctcagaggtatcaacaaaggatattcaggtttagttaacatatcagcagccagggcct

SEQ ID NO: 434381 - DNA, 140 bp, Artificial Sequence
  Synthetic
atacgccatgctgggtctccacaccagaccacggatcaaacatattttaatcaaacaccctaaatttttaatcatacacacaataatcactttggtagcgttacctttcagtacagtatacgtacttgggagtcggccat

SEQ ID NO: 434382 - DNA, 140 bp, Artificial Sequence
  Synthetic
atggccgactcccaagtacgtatactgtactgaaaggtaacgctaccaaagtgattattgtgtgtatgattaaaaatttagggtgtttgattaaaatatgtttgatccgtggtctggtgtggagacccagcatggcgtat

SEQ ID NO: 434383 - DNA, 140 bp, Artificial Sequence
  Synthetic
aggccctggctgctgatatgggtaatcgaggaaagacttctgagcatggcagaattatcaacgcgttacaacttgcctgcaaatgttacagaaaagagcataaatcttgaccttaattccgaccttttgggacagcggtg

SEQ ID NO: 434384 - DNA, 140 bp, Artificial Sequence
  Synthetic
caccgctgtcccaaaaggtcggaattaaggtcaagatttatgctcttttctgtaacatttgcaggcaagttgtaacgcgttgataattctgccatgctcagaagtctttcctcgattacccatatcagcagccagggcct

SEQ ID NO: 434385 - DNA, 140 bp, Artificial Sequence
  Synthetic
atacgccatgctgggtctccacagcacgatggataaaagaacccagtgttgggggctggacagtgaagtgggggaactttgttttccacataccaaatactggaatgacattgttgcatccgtacttgggagtcggccat

SEQ ID NO: 434386 - DNA, 140 bp, Artificial Sequence
  Synthetic
atggccgactcccaagtacggatgcaacaatgtcattccagtatttggtatgtggaaaacaaagttcccccacttcactgtccagcccccaacactgggttcttttatccatcgtgctgtggagacccagcatggcgtat

SEQ ID NO: 434387 - DNA, 140 bp, Artificial Sequence
  Synthetic
atacgccatgctgggtctcctcaggaatttatcacatagatcacttcggattcttcaatctaccttccgacatgaattggtgctcacccgactagcccaccacataccgttaatttctttcgtacttgggagtcggccat

SEQ ID NO: 434388 - DNA, 140 bp, Artificial Sequence
  Synthetic
atggccgactcccaagtacgaaagaaattaacggtatgtggtgggctagtcgggtgagcaccaattcatgtcggaaggtagattgaagaatccgaagtgatctatgtgataaattcctgaggagacccagcatggcgtat

SEQ ID NO: 434389 - DNA, 140 bp, Artificial Sequence
  Synthetic
atacgccatgctgggtctccttttctcatctctttaaaaaccccaagtcaacaattatagaaccgttcttggccctgaggatcttgcttggagttgctttgaaggatcaagaattacagccgtacttgggagtcggccat

SEQ ID NO: 434390 - DNA, 140 bp, Artificial Sequence
  Synthetic
atggccgactcccaagtacggctgtaattcttgatccttcaaagcaactccaagcaagatcctcagggccaagaacggttctataattgttgacttggggtttttaaagagatgagaaaaggagacccagcatggcgtat

SEQ ID NO: 434391 - DNA, 140 bp, Artificial Sequence
  Synthetic
atacgccatgctgggtctccccctggaatcgaaggactttatactgctggtttaattaaaaaccaaaacaatttggtctgcaggttgaggcgtctagccaatcaaactgccaaatccttgcgtacttgggagtcggccat

SEQ ID NO: 434392 - DNA, 140 bp, Artificial Sequence
  Synthetic
atggccgactcccaagtacgcaaggatttggcagtttgattggctagacgcctcaacctgcagaccaaattgttttggtttttaattaaaccagcagtataaagtccttcgattccagggggagacccagcatggcgtat

SEQ ID NO: 434393 - DNA, 140 bp, Artificial Sequence
  Synthetic
atacgccatgctgggtctcctgttatcacctgataaagttcaaaagcatcaaattttagctgacacctgttgtccaattgacagcttttgggtctatccaagcaagtccacaaggaccaacgtacttgggagtcggccat

SEQ ID NO: 434394 - DNA, 140 bp, Artificial Sequence
  Synthetic
atggccgactcccaagtacgttggtccttgtggacttgcttggatagacccaaaagctgtcaattggacaacaggtgtcagctaaaatttgatgcttttgaactttatcaggtgataacaggagacccagcatggcgtat

SEQ ID NO: 434395 - DNA, 140 bp, Artificial Sequence
  Synthetic
aggccctggctgctgatatgccaagcagtattgaaataaagttaactggacaacagatcattatcactcgtgttaatatggggtttctagtggaagtcaggcgaattgacattgaaccttgaccttttgggacagcggtg

SEQ ID NO: 434396 - DNA, 140 bp, Artificial Sequence
  Synthetic
caccgctgtcccaaaaggtcaaggttcaatgtcaattcgcctgacttccactagaaaccccatattaacacgagtgataatgatctgttgtccagttaactttatttcaatactgcttggcatatcagcagccagggcct

SEQ ID NO: 434397 - DNA, 140 bp, Artificial Sequence
  Synthetic
aggccctggctgctgatatgagaatactcctttttcgcatttgataaattgttcatttcttgaactttcttcacataccagttcagtctcttcaaatcaacaagtgaccaattcaaaatagaccttttgggacagcggtg

SEQ ID NO: 434398 - DNA, 140 bp, Artificial Sequence
  Synthetic
caccgctgtcccaaaaggtctattttgaattggtcacttgttgatttgaagagactgaactggtatgtgaagaaagttcaagaaatgaacaatttatcaaatgcgaaaaaggagtattctcatatcagcagccagggcct

SEQ ID NO: 434399 - DNA, 140 bp, Artificial Sequence
  Synthetic
aggccctggctgctgatatggaggcagttctaagagaacacagccagatggagaagggccaacccctcaacctgacacaatacatgaacagcaaaattgccatataagtagcttaaattagaccttttgggacagcggtg

SEQ ID NO: 434400 - DNA, 140 bp, Artificial Sequence
  Synthetic
caccgctgtcccaaaaggtctaatttaagctacttatatggcaattttgctgttcatgtattgtgtcaggttgaggggttggcccttctccatctggctgtgttctcttagaactgcctccatatcagcagccagggcct

SEQ ID NO: 434401 - DNA, 140 bp, Artificial Sequence
  Synthetic
aggccctggctgctgatatgtaaattatggatcaacagatctacaggggatggatatcaagatgccactctcggagcaaaatctggttgaaaattgtcaatcatcaaagggcattagattgaccttttgggacagcggtg

SEQ ID NO: 434402 - DNA, 140 bp, Artificial Sequence
  Synthetic
caccgctgtcccaaaaggtcaatctaatgccctttgatgattgacaattttcaaccagattttgctccgagagtggcatcttgatatccatcccctgtagatctgttgatccataatttacatatcagcagccagggcct

SEQ ID NO: 434403 - DNA, 140 bp, Artificial Sequence
  Synthetic
aggccctggctgctgatatgtttcaaccggaagaaccactgcaccagctgctgcctttgatgcttacttaaatgagcatggtgtccctcccccccaacccgcgattttcaaagatcttgggaccttttgggacagcggtg

SEQ ID NO: 434404 - DNA, 140 bp, Artificial Sequence
  Synthetic
caccgctgtcccaaaaggtcccaagatctttgaaaatcgcgggttgggggggagggacaccatgctcatttaagtaagcatcaaaggcagcagctggtgcagtggttcttccggttgaaacatatcagcagccagggcct

SEQ ID NO: 434405 - DNA, 140 bp, Artificial Sequence
  Synthetic
atacgccatgctgggtctcccaaggacaatccaaaaacaacaaaacatgaccagggatgtgtggggaaggactcttcaccgcgacaaatgtcccctgaagacaacatgcagactcctgcacgtacttgggagtcggccat

SEQ ID NO: 434406 - DNA, 140 bp, Artificial Sequence
  Synthetic
atggccgactcccaagtacgtgcaggagtctgcatgttgtcttcaggggacatttgtcgcggtgaagagtccttccccacacatccctggtcatgttttgttgtttttggattgtccttgggagacccagcatggcgtat

SEQ ID NO: 434407 - DNA, 140 bp, Artificial Sequence
  Synthetic
atacgccatgctgggtctccgaactcttattaagagtcacaaccgaggaaaggacattttccttaattaatagacatgccattgactttctactcacaaggtggggaggaacatgcaaagcgtacttgggagtcggccat

SEQ ID NO: 434408 - DNA, 140 bp, Artificial Sequence
  Synthetic
atggccgactcccaagtacgctttgcatgttcctccccaccttgtgagtagaaagtcaatggcatgtctattaattaaggaaaatgtcctttcctcggttgtgactcttaataagagttcggagacccagcatggcgtat

SEQ ID NO: 434409 - DNA, 140 bp, Artificial Sequence
  Synthetic
aggccctggctgctgatatgtaggctgttcctataatctgattgtgagagtataaacttgtagaattaccgtgagtcacaactgttgcatatcttccaaaatatatcttttgtaggtgatgaccttttgggacagcggtg

SEQ ID NO: 434410 - DNA, 140 bp, Artificial Sequence
  Synthetic
caccgctgtcccaaaaggtcatcacctacaaaagatatattttggaagatatgcaacagttgtgactcacggtaattctacaagtttatactctcacaatcagattataggaacagcctacatatcagcagccagggcct

SEQ ID NO: 434411 - DNA, 140 bp, Artificial Sequence
  Synthetic
aggccctggctgctgatatgaccgggacagaaattttaggtataagtccgttacgatcctctagatattcatcaacttccagggaacggtctctactatctagagaacaagcttcatattgaccttttgggacagcggtg

SEQ ID NO: 434412 - DNA, 140 bp, Artificial Sequence
  Synthetic
caccgctgtcccaaaaggtcaatatgaagcttgttctctagatagtagagaccgttccctggaagttgatgaatatctagaggatcgtaacggacttatacctaaaatttctgtcccggtcatatcagcagccagggcct

SEQ ID NO: 434413 - DNA, 140 bp, Artificial Sequence
  Synthetic
aggccctggctgctgatatgtatcatgttagacgccagttatctatcttaagtgaatcctttcttcaatatgcagcatccaactcaatatcctgatgcaaggttgtcctctcctatagtcgaccttttgggacagcggtg

SEQ ID NO: 434414 - DNA, 140 bp, Artificial Sequence
  Synthetic
caccgctgtcccaaaaggtcgactataggagaggacaaccttgcatcaggatattgagttggatgctgcatattgaagaaaggattcacttaagatagataactggcgtctaacatgatacatatcagcagccagggcct

SEQ ID NO: 434415 - DNA, 140 bp, Artificial Sequence
  Synthetic
atacgccatgctgggtctccctagaccagtgtgatttattagccagaagtttagggttatacagtcattattcacataatccgaaattgcgtaattgtaggattccacatcacatttacccgtacttgggagtcggccat

SEQ ID NO: 434416 - DNA, 140 bp, Artificial Sequence
  Synthetic
atggccgactcccaagtacgggtaaatgtgatgtggaatcctacaattacgcaatttcggattatgtgaataatgactgtataaccctaaacttctggctaataaatcacactggtctagggagacccagcatggcgtat

SEQ ID NO: 434417 - DNA, 140 bp, Artificial Sequence
  Synthetic
atacgccatgctgggtctccgtttaaggaattcaacagcattaaagacatttcttcagaactgttcaatactcaccgttccttttcattcaatttgggaccatattttaacttccattcacgtacttgggagtcggccat

SEQ ID NO: 434418 - DNA, 140 bp, Artificial Sequence
  Synthetic
atggccgactcccaagtacgtgaatggaagttaaaatatggtcccaaattgaatgaaaaggaacggtgagtattgaacagttctgaagaaatgtctttaatgctgttgaattccttaaacggagacccagcatggcgtat

SEQ ID NO: 434419 - DNA, 140 bp, Artificial Sequence
  Synthetic
aggccctggctgctgatatgctcaccgttccttttcattcaatttgggaccatattttaacttccattcaatatgatgcaattaatcatgttgatgattttaaatacctattgccatctggaccttttgggacagcggtg

SEQ ID NO: 434420 - DNA, 140 bp, Artificial Sequence
  Synthetic
caccgctgtcccaaaaggtccagatggcaataggtatttaaaatcatcaacatgattaattgcatcatattgaatggaagttaaaatatggtcccaaattgaatgaaaaggaacggtgagcatatcagcagccagggcct

SEQ ID NO: 434421 - DNA, 140 bp, Artificial Sequence
  Synthetic
atacgccatgctgggtctccagctagtcaagtatgcaaattgggacaacgagttcctaaagacatatcttaataagatcttaagactagatcatgtttttccagcttctgcaaggtcacacgtacttgggagtcggccat

SEQ ID NO: 434422 - DNA, 140 bp, Artificial Sequence
  Synthetic
atggccgactcccaagtacgtgtgaccttgcagaagctggaaaaacatgatctagtcttaagatcttattaagatatgtctttaggaactcgttgtcccaatttgcatacttgactagctggagacccagcatggcgtat

SEQ ID NO: 434423 - DNA, 140 bp, Artificial Sequence
  Synthetic
atacgccatgctgggtctccatgtgaggatttttctcctaaggaaaacccttattattgggggatgttgttactcgtacatttatctcaacttgccagaaggataaaaggacaaagagggcgtacttgggagtcggccat

SEQ ID NO: 434424 - DNA, 140 bp, Artificial Sequence
  Synthetic
atggccgactcccaagtacgccctctttgtccttttatccttctggcaagttgagataaatgtacgagtaacaacatcccccaataataagggttttccttaggagaaaaatcctcacatggagacccagcatggcgtat

SEQ ID NO: 434425 - DNA, 140 bp, Artificial Sequence
  Synthetic
atacgccatgctgggtctcctcattaagaagtaactggaagtttataggaacagatttggagttgtttggaatagcagactttattatttttaaggttccagtaaaaacgataatccggacgtacttgggagtcggccat

SEQ ID NO: 434426 - DNA, 140 bp, Artificial Sequence
  Synthetic
atggccgactcccaagtacgtccggattatcgtttttactggaaccttaaaaataataaagtctgctattccaaacaactccaaatctgttcctataaacttccagttacttcttaatgaggagacccagcatggcgtat

SEQ ID NO: 434427 - DNA, 140 bp, Artificial Sequence
  Synthetic
aggccctggctgctgatatggaccaaaacttgaccccttatctatgtgacgatgagtttattgtaagcgtcgctagttatgaatgttttattatgattaaagacgtcttcattgagaggtgaccttttgggacagcggtg

SEQ ID NO: 434428 - DNA, 140 bp, Artificial Sequence
  Synthetic
caccgctgtcccaaaaggtcacctctcaatgaagacgtctttaatcataataaaacattcataactagcgacgcttacaataaactcatcgtcacatagataaggggtcaagttttggtccatatcagcagccagggcct

SEQ ID NO: 434429 - DNA, 140 bp, Artificial Sequence
  Synthetic
aggccctggctgctgatatgcgctagttatgaatgttttattatgattaaagacgtcttcattgagaggtataacacatgggaaatatgtgcccgcgcttggctcgaagacagtgatggagaccttttgggacagcggtg

SEQ ID NO: 434430 - DNA, 140 bp, Artificial Sequence
  Synthetic
caccgctgtcccaaaaggtctccatcactgtcttcgagccaagcgcgggcacatatttcccatgtgttatacctctcaatgaagacgtctttaatcataataaaacattcataactagcgcatatcagcagccagggcct

SEQ ID NO: 434431 - DNA, 140 bp, Artificial Sequence
  Synthetic
atacgccatgctgggtctccgcagaaagcgaacaagccaatgctcagttgaacacaactctagatcctacagaaaatcccaccacagcacaagacaccaacagcacaaccaacatcgtcacgtacttgggagtcggccat

SEQ ID NO: 434432 - DNA, 140 bp, Artificial Sequence
  Synthetic
atggccgactcccaagtacgtgacgatgttggttgtgctgttggtgtcttgtgctgtggtgggattttctgtaggatctagagttgtgttcaactgagcattggcttgttcgctttctgcggagacccagcatggcgtat

SEQ ID NO: 434433 - DNA, 140 bp, Artificial Sequence; identical to SEQ ID NO: 377503
  Synthetic

SEQ ID NO: 434434 - DNA, 140 bp, Artificial Sequence; identical to SEQ ID NO: 377504
  Synthetic

SEQ ID NO: 434435 - DNA, 140 bp, Artificial Sequence
  Synthetic
aggccctggctgctgatatgccaaattattgccatgtacctggaggacggtttcaaattgattaaacacttagaacccttgtgtgtcagctgtatacaaacacacggcatcttcacaccagaccttttgggacagcggtg

SEQ ID NO: 434436 - DNA, 140 bp, Artificial Sequence
  Synthetic
caccgctgtcccaaaaggtctggtgtgaagatgccgtgtgtttgtatacagctgacacacaagggttctaagtgtttaatcaatttgaaaccgtcctccaggtacatggcaataatttggcatatcagcagccagggcct

SEQ ID NO: 434437 - DNA, 140 bp, Artificial Sequence
  Synthetic
aggccctggctgctgatatgctgtatacaaacacatggcatctttacaccaagaaaatactggttccaatcacagatgattaagtcatattatgatgaactccatgatctcaatttgaaagaccttttgggacagcggtg

SEQ ID NO: 434438 - DNA, 140 bp, Artificial Sequence
  Synthetic
caccgctgtcccaaaaggtctttcaaattgagatcatggagttcatcataatatgacttaatcatctgtgattggaaccagtattttcttggtgtaaagatgccatgtgtttgtatacagcatatcagcagccagggcct

SEQ ID NO: 434439 - DNA, 140 bp, Artificial Sequence
  Synthetic
aggccctggctgctgatatgcccaaaactttattaaaaccataattcaggcaagattgacccctcagcaatactgtgaattattctctctacaaaaacattggggtcatcccgttttatagaccttttgggacagcggtg

SEQ ID NO: 434440 - DNA, 140 bp, Artificial Sequence
  Synthetic
caccgctgtcccaaaaggtctataaaacgggatgaccccaatgtttttgtagagagaataattcacagtattgctgaggggtcaatcttgcctgaattatggttttaataaagttttgggcatatcagcagccagggcct

SEQ ID NO: 434441 - DNA, 140 bp, Artificial Sequence
  Synthetic
atacgccatgctgggtctccaccatatatcattaatataaaagaacgatctgctataatctataggcatctcttttacatacattggggaaagaactaggttatcgttgagattagaaggcgtacttgggagtcggccat

SEQ ID NO: 434442 - DNA, 140 bp, Artificial Sequence
  Synthetic
atggccgactcccaagtacgccttctaatctcaacgataacctagttctttccccaatgtatgtaaaagagatgcctatagattatagcagatcgttcttttatattaatgatatatggtggagacccagcatggcgtat

SEQ ID NO: 434443 - DNA, 140 bp, Artificial Sequence
  Synthetic
atacgccatgctgggtctcccaatgatgttgcactagataaggttaaaaaacatgcgcaagctacaaaaatcttaaaacctaaagtcatgttcgaaaccttttgtgttttcaaatttatacgtacttgggagtcggccat

SEQ ID NO: 434444 - DNA, 140 bp, Artificial Sequence
  Synthetic
atggccgactcccaagtacgtataaatttgaaaacacaaaaggtttcgaacatgactttaggttttaagatttttgtagcttgcgcatgttttttaaccttatctagtgcaacatcattgggagacccagcatggcgtat

SEQ ID NO: 434445 - DNA, 140 bp, Artificial Sequence
  Synthetic
aggccctggctgctgatatgcttactttacacaagataatcttatatcaccttaagccttacataagtgagaaaatcacgcgcacagattaacttgtgatagaacgttcggtcacgccaggaccttttgggacagcggtg

SEQ ID NO: 434446 - DNA, 140 bp, Artificial Sequence
  Synthetic
caccgctgtcccaaaaggtcctggcgtgaccgaacgttctatcacaagttaatctgtgcgcgtgattttctcacttatgtaaggcttaaggtgatataagattatcttgtgtaaagtaagcatatcagcagccagggcct

SEQ ID NO: 434447 - DNA, 140 bp, Artificial Sequence
  Synthetic
atacgccatgctgggtctccgtagcaaagaatcattatcattctcaaggatcatggtataaaaccacacatgatttgcatttgactccatatcttagacaacatattgtgtcaaattcatcgtacttgggagtcggccat

SEQ ID NO: 434448 - DNA, 140 bp, Artificial Sequence
  Synthetic
atggccgactcccaagtacgatgaatttgacacaatatgttgtctaagatatggagtcaaatgcaaatcatgtgtggttttataccatgatccttgagaatgataatgattctttgctacggagacccagcatggcgtat

SEQ ID NO: 434449 - DNA, 140 bp, Artificial Sequence
  Synthetic
atacgccatgctgggtctccttccgtcacaagccgaaatttatcaacatctttgggagtggtattttgtggagcatgaacctcttttttcaactaaaattataagtgatttaagcattttcgtacttgggagtcggccat

SEQ ID NO: 434450 - DNA, 140 bp, Artificial Sequence
  Synthetic
atggccgactcccaagtacgaaaatgcttaaatcacttataattttagttgaaaaaagaggttcatgctccacaaaataccactcccaaagatgttgataaatttcggcttgtgacggaaggagacccagcatggcgtat

SEQ ID NO: 434451 - DNA, 140 bp, Artificial Sequence
  Synthetic
atacgccatgctgggtctccttctccaagccaaacctctcagccaaggatttagcccttttattgtttacccatctacccggcaacaacactccattccacatcctagctcaggtcctttcgtacttgggagtcggccat

SEQ ID NO: 434452 - DNA, 140 bp, Artificial Sequence
  Synthetic
atggccgactcccaagtacgaaaggacctgagctaggatgtggaatggagtgttgttgccgggtagatgggtaaacaataaaagggctaaatccttggctgagaggtttggcttggagaaggagacccagcatggcgtat

SEQ ID NO: 434453 - DNA, 140 bp, Artificial Sequence
  Synthetic
atacgccatgctgggtctcctacaagattagtttgtattgatttcaacaatgctttaaccttacattgctgctttaaatagttgattaagctgatcagcttgtaatatgtaatctcttctcgtacttgggagtcggccat

SEQ ID NO: 434454 - DNA, 140 bp, Artificial Sequence
  Synthetic
atggccgactcccaagtacgagaagagattacatattacaagctgatcagcttaatcaactatttaaagcagcaatgtaaggttaaagcattgttgaaatcaatacaaactaatcttgtaggagacccagcatggcgtat

SEQ ID NO: 434455 - DNA, 140 bp, Artificial Sequence
  Synthetic
aggccctggctgctgatatgatgtaaatgtaaattaagaaaaaccaatatataaaattaaaaaattaaaaaactttgatataagtaacacaaaacattcttcatctttttagtgtgtccagaccttttgggacagcggtg

SEQ ID NO: 434456 - DNA, 140 bp, Artificial Sequence
  Synthetic
caccgctgtcccaaaaggtctggacacactaaaaagatgaagaatgttttgtgttacttatatcaaagttttttaattttttaattttatatattggtttttcttaatttacatttacatcatatcagcagccagggcct

SEQ ID NO: 434457 - DNA, 140 bp, Artificial Sequence
  Synthetic
atacgccatgctgggtctccttataagttcaaaacgttgtaaattatacttgcataaaatactgttttaattaagaaaaactatgaagaacattaagtggatttttccttcttagtgttccgtacttgggagtcggccat

SEQ ID NO: 434458 - DNA, 140 bp, Artificial Sequence
  Synthetic
atggccgactcccaagtacggaacactaagaaggaaaaatccacttaatgttcttcatagtttttcttaattaaaacagtattttatgcaagtataatttacaacgttttgaacttataaggagacccagcatggcgtat

SEQ ID NO: 434459 - DNA, 140 bp, Artificial Sequence
  Synthetic
aggccctggctgctgatatggttgatgactttaaatacctattgccctctgagctagtcaagtatgcaaattgggacaacgagtttttgaaggcatatcttaataagatcttaggacttggaccttttgggacagcggtg

SEQ ID NO: 434460 - DNA, 140 bp, Artificial Sequence
  Synthetic
caccgctgtcccaaaaggtccaagtcctaagatcttattaagatatgccttcaaaaactcgttgtcccaatttgcatacttgactagctcagagggcaataggtatttaaagtcatcaaccatatcagcagccagggcct

SEQ ID NO: 434461 - DNA, 140 bp, Artificial Sequence
  Synthetic
aggccctggctgctgatatgtcagcaagcataggggaaaacgccatagtgaggggtgcgagttttgttactgatcttgagaaatacaaccttgccttccgatatgaatttacacggcattgaccttttgggacagcggtg

SEQ ID NO: 434462 - DNA, 140 bp, Artificial Sequence
  Synthetic
caccgctgtcccaaaaggtcaatgccgtgtaaattcatatcggaaggcaaggttgtatttctcaagatcagtaacaaaactcgcacccctcactatggcgttttcccctatgcttgctgacatatcagcagccagggcct

SEQ ID NO: 434463 - DNA, 140 bp, Artificial Sequence
  Synthetic
atacgccatgctgggtctcctcataaactactgtaatcgatgttatggtgtgaagaatttattcgattggatgcactttttaataccactatgttatatgcatgtcagtgatttttatagcgtacttgggagtcggccat

SEQ ID NO: 434464 - DNA, 140 bp, Artificial Sequence
  Synthetic
atggccgactcccaagtacgctataaaaatcactgacatgcatataacatagtggtattaaaaagtgcatccaatcgaataaattcttcacaccataacatcgattacagtagtttatgaggagacccagcatggcgtat

SEQ ID NO: 434465 - DNA, 140 bp, Artificial Sequence
  Synthetic
atacgccatgctgggtctcccccaccacattgtgtgacagaagataaccgaaataacccacctgattgtgctaatgcttatcattatcacttaggaggtatagagggacttcaacagaaacgtacttgggagtcggccat

SEQ ID NO: 434466 - DNA, 140 bp, Artificial Sequence
  Synthetic
atggccgactcccaagtacgtttctgttgaagtccctctatacctcctaagtgataatgataagcattagcacaatcaggtgggttatttcggttatcttctgtcacacaatgtggtgggggagacccagcatggcgtat

SEQ ID NO: 434467 - DNA, 140 bp, Artificial Sequence
  Synthetic
atacgccatgctgggtctccttgtggacatgtatatcatgtgcccaaatcacccttgtggagttaaagactaaattaaaattaaagtccagtgtcatgggtgataaccaatgtataacaacgtacttgggagtcggccat

SEQ ID NO: 434468 - DNA, 140 bp, Artificial Sequence
  Synthetic
atggccgactcccaagtacgttgttatacattggttatcacccatgacactggactttaattttaatttagtctttaactccacaagggtgatttgggcacatgatatacatgtccacaaggagacccagcatggcgtat

SEQ ID NO: 434469 - DNA, 140 bp, Artificial Sequence
  Synthetic
atacgccatgctgggtctccctctaagtctttttccaattgatgctcccaacgattatcaagagaacgaagctgaattgaatgcggcacgagttgctgtcgaattagctattactacgggcgtacttgggagtcggccat

SEQ ID NO: 434470 - DNA, 140 bp, Artificial Sequence
  Synthetic
atggccgactcccaagtacgcccgtagtaatagctaattcgacagcaactcgtgccgcattcaattcagcttcgttctcttgataatcgttgggagcatcaattggaaaaagacttagagggagacccagcatggcgtat

SEQ ID NO: 434471 - DNA, 140 bp, Artificial Sequence
  Synthetic
aggccctggctgctgatatgagtttacgtattgttgattgttatggtttgatattcaattgttatcatagtcaagagtaaccttttctatttgatgcattaatgttttaaactacctcttgaccttttgggacagcggtg

SEQ ID NO: 434472 - DNA, 140 bp, Artificial Sequence
  Synthetic
caccgctgtcccaaaaggtcaagaggtagtttaaaacattaatgcatcaaatagaaaaggttactcttgactatgataacaattgaatatcaaaccataacaatcaacaatacgtaaactcatatcagcagccagggcct

SEQ ID NO: 434473 - DNA, 140 bp, Artificial Sequence
  Synthetic
atacgccatgctgggtctccataataaaagatgtagttgccctaatttgtattcactaacctaaaataatagtattatcacactagatagtcatcacataataagttgtttctatgaattcgtacttgggagtcggccat

SEQ ID NO: 434474 - DNA, 140 bp, Artificial Sequence
  Synthetic
atggccgactcccaagtacgaattcatagaaacaacttattatgtgatgactatctagtgtgataatactattattttaggttagtgaatacaaattagggcaactacatcttttattatggagacccagcatggcgtat

SEQ ID NO: 434475 - DNA, 140 bp, Artificial Sequence
  Synthetic
aggccctggctgctgatatgaaaaattaattgctctcataacgccccaagttttaggagggttatcatttctgaatccagagaaattgttctacaggaatataagtgatcctctcacttcgaccttttgggacagcggtg

SEQ ID NO: 434476 - DNA, 140 bp, Artificial Sequence
  Synthetic
caccgctgtcccaaaaggtcgaagtgagaggatcacttatattcctgtagaacaatttctctggattcagaaatgataaccctcctaaaacttggggcgttatgagagcaattaatttttcatatcagcagccagggcct

SEQ ID NO: 434477 - DNA, 140 bp, Artificial Sequence
  Synthetic
atacgccatgctgggtctccctgaatccagagaaattgttctacaggaatataagtgatcctctcacttcgggtctatttcaacttaaaaatgcattggaatttcttggaaagggagaatcgtacttgggagtcggccat

SEQ ID NO: 434478 - DNA, 140 bp, Artificial Sequence
  Synthetic
atggccgactcccaagtacgattctccctttccaagaaattccaatgcatttttaagttgaaatagacccgaagtgagaggatcacttatattcctgtagaacaatttctctggattcagggagacccagcatggcgtat

SEQ ID NO: 434479 - DNA, 140 bp, Artificial Sequence
  Synthetic
atacgccatgctgggtctccaagcttttgtggatggtttcaatatgtgcgtagaggttaatttaaagagatttcttgttgcacagttttttgtattacttacttgggcttgaagacatagcgtacttgggagtcggccat

SEQ ID NO: 434480 - DNA, 140 bp, Artificial Sequence
  Synthetic
atggccgactcccaagtacgctatgtcttcaagcccaagtaagtaatacaaaaaactgtgcaacaagaaatctctttaaattaacctctacgcacatattgaaaccatccacaaaagcttggagacccagcatggcgtat

SEQ ID NO: 434481 - DNA, 140 bp, Artificial Sequence
  Synthetic
aggccctggctgctgatatgtcaaaaccagggttaaagacatggtaccgtgatcaaaacttaactccttatctgtgtgatgatgaatttgttgtaagcatcgctagttatgaatgttttagaccttttgggacagcggtg

SEQ ID NO: 434482 - DNA, 140 bp, Artificial Sequence
  Synthetic
caccgctgtcccaaaaggtctaaaacattcataactagcgatgcttacaacaaattcatcatcacacagataaggagttaagttttgatcacggtaccatgtctttaaccctggttttgacatatcagcagccagggcct

SEQ ID NO: 434483 - DNA, 140 bp, Artificial Sequence
  Synthetic
atacgccatgctgggtctcctatattaagagatttgtacaatcaaggggaccaaattataaccatgtatctagaggatggtttcaaattaataaaacacttagaacctttatgtgtcagtcgtacttgggagtcggccat

SEQ ID NO: 434484 - DNA, 140 bp, Artificial Sequence
  Synthetic
atggccgactcccaagtacgactgacacataaaggttctaagtgttttattaatttgaaaccatcctctagatacatggttataatttggtccccttgattgtacaaatctcttaatataggagacccagcatggcgtat

SEQ ID NO: 434485 - DNA, 140 bp, Artificial Sequence
  Synthetic
aggccctggctgctgatatgactacagaagggacaatgttgatgaaattaagagaattaacaagaaaccgatggaaaagctggttttcttatattgatgcattggacgatgatttatctggaccttttgggacagcggtg

SEQ ID NO: 434486 - DNA, 140 bp, Artificial Sequence
  Synthetic
caccgctgtcccaaaaggtccagataaatcatcgtccaatgcatcaatataagaaaaccagcttttccatcggtttcttgttaattctcttaatttcatcaacattgtcccttctgtagtcatatcagcagccagggcct

SEQ ID NO: 434487 - DNA, 140 bp, Artificial Sequence
  Synthetic
atacgccatgctgggtctccagtctttagaaaaattcacatgtactgttgatgtggctaatttcttgagggcatattcatggtccgacgttttaaaagggaaaaggctgatcggtgccaccgtacttgggagtcggccat

SEQ ID NO: 434488 - DNA, 140 bp, Artificial Sequence
  Synthetic
atggccgactcccaagtacggtggcaccgatcagccttttcccttttaaaacgtcggaccatgaatatgccctcaagaaattagccacatcaacagtacatgtgaatttttctaaagactggagacccagcatggcgtat

SEQ ID NO: 434489 - DNA, 140 bp, Artificial Sequence
  Synthetic
atacgccatgctgggtctccattaccatgtttactagagcaatttaaggtaaaatggattaatttatctgaggatttaagggaacaatttaacctgtcttcagaatcagaattaactatacgtacttgggagtcggccat

SEQ ID NO: 434490 - DNA, 140 bp, Artificial Sequence
  Synthetic
atggccgactcccaagtacgtatagttaattctgattctgaagacaggttaaattgttcccttaaatcctcagataaattaatccattttaccttaaattgctctagtaaacatggtaatggagacccagcatggcgtat

SEQ ID NO: 434491 - DNA, 140 bp, Artificial Sequence
  Synthetic
aggccctggctgctgatatgaggatttaagggaacaatttaacctgtcttcagaatcagaattaactataaatttgttgccgtatgactgcaaggaactgcgactcggaggaagccatgagaccttttgggacagcggtg

SEQ ID NO: 434492 - DNA, 140 bp, Artificial Sequence
  Synthetic
caccgctgtcccaaaaggtctcatggcttcctccgagtcgcagttccttgcagtcatacggcaacaaatttatagttaattctgattctgaagacaggttaaattgttcccttaaatcctcatatcagcagccagggcct

SEQ ID NO: 434493 - DNA, 140 bp, Artificial Sequence
  Synthetic
atacgccatgctgggtctcccacagagttaaattatgtcagttgtgctctcgaccggaaagttgtccagaaacatccctccgttaaacgtctggcctggacgataggaaatcgagcaccacgtacttgggagtcggccat

SEQ ID NO: 434494 - DNA, 140 bp, Artificial Sequence
  Synthetic
atggccgactcccaagtacgtggtgctcgatttcctatcgtccaggccagacgtttaacggagggatgtttctggacaactttccggtcgagagcacaactgacataatttaactctgtgggagacccagcatggcgtat

SEQ ID NO: 434495 - DNA, 140 bp, Artificial Sequence
  Synthetic
atacgccatgctgggtctcctatataggctcacggacagaagataagattggttatcctcccttaagagtgaattgcccgtcagcagcacttaaagaagctattgagatggtttctagatcgtacttgggagtcggccat

SEQ ID NO: 434496 - DNA, 140 bp, Artificial Sequence
  Synthetic
atggccgactcccaagtacgatctagaaaccatctcaatagcttctttaagtgctgctgacgggcaattcactcttaagggaggataaccaatcttatcttctgtccgtgagcctatataggagacccagcatggcgtat

SEQ ID NO: 434497 - DNA, 140 bp, Artificial Sequence
  Synthetic
atacgccatgctgggtctcccttctcaattcaagagtaaatctagactaccagacagtgcttaactttttacctactcactactcaggcaacatagttcatagatataatgatcaatatgcgtacttgggagtcggccat

SEQ ID NO: 434498 - DNA, 140 bp, Artificial Sequence
  Synthetic
atggccgactcccaagtacgcatattgatcattatatctatgaactatgttgcctgagtagtgagtaggtaaaaagttaagcactgtctggtagtctagatttactcttgaattgagaagggagacccagcatggcgtat

SEQ ID NO: 434499 - DNA, 140 bp, Artificial Sequence
  Synthetic
atacgccatgctgggtctcctcacataccatttcagtcccttctaatcaacaaatgactaattcaaagtatattgttcatccagaaaatattcctgaaacgaatgcaagaaccgaattaacgtacttgggagtcggccat

SEQ ID NO: 434500 - DNA, 140 bp, Artificial Sequence
  Synthetic
atggccgactcccaagtacgttaattcggttcttgcattcgtttcaggaatattttctggatgaacaatatactttgaattagtcatttgttgattagaagggactgaaatggtatgtgaggagacccagcatggcgtat

SEQ ID NO: 434501 - DNA, 140 bp, Artificial Sequence
  Synthetic
atacgccatgctgggtctccggcaacattcctttatggcaaataggatgagcaatacatctacacgtgcaattatatcaactaatacgctgggtaaatatgctgggggaggtcaagctgccgtacttgggagtcggccat

SEQ ID NO: 434502 - DNA, 140 bp, Artificial Sequence
  Synthetic
atggccgactcccaagtacggcagcttgacctcccccagcatatttacccagcgtattagttgatataattgcacgtgtagatgtattgctcatcctatttgccataaaggaatgttgccggagacccagcatggcgtat

SEQ ID NO: 434503 - DNA, 140 bp, Artificial Sequence
  Synthetic
aggccctggctgctgatatgattatatcaactaatacgctgggtaaatatgctgggggaggtcaagctgccattgatagtaatataatcttccaaaatactattaatttaggagttgcaggaccttttgggacagcggtg

SEQ ID NO: 434504 - DNA, 140 bp, Artificial Sequence
  Synthetic
caccgctgtcccaaaaggtcctgcaactcctaaattaatagtattttggaagattatattactatcaatggcagcttgacctcccccagcatatttacccagcgtattagttgatataatcatatcagcagccagggcct

SEQ ID NO: 434505 - DNA, 140 bp, Artificial Sequence
  Synthetic
aggccctggctgctgatatgactttccgtttaatgttaaataagtgctgcacacggcatgtaccatctgaatacctattttttgataaacctttggatgtagatttgaacaagtacatgggaccttttgggacagcggtg

SEQ ID NO: 434506 - DNA, 140 bp, Artificial Sequence
  Synthetic
caccgctgtcccaaaaggtcccatgtacttgttcaaatctacatccaaaggtttatcaaaaaataggtattcagatggtacatgccgtgtgcagcacttatttaacattaaacggaaagtcatatcagcagccagggcct

SEQ ID NO: 434507 - DNA, 140 bp, Artificial Sequence
  Synthetic
atacgccatgctgggtctccttcccatatcacttgattaaaaacagggaagaactccaacatgaggaccacatgcttctttatcagtctcatcttaatccaagggataaaaactctccctcgtacttgggagtcggccat

SEQ ID NO: 434508 - DNA, 140 bp, Artificial Sequence
  Synthetic
atggccgactcccaagtacgagggagagtttttatcccttggattaagatgagactgataaagaagcatgtggtcctcatgttggagttcttccctgtttttaatcaagtgatatgggaaggagacccagcatggcgtat

SEQ ID NO: 434509 - DNA, 140 bp, Artificial Sequence; identical to SEQ ID NO: 377515
  Synthetic

SEQ ID NO: 434510 - DNA, 140 bp, Artificial Sequence; identical to SEQ ID NO: 377516
  Synthetic

SEQ ID NO: 434511 - DNA, 140 bp, Artificial Sequence
  Synthetic
atacgccatgctgggtctcccgcaaacaaatgacactggatgctttggtactcttcaagaatacaattctacgaagaaccaaacatgtgctccgtctaaaacacccccaccaccgcccaccgtacttgggagtcggccat

SEQ ID NO: 434512 - DNA, 140 bp, Artificial Sequence
  Synthetic
atggccgactcccaagtacggtgggcggtggtgggggtgttttagacggagcacatgtttggttcttcgtagaattgtattcttgaagagtaccaaagcatccagtgtcatttgtttgcgggagacccagcatggcgtat

SEQ ID NO: 434513 - DNA, 140 bp, Artificial Sequence
  Synthetic
aggccctggctgctgatatgacgaagaaccaaacatgtgctccgtctaaaacacccccaccaccgcccacagcccatccggaggtcaaacccacaagaaccccaactgatgccactagacgaccttttgggacagcggtg

SEQ ID NO: 434514 - DNA, 140 bp, Artificial Sequence
  Synthetic
caccgctgtcccaaaaggtcgtctagtggcatcagttggggttcttgtgggtttgacctccggatgggctgtgggcggtggtgggggtgttttagacggagcacatgtttggttcttcgtcatatcagcagccagggcct

SEQ ID NO: 434515 - DNA, 140 bp, Artificial Sequence
  Synthetic
atacgccatgctgggtctccttccttatatcatccacaatcaggaatttatcacatagatcacttcggattcttcaatctactttccgacatgaattagtgctcacccggctagcccacccgtacttgggagtcggccat

SEQ ID NO: 434516 - DNA, 140 bp, Artificial Sequence
  Synthetic
atggccgactcccaagtacgggtgggctagccgggtgagcactaattcatgtcggaaagtagattgaagaatccgaagtgatctatgtgataaattcctgattgtggatgatataaggaaggagacccagcatggcgtat

SEQ ID NO: 434517 - DNA, 140 bp, Artificial Sequence
  Synthetic
aggccctggctgctgatatgcgccacagcaaggaggaaacaacacaaaccactcccaagacgctgcaactaaacttgacaacaccaatacagctgcacaaccgcctacgccctcccacaagaccttttgggacagcggtg

SEQ ID NO: 434518 - DNA, 140 bp, Artificial Sequence
  Synthetic
caccgctgtcccaaaaggtcttgtgggagggcgtaggcggttgtgcagctgtattggtgttgtcaagtttagttgcagcgtcttgggagtggtttgtgttgtttcctccttgctgtggcgcatatcagcagccagggcct

SEQ ID NO: 434519 - DNA, 140 bp, Artificial Sequence
  Synthetic
atacgccatgctgggtctccacataccgttaatttctctaatgttagggggctctgcaggagagaaaagttcatcagatgctgttcgattatttcttacagcaagttaccagaatttcatcgtacttgggagtcggccat

SEQ ID NO: 434520 - DNA, 140 bp, Artificial Sequence
  Synthetic
atggccgactcccaagtacgatgaaattctggtaacttgctgtaagaaataatcgaacagcatctgatgaacttttctctcctgcagagccccctaacattagagaaattaacggtatgtggagacccagcatggcgtat

SEQ ID NO: 434521 - DNA, 140 bp, Artificial Sequence
  Synthetic
aggccctggctgctgatatgaaaaatgagccactttccctctactctgaactaaggaaatttctcttatcagcctaaaatctgatccgttaggtcatgggcccttcataatctgtttgaggaccttttgggacagcggtg

SEQ ID NO: 434522 - DNA, 140 bp, Artificial Sequence
  Synthetic
caccgctgtcccaaaaggtcctcaaacagattatgaagggcccatgacctaacggatcagattttaggctgataagagaaatttccttagttcagagtagagggaaagtggctcatttttcatatcagcagccagggcct

SEQ ID NO: 434523 - DNA, 140 bp, Artificial Sequence
  Synthetic
atacgccatgctgggtctccccacaatttcagttgtctgatgaagaagggccagtcatcactaccggtttggctttactttcctagtgaagggcaacaattgaaacctatattaaaaatccgtacttgggagtcggccat

SEQ ID NO: 434524 - DNA, 140 bp, Artificial Sequence
  Synthetic
atggccgactcccaagtacggatttttaatataggtttcaattgttgcccttcactaggaaagtaaagccaaaccggtagtgatgactggcccttcttcatcagacaactgaaattgtggggagacccagcatggcgtat

SEQ ID NO: 434525 - DNA, 140 bp, Artificial Sequence
  Synthetic
atacgccatgctgggtctccttacagagattgtcagacttgttatcacctgacaaagttcaaaggtgtaaaactttagctgacacctgttgttcaattgatagcttttgggtttatccaacgtacttgggagtcggccat

SEQ ID NO: 434526 - DNA, 140 bp, Artificial Sequence
  Synthetic
atggccgactcccaagtacgttggataaacccaaaagctatcaattgaacaacaggtgtcagctaaagttttacacctttgaactttgtcaggtgataacaagtctgacaatctctgtaaggagacccagcatggcgtat

SEQ ID NO: 434527 - DNA, 140 bp, Artificial Sequence
  Synthetic
atacgccatgctgggtctccgcaagtctacgcggactaaccattattacgcaagtcttaattattggagagacaaagctaataaggtcaagaatactcctttttcgcatttgataaattgcgtacttgggagtcggccat

SEQ ID NO: 434528 - DNA, 140 bp, Artificial Sequence
  Synthetic
atggccgactcccaagtacgcaatttatcaaatgcgaaaaaggagtattcttgaccttattagctttgtctctccaataattaagacttgcgtaataatggttagtccgcgtagacttgcggagacccagcatggcgtat

SEQ ID NO: 434529 - DNA, 140 bp, Artificial Sequence
  Synthetic
aggccctggctgctgatatggacaaagctaataaggtcaagaatactcctttttcgcatttgataaattgttcatttcttgaactttcttcacataccagttcagtctcttctaatcaacgaccttttgggacagcggtg

SEQ ID NO: 434530 - DNA, 140 bp, Artificial Sequence
  Synthetic
caccgctgtcccaaaaggtcgttgattagaagagactgaactggtatgtgaagaaagttcaagaaatgaacaatttatcaaatgcgaaaaaggagtattcttgaccttattagctttgtccatatcagcagccagggcct

SEQ ID NO: 434531 - DNA, 140 bp, Artificial Sequence
  Synthetic
atacgccatgctgggtctccttcatttcttgaactttcttcacataccagttcagtctcttctaatcaacaggtgaccaattcaaaatatattgttcatccagaagatattcctgaaatacgtacttgggagtcggccat

SEQ ID NO: 434532 - DNA, 140 bp, Artificial Sequence
  Synthetic
atggccgactcccaagtacgtatttcaggaatatcttctggatgaacaatatattttgaattggtcacctgttgattagaagagactgaactggtatgtgaagaaagttcaagaaatgaaggagacccagcatggcgtat

SEQ ID NO: 434533 - DNA, 140 bp, Artificial Sequence
  Synthetic
aggccctggctgctgatatgatgtgttaggtgagttgtacaaccagggagaccaaattattgccatgtacctggaagacggtttcaaattgattaaacacttggaacccttgtgtgtcaggaccttttgggacagcggtg

SEQ ID NO: 434534 - DNA, 140 bp, Artificial Sequence
  Synthetic
caccgctgtcccaaaaggtcctgacacacaagggttccaagtgtttaatcaatttgaaaccgtcttccaggtacatggcaataatttggtctccctggttgtacaactcacctaacacatcatatcagcagccagggcct

SEQ ID NO: 434535 - DNA, 140 bp, Artificial Sequence
  Synthetic
atacgccatgctgggtctccaatacaaggactaaattgatagagtatggatcaacagctctacagaggatggacatcaagatgccaccctcggagcagaatctggtcgaaaattgtcgaccgtacttgggagtcggccat

SEQ ID NO: 434536 - DNA, 140 bp, Artificial Sequence
  Synthetic
atggccgactcccaagtacggtcgacaattttcgaccagattctgctccgagggtggcatcttgatgtccatcctctgtagagctgttgatccatactctatcaatttagtccttgtattggagacccagcatggcgtat

SEQ ID NO: 434537 - DNA, 140 bp, Artificial Sequence
  Synthetic
atacgccatgctgggtctcccatcaaaggacatcagattcaaggacaatcaaaaaataacaaaacatgaccagagatatgagaagaaggaatcctcacaacaacaaatgtcccctgaagacgtacttgggagtcggccat

SEQ ID NO: 434538 - DNA, 140 bp, Artificial Sequence
  Synthetic
atggccgactcccaagtacgtcttcaggggacatttgttgttgtgaggattccttcttctcatatctctggtcatgttttgttattttttgattgtccttgaatctgatgtcctttgatgggagacccagcatggcgtat

SEQ ID NO: 434539 - DNA, 140 bp, Artificial Sequence
  Synthetic
aggccctggctgctgatatgcaacatgcagactcttgcgtacatgcacaattcctccccatctcaaacctttataaaatcaatagatgtacatgaggactttgatgcctcgagagtaatcgaccttttgggacagcggtg

SEQ ID NO: 434540 - DNA, 140 bp, Artificial Sequence
  Synthetic
caccgctgtcccaaaaggtcgattactctcgaggcatcaaagtcctcatgtacatctattgattttataaaggtttgagatggggaggaattgtgcatgtacgcaagagtctgcatgttgcatatcagcagccagggcct

SEQ ID NO: 434541 - DNA, 140 bp, Artificial Sequence
  Synthetic
aggccctggctgctgatatgttaaattctaaaataaataattttaaccttacggattgcaccattaatacaaatttattgacaacccctaccgggacagaatttttagatacaagcccatgaccttttgggacagcggtg

SEQ ID NO: 434542 - DNA, 140 bp, Artificial Sequence
  Synthetic
caccgctgtcccaaaaggtcatgggcttgtatctaaaaattctgtcccggtaggggttgtcaataaatttgtattaatggtgcaatccgtaaggttaaaattatttattttagaatttaacatatcagcagccagggcct

SEQ ID NO: 434543 - DNA, 140 bp, Artificial Sequence
  Synthetic
atacgccatgctgggtctcctacaatcctctaggtattcatcaactcctagagaaaggtctttactatctagagaacaagcctcatatttgtatgttgattgcagtaatattccttctatcgtacttgggagtcggccat

SEQ ID NO: 434544 - DNA, 140 bp, Artificial Sequence
  Synthetic
atggccgactcccaagtacgatagaaggaatattactgcaatcaacatacaaatatgaggcttgttctctagatagtaaagacctttctctaggagttgatgaatacctagaggattgtaggagacccagcatggcgtat

SEQ ID NO: 434545 - DNA, 140 bp, Artificial Sequence; identical to SEQ ID NO: 377519
  Synthetic

SEQ ID NO: 434546 - DNA, 140 bp, Artificial Sequence; identical to SEQ ID NO: 377520
  Synthetic

SEQ ID NO: 434547 - DNA, 140 bp, Artificial Sequence
  Synthetic
atacgccatgctgggtctcccaagggccttcatcaacaatgccacccactccatcaccacaaccaagcacgccacagcaagaaggaaacaacacagaccattcccaaagtgctgtgactgcgtacttgggagtcggccat

SEQ ID NO: 434548 - DNA, 140 bp, Artificial Sequence
  Synthetic
atggccgactcccaagtacgcagtcacagcactttgggaatggtctgtgttgtttccttcttgctgtggcgtgcttggttgtggtgatggagtgggtggcattgttgatgaaggcccttgggagacccagcatggcgtat

SEQ ID NO: 434549 - DNA, 140 bp, Artificial Sequence
  Synthetic
aggccctggctgctgatatgtgttaatcaatgcctacaaacgtgatttacatgcttgttttgatagcaatcaattctgtcggtttacaggggtagtctcatcaatgcattacaagctttagaccttttgggacagcggtg

SEQ ID NO: 434550 - DNA, 140 bp, Artificial Sequence
  Synthetic
caccgctgtcccaaaaggtctaaagcttgtaatgcattgatgagactacccctgtaaaccgacagaattgattgctatcaaaacaagcatgtaaatcacgtttgtaggcattgattaacacatatcagcagccagggcct

SEQ ID NO: 434551 - DNA, 140 bp, Artificial Sequence
  Synthetic
aggccctggctgctgatatgtcgaaaaatgctccccaatacggacaaggctttcaagagtccgcaggactgtgggtcaccgtctctttctaaagggctctcaaaagacaaacaggagcaagaccttttgggacagcggtg

SEQ ID NO: 434552 - DNA, 140 bp, Artificial Sequence
  Synthetic
caccgctgtcccaaaaggtcttgctcctgtttgtcttttgagagccctttagaaagagacggtgacccacagtcctgcggactcttgaaagccttgtccgtattggggagcatttttcgacatatcagcagccagggcct

SEQ ID NO: 434553 - DNA, 140 bp, Artificial Sequence
  Synthetic
atacgccatgctgggtctccttgccaatgtatcctcttccttatcacatgccaatcaagaaaaacaaagagtcgaagaatattaaagattctctttaatattcaaaaacagttcttaattcgtacttgggagtcggccat

SEQ ID NO: 434554 - DNA, 140 bp, Artificial Sequence
  Synthetic
atggccgactcccaagtacgaattaagaactgtttttgaatattaaagagaatctttaatattcttcgactctttgtttttcttgattggcatgtgataaggaagaggatacattggcaaggagacccagcatggcgtat

SEQ ID NO: 434555 - DNA, 140 bp, Artificial Sequence
  Synthetic
aggccctggctgctgatatgctttgcttgaatcaagaagactaatattgaacaatctaactatccaaattacagatattacaaatccattatggctagattctgtaatacaatatttaccgaccttttgggacagcggtg

SEQ ID NO: 434556 - DNA, 140 bp, Artificial Sequence
  Synthetic
caccgctgtcccaaaaggtcggtaaatattgtattacagaatctagccataatggatttgtaatatctgtaatttggatagttagattgttcaatattagtcttcttgattcaagcaaagcatatcagcagccagggcct

SEQ ID NO: 434557 - DNA, 140 bp, Artificial Sequence
  Synthetic
atacgccatgctgggtctccccaacccgaccacacaacatcttgtatatttcagaaagaaacgaagtatcctctggagggaaggcgacatgtttccttttctggacgggttaataaatgccgtacttgggagtcggccat

SEQ ID NO: 434558 - DNA, 140 bp, Artificial Sequence
  Synthetic
atggccgactcccaagtacggcatttattaacccgtccagaaaaggaaacatgtcgccttccctccagaggatacttcgtttctttctgaaatatacaagatgttgtgtggtcgggttggggagacccagcatggcgtat

SEQ ID NO: 434559 - DNA, 140 bp, Artificial Sequence
  Synthetic
atacgccatgctgggtctccttttcagtttcaactcttattgtgagacttgaacacaattctactaacttcgataagcgaccccaaattcaagtttcctgaaagctaggataacaataatcgtacttgggagtcggccat

SEQ ID NO: 434560 - DNA, 140 bp, Artificial Sequence
  Synthetic
atggccgactcccaagtacgattattgttatcctagctttcaggaaacttgaatttggggtcgcttatcgaagttagtagaattgtgttcaagtctcacaataagagttgaaactgaaaaggagacccagcatggcgtat

SEQ ID NO: 434561 - DNA, 140 bp, Artificial Sequence
  Synthetic
atacgccatgctgggtctcccccagcagaccagctatcaaatcaacatggtataactccgaattatgtgggcgacttgaatctagatgatcagtttaaagggaatgtttgtcacgccttccgtacttgggagtcggccat

SEQ ID NO: 434562 - DNA, 140 bp, Artificial Sequence
  Synthetic
atggccgactcccaagtacggaaggcgtgacaaacattccctttaaactgatcatctagattcaagtcgcccacataattcggagttataccatgttgatttgatagctggtctgctgggggagacccagcatggcgtat

SEQ ID NO: 434563 - DNA, 140 bp, Artificial Sequence
  Synthetic
aggccctggctgctgatatggatcatgaccttgataatctaacaaatcgtgaacttttgctattgatggcccgaaaaatgctccccaatacagacaagacctttagaagtccgcaggactgaccttttgggacagcggtg

SEQ ID NO: 434564 - DNA, 140 bp, Artificial Sequence
  Synthetic
caccgctgtcccaaaaggtcagtcctgcggacttctaaaggtcttgtctgtattggggagcatttttcgggccatcaatagcaaaagttcacgatttgttagattatcaaggtcatgatccatatcagcagccagggcct

SEQ ID NO: 434565 - DNA, 140 bp, Artificial Sequence
  Synthetic
atacgccatgctgggtctccggtgggaatttttctgatttgtaaagcaatgtcgcgccaaagacaagcaattccctactggttaaaacatatagaaaagaattatcctgcttcattacaccgtacttgggagtcggccat

SEQ ID NO: 434566 - DNA, 140 bp, Artificial Sequence
  Synthetic
atggccgactcccaagtacggtgtaatgaagcaggataattcttttctatatgttttaaccagtagggaattgcttgtctttggcgcgacattgctttacaaatcagaaaaattcccaccggagacccagcatggcgtat

SEQ ID NO: 434567 - DNA, 140 bp, Artificial Sequence
  Synthetic
aggccctggctgctgatatgttccctactggttaaaacatatagaaaagaattatcctgcttcattacacgagtttttcctaactttagggtttccttctttagaatcatctttctgccagaccttttgggacagcggtg

SEQ ID NO: 434568 - DNA, 140 bp, Artificial Sequence
  Synthetic
caccgctgtcccaaaaggtctggcagaaagatgattctaaagaaggaaaccctaaagttaggaaaaactcgtgtaatgaagcaggataattcttttctatatgttttaaccagtagggaacatatcagcagccagggcct

SEQ ID NO: 434569 - DNA, 140 bp, Artificial Sequence
  Synthetic
aggccctggctgctgatatgataccaaaatcctgtctcagctaaggagcttcaagcagattggcccgacatgtcatttgatgaaggagacatgttgcgatgaacttgtagtccagataacgaccttttgggacagcggtg

SEQ ID NO: 434570 - DNA, 140 bp, Artificial Sequence
  Synthetic
caccgctgtcccaaaaggtcgttatctggactacaagttcatcgcaacatgtctccttcatcaaatgacatgtcgggccaatctgcttgaagctccttagctgagacaggattttggtatcatatcagcagccagggcct

SEQ ID NO: 434571 - DNA, 140 bp, Artificial Sequence
  Synthetic
atacgccatgctgggtctcctcgttatactattccattcagtgaaggaaaggctctttttcacaaggtccagtcttatgttcgtcaaggcaaacaacatttacattctcttatgttggatcgtacttgggagtcggccat

SEQ ID NO: 434572 - DNA, 140 bp, Artificial Sequence
  Synthetic
atggccgactcccaagtacgatccaacataagagaatgtaaatgttgtttgccttgacgaacataagactggaccttgtgaaaaagagcctttccttcactgaatggaatagtataacgaggagacccagcatggcgtat

SEQ ID NO: 434573 - DNA, 140 bp, Artificial Sequence
  Synthetic
aggccctggctgctgatatgattaaggggaaagataactaaatattataacgatatattaaagttgaatctagtcatcaaggcagtagagaaaggtaaaaattggtcacaacttgttgaagaccttttgggacagcggtg

SEQ ID NO: 434574 - DNA, 140 bp, Artificial Sequence
  Synthetic
caccgctgtcccaaaaggtcttcaacaagttgtgaccaatttttacctttctctactgccttgatgactagattcaactttaatatatcgttataatatttagttatctttccccttaatcatatcagcagccagggcct

SEQ ID NO: 434575 - DNA, 140 bp, Artificial Sequence
  Synthetic
atacgccatgctgggtctcctggtaactttttaatgttagttactcaaatattattgctcataattggtattaatattgacacattgggtgagtccttgagctttatccttaatataatgcgtacttgggagtcggccat

SEQ ID NO: 434576 - DNA, 140 bp, Artificial Sequence
  Synthetic
atggccgactcccaagtacgcattatattaaggataaagctcaaggactcacccaatgtgtcaatattaataccaattatgagcaataatatttgagtaactaacattaaaaagttaccaggagacccagcatggcgtat

SEQ ID NO: 434577 - DNA, 140 bp, Artificial Sequence
  Synthetic
atacgccatgctgggtctccacccttcctaatatgcattcagtatgcatagtacatgtagatcatgagtgttttggatgtgagaaacggttattacttaaattggattttattaggaatacgtacttgggagtcggccat

SEQ ID NO: 434578 - DNA, 140 bp, Artificial Sequence
  Synthetic
atggccgactcccaagtacgtattcctaataaaatccaatttaagtaataaccgtttctcacatccaaaacactcatgatctacatgtactatgcatactgaatgcatattaggaagggtggagacccagcatggcgtat

SEQ ID NO: 434579 - DNA, 140 bp, Artificial Sequence
  Synthetic
atacgccatgctgggtctccttctttccgttcggtttgtctaaatctagatcattaagggcataactttaacaaagagaactccatttaattcacaaaaataatctatttaaaagggaggcgtacttgggagtcggccat

SEQ ID NO: 434580 - DNA, 140 bp, Artificial Sequence
  Synthetic
atggccgactcccaagtacgcctcccttttaaatagattatttttgtgaattaaatggagttctctttgttaaagttatgcccttaatgatctagatttagacaaaccgaacggaaagaaggagacccagcatggcgtat

SEQ ID NO: 434581 - DNA, 140 bp, Artificial Sequence
  Synthetic
atacgccatgctgggtctcctattattaacaacttatttttatttaatcttttaaatgcaaatcaaaagaggacatgagccaccctcattttacttcaatacgaaggaattcttcttctccgtacttgggagtcggccat

SEQ ID NO: 434582 - DNA, 140 bp, Artificial Sequence
  Synthetic
atggccgactcccaagtacggagaagaagaattccttcgtattgaagtaaaatgagggtggctcatgtcctcttttgatttgcatttaaaagattaaataaaaataagttgttaataataggagacccagcatggcgtat

SEQ ID NO: 434583 - DNA, 140 bp, Artificial Sequence
  Synthetic
atacgccatgctgggtctcccaaccaccaagccgcatcatctatatatcatgaaactcagttgccctccaaacctcactacaccaattatcatccacgtgcaagatcgatgagctcaacccgtacttgggagtcggccat

SEQ ID NO: 434584 - DNA, 140 bp, Artificial Sequence
  Synthetic
atggccgactcccaagtacgggttgagctcatcgatcttgcacgtggatgataattggtgtagtgaggtttggagggcaactgagtttcatgatatatagatgatgcggcttggtggttgggagacccagcatggcgtat

SEQ ID NO: 434585 - DNA, 140 bp, Artificial Sequence
  Synthetic
aggccctggctgctgatatgttaagcctcacacaagtgagagaattacacgcacagattaacttgtgattggatgttcggtcacaacaatggtaactatttagtgttggtcactcaaatagaccttttgggacagcggtg

SEQ ID NO: 434586 - DNA, 140 bp, Artificial Sequence
  Synthetic
caccgctgtcccaaaaggtctatttgagtgaccaacactaaatagttaccattgttgtgaccgaacatccaatcacaagttaatctgtgcgtgtaattctctcacttgtgtgaggcttaacatatcagcagccagggcct

SEQ ID NO: 434587 - DNA, 140 bp, Artificial Sequence
  Synthetic
atacgccatgctgggtctccaaaagaattgaatataggaagaacttttgggaaattaccatatcgtgtcagaaatgtccaaacactcgcagaagctttgctagcagatggactagcaaaacgtacttgggagtcggccat

SEQ ID NO: 434588 - DNA, 140 bp, Artificial Sequence
  Synthetic
atggccgactcccaagtacgttttgctagtccatctgctagcaaagcttctgcgagtgtttggacatttctgacacgatatggtaatttcccaaaagttcttcctatattcaattcttttggagacccagcatggcgtat

SEQ ID NO: 434589 - DNA, 140 bp, Artificial Sequence
  Synthetic
aggccctggctgctgatatgtgatcattcataattggtattaatattggtacattgggtgaatccttgagctttatcctttatatgatgtaaaaaattaaggaattactaagatatactagaccttttgggacagcggtg

SEQ ID NO: 434590 - DNA, 140 bp, Artificial Sequence
  Synthetic
caccgctgtcccaaaaggtctagtatatcttagtaattccttaattttttacatcatataaaggataaagctcaaggattcacccaatgtaccaatattaataccaattatgaatgatcacatatcagcagccagggcct

SEQ ID NO: 434591 - DNA, 140 bp, Artificial Sequence
  Synthetic
aggccctggctgctgatatgcaattatttatcatcgattgtttagtttgagggattccacatcatcttaaatccaataacacgattttgtttgatttttcttttaatttctacaccacaagaccttttgggacagcggtg

SEQ ID NO: 434592 - DNA, 140 bp, Artificial Sequence
  Synthetic
caccgctgtcccaaaaggtcttgtggtgtagaaattaaaagaaaaatcaaacaaaatcgtgttattggatttaagatgatgtggaatccctcaaactaaacaatcgatgataaataattgcatatcagcagccagggcct

SEQ ID NO: 434593 - DNA, 140 bp, Artificial Sequence
  Synthetic
atacgccatgctgggtctccgttaaattgagttataacataccatatatcaaagatacagaagaactgtttgctgtgagctataagcatttctgttaaatacattggggaaagagctaggcgtacttgggagtcggccat

SEQ ID NO: 434594 - DNA, 140 bp, Artificial Sequence
  Synthetic
atggccgactcccaagtacgcctagctctttccccaatgtatttaacagaaatgcttatagctcacagcaaacagttcttctgtatctttgatatatggtatgttataactcaatttaacggagacccagcatggcgtat

SEQ ID NO: 434595 - DNA, 140 bp, Artificial Sequence
  Synthetic
aggccctggctgctgatatgtgctgacatcttttcaagaacacccagtggaaaacggcttcaagtcttaggttatctggaaggaacaagaacattactagcttctcggacaatcagtttagaccttttgggacagcggtg

SEQ ID NO: 434596 - DNA, 140 bp, Artificial Sequence
  Synthetic
caccgctgtcccaaaaggtctaaactgattgtccgagaagctagtaatgttcttgttccttccagataacctaagacttgaagccgttttccactgggtgttcttgaaaagatgtcagcacatatcagcagccagggcct

SEQ ID NO: 434597 - DNA, 140 bp, Artificial Sequence
  Synthetic
aggccctggctgctgatatgttaccattgagatcaagaaaactacgttatgttttctttgatgacaagtgataaaacttcgtagttaaagttccagaatgtcaatgtgaatgtgaattaagaccttttgggacagcggtg

SEQ ID NO: 434598 - DNA, 140 bp, Artificial Sequence
  Synthetic
caccgctgtcccaaaaggtcttaattcacattcacattgacattctggaactttaactacgaagttttatcacttgtcatcaaagaaaacataacgtagttttcttgatctcaatggtaacatatcagcagccagggcct

SEQ ID NO: 434599 - DNA, 140 bp, Artificial Sequence
  Synthetic
atacgccatgctgggtctccgtcattgtgccctccattgctaagtcaactcaactgacgataatactccttctgaaatagtaagaaaaactaatgaagaacattaattgctgggtaaaagcgtacttgggagtcggccat

SEQ ID NO: 434600 - DNA, 140 bp, Artificial Sequence
  Synthetic
atggccgactcccaagtacgcttttacccagcaattaatgttcttcattagtttttcttactatttcagaaggagtattatcgtcagttgagttgacttagcaatggagggcacaatgacggagacccagcatggcgtat

SEQ ID NO: 434601 - DNA, 140 bp, Artificial Sequence
  Synthetic
atacgccatgctgggtctccaaaaactaatatataaaattaaaaaattgaaaagctttgatacaagtaacacaaaacattattcatcttttttgtgtgtcccatcttttttgtgtgtccacgtacttgggagtcggccat

SEQ ID NO: 434602 - DNA, 140 bp, Artificial Sequence
  Synthetic
atggccgactcccaagtacgtggacacacaaaaaagatgggacacacaaaaaagatgaataatgttttgtgttacttgtatcaaagcttttcaattttttaattttatatattagtttttggagacccagcatggcgtat

SEQ ID NO: 434603 - DNA, 140 bp, Artificial Sequence; identical to SEQ ID NO: 377401
  Synthetic

SEQ ID NO: 434604 - DNA, 140 bp, Artificial Sequence; identical to SEQ ID NO: 377402
  Synthetic

SEQ ID NO: 434605 - DNA, 140 bp, Artificial Sequence
  Synthetic
atacgccatgctgggtctcccgtagtagtgcagaaagtagtcccactaatcatattccccgtgctcgaccacccccaacattcaacttatcgaaaccccctcctcctccaaaagacatgtcgtacttgggagtcggccat

SEQ ID NO: 434606 - DNA, 140 bp, Artificial Sequence
  Synthetic
atggccgactcccaagtacgacatgtcttttggaggaggagggggtttcgataagttgaatgttgggggtggtcgagcacggggaatatgattagtgggactactttctgcactactacgggagacccagcatggcgtat

SEQ ID NO: 434607 - DNA, 140 bp, Artificial Sequence; identical to SEQ ID NO: 377405
  Synthetic

SEQ ID NO: 434608 - DNA, 140 bp, Artificial Sequence; identical to SEQ ID NO: 377406
  Synthetic

SEQ ID NO: 434609 - DNA, 140 bp, Artificial Sequence; identical to SEQ ID NO: 377407
  Synthetic

SEQ ID NO: 434610 - DNA, 140 bp, Artificial Sequence; identical to SEQ ID NO: 377408
  Synthetic

SEQ ID NO: 434611 - DNA, 140 bp, Artificial Sequence
  Synthetic
atacgccatgctgggtctccatgcgggctatgaatttgatgtcatcaagaatgcagatgcaacccgctttctggatgtgattcctaatgaacctcattacagccctttaattctagccctcgtacttgggagtcggccat

SEQ ID NO: 434612 - DNA, 140 bp, Artificial Sequence
  Synthetic
atggccgactcccaagtacgagggctagaattaaagggctgtaatgaggttcattaggaatcacatccagaaagcgggttgcatctgcattcttgatgacatcaaattcatagcccgcatggagacccagcatggcgtat

SEQ ID NO: 434613 - DNA, 140 bp, Artificial Sequence
  Synthetic
aggccctggctgctgatatgctggatgtgattcctaatgaacctcattacagccctttaattctagcccttaagacattggaaagtactgaatctcagagggggagaattgggctcttttgaccttttgggacagcggtg

SEQ ID NO: 434614 - DNA, 140 bp, Artificial Sequence
  Synthetic
caccgctgtcccaaaaggtcaaaagagcccaattctccccctctgagattcagtactttccaatgtcttaagggctagaattaaagggctgtaatgaggttcattaggaatcacatccagcatatcagcagccagggcct

SEQ ID NO: 434615 - DNA, 140 bp, Artificial Sequence
  Synthetic
atacgccatgctgggtctcctatcattttgcagtcttttcctcccaaaacttgtcgtcggagaccgagctagtatcgaaaaggctttaagacaagtaacagtgcatcaagaacaggggatcgtacttgggagtcggccat

SEQ ID NO: 434616 - DNA, 140 bp, Artificial Sequence
  Synthetic
atggccgactcccaagtacgatcccctgttcttgatgcactgttacttgtcttaaagccttttcgatactagctcggtctccgacgacaagttttgggaggaaaagactgcaaaatgataggagacccagcatggcgtat

SEQ ID NO: 434617 - DNA, 140 bp, Artificial Sequence
  Synthetic
atacgccatgctgggtctcccgtcacataccctaatcattggcttaccacaggccacatgaaagtaattttcgggattttgaggtccagcttcattttaaagtttgtgttgattcatcaacgtacttgggagtcggccat

SEQ ID NO: 434618 - DNA, 140 bp, Artificial Sequence
  Synthetic
atggccgactcccaagtacgttgatgaatcaacacaaactttaaaatgaagctggacctcaaaatcccgaaaattactttcatgtggcctgtggtaagccaatgattagggtatgtgacgggagacccagcatggcgtat

SEQ ID NO: 434619 - DNA, 140 bp, Artificial Sequence
  Synthetic
atacgccatgctgggtctccatgctaacccgacactcagtgctgtttaataagataattgggtacgacaatggcccttctgtacaaagggtctgattcagatagatatttgtcagattcacgtacttgggagtcggccat

SEQ ID NO: 434620 - DNA, 140 bp, Artificial Sequence
  Synthetic
atggccgactcccaagtacgtgaatctgacaaatatctatctgaatcagaccctttgtacagaagggccattgtcgtacccaattatcttattaaacagcactgagtgtcgggttagcatggagacccagcatggcgtat

SEQ ID NO: 434621 - DNA, 140 bp, Artificial Sequence
  Synthetic
atacgccatgctgggtctcctgtatgttgattgcagtaatattccttctatctctctagacccgggttttcggaatatgtctgatcagaatcaaattcaaatgttaatcaatgcctataacgtacttgggagtcggccat

SEQ ID NO: 434622 - DNA, 140 bp, Artificial Sequence
  Synthetic
atggccgactcccaagtacgttataggcattgattaacatttgaatttgattctgatcagacatattccgaaaacccgggtctagagagatagaaggaatattactgcaatcaacatacaggagacccagcatggcgtat

SEQ ID NO: 434623 - DNA, 140 bp, Artificial Sequence
  Synthetic
aggccctggctgctgatatgaggaacagatttggagctgtttggaatagcagattttgttatttttaaggttccagtaaaaacaataatccgaaatgctgtaagcttacaagcttcaaaagaccttttgggacagcggtg

SEQ ID NO: 434624 - DNA, 140 bp, Artificial Sequence
  Synthetic
caccgctgtcccaaaaggtcttttgaagcttgtaagcttacagcatttcggattattgtttttactggaaccttaaaaataacaaaatctgctattccaaacagctccaaatctgttcctcatatcagcagccagggcct

SEQ ID NO: 434625 - DNA, 140 bp, Artificial Sequence
  Synthetic
atacgccatgctgggtctcctgcactgttgatgtggctaatttcttgagagcatattcatggtcagatgtcttgaaaggaaaaaggttaattggtgccacactaccatgtttactggagccgtacttgggagtcggccat

SEQ ID NO: 434626 - DNA, 140 bp, Artificial Sequence
  Synthetic
atggccgactcccaagtacggctccagtaaacatggtagtgtggcaccaattaacctttttcctttcaagacatctgaccatgaatatgctctcaagaaattagccacatcaacagtgcaggagacccagcatggcgtat

SEQ ID NO: 434627 - DNA, 140 bp, Artificial Sequence
  Synthetic
atacgccatgctgggtctccacttgccaggaggataaaaggacaaagagggtcattaagaagtaactggaagtttataggaacagatttagagctgtttggaatagcagattttattattcgtacttgggagtcggccat

SEQ ID NO: 434628 - DNA, 140 bp, Artificial Sequence
  Synthetic
atggccgactcccaagtacgaataataaaatctgctattccaaacagctctaaatctgttcctataaacttccagttacttcttaatgaccctctttgtccttttatcctcctggcaagtggagacccagcatggcgtat

SEQ ID NO: 434629 - DNA, 140 bp, Artificial Sequence
  Synthetic
aggccctggctgctgatatgcaatgttggcgaacaatatcaacaactacgagaggcggcacatgatgcggaagtaaaactacaaaggcgacatgaacatcaggaaattcaagctattgccgaccttttgggacagcggtg

SEQ ID NO: 434630 - DNA, 140 bp, Artificial Sequence
  Synthetic
caccgctgtcccaaaaggtcggcaatagcttgaatttcctgatgttcatgtcgcctttgtagttttacttccgcatcatgtgccgcctctcgtagttgttgatattgttcgccaacattgcatatcagcagccagggcct

SEQ ID NO: 434631 - DNA, 140 bp, Artificial Sequence
  Synthetic
atacgccatgctgggtctccgaggatgacgaggaaaggaagatattagaacaattccaccttcagaaaactgaaatcacacacagtcagacactagccgtcctcagccagaaacgagaaacgtacttgggagtcggccat

SEQ ID NO: 434632 - DNA, 140 bp, Artificial Sequence
  Synthetic
atggccgactcccaagtacgtttctcgtttctggctgaggacggctagtgtctgactgtgtgtgatttcagttttctgaaggtggaattgttctaatatcttcctttcctcgtcatcctcggagacccagcatggcgtat

SEQ ID NO: 434633 - DNA, 140 bp, Artificial Sequence
  Synthetic
atacgccatgctgggtctcccggaacaagatccagccaaaagttatttgctgttagagaatactagattcagggatgatcagaaaatattaagacatgatcagaaagctgagaggggtgacgtacttgggagtcggccat

SEQ ID NO: 434634 - DNA, 140 bp, Artificial Sequence
  Synthetic
atggccgactcccaagtacgtcacccctctcagctttctgatcatgtcttaatattttctgatcatccctgaatctagtattctctaacagcaaataacttttggctggatcttgttccgggagacccagcatggcgtat

SEQ ID NO: 434635 - DNA, 140 bp, Artificial Sequence; identical to SEQ ID NO: 377427
  Synthetic

SEQ ID NO: 434636 - DNA, 140 bp, Artificial Sequence; identical to SEQ ID NO: 377428
  Synthetic

SEQ ID NO: 434637 - DNA, 140 bp, Artificial Sequence
  Synthetic
atacgccatgctgggtctcctacacctgtggaagtaacggttcaagccaggcccatgaatcgaccaactgctctgcctcccccagttgacgacaagattgagcatgaatctacagaagatcgtacttgggagtcggccat

SEQ ID NO: 434638 - DNA, 140 bp, Artificial Sequence
  Synthetic
atggccgactcccaagtacgatcttctgtagattcatgctcaatcttgtcgtcaactgggggaggcagagcagttggtcgattcatgggcctggcttgaaccgttacttccacaggtgtaggagacccagcatggcgtat

SEQ ID NO: 434639 - DNA, 140 bp, Artificial Sequence
  Synthetic
aggccctggctgctgatatgtgtcatttgacgaaaggagacatgttgctatgaacttgtagtccagataacacagtacggttacccacttatccactctgatacgaattatccccggatcgaccttttgggacagcggtg

SEQ ID NO: 434640 - DNA, 140 bp, Artificial Sequence
  Synthetic
caccgctgtcccaaaaggtcgatccggggataattcgtatcagagtggataagtgggtaaccgtactgtgttatctggactacaagttcatagcaacatgtctcctttcgtcaaatgacacatatcagcagccagggcct

SEQ ID NO: 434641 - DNA, 140 bp, Artificial Sequence
  Synthetic
aggccctggctgctgatatgatgcaaatccaacgctcagtgccgtttgaaatgatgctcaaatgagataggagcccatctgcataagaagcatggcttaaatgagtgtctgttaaattctgaccttttgggacagcggtg

SEQ ID NO: 434642 - DNA, 140 bp, Artificial Sequence
  Synthetic
caccgctgtcccaaaaggtcagaatttaacagacactcatttaagccatgcttcttatgcagatgggctcctatctcatttgagcatcatttcaaacggcactgagcgttggatttgcatcatatcagcagccagggcct

SEQ ID NO: 434643 - DNA, 140 bp, Artificial Sequence
  Synthetic
atacgccatgctgggtctccccacagatcagaaattgggaaattggatgagacatcactccgtgcagcattaagtttgacgtgtgctggaattcgaaagacgaatagatccttgatcaaccgtacttgggagtcggccat

SEQ ID NO: 434644 - DNA, 140 bp, Artificial Sequence
  Synthetic
atggccgactcccaagtacggttgatcaaggatctattcgtctttcgaattccagcacacgtcaaacttaatgctgcacggagtgatgtctcatccaatttcccaatttctgatctgtggggagacccagcatggcgtat

SEQ ID NO: 434645 - DNA, 140 bp, Artificial Sequence
  Synthetic
atacgccatgctgggtctcccatcgagagaatttcaagggattcctgaaccgccaagacaatcccaagacctcaataacagccaaggaaagcaggaagatgaatccacaaatccgattaacgtacttgggagtcggccat

SEQ ID NO: 434646 - DNA, 140 bp, Artificial Sequence
  Synthetic
atggccgactcccaagtacgttaatcggatttgtggattcatcttcctgctttccttggctgttattgaggtcttgggattgtcttggcggttcaggaatcccttgaaattctctcgatgggagacccagcatggcgtat

SEQ ID NO: 434647 - DNA, 140 bp, Artificial Sequence; identical to SEQ ID NO: 377435
  Synthetic

SEQ ID NO: 434648 - DNA, 140 bp, Artificial Sequence; identical to SEQ ID NO: 377436
  Synthetic

SEQ ID NO: 434649 - DNA, 140 bp, Artificial Sequence
  Synthetic
atacgccatgctgggtctccgagatggatttacatagtttgttagaattgggtacaaaacctactgctcctcatgttcgtaataagaaggtgatattattcgacacaaatcatcaggttacgtacttgggagtcggccat

SEQ ID NO: 434650 - DNA, 140 bp, Artificial Sequence
  Synthetic
atggccgactcccaagtacgtaacctgatgatttgtgtcgaataatatcaccttcttattacgaacatgaggagcagtaggttttgtacccaattctaacaaactatgtaaatccatctcggagacccagcatggcgtat

SEQ ID NO: 434651 - DNA, 140 bp, Artificial Sequence
  Synthetic
atacgccatgctgggtctccgacaatgaacaaggagttgatcttccacctcctccgttgtacgctcaggaaaaaagacaggacccaatacagcacccagcagcaaaccctcaggatccctcgtacttgggagtcggccat

SEQ ID NO: 434652 - DNA, 140 bp, Artificial Sequence
  Synthetic
atggccgactcccaagtacgagggatcctgagggtttgctgctgggtgctgtattgggtcctgtcttttttcctgagcgtacaacggaggaggtggaagatcaactccttgttcattgtcggagacccagcatggcgtat

SEQ ID NO: 434653 - DNA, 140 bp, Artificial Sequence; identical to SEQ ID NO: 377439
  Synthetic

SEQ ID NO: 434654 - DNA, 140 bp, Artificial Sequence; identical to SEQ ID NO: 377440
  Synthetic

SEQ ID NO: 434655 - DNA, 140 bp, Artificial Sequence
  Synthetic
aggccctggctgctgatatgttccgacaaagataaattcaacacaagtcctatcgcaaaatacttgcgtgatgcgggttatgaatttgatgtcatcaagaatgcagatgcaacccgctttgaccttttgggacagcggtg

SEQ ID NO: 434656 - DNA, 140 bp, Artificial Sequence
  Synthetic
caccgctgtcccaaaaggtcaaagcgggttgcatctgcattcttgatgacatcaaattcataacccgcatcacgcaagtattttgcgataggacttgtgttgaatttatctttgtcggaacatatcagcagccagggcct

SEQ ID NO: 434657 - DNA, 140 bp, Artificial Sequence
  Synthetic
atacgccatgctgggtctccctggatgtgatccccaatgaacctcattacagccctttaattctggcccttaaaacattagaaagcactgaatctcagagggggaggattgggctcttttcgtacttgggagtcggccat

SEQ ID NO: 434658 - DNA, 140 bp, Artificial Sequence
  Synthetic
atggccgactcccaagtacgaaaagagcccaatcctccccctctgagattcagtgctttctaatgttttaagggccagaattaaagggctgtaatgaggttcattggggatcacatccagggagacccagcatggcgtat

SEQ ID NO: 434659 - DNA, 140 bp, Artificial Sequence; identical to SEQ ID NO: 377443
  Synthetic

SEQ ID NO: 434660 - DNA, 140 bp, Artificial Sequence; identical to SEQ ID NO: 377444
  Synthetic

SEQ ID NO: 434661 - DNA, 140 bp, Artificial Sequence
  Synthetic
atacgccatgctgggtctcctgtcattctgcagtctttttctcccaaaacttgtcgtcggagaccgggccagtatcgaaaaggccttaagacaagtgacagtacatcaagaacagggaatcgtacttgggagtcggccat

SEQ ID NO: 434662 - DNA, 140 bp, Artificial Sequence
  Synthetic
atggccgactcccaagtacgattccctgttcttgatgtactgtcacttgtcttaaggccttttcgatactggcccggtctccgacgacaagttttgggagaaaaagactgcagaatgacaggagacccagcatggcgtat

SEQ ID NO: 434663 - DNA, 140 bp, Artificial Sequence
  Synthetic
atacgccatgctgggtctcctgtcacataccctaatcattggcttactacaggtcacatgaaagtaatttttgggatcttgaggtctagctttattttaaagtttgtgttgattcatcaacgtacttgggagtcggccat

SEQ ID NO: 434664 - DNA, 140 bp, Artificial Sequence
  Synthetic
atggccgactcccaagtacgttgatgaatcaacacaaactttaaaataaagctagacctcaagatcccaaaaattactttcatgtgacctgtagtaagccaatgattagggtatgtgacaggagacccagcatggcgtat

SEQ ID NO: 434665 - DNA, 140 bp, Artificial Sequence
  Synthetic
aggccctggctgctgatatgacagcaatcaaatttatttgaatatttgaaccaccttttagtatcctattacttgttactattgtgtgagacaacataagccatcaaataacaatcacgggaccttttgggacagcggtg

SEQ ID NO: 434666 - DNA, 140 bp, Artificial Sequence
  Synthetic
caccgctgtcccaaaaggtcccgtgattgttatttgatggcttatgttgtctcacacaatagtaacaagtaataggatactaaaaggtggttcaaatattcaaataaatttgattgctgtcatatcagcagccagggcct

SEQ ID NO: 434667 - DNA, 140 bp, Artificial Sequence
  Synthetic
atacgccatgctgggtctccgcaaggactgggcatactatggtggtcttagagcattgtccagtgctacaaattcttttttcaattgctataattatacaactacaaacctccatacattcgtacttgggagtcggccat

SEQ ID NO: 434668 - DNA, 140 bp, Artificial Sequence
  Synthetic
atggccgactcccaagtacgaatgtatggaggtttgtagttgtataattatagcaattgaaaaaagaatttgtagcactggacaatgctctaagaccaccatagtatgcccagtccttgcggagacccagcatggcgtat

SEQ ID NO: 434669 - DNA, 140 bp, Artificial Sequence
  Synthetic
atacgccatgctgggtctccgtgcggacctccaaagtgaaaaacgaagttgctagtttcaagcaggcgttgagcaacttagcccgacacggagagtacgcaccatttgcacgggttttgacgtacttgggagtcggccat

SEQ ID NO: 434670 - DNA, 140 bp, Artificial Sequence
  Synthetic
atggccgactcccaagtacgtcaaaacccgtgcaaatggtgcgtactctccgtgtcgggctaagttgctcaacgcctgcttgaaactagcaacttcgtttttcactttggaggtccgcacggagacccagcatggcgtat

SEQ ID NO: 434671 - DNA, 140 bp, Artificial Sequence
  Synthetic
atacgccatgctgggtctccagcctaaaatctgatccgttaggtcatgggcccttcataatctgtttgagcatgaatgttgatcaaatgaccaaataatagtgcatttgtatagattcaacgtacttgggagtcggccat

SEQ ID NO: 434672 - DNA, 140 bp, Artificial Sequence
  Synthetic
atggccgactcccaagtacgttgaatctatacaaatgcactattatttggtcatttgatcaacattcatgctcaaacagattatgaagggcccatgacctaacggatcagattttaggctggagacccagcatggcgtat

SEQ ID NO: 434673 - DNA, 140 bp, Artificial Sequence
  Synthetic
atacgccatgctgggtctccatttatcagggattaacaatctcgaacatggactctatcctcagctctcagcaattgcgctgggtgtagcgacagcacatggcagtacattggctggtgtcgtacttgggagtcggccat

SEQ ID NO: 434674 - DNA, 140 bp, Artificial Sequence
  Synthetic
atggccgactcccaagtacgacaccagccaatgtactgccatgtgctgtcgctacacccagcgcaattgctgagagctgaggatagagtccatgttcgagattgttaatccctgataaatggagacccagcatggcgtat

SEQ ID NO: 434675 - DNA, 140 bp, Artificial Sequence
  Synthetic
atacgccatgctgggtctcccaatgtcggcgaacaatatcaacagctacgagaggcagcacatgatgcagaagtaaaactacaaagacgacatgaacatcaggaaattcaagctattgcccgtacttgggagtcggccat

SEQ ID NO: 434676 - DNA, 140 bp, Artificial Sequence
  Synthetic
atggccgactcccaagtacgggcaatagcttgaatttcctgatgttcatgtcgtctttgtagttttacttctgcatcatgtgctgcctctcgtagctgttgatattgttcgccgacattgggagacccagcatggcgtat

SEQ ID NO: 434677 - DNA, 140 bp, Artificial Sequence
  Synthetic
atacgccatgctgggtctccatgaggttatataattactcatagtgtaaagtataattcttacctctgtttcttctgttttccctttcttttataatatgccaattaagaaaaactaaaacgtacttgggagtcggccat

SEQ ID NO: 434678 - DNA, 140 bp, Artificial Sequence
  Synthetic
atggccgactcccaagtacgttttagtttttcttaattggcatattataaaagaaagggaaaacagaagaaacagaggtaagaattatactttacactatgagtaattatataacctcatggagacccagcatggcgtat

SEQ ID NO: 434679 - DNA, 140 bp, Artificial Sequence; identical to SEQ ID NO: 377459
  Synthetic

SEQ ID NO: 434680 - DNA, 140 bp, Artificial Sequence; identical to SEQ ID NO: 377460
  Synthetic

SEQ ID NO: 434681 - DNA, 140 bp, Artificial Sequence
  Synthetic
aggccctggctgctgatatgtacatacatagttcccccccatatcaaacccttacaaaatcatcagatgtacatgaggactttgatgcctcgaaggtaatcttaaattctgaaataaatagaccttttgggacagcggtg

SEQ ID NO: 434682 - DNA, 140 bp, Artificial Sequence
  Synthetic
caccgctgtcccaaaaggtctatttatttcagaatttaagattaccttcgaggcatcaaagtcctcatgtacatctgatgattttgtaagggtttgatatgggggggaactatgtatgtacatatcagcagccagggcct

SEQ ID NO: 434683 - DNA, 140 bp, Artificial Sequence
  Synthetic
atacgccatgctgggtctccgactcatcatacatgcagcaagtcagcgaagggttgatgactggaaaagtacccatagatcaagtgtttggtgccaatcccttagagaagttatacaagacgtacttgggagtcggccat

SEQ ID NO: 434684 - DNA, 140 bp, Artificial Sequence
  Synthetic
atggccgactcccaagtacgtcttgtataacttctctaagggattggcaccaaacacttgatctatgggtacttttccagtcatcaacccttcgctgacttgctgcatgtatgatgagtcggagacccagcatggcgtat

SEQ ID NO: 434685 - DNA, 140 bp, Artificial Sequence
  Synthetic
aggccctggctgctgatatgcttactttacacaagataatcttatatcgccttaagccttacataagtgagaaaatcacgcgcacagattaacttgtgattgaacgttcggtcacaccaggaccttttgggacagcggtg

SEQ ID NO: 434686 - DNA, 140 bp, Artificial Sequence
  Synthetic
caccgctgtcccaaaaggtcctggtgtgaccgaacgttcaatcacaagttaatctgtgcgcgtgattttctcacttatgtaaggcttaaggcgatataagattatcttgtgtaaagtaagcatatcagcagccagggcct

SEQ ID NO: 434687 - DNA, 140 bp, Artificial Sequence
  Synthetic
atacgccatgctgggtctcctgcatgcacaattcctccccatctcaaacctttataaaatcaatagatgtacatgaggactttgatgcctcgagagtaatcttaaattctaaaataaatacgtacttgggagtcggccat

SEQ ID NO: 434688 - DNA, 140 bp, Artificial Sequence
  Synthetic
atggccgactcccaagtacgtatttattttagaatttaagattactctcgaggcatcaaagtcctcatgtacatctattgattttataaaggtttgagatggggaggaattgtgcatgcaggagacccagcatggcgtat

SEQ ID NO: 434689 - DNA, 140 bp, Artificial Sequence
  Synthetic
atacgccatgctgggtctcccatcgagagaatttcaagggattcctgaaccgccaagacaatctcaggacatcgataacagccaaggaaagcaagaagatgaatcaacaaacctgattaacgtacttgggagtcggccat

SEQ ID NO: 434690 - DNA, 140 bp, Artificial Sequence
  Synthetic
atggccgactcccaagtacgttaatcaggtttgttgattcatcttcttgctttccttggctgttatcgatgtcctgagattgtcttggcggttcaggaatcccttgaaattctctcgatgggagacccagcatggcgtat

SEQ ID NO: 434691 - DNA, 140 bp, Artificial Sequence
  Synthetic
atacgccatgctgggtctccgaaaccgtttttgcgatatcaagaactgcctcctgtccaggaggatgatgaatcggaatacacaactgactctcaggaaagtattgaccagccaggatcccgtacttgggagtcggccat

SEQ ID NO: 434692 - DNA, 140 bp, Artificial Sequence
  Synthetic
atggccgactcccaagtacgggatcctggctggtcaatactttcctgagagtcagttgtgtattccgattcatcatcctcctggacaggaggcagttcttgatatcgcaaaaacggtttcggagacccagcatggcgtat

SEQ ID NO: 434693 - DNA, 140 bp, Artificial Sequence
  Synthetic
atacgccatgctgggtctccgacaatgaacaaggggttgatcttccacctcctccgttgtacgctcaggaaaagagacaggacccaatacagcacccagcagtaagctctcaggatccctcgtacttgggagtcggccat

SEQ ID NO: 434694 - DNA, 140 bp, Artificial Sequence
  Synthetic
atggccgactcccaagtacgagggatcctgagagcttactgctgggtgctgtattgggtcctgtctcttttcctgagcgtacaacggaggaggtggaagatcaaccccttgttcattgtcggagacccagcatggcgtat

SEQ ID NO: 434695 - DNA, 140 bp, Artificial Sequence
  Synthetic
atacgccatgctgggtctccttggcagtattggtgatgtaaatggtgatatcttagaacccataaggtcaccctcttcaccgtctgctcctcaggaagacacaagggcaagagaagcctacgtacttgggagtcggccat

SEQ ID NO: 434696 - DNA, 140 bp, Artificial Sequence
  Synthetic
atggccgactcccaagtacgtaggcttctcttgcccttgtgtcttcctgaggagcagacggtgaagagggtgaccttatgggttctaagatatcaccatttacatcaccaatactgccaaggagacccagcatggcgtat

SEQ ID NO: 434697 - DNA, 140 bp, Artificial Sequence
  Synthetic
aggccctggctgctgatatgaaggttaaaaaacatgcgcaatctgtaaaaatcttaaaacctaaagtcatgtttgaaactttttgtgttttcaaatttatagtagcaaagaatcattatcgaccttttgggacagcggtg

SEQ ID NO: 434698 - DNA, 140 bp, Artificial Sequence
  Synthetic
caccgctgtcccaaaaggtcgataatgattctttgctactataaatttgaaaacacaaaaagtttcaaacatgactttaggttttaagatttttacagattgcgcatgttttttaaccttcatatcagcagccagggcct

SEQ ID NO: 434699 - DNA, 140 bp, Artificial Sequence
  Synthetic
atacgccatgctgggtctcccttctgcagacaaatcctccagaatcacttataacagcccttgttgaggaataccaaaatcctgtctcagccaaagagcttcaagcagattggcccgacacgtacttgggagtcggccat

SEQ ID NO: 434700 - DNA, 140 bp, Artificial Sequence
  Synthetic
atggccgactcccaagtacgtgtcgggccaatctgcttgaagctctttggctgagacaggattttggtattcctcaacaagggctgttataagtgattctggaggatttgtctgcagaagggagacccagcatggcgtat

SEQ ID NO: 434701 - DNA, 140 bp, Artificial Sequence
  Synthetic
atacgccatgctgggtctcctgtcatttgatgaaaggagacatgttgctatgaacttgtaacccggatactacagcacgattacccacccatccacttcgatatgattcaccctcagatccgtacttgggagtcggccat

SEQ ID NO: 434702 - DNA, 140 bp, Artificial Sequence
  Synthetic
atggccgactcccaagtacggatctgagggtgaatcatatcgaagtggatgggtgggtaatcgtgctgtagtatccgggttacaagttcatagcaacatgtctcctttcatcaaatgacaggagacccagcatggcgtat

SEQ ID NO: 434703 - DNA, 140 bp, Artificial Sequence
  Synthetic
atacgccatgctgggtctccacagcaatcaaccctatttgaatatccaaaccactatttagtatcctattacttgtcactattgtgtgagacaacataagctatcaaataacaatcacggcgtacttgggagtcggccat

SEQ ID NO: 434704 - DNA, 140 bp, Artificial Sequence
  Synthetic
atggccgactcccaagtacgccgtgattgttatttgatagcttatgttgtctcacacaatagtgacaagtaataggatactaaatagtggtttggatattcaaatagggttgattgctgtggagacccagcatggcgtat

SEQ ID NO: 434705 - DNA, 140 bp, Artificial Sequence
  Synthetic
atacgccatgctgggtctccgcaagaactgggcatacgatggtgatttgagagtattgttcagtgctacaaattcttttttcaattgctataatgatacaactacaaatctccgtacactcgtacttgggagtcggccat

SEQ ID NO: 434706 - DNA, 140 bp, Artificial Sequence
  Synthetic
atggccgactcccaagtacgagtgtacggagatttgtagttgtatcattatagcaattgaaaaaagaatttgtagcactgaacaatactctcaaatcaccatcgtatgcccagttcttgcggagacccagcatggcgtat

SEQ ID NO: 434707 - DNA, 140 bp, Artificial Sequence
  Synthetic
atacgccatgctgggtctcctattgttcatccagagaatatccctgaaataaatgcaagaaccaaattaataaattatggatcaacagctctacaggggatggatatcaagatgccactccgtacttgggagtcggccat

SEQ ID NO: 434708 - DNA, 140 bp, Artificial Sequence
  Synthetic
atggccgactcccaagtacggagtggcatcttgatatccatcccctgtagagctgttgatccataatttattaatttggttcttgcatttatttcagggatattctctggatgaacaataggagacccagcatggcgtat

SEQ ID NO: 434709 - DNA, 140 bp, Artificial Sequence
  Synthetic
atacgccatgctgggtctccactgaaaatgagaaaaccagtgcccccccgaaaacaaccctgcctccaacagaaagtcctaccacagaaaagagcaccaacaatacaaaaagccccaccacgtacttgggagtcggccat

SEQ ID NO: 434710 - DNA, 140 bp, Artificial Sequence
  Synthetic
atggccgactcccaagtacgtggtggggctttttgtattgttggtgctcttttctgtggtaggactttctgttggaggcagggttgttttcgggggggcactggttttctcattttcagtggagacccagcatggcgtat

SEQ ID NO: 434711 - DNA, 140 bp, Artificial Sequence
  Synthetic
atacgccatgctgggtctccttgattgaacttctcaaatggtgcactatcctactgttttactcaacttggtatattgtaacatatcagcggactctccacttttcttcttgtatattctcgtacttgggagtcggccat

SEQ ID NO: 434712 - DNA, 140 bp, Artificial Sequence
  Synthetic
atggccgactcccaagtacgagaatatacaagaagaaaagtggagagtccgctgatatgttacaatataccaagttgagtaaaacagtaggatagtgcaccatttgagaagttcaatcaaggagacccagcatggcgtat

SEQ ID NO: 434713 - DNA, 140 bp, Artificial Sequence
  Synthetic
atacgccatgctgggtctccctataagtcatttacttgatagaatgtcaagtctactggttcagagtctcctcactccaatgaatgtaataattaactgttagcttagatgacaacagttcgtacttgggagtcggccat

SEQ ID NO: 434714 - DNA, 140 bp, Artificial Sequence
  Synthetic
atggccgactcccaagtacgaactgttgtcatctaagctaacagttaattattacattcattggagtgaggagactctgaaccagtagacttgacattctatcaagtaaatgacttatagggagacccagcatggcgtat

SEQ ID NO: 434715 - DNA, 140 bp, Artificial Sequence
  Synthetic
atacgccatgctgggtctcctattattaacaacttatttttatttaatcttttaaatgcaaatcaaaagaggacatgagccaccctcactttacttcaatacaaagaaattcttcttttccgtacttgggagtcggccat

SEQ ID NO: 434716 - DNA, 140 bp, Artificial Sequence
  Synthetic
atggccgactcccaagtacggaaaagaagaatttctttgtattgaagtaaagtgagggtggctcatgtcctcttttgatttgcatttaaaagattaaataaaaataagttgttaataataggagacccagcatggcgtat

SEQ ID NO: 434717 - DNA, 140 bp, Artificial Sequence
  Synthetic
atacgccatgctgggtctccatgaggttatataattactcatggtgtaaaatgtaattcttacctctatttcttctgttttccctctcctttataatatgccaattaagaaaaactaaaacgtacttgggagtcggccat

SEQ ID NO: 434718 - DNA, 140 bp, Artificial Sequence
  Synthetic
atggccgactcccaagtacgttttagtttttcttaattggcatattataaaggagagggaaaacagaagaaatagaggtaagaattacattttacaccatgagtaattatataacctcatggagacccagcatggcgtat

SEQ ID NO: 434719 - DNA, 140 bp, Artificial Sequence
  Synthetic
atacgccatgctgggtctccatcgaagaatattaaagattttctttaatattcagaaaaggttttttattctcttctttctttttacaaatatattaaaataataattctcacaatgtggcgtacttgggagtcggccat

SEQ ID NO: 434720 - DNA, 140 bp, Artificial Sequence
  Synthetic
atggccgactcccaagtacgccacattgtgagaattattattttaatatatttgtaaaaagaaagaagagaataaaaaaccttttctgaatattaaagaaaatctttaatattcttcgatggagacccagcatggcgtat

SEQ ID NO: 434721 - DNA, 140 bp, Artificial Sequence; identical to SEQ ID NO: 377493
  Synthetic

SEQ ID NO: 434722 - DNA, 140 bp, Artificial Sequence; identical to SEQ ID NO: 377494
  Synthetic

SEQ ID NO: 434723 - DNA, 140 bp, Artificial Sequence
  Synthetic
atacgccatgctgggtctccgactcatcatatatgcaacaagtcagcgaagggttgatgactggaaaagttcccatagatcaggtgtttggtaccaatcccttagagaagctatacaagacgtacttgggagtcggccat

SEQ ID NO: 434724 - DNA, 140 bp, Artificial Sequence
  Synthetic
atggccgactcccaagtacgtcttgtatagcttctctaagggattggtaccaaacacctgatctatgggaacttttccagtcatcaacccttcgctgacttgttgcatatatgatgagtcggagacccagcatggcgtat

SEQ ID NO: 434725 - DNA, 140 bp, Artificial Sequence
  Synthetic
atacgccatgctgggtctccgaagaaaaccaaaaggcacagttggactacaatgtagcccttgtctaatgtcaaaggcaacaagtactgatgatattatttgggaccaactggtcgtgagcgtacttgggagtcggccat

SEQ ID NO: 434726 - DNA, 140 bp, Artificial Sequence
  Synthetic
atggccgactcccaagtacgctcacgaccagttggtcccaaataatatcatcagtacttgttgcctttgacattagacaagggctacattgtagtccaactgtgccttttggttttcttcggagacccagcatggcgtat

SEQ ID NO: 434727 - DNA, 140 bp, Artificial Sequence
  Synthetic
atacgccatgctgggtctccgaaaacactagctgatctacttataccgataaataggcagatatcggacattcaaagtactctaagtgaagtaacaacaagagtccatgaaattgagcggcgtacttgggagtcggccat

SEQ ID NO: 434728 - DNA, 140 bp, Artificial Sequence
  Synthetic
atggccgactcccaagtacgccgctcaatttcatggactcttgttgttacttcacttagagtactttgaatgtccgatatctgcctatttatcggtataagtagatcagctagtgttttcggagacccagcatggcgtat

SEQ ID NO: 434729 - DNA, 140 bp, Artificial Sequence
  Synthetic
atacgccatgctgggtctcccaattacatgaaatcaccccagtcttgaaaatgggaaggacactggaagcaatctccaaggggatgtcagaaatgttagctaaatatgaccaccttgtaacgtacttgggagtcggccat

SEQ ID NO: 434730 - DNA, 140 bp, Artificial Sequence
  Synthetic
atggccgactcccaagtacgttacaaggtggtcatatttagctaacatttctgacatccccttggagattgcttccagtgtccttcccattttcaagactggggtgatttcatgtaattgggagacccagcatggcgtat

SEQ ID NO: 434731 - DNA, 140 bp, Artificial Sequence
  Synthetic
atacgccatgctgggtctcctctcaactggaagaaccactgcaccagctgctgcctttgatgcttacttaaatgagcatggtgtccctcctcctcaacccgcgattttcaaagatcttggcgtacttgggagtcggccat

SEQ ID NO: 434732 - DNA, 140 bp, Artificial Sequence
  Synthetic
atggccgactcccaagtacgccaagatctttgaaaatcgcgggttgaggaggagggacaccatgctcatttaagtaagcatcaaaggcagcagctggtgcagtggttcttccagttgagaggagacccagcatggcgtat

SEQ ID NO: 434733 - DNA, 140 bp, Artificial Sequence
  Synthetic
atacgccatgctgggtctccggttgcccaacaagcttgtagtaaggggactacggttaaaaatgcaacaacagatgcagccgacaagatgtcgaaggtccttgaactcagtgaggaaacgcgtacttgggagtcggccat

SEQ ID NO: 434734 - DNA, 140 bp, Artificial Sequence
  Synthetic
atggccgactcccaagtacgcgtttcctcactgagttcaaggaccttcgacatcttgtcggctgcatctgttgttgcatttttaaccgtagtccccttactacaagcttgttgggcaaccggagacccagcatggcgtat

SEQ ID NO: 434735 - DNA, 140 bp, Artificial Sequence
  Synthetic
atacgccatgctgggtctcctctccatccacccgaatctgccgcctattgttctaccaacagtcaagaagcaggcttatcgtcagcacaaaaatcccaacaatggaccattgctggccatcgtacttgggagtcggccat

SEQ ID NO: 434736 - DNA, 140 bp, Artificial Sequence
  Synthetic
atggccgactcccaagtacgatggccagcaatggtccattgttgggatttttgtgctgacgataagcctgcttcttgactgttggtagaacaataggcggcagattcgggtggatggagaggagacccagcatggcgtat

SEQ ID NO: 434737 - DNA, 140 bp, Artificial Sequence; identical to SEQ ID NO: 377507
  Synthetic

SEQ ID NO: 434738 - DNA, 140 bp, Artificial Sequence; identical to SEQ ID NO: 377508
  Synthetic

SEQ ID NO: 434739 - DNA, 140 bp, Artificial Sequence
  Synthetic
atacgccatgctgggtctccatgatgaagaaaaggggagaaaattcccccgtggtttattttcaagcacctgagaacttccctttgaatggcttcaataacagacaagttgtgctagcgtcgtacttgggagtcggccat

SEQ ID NO: 434740 - DNA, 140 bp, Artificial Sequence
  Synthetic
atggccgactcccaagtacgacgctagcacaacttgtctgttattgaagccattcaaagggaagttctcaggtgcttgaaaataaaccacgggggaattttctccccttttcttcatcatggagacccagcatggcgtat

SEQ ID NO: 434741 - DNA, 140 bp, Artificial Sequence
  Synthetic
aggccctggctgctgatatgacttgatgatgcagctctgtttcacctttctgttgatttcaatgttacagctatatctaagtgtctaattaacaacttgtacctctaaggaaaatcatgagaccttttgggacagcggtg

SEQ ID NO: 434742 - DNA, 140 bp, Artificial Sequence
  Synthetic
caccgctgtcccaaaaggtctcatgattttccttagaggtacaagttgttaattagacacttagatatagctgtaacattgaaatcaacagaaaggtgaaacagagctgcatcatcaagtcatatcagcagccagggcct

SEQ ID NO: 434743 - DNA, 140 bp, Artificial Sequence
  Synthetic
atacgccatgctgggtctccttgcaagggaagttatcttcccgagttgatacaaagacactaaacatttcaaaagcatgtatgtgggcaaaacgtaactagaccatcttgattgaagtagcgtacttgggagtcggccat

SEQ ID NO: 434744 - DNA, 140 bp, Artificial Sequence
  Synthetic
atggccgactcccaagtacgctacttcaatcaagatggtctagttacgttttgcccacatacatgcttttgaaatgtttagtgtctttgtatcaactcgggaagataacttcccttgcaaggagacccagcatggcgtat

SEQ ID NO: 434745 - DNA, 140 bp, Artificial Sequence
  Synthetic
atacgccatgctgggtctcctaatttatttctgtcttaaatgtgattttcacttcaaaagagttaaatggtgatagatcaatctttgaaattacccatttatacattatagagaaactaacgtacttgggagtcggccat

SEQ ID NO: 434746 - DNA, 140 bp, Artificial Sequence
  Synthetic
atggccgactcccaagtacgttagtttctctataatgtataaatgggtaatttcaaagattgatctatcaccatttaactcttttgaagtgaaaatcacatttaagacagaaataaattaggagacccagcatggcgtat

SEQ ID NO: 434747 - DNA, 140 bp, Artificial Sequence
  Synthetic
atacgccatgctgggtctcctattactaacaaaaggggtctacctaacgggtatgatcgagtgatcagtctatcttataaaccaaacaattgacttcttactttttaagaatcaactaaccgtacttgggagtcggccat

SEQ ID NO: 434748 - DNA, 140 bp, Artificial Sequence
  Synthetic
atggccgactcccaagtacggttagttgattcttaaaaagtaagaagtcaattgtttggtttataagatagactgatcactcgatcatacccgttaggtagaccccttttgttagtaataggagacccagcatggcgtat

SEQ ID NO: 434749 - DNA, 140 bp, Artificial Sequence
  Synthetic
atacgccatgctgggtctccagcatagaaaccacatttatccttacgtaatctttggcttagttggaattaacttttgttgtaattcaatacgtttagtcatagtatattgtaggattttcgtacttgggagtcggccat

SEQ ID NO: 434750 - DNA, 140 bp, Artificial Sequence
  Synthetic
atggccgactcccaagtacgaaaatcctacaatatactatgactaaacgtattgaattacaacaaaagttaattccaactaagccaaagattacgtaaggataaatgtggtttctatgctggagacccagcatggcgtat

SEQ ID NO: 434751 - DNA, 140 bp, Artificial Sequence; identical to SEQ ID NO: 377521
  Synthetic

SEQ ID NO: 434752 - DNA, 140 bp, Artificial Sequence; identical to SEQ ID NO: 377522
  Synthetic

SEQ ID NO: 434753 - DNA, 140 bp, Artificial Sequence
  Synthetic
atacgccatgctgggtctccttataagtttagaataccttaaatcatacccacaaaaaatactgttttaattaagaaaaactatgaagaacattaagaagatctttctctcgtagtgttccgtacttgggagtcggccat

SEQ ID NO: 434754 - DNA, 140 bp, Artificial Sequence
  Synthetic
atggccgactcccaagtacggaacactacgagagaaagatcttcttaatgttcttcatagtttttcttaattaaaacagtattttttgtgggtatgatttaaggtattctaaacttataaggagacccagcatggcgtat

SEQ ID NO: 434755 - DNA, 140 bp, Artificial Sequence
  Synthetic
atacgccatgctgggtctccttttactggaagaagtattccaatcttaacttgttggatcagttgtcacttaagttgttatttttaaaattgattcacacaaagtagtttaaatttgtatcgtacttgggagtcggccat

SEQ ID NO: 434756 - DNA, 140 bp, Artificial Sequence
  Synthetic
atggccgactcccaagtacgatacaaatttaaactactttgtgtgaatcaattttaaaaataacaacttaagtgacaactgatccaacaagttaagattggaatacttcttccagtaaaaggagacccagcatggcgtat

SEQ ID NO: 434757 - DNA, 140 bp, Artificial Sequence
  Synthetic
atacgccatgctgggtctccctagaataaattttaatatggccagttccagcaattacaatacatacatgcaataccttaacccccctccttatgctgaccacggtgcaaaccagttaatcgtacttgggagtcggccat

SEQ ID NO: 434758 - DNA, 140 bp, Artificial Sequence
  Synthetic
atggccgactcccaagtacgattaactggtttgcaccgtggtcagcataaggaggggggttaaggtattgcatgtatgtattgtaattgctggaactggccatattaaaatttattctagggagacccagcatggcgtat

SEQ ID NO: 434759 - DNA, 140 bp, Artificial Sequence
  Synthetic
aggccctggctgctgatatgggaagccaaaacatgctacaatataagtgtaacggatccctctggaaaatccttgctgttagatcctcctaccaacatccgtgactatcctaaatgcaaagaccttttgggacagcggtg

SEQ ID NO: 434760 - DNA, 140 bp, Artificial Sequence
  Synthetic
caccgctgtcccaaaaggtctttgcatttaggatagtcacggatgttggtaggaggatctaacagcaaggattttccagagggatccgttacacttatattgtagcatgttttggcttcccatatcagcagccagggcct

SEQ ID NO: 434761 - DNA, 140 bp, Artificial Sequence
  Synthetic
atacgccatgctgggtctccactatccatcatattcaaggtcaaaaccctcatgcacaggggatcgcccttcatttatggggagcattttttctgtatgatcgcattgcctccacaacaacgtacttgggagtcggccat

SEQ ID NO: 434762 - DNA, 140 bp, Artificial Sequence
  Synthetic
atggccgactcccaagtacgttgttgtggaggcaatgcgatcatacagaaaaaatgctccccataaatgaagggcgatcccctgtgcatgagggttttgaccttgaatatgatggatagtggagacccagcatggcgtat

SEQ ID NO: 434763 - DNA, 140 bp, Artificial Sequence
  Synthetic
atacgccatgctgggtctccactttagaggcaataattgacatatctgcgtataacgaacgaacagtcaaaggcgttccggcatggctgcctcttgggatcatgagcaatttcgaatatccgtacttgggagtcggccat

SEQ ID NO: 434764 - DNA, 140 bp, Artificial Sequence
  Synthetic
atggccgactcccaagtacggatattcgaaattgctcatgatcccaagaggcagccatgccggaacgcctttgactgttcgttcgttatacgcagatatgtcaattattgcctctaaagtggagacccagcatggcgtat

SEQ ID NO: 434765 - DNA, 140 bp, Artificial Sequence
  Synthetic
aggccctggctgctgatatgtgtaccgaggcaaagtcttcactgaagggaacatagcagctatgattgtcaataagacagtgcacaaaatgattttctcgcggcaaggacaagggtaccggaccttttgggacagcggtg

SEQ ID NO: 434766 - DNA, 140 bp, Artificial Sequence
  Synthetic
caccgctgtcccaaaaggtccggtacccttgtccttgccgcgagaaaatcattttgtgcactgtcttattgacaatcatagctgctatgttcccttcagtgaagactttgcctcggtacacatatcagcagccagggcct

SEQ ID NO: 434767 - DNA, 140 bp, Artificial Sequence
  Synthetic
atacgccatgctgggtctccctttagcccatacagtggctgcgttgctcacaggcagctatacaatcacccagtttactcataatgggcaaaaattcgtccgtgtcaatcgactcggtaccgtacttgggagtcggccat

SEQ ID NO: 434768 - DNA, 140 bp, Artificial Sequence
  Synthetic
atggccgactcccaagtacggtaccgagtcgattgacacggacgaatttttgcccattatgagtaaactgggtgattgtatagctgcctgtgagcaacgcagccactgtatgggctaaagggagacccagcatggcgtat

SEQ ID NO: 434769 - DNA, 140 bp, Artificial Sequence
  Synthetic
atacgccatgctgggtctccggacatgctgttcaaggaattttaatttataaccaaccattgcaagaattaatttactttttccgttatacttacttgcattaattctttgaatatttagcgtacttgggagtcggccat

SEQ ID NO: 434770 - DNA, 140 bp, Artificial Sequence
  Synthetic
atggccgactcccaagtacgctaaatattcaaagaattaatgcaagtaagtataacggaaaaagtaaattaattcttgcaatggttggttataaattaaaattccttgaacagcatgtccggagacccagcatggcgtat

SEQ ID NO: 434771 - DNA, 140 bp, Artificial Sequence
  Synthetic
atacgccatgctgggtctcccgcaaacgaatgacactggatgtttcggcgctcttcaagaatacaattctacaaagaaccaaacatgtgctccgtccaaaatacctccaccactgcccaccgtacttgggagtcggccat

SEQ ID NO: 434772 - DNA, 140 bp, Artificial Sequence
  Synthetic
atggccgactcccaagtacggtgggcagtggtggaggtattttggacggagcacatgtttggttctttgtagaattgtattcttgaagagcgccgaaacatccagtgtcattcgtttgcgggagacccagcatggcgtat

SEQ ID NO: 434773 - DNA, 140 bp, Artificial Sequence
  Synthetic
atacgccatgctgggtctccgcatatttcattcaaacaccccaaattttcaatcatacacataataaccattttagtagcgttacctttcaatacaatctaggtgattgtgaaaagacttcgtacttgggagtcggccat

SEQ ID NO: 434774 - DNA, 140 bp, Artificial Sequence
  Synthetic
atggccgactcccaagtacgaagtcttttcacaatcacctagattgtattgaaaggtaacgctactaaaatggttattatgtgtatgattgaaaatttggggtgtttgaatgaaatatgcggagacccagcatggcgtat

SEQ ID NO: 434775 - DNA, 140 bp, Artificial Sequence
  Synthetic
atacgccatgctgggtctccctggcgtccgtccaaggacaaattaattggaaacaccatgcatcctgcagtctccgttcacccgaatttaccgcctattgttctaccaacagtcaagaagcgtacttgggagtcggccat

SEQ ID NO: 434776 - DNA, 140 bp, Artificial Sequence
  Synthetic
atggccgactcccaagtacgcttcttgactgttggtagaacaataggcggtaaattcgggtgaacggagactgcaggatgcatggtgtttccaattaatttgtccttggacggacgccagggagacccagcatggcgtat

SEQ ID NO: 434777 - DNA, 140 bp, Artificial Sequence
  Synthetic
atacgccatgctgggtctcctcagggtccggagaacgagaaccccacacaacttctgatgcggtcaccaagcaagggctttcatcaacaatgccacccactccctcaccacaaccaagcacgtacttgggagtcggccat

SEQ ID NO: 434778 - DNA, 140 bp, Artificial Sequence
  Synthetic
atggccgactcccaagtacgtgcttggttgtggtgagggagtgggtggcattgttgatgaaagcccttgcttggtgaccgcatcagaagttgtgtggggttctcgttctccggaccctgaggagacccagcatggcgtat

SEQ ID NO: 434779 - DNA, 140 bp, Artificial Sequence
  Synthetic
atacgccatgctgggtctcccaggcttatcgccagcacaaaaatcccaacaatggtccactgctggccatatctggcatccttcatcaactgagagtcgaaaaagtcccagaaaagacaacgtacttgggagtcggccat

SEQ ID NO: 434780 - DNA, 140 bp, Artificial Sequence
  Synthetic
atggccgactcccaagtacgttgtcttttctgggactttttcgactctcagttgatgaaggatgccagatatggccagcagtggaccattgttgggatttttgtgctggcgataagcctgggagacccagcatggcgtat

SEQ ID NO: 434781 - DNA, 140 bp, Artificial Sequence; identical to SEQ ID NO: 377539
  Synthetic

SEQ ID NO: 434782 - DNA, 140 bp, Artificial Sequence; identical to SEQ ID NO: 377540
  Synthetic

SEQ ID NO: 434783 - DNA, 140 bp, Artificial Sequence
  Synthetic
atacgccatgctgggtctcccactaccacaatctctactaacaacacctccaaacacaacttcagcactctctctgcaccattacaaaacaccaccaatgacaacacacagagcacaatccgtacttgggagtcggccat

SEQ ID NO: 434784 - DNA, 140 bp, Artificial Sequence
  Synthetic
atggccgactcccaagtacggattgtgctctgtgtgttgtcattggtggtgttttgtaatggtgcagagagagtgctgaagttgtgtttggaggtgttgttagtagagattgtggtagtgggagacccagcatggcgtat

SEQ ID NO: 434785 - DNA, 140 bp, Artificial Sequence
  Synthetic
aggccctggctgctgatatgtgagaacttccctttgaatggcttcaacaacagacaagttgtactagcgtatgcgaatccaacactcagcgccgtttaaaatgatgctcaaataaaacaggaccttttgggacagcggtg

SEQ ID NO: 434786 - DNA, 140 bp, Artificial Sequence
  Synthetic
caccgctgtcccaaaaggtcctgttttatttgagcatcattttaaacggcgctgagtgttggattcgcatacgctagtacaacttgtctgttgttgaagccattcaaagggaagttctcacatatcagcagccagggcct

SEQ ID NO: 434787 - DNA, 140 bp, Artificial Sequence; identical to SEQ ID NO: 377543
  Synthetic

SEQ ID NO: 434788 - DNA, 140 bp, Artificial Sequence; identical to SEQ ID NO: 377544
  Synthetic

SEQ ID NO: 434789 - DNA, 140 bp, Artificial Sequence
  Synthetic
atacgccatgctgggtctccaagtccatctgtataaggagtatggcttaaatgggtatttgtcagattcttaagagattagtttgtattgatttaaataatgctttaaccttacattgctcgtacttgggagtcggccat

SEQ ID NO: 434790 - DNA, 140 bp, Artificial Sequence
  Synthetic
atggccgactcccaagtacgagcaatgtaaggttaaagcattatttaaatcaatacaaactaatctcttaagaatctgacaaatacccatttaagccatactccttatacagatggacttggagacccagcatggcgtat

SEQ ID NO: 434791 - DNA, 140 bp, Artificial Sequence
  Synthetic
atacgccatgctgggtctcccaacggcaccaaacacgacaaatgagcatttcaccagtcctccccccacccccagctcgactgcacaacatcttgtatatttcagaagaaagcgaagtatcgtacttgggagtcggccat

SEQ ID NO: 434792 - DNA, 140 bp, Artificial Sequence
  Synthetic
atggccgactcccaagtacgatacttcgctttcttctgaaatatacaagatgttgtgcagtcgagctgggggtggggggaggactggtgaaatgctcatttgtcgtgtttggtgccgttgggagacccagcatggcgtat

SEQ ID NO: 434793 - DNA, 140 bp, Artificial Sequence
  Synthetic
atacgccatgctgggtctccgctttaaatggttgattaagctgattagcttgtaatatataatctcttctgggccatcagatctgtaatgggtttactagattatatacaagacacagtacgtacttgggagtcggccat

SEQ ID NO: 434794 - DNA, 140 bp, Artificial Sequence
  Synthetic
atggccgactcccaagtacgtactgtgtcttgtatataatctagtaaacccattacagatctgatggcccagaagagattatatattacaagctaatcagcttaatcaaccatttaaagcggagacccagcatggcgtat

SEQ ID NO: 434795 - DNA, 140 bp, Artificial Sequence
  Synthetic
aggccctggctgctgatatgtttgattcaagatttaaaatgcaacaaccccgtggaaggagtcgaactcgcaaccaccaagccgcatcatctatatatcatgaaactcagttgccctccagaccttttgggacagcggtg

SEQ ID NO: 434796 - DNA, 140 bp, Artificial Sequence
  Synthetic
caccgctgtcccaaaaggtctggagggcaactgagtttcatgatatatagatgatgcggcttggtggttgcgagttcgactccttccacggggttgttgcattttaaatcttgaatcaaacatatcagcagccagggcct

SEQ ID NO: 434797 - DNA, 140 bp, Artificial Sequence
  Synthetic
atacgccatgctgggtctccatattttataaacaattcttgctcagttttgctttgatttaataacatacatcattgtgcctttcattgctaggtcaacccaactgataatgatattcctcgtacttgggagtcggccat

SEQ ID NO: 434798 - DNA, 140 bp, Artificial Sequence
  Synthetic
atggccgactcccaagtacgaggaatatcattatcagttgggttgacctagcaatgaaaggcacaatgatgtatgttattaaatcaaagcaaaactgagcaagaattgtttataaaatatggagacccagcatggcgtat

SEQ ID NO: 434799 - DNA, 140 bp, Artificial Sequence
  Synthetic
atacgccatgctgggtctcctcctctagttctggtgcctcggctgaggaagatcaacatgcctcccccaatattagtttaactttatcttattttcctaatataaatgagaacactgcctcgtacttgggagtcggccat

SEQ ID NO: 434800 - DNA, 140 bp, Artificial Sequence
  Synthetic
atggccgactcccaagtacgaggcagtgttctcatttatattaggaaaataagataaagttaaactaatattgggggaggcatgttgatcttcctcagccgaggcaccagaactagaggaggagacccagcatggcgtat

SEQ ID NO: 434801 - DNA, 140 bp, Artificial Sequence
  Synthetic
atacgccatgctgggtctcctctgaaatagtaagaaaaactaatgaagaacattaattactgggtaaaagtgattaagttctttaaatttgatcaaagtaatattttgtcagtgaatatacgtacttgggagtcggccat

SEQ ID NO: 434802 - DNA, 140 bp, Artificial Sequence
  Synthetic
atggccgactcccaagtacgtatattcactgacaaaatattactttgatcaaatttaaagaacttaatcacttttacccagtaattaatgttcttcattagtttttcttactatttcagaggagacccagcatggcgtat

SEQ ID NO: 434803 - DNA, 140 bp, Artificial Sequence
  Synthetic
atacgccatgctgggtctccttctcatatcacttgattaaaaacaggaaattatcctaacatgaaaaccacatgtctccttatcagtcttatcttaatccaaggggtaaaaactctccctcgtacttgggagtcggccat

SEQ ID NO: 434804 - DNA, 140 bp, Artificial Sequence
  Synthetic
atggccgactcccaagtacgagggagagtttttaccccttggattaagataagactgataaggagacatgtggttttcatgttaggataatttcctgtttttaatcaagtgatatgagaaggagacccagcatggcgtat

SEQ ID NO: 434805 - DNA, 140 bp, Artificial Sequence
  Synthetic
atacgccatgctgggtctccccctggaattgaaggactttacactgctgttttaattaaaaatcaaaacaatttggtctgcaggttgaggcgtctagccaatcaaactgccaaatccttgcgtacttgggagtcggccat

SEQ ID NO: 434806 - DNA, 140 bp, Artificial Sequence
  Synthetic
atggccgactcccaagtacgcaaggatttggcagtttgattggctagacgcctcaacctgcagaccaaattgttttgatttttaattaaaacagcagtgtaaagtccttcaattccagggggagacccagcatggcgtat

SEQ ID NO: 434807 - DNA, 140 bp, Artificial Sequence
  Synthetic
atacgccatgctgggtctccattttagagatagccagtaacattcaaccccaaaatgtggattcagtatgctccgggactctccagaagacagaagacgttcatctgatgggattcacaccgtacttgggagtcggccat

SEQ ID NO: 434808 - DNA, 140 bp, Artificial Sequence
  Synthetic
atggccgactcccaagtacggtgtgaatcccatcagatgaacgtcttctgtcttctggagagtcccggagcatactgaatccacattttggggttgaatgttactggctatctctaaaatggagacccagcatggcgtat

SEQ ID NO: 434809 - DNA, 140 bp, Artificial Sequence; identical to SEQ ID NO: 377555
  Synthetic

SEQ ID NO: 434810 - DNA, 140 bp, Artificial Sequence; identical to SEQ ID NO: 377556
  Synthetic

SEQ ID NO: 434811 - DNA, 140 bp, Artificial Sequence
  Synthetic
atacgccatgctgggtctcctgagcgggcaaaaagttgctgattcccctttagaggcatccaaacgatgggccttcagggcaggtgtacctcccaagaatgttgagtatacagaaggggacgtacttgggagtcggccat

SEQ ID NO: 434812 - DNA, 140 bp, Artificial Sequence
  Synthetic
atggccgactcccaagtacgtccccttctgtatactcaacattcttgggaggtacacctgccctgaaggcccatcgtttggatgcctctaaaggggaatcagcaactttttgcccgctcaggagacccagcatggcgtat

SEQ ID NO: 434813 - DNA, 140 bp, Artificial Sequence
  Synthetic
atacgccatgctgggtctcctgcttggacctgattgttgcatcgggatagaagacttgtccaaaaatatttcagagcaaattgaccaaattaaaaaggacgaacaaaaagaggggactggcgtacttgggagtcggccat

SEQ ID NO: 434814 - DNA, 140 bp, Artificial Sequence
  Synthetic
atggccgactcccaagtacgccagtcccctctttttgttcgtcctttttaatttggtcaatttgctctgaaatatttttggacaagtcttctatcccgatgcaacaatcaggtccaagcaggagacccagcatggcgtat

SEQ ID NO: 434815 - DNA, 140 bp, Artificial Sequence
  Synthetic
atacgccatgctgggtctccactatccatcatattcaaggtcaaaaccctcatgcacaggggatcgctctccatttgtggggagcatttttcttgtatgatcgcatcgcctccacaacgacgtacttgggagtcggccat

SEQ ID NO: 434816 - DNA, 140 bp, Artificial Sequence
  Synthetic
atggccgactcccaagtacgtcgttgtggaggcgatgcgatcatacaagaaaaatgctccccacaaatggagagcgatcccctgtgcatgagggttttgaccttgaatatgatggatagtggagacccagcatggcgtat

SEQ ID NO: 434817 - DNA, 140 bp, Artificial Sequence
  Synthetic
atacgccatgctgggtctcctgtatttgtcgtatctttactaaatatatcggataacgttaaatgtgtaatgattaggactttaggacaattgctactgagccctttttctaatctactgcgtacttgggagtcggccat

SEQ ID NO: 434818 - DNA, 140 bp, Artificial Sequence
  Synthetic
atggccgactcccaagtacgcagtagattagaaaaagggctcagtagcaattgtcctaaagtcctaatcattacacatttaacgttatccgatatatttagtaaagatacgacaaatacaggagacccagcatggcgtat

SEQ ID NO: 434819 - DNA, 140 bp, Artificial Sequence; identical to SEQ ID NO: 377563
  Synthetic

SEQ ID NO: 434820 - DNA, 140 bp, Artificial Sequence; identical to SEQ ID NO: 377564
  Synthetic

SEQ ID NO: 434821 - DNA, 140 bp, Artificial Sequence
  Synthetic
aggccctggctgctgatatggccgcaatactgtaatcaacactgctgtatctctccctcaagccatctgactcaacttaataaacatgacttgattcagagagtgtgccgaaaacgttatgaccttttgggacagcggtg

SEQ ID NO: 434822 - DNA, 140 bp, Artificial Sequence
  Synthetic
caccgctgtcccaaaaggtcataacgttttcggcacactctctgaatcaagtcatgtttattaagttgagtcagatggcttgagggagagatacagcagtgttgattacagtattgcggccatatcagcagccagggcct

SEQ ID NO: 434823 - DNA, 140 bp, Artificial Sequence
  Synthetic
atacgccatgctgggtctcccgcaaacgaatgacactggatgcttcggtactcttcaagaatataattctacaaagaaccaaacatgtgctccgtccaaaaaacctttaccactgcccaccgtacttgggagtcggccat

SEQ ID NO: 434824 - DNA, 140 bp, Artificial Sequence
  Synthetic
atggccgactcccaagtacggtgggcagtggtaaaggttttttggacggagcacatgtttggttctttgtagaattatattcttgaagagtaccgaagcatccagtgtcattcgtttgcgggagacccagcatggcgtat

SEQ ID NO: 434825 - DNA, 140 bp, Artificial Sequence
  Synthetic
atacgccatgctgggtctccagcccatccggaggtcaagctcactagcacctcaactgatgccaccaaactcaataccacagacccaaacagtgatgatgaggacctcacaacatctggccgtacttgggagtcggccat

SEQ ID NO: 434826 - DNA, 140 bp, Artificial Sequence
  Synthetic
atggccgactcccaagtacggccagatgttgtgaggtcctcatcatcactgtttgggtctgtggtattgagtttggtggcatcagttgaggtgctagtgagcttgacctccggatgggctggagacccagcatggcgtat

SEQ ID NO: 434827 - DNA, 140 bp, Artificial Sequence
  Synthetic
atacgccatgctgggtctcctcagggtctggagaacaggaaccttacacaacttctgacgcagccacgaagcaagggctttcatcaacaatgccgcccactccctcaccacaaccaagcacgtacttgggagtcggccat

SEQ ID NO: 434828 - DNA, 140 bp, Artificial Sequence
  Synthetic
atggccgactcccaagtacgtgcttggttgtggtgagggagtgggcggcattgttgatgaaagcccttgcttcgtggctgcgtcagaagttgtgtaaggttcctgttctccagaccctgaggagacccagcatggcgtat

SEQ ID NO: 434829 - DNA, 140 bp, Artificial Sequence
  Synthetic
atacgccatgctgggtctcccgccacagcaaggaggaaacaacacgaaccattcccaaggtgttgtgactgaacccggcaaaaccaacacaactgcacaaccgtccatgccccctcacaacgtacttgggagtcggccat

SEQ ID NO: 434830 - DNA, 140 bp, Artificial Sequence
  Synthetic
atggccgactcccaagtacgttgtgagggggcatggacggttgtgcagttgtgttggttttgccgggttcagtcacaacaccttgggaatggttcgtgttgtttcctccttgctgtggcgggagacccagcatggcgtat

SEQ ID NO: 434831 - DNA, 140 bp, Artificial Sequence
  Synthetic
atacgccatgctgggtctcccactactacaatctctactaacaacacctccaagcacaacctcagcactccctctgtaccaatacaaaatgccactaattacaacacacagagcacggcccgtacttgggagtcggccat

SEQ ID NO: 434832 - DNA, 140 bp, Artificial Sequence
  Synthetic
atggccgactcccaagtacgggccgtgctctgtgtgttgtaattagtggcattttgtattggtacagagggagtgctgaggttgtgcttggaggtgttgttagtagagattgtagtagtgggagacccagcatggcgtat

SEQ ID NO: 434833 - DNA, 140 bp, Artificial Sequence
  Synthetic
atacgccatgctgggtctcccctgaaaatgagcaaaccagtgccccctcgaaaacaaccctgcttccaacagaaaatcctacaacagcaaagagcaccaatagtacaaaaagccccactacgtacttgggagtcggccat

SEQ ID NO: 434834 - DNA, 140 bp, Artificial Sequence
  Synthetic
atggccgactcccaagtacgtagtggggctttttgtactattggtgctctttgctgttgtaggattttctgttggaagcagggttgttttcgagggggcactggtttgctcattttcaggggagacccagcatggcgtat

SEQ ID NO: 434835 - DNA, 140 bp, Artificial Sequence; identical to SEQ ID NO: 377577
  Synthetic

SEQ ID NO: 434836 - DNA, 140 bp, Artificial Sequence; identical to SEQ ID NO: 377578
  Synthetic

SEQ ID NO: 434837 - DNA, 140 bp, Artificial Sequence
  Synthetic
atacgccatgctgggtctcccaacagtaccaaatacgacaaataagtattccaccagtccctcccccacccccaactcgactgcacaacatcttgtatatttcagaaggaaacgaaatatcgtacttgggagtcggccat

SEQ ID NO: 434838 - DNA, 140 bp, Artificial Sequence
  Synthetic
atggccgactcccaagtacgatatttcgtttccttctgaaatatacaagatgttgtgcagtcgagttgggggtgggggagggactggtggaatacttatttgtcgtatttggtactgttgggagacccagcatggcgtat

SEQ ID NO: 434839 - DNA, 140 bp, Artificial Sequence
  Synthetic
atacgccatgctgggtctcctctctggagggaaggcgacatgttcccttttctggatgggttaataaatgctccgattgattttgatccggttccaaatacaaagacaatctttgatgaacgtacttgggagtcggccat

SEQ ID NO: 434840 - DNA, 140 bp, Artificial Sequence
  Synthetic
atggccgactcccaagtacgttcatcaaagattgtctttgtatttggaaccggatcaaaatcaatcggagcatttattaacccatccagaaaagggaacatgtcgccttccctccagagaggagacccagcatggcgtat

SEQ ID NO: 434841 - DNA, 140 bp, Artificial Sequence; identical to SEQ ID NO: 377581
  Synthetic

SEQ ID NO: 434842 - DNA, 140 bp, Artificial Sequence; identical to SEQ ID NO: 377582
  Synthetic

SEQ ID NO: 434843 - DNA, 140 bp, Artificial Sequence
  Synthetic
atacgccatgctgggtctcctcctctagttctggtgcttcagctgaggaagatcagcatgcctcccctaatatcagtttaactttatcttactttcctaaggtaaatgaaaacactgccccgtacttgggagtcggccat

SEQ ID NO: 434844 - DNA, 140 bp, Artificial Sequence
  Synthetic
atggccgactcccaagtacggggcagtgttttcatttaccttaggaaagtaagataaagttaaactgatattaggggaggcatgctgatcttcctcagctgaagcaccagaactagaggaggagacccagcatggcgtat

SEQ ID NO: 434845 - DNA, 140 bp, Artificial Sequence
  Synthetic
atacgccatgctgggtctccggagttgctttgaaggatcaagaattacagcaatcattaattcctggatttagatctattgttcatatgctttcagaatggttgctcctagaggtaacgtcgtacttgggagtcggccat

SEQ ID NO: 434846 - DNA, 140 bp, Artificial Sequence
  Synthetic
atggccgactcccaagtacgacgttacctctaggagcaaccattctgaaagcatatgaacaatagatctaaatccaggaattaatgattgctgtaattcttgatccttcaaagcaactccggagacccagcatggcgtat

SEQ ID NO: 434847 - DNA, 140 bp, Artificial Sequence
  Synthetic
atacgccatgctgggtctccccctggaatcgaaggactttatactgctggtttaattaaaaatcaaaataatttggtttgcaggttgaggcgtctagccaatcagactgccaaatccttgcgtacttgggagtcggccat

SEQ ID NO: 434848 - DNA, 140 bp, Artificial Sequence
  Synthetic
atggccgactcccaagtacgcaaggatttggcagtctgattggctagacgcctcaacctgcaaaccaaattattttgatttttaattaaaccagcagtataaagtccttcgattccagggggagacccagcatggcgtat

SEQ ID NO: 434849 - DNA, 140 bp, Artificial Sequence
  Synthetic
atacgccatgctgggtctccgaactcttattaagagtcacaaccgaggaaagaacattttccttaatcaatagacatgccattgattttttactcgcaaggtggggaggaacatgcaaagcgtacttgggagtcggccat

SEQ ID NO: 434850 - DNA, 140 bp, Artificial Sequence
  Synthetic
atggccgactcccaagtacgctttgcatgttcctccccaccttgcgagtaaaaaatcaatggcatgtctattgattaaggaaaatgttctttcctcggttgtgactcttaataagagttcggagacccagcatggcgtat

SEQ ID NO: 434851 - DNA, 140 bp, Artificial Sequence
  Synthetic
aggccctggctgctgatatgatgatgaagaaaagaggagaaagttccccggtggtttattttcaagcgcctgagaacttccctttaaatggcttcaacaatagacaggttgtactagcatgaccttttgggacagcggtg

SEQ ID NO: 434852 - DNA, 140 bp, Artificial Sequence
  Synthetic
caccgctgtcccaaaaggtcatgctagtacaacctgtctattgttgaagccatttaaagggaagttctcaggcgcttgaaaataaaccaccggggaactttctcctcttttcttcatcatcatatcagcagccagggcct

SEQ ID NO: 434853 - DNA, 140 bp, Artificial Sequence
  Synthetic
atacgccatgctgggtctcctgcttggacctgattgttgcatcggaatagaagacttgtccagaaatatttcagaacaaattgatcaaatcaaaaaggacgaacaaaaagaggggactggcgtacttgggagtcggccat

SEQ ID NO: 434854 - DNA, 140 bp, Artificial Sequence
  Synthetic
atggccgactcccaagtacgccagtcccctctttttgttcgtcctttttgatttgatcaatttgttctgaaatatttctggacaagtcttctattccgatgcaacaatcaggtccaagcaggagacccagcatggcgtat

SEQ ID NO: 434855 - DNA, 140 bp, Artificial Sequence
  Synthetic
aggccctggctgctgatatgtaagtctgacgtgtgctggaattcgaaagacgaatagatccttgatcaacaccatgacagaattacacatgaaccatgaaaatctcccgcaagaccaaaagaccttttgggacagcggtg

SEQ ID NO: 434856 - DNA, 140 bp, Artificial Sequence
  Synthetic
caccgctgtcccaaaaggtcttttggtcttgcgggagattttcatggttcatgtgtaattctgtcatggtgttgatcaaggatctattcgtctttcgaattccagcacacgtcagacttacatatcagcagccagggcct

SEQ ID NO: 434857 - DNA, 140 bp, Artificial Sequence
  Synthetic
atacgccatgctgggtctccttggggtctgggtggtaaatggtggacatcagactggggtgttcttactaacttgggcatcttgctactactgtccatagctgtcttaattgctctgtcccgtacttgggagtcggccat

SEQ ID NO: 434858 - DNA, 140 bp, Artificial Sequence
  Synthetic
atggccgactcccaagtacgggacagagcaattaagacagctatggacagtagtagcaagatgcccaagttagtaagaacaccccagtctgatgtccaccatttaccacccagaccccaaggagacccagcatggcgtat

SEQ ID NO: 434859 - DNA, 140 bp, Artificial Sequence
  Synthetic
atacgccatgctgggtctccttggggtctaggtggtaaatggtggacatccgactggggtgttcttactaacttgggcattttgctactattatccatagctgtcttgattgctctatcccgtacttgggagtcggccat

SEQ ID NO: 434860 - DNA, 140 bp, Artificial Sequence
  Synthetic
atggccgactcccaagtacgggatagagcaatcaagacagctatggataatagtagcaaaatgcccaagttagtaagaacaccccagtcggatgtccaccatttaccacctagaccccaaggagacccagcatggcgtat

SEQ ID NO: 434861 - DNA, 140 bp, Artificial Sequence
  Synthetic
aggccctggctgctgatatgaattcgaagccgccttatggcaaggttgggataagagatcgatatctctattcgtacaagcagctttatatgtaatgaacaatatcccctgtgaatcatcgaccttttgggacagcggtg

SEQ ID NO: 434862 - DNA, 140 bp, Artificial Sequence
  Synthetic
caccgctgtcccaaaaggtcgatgattcacaggggatattgttcattacatataaagctgcttgtacgaatagagatatcgatctcttatcccaaccttgccataaggcggcttcgaattcatatcagcagccagggcct

SEQ ID NO: 434863 - DNA, 140 bp, Artificial Sequence
  Synthetic
atacgccatgctgggtctccaaatcaacttgggagatttttgagaagctgataacttaatgtgaatcaacagtttacgtattatcgattattatggtttgagattcaactgttatcatcgcgtacttgggagtcggccat

SEQ ID NO: 434864 - DNA, 140 bp, Artificial Sequence
  Synthetic
atggccgactcccaagtacgcgatgataacagttgaatctcaaaccataataatcgataatacgtaaactgttgattcacattaagttatcagcttctcaaaaatctcccaagttgatttggagacccagcatggcgtat

SEQ ID NO: 434865 - DNA, 140 bp, Artificial Sequence; identical to SEQ ID NO: 377597
  Synthetic

SEQ ID NO: 434866 - DNA, 140 bp, Artificial Sequence; identical to SEQ ID NO: 377598
  Synthetic

SEQ ID NO: 434867 - DNA, 140 bp, Artificial Sequence
  Synthetic
atacgccatgctgggtctcctcaagagtgacctttcctatttgatgcattaatgttttaaactacctcttaagcctttgtggatggtctcaatatgcgcgtaagggttaatttaaagagacgtacttgggagtcggccat

SEQ ID NO: 434868 - DNA, 140 bp, Artificial Sequence
  Synthetic
atggccgactcccaagtacgtctctttaaattaacccttacgcgcatattgagaccatccacaaaggcttaagaggtagtttaaaacattaatgcatcaaataggaaaggtcactcttgaggagacccagcatggcgtat

SEQ ID NO: 434869 - DNA, 140 bp, Artificial Sequence
  Synthetic
atacgccatgctgggtctcctttcttgttgcatagtttttcgtgttactgatttaggcttgaagacatagttaagactggccgaaaatgctctccagtcaactccatttcctctcaggggcgtacttgggagtcggccat

SEQ ID NO: 434870 - DNA, 140 bp, Artificial Sequence
  Synthetic
atggccgactcccaagtacgcccctgagaggaaatggagttgactggagagcattttcggccagtcttaactatgtcttcaagcctaaatcagtaacacgaaaaactatgcaacaagaaaggagacccagcatggcgtat

SEQ ID NO: 434871 - DNA, 140 bp, Artificial Sequence
  Synthetic
atacgccatgctgggtctccagacgtgctgtccaaagagtcttaatccataatcaaccattgcaagaattaatttactttttccgttatacttatctacattaattctttaaatgtccagcgtacttgggagtcggccat

SEQ ID NO: 434872 - DNA, 140 bp, Artificial Sequence
  Synthetic
atggccgactcccaagtacgctggacatttaaagaattaatgtagataagtataacggaaaaagtaaattaattcttgcaatggttgattatggattaagactctttggacagcacgtctggagacccagcatggcgtat

SEQ ID NO: 434873 - DNA, 140 bp, Artificial Sequence
  Synthetic
atacgccatgctgggtctcccattattaacaacttgccttacttcaatcttttggatgcaaatcataaggaaagatgagccactttccctctaccctaagctaaggaaatttctcttatccgtacttgggagtcggccat

SEQ ID NO: 434874 - DNA, 140 bp, Artificial Sequence
  Synthetic
atggccgactcccaagtacggataagagaaatttccttagcttagggtagagggaaagtggctcatctttccttatgatttgcatccaaaagattgaagtaaggcaagttgttaataatgggagacccagcatggcgtat

SEQ ID NO: 434875 - DNA, 140 bp, Artificial Sequence
  Synthetic
atacgccatgctgggtctccagctcaaaatatgatccgtcaggtcacgggccattcataatctgtttgagcgtgaatattgatcaaataaccaaatgatgttgcatttgtatagacgcaacgtacttgggagtcggccat

SEQ ID NO: 434876 - DNA, 140 bp, Artificial Sequence
  Synthetic
atggccgactcccaagtacgttgcgtctatacaaatgcaacatcatttggttatttgatcaatattcacgctcaaacagattatgaatggcccgtgacctgacggatcatattttgagctggagacccagcatggcgtat

SEQ ID NO: 434877 - DNA, 140 bp, Artificial Sequence
  Synthetic
atacgccatgctgggtctccttatcctttattaagaaaaagacaaatagaacacagatagttgacaaaattttactttgataaattttgcgaggaattataaaaatcttgaaggataattcgtacttgggagtcggccat

SEQ ID NO: 434878 - DNA, 140 bp, Artificial Sequence
  Synthetic
atggccgactcccaagtacgaattatccttcaagatttttataattcctcgcaaaatttatcaaagtaaaattttgtcaactatctgtgttctatttgtctttttcttaataaaggataaggagacccagcatggcgtat

SEQ ID NO: 434879 - DNA, 140 bp, Artificial Sequence
  Synthetic
atacgccatgctgggtctcctatagtagagtagaatcgaagaacattaagtgttctttgttagaattattcatccaagttgtttttgagtatattcgcttcaatacaactcctctttatacgtacttgggagtcggccat

SEQ ID NO: 434880 - DNA, 140 bp, Artificial Sequence
  Synthetic
atggccgactcccaagtacgtataaagaggagttgtattgaagcgaatatactcaaaaacaacttggatgaataattctaacaaagaacacttaatgttcttcgattctactctactataggagacccagcatggcgtat

SEQ ID NO: 434881 - DNA, 140 bp, Artificial Sequence
  Synthetic
atacgccatgctgggtctcctgttccagagtggcaacaaacaaggaatctattctcccacctctttaaaaacccaaaatcaacaattatagaaccgtttttggccctgaggattttgcttcgtacttgggagtcggccat

SEQ ID NO: 434882 - DNA, 140 bp, Artificial Sequence
  Synthetic
atggccgactcccaagtacgaagcaaaatcctcagggccaaaaacggttctataattgttgattttgggtttttaaagaggtgggagaatagattccttgtttgttgccactctggaacaggagacccagcatggcgtat

SEQ ID NO: 434883 - DNA, 140 bp, Artificial Sequence
  Synthetic
atacgccatgctgggtctcctttgatttaagatttaaaatgcaacaacctcgtggaaggagtcgaacccgtaaccaccaagccacaccgtctatatatcatgaaactcaattgccctccacgtacttgggagtcggccat

SEQ ID NO: 434884 - DNA, 140 bp, Artificial Sequence
  Synthetic
atggccgactcccaagtacgtggagggcaattgagtttcatgatatatagacggtgtggcttggtggttacgggttcgactccttccacgaggttgttgcattttaaatcttaaatcaaaggagacccagcatggcgtat

SEQ ID NO: 434885 - DNA, 140 bp, Artificial Sequence
  Synthetic
atacgccatgctgggtctccggagttgctttgaaggatcaagaattacagcaatcattgattcctggatttagatctattgttcatatgctatcagaatggctgctcctggaggtcacgtcgtacttgggagtcggccat

SEQ ID NO: 434886 - DNA, 140 bp, Artificial Sequence
  Synthetic
atggccgactcccaagtacgacgtgacctccaggagcagccattctgatagcatatgaacaatagatctaaatccaggaatcaatgattgctgtaattcttgatccttcaaagcaactccggagacccagcatggcgtat

SEQ ID NO: 434887 - DNA, 140 bp, Artificial Sequence
  Synthetic
atacgccatgctgggtctccaaccccattacacaaatcatcatccacgtgcaagatctatgagctcaacccgtagtagtgcagaaagcagtcccaccaatcacattcctcgtgctcgacccgtacttgggagtcggccat

SEQ ID NO: 434888 - DNA, 140 bp, Artificial Sequence
  Synthetic
atggccgactcccaagtacgggtcgagcacgaggaatgtgattggtgggactgctttctgcactactacgggttgagctcatagatcttgcacgtggatgatgatttgtgtaatggggttggagacccagcatggcgtat

SEQ ID NO: 434889 - DNA, 140 bp, Artificial Sequence
  Synthetic
atacgccatgctgggtctccaccctcgacattcaacttatcgaaaccccctcctcccccaaaggacatgtgcaggaatatgaaaattggattgccgtgcactgatcctacttgtaataggcgtacttgggagtcggccat

SEQ ID NO: 434890 - DNA, 140 bp, Artificial Sequence
  Synthetic
atggccgactcccaagtacgcctattacaagtaggatcagtgcacggcaatccaattttcatattcctgcacatgtcctttgggggaggagggggtttcgataagttgaatgtcgagggtggagacccagcatggcgtat

SEQ ID NO: 434891 - DNA, 140 bp, Artificial Sequence
  Synthetic
atacgccatgctgggtctccgatcatgaccttgataatctaacaaatcgtgaacttttgctattgatggcccgaaaaatgctccccaatacggataagacatttagaagtccgcaggactcgtacttgggagtcggccat

SEQ ID NO: 434892 - DNA, 140 bp, Artificial Sequence
  Synthetic
atggccgactcccaagtacgagtcctgcggacttctaaatgtcttatccgtattggggagcatttttcgggccatcaatagcaaaagttcacgatttgttagattatcaaggtcatgatcggagacccagcatggcgtat

SEQ ID NO: 434893 - DNA, 140 bp, Artificial Sequence
  Synthetic
atacgccatgctgggtctccgtggaagtcaggaggattgatattgaaccttgttgtggtgagacagtcctctcagaatcagttgtttttgggctagtggctgaggcagttctaagagaaccgtacttgggagtcggccat

SEQ ID NO: 434894 - DNA, 140 bp, Artificial Sequence
  Synthetic
atggccgactcccaagtacggttctcttagaactgcctcagccactagcccaaaaacaactgattctgagaggactgtctcaccacaacaaggttcaatatcaatcctcctgacttccacggagacccagcatggcgtat

SEQ ID NO: 434895 - DNA, 140 bp, Artificial Sequence
  Synthetic
atacgccatgctgggtctccgaccacataataatgttggaggcacagtacattatagttaattgtcttgtatactaagggatatacctaacctgatttatatttactggtataaaatagtcgtacttgggagtcggccat

SEQ ID NO: 434896 - DNA, 140 bp, Artificial Sequence
  Synthetic
atggccgactcccaagtacgactattttataccagtaaatataaatcaggttaggtatatcccttagtatacaagacaattaactataatgtactgtgcctccaacattattatgtggtcggagacccagcatggcgtat

SEQ ID NO: 434897 - DNA, 140 bp, Artificial Sequence
  Synthetic
atacgccatgctgggtctccaccatgacagaattacacattaatcacgaaaatctcccgcaagaccaaaatggtgttatcaagcagacatacacaggtattcaccttgataaaggaggtccgtacttgggagtcggccat

SEQ ID NO: 434898 - DNA, 140 bp, Artificial Sequence
  Synthetic
atggccgactcccaagtacggacctcctttatcaaggtgaatacctgtgtatgtctgcttgataacaccattttggtcttgcgggagattttcgtgattaatgtgtaattctgtcatggtggagacccagcatggcgtat

SEQ ID NO: 434899 - DNA, 140 bp, Artificial Sequence
  Synthetic
atacgccatgctgggtctcctatcctccaaaatatatcttttgcaagtgatgtgtgcttgaatacttcgatataatacatactaataacgattgattaagaaaaatcaatgatggatattcgtacttgggagtcggccat

SEQ ID NO: 434900 - DNA, 140 bp, Artificial Sequence
  Synthetic
atggccgactcccaagtacgaatatccatcattgatttttcttaatcaatcgttattagtatgtattatatcgaagtattcaagcacacatcacttgcaaaagatatattttggaggataggagacccagcatggcgtat

SEQ ID NO: 434901 - DNA, 140 bp, Artificial Sequence
  Synthetic
atacgccatgctgggtctccgatcagtgtgcaagcctcatacgatcattttattcttcctcaaagtcaaggcaaaggacaatgattattgttcgaagattgacaatttgatcactttcagcgtacttgggagtcggccat

SEQ ID NO: 434902 - DNA, 140 bp, Artificial Sequence
  Synthetic
atggccgactcccaagtacgctgaaagtgatcaaattgtcaatcttcgaacaataatcattgtcctttgccttgactttgaggaagaataaaatgatcgtatgaggcttgcacactgatcggagacccagcatggcgtat

SEQ ID NO: 434903 - DNA, 140 bp, Artificial Sequence
  Synthetic
atacgccatgctgggtctccttttcaatttcaacccttatcgcgagatttggacacgatcttactaacttcaataactgaccccaaattcaagtttactaaaggctaagatgaaaataatcgtacttgggagtcggccat

SEQ ID NO: 434904 - DNA, 140 bp, Artificial Sequence
  Synthetic
atggccgactcccaagtacgattattttcatcttagcctttagtaaacttgaatttggggtcagttattgaagttagtaagatcgtgtccaaatctcgcgataagggttgaaattgaaaaggagacccagcatggcgtat

SEQ ID NO: 434905 - DNA, 140 bp, Artificial Sequence
  Synthetic
aggccctggctgctgatatgaccgggacagaatttttagatacaagcccattacaatcctctaggtattcatcaaatcctagggaacggtctctaccatctagagaacaagcctcatattgaccttttgggacagcggtg

SEQ ID NO: 434906 - DNA, 140 bp, Artificial Sequence
  Synthetic
caccgctgtcccaaaaggtcaatatgaggcttgttctctagatggtagagaccgttccctaggatttgatgaatacctagaggattgtaatgggcttgtatctaaaaattctgtcccggtcatatcagcagccagggcct

SEQ ID NO: 434907 - DNA, 140 bp, Artificial Sequence
  Synthetic
atacgccatgctgggtctcctcttgctaaattgtcgtcagcatcaaatgtcactttccgtttaatgttaaacaagtgctgcacgcggcatgtgccatctgaatacctattttttgataaacgtacttgggagtcggccat

SEQ ID NO: 434908 - DNA, 140 bp, Artificial Sequence
  Synthetic
atggccgactcccaagtacgtttatcaaaaaataggtattcagatggcacatgccgcgtgcagcacttgtttaacattaaacggaaagtgacatttgatgctgacgacaatttagcaagaggagacccagcatggcgtat

SEQ ID NO: 434909 - DNA, 140 bp, Artificial Sequence
  Synthetic
atacgccatgctgggtctccctttattgatacccttgagagacaactgttgacgctagatcacggatcaagcatatttcaatcaaacatcctaaattttcaatcgtacacataataaccacgtacttgggagtcggccat

SEQ ID NO: 434910 - DNA, 140 bp, Artificial Sequence
  Synthetic
atggccgactcccaagtacgtggttattatgtgtacgattgaaaatttaggatgtttgattgaaatatgcttgatccgtgatctagcgtcaacagttgtctctcaagggtatcaataaagggagacccagcatggcgtat

SEQ ID NO: 434911 - DNA, 140 bp, Artificial Sequence
  Synthetic
atacgccatgctgggtctccttttggtagcattgctttgcagtataggataggtggtcgtgaaaagacttccaagcatggcagaactatcaacgcgttacaacttgcctgtgaatgttaccgtacttgggagtcggccat

SEQ ID NO: 434912 - DNA, 140 bp, Artificial Sequence
  Synthetic
atggccgactcccaagtacggtaacattcacaggcaagttgtaacgcgttgatagttctgccatgcttggaagtcttttcacgaccacctatcctatactgcaaagcaatgctaccaaaaggagacccagcatggcgtat

SEQ ID NO: 434913 - DNA, 140 bp, Artificial Sequence
  Synthetic
aggccctggctgctgatatgaccatgttttttcagcttctgcaaggtcacagtgtgaggatttttctcctaaggaaaatccttattattgggggatgttattactcgtgcatctatctcagaccttttgggacagcggtg

SEQ ID NO: 434914 - DNA, 140 bp, Artificial Sequence
  Synthetic
caccgctgtcccaaaaggtctgagatagatgcacgagtaataacatcccccaataataaggattttccttaggagaaaaatcctcacactgtgaccttgcagaagctgaaaaaacatggtcatatcagcagccagggcct

SEQ ID NO: 434915 - DNA, 140 bp, Artificial Sequence
  Synthetic
aggccctggctgctgatatgatcatcaaaccccgtaatgagccgatttgctgctgacatcttttcaagaacgcctagtggaaaacggcttcaagtcttaggctatctggaaggaacaagagaccttttgggacagcggtg

SEQ ID NO: 434916 - DNA, 140 bp, Artificial Sequence
  Synthetic
caccgctgtcccaaaaggtctcttgttccttccagatagcctaagacttgaagccgttttccactaggcgttcttgaaaagatgtcagcagcaaatcggctcattacggggtttgatgatcatatcagcagccagggcct

SEQ ID NO: 434917 - DNA, 140 bp, Artificial Sequence
  Synthetic
atacgccatgctgggtctcctgttccagagtggcaacaaacaaggaatctattctcccatctcttcaaaaatccgaaatcaacaattatagaaccgttcttggctctgaggatcttgcttcgtacttgggagtcggccat

SEQ ID NO: 434918 - DNA, 140 bp, Artificial Sequence
  Synthetic
atggccgactcccaagtacgaagcaagatcctcagagccaagaacggttctataattgttgatttcggatttttgaagagatgggagaatagattccttgtttgttgccactctggaacaggagacccagcatggcgtat

SEQ ID NO: 434919 - DNA, 140 bp, Artificial Sequence
  Synthetic
atacgccatgctgggtctccaaccacataataatgttggaggcacagtacattatagttaattatcctgtataacaaagaatatacctaccctgatttatatttactggtataaaatagtcgtacttgggagtcggccat

SEQ ID NO: 434920 - DNA, 140 bp, Artificial Sequence
  Synthetic
atggccgactcccaagtacgactattttataccagtaaatataaatcagggtaggtatattctttgttatacaggataattaactataatgtactgtgcctccaacattattatgtggttggagacccagcatggcgtat

SEQ ID NO: 434921 - DNA, 140 bp, Artificial Sequence
  Synthetic
atacgccatgctgggtctccggagttgctttgaaggaccaagaattacagcaatcattgattcctgggtttaggtctattgttcatatgctttcggaatggttgctcctggaggtcacgtcgtacttgggagtcggccat

SEQ ID NO: 434922 - DNA, 140 bp, Artificial Sequence
  Synthetic
atggccgactcccaagtacgacgtgacctccaggagcaaccattccgaaagcatatgaacaatagacctaaacccaggaatcaatgattgctgtaattcttggtccttcaaagcaactccggagacccagcatggcgtat

SEQ ID NO: 434923 - DNA, 140 bp, Artificial Sequence
  Synthetic
aggccctggctgctgatatgtaggtctattgttcatatgctttcggaatggttgctcctggaggtcacgtcggcaatccacattagtcccaatctgttgggaatctatttgacttcagatgaccttttgggacagcggtg

SEQ ID NO: 434924 - DNA, 140 bp, Artificial Sequence
  Synthetic
caccgctgtcccaaaaggtcatctgaagtcaaatagattcccaacagattgggactaatgtggattgccgacgtgacctccaggagcaaccattccgaaagcatatgaacaatagacctacatatcagcagccagggcct

SEQ ID NO: 434925 - DNA, 140 bp, Artificial Sequence; identical to SEQ ID NO: 377567
  Synthetic

SEQ ID NO: 434926 - DNA, 140 bp, Artificial Sequence; identical to SEQ ID NO: 377568
  Synthetic

SEQ ID NO: 434927 - DNA, 140 bp, Artificial Sequence
  Synthetic
atacgccatgctgggtctcccttcaaatttcagacaataaggctgagtgtgcccaaaactttattaaaactatagttcaggcgaaattgactcctcaacaatactgtgaattattctccccgtacttgggagtcggccat

SEQ ID NO: 434928 - DNA, 140 bp, Artificial Sequence
  Synthetic
atggccgactcccaagtacggggagaataattcacagtattgttgaggagtcaatttcgcctgaactatagttttaataaagttttgggcacactcagccttattgtctgaaatttgaagggagacccagcatggcgtat

SEQ ID NO: 434929 - DNA, 140 bp, Artificial Sequence
  Synthetic
atacgccatgctgggtctccaaccacataataatgttggaggcacagtacattatagttgattatcctgtataataaaggatatacttaccctgatttatatttactggtataaaatagtcgtacttgggagtcggccat

SEQ ID NO: 434930 - DNA, 140 bp, Artificial Sequence
  Synthetic
atggccgactcccaagtacgactattttataccagtaaatataaatcagggtaagtatatcctttattatacaggataatcaactataatgtactgtgcctccaacattattatgtggttggagacccagcatggcgtat

SEQ ID NO: 434931 - DNA, 140 bp, Artificial Sequence
  Synthetic
atacgccatgctgggtctccagcatcatcttatcaactagttgtcatacaataggctgttcctataatctgatggtgaaagtataagcttgtagagttaccatgagtcacaactgttgtacgtacttgggagtcggccat

SEQ ID NO: 434932 - DNA, 140 bp, Artificial Sequence
  Synthetic
atggccgactcccaagtacgtacaacagttgtgactcatggtaactctacaagcttatactttcaccatcagattataggaacagcctattgtatgacaactagttgataagatgatgctggagacccagcatggcgtat

SEQ ID NO: 434933 - DNA, 140 bp, Artificial Sequence
  Synthetic
atacgccatgctgggtctcctattgtccaaaatatatcttgtgcaagtagtgtgtgcttgaatatgctgatgtaatacacactaataatgattgattaagaaaaatcaatgatggatattcgtacttgggagtcggccat

SEQ ID NO: 434934 - DNA, 140 bp, Artificial Sequence
  Synthetic
atggccgactcccaagtacgaatatccatcattgatttttcttaatcaatcattattagtgtgtattacatcagcatattcaagcacacactacttgcacaagatatattttggacaataggagacccagcatggcgtat

SEQ ID NO: 434935 - DNA, 140 bp, Artificial Sequence
  Synthetic
atacgccatgctgggtctccaaatgtccatcaagcaggtgtcgtaaaatattaggggtttcaaatgctgccagacttactaaattttacataggattatataattctcttcgatatacgtcgtacttgggagtcggccat

SEQ ID NO: 434936 - DNA, 140 bp, Artificial Sequence
  Synthetic
atggccgactcccaagtacgacgtatatcgaagagaattatataatcctatgtaaaatttagtaagtctggcagcatttgaaacccctaatattttacgacacctgcttgatggacatttggagacccagcatggcgtat

SEQ ID NO: 434937 - DNA, 140 bp, Artificial Sequence
  Synthetic
atacgccatgctgggtctcctatatctttagcaaagtaatgaaaacagctttatcatgttagacgccaattattcatcttaagtgaatcctttcttcaatatgcagcatccaactcaatacgtacttgggagtcggccat

SEQ ID NO: 434938 - DNA, 140 bp, Artificial Sequence
  Synthetic
atggccgactcccaagtacgtattgagttggatgctgcatattgaagaaaggattcacttaagatgaataattggcgtctaacatgataaagctgttttcattactttgctaaagatataggagacccagcatggcgtat

SEQ ID NO: 434939 - DNA, 140 bp, Artificial Sequence
  Synthetic
atacgccatgctgggtctcctcctgatgcaaggttgtcctctcctataatcctagatcagtgtgacttattagctagaagtttagggttgtatagtcattattcacataatccaaaattgcgtacttgggagtcggccat

SEQ ID NO: 434940 - DNA, 140 bp, Artificial Sequence
  Synthetic
atggccgactcccaagtacgcaattttggattatgtgaataatgactatacaaccctaaacttctagctaataagtcacactgatctaggattataggagaggacaaccttgcatcaggaggagacccagcatggcgtat

SEQ ID NO: 434941 - DNA, 140 bp, Artificial Sequence
  Synthetic
atacgccatgctgggtctccaaaagagttgaatataggaagaacttttgggaagttaccgtatcgtgtcagaaatgtccaaacactcgcagaagccctgctagcagatggactggcaaaacgtacttgggagtcggccat

SEQ ID NO: 434942 - DNA, 140 bp, Artificial Sequence
  Synthetic
atggccgactcccaagtacgttttgccagtccatctgctagcagggcttctgcgagtgtttggacatttctgacacgatacggtaacttcccaaaagttcttcctatattcaactcttttggagacccagcatggcgtat

SEQ ID NO: 434943 - DNA, 140 bp, Artificial Sequence
  Synthetic
atacgccatgctgggtctcccgtaattgtagaattccacatcacatttaccgtttaaggaattcgacagccttaaagacatttctccagaactgttcaatactcaccgttccttttcattcgtacttgggagtcggccat

SEQ ID NO: 434944 - DNA, 140 bp, Artificial Sequence
  Synthetic
atggccgactcccaagtacgaatgaaaaggaacggtgagtattgaacagttctggagaaatgtctttaaggctgtcgaattccttaaacggtaaatgtgatgtggaattctacaattacgggagacccagcatggcgtat

SEQ ID NO: 434945 - DNA, 140 bp, Artificial Sequence
  Synthetic
atacgccatgctgggtctccacgctatagtgaggggtgcaagttttgttactgatcttgagaaatacaacctcgccttccgatatgaatttacacggcatttcatagactactgtaatcgcgtacttgggagtcggccat

SEQ ID NO: 434946 - DNA, 140 bp, Artificial Sequence
  Synthetic
atggccgactcccaagtacgcgattacagtagtctatgaaatgccgtgtaaattcatatcggaaggcgaggttgtatttctcaagatcagtaacaaaacttgcacccctcactatagcgtggagacccagcatggcgtat

SEQ ID NO: 434947 - DNA, 140 bp, Artificial Sequence
  Synthetic
atacgccatgctgggtctccttgggacaacgagttcttaaaggcatatcttaataagatcttaggacttaaccatgtttttccaacttctgcaaggtcacaatgtgaggatttttctcctcgtacttgggagtcggccat

SEQ ID NO: 434948 - DNA, 140 bp, Artificial Sequence
  Synthetic
atggccgactcccaagtacgaggagaaaaatcctcacattgtgaccttgcagaagttggaaaaacatggttaagtcctaagatcttattaagatatgcctttaagaactcgttgtcccaaggagacccagcatggcgtat

SEQ ID NO: 434949 - DNA, 140 bp, Artificial Sequence; identical to SEQ ID NO: 377671
  Synthetic

SEQ ID NO: 434950 - DNA, 140 bp, Artificial Sequence; identical to SEQ ID NO: 377672
  Synthetic

SEQ ID NO: 434951 - DNA, 140 bp, Artificial Sequence
  Synthetic
aggccctggctgctgatatgacttgccaggaggataaaaggacaaagagggtcattaagaagtaactggaagtttataggaacagatttggagctgtttggaatagcagattttgttattgaccttttgggacagcggtg

SEQ ID NO: 434952 - DNA, 140 bp, Artificial Sequence
  Synthetic
caccgctgtcccaaaaggtcaataacaaaatctgctattccaaacagctccaaatctgttcctataaacttccagttacttcttaatgaccctctttgtccttttatcctcctggcaagtcatatcagcagccagggcct

SEQ ID NO: 434953 - DNA, 140 bp, Artificial Sequence; identical to SEQ ID NO: 377571
  Synthetic

SEQ ID NO: 434954 - DNA, 140 bp, Artificial Sequence; identical to SEQ ID NO: 377572
  Synthetic

SEQ ID NO: 434955 - DNA, 140 bp, Artificial Sequence; identical to SEQ ID NO: 377675
  Synthetic

SEQ ID NO: 434956 - DNA, 140 bp, Artificial Sequence; identical to SEQ ID NO: 377676
  Synthetic

SEQ ID NO: 434957 - DNA, 140 bp, Artificial Sequence
  Synthetic
atacgccatgctgggtctccttcaaaaccagggttaagggtatggtaccgtgaccaaaacttgaccccttatctatgcgacgatgagtttattgtaagcgtcgctagttatgaatgttttcgtacttgggagtcggccat

SEQ ID NO: 434958 - DNA, 140 bp, Artificial Sequence
  Synthetic
atggccgactcccaagtacgaaaacattcataactagcgacgcttacaataaactcatcgtcgcatagataaggggtcaagttttggtcacggtaccatacccttaaccctggttttgaaggagacccagcatggcgtat

SEQ ID NO: 434959 - DNA, 140 bp, Artificial Sequence
  Synthetic
atacgccatgctgggtctccattatgattaaagacgtcttcattgagaggtacaacacatgggagatatgtgcccgcgcttggctcgaagacagtgatggagctgattatcctcctcttgcgtacttgggagtcggccat

SEQ ID NO: 434960 - DNA, 140 bp, Artificial Sequence
  Synthetic
atggccgactcccaagtacgcaagaggaggataatcagctccatcactgtcttcgagccaagcgcgggcacatatctcccatgtgttgtacctctcaatgaagacgtctttaatcataatggagacccagcatggcgtat

SEQ ID NO: 434961 - DNA, 140 bp, Artificial Sequence
  Synthetic
aggccctggctgctgatatgaagcctgaggaaacatttgtccattcagggttcatttattttggtaaaaagcaatatctcaacggtgttcaactgccgcaatcattgaaaacaatggcaagaccttttgggacagcggtg

SEQ ID NO: 434962 - DNA, 140 bp, Artificial Sequence
  Synthetic
caccgctgtcccaaaaggtcttgccattgttttcaatgattgcggcagttgaacaccgttgagatattgctttttaccaaaataaatgaaccctgaatggacaaatgtttcctcaggcttcatatcagcagccagggcct

SEQ ID NO: 434963 - DNA, 140 bp, Artificial Sequence
  Synthetic
atacgccatgctgggtctccatgtgctaggtgagttatacaaccaaggagatcaaattattgccatgtacctggaggacggcttcaaattgattaaacacttagaacctttatgtgttagcgtacttgggagtcggccat

SEQ ID NO: 434964 - DNA, 140 bp, Artificial Sequence
  Synthetic
atggccgactcccaagtacgctaacacataaaggttctaagtgtttaatcaatttgaagccgtcctccaggtacatggcaataatttgatctccttggttgtataactcacctagcacatggagacccagcatggcgtat

SEQ ID NO: 434965 - DNA, 140 bp, Artificial Sequence
  Synthetic
atacgccatgctgggtctccggtgtggacccttatctgactctattttcgatgatcttcaaggttctctggccagtattggtacatcctttgagagaggaacaagcgagacacggcacatcgtacttgggagtcggccat

SEQ ID NO: 434966 - DNA, 140 bp, Artificial Sequence
  Synthetic
atggccgactcccaagtacgatgtgccgtgtctcgcttgttcctctctcaaaggatgtaccaatactggccagagaaccttgaagatcatcgaaaatagagtcagataagggtccacaccggagacccagcatggcgtat

SEQ ID NO: 434967 - DNA, 140 bp, Artificial Sequence
  Synthetic
atacgccatgctgggtctccctgtatacaaacacatggcatttttacaccaagaaaatactggttccaatcacagatgatcaagtcatattatgatgaactctgttgtctcaatttgaagcgtacttgggagtcggccat

SEQ ID NO: 434968 - DNA, 140 bp, Artificial Sequence
  Synthetic
atggccgactcccaagtacgcttcaaattgagacaacagagttcatcataatatgacttgatcatctgtgattggaaccagtattttcttggtgtaaaaatgccatgtgtttgtatacagggagacccagcatggcgtat

SEQ ID NO: 434969 - DNA, 140 bp, Artificial Sequence
  Synthetic
atacgccatgctgggtctcccttcaaatttcagacaataaagccgagtgtgcccaaaactttattaaaactataattcaggcgaaattgacccctcaacaatactgtgaattattctctccgtacttgggagtcggccat

SEQ ID NO: 434970 - DNA, 140 bp, Artificial Sequence
  Synthetic
atggccgactcccaagtacggagagaataattcacagtattgttgaggggtcaatttcgcctgaattatagttttaataaagttttgggcacactcggctttattgtctgaaatttgaagggagacccagcatggcgtat

SEQ ID NO: 434971 - DNA, 140 bp, Artificial Sequence
  Synthetic
atacgccatgctgggtctccaacgccccaagttttaggagggttatcatttttaaatccagaaaaattgttctaccggaacataagtgatcctctcacttcaggtctatttcaactcaagcgtacttgggagtcggccat

SEQ ID NO: 434972 - DNA, 140 bp, Artificial Sequence
  Synthetic
atggccgactcccaagtacgcttgagttgaaatagacctgaagtgagaggatcacttatgttccggtagaacaatttttctggatttaaaaatgataaccctcctaaaacttggggcgttggagacccagcatggcgtat

SEQ ID NO: 434973 - DNA, 140 bp, Artificial Sequence
  Synthetic
aggccctggctgctgatatgaaggtcaaaaaacatgcacaatctacaaaaatcttaaaacctaaagtcatgtttgaaaccttttgtgttttcaagttcatagtagcaaagaatcattatcgaccttttgggacagcggtg

SEQ ID NO: 434974 - DNA, 140 bp, Artificial Sequence
  Synthetic
caccgctgtcccaaaaggtcgataatgattctttgctactatgaacttgaaaacacaaaaggtttcaaacatgactttaggttttaagatttttgtagattgtgcatgttttttgaccttcatatcagcagccagggcct

SEQ ID NO: 434975 - DNA, 140 bp, Artificial Sequence
  Synthetic
aggccctggctgctgatatgaatctatttgacttcagatatgtttaagattctgatggcaggtgtgaaaaatttcttcaataagatgttcactcttcatgttgtaaatgaccacggaaaagaccttttgggacagcggtg

SEQ ID NO: 434976 - DNA, 140 bp, Artificial Sequence
  Synthetic
caccgctgtcccaaaaggtcttttccgtggtcatttacaacatgaagagtgaacatcttattgaagaaatttttcacacctgccatcagaatcttaaacatatctgaagtcaaatagattcatatcagcagccagggcct

SEQ ID NO: 434977 - DNA, 140 bp, Artificial Sequence
  Synthetic
atacgccatgctgggtctcctaaaaaacctggtttagcagatgcctcagattttgtcatgaatccattaggcttaaatgtaccaggatcaaaggaaataataacgttccttagacaaacacgtacttgggagtcggccat

SEQ ID NO: 434978 - DNA, 140 bp, Artificial Sequence
  Synthetic
atggccgactcccaagtacgtgtttgtctaaggaacgttattatttcctttgatcctggtacatttaagcctaatggattcatgacaaaatctgaggcatctgctaaaccaggttttttaggagacccagcatggcgtat

SEQ ID NO: 434979 - DNA, 140 bp, Artificial Sequence
  Synthetic
atacgccatgctgggtctccgtggaagtcaggagaattgacattgaaccttgttgtggtgagacaatcctttcagagtcagttgcttttggactagtggttgaggcagttctaagagaaccgtacttgggagtcggccat

SEQ ID NO: 434980 - DNA, 140 bp, Artificial Sequence
  Synthetic
atggccgactcccaagtacggttctcttagaactgcctcaaccactagtccaaaagcaactgactctgaaaggattgtctcaccacaacaaggttcaatgtcaattctcctgacttccacggagacccagcatggcgtat

SEQ ID NO: 434981 - DNA, 140 bp, Artificial Sequence
  Synthetic
atacgccatgctgggtctccttatcagcatctttgggagtggtatttcgtggagcatgaacctcttttttcaactaaaataataagtgatttaagtattttcattaaagacagggccactcgtacttgggagtcggccat

SEQ ID NO: 434982 - DNA, 140 bp, Artificial Sequence
  Synthetic
atggccgactcccaagtacgagtggccctgtctttaatgaaaatacttaaatcacttattattttagttgaaaaaagaggttcatgctccacgaaataccactcccaaagatgctgataaggagacccagcatggcgtat

SEQ ID NO: 434983 - DNA, 140 bp, Artificial Sequence
  Synthetic
atacgccatgctgggtctccgctgtgaaccaggagtgttgggacagtgtcttcgatagaagtgtattaggatataaccctcctgttagatttcagtcaaagagagtgccagagcaattttcgtacttgggagtcggccat

SEQ ID NO: 434984 - DNA, 140 bp, Artificial Sequence
  Synthetic
atggccgactcccaagtacgaaaattgctctggcactctctttgactgaaatctaacaggagggttatatcctaatacacttctatcgaagacactgtcccaacactcctggttcacagcggagacccagcatggcgtat

SEQ ID NO: 434985 - DNA, 140 bp, Artificial Sequence; identical to SEQ ID NO: 377695
  Synthetic

SEQ ID NO: 434986 - DNA, 140 bp, Artificial Sequence; identical to SEQ ID NO: 377696
  Synthetic

SEQ ID NO: 434987 - DNA, 140 bp, Artificial Sequence; identical to SEQ ID NO: 377697
  Synthetic

SEQ ID NO: 434988 - DNA, 140 bp, Artificial Sequence; identical to SEQ ID NO: 377698
  Synthetic

SEQ ID NO: 434989 - DNA, 140 bp, Artificial Sequence
  Synthetic
atacgccatgctgggtctccaaaagagttgaatataggaagaacttttgggaaattaccgtatcgtgtcagaaatgtccaaacactcgcagaagccttgctggctgatggattagcaaaacgtacttgggagtcggccat

SEQ ID NO: 434990 - DNA, 140 bp, Artificial Sequence
  Synthetic
atggccgactcccaagtacgttttgctaatccatcagccagcaaggcttctgcgagtgtttggacatttctgacacgatacggtaatttcccaaaagttcttcctatattcaactcttttggagacccagcatggcgtat

SEQ ID NO: 434991 - DNA, 140 bp, Artificial Sequence; identical to SEQ ID NO: 377575
  Synthetic

SEQ ID NO: 434992 - DNA, 140 bp, Artificial Sequence; identical to SEQ ID NO: 377576
  Synthetic

SEQ ID NO: 434993 - DNA, 140 bp, Artificial Sequence
  Synthetic
atacgccatgctgggtctccgcattccctagtaatatgatggttgtcactgagagggaacagaaagaagcattactgcatcaggcttcttggcaccataattcagcaagcataggggaaacgtacttgggagtcggccat

SEQ ID NO: 434994 - DNA, 140 bp, Artificial Sequence
  Synthetic
atggccgactcccaagtacgtttcccctatgcttgctgaattatggtgccaagaagcctgatgcagtaatgcttctttctgttccctctcagtgacaaccatcatattactagggaatgcggagacccagcatggcgtat

SEQ ID NO: 434995 - DNA, 140 bp, Artificial Sequence
  Synthetic
atacgccatgctgggtctcctaatctatcttcagactcaaaatcaactataaacttgttgccgtatgactgtaaggaactgcgacttgaaggaagcaatgacacagagttaaattatgtccgtacttgggagtcggccat

SEQ ID NO: 434996 - DNA, 140 bp, Artificial Sequence
  Synthetic
atggccgactcccaagtacggacataatttaactctgtgtcattgcttccttcaagtcgcagttccttacagtcatacggcaacaagtttatagttgattttgagtctgaagatagattaggagacccagcatggcgtat

SEQ ID NO: 434997 - DNA, 140 bp, Artificial Sequence; identical to SEQ ID NO: 377703
  Synthetic

SEQ ID NO: 434998 - DNA, 140 bp, Artificial Sequence; identical to SEQ ID NO: 377704
  Synthetic

SEQ ID NO: 434999 - DNA, 140 bp, Artificial Sequence
  Synthetic
atacgccatgctgggtctccattaatattgaacaacctaactatccaaattacagatattacaagtccactatggctagattctgtaatacaatacttacctgaagatagcgacattcttcgtacttgggagtcggccat

SEQ ID NO: 435000 - DNA, 140 bp, Artificial Sequence
  Synthetic
atggccgactcccaagtacgaagaatgtcgctatcttcaggtaagtattgtattacagaatctagccatagtggacttgtaatatctgtaatttggatagttaggttgttcaatattaatggagacccagcatggcgtat

SEQ ID NO: 435001 - DNA, 140 bp, Artificial Sequence
  Synthetic
aggccctggctgctgatatgaagataagatcggttatcctcccttaagagtaaattgcccatcagcagcacttaaagaagctattgagatggtttctagattgttatgggtgactcaagggaccttttgggacagcggtg

SEQ ID NO: 435002 - DNA, 140 bp, Artificial Sequence
  Synthetic
caccgctgtcccaaaaggtcccttgagtcacccataacaatctagaaaccatctcaatagcttctttaagtgctgctgatgggcaatttactcttaagggaggataaccgatcttatcttcatatcagcagccagggcct

SEQ ID NO: 435003 - DNA, 140 bp, Artificial Sequence
  Synthetic
aggccctggctgctgatatgagtgtcatgggtgataatcaatgtataacaactctaagtctgtttccagttgatgctcccaatgattatcaagagaacgaagctgaattgaatgcagcgcgaccttttgggacagcggtg

SEQ ID NO: 435004 - DNA, 140 bp, Artificial Sequence
  Synthetic
caccgctgtcccaaaaggtcgcgctgcattcaattcagcttcgttctcttgataatcattgggagcatcaactggaaacagacttagagttgttatacattgattatcacccatgacactcatatcagcagccagggcct

SEQ ID NO: 435005 - DNA, 140 bp, Artificial Sequence
  Synthetic
atacgccatgctgggtctcctgttataaagtagagtcgaagaacattaaatgttctttgttagaattattcatctaagttgtttttgagtatattcgcttcaatacaactcctctttatacgtacttgggagtcggccat

SEQ ID NO: 435006 - DNA, 140 bp, Artificial Sequence
  Synthetic
atggccgactcccaagtacgtataaagaggagttgtattgaagcgaatatactcaaaaacaacttagatgaataattctaacaaagaacatttaatgttcttcgactctactttataacaggagacccagcatggcgtat

SEQ ID NO: 435007 - DNA, 140 bp, Artificial Sequence
  Synthetic
aggccctggctgctgatatgtgggtaaatatgctgggggaggtcaagctgctattgatagtaatataatctttcaaaatactattaatttaggagttgcagttttagatattgcattgtcgaccttttgggacagcggtg

SEQ ID NO: 435008 - DNA, 140 bp, Artificial Sequence
  Synthetic
caccgctgtcccaaaaggtcgacaatgcaatatctaaaactgcaactcctaaattaatagtattttgaaagattatattactatcaatagcagcttgacctcccccagcatatttacccacatatcagcagccagggcct

SEQ ID NO: 435009 - DNA, 140 bp, Artificial Sequence
  Synthetic
atacgccatgctgggtctccgcaatatcttaacggtgttcaactgccacaatcattgaaaacaatggcaaggtgtggacccttgtctgactctatttttgatgatcttcaaggctctctacgtacttgggagtcggccat

SEQ ID NO: 435010 - DNA, 140 bp, Artificial Sequence
  Synthetic
atggccgactcccaagtacgtagagagccttgaagatcatcaaaaatagagtcagacaagggtccacaccttgccattgttttcaatgattgtggcagttgaacaccgttaagatattgcggagacccagcatggcgtat

SEQ ID NO: 435011 - DNA, 140 bp, Artificial Sequence
  Synthetic
aggccctggctgctgatatgtcttgctaaattgtcgtcagcatcaaatgtcactttccgtttaatgttaaataagtgctgcacgcggcatgtaccgtccgaatacctatattttgataaagaccttttgggacagcggtg

SEQ ID NO: 435012 - DNA, 140 bp, Artificial Sequence
  Synthetic
caccgctgtcccaaaaggtctttatcaaaatataggtattcggacggtacatgccgcgtgcagcacttatttaacattaaacggaaagtgacatttgatgctgacgacaatttagcaagacatatcagcagccagggcct

SEQ ID NO: 435013 - DNA, 140 bp, Artificial Sequence
  Synthetic
aggccctggctgctgatatgcctttagatgtggatttgaacaagtatatggacaatgagttggtttatgacaatgaccctctttgcagtgggattaaagggagattaggcagagtatctcgaccttttgggacagcggtg

SEQ ID NO: 435014 - DNA, 140 bp, Artificial Sequence
  Synthetic
caccgctgtcccaaaaggtcgagatactctgcctaatctccctttaatcccactgcaaagagggtcattgtcataaaccaactcattgtccatatacttgttcaaatccacatctaaaggcatatcagcagccagggcct

SEQ ID NO: 435015 - DNA, 140 bp, Artificial Sequence
  Synthetic
atacgccatgctgggtctcctattaaatcagaatcaccttggatttcccctagggttcaatattgatatttcttgtttcaaaaagcctcttaccttctcggaaaagttaattgccctcatcgtacttgggagtcggccat

SEQ ID NO: 435016 - DNA, 140 bp, Artificial Sequence
  Synthetic
atggccgactcccaagtacgatgagggcaattaacttttccgagaaggtaagaggctttttgaaacaagaaatatcaatattgaaccctaggggaaatccaaggtgattctgatttaataggagacccagcatggcgtat

SEQ ID NO: 435017 - DNA, 140 bp, Artificial Sequence
  Synthetic
aggccctggctgctgatatgcagcaatcaaatttatttaaatattcaaactactttttaggatcctattacttgttactattgtgtgagacaacataagctatcaaataacaatcacggggaccttttgggacagcggtg

SEQ ID NO: 435018 - DNA, 140 bp, Artificial Sequence
  Synthetic
caccgctgtcccaaaaggtccccgtgattgttatttgatagcttatgttgtctcacacaatagtaacaagtaataggatcctaaaaagtagtttgaatatttaaataaatttgattgctgcatatcagcagccagggcct

SEQ ID NO: 435019 - DNA, 140 bp, Artificial Sequence; identical to SEQ ID NO: 377719
  Synthetic

SEQ ID NO: 435020 - DNA, 140 bp, Artificial Sequence; identical to SEQ ID NO: 377720
  Synthetic

SEQ ID NO: 435021 - DNA, 140 bp, Artificial Sequence
  Synthetic
atacgccatgctgggtctccaatgcattggaatttcttgaaaaggaagaattattctatattttgattgctaaaaaacctggtttagcagatgcctcagatttcgttatgaatcctttagcgtacttgggagtcggccat

SEQ ID NO: 435022 - DNA, 140 bp, Artificial Sequence
  Synthetic
atggccgactcccaagtacgctaaaggattcataacgaaatctgaggcatctgctaaaccaggttttttagcaatcaaaatatagaataattcttccttttcaagaaattccaatgcattggagacccagcatggcgtat

SEQ ID NO: 435023 - DNA, 140 bp, Artificial Sequence
  Synthetic
atacgccatgctgggtctccgcttaaatgtaccaggatcaagggaaataataacgttccttagacagacagttcgtgaaaatatcacaatcacatcgcaaaatagaataataaattctctcgtacttgggagtcggccat

SEQ ID NO: 435024 - DNA, 140 bp, Artificial Sequence
  Synthetic
atggccgactcccaagtacgagagaatttattattctattttgcgatgtgattgtgatattttcacgaactgtctgtctaaggaacgttattatttcccttgatcctggtacatttaagcggagacccagcatggcgtat

SEQ ID NO: 435025 - DNA, 140 bp, Artificial Sequence
  Synthetic
aggccctggctgctgatatggttcgtgaaaatatcacaatcacatcgcaaaatagaataataaattctcttttccacataggctctgatttagaggaccaaagggtgtgtgagtggctttgaccttttgggacagcggtg

SEQ ID NO: 435026 - DNA, 140 bp, Artificial Sequence
  Synthetic
caccgctgtcccaaaaggtcaaagccactcacacaccctttggtcctctaaatcagagcctatgtggaaaagagaatttattattctattttgcgatgtgattgtgatattttcacgaaccatatcagcagccagggcct

SEQ ID NO: 435027 - DNA, 140 bp, Artificial Sequence
  Synthetic
aggccctggctgctgatatgtatcatcaaaccccgtaatgagccgatttgctgctgacatcttttcaagaacacccagtggaaaacggcttcaagtcttaggctatctggaaggaacaaggaccttttgggacagcggtg

SEQ ID NO: 435028 - DNA, 140 bp, Artificial Sequence
  Synthetic
caccgctgtcccaaaaggtccttgttccttccagatagcctaagacttgaagccgttttccactgggtgttcttgaaaagatgtcagcagcaaatcggctcattacggggtttgatgatacatatcagcagccagggcct

SEQ ID NO: 435029 - DNA, 140 bp, Artificial Sequence
  Synthetic
aggccctggctgctgatatgacacccagtggaaaacggcttcaagtcttaggctatctggaaggaacaagaacattgctagcttctcggacaatcagtctaactacagaagggacaatgtgaccttttgggacagcggtg

SEQ ID NO: 435030 - DNA, 140 bp, Artificial Sequence
  Synthetic
caccgctgtcccaaaaggtcacattgtcccttctgtagttagactgattgtccgagaagctagcaatgttcttgttccttccagatagcctaagacttgaagccgttttccactgggtgtcatatcagcagccagggcct

SEQ ID NO: 435031 - DNA, 140 bp, Artificial Sequence; identical to SEQ ID NO: 377729
  Synthetic

SEQ ID NO: 435032 - DNA, 140 bp, Artificial Sequence; identical to SEQ ID NO: 377730
  Synthetic

SEQ ID NO: 435033 - DNA, 140 bp, Artificial Sequence
  Synthetic
atacgccatgctgggtctccatgcacagttgatgtagctaacttcttgagggcatattcatggtctgacgtcttaaaagggaaaaggctaattggtgccacattaccgtgtttactagagcgtacttgggagtcggccat

SEQ ID NO: 435034 - DNA, 140 bp, Artificial Sequence
  Synthetic
atggccgactcccaagtacgctctagtaaacacggtaatgtggcaccaattagccttttcccttttaagacgtcagaccatgaatatgccctcaagaagttagctacatcaactgtgcatggagacccagcatggcgtat

SEQ ID NO: 435035 - DNA, 140 bp, Artificial Sequence
  Synthetic
atacgccatgctgggtctcccaatttaaggtaaagtggattaatttatctgaggatttaagggaacaatttaatctgtcttcagacgcagagtcaactataaattttttgccatatgactcgtacttgggagtcggccat

SEQ ID NO: 435036 - DNA, 140 bp, Artificial Sequence
  Synthetic
atggccgactcccaagtacgagtcatatggcaaaaaatttatagttgactctgcgtctgaagacagattaaattgttcccttaaatcctcagataaattaatccactttaccttaaattgggagacccagcatggcgtat

SEQ ID NO: 435037 - DNA, 140 bp, Artificial Sequence
  Synthetic
atacgccatgctgggtctccgcaaggaactgcgccttggaggaagcaatgacacagagttgaattatgtcagttgtgctctcgaccggaaagttgtccagaaacatccctctgttaatcgcgtacttgggagtcggccat

SEQ ID NO: 435038 - DNA, 140 bp, Artificial Sequence
  Synthetic
atggccgactcccaagtacgcgattaacagagggatgtttctggacaactttccggtcgagagcacaactgacataattcaactctgtgtcattgcttcctccaaggcgcagttccttgcggagacccagcatggcgtat

SEQ ID NO: 435039 - DNA, 140 bp, Artificial Sequence
  Synthetic
aggccctggctgctgatatgagttgtgctctcgaccggaaagttgtccagaaacatccctctgttaatcgtcttgcttggacgataggaaatcgagcaccgtatataggctcacggacaggaccttttgggacagcggtg

SEQ ID NO: 435040 - DNA, 140 bp, Artificial Sequence
  Synthetic
caccgctgtcccaaaaggtcctgtccgtgagcctatatacggtgctcgatttcctatcgtccaagcaagacgattaacagagggatgtttctggacaactttccggtcgagagcacaactcatatcagcagccagggcct

SEQ ID NO: 435041 - DNA, 140 bp, Artificial Sequence
  Synthetic
atacgccatgctgggtctcctcagagcaaaatctagtcgaaaattgtcgaccatcagagggcatcagattcaaggacaatcaaaaaataacaaaacatgaccagagatgtgagagggaggcgtacttgggagtcggccat

SEQ ID NO: 435042 - DNA, 140 bp, Artificial Sequence
  Synthetic
atggccgactcccaagtacgcctccctctcacatctctggtcatgttttgttattttttgattgtccttgaatctgatgccctctgatggtcgacaattttcgactagattttgctctgaggagacccagcatggcgtat

SEQ ID NO: 435043 - DNA, 140 bp, Artificial Sequence
  Synthetic
atacgccatgctgggtctccaatcttcaccgcaacagatgttccctgaagataacatgcagactcctgcgcacatacatagttcctccccatttcaaatccttataaaatcactagatgccgtacttgggagtcggccat

SEQ ID NO: 435044 - DNA, 140 bp, Artificial Sequence
  Synthetic
atggccgactcccaagtacggcatctagtgattttataaggatttgaaatggggaggaactatgtatgtgcgcaggagtctgcatgttatcttcagggaacatctgttgcggtgaagattggagacccagcatggcgtat

SEQ ID NO: 435045 - DNA, 140 bp, Artificial Sequence
  Synthetic
atacgccatgctgggtctccacatgaggactttgatgcctcgaagataatcttaaattctgaaataaataatcttaaccttacggagtatactcttaatacaaagttattgacaactcctcgtacttgggagtcggccat

SEQ ID NO: 435046 - DNA, 140 bp, Artificial Sequence
  Synthetic
atggccgactcccaagtacgaggagttgtcaataactttgtattaagagtatactccgtaaggttaagattatttatttcagaatttaagattatcttcgaggcatcaaagtcctcatgtggagacccagcatggcgtat

SEQ ID NO: 435047 - DNA, 140 bp, Artificial Sequence
  Synthetic
atacgccatgctgggtctccaaatagaatgagtaatacttccacacgtgcaattatatcaactaacacactgggtaaatacgcagggggaggtcaagctgcgattgatagtaatataatccgtacttgggagtcggccat

SEQ ID NO: 435048 - DNA, 140 bp, Artificial Sequence
  Synthetic
atggccgactcccaagtacggattatattactatcaatcgcagcttgacctccccctgcgtatttacccagtgtgttagttgatataattgcacgtgtggaagtattactcattctatttggagacccagcatggcgtat

SEQ ID NO: 435049 - DNA, 140 bp, Artificial Sequence
  Synthetic
atacgccatgctgggtctcctttcaaaatactattaatttaggggttgcagttttagatattgcattatctcttgctaaattgtcgtcatcatcaaatgtcactttccgtttgatgttaacgtacttgggagtcggccat

SEQ ID NO: 435050 - DNA, 140 bp, Artificial Sequence
  Synthetic
atggccgactcccaagtacgttaacatcaaacggaaagtgacatttgatgatgacgacaatttagcaagagataatgcaatatctaaaactgcaacccctaaattaatagtattttgaaaggagacccagcatggcgtat

SEQ ID NO: 435051 - DNA, 140 bp, Artificial Sequence
  Synthetic
atacgccatgctgggtctccactctggagaaaatgaaaatgattgtgatgcagagttaagaatttggagtgttcaggaggacgacctggcagcaggactcagttggataccgttttttggcgtacttgggagtcggccat

SEQ ID NO: 435052 - DNA, 140 bp, Artificial Sequence
  Synthetic
atggccgactcccaagtacgccaaaaaacggtatccaactgagtcctgctgccaggtcgtcctcctgaacactccaaattcttaactctgcatcacaatcattttcattttctccagagtggagacccagcatggcgtat

SEQ ID NO: 435053 - DNA, 140 bp, Artificial Sequence
  Synthetic
atacgccatgctgggtctccaaattgaaaaaggcaatttgtttggccgaaggggaaggaagtggtgctcggttacttttgaagtggaaggaaacggattatttattcttcaacactttggcgtacttgggagtcggccat

SEQ ID NO: 435054 - DNA, 140 bp, Artificial Sequence
  Synthetic
atggccgactcccaagtacgccaaagtgttgaagaataaataatccgtttccttccacttcaaaagtaaccgagcaccacttccttccccttcggccaaacaaattgcctttttcaatttggagacccagcatggcgtat

SEQ ID NO: 435055 - DNA, 140 bp, Artificial Sequence
  Synthetic
atacgccatgctgggtctccctacggattcacaacaagaagccgagattttgagtggccgggtaataccgagaatgttgtataacatagacagattaagtgctttgcttgaatcaaggagcgtacttgggagtcggccat

SEQ ID NO: 435056 - DNA, 140 bp, Artificial Sequence
  Synthetic
atggccgactcccaagtacgctccttgattcaagcaaagcacttaatctgtctatgttatacaacattctcggtattacccggccactcaaaatctcggcttcttgttgtgaatccgtagggagacccagcatggcgtat

SEQ ID NO: 435057 - DNA, 140 bp, Artificial Sequence
  Synthetic
atacgccatgctgggtctcctatggctagattctgtaatacaatatttacctgaagatagtgacattcttacaatggacgcagagaccaccaaggatgaaacaagggaacagctttataacgtacttgggagtcggccat

SEQ ID NO: 435058 - DNA, 140 bp, Artificial Sequence
  Synthetic
atggccgactcccaagtacgttataaagctgttcccttgtttcatccttggtggtctctgcgtccattgtaagaatgtcactatcttcaggtaaatattgtattacagaatctagccataggagacccagcatggcgtat

SEQ ID NO: 435059 - DNA, 140 bp, Artificial Sequence; identical to SEQ ID NO: 377757
  Synthetic

SEQ ID NO: 435060 - DNA, 140 bp, Artificial Sequence; identical to SEQ ID NO: 377758
  Synthetic

SEQ ID NO: 435061 - DNA, 140 bp, Artificial Sequence
  Synthetic
atacgccatgctgggtctccgatgttagggggctctgcaggagagaaaagttcatcagatgccgtccggctatttcttacagcaagttatcagaatttcatcaacaatttcagttgtctgcgtacttgggagtcggccat

SEQ ID NO: 435062 - DNA, 140 bp, Artificial Sequence
  Synthetic
atggccgactcccaagtacgcagacaactgaaattgttgatgaaattctgataacttgctgtaagaaatagccggacggcatctgatgaacttttctctcctgcagagccccctaacatcggagacccagcatggcgtat

SEQ ID NO: 435063 - DNA, 140 bp, Artificial Sequence
  Synthetic
aggccctggctgctgatatgctcaaatgcaaaaaactcagaatggtacttgtgttgcggtaaacgaagaattcaacggctccaaattgatttctcagaccaggtgggaatttttctgattgaccttttgggacagcggtg

SEQ ID NO: 435064 - DNA, 140 bp, Artificial Sequence
  Synthetic
caccgctgtcccaaaaggtcaatcagaaaaattcccacctggtctgagaaatcaatttggagccgttgaattcttcgtttaccgcaacacaagtaccattctgagttttttgcatttgagcatatcagcagccagggcct

SEQ ID NO: 435065 - DNA, 140 bp, Artificial Sequence
  Synthetic
atacgccatgctgggtctccataaaaaagggccaatcatcactaccagtttggctttactttcctagcgaagggcaacagttgaaacctatattgaaaatcttacagaggttatcagactcgtacttgggagtcggccat

SEQ ID NO: 435066 - DNA, 140 bp, Artificial Sequence
  Synthetic
atggccgactcccaagtacgagtctgataacctctgtaagattttcaatataggtttcaactgttgcccttcgctaggaaagtaaagccaaactggtagtgatgattggcccttttttatggagacccagcatggcgtat

SEQ ID NO: 435067 - DNA, 140 bp, Artificial Sequence
  Synthetic
atacgccatgctgggtctcctgttttcacctgacaaagttcaaaagcgtaaaattttagctgacacctgttatccagttgatagcttttgggtttatccaagcaagtccacaaggaccaacgtacttgggagtcggccat

SEQ ID NO: 435068 - DNA, 140 bp, Artificial Sequence
  Synthetic
atggccgactcccaagtacgttggtccttgtggacttgcttggataaacccaaaagctatcaactggataacaggtgtcagctaaaattttacgcttttgaactttgtcaggtgaaaacaggagacccagcatggcgtat

SEQ ID NO: 435069 - DNA, 140 bp, Artificial Sequence; identical to SEQ ID NO: 377765
  Synthetic

SEQ ID NO: 435070 - DNA, 140 bp, Artificial Sequence; identical to SEQ ID NO: 377766
  Synthetic

SEQ ID NO: 435071 - DNA, 140 bp, Artificial Sequence
  Synthetic
atacgccatgctgggtctcctactagacttgagaaatcactttatttgctcattaaggggaaagataactaaatattacaatgatatattaaagttaaatctagtcatcaaggcagtagacgtacttgggagtcggccat

SEQ ID NO: 435072 - DNA, 140 bp, Artificial Sequence
  Synthetic
atggccgactcccaagtacgtctactgccttgatgactagatttaactttaatatatcattgtaatatttagttatctttccccttaatgagcaaataaagtgatttctcaagtctagtaggagacccagcatggcgtat

SEQ ID NO: 435073 - DNA, 140 bp, Artificial Sequence
  Synthetic
atacgccatgctgggtctcctgaattatggatcaacaactttacaggggatggacatcaaaatgccactctcggagcaaaatctagtcgaaaattgtcgaccatcaaagggcatcagatgcgtacttgggagtcggccat

SEQ ID NO: 435074 - DNA, 140 bp, Artificial Sequence
  Synthetic
atggccgactcccaagtacgcatctgatgccctttgatggtcgacaattttcgactagattttgctccgagagtggcattttgatgtccatcccctgtaaagttgttgatccataattcaggagacccagcatggcgtat

SEQ ID NO: 435075 - DNA, 140 bp, Artificial Sequence
  Synthetic
atacgccatgctgggtctcccaaggacaatcaaaaaataataaaacatgaccaaagatatgggaagaaggagtcctcatcgcaacaaatgctccccaaagacaacatgcaaactcctgcgcgtacttgggagtcggccat

SEQ ID NO: 435076 - DNA, 140 bp, Artificial Sequence
  Synthetic
atggccgactcccaagtacgcgcaggagtttgcatgttgtctttggggagcatttgttgcgatgaggactccttcttcccatatctttggtcatgttttattattttttgattgtccttgggagacccagcatggcgtat

SEQ ID NO: 435077 - DNA, 140 bp, Artificial Sequence; identical to SEQ ID NO: 377587
  Synthetic

SEQ ID NO: 435078 - DNA, 140 bp, Artificial Sequence; identical to SEQ ID NO: 377588
  Synthetic

SEQ ID NO: 435079 - DNA, 140 bp, Artificial Sequence
  Synthetic
atacgccatgctgggtctcctacatacatggctcctccccatctcaaaccattataaaatcactagatgtacatgaggactttgatgcctcgaaggtaatcttaaattctgaaacaaatacgtacttgggagtcggccat

SEQ ID NO: 435080 - DNA, 140 bp, Artificial Sequence
  Synthetic
atggccgactcccaagtacgtatttgtttcagaatttaagattaccttcgaggcatcaaagtcctcatgtacatctagtgattttataatggtttgagatggggaggagccatgtatgtaggagacccagcatggcgtat

SEQ ID NO: 435081 - DNA, 140 bp, Artificial Sequence
  Synthetic
atacgccatgctgggtctccaccctaaccttacagattgtacccttaatacaaagttcttgacaactctcaccgggacagaaattttaggtacaagtccattacaaccctctagatattccgtacttgggagtcggccat

SEQ ID NO: 435082 - DNA, 140 bp, Artificial Sequence
  Synthetic
atggccgactcccaagtacggaatatctagagggttgtaatggacttgtacctaaaatttctgtcccggtgagagttgtcaagaactttgtattaagggtacaatctgtaaggttagggtggagacccagcatggcgtat

SEQ ID NO: 435083 - DNA, 140 bp, Artificial Sequence
  Synthetic
aggccctggctgctgatatgaccgggacagaaattttaggtacaagtccattacaaccctctagatattcatcaacttccaaggaacggtctctactatctagagaacaagcttcatattgaccttttgggacagcggtg

SEQ ID NO: 435084 - DNA, 140 bp, Artificial Sequence
  Synthetic
caccgctgtcccaaaaggtcaatatgaagcttgttctctagatagtagagaccgttccttggaagttgatgaatatctagagggttgtaatggacttgtacctaaaatttctgtcccggtcatatcagcagccagggcct

SEQ ID NO: 435085 - DNA, 140 bp, Artificial Sequence
  Synthetic
aggccctggctgctgatatgaaaatctcgaaggacaaattattgtaaaacagagtcgaagaacattaagtgttctttgttaaaactattcattcaagttgtttttgagtatatctacttcgaccttttgggacagcggtg

SEQ ID NO: 435086 - DNA, 140 bp, Artificial Sequence
  Synthetic
caccgctgtcccaaaaggtcgaagtagatatactcaaaaacaacttgaatgaatagttttaacaaagaacacttaatgttcttcgactctgttttacaataatttgtccttcgagattttcatatcagcagccagggcct

SEQ ID NO: 435087 - DNA, 140 bp, Artificial Sequence
  Synthetic
atacgccatgctgggtctccggtaactttttaacgttaattactcagatgttattgctcataattagcattaatattggcacattgggtgaatccttgagctttatccctaatatggtgtcgtacttgggagtcggccat

SEQ ID NO: 435088 - DNA, 140 bp, Artificial Sequence
  Synthetic
atggccgactcccaagtacgacaccatattagggataaagctcaaggattcacccaatgtgccaatattaatgctaattatgagcaataacatctgagtaattaacgttaaaaagttaccggagacccagcatggcgtat

SEQ ID NO: 435089 - DNA, 140 bp, Artificial Sequence
  Synthetic
aggccctggctgctgatatgacgtgatttacatgcttgtttcgatagcaatcaattctgtcgttttacaggggtagtctcatcaatgcattacaagctttatgatcttttgcctccaggtgaccttttgggacagcggtg

SEQ ID NO: 435090 - DNA, 140 bp, Artificial Sequence
  Synthetic
caccgctgtcccaaaaggtcacctggaggcaaaagatcataaagcttgtaatgcattgatgagactacccctgtaaaacgacagaattgattgctatcgaaacaagcatgtaaatcacgtcatatcagcagccagggcct

SEQ ID NO: 435091 - DNA, 140 bp, Artificial Sequence
  Synthetic
aggccctggctgctgatatgcacagtacggttacccacttatccactctgatacgaattatccccagatcatggcaatcaaatctacctgaatattcaaaccactcttcaatatcctattgaccttttgggacagcggtg

SEQ ID NO: 435092 - DNA, 140 bp, Artificial Sequence
  Synthetic
caccgctgtcccaaaaggtcaataggatattgaagagtggtttgaatattcaggtagatttgattgccatgatctggggataattcgtatcagagtggataagtgggtaaccgtactgtgcatatcagcagccagggcct

SEQ ID NO: 435093 - DNA, 140 bp, Artificial Sequence
  Synthetic
atacgccatgctgggtctccgagttgagaaaggcaatttgcttggctgaaggggaaggaagtggtgctcggttacttttgaagtggaaggaaactgattatttattcttcaacactctggcgtacttgggagtcggccat

SEQ ID NO: 435094 - DNA, 140 bp, Artificial Sequence
  Synthetic
atggccgactcccaagtacgccagagtgttgaagaataaataatcagtttccttccacttcaaaagtaaccgagcaccacttccttccccttcagccaagcaaattgcctttctcaactcggagacccagcatggcgtat

SEQ ID NO: 435095 - DNA, 140 bp, Artificial Sequence
  Synthetic
atacgccatgctgggtctccctacagattcacagcaagaagcagagatcttgagtggcagggtaataccgagaatgttgtataatatagacaaattaagtgttttgcttgaatcaagaagcgtacttgggagtcggccat

SEQ ID NO: 435096 - DNA, 140 bp, Artificial Sequence
  Synthetic
atggccgactcccaagtacgcttcttgattcaagcaaaacacttaatttgtctatattatacaacattctcggtattaccctgccactcaagatctctgcttcttgctgtgaatctgtagggagacccagcatggcgtat

SEQ ID NO: 435097 - DNA, 140 bp, Artificial Sequence
  Synthetic
atacgccatgctgggtctccacagtcaaatggagaagggccaacctctcaatctgacacaatacatgaacagcaaaattgctatataagtggcttaaattagcatgggtattcctagttccgtacttgggagtcggccat

SEQ ID NO: 435098 - DNA, 140 bp, Artificial Sequence
  Synthetic
atggccgactcccaagtacggaactaggaatacccatgctaatttaagccacttatatagcaattttgctgttcatgtattgtgtcagattgagaggttggcccttctccatttgactgtggagacccagcatggcgtat

SEQ ID NO: 435099 - DNA, 140 bp, Artificial Sequence
  Synthetic
aggccctggctgctgatatgcttctgttttctctttcctttgtaatatgccaattaagaaaaactaaaaatcgaagaatattaaagattttctttaatattcagaaaaggttttttattcgaccttttgggacagcggtg

SEQ ID NO: 435100 - DNA, 140 bp, Artificial Sequence
  Synthetic
caccgctgtcccaaaaggtcgaataaaaaaccttttctgaatattaaagaaaatctttaatattcttcgatttttagtttttcttaattggcatattacaaaggaaagagaaaacagaagcatatcagcagccagggcct

SEQ ID NO: 435101 - DNA, 140 bp, Artificial Sequence
  Synthetic
atacgccatgctgggtctccgactattgtgaatatttggacacgtacttctcctaatatcccaaaaattagtatcatcaaggtgtttttattagactatgaagggactttattcttaatgcgtacttgggagtcggccat

SEQ ID NO: 435102 - DNA, 140 bp, Artificial Sequence
  Synthetic
atggccgactcccaagtacgcattaagaataaagtcccttcatagtctaataaaaacaccttgatgatactaatttttgggatattaggagaagtacgtgtccaaatattcacaatagtcggagacccagcatggcgtat

SEQ ID NO: 435103 - DNA, 140 bp, Artificial Sequence
  Synthetic
atacgccatgctgggtctccatcatgattaaagacgtcttcattgagaggtataacacgtgggaaatatgtgcccgcgcctggctcgaagacagtgatggagctgattatcctcctcttgcgtacttgggagtcggccat

SEQ ID NO: 435104 - DNA, 140 bp, Artificial Sequence
  Synthetic
atggccgactcccaagtacgcaagaggaggataatcagctccatcactgtcttcgagccaggcgcgggcacatatttcccacgtgttatacctctcaatgaagacgtctttaatcatgatggagacccagcatggcgtat

SEQ ID NO: 435105 - DNA, 140 bp, Artificial Sequence
  Synthetic
aggccctggctgctgatatgaatatccatcaagcaggtgtcgcaaaataccaggggtttcatatgctgccatatttactaaatcttacataggattatatcattctcttcgatacacgttgaccttttgggacagcggtg

SEQ ID NO: 435106 - DNA, 140 bp, Artificial Sequence
  Synthetic
caccgctgtcccaaaaggtcaacgtgtatcgaagagaatgatataatcctatgtaagatttagtaaatatggcagcatatgaaacccctggtattttgcgacacctgcttgatggatattcatatcagcagccagggcct

SEQ ID NO: 435107 - DNA, 140 bp, Artificial Sequence
  Synthetic
aggccctggctgctgatatgtcgaagaatattaaagattttctttaatattcagaaaaggttttttattctcttctttctttttgcaaacatattgaaataataattttcacaatgtggggaccttttgggacagcggtg

SEQ ID NO: 435108 - DNA, 140 bp, Artificial Sequence
  Synthetic
caccgctgtcccaaaaggtccccacattgtgaaaattattatttcaatatgtttgcaaaaagaaagaagagaataaaaaaccttttctgaatattaaagaaaatctttaatattcttcgacatatcagcagccagggcct

SEQ ID NO: 435109 - DNA, 140 bp, Artificial Sequence
  Synthetic
atacgccatgctgggtctcctgtaaagcaatgtcgcgccagagacaagcaattccttattggttaaaacatatagaaaagaattatcctgcttcattacacgaatttttcctaactttagcgtacttgggagtcggccat

SEQ ID NO: 435110 - DNA, 140 bp, Artificial Sequence
  Synthetic
atggccgactcccaagtacgctaaagttaggaaaaattcgtgtaatgaagcaggataattcttttctatatgttttaaccaataaggaattgcttgtctctggcgcgacattgctttacaggagacccagcatggcgtat

SEQ ID NO: 435111 - DNA, 140 bp, Artificial Sequence
  Synthetic
aggccctggctgctgatatgtatagaaaagaattatcctgcttcattacacgaatttttcctaactttaggttttccttctttagagtcatctttctgccaccgttatactattccattcgaccttttgggacagcggtg

SEQ ID NO: 435112 - DNA, 140 bp, Artificial Sequence
  Synthetic
caccgctgtcccaaaaggtcgaatggaatagtataacggtggcagaaagatgactctaaagaaggaaaacctaaagttaggaaaaattcgtgtaatgaagcaggataattcttttctatacatatcagcagccagggcct

SEQ ID NO: 435113 - DNA, 140 bp, Artificial Sequence
  Synthetic
aggccctggctgctgatatgtataagtgatttacttgatagaatgtcaagtccactggtttggagtttccttactctaatgattgtaataattaactgttggcttagatgataacagatagaccttttgggacagcggtg

SEQ ID NO: 435114 - DNA, 140 bp, Artificial Sequence
  Synthetic
caccgctgtcccaaaaggtctatctgttatcatctaagccaacagttaattattacaatcattagagtaaggaaactccaaaccagtggacttgacattctatcaagtaaatcacttatacatatcagcagccagggcct

SEQ ID NO: 435115 - DNA, 140 bp, Artificial Sequence
  Synthetic
atacgccatgctgggtctccttactctaatgattgtaataattaactgttggcttagatgataacagatacgaggttatataattactcatagtataaagtataattcttgcctctgtttcgtacttgggagtcggccat

SEQ ID NO: 435116 - DNA, 140 bp, Artificial Sequence
  Synthetic
atggccgactcccaagtacgaaacagaggcaagaattatactttatactatgagtaattatataacctcgtatctgttatcatctaagccaacagttaattattacaatcattagagtaaggagacccagcatggcgtat

SEQ ID NO: 435117 - DNA, 140 bp, Artificial Sequence
  Synthetic
atacgccatgctgggtctccaaaaggtaaaaattggtcacagcttgttgagacccttcccaatatgcattcagtatgcatagtacacgtagaccatgagtgttttggatgcgaaaaacggcgtacttgggagtcggccat

SEQ ID NO: 435118 - DNA, 140 bp, Artificial Sequence
  Synthetic
atggccgactcccaagtacgccgtttttcgcatccaaaacactcatggtctacgtgtactatgcatactgaatgcatattgggaagggtctcaacaagctgtgaccaatttttaccttttggagacccagcatggcgtat

SEQ ID NO: 435119 - DNA, 140 bp, Artificial Sequence
  Synthetic
atacgccatgctgggtctccatgtgttaggtgagttatacaaccagggagaccaaattattgccatgtacttggaagacggtttcaaattgattaaacacttggaacccttgtgtgtcagcgtacttgggagtcggccat

SEQ ID NO: 435120 - DNA, 140 bp, Artificial Sequence
  Synthetic
atggccgactcccaagtacgctgacacacaagggttccaagtgtttaatcaatttgaaaccgtcttccaagtacatggcaataatttggtctccctggttgtataactcacctaacacatggagacccagcatggcgtat

SEQ ID NO: 435121 - DNA, 140 bp, Artificial Sequence
  Synthetic
atacgccatgctgggtctccttattacttaaattggattttattagaaatacaaaaatcgcagagcaaaaattgcttaatagagtaatcgggtatatcctgttctttccgttcggtctgtcgtacttgggagtcggccat

SEQ ID NO: 435122 - DNA, 140 bp, Artificial Sequence
  Synthetic
atggccgactcccaagtacgacagaccgaacggaaagaacaggatatacccgattactctattaagcaatttttgctctgcgatttttgtatttctaataaaatccaatttaagtaataaggagacccagcatggcgtat

SEQ ID NO: 435123 - DNA, 140 bp, Artificial Sequence
  Synthetic
atacgccatgctgggtctccttaagtctggatcattaagggcataactttaacagagagaacttcatttaattcacaaaaataatctatttaaaagtgggggttaaattttctagggtgtcgtacttgggagtcggccat

SEQ ID NO: 435124 - DNA, 140 bp, Artificial Sequence
  Synthetic
atggccgactcccaagtacgacaccctagaaaatttaacccccacttttaaatagattatttttgtgaattaaatgaagttctctctgttaaagttatgcccttaatgatccagacttaaggagacccagcatggcgtat

SEQ ID NO: 435125 - DNA, 140 bp, Artificial Sequence
  Synthetic
aggccctggctgctgatatgatgaaattaagggaattaacaagaaaccgatggaaaagctggttttcttatattgatgcattggacgatgatttatctgagtccttagaaaaattcacatgaccttttgggacagcggtg

SEQ ID NO: 435126 - DNA, 140 bp, Artificial Sequence
  Synthetic
caccgctgtcccaaaaggtcatgtgaatttttctaaggactcagataaatcatcgtccaatgcatcaatataagaaaaccagcttttccatcggtttcttgttaattcccttaatttcatcatatcagcagccagggcct

SEQ ID NO: 435127 - DNA, 140 bp, Artificial Sequence
  Synthetic
atacgccatgctgggtctcctgtatgagaaatcataaaataaacaagaaaaagaaaaagctattagacagcttactttacagaagataatcttataacgctttaggccttacacaggttacgtacttgggagtcggccat

SEQ ID NO: 435128 - DNA, 140 bp, Artificial Sequence
  Synthetic
atggccgactcccaagtacgtaacctgtgtaaggcctaaagcgttataagattatcttctgtaaagtaagctgtctaatagctttttctttttcttgtttattttatgatttctcatacaggagacccagcatggcgtat

SEQ ID NO: 435129 - DNA, 140 bp, Artificial Sequence
  Synthetic
atacgccatgctgggtctcctgtatttgtcgtatttttactaaatatattggataacattaagtgtgcaatgatgagaactttaagataattgctactgagcccttcttctgatctactgcgtacttgggagtcggccat

SEQ ID NO: 435130 - DNA, 140 bp, Artificial Sequence
  Synthetic
atggccgactcccaagtacgcagtagatcagaagaagggctcagtagcaattatcttaaagttctcatcattgcacacttaatgttatccaatatatttagtaaaaatacgacaaatacaggagacccagcatggcgtat

SEQ ID NO: 435131 - DNA, 140 bp, Artificial Sequence
  Synthetic
atacgccatgctgggtctccgaaaattacgcgcacagattaacttgtgattgaacgttcagttacaacaatggtgactttttcacgttggttattcaaacattattgatcataattagtgcgtacttgggagtcggccat

SEQ ID NO: 435132 - DNA, 140 bp, Artificial Sequence
  Synthetic
atggccgactcccaagtacgcactaattatgatcaataatgtttgaataaccaacgtgaaaaagtcaccattgttgtaactgaacgttcaatcacaagttaatctgtgcgcgtaattttcggagacccagcatggcgtat

SEQ ID NO: 435133 - DNA, 140 bp, Artificial Sequence
  Synthetic
aggccctggctgctgatatggaatgaggacgaagacactcttgacgacagtgtcatgatcccgagcacaacatcaagagaatttcaaaggattccagaaccaccaagacaatctcaagacgaccttttgggacagcggtg

SEQ ID NO: 435134 - DNA, 140 bp, Artificial Sequence
  Synthetic
caccgctgtcccaaaaggtcgtcttgagattgtcttggtggttctggaatcctttgaaattctcttgatgttgtgctcgggatcatgacactgtcgtcaagagtgtcttcgtcctcattccatatcagcagccagggcct

SEQ ID NO: 435135 - DNA, 140 bp, Artificial Sequence
  Synthetic
atacgccatgctgggtctccttagcattggcacatggggtgaatccttgaactttatccctaatatgaggcaagagattaaggaaatactgagatatactggttgaactgagttatgacacgtacttgggagtcggccat

SEQ ID NO: 435136 - DNA, 140 bp, Artificial Sequence
  Synthetic
atggccgactcccaagtacgtgtcataactcagttcaaccagtatatctcagtatttccttaatctcttgcctcatattagggataaagttcaaggattcaccccatgtgccaatgctaaggagacccagcatggcgtat

SEQ ID NO: 435137 - DNA, 140 bp, Artificial Sequence
  Synthetic
atacgccatgctgggtctcctgccatatatcataaatataaaagaactgtttgctataatctataagcctctcttttagatacattggagaaagaacgaggttatcattgagatcgaaaacgtacttgggagtcggccat

SEQ ID NO: 435138 - DNA, 140 bp, Artificial Sequence
  Synthetic
atggccgactcccaagtacgttttcgatctcaatgataacctcgttctttctccaatgtatctaaaagagaggcttatagattatagcaaacagttcttttatatttatgatatatggcaggagacccagcatggcgtat

SEQ ID NO: 435139 - DNA, 140 bp, Artificial Sequence
  Synthetic
atacgccatgctgggtctccacctacgttacattttctctgatgataagtgataaaatttcgtagctaaatttctagaatgttaatgtgaatgtaaattaagaaaaaccaatatataaaacgtacttgggagtcggccat

SEQ ID NO: 435140 - DNA, 140 bp, Artificial Sequence
  Synthetic
atggccgactcccaagtacgttttatatattggtttttcttaatttacattcacattaacattctagaaatttagctacgaaattttatcacttatcatcagagaaaatgtaacgtaggtggagacccagcatggcgtat

SEQ ID NO: 435141 - DNA, 140 bp, Artificial Sequence
  Synthetic
aggccctggctgctgatatgatgtgaatgtaaattaagaaaaaccaatatataaaattaaaaaagtaaaaagctttgatacaagtaacacaaaacattcttcatcttttaagtgtgtccagaccttttgggacagcggtg

SEQ ID NO: 435142 - DNA, 140 bp, Artificial Sequence
  Synthetic
caccgctgtcccaaaaggtctggacacacttaaaagatgaagaatgttttgtgttacttgtatcaaagctttttacttttttaattttatatattggtttttcttaatttacattcacatcatatcagcagccagggcct

SEQ ID NO: 435143 - DNA, 140 bp, Artificial Sequence
  Synthetic
atacgccatgctgggtctccattgtaacgtagagtcgaagaacattaagtgttctttgttagaattattcatccaagttgttttgagtatactcgcttcaatacaacttcccttcatattcgtacttgggagtcggccat

SEQ ID NO: 435144 - DNA, 140 bp, Artificial Sequence
  Synthetic
atggccgactcccaagtacgaatatgaagggaagttgtattgaagcgagtatactcaaaacaacttggatgaataattctaacaaagaacacttaatgttcttcgactctacgttacaatggagacccagcatggcgtat

SEQ ID NO: 435145 - DNA, 140 bp, Artificial Sequence
  Synthetic
atacgccatgctgggtctcccttctgcagacaaatcctccagaatcacttataacagccctcatagaagaataccaaaatcctgtctcagctaaggagctccaagcagattggcccgacacgtacttgggagtcggccat

SEQ ID NO: 435146 - DNA, 140 bp, Artificial Sequence
  Synthetic
atggccgactcccaagtacgtgtcgggccaatctgcttggagctccttagctgagacaggattttggtattcttctatgagggctgttataagtgattctggaggatttgtctgcagaagggagacccagcatggcgtat

SEQ ID NO: 435147 - DNA, 140 bp, Artificial Sequence
  Synthetic
atacgccatgctgggtctcccatctacccggcaacaacactccattccatatcctagctcaagtcctttcaaaaattgcttacaagtcaggaaaatccggagcatttttggatgcatttccgtacttgggagtcggccat

SEQ ID NO: 435148 - DNA, 140 bp, Artificial Sequence
  Synthetic
atggccgactcccaagtacggaaatgcatccaaaaatgctccggattttcctgacttgtaagcaatttttgaaaggacttgagctaggatatggaatggagtgttgttgccgggtagatgggagacccagcatggcgtat

SEQ ID NO: 435149 - DNA, 140 bp, Artificial Sequence
  Synthetic
aggccctggctgctgatatgacagcaatcaaatttatttaaatattcaaactactttttaggatcctattacttgttactattgtgtaagacaacataagctatcaaataacaatcacatgaccttttgggacagcggtg

SEQ ID NO: 435150 - DNA, 140 bp, Artificial Sequence
  Synthetic
caccgctgtcccaaaaggtcatgtgattgttatttgatagcttatgttgtcttacacaatagtaacaagtaataggatcctaaaaagtagtttgaatatttaaataaatttgattgctgtcatatcagcagccagggcct

SEQ ID NO: 435151 - DNA, 140 bp, Artificial Sequence
  Synthetic
aggccctggctgctgatatgtttcaaatttcaggcaataaagctgagtgtgctcaaaactttattaaaactataattcaggcgaaattgactcctcaacaatactgtgaattattctctcgaccttttgggacagcggtg

SEQ ID NO: 435152 - DNA, 140 bp, Artificial Sequence
  Synthetic
caccgctgtcccaaaaggtcgagagaataattcacagtattgttgaggagtcaatttcgcctgaattatagttttaataaagttttgagcacactcagctttattgcctgaaatttgaaacatatcagcagccagggcct

SEQ ID NO: 435153 - DNA, 140 bp, Artificial Sequence
  Synthetic
atacgccatgctgggtctccttttcagtttcaacccttatcgcgagacttgaatacaatcctactaacttcaataagtgaccccaaattcaagtttgctgaaagctaagatgacaatgatcgtacttgggagtcggccat

SEQ ID NO: 435154 - DNA, 140 bp, Artificial Sequence
  Synthetic
atggccgactcccaagtacgatcattgtcatcttagctttcagcaaacttgaatttggggtcacttattgaagttagtaggattgtattcaagtctcgcgataagggttgaaactgaaaaggagacccagcatggcgtat

SEQ ID NO: 435155 - DNA, 140 bp, Artificial Sequence
  Synthetic
atacgccatgctgggtctcctacaaaagcattggggtcaccccgttttatataatgatgttgcactagataaggttaaaaaacatgcgcaatctgtaaaaatcttaaaacctaaagtcatcgtacttgggagtcggccat

SEQ ID NO: 435156 - DNA, 140 bp, Artificial Sequence
  Synthetic
atggccgactcccaagtacgatgactttaggttttaagatttttacagattgcgcatgttttttaaccttatctagtgcaacatcattatataaaacggggtgaccccaatgcttttgtaggagacccagcatggcgtat

SEQ ID NO: 435157 - DNA, 140 bp, Artificial Sequence
  Synthetic
atacgccatgctgggtctccaatgttagggggttctgcaggagagaaaagttcatcagatgctgttcggctatttcttacagcaagttaccagaatttcatcaacaacttcagttgtttgcgtacttgggagtcggccat

SEQ ID NO: 435158 - DNA, 140 bp, Artificial Sequence
  Synthetic
atggccgactcccaagtacgcaaacaactgaagttgttgatgaaattctggtaacttgctgtaagaaatagccgaacagcatctgatgaacttttctctcctgcagaaccccctaacattggagacccagcatggcgtat

SEQ ID NO: 435159 - DNA, 140 bp, Artificial Sequence
  Synthetic
aggccctggctgctgatatgagtaactccgagcattcactctacaaatactcaaattaatactgctaaatctggaactatgaacccaagtagcgacgatgaggaccttatgatttccggcgaccttttgggacagcggtg

SEQ ID NO: 435160 - DNA, 140 bp, Artificial Sequence
  Synthetic
caccgctgtcccaaaaggtcgccggaaatcataaggtcctcatcgtcgctacttgggttcatagttccagatttagcagtattaatttgagtatttgtagagtgaatgctcggagttactcatatcagcagccagggcct

SEQ ID NO: 435161 - DNA, 140 bp, Artificial Sequence
  Synthetic
atacgccatgctgggtctccgtccctccaaatccaacaatcgacaaaggatgggtctgtgtttattcatctgagcaaggtgagacacgggctcttaaaatctaattcttattgttcaaagcgtacttgggagtcggccat

SEQ ID NO: 435162 - DNA, 140 bp, Artificial Sequence
  Synthetic
atggccgactcccaagtacgctttgaacaataagaattagattttaagagcccgtgtctcaccttgctcagatgaataaacacagacccatcctttgtcgattgttggatttggagggacggagacccagcatggcgtat

SEQ ID NO: 435163 - DNA, 140 bp, Artificial Sequence; identical to SEQ ID NO: 377599
  Synthetic

SEQ ID NO: 435164 - DNA, 140 bp, Artificial Sequence; identical to SEQ ID NO: 377600
  Synthetic

SEQ ID NO: 435165 - DNA, 140 bp, Artificial Sequence
  Synthetic
atacgccatgctgggtctcctcaggagtgaccttttctatttgatgcattaatgttttaaactacctcttaagcctttgagggcggtcccaatatgtgcgtaggggttaatttaaagggacgtacttgggagtcggccat

SEQ ID NO: 435166 - DNA, 140 bp, Artificial Sequence
  Synthetic
atggccgactcccaagtacgtccctttaaattaacccctacgcacatattgggaccgccctcaaaggcttaagaggtagtttaaaacattaatgcatcaaatagaaaaggtcactcctgaggagacccagcatggcgtat

SEQ ID NO: 435167 - DNA, 140 bp, Artificial Sequence
  Synthetic
atacgccatgctgggtctccgtttgaaactttttgtgttttcaaatttatagtagcaaagaatcattatcattctcaaggatcatggtataaaaccacacatgatttgcatttaactccacgtacttgggagtcggccat

SEQ ID NO: 435168 - DNA, 140 bp, Artificial Sequence
  Synthetic
atggccgactcccaagtacgtggagttaaatgcaaatcatgtgtggttttataccatgatccttgagaatgataatgattctttgctactataaatttgaaaacacaaaaagtttcaaacggagacccagcatggcgtat

SEQ ID NO: 435169 - DNA, 140 bp, Artificial Sequence
  Synthetic
atacgccatgctgggtctccaaaagcatatatgtgggcaaaacgcgactagaccatcttaatagaagtagtaatttatttctgtcttaagtgtgattttcaccttgaaagagttaaatggcgtacttgggagtcggccat

SEQ ID NO: 435170 - DNA, 140 bp, Artificial Sequence
  Synthetic
atggccgactcccaagtacgccatttaactctttcaaggtgaaaatcacacttaagacagaaataaattactacttctattaagatggtctagtcgcgttttgcccacatatatgcttttggagacccagcatggcgtat

SEQ ID NO: 435171 - DNA, 140 bp, Artificial Sequence
  Synthetic
atacgccatgctgggtctcctgatagattaatccttgaagttactcttttatgtattatggaggaactaatattactaacaaaaggggtctacctaacaggtatgattgagtgatcagtacgtacttgggagtcggccat

SEQ ID NO: 435172 - DNA, 140 bp, Artificial Sequence
  Synthetic
atggccgactcccaagtacgtactgatcactcaatcatacctgttaggtagaccccttttgttagtaatattagttcctccataatacataaaagagtaacttcaaggattaatctatcaggagacccagcatggcgtat

SEQ ID NO: 435173 - DNA, 140 bp, Artificial Sequence
  Synthetic
atacgccatgctgggtctccctatatctaagtgtctaattaacaacttgtacctctaaggaaaaacatgaagaacattaagaaaaaggatgttcttattctttgactaaacctgcatattcgtacttgggagtcggccat

SEQ ID NO: 435174 - DNA, 140 bp, Artificial Sequence
  Synthetic
atggccgactcccaagtacgaatatgcaggtttagtcaaagaataagaacatcctttttcttaatgttcttcatgtttttccttagaggtacaagttgttaattagacacttagatatagggagacccagcatggcgtat

SEQ ID NO: 435175 - DNA, 140 bp, Artificial Sequence
  Synthetic
atacgccatgctgggtctccattttaaccttacggattgcaccattaatacaaatttattgacaacccctaccgggacagaatttttagatacaagcccattacaatcctctaggtattccgtacttgggagtcggccat

SEQ ID NO: 435176 - DNA, 140 bp, Artificial Sequence
  Synthetic
atggccgactcccaagtacggaatacctagaggattgtaatgggcttgtatctaaaaattctgtcccggtaggggttgtcaataaatttgtattaatggtgcaatccgtaaggttaaaatggagacccagcatggcgtat

SEQ ID NO: 435177 - DNA, 140 bp, Artificial Sequence
  Synthetic
atacgccatgctgggtctccaaagcatatatgggggcaaaacgtaactagaccatcttaataggagtagtaatttatttctgtcttaagtgtgatttttaccttgaaagagttaaatggtcgtacttgggagtcggccat

SEQ ID NO: 435178 - DNA, 140 bp, Artificial Sequence
  Synthetic
atggccgactcccaagtacgaccatttaactctttcaaggtaaaaatcacacttaagacagaaataaattactactcctattaagatggtctagttacgttttgcccccatatatgctttggagacccagcatggcgtat

SEQ ID NO: 435179 - DNA, 140 bp, Artificial Sequence
  Synthetic
atacgccatgctgggtctcctattgcaacgtagagtcgaagaacattaagtgttctttgttagaattattcatccaagttgtttttgagtatacttgcgtcaatacaacttcccttcatacgtacttgggagtcggccat

SEQ ID NO: 435180 - DNA, 140 bp, Artificial Sequence
  Synthetic
atggccgactcccaagtacgtatgaagggaagttgtattgacgcaagtatactcaaaaacaacttggatgaataattctaacaaagaacacttaatgttcttcgactctacgttgcaataggagacccagcatggcgtat

SEQ ID NO: 435181 - DNA, 140 bp, Artificial Sequence
  Synthetic
aggccctggctgctgatatgttcccacatcacttgattaaaaacagggaattactccaacatgtggactacatgcttctttatcagtctcatcttaatccaagggataaaaactctccctgaccttttgggacagcggtg

SEQ ID NO: 435182 - DNA, 140 bp, Artificial Sequence
  Synthetic
caccgctgtcccaaaaggtcagggagagtttttatcccttggattaagatgagactgataaagaagcatgtagtccacatgttggagtaattccctgtttttaatcaagtgatgtgggaacatatcagcagccagggcct

SEQ ID NO: 435183 - DNA, 140 bp, Artificial Sequence
  Synthetic
aggccctggctgctgatatggaagccaaaacatgctacaatataagtgtaacggatccctctggaaaatccttgctgttagatcctcctaccaacatccgtgactatcctaaatgcaaaagaccttttgggacagcggtg

SEQ ID NO: 435184 - DNA, 140 bp, Artificial Sequence
  Synthetic
caccgctgtcccaaaaggtcttttgcatttaggatagtcacggatgttggtaggaggatctaacagcaaggattttccagagggatccgttacacttatattgtagcatgttttggcttccatatcagcagccagggcct

SEQ ID NO: 435185 - DNA, 140 bp, Artificial Sequence
  Synthetic
aggccctggctgctgatatgcaatttgctcataatgggcaaaaattcgttcgtgtcaatcgactcggtacaggaaccccagcacacccactcagaatgttgcgtgaagggaatcaagcttgaccttttgggacagcggtg

SEQ ID NO: 435186 - DNA, 140 bp, Artificial Sequence
  Synthetic
caccgctgtcccaaaaggtcaagcttgattcccttcacgcaacattctgagtgggtgtgctggggttcctgtaccgagtcgattgacacgaacgaatttttgcccattatgagcaaattgcatatcagcagccagggcct

SEQ ID NO: 435187 - DNA, 140 bp, Artificial Sequence
  Synthetic
aggccctggctgctgatatgttattcagaatatggtgatccccagaaatttttccaccaatcaattcacctacaatctcactaacttagtattgagtgtgcaaaagcttcctgatgatgcgaccttttgggacagcggtg

SEQ ID NO: 435188 - DNA, 140 bp, Artificial Sequence
  Synthetic
caccgctgtcccaaaaggtcgcatcatcaggaagcttttgcacactcaatactaagttagtgagattgtaggtgaattgattggtggaaaaatttctggggatcaccatattctgaataacatatcagcagccagggcct

SEQ ID NO: 435189 - DNA, 140 bp, Artificial Sequence
  Synthetic
aggccctggctgctgatatgggaagacggtttcaaattgattaaacacttggaacccttgtgtgtcagctgtatacaaacacatggcatctttacaccaagaaaatactggttccaatcagaccttttgggacagcggtg

SEQ ID NO: 435190 - DNA, 140 bp, Artificial Sequence
  Synthetic
caccgctgtcccaaaaggtctgattggaaccagtattttcttggtgtaaagatgccatgtgtttgtatacagctgacacacaagggttccaagtgtttaatcaatttgaaaccgtcttcccatatcagcagccagggcct

SEQ ID NO: 435191 - DNA, 140 bp, Artificial Sequence
  Synthetic
atacgccatgctgggtctcctgcactgttgatgtggctaatttcttgagagcatattcatggtcagatgtcttaaaaggaaaaaagttaattggtgccacactaccatgtttacttgagccgtacttgggagtcggccat

SEQ ID NO: 435192 - DNA, 140 bp, Artificial Sequence
  Synthetic
atggccgactcccaagtacggctcaagtaaacatggtagtgtggcaccaattaacttttttccttttaagacatctgaccatgaatatgctctcaagaaattagccacatcaacagtgcaggagacccagcatggcgtat

SEQ ID NO: 435193 - DNA, 140 bp, Artificial Sequence
  Synthetic
atacgccatgctgggtctcccagatgattaagtcatattatgatgaactctgtagtctcaatttgaaatttcaaatttcaggcaataaagctgagtgtgctcaaaactttattaaaactacgtacttgggagtcggccat

SEQ ID NO: 435194 - DNA, 140 bp, Artificial Sequence
  Synthetic
atggccgactcccaagtacgtagttttaataaagttttgagcacactcagctttattgcctgaaatttgaaatttcaaattgagactacagagttcatcataatatgacttaatcatctgggagacccagcatggcgtat

SEQ ID NO: 435195 - DNA, 140 bp, Artificial Sequence
  Synthetic
atacgccatgctgggtctccttttagtagcgttgcctttcagtacagtctaggtgattgttgaaagacttccaagcatggcagaattatcaacgcgttacaacttgcctgcaaatgttaccgtacttgggagtcggccat

SEQ ID NO: 435196 - DNA, 140 bp, Artificial Sequence
  Synthetic
atggccgactcccaagtacggtaacatttgcaggcaagttgtaacgcgttgataattctgccatgcttggaagtctttcaacaatcacctagactgtactgaaaggcaacgctactaaaaggagacccagcatggcgtat

SEQ ID NO: 435197 - DNA, 140 bp, Artificial Sequence
  Synthetic
aggccctggctgctgatatgaccactgcaatctctactaacaacacctccaagagcaacttcagcaccctctctgcaccactacaaaacaccatcaattacgacacacagagcacagccagaccttttgggacagcggtg

SEQ ID NO: 435198 - DNA, 140 bp, Artificial Sequence
  Synthetic
caccgctgtcccaaaaggtctggctgtgctctgtgtgtcgtaattgatggtgttttgtagtggtgcagagagggtgctgaagttgctcttggaggtgttgttagtagagattgcagtggtcatatcagcagccagggcct

SEQ ID NO: 435199 - DNA, 140 bp, Artificial Sequence
  Synthetic
atacgccatgctgggtctcccacaaacgaatgacactggatgcttcggcgctcttcaagaatacaactccacgaagaatcaaacatgtgctccgtccaaaataccttcaccactgcccaccgtacttgggagtcggccat

SEQ ID NO: 435200 - DNA, 140 bp, Artificial Sequence
  Synthetic
atggccgactcccaagtacggtgggcagtggtgaaggtattttggacggagcacatgtttgattcttcgtggagttgtattcttgaagagcgccgaagcatccagtgtcattcgtttgtgggagacccagcatggcgtat

SEQ ID NO: 435201 - DNA, 140 bp, Artificial Sequence
  Synthetic
aggccctggctgctgatatgacgaagaatcaaacatgtgctccgtccaaaataccttcaccactgcccacaacccgctcagagattaaacccacaagcaccccaactgatgccaccgcacgaccttttgggacagcggtg

SEQ ID NO: 435202 - DNA, 140 bp, Artificial Sequence
  Synthetic
caccgctgtcccaaaaggtcgtgcggtggcatcagttggggtgcttgtgggtttaatctctgagcgggttgtgggcagtggtgaaggtattttggacggagcacatgtttgattcttcgtcatatcagcagccagggcct

SEQ ID NO: 435203 - DNA, 140 bp, Artificial Sequence
  Synthetic
aggccctggctgctgatatgggtaaatatgctggggggggtcaagctgctattgatagtaatataatcttccaaaatactatcaatttaggagtggcagttttagatattgcattatctcgaccttttgggacagcggtg

SEQ ID NO: 435204 - DNA, 140 bp, Artificial Sequence
  Synthetic
caccgctgtcccaaaaggtcgagataatgcaatatctaaaactgccactcctaaattgatagtattttggaagattatattactatcaatagcagcttgaccccccccagcatatttacccatatcagcagccagggcct

SEQ ID NO: 435205 - DNA, 140 bp, Artificial Sequence
  Synthetic
atacgccatgctgggtctcctgggtcaagcagatttttccttgaatcaaatattggattttgctgaaaagttagagtatttggctccttcttataggaatttttctttctcattaaaagacgtacttgggagtcggccat

SEQ ID NO: 435206 - DNA, 140 bp, Artificial Sequence
  Synthetic
atggccgactcccaagtacgtcttttaatgagaaagaaaaattcctataagaaggagccaaatactctaacttttcagcaaaatccaatatttgattcaaggaaaaatctgcttgacccaggagacccagcatggcgtat

SEQ ID NO: 435207 - DNA, 140 bp, Artificial Sequence
  Synthetic
atacgccatgctgggtctccgcaagggttttcatcaacaatgccacccactccctcaccacaaccaagcacgccacagcaagaaggaaacaacacagaccattcccaaggtgctgtgactcgtacttgggagtcggccat

SEQ ID NO: 435208 - DNA, 140 bp, Artificial Sequence
  Synthetic
atggccgactcccaagtacgagtcacagcaccttgggaatggtctgtgttgtttccttcttgctgtggcgtgcttggttgtggtgagggagtgggtggcattgttgatgaaaacccttgcggagacccagcatggcgtat

SEQ ID NO: 435209 - DNA, 140 bp, Artificial Sequence
  Synthetic
atacgccatgctgggtctccgtatacaaacacatggcatctttacaccaggaaaatactggttccaatcacagaggattgagtcatattatgaggagctctgtagtctcaattggaaattcgtacttgggagtcggccat

SEQ ID NO: 435210 - DNA, 140 bp, Artificial Sequence
  Synthetic
atggccgactcccaagtacgaatttccaattgagactacagagctcctcataatatgactcaatcctctgtgattggaaccagtattttcctggtgtaaagatgccatgtgtttgtatacggagacccagcatggcgtat

SEQ ID NO: 435211 - DNA, 140 bp, Artificial Sequence
  Synthetic
aggccctggctgctgatatgcaatattggcacattgggtgagtccttgagctttatccttaatataatgtaagaaattaaggaaatactgagatatactagttgaattgagttatgacatgaccttttgggacagcggtg

SEQ ID NO: 435212 - DNA, 140 bp, Artificial Sequence
  Synthetic
caccgctgtcccaaaaggtcatgtcataactcaattcaactagtatatctcagtatttccttaatttcttacattatattaaggataaagctcaaggactcacccaatgtgccaatattgcatatcagcagccagggcct

SEQ ID NO: 435213 - DNA, 140 bp, Artificial Sequence
  Synthetic
atacgccatgctgggtctccaaatattacaatgatatattaaagttaaatctagttatcaaggcagtagagaaaggtaaaaattggtcacaacttgttgagacccttcctaatatgcattcgtacttgggagtcggccat

SEQ ID NO: 435214 - DNA, 140 bp, Artificial Sequence
  Synthetic
atggccgactcccaagtacgaatgcatattaggaagggtctcaacaagttgtgaccaatttttacctttctctactgccttgataactagatttaactttaatatatcattgtaatatttggagacccagcatggcgtat

SEQ ID NO: 435215 - DNA, 140 bp, Artificial Sequence
  Synthetic
atacgccatgctgggtctccaggaaatcttaccacagcaaagagcaccaacaacacgaaaggccccaccacaacggcaccaaatatgacaaatgagcatttaaccagtccctcccccacccgtacttgggagtcggccat

SEQ ID NO: 435216 - DNA, 140 bp, Artificial Sequence
  Synthetic
atggccgactcccaagtacgggtgggggagggactggttaaatgctcatttgtcatatttggtgccgttgtggtggggcctttcgtgttgttggtgctctttgctgtggtaagatttcctggagacccagcatggcgtat

SEQ ID NO: 435217 - DNA, 140 bp, Artificial Sequence
  Synthetic
atacgccatgctgggtctccttgaaactttttgtgttttcaaatttatagtagcaaagaatcattatcattctcaaggatcatggtataaaaccacaatggatttgcatttaactccatacgtacttgggagtcggccat

SEQ ID NO: 435218 - DNA, 140 bp, Artificial Sequence
  Synthetic
atggccgactcccaagtacgtatggagttaaatgcaaatccattgtggttttataccatgatccttgagaatgataatgattctttgctactataaatttgaaaacacaaaaagtttcaaggagacccagcatggcgtat

SEQ ID NO: 435219 - DNA, 140 bp, Artificial Sequence
  Synthetic
aggccctggctgctgatatgggagtaaacttggtgacaggtcatgatgcctatgacagtatcatcagtaattcagtaggtcaaactagattctcaggacttcttattgtgaaaacagttcgaccttttgggacagcggtg

SEQ ID NO: 435220 - DNA, 140 bp, Artificial Sequence
  Synthetic
caccgctgtcccaaaaggtcgaactgttttcacaataagaagtcctgagaatctagtttgacctactgaattactgatgatactgtcataggcatcatgacctgtcaccaagtttactcccatatcagcagccagggcct

SEQ ID NO: 435221 - DNA, 140 bp, Artificial Sequence
  Synthetic
aggccctggctgctgatatgaatcacataataatgttggaggcacagtatattatagttgattgttctgtacaataaaggatatatctactctgagttatatttactggtatatgatagtgaccttttgggacagcggtg

SEQ ID NO: 435222 - DNA, 140 bp, Artificial Sequence
  Synthetic
caccgctgtcccaaaaggtcactatcatataccagtaaatataactcagagtagatatatcctttattgtacagaacaatcaactataatatactgtgcctccaacattattatgtgattcatatcagcagccagggcct

SEQ ID NO: 435223 - DNA, 140 bp, Artificial Sequence
  Synthetic
aggccctggctgctgatatgaaaagagttgaatataggaagaacttttgggaaattaccatatcgtgtcagaaatgtccaaacactcgcagaagccttgctagcagatggactagcaaaagaccttttgggacagcggtg

SEQ ID NO: 435224 - DNA, 140 bp, Artificial Sequence
  Synthetic
caccgctgtcccaaaaggtcttttgctagtccatctgctagcaaggcttctgcgagtgtttggacatttctgacacgatatggtaatttcccaaaagttcttcctatattcaactcttttcatatcagcagccagggcct

SEQ ID NO: 435225 - DNA, 140 bp, Artificial Sequence
  Synthetic
atacgccatgctgggtctccttggcagtattggtgatgtaaatggtgatatcttagaacccataagatcaccttcttcaccgtctgctcctcaggaagacacaagggcaagggaagcctacgtacttgggagtcggccat

SEQ ID NO: 435226 - DNA, 140 bp, Artificial Sequence
  Synthetic
atggccgactcccaagtacgtaggcttcccttgcccttgtgtcttcctgaggagcagacggtgaagaaggtgatcttatgggttctaagatatcaccatttacatcaccaatactgccaaggagacccagcatggcgtat

SEQ ID NO: 435227 - DNA, 140 bp, Artificial Sequence
  Synthetic
atacgccatgctgggtctccagacgtgccgttcaaagagtcttgatttataattaaccattgtaaggattaatttactctttccgttatacttatctacattaattccttgaatgtccagcgtacttgggagtcggccat

SEQ ID NO: 435228 - DNA, 140 bp, Artificial Sequence
  Synthetic
atggccgactcccaagtacgctggacattcaaggaattaatgtagataagtataacggaaagagtaaattaatccttacaatggttaattataaatcaagactctttgaacggcacgtctggagacccagcatggcgtat

SEQ ID NO: 435229 - DNA, 140 bp, Artificial Sequence
  Synthetic
aggccctggctgctgatatgcatcattaacaacttgtcttaattcaatcccttggatgcaaaccataaggaaaaatgagccactttccctctactctgagctaaggaaacttctcttatcgaccttttgggacagcggtg

SEQ ID NO: 435230 - DNA, 140 bp, Artificial Sequence
  Synthetic
caccgctgtcccaaaaggtcgataagagaagtttccttagctcagagtagagggaaagtggctcatttttccttatggtttgcatccaagggattgaattaagacaagttgttaatgatgcatatcagcagccagggcct

SEQ ID NO: 435231 - DNA, 140 bp, Artificial Sequence
  Synthetic
aggccctggctgctgatatgcacagagaattgataaaattttactttgatcatttttgcgaagaattataaaaatctcgaaggacaaattattgtaaaacagagtcgaagaacattaagtgaccttttgggacagcggtg

SEQ ID NO: 435232 - DNA, 140 bp, Artificial Sequence
  Synthetic
caccgctgtcccaaaaggtcacttaatgttcttcgactctgttttacaataatttgtccttcgagatttttataattcttcgcaaaaatgatcaaagtaaaattttatcaattctctgtgcatatcagcagccagggcct

SEQ ID NO: 435233 - DNA, 140 bp, Artificial Sequence
  Synthetic
atacgccatgctgggtctcctgttatatgcatgtcagtgatttttatagcccaccacattgcgtaacagaagataaccgaaataacccaccggattgtgctaatgcttatcattatcactcgtacttgggagtcggccat

SEQ ID NO: 435234 - DNA, 140 bp, Artificial Sequence
  Synthetic
atggccgactcccaagtacgagtgataatgataagcattagcacaatccggtgggttatttcggttatcttctgttacgcaatgtggtgggctataaaaatcactgacatgcatataacaggagacccagcatggcgtat

SEQ ID NO: 435235 - DNA, 140 bp, Artificial Sequence
  Synthetic
aggccctggctgctgatatgaattcttcttttaattgccataatgatacaactataaacctccgtacatttgccgcagtactgtaatcaacactgctgtatctcttcttcaagccatcttgaccttttgggacagcggtg

SEQ ID NO: 435236 - DNA, 140 bp, Artificial Sequence
  Synthetic
caccgctgtcccaaaaggtcaagatggcttgaagaagagatacagcagtgttgattacagtactgcggcaaatgtacggaggtttatagttgtatcattatggcaattaaaagaagaattcatatcagcagccagggcct

SEQ ID NO: 435237 - DNA, 140 bp, Artificial Sequence
  Synthetic
aggccctggctgctgatatgcatccaagttgtttttgagtatactcgcgtcaatacaacttcccttcatatttgattcaagatttaaaatgcaacaaccccgtggaagaagtcgaactcggaccttttgggacagcggtg

SEQ ID NO: 435238 - DNA, 140 bp, Artificial Sequence
  Synthetic
caccgctgtcccaaaaggtccgagttcgacttcttccacggggttgttgcattttaaatcttgaatcaaatatgaagggaagttgtattgacgcgagtatactcaaaaacaacttggatgcatatcagcagccagggcct

SEQ ID NO: 435239 - DNA, 140 bp, Artificial Sequence
  Synthetic
aggccctggctgctgatatgttaaatctgaatcattaagagcataacttttacaaagagaacttcatttaatctacagaaataatctatttaaaaatgagggttacatttactaaattatgaccttttgggacagcggtg

SEQ ID NO: 435240 - DNA, 140 bp, Artificial Sequence
  Synthetic
caccgctgtcccaaaaggtcataatttagtaaatgtaaccctcatttttaaatagattatttctgtagattaaatgaagttctctttgtaaaagttatgctcttaatgattcagatttaacatatcagcagccagggcct

SEQ ID NO: 435241 - DNA, 140 bp, Artificial Sequence
  Synthetic
atacgccatgctgggtctccgtgggtcaccgtcactttctaaagggctctcaaaagataaacaagagcaaacgaaagatgtgttgaccttggaaaatctaggacacattctgaactacctcgtacttgggagtcggccat

SEQ ID NO: 435242 - DNA, 140 bp, Artificial Sequence
  Synthetic
atggccgactcccaagtacgaggtagttcagaatgtgtcctagattttccaaggtcaacacatctttcgtttgctcttgtttatcttttgagagccctttagaaagtgacggtgacccacggagacccagcatggcgtat

SEQ ID NO: 435243 - DNA, 140 bp, Artificial Sequence
  Synthetic
atacgccatgctgggtctccaagcagaacatttgatgctttcctcggagtggttcctccagtgataagagtcaaaaacttccaaacagtccctcgcccgtgtcaaaaaagccttcgggctcgtacttgggagtcggccat

SEQ ID NO: 435244 - DNA, 140 bp, Artificial Sequence
  Synthetic
atggccgactcccaagtacgagcccgaaggcttttttgacacgggcgagggactgtttggaagtttttgactcttatcactggaggaaccactccgaggaaagcatcaaatgttctgcttggagacccagcatggcgtat

SEQ ID NO: 435245 - DNA, 140 bp, Artificial Sequence
  Synthetic
aggccctggctgctgatatgtagatctattgttcatatgctatcagaatggctgctcctggaggtcacgtcggcaatccatattagccctaatctgttgggaatctatttgacttcagacgaccttttgggacagcggtg

SEQ ID NO: 435246 - DNA, 140 bp, Artificial Sequence
  Synthetic
caccgctgtcccaaaaggtcgtctgaagtcaaatagattcccaacagattagggctaatatggattgccgacgtgacctccaggagcagccattctgatagcatatgaacaatagatctacatatcagcagccagggcct

SEQ ID NO: 435247 - DNA, 140 bp, Artificial Sequence
  Synthetic
aggccctggctgctgatatgttaaatgtaccaggatcaagggaaataataacgttccttagacaaacagttcgtgaaaatatcacgatcacgtcacaaaatagaataataaattccctttgaccttttgggacagcggtg

SEQ ID NO: 435248 - DNA, 140 bp, Artificial Sequence
  Synthetic
caccgctgtcccaaaaggtcaaagggaatttattattctattttgtgacgtgatcgtgatattttcacgaactgtttgtctaaggaacgttattatttcccttgatcctggtacatttaacatatcagcagccagggcct

SEQ ID NO: 435249 - DNA, 140 bp, Artificial Sequence
  Synthetic
atacgccatgctgggtctccagaacattaagaaaaaggatgttcttattcttcaactaaacttgcatatcctttgttgatacccttgggagacaacttttgacactagatcacggatcaacgtacttgggagtcggccat

SEQ ID NO: 435250 - DNA, 140 bp, Artificial Sequence
  Synthetic
atggccgactcccaagtacgttgatccgtgatctagtgtcaaaagttgtctcccaagggtatcaacaaaggatatgcaagtttagttgaagaataagaacatcctttttcttaatgttctggagacccagcatggcgtat

SEQ ID NO: 435251 - DNA, 140 bp, Artificial Sequence
  Synthetic
aggccctggctgctgatatgctttgttgatacccttgggagacaacttttgacactagatcacggatcaagcatattccattcaaacaccctaaattttcaatcatacacataataaccagaccttttgggacagcggtg

SEQ ID NO: 435252 - DNA, 140 bp, Artificial Sequence
  Synthetic
caccgctgtcccaaaaggtctggttattatgtgtatgattgaaaatttagggtgtttgaatggaatatgcttgatccgtgatctagtgtcaaaagttgtctcccaagggtatcaacaaagcatatcagcagccagggcct

SEQ ID NO: 435253 - DNA, 140 bp, Artificial Sequence; identical to SEQ ID NO: 377603
  Synthetic

SEQ ID NO: 435254 - DNA, 140 bp, Artificial Sequence; identical to SEQ ID NO: 377604
  Synthetic

SEQ ID NO: 435255 - DNA, 140 bp, Artificial Sequence
  Synthetic
atacgccatgctgggtctcctattgatgcattggacgatgatttatctgagtccttagaaaaattcacatgtactgttgatatagctaatttcttgagggcatattcatggctcgacgtccgtacttgggagtcggccat

SEQ ID NO: 435256 - DNA, 140 bp, Artificial Sequence
  Synthetic
atggccgactcccaagtacggacgtcgagccatgaatatgccctcaagaaattagctatatcaacagtacatgtgaatttttctaaggactcagataaatcatcgtccaatgcatcaataggagacccagcatggcgtat

SEQ ID NO: 435257 - DNA, 140 bp, Artificial Sequence
  Synthetic
aggccctggctgctgatatggaacttacttctttaaaaattaatttacactaaacaattcgtttttgttgacggaacaaattcagacatggccagttccagcaatcacaatacgtatatggaccttttgggacagcggtg

SEQ ID NO: 435258 - DNA, 140 bp, Artificial Sequence
  Synthetic
caccgctgtcccaaaaggtccatatacgtattgtgattgctggaactggccatgtctgaatttgttccgtcaacaaaaacgaattgtttagtgtaaattaatttttaaagaagtaagttccatatcagcagccagggcct

SEQ ID NO: 435259 - DNA, 140 bp, Artificial Sequence
  Synthetic
atacgccatgctgggtctccatgcgaatccaacactcagtgccatttgaaatgatgttcaaatgagacagaagtccatctgtataaggagtatggcttaagtggatatttgtcagattctcgtacttgggagtcggccat

SEQ ID NO: 435260 - DNA, 140 bp, Artificial Sequence
  Synthetic
atggccgactcccaagtacgagaatctgacaaatatccacttaagccatactccttatacagatggacttctgtctcatttgaacatcatttcaaatggcactgagtgttggattcgcatggagacccagcatggcgtat

SEQ ID NO: 435261 - DNA, 140 bp, Artificial Sequence
  Synthetic
atacgccatgctgggtctcctttgcttgacacaagataatcttgtatcaccttaagcctcacacaagtgagagaattacacgcacagattaacttgtgattggatgttcggtcacaacaacgtacttgggagtcggccat

SEQ ID NO: 435262 - DNA, 140 bp, Artificial Sequence
  Synthetic
atggccgactcccaagtacgttgttgtgaccgaacatccaatcacaagttaatctgtgcgtgtaattctctcacttgtgtgaggcttaaggtgatacaagattatcttgtgtcaagcaaaggagacccagcatggcgtat

SEQ ID NO: 435263 - DNA, 140 bp, Artificial Sequence; identical to SEQ ID NO: 377535
  Synthetic

SEQ ID NO: 435264 - DNA, 140 bp, Artificial Sequence; identical to SEQ ID NO: 377536
  Synthetic

SEQ ID NO: 435265 - DNA, 140 bp, Artificial Sequence
  Synthetic
atacgccatgctgggtctccagcatcatcttattaaatagctgtcatataacaggctgttcctataatctgattgtgagattataaacttgtagaattaccgtgggtcacaactgttgcacgtacttgggagtcggccat

SEQ ID NO: 435266 - DNA, 140 bp, Artificial Sequence
  Synthetic
atggccgactcccaagtacgtgcaacagttgtgacccacggtaattctacaagtttataatctcacaatcagattataggaacagcctgttatatgacagctatttaataagatgatgctggagacccagcatggcgtat

SEQ ID NO: 435267 - DNA, 140 bp, Artificial Sequence
  Synthetic
aggccctggctgctgatatgtatcttccaaaatatatcttttgcaagcgatgtgtgcttgaatacatcgatataatacatactaataatgattgattaagaaaaaccaatgatggatattgaccttttgggacagcggtg

SEQ ID NO: 435268 - DNA, 140 bp, Artificial Sequence
  Synthetic
caccgctgtcccaaaaggtcaatatccatcattggtttttcttaatcaatcattattagtatgtattatatcgatgtattcaagcacacatcgcttgcaaaagatatattttggaagatacatatcagcagccagggcct

SEQ ID NO: 435269 - DNA, 140 bp, Artificial Sequence
  Synthetic
atacgccatgctgggtctcctgtacttgttaaattttacataggattatataattctcttcgatacacatcatatctttaacaaaataacgaaaacaactttatcatgtcagacgccagtcgtacttgggagtcggccat

SEQ ID NO: 435270 - DNA, 140 bp, Artificial Sequence
  Synthetic
atggccgactcccaagtacgactggcgtctgacatgataaagttgttttcgttattttgttaaagatatgatgtgtatcgaagagaattatataatcctatgtaaaatttaacaagtacaggagacccagcatggcgtat

SEQ ID NO: 435271 - DNA, 140 bp, Artificial Sequence
  Synthetic
aggccctggctgctgatatgtccaactattgctgcatggacactaggagaaactatagtcggaagcattttttctgatgagtcttctcaaagtacagatccaataagttcaggttgcacagaccttttgggacagcggtg

SEQ ID NO: 435272 - DNA, 140 bp, Artificial Sequence
  Synthetic
caccgctgtcccaaaaggtctgtgcaacctgaacttattggatctgtactttgagaagactcatcagaaaaaatgcttccgactatagtttctcctagtgtccatgcagcaatagttggacatatcagcagccagggcct

SEQ ID NO: 435273 - DNA, 140 bp, Artificial Sequence
  Synthetic
atacgccatgctgggtctcctttctgatgagtcttctcaaagtacagatccaataagttcaggttgcacaaaaactttcgtcacacatttccttgtgtatccagttgagagtattttttacgtacttgggagtcggccat

SEQ ID NO: 435274 - DNA, 140 bp, Artificial Sequence
  Synthetic
atggccgactcccaagtacgtaaaaaatactctcaactggatacacaaggaaatgtgtgacgaaagtttttgtgcaacctgaacttattggatctgtactttgagaagactcatcagaaaggagacccagcatggcgtat

SEQ ID NO: 435275 - DNA, 140 bp, Artificial Sequence
  Synthetic
atacgccatgctgggtctccgaagataatcgaaataacccacctgattgtgctaatgcttatcattatcacttaggaggtatagagggacttcagcagaaattgtggacatgcatatcatcgtacttgggagtcggccat

SEQ ID NO: 435276 - DNA, 140 bp, Artificial Sequence
  Synthetic
atggccgactcccaagtacgatgatatgcatgtccacaatttctgctgaagtccctctatacctcctaagtgataatgataagcattagcacaatcaggtgggttatttcgattatcttcggagacccagcatggcgtat

SEQ ID NO: 435277 - DNA, 140 bp, Artificial Sequence
  Synthetic
atacgccatgctgggtctccgtgggtcaccgtctctttctaaagggctctcaaaagataaacaggagcaaacgaaggatgtgttgaccttggaaaatctaggacacatcctgagctatctcgtacttgggagtcggccat

SEQ ID NO: 435278 - DNA, 140 bp, Artificial Sequence
  Synthetic
atggccgactcccaagtacgagatagctcaggatgtgtcctagattttccaaggtcaacacatccttcgtttgctcctgtttatcttttgagagccctttagaaagagacggtgacccacggagacccagcatggcgtat

SEQ ID NO: 435279 - DNA, 140 bp, Artificial Sequence
  Synthetic
atacgccatgctgggtctcctatcagtttaactttatcttatcttcctcatacaagtgaaaacactgcctactctggagaaaatgaaaatgattgtgatgcagagctaagaatttggagccgtacttgggagtcggccat

SEQ ID NO: 435280 - DNA, 140 bp, Artificial Sequence
  Synthetic
atggccgactcccaagtacggctccaaattcttagctctgcatcacaatcattttcattttctccagagtaggcagtgttttcacttgtatgaggaagataagataaagttaaactgataggagacccagcatggcgtat

SEQ ID NO: 435281 - DNA, 140 bp, Artificial Sequence
  Synthetic
atacgccatgctgggtctccgtgcccagatcacccttgtagagttaaaaactaaattaaaattaaaatccagtgtcatgggtgataatcaatgtataacaactctaagtctttttccaatcgtacttgggagtcggccat

SEQ ID NO: 435282 - DNA, 140 bp, Artificial Sequence
  Synthetic
atggccgactcccaagtacgattggaaaaagacttagagttgttatacattgattatcacccatgacactggattttaattttaatttagtttttaactctacaagggtgatctgggcacggagacccagcatggcgtat

SEQ ID NO: 435283 - DNA, 140 bp, Artificial Sequence
  Synthetic
atacgccatgctgggtctcctttcttgttgcacagtttcttgcattacttatttggacttgaagacatagttaagactggccgaaaatgctctccagtcaactccgttcccgctcagaagcgtacttgggagtcggccat

SEQ ID NO: 435284 - DNA, 140 bp, Artificial Sequence
  Synthetic
atggccgactcccaagtacgcttctgagcgggaacggagttgactggagagcattttcggccagtcttaactatgtcttcaagtccaaataagtaatgcaagaaactgtgcaacaagaaaggagacccagcatggcgtat

SEQ ID NO: 435285 - DNA, 140 bp, Artificial Sequence
  Synthetic
aggccctggctgctgatatgggacatgctgttcaaggaattttaatttataactaaccattgcaagaattaatttactttttccgttatacttacttgcattaattctttgaatatttaggaccttttgggacagcggtg

SEQ ID NO: 435286 - DNA, 140 bp, Artificial Sequence
  Synthetic
caccgctgtcccaaaaggtcctaaatattcaaagaattaatgcaagtaagtataacggaaaaagtaaattaattcttgcaatggttagttataaattaaaattccttgaacagcatgtcccatatcagcagccagggcct

SEQ ID NO: 435287 - DNA, 140 bp, Artificial Sequence
  Synthetic
aggccctggctgctgatatggagttgctgtcgaattagctattactacgggttatagtggtatatttttgaagcctgaagaaacatttgtccattcagggttcatttattttggtaaaaagaccttttgggacagcggtg

SEQ ID NO: 435288 - DNA, 140 bp, Artificial Sequence
  Synthetic
caccgctgtcccaaaaggtctttttaccaaaataaatgaaccctgaatggacaaatgtttcttcaggcttcaaaaatataccactataacccgtagtaatagctaattcgacagcaactccatatcagcagccagggcct

SEQ ID NO: 435289 - DNA, 140 bp, Artificial Sequence
  Synthetic
atacgccatgctgggtctccaccaggacagaaattttagatacaagtccgttacaatcctctagatattcatcaacttccagggaacggtctctactatccagagaacaagcttcatattcgtacttgggagtcggccat

SEQ ID NO: 435290 - DNA, 140 bp, Artificial Sequence
  Synthetic
atggccgactcccaagtacgaatatgaagcttgttctctggatagtagagaccgttccctggaagttgatgaatatctagaggattgtaacggacttgtatctaaaatttctgtcctggtggagacccagcatggcgtat

SEQ ID NO: 435291 - DNA, 140 bp, Artificial Sequence
  Synthetic
atacgccatgctgggtctcccattcaagttgtttttgagtatatctacttcaacacaactcccctttatatttgattcaagatttaaaatgcaacaacctcgtggaagaagtcgaacccgcgtacttgggagtcggccat

SEQ ID NO: 435292 - DNA, 140 bp, Artificial Sequence
  Synthetic
atggccgactcccaagtacgcgggttcgacttcttccacgaggttgttgcattttaaatcttgaatcaaatataaaggggagttgtgttgaagtagatatactcaaaaacaacttgaatgggagacccagcatggcgtat

SEQ ID NO: 435293 - DNA, 140 bp, Artificial Sequence
  Synthetic
atacgccatgctgggtctccagcatcatcttattgaatagttatcatacaataggctgttcctataatctgattgtgagattataaacttgtagaattaccgtgggtcacaactgttgcacgtacttgggagtcggccat

SEQ ID NO: 435294 - DNA, 140 bp, Artificial Sequence
  Synthetic
atggccgactcccaagtacgtgcaacagttgtgacccacggtaattctacaagtttataatctcacaatcagattataggaacagcctattgtatgataactattcaataagatgatgctggagacccagcatggcgtat

SEQ ID NO: 435295 - DNA, 140 bp, Artificial Sequence
  Synthetic
atacgccatgctgggtctccaagacaagatcggttatcctcccttaagagtaaattgtccatcagcagcacttaaggaagccattgagatggtttctagattattatgggtgactcaaggcgtacttgggagtcggccat

SEQ ID NO: 435296 - DNA, 140 bp, Artificial Sequence
  Synthetic
atggccgactcccaagtacgccttgagtcacccataataatctagaaaccatctcaatggcttccttaagtgctgctgatggacaatttactcttaagggaggataaccgatcttgtcttggagacccagcatggcgtat

SEQ ID NO: 435297 - DNA, 140 bp, Artificial Sequence
  Synthetic
atacgccatgctgggtctcccactgcagaccgagaaaaattgcttattcctctcctcaattcgagagtaaatctggactatcagacagtgcttaactttttacctacacactactcaggccgtacttgggagtcggccat

SEQ ID NO: 435298 - DNA, 140 bp, Artificial Sequence
  Synthetic
atggccgactcccaagtacggcctgagtagtgtgtaggtaaaaagttaagcactgtctgatagtccagatttactctcgaattgaggagaggaataagcaatttttctcggtctgcagtgggagacccagcatggcgtat

SEQ ID NO: 435299 - DNA, 140 bp, Artificial Sequence
  Synthetic
aggccctggctgctgatatgaatcagtgtgcaagcctcatacgaccattttattcttcctcaaagtcaaggtaaaggacagtgattattgattgaaggttgacaatcagatcaccttcaggaccttttgggacagcggtg

SEQ ID NO: 435300 - DNA, 140 bp, Artificial Sequence
  Synthetic
caccgctgtcccaaaaggtcctgaaggtgatctgattgtcaaccttcaatcaataatcactgtcctttaccttgactttgaggaagaataaaatggtcgtatgaggcttgcacactgattcatatcagcagccagggcct

SEQ ID NO: 435301 - DNA, 140 bp, Artificial Sequence
  Synthetic
atacgccatgctgggtctccgaatgccattcagtattatgggcaggttcaactcaagaaaccatatagctcaaatgcaaaaaactcagaatggtacttgtgttgcggtaaacgaagaattcgtacttgggagtcggccat

SEQ ID NO: 435302 - DNA, 140 bp, Artificial Sequence
  Synthetic
atggccgactcccaagtacgaattcttcgtttaccgcaacacaagtaccattctgagttttttgcatttgagctatatggtttcttgagttgaacctgcccataatactgaatggcattcggagacccagcatggcgtat

SEQ ID NO: 435303 - DNA, 140 bp, Artificial Sequence
  Synthetic
atacgccatgctgggtctccctttgttgatacccctgagggaccacttttgacactagaccacggatcaaacatattttaatcaaacaccctaacttttcaatcatacacataataaccacgtacttgggagtcggccat

SEQ ID NO: 435304 - DNA, 140 bp, Artificial Sequence
  Synthetic
atggccgactcccaagtacgtggttattatgtgtatgattgaaaagttagggtgtttgattaaaatatgtttgatccgtggtctagtgtcaaaagtggtccctcaggggtatcaacaaagggagacccagcatggcgtat

SEQ ID NO: 435305 - DNA, 140 bp, Artificial Sequence
  Synthetic
atacgccatgctgggtctcctcggagcaaaaactggttgaaaattgtcgaccatcaaaggacattagattcaaggacaatccaaaaacaacaaaacatgaccagggatgtgtggggaaggcgtacttgggagtcggccat

SEQ ID NO: 435306 - DNA, 140 bp, Artificial Sequence
  Synthetic
atggccgactcccaagtacgccttccccacacatccctggtcatgttttgttgtttttggattgtccttgaatctaatgtcctttgatggtcgacaattttcaaccagtttttgctccgaggagacccagcatggcgtat

SEQ ID NO: 435307 - DNA, 140 bp, Artificial Sequence
  Synthetic
atacgccatgctgggtctccatcccaaataccggaatgacattgttgcatcatttaaaatctaattttgttgttccagaatggcaacaaacaaggagtctcttctcccatctctttaaaacgtacttgggagtcggccat

SEQ ID NO: 435308 - DNA, 140 bp, Artificial Sequence
  Synthetic
atggccgactcccaagtacgttttaaagagatgggagaagagactccttgtttgttgccattctggaacaacaaaattagattttaaatgatgcaacaatgtcattccggtatttgggatggagacccagcatggcgtat

SEQ ID NO: 435309 - DNA, 140 bp, Artificial Sequence
  Synthetic
atacgccatgctgggtctccctggaggacggtttcaaattgattaaacacttagaacccttgtgtgtcagctgtatacaaacacacggcatcttcacaccaagaaaatattggttccaatcgtacttgggagtcggccat

SEQ ID NO: 435310 - DNA, 140 bp, Artificial Sequence
  Synthetic
atggccgactcccaagtacgattggaaccaatattttcttggtgtgaagatgccgtgtgtttgtatacagctgacacacaagggttctaagtgtttaatcaatttgaaaccgtcctccagggagacccagcatggcgtat

SEQ ID NO: 435311 - DNA, 140 bp, Artificial Sequence
  Synthetic
atacgccatgctgggtctccatcaacttccagggaacggtctctactatctagagaacaagcttcatatttgtatgttgattgcagtaatattccctctatctctctagacccgggctttcgtacttgggagtcggccat

SEQ ID NO: 435312 - DNA, 140 bp, Artificial Sequence
  Synthetic
atggccgactcccaagtacgaaagcccgggtctagagagatagagggaatattactgcaatcaacatacaaatatgaagcttgttctctagatagtagagaccgttccctggaagttgatggagacccagcatggcgtat

SEQ ID NO: 435313 - DNA, 140 bp, Artificial Sequence
  Synthetic
atacgccatgctgggtctccaaatgtccatcaagcaagtgttgtagaataccaggggtttcacaggctgctaaacttactaaattttacataggattatataattcttttcgatacacgtcgtacttgggagtcggccat

SEQ ID NO: 435314 - DNA, 140 bp, Artificial Sequence
  Synthetic
atggccgactcccaagtacgacgtgtatcgaaaagaattatataatcctatgtaaaatttagtaagtttagcagcctgtgaaacccctggtattctacaacacttgcttgatggacatttggagacccagcatggcgtat

SEQ ID NO: 435315 - DNA, 140 bp, Artificial Sequence
  Synthetic
aggccctggctgctgatatgtatgagaaataataaaataaacaagaagaagaaaaaactattagacagcttgctttacacaagataatcttatatcgtctcaaaccgtacacaagtaggggaccttttgggacagcggtg

SEQ ID NO: 435316 - DNA, 140 bp, Artificial Sequence
  Synthetic
caccgctgtcccaaaaggtcccctacttgtgtacggtttgagacgatataagattatcttgtgtaaagcaagctgtctaatagttttttcttcttcttgtttattttattatttctcatacatatcagcagccagggcct

SEQ ID NO: 435317 - DNA, 140 bp, Artificial Sequence
  Synthetic
atacgccatgctgggtctcctattatacatacgagtaacgattgattaagaaaaatcaatgatggatattaaatgtccatcaagcaggtgtcgtaagataccaggggtttcacatactgccgtacttgggagtcggccat

SEQ ID NO: 435318 - DNA, 140 bp, Artificial Sequence
  Synthetic
atggccgactcccaagtacggcagtatgtgaaacccctggtatcttacgacacctgcttgatggacatttaatatccatcattgatttttcttaatcaatcgttactcgtatgtataataggagacccagcatggcgtat

SEQ ID NO: 435319 - DNA, 140 bp, Artificial Sequence
  Synthetic
aggccctggctgctgatatgaggaatgccattcagtattatgggcaggttcaactcaagaaaccatatagctcaaatgcaaagaactcagaatggtacttgtgttgcggtaaacgaagaagaccttttgggacagcggtg

SEQ ID NO: 435320 - DNA, 140 bp, Artificial Sequence
  Synthetic
caccgctgtcccaaaaggtcttcttcgtttaccgcaacacaagtaccattctgagttctttgcatttgagctatatggtttcttgagttgaacctgcccataatactgaatggcattcctcatatcagcagccagggcct

SEQ ID NO: 435321 - DNA, 140 bp, Artificial Sequence
  Synthetic
atacgccatgctgggtctccagcccatctgcataagaagcatggcttaaatgggtatctgttaaattctcacaagattagtttgtattgatttcaacaatgctttaaccttacattgctgcgtacttgggagtcggccat

SEQ ID NO: 435322 - DNA, 140 bp, Artificial Sequence
  Synthetic
atggccgactcccaagtacgcagcaatgtaaggttaaagcattgttgaaatcaatacaaactaatcttgtgagaatttaacagatacccatttaagccatgcttcttatgcagatgggctggagacccagcatggcgtat

SEQ ID NO: 435323 - DNA, 140 bp, Artificial Sequence
  Synthetic
atacgccatgctgggtctcctatatctttagcaaagtgaggaaaacagctttatcatgttagatgccagttatccattttaagtgaatcctttcctcaacatgcagcatccaactcaatacgtacttgggagtcggccat

SEQ ID NO: 435324 - DNA, 140 bp, Artificial Sequence
  Synthetic
atggccgactcccaagtacgtattgagttggatgctgcatgttgaggaaaggattcacttaaaatggataactggcatctaacatgataaagctgttttcctcactttgctaaagatataggagacccagcatggcgtat

SEQ ID NO: 435325 - DNA, 140 bp, Artificial Sequence
  Synthetic
aggccctggctgctgatatgacaagattagtttgtattgatttcaacaatgctttaaccttacattgctgctttaaatggttaattaagctgattagcttgcaatatgtgatttcttttggaccttttgggacagcggtg

SEQ ID NO: 435326 - DNA, 140 bp, Artificial Sequence
  Synthetic
caccgctgtcccaaaaggtccaaaagaaatcacatattgcaagctaatcagcttaattaaccatttaaagcagcaatgtaaggttaaagcattgttgaaatcaatacaaactaatcttgtcatatcagcagccagggcct

SEQ ID NO: 435327 - DNA, 140 bp, Artificial Sequence
  Synthetic
aggccctggctgctgatatgagcagctttatatgtaatgaacaatatcccctgtgaatcatcaatcagtgtgcaagcctcatacgaatcattttattcttcctcaaagtcaaggtaaagggaccttttgggacagcggtg

SEQ ID NO: 435328 - DNA, 140 bp, Artificial Sequence
  Synthetic
caccgctgtcccaaaaggtccctttaccttgactttgaggaagaataaaatgattcgtatgaggcttgcacactgattgatgattcacaggggatattgttcattacatataaagctgctcatatcagcagccagggcct

SEQ ID NO: 435329 - DNA, 140 bp, Artificial Sequence
  Synthetic
aggccctggctgctgatatgttaaatctgaatcattaagagcataactttaacaaagagaacttcatttaattcacagaaataatctatttaaaaatgagggttacattttctaaattatgaccttttgggacagcggtg

SEQ ID NO: 435330 - DNA, 140 bp, Artificial Sequence
  Synthetic
caccgctgtcccaaaaggtcataatttagaaaatgtaaccctcatttttaaatagattatttctgtgaattaaatgaagttctctttgttaaagttatgctcttaatgattcagatttaacatatcagcagccagggcct

SEQ ID NO: 435331 - DNA, 140 bp, Artificial Sequence
  Synthetic
atacgccatgctgggtctcctgtatgagaaataataaaataaacaagaagaagaaaaaactattagacagcttactttacacaagataatcttatatcgccttaagccttacataagtgacgtacttgggagtcggccat

SEQ ID NO: 435332 - DNA, 140 bp, Artificial Sequence
  Synthetic
atggccgactcccaagtacgtcacttatgtaaggcttaaggcgatataagattatcttgtgtaaagtaagctgtctaatagttttttcttcttcttgtttattttattatttctcatacaggagacccagcatggcgtat

SEQ ID NO: 435333 - DNA, 140 bp, Artificial Sequence
  Synthetic
atacgccatgctgggtctcctctctgcaccaccacaaaacaccaccaattatgacacacagagcacagccactgaaaatgaacaaaccagtgcccccttgaaaacaaccctgcctcctaccgtacttgggagtcggccat

SEQ ID NO: 435334 - DNA, 140 bp, Artificial Sequence
  Synthetic
atggccgactcccaagtacggtaggaggcagggttgttttcaagggggcactggtttgttcattttcagtggctgtgctctgtgtgtcataattggtggtgttttgtggtggtgcagagaggagacccagcatggcgtat

SEQ ID NO: 435335 - DNA, 140 bp, Artificial Sequence
  Synthetic
aggccctggctgctgatatgttatcaacatctttgggagtggtattttgtggagcatgaacctcttttttcaactaaaattataagtgatttaagcattttcataaaagatagggctactgaccttttgggacagcggtg

SEQ ID NO: 435336 - DNA, 140 bp, Artificial Sequence
  Synthetic
caccgctgtcccaaaaggtcagtagccctatcttttatgaaaatgcttaaatcacttataattttagttgaaaaaagaggttcatgctccacaaaataccactcccaaagatgttgataacatatcagcagccagggcct

SEQ ID NO: 435337 - DNA, 140 bp, Artificial Sequence
  Synthetic
atacgccatgctgggtctcccactagtttgttgtaaattactcgatcaaaatgttcttaagctatcttcaacttaatgatgcaactctgtttcatctttcttttgatttcaatgtcacagcgtacttgggagtcggccat

SEQ ID NO: 435338 - DNA, 140 bp, Artificial Sequence
  Synthetic
atggccgactcccaagtacgctgtgacattgaaatcaaaagaaagatgaaacagagttgcatcattaagttgaagatagcttaagaacattttgatcgagtaatttacaacaaactagtgggagacccagcatggcgtat

SEQ ID NO: 435339 - DNA, 140 bp, Artificial Sequence
  Synthetic
aggccctggctgctgatatgaaattatggatcaacagctcaacaggggatggatatcaagatgccactctcggagcaaaatttggttgaaaactgtcgaccatcaaagggcatcagattcgaccttttgggacagcggtg

SEQ ID NO: 435340 - DNA, 140 bp, Artificial Sequence
  Synthetic
caccgctgtcccaaaaggtcgaatctgatgccctttgatggtcgacagttttcaaccaaattttgctccgagagtggcatcttgatatccatcccctgttgagctgttgatccataatttcatatcagcagccagggcct

SEQ ID NO: 435341 - DNA, 140 bp, Artificial Sequence
  Synthetic
atacgccatgctgggtctcctgtacgttgattgcagtaatattccttctatctctctagacccaggttttcggagtatgtctgatcagaatcaagttcaaatgttaatcaatacctacaacgtacttgggagtcggccat

SEQ ID NO: 435342 - DNA, 140 bp, Artificial Sequence
  Synthetic
atggccgactcccaagtacgttgtaggtattgattaacatttgaacttgattctgatcagacatactccgaaaacctgggtctagagagatagaaggaatattactgcaatcaacgtacaggagacccagcatggcgtat

SEQ ID NO: 435343 - DNA, 140 bp, Artificial Sequence
  Synthetic
aggccctggctgctgatatgatctggactatcagacagtgcttaactttttacctacacactactcaggcaacatagttcatagatataatgatcaatatggacaacattcctttatggcgaccttttgggacagcggtg

SEQ ID NO: 435344 - DNA, 140 bp, Artificial Sequence
  Synthetic
caccgctgtcccaaaaggtcgccataaaggaatgttgtccatattgatcattatatctatgaactatgttgcctgagtagtgtgtaggtaaaaagttaagcactgtctgatagtccagatcatatcagcagccagggcct

SEQ ID NO: 435345 - DNA, 140 bp, Artificial Sequence
  Synthetic
atacgccatgctgggtctcccaatgaccctctttgcagtgggattaaagggagattaggcagagtatctcgatcaacactctcattgagtttgaatgtcagtgacattggttcttatgaccgtacttgggagtcggccat

SEQ ID NO: 435346 - DNA, 140 bp, Artificial Sequence
  Synthetic
atggccgactcccaagtacggtcataagaaccaatgtcactgacattcaaactcaatgagagtgttgatcgagatactctgcctaatctccctttaatcccactgcaaagagggtcattgggagacccagcatggcgtat

SEQ ID NO: 435347 - DNA, 140 bp, Artificial Sequence
  Synthetic
aggccctggctgctgatatggatcaacactctcattgagtttgaatgtcagtgacattggttcttatgactttccaactattgctgcatggacactaggagaaactatagtcggaagcatgaccttttgggacagcggtg

SEQ ID NO: 435348 - DNA, 140 bp, Artificial Sequence
  Synthetic
caccgctgtcccaaaaggtcatgcttccgactatagtttctcctagtgtccatgcagcaatagttggaaagtcataagaaccaatgtcactgacattcaaactcaatgagagtgttgatccatatcagcagccagggcct

SEQ ID NO: 435349 - DNA, 140 bp, Artificial Sequence
  Synthetic
atacgccatgctgggtctccgaaaattacgcgcacagattaactagtgattaagtgtttggtcacaccagaggtaactttttaacgttaattactcagatgttattgctcataattagcacgtacttgggagtcggccat

SEQ ID NO: 435350 - DNA, 140 bp, Artificial Sequence
  Synthetic
atggccgactcccaagtacgtgctaattatgagcaataacatctgagtaattaacgttaaaaagttacctctggtgtgaccaaacacttaatcactagttaatctgtgcgcgtaattttcggagacccagcatggcgtat

SEQ ID NO: 435351 - DNA, 140 bp, Artificial Sequence
  Synthetic
atacgccatgctgggtctccgcttaaatgtaccaggatcaagggaaataataacgttccttagacaaacagttcgtgaaaatatcacgatcacgtcacaaaatagaataataaattccctcgtacttgggagtcggccat

SEQ ID NO: 435352 - DNA, 140 bp, Artificial Sequence
  Synthetic
atggccgactcccaagtacgagggaatttattattctattttgtgacgtgatcgtgatattttcacgaactgtttgtctaaggaacgttattatttcccttgatcctggtacatttaagcggagacccagcatggcgtat

SEQ ID NO: 435353 - DNA, 140 bp, Artificial Sequence
  Synthetic
atacgccatgctgggtctcccaatttgggatcatattttaacttccattcaatatgatgcaattaatcatgttgatgattttaaatacctattgccatctgagctagtcaagtatgcgaacgtacttgggagtcggccat

SEQ ID NO: 435354 - DNA, 140 bp, Artificial Sequence
  Synthetic
atggccgactcccaagtacgttcgcatacttgactagctcagatggcaataggtatttaaaatcatcaacatgattaattgcatcatattgaatggaagttaaaatatgatcccaaattgggagacccagcatggcgtat

SEQ ID NO: 435355 - DNA, 140 bp, Artificial Sequence
  Synthetic
aggccctggctgctgatatgccattattacgcaagtcttaattattggagagacaaggctaataaggtcaagaatactcctttttcgcatttgataaattgttcatttcttgaactttctgaccttttgggacagcggtg

SEQ ID NO: 435356 - DNA, 140 bp, Artificial Sequence
  Synthetic
caccgctgtcccaaaaggtcagaaagttcaagaaatgaacaatttatcaaatgcgaaaaaggagtattcttgaccttattagccttgtctctccaataattaagacttgcgtaataatggcatatcagcagccagggcct

SEQ ID NO: 435357 - DNA, 140 bp, Artificial Sequence
  Synthetic
atacgccatgctgggtctcctcacataccagttcagtctcttctaatcaacatgtgaccaattcaaaatatatttttcatccagaagagattcctgaaataaatacaaggactaaattgacgtacttgggagtcggccat

SEQ ID NO: 435358 - DNA, 140 bp, Artificial Sequence
  Synthetic
atggccgactcccaagtacgtcaatttagtccttgtatttatttcaggaatctcttctggatgaaaaatatattttgaattggtcacatgttgattagaagagactgaactggtatgtgaggagacccagcatggcgtat

SEQ ID NO: 435359 - DNA, 140 bp, Artificial Sequence
  Synthetic
aggccctggctgctgatatggatcttctagaaggaggtttgctgactttgtgtgttgaacattactataattctgataaagataaattcaacacaagtcctatcgcgaaatatttacgtggaccttttgggacagcggtg

SEQ ID NO: 435360 - DNA, 140 bp, Artificial Sequence
  Synthetic
caccgctgtcccaaaaggtccacgtaaatatttcgcgataggacttgtgttgaatttatctttatcagaattatagtaatgttcaacacacaaagtcagcaaacctccttctagaagatccatatcagcagccagggcct

SEQ ID NO: 435361 - DNA, 140 bp, Artificial Sequence
  Synthetic
atacgccatgctgggtctccttgggacaacgagttcttaaaagcatatcttaataagatcttaggacttgaccatgttttttcagcttctgcaaggtcacagtgtgaggatttttctcctcgtacttgggagtcggccat

SEQ ID NO: 435362 - DNA, 140 bp, Artificial Sequence
  Synthetic
atggccgactcccaagtacgaggagaaaaatcctcacactgtgaccttgcagaagctgaaaaaacatggtcaagtcctaagatcttattaagatatgcttttaagaactcgttgtcccaaggagacccagcatggcgtat

SEQ ID NO: 435363 - DNA, 140 bp, Artificial Sequence
  Synthetic
aggccctggctgctgatatgaccgggacagaatttttagatacaagcccattacaatcctctaggtattcatcaaatcctagggaacgatctctaccatctagagagcaagcctcatattgaccttttgggacagcggtg

SEQ ID NO: 435364 - DNA, 140 bp, Artificial Sequence
  Synthetic
caccgctgtcccaaaaggtcaatatgaggcttgctctctagatggtagagatcgttccctaggatttgatgaatacctagaggattgtaatgggcttgtatctaaaaattctgtcccggtcatatcagcagccagggcct

SEQ ID NO: 435365 - DNA, 140 bp, Artificial Sequence
  Synthetic
atacgccatgctgggtctccgtatttgtcgtatctttactaaatatatcggataacgttaaatgtgtaatgattaggactttaggacaattgctactgagcccttttctaatctactgaacgtacttgggagtcggccat

SEQ ID NO: 435366 - DNA, 140 bp, Artificial Sequence
  Synthetic
atggccgactcccaagtacgttcagtagattagaaaagggctcagtagcaattgtcctaaagtcctaatcattacacatttaacgttatccgatatatttagtaaagatacgacaaatacggagacccagcatggcgtat

SEQ ID NO: 435367 - DNA, 140 bp, Artificial Sequence
  Synthetic
atacgccatgctgggtctccttggtattttgaggtctagctttattttaaagtttgtgttgattcatcaaggagtaaacttggtgacaggtcatgatgcctatgacagtatcatcagtaacgtacttgggagtcggccat

SEQ ID NO: 435368 - DNA, 140 bp, Artificial Sequence
  Synthetic
atggccgactcccaagtacgttactgatgatactgtcataggcatcatgacctgtcaccaagtttactccttgatgaatcaacacaaactttaaaataaagctagacctcaaaataccaaggagacccagcatggcgtat

SEQ ID NO: 435369 - DNA, 140 bp, Artificial Sequence
  Synthetic
aggccctggctgctgatatgatttggctccttcttataggaatttttccttctcattaaaagaaaaagagttgaatataggaagaacttttgggaagttaccgtatcgtgtcagaaatgtgaccttttgggacagcggtg

SEQ ID NO: 435370 - DNA, 140 bp, Artificial Sequence
  Synthetic
caccgctgtcccaaaaggtcacatttctgacacgatacggtaacttcccaaaagttcttcctatattcaactctttttcttttaatgagaaggaaaaattcctataagaaggagccaaatcatatcagcagccagggcct

SEQ ID NO: 435371 - DNA, 140 bp, Artificial Sequence
  Synthetic
aggccctggctgctgatatgaacccagtgttgggggctggacagtgaagtggggaaactttgttttccacataccaaatactggaatgacattgttgcatcatttaaagtctaattttgtgaccttttgggacagcggtg

SEQ ID NO: 435372 - DNA, 140 bp, Artificial Sequence
  Synthetic
caccgctgtcccaaaaggtcacaaaattagactttaaatgatgcaacaatgtcattccagtatttggtatgtggaaaacaaagtttccccacttcactgtccagcccccaacactgggttcatatcagcagccagggcct

SEQ ID NO: 435373 - DNA, 140 bp, Artificial Sequence
  Synthetic
aggccctggctgctgatatgtacacctgttgaagtaacggttcaagccagacctgtgaatcgaccaactgctctgcctcctccagttgacgacaaaattgagcatgaatctacaggagatgaccttttgggacagcggtg

SEQ ID NO: 435374 - DNA, 140 bp, Artificial Sequence
  Synthetic
caccgctgtcccaaaaggtcatctcctgtagattcatgctcaattttgtcgtcaactggaggaggcagagcagttggtcgattcacaggtctggcttgaaccgttacttcaacaggtgtacatatcagcagccagggcct

SEQ ID NO: 435375 - DNA, 140 bp, Artificial Sequence
  Synthetic
aggccctggctgctgatatgagctcttcttcaagtagctttgttgacttgaatgatccatttgcactgctgaatgaggacgaagatactcttgatgacagtgtcatgatcccgagcacaagaccttttgggacagcggtg

SEQ ID NO: 435376 - DNA, 140 bp, Artificial Sequence
  Synthetic
caccgctgtcccaaaaggtcttgtgctcgggatcatgacactgtcatcaagagtatcttcgtcctcattcagcagtgcaaatggatcattcaagtcaacaaagctacttgaagaagagctcatatcagcagccagggcct

SEQ ID NO: 435377 - DNA, 140 bp, Artificial Sequence
  Synthetic
aggccctggctgctgatatggagaattacacgcacagattaacttgtgattggatgttcggtcacaacaatggtaactatttagtgttggtcactcaaatatgatcactaatgattggtagaccttttgggacagcggtg

SEQ ID NO: 435378 - DNA, 140 bp, Artificial Sequence
  Synthetic
caccgctgtcccaaaaggtctaccaatcattagtgatcatatttgagtgaccaacactaaatagttaccattgttgtgaccgaacatccaatcacaagttaatctgtgcgtgtaattctccatatcagcagccagggcct

SEQ ID NO: 435379 - DNA, 140 bp, Artificial Sequence
  Synthetic
atacgccatgctgggtctccactcatcatatatgcaacaagtcagtgaggggttgatgactggaaaagttcccatagatcaagtgtttggtgccaatcccttagagaagttatacaagagcgtacttgggagtcggccat

SEQ ID NO: 435380 - DNA, 140 bp, Artificial Sequence
  Synthetic
atggccgactcccaagtacgctcttgtataacttctctaagggattggcaccaaacacttgatctatgggaacttttccagtcatcaacccctcactgacttgttgcatatatgatgagtggagacccagcatggcgtat

SEQ ID NO: 435381 - DNA, 140 bp, Artificial Sequence
  Synthetic
atacgccatgctgggtctcctgaattatcgcctgactttacaaattatgaggataatcagcagaattggccacaaagagtggtgacaaagaagggtaggactttcctttatcccaatgatcgtacttgggagtcggccat

SEQ ID NO: 435382 - DNA, 140 bp, Artificial Sequence
  Synthetic
atggccgactcccaagtacgatcattgggataaaggaaagtcctacccttctttgtcaccactctttgtggccaattctgctgattatcctcataatttgtaaagtcaggcgataattcaggagacccagcatggcgtat

SEQ ID NO: 435383 - DNA, 140 bp, Artificial Sequence
  Synthetic
atacgccatgctgggtctccacgtgatttacatgcttgttttgatagcaatcaattctgtcggtttacaggggtagtctcatcaatgcattacaagctttatgatcttttgcctccaggtcgtacttgggagtcggccat

SEQ ID NO: 435384 - DNA, 140 bp, Artificial Sequence
  Synthetic
atggccgactcccaagtacgacctggaggcaaaagatcataaagcttgtaatgcattgatgagactacccctgtaaaccgacagaattgattgctatcaaaacaagcatgtaaatcacgtggagacccagcatggcgtat

SEQ ID NO: 435385 - DNA, 140 bp, Artificial Sequence
  Synthetic
atacgccatgctgggtctccctcctgcagacaagtcctccagaatcacttgtaacagccctcgtcgaggaataccaaaatcctgtctcagccaaggagctccaagcagattggcccgacacgtacttgggagtcggccat

SEQ ID NO: 435386 - DNA, 140 bp, Artificial Sequence
  Synthetic
atggccgactcccaagtacgtgtcgggccaatctgcttggagctccttggctgagacaggattttggtattcctcgacgagggctgttacaagtgattctggaggacttgtctgcaggagggagacccagcatggcgtat

SEQ ID NO: 435387 - DNA, 140 bp, Artificial Sequence
  Synthetic
atacgccatgctgggtctccggttgctcaacaagcttgtagtaaggggaccatggttaaaaatgaaacaacagatgcagccgacaagatgtcgaaagttcttgaactcagtgaggagacgcgtacttgggagtcggccat

SEQ ID NO: 435388 - DNA, 140 bp, Artificial Sequence
  Synthetic
atggccgactcccaagtacgcgtctcctcactgagttcaagaactttcgacatcttgtcggctgcatctgttgtttcatttttaaccatggtccccttactacaagcttgttgagcaaccggagacccagcatggcgtat

SEQ ID NO: 435389 - DNA, 140 bp, Artificial Sequence
  Synthetic
atacgccatgctgggtctcctgcctcagtactgtaatcaacactgctgtatctcttcttcaagccatcttatttaacttaataaacatgacttgattcagagaatatgctgaaaatgttacgtacttgggagtcggccat

SEQ ID NO: 435390 - DNA, 140 bp, Artificial Sequence
  Synthetic
atggccgactcccaagtacgtaacattttcagcatattctctgaatcaagtcatgtttattaagttaaataagatggcttgaagaagagatacagcagtgttgattacagtactgaggcaggagacccagcatggcgtat

SEQ ID NO: 435391 - DNA, 140 bp, Artificial Sequence
  Synthetic
aggccctggctgctgatatgatttaacttaataaacatgacttgattcagagaatatgctgaaaatgttattgattgaacttctcagatggtgcactattctactgttttactcagcttagaccttttgggacagcggtg

SEQ ID NO: 435392 - DNA, 140 bp, Artificial Sequence
  Synthetic
caccgctgtcccaaaaggtctaagctgagtaaaacagtagaatagtgcaccatctgagaagttcaatcaataacattttcagcatattctctgaatcaagtcatgtttattaagttaaatcatatcagcagccagggcct

SEQ ID NO: 435393 - DNA, 140 bp, Artificial Sequence
  Synthetic
atacgccatgctgggtctccgtataccgcaacatataagtggactctccacccctctcctcgtgcattttctataaatcacttactcgatagaatgtcaagtctacaagtttggagtctccgtacttgggagtcggccat

SEQ ID NO: 435394 - DNA, 140 bp, Artificial Sequence
  Synthetic
atggccgactcccaagtacggagactccaaacttgtagacttgacattctatcgagtaagtgatttatagaaaatgcacgaggagaggggtggagagtccacttatatgttgcggtatacggagacccagcatggcgtat

SEQ ID NO: 435395 - DNA, 140 bp, Artificial Sequence
  Synthetic
aggccctggctgctgatatgccgggacagaaatcttaggtataagtccgttacgatcctctagatattcatcaacttccagggaacggtctcgactatctagagaacaagcttcatatttgaccttttgggacagcggtg

SEQ ID NO: 435396 - DNA, 140 bp, Artificial Sequence
  Synthetic
caccgctgtcccaaaaggtcaaatatgaagcttgttctctagatagtcgagaccgttccctggaagttgatgaatatctagaggatcgtaacggacttatacctaagatttctgtcccggcatatcagcagccagggcct

SEQ ID NO: 435397 - DNA, 140 bp, Artificial Sequence
  Synthetic
atacgccatgctgggtctcccttactctaataaatgtaataattaactgttggcttagagaataacaggtatgagattgtataataacttatagtgtagagtgtaattcttacctctgttcgtacttgggagtcggccat

SEQ ID NO: 435398 - DNA, 140 bp, Artificial Sequence
  Synthetic
atggccgactcccaagtacgaacagaggtaagaattacactctacactataagttattatacaatctcatacctgttattctctaagccaacagttaattattacatttattagagtaagggagacccagcatggcgtat

SEQ ID NO: 435399 - DNA, 140 bp, Artificial Sequence
  Synthetic
aggccctggctgctgatatgcaataagtgaccccaaattcaagtttactgaagactacgacgataataatcaccaattcattgtaaattactcgattaaaatattcttaagctatcttaagaccttttgggacagcggtg

SEQ ID NO: 435400 - DNA, 140 bp, Artificial Sequence
  Synthetic
caccgctgtcccaaaaggtcttaagatagcttaagaatattttaatcgagtaatttacaatgaattggtgattattatcgtcgtagtcttcagtaaacttgaatttggggtcacttattgcatatcagcagccagggcct

SEQ ID NO: 435401 - DNA, 140 bp, Artificial Sequence
  Synthetic
atacgccatgctgggtctccattgaagaatattaaagattttctttaatattcagaaaagattttttattctcttctctctttttacaaacatattaaaataataattctcacaatgtggcgtacttgggagtcggccat

SEQ ID NO: 435402 - DNA, 140 bp, Artificial Sequence
  Synthetic
atggccgactcccaagtacgccacattgtgagaattattattttaatatgtttgtaaaaagagagaagagaataaaaaatcttttctgaatattaaagaaaatctttaatattcttcaatggagacccagcatggcgtat

SEQ ID NO: 435403 - DNA, 140 bp, Artificial Sequence
  Synthetic
aggccctggctgctgatatgtatttcttacagcaagttatcagaattttatcaataatttcagttgtctgatgaagaagggtcagtcatcgctaccggtttggctttactttcctagtgagaccttttgggacagcggtg

SEQ ID NO: 435404 - DNA, 140 bp, Artificial Sequence
  Synthetic
caccgctgtcccaaaaggtctcactaggaaagtaaagccaaaccggtagcgatgactgacccttcttcatcagacaactgaaattattgataaaattctgataacttgctgtaagaaatacatatcagcagccagggcct

SEQ ID NO: 435405 - DNA, 140 bp, Artificial Sequence
  Synthetic
aggccctggctgctgatatggaaaacactagctgacctacttataccgataaataggcagatatcagacattcaaagcactctaagcgaagtgataacaagagttcatgaaattgagcgggaccttttgggacagcggtg

SEQ ID NO: 435406 - DNA, 140 bp, Artificial Sequence
  Synthetic
caccgctgtcccaaaaggtcccgctcaatttcatgaactcttgttatcacttcgcttagagtgctttgaatgtctgatatctgcctatttatcggtataagtaggtcagctagtgttttccatatcagcagccagggcct

SEQ ID NO: 435407 - DNA, 140 bp, Artificial Sequence; identical to SEQ ID NO: 377579
  Synthetic

SEQ ID NO: 435408 - DNA, 140 bp, Artificial Sequence; identical to SEQ ID NO: 377580
  Synthetic

SEQ ID NO: 435409 - DNA, 140 bp, Artificial Sequence; identical to SEQ ID NO: 377565
  Synthetic

SEQ ID NO: 435410 - DNA, 140 bp, Artificial Sequence; identical to SEQ ID NO: 377566
  Synthetic

SEQ ID NO: 435411 - DNA, 140 bp, Artificial Sequence
  Synthetic
aggccctggctgctgatatgatactttatgaacaatttttgctcagttttgttttgatttaataatatatatcgttgtgcccttcattgctaaatcaactcaactgatgatgatattcctgaccttttgggacagcggtg

SEQ ID NO: 435412 - DNA, 140 bp, Artificial Sequence
  Synthetic
caccgctgtcccaaaaggtcaggaatatcatcatcagttgagttgatttagcaatgaagggcacaacgatatatattattaaatcaaaacaaaactgagcaaaaattgttcataaagtatcatatcagcagccagggcct

SEQ ID NO: 435413 - DNA, 140 bp, Artificial Sequence
  Synthetic
atacgccatgctgggtctccttcccatatcacttgattaaaaacagggaattactccaacatgaggactacatgcttctttatcagtctcatcttaatccaagggataaaaactctccctcgtacttgggagtcggccat

SEQ ID NO: 435414 - DNA, 140 bp, Artificial Sequence
  Synthetic
atggccgactcccaagtacgagggagagtttttatcccttggattaagatgagactgataaagaagcatgtagtcctcatgttggagtaattccctgtttttaatcaagtgatatgggaaggagacccagcatggcgtat

SEQ ID NO: 435415 - DNA, 140 bp, Artificial Sequence
  Synthetic
aggccctggctgctgatatgtaacctgtctccagaatcagaattaactataaatttgttgccgtatgactgcaaggaactgcgacttggagggagcaatgacacagagttaaattatgtcgaccttttgggacagcggtg

SEQ ID NO: 435416 - DNA, 140 bp, Artificial Sequence
  Synthetic
caccgctgtcccaaaaggtcgacataatttaactctgtgtcattgctccctccaagtcgcagttccttgcagtcatacggcaacaaatttatagttaattctgattctggagacaggttacatatcagcagccagggcct

SEQ ID NO: 435417 - DNA, 140 bp, Artificial Sequence
  Synthetic
atacgccatgctgggtctccgtggaagttaggaggattgacatagaaccctgttgtggtgagacagtcctttcagaatcagttgtttttgggctagtggctgaggcagttctaagagaaccgtacttgggagtcggccat

SEQ ID NO: 435418 - DNA, 140 bp, Artificial Sequence
  Synthetic
atggccgactcccaagtacggttctcttagaactgcctcagccactagcccaaaaacaactgattctgaaaggactgtctcaccacaacagggttctatgtcaatcctcctaacttccacggagacccagcatggcgtat

SEQ ID NO: 435419 - DNA, 140 bp, Artificial Sequence
  Synthetic
aggccctggctgctgatatgtctccgaaccaccacaaaacaccaccaatcccaacacacaaagcatggccactgaaaatgagaaaactagtgcccccccgaaaacaaccctgcctccaatgaccttttgggacagcggtg

SEQ ID NO: 435420 - DNA, 140 bp, Artificial Sequence
  Synthetic
caccgctgtcccaaaaggtcattggaggcagggttgttttcgggggggcactagttttctcattttcagtggccatgctttgtgtgttgggattggtggtgttttgtggtggttcggagacatatcagcagccagggcct

SEQ ID NO: 435421 - DNA, 140 bp, Artificial Sequence
  Synthetic
atacgccatgctgggtctccccttctgttttctctttcttttgtaatatgccaattaagaaaaactaaaaatcgaagaatattaaagattttctttaatattcagaaaaggttttttattcgtacttgggagtcggccat

SEQ ID NO: 435422 - DNA, 140 bp, Artificial Sequence
  Synthetic
atggccgactcccaagtacgaataaaaaaccttttctgaatattaaagaaaatctttaatattcttcgatttttagtttttcttaattggcatattacaaaagaaagagaaaacagaaggggagacccagcatggcgtat

SEQ ID NO: 435423 - DNA, 140 bp, Artificial Sequence
  Synthetic
atacgccatgctgggtctccaatttccaaggggatgtcagaaatgttagccaaatatgaccacctcgtaatttcaaccggaagaaccactgcaccagctgctgcctttgatgcttacttacgtacttgggagtcggccat

SEQ ID NO: 435424 - DNA, 140 bp, Artificial Sequence
  Synthetic
atggccgactcccaagtacgtaagtaagcatcaaaggcagcagctggtgcagtggttcttccggttgaaattacgaggtggtcatatttggctaacatttctgacatccccttggaaattggagacccagcatggcgtat

SEQ ID NO: 435425 - DNA, 140 bp, Artificial Sequence
  Synthetic
atacgccatgctgggtctccttctattggaaggagtatttcaatctcaacttgttggattaattataacttaagttgtcccttttaaaattaattcacataaggtagtttaaatttgtatcgtacttgggagtcggccat

SEQ ID NO: 435426 - DNA, 140 bp, Artificial Sequence
  Synthetic
atggccgactcccaagtacgatacaaatttaaactaccttatgtgaattaattttaaaagggacaacttaagttataattaatccaacaagttgagattgaaatactccttccaatagaaggagacccagcatggcgtat

SEQ ID NO: 435427 - DNA, 140 bp, Artificial Sequence
  Synthetic
aggccctggctgctgatatgtaagttgtcccttttaaaattaattcacataaggtagtttaaatttgtatctagaacagattttaatatggccagttctagcaattacaacacatacatggaccttttgggacagcggtg

SEQ ID NO: 435428 - DNA, 140 bp, Artificial Sequence
  Synthetic
caccgctgtcccaaaaggtccatgtatgtgttgtaattgctagaactggccatattaaaatctgttctagatacaaatttaaactaccttatgtgaattaattttaaaagggacaacttacatatcagcagccagggcct

SEQ ID NO: 435429 - DNA, 140 bp, Artificial Sequence
  Synthetic
atacgccatgctgggtctccatagtcaaatggagaagggccaacctctcaatctgacacaatacatgaacagcaaaattgctatataagtggcttaaactagcatgagtatttccaggtccgtacttgggagtcggccat

SEQ ID NO: 435430 - DNA, 140 bp, Artificial Sequence
  Synthetic
atggccgactcccaagtacggacctggaaatactcatgctagtttaagccacttatatagcaattttgctgttcatgtattgtgtcagattgagaggttggcccttctccatttgactatggagacccagcatggcgtat

SEQ ID NO: 435431 - DNA, 140 bp, Artificial Sequence
  Synthetic
aggccctggctgctgatatgactttagaagcgataattgacatatctgcgtataacgagcgaacagtcaaaggtgtcccagcatggctgcctcttgggattatgagcaattttgaatatcgaccttttgggacagcggtg

SEQ ID NO: 435432 - DNA, 140 bp, Artificial Sequence
  Synthetic
caccgctgtcccaaaaggtcgatattcaaaattgctcataatcccaagaggcagccatgctgggacacctttgactgttcgctcgttatacgcagatatgtcaattatcgcttctaaagtcatatcagcagccagggcct

SEQ ID NO: 435433 - DNA, 140 bp, Artificial Sequence
  Synthetic
aggccctggctgctgatatgatgcgggctatgagtttgatgtcatcaagaatgcagatgcaacccgttttctggatgtgattcctaatgaacctcattacagtcctttaattttggccctgaccttttgggacagcggtg

SEQ ID NO: 435434 - DNA, 140 bp, Artificial Sequence
  Synthetic
caccgctgtcccaaaaggtcagggccaaaattaaaggactgtaatgaggttcattaggaatcacatccagaaaacgggttgcatctgcattcttgatgacatcaaactcatagcccgcatcatatcagcagccagggcct

SEQ ID NO: 435435 - DNA, 140 bp, Artificial Sequence
  Synthetic
aggccctggctgctgatatgctttagctcatactgtggctgcattgctcacaggcagctatacaatcacccaatttactcacaacgggcaaaaatttgtccgtgtcaatcgactcggtacgaccttttgggacagcggtg

SEQ ID NO: 435436 - DNA, 140 bp, Artificial Sequence
  Synthetic
caccgctgtcccaaaaggtcgtaccgagtcgattgacacggacaaatttttgcccgttgtgagtaaattgggtgattgtatagctgcctgtgagcaatgcagccacagtatgagctaaagcatatcagcagccagggcct

SEQ ID NO: 435437 - DNA, 140 bp, Artificial Sequence
  Synthetic
atacgccatgctgggtctccttttctttgatcattcttgcgaggaattataaaaatctcgaaggacaaattattgtaaaacagagtcgaagaacattaagtgttctttgttgaaactattcgtacttgggagtcggccat

SEQ ID NO: 435438 - DNA, 140 bp, Artificial Sequence
  Synthetic
atggccgactcccaagtacgaatagtttcaacaaagaacacttaatgttcttcgactctgttttacaataatttgtccttcgagatttttataattcctcgcaagaatgatcaaagaaaaggagacccagcatggcgtat

SEQ ID NO: 435439 - DNA, 140 bp, Artificial Sequence
  Synthetic
atacgccatgctgggtctcctacaaaagcattggggtcatcccgttttatacaatgatgttgcactagataaggttaaaaaacatgcgcaatcgacaaaaatcttaaaacctaaagtcatcgtacttgggagtcggccat

SEQ ID NO: 435440 - DNA, 140 bp, Artificial Sequence
  Synthetic
atggccgactcccaagtacgatgactttaggttttaagatttttgtcgattgcgcatgttttttaaccttatctagtgcaacatcattgtataaaacgggatgaccccaatgcttttgtaggagacccagcatggcgtat

SEQ ID NO: 435441 - DNA, 140 bp, Artificial Sequence
  Synthetic
atacgccatgctgggtctccgtaaatgctgcacacggcatgtaccgtccgaatacctgttttttgataaacctttagacgtggatctgaacaagtatatggataatgaactggtttatgacgtacttgggagtcggccat

SEQ ID NO: 435442 - DNA, 140 bp, Artificial Sequence
  Synthetic
atggccgactcccaagtacgtcataaaccagttcattatccatatacttgttcagatccacgtctaaaggtttatcaaaaaacaggtattcggacggtacatgccgtgtgcagcatttacggagacccagcatggcgtat

SEQ ID NO: 435443 - DNA, 140 bp, Artificial Sequence
  Synthetic
aggccctggctgctgatatgctggcgcccatccaaggacaaattaattgggaacaccatgcatcctgcagtctccatccacccgaatttgccacctattgttctaccaacagtcaagaaggaccttttgggacagcggtg

SEQ ID NO: 435444 - DNA, 140 bp, Artificial Sequence
  Synthetic
caccgctgtcccaaaaggtccttcttgactgttggtagaacaataggtggcaaattcgggtggatggagactgcaggatgcatggtgttcccaattaatttgtccttggatgggcgccagcatatcagcagccagggcct

SEQ ID NO: 435445 - DNA, 140 bp, Artificial Sequence
  Synthetic
aggccctggctgctgatatgatcattgtgcccttcattgctaagtaaactcaactgatgatgatattccttctgaaatagtaagaaaaactaatgaagaacattaattgccaggtaagaggaccttttgggacagcggtg

SEQ ID NO: 435446 - DNA, 140 bp, Artificial Sequence
  Synthetic
caccgctgtcccaaaaggtcctcttacctggcaattaatgttcttcattagtttttcttactatttcagaaggaatatcatcatcagttgagtttacttagcaatgaagggcacaatgatcatatcagcagccagggcct

SEQ ID NO: 435447 - DNA, 140 bp, Artificial Sequence
  Synthetic
atacgccatgctgggtctccaaacaggatgagtaatacatctacacgtgcaattatatcaactaacacactgggtaaatatgctggggggggtcaagctgctattgatagtaatataatccgtacttgggagtcggccat

SEQ ID NO: 435448 - DNA, 140 bp, Artificial Sequence
  Synthetic
atggccgactcccaagtacggattatattactatcaatagcagcttgaccccccccagcatatttacccagtgtgttagttgatataattgcacgtgtagatgtattactcatcctgtttggagacccagcatggcgtat

SEQ ID NO: 435449 - DNA, 140 bp, Artificial Sequence
  Synthetic
atacgccatgctgggtctccgcaagggttttcatcaacggtgccgcccactccctcaccacaaccaagcacgccacagcaagagggaaacaacgcagaccattcccaaggtgctgtgactcgtacttgggagtcggccat

SEQ ID NO: 435450 - DNA, 140 bp, Artificial Sequence
  Synthetic
atggccgactcccaagtacgagtcacagcaccttgggaatggtctgcgttgtttccctcttgctgtggcgtgcttggttgtggtgagggagtgggcggcaccgttgatgaaaacccttgcggagacccagcatggcgtat

SEQ ID NO: 435451 - DNA, 140 bp, Artificial Sequence
  Synthetic
atacgccatgctgggtctcctacaagattagtttgtattgattttaataatgctttaaccttacattgctgctttaaatgattgatcaagctgattaacttgtaatatgtaacctcttttcgtacttgggagtcggccat

SEQ ID NO: 435452 - DNA, 140 bp, Artificial Sequence
  Synthetic
atggccgactcccaagtacgaaaagaggttacatattacaagttaatcagcttgatcaatcatttaaagcagcaatgtaaggttaaagcattattaaaatcaatacaaactaatcttgtaggagacccagcatggcgtat

SEQ ID NO: 435453 - DNA, 140 bp, Artificial Sequence
  Synthetic
atacgccatgctgggtctccatactttatgaacaatttttgctcagttttgttttgatttaataatatatatcgttgtgcccttcattgctaagtcaactcaactgataatgatattcctcgtacttgggagtcggccat

SEQ ID NO: 435454 - DNA, 140 bp, Artificial Sequence
  Synthetic
atggccgactcccaagtacgaggaatatcattatcagttgagttgacttagcaatgaagggcacaacgatatatattattaaatcaaaacaaaactgagcaaaaattgttcataaagtatggagacccagcatggcgtat

SEQ ID NO: 435455 - DNA, 140 bp, Artificial Sequence
  Synthetic
atacgccatgctgggtctcccctgaaatagtaagaaaaactaatgaagaacattaattgctggataaaagtgattaagttctttaaatttgatcaaagtaatattttatcagtgaatacacgtacttgggagtcggccat

SEQ ID NO: 435456 - DNA, 140 bp, Artificial Sequence
  Synthetic
atggccgactcccaagtacgtgtattcactgataaaatattactttgatcaaatttaaagaacttaatcacttttatccagcaattaatgttcttcattagtttttcttactatttcaggggagacccagcatggcgtat

SEQ ID NO: 435457 - DNA, 140 bp, Artificial Sequence
  Synthetic
atacgccatgctgggtctccctttagtagcgttacctttcagtacagtataggtaatcgaggaaagacttctgagcatggcagaattatcaacgcgttacaacttgcctgcaaatgttaccgtacttgggagtcggccat

SEQ ID NO: 435458 - DNA, 140 bp, Artificial Sequence
  Synthetic
atggccgactcccaagtacggtaacatttgcaggcaagttgtaacgcgttgataattctgccatgctcagaagtctttcctcgattacctatactgtactgaaaggtaacgctactaaagggagacccagcatggcgtat

SEQ ID NO: 435459 - DNA, 140 bp, Artificial Sequence
  Synthetic
aggccctggctgctgatatgtgagcgggcagaaagttgctgattcccctttggaggcatccaagcgatgggctttcaggacaggtgtacctcctaagaatgttgagtatacggaaggggagaccttttgggacagcggtg

SEQ ID NO: 435460 - DNA, 140 bp, Artificial Sequence
  Synthetic
caccgctgtcccaaaaggtctccccttccgtatactcaacattcttaggaggtacacctgtcctgaaagcccatcgcttggatgcctccaaaggggaatcagcaactttctgcccgctcacatatcagcagccagggcct

SEQ ID NO: 435461 - DNA, 140 bp, Artificial Sequence
  Synthetic
atacgccatgctgggtctccataaagtagagtcgaagaacattaaatgttctttgttagaattattcatctaagttgtttttgagtatattcgcttcaatacaactcctcttatatttgacgtacttgggagtcggccat

SEQ ID NO: 435462 - DNA, 140 bp, Artificial Sequence
  Synthetic
atggccgactcccaagtacgtcaaatataagaggagttgtattgaagcgaatatactcaaaaacaacttagatgaataattctaacaaagaacatttaatgttcttcgactctactttatggagacccagcatggcgtat

SEQ ID NO: 435463 - DNA, 140 bp, Artificial Sequence
  Synthetic
aggccctggctgctgatatgaataagacagtgcacaaaatgattttctcgaggcaaggacaagggtaccgtcacatgaatctgacttctactaataaatattggacaagtagcaacggaagaccttttgggacagcggtg

SEQ ID NO: 435464 - DNA, 140 bp, Artificial Sequence
  Synthetic
caccgctgtcccaaaaggtcttccgttgctacttgtccaatatttattagtagaagtcagattcatgtgacggtacccttgtccttgcctcgagaaaatcattttgtgcactgtcttattcatatcagcagccagggcct

SEQ ID NO: 435465 - DNA, 140 bp, Artificial Sequence
  Synthetic
atacgccatgctgggtctccagcccatccggagatcaaacccacaagcaccccaaccgatgccactagactcaacaccacaaacccaaacagtgatgatgaggatctcacaacatccggccgtacttgggagtcggccat

SEQ ID NO: 435466 - DNA, 140 bp, Artificial Sequence
  Synthetic
atggccgactcccaagtacggccggatgttgtgagatcctcatcatcactgtttgggtttgtggtgttgagtctagtggcatcggttggggtgcttgtgggtttgatctccggatgggctggagacccagcatggcgtat

SEQ ID NO: 435467 - DNA, 140 bp, Artificial Sequence
  Synthetic
aggccctggctgctgatatgtcaacaccacaaacccaaacagtgatgatgaggatctcacaacatccggctcggggtctggggaacaggaacccgatacgacttctgatgcggtcactaagaccttttgggacagcggtg

SEQ ID NO: 435468 - DNA, 140 bp, Artificial Sequence
  Synthetic
caccgctgtcccaaaaggtcttagtgaccgcatcagaagtcgtatcgggttcctgttccccagaccccgagccggatgttgtgagatcctcatcatcactgtttgggtttgtggtgttgacatatcagcagccagggcct

SEQ ID NO: 435469 - DNA, 140 bp, Artificial Sequence
  Synthetic
atacgccatgctgggtctcccaccaccacaatctccaccaacaacacctccaaacacaacctcagcaccctctccgaactaccacaaaacaccaccaatcccaacacacaaagcatggcccgtacttgggagtcggccat

SEQ ID NO: 435470 - DNA, 140 bp, Artificial Sequence
  Synthetic
atggccgactcccaagtacgggccatgctttgtgtgttgggattggtggtgttttgtggtagttcggagagggtgctgaggttgtgtttggaggtgttgttggtggagattgtggtggtgggagacccagcatggcgtat

SEQ ID NO: 435471 - DNA, 140 bp, Artificial Sequence
  Synthetic
aggccctggctgctgatatgagaaagtcctaccacagaaaagagcaccaacaatacaaaaagccccaccacaatggaaccaaatacaacaaatggacatttcactagtccctcctccaccgaccttttgggacagcggtg

SEQ ID NO: 435472 - DNA, 140 bp, Artificial Sequence
  Synthetic
caccgctgtcccaaaaggtcggtggaggagggactagtgaaatgtccatttgttgtatttggttccattgtggtggggctttttgtattgttggtgctcttttctgtggtaggactttctcatatcagcagccagggcct

SEQ ID NO: 435473 - DNA, 140 bp, Artificial Sequence
  Synthetic
atacgccatgctgggtctccttccaaaatactatcaatttaggagttgcagttttagatattgcattatctcttgctaaattgtcatcagcatcaaatgtcactttccgtttaatgttaacgtacttgggagtcggccat

SEQ ID NO: 435474 - DNA, 140 bp, Artificial Sequence
  Synthetic
atggccgactcccaagtacgttaacattaaacggaaagtgacatttgatgctgatgacaatttagcaagagataatgcaatatctaaaactgcaactcctaaattgatagtattttggaaggagacccagcatggcgtat

SEQ ID NO: 435475 - DNA, 140 bp, Artificial Sequence
  Synthetic
atacgccatgctgggtctccgttcaggaggacgacctggcagcagggcttagttggataccattttttggccctggaatcgaaggactttataccgctggtttaattaaaaatcaaaacacgtacttgggagtcggccat

SEQ ID NO: 435476 - DNA, 140 bp, Artificial Sequence
  Synthetic
atggccgactcccaagtacgtgttttgatttttaattaaaccagcggtataaagtccttcgattccagggccaaaaaatggtatccaactaagccctgctgccaggtcgtcctcctgaacggagacccagcatggcgtat

SEQ ID NO: 435477 - DNA, 140 bp, Artificial Sequence
  Synthetic
aggccctggctgctgatatgcatctttgggagtggtatttcgtggagcatgaacctcttttctcaactaaaataataagtgatttaagtatctttataaaagacaggctgaccgctgtgagaccttttgggacagcggtg

SEQ ID NO: 435478 - DNA, 140 bp, Artificial Sequence
  Synthetic
caccgctgtcccaaaaggtctcacagcggtcagcctgtcttttataaagatacttaaatcacttattattttagttgagaaaagaggttcatgctccacgaaataccactcccaaagatgcatatcagcagccagggcct

SEQ ID NO: 435479 - DNA, 140 bp, Artificial Sequence
  Synthetic
aggccctggctgctgatatggaactcttactaagggtcacaaccgaggaaagaacattttccttaatcaatagacatgctattgactttctactcacaaggtggggaggaacatgcaaaggaccttttgggacagcggtg

SEQ ID NO: 435480 - DNA, 140 bp, Artificial Sequence
  Synthetic
caccgctgtcccaaaaggtcctttgcatgttcctccccaccttgtgagtagaaagtcaatagcatgtctattgattaaggaaaatgttctttcctcggttgtgacccttagtaagagttccatatcagcagccagggcct

SEQ ID NO: 435481 - DNA, 140 bp, Artificial Sequence
  Synthetic
atacgccatgctgggtctcctcaacaccacagacccaaacagcgatgatgaggaccttataacatccggttcagggtccggagaacaggaaccctatacaacttccgatgcagtcactaacgtacttgggagtcggccat

SEQ ID NO: 435482 - DNA, 140 bp, Artificial Sequence
  Synthetic
atggccgactcccaagtacgttagtgactgcatcggaagttgtatagggttcctgttctccggaccctgaaccggatgttataaggtcctcatcatcgctgtttgggtctgtggtgttgaggagacccagcatggcgtat

SEQ ID NO: 435483 - DNA, 140 bp, Artificial Sequence
  Synthetic
aggccctggctgctgatatgtgcttggacctgattgttgcataggaatagaggacttgtccagaaatatttcagaacagattgaccaaatcaagaaggacgaacaaaaagaggggactgggaccttttgggacagcggtg

SEQ ID NO: 435484 - DNA, 140 bp, Artificial Sequence
  Synthetic
caccgctgtcccaaaaggtcccagtcccctctttttgttcgtccttcttgatttggtcaatctgttctgaaatatttctggacaagtcctctattcctatgcaacaatcaggtccaagcacatatcagcagccagggcct

SEQ ID NO: 435485 - DNA, 140 bp, Artificial Sequence
  Synthetic
aggccctggctgctgatatgtgattagagctttaggacaattgctactgagcccttcttctaatctactgaaatcaacttgggagatttttaagaagccgataactcaatgtgaatcaatgaccttttgggacagcggtg

SEQ ID NO: 435486 - DNA, 140 bp, Artificial Sequence
  Synthetic
caccgctgtcccaaaaggtcattgattcacattgagttatcggcttcttaaaaatctcccaagttgatttcagtagattagaagaagggctcagtagcaattgtcctaaagctctaatcacatatcagcagccagggcct

SEQ ID NO: 435487 - DNA, 140 bp, Artificial Sequence
  Synthetic
atacgccatgctgggtctccagtttatgtattattgattattatagtttaatattcaactgttatcattatcaggaatgaccttttttatttgttacattaacgttttaaactacctcttcgtacttgggagtcggccat

SEQ ID NO: 435488 - DNA, 140 bp, Artificial Sequence
  Synthetic
atggccgactcccaagtacgaagaggtagtttaaaacgttaatgtaacaaataaaaaaggtcattcctgataatgataacagttgaatattaaactataataatcaataatacataaactggagacccagcatggcgtat

SEQ ID NO: 435489 - DNA, 140 bp, Artificial Sequence
  Synthetic
aggccctggctgctgatatgttattacttaaattggattttattagaaatacaaagatcgcagaacaaaaattacttaatagagtaatcgggtatatcctgttctttccgttcggtttgtgaccttttgggacagcggtg

SEQ ID NO: 435490 - DNA, 140 bp, Artificial Sequence
  Synthetic
caccgctgtcccaaaaggtcacaaaccgaacggaaagaacaggatatacccgattactctattaagtaatttttgttctgcgatctttgtatttctaataaaatccaatttaagtaataacatatcagcagccagggcct

SEQ ID NO: 435491 - DNA, 140 bp, Artificial Sequence
  Synthetic
atacgccatgctgggtctcctggtaactatttagtgttggtcactcaaatatgatcactcataattggtattaatattggtacattgggtgaatccttgagctttatcctttatatgatgcgtacttgggagtcggccat

SEQ ID NO: 435492 - DNA, 140 bp, Artificial Sequence
  Synthetic
atggccgactcccaagtacgcatcatataaaggataaagctcaaggattcacccaatgtaccaatattaataccaattatgagtgatcatatttgagtgaccaacactaaatagttaccaggagacccagcatggcgtat

SEQ ID NO: 435493 - DNA, 140 bp, Artificial Sequence
  Synthetic
atacgccatgctgggtctccttcttttaaacacattggggaaagagctaggttaccattgagatcaagaaaactacgttatgtcttccttgatgacaaatgataaaactttgtagttacacgtacttgggagtcggccat

SEQ ID NO: 435494 - DNA, 140 bp, Artificial Sequence
  Synthetic
atggccgactcccaagtacgtgtaactacaaagttttatcatttgtcatcaaggaagacataacgtagttttcttgatctcaatggtaacctagctctttccccaatgtgtttaaaagaaggagacccagcatggcgtat

SEQ ID NO: 435495 - DNA, 140 bp, Artificial Sequence
  Synthetic
aggccctggctgctgatatgtccgataaagataaattcaacacaagtcctatcgcaaaatacttgcgtgatgcgggctatgagtttgatgtcatcaaaaatgcagatgcaacccgctttcgaccttttgggacagcggtg

SEQ ID NO: 435496 - DNA, 140 bp, Artificial Sequence
  Synthetic
caccgctgtcccaaaaggtcgaaagcgggttgcatctgcatttttgatgacatcaaactcatagcccgcatcacgcaagtattttgcgataggacttgtgttgaatttatctttatcggacatatcagcagccagggcct

SEQ ID NO: 435497 - DNA, 140 bp, Artificial Sequence
  Synthetic
atacgccatgctgggtctcccatgaatattgatcaaatgatgaaatgatagtgcatttgcatagactcaattatcctttattaagaaaaagataaatagaacacagagaattgataaaatcgtacttgggagtcggccat

SEQ ID NO: 435498 - DNA, 140 bp, Artificial Sequence
  Synthetic
atggccgactcccaagtacgattttatcaattctctgtgttctatttatctttttcttaataaaggataattgagtctatgcaaatgcactatcatttcatcatttgatcaatattcatgggagacccagcatggcgtat

SEQ ID NO: 435499 - DNA, 140 bp, Artificial Sequence
  Synthetic
aggccctggctgctgatatgagatgtgttgaccttggaaaatctaggacacattctgagctatctccacagatcagaaattggaaattggatgagacatcttcgtgcagcattaagtctggaccttttgggacagcggtg

SEQ ID NO: 435500 - DNA, 140 bp, Artificial Sequence
  Synthetic
caccgctgtcccaaaaggtccagacttaatgctgcacgaagatgtctcatccaatttccaatttctgatctgtggagatagctcagaatgtgtcctagattttccaaggtcaacacatctcatatcagcagccagggcct

SEQ ID NO: 435501 - DNA, 140 bp, Artificial Sequence
  Synthetic
atacgccatgctgggtctcctaagaaattaaggaaatactgagatatgctagttgaattgagttatgacttaccatatatcataaatataaaagaacgatctgctgtaatctataagcatcgtacttgggagtcggccat

SEQ ID NO: 435502 - DNA, 140 bp, Artificial Sequence
  Synthetic
atggccgactcccaagtacgatgcttatagattacagcagatcgttcttttatatttatgatatatggtaagtcataactcaattcaactagcatatctcagtatttccttaatttcttaggagacccagcatggcgtat

SEQ ID NO: 435503 - DNA, 140 bp, Artificial Sequence
  Synthetic
atacgccatgctgggtctcccaaccaccaagccataccgtctatatatcatgaaactcaattgccctccaaacctaattacaccaatcaccatccacgtgcaagatctatgagctcaacccgtacttgggagtcggccat

SEQ ID NO: 435504 - DNA, 140 bp, Artificial Sequence
  Synthetic
atggccgactcccaagtacgggttgagctcatagatcttgcacgtggatggtgattggtgtaattaggtttggagggcaattgagtttcatgatatatagacggtatggcttggtggttgggagacccagcatggcgtat

SEQ ID NO: 435505 - DNA, 140 bp, Artificial Sequence
  Synthetic
atacgccatgctgggtctcctgcggacctccaaagtaaaaaatgaagttgctagtttcaagcaggcgttgagcaacctagcccgacatggagaatacgcaccattcgcacgggttctgaacgtacttgggagtcggccat

SEQ ID NO: 435506 - DNA, 140 bp, Artificial Sequence
  Synthetic
atggccgactcccaagtacgttcagaacccgtgcgaatggtgcgtattctccatgtcgggctaggttgctcaacgcctgcttgaaactagcaacttcattttttactttggaggtccgcaggagacccagcatggcgtat

SEQ ID NO: 435507 - DNA, 140 bp, Artificial Sequence
  Synthetic
atacgccatgctgggtctcccaaaggcgacaagtactgatgatattatttgggaccaactgatcgtgaagagaacactagctgatctacttataccgataaataggcagatatcagacatcgtacttgggagtcggccat

SEQ ID NO: 435508 - DNA, 140 bp, Artificial Sequence
  Synthetic
atggccgactcccaagtacgatgtctgatatctgcctatttatcggtataagtagatcagctagtgttctcttcacgatcagttggtcccaaataatatcatcagtacttgtcgcctttgggagacccagcatggcgtat

SEQ ID NO: 435509 - DNA, 140 bp, Artificial Sequence
  Synthetic
aggccctggctgctgatatgaattcgaagccgccttatggcaaggttgggataagagatcgatatctctattcgtacaagctgctttatatgtaatgaataatatcccctgtgaatcatcgaccttttgggacagcggtg

SEQ ID NO: 435510 - DNA, 140 bp, Artificial Sequence
  Synthetic
caccgctgtcccaaaaggtcgatgattcacaggggatattattcattacatataaagcagcttgtacgaatagagatatcgatctcttatcccaaccttgccataaggcggcttcgaattcatatcagcagccagggcct

SEQ ID NO: 435511 - DNA, 140 bp, Artificial Sequence
  Synthetic
atacgccatgctgggtctccttcgtacaagctgctttatatgtaatgaataatatcccctgtgaatcatcaatcagtgtacaagcctcatacgaccattttattcttcctcaaagtcaagcgtacttgggagtcggccat

SEQ ID NO: 435512 - DNA, 140 bp, Artificial Sequence
  Synthetic
atggccgactcccaagtacgcttgactttgaggaagaataaaatggtcgtatgaggcttgtacactgattgatgattcacaggggatattattcattacatataaagcagcttgtacgaaggagacccagcatggcgtat

SEQ ID NO: 435513 - DNA, 140 bp, Artificial Sequence
  Synthetic
atacgccatgctgggtctcctacatacatagttcccccccatatcaaacccttacaaaatcaccagatgtacatgaggactttgatgcctcgaaggtaatcttaaattctgaaataaatacgtacttgggagtcggccat

SEQ ID NO: 435514 - DNA, 140 bp, Artificial Sequence
  Synthetic
atggccgactcccaagtacgtatttatttcagaatttaagattaccttcgaggcatcaaagtcctcatgtacatctggtgattttgtaagggtttgatatgggggggaactatgtatgtaggagacccagcatggcgtat

SEQ ID NO: 435515 - DNA, 140 bp, Artificial Sequence
  Synthetic
aggccctggctgctgatatgttttcagtttcaactcttattgtgagacttgaacacaattctactaacttcaataagcgaccctaaattcaagtttcctgaaagctaggataacaataatgaccttttgggacagcggtg

SEQ ID NO: 435516 - DNA, 140 bp, Artificial Sequence
  Synthetic
caccgctgtcccaaaaggtcattattgttatcctagctttcaggaaacttgaatttagggtcgcttattgaagttagtagaattgtgttcaagtctcacaataagagttgaaactgaaaacatatcagcagccagggcct

SEQ ID NO: 435517 - DNA, 140 bp, Artificial Sequence
  Synthetic
atacgccatgctgggtctcccacaaggtcattgtaaattactcgatcaaaatgttattaagctatcttaaacttaatgatgcagctctgtttcacctttcttttgatttcaatgtcatagcgtacttgggagtcggccat

SEQ ID NO: 435518 - DNA, 140 bp, Artificial Sequence
  Synthetic
atggccgactcccaagtacgctatgacattgaaatcaaaagaaaggtgaaacagagctgcatcattaagtttaagatagcttaataacattttgatcgagtaatttacaatgaccttgtgggagacccagcatggcgtat

SEQ ID NO: 435519 - DNA, 140 bp, Artificial Sequence
  Synthetic
atacgccatgctgggtctccacagcacggttacctacttatctactttgatccgattcgtcctcagatcacagcaatcaaatttatttaaatattcaaactactttttaggatcctattacgtacttgggagtcggccat

SEQ ID NO: 435520 - DNA, 140 bp, Artificial Sequence
  Synthetic
atggccgactcccaagtacgtaataggatcctaaaaagtagtttgaatatttaaataaatttgattgctgtgatctgaggacgaatcggatcaaagtagataagtaggtaaccgtgctgtggagacccagcatggcgtat

SEQ ID NO: 435521 - DNA, 140 bp, Artificial Sequence
  Synthetic
atacgccatgctgggtctccctatattcaagtgtctgattaacaatttgtacctctaaggaaaatcatgaagaacattaagaaaaaggatgttcttattctctaactaaacctgaatatccgtacttgggagtcggccat

SEQ ID NO: 435522 - DNA, 140 bp, Artificial Sequence
  Synthetic
atggccgactcccaagtacggatattcaggtttagttagagaataagaacatcctttttcttaatgttcttcatgattttccttagaggtacaaattgttaatcagacacttgaatatagggagacccagcatggcgtat

SEQ ID NO: 435523 - DNA, 140 bp, Artificial Sequence
  Synthetic
aggccctggctgctgatatgtaatttatttctgttttaaatgtgattttaacttttaaagggttaaatggtgatagattaatcctcaaggttactcatttatatattatagggaaactaagaccttttgggacagcggtg

SEQ ID NO: 435524 - DNA, 140 bp, Artificial Sequence
  Synthetic
caccgctgtcccaaaaggtcttagtttccctataatatataaatgagtaaccttgaggattaatctatcaccatttaaccctttaaaagttaaaatcacatttaaaacagaaataaattacatatcagcagccagggcct

SEQ ID NO: 435525 - DNA, 140 bp, Artificial Sequence
  Synthetic
atacgccatgctgggtctccctttgttgatacctctgagggacaacttttgacactagaccacggatcaaacattttttaatcaaacaccccaacttttcaatcatacacctaataaccacgtacttgggagtcggccat

SEQ ID NO: 435526 - DNA, 140 bp, Artificial Sequence
  Synthetic
atggccgactcccaagtacgtggttattaggtgtatgattgaaaagttggggtgtttgattaaaaaatgtttgatccgtggtctagtgtcaaaagttgtccctcagaggtatcaacaaagggagacccagcatggcgtat

SEQ ID NO: 435527 - DNA, 140 bp, Artificial Sequence
  Synthetic
aggccctggctgctgatatgattcttttttcaattgctataatgatacaactacgaacctccatacatttgccgcaatactgtaatcaacactgctgtatctcttcttcaagccatctgagaccttttgggacagcggtg

SEQ ID NO: 435528 - DNA, 140 bp, Artificial Sequence
  Synthetic
caccgctgtcccaaaaggtctcagatggcttgaagaagagatacagcagtgttgattacagtattgcggcaaatgtatggaggttcgtagttgtatcattatagcaattgaaaaaagaatcatatcagcagccagggcct

SEQ ID NO: 435529 - DNA, 140 bp, Artificial Sequence
  Synthetic
aggccctggctgctgatatgaccatgtttttccaacttctgcaaggtcacaatgtgaggatttttctcctaaggaaaatccttattattgggggatgttgttactcgtacatttgtcccagaccttttgggacagcggtg

SEQ ID NO: 435530 - DNA, 140 bp, Artificial Sequence
  Synthetic
caccgctgtcccaaaaggtctgggacaaatgtacgagtaacaacatcccccaataataaggattttccttaggagaaaaatcctcacattgtgaccttgcagaagttggaaaaacatggtcatatcagcagccagggcct

SEQ ID NO: 435531 - DNA, 140 bp, Artificial Sequence
  Synthetic
aggccctggctgctgatatgataccaaatactggaatgacattgttgcatcatttaaagtctaacttcgtggttccagaatggcaacaaacgaggaatctattttctcatctctttaaaagaccttttgggacagcggtg

SEQ ID NO: 435532 - DNA, 140 bp, Artificial Sequence
  Synthetic
caccgctgtcccaaaaggtcttttaaagagatgagaaaatagattcctcgtttgttgccattctggaaccacgaagttagactttaaatgatgcaacaatgtcattccagtatttggtatcatatcagcagccagggcct

SEQ ID NO: 435533 - DNA, 140 bp, Artificial Sequence
  Synthetic
aggccctggctgctgatatgttattctaatgattgtaataattaactgttggcttagatgataacagatatgaagttatataattactcatagtgtaaagtataattcttgcctctgtttgaccttttgggacagcggtg

SEQ ID NO: 435534 - DNA, 140 bp, Artificial Sequence
  Synthetic
caccgctgtcccaaaaggtcaaacagaggcaagaattatactttacactatgagtaattatataacttcatatctgttatcatctaagccaacagttaattattacaatcattagaataacatatcagcagccagggcct

SEQ ID NO: 435535 - DNA, 140 bp, Artificial Sequence
  Synthetic
aggccctggctgctgatatgttaagactggccgaaaatgctctccagtcaactccgttcccgctcagaagggacatgctgttcaaggaattttaatttataaccaaccgttacaagaattgaccttttgggacagcggtg

SEQ ID NO: 435536 - DNA, 140 bp, Artificial Sequence
  Synthetic
caccgctgtcccaaaaggtcaattcttgtaacggttggttataaattaaaattccttgaacagcatgtcccttctgagcgggaacggagttgactggagagcattttcggccagtcttaacatatcagcagccagggcct

SEQ ID NO: 435537 - DNA, 140 bp, Artificial Sequence
  Synthetic
aggccctggctgctgatatgggagttgctttgaaggatcaagaattacagcaatcattgattcctggatttagatccattgttcatatgctctcagaatggttactcctagaggtcacgtgaccttttgggacagcggtg

SEQ ID NO: 435538 - DNA, 140 bp, Artificial Sequence
  Synthetic
caccgctgtcccaaaaggtcacgtgacctctaggagtaaccattctgagagcatatgaacaatggatctaaatccaggaatcaatgattgctgtaattcttgatccttcaaagcaactcccatatcagcagccagggcct

SEQ ID NO: 435539 - DNA, 140 bp, Artificial Sequence
  Synthetic
atacgccatgctgggtctccatgaaaaagggccagtcatcactaccggtttggctttactttcctagtgaagggcaacaattaaaacctatattaaaaatcttacagagattatcagactcgtacttgggagtcggccat

SEQ ID NO: 435540 - DNA, 140 bp, Artificial Sequence
  Synthetic
atggccgactcccaagtacgagtctgataatctctgtaagatttttaatataggttttaattgttgcccttcactaggaaagtaaagccaaaccggtagtgatgactggccctttttcatggagacccagcatggcgtat

SEQ ID NO: 435541 - DNA, 140 bp, Artificial Sequence
  Synthetic
atacgccatgctgggtctcccggctatccatattagccccaatctgttgggaatctacttgacttcagatatgtttaagattctgatggcaggtgtgaaaaatttcttcaataagatgttcgtacttgggagtcggccat

SEQ ID NO: 435542 - DNA, 140 bp, Artificial Sequence
  Synthetic
atggccgactcccaagtacgaacatcttattgaagaaatttttcacacctgccatcagaatcttaaacatatctgaagtcaagtagattcccaacagattggggctaatatggatagccgggagacccagcatggcgtat

SEQ ID NO: 435543 - DNA, 140 bp, Artificial Sequence
  Synthetic
atacgccatgctgggtctccgtggaagtcaggcgaattgacattgaaccttgttgtggtgagacaatcctttcagagtcagttgtttttggactagtggctgaggcagttctaagagaaccgtacttgggagtcggccat

SEQ ID NO: 435544 - DNA, 140 bp, Artificial Sequence
  Synthetic
atggccgactcccaagtacggttctcttagaactgcctcagccactagtccaaaaacaactgactctgaaaggattgtctcaccacaacaaggttcaatgtcaattcgcctgacttccacggagacccagcatggcgtat

SEQ ID NO: 435545 - DNA, 140 bp, Artificial Sequence
  Synthetic
aggccctggctgctgatatgaaaaattgcttacaagtcaggaaaatccggagcatttttggatgcatttcaccagattctaagtgaaggagagaatgctcaggcagcattaactcgactagaccttttgggacagcggtg

SEQ ID NO: 435546 - DNA, 140 bp, Artificial Sequence
  Synthetic
caccgctgtcccaaaaggtctagtcgagttaatgctgcctgagcattctctccttcacttagaatctggtgaaatgcatccaaaaatgctccggattttcctgacttgtaagcaatttttcatatcagcagccagggcct

SEQ ID NO: 435547 - DNA, 140 bp, Artificial Sequence
  Synthetic
atacgccatgctgggtctccagcaaaattgccatataagtagcttaaattagcatgggtatcccaagtttaatcacataataatgttggaggcacagtatattatagttgattgttctgtcgtacttgggagtcggccat

SEQ ID NO: 435548 - DNA, 140 bp, Artificial Sequence
  Synthetic
atggccgactcccaagtacgacagaacaatcaactataatatactgtgcctccaacattattatgtgattaaacttgggatacccatgctaatttaagctacttatatggcaattttgctggagacccagcatggcgtat

SEQ ID NO: 435549 - DNA, 140 bp, Artificial Sequence
  Synthetic
aggccctggctgctgatatgaatcacataataatgttggaggcacagtatattatagttgattgttctgtacaataaaggatatacctactctgagttatatttactggtatatgatagtgaccttttgggacagcggtg

SEQ ID NO: 435550 - DNA, 140 bp, Artificial Sequence
  Synthetic
caccgctgtcccaaaaggtcactatcatataccagtaaatataactcagagtaggtatatcctttattgtacagaacaatcaactataatatactgtgcctccaacattattatgtgattcatatcagcagccagggcct

SEQ ID NO: 435551 - DNA, 140 bp, Artificial Sequence
  Synthetic
atacgccatgctgggtctccgagcaaggtgagacacgggccctgaaaatctaattctcactgttaatagttgcaaggagagtgatctttccaagttgatacaaagacactaaacatttcacgtacttgggagtcggccat

SEQ ID NO: 435552 - DNA, 140 bp, Artificial Sequence
  Synthetic
atggccgactcccaagtacgtgaaatgtttagtgtctttgtatcaacttggaaagatcactctccttgcaactattaacagtgagaattagattttcagggcccgtgtctcaccttgctcggagacccagcatggcgtat

SEQ ID NO: 435553 - DNA, 140 bp, Artificial Sequence
  Synthetic
aggccctggctgctgatatggattgtgagagtataaacttgtagaattaccgtgagtcacaactgttgcatatcttccaaaatatatcttttgtaggtgatgtgtgcttgaatacaccgagaccttttgggacagcggtg

SEQ ID NO: 435554 - DNA, 140 bp, Artificial Sequence
  Synthetic
caccgctgtcccaaaaggtctcggtgtattcaagcacacatcacctacaaaagatatattttggaagatatgcaacagttgtgactcacggtaattctacaagtttatactctcacaatccatatcagcagccagggcct

SEQ ID NO: 435555 - DNA, 140 bp, Artificial Sequence
  Synthetic
aggccctggctgctgatatgaatttatttctgtcttaagtgtgatttttaccttgaaagagttaaatggtaatagattaatccttgaagttactcttttatatattatagaggaattaatgaccttttgggacagcggtg

SEQ ID NO: 435556 - DNA, 140 bp, Artificial Sequence
  Synthetic
caccgctgtcccaaaaggtcattaattcctctataatatataaaagagtaacttcaaggattaatctattaccatttaactctttcaaggtaaaaatcacacttaagacagaaataaattcatatcagcagccagggcct

SEQ ID NO: 435557 - DNA, 140 bp, Artificial Sequence
  Synthetic
atacgccatgctgggtctccatacctattttttgataaacctttggatgtagatttgaacaagtacatggacaatgagttggtttatgacaatgaccctctttgcagtgggattaaagggcgtacttgggagtcggccat

SEQ ID NO: 435558 - DNA, 140 bp, Artificial Sequence
  Synthetic
atggccgactcccaagtacgccctttaatcccactgcaaagagggtcattgtcataaaccaactcattgtccatgtacttgttcaaatctacatccaaaggtttatcaaaaaataggtatggagacccagcatggcgtat

SEQ ID NO: 435559 - DNA, 140 bp, Artificial Sequence
  Synthetic
atacgccatgctgggtctccacatagaaaacatatttatctttgtgtgatcctcggcttagttggaattaacttttgtggtaattcaagacgcttattcatagtagattatatgatttttcgtacttgggagtcggccat

SEQ ID NO: 435560 - DNA, 140 bp, Artificial Sequence
  Synthetic
atggccgactcccaagtacgaaaaatcatataatctactatgaataagcgtcttgaattaccacaaaagttaattccaactaagccgaggatcacacaaagataaatatgttttctatgtggagacccagcatggcgtat

SEQ ID NO: 435561 - DNA, 140 bp, Artificial Sequence
  Synthetic
aggccctggctgctgatatgtagaacaaattttaatatggccagttccagcaattacaatacatacatgcaatacttgaatccccctccttatgctgatcacggtgcaaaccagttaatcgaccttttgggacagcggtg

SEQ ID NO: 435562 - DNA, 140 bp, Artificial Sequence
  Synthetic
caccgctgtcccaaaaggtcgattaactggtttgcaccgtgatcagcataaggagggggattcaagtattgcatgtatgtattgtaattgctggaactggccatattaaaatttgttctacatatcagcagccagggcct

SEQ ID NO: 435563 - DNA, 140 bp, Artificial Sequence
  Synthetic
atacgccatgctgggtctccaatacttgaatccccctccttatgctgatcacggtgcaaaccagttaatcccggcggatcagctatcaaaccagcagggtataactccaaattatgtgggcgtacttgggagtcggccat

SEQ ID NO: 435564 - DNA, 140 bp, Artificial Sequence
  Synthetic
atggccgactcccaagtacgcccacataatttggagttataccctgctggtttgatagctgatccgccgggattaactggtttgcaccgtgatcagcataaggagggggattcaagtattggagacccagcatggcgtat

SEQ ID NO: 435565 - DNA, 140 bp, Artificial Sequence
  Synthetic
atacgccatgctgggtctccccactattatgcaagccttaattattggagagacaaagctaataaggtcaagaatactcctttttcgcatttgataaattgttcatttcttgaactttctcgtacttgggagtcggccat

SEQ ID NO: 435566 - DNA, 140 bp, Artificial Sequence
  Synthetic
atggccgactcccaagtacgagaaagttcaagaaatgaacaatttatcaaatgcgaaaaaggagtattcttgaccttattagctttgtctctccaataattaaggcttgcataatagtggggagacccagcatggcgtat

SEQ ID NO: 435567 - DNA, 140 bp, Artificial Sequence
  Synthetic
aggccctggctgctgatatgggtgttccagcatggctgcctcttgggattatgagcaattttgaatatcctttagctcatactgtggctgcgttgctcacaggcagctatacaatcacccgaccttttgggacagcggtg

SEQ ID NO: 435568 - DNA, 140 bp, Artificial Sequence
  Synthetic
caccgctgtcccaaaaggtcgggtgattgtatagctgcctgtgagcaacgcagccacagtatgagctaaaggatattcaaaattgctcataatcccaagaggcagccatgctggaacacccatatcagcagccagggcct

SEQ ID NO: 435569 - DNA, 140 bp, Artificial Sequence; identical to SEQ ID NO: 377547
  Synthetic

SEQ ID NO: 435570 - DNA, 140 bp, Artificial Sequence; identical to SEQ ID NO: 377548
  Synthetic

SEQ ID NO: 435571 - DNA, 140 bp, Artificial Sequence
  Synthetic
aggccctggctgctgatatgggacatgctgttcaaggaattttaatttataaccaaccgttacaagaattaatttactttttccgttatacttacttgcattaattctttgaatatttaggaccttttgggacagcggtg

SEQ ID NO: 435572 - DNA, 140 bp, Artificial Sequence
  Synthetic
caccgctgtcccaaaaggtcctaaatattcaaagaattaatgcaagtaagtataacggaaaaagtaaattaattcttgtaacggttggttataaattaaaattccttgaacagcatgtcccatatcagcagccagggcct

SEQ ID NO: 435573 - DNA, 140 bp, Artificial Sequence
  Synthetic
aggccctggctgctgatatgtttaaggttccagtaaaaacgataatccggaatgcagtaagtttacaagcttcaaaaccagggttgagggtatggtaccgtgaccaaaacttgaccccttgaccttttgggacagcggtg

SEQ ID NO: 435574 - DNA, 140 bp, Artificial Sequence
  Synthetic
caccgctgtcccaaaaggtcaaggggtcaagttttggtcacggtaccataccctcaaccctggttttgaagcttgtaaacttactgcattccggattatcgtttttactggaaccttaaacatatcagcagccagggcct

SEQ ID NO: 435575 - DNA, 140 bp, Artificial Sequence
  Synthetic
aggccctggctgctgatatgatctatgtgacgatgagtttattgtaagcgtcgctagttatgaatgttttattatgattaaagatgtcttcattgagaggtataatacatgggaaatatggaccttttgggacagcggtg

SEQ ID NO: 435576 - DNA, 140 bp, Artificial Sequence
  Synthetic
caccgctgtcccaaaaggtccatatttcccatgtattatacctctcaatgaagacatctttaatcataataaaacattcataactagcgacgcttacaataaactcatcgtcacatagatcatatcagcagccagggcct

SEQ ID NO: 435577 - DNA, 140 bp, Artificial Sequence; identical to SEQ ID NO: 377479
  Synthetic

SEQ ID NO: 435578 - DNA, 140 bp, Artificial Sequence; identical to SEQ ID NO: 377480
  Synthetic

SEQ ID NO: 435579 - DNA, 140 bp, Artificial Sequence
  Synthetic
atacgccatgctgggtctcctgcccgcgcttggctcgaagacagtgatggagctgattatcctcctcttgatgtgttaggtgagttatacaattatggagaccaaattattgccatgtaccgtacttgggagtcggccat

SEQ ID NO: 435580 - DNA, 140 bp, Artificial Sequence
  Synthetic
atggccgactcccaagtacggtacatggcaataatttggtctccataattgtataactcacctaacacatcaagaggaggataatcagctccatcactgtcttcgagccaagcgcgggcaggagacccagcatggcgtat

SEQ ID NO: 435581 - DNA, 140 bp, Artificial Sequence
  Synthetic
aggccctggctgctgatatggagaacttccctttgaatggcttcaacaacagacaagttgtactagcgtatgcgaatccaacgctcagtgccgtttgaaatgatgctcaaatgagacagggaccttttgggacagcggtg

SEQ ID NO: 435582 - DNA, 140 bp, Artificial Sequence
  Synthetic
caccgctgtcccaaaaggtccctgtctcatttgagcatcatttcaaacggcactgagcgttggattcgcatacgctagtacaacttgtctgttgttgaagccattcaaagggaagttctccatatcagcagccagggcct

SEQ ID NO: 435583 - DNA, 140 bp, Artificial Sequence
  Synthetic
atacgccatgctgggtctcccacagatgattaagtcatattatgatgagctctgtgatcttaatctgaaacttcgaatttcagacaataaggccgagtgtgcccaaaactttattaaaaccgtacttgggagtcggccat

SEQ ID NO: 435584 - DNA, 140 bp, Artificial Sequence
  Synthetic
atggccgactcccaagtacggttttaataaagttttgggcacactcggccttattgtctgaaattcgaagtttcagattaagatcacagagctcatcataatatgacttaatcatctgtgggagacccagcatggcgtat

SEQ ID NO: 435585 - DNA, 140 bp, Artificial Sequence
  Synthetic
aggccctggctgctgatatgaaaaacttcctgatgatgcctggcgcccatccaaggacaaattaattgggaacaccatgcatcctgcagtctccatccacccgaatttgccgcctattgtgaccttttgggacagcggtg

SEQ ID NO: 435586 - DNA, 140 bp, Artificial Sequence
  Synthetic
caccgctgtcccaaaaggtcacaataggcggcaaattcgggtggatggagactgcaggatgcatggtgttcccaattaatttgtccttggatgggcgccaggcatcatcaggaagtttttcatatcagcagccagggcct

SEQ ID NO: 435587 - DNA, 140 bp, Artificial Sequence
  Synthetic
atacgccatgctgggtctcctgaattgtcgcctgatttcacaaattatgaggataatcagcagaattggccacaaagagtggtgacaaagaagggtaggactttcctttatcctaatgatcgtacttgggagtcggccat

SEQ ID NO: 435588 - DNA, 140 bp, Artificial Sequence
  Synthetic
atggccgactcccaagtacgatcattaggataaaggaaagtcctacccttctttgtcaccactctttgtggccaattctgctgattatcctcataatttgtgaaatcaggcgacaattcaggagacccagcatggcgtat

SEQ ID NO: 435589 - DNA, 140 bp, Artificial Sequence
  Synthetic
atacgccatgctgggtctccggtcatcagatctataatgggtttactagattatataaaagaaatagtaatattttataaacaattcttgcttagttttactttgatttactaacatatacgtacttgggagtcggccat

SEQ ID NO: 435590 - DNA, 140 bp, Artificial Sequence
  Synthetic
atggccgactcccaagtacgtatatgttagtaaatcaaagtaaaactaagcaagaattgtttataaaatattactatttcttttatataatctagtaaacccattatagatctgatgaccggagacccagcatggcgtat

SEQ ID NO: 435591 - DNA, 140 bp, Artificial Sequence
  Synthetic
atacgccatgctgggtctccaccttaaccttacggattgtacgcttaatacaaagtcattgacaactcctaccgggacagaaatcttaggtataagtccgttacgatcctctagatattccgtacttgggagtcggccat

SEQ ID NO: 435592 - DNA, 140 bp, Artificial Sequence
  Synthetic
atggccgactcccaagtacggaatatctagaggatcgtaacggacttatacctaagatttctgtcccggtaggagttgtcaatgactttgtattaagcgtacaatccgtaaggttaaggtggagacccagcatggcgtat

SEQ ID NO: 435593 - DNA, 140 bp, Artificial Sequence
  Synthetic
atacgccatgctgggtctccgctgtgaaccaggagtgttgggacagtgtcttcgatagaagtgtattaggatataatcctcctgttagatttcagtcaaagagagtgccggagcaattttcgtacttgggagtcggccat

SEQ ID NO: 435594 - DNA, 140 bp, Artificial Sequence
  Synthetic
atggccgactcccaagtacgaaaattgctccggcactctctttgactgaaatctaacaggaggattatatcctaatacacttctatcgaagacactgtcccaacactcctggttcacagcggagacccagcatggcgtat

SEQ ID NO: 435595 - DNA, 140 bp, Artificial Sequence
  Synthetic
aggccctggctgctgatatgtagattatggatcaacagctctacaggggatggatatcaagatgccactctcggagcaaaatctggttggaaattgtcgaccatcaaagggcattagattgaccttttgggacagcggtg

SEQ ID NO: 435596 - DNA, 140 bp, Artificial Sequence
  Synthetic
caccgctgtcccaaaaggtcaatctaatgccctttgatggtcgacaatttccaaccagattttgctccgagagtggcatcttgatatccatcccctgtagagctgttgatccataatctacatatcagcagccagggcct

SEQ ID NO: 435597 - DNA, 140 bp, Artificial Sequence
  Synthetic
aggccctggctgctgatatgtgggtcaagcagacttttccttgaatcaaatattggattttgctgaaaagttagagtatttggctccttcttataggaatttttccttctcattaaaagagaccttttgggacagcggtg

SEQ ID NO: 435598 - DNA, 140 bp, Artificial Sequence
  Synthetic
caccgctgtcccaaaaggtctcttttaatgagaaggaaaaattcctataagaaggagccaaatactctaacttttcagcaaaatccaatatttgattcaaggaaaagtctgcttgacccacatatcagcagccagggcct

SEQ ID NO: 435599 - DNA, 140 bp, Artificial Sequence
  Synthetic
atacgccatgctgggtctcccccagttgagagtattttttatgcatttggggctaacttaatagtagaaagtttaagcctgagtaggatcaaatcaattaagaatctctcagatttgacacgtacttgggagtcggccat

SEQ ID NO: 435600 - DNA, 140 bp, Artificial Sequence
  Synthetic
atggccgactcccaagtacgtgtcaaatctgagagattcttaattgatttgatcctactcaggcttaaactttctactattaagttagccccaaatgcataaaaaatactctcaactgggggagacccagcatggcgtat

SEQ ID NO: 435601 - DNA, 140 bp, Artificial Sequence
  Synthetic
aggccctggctgctgatatgttttagtagcgttacctttcaatacaatctaggtgattgtgaaaagacttccaaacatggcagaattatcaacgcgttacaacttgcctgcaaatgttacgaccttttgggacagcggtg

SEQ ID NO: 435602 - DNA, 140 bp, Artificial Sequence
  Synthetic
caccgctgtcccaaaaggtcgtaacatttgcaggcaagttgtaacgcgttgataattctgccatgtttggaagtcttttcacaatcacctagattgtattgaaaggtaacgctactaaaacatatcagcagccagggcct

SEQ ID NO: 435603 - DNA, 140 bp, Artificial Sequence
  Synthetic
atacgccatgctgggtctcccaacaccacagatccaaatagtgatgatgaggacctcacaacatccggttcagggtccggagaacaggaaccccacacaacttccgatgcggtcactacgcgtacttgggagtcggccat

SEQ ID NO: 435604 - DNA, 140 bp, Artificial Sequence
  Synthetic
atggccgactcccaagtacgcgtagtgaccgcatcggaagttgtgtggggttcctgttctccggaccctgaaccggatgttgtgaggtcctcatcatcactatttggatctgtggtgttgggagacccagcatggcgtat

SEQ ID NO: 435605 - DNA, 140 bp, Artificial Sequence
  Synthetic
atacgccatgctgggtctccgcaagaactgggcacatgatggtgatttgagagcgctgcctagtgctacaaattcttcttttaattaccataatgatacaactataaacctccgtacattcgtacttgggagtcggccat

SEQ ID NO: 435606 - DNA, 140 bp, Artificial Sequence
  Synthetic
atggccgactcccaagtacgaatgtacggaggtttatagttgtatcattatggtaattaaaagaagaatttgtagcactaggcagcgctctcaaatcaccatcatgtgcccagttcttgcggagacccagcatggcgtat

SEQ ID NO: 435607 - DNA, 140 bp, Artificial Sequence
  Synthetic
aggccctggctgctgatatggccagtattggtacatcctttgagagaggaacaagcgagacacggcacatttttccgagccgttggatagcttcattccattcaatgttagcaataaattgaccttttgggacagcggtg

SEQ ID NO: 435608 - DNA, 140 bp, Artificial Sequence
  Synthetic
caccgctgtcccaaaaggtcaatttattgctaacattgaatggaatgaagctatccaacggctcggaaaaatgtgccgtgtctcgcttgttcctctctcaaaggatgtaccaatactggccatatcagcagccagggcct

SEQ ID NO: 435609 - DNA, 140 bp, Artificial Sequence
  Synthetic
atacgccatgctgggtctccgggcaacaactaaaacctattttaaaaattttgcaaaggttatcatgtttattaacaactaaaaaggctcaaaatcacagacctgtagctgatacttgttcgtacttgggagtcggccat

SEQ ID NO: 435610 - DNA, 140 bp, Artificial Sequence
  Synthetic
atggccgactcccaagtacgaacaagtatcagctacaggtctgtgattttgagcctttttagttgttaataaacatgataacctttgcaaaatttttaaaataggttttagttgttgcccggagacccagcatggcgtat

SEQ ID NO: 435611 - DNA, 140 bp, Artificial Sequence
  Synthetic
aggccctggctgctgatatgctctgcaccactacaaaacaccatcaattacgacacacagagcacagccactgaaaatgaacaaaccagtgccccctcgaaaacaaccctgcctccaacagaccttttgggacagcggtg

SEQ ID NO: 435612 - DNA, 140 bp, Artificial Sequence
  Synthetic
caccgctgtcccaaaaggtctgttggaggcagggttgttttcgagggggcactggtttgttcattttcagtggctgtgctctgtgtgtcgtaattgatggtgttttgtagtggtgcagagcatatcagcagccagggcct

SEQ ID NO: 435613 - DNA, 140 bp, Artificial Sequence
  Synthetic
aggccctggctgctgatatgggaaatcttaccacagcaaagagcaccaacaacacgaaaggccccaccacaacggcaccaaatatgacaaatgggcatttaaccagtccctcccccacccgaccttttgggacagcggtg

SEQ ID NO: 435614 - DNA, 140 bp, Artificial Sequence
  Synthetic
caccgctgtcccaaaaggtcgggtgggggagggactggttaaatgcccatttgtcatatttggtgccgttgtggtggggcctttcgtgttgttggtgctctttgctgtggtaagatttcccatatcagcagccagggcct

SEQ ID NO: 435615 - DNA, 140 bp, Artificial Sequence
  Synthetic
atacgccatgctgggtctccgcaatatctcaacggtgtacaactgccacaatcgctaaaaacaatggcaaggtgtggacccttatctgactctatctttgatgaccttcaaggttctctacgtacttgggagtcggccat

SEQ ID NO: 435616 - DNA, 140 bp, Artificial Sequence
  Synthetic
atggccgactcccaagtacgtagagaaccttgaaggtcatcaaagatagagtcagataagggtccacaccttgccattgtttttagcgattgtggcagttgtacaccgttgagatattgcggagacccagcatggcgtat

SEQ ID NO: 435617 - DNA, 140 bp, Artificial Sequence
  Synthetic
aggccctggctgctgatatgttcaactggaagaaccactgcaccagctgctgcctttgatgcttacttaaatgagcatggtgtccctcccccccaacctgcgattttcaaagatcttggggaccttttgggacagcggtg

SEQ ID NO: 435618 - DNA, 140 bp, Artificial Sequence
  Synthetic
caccgctgtcccaaaaggtccccaagatctttgaaaatcgcaggttgggggggagggacaccatgctcatttaagtaagcatcaaaggcagcagctggtgcagtggttcttccagttgaacatatcagcagccagggcct

SEQ ID NO: 435619 - DNA, 140 bp, Artificial Sequence
  Synthetic
aggccctggctgctgatatgcacagcacggttacctacttatctactttgatccaattcatcctcagaccacagcaatcaaatttatttaaatattcaaactactttttaggatcctattgaccttttgggacagcggtg

SEQ ID NO: 435620 - DNA, 140 bp, Artificial Sequence
  Synthetic
caccgctgtcccaaaaggtcaataggatcctaaaaagtagtttgaatatttaaataaatttgattgctgtggtctgaggatgaattggatcaaagtagataagtaggtaaccgtgctgtgcatatcagcagccagggcct

SEQ ID NO: 435621 - DNA, 140 bp, Artificial Sequence
  Synthetic
atacgccatgctgggtctccaacgccccaagttttaggagggttatcctttctgaatccagagaaattgttctacaggaatataagtgatcctctcacttcgggtctatttcaactcaagcgtacttgggagtcggccat

SEQ ID NO: 435622 - DNA, 140 bp, Artificial Sequence
  Synthetic
atggccgactcccaagtacgcttgagttgaaatagacccgaagtgagaggatcacttatattcctgtagaacaatttctctggattcagaaaggataaccctcctaaaacttggggcgttggagacccagcatggcgtat

SEQ ID NO: 435623 - DNA, 140 bp, Artificial Sequence
  Synthetic
atacgccatgctgggtctccaatgcattggaatttcttggaaaggaagaattgttctatatcttgattgctaaaaaacctgggttagcagatgcctcagatttcgtcatgaatccattagcgtacttgggagtcggccat

SEQ ID NO: 435624 - DNA, 140 bp, Artificial Sequence
  Synthetic
atggccgactcccaagtacgctaatggattcatgacgaaatctgaggcatctgctaacccaggttttttagcaatcaagatatagaacaattcttcctttccaagaaattccaatgcattggagacccagcatggcgtat

SEQ ID NO: 435625 - DNA, 140 bp, Artificial Sequence
  Synthetic
atacgccatgctgggtctcctgttatcacctgacaaagttcaaaagcatcaaatcttagctgacacctgttgtccaattgacagcttttgggtctatccaagcaagtccacaaggactaacgtacttgggagtcggccat

SEQ ID NO: 435626 - DNA, 140 bp, Artificial Sequence
  Synthetic
atggccgactcccaagtacgttagtccttgtggacttgcttggatagacccaaaagctgtcaattggacaacaggtgtcagctaagatttgatgcttttgaactttgtcaggtgataacaggagacccagcatggcgtat

SEQ ID NO: 435627 - DNA, 140 bp, Artificial Sequence
  Synthetic
aggccctggctgctgatatggttcgtgaaaatatcacgatcacgtcacaaaatagaataataaattctctctttcatataggttctgatttagaggaccagaaggtgtgtgagtggctttgaccttttgggacagcggtg

SEQ ID NO: 435628 - DNA, 140 bp, Artificial Sequence
  Synthetic
caccgctgtcccaaaaggtcaaagccactcacacaccttctggtcctctaaatcagaacctatatgaaagagagaatttattattctattttgtgacgtgatcgtgatattttcacgaaccatatcagcagccagggcct

SEQ ID NO: 435629 - DNA, 140 bp, Artificial Sequence
  Synthetic
atacgccatgctgggtctcctatcatcaaaccccgtaatgagccgatttgccgctgacatcttttcaagaacacccagtggaaaacggcttcaagtcttaggttatctggaaggaacaagcgtacttgggagtcggccat

SEQ ID NO: 435630 - DNA, 140 bp, Artificial Sequence
  Synthetic
atggccgactcccaagtacgcttgttccttccagataacctaagacttgaagccgttttccactgggtgttcttgaaaagatgtcagcggcaaatcggctcattacggggtttgatgataggagacccagcatggcgtat

SEQ ID NO: 435631 - DNA, 140 bp, Artificial Sequence
  Synthetic
atacgccatgctgggtctcctacaaaagcattggggtcatcccgttctatacaatgatgttgcactagataaggtcaaaaaacatgcacaatctacaaaaatcttaaaacctaaagtcatcgtacttgggagtcggccat

SEQ ID NO: 435632 - DNA, 140 bp, Artificial Sequence
  Synthetic
atggccgactcccaagtacgatgactttaggttttaagatttttgtagattgtgcatgttttttgaccttatctagtgcaacatcattgtatagaacgggatgaccccaatgcttttgtaggagacccagcatggcgtat

SEQ ID NO: 435633 - DNA, 140 bp, Artificial Sequence
  Synthetic
atacgccatgctgggtctcctatgtgtcgttcaaagagtcttgatttataactaaccattgtaagaattaatttactctttccgttatacttatctgcattaattccttgaatgtccagtcgtacttgggagtcggccat

SEQ ID NO: 435634 - DNA, 140 bp, Artificial Sequence
  Synthetic
atggccgactcccaagtacgactggacattcaaggaattaatgcagataagtataacggaaagagtaaattaattcttacaatggttagttataaatcaagactctttgaacgacacataggagacccagcatggcgtat

SEQ ID NO: 435635 - DNA, 140 bp, Artificial Sequence
  Synthetic
aggccctggctgctgatatgcttaaagaagctattgagatggtttctagattgttatgggtgactcaaggcactgcagatcgagagaaattgcttattcctcttctcaattcaagagtaagaccttttgggacagcggtg

SEQ ID NO: 435636 - DNA, 140 bp, Artificial Sequence
  Synthetic
caccgctgtcccaaaaggtcttactcttgaattgagaagaggaataagcaatttctctcgatctgcagtgccttgagtcacccataacaatctagaaaccatctcaatagcttctttaagcatatcagcagccagggcct

SEQ ID NO: 435637 - DNA, 140 bp, Artificial Sequence
  Synthetic
atacgccatgctgggtctccttgcaagggaagtgatctttccgagttgatacaaagacactaaacatttcaaaagcatgtatgtggacaaaacataattagaccatcttaattggagtagcgtacttgggagtcggccat

SEQ ID NO: 435638 - DNA, 140 bp, Artificial Sequence
  Synthetic
atggccgactcccaagtacgctactccaattaagatggtctaattatgttttgtccacatacatgcttttgaaatgtttagtgtctttgtatcaactcggaaagatcacttcccttgcaaggagacccagcatggcgtat

SEQ ID NO: 435639 - DNA, 140 bp, Artificial Sequence
  Synthetic
atacgccatgctgggtctccgggggggccccccccaaaaaaggccccccaggggccgacagccagcatcgcggggaagcacacccaccccacacacgaccacggcaaccgaaccagagtccgtacttgggagtcggccat

SEQ ID NO: 435640 - DNA, 140 bp, Artificial Sequence
  Synthetic
atggccgactcccaagtacggactctggttcggttgccgtggtcgtgtgtggggtgggtgtgcttccccgcgatgctggctgtcggcccctggggggccttttttggggggggcccccccggagacccagcatggcgtat

SEQ ID NO: 435641 - DNA, 140 bp, Artificial Sequence
  Synthetic
atacgccatgctgggtctccatccgagatggccacacttttaaggagcttagcattgttcaaaagaaacaaggacaaaccacccattacatcaggatccggtggagccatcagaggaatccgtacttgggagtcggccat

SEQ ID NO: 435642 - DNA, 140 bp, Artificial Sequence
  Synthetic
atggccgactcccaagtacggattcctctgatggctccaccggatcctgatgtaatgggtggtttgtccttgtttcttttgaacaatgctaagctccttaaaagtgtggccatctcggatggagacccagcatggcgtat

SEQ ID NO: 435643 - DNA, 140 bp, Artificial Sequence
  Synthetic
aggccctggctgctgatatgaggacaaaccacccattacatcaggatccggtggagccatcagaggaatcaaacacattattatagtaccaatccctggagattcctcaattaccacccggaccttttgggacagcggtg

SEQ ID NO: 435644 - DNA, 140 bp, Artificial Sequence
  Synthetic
caccgctgtcccaaaaggtccgggtggtaattgaggaatctccagggattggtactataataatgtgtttgattcctctgatggctccaccggatcctgatgtaatgggtggtttgtcctcatatcagcagccagggcct

SEQ ID NO: 435645 - DNA, 140 bp, Artificial Sequence
  Synthetic
atacgccatgctgggtctccgcgggcccaaactaacaggggcactaataggtatattatccttatttgtggagtctccaggtcaattgattcagaggatcaccgatgaccctgacgttagcgtacttgggagtcggccat

SEQ ID NO: 435646 - DNA, 140 bp, Artificial Sequence
  Synthetic
atggccgactcccaagtacgctaacgtcagggtcatcggtgatcctctgaatcaattgacctggagactccacaaataaggataatatacctattagtgcccctgttagtttgggcccgcggagacccagcatggcgtat

SEQ ID NO: 435647 - DNA, 140 bp, Artificial Sequence
  Synthetic
aggccctggctgctgatatgcacttaggattcaagatcctattatcagggacaagagcaggattagggatatccgagatggccacacttttaaggagcttagcattgttcaaaagaaacagaccttttgggacagcggtg

SEQ ID NO: 435648 - DNA, 140 bp, Artificial Sequence
  Synthetic
caccgctgtcccaaaaggtctgtttcttttgaacaatgctaagctccttaaaagtgtggccatctcggatatccctaatcctgctcttgtccctgataataggatcttgaatcctaagtgcatatcagcagccagggcct

SEQ ID NO: 435649 - DNA, 140 bp, Artificial Sequence
  Synthetic
aggccctggctgctgatatgcatcaggctgttagaggttgtccagagtgaccagtcacaatctggccttaccttcgcatcaagaggtaccaacatggaggatgaggcggaccaatactttgaccttttgggacagcggtg

SEQ ID NO: 435650 - DNA, 140 bp, Artificial Sequence
  Synthetic
caccgctgtcccaaaaggtcaaagtattggtccgcctcatcctccatgttggtacctcttgatgcgaaggtaaggccagattgtgactggtcactctggacaacctctaacagcctgatgcatatcagcagccagggcct

SEQ ID NO: 435651 - DNA, 140 bp, Artificial Sequence
  Synthetic
atacgccatgctgggtctcctcacatgatgatccaagcagtagtgatcaatccaggttcggatggttcgagaacaaggaaatctcagatattgaagtgcaagaccctgagggattcaacacgtacttgggagtcggccat

SEQ ID NO: 435652 - DNA, 140 bp, Artificial Sequence
  Synthetic
atggccgactcccaagtacgtgttgaatccctcagggtcttgcacttcaatatctgagatttccttgttctcgaaccatccgaacctggattgatcactactgcttggatcatcatgtgaggagacccagcatggcgtat

SEQ ID NO: 435653 - DNA, 140 bp, Artificial Sequence
  Synthetic
aggccctggctgctgatatggaacaaggaaatctcagatattgaagtgcaagaccctgagggattcaacatgattctgggtaccattctagcccaaatttgggtcttgctcgcaaaggcggaccttttgggacagcggtg

SEQ ID NO: 435654 - DNA, 140 bp, Artificial Sequence
  Synthetic
caccgctgtcccaaaaggtccgcctttgcgagcaagacccaaatttgggctagaatggtacccagaatcatgttgaatccctcagggtcttgcacttcaatatctgagatttccttgttccatatcagcagccagggcct

SEQ ID NO: 435655 - DNA, 140 bp, Artificial Sequence
  Synthetic
atacgccatgctgggtctcctgattctgggtaccattctagcccaaatttgggtcttgctcgcaaaggcggttacggccccagacacggcagctgattcggagctaagaaggtggataaacgtacttgggagtcggccat

SEQ ID NO: 435656 - DNA, 140 bp, Artificial Sequence
  Synthetic
atggccgactcccaagtacgtttatccaccttcttagctccgaatcagctgccgtgtctggggccgtaaccgcctttgcgagcaagacccaaatttgggctagaatggtacccagaatcaggagacccagcatggcgtat

SEQ ID NO: 435657 - DNA, 140 bp, Artificial Sequence
  Synthetic
aggccctggctgctgatatggttacggccccagacacggcagctgattcggagctaagaaggtggataaagtacacccaacaaagaagggtagttggtgaatttagattggagagaaaatgaccttttgggacagcggtg

SEQ ID NO: 435658 - DNA, 140 bp, Artificial Sequence
  Synthetic
caccgctgtcccaaaaggtcattttctctccaatctaaattcaccaactacccttctttgttgggtgtactttatccaccttcttagctccgaatcagctgccgtgtctggggccgtaaccatatcagcagccagggcct

SEQ ID NO: 435659 - DNA, 140 bp, Artificial Sequence
  Synthetic
atacgccatgctgggtctcccagggatcagggaaaggtgtcagcttccagctcgtcaagctaggtgtctggaaatccccaaccgacatgcaatcctgggtccccctatcaacggatgatccgtacttgggagtcggccat

SEQ ID NO: 435660 - DNA, 140 bp, Artificial Sequence
  Synthetic
atggccgactcccaagtacggatcatccgttgatagggggacccaggattgcatgtcggttggggatttccagacacctagcttgacgagctggaagctgacacctttccctgatccctgggagacccagcatggcgtat

SEQ ID NO: 435661 - DNA, 140 bp, Artificial Sequence
  Synthetic
aggccctggctgctgatatgttggctgctttatgcctcttagcctggatagtgatctgacaatgtacctaaaggacaaggcacttgctgctctccaaagggaatgggattcagtttacccgaccttttgggacagcggtg

SEQ ID NO: 435662 - DNA, 140 bp, Artificial Sequence
  Synthetic
caccgctgtcccaaaaggtcgggtaaactgaatcccattccctttggagagcagcaagtgccttgtcctttaggtacattgtcagatcactatccaggctaagaggcataaagcagccaacatatcagcagccagggcct

SEQ ID NO: 435663 - DNA, 140 bp, Artificial Sequence
  Synthetic
aggccctggctgctgatatgcccaagtgtcatttctacacggtgatcaaagtgagaatgagctcccaggattggggggcaaggaagataggagggtcaaacagagtcggggagaagccaggaccttttgggacagcggtg

SEQ ID NO: 435664 - DNA, 140 bp, Artificial Sequence
  Synthetic
caccgctgtcccaaaaggtcctggcttctccccgactctgtttgaccctcctatcttccttgccccccaatcctgggagctcattctcactttgatcaccgtgtagaaatgacacttgggcatatcagcagccagggcct

SEQ ID NO: 435665 - DNA, 140 bp, Artificial Sequence
  Synthetic
atacgccatgctgggtctccttggggggcaaggaagataggagggtcaaacagagtcggggagaagccagggagagctacagagagaccgggtccagcagagcaagtgatgagagagctgcgtacttgggagtcggccat

SEQ ID NO: 435666 - DNA, 140 bp, Artificial Sequence
  Synthetic
atggccgactcccaagtacgcagctctctcatcacttgctctgctggacccggtctctctgtagctctccctggcttctccccgactctgtttgaccctcctatcttccttgccccccaaggagacccagcatggcgtat

SEQ ID NO: 435667 - DNA, 140 bp, Artificial Sequence
  Synthetic
atacgccatgctgggtctcccccatcttccaaccagcacacccctagacattgacactgcatcggagtcaggccaagatccgcaggacagtcgaaggtcagctgacgccctgctcaggctcgtacttgggagtcggccat

SEQ ID NO: 435668 - DNA, 140 bp, Artificial Sequence
  Synthetic
atggccgactcccaagtacgagcctgagcagggcgtcagctgaccttcgactgtcctgcggatcttggcctgactccgatgcagtgtcaatgtctaggggtgtgctggttggaagatgggggagacccagcatggcgtat

SEQ ID NO: 435669 - DNA, 140 bp, Artificial Sequence
  Synthetic
aggccctggctgctgatatgaaaagacatcagtatcccacagcctccccaagtcccccggtctcctcttcgtctcgaagggaccaaaagatcaatccaccacatccgacgatactcaattgaccttttgggacagcggtg

SEQ ID NO: 435670 - DNA, 140 bp, Artificial Sequence
  Synthetic
caccgctgtcccaaaaggtcaattgagtatcgtcggatgtggtggattgatcttttggtcccttcgagacgaagaggagaccgggggacttggggaggctgtgggatactgatgtcttttcatatcagcagccagggcct

SEQ ID NO: 435671 - DNA, 140 bp, Artificial Sequence
  Synthetic
atacgccatgctgggtctccgcaaaccatggcaggaatcttggaggaacaaggctcagacacggacacccctagggtgtacaatgacagtgatcttctagactaggtgcgagaggccgagcgtacttgggagtcggccat

SEQ ID NO: 435672 - DNA, 140 bp, Artificial Sequence
  Synthetic
atggccgactcccaagtacgctcggcctctcgcacctagtctagaagatcactgtcattgtacaccctaggggtgtccgtgtctgagccttgttcctccaagattcctgccatggtttgcggagacccagcatggcgtat

SEQ ID NO: 435673 - DNA, 140 bp, Artificial Sequence
  Synthetic
atacgccatgctgggtctccccatggcagcatggtcagaaatatcagacaacccaggacaggaccgagccacccgcaaggaagagaaggcaggcagttcgggtctcagcaaaccatgcctcgtacttgggagtcggccat

SEQ ID NO: 435674 - DNA, 140 bp, Artificial Sequence
  Synthetic
atggccgactcccaagtacgaggcatggtttgctgagacccgaactgcctgccttctcttccttgcgggtggctcggtcctgtcctgggttgtctgatatttctgaccatgctgccatggggagacccagcatggcgtat

SEQ ID NO: 435675 - DNA, 140 bp, Artificial Sequence
  Synthetic
atacgccatgctgggtctcccagcggtgaagcggttaagggaatccaagatgctgactctatcatggttcaatcaggccttgatggtgatagcaccctctcaggaggagacgatgaatctcgtacttgggagtcggccat

SEQ ID NO: 435676 - DNA, 140 bp, Artificial Sequence
  Synthetic
atggccgactcccaagtacgagattcatcgtctcctcctgagagggtgctatcaccatcaaggcctgattgaaccatgatagagtcagcatcttggattcccttaaccgcttcaccgctgggagacccagcatggcgtat

SEQ ID NO: 435677 - DNA, 140 bp, Artificial Sequence
  Synthetic
atacgccatgctgggtctccgaaaacagcgatgtggatattggcgaacctgataccgagggatatgctatcactgaccggggatctgctcccatctctatggggttcagggcttctgatgcgtacttgggagtcggccat

SEQ ID NO: 435678 - DNA, 140 bp, Artificial Sequence
  Synthetic
atggccgactcccaagtacgcatcagaagccctgaaccccatagagatgggagcagatccccggtcagtgatagcatatccctcggtatcaggttcgccaatatccacatcgctgttttcggagacccagcatggcgtat

SEQ ID NO: 435679 - DNA, 140 bp, Artificial Sequence
  Synthetic
aggccctggctgctgatatgcactgaccggggatctgctcccatctctatggggttcagggcttctgatgttgaaactgcagaaggaggggagatccacgagctcctgaaactccaatccgaccttttgggacagcggtg

SEQ ID NO: 435680 - DNA, 140 bp, Artificial Sequence
  Synthetic
caccgctgtcccaaaaggtcggattggagtttcaggagctcgtggatctcccctccttctgcagtttcaacatcagaagccctgaaccccatagagatgggagcagatccccggtcagtgcatatcagcagccagggcct

SEQ ID NO: 435681 - DNA, 140 bp, Artificial Sequence
  Synthetic
atacgccatgctgggtctcccgaggtaacaactttccgaagcttgggaaaactctcaatgttcctccgcccccgaatcccagtagggccagcactgccgagacacccattaaaaagggcacgtacttgggagtcggccat

SEQ ID NO: 435682 - DNA, 140 bp, Artificial Sequence
  Synthetic
atggccgactcccaagtacgtgccctttttaatgggtgtctcggcagtgctggccctactgggattcgggggcggaggaacattgagagttttcccaagcttcggaaagttgttacctcgggagacccagcatggcgtat

SEQ ID NO: 435683 - DNA, 140 bp, Artificial Sequence
  Synthetic
atacgccatgctgggtctccggtggtgcaacccaatgtgctcgaaagtcaccctcggaaccatcagggccaggtgcacctgcggggaatgtccccgagtgtgtgagcaatgccgcactgacgtacttgggagtcggccat

SEQ ID NO: 435684 - DNA, 140 bp, Artificial Sequence
  Synthetic
atggccgactcccaagtacgtcagtgcggcattgctcacacactcggggacattccccgcaggtgcacctggccctgatggttccgagggtgactttcgagcacattgggttgcaccaccggagacccagcatggcgtat

SEQ ID NO: 435685 - DNA, 140 bp, Artificial Sequence
  Synthetic
atacgccatgctgggtctcctacaggagtggacacccggatctggtaccacaatctccccgagatcccagaacaatgaagaagggggagactattatgatgatgagctgttctccgatgtcgtacttgggagtcggccat

SEQ ID NO: 435686 - DNA, 140 bp, Artificial Sequence
  Synthetic
atggccgactcccaagtacgacatcggagaacagctcatcatcataatagtctcccccttcttcattgttctgggatctcggggagattgtggtaccagatccgggtgtccactcctgtaggagacccagcatggcgtat

SEQ ID NO: 435687 - DNA, 140 bp, Artificial Sequence
  Synthetic
aggccctggctgctgatatgaaccaggtccacacagccgccagccaatcaaccatccactcccacgattggagccgatggcagaagagcaggcacgccatgtcaaaaacggactggaatggaccttttgggacagcggtg

SEQ ID NO: 435688 - DNA, 140 bp, Artificial Sequence
  Synthetic
caccgctgtcccaaaaggtccattccagtccgtttttgacatggcgtgcctgctcttctgccatcggctccaatcgtgggagtggatggttgattggctggcggctgtgtggacctggttcatatcagcagccagggcct

SEQ ID NO: 435689 - DNA, 140 bp, Artificial Sequence
  Synthetic
atacgccatgctgggtctcccagccgacaactccaaggaatgacaagtggacggaccagttccagaggacagctgctgaaggaatttcaactaaagccgatcgggaaaaaggtgagctcacgtacttgggagtcggccat

SEQ ID NO: 435690 - DNA, 140 bp, Artificial Sequence
  Synthetic
atggccgactcccaagtacgtgagctcacctttttcccgatcggctttagttgaaattccttcagcagctgtcctctggaactggtccgtccacttgtcattccttggagttgtcggctgggagacccagcatggcgtat

SEQ ID NO: 435691 - DNA, 140 bp, Artificial Sequence
  Synthetic
atacgccatgctgggtctccctccattataaaatccagccggctagaggaggatcggaagcgttacctgatgactctccttgatgatatcaaaggagccaacgatcttgccaagttccaccgtacttgggagtcggccat

SEQ ID NO: 435692 - DNA, 140 bp, Artificial Sequence
  Synthetic
atggccgactcccaagtacggtggaacttggcaagatcgttggctcctttgatatcatcaaggagagtcatcaggtaacgcttccgatcctcctctagccggctggattttataatggagggagacccagcatggcgtat

SEQ ID NO: 435693 - DNA, 140 bp, Artificial Sequence
  Synthetic
aggccctggctgctgatatgtgactctccttgatgatatcaaaggagccaacgatcttgccaagttccaccagatgctgatgaagataataatgaagtagctacagctcaacttacctgcgaccttttgggacagcggtg

SEQ ID NO: 435694 - DNA, 140 bp, Artificial Sequence
  Synthetic
caccgctgtcccaaaaggtcgcaggtaagttgagctgtagctacttcattattatcttcatcagcatctggtggaacttggcaagatcgttggctcctttgatatcatcaaggagagtcacatatcagcagccagggcct

SEQ ID NO: 435695 - DNA, 140 bp, Artificial Sequence
  Synthetic
atacgccatgctgggtctccaacttaggagcaaagtgattgcctcccaagttccacaatgacagagatctacgacttcgacaagtcggcatgggacatcaaagggtcgatcgctccgatacgtacttgggagtcggccat

SEQ ID NO: 435696 - DNA, 140 bp, Artificial Sequence
  Synthetic
atggccgactcccaagtacgtatcggagcgatcgaccctttgatgtcccatgccgacttgtcgaagtcgtagatctctgtcattgtggaacttgggaggcaatcactttgctcctaagttggagacccagcatggcgtat

SEQ ID NO: 435697 - DNA, 140 bp, Artificial Sequence
  Synthetic
atacgccatgctgggtctcctgggggggtaaggaagatatgagggtcaaacagagtcggggagaagccagagagagctacagagaaaccaggcccagcagagcaagtgacgcgagagctacgtacttgggagtcggccat

SEQ ID NO: 435698 - DNA, 140 bp, Artificial Sequence
  Synthetic
atggccgactcccaagtacgtagctctcgcgtcacttgctctgctgggcctggtttctctgtagctctctctggcttctccccgactctgtttgaccctcatatcttccttacccccccaggagacccagcatggcgtat

SEQ ID NO: 435699 - DNA, 140 bp, Artificial Sequence
  Synthetic
aggccctggctgctgatatggcatttgggtccctgcccttaggtgttggtagatccacagcaaaacccgaggaactcctcaaagaggccactgagcttgacatagttgttagacgtacaggaccttttgggacagcggtg

SEQ ID NO: 435700 - DNA, 140 bp, Artificial Sequence
  Synthetic
caccgctgtcccaaaaggtcctgtacgtctaacaactatgtcaagctcagtggcctctttgaggagttcctcgggttttgctgtggatctaccaacacctaagggcagggacccaaatgccatatcagcagccagggcct

SEQ ID NO: 435701 - DNA, 140 bp, Artificial Sequence
  Synthetic
atacgccatgctgggtctcccagggctcaatgaaaaactggtgttctacaacaacaccccactaactctcctcacaccttggagaaaggtcctaacaacagggagtgtcttcaatgcaaacgtacttgggagtcggccat

SEQ ID NO: 435702 - DNA, 140 bp, Artificial Sequence
  Synthetic
atggccgactcccaagtacgtttgcattgaagacactccctgttgttaggacctttctccaaggtgtgaggagagttagtggggtgttgttgtagaacaccagtttttcattgagccctgggagacccagcatggcgtat

SEQ ID NO: 435703 - DNA, 140 bp, Artificial Sequence
  Synthetic
aggccctggctgctgatatgctcacaccttggagaaaggtcctaacaacagggagtgtcttcaatgcaaaccaagtgtgcaatgcggttaatctaataccgctggacaccccgcagaggtgaccttttgggacagcggtg

SEQ ID NO: 435704 - DNA, 140 bp, Artificial Sequence
  Synthetic
caccgctgtcccaaaaggtcacctctgcggggtgtccagcggtattagattaaccgcattgcacacttggtttgcattgaagacactccctgttgttaggacctttctccaaggtgtgagcatatcagcagccagggcct

SEQ ID NO: 435705 - DNA, 140 bp, Artificial Sequence
  Synthetic
atacgccatgctgggtctccaccgttcccagaagaatgctggaattcagatcggtcaatgcagtggccttcaacctgctagtgacccttaggattgacaaggcgattggccctgggaagacgtacttgggagtcggccat

SEQ ID NO: 435706 - DNA, 140 bp, Artificial Sequence
  Synthetic
atggccgactcccaagtacgtcttcccagggccaatcgccttgtcaatcctaagggtcactagcaggttgaaggccactgcattgaccgatctgaattccagcattcttctgggaacggtggagacccagcatggcgtat

SEQ ID NO: 435707 - DNA, 140 bp, Artificial Sequence
  Synthetic
aggccctggctgctgatatgcaacctgctagtgacccttaggattgacaaggcgattggccctgggaagatcatcgacaatgcagagcaacttcctgaggcaacatttatggtccacatcgaccttttgggacagcggtg

SEQ ID NO: 435708 - DNA, 140 bp, Artificial Sequence
  Synthetic
caccgctgtcccaaaaggtcgatgtggaccataaatgttgcctcaggaagttgctctgcattgtcgatgatcttcccagggccaatcgccttgtcaatcctaagggtcactagcaggttgcatatcagcagccagggcct

SEQ ID NO: 435709 - DNA, 140 bp, Artificial Sequence
  Synthetic
atacgccatgctgggtctcctcatcgacaatgcagagcaacttcctgaggcaacatttatggtccacatcgggaacttcaggagaaagaagagtgaagtctactctgccgattattgcaacgtacttgggagtcggccat

SEQ ID NO: 435710 - DNA, 140 bp, Artificial Sequence
  Synthetic
atggccgactcccaagtacgttgcaataatcggcagagtagacttcactcttctttctcctgaagttcccgatgtggaccataaatgttgcctcaggaagttgctctgcattgtcgatgaggagacccagcatggcgtat

SEQ ID NO: 435711 - DNA, 140 bp, Artificial Sequence
  Synthetic
aggccctggctgctgatatggggaacttcaggagaaagaagagtgaagtctactctgccgattattgcaaaatgaaaatcgaaaagatgggcctggtttttgcacttggtgggatagggggaccttttgggacagcggtg

SEQ ID NO: 435712 - DNA, 140 bp, Artificial Sequence
  Synthetic
caccgctgtcccaaaaggtccccctatcccaccaagtgcaaaaaccaggcccatcttttcgattttcattttgcaataatcggcagagtagacttcactcttctttctcctgaagttccccatatcagcagccagggcct

SEQ ID NO: 435713 - DNA, 140 bp, Artificial Sequence
  Synthetic
atacgccatgctgggtctccaccaaacaaagttgggtaaggatagttcaaatcaatgatcatcttctagtgcacttaggattcaagatcctattatcagggacaagagcaggattagggacgtacttgggagtcggccat

SEQ ID NO: 435714 - DNA, 140 bp, Artificial Sequence
  Synthetic
atggccgactcccaagtacgtccctaatcctgctcttgtccctgataataggatcttgaatcctaagtgcactagaagatgatcattgatttgaactatccttacccaactttgtttggtggagacccagcatggcgtat

SEQ ID NO: 435715 - DNA, 140 bp, Artificial Sequence
  Synthetic
aggccctggctgctgatatgtagagcctatccatggtccttcacttgatgctcaaaacttgcacataactgtgtgcaacatggtatacacatgctatatgacctacctcgacccgttgttgaccttttgggacagcggtg

SEQ ID NO: 435716 - DNA, 140 bp, Artificial Sequence
  Synthetic
caccgctgtcccaaaaggtcaacaacgggtcgaggtaggtcatatagcatgtgtataccatgttgcacacagttatgtgcaagttttgagcatcaagtgaaggaccatggataggctctacatatcagcagccagggcct

SEQ ID NO: 435717 - DNA, 140 bp, Artificial Sequence
  Synthetic
atacgccatgctgggtctccgcccggacaaaaaagccccctccaaaagattccacggaccaagcgagaggccagccagcagccgacggcaagcgtggacactgggcggcccaagcacagacgtacttgggagtcggccat

SEQ ID NO: 435718 - DNA, 140 bp, Artificial Sequence
  Synthetic
atggccgactcccaagtacgtctgtgcttgggccgcccagtgtccacgcttgccgtcggctgctggctggcctctcgcttggtccgtggaatcttttggagggggcttttttgtccgggcggagacccagcatggcgtat

SEQ ID NO: 435719 - DNA, 140 bp, Artificial Sequence
  Synthetic
atacgccatgctgggtctccacagccccgatacaaggccaccaccagccatcccaatccgcgtcctcctcgtgggacccccgaggaccaacccccaaggtcgccccggacacagaccacccgtacttgggagtcggccat

SEQ ID NO: 435720 - DNA, 140 bp, Artificial Sequence
  Synthetic
atggccgactcccaagtacgggtggtctgtgtccggggcgaccttgggggttggtcctcgggggtcccacgaggaggacgcggattgggatggctggtggtggccttgtatcggggctgtggagacccagcatggcgtat

SEQ ID NO: 435721 - DNA, 140 bp, Artificial Sequence
  Synthetic
atacgccatgctgggtctccaaccgcatccctccagccctcgggaaaggaacccccagcaactggaagggccctccccccttcccccaacgcaagaactccacaaccgaaccacacaagccgtacttgggagtcggccat

SEQ ID NO: 435722 - DNA, 140 bp, Artificial Sequence
  Synthetic
atggccgactcccaagtacggcttgtgtggttcggttgtggagttcttgcgttgggggaaggggggagggcccttccagttgctgggggttcctttcccgagggctggagggatgcggttggagacccagcatggcgtat

SEQ ID NO: 435723 - DNA, 140 bp, Artificial Sequence
  Synthetic
aggccctggctgctgatatggcaagccatggcaggaatctcggaagaacaaggctcagacacggacacccctagagtgtacaatgacagagatcttctagactaggtgcaagaggccgaggaccttttgggacagcggtg

SEQ ID NO: 435724 - DNA, 140 bp, Artificial Sequence
  Synthetic
caccgctgtcccaaaaggtcctcggcctcttgcacctagtctagaagatctctgtcattgtacactctaggggtgtccgtgtctgagccttgttcttccgagattcctgccatggcttgccatatcagcagccagggcct

SEQ ID NO: 435725 - DNA, 140 bp, Artificial Sequence
  Synthetic
atacgccatgctgggtctccgaccgaggtgacccaaccgcaggcatccgactccctagacagatcctctccccccggcaaactaaacaaaacttagggccaaggaacatacacacccgaccgtacttgggagtcggccat

SEQ ID NO: 435726 - DNA, 140 bp, Artificial Sequence
  Synthetic
atggccgactcccaagtacggtcgggtgtgtatgttccttggccctaagttttgtttagtttgccggggggagaggatctgtctagggagtcggatgcctgcggttgggtcacctcggtcggagacccagcatggcgtat

SEQ ID NO: 435727 - DNA, 140 bp, Artificial Sequence
  Synthetic
aggccctggctgctgatatgcccccggcaaactaaacaaaacttagggccaaggaacatacacacccgacagaacccagaccccggcccacggcaccgcgcccccaccccccgaaaaccagaccttttgggacagcggtg

SEQ ID NO: 435728 - DNA, 140 bp, Artificial Sequence
  Synthetic
caccgctgtcccaaaaggtctggttttcggggggtgggggcgcggtgccgtgggccggggtctgggttctgtcgggtgtgtatgttccttggccctaagttttgtttagtttgccgggggcatatcagcagccagggcct

SEQ ID NO: 435729 - DNA, 140 bp, Artificial Sequence
  Synthetic
atacgccatgctgggtctcccacaccaacccccgaccagacccagcacccagccaccgacaatccaagacgggggggcccccccaaaaaaaggcccccaggggccgacagccagcatcgccgtacttgggagtcggccat

SEQ ID NO: 435730 - DNA, 140 bp, Artificial Sequence
  Synthetic
atggccgactcccaagtacggcgatgctggctgtcggcccctgggggcctttttttgggggggcccccccgtcttggattgtcggtggctgggtgctgggtctggtcgggggttggtgtgggagacccagcatggcgtat

SEQ ID NO: 435731 - DNA, 140 bp, Artificial Sequence
  Synthetic
atacgccatgctgggtctccgaggaagcccactcaccccacacacgaccacggcaaccgaaccagagtccagaccaccctgggccaccagcccccggactcggccatcaccccggaaaaacgtacttgggagtcggccat

SEQ ID NO: 435732 - DNA, 140 bp, Artificial Sequence
  Synthetic
atggccgactcccaagtacgtttttccggggtgatggccgagtccgggggctggtggcccagggtggtctggactctggttcggttgccgtggtcgtgtgtggggtgagtgggcttcctcggagacccagcatggcgtat

SEQ ID NO: 435733 - DNA, 140 bp, Artificial Sequence
  Synthetic
atacgccatgctgggtctcctggccttgtcgaacacagaatgggagtaggtaatattgtcaaggtgctttttaacgggaggcccgaagtcacgtgggtaggcagtgtagattgcttcaatcgtacttgggagtcggccat

SEQ ID NO: 435734 - DNA, 140 bp, Artificial Sequence
  Synthetic
atggccgactcccaagtacgattgaagcaatctacactgcctacccacgtgacttcgggcctcccgttaaaaagcaccttgacaatattacctactcccattctgtgttcgacaaggccaggagacccagcatggcgtat

SEQ ID NO: 435735 - DNA, 140 bp, Artificial Sequence
  Synthetic
atacgccatgctgggtctccaaagacaccagcatcccacggcctctccaagtcccccggtctcctcctcttctcgaaggggccaaaagatcaatccaccacatccgacgacactcagctccgtacttgggagtcggccat

SEQ ID NO: 435736 - DNA, 140 bp, Artificial Sequence
  Synthetic
atggccgactcccaagtacggagctgagtgtcgtcggatgtggtggattgatcttttggccccttcgagaagaggaggagaccgggggacttggagaggccgtgggatgctggtgtctttggagacccagcatggcgtat

SEQ ID NO: 435737 - DNA, 140 bp, Artificial Sequence
  Synthetic
aggccctggctgctgatatgtctcgaaggggccaaaagatcaatccaccacatccgacgacactcagctccccacccccaaaggagacaccgggaaccccagaatcaagactcatccagtgaccttttgggacagcggtg

SEQ ID NO: 435738 - DNA, 140 bp, Artificial Sequence
  Synthetic
caccgctgtcccaaaaggtcactggatgagtcttgattctggggttcccggtgtctcctttgggggtggggagctgagtgtcgtcggatgtggtggattgatcttttggccccttcgagacatatcagcagccagggcct

SEQ ID NO: 435739 - DNA, 140 bp, Artificial Sequence
  Synthetic
aggccctggctgctgatatgtgttaactctccaaacacccaccggtcaaatccattggggcaatctctctaagataggggtggtagggataggaagtgcaagctacaaagttatgactcggaccttttgggacagcggtg

SEQ ID NO: 435740 - DNA, 140 bp, Artificial Sequence
  Synthetic
caccgctgtcccaaaaggtccgagtcataactttgtagcttgcacttcctatccctaccacccctatcttagagagattgccccaatggatttgaccggtgggtgtttggagagttaacacatatcagcagccagggcct

SEQ ID NO: 435741 - DNA, 140 bp, Artificial Sequence
  Synthetic
aggccctggctgctgatatgaaccggctaatgaatcctgaaaagattaagcagcagataattgaatcatctgtgcggacttcacctggacttataggtcacatcctatccattaagcaacgaccttttgggacagcggtg

SEQ ID NO: 435742 - DNA, 140 bp, Artificial Sequence
  Synthetic
caccgctgtcccaaaaggtcgttgcttaatggataggatgtgacctataagtccaggtgaagtccgcacagatgattcaattatctgctgcttaatcttttcaggattcattagccggttcatatcagcagccagggcct

SEQ ID NO: 435743 - DNA, 140 bp, Artificial Sequence
  Synthetic
aggccctggctgctgatatgacagttttggaaccaattagagatgcacttaatgcaatgacccagaatataagaccggttcagagtgtagcttcaagtaggagacacaagagatttgcgggaccttttgggacagcggtg

SEQ ID NO: 435744 - DNA, 140 bp, Artificial Sequence
  Synthetic
caccgctgtcccaaaaggtcccgcaaatctcttgtgtctcctacttgaagctacactctgaaccggtcttatattctgggtcattgcattaagtgcatctctaattggttccaaaactgtcatatcagcagccagggcct

SEQ ID NO: 435745 - DNA, 140 bp, Artificial Sequence
  Synthetic
atacgccatgctgggtctccgagttgtcctggcaggtgcggccctaggcgttgccacagctgctcagataacagccggcattgcacttcaccagtccatgctgaactctcaagccatcgacgtacttgggagtcggccat

SEQ ID NO: 435746 - DNA, 140 bp, Artificial Sequence
  Synthetic
atggccgactcccaagtacgtcgatggcttgagagttcagcatggactggtgaagtgcaatgccggctgttatctgagcagctgtggcaacgcctagggccgcacctgccaggacaactcggagacccagcatggcgtat

SEQ ID NO: 435747 - DNA, 140 bp, Artificial Sequence
  Synthetic
atacgccatgctgggtctcccaggctttgagctatgcgcttggaggagatatcaataaggtgttagaaaagctcggatacagtggaggtgatttactgggcatcttagagagcagaggaacgtacttgggagtcggccat

SEQ ID NO: 435748 - DNA, 140 bp, Artificial Sequence
  Synthetic
atggccgactcccaagtacgttcctctgctctctaagatgcccagtaaatcacctccactgtatccgagcttttctaacaccttattgatatctcctccaagcgcatagctcaaagcctgggagacccagcatggcgtat

SEQ ID NO: 435749 - DNA, 140 bp, Artificial Sequence
  Synthetic
aggccctggctgctgatatggctcggatacagtggaggtgatttactgggcatcttagagagcagaggaataaaggcccggataactcacgtcgacacagagtcctacttcattgtactcgaccttttgggacagcggtg

SEQ ID NO: 435750 - DNA, 140 bp, Artificial Sequence
  Synthetic
caccgctgtcccaaaaggtcgagtacaatgaagtaggactctgtgtcgacgtgagttatccgggcctttattcctctgctctctaagatgcccagtaaatcacctccactgtatccgagccatatcagcagccagggcct

SEQ ID NO: 435751 - DNA, 140 bp, Artificial Sequence
  Synthetic
atacgccatgctgggtctcctgccctgattaaggactaattggttgaactccggaaccctaatcctgccctgggtggttaggcattatttgtaatatattaaagaatactttgaaaataccgtacttgggagtcggccat

SEQ ID NO: 435752 - DNA, 140 bp, Artificial Sequence
  Synthetic
atggccgactcccaagtacggtattttcaaagtattctttaatatattacaaataatgcctaaccacccagggcaggattagggttccggagttcaaccaattagtccttaatcagggcaggagacccagcatggcgtat

SEQ ID NO: 435753 - DNA, 140 bp, Artificial Sequence
  Synthetic
atacgccatgctgggtctccccaccacatccgacgacactcaactccccacccctaaaagatacaccgggagtcccataatcaagactcatccaatgtccatcatgggtctcaaggtgaacgtacttgggagtcggccat

SEQ ID NO: 435754 - DNA, 140 bp, Artificial Sequence
  Synthetic
atggccgactcccaagtacgttcaccttgagacccatgatggacattggatgagtcttgattatgggactcccggtgtatcttttaggggtggggagttgagtgtcgtcggatgtggtggggagacccagcatggcgtat

SEQ ID NO: 435755 - DNA, 140 bp, Artificial Sequence
  Synthetic
aggccctggctgctgatatgtcatcgtgtactttcatgccagaggggactgtgtgcagccaaaatgccttgtacccgatgagtcctctgctccaagaatgcctccgggggtccaccaagtgaccttttgggacagcggtg

SEQ ID NO: 435756 - DNA, 140 bp, Artificial Sequence
  Synthetic
caccgctgtcccaaaaggtcacttggtggacccccggaggcattcttggagcagaggactcatcgggtacaaggcattttggctgcacacagtcccctctggcatgaaagtacacgatgacatatcagcagccagggcct

SEQ ID NO: 435757 - DNA, 140 bp, Artificial Sequence
  Synthetic
aggccctggctgctgatatgtcgctgtactccaaagtcagtgataaggttttccaatgcttgagggatactaactcacggcttggcctaggctccgaattgagggaggacatcaaggagagaccttttgggacagcggtg

SEQ ID NO: 435758 - DNA, 140 bp, Artificial Sequence
  Synthetic
caccgctgtcccaaaaggtctctccttgatgtcctccctcaattcggagcctaggccaagccgtgagttagtatccctcaagcattggaaaaccttatcactgactttggagtacagcgacatatcagcagccagggcct

SEQ ID NO: 435759 - DNA, 140 bp, Artificial Sequence
  Synthetic
aggccctggctgctgatatgtcacaagggaacctaatagccaattgtgcatcaatcctctgcaagtgttacacaacaggaacgatcattaatcaagaccctgacaagatcctaacatacagaccttttgggacagcggtg

SEQ ID NO: 435760 - DNA, 140 bp, Artificial Sequence
  Synthetic
caccgctgtcccaaaaggtctgtatgttaggatcttgtcagggtcttgattaatgatcgttcctgttgtgtaacacttgcagaggattgatgcacaattggctattaggttcccttgtgacatatcagcagccagggcct

SEQ ID NO: 435761 - DNA, 140 bp, Artificial Sequence
  Synthetic
aggccctggctgctgatatgctctggagctatgccatgggagtgggagtggaacttgaaaactccatgggaggtttaaactttggtcgatcttactttgatccagcgtattttagattaggaccttttgggacagcggtg

SEQ ID NO: 435762 - DNA, 140 bp, Artificial Sequence
  Synthetic
caccgctgtcccaaaaggtcctaatctaaaatacgctggatcaaagtaagatcgaccaaagtttaaacctcccatggagttttcaagttccactcccactcccatggcatagctccagagcatatcagcagccagggcct

SEQ ID NO: 435763 - DNA, 140 bp, Artificial Sequence
  Synthetic
atacgccatgctgggtctccgtcgggagcaggaggtatccggacgcggtgtacttgcacagaattgacctcggtcctcccatatcattggagaggttggacgtggggacgaatctggggacgtacttgggagtcggccat

SEQ ID NO: 435764 - DNA, 140 bp, Artificial Sequence
  Synthetic
atggccgactcccaagtacgtccccagattcgtccccacgtccaacctctccaatgatatgggaggaccgaggtcaattctgtgcaagtacaccgcgtccggatacctcctgctcccgacggagacccagcatggcgtat

SEQ ID NO: 435765 - DNA, 140 bp, Artificial Sequence
  Synthetic
aggccctggctgctgatatgcctgattgcagtgtgtcttggggggttgatagggatccccgctttaatatgttgctgcagggggcgttgtaccagaaagggagagcaagttggtatgtcagaccttttgggacagcggtg

SEQ ID NO: 435766 - DNA, 140 bp, Artificial Sequence
  Synthetic
caccgctgtcccaaaaggtctgacataccaacttgctctccctttctggtacaacgccccctgcagcaacatattaaagcggggatccctatcaaccccccaagacacactgcaatcaggcatatcagcagccagggcct

SEQ ID NO: 435767 - DNA, 140 bp, Artificial Sequence
  Synthetic
atacgccatgctgggtctccgtcgctctgatcctctacaactcttgaaacacaaatgtcccacaagtctcctcttcgtcatcaagcaaccaccgcatccagcatcaagcccacctgaaatcgtacttgggagtcggccat

SEQ ID NO: 435768 - DNA, 140 bp, Artificial Sequence
  Synthetic
atggccgactcccaagtacgatttcaggtgggcttgatgctggatgcggtggttgcttgatgacgaagaggagacttgtgggacatttgtgtttcaagagttgtagaggatcagagcgacggagacccagcatggcgtat

SEQ ID NO: 435769 - DNA, 140 bp, Artificial Sequence
  Synthetic
aggccctggctgctgatatgagggtgcaagatcatccacaatgtcaccacaacgagaccgaataaatgccttctacaaagacaacccccatcctaagggaagtaggatagttattaacaggaccttttgggacagcggtg

SEQ ID NO: 435770 - DNA, 140 bp, Artificial Sequence
  Synthetic
caccgctgtcccaaaaggtcctgttaataactatcctacttcccttaggatgggggttgtctttgtagaaggcatttattcggtctcgttgtggtgacattgtggatgatcttgcaccctcatatcagcagccagggcct

SEQ ID NO: 435771 - DNA, 140 bp, Artificial Sequence
  Synthetic
atacgccatgctgggtctccaggctctcaagagtggtataccactgtgcccaagtatgttgcaacccaagggtaccttatctcgaattttgatgagtcatcgtgtactttcatgccagagcgtacttgggagtcggccat

SEQ ID NO: 435772 - DNA, 140 bp, Artificial Sequence
  Synthetic
atggccgactcccaagtacgctctggcatgaaagtacacgatgactcatcaaaattcgagataaggtacccttgggttgcaacatacttgggcacagtggtataccactcttgagagcctggagacccagcatggcgtat

SEQ ID NO: 435773 - DNA, 140 bp, Artificial Sequence
  Synthetic
atacgccatgctgggtctcccactcttcaagatcatcggtgatgaagtgggcctgaggacacctcagagattcactgacctagtgaaattcatctctgacaagattaaattccttaatcccgtacttgggagtcggccat

SEQ ID NO: 435774 - DNA, 140 bp, Artificial Sequence
  Synthetic
atggccgactcccaagtacgggattaaggaatttaatcttgtcagagatgaatttcactaggtcagtgaatctctgaggtgtcctcaggcccacttcatcaccgatgatcttgaagagtgggagacccagcatggcgtat

SEQ ID NO: 435775 - DNA, 140 bp, Artificial Sequence
  Synthetic
aggccctggctgctgatatgagagaatcaaattggattatgatcaatactgtgcagatgtggctgctgaagaactcatgaatgcattggtgaacgcaactctactggaggccagggcaacgaccttttgggacagcggtg

SEQ ID NO: 435776 - DNA, 140 bp, Artificial Sequence
  Synthetic
caccgctgtcccaaaaggtcgttgccctggcctccagtagagttgcgttcaccaatgcattcatgagttcttcagcagccacatctgcacagtattgatcataatccaatttgattctctcatatcagcagccagggcct

SEQ ID NO: 435777 - DNA, 140 bp, Artificial Sequence
  Synthetic
atacgccatgctgggtctcccaatcagttcctagctgtctcaaagggaaactgctcagggcccactacaatcagaggtcaattctcaaacatgtcgctgtccctgttggacttgtatttacgtacttgggagtcggccat

SEQ ID NO: 435778 - DNA, 140 bp, Artificial Sequence
  Synthetic
atggccgactcccaagtacgtaaatacaagtccaacagggacagcgacatgtttgagaattgacctctgattgtagtgggccctgagcagtttccctttgagacagctaggaactgattgggagacccagcatggcgtat

SEQ ID NO: 435779 - DNA, 140 bp, Artificial Sequence
  Synthetic
aggccctggctgctgatatgagtcgaggttacaatgtgtcatctatagtcactatgacatcccagggaatgtacgggggaacttacctagtggaaaagcctaatctgagcagtaaagggtgaccttttgggacagcggtg

SEQ ID NO: 435780 - DNA, 140 bp, Artificial Sequence
  Synthetic
caccgctgtcccaaaaggtcaccctttactgctcagattaggcttttccactaggtaagttcccccgtacattccctgggatgtcatagtgactatagatgacacattgtaacctcgactcatatcagcagccagggcct

SEQ ID NO: 435781 - DNA, 140 bp, Artificial Sequence
  Synthetic
atacgccatgctgggtctcctgaaacataaatgtcccacaagtctccccttcatcatcaagcaaccgccgcatccagcaccaagcccacctgaaattatctccggcttccctctggccgacgtacttgggagtcggccat

SEQ ID NO: 435782 - DNA, 140 bp, Artificial Sequence
  Synthetic
atggccgactcccaagtacgtcggccagagggaagccggagataatttcaggtgggcttggtgctggatgcggcggttgcttgatgatgaaggggagacttgtgggacatttatgtttcaggagacccagcatggcgtat

SEQ ID NO: 435783 - DNA, 140 bp, Artificial Sequence
  Synthetic
atacgccatgctgggtctccggaaaggccacaacccgcgcaccccagccccgatccggcggggagccacccaacccgaaccagcacccaagagcgatccccgaaggacccccgaaccgcacgtacttgggagtcggccat

SEQ ID NO: 435784 - DNA, 140 bp, Artificial Sequence
  Synthetic
atggccgactcccaagtacgtgcggttcgggggtccttcggggatcgctcttgggtgctggttcgggttgggtggctccccgccggatcggggctggggtgcgcgggttgtggcctttccggagacccagcatggcgtat

SEQ ID NO: 435785 - DNA, 140 bp, Artificial Sequence
  Synthetic
aggccctggctgctgatatgttatgttttgctggctgttctgttcgtcatgtttctgagcttgatcgggttgctagccattgcaggcattagacttcatcgggcagccatctacaccgcagaccttttgggacagcggtg

SEQ ID NO: 435786 - DNA, 140 bp, Artificial Sequence
  Synthetic
caccgctgtcccaaaaggtctgcggtgtagatggctgcccgatgaagtctaatgcctgcaatggctagcaacccgatcaagctcagaaacatgacgaacagaacagccagcaaaacataacatatcagcagccagggcct

SEQ ID NO: 435787 - DNA, 140 bp, Artificial Sequence
  Synthetic
atacgccatgctgggtctccgcgagaatcccgagtgggcaccactgaaggacaacaggattccttcatacggggtcttgtctgttaatctgagtctgacagttgagctcaaaatcaaaatcgtacttgggagtcggccat

SEQ ID NO: 435788 - DNA, 140 bp, Artificial Sequence
  Synthetic
atggccgactcccaagtacgattttgattttgagctcaactgtcagactcagattaacagacaagaccccgtatgaaggaatcctgttgtccttcagtggtgcccactcgggattctcgcggagacccagcatggcgtat

SEQ ID NO: 435789 - DNA, 140 bp, Artificial Sequence
  Synthetic
atacgccatgctgggtctcctctcacttggtgtatcaacccgccagagagaatcaaattggattatgatcaatactgtgcagacgtggctgctgaagagctcatgaatgcattggtgaaccgtacttgggagtcggccat

SEQ ID NO: 435790 - DNA, 140 bp, Artificial Sequence
  Synthetic
atggccgactcccaagtacggttcaccaatgcattcatgagctcttcagcagccacgtctgcacagtattgatcataatccaatttgattctctctggcgggttgatacaccaagtgagaggagacccagcatggcgtat

SEQ ID NO: 435791 - DNA, 140 bp, Artificial Sequence
  Synthetic
atacgccatgctgggtctccgccatgccccaacatacctacctgcggaggtggatggtgatgtcaaactcagttccaatctggtgattctacctggtcaagatctccaatatgttttggccgtacttgggagtcggccat

SEQ ID NO: 435792 - DNA, 140 bp, Artificial Sequence
  Synthetic
atggccgactcccaagtacggccaaaacatattggagatcttgaccaggtagaatcaccagattggaactgagtttgacatcaccatccacctccgcaggtaggtatgttggggcatggcggagacccagcatggcgtat

SEQ ID NO: 435793 - DNA, 140 bp, Artificial Sequence
  Synthetic
atacgccatgctgggtctccgaagatggaaccaatagcagatagggctgccagtgaaccggtcacatgatgtcacccagacatcaggcatacccgctagtgtgaaatagacatcagaattcgtacttgggagtcggccat

SEQ ID NO: 435794 - DNA, 140 bp, Artificial Sequence
  Synthetic
atggccgactcccaagtacgaattctgatgtctatttcacactagcgggtatgcctgatgtctgggtgacatcatgtgaccggttcactggcagccctatctgctattggttccatcttcggagacccagcatggcgtat

SEQ ID NO: 435795 - DNA, 140 bp, Artificial Sequence
  Synthetic
atacgccatgctgggtctccataagatagtagctatcctggagtatgctcgagtccctcacgcttacagcctggaggaccctacactgtgtcagaacatcaagcaccgcctaaaaaacggcgtacttgggagtcggccat

SEQ ID NO: 435796 - DNA, 140 bp, Artificial Sequence
  Synthetic
atggccgactcccaagtacgccgttttttaggcggtgcttgatgttctgacacagtgtagggtcctccaggctgtaagcgtgagggactcgagcatactccaggatagctactatcttatggagacccagcatggcgtat

SEQ ID NO: 435797 - DNA, 140 bp, Artificial Sequence
  Synthetic
aggccctggctgctgatatgagtccaagcttaggagttatccggcccactctcatattccatatccaaattgtaatcaggatttatttaacatagaagacaaagagtcaacaaggaagatgaccttttgggacagcggtg

SEQ ID NO: 435798 - DNA, 140 bp, Artificial Sequence
  Synthetic
caccgctgtcccaaaaggtcatcttccttgttgactctttgtcttctatgttaaataaatcctgattacaatttggatatggaatatgagagtgggccggataactcctaagcttggactcatatcagcagccagggcct

SEQ ID NO: 435799 - DNA, 140 bp, Artificial Sequence
  Synthetic
atacgccatgctgggtctcctgtaatcaggatttatttaacatagaagacaaagagtcaacaaggaagatccgtgagctcctaaaaaagggaaattcgctgtactccaaggtcagtgatacgtacttgggagtcggccat

SEQ ID NO: 435800 - DNA, 140 bp, Artificial Sequence
  Synthetic
atggccgactcccaagtacgtatcactgaccttggagtacagcgaatttcccttttttaggagctcacggatcttccttgttgactctttgtcttctatgttaaataaatcctgattacaggagacccagcatggcgtat

SEQ ID NO: 435801 - DNA, 140 bp, Artificial Sequence
  Synthetic
atacgccatgctgggtctcctgacgtttgaactggttttgatgtattgtgatgtcatagaggggaggttaatgacagagaccgctatgaccattgatgctaggtatgcagaacttctaggcgtacttgggagtcggccat

SEQ ID NO: 435802 - DNA, 140 bp, Artificial Sequence
  Synthetic
atggccgactcccaagtacgcctagaagttctgcatacctagcatcaatggtcatagcggtctctgtcattaacctcccctctatgacatcacaatacatcaaaaccagttcaaacgtcaggagacccagcatggcgtat

SEQ ID NO: 435803 - DNA, 140 bp, Artificial Sequence
  Synthetic
aggccctggctgctgatatgatgacagagaccgctatgaccattgatgctaggtatgcagaacttctaggaagagtcagatacatgtggaaactgatagatggtttcttccctgcactcggaccttttgggacagcggtg

SEQ ID NO: 435804 - DNA, 140 bp, Artificial Sequence
  Synthetic
caccgctgtcccaaaaggtccgagtgcagggaagaaaccatctatcagtttccacatgtatctgactcttcctagaagttctgcatacctagcatcaatggtcatagcggtctctgtcatcatatcagcagccagggcct

SEQ ID NO: 435805 - DNA, 140 bp, Artificial Sequence
  Synthetic
atacgccatgctgggtctccctagaggaccctacactgtgtcagaacatcaagcaccgcctggaaaccggattttccaaccagatgatcataaacaatgtggaagttgggaatgtcatcacgtacttgggagtcggccat

SEQ ID NO: 435806 - DNA, 140 bp, Artificial Sequence
  Synthetic
atggccgactcccaagtacgtgatgacattcccaacttccacattgtttatgatcatctggttggaaaatccggtttccaggcggtgcttgatgttctgacacagtgtagggtcctctagggagacccagcatggcgtat

SEQ ID NO: 435807 - DNA, 140 bp, Artificial Sequence
  Synthetic
aggccctggctgctgatatgagtcgggagcaggaggtatccggacgcggtgtacctgcacagaactgatctcggccctcccatatcattggagaagttggacgtagggacaaatctgggggaccttttgggacagcggtg

SEQ ID NO: 435808 - DNA, 140 bp, Artificial Sequence
  Synthetic
caccgctgtcccaaaaggtcccccagatttgtccctacgtccaacttctccaatgatatgggagggccgagatcagttctgtgcaggtacaccgcgtccggatacctcctgctcccgactcatatcagcagccagggcct

SEQ ID NO: 435809 - DNA, 140 bp, Artificial Sequence
  Synthetic
atacgccatgctgggtctccacatgaatcagcctaaagtcattgtgtatgagactctgatgaaaggtcatgccatattttgtggaatcataatcaacggctatcgtgacaggcacggaggcgtacttgggagtcggccat

SEQ ID NO: 435810 - DNA, 140 bp, Artificial Sequence
  Synthetic
atggccgactcccaagtacgcctccgtgcctgtcacgatagccgttgattatgattccacaaaatatggcatgacctttcatcagagtctcatacacaatgactttaggctgattcatgtggagacccagcatggcgtat

SEQ ID NO: 435811 - DNA, 140 bp, Artificial Sequence
  Synthetic
atacgccatgctgggtctcccagttggccacccctgaccctccccctgcatgctgcagacacaatccggaatgcccaagcctcaggcgaagggttaacacatgagcagtgcgttgataaccgtacttgggagtcggccat

SEQ ID NO: 435812 - DNA, 140 bp, Artificial Sequence
  Synthetic
atggccgactcccaagtacggttatcaacgcactgctcatgtgttaacccttcgcctgaggcttgggcattccggattgtgtctgcagcatgcagggggagggtcaggggtggccaactgggagacccagcatggcgtat

SEQ ID NO: 435813 - DNA, 140 bp, Artificial Sequence
  Synthetic
atacgccatgctgggtctcctggaaatcatttgctggagtgagatttggctgttttatgcctcttagcctggacagtgatctgacaatgtacctaaaggacaaggcacttgctgctctcccgtacttgggagtcggccat

SEQ ID NO: 435814 - DNA, 140 bp, Artificial Sequence
  Synthetic
atggccgactcccaagtacgggagagcagcaagtgccttgtcctttaggtacattgtcagatcactgtccaggctaagaggcataaaacagccaaatctcactccagcaaatgatttccaggagacccagcatggcgtat

SEQ ID NO: 435815 - DNA, 140 bp, Artificial Sequence
  Synthetic
aggccctggctgctgatatgaggacaatgggatggccaaggatgagcacgatttgaccaaggcactccacactctagctgtctcaggagtccccaaagatctcaaagaaagtcacagggggaccttttgggacagcggtg

SEQ ID NO: 435816 - DNA, 140 bp, Artificial Sequence
  Synthetic
caccgctgtcccaaaaggtccccctgtgactttctttgagatctttggggactcctgagacagctagagtgtggagtgccttggtcaaatcgtgctcatccttggccatcccattgtcctcatatcagcagccagggcct

SEQ ID NO: 435817 - DNA, 140 bp, Artificial Sequence
  Synthetic
atacgccatgctgggtctccggaacgttaaagcagcaaaagggtttgtaggattccctcatgtaattcgggagaatcaagacactgatcatccggagaatatagaaacttacgagacagtcgtacttgggagtcggccat

SEQ ID NO: 435818 - DNA, 140 bp, Artificial Sequence
  Synthetic
atggccgactcccaagtacgactgtctcgtaagtttctatattctccggatgatcagtgtcttgattctcccgaattacatgagggaatcctacaaacccttttgctgctttaacgttccggagacccagcatggcgtat

SEQ ID NO: 435819 - DNA, 140 bp, Artificial Sequence
  Synthetic
atacgccatgctgggtctccccctcattttttcagtggctgcataagaggcttgaaacctctgtcctctatgtaagtgaccctcattgcccccccgaccttgacgcccatgtcccgttatcgtacttgggagtcggccat

SEQ ID NO: 435820 - DNA, 140 bp, Artificial Sequence
  Synthetic
atggccgactcccaagtacgataacgggacatgggcgtcaaggtcgggggggcaatgagggtcacttacatagaggacagaggtttcaagcctcttatgcagccactgaaaaaatgagggggagacccagcatggcgtat

SEQ ID NO: 435821 - DNA, 140 bp, Artificial Sequence
  Synthetic
atacgccatgctgggtctccgcaaagtccctaatgaccaaatcttcatcaagtaccctatgggaggcatagaagggtattgtcagaagttgtggaccatcagcaccattccctacttatacgtacttgggagtcggccat

SEQ ID NO: 435822 - DNA, 140 bp, Artificial Sequence
  Synthetic
atggccgactcccaagtacgtataagtagggaatggtgctgatggtccacaacttctgacaatacccttctatgcctcccatagggtacttgatgaagatttggtcattagggactttgcggagacccagcatggcgtat

SEQ ID NO: 435823 - DNA, 140 bp, Artificial Sequence
  Synthetic
aggccctggctgctgatatgcctggctgcttatgagagcggagtaaggattgcttcgttagtgcaaggggacaatcagaccatagccgtaacaaaaagggtacccagcacatggccttacgaccttttgggacagcggtg

SEQ ID NO: 435824 - DNA, 140 bp, Artificial Sequence
  Synthetic
caccgctgtcccaaaaggtcgtaaggccatgtgctgggtaccctttttgttacggctatggtctgattgtccccttgcactaacgaagcaatccttactccgctctcataagcagccaggcatatcagcagccagggcct

SEQ ID NO: 435825 - DNA, 140 bp, Artificial Sequence
  Synthetic
atacgccatgctgggtctccacaatcagaccatagccgtaacaaaaagggtacccagcacatggccttacaaccttaagaaacgggaagctgctagagtaactagagattactttgtaatcgtacttgggagtcggccat

SEQ ID NO: 435826 - DNA, 140 bp, Artificial Sequence
  Synthetic
atggccgactcccaagtacgattacaaagtaatctctagttactctagcagcttcccgtttcttaaggttgtaaggccatgtgctgggtaccctttttgttacggctatggtctgattgtggagacccagcatggcgtat

SEQ ID NO: 435827 - DNA, 140 bp, Artificial Sequence
  Synthetic
atacgccatgctgggtctcctcttaggcaaaggctacatgacattggccatcacctcaaggcaaatgagacaattgtttcatcacatttttttgtctattcaaaaggaatatattatgatcgtacttgggagtcggccat

SEQ ID NO: 435828 - DNA, 140 bp, Artificial Sequence
  Synthetic
atggccgactcccaagtacgatcataatatattccttttgaatagacaaaaaaatgtgatgaaacaattgtctcatttgccttgaggtgatggccaatgtcatgtagcctttgcctaagaggagacccagcatggcgtat

SEQ ID NO: 435829 - DNA, 140 bp, Artificial Sequence
  Synthetic
aggccctggctgctgatatggtcagagactatagttgatgaaacaagggcggcatgcagtaatattgctacaacaatggccaaaagcattgagagaggttatgaccgttatcttgcatatgaccttttgggacagcggtg

SEQ ID NO: 435830 - DNA, 140 bp, Artificial Sequence
  Synthetic
caccgctgtcccaaaaggtcatatgcaagataacggtcataacctctctcaatgcttttggccattgttgtagcaatattactgcatgccgcccttgtttcatcaactatagtctctgaccatatcagcagccagggcct

SEQ ID NO: 435831 - DNA, 140 bp, Artificial Sequence
  Synthetic
aggccctggctgctgatatgatgaattatctgaatatgagcaggctgtttgtcagaaacatcggtgatccagtaacatcatcaattgctgatctcaagagaatgattctcgcatcactaagaccttttgggacagcggtg

SEQ ID NO: 435832 - DNA, 140 bp, Artificial Sequence
  Synthetic
caccgctgtcccaaaaggtcttagtgatgcgagaatcattctcttgagatcagcaattgatgatgttactggatcaccgatgtttctgacaaacagcctgctcatattcagataattcatcatatcagcagccagggcct

SEQ ID NO: 435833 - DNA, 140 bp, Artificial Sequence
  Synthetic
aggccctggctgctgatatgtgcctgaagagaccctccatcaagtaatgacacaacaaccgggggactcttcattcctagactgggctagcgacccttactcagcaaatcttgtatgcgtgaccttttgggacagcggtg

SEQ ID NO: 435834 - DNA, 140 bp, Artificial Sequence
  Synthetic
caccgctgtcccaaaaggtcacgcatacaagatttgctgagtaagggtcgctagcccagtctaggaatgaagagtcccccggttgttgtgtcattacttgatggagggtctcttcaggcacatatcagcagccagggcct

SEQ ID NO: 435835 - DNA, 140 bp, Artificial Sequence
  Synthetic
atacgccatgctgggtctcctcattcctagactgggctagcgacccttactcagcaaatcttgtatgcgtccagagcatcactagactcctcaagaacataactgcaaggtttgtcctgacgtacttgggagtcggccat

SEQ ID NO: 435836 - DNA, 140 bp, Artificial Sequence
  Synthetic
atggccgactcccaagtacgtcaggacaaaccttgcagttatgttcttgaggagtctagtgatgctctggacgcatacaagatttgctgagtaagggtcgctagcccagtctaggaatgaggagacccagcatggcgtat

SEQ ID NO: 435837 - DNA, 140 bp, Artificial Sequence
  Synthetic
aggccctggctgctgatatgccagagcatcactagactcctcaagaacataactgcaaggtttgtcctgatccacagtccaaacccaatgttaaaagggttattccatgatgacagcaaagaccttttgggacagcggtg

SEQ ID NO: 435838 - DNA, 140 bp, Artificial Sequence
  Synthetic
caccgctgtcccaaaaggtctttgctgtcatcatggaataacccttttaacattgggtttggactgtggatcaggacaaaccttgcagttatgttcttgaggagtctagtgatgctctggcatatcagcagccagggcct

SEQ ID NO: 435839 - DNA, 140 bp, Artificial Sequence
  Synthetic
atacgccatgctgggtctccgaagaggacgagagactggcggcattcctcatggacaggcatattatagtacctagggcagctcatgaaatcctggatcatagtgtcacaggggcaagagcgtacttgggagtcggccat

SEQ ID NO: 435840 - DNA, 140 bp, Artificial Sequence
  Synthetic
atggccgactcccaagtacgctcttgcccctgtgacactatgatccaggatttcatgagctgccctaggtactataatatgcctgtccatgaggaatgccgccagtctctcgtcctcttcggagacccagcatggcgtat

SEQ ID NO: 435841 - DNA, 140 bp, Artificial Sequence
  Synthetic
aggccctggctgctgatatgacctagggcagctcatgaaatcctggatcatagtgtcacaggggcaagagagtctattgcaggcatgctagataccacaaaaggcctgattcgagccagcgaccttttgggacagcggtg

SEQ ID NO: 435842 - DNA, 140 bp, Artificial Sequence
  Synthetic
caccgctgtcccaaaaggtcgctggctcgaatcaggccttttgtggtatctagcatgcctgcaatagactctcttgcccctgtgacactatgatccaggatttcatgagctgccctaggtcatatcagcagccagggcct

SEQ ID NO: 435843 - DNA, 140 bp, Artificial Sequence
  Synthetic
atacgccatgctgggtctccatgaggaaaggggggttaacctctcgagtgataaccagattgtccaattatgactatgaacaatttagagcagggatggtgctattgacaggaagaaagacgtacttgggagtcggccat

SEQ ID NO: 435844 - DNA, 140 bp, Artificial Sequence
  Synthetic
atggccgactcccaagtacgtctttcttcctgtcaatagcaccatccctgctctaaattgttcatagtcataattggacaatctggttatcactcgagaggttaacccccctttcctcatggagacccagcatggcgtat

SEQ ID NO: 435845 - DNA, 140 bp, Artificial Sequence
  Synthetic
aggccctggctgctgatatgtgactatgaacaatttagagcagggatggtgctattgacaggaagaaagagaaatgtcctcattgacaaagagtcatgttcagttcaactggctagagccgaccttttgggacagcggtg

SEQ ID NO: 435846 - DNA, 140 bp, Artificial Sequence
  Synthetic
caccgctgtcccaaaaggtcggctctagccagttgaactgaacatgactctttgtcaatgaggacatttctctttcttcctgtcaatagcaccatccctgctctaaattgttcatagtcacatatcagcagccagggcct

SEQ ID NO: 435847 - DNA, 140 bp, Artificial Sequence
  Synthetic
atacgccatgctgggtctccgtcatgagacatgtgtcatctgcgagtgtggatcagtcaactacggatggttttttgtcccctcgggttgccaactggatgatattgacaaggaaacatccgtacttgggagtcggccat

SEQ ID NO: 435848 - DNA, 140 bp, Artificial Sequence
  Synthetic
atggccgactcccaagtacggatgtttccttgtcaatatcatccagttggcaacccgaggggacaaaaaaccatccgtagttgactgatccacactcgcagatgacacatgtctcatgacggagacccagcatggcgtat

SEQ ID NO: 435849 - DNA, 140 bp, Artificial Sequence
  Synthetic
atacgccatgctgggtctccatccttgagagtcccatatattggttctaccactgatgagagaacagacatgaagctcgccttcgtaagagccccaagtcgatccttgcgatctgctgttcgtacttgggagtcggccat

SEQ ID NO: 435850 - DNA, 140 bp, Artificial Sequence
  Synthetic
atggccgactcccaagtacgaacagcagatcgcaaggatcgacttggggctcttacgaaggcgagcttcatgtctgttctctcatcagtggtagaaccaatatatgggactctcaaggatggagacccagcatggcgtat

SEQ ID NO: 435851 - DNA, 140 bp, Artificial Sequence
  Synthetic
aggccctggctgctgatatgtgaagctcgccttcgtaagagccccaagtcgatccttgcgatctgctgttagaatagcaacagtgtactcatgggcttacggtgatgatgatagttcttggaccttttgggacagcggtg

SEQ ID NO: 435852 - DNA, 140 bp, Artificial Sequence
  Synthetic
caccgctgtcccaaaaggtccaagaactatcatcatcaccgtaagcccatgagtacactgttgctattctaacagcagatcgcaaggatcgacttggggctcttacgaaggcgagcttcacatatcagcagccagggcct

SEQ ID NO: 435853 - DNA, 140 bp, Artificial Sequence
  Synthetic
aggccctggctgctgatatggaacgaagcctggttgttggcaaggcaaagggccaatgtgagcctggaggagctaagggtgatcactcccatctcaacttcgactaatttagcgcatagggaccttttgggacagcggtg

SEQ ID NO: 435854 - DNA, 140 bp, Artificial Sequence
  Synthetic
caccgctgtcccaaaaggtccctatgcgctaaattagtcgaagttgagatgggagtgatcacccttagctcctccaggctcacattggccctttgccttgccaacaaccaggcttcgttccatatcagcagccagggcct

SEQ ID NO: 435855 - DNA, 140 bp, Artificial Sequence
  Synthetic
atacgccatgctgggtctccttgagggatcgtagcactcaagtgaaatactcaggtacatcccttgtccgagtggcaaggtataccacaatctccaacgacaatctctcatttgtcatatcgtacttgggagtcggccat

SEQ ID NO: 435856 - DNA, 140 bp, Artificial Sequence
  Synthetic
atggccgactcccaagtacgatatgacaaatgagagattgtcgttggagattgtggtataccttgccactcggacaagggatgtacctgagtatttcacttgagtgctacgatccctcaaggagacccagcatggcgtat

SEQ ID NO: 435857 - DNA, 140 bp, Artificial Sequence
  Synthetic
atacgccatgctgggtctcccagataagaaggttgatactaactttatataccaacaaggaatgcttctagggttgggtgttttagaaacattgtttcgactcgagaaagatactggatccgtacttgggagtcggccat

SEQ ID NO: 435858 - DNA, 140 bp, Artificial Sequence
  Synthetic
atggccgactcccaagtacggatccagtatctttctcgagtcgaaacaatgtttctaaaacacccaaccctagaagcattccttgttggtatataaagttagtatcaaccttcttatctgggagacccagcatggcgtat

SEQ ID NO: 435859 - DNA, 140 bp, Artificial Sequence
  Synthetic
atacgccatgctgggtctccatctaacacggtattacatcttcacgtcgaaacagattgttgcgtgatcccgatgatagatcatcccaggatacccagctcccgcaagctagagctgaggcgtacttgggagtcggccat

SEQ ID NO: 435860 - DNA, 140 bp, Artificial Sequence
  Synthetic
atggccgactcccaagtacgcctcagctctagcttgcgggagctgggtatcctgggatgatctatcatcgggatcacgcaacaatctgtttcgacgtgaagatgtaataccgtgttagatggagacccagcatggcgtat

SEQ ID NO: 435861 - DNA, 140 bp, Artificial Sequence
  Synthetic
atacgccatgctgggtctccgcagagctatgtaccaacccattgatatatgataatgcacctttaattgacagagatgcaacaaggctatacacccagagccataggaggcaccttgtggcgtacttgggagtcggccat

SEQ ID NO: 435862 - DNA, 140 bp, Artificial Sequence
  Synthetic
atggccgactcccaagtacgccacaaggtgcctcctatggctctgggtgtatagccttgttgcatctctgtcaattaaaggtgcattatcatatatcaatgggttggtacatagctctgcggagacccagcatggcgtat

SEQ ID NO: 435863 - DNA, 140 bp, Artificial Sequence
  Synthetic
aggccctggctgctgatatgcagagatgcaacaaggctatacacccagagccataggaggcaccttgtggaatttgttacatggtccacaccccaactatatcacattctagctaagtccgaccttttgggacagcggtg

SEQ ID NO: 435864 - DNA, 140 bp, Artificial Sequence
  Synthetic
caccgctgtcccaaaaggtcggacttagctagaatgtgatatagttggggtgtggaccatgtaacaaattccacaaggtgcctcctatggctctgggtgtatagccttgttgcatctctgcatatcagcagccagggcct

SEQ ID NO: 435865 - DNA, 140 bp, Artificial Sequence
  Synthetic
atacgccatgctgggtctccaatttgttacatggtccacaccccaactatatcacattctagctaagtccacagcactatctatgattgacctggtaacaaaatttgagaaggaccatatcgtacttgggagtcggccat

SEQ ID NO: 435866 - DNA, 140 bp, Artificial Sequence
  Synthetic
atggccgactcccaagtacgatatggtccttctcaaattttgttaccaggtcaatcatagatagtgctgtggacttagctagaatgtgatatagttggggtgtggaccatgtaacaaattggagacccagcatggcgtat

SEQ ID NO: 435867 - DNA, 140 bp, Artificial Sequence
  Synthetic
aggccctggctgctgatatgacagcactatctatgattgacctggtaacaaaatttgagaaggaccatatgaatgaaatttcagctctcataggggatgacgatatcaatagtttcataagaccttttgggacagcggtg

SEQ ID NO: 435868 - DNA, 140 bp, Artificial Sequence
  Synthetic
caccgctgtcccaaaaggtcttatgaaactattgatatcgtcatcccctatgagagctgaaatttcattcatatggtccttctcaaattttgttaccaggtcaatcatagatagtgctgtcatatcagcagccagggcct

SEQ ID NO: 435869 - DNA, 140 bp, Artificial Sequence
  Synthetic
atacgccatgctgggtctcctgatgctcaaaacttgcacacaactgtgtgcaacatggtttacacatgctatatgacctacctcgacctgttgttgaatgaagagttagaagagttcacacgtacttgggagtcggccat

SEQ ID NO: 435870 - DNA, 140 bp, Artificial Sequence
  Synthetic
atggccgactcccaagtacgtgtgaactcttctaactcttcattcaacaacaggtcgaggtaggtcatatagcatgtgtaaaccatgttgcacacagttgtgtgcaagttttgagcatcaggagacccagcatggcgtat

SEQ ID NO: 435871 - DNA, 140 bp, Artificial Sequence
  Synthetic
aggccctggctgctgatatgatatgacctacctcgacctgttgttgaatgaagagttagaagagttcacatttcttttgtgtgaaagcgacgaggatgtagtaccggacagattcgacaagaccttttgggacagcggtg

SEQ ID NO: 435872 - DNA, 140 bp, Artificial Sequence
  Synthetic
caccgctgtcccaaaaggtcttgtcgaatctgtccggtactacatcctcgtcgctttcacacaaaagaaatgtgaactcttctaactcttcattcaacaacaggtcgaggtaggtcatatcatatcagcagccagggcct

SEQ ID NO: 435873 - DNA, 140 bp, Artificial Sequence
  Synthetic
atacgccatgctgggtctccatctccggcggggatctatcaaacagataagattgagagttgatccgggattcatttttgacgccctcgctgaggtaaatgtcagtcaaccaaagatcggcgtacttgggagtcggccat

SEQ ID NO: 435874 - DNA, 140 bp, Artificial Sequence
  Synthetic
atggccgactcccaagtacgccgatctttggttgactgacatttacctcagcgagggcgtcaaaaatgaatcccggatcaactctcaatcttatctgtttgatagatccccgccggagatggagacccagcatggcgtat

SEQ ID NO: 435875 - DNA, 140 bp, Artificial Sequence
  Synthetic
aggccctggctgctgatatgatgatgttgcaaaactgctcaaagatatcaacacaagcaagcacaatcttcccatttcagggggtagtctcgccaattatgaaatccatgctttccgcaggaccttttgggacagcggtg

SEQ ID NO: 435876 - DNA, 140 bp, Artificial Sequence
  Synthetic
caccgctgtcccaaaaggtcctgcggaaagcatggatttcataattggcgagactaccccctgaaatgggaagattgtgcttgcttgtgttgatatctttgagcagttttgcaacatcatcatatcagcagccagggcct

SEQ ID NO: 435877 - DNA, 140 bp, Artificial Sequence
  Synthetic
aggccctggctgctgatatgtaattaggagatgccttgagccaggggaagacggcttgttcttgggtgaggggtcgggttctatgttgatcacttataaggagatactaaaactaaacaagaccttttgggacagcggtg

SEQ ID NO: 435878 - DNA, 140 bp, Artificial Sequence
  Synthetic
caccgctgtcccaaaaggtcttgtttagttttagtatctccttataagtgatcaacatagaacccgacccctcacccaagaacaagccgtcttcccctggctcaaggcatctcctaattacatatcagcagccagggcct

SEQ ID NO: 435879 - DNA, 140 bp, Artificial Sequence
  Synthetic
aggccctggctgctgatatggtgcttctataatagtggggtttccgccaattctagatctggtcaaagggaattagcaccctatccctccgaagttggccttgtcgaacacagaatgggagaccttttgggacagcggtg

SEQ ID NO: 435880 - DNA, 140 bp, Artificial Sequence
  Synthetic
caccgctgtcccaaaaggtctcccattctgtgttcgacaaggccaacttcggagggatagggtgctaattccctttgaccagatctagaattggcggaaaccccactattatagaagcaccatatcagcagccagggcct

SEQ ID NO: 435881 - DNA, 140 bp, Artificial Sequence
  Synthetic
atacgccatgctgggtctccctagtgtggggtttatccattcagatatagagaccttacctaacaaagatactatagagaagctagaggaattggcagccatcttatcgatggctctgctcgtacttgggagtcggccat

SEQ ID NO: 435882 - DNA, 140 bp, Artificial Sequence
  Synthetic
atggccgactcccaagtacgagcagagccatcgataagatggctgccaattcctctagcttctctatagtatctttgttaggtaaggtctctatatctgaatggataaaccccacactagggagacccagcatggcgtat

SEQ ID NO: 435883 - DNA, 140 bp, Artificial Sequence
  Synthetic
atacgccatgctgggtctccccttggcaaaataggatcaatactggtgattaagcttatgcctttaagcggggattttgttcagggatttataagctatgtagggtctcattatagagaacgtacttgggagtcggccat

SEQ ID NO: 435884 - DNA, 140 bp, Artificial Sequence
  Synthetic
atggccgactcccaagtacgttctctataatgagaccctacatagcttataaatccctgaacaaaatccccgcttaaaggcataagcttaatcaccagtattgatcctattttgccaaggggagacccagcatggcgtat

SEQ ID NO: 435885 - DNA, 140 bp, Artificial Sequence
  Synthetic
aggccctggctgctgatatgggtcacatcctatccattaagcaactaagctgcatacaagcaattgtgggaggcgcagttagtagaggtgatatcaaccctactctgaaaaaacttacacgaccttttgggacagcggtg

SEQ ID NO: 435886 - DNA, 140 bp, Artificial Sequence
  Synthetic
caccgctgtcccaaaaggtcgtgtaagttttttcagagtagggttgatatcacctctactaactgcgcctcccacaattgcttgtatgcagcttagttgcttaatggataggatgtgacccatatcagcagccagggcct

SEQ ID NO: 435887 - DNA, 140 bp, Artificial Sequence
  Synthetic
aggccctggctgctgatatgaccaaagaagtcaacaagggatgttccacgcttaccccgtattggtaagtagcaggcaacgagaacttgtatctaggatcacccgcaaattttgggggcagaccttttgggacagcggtg

SEQ ID NO: 435888 - DNA, 140 bp, Artificial Sequence
  Synthetic
caccgctgtcccaaaaggtctgcccccaaaatttgcgggtgatcctagatacaagttctcgttgcctgctacttaccaatacggggtaagcgtggaacatcccttgttgacttctttggtcatatcagcagccagggcct

SEQ ID NO: 435889 - DNA, 140 bp, Artificial Sequence
  Synthetic
aggccctggctgctgatatgaccaaacaaagttgggtaaggatagatcaatcaatgatcatattctagtacacttaggattcaagatcctattatcagggacaagggcaggattagggacgaccttttgggacagcggtg

SEQ ID NO: 435890 - DNA, 140 bp, Artificial Sequence
  Synthetic
caccgctgtcccaaaaggtcgtccctaatcctgcccttgtccctgataataggatcttgaatcctaagtgtactagaatatgatcattgattgatctatccttacccaactttgtttggtcatatcagcagccagggcct

SEQ ID NO: 435891 - DNA, 140 bp, Artificial Sequence
  Synthetic
aggccctggctgctgatatgaggacaaaccacccattacatcaggatctggtggagccatccgaggaatcaaacacattattatagtaccaatccctggagattcctcaatcaccactcggaccttttgggacagcggtg

SEQ ID NO: 435892 - DNA, 140 bp, Artificial Sequence
  Synthetic
caccgctgtcccaaaaggtccgagtggtgattgaggaatctccagggattggtactataataatgtgtttgattcctcggatggctccaccagatcctgatgtaatgggtggtttgtcctcatatcagcagccagggcct

SEQ ID NO: 435893 - DNA, 140 bp, Artificial Sequence
  Synthetic
atacgccatgctgggtctcccataaggctgttagaggttgtccagagtgaccagtcacaatctggccttaccttcgcatcaagaggtaccaacatggaggacgaggcggaccaatactttcgtacttgggagtcggccat

SEQ ID NO: 435894 - DNA, 140 bp, Artificial Sequence
  Synthetic
atggccgactcccaagtacgaaagtattggtccgcctcgtcctccatgttggtacctcttgatgcgaaggtaaggccagattgtgactggtcactctggacaacctctaacagccttatgggagacccagcatggcgtat

SEQ ID NO: 435895 - DNA, 140 bp, Artificial Sequence
  Synthetic
aggccctggctgctgatatgtaatcctactctgaaaaaacttacacctatagagcaggtgctggtcaattgcgggttggcaattaacggacctaagctgtgcaaagaattgatccaccatgaccttttgggacagcggtg

SEQ ID NO: 435896 - DNA, 140 bp, Artificial Sequence
  Synthetic
caccgctgtcccaaaaggtcatggtggatcaattctttgcacagcttaggtccgttaattgccaacccgcaattgaccagcacctgctctataggtgtaagttttttcagagtaggattacatatcagcagccagggcct

SEQ ID NO: 435897 - DNA, 140 bp, Artificial Sequence
  Synthetic
aggccctggctgctgatatggaacaaggaaatctcagatattgaagtgcaagaccctgagggattcaacatgattctaggcaccattctagcccagatttgggtcttgctcgcaaaggcggaccttttgggacagcggtg

SEQ ID NO: 435898 - DNA, 140 bp, Artificial Sequence
  Synthetic
caccgctgtcccaaaaggtccgcctttgcgagcaagacccaaatctgggctagaatggtgcctagaatcatgttgaatccctcagggtcttgcacttcaatatctgagatttccttgttccatatcagcagccagggcct

SEQ ID NO: 435899 - DNA, 140 bp, Artificial Sequence
  Synthetic
aggccctggctgctgatatgggttggatgtggtgaggaacaggattgccgaggacctctccttacgccgattcatggtcgctttaatcctggatatcaagagaacacccgggaacaaaccgaccttttgggacagcggtg

SEQ ID NO: 435900 - DNA, 140 bp, Artificial Sequence
  Synthetic
caccgctgtcccaaaaggtcggtttgttcccgggtgttctcttgatatccaggattaaagcgaccatgaatcggcgtaaggagaggtcctcggcaatcctgttcctcaccacatccaacccatatcagcagccagggcct

SEQ ID NO: 435901 - DNA, 140 bp, Artificial Sequence
  Synthetic
aggccctggctgctgatatggattagccagttttatcctgactattaagtttgggatagaaactatgtatcctgctcttggactgcatgaatttgctggtgagttatccacacttgagtcgaccttttgggacagcggtg

SEQ ID NO: 435902 - DNA, 140 bp, Artificial Sequence
  Synthetic
caccgctgtcccaaaaggtcgactcaagtgtggataactcaccagcaaattcatgcagtccaagagcaggatacatagtttctatcccaaacttaatagtcaggataaaactggctaatccatatcagcagccagggcct

SEQ ID NO: 435903 - DNA, 140 bp, Artificial Sequence
  Synthetic
aggccctggctgctgatatgcctgctcttggactgcatgaatttgctggtgagttatccacacttgagtcattgatgaatctttaccaacaaatgggggaaactgcaccctacatggtaagaccttttgggacagcggtg

SEQ ID NO: 435904 - DNA, 140 bp, Artificial Sequence
  Synthetic
caccgctgtcccaaaaggtcttaccatgtagggtgcagtttcccccatttgttggtaaagattcatcaatgactcaagtgtggataactcaccagcaaattcatgcagtccaagagcaggcatatcagcagccagggcct

SEQ ID NO: 435905 - DNA, 140 bp, Artificial Sequence
  Synthetic
atacgccatgctgggtctccagggttgaactttggccgatcttactttgatccggcatattttagattagggcaagagatggtaaggaggtcagctggaaaggtcagttccacattggcacgtacttgggagtcggccat

SEQ ID NO: 435906 - DNA, 140 bp, Artificial Sequence
  Synthetic
atggccgactcccaagtacgtgccaatgtggaactgacctttccagctgacctccttaccatctcttgccctaatctaaaatatgccggatcaaagtaagatcggccaaagttcaaccctggagacccagcatggcgtat

SEQ ID NO: 435907 - DNA, 140 bp, Artificial Sequence
  Synthetic
aggccctggctgctgatatgggcaagagatggtaaggaggtcagctggaaaggtcagttccacattggcatctgaactcggtatcactgccgaggatgcaaggcttgtctcagagattgcgaccttttgggacagcggtg

SEQ ID NO: 435908 - DNA, 140 bp, Artificial Sequence
  Synthetic
caccgctgtcccaaaaggtcgcaatctctgagacaagccttgcatcctcggcagtgataccgagttcagatgccaatgtggaactgacctttccagctgacctccttaccatctcttgcccatatcagcagccagggcct

SEQ ID NO: 435909 - DNA, 140 bp, Artificial Sequence
  Synthetic
atacgccatgctgggtctccttggggggcaaggaagataggagagccaaacagagccgaggagaagccagggagagctacagagaaactgggtccagcagagcaagtgatgcaagagctgcgtacttgggagtcggccat

SEQ ID NO: 435910 - DNA, 140 bp, Artificial Sequence
  Synthetic
atggccgactcccaagtacgcagctcttgcatcacttgctctgctggacccagtttctctgtagctctccctggcttctcctcggctctgtttggctctcctatcttccttgccccccaaggagacccagcatggcgtat

SEQ ID NO: 435911 - DNA, 140 bp, Artificial Sequence
  Synthetic
atacgccatgctgggtctcccccatcttccaaccagcacaccccttgacattgacactgcatcggagacaagccaagatctgcaagacagtcgaaggtcagctgacgccctgctcaggctcgtacttgggagtcggccat

SEQ ID NO: 435912 - DNA, 140 bp, Artificial Sequence
  Synthetic
atggccgactcccaagtacgagcctgagcagggcgtcagctgaccttcgactgtcttgcagatcttggcttgtctccgatgcagtgtcaatgtcaaggggtgtgctggttggaagatgggggagacccagcatggcgtat

SEQ ID NO: 435913 - DNA, 140 bp, Artificial Sequence
  Synthetic
aggccctggctgctgatatgctctggagctatgccatgggagtaggagtggaacttgaaaactccatgggaggtttgaactttggccgatcttacttcgatccagcatatttcagactaggaccttttgggacagcggtg

SEQ ID NO: 435914 - DNA, 140 bp, Artificial Sequence
  Synthetic
caccgctgtcccaaaaggtcctagtctgaaatatgctggatcgaagtaagatcggccaaagttcaaacctcccatggagttttcaagttccactcctactcccatggcatagctccagagcatatcagcagccagggcct

SEQ ID NO: 435915 - DNA, 140 bp, Artificial Sequence
  Synthetic
atacgccatgctgggtctccgcaagccatggcaggaatctcggaagagcaaggctcagacacggacacccccagagtgtacaatgacagagatcttctagactaggtacgagaggccgagcgtacttgggagtcggccat

SEQ ID NO: 435916 - DNA, 140 bp, Artificial Sequence
  Synthetic
atggccgactcccaagtacgctcggcctctcgtacctagtctagaagatctctgtcattgtacactctgggggtgtccgtgtctgagccttgctcttccgagattcctgccatggcttgcggagacccagcatggcgtat

SEQ ID NO: 435917 - DNA, 140 bp, Artificial Sequence
  Synthetic
aggccctggctgctgatatggatcagaacaacatccgcctaccctccatcattgttataaaaaacttaggaaccaggtccacacagccgccagccaatcaaccatccactcccacgattggaccttttgggacagcggtg

SEQ ID NO: 435918 - DNA, 140 bp, Artificial Sequence
  Synthetic
caccgctgtcccaaaaggtccaatcgtgggagtggatggttgattggctggcggctgtgtggacctggttcctaagttttttataacaatgatggagggtaggcggatgttgttctgatccatatcagcagccagggcct

SEQ ID NO: 435919 - DNA, 140 bp, Artificial Sequence
  Synthetic
atacgccatgctgggtctccaatgcatactacagaggacaggatcagtagagcggttggacccagacaatcccaagtgtcattcctacacggtgatcaaaatgaaaatgagctaccgagacgtacttgggagtcggccat

SEQ ID NO: 435920 - DNA, 140 bp, Artificial Sequence
  Synthetic
atggccgactcccaagtacgtctcggtagctcattttcattttgatcaccgtgtaggaatgacacttgggattgtctgggtccaaccgctctactgatcctgtcctctgtagtatgcattggagacccagcatggcgtat

SEQ ID NO: 435921 - DNA, 140 bp, Artificial Sequence
  Synthetic
aggccctggctgctgatatgcatccgggctctcaaggccgagcccatcggctcactggccgtcgaggaagccatggcagcatggtcagaaatatcagacaacccaggacaggaccgagccgaccttttgggacagcggtg

SEQ ID NO: 435922 - DNA, 140 bp, Artificial Sequence
  Synthetic
caccgctgtcccaaaaggtcggctcggtcctgtcctgggttgtctgatatttctgaccatgctgccatggcttcctcgacggccagtgagccgatgggctcggccttgagagcccggatgcatatcagcagccagggcct

SEQ ID NO: 435923 - DNA, 140 bp, Artificial Sequence
  Synthetic
aggccctggctgctgatatgagagagctacagagaaaccaggcccagcagagcaagtgacgcgagagctacccatcctccaaccgacacacccttagacattgacactgcatcggagtccgaccttttgggacagcggtg

SEQ ID NO: 435924 - DNA, 140 bp, Artificial Sequence
  Synthetic
caccgctgtcccaaaaggtcggactccgatgcagtgtcaatgtctaagggtgtgtcggttggaggatgggtagctctcgcgtcacttgctctgctgggcctggtttctctgtagctctctcatatcagcagccagggcct

SEQ ID NO: 435925 - DNA, 140 bp, Artificial Sequence
  Synthetic
aggccctggctgctgatatgacctgcaaggaagagaaggcaagcagttcgggtctcagcaaaccatgcctctcagcaattggatcaactgaaggcggtgcacctcgcatccgcggtcagggaccttttgggacagcggtg

SEQ ID NO: 435926 - DNA, 140 bp, Artificial Sequence
  Synthetic
caccgctgtcccaaaaggtccctgaccgcggatgcgaggtgcaccgccttcagttgatccaattgctgagaggcatggtttgctgagacccgaactgcttgccttctcttccttgcaggtcatatcagcagccagggcct

SEQ ID NO: 435927 - DNA, 140 bp, Artificial Sequence
  Synthetic
aggccctggctgctgatatgagccaagatccgcaggacagtcgaaggtcagctgacgccctgctcaggctgcaagccatggcaggaatctcggaagaacaaggctcagacacggacacccgaccttttgggacagcggtg

SEQ ID NO: 435928 - DNA, 140 bp, Artificial Sequence
  Synthetic
caccgctgtcccaaaaggtcgggtgtccgtgtctgagccttgttcttccgagattcctgccatggcttgcagcctgagcagggcgtcagctgaccttcgactgtcctgcggatcttggctcatatcagcagccagggcct

SEQ ID NO: 435929 - DNA, 140 bp, Artificial Sequence
  Synthetic
aggccctggctgctgatatggatctggagagagcgatgacgacgctgaaactttgggaatcccctcaagaaatctccaggcatcaagcactgggttacagtgttatcatgtttatgatcagaccttttgggacagcggtg

SEQ ID NO: 435930 - DNA, 140 bp, Artificial Sequence
  Synthetic
caccgctgtcccaaaaggtctgatcataaacatgataacactgtaacccagtgcttgatgcctggagatttcttgaggggattcccaaagtttcagcgtcgtcatcgctctctccagatccatatcagcagccagggcct

SEQ ID NO: 435931 - DNA, 140 bp, Artificial Sequence
  Synthetic
aggccctggctgctgatatgagaggcaacaactttccgaagcttgggaaaactctcaatgttcctccgcccccgaaccccggtagggccagcgcttccgagacacccattaaaaagggcagaccttttgggacagcggtg

SEQ ID NO: 435932 - DNA, 140 bp, Artificial Sequence
  Synthetic
caccgctgtcccaaaaggtctgccctttttaatgggtgtctcggaagcgctggccctaccggggttcgggggcggaggaacattgagagttttcccaagcttcggaaagttgttgcctctcatatcagcagccagggcct

SEQ ID NO: 435933 - DNA, 140 bp, Artificial Sequence
  Synthetic
atacgccatgctgggtctccctcagcaattggatcaactgaaggcggtgcacctcgcatccgcggtcagggatctggagagagcgatgacgacgctgaaactttgggaatcccctcaggacgtacttgggagtcggccat

SEQ ID NO: 435934 - DNA, 140 bp, Artificial Sequence
  Synthetic
atggccgactcccaagtacgtcctgaggggattcccaaagtttcagcgtcgtcatcgctctctccagatccctgaccgcggatgcgaggtgcaccgccttcagttgatccaattgctgagggagacccagcatggcgtat

SEQ ID NO: 435935 - DNA, 140 bp, Artificial Sequence
  Synthetic
atacgccatgctgggtctccttgaaactgcagaaggaggggagatccacgagctcctgagactccaatccagaggcaacaactttccaaagcttaggaaaactctcaatgttcccccgcccgtacttgggagtcggccat

SEQ ID NO: 435936 - DNA, 140 bp, Artificial Sequence
  Synthetic
atggccgactcccaagtacgggcgggggaacattgagagttttcctaagctttggaaagttgttgcctctggattggagtctcaggagctcgtggatctcccctccttctgcagtttcaaggagacccagcatggcgtat

SEQ ID NO: 435937 - DNA, 140 bp, Artificial Sequence
  Synthetic
aggccctggctgctgatatgagtgccccgcaatgcccgaaaacgaccctcctcataatgatagccagaaggcccggacaaaaaagctccccccaaaaaaaattcacggaccaaacgagaggaccttttgggacagcggtg

SEQ ID NO: 435938 - DNA, 140 bp, Artificial Sequence
  Synthetic
caccgctgtcccaaaaggtcctctcgtttggtccgtgaattttttttggggggagcttttttgtccgggccttctggctatcattatgaggagggtcgttttcgggcattgcggggcactcatatcagcagccagggcct

SEQ ID NO: 435939 - DNA, 140 bp, Artificial Sequence
  Synthetic
atacgccatgctgggtctccagctgctgaaggaatttcagctaaaaccgatcgggaaaaagatgagctcagccgtcgggtttgttcctgacaccggccctgcatcacgcagtgtaatccgcgtacttgggagtcggccat

SEQ ID NO: 435940 - DNA, 140 bp, Artificial Sequence
  Synthetic
atggccgactcccaagtacgcggattacactgcgtgatgcagggccggtgtcaggaacaaacccgacggctgagctcatctttttcccgatcggttttagctgaaattccttcagcagctggagacccagcatggcgtat

SEQ ID NO: 435941 - DNA, 140 bp, Artificial Sequence
  Synthetic
aggccctggctgctgatatggccgtcgggtttgttcctgacaccggccctgcatcacgcagtgtaatccgctccattataaaatccagccggctagaggaggatcggaagcgttacctgagaccttttgggacagcggtg

SEQ ID NO: 435942 - DNA, 140 bp, Artificial Sequence
  Synthetic
caccgctgtcccaaaaggtctcaggtaacgcttccgatcctcctctagccggctggattttataatggagcggattacactgcgtgatgcagggccggtgtcaggaacaaacccgacggccatatcagcagccagggcct

SEQ ID NO: 435943 - DNA, 140 bp, Artificial Sequence
  Synthetic
atacgccatgctgggtctcccagatgctgatgaagataataatgaagtagctacagctcaacttacctgccaaccccatgccagtcgacctaactagtacaacctaaatccattataaaacgtacttgggagtcggccat

SEQ ID NO: 435944 - DNA, 140 bp, Artificial Sequence
  Synthetic
atggccgactcccaagtacgttttataatggatttaggttgtactagttaggtcgactggcatggggttggcaggtaagttgagctgtagctacttcattattatcttcatcagcatctgggagacccagcatggcgtat

SEQ ID NO: 435945 - DNA, 140 bp, Artificial Sequence
  Synthetic
atacgccatgctgggtctccaaccgcatccctaccacccccgggaaagaaacccccagcaactggaagagcccttcccctttccctcaacacaagaactccacaaccgaaccacacaagccgtacttgggagtcggccat

SEQ ID NO: 435946 - DNA, 140 bp, Artificial Sequence
  Synthetic
atggccgactcccaagtacggcttgtgtggttcggttgtggagttcttgtgttgagggaaaggggaagggctcttccagttgctgggggtttctttcccgggggtggtagggatgcggttggagacccagcatggcgtat

SEQ ID NO: 435947 - DNA, 140 bp, Artificial Sequence
  Synthetic
atacgccatgctgggtctccagatcctggtctaggcgacagaaaagatgaatgttttatgtacatgtttctgctgggggttgttgaggacagcgatctcctagggcctccaatcgggcgacgtacttgggagtcggccat

SEQ ID NO: 435948 - DNA, 140 bp, Artificial Sequence
  Synthetic
atggccgactcccaagtacgtcgcccgattggaggccctaggagatcgctgtcctcaacaacccccagcagaaacatgtacataaaacattcatcttttctgtcgcctagaccaggatctggagacccagcatggcgtat

SEQ ID NO: 435949 - DNA, 140 bp, Artificial Sequence
  Synthetic
atacgccatgctgggtctccgcatttgggtccctgcctttaggtgttggcagatccacagcaaaacccgaagaactcctcaaagaggccactgagcttgacatagttgttagacgcacagcgtacttgggagtcggccat

SEQ ID NO: 435950 - DNA, 140 bp, Artificial Sequence
  Synthetic
atggccgactcccaagtacgctgtgcgtctaacaactatgtcaagctcagtggcctctttgaggagttcttcgggttttgctgtggatctgccaacacctaaaggcagggacccaaatgcggagacccagcatggcgtat

SEQ ID NO: 435951 - DNA, 140 bp, Artificial Sequence
  Synthetic
atacgccatgctgggtctccaccgttcctagaagaatgctggaattcagatcggtcaatgcagtggccttcaacctgctggtgacccttaggattgacaaggcgattggccctgggaagacgtacttgggagtcggccat

SEQ ID NO: 435952 - DNA, 140 bp, Artificial Sequence
  Synthetic
atggccgactcccaagtacgtcttcccagggccaatcgccttgtcaatcctaagggtcaccagcaggttgaaggccactgcattgaccgatctgaattccagcattcttctaggaacggtggagacccagcatggcgtat

SEQ ID NO: 435953 - DNA, 140 bp, Artificial Sequence
  Synthetic
atacgccatgctgggtctccgcaccagtcttcacattagaagcacaggcaaaatgagcaagactctccatgcacaactcgggttcaagaagaccctatgttacccactgatggatatcaacgtacttgggagtcggccat

SEQ ID NO: 435954 - DNA, 140 bp, Artificial Sequence
  Synthetic
atggccgactcccaagtacgttgatatccatcagtgggtaacatagggtcttcttgaacccgagttgtgcatggagagtcttgctcattttgcctgtgcttctaatgtgaagactggtgcggagacccagcatggcgtat

SEQ ID NO: 435955 - DNA, 140 bp, Artificial Sequence
  Synthetic
atacgccatgctgggtctccgacgttatcataaatgatgaccaaggattattcaaagttctgtagaccgtagtgcccagcaatgcccgaagacgaccctcctcacaatgacagccagaagcgtacttgggagtcggccat

SEQ ID NO: 435956 - DNA, 140 bp, Artificial Sequence
  Synthetic
atggccgactcccaagtacgcttctggctgtcattgtgaggagggtcgtcttcgggcattgctgggcactacggtctacagaactttgaataatccttggtcatcatttatgataacgtcggagacccagcatggcgtat

SEQ ID NO: 435957 - DNA, 140 bp, Artificial Sequence
  Synthetic
atacgccatgctgggtctccgcccggaaaaaaaggccccctccgaaagactccacagaccaaatgagaggccagccagcagctgacggcaagcacgaacaccaggcggccccagcacagacgtacttgggagtcggccat

SEQ ID NO: 435958 - DNA, 140 bp, Artificial Sequence
  Synthetic
atggccgactcccaagtacgtctgtgctggggccgcctggtgttcgtgcttgccgtcagctgctggctggcctctcatttggtctgtggagtctttcggagggggcctttttttccgggcggagacccagcatggcgtat

SEQ ID NO: 435959 - DNA, 140 bp, Artificial Sequence
  Synthetic
atacgccatgctgggtctccacagccctgacataaggccaccaccagccatcccaatctgcatcctcctcgtaggacccccgaggaccaacccccaaggttgccccccacccaaaccacccgtacttgggagtcggccat

SEQ ID NO: 435960 - DNA, 140 bp, Artificial Sequence
  Synthetic
atggccgactcccaagtacgggtggtttgggtggggggcaaccttgggggttggtcctcgggggtcctacgaggaggatgcagattgggatggctggtggtggccttatgtcagggctgtggagacccagcatggcgtat

SEQ ID NO: 435961 - DNA, 140 bp, Artificial Sequence
  Synthetic
atacgccatgctgggtctccgccagccagcagccgacggcaagcgcgaacatcaggcggccccagcacagaacagccccgacacagggcctccaccagccatcccaatccgcatcctcctcgtacttgggagtcggccat

SEQ ID NO: 435962 - DNA, 140 bp, Artificial Sequence
  Synthetic
atggccgactcccaagtacgaggaggatgcggattgggatggctggtggaggccctgtgtcggggctgttctgtgctggggccgcctgatgttcgcgcttgccgtcggctgctggctggcggagacccagcatggcgtat

SEQ ID NO: 435963 - DNA, 140 bp, Artificial Sequence
  Synthetic
aggccctggctgctgatatgcaaccgcatctccacagttcccgggaaggaaacccccagcaactggaaggcccctccccctctcccccaatgcaagaactccacaaccgaaccgcacaaggaccttttgggacagcggtg

SEQ ID NO: 435964 - DNA, 140 bp, Artificial Sequence
  Synthetic
caccgctgtcccaaaaggtccttgtgcggttcggttgtggagttcttgcattgggggagagggggaggggccttccagttgctgggggtttccttcccgggaactgtggagatgcggttgcatatcagcagccagggcct

SEQ ID NO: 435965 - DNA, 140 bp, Artificial Sequence
  Synthetic
atacgccatgctgggtctcccccctccccctctcccccaatgcaagaactccacaaccgaaccgcacaagcgaccgaggtgacccaaccgcaggcacctgactccctagacagatcctctcgtacttgggagtcggccat

SEQ ID NO: 435966 - DNA, 140 bp, Artificial Sequence
  Synthetic
atggccgactcccaagtacgagaggatctgtctagggagtcaggtgcctgcggttgggtcacctcggtcgcttgtgcggttcggttgtggagttcttgcattgggggagagggggaggggggagacccagcatggcgtat

SEQ ID NO: 435967 - DNA, 140 bp, Artificial Sequence
  Synthetic
aggccctggctgctgatatgccccccgacaaactaaacaaaacttagggccaaggaacatacacacccaacagaactcagaccccgacccacggcaccgcgcccccaccccccgacaaccgaccttttgggacagcggtg

SEQ ID NO: 435968 - DNA, 140 bp, Artificial Sequence
  Synthetic
caccgctgtcccaaaaggtcggttgtcggggggtgggggcgcggtgccgtgggtcggggtctgagttctgttgggtgtgtatgttccttggccctaagttttgtttagtttgtcggggggcatatcagcagccagggcct

SEQ ID NO: 435969 - DNA, 140 bp, Artificial Sequence
  Synthetic
atacgccatgctgggtctccagcaggagccctcaacccatcccgccggctcccccggtgcccacaggcaggcacaccaacccccgaacagacccagcacccagccatcgacaatccaagacgtacttgggagtcggccat

SEQ ID NO: 435970 - DNA, 140 bp, Artificial Sequence
  Synthetic
atggccgactcccaagtacgtcttggattgtcgatggctgggtgctgggtctgttcgggggttggtgtgcctgcctgtgggcaccgggggagccggcgggatgggttgagggctcctgctggagacccagcatggcgtat

SEQ ID NO: 435971 - DNA, 140 bp, Artificial Sequence
  Synthetic
aggccctggctgctgatatggcacaccaacccccgaacagacccagcacccagccatcgacaatccaagacggggggccccccccaaaaaaagcccccaggggccgacagccagcaccgcgaccttttgggacagcggtg

SEQ ID NO: 435972 - DNA, 140 bp, Artificial Sequence
  Synthetic
caccgctgtcccaaaaggtcgcggtgctggctgtcggcccctgggggctttttttggggggggccccccgtcttggattgtcgatggctgggtgctgggtctgttcgggggttggtgtgccatatcagcagccagggcct

SEQ ID NO: 435973 - DNA, 140 bp, Artificial Sequence
  Synthetic
atacgccatgctgggtctccgaggaagcccacccaccccacacacgaccacggcaatcgaaccagaatccagaccaccctgggccaccagctcccagactcggccatcaacccgggaaaacgtacttgggagtcggccat

SEQ ID NO: 435974 - DNA, 140 bp, Artificial Sequence
  Synthetic
atggccgactcccaagtacgttttcccgggttgatggccgagtctgggagctggtggcccagggtggtctggattctggttcgattgccgtggtcgtgtgtggggtgggtgggcttcctcggagacccagcatggcgtat

SEQ ID NO: 435975 - DNA, 140 bp, Artificial Sequence
  Synthetic
atacgccatgctgggtctcctctcgaagggactaaaagatcaatccaccacatccgacgacactcaactccccgtccctaaaggagacaccgggaatcccggaattaagactcatccaatcgtacttgggagtcggccat

SEQ ID NO: 435976 - DNA, 140 bp, Artificial Sequence
  Synthetic
atggccgactcccaagtacgattggatgagtcttaattccgggattcccggtgtctcctttagggacggggagttgagtgtcgtcggatgtggtggattgatcttttagtcccttcgagaggagacccagcatggcgtat

SEQ ID NO: 435977 - DNA, 140 bp, Artificial Sequence
  Synthetic
aggccctggctgctgatatgcaacccgaaccagcacccaagaacgaaccccgaaggacccccgaaccgcaaaagacatcagcaccctacagcctctccaagtttcctggtctcctcctccgaccttttgggacagcggtg

SEQ ID NO: 435978 - DNA, 140 bp, Artificial Sequence
  Synthetic
caccgctgtcccaaaaggtcggaggaggagaccaggaaacttggagaggctgtagggtgctgatgtcttttgcggttcgggggtccttcggggttcgttcttgggtgctggttcgggttgcatatcagcagccagggcct

SEQ ID NO: 435979 - DNA, 140 bp, Artificial Sequence
  Synthetic
atacgccatgctgggtctccaagaccagttcagagtgtaacttcaagtaggagacacaagagatttgcaggagttgtcctggcaggtgcggccctaggcgttgctacagctgctcagatacgtacttgggagtcggccat

SEQ ID NO: 435980 - DNA, 140 bp, Artificial Sequence
  Synthetic
atggccgactcccaagtacgtatctgagcagctgtagcaacgcctagggccgcacctgccaggacaactcctgcaaatctcttgtgtctcctacttgaagttacactctgaactggtcttggagacccagcatggcgtat

SEQ ID NO: 435981 - DNA, 140 bp, Artificial Sequence
  Synthetic
atacgccatgctgggtctcccatgctggagccacttttacttgcttacctgcagttgaggggtataacagtagaactcagaggtgctttccttaaccactgctttactgaaatacatgctcgtacttgggagtcggccat

SEQ ID NO: 435982 - DNA, 140 bp, Artificial Sequence
  Synthetic
atggccgactcccaagtacgagcatgtatttcagtaaagcagtggttaaggaaagcacctctgagttctactgttatacccctcaactgcaggtaagcaagtaaaagtggctccagcatgggagacccagcatggcgtat

SEQ ID NO: 435983 - DNA, 140 bp, Artificial Sequence
  Synthetic
aggccctggctgctgatatgagaccaccctgggccaccagttcccagactcggccatcaccccgcagaaaggaaaggccacaacctgcgcaccccagccccgatccggcgggcagccaccgaccttttgggacagcggtg

SEQ ID NO: 435984 - DNA, 140 bp, Artificial Sequence
  Synthetic
caccgctgtcccaaaaggtcggtggctgcccgccggatcggggctggggtgcgcaggttgtggcctttcctttctgcggggtgatggccgagtctgggaactggtggcccagggtggtctcatatcagcagccagggcct

SEQ ID NO: 435985 - DNA, 140 bp, Artificial Sequence
  Synthetic
atacgccatgctgggtctcccacaacaggaacgatcattaatcaagaccctgacaagatcctaacatacattgctgccgatcactgcccggtggtcgaggtgaacggcgtgaccatccaacgtacttgggagtcggccat

SEQ ID NO: 435986 - DNA, 140 bp, Artificial Sequence
  Synthetic
atggccgactcccaagtacgttggatggtcacgccgttcacctcgaccaccgggcagtgatcggcagcaatgtatgttaggatcttgtcagggtcttgattaatgatcgttcctgttgtgggagacccagcatggcgtat

SEQ ID NO: 435987 - DNA, 140 bp, Artificial Sequence
  Synthetic
atacgccatgctgggtctccgtcgggagcaggaggtatccggatgctgtgtacttgcacagaattgacctcggtcctcccatatcattggagaggttagacgtagggacaaatctggggacgtacttgggagtcggccat

SEQ ID NO: 435988 - DNA, 140 bp, Artificial Sequence
  Synthetic
atggccgactcccaagtacgtccccagatttgtccctacgtctaacctctccaatgatatgggaggaccgaggtcaattctgtgcaagtacacagcatccggatacctcctgctcccgacggagacccagcatggcgtat

SEQ ID NO: 435989 - DNA, 140 bp, Artificial Sequence
  Synthetic
atacgccatgctgggtctcccagagttgtcacaactgagcatgtaccgagtgtttgaagtaggtgttatcagaaatccgggtttgggggctccggtgttccatatgacaaactattttgacgtacttgggagtcggccat

SEQ ID NO: 435990 - DNA, 140 bp, Artificial Sequence
  Synthetic
atggccgactcccaagtacgtcaaaatagtttgtcatatggaacaccggagcccccaaacccggatttctgataacacctacttcaaacactcggtacatgctcagttgtgacaactctgggagacccagcatggcgtat

SEQ ID NO: 435991 - DNA, 140 bp, Artificial Sequence
  Synthetic
atacgccatgctgggtctcccagatattgaggagtatgaaaggtttatcgagcactagcatagtttacatcctgattgcagtgtgtcttggagggttgatagggatccccgctttaatatcgtacttgggagtcggccat

SEQ ID NO: 435992 - DNA, 140 bp, Artificial Sequence
  Synthetic
atggccgactcccaagtacgatattaaagcggggatccctatcaaccctccaagacacactgcaatcaggatgtaaactatgctagtgctcgataaacctttcatactcctcaatatctgggagacccagcatggcgtat

SEQ ID NO: 435993 - DNA, 140 bp, Artificial Sequence
  Synthetic
aggccctggctgctgatatgagaccaggcctaaagcctgatcttaccggaacatcaaaatcctatgtaaggtcgctctgaccctctacaactcttggaacacaaatgtcccacaagtctcgaccttttgggacagcggtg

SEQ ID NO: 435994 - DNA, 140 bp, Artificial Sequence
  Synthetic
caccgctgtcccaaaaggtcgagacttgtgggacatttgtgttccaagagttgtagagggtcagagcgaccttacataggattttgatgttccggtaagatcaggctttaggcctggtctcatatcagcagccagggcct

SEQ ID NO: 435995 - DNA, 140 bp, Artificial Sequence
  Synthetic
aggccctggctgctgatatgctcttcgtcatcaagcaaccaccgcatccagcatcaagcccacctgaaattgtctccggcttccctctggccgagcaatatcagtagttaattaaaacttgaccttttgggacagcggtg

SEQ ID NO: 435996 - DNA, 140 bp, Artificial Sequence
  Synthetic
caccgctgtcccaaaaggtcaagttttaattaactactgatattgctcggccagagggaagccggagacaatttcaggtgggcttgatgctggatgcggtggttgcttgatgacgaagagcatatcagcagccagggcct

SEQ ID NO: 435997 - DNA, 140 bp, Artificial Sequence
  Synthetic
aggccctggctgctgatatgagggtgcaagatcatccacaatgtcaccacaacgagaccggataaatgccttctacaaagataacccccatcccaagggaagtaggatagttattaacaggaccttttgggacagcggtg

SEQ ID NO: 435998 - DNA, 140 bp, Artificial Sequence
  Synthetic
caccgctgtcccaaaaggtcctgttaataactatcctacttcccttgggatgggggttatctttgtagaaggcatttatccggtctcgttgtggtgacattgtggatgatcttgcaccctcatatcagcagccagggcct

SEQ ID NO: 435999 - DNA, 140 bp, Artificial Sequence
  Synthetic
aggccctggctgctgatatgtctagatgtaactaactcaatcgagcatcaggtcaaggacgtgctgacaccactcttcaaaatcatcggtgatgaagtgggcctgagaacacctcagagagaccttttgggacagcggtg

SEQ ID NO: 436000 - DNA, 140 bp, Artificial Sequence
  Synthetic
caccgctgtcccaaaaggtctctctgaggtgttctcaggcccacttcatcaccgatgattttgaagagtggtgtcagcacgtccttgacctgatgctcgattgagttagttacatctagacatatcagcagccagggcct

SEQ ID NO: 436001 - DNA, 140 bp, Artificial Sequence
  Synthetic
atacgccatgctgggtctccagagaatcaaattggactatgatcaatactgtgcagatgtggctgctgaagagctcatgaatgcattggtgaactcaactctactggagactaggacaaccgtacttgggagtcggccat

SEQ ID NO: 436002 - DNA, 140 bp, Artificial Sequence
  Synthetic
atggccgactcccaagtacggttgtcctagtctccagtagagttgagttcaccaatgcattcatgagctcttcagcagccacatctgcacagtattgatcatagtccaatttgattctctggagacccagcatggcgtat

SEQ ID NO: 436003 - DNA, 140 bp, Artificial Sequence
  Synthetic
atacgccatgctgggtctcccaatcagttcctagctgtctcaaagggaaactgctcagggcccactacaatcagaggtcaattctcaaacatgtcgttgtccctgttggacttgtatttgcgtacttgggagtcggccat

SEQ ID NO: 436004 - DNA, 140 bp, Artificial Sequence
  Synthetic
atggccgactcccaagtacgcaaatacaagtccaacagggacaacgacatgtttgagaattgacctctgattgtagtgggccctgagcagtttccctttgagacagctaggaactgattgggagacccagcatggcgtat

SEQ ID NO: 436005 - DNA, 140 bp, Artificial Sequence
  Synthetic
atacgccatgctgggtctccagtcgaggttacaatgtgtcatctatagtcactatgacatcccagggaatgtacgggggaacttacctagtggaaaagcctaatctgagcagcaaagggtcgtacttgggagtcggccat

SEQ ID NO: 436006 - DNA, 140 bp, Artificial Sequence
  Synthetic
atggccgactcccaagtacgaccctttgctgctcagattaggcttttccactaggtaagttcccccgtacattccctgggatgtcatagtgactatagatgacacattgtaacctcgactggagacccagcatggcgtat

SEQ ID NO: 436007 - DNA, 140 bp, Artificial Sequence
  Synthetic
atacgccatgctgggtctcccagagttgccacaaccaagcatgcaccgagtgtttgaagtaggtgtcatcagaaatccgggtttgggggctccggtgttccatatgacaaactattttgacgtacttgggagtcggccat

SEQ ID NO: 436008 - DNA, 140 bp, Artificial Sequence
  Synthetic
atggccgactcccaagtacgtcaaaatagtttgtcatatggaacaccggagcccccaaacccggatttctgatgacacctacttcaaacactcggtgcatgcttggttgtggcaactctgggagacccagcatggcgtat

SEQ ID NO: 436009 - DNA, 140 bp, Artificial Sequence
  Synthetic
atacgccatgctgggtctccccgtgaactcctcaaaaagggaaattcgctgtactctaaagtcagtaataaggttttccaatgcttgagggacactaattcacggcttggtctaggctcccgtacttgggagtcggccat

SEQ ID NO: 436010 - DNA, 140 bp, Artificial Sequence
  Synthetic
atggccgactcccaagtacgggagcctagaccaagccgtgaattagtgtccctcaagcattggaaaaccttattactgactttagagtacagcgaatttccctttttgaggagttcacggggagacccagcatggcgtat

SEQ ID NO: 436011 - DNA, 140 bp, Artificial Sequence
  Synthetic
atacgccatgctgggtctccgcagccagtcagcaatgatttcagcaactgtatggtggctttgggggagctcaaactcgcagctctttgccacggggaagattctatcacaattccctatcgtacttgggagtcggccat

SEQ ID NO: 436012 - DNA, 140 bp, Artificial Sequence
  Synthetic
atggccgactcccaagtacgatagggaattgtgatagaatcttccccgtggcaaagagctgcgagtttgagctcccccaaagccaccatacagttgctgaaatcattgctgactggctgcggagacccagcatggcgtat

SEQ ID NO: 436013 - DNA, 140 bp, Artificial Sequence
  Synthetic
aggccctggctgctgatatgtaacatttgagctggttttgatgtattgtgatgtcatagaggggaggttaatgacagagactgctatgaccattgatgctagatatacagagcttctagggaccttttgggacagcggtg

SEQ ID NO: 436014 - DNA, 140 bp, Artificial Sequence
  Synthetic
caccgctgtcccaaaaggtccctagaagctctgtatatctagcatcaatggtcatagcagtctctgtcattaacctcccctctatgacatcacaatacatcaaaaccagctcaaatgttacatatcagcagccagggcct

SEQ ID NO: 436015 - DNA, 140 bp, Artificial Sequence
  Synthetic
atacgccatgctgggtctccaatcaagcaaaatgggctgtcccgacaacacgaacagatgacaagttgcgaatggagacatgcttccagcaggcgtgtaagggtaaaatccaagcactctcgtacttgggagtcggccat

SEQ ID NO: 436016 - DNA, 140 bp, Artificial Sequence
  Synthetic
atggccgactcccaagtacgagagtgcttggattttacccttacacgcctgctggaagcatgtctccattcgcaacttgtcatctgttcgtgttgtcgggacagcccattttgcttgattggagacccagcatggcgtat

SEQ ID NO: 436017 - DNA, 140 bp, Artificial Sequence
  Synthetic
atacgccatgctgggtctccgcgagaatcccgagtgggcaccattgaaggataacaggattccttcatacggggtcttgtctgttgatctgagtctgacagttgagcttaaaatcaaaatcgtacttgggagtcggccat

SEQ ID NO: 436018 - DNA, 140 bp, Artificial Sequence
  Synthetic
atggccgactcccaagtacgattttgattttaagctcaactgtcagactcagatcaacagacaagaccccgtatgaaggaatcctgttatccttcaatggtgcccactcgggattctcgcggagacccagcatggcgtat

SEQ ID NO: 436019 - DNA, 140 bp, Artificial Sequence
  Synthetic
atacgccatgctgggtctccaacctagccttaggtgtaatcaacacattggagtggataccgagattcaaggttagtcccaacctctttactgtcccaattaaggaagcaggcgaggactcgtacttgggagtcggccat

SEQ ID NO: 436020 - DNA, 140 bp, Artificial Sequence
  Synthetic
atggccgactcccaagtacgagtcctcgcctgcttccttaattgggacagtaaagaggttgggactaaccttgaatctcggtatccactccaatgtgttgattacacctaaggctaggttggagacccagcatggcgtat

SEQ ID NO: 436021 - DNA, 140 bp, Artificial Sequence
  Synthetic
atacgccatgctgggtctccaacctacgatacttccagggttgaacatgctgtggtttattatgtttacagcccaagccgctcattttcttacttttatccttttaggttgcctataaagcgtacttgggagtcggccat

SEQ ID NO: 436022 - DNA, 140 bp, Artificial Sequence
  Synthetic
atggccgactcccaagtacgctttataggcaacctaaaaggataaaagtaagaaaatgagcggcttgggctgtaaacataataaaccacagcatgttcaaccctggaagtatcgtaggttggagacccagcatggcgtat

SEQ ID NO: 436023 - DNA, 140 bp, Artificial Sequence
  Synthetic
atacgccatgctgggtctccactctggctgtctcaggagtccctaaagatctcaaagaaagtcacagaggggggccagtcctaaaaacctactcccgaagcccagcccacacaaataccacgtacttgggagtcggccat

SEQ ID NO: 436024 - DNA, 140 bp, Artificial Sequence
  Synthetic
atggccgactcccaagtacgtggtatttgtgtgggctgggcttcgggagtaggtttttaggactggcccccctctgtgactttctttgagatctttagggactcctgagacagccagagtggagacccagcatggcgtat

SEQ ID NO: 436025 - DNA, 140 bp, Artificial Sequence
  Synthetic
atacgccatgctgggtctccgaagatggaaccaatcgcggataaggctgccagtgaaccaatcacatgatgtcacccagacatcaggcatacccgctagtgtaaaatggacattagcattcgtacttgggagtcggccat

SEQ ID NO: 436026 - DNA, 140 bp, Artificial Sequence
  Synthetic
atggccgactcccaagtacgaatgctaatgtccattttacactagcgggtatgcctgatgtctgggtgacatcatgtgattggttcactggcagccttatccgcgattggttccatcttcggagacccagcatggcgtat

SEQ ID NO: 436027 - DNA, 140 bp, Artificial Sequence
  Synthetic
atacgccatgctgggtctccgcaaagtccccaatgaccaaatcttcattaagtaccctatgggaggtatagaagggtattgtcagaagctgtggaccatcagcaccattccctatttatacgtacttgggagtcggccat

SEQ ID NO: 436028 - DNA, 140 bp, Artificial Sequence
  Synthetic
atggccgactcccaagtacgtataaatagggaatggtgctgatggtccacagcttctgacaatacccttctatacctcccatagggtacttaatgaagatttggtcattggggactttgcggagacccagcatggcgtat

SEQ ID NO: 436029 - DNA, 140 bp, Artificial Sequence
  Synthetic
atacgccatgctgggtctcctgtaatcaggatttatttaacatagaggacaaagagtcaacgaggaagatccgtgaactcctcaaaaaggggaattcgctgtactccaaagtcagtgatacgtacttgggagtcggccat

SEQ ID NO: 436030 - DNA, 140 bp, Artificial Sequence
  Synthetic
atggccgactcccaagtacgtatcactgactttggagtacagcgaattcccctttttgaggagttcacggatcttcctcgttgactctttgtcctctatgttaaataaatcctgattacaggagacccagcatggcgtat

SEQ ID NO: 436031 - DNA, 140 bp, Artificial Sequence
  Synthetic
atacgccatgctgggtctccgcacagctcccaatggtttgagccctttctgttttggtttacagtcaagactgagatgaggtcagtgattaaatcacaaacccatacttgccataggaggcgtacttgggagtcggccat

SEQ ID NO: 436032 - DNA, 140 bp, Artificial Sequence
  Synthetic
atggccgactcccaagtacgcctcctatggcaagtatgggtttgtgatttaatcactgacctcatctcagtcttgactgtaaaccaaaacagaaagggctcaaaccattgggagctgtgcggagacccagcatggcgtat

SEQ ID NO: 436033 - DNA, 140 bp, Artificial Sequence
  Synthetic
aggccctggctgctgatatgtcgtgaccttgttgctataatcagtaaagagtctcaacatgtatattacctgacatttgaactggttttgatgtattgtgatgtcatagaggggaggttagaccttttgggacagcggtg

SEQ ID NO: 436034 - DNA, 140 bp, Artificial Sequence
  Synthetic
caccgctgtcccaaaaggtctaacctcccctctatgacatcacaatacatcaaaaccagttcaaatgtcaggtaatatacatgttgagactctttactgattatagcaacaaggtcacgacatatcagcagccagggcct

SEQ ID NO: 436035 - DNA, 140 bp, Artificial Sequence
  Synthetic
atacgccatgctgggtctccccattgctttactgaaatacatgatgtccttgaccaaaacgggttttctgatgaaggtacttatcatgagctaactgaagctctagattacattttcatacgtacttgggagtcggccat

SEQ ID NO: 436036 - DNA, 140 bp, Artificial Sequence
  Synthetic
atggccgactcccaagtacgtatgaaaatgtaatctagagcttcagttagctcatgataagtaccttcatcagaaaacccgttttggtcaaggacatcatgtatttcagtaaagcaatggggagacccagcatggcgtat

SEQ ID NO: 436037 - DNA, 140 bp, Artificial Sequence
  Synthetic
atacgccatgctgggtctccgcccggacaaaaaaaactcccccccaaaaaattcaacggaccaaacgagaggccagccagcagccgacggcaagcgcgaacatcaggcggccccagcacacgtacttgggagtcggccat

SEQ ID NO: 436038 - DNA, 140 bp, Artificial Sequence
  Synthetic
atggccgactcccaagtacgtgtgctggggccgcctgatgttcgcgcttgccgtcggctgctggctggcctctcgtttggtccgttgaattttttgggggggagttttttttgtccgggcggagacccagcatggcgtat

SEQ ID NO: 436039 - DNA, 140 bp, Artificial Sequence
  Synthetic
aggccctggctgctgatatgatgctcaagcttcaggtgaagggttaacacatgagcagtgcgttgataactggaagtcttttgctggagtgaaatttggctgctttatgcctcttagcctgaccttttgggacagcggtg

SEQ ID NO: 436040 - DNA, 140 bp, Artificial Sequence
  Synthetic
caccgctgtcccaaaaggtcaggctaagaggcataaagcagccaaatttcactccagcaaaagacttccagttatcaacgcactgctcatgtgttaacccttcacctgaagcttgagcatcatatcagcagccagggcct

SEQ ID NO: 436041 - DNA, 140 bp, Artificial Sequence
  Synthetic
atacgccatgctgggtctcctccatgaccctgagttcaacctgtcttacagcctgaaagaaaaggagatcaaggaaacaggtagactttttgctaaaatgacttacaaaatgagggcatgcgtacttgggagtcggccat

SEQ ID NO: 436042 - DNA, 140 bp, Artificial Sequence
  Synthetic
atggccgactcccaagtacgcatgccctcattttgtaagtcattttagcaaaaagtctacctgtttccttgatctccttttctttcaggctgtaagacaggttgaactcagggtcatggaggagacccagcatggcgtat

SEQ ID NO: 436043 - DNA, 140 bp, Artificial Sequence
  Synthetic
atacgccatgctgggtctccggggccagtctcaaaaacccactcccgaagcccagcccactcaagtaccaggaacgtgaaagcagcaaaagggtttatagggttccctcatgtaattcggcgtacttgggagtcggccat

SEQ ID NO: 436044 - DNA, 140 bp, Artificial Sequence
  Synthetic
atggccgactcccaagtacgccgaattacatgagggaaccctataaacccttttgctgctttcacgttcctggtacttgagtgggctgggcttcgggagtgggtttttgagactggccccggagacccagcatggcgtat

SEQ ID NO: 436045 - DNA, 140 bp, Artificial Sequence
  Synthetic
aggccctggctgctgatatgggaacgtgaaagcagcaaaagggtttatagggttccctcatgtaattcggcaggaccaagacactgatcacccagagaatatggaagcttacgagacagtgaccttttgggacagcggtg

SEQ ID NO: 436046 - DNA, 140 bp, Artificial Sequence
  Synthetic
caccgctgtcccaaaaggtcactgtctcgtaagcttccatattctctgggtgatcagtgtcttggtcctgccgaattacatgagggaaccctataaacccttttgctgctttcacgttcccatatcagcagccagggcct

SEQ ID NO: 436047 - DNA, 140 bp, Artificial Sequence
  Synthetic
atacgccatgctgggtctcccagtgcatttatcacgactgatctcaagaagtactgccttaattggagatatgagaccatcagcttgtttgcacagaggctaaatgagatttacggattacgtacttgggagtcggccat

SEQ ID NO: 436048 - DNA, 140 bp, Artificial Sequence
  Synthetic
atggccgactcccaagtacgtaatccgtaaatctcatttagcctctgtgcaaacaagctgatggtctcatatctccaattaaggcagtacttcttgagatcagtcgtgataaatgcactgggagacccagcatggcgtat

SEQ ID NO: 436049 - DNA, 140 bp, Artificial Sequence
  Synthetic
aggccctggctgctgatatgccctcattttttcagtggctgcataagaggcttgaaacctctgtcctgtatgtaagtgaccctcattgcccccccaaccttgacgcccatgtcccgttatgaccttttgggacagcggtg

SEQ ID NO: 436050 - DNA, 140 bp, Artificial Sequence
  Synthetic
caccgctgtcccaaaaggtcataacgggacatgggcgtcaaggttgggggggcaatgagggtcacttacatacaggacagaggtttcaagcctcttatgcagccactgaaaaaatgagggcatatcagcagccagggcct

SEQ ID NO: 436051 - DNA, 140 bp, Artificial Sequence
  Synthetic
atacgccatgctgggtctcccatccaggcaaaacacttgtgtgttctggcagatttgtactgtcaaccagggacctgcccaccaattcgaggtctaagaccggtagagaaatgtgcagttcgtacttgggagtcggccat

SEQ ID NO: 436052 - DNA, 140 bp, Artificial Sequence
  Synthetic
atggccgactcccaagtacgaactgcacatttctctaccggtcttagacctcgaattggtgggcaggtccctggttgacagtacaaatctgccagaacacacaagtgttttgcctggatgggagacccagcatggcgtat

SEQ ID NO: 436053 - DNA, 140 bp, Artificial Sequence
  Synthetic
aggccctggctgctgatatgcacaatcaattcaaccatgacccgggatgtagtcatacccctcctcacaaacaacgatctcctaataaggatggcactattgcccgctcctattggaggggaccttttgggacagcggtg

SEQ ID NO: 436054 - DNA, 140 bp, Artificial Sequence
  Synthetic
caccgctgtcccaaaaggtcccctccaataggagcgggcaatagtgccatccttattaggagatcgttgtttgtgaggaggggtatgactacatcccgggtcatggttgaattgattgtgcatatcagcagccagggcct

SEQ ID NO: 436055 - DNA, 140 bp, Artificial Sequence
  Synthetic
atacgccatgctgggtctccgtgaaccttgtataccccagatacagcaacttcatatctactgaatcttatttggttatgacagatctcaaggctaaccggctaatgaatcctgaaaagacgtacttgggagtcggccat

SEQ ID NO: 436056 - DNA, 140 bp, Artificial Sequence
  Synthetic
atggccgactcccaagtacgtcttttcaggattcattagccggttagccttgagatctgtcataaccaaataagattcagtagatatgaagttgctgtatctggggtatacaaggttcacggagacccagcatggcgtat

SEQ ID NO: 436057 - DNA, 140 bp, Artificial Sequence
  Synthetic
atacgccatgctgggtctccagacgcagttagtagaggtgatatcaatcctactctgaaaaaacttacacctatagagcaggtgctgatcaattgcgggttggcaattaacggacctaaacgtacttgggagtcggccat

SEQ ID NO: 436058 - DNA, 140 bp, Artificial Sequence
  Synthetic
atggccgactcccaagtacgtttaggtccgttaattgccaacccgcaattgatcagcacctgctctataggtgtaagttttttcagagtaggattgatatcacctctactaactgcgtctggagacccagcatggcgtat

SEQ ID NO: 436059 - DNA, 140 bp, Artificial Sequence
  Synthetic
aggccctggctgctgatatgatccttgagagtcccatatattggttctaccactgatgagagaacagacatgaagcttgccttcgtaagagccccaagtcgatccttgcgatctgctgttgaccttttgggacagcggtg

SEQ ID NO: 436060 - DNA, 140 bp, Artificial Sequence
  Synthetic
caccgctgtcccaaaaggtcaacagcagatcgcaaggatcgacttggggctcttacgaaggcaagcttcatgtctgttctctcatcagtggtagaaccaatatatgggactctcaaggatcatatcagcagccagggcct

SEQ ID NO: 436061 - DNA, 140 bp, Artificial Sequence
  Synthetic
aggccctggctgctgatatgtgaagcttgccttcgtaagagccccaagtcgatccttgcgatctgctgttagaatagcaacagtgtactcatgggcttacggtgatgatgacagctcttggaccttttgggacagcggtg

SEQ ID NO: 436062 - DNA, 140 bp, Artificial Sequence
  Synthetic
caccgctgtcccaaaaggtccaagagctgtcatcatcaccgtaagcccatgagtacactgttgctattctaacagcagatcgcaaggatcgacttggggctcttacgaaggcaagcttcacatatcagcagccagggcct

SEQ ID NO: 436063 - DNA, 140 bp, Artificial Sequence
  Synthetic
atacgccatgctgggtctccaaacacattattatagtaccaatccctggagattcctcaattaccactcgatccagactactggaccggttggtcaggttaattggaaacccggatgtgacgtacttgggagtcggccat

SEQ ID NO: 436064 - DNA, 140 bp, Artificial Sequence
  Synthetic
atggccgactcccaagtacgtcacatccgggtttccaattaacctgaccaaccggtccagtagtctggatcgagtggtaattgaggaatctccagggattggtactataataatgtgtttggagacccagcatggcgtat

SEQ ID NO: 436065 - DNA, 140 bp, Artificial Sequence
  Synthetic
atacgccatgctgggtctcccagacaagaaggttgacactaactttatataccaacaaggaatgcttctagggttgggtgttttagaaacattgtttcgactcgagaaagacacaggatccgtacttgggagtcggccat

SEQ ID NO: 436066 - DNA, 140 bp, Artificial Sequence
  Synthetic
atggccgactcccaagtacggatcctgtgtctttctcgagtcgaaacaatgtttctaaaacacccaaccctagaagcattccttgttggtatataaagttagtgtcaaccttcttgtctgggagacccagcatggcgtat

SEQ ID NO: 436067 - DNA, 140 bp, Artificial Sequence
  Synthetic
aggccctggctgctgatatgggttggatgtggtgaggaacaggattgccgaggacctctccttacgccgattcatggtcgctctaatcctggatatcaagaggacacccgggaacaaaccgaccttttgggacagcggtg

SEQ ID NO: 436068 - DNA, 140 bp, Artificial Sequence
  Synthetic
caccgctgtcccaaaaggtcggtttgttcccgggtgtcctcttgatatccaggattagagcgaccatgaatcggcgtaaggagaggtcctcggcaatcctgttcctcaccacatccaacccatatcagcagccagggcct

SEQ ID NO: 436069 - DNA, 140 bp, Artificial Sequence
  Synthetic
atacgccatgctgggtctccaaggagtgtttaaggtgcttgtcaatgctctaagccacccaaagatctacaagaaattctggcattgcggtattatagagcctatccatggtccttcactcgtacttgggagtcggccat

SEQ ID NO: 436070 - DNA, 140 bp, Artificial Sequence
  Synthetic
atggccgactcccaagtacgagtgaaggaccatggataggctctataataccgcaatgccagaatttcttgtagatctttgggtggcttagagcattgacaagcaccttaaacactccttggagacccagcatggcgtat

SEQ ID NO: 436071 - DNA, 140 bp, Artificial Sequence
  Synthetic
atacgccatgctgggtctccggcaagagatggtgaggaggtcagctgggaaagtcagttccacattagcatctgaactcggtatcactgctgaggatgcaaggcttgtttcagagattgccgtacttgggagtcggccat

SEQ ID NO: 436072 - DNA, 140 bp, Artificial Sequence
  Synthetic
atggccgactcccaagtacggcaatctctgaaacaagccttgcatcctcagcagtgataccgagttcagatgctaatgtggaactgactttcccagctgacctcctcaccatctcttgccggagacccagcatggcgtat

SEQ ID NO: 436073 - DNA, 140 bp, Artificial Sequence
  Synthetic
atacgccatgctgggtctcccatccaggcaaaacacttgtgtgttctggcagatctgtactgtcaaccagggacctgcccaccaattcgaggtcttaggccggtagagaaatgtgcagttcgtacttgggagtcggccat

SEQ ID NO: 436074 - DNA, 140 bp, Artificial Sequence
  Synthetic
atggccgactcccaagtacgaactgcacatttctctaccggcctaagacctcgaattggtgggcaggtccctggttgacagtacagatctgccagaacacacaagtgttttgcctggatgggagacccagcatggcgtat

SEQ ID NO: 436075 - DNA, 140 bp, Artificial Sequence
  Synthetic
atacgccatgctgggtctccacccgcaaggaagaggaggcaggcagttcgggtctcagcaaaccatgcctctcagcaattggatcaactgaaggcagtgcacctcgcatctgcggtcaggcgtacttgggagtcggccat

SEQ ID NO: 436076 - DNA, 140 bp, Artificial Sequence
  Synthetic
atggccgactcccaagtacgcctgaccgcagatgcgaggtgcactgccttcagttgatccaattgctgagaggcatggtttgctgagacccgaactgcctgcctcctcttccttgcgggtggagacccagcatggcgtat

SEQ ID NO: 436077 - DNA, 140 bp, Artificial Sequence
  Synthetic
aggccctggctgctgatatgagaggcaacaacttcccgaagcttgggaaaactctcaatgttcctccgcccccgaaccccggtagggccagcacttccgagacacccattaaaaaggggagaccttttgggacagcggtg

SEQ ID NO: 436078 - DNA, 140 bp, Artificial Sequence
  Synthetic
caccgctgtcccaaaaggtctcccctttttaatgggtgtctcggaagtgctggccctaccggggttcgggggcggaggaacattgagagttttcccaagcttcgggaagttgttgcctctcatatcagcagccagggcct

SEQ ID NO: 436079 - DNA, 140 bp, Artificial Sequence
  Synthetic
atacgccatgctgggtctcccttgggcaaaataggatcaatactggtgattaagcttatgcctttcagcggggattttgttcagggatttataagttatgtagggtctcattatagagagcgtacttgggagtcggccat

SEQ ID NO: 436080 - DNA, 140 bp, Artificial Sequence
  Synthetic
atggccgactcccaagtacgctctctataatgagaccctacataacttataaatccctgaacaaaatccccgctgaaaggcataagcttaatcaccagtattgatcctattttgcccaagggagacccagcatggcgtat

SEQ ID NO: 436081 - DNA, 140 bp, Artificial Sequence
  Synthetic
aggccctggctgctgatatgccaagacatcaaaacagccttggccaaaatacacgaggataatcagaagataatctccaagctagaatcactgctgttattgaagggagaagttgagtcagaccttttgggacagcggtg

SEQ ID NO: 436082 - DNA, 140 bp, Artificial Sequence
  Synthetic
caccgctgtcccaaaaggtctgactcaacttctcccttcaataacagcagtgattctagcttggagattatcttctgattatcctcgtgtattttggccaaggctgttttgatgtcttggcatatcagcagccagggcct

SEQ ID NO: 436083 - DNA, 140 bp, Artificial Sequence
  Synthetic
atacgccatgctgggtctccctgtgcaaagaattgatccaccatgatgttgcctcagggcaagatggattgcttaactctatactcatcctctacagggagttggcaagattcaaagacacgtacttgggagtcggccat

SEQ ID NO: 436084 - DNA, 140 bp, Artificial Sequence
  Synthetic
atggccgactcccaagtacgtgtctttgaatcttgccaactccctgtagaggatgagtatagagttaagcaatccatcttgccctgaggcaacatcatggtggatcaattctttgcacagggagacccagcatggcgtat

SEQ ID NO: 436085 - DNA, 140 bp, Artificial Sequence
  Synthetic
atacgccatgctgggtctccaccaaagaagtcaacaagggatgttccacgcttaccccgtattggtaagtagcaggcaacgagaacttatatctaggatcacccgcaaattttgggggcacgtacttgggagtcggccat

SEQ ID NO: 436086 - DNA, 140 bp, Artificial Sequence
  Synthetic
atggccgactcccaagtacgtgcccccaaaatttgcgggtgatcctagatataagttctcgttgcctgctacttaccaatacggggtaagcgtggaacatcccttgttgacttctttggtggagacccagcatggcgtat

SEQ ID NO: 436087 - DNA, 140 bp, Artificial Sequence
  Synthetic
atacgccatgctgggtctcctattcttctttattccgggaacagaaagttgataaatcggtttgtccagaatctcaagtccggttatctgatactagatttacaccagaatatcttcgttcgtacttgggagtcggccat

SEQ ID NO: 436088 - DNA, 140 bp, Artificial Sequence
  Synthetic
atggccgactcccaagtacgaacgaagatattctggtgtaaatctagtatcagataaccggacttgagattctggacaaaccgatttatcaactttctgttcccggaataaagaagaataggagacccagcatggcgtat

SEQ ID NO: 436089 - DNA, 140 bp, Artificial Sequence
  Synthetic
aggccctggctgctgatatgaagaatctatccaagtcagagaaacagattattatgacggggggtttaaaacgtgagtgggtttttaaggtaacagtcaaggagaccaaagaatggtatagaccttttgggacagcggtg

SEQ ID NO: 436090 - DNA, 140 bp, Artificial Sequence
  Synthetic
caccgctgtcccaaaaggtctataccattctttggtctccttgactgttaccttaaaaacccactcacgttttaaaccccccgtcataataatctgtttctctgacttggatagattcttcatatcagcagccagggcct

SEQ ID NO: 436091 - DNA, 140 bp, Artificial Sequence
  Synthetic
atacgccatgctgggtctccaccaaacaaagttgggtaaggatagttcaatcaatgatcatcttctagtgcacttaggattcaagatcctattatcagggacaagagcaggattagggatcgtacttgggagtcggccat

SEQ ID NO: 436092 - DNA, 140 bp, Artificial Sequence
  Synthetic
atggccgactcccaagtacgatccctaatcctgctcttgtccctgataataggatcttgaatcctaagtgcactagaagatgatcattgattgaactatccttacccaactttgtttggtggagacccagcatggcgtat

SEQ ID NO: 436093 - DNA, 140 bp, Artificial Sequence
  Synthetic
atacgccatgctgggtctccccaagtgtgcaatgcggttaatctgataccgctggataccccgcagaggttccgtgttgtttatatgagcatcacccgtctttcggataacgggtattaccgtacttgggagtcggccat

SEQ ID NO: 436094 - DNA, 140 bp, Artificial Sequence
  Synthetic
atggccgactcccaagtacggtaatacccgttatccgaaagacgggtgatgctcatataaacaacacggaacctctgcggggtatccagcggtatcagattaaccgcattgcacacttggggagacccagcatggcgtat

SEQ ID NO: 436095 - DNA, 140 bp, Artificial Sequence
  Synthetic
atacgccatgctgggtctccaccgttcctagaagaatgctagaattcagatcggtcaatgcagtggctttcaacctgctggtgacccttaggattgacaaagcgattggccctgggaagacgtacttgggagtcggccat

SEQ ID NO: 436096 - DNA, 140 bp, Artificial Sequence
  Synthetic
atggccgactcccaagtacgtcttcccagggccaatcgctttgtcaatcctaagggtcaccagcaggttgaaagccactgcattgaccgatctgaattctagcattcttctaggaacggtggagacccagcatggcgtat

SEQ ID NO: 436097 - DNA, 140 bp, Artificial Sequence
  Synthetic
atacgccatgctgggtctccgtacacccaacaaagaagggtagttggtgaatttagattggagagaaaatggttggatgtggtgaggaacaggattgccgaggacctctccttacgccgacgtacttgggagtcggccat

SEQ ID NO: 436098 - DNA, 140 bp, Artificial Sequence
  Synthetic
atggccgactcccaagtacgtcggcgtaaggagaggtcctcggcaatcctgttcctcaccacatccaaccattttctctccaatctaaattcaccaactacccttctttgttgggtgtacggagacccagcatggcgtat

SEQ ID NO: 436099 - DNA, 140 bp, Artificial Sequence
  Synthetic
aggccctggctgctgatatgggttggatgtggtgaggaacaggattgccgaggacctctccttacgccgattcatggtcgctctaatcctggatatcaagagaacacccggaaacaaaccgaccttttgggacagcggtg

SEQ ID NO: 436100 - DNA, 140 bp, Artificial Sequence
  Synthetic
caccgctgtcccaaaaggtcggtttgtttccgggtgttctcttgatatccaggattagagcgaccatgaatcggcgtaaggagaggtcctcggcaatcctgttcctcaccacatccaacccatatcagcagccagggcct

SEQ ID NO: 436101 - DNA, 140 bp, Artificial Sequence
  Synthetic
atacgccatgctgggtctcccctgctcttggactgcatgaatttgctggtgagttatccacacttgagtccttgatgaacctttaccagcaaatgggggaaactgcaccctacatggtaacgtacttgggagtcggccat

SEQ ID NO: 436102 - DNA, 140 bp, Artificial Sequence
  Synthetic
atggccgactcccaagtacgttaccatgtagggtgcagtttcccccatttgctggtaaaggttcatcaaggactcaagtgtggataactcaccagcaaattcatgcagtccaagagcaggggagacccagcatggcgtat

SEQ ID NO: 436103 - DNA, 140 bp, Artificial Sequence
  Synthetic
atacgccatgctgggtctccgacgtgatcataaatgatgaccaaggactattcaaagttctgtagaccgtagtgcccagcaatacccgaaaacgacccccctcataatgacagccagaagcgtacttgggagtcggccat

SEQ ID NO: 436104 - DNA, 140 bp, Artificial Sequence
  Synthetic
atggccgactcccaagtacgcttctggctgtcattatgaggggggtcgttttcgggtattgctgggcactacggtctacagaactttgaatagtccttggtcatcatttatgatcacgtcggagacccagcatggcgtat

SEQ ID NO: 436105 - DNA, 140 bp, Artificial Sequence
  Synthetic
aggccctggctgctgatatgctctggagctatgccatgggagtaggagtggaacttgaaaactccatgggaggtttgaactttggccgatcttactttgatccagcatattttagattaggaccttttgggacagcggtg

SEQ ID NO: 436106 - DNA, 140 bp, Artificial Sequence
  Synthetic
caccgctgtcccaaaaggtcctaatctaaaatatgctggatcaaagtaagatcggccaaagttcaaacctcccatggagttttcaagttccactcctactcccatggcatagctccagagcatatcagcagccagggcct

SEQ ID NO: 436107 - DNA, 140 bp, Artificial Sequence
  Synthetic
atacgccatgctgggtctccgcccggacaaaaaagccccctccaaaagactccacggaccaagtgagaggccagccagcagctgacggcaagcgtgaacaccaggcggcctgggcacagacgtacttgggagtcggccat

SEQ ID NO: 436108 - DNA, 140 bp, Artificial Sequence
  Synthetic
atggccgactcccaagtacgtctgtgcccaggccgcctggtgttcacgcttgccgtcagctgctggctggcctctcacttggtccgtggagtcttttggagggggcttttttgtccgggcggagacccagcatggcgtat

SEQ ID NO: 436109 - DNA, 140 bp, Artificial Sequence
  Synthetic
atacgccatgctgggtctccacagccccgacacaaggcaaccaccagccatcccaatctgcgtcctcctcgtgggacccccgaggaccaacccccaaggtcgcccccgacccagaccacccgtacttgggagtcggccat

SEQ ID NO: 436110 - DNA, 140 bp, Artificial Sequence
  Synthetic
atggccgactcccaagtacgggtggtctgggtcgggggcgaccttgggggttggtcctcgggggtcccacgaggaggacgcagattgggatggctggtggttgccttgtgtcggggctgtggagacccagcatggcgtat

SEQ ID NO: 436111 - DNA, 140 bp, Artificial Sequence
  Synthetic
atacgccatgctgggtctccaatgcatactactgaggacaagatcagtagagcggttggacccagacaagcccaagtatcatttctacacggtgatcaaagtgagaatgagctaccgagacgtacttgggagtcggccat

SEQ ID NO: 436112 - DNA, 140 bp, Artificial Sequence
  Synthetic
atggccgactcccaagtacgtctcggtagctcattctcactttgatcaccgtgtagaaatgatacttgggcttgtctgggtccaaccgctctactgatcttgtcctcagtagtatgcattggagacccagcatggcgtat

SEQ ID NO: 436113 - DNA, 140 bp, Artificial Sequence
  Synthetic
atacgccatgctgggtctccaaccgcatccccacagcccccgggaaagagacccccagcaactggaaggcccctccccctttccctcaacgcaagaactccacaaccgaaccgcacaagccgtacttgggagtcggccat

SEQ ID NO: 436114 - DNA, 140 bp, Artificial Sequence
  Synthetic
atggccgactcccaagtacggcttgtgcggttcggttgtggagttcttgcgttgagggaaagggggaggggccttccagttgctgggggtctctttcccgggggctgtggggatgcggttggagacccagcatggcgtat

SEQ ID NO: 436115 - DNA, 140 bp, Artificial Sequence
  Synthetic
atacgccatgctgggtctccttggggggcaaggaagataggagggtcaaacagagtcgaggagaagccagggagagctacagagaaaccgggcccagcagagcaagtgatgcgagagctgcgtacttgggagtcggccat

SEQ ID NO: 436116 - DNA, 140 bp, Artificial Sequence
  Synthetic
atggccgactcccaagtacgcagctctcgcatcacttgctctgctgggcccggtttctctgtagctctccctggcttctcctcgactctgtttgaccctcctatcttccttgccccccaaggagacccagcatggcgtat

SEQ ID NO: 436117 - DNA, 140 bp, Artificial Sequence
  Synthetic
atacgccatgctgggtctcccccatcttccaaccggcacacccctagacattgacactgcatcggagtccagccaagatccgcaggacagtcgaaggtcagctgacgccctgcttaggctcgtacttgggagtcggccat

SEQ ID NO: 436118 - DNA, 140 bp, Artificial Sequence
  Synthetic
atggccgactcccaagtacgagcctaagcagggcgtcagctgaccttcgactgtcctgcggatcttggctggactccgatgcagtgtcaatgtctaggggtgtgccggttggaagatgggggagacccagcatggcgtat

SEQ ID NO: 436119 - DNA, 140 bp, Artificial Sequence
  Synthetic
atacgccatgctgggtctccgcaagccatggcaggaatctcggaagaacaaggctcagacacggacacccctatagtgtacaatgacagaaatcttctagactaggtgcgagaggccgagcgtacttgggagtcggccat

SEQ ID NO: 436120 - DNA, 140 bp, Artificial Sequence
  Synthetic
atggccgactcccaagtacgctcggcctctcgcacctagtctagaagatttctgtcattgtacactataggggtgtccgtgtctgagccttgttcttccgagattcctgccatggcttgcggagacccagcatggcgtat

SEQ ID NO: 436121 - DNA, 140 bp, Artificial Sequence
  Synthetic
atacgccatgctgggtctcccacaccaaccctcgaacagacccagcacccagccatcgacaattcaagacggggggccccccccaaaaaaaggcccccaggggccgacagccagcaccgccgtacttgggagtcggccat

SEQ ID NO: 436122 - DNA, 140 bp, Artificial Sequence
  Synthetic
atggccgactcccaagtacggcggtgctggctgtcggcccctgggggcctttttttggggggggccccccgtcttgaattgtcgatggctgggtgctgggtctgttcgagggttggtgtgggagacccagcatggcgtat

SEQ ID NO: 436123 - DNA, 140 bp, Artificial Sequence
  Synthetic
atacgccatgctgggtctccgaccagaacaacatccgcctaccctccatcattgttataaaaaacttaggaaccaggtccacacagccgccagcccatcaaccatccactcccacgattgcgtacttgggagtcggccat

SEQ ID NO: 436124 - DNA, 140 bp, Artificial Sequence
  Synthetic
atggccgactcccaagtacgcaatcgtgggagtggatggttgatgggctggcggctgtgtggacctggttcctaagttttttataacaatgatggagggtaggcggatgttgttctggtcggagacccagcatggcgtat

SEQ ID NO: 436125 - DNA, 140 bp, Artificial Sequence
  Synthetic
atacgccatgctgggtctccgaggaagcccacccaccccacacacgaccacaggaaccgaaccagaatccagaccaccctgggccaccagttcccagactcggccatcaccccgcagaaacgtacttgggagtcggccat

SEQ ID NO: 436126 - DNA, 140 bp, Artificial Sequence
  Synthetic
atggccgactcccaagtacgtttctgcggggtgatggccgagtctgggaactggtggcccagggtggtctggattctggttcggttcctgtggtcgtgtgtggggtgggtgggcttcctcggagacccagcatggcgtat

SEQ ID NO: 436127 - DNA, 140 bp, Artificial Sequence
  Synthetic
atacgccatgctgggtctccgagccgatggcagaagagcaggcacgccatgtcaaaaacggactggaatgcatccgggctctcaaggccgagcccatcggctcactggccatcgaggaagcgtacttgggagtcggccat

SEQ ID NO: 436128 - DNA, 140 bp, Artificial Sequence
  Synthetic
atggccgactcccaagtacgcttcctcgatggccagtgagccgatgggctcggccttgagagcccggatgcattccagtccgtttttgacatggcgtgcctgctcttctgccatcggctcggagacccagcatggcgtat

SEQ ID NO: 436129 - DNA, 140 bp, Artificial Sequence
  Synthetic
aggccctggctgctgatatgcatccgggctctcaaggccgagcccatcggctcactggccatcgaggaagctatggcagcatggtcagaaatatcagacaacccaggacaggagcgagccgaccttttgggacagcggtg

SEQ ID NO: 436130 - DNA, 140 bp, Artificial Sequence
  Synthetic
caccgctgtcccaaaaggtcggctcgctcctgtcctgggttgtctgatatttctgaccatgctgccatagcttcctcgatggccagtgagccgatgggctcggccttgagagcccggatgcatatcagcagccagggcct

SEQ ID NO: 436131 - DNA, 140 bp, Artificial Sequence
  Synthetic
atacgccatgctgggtctccacctgcagggaagagaaggcaggcagttcgggtctcagcaaaccatgcctctcagcaattggatcaactgaaggcggtgcacctcgcatccgcggtcaggcgtacttgggagtcggccat

SEQ ID NO: 436132 - DNA, 140 bp, Artificial Sequence
  Synthetic
atggccgactcccaagtacgcctgaccgcggatgcgaggtgcaccgccttcagttgatccaattgctgagaggcatggtttgctgagacccgaactgcctgccttctcttccctgcaggtggagacccagcatggcgtat

SEQ ID NO: 436133 - DNA, 140 bp, Artificial Sequence
  Synthetic
atacgccatgctgggtctccgacctggagagagcgatgacgacgctgaaactttgggaatccccccaagaaatctccaggcatcaagcactgggttacagtgttattatgtttatgatcacgtacttgggagtcggccat

SEQ ID NO: 436134 - DNA, 140 bp, Artificial Sequence
  Synthetic
atggccgactcccaagtacgtgatcataaacataataacactgtaacccagtgcttgatgcctggagatttcttggggggattcccaaagtttcagcgtcgtcatcgctctctccaggtcggagacccagcatggcgtat

SEQ ID NO: 436135 - DNA, 140 bp, Artificial Sequence
  Synthetic
aggccctggctgctgatatgcactgaccggggatctgctcccatctctatggggttcagggcttctgatgttgaaactgcagaaggaggggagatccacgagctcctgagactccaatccgaccttttgggacagcggtg

SEQ ID NO: 436136 - DNA, 140 bp, Artificial Sequence
  Synthetic
caccgctgtcccaaaaggtcggattggagtctcaggagctcgtggatctcccctccttctgcagtttcaacatcagaagccctgaaccccatagagatgggagcagatccccggtcagtgcatatcagcagccagggcct

SEQ ID NO: 436137 - DNA, 140 bp, Artificial Sequence
  Synthetic
atacgccatgctgggtctccttgaaactgcagaaggaggggagatccacgagctcctgagactccaatccagaggcaacaactttccgaagcttgggaaaactctcaatgttcctccgcccgtacttgggagtcggccat

SEQ ID NO: 436138 - DNA, 140 bp, Artificial Sequence
  Synthetic
atggccgactcccaagtacgggcggaggaacattgagagttttcccaagcttcggaaagttgttgcctctggattggagtctcaggagctcgtggatctcccctccttctgcagtttcaaggagacccagcatggcgtat

SEQ ID NO: 436139 - DNA, 140 bp, Artificial Sequence
  Synthetic
atacgccatgctgggtctcccccggaccccggtagggccagcacttccgggacacccattaaaaagggcacagagcgcagattagcctcatttggaacggagatcgcgtctttattgacacgtacttgggagtcggccat

SEQ ID NO: 436140 - DNA, 140 bp, Artificial Sequence
  Synthetic
atggccgactcccaagtacgtgtcaataaagacgcgatctccgttccaaatgaggctaatctgcgctctgtgccctttttaatgggtgtcccggaagtgctggccctaccggggtccgggggagacccagcatggcgtat

SEQ ID NO: 436141 - DNA, 140 bp, Artificial Sequence
  Synthetic
atacgccatgctgggtctcctacaggagtggacacccgaatctggtaccacaatctccccgagatcccagaataatgaagaagggggagactattatgatgatgagctgttctctgatgtcgtacttgggagtcggccat

SEQ ID NO: 436142 - DNA, 140 bp, Artificial Sequence
  Synthetic
atggccgactcccaagtacgacatcagagaacagctcatcatcataatagtctcccccttcttcattattctgggatctcggggagattgtggtaccagattcgggtgtccactcctgtaggagacccagcatggcgtat

SEQ ID NO: 436143 - DNA, 140 bp, Artificial Sequence
  Synthetic
atacgccatgctgggtctccccaagatattaaaacagccttggccaaaatacacgaggataatcagaagataatctccaagctagaatcactgctgttattgaagggagaagttgagtcacgtacttgggagtcggccat

SEQ ID NO: 436144 - DNA, 140 bp, Artificial Sequence
  Synthetic
atggccgactcccaagtacgtgactcaacttctcccttcaataacagcagtgattctagcttggagattatcttctgattatcctcgtgtattttggccaaggctgttttaatatcttggggagacccagcatggcgtat

SEQ ID NO: 436145 - DNA, 140 bp, Artificial Sequence
  Synthetic
aggccctggctgctgatatgtaatctccaagctagaatcactgctgttattgaagggagaagttgagtcaattaagaagcagatcaacaggcaaaatatcagcatatccaccctggaagggaccttttgggacagcggtg

SEQ ID NO: 436146 - DNA, 140 bp, Artificial Sequence
  Synthetic
caccgctgtcccaaaaggtcccttccagggtggatatgctgatattttgcctgttgatctgcttcttaattgactcaacttctcccttcaataacagcagtgattctagcttggagattacatatcagcagccagggcct

SEQ ID NO: 436147 - DNA, 140 bp, Artificial Sequence
  Synthetic
atacgccatgctgggtctccgttgctgcagggggcgttgtaacaaaaagggagaacaagttggtatgtcaagaccaggcctaaagcctgatcttacaggaacatcaaaatcctatgtaagcgtacttgggagtcggccat

SEQ ID NO: 436148 - DNA, 140 bp, Artificial Sequence
  Synthetic
atggccgactcccaagtacgcttacataggattttgatgttcctgtaagatcaggctttaggcctggtcttgacataccaacttgttctccctttttgttacaacgccccctgcagcaacggagacccagcatggcgtat

SEQ ID NO: 436149 - DNA, 140 bp, Artificial Sequence
  Synthetic
aggccctggctgctgatatgggcagagattcaggccgagcactggccgaagttctcaagaaacccgttgccagccgacaactccaaggaatgacaaatggacggaccagttccagaggacgaccttttgggacagcggtg

SEQ ID NO: 436150 - DNA, 140 bp, Artificial Sequence
  Synthetic
caccgctgtcccaaaaggtcgtcctctggaactggtccgtccatttgtcattccttggagttgtcggctggcaacgggtttcttgagaacttcggccagtgctcggcctgaatctctgcccatatcagcagccagggcct

SEQ ID NO: 436151 - DNA, 140 bp, Artificial Sequence
  Synthetic
aggccctggctgctgatatgacgacttcgacaagtcggcatgggacatcaaagggtcgatcgctccgatacaacccaccacctacagtgatggcaggctggtgccccaggtcagagtcatgaccttttgggacagcggtg

SEQ ID NO: 436152 - DNA, 140 bp, Artificial Sequence
  Synthetic
caccgctgtcccaaaaggtcatgactctgacctggggcaccagcctgccatcactgtaggtggtgggttgtatcggagcgatcgaccctttgatgtcccatgccgacttgtcgaagtcgtcatatcagcagccagggcct

SEQ ID NO: 436153 - DNA, 140 bp, Artificial Sequence
  Synthetic
atacgccatgctgggtctcctcaataactgcacgagggtagagattgcagaatacaggagactactgagaacagttttggaaccaattagagatgcacttaatgcaatgacccagaatatcgtacttgggagtcggccat

SEQ ID NO: 436154 - DNA, 140 bp, Artificial Sequence
  Synthetic
atggccgactcccaagtacgatattctgggtcattgcattaagtgcatctctaattggttccaaaactgttctcagtagtctcctgtattctgcaatctctaccctcgtgcagttattgaggagacccagcatggcgtat

SEQ ID NO: 436155 - DNA, 140 bp, Artificial Sequence
  Synthetic
aggccctggctgctgatatgctcacaccttggagaaaggtcctaacaacagggagtgtcttcaacgcaaaccaagtgtgcaatgcggttaatctgataccgctcgataccccgcagaggtgaccttttgggacagcggtg

SEQ ID NO: 436156 - DNA, 140 bp, Artificial Sequence
  Synthetic
caccgctgtcccaaaaggtcacctctgcggggtatcgagcggtatcagattaaccgcattgcacacttggtttgcgttgaagacactccctgttgttaggacctttctccaaggtgtgagcatatcagcagccagggcct

SEQ ID NO: 436157 - DNA, 140 bp, Artificial Sequence
  Synthetic
aggccctggctgctgatatgtccgtgttgtttatatgagcatcacccgtctttcggataacgggtattacaccgttcctagaagaatgctggaattcagatcggtcaatgcagtggccttgaccttttgggacagcggtg

SEQ ID NO: 436158 - DNA, 140 bp, Artificial Sequence
  Synthetic
caccgctgtcccaaaaggtcaaggccactgcattgaccgatctgaattccagcattcttctaggaacggtgtaatacccgttatccgaaagacgggtgatgctcatataaacaacacggacatatcagcagccagggcct

SEQ ID NO: 436159 - DNA, 140 bp, Artificial Sequence
  Synthetic
aggccctggctgctgatatggaaatccccaaccgacatgcaatcctgggtccccctatcaacggatgatccagtgatagacaggctctacctctcatctcacagaggcgttatcgctgacgaccttttgggacagcggtg

SEQ ID NO: 436160 - DNA, 140 bp, Artificial Sequence
  Synthetic
caccgctgtcccaaaaggtcgtcagcgataacgcctctgtgagatgagaggtagagcctgtctatcactggatcatccgttgatagggggacccaggattgcatgtcggttggggatttccatatcagcagccagggcct

SEQ ID NO: 436161 - DNA, 140 bp, Artificial Sequence
  Synthetic
aggccctggctgctgatatgcaacctgctggtgacccttaggattgacaaggcgataggccctgggaagatcatcgacaatacagagcaacttcctgaggcaacatttatggtccacatcgaccttttgggacagcggtg

SEQ ID NO: 436162 - DNA, 140 bp, Artificial Sequence
  Synthetic
caccgctgtcccaaaaggtcgatgtggaccataaatgttgcctcaggaagttgctctgtattgtcgatgatcttcccagggcctatcgccttgtcaatcctaagggtcaccagcaggttgcatatcagcagccagggcct

SEQ ID NO: 436163 - DNA, 140 bp, Artificial Sequence
  Synthetic
aggccctggctgctgatatggcaccagtcttcacattagaagcacaggcaaaatgagcaagactctccatgcacaactcgggttcaagaagaccttatgttacccgctgatggatatcaagaccttttgggacagcggtg

SEQ ID NO: 436164 - DNA, 140 bp, Artificial Sequence
  Synthetic
caccgctgtcccaaaaggtcttgatatccatcagcgggtaacataaggtcttcttgaacccgagttgtgcatggagagtcttgctcattttgcctgtgcttctaatgtgaagactggtgccatatcagcagccagggcct

SEQ ID NO: 436165 - DNA, 140 bp, Artificial Sequence
  Synthetic
atacgccatgctgggtctccccactgctttactgaaatacatgatgttcttgaccaaaacgggttttctgatgaaggtacttatcatgagttaattgaagctctagattacattttcatacgtacttgggagtcggccat

SEQ ID NO: 436166 - DNA, 140 bp, Artificial Sequence
  Synthetic
atggccgactcccaagtacgtatgaaaatgtaatctagagcttcaattaactcatgataagtaccttcatcagaaaacccgttttggtcaagaacatcatgtatttcagtaaagcagtggggagacccagcatggcgtat

SEQ ID NO: 436167 - DNA, 140 bp, Artificial Sequence
  Synthetic
atacgccatgctgggtctccacagccctgatacaaggccaccaccagccaccccaatctgcatcctcctcgtgggacccccgaggaccaacccccaaggctgcccccgatccaaaccacccgtacttgggagtcggccat

SEQ ID NO: 436168 - DNA, 140 bp, Artificial Sequence
  Synthetic
atggccgactcccaagtacgggtggtttggatcgggggcagccttgggggttggtcctcgggggtcccacgaggaggatgcagattggggtggctggtggtggccttgtatcagggctgtggagacccagcatggcgtat

SEQ ID NO: 436169 - DNA, 140 bp, Artificial Sequence
  Synthetic
atacgccatgctgggtctccaaccgcatccccaccacccccgggaaagaaacccccagcaattggaaggcccctccccctcttcctcaacacaagaactccacaaccgaaccgcacaagccgtacttgggagtcggccat

SEQ ID NO: 436170 - DNA, 140 bp, Artificial Sequence
  Synthetic
atggccgactcccaagtacggcttgtgcggttcggttgtggagttcttgtgttgaggaagagggggaggggccttccaattgctgggggtttctttcccgggggtggtggggatgcggttggagacccagcatggcgtat

SEQ ID NO: 436171 - DNA, 140 bp, Artificial Sequence
  Synthetic
atacgccatgctgggtctccgaccgaggtgacccaaccgcgcggcatccgactccctagacagatcctctctccccggcaaactaaacaaaacttagggccaaggaacatacacacccaacgtacttgggagtcggccat

SEQ ID NO: 436172 - DNA, 140 bp, Artificial Sequence
  Synthetic
atggccgactcccaagtacgttgggtgtgtatgttccttggccctaagttttgtttagtttgccggggagagaggatctgtctagggagtcggatgccgcgcggttgggtcacctcggtcggagacccagcatggcgtat

SEQ ID NO: 436173 - DNA, 140 bp, Artificial Sequence
  Synthetic
aggccctggctgctgatatgcagaacccagaccccggcccacggcgccgcgcccccaacccccgacaaccagagggagcccccaaccaatcccgccggctcccccggtgcccacaggcaggaccttttgggacagcggtg

SEQ ID NO: 436174 - DNA, 140 bp, Artificial Sequence
  Synthetic
caccgctgtcccaaaaggtcctgcctgtgggcaccgggggagccggcgggattggttgggggctccctctggttgtcgggggttgggggcgcggcgccgtgggccggggtctgggttctgcatatcagcagccagggcct

SEQ ID NO: 436175 - DNA, 140 bp, Artificial Sequence
  Synthetic
aggccctggctgctgatatgggacaccaacccccgaacagacccagcacccaaccatcgacaatccaagacgggggggcccccccaaaaaaaggcccccaggggccgacagccagcaccggaccttttgggacagcggtg

SEQ ID NO: 436176 - DNA, 140 bp, Artificial Sequence
  Synthetic
caccgctgtcccaaaaggtccggtgctggctgtcggcccctgggggcctttttttgggggggcccccccgtcttggattgtcgatggttgggtgctgggtctgttcgggggttggtgtcccatatcagcagccagggcct

SEQ ID NO: 436177 - DNA, 140 bp, Artificial Sequence
  Synthetic
atacgccatgctgggtctcccgggggggcccccccaaaaaaaggcccccaggggccgacagccagcaccgcgaggaagcccacccaccccacacacgaccacggcaaccaaaccagaacccgtacttgggagtcggccat

SEQ ID NO: 436178 - DNA, 140 bp, Artificial Sequence
  Synthetic
atggccgactcccaagtacgggttctggtttggttgccgtggtcgtgtgtggggtgggtgggcttcctcgcggtgctggctgtcggcccctgggggcctttttttgggggggcccccccgggagacccagcatggcgtat

SEQ ID NO: 436179 - DNA, 140 bp, Artificial Sequence
  Synthetic
atacgccatgctgggtctcccgaggaagcccacccaccccacacacgaccacggcaaccaaaccagaacccagaccaccctggccaccagctcccagactcggccatcaccccgcagaaacgtacttgggagtcggccat

SEQ ID NO: 436180 - DNA, 140 bp, Artificial Sequence
  Synthetic
atggccgactcccaagtacgtttctgcggggtgatggccgagtctgggagctggtggccagggtggtctgggttctggtttggttgccgtggtcgtgtgtggggtgggtgggcttcctcgggagacccagcatggcgtat

SEQ ID NO: 436181 - DNA, 140 bp, Artificial Sequence
  Synthetic
atacgccatgctgggtctccgaagacgaagccaatcgcagatagggcagccagtgaactaacaacatgatttcactcagacatcaagaatacccaccagtgtggaatagacatcagaattcgtacttgggagtcggccat

SEQ ID NO: 436182 - DNA, 140 bp, Artificial Sequence
  Synthetic
atggccgactcccaagtacgaattctgatgtctattccacactggtgggtattcttgatgtctgagtgaaatcatgttgttagttcactggctgccctatctgcgattggcttcgtcttcggagacccagcatggcgtat

SEQ ID NO: 436183 - DNA, 140 bp, Artificial Sequence
  Synthetic
atacgccatgctgggtctccatgacagagaccgctatgaccattgatgctaggtatacagagcttctaggaagagtcagatacatgtggaaactgatagatggtttcttccctgcactcgcgtacttgggagtcggccat

SEQ ID NO: 436184 - DNA, 140 bp, Artificial Sequence
  Synthetic
atggccgactcccaagtacgcgagtgcagggaagaaaccatctatcagtttccacatgtatctgactcttcctagaagctctgtatacctagcatcaatggtcatagcggtctctgtcatggagacccagcatggcgtat

SEQ ID NO: 436185 - DNA, 140 bp, Artificial Sequence
  Synthetic
aggccctggctgctgatatgcaacccgaaccagcacccaagagcgatccccgaaggacccccgaaccgcaaaggacatcagtatcccacagcctctccaagtcccccggtctcctcctctgaccttttgggacagcggtg

SEQ ID NO: 436186 - DNA, 140 bp, Artificial Sequence
  Synthetic
caccgctgtcccaaaaggtcagaggaggagaccgggggacttggagaggctgtgggatactgatgtcctttgcggttcgggggtccttcggggatcgctcttgggtgctggttcgggttgcatatcagcagccagggcct

SEQ ID NO: 436187 - DNA, 140 bp, Artificial Sequence
  Synthetic
atacgccatgctgggtctcctctcgaagggaccaaaagatcaatccaccacacccgacgacactcaactccccacccctaaaggagacaccgggaatcccagaatcaagactcatccaatcgtacttgggagtcggccat

SEQ ID NO: 436188 - DNA, 140 bp, Artificial Sequence
  Synthetic
atggccgactcccaagtacgattggatgagtcttgattctgggattcccggtgtctcctttaggggtggggagttgagtgtcgtcgggtgtggtggattgatcttttggtcccttcgagaggagacccagcatggcgtat

SEQ ID NO: 436189 - DNA, 140 bp, Artificial Sequence
  Synthetic
aggccctggctgctgatatggtccatcatgggtctcaaggtgaacgtctctgccatattcatggcagtactgttaactctccaaacacccaccggtcaaatccattggggcaatctctctgaccttttgggacagcggtg

SEQ ID NO: 436190 - DNA, 140 bp, Artificial Sequence
  Synthetic
caccgctgtcccaaaaggtcagagagattgccccaatggatttgaccggtgggtgtttggagagttaacagtactgccatgaatatggcagagacgttcaccttgagacccatgatggaccatatcagcagccagggcct

SEQ ID NO: 436191 - DNA, 140 bp, Artificial Sequence
  Synthetic
atacgccatgctgggtctcccccaaaggaactgggtcacggaggcttgtaaatgttttccttaatgattcgagctttgacccatatgacatgataatgtatgttgtaagtggagcttacccgtacttgggagtcggccat

SEQ ID NO: 436192 - DNA, 140 bp, Artificial Sequence
  Synthetic
atggccgactcccaagtacgggtaagctccacttacaacatacattatcatgtcatatgggtcaaagctcgaatcattaaggaaaacatttacaagcctccgtgacccagttcctttgggggagacccagcatggcgtat

SEQ ID NO: 436193 - DNA, 140 bp, Artificial Sequence
  Synthetic
atacgccatgctgggtctccctagtgtgggatttatccattcagatatagagaccttacctaacaaagatactgtagagaagctagaggaattggcagccatcttatcaatggctctactcgtacttgggagtcggccat

SEQ ID NO: 436194 - DNA, 140 bp, Artificial Sequence
  Synthetic
atggccgactcccaagtacgagtagagccattgataagatggctgccaattcctctagcttctctacagtatctttgttaggtaaggtctctatatctgaatggataaatcccacactagggagacccagcatggcgtat

SEQ ID NO: 436195 - DNA, 140 bp, Artificial Sequence
  Synthetic
aggccctggctgctgatatgggggccagtcttaaaaacccactcccgaagcccagtccacacaagtaccaagaacgtgagagcagcaaaagggtttataggattccctcatgtaattcgggaccttttgggacagcggtg

SEQ ID NO: 436196 - DNA, 140 bp, Artificial Sequence
  Synthetic
caccgctgtcccaaaaggtcccgaattacatgagggaatcctataaacccttttgctgctctcacgttcttggtacttgtgtggactgggcttcgggagtgggtttttaagactggcccccatatcagcagccagggcct

SEQ ID NO: 436197 - DNA, 140 bp, Artificial Sequence
  Synthetic
atacgccatgctgggtctcccggccagaagctcgggctcaaattgctcagatactatacagaaatcctgtcattatttggccccagcttacgggaccccatatctgcggagatatctatccgtacttgggagtcggccat

SEQ ID NO: 436198 - DNA, 140 bp, Artificial Sequence
  Synthetic
atggccgactcccaagtacggatagatatctccgcagatatggggtcccgtaagctggggccaaataatgacaggatttctgtatagtatctgagcaatttgagcccgagcttctggccgggagacccagcatggcgtat

SEQ ID NO: 436199 - DNA, 140 bp, Artificial Sequence
  Synthetic
aggccctggctgctgatatggctagagggggtctcgtacaacataggctctcaagagtggtataccactgtgcccaagtatgttgcaacccaagggtaccttatctcgaattttgatgaggaccttttgggacagcggtg

SEQ ID NO: 436200 - DNA, 140 bp, Artificial Sequence
  Synthetic
caccgctgtcccaaaaggtcctcatcaaaattcgagataaggtacccttgggttgcaacatacttgggcacagtggtataccactcttgagagcctatgttgtacgagaccccctctagccatatcagcagccagggcct

SEQ ID NO: 436201 - DNA, 140 bp, Artificial Sequence
  Synthetic
aggccctggctgctgatatgcctgtgctcgtacactcgtatccgggtcttttgggaaccggttcattttatcacaagggaacctaatagccaattgtgcatcaatcctttgcaagtgttagaccttttgggacagcggtg

SEQ ID NO: 436202 - DNA, 140 bp, Artificial Sequence
  Synthetic
caccgctgtcccaaaaggtctaacacttgcaaaggattgatgcacaattggctattaggttcccttgtgataaaatgaaccggttcccaaaagacccggatacgagtgtacgagcacaggcatatcagcagccagggcct

SEQ ID NO: 436203 - DNA, 140 bp, Artificial Sequence
  Synthetic
atacgccatgctgggtctcccatccaagcaaaacacttgtgtgttttgacagatttgtactgtcaaccagggacctgcccaccaatccgaggtctaagaccggtagagaaatgtgcagttcgtacttgggagtcggccat

SEQ ID NO: 436204 - DNA, 140 bp, Artificial Sequence
  Synthetic
atggccgactcccaagtacgaactgcacatttctctaccggtcttagacctcggattggtgggcaggtccctggttgacagtacaaatctgtcaaaacacacaagtgttttgcttggatgggagacccagcatggcgtat

SEQ ID NO: 436205 - DNA, 140 bp, Artificial Sequence
  Synthetic
atacgccatgctgggtctcctatctccggcttccctctggccgaacaatatcggtagttaattaaaacttagggtgcaagatcatccacaatgtcaccacaacgagaccggataaatgcccgtacttgggagtcggccat

SEQ ID NO: 436206 - DNA, 140 bp, Artificial Sequence
  Synthetic
atggccgactcccaagtacgggcatttatccggtctcgttgtggtgacattgtggatgatcttgcaccctaagttttaattaactaccgatattgttcggccagagggaagccggagataggagacccagcatggcgtat

SEQ ID NO: 436207 - DNA, 140 bp, Artificial Sequence
  Synthetic
atacgccatgctgggtctccttctacaaagataacccccatcccaagggaagtaggatagtcattaacagagaacatcttatgattgatagaccttatgttttgctggctgttctgtttgcgtacttgggagtcggccat

SEQ ID NO: 436208 - DNA, 140 bp, Artificial Sequence
  Synthetic
atggccgactcccaagtacgcaaacagaacagccagcaaaacataaggtctatcaatcataagatgttctctgttaatgactatcctacttcccttgggatgggggttatctttgtagaaggagacccagcatggcgtat

SEQ ID NO: 436209 - DNA, 140 bp, Artificial Sequence
  Synthetic
aggccctggctgctgatatgttcactgacctagtgaaattcatctctgacaagattaaattccttaatccggatagggagtacgacttcagagatctcacttggtgtatcaacccgccaggaccttttgggacagcggtg

SEQ ID NO: 436210 - DNA, 140 bp, Artificial Sequence
  Synthetic
caccgctgtcccaaaaggtcctggcgggttgatacaccaagtgagatctctgaagtcgtactccctatccggattaaggaatttaatcttgtcagagatgaatttcactaggtcagtgaacatatcagcagccagggcct

SEQ ID NO: 436211 - DNA, 140 bp, Artificial Sequence
  Synthetic
aggccctggctgctgatatggagctcatgaatgcattggtgaactcaactctactggagaccagaacaaccaatcagttcctagctgtctcaaagggaaactgctcagggcccactacaagaccttttgggacagcggtg

SEQ ID NO: 436212 - DNA, 140 bp, Artificial Sequence
  Synthetic
caccgctgtcccaaaaggtcttgtagtgggccctgagcagtttccctttgagacagctaggaactgattggttgttctggtctccagtagagttgagttcaccaatgcattcatgagctccatatcagcagccagggcct

SEQ ID NO: 436213 - DNA, 140 bp, Artificial Sequence
  Synthetic
atacgccatgctgggtctcctatccaggcaaaacacttgtgtgttctagcagatttgtactgtcaaccagggacctgcccaccaattcgaggtctacgacctgtagagaaatgtgcagttcgtacttgggagtcggccat

SEQ ID NO: 436214 - DNA, 140 bp, Artificial Sequence
  Synthetic
atggccgactcccaagtacgaactgcacatttctctacaggtcgtagacctcgaattggtgggcaggtccctggttgacagtacaaatctgctagaacacacaagtgttttgcctggataggagacccagcatggcgtat

SEQ ID NO: 436215 - DNA, 140 bp, Artificial Sequence
  Synthetic
atacgccatgctgggtctccatctccggcgaggatcgatcaaacagataagattgagagttgatccaggattcatttttgacgccctcgctgaggtaaatgtcagtcagccaaagatcggcgtacttgggagtcggccat

SEQ ID NO: 436216 - DNA, 140 bp, Artificial Sequence
  Synthetic
atggccgactcccaagtacgccgatctttggctgactgacatttacctcagcgagggcgtcaaaaatgaatcctggatcaactctcaatcttatctgtttgatcgatcctcgccggagatggagacccagcatggcgtat

SEQ ID NO: 436217 - DNA, 140 bp, Artificial Sequence
  Synthetic
atacgccatgctgggtctccgcaaccagtcagtaatgatctcagcaactgtatggtggctttgggggagctcaaactcgcagccctttgtcaccgggaagattctatcacaattccctatcgtacttgggagtcggccat

SEQ ID NO: 436218 - DNA, 140 bp, Artificial Sequence
  Synthetic
atggccgactcccaagtacgatagggaattgtgatagaatcttcccggtgacaaagggctgcgagtttgagctcccccaaagccaccatacagttgctgagatcattactgactggttgcggagacccagcatggcgtat

SEQ ID NO: 436219 - DNA, 140 bp, Artificial Sequence
  Synthetic
aggccctggctgctgatatggtaggtaatattgtcaaagtgctctttaacgggaggcccgaagtcacgtgggtaggcagtgtagattgcttcaatttcatagtcagtaatatccctacctgaccttttgggacagcggtg

SEQ ID NO: 436220 - DNA, 140 bp, Artificial Sequence
  Synthetic
caccgctgtcccaaaaggtcaggtagggatattactgactatgaaattgaagcaatctacactgcctacccacgtgacttcgggcctcccgttaaagagcactttgacaatattacctaccatatcagcagccagggcct

SEQ ID NO: 436221 - DNA, 140 bp, Artificial Sequence
  Synthetic
aggccctggctgctgatatgggtaggcagtgtagattgcttcaatttcatagtcagtaatatccctacctctagtgtggggtttatccattcagatatagagaccttacctaacaaagatgaccttttgggacagcggtg

SEQ ID NO: 436222 - DNA, 140 bp, Artificial Sequence
  Synthetic
caccgctgtcccaaaaggtcatctttgttaggtaaggtctctatatctgaatggataaaccccacactagaggtagggatattactgactatgaaattgaagcaatctacactgcctacccatatcagcagccagggcct

SEQ ID NO: 436223 - DNA, 140 bp, Artificial Sequence
  Synthetic
aggccctggctgctgatatgagttccaatctggtgattctacctggtcaagatctccaatatgttttggcaacctacgatacttccagggttgaacatgctgtggtttattacgtttacagaccttttgggacagcggtg

SEQ ID NO: 436224 - DNA, 140 bp, Artificial Sequence
  Synthetic
caccgctgtcccaaaaggtctgtaaacgtaataaaccacagcatgttcaaccctggaagtatcgtaggttgccaaaacatattggagatcttgaccaggtagaatcaccagattggaactcatatcagcagccagggcct

SEQ ID NO: 436225 - DNA, 140 bp, Artificial Sequence
  Synthetic
aggccctggctgctgatatggcccaagccgctcattttcttacttttatccttttaggttgcctataaagggggtccccatcgaattacaagtggaatgcttcacatgggaccaaaaactgaccttttgggacagcggtg

SEQ ID NO: 436226 - DNA, 140 bp, Artificial Sequence
  Synthetic
caccgctgtcccaaaaggtcagtttttggtcccatgtgaagcattccacttgtaattcgatggggaccccctttataggcaacctaaaaggataaaagtaagaaaatgagcggcttgggccatatcagcagccagggcct

SEQ ID NO: 436227 - DNA, 140 bp, Artificial Sequence
  Synthetic
aggccctggctgctgatatgctggtgccgtcacttctgtgtgcttgcggactcagaatctggtggacatatcactcactctgggatggtgggcatgggagtcagctgcacagtcacccgggaccttttgggacagcggtg

SEQ ID NO: 436228 - DNA, 140 bp, Artificial Sequence
  Synthetic
caccgctgtcccaaaaggtcccgggtgactgtgcagctgactcccatgcccaccatcccagagtgagtgatatgtccaccagattctgagtccgcaagcacacagaagtgacggcaccagcatatcagcagccagggcct

SEQ ID NO: 436229 - DNA, 140 bp, Artificial Sequence
  Synthetic
aggccctggctgctgatatgaagaaaaacgtagggtccaagtggttccccgttatggactcgctatctgtcaaccagatcttataccctgaagttcacctagatagcccgatagttaccagaccttttgggacagcggtg

SEQ ID NO: 436230 - DNA, 140 bp, Artificial Sequence
  Synthetic
caccgctgtcccaaaaggtctggtaactatcgggctatctaggtgaacttcagggtataagatctggttgacagatagcgagtccataacggggaaccacttggaccctacgtttttcttcatatcagcagccagggcct

SEQ ID NO: 436231 - DNA, 140 bp, Artificial Sequence
  Synthetic
atacgccatgctgggtctccattttccaaccaaatgattataaacaatgtggaagttgggaatgtcatcaagtccaagcttaggagttatccggcccactctcatattccatatccaaatcgtacttgggagtcggccat

SEQ ID NO: 436232 - DNA, 140 bp, Artificial Sequence
  Synthetic
atggccgactcccaagtacgatttggatatggaatatgagagtgggccggataactcctaagcttggacttgatgacattcccaacttccacattgtttataatcatttggttggaaaatggagacccagcatggcgtat

SEQ ID NO: 436233 - DNA, 140 bp, Artificial Sequence
  Synthetic
atacgccatgctgggtctccaggttttccaatgcttaagggacactaactcacggcttggcctaggctccgaattgagggaggacatcaaggagaaagttattaacttgggagtttacatcgtacttgggagtcggccat

SEQ ID NO: 436234 - DNA, 140 bp, Artificial Sequence
  Synthetic
atggccgactcccaagtacgatgtaaactcccaagttaataactttctccttgatgtcctccctcaattcggagcctaggccaagccgtgagttagtgtcccttaagcattggaaaacctggagacccagcatggcgtat

SEQ ID NO: 436235 - DNA, 140 bp, Artificial Sequence
  Synthetic
aggccctggctgctgatatgctgagatgaggtcagtgattaaatcacaaacccatacttgccataggaggagacacacacctgtattcttcactggtagttcagttgagttgctaatctcgaccttttgggacagcggtg

SEQ ID NO: 436236 - DNA, 140 bp, Artificial Sequence
  Synthetic
caccgctgtcccaaaaggtcgagattagcaactcaactgaactaccagtgaagaatacaggtgtgtgtctcctcctatggcaagtatgggtttgtgatttaatcactgacctcatctcagcatatcagcagccagggcct

SEQ ID NO: 436237 - DNA, 140 bp, Artificial Sequence
  Synthetic
atacgccatgctgggtctccagacacacacctgtattcttcactggtagttcagttgagttgctaatctctcgtgaccttgttgctataatcagtaaagagtctcaacatgtatattacccgtacttgggagtcggccat

SEQ ID NO: 436238 - DNA, 140 bp, Artificial Sequence
  Synthetic
atggccgactcccaagtacgggtaatatacatgttgagactctttactgattatagcaacaaggtcacgagagattagcaactcaactgaactaccagtgaagaatacaggtgtgtgtctggagacccagcatggcgtat

SEQ ID NO: 436239 - DNA, 140 bp, Artificial Sequence
  Synthetic
aggccctggctgctgatatgaagagtcagatacatgtggaaactgatagatggtttcttccctgcactcgggaatccaacttatcaaattgtagccatgctggagcctctttcacttgctgaccttttgggacagcggtg

SEQ ID NO: 436240 - DNA, 140 bp, Artificial Sequence
  Synthetic
caccgctgtcccaaaaggtcagcaagtgaaagaggctccagcatggctacaatttgataagttggattcccgagtgcagggaagaaaccatctatcagtttccacatgtatctgactcttcatatcagcagccagggcct

SEQ ID NO: 436241 - DNA, 140 bp, Artificial Sequence
  Synthetic
atacgccatgctgggtctcccccatcctccaaccagcatgcccctagacattgacactgcatcggagtcaggccaagatccgcaggacagtcgaaggtcagctgacgctctgctcaggctcgtacttgggagtcggccat

SEQ ID NO: 436242 - DNA, 140 bp, Artificial Sequence
  Synthetic
atggccgactcccaagtacgagcctgagcagagcgtcagctgaccttcgactgtcctgcggatcttggcctgactccgatgcagtgtcaatgtctaggggcatgctggttggaggatgggggagacccagcatggcgtat

SEQ ID NO: 436243 - DNA, 140 bp, Artificial Sequence
  Synthetic
aggccctggctgctgatatgtacctgcagctgagggatataacagtagaactcagaggtgctttccttaaccactgctttactgaaatacatgatgttcttgaccaaaacgggttttctggaccttttgggacagcggtg

SEQ ID NO: 436244 - DNA, 140 bp, Artificial Sequence
  Synthetic
caccgctgtcccaaaaggtccagaaaacccgttttggtcaagaacatcatgtatttcagtaaagcagtggttaaggaaagcacctctgagttctactgttatatccctcagctgcaggtacatatcagcagccagggcct

SEQ ID NO: 436245 - DNA, 140 bp, Artificial Sequence
  Synthetic
atacgccatgctgggtctccgcaagccatggcaggaatcttggaagaacaaggctcagacacggacacccctagggtatacaatgacagagatcttctagattaggtgcgagaggccgagcgtacttgggagtcggccat

SEQ ID NO: 436246 - DNA, 140 bp, Artificial Sequence
  Synthetic
atggccgactcccaagtacgctcggcctctcgcacctaatctagaagatctctgtcattgtataccctaggggtgtccgtgtctgagccttgttcttccaagattcctgccatggcttgcggagacccagcatggcgtat

SEQ ID NO: 436247 - DNA, 140 bp, Artificial Sequence
  Synthetic
atacgccatgctgggtctccactgatgacatacatctgacaggggagattttctcatttttcagaagtttcggccaccccagacttgaagcagtaacggctgctgaaaatgttaggaaatcgtacttgggagtcggccat

SEQ ID NO: 436248 - DNA, 140 bp, Artificial Sequence
  Synthetic
atggccgactcccaagtacgatttcctaacattttcagcagccgttactgcttcaagtctggggtggccgaaacttctgaaaaatgagaaaatctcccctgtcagatgtatgtcatcagtggagacccagcatggcgtat

SEQ ID NO: 436249 - DNA, 140 bp, Artificial Sequence
  Synthetic
atacgccatgctgggtctcccagttggccaccgctgaccctccccctgcatgctgcagacacaatccggaatgctcaagcttcaggtgaagggttaacacatgagcagtgcgttgataaccgtacttgggagtcggccat

SEQ ID NO: 436250 - DNA, 140 bp, Artificial Sequence
  Synthetic
atggccgactcccaagtacggttatcaacgcactgctcatgtgttaacccttcacctgaagcttgagcattccggattgtgtctgcagcatgcagggggagggtcagcggtggccaactgggagacccagcatggcgtat

SEQ ID NO: 436251 - DNA, 140 bp, Artificial Sequence
  Synthetic
atacgccatgctgggtctcctggaaatcttttgctggagtgaaatttggctgctttatgcctcttagcctggatagtgatctgacaatgtacctaaaggacaaggcacttgctgctctcccgtacttgggagtcggccat

SEQ ID NO: 436252 - DNA, 140 bp, Artificial Sequence
  Synthetic
atggccgactcccaagtacgggagagcagcaagtgccttgtcctttaggtacattgtcagatcactatccaggctaagaggcataaagcagccaaatttcactccagcaaaagatttccaggagacccagcatggcgtat

SEQ ID NO: 436253 - DNA, 140 bp, Artificial Sequence
  Synthetic
atacgccatgctgggtctccaaagggaatgggattcagtttacccgaaagagttcctgcgttacgaccctcccaagggaaccgggtcacggaggcttgtagatgttttccttaatgattccgtacttgggagtcggccat

SEQ ID NO: 436254 - DNA, 140 bp, Artificial Sequence
  Synthetic
atggccgactcccaagtacggaatcattaaggaaaacatctacaagcctccgtgacccggttcccttgggagggtcgtaacgcaggaactctttcgggtaaactgaatcccattccctttggagacccagcatggcgtat

SEQ ID NO: 436255 - DNA, 140 bp, Artificial Sequence
  Synthetic
atacgccatgctgggtctccccaagtgattgctgaaaatctaatctcaaacgggattggcaaatattttaaggacaatgggatggccaaggatgagcacgatttgactaaggcactccaccgtacttgggagtcggccat

SEQ ID NO: 436256 - DNA, 140 bp, Artificial Sequence
  Synthetic
atggccgactcccaagtacggtggagtgccttagtcaaatcgtgctcatccttggccatcccattgtccttaaaatatttgccaatcccgtttgagattagattttcagcaatcacttggggagacccagcatggcgtat

SEQ ID NO: 436257 - DNA, 140 bp, Artificial Sequence
  Synthetic
atacgccatgctgggtctccggaacgtgagagcagcaaaagggtttatagggttccctcaagtaattcggcaggaccaagacactgatcatccggagaatatggaagcttacgagacagtcgtacttgggagtcggccat

SEQ ID NO: 436258 - DNA, 140 bp, Artificial Sequence
  Synthetic
atggccgactcccaagtacgactgtctcgtaagcttccatattctccggatgatcagtgtcttggtcctgccgaattacttgagggaaccctataaacccttttgctgctctcacgttccggagacccagcatggcgtat

SEQ ID NO: 436259 - DNA, 140 bp, Artificial Sequence
  Synthetic
aggccctggctgctgatatgcaggaccaagacactgatcatccggagaatatggaagcttacgagacagtcagtgcatttatcacgactgatctcaagaagtactgccttaattggagatgaccttttgggacagcggtg

SEQ ID NO: 436260 - DNA, 140 bp, Artificial Sequence
  Synthetic
caccgctgtcccaaaaggtcatctccaattaaggcagtacttcttgagatcagtcgtgataaatgcactgactgtctcgtaagcttccatattctccggatgatcagtgtcttggtcctgcatatcagcagccagggcct

SEQ ID NO: 436261 - DNA, 140 bp, Artificial Sequence
  Synthetic
atacgccatgctgggtctccccctcatttttccagtggctgcataagaggcttgagacctctgtcctgtatgtaagtgaccctcattgcccccccgaccttgacgcccatatcccgttatcgtacttgggagtcggccat

SEQ ID NO: 436262 - DNA, 140 bp, Artificial Sequence
  Synthetic
atggccgactcccaagtacgataacgggatatgggcgtcaaggtcgggggggcaatgagggtcacttacatacaggacagaggtctcaagcctcttatgcagccactggaaaaatgagggggagacccagcatggcgtat

SEQ ID NO: 436263 - DNA, 140 bp, Artificial Sequence
  Synthetic
aggccctggctgctgatatgtgtaagtgaccctcattgcccccccgaccttgacgcccatatcccgttatataaagtccccaatgatcaaatcttcattaagtaccctatgggaggtatagaccttttgggacagcggtg

SEQ ID NO: 436264 - DNA, 140 bp, Artificial Sequence
  Synthetic
caccgctgtcccaaaaggtctatacctcccatagggtacttaatgaagatttgatcattggggactttatataacgggatatgggcgtcaaggtcgggggggcaatgagggtcacttacacatatcagcagccagggcct

SEQ ID NO: 436265 - DNA, 140 bp, Artificial Sequence
  Synthetic
atacgccatgctgggtctccgtaggacccccgaggaccaacccccaaggtcgctccggacacagaccaccagccgcatccccacagccctcgggaaaggaacccccagcaactggaaggccgtacttgggagtcggccat

SEQ ID NO: 436266 - DNA, 140 bp, Artificial Sequence
  Synthetic
atggccgactcccaagtacggccttccagttgctgggggttcctttcccgagggctgtggggatgcggctggtggtctgtgtccggagcgaccttgggggttggtcctcgggggtcctacggagacccagcatggcgtat

SEQ ID NO: 436267 - DNA, 140 bp, Artificial Sequence
  Synthetic
atacgccatgctgggtctcccccttcccccctcccccaacgcaagaaccccacaaccgaaccgcacaagcgaccgaggtgacccaaccgcaggcatccgactccctagacagaccctccccgtacttgggagtcggccat

SEQ ID NO: 436268 - DNA, 140 bp, Artificial Sequence
  Synthetic
atggccgactcccaagtacggggagggtctgtctagggagtcggatgcctgcggttgggtcacctcggtcgcttgtgcggttcggttgtggggttcttgcgttgggggaggggggaagggggagacccagcatggcgtat

SEQ ID NO: 436269 - DNA, 140 bp, Artificial Sequence
  Synthetic
atacgccatgctgggtctcctccctgaacgtcctaaaagtgatacagcaaattctgatctctcttggcttcacaatcaattcaaccatgacccgggatgtagtcatacccctcctcacaacgtacttgggagtcggccat

SEQ ID NO: 436270 - DNA, 140 bp, Artificial Sequence
  Synthetic
atggccgactcccaagtacgttgtgaggaggggtatgactacatcccgggtcatggttgaattgattgtgaagccaagagagatcagaatttgctgtatcacttttaggacgttcagggaggagacccagcatggcgtat

SEQ ID NO: 436271 - DNA, 140 bp, Artificial Sequence
  Synthetic
atacgccatgctgggtctccacaacgacctcttaataaggatggcactgttgcccgctcctattggggggatgaattatctgaatatgagcaggctgtttgtcagaaacatcggtgatcccgtacttgggagtcggccat

SEQ ID NO: 436272 - DNA, 140 bp, Artificial Sequence
  Synthetic
atggccgactcccaagtacgggatcaccgatgtttctgacaaacagcctgctcatattcagataattcatccccccaataggagcgggcaacagtgccatccttattaagaggtcgttgtggagacccagcatggcgtat

SEQ ID NO: 436273 - DNA, 140 bp, Artificial Sequence
  Synthetic
atacgccatgctgggtctccgaggaagcccacccaccccacacacgaccacggcaaccaaaccagagcccagaccaccctgggccaccagctcccagactcggccatcaccccgaaaaaacgtacttgggagtcggccat

SEQ ID NO: 436274 - DNA, 140 bp, Artificial Sequence
  Synthetic
atggccgactcccaagtacgttttttcggggtgatggccgagtctgggagctggtggcccagggtggtctgggctctggtttggttgccgtggtcgtgtgtggggtgggtgggcttcctcggagacccagcatggcgtat

SEQ ID NO: 436275 - DNA, 140 bp, Artificial Sequence
  Synthetic
atacgccatgctgggtctccagtaacatcatcaattgctgatctcaagagaatgattctcgcctcactaatgcctgaagagaccctccatcaagtaatgacacaacaaccgggggactctcgtacttgggagtcggccat

SEQ ID NO: 436276 - DNA, 140 bp, Artificial Sequence
  Synthetic
atggccgactcccaagtacgagagtcccccggttgttgtgtcattacttgatggagggtctcttcaggcattagtgaggcgagaatcattctcttgagatcagcaattgatgatgttactggagacccagcatggcgtat

SEQ ID NO: 436277 - DNA, 140 bp, Artificial Sequence
  Synthetic
aggccctggctgctgatatgccagagcatcactagactcctcaagaacataactgcaaggtttgtcctgatccatagtccaaacccaatgttaaaaggattattccatgatgacagtaaagaccttttgggacagcggtg

SEQ ID NO: 436278 - DNA, 140 bp, Artificial Sequence
  Synthetic
caccgctgtcccaaaaggtctttactgtcatcatggaataatccttttaacattgggtttggactatggatcaggacaaaccttgcagttatgttcttgaggagtctagtgatgctctggcatatcagcagccagggcct

SEQ ID NO: 436279 - DNA, 140 bp, Artificial Sequence
  Synthetic
aggccctggctgctgatatgctaagaagccatatgtgggcgaggctagctcgaggacggcctatttacggccttgaggtccctgatgtactagaatctatgcgaggccaccttattcggcgaccttttgggacagcggtg

SEQ ID NO: 436280 - DNA, 140 bp, Artificial Sequence
  Synthetic
caccgctgtcccaaaaggtcgccgaataaggtggcctcgcatagattctagtacatcagggacctcaaggccgtaaataggccgtcctcgagctagcctcgcccacatatggcttcttagcatatcagcagccagggcct

SEQ ID NO: 436281 - DNA, 140 bp, Artificial Sequence
  Synthetic
aggccctggctgctgatatgcagataagaaggttgatactaactttatataccaacaaggaatgcttctagggttgggtgttttagaaacattgtttcgactcgagaaagataccggatcgaccttttgggacagcggtg

SEQ ID NO: 436282 - DNA, 140 bp, Artificial Sequence
  Synthetic
caccgctgtcccaaaaggtcgatccggtatctttctcgagtcgaaacaatgtttctaaaacacccaaccctagaagcattccttgttggtatataaagttagtatcaaccttcttatctgcatatcagcagccagggcct

SEQ ID NO: 436283 - DNA, 140 bp, Artificial Sequence
  Synthetic
atacgccatgctgggtctccgtcgctctgatcccctacaactcttgaaacacagatttcccacaagtctcctctccgtcatcaagcaaccaccgcatccagcatcaaggccacccgaaatcgtacttgggagtcggccat

SEQ ID NO: 436284 - DNA, 140 bp, Artificial Sequence
  Synthetic
atggccgactcccaagtacgatttcgggtggccttgatgctggatgcggtggttgcttgatgacggagaggagacttgtgggaaatctgtgtttcaagagttgtaggggatcagagcgacggagacccagcatggcgtat

SEQ ID NO: 436285 - DNA, 140 bp, Artificial Sequence
  Synthetic
aggccctggctgctgatatgaaggagtgtttaaggtgcttgtcaatgctctaagccacccaaagatctacaagaaattctggcattgtggtattatagagcctatccatggtccttcactgaccttttgggacagcggtg

SEQ ID NO: 436286 - DNA, 140 bp, Artificial Sequence
  Synthetic
caccgctgtcccaaaaggtcagtgaaggaccatggataggctctataataccacaatgccagaatttcttgtagatctttgggtggcttagagcattgacaagcaccttaaacactccttcatatcagcagccagggcct

SEQ ID NO: 436287 - DNA, 140 bp, Artificial Sequence
  Synthetic
atacgccatgctgggtctccgcaaccagtcagtaatgatttcagcaactgcatggtggctttgggggagctcaggttcgcagccctctgtcacagggaagattctgtcacggttccctatcgtacttgggagtcggccat

SEQ ID NO: 436288 - DNA, 140 bp, Artificial Sequence
  Synthetic
atggccgactcccaagtacgatagggaaccgtgacagaatcttccctgtgacagagggctgcgaacctgagctcccccaaagccaccatgcagttgctgaaatcattactgactggttgcggagacccagcatggcgtat

SEQ ID NO: 436289 - DNA, 140 bp, Artificial Sequence
  Synthetic
atacgccatgctgggtctccggggtcccaatcgaattacaagtggaatgcttcacatgggaccaaaaactctggtgccgtcacttctgtgtgcttgcggattcagaatctggtggacatacgtacttgggagtcggccat

SEQ ID NO: 436290 - DNA, 140 bp, Artificial Sequence
  Synthetic
atggccgactcccaagtacgtatgtccaccagattctgaatccgcaagcacacagaagtgacggcaccagagtttttggtcccatgtgaagcattccacttgtaattcgattgggaccccggagacccagcatggcgtat

SEQ ID NO: 436291 - DNA, 140 bp, Artificial Sequence
  Synthetic
aggccctggctgctgatatgctaaccgaccatatcaaggcagaggctaggttatctccagcaggatcttcgtggaacataaatccaattattgtagaccattactcatgctctctgacttgaccttttgggacagcggtg

SEQ ID NO: 436292 - DNA, 140 bp, Artificial Sequence
  Synthetic
caccgctgtcccaaaaggtcaagtcagagagcatgagtaatggtctacaataattggatttatgttccacgaagatcctgctggagataacctagcctctgccttgatatggtcggttagcatatcagcagccagggcct

SEQ ID NO: 436293 - DNA, 140 bp, Artificial Sequence
  Synthetic
aggccctggctgctgatatgatgatgttgcaaaattgctcaaagatatcaacacaagcaagcacaatcttcccatttcagggggcaatctcgccaattatgaaatccatgctttccgcaggaccttttgggacagcggtg

SEQ ID NO: 436294 - DNA, 140 bp, Artificial Sequence
  Synthetic
caccgctgtcccaaaaggtcctgcggaaagcatggatttcataattggcgagattgccccctgaaatgggaagattgtgcttgcttgtgttgatatctttgagcaattttgcaacatcatcatatcagcagccagggcct

SEQ ID NO: 436295 - DNA, 140 bp, Artificial Sequence
  Synthetic
atacgccatgctgggtctccggatcgggttctatgttgatcacttataaggagatacttaaactaaacaagtgcttctataatagtggggtttccgccaattctagatctggtcaaagggcgtacttgggagtcggccat

SEQ ID NO: 436296 - DNA, 140 bp, Artificial Sequence
  Synthetic
atggccgactcccaagtacgccctttgaccagatctagaattggcggaaaccccactattatagaagcacttgtttagtttaagtatctccttataagtgatcaacatagaacccgatccggagacccagcatggcgtat

SEQ ID NO: 436297 - DNA, 140 bp, Artificial Sequence
  Synthetic
atacgccatgctgggtctccacacagagtcctacttcattgtcctcagtatagcctatccgacgctgtccgagattaagggggtgattgtccaccggctagagggggtctcgtacaacatcgtacttgggagtcggccat

SEQ ID NO: 436298 - DNA, 140 bp, Artificial Sequence
  Synthetic
atggccgactcccaagtacgatgttgtacgagaccccctctagccggtggacaatcacccccttaatctcggacagcgtcggataggctatactgaggacaatgaagtaggactctgtgtggagacccagcatggcgtat

SEQ ID NO: 436299 - DNA, 140 bp, Artificial Sequence
  Synthetic
aggccctggctgctgatatgccctcattttttcagtggctgcataagaggcttgaaacctctgtcctctatgtaagtgatcctcattgcccccccgaccttgacgcccatgtcccgttatgaccttttgggacagcggtg

SEQ ID NO: 436300 - DNA, 140 bp, Artificial Sequence
  Synthetic
caccgctgtcccaaaaggtcataacgggacatgggcgtcaaggtcgggggggcaatgaggatcacttacatagaggacagaggtttcaagcctcttatgcagccactgaaaaaatgagggcatatcagcagccagggcct

SEQ ID NO: 436301 - DNA, 140 bp, Artificial Sequence
  Synthetic
aggccctggctgctgatatgagaccaccctgggccaccagctcccagactcggccatcaccccgaaaaaaggaaaggccacaacccgcgcaccccaggcccgatccggcgggaagccaccgaccttttgggacagcggtg

SEQ ID NO: 436302 - DNA, 140 bp, Artificial Sequence
  Synthetic
caccgctgtcccaaaaggtcggtggcttcccgccggatcgggcctggggtgcgcgggttgtggcctttccttttttcggggtgatggccgagtctgggagctggtggcccagggtggtctcatatcagcagccagggcct

SEQ ID NO: 436303 - DNA, 140 bp, Artificial Sequence
  Synthetic
atacgccatgctgggtctccgggctacttgtgtcccaatcactcaagagcattgcaagatgtgtattctggtcagagactatagttgatgaaacaagggcagcatgcagtaatattgctacgtacttgggagtcggccat

SEQ ID NO: 436304 - DNA, 140 bp, Artificial Sequence
  Synthetic
atggccgactcccaagtacgtagcaatattactgcatgctgcccttgtttcatcaactatagtctctgaccagaatacacatcttgcaatgctcttgagtgattgggacacaagtagcccggagacccagcatggcgtat

SEQ ID NO: 436305 - DNA, 140 bp, Artificial Sequence
  Synthetic
aggccctggctgctgatatgagaacatcttatgattgatagaccttatgttttgctggctgttctattcgtcatgtttctgagcttgatcgggttgctagccattgcaggcattagacttgaccttttgggacagcggtg

SEQ ID NO: 436306 - DNA, 140 bp, Artificial Sequence
  Synthetic
caccgctgtcccaaaaggtcaagtctaatgcctgcaatggctagcaacccgatcaagctcagaaacatgacgaatagaacagccagcaaaacataaggtctatcaatcataagatgttctcatatcagcagccagggcct

SEQ ID NO: 436307 - DNA, 140 bp, Artificial Sequence
  Synthetic
aggccctggctgctgatatgcattcttctttactccgggaacagaaagttgataaataagtttatccagaatctcaagtccggctatctgatactagacttacaccagaatatcttcgttgaccttttgggacagcggtg

SEQ ID NO: 436308 - DNA, 140 bp, Artificial Sequence
  Synthetic
caccgctgtcccaaaaggtcaacgaagatattctggtgtaagtctagtatcagatagccggacttgagattctggataaacttatttatcaactttctgttcccggagtaaagaagaatgcatatcagcagccagggcct

SEQ ID NO: 436309 - DNA, 140 bp, Artificial Sequence
  Synthetic
atacgccatgctgggtctccctccggaaccctaatcctgccctaggtggttaggcattatttgcaatatattaaagaaaactttgaaaatacgaagtttctattcccagctttgtctggtcgtacttgggagtcggccat

SEQ ID NO: 436310 - DNA, 140 bp, Artificial Sequence
  Synthetic
atggccgactcccaagtacgaccagacaaagctgggaatagaaacttcgtattttcaaagttttctttaatatattgcaaataatgcctaaccacctagggcaggattagggttccggagggagacccagcatggcgtat

SEQ ID NO: 436311 - DNA, 140 bp, Artificial Sequence
  Synthetic
atacgccatgctgggtctcctcctggagaactcaattcagaacaagttcagtgcaggatcataccctctgctctggagctatgccatgggagtaggagtggaacttgaaaactccatgggcgtacttgggagtcggccat

SEQ ID NO: 436312 - DNA, 140 bp, Artificial Sequence
  Synthetic
atggccgactcccaagtacgcccatggagttttcaagttccactcctactcccatggcatagctccagagcagagggtatgatcctgcactgaacttgttctgaattgagttctccaggaggagacccagcatggcgtat

SEQ ID NO: 436313 - DNA, 140 bp, Artificial Sequence
  Synthetic
aggccctggctgctgatatgggcaagagatggtgaggaggtcagctggaaaggtcagttccacattggcatctgaactcggtatcactgccgaggatgcaaggcttgtttcagagattgcgaccttttgggacagcggtg

SEQ ID NO: 436314 - DNA, 140 bp, Artificial Sequence
  Synthetic
caccgctgtcccaaaaggtcgcaatctctgaaacaagccttgcatcctcggcagtgataccgagttcagatgccaatgtggaactgacctttccagctgacctcctcaccatctcttgcccatatcagcagccagggcct

SEQ ID NO: 436315 - DNA, 140 bp, Artificial Sequence
  Synthetic
atacgccatgctgggtctcctattcttctttactccgggaacagaaagttgataaatcggtttatccagaatctcaagtccggttatctaatactagacttacaccagaatatcttcgttcgtacttgggagtcggccat

SEQ ID NO: 436316 - DNA, 140 bp, Artificial Sequence
  Synthetic
atggccgactcccaagtacgaacgaagatattctggtgtaagtctagtattagataaccggacttgagattctggataaaccgatttatcaactttctgttcccggagtaaagaagaataggagacccagcatggcgtat

SEQ ID NO: 436317 - DNA, 140 bp, Artificial Sequence
  Synthetic
aggccctggctgctgatatgggggccagtcctaaaaacctactcccgaagcccagcccacacaaataccaggaacgtgagggcagcaaaagggtttatagggttccctcagataattcgggaccttttgggacagcggtg

SEQ ID NO: 436318 - DNA, 140 bp, Artificial Sequence
  Synthetic
caccgctgtcccaaaaggtcccgaattatctgagggaaccctataaacccttttgctgccctcacgttcctggtatttgtgtgggctgggcttcgggagtaggtttttaggactggcccccatatcagcagccagggcct

SEQ ID NO: 436319 - DNA, 140 bp, Artificial Sequence
  Synthetic
aggccctggctgctgatatgggagagctacagagaaaccgggcccagcagagcaagtgatgcgagagccgcccatcttccaaccggcacacccccagacactgacactgcaccggagtccgaccttttgggacagcggtg

SEQ ID NO: 436320 - DNA, 140 bp, Artificial Sequence
  Synthetic
caccgctgtcccaaaaggtcggactccggtgcagtgtcagtgtctgggggtgtgccggttggaagatgggcggctctcgcatcacttgctctgctgggcccggtttctctgtagctctcccatatcagcagccagggcct

SEQ ID NO: 436321 - DNA, 140 bp, Artificial Sequence
  Synthetic
atacgccatgctgggtctccgatctccaggcatcaagcactgggttacagtgttgttatgtttatgatcacagcggtgaagcggttgagggaatccaagatgctgactctatcgtggttccgtacttgggagtcggccat

SEQ ID NO: 436322 - DNA, 140 bp, Artificial Sequence
  Synthetic
atggccgactcccaagtacggaaccacgatagagtcagcatcttggattccctcaaccgcttcaccgctgtgatcataaacataacaacactgtaacccagtgcttgatgcctggagatcggagacccagcatggcgtat

SEQ ID NO: 436323 - DNA, 140 bp, Artificial Sequence
  Synthetic
aggccctggctgctgatatgcagcggtgaagcggttgagggaatccaagatgctgactctatcgtggttcaatcaggccttgatggtggtagcaccctctcaggaggagacaatgaatctgaccttttgggacagcggtg

SEQ ID NO: 436324 - DNA, 140 bp, Artificial Sequence
  Synthetic
caccgctgtcccaaaaggtcagattcattgtctcctcctgagagggtgctaccaccatcaaggcctgattgaaccacgatagagtcagcatcttggattccctcaaccgcttcaccgctgcatatcagcagccagggcct

SEQ ID NO: 436325 - DNA, 140 bp, Artificial Sequence
  Synthetic
aggccctggctgctgatatgagctgctgaaggaatttcagctaaagccgatcgggaaaaagatgagctcagccgtcgggtttgttcctgacaccggccctgcatcacgcagtgtaatccggaccttttgggacagcggtg

SEQ ID NO: 436326 - DNA, 140 bp, Artificial Sequence
  Synthetic
caccgctgtcccaaaaggtccggattacactgcgtgatgcagggccggtgtcaggaacaaacccgacggctgagctcatctttttcccgatcggctttagctgaaattccttcagcagctcatatcagcagccagggcct

SEQ ID NO: 436327 - DNA, 140 bp, Artificial Sequence
  Synthetic
atacgccatgctgggtctccgcccggacaaaaaagccccctccgaaagactccacggaccaagcgagaggccagccagcagccgacggcaagcgcgaacaccaggcggccccagcacagacgtacttgggagtcggccat

SEQ ID NO: 436328 - DNA, 140 bp, Artificial Sequence
  Synthetic
atggccgactcccaagtacgtctgtgctggggccgcctggtgttcgcgcttgccgtcggctgctggctggcctctcgcttggtccgtggagtctttcggagggggcttttttgtccgggcggagacccagcatggcgtat

SEQ ID NO: 436329 - DNA, 140 bp, Artificial Sequence
  Synthetic
atacgccatgctgggtctccagaacccagaccccggcccacggcgccgcgcccccaacccccgacaaccagagggagcccccaaccaatcccgccggctcccccggtgcccacaggcaggcgtacttgggagtcggccat

SEQ ID NO: 436330 - DNA, 140 bp, Artificial Sequence
  Synthetic
atggccgactcccaagtacgcctgcctgtgggcaccgggggagccggcgggattggttgggggctccctctggttgtcgggggttgggggcgcggcgccgtgggccggggtctgggttctggagacccagcatggcgtat

SEQ ID NO: 436331 - DNA, 140 bp, Artificial Sequence
  Synthetic
aggccctggctgctgatatggaggaagcccacccaccccacacacgaccacggcaaccaaaccagaacccagaccaccctgggccaccagctcccagactcggccatcaccccgcagaaagaccttttgggacagcggtg

SEQ ID NO: 436332 - DNA, 140 bp, Artificial Sequence
  Synthetic
caccgctgtcccaaaaggtctttctgcggggtgatggccgagtctgggagctggtggcccagggtggtctgggttctggtttggttgccgtggtcgtgtgtggggtgggtgggcttcctccatatcagcagccagggcct

SEQ ID NO: 436333 - DNA, 140 bp, Artificial Sequence
  Synthetic
atacgccatgctgggtctccgacgtgatcataaatgatgaccaaggactattcaaagttctgtagaccgcagtgccccgcaatgcccgaaaacgaccctcctcataatgatagccagaagcgtacttgggagtcggccat

SEQ ID NO: 436334 - DNA, 140 bp, Artificial Sequence
  Synthetic
atggccgactcccaagtacgcttctggctatcattatgaggagggtcgttttcgggcattgcggggcactgcggtctacagaactttgaatagtccttggtcatcatttatgatcacgtcggagacccagcatggcgtat

SEQ ID NO: 436335 - DNA, 140 bp, Artificial Sequence
  Synthetic
atacgccatgctgggtctcctgattctgggtaccattctagcccagatctgggtcttgctcgcaaaggcggttacggccccagacactgcagctgattcggaactgagaaggtggataaacgtacttgggagtcggccat

SEQ ID NO: 436336 - DNA, 140 bp, Artificial Sequence
  Synthetic
atggccgactcccaagtacgtttatccaccttctcagttccgaatcagctgcagtgtctggggccgtaaccgcctttgcgagcaagacccagatctgggctagaatggtacccagaatcaggagacccagcatggcgtat

SEQ ID NO: 436337 - DNA, 140 bp, Artificial Sequence
  Synthetic
atacgccatgctgggtctcccggtcctcccatatcattggagaggttggacgtagggacaaatctggggaatgcaattgctaagttggaggatgccaaggaattgttggagtcatcggaccgtacttgggagtcggccat

SEQ ID NO: 436338 - DNA, 140 bp, Artificial Sequence
  Synthetic
atggccgactcccaagtacggtccgatgactccaacaattccttggcatcctccaacttagcaattgcattccccagatttgtccctacgtccaacctctccaatgatatgggaggaccgggagacccagcatggcgtat

SEQ ID NO: 436339 - DNA, 140 bp, Artificial Sequence
  Synthetic
aggccctggctgctgatatgtcaaactcgcagccctttgtcacggggaagattctatcacaattccctatcagggatcagggaaaggtgtcagcttccagctcgtcaagctaggtgtctggaccttttgggacagcggtg

SEQ ID NO: 436340 - DNA, 140 bp, Artificial Sequence
  Synthetic
caccgctgtcccaaaaggtccagacacctagcttgacgagctggaagctgacacctttccctgatccctgatagggaattgtgatagaatcttccccgtgacaaagggctgcgagtttgacatatcagcagccagggcct

SEQ ID NO: 436341 - DNA, 140 bp, Artificial Sequence
  Synthetic
aggccctggctgctgatatggaagatggaaccaatcgcagatagggctgctagtgaaccaatcacatgatgtcacccagacatcaggcatacccactagtgtgaaatagacatcagaattgaccttttgggacagcggtg

SEQ ID NO: 436342 - DNA, 140 bp, Artificial Sequence
  Synthetic
caccgctgtcccaaaaggtcaattctgatgtctatttcacactagtgggtatgcctgatgtctgggtgacatcatgtgattggttcactagcagccctatctgcgattggttccatcttccatatcagcagccagggcct

SEQ ID NO: 436343 - DNA, 140 bp, Artificial Sequence
  Synthetic
aggccctggctgctgatatggaaatccccaaccgacatgcaatcctgggtccccctatcaacggatgatccagtgatagataggctttacctctcatctcacagaggtgttatcgctgacgaccttttgggacagcggtg

SEQ ID NO: 436344 - DNA, 140 bp, Artificial Sequence
  Synthetic
caccgctgtcccaaaaggtcgtcagcgataacacctctgtgagatgagaggtaaagcctatctatcactggatcatccgttgatagggggacccaggattgcatgtcggttggggatttccatatcagcagccagggcct

SEQ ID NO: 436345 - DNA, 140 bp, Artificial Sequence
  Synthetic
atacgccatgctgggtctccgaatgaaatttcagctctcataggggatgacgatatcaatagtttcataactgagtttctgctcatagagccaagattattcactatctacttgggccagcgtacttgggagtcggccat

SEQ ID NO: 436346 - DNA, 140 bp, Artificial Sequence
  Synthetic
atggccgactcccaagtacgctggcccaagtagatagtgaataatcttggctctatgagcagaaactcagttatgaaactattgatatcgtcatcccctatgagagctgaaatttcattcggagacccagcatggcgtat

SEQ ID NO: 436347 - DNA, 140 bp, Artificial Sequence
  Synthetic
aggccctggctgctgatatgcctgggcaaaataggatcaatactggtgattaagcttatgcctttcagcggggattttgttcagggatttataagttatgtagggtctcattatagagaagaccttttgggacagcggtg

SEQ ID NO: 436348 - DNA, 140 bp, Artificial Sequence
  Synthetic
caccgctgtcccaaaaggtcttctctataatgagaccctacataacttataaatccctgaacaaaatccccgctgaaaggcataagcttaatcaccagtattgatcctattttgcccaggcatatcagcagccagggcct

SEQ ID NO: 436349 - DNA, 140 bp, Artificial Sequence
  Synthetic
atacgccatgctgggtctccacagccccgacacaaggccactaccagccatcccaatctgcgtcctcctcgtaggacccctgaggaccaacccccaaggtcgctccggacacagaccacccgtacttgggagtcggccat

SEQ ID NO: 436350 - DNA, 140 bp, Artificial Sequence
  Synthetic
atggccgactcccaagtacgggtggtctgtgtccggagcgaccttgggggttggtcctcaggggtcctacgaggaggacgcagattgggatggctggtagtggccttgtgtcggggctgtggagacccagcatggcgtat

SEQ ID NO: 436351 - DNA, 140 bp, Artificial Sequence
  Synthetic
atacgccatgctgggtctccagccgcatccccacagctcccgggaaaggaacccccagcaactggaaggccccttcccccctcccccaacgcaagaaccccgcaaccgaaccgcacaagccgtacttgggagtcggccat

SEQ ID NO: 436352 - DNA, 140 bp, Artificial Sequence
  Synthetic
atggccgactcccaagtacggcttgtgcggttcggttgcggggttcttgcgttgggggaggggggaaggggccttccagttgctgggggttcctttcccgggagctgtggggatgcggctggagacccagcatggcgtat

SEQ ID NO: 436353 - DNA, 140 bp, Artificial Sequence
  Synthetic
aggccctggctgctgatatgtcacatgatgatccaattagtagtgatcaatccaggttcggatggtttgagaacaaggaaatctcagatattgaagtgcaagaccctgagggattcaacagaccttttgggacagcggtg

SEQ ID NO: 436354 - DNA, 140 bp, Artificial Sequence
  Synthetic
caccgctgtcccaaaaggtctgttgaatccctcagggtcttgcacttcaatatctgagatttccttgttctcaaaccatccgaacctggattgatcactactaattggatcatcatgtgacatatcagcagccagggcct

SEQ ID NO: 436355 - DNA, 140 bp, Artificial Sequence
  Synthetic
atacgccatgctgggtctcccagaccaccctgggccaccagctcccaaactcggccaccaccccgcaaaaaggaaaggccacaacccgcgcaccccagccccgatccggcgggcagccatcgtacttgggagtcggccat

SEQ ID NO: 436356 - DNA, 140 bp, Artificial Sequence
  Synthetic
atggccgactcccaagtacgatggctgcccgccggatcggggctggggtgcgcgggttgtggcctttcctttttgcggggtggtggccgagtttgggagctggtggcccagggtggtctgggagacccagcatggcgtat

SEQ ID NO: 436357 - DNA, 140 bp, Artificial Sequence
  Synthetic
atacgccatgctgggtctccccaacctgaaccagcacccaagagcgatccctgggggacccccaaaccgcaaaagacatcagtatcccacagcctccccaagtcccccggtctcctcttccgtacttgggagtcggccat

SEQ ID NO: 436358 - DNA, 140 bp, Artificial Sequence
  Synthetic
atggccgactcccaagtacggaagaggagaccgggggacttggggaggctgtgggatactgatgtcttttgcggtttgggggtcccccagggatcgctcttgggtgctggttcaggttggggagacccagcatggcgtat

SEQ ID NO: 436359 - DNA, 140 bp, Artificial Sequence
  Synthetic
aggccctggctgctgatatgaagaaattctggcattgtggtattatagagcctatccatggtccttcacttgatgctcaaaacttgcacacaactgtgtgcaacatggtttacacatgctgaccttttgggacagcggtg

SEQ ID NO: 436360 - DNA, 140 bp, Artificial Sequence
  Synthetic
caccgctgtcccaaaaggtcagcatgtgtaaaccatgttgcacacagttgtgtgcaagttttgagcatcaagtgaaggaccatggataggctctataataccacaatgccagaatttcttcatatcagcagccagggcct

SEQ ID NO: 436361 - DNA, 140 bp, Artificial Sequence
  Synthetic
atacgccatgctgggtctccccagagcatcactagactcctcaagaacataactgcaaggtttgtcctaatccacagtccaaacccaatgttaaagggattattccatgatgacagtaaacgtacttgggagtcggccat

SEQ ID NO: 436362 - DNA, 140 bp, Artificial Sequence
  Synthetic
atggccgactcccaagtacgtttactgtcatcatggaataatccctttaacattgggtttggactgtggattaggacaaaccttgcagttatgttcttgaggagtctagtgatgctctggggagacccagcatggcgtat

SEQ ID NO: 436363 - DNA, 140 bp, Artificial Sequence
  Synthetic
atacgccatgctgggtctccagatcctggtctaggcgacaggaaggatgaatgctttatgtacatgtttctgctgggggttgttgaggacagcgatcccctagggcctccaatcgggcgacgtacttgggagtcggccat

SEQ ID NO: 436364 - DNA, 140 bp, Artificial Sequence
  Synthetic
atggccgactcccaagtacgtcgcccgattggaggccctaggggatcgctgtcctcaacaacccccagcagaaacatgtacataaagcattcatccttcctgtcgcctagaccaggatctggagacccagcatggcgtat

SEQ ID NO: 436365 - DNA, 140 bp, Artificial Sequence
  Synthetic
aggccctggctgctgatatgcagtatagcctatccgacgctgtccgagattaagggggtgattgtccaccggcttgagtgggtctcgtacaatataggctctcaggagtggtataccactgaccttttgggacagcggtg

SEQ ID NO: 436366 - DNA, 140 bp, Artificial Sequence
  Synthetic
caccgctgtcccaaaaggtcagtggtataccactcctgagagcctatattgtacgagacccactcaagccggtggacaatcacccccttaatctcggacagcgtcggataggctatactgcatatcagcagccagggcct

SEQ ID NO: 436367 - DNA, 140 bp, Artificial Sequence
  Synthetic
atacgccatgctgggtctccgggaaggggacaactcgcgcaccccagccccgacccggcgggcagccacccaacccgaaccagcacccaagagcgaaccccgaaggacccccgaaccgcacgtacttgggagtcggccat

SEQ ID NO: 436368 - DNA, 140 bp, Artificial Sequence
  Synthetic
atggccgactcccaagtacgtgcggttcgggggtccttcggggttcgctcttgggtgctggttcgggttgggtggctgcccgccgggtcggggctggggtgcgcgagttgtccccttcccggagacccagcatggcgtat

SEQ ID NO: 436369 - DNA, 140 bp, Artificial Sequence
  Synthetic
aggccctggctgctgatatggaaatccccaaccgacatgcaatcctgggtccccttatcaacggatgatccagtgatagacaggctttacctctcatctcacagaggtgttatcgctgacgaccttttgggacagcggtg

SEQ ID NO: 436370 - DNA, 140 bp, Artificial Sequence
  Synthetic
caccgctgtcccaaaaggtcgtcagcgataacacctctgtgagatgagaggtaaagcctgtctatcactggatcatccgttgataaggggacccaggattgcatgtcggttggggatttccatatcagcagccagggcct

SEQ ID NO: 436371 - DNA, 140 bp, Artificial Sequence
  Synthetic
aggccctggctgctgatatgtgcttcgggattcgggccattgatcacacacggttcagggatggacctatacaaatccaaccacaacaatgtgtattggctgactatcccgccaatgaaggaccttttgggacagcggtg

SEQ ID NO: 436372 - DNA, 140 bp, Artificial Sequence
  Synthetic
caccgctgtcccaaaaggtccttcattggcgggatagtcagccaatacacattgttgtggttggatttgtataggtccatccctgaaccgtgtgtgatcaatggcccgaatcccgaagcacatatcagcagccagggcct

SEQ ID NO: 436373 - DNA, 140 bp, Artificial Sequence
  Synthetic
atacgccatgctgggtctcctcctgattgcagtgtgtcttggagggttgatagggatccccgctttaatatgttgctgcagggggcgctgtaacaaaagggagaacaagttggtatgtcacgtacttgggagtcggccat

SEQ ID NO: 436374 - DNA, 140 bp, Artificial Sequence
  Synthetic
atggccgactcccaagtacgtgacataccaacttgttctcccttttgttacagcgccccctgcagcaacatattaaagcggggatccctatcaaccctccaagacacactgcaatcaggaggagacccagcatggcgtat

SEQ ID NO: 436375 - DNA, 140 bp, Artificial Sequence
  Synthetic
atacgccatgctgggtctccgaagatggaactaaccgcagacagggctgccagtgaatcgatcacgtgatgtcacccagacatcaggcatacccactagtgtgaaatagacatcagaattcgtacttgggagtcggccat

SEQ ID NO: 436376 - DNA, 140 bp, Artificial Sequence
  Synthetic
atggccgactcccaagtacgaattctgatgtctatttcacactagtgggtatgcctgatgtctgggtgacatcacgtgatcgattcactggcagccctgtctgcggttagttccatcttcggagacccagcatggcgtat

SEQ ID NO: 436377 - DNA, 140 bp, Artificial Sequence
  Synthetic
aggccctggctgctgatatgggttggatgtggtgaggaacaggattgccgaggacctctctttacgccgattcatggtggctctaatcctggatatcaagaggacacccgggaacaaaccgaccttttgggacagcggtg

SEQ ID NO: 436378 - DNA, 140 bp, Artificial Sequence
  Synthetic
caccgctgtcccaaaaggtcggtttgttcccgggtgtcctcttgatatccaggattagagccaccatgaatcggcgtaaagagaggtcctcggcaatcctgttcctcaccacatccaacccatatcagcagccagggcct

SEQ ID NO: 436379 - DNA, 140 bp, Artificial Sequence
  Synthetic
atacgccatgctgggtctccttggggggcaaggaagacaggagggtcaaacagagtcggggagaagccagggagagctacagagaaaccgggtccagcagagcaagtgatgcgagagctgcgtacttgggagtcggccat

SEQ ID NO: 436380 - DNA, 140 bp, Artificial Sequence
  Synthetic
atggccgactcccaagtacgcagctctcgcatcacttgctctgctggacccggtttctctgtagctctccctggcttctccccgactctgtttgaccctcctgtcttccttgccccccaaggagacccagcatggcgtat

SEQ ID NO: 436381 - DNA, 140 bp, Artificial Sequence
  Synthetic
aggccctggctgctgatatgcccaagggaaccgggtcacggaggcttgtagatgttttccttagtgattcgagctttgacccatatgatatgataatgtatgtcgtaaatggatcctaccgaccttttgggacagcggtg

SEQ ID NO: 436382 - DNA, 140 bp, Artificial Sequence
  Synthetic
caccgctgtcccaaaaggtcggtaggatccatttacgacatacattatcatatcatatgggtcaaagctcgaatcactaaggaaaacatctacaagcctccgtgacccggttcccttgggcatatcagcagccagggcct

SEQ ID NO: 436383 - DNA, 140 bp, Artificial Sequence
  Synthetic
aggccctggctgctgatatgacctgcaaggaagaggaggcaggcagttcgggtctcagcaaaccatgcctctcagcaattggatcaactgaaggcggtgcacctcgcatccgcggtcagggaccttttgggacagcggtg

SEQ ID NO: 436384 - DNA, 140 bp, Artificial Sequence
  Synthetic
caccgctgtcccaaaaggtccctgaccgcggatgcgaggtgcaccgccttcagttgatccaattgctgagaggcatggtttgctgagacccgaactgcctgcctcctcttccttgcaggtcatatcagcagccagggcct

SEQ ID NO: 436385 - DNA, 140 bp, Artificial Sequence
  Synthetic
aggccctggctgctgatatggatctggagaaagcgatgacgacgctgaaactttgggaatcccctcaagaaatctccaggcatcaagcactgggctacagtgccatcatgtttatgatcagaccttttgggacagcggtg

SEQ ID NO: 436386 - DNA, 140 bp, Artificial Sequence
  Synthetic
caccgctgtcccaaaaggtctgatcataaacatgatggcactgtagcccagtgcttgatgcctggagatttcttgaggggattcccaaagtttcagcgtcgtcatcgctttctccagatccatatcagcagccagggcct

SEQ ID NO: 436387 - DNA, 140 bp, Artificial Sequence
  Synthetic
atacgccatgctgggtctcccccgaaccccagtaggggcagcacttccgagacacccattaaaaagggcacagacgcgagattggcctcatttggaacggagatcgcgtctttattgacacgtacttgggagtcggccat

SEQ ID NO: 436388 - DNA, 140 bp, Artificial Sequence
  Synthetic
atggccgactcccaagtacgtgtcaataaagacgcgatctccgttccaaatgaggccaatctcgcgtctgtgccctttttaatgggtgtctcggaagtgctgcccctactggggttcgggggagacccagcatggcgtat

SEQ ID NO: 436389 - DNA, 140 bp, Artificial Sequence
  Synthetic
atacgccatgctgggtctccacgaccccactgcagatgtcgaactcaatcccgacctgaaacccatcataggcagagattcaggccgagcactggccgaagttctcaagaagcccgttgccgtacttgggagtcggccat

SEQ ID NO: 436390 - DNA, 140 bp, Artificial Sequence
  Synthetic
atggccgactcccaagtacggcaacgggcttcttgagaacttcggccagtgctcggcctgaatctctgcctatgatgggtttcaggtcgggattgagttcgacatctgcagtggggtcgtggagacccagcatggcgtat

SEQ ID NO: 436391 - DNA, 140 bp, Artificial Sequence
  Synthetic
atacgccatgctgggtctcccagccgacaactccagggaatgactaatggacggaccagttccagaggacagctgctgaaggaatttcaactaaagccgatcgggaaaaaggtgagctcacgtacttgggagtcggccat

SEQ ID NO: 436392 - DNA, 140 bp, Artificial Sequence
  Synthetic
atggccgactcccaagtacgtgagctcacctttttcccgatcggctttagttgaaattccttcagcagctgtcctctggaactggtccgtccattagtcattccctggagttgtcggctgggagacccagcatggcgtat

SEQ ID NO: 436393 - DNA, 140 bp, Artificial Sequence
  Synthetic
aggccctggctgctgatatgagatcctggtctaggtgataggaaggatgaatgctttatgtacatgtttctgctgggggttgttgaggacagcgatcccctagggcctccaatcgggcgagaccttttgggacagcggtg

SEQ ID NO: 436394 - DNA, 140 bp, Artificial Sequence
  Synthetic
caccgctgtcccaaaaggtctcgcccgattggaggccctaggggatcgctgtcctcaacaacccccagcagaaacatgtacataaagcattcatccttcctatcacctagaccaggatctcatatcagcagccagggcct

SEQ ID NO: 436395 - DNA, 140 bp, Artificial Sequence
  Synthetic
atacgccatgctgggtctccgcattcgggtccttgcccttaggtgttggtagatccatagcaaaacccgaggaactcctcatagaggccactgagcttgacatagttgttagacgtacagcgtacttgggagtcggccat

SEQ ID NO: 436396 - DNA, 140 bp, Artificial Sequence
  Synthetic
atggccgactcccaagtacgctgtacgtctaacaactatgtcaagctcagtggcctctatgaggagttcctcgggttttgctatggatctaccaacacctaagggcaaggacccgaatgcggagacccagcatggcgtat

SEQ ID NO: 436397 - DNA, 140 bp, Artificial Sequence
  Synthetic
atacgccatgctgggtctcctgaagaccttaatcggttactctggaggagcagatgcaagatagtaagaatccaggcagttttgcagccatcagttcctcaagaattccgcatttacgaccgtacttgggagtcggccat

SEQ ID NO: 436398 - DNA, 140 bp, Artificial Sequence
  Synthetic
atggccgactcccaagtacggtcgtaaatgcggaattcttgaggaactgatggctgcaaaactgcctggattcttactatcttgcatctgctcctccagagtaaccgattaaggtcttcaggagacccagcatggcgtat

SEQ ID NO: 436399 - DNA, 140 bp, Artificial Sequence
  Synthetic
atacgccatgctgggtctccgacgtgatcataaatgatgaccaaggactattcaaagttctgtagaccgcagtgctcagcaatacccgaagacgacccccctcataatgacagccagaaacgtacttgggagtcggccat

SEQ ID NO: 436400 - DNA, 140 bp, Artificial Sequence
  Synthetic
atggccgactcccaagtacgtttctggctgtcattatgaggggggtcgtcttcgggtattgctgagcactgcggtctacagaactttgaatagtccttggtcatcatttatgatcacgtcggagacccagcatggcgtat

SEQ ID NO: 436401 - DNA, 140 bp, Artificial Sequence
  Synthetic
atacgccatgctgggtctccgcccggacaaaaaagccccctccaaaagactccacggaccaagcgagaggccagccagcagccgacagcaagtgtggacaccaggcggcccaagcacagacgtacttgggagtcggccat

SEQ ID NO: 436402 - DNA, 140 bp, Artificial Sequence
  Synthetic
atggccgactcccaagtacgtctgtgcttgggccgcctggtgtccacacttgctgtcggctgctggctggcctctcgcttggtccgtggagtcttttggagggggcttttttgtccgggcggagacccagcatggcgtat

SEQ ID NO: 436403 - DNA, 140 bp, Artificial Sequence
  Synthetic
aggccctggctgctgatatgccagccagcagccgacagcaagtgtggacaccaggcggcccaagcacagaacagccccgacacaaggccaccaccagccatcccaatatgcgtcctcctcgaccttttgggacagcggtg

SEQ ID NO: 436404 - DNA, 140 bp, Artificial Sequence
  Synthetic
caccgctgtcccaaaaggtcgaggaggacgcatattgggatggctggtggtggccttgtgtcggggctgttctgtgcttgggccgcctggtgtccacacttgctgtcggctgctggctggcatatcagcagccagggcct

SEQ ID NO: 436405 - DNA, 140 bp, Artificial Sequence
  Synthetic
atacgccatgctgggtctccacagccccgacacaaggccaccaccagccatcccaatatgcgtcctcctcgtgggacccccgaggaccaacccccaaggtcgctccggacacagaccacccgtacttgggagtcggccat

SEQ ID NO: 436406 - DNA, 140 bp, Artificial Sequence
  Synthetic
atggccgactcccaagtacgggtggtctgtgtccggagcgaccttgggggttggtcctcgggggtcccacgaggaggacgcatattgggatggctggtggtggccttgtgtcggggctgtggagacccagcatggcgtat

SEQ ID NO: 436407 - DNA, 140 bp, Artificial Sequence
  Synthetic
atacgccatgctgggtctccaactgcatccccacagctcccgggaaaggaacccccagcaactggaaggcccctccccccctccccaaacgcaagaaccccacaaccgaaccgcacaagccgtacttgggagtcggccat

SEQ ID NO: 436408 - DNA, 140 bp, Artificial Sequence
  Synthetic
atggccgactcccaagtacggcttgtgcggttcggttgtggggttcttgcgtttggggagggggggaggggccttccagttgctgggggttcctttcccgggagctgtggggatgcagttggagacccagcatggcgtat

SEQ ID NO: 436409 - DNA, 140 bp, Artificial Sequence
  Synthetic
atacgccatgctgggtctccgaccgaggtgacccaaccgcaggcatccgactccccagacagatcctctccccccggcatactaaacaaaacttagggccaaggaacacacacactcgaccgtacttgggagtcggccat

SEQ ID NO: 436410 - DNA, 140 bp, Artificial Sequence
  Synthetic
atggccgactcccaagtacggtcgagtgtgtgtgttccttggccctaagttttgtttagtatgccggggggagaggatctgtctggggagtcggatgcctgcggttgggtcacctcggtcggagacccagcatggcgtat

SEQ ID NO: 436411 - DNA, 140 bp, Artificial Sequence
  Synthetic
aggccctggctgctgatatgcccccggcatactaaacaaaacttagggccaaggaacacacacactcgacagaacccagaccccggcccgcggcaccgcgcccccaccccccgaaaaccagaccttttgggacagcggtg

SEQ ID NO: 436412 - DNA, 140 bp, Artificial Sequence
  Synthetic
caccgctgtcccaaaaggtctggttttcggggggtgggggcgcggtgccgcgggccggggtctgggttctgtcgagtgtgtgtgttccttggccctaagttttgtttagtatgccgggggcatatcagcagccagggcct

SEQ ID NO: 436413 - DNA, 140 bp, Artificial Sequence
  Synthetic
atacgccatgctgggtctccgaggaagcacacccaccccacacacgaccacggcaaccgaaccagagtccagaccaccctgggccaccagctcccagactcggccatcaccccgcaaaaacgtacttgggagtcggccat

SEQ ID NO: 436414 - DNA, 140 bp, Artificial Sequence
  Synthetic
atggccgactcccaagtacgtttttgcggggtgatggccgagtctgggagctggtggcccagggtggtctggactctggttcggttgccgtggtcgtgtgtggggtgggtgtgcttcctcggagacccagcatggcgtat

SEQ ID NO: 436415 - DNA, 140 bp, Artificial Sequence
  Synthetic
atacgccatgctgggtctcctctcgaagggaccaaaagatcaatccaccacatccgacgatactcaattccccacccctaaaggagacaccgggaatcccaggatcaagactcatccagtcgtacttgggagtcggccat

SEQ ID NO: 436416 - DNA, 140 bp, Artificial Sequence
  Synthetic
atggccgactcccaagtacgactggatgagtcttgatcctgggattcccggtgtctcctttaggggtggggaattgagtatcgtcggatgtggtggattgatcttttggtcccttcgagaggagacccagcatggcgtat

SEQ ID NO: 436417 - DNA, 140 bp, Artificial Sequence
  Synthetic
atacgccatgctgggtctccgtccatcatgggtctcaaggtgaacgtctttgccatattcatggcagtactgttaactctccaaacacccaccggtcaaatccattggggcaatctctctcgtacttgggagtcggccat

SEQ ID NO: 436418 - DNA, 140 bp, Artificial Sequence
  Synthetic
atggccgactcccaagtacgagagagattgccccaatggatttgaccggtgggtgtttggagagttaacagtactgccatgaatatggcaaagacgttcaccttgagacccatgatggacggagacccagcatggcgtat

SEQ ID NO: 436419 - DNA, 140 bp, Artificial Sequence
  Synthetic
aggccctggctgctgatatgacagccggcattgcacttcaccagtccatgctgaactctcaagccatcgacaatctgagagcaagcctggaaactactaatcaggcaattgaggcaatcagaccttttgggacagcggtg

SEQ ID NO: 436420 - DNA, 140 bp, Artificial Sequence
  Synthetic
caccgctgtcccaaaaggtctgattgcctcaattgcctgattagtagtttccaggcttgctctcagattgtcgatggcttgagagttcagcatggactggtgaagtgcaatgccggctgtcatatcagcagccagggcct

SEQ ID NO: 436421 - DNA, 140 bp, Artificial Sequence
  Synthetic
aggccctggctgctgatatgtttggttatgacagatctcaaggctaaccggctaatgaatcctgaaaagattaagcagcagataattgaatcatctgtgaggacttcacctggacttatagaccttttgggacagcggtg

SEQ ID NO: 436422 - DNA, 140 bp, Artificial Sequence
  Synthetic
caccgctgtcccaaaaggtctataagtccaggtgaagtcctcacagatgattcaattatctgctgcttaatcttttcaggattcattagccggttagccttgagatctgtcataaccaaacatatcagcagccagggcct

SEQ ID NO: 436423 - DNA, 140 bp, Artificial Sequence
  Synthetic
atacgccatgctgggtctccgtcgggagcaggaggtatccggacacggtgtacctgcacagaattgacctcggtcctcccatatcattggagaggttggacgtagggacaaatctggggacgtacttgggagtcggccat

SEQ ID NO: 436424 - DNA, 140 bp, Artificial Sequence
  Synthetic
atggccgactcccaagtacgtccccagatttgtccctacgtccaacctctccaatgatatgggaggaccgaggtcaattctgtgcaggtacaccgtgtccggatacctcctgctcccgacggagacccagcatggcgtat

SEQ ID NO: 436425 - DNA, 140 bp, Artificial Sequence
  Synthetic
atacgccatgctgggtctccagatcctggtctaggcgacaggaaggatgaatgctttatgtacatgtttctgctgggagttgttgaggacagcgatcccttagggcccccaatcgggcgacgtacttgggagtcggccat

SEQ ID NO: 436426 - DNA, 140 bp, Artificial Sequence
  Synthetic
atggccgactcccaagtacgtcgcccgattgggggccctaagggatcgctgtcctcaacaactcccagcagaaacatgtacataaagcattcatccttcctgtcgcctagaccaggatctggagacccagcatggcgtat

SEQ ID NO: 436427 - DNA, 140 bp, Artificial Sequence
  Synthetic
aggccctggctgctgatatgagaacatcttatgattgatagaccttatgttttgctggctgttctattcgtcatgtttctgagcttgatcgggttgctagccattgcaggcattagactcgaccttttgggacagcggtg

SEQ ID NO: 436428 - DNA, 140 bp, Artificial Sequence
  Synthetic
caccgctgtcccaaaaggtcgagtctaatgcctgcaatggctagcaacccgatcaagctcagaaacatgacgaatagaacagccagcaaaacataaggtctatcaatcataagatgttctcatatcagcagccagggcct

SEQ ID NO: 436429 - DNA, 140 bp, Artificial Sequence
  Synthetic
atacgccatgctgggtctcccatcgggcagccatctacaccgcagagatccataagagcctcagcaccaatctagatgtaactaactcaatcgagcatcaggtcaaggacgtgctgacaccgtacttgggagtcggccat

SEQ ID NO: 436430 - DNA, 140 bp, Artificial Sequence
  Synthetic
atggccgactcccaagtacggtgtcagcacgtccttgacctgatgctcgattgagttagttacatctagattggtgctgaggctcttatggatctctgcggtgtagatggctgcccgatgggagacccagcatggcgtat

SEQ ID NO: 436431 - DNA, 140 bp, Artificial Sequence
  Synthetic
atacgccatgctgggtctcccgtgggacccccgaggaccaacccccaaggtcgccccagaccaaaaccaccaaccgcatctccacagttcccgggaaagaaacccccagcaactggaaggcgtacttgggagtcggccat

SEQ ID NO: 436432 - DNA, 140 bp, Artificial Sequence
  Synthetic
atggccgactcccaagtacgccttccagttgctgggggtttctttcccgggaactgtggagatgcggttggtggttttggtctggggcgaccttgggggttggtcctcgggggtcccacgggagacccagcatggcgtat

SEQ ID NO: 436433 - DNA, 140 bp, Artificial Sequence
  Synthetic
aggccctggctgctgatatgcagagttgtcacaactgagcatgcaccgagtgtttgaagtaggggttatcagaaatccgggtttgggggctccggtgttccatatgacaaactattttgagaccttttgggacagcggtg

SEQ ID NO: 436434 - DNA, 140 bp, Artificial Sequence
  Synthetic
caccgctgtcccaaaaggtctcaaaatagtttgtcatatggaacaccggagcccccaaacccggatttctgataacccctacttcaaacactcggtgcatgctcagttgtgacaactctgcatatcagcagccagggcct

SEQ ID NO: 436435 - DNA, 140 bp, Artificial Sequence
  Synthetic
atacgccatgctgggtctccgcaaccagtcagtaatgatttcagcaactgcatggtggctttgggggagctcaaattcgcagccctctgtcacagggaagattctatcacaattccctatcgtacttgggagtcggccat

SEQ ID NO: 436436 - DNA, 140 bp, Artificial Sequence
  Synthetic
atggccgactcccaagtacgatagggaattgtgatagaatcttccctgtgacagagggctgcgaatttgagctcccccaaagccaccatgcagttgctgaaatcattactgactggttgcggagacccagcatggcgtat

SEQ ID NO: 436437 - DNA, 140 bp, Artificial Sequence
  Synthetic
atacgccatgctgggtctcctgcttcaggattcgggccattgatcacacacggttcagggatggacctatacaaaaccaaccacaacaatgtgtattggctgactatcccgccaatgaagcgtacttgggagtcggccat

SEQ ID NO: 436438 - DNA, 140 bp, Artificial Sequence
  Synthetic
atggccgactcccaagtacgcttcattggcgggatagtcagccaatacacattgttgtggttggttttgtataggtccatccctgaaccgtgtgtgatcaatggcccgaatcctgaagcaggagacccagcatggcgtat

SEQ ID NO: 436439 - DNA, 140 bp, Artificial Sequence
  Synthetic
atacgccatgctgggtctccaacctagccttaggtgtaatcaacacattggagtggataccgagattcaaggttagtcccaacctcttcactgttccaatcaaggaagcaggcgaggactcgtacttgggagtcggccat

SEQ ID NO: 436440 - DNA, 140 bp, Artificial Sequence
  Synthetic
atggccgactcccaagtacgagtcctcgcctgcttccttgattggaacagtgaagaggttgggactaaccttgaatctcggtatccactccaatgtgttgattacacctaaggctaggttggagacccagcatggcgtat

SEQ ID NO: 436441 - DNA, 140 bp, Artificial Sequence
  Synthetic
atacgccatgctgggtctccgaagatggaaccaatcgcagatagggctgccagtgaaccgatcacatgatgtcacccagacatcaggcatacccactagtgtgaaatagacatcagaattcgtacttgggagtcggccat

SEQ ID NO: 436442 - DNA, 140 bp, Artificial Sequence
  Synthetic
atggccgactcccaagtacgaattctgatgtctatttcacactagtgggtatgcctgatgtctgggtgacatcatgtgatcggttcactggcagccctatctgcgattggttccatcttcggagacccagcatggcgtat

SEQ ID NO: 436443 - DNA, 140 bp, Artificial Sequence
  Synthetic
atacgccatgctgggtctccaagaaaaacgtagggtccaagtggtttcccgttatggactcgctatctgtcaaccagatcttataccctgaagttcacctagatagcccgatagttaccacgtacttgggagtcggccat

SEQ ID NO: 436444 - DNA, 140 bp, Artificial Sequence
  Synthetic
atggccgactcccaagtacgtggtaactatcgggctatctaggtgaacttcagggtataagatctggttgacagatagcgagtccataacgggaaaccacttggaccctacgtttttcttggagacccagcatggcgtat

SEQ ID NO: 436445 - DNA, 140 bp, Artificial Sequence
  Synthetic
atacgccatgctgggtctccggaatccaacttatcaaattgtagccatgctggagccactttcacttgcttacctgcaactgagggatataacagtagaactcagaggtgctttccttaacgtacttgggagtcggccat

SEQ ID NO: 436446 - DNA, 140 bp, Artificial Sequence
  Synthetic
atggccgactcccaagtacgttaaggaaagcacctctgagttctactgttatatccctcagttgcaggtaagcaagtgaaagtggctccagcatggctacaatttgataagttggattccggagacccagcatggcgtat

SEQ ID NO: 436447 - DNA, 140 bp, Artificial Sequence
  Synthetic
aggccctggctgctgatatgatgaaggtacttatcatgagttaattgaagccctagattacattttcataactgatgacatacatctgacaggggagattttctcatttttcagaagtttgaccttttgggacagcggtg

SEQ ID NO: 436448 - DNA, 140 bp, Artificial Sequence
  Synthetic
caccgctgtcccaaaaggtcaaacttctgaaaaatgagaaaatctcccctgtcagatgtatgtcatcagttatgaaaatgtaatctagggcttcaattaactcatgataagtaccttcatcatatcagcagccagggcct

SEQ ID NO: 436449 - DNA, 140 bp, Artificial Sequence
  Synthetic
atacgccatgctgggtctccaggttttccaatgcctgagggacactaactcacggcttggcctaggctctgaattgagagaggacatcaaggagaaaattattaacttgggagtttacatcgtacttgggagtcggccat

SEQ ID NO: 436450 - DNA, 140 bp, Artificial Sequence
  Synthetic
atggccgactcccaagtacgatgtaaactcccaagttaataattttctccttgatgtcctctctcaattcagagcctaggccaagccgtgagttagtgtccctcaggcattggaaaacctggagacccagcatggcgtat

SEQ ID NO: 436451 - DNA, 140 bp, Artificial Sequence
  Synthetic
aggccctggctgctgatatgggacagtgatctgacaatgtacctaaaggacaaggcacttgctgctctacaaagggaatgggattcagtttacccgaaagagttcctgcgttacgaccctgaccttttgggacagcggtg

SEQ ID NO: 436452 - DNA, 140 bp, Artificial Sequence
  Synthetic
caccgctgtcccaaaaggtcagggtcgtaacgcaggaactctttcgggtaaactgaatcccattccctttgtagagcagcaagtgccttgtcctttaggtacattgtcagatcactgtcccatatcagcagccagggcct

SEQ ID NO: 436453 - DNA, 140 bp, Artificial Sequence
  Synthetic
aggccctggctgctgatatgccaagtgatcgctgaaaatctaatctcaaacgggattggcaagtactttaaggacaatgggatggccaaggatgagcacgatttgactaaggcactccacgaccttttgggacagcggtg

SEQ ID NO: 436454 - DNA, 140 bp, Artificial Sequence
  Synthetic
caccgctgtcccaaaaggtcgtggagtgccttagtcaaatcgtgctcatccttggccatcccattgtccttaaagtacttgccaatcccgtttgagattagattttcagcgatcacttggcatatcagcagccagggcct

SEQ ID NO: 436455 - DNA, 140 bp, Artificial Sequence
  Synthetic
atacgccatgctgggtctccggaacgttaaagcagaaaaagggtttgtaggattccctcatgtaattcggcagaatcaagacactgatcatccggagaatatagaaacctacgagacagtcgtacttgggagtcggccat

SEQ ID NO: 436456 - DNA, 140 bp, Artificial Sequence
  Synthetic
atggccgactcccaagtacgactgtctcgtaggtttctatattctccggatgatcagtgtcttgattctgccgaattacatgagggaatcctacaaaccctttttctgctttaacgttccggagacccagcatggcgtat

SEQ ID NO: 436457 - DNA, 140 bp, Artificial Sequence
  Synthetic
atacgccatgctgggtctccctaaccgatcatatcaaggcagaggctaggttatctccagcaggatcttcgtggaacataaatccaattattgtagaccattactcatgctctctgacctcgtacttgggagtcggccat

SEQ ID NO: 436458 - DNA, 140 bp, Artificial Sequence
  Synthetic
atggccgactcccaagtacgaggtcagagagcatgagtaatggtctacaataattggatttatgttccacgaagatcctgctggagataacctagcctctgccttgatatgatcggttagggagacccagcatggcgtat

SEQ ID NO: 436459 - DNA, 140 bp, Artificial Sequence
  Synthetic
aggccctggctgctgatatgagacgcagttagtagaggtgatatcaaccctattctgaaaaaacttacacctatagagcaggtgctgatcaattgcgggttggcaattaacggacctaaagaccttttgggacagcggtg

SEQ ID NO: 436460 - DNA, 140 bp, Artificial Sequence
  Synthetic
caccgctgtcccaaaaggtctttaggtccgttaattgccaacccgcaattgatcagcacctgctctataggtgtaagttttttcagaatagggttgatatcacctctactaactgcgtctcatatcagcagccagggcct

SEQ ID NO: 436461 - DNA, 140 bp, Artificial Sequence
  Synthetic
aggccctggctgctgatatgacgtgagtgggtttttaaggtaacagtcaaggagaccaaagaatggtataagttagtcggatacagtgccctgattaaggattaattggttgaactccgggaccttttgggacagcggtg

SEQ ID NO: 436462 - DNA, 140 bp, Artificial Sequence
  Synthetic
caccgctgtcccaaaaggtcccggagttcaaccaattaatccttaatcagggcactgtatccgactaacttataccattctttggtctccttgactgttaccttaaaaacccactcacgtcatatcagcagccagggcct

SEQ ID NO: 436463 - DNA, 140 bp, Artificial Sequence
  Synthetic
aggccctggctgctgatatgtcttaggcaaaggctacatgacattggccatcacctcaaggcaaatgagacaattgtttcatcacatttttttgtctattcaaaagggatatattatgatgaccttttgggacagcggtg

SEQ ID NO: 436464 - DNA, 140 bp, Artificial Sequence
  Synthetic
caccgctgtcccaaaaggtcatcataatatatcccttttgaatagacaaaaaaatgtgatgaaacaattgtctcatttgccttgaggtgatggccaatgtcatgtagcctttgcctaagacatatcagcagccagggcct

SEQ ID NO: 436465 - DNA, 140 bp, Artificial Sequence
  Synthetic
aggccctggctgctgatatggtcagagactatagttgatgaaacaagggcagcatgcagtaatattgctacaacaatggctaaaagcatcgagagaggttatgaccgttatcttgcatatgaccttttgggacagcggtg

SEQ ID NO: 436466 - DNA, 140 bp, Artificial Sequence
  Synthetic
caccgctgtcccaaaaggtcatatgcaagataacggtcataacctctctcgatgcttttagccattgttgtagcaatattactgcatgctgcccttgtttcatcaactatagtctctgaccatatcagcagccagggcct

SEQ ID NO: 436467 - DNA, 140 bp, Artificial Sequence
  Synthetic
atacgccatgctgggtctccaatgcacactactgaggacaggatcagtagagcggtcggacccagacaagcccaagtgtcatttctacacggtgatcaaagtgagaatgagctaccaggacgtacttgggagtcggccat

SEQ ID NO: 436468 - DNA, 140 bp, Artificial Sequence
  Synthetic
atggccgactcccaagtacgtcctggtagctcattctcactttgatcaccgtgtagaaatgacacttgggcttgtctgggtccgaccgctctactgatcctgtcctcagtagtgtgcattggagacccagcatggcgtat

SEQ ID NO: 436469 - DNA, 140 bp, Artificial Sequence
  Synthetic
atacgccatgctgggtctccgcaagccatggcaggaatctcggaagagcaaggctcagacacagacacccccagagtgtataatgacagagatcttctagactaggtgcgagaggccgaacgtacttgggagtcggccat

SEQ ID NO: 436470 - DNA, 140 bp, Artificial Sequence
  Synthetic
atggccgactcccaagtacgttcggcctctcgcacctagtctagaagatctctgtcattatacactctgggggtgtctgtgtctgagccttgctcttccgagattcctgccatggcttgcggagacccagcatggcgtat

SEQ ID NO: 436471 - DNA, 140 bp, Artificial Sequence
  Synthetic
atacgccatgctgggtctccagaatagcaacagtgtactcatgggcttacggtgatgatgatagctcttggaacgaagcctggttgttggcaaggcaaagggccaatgtgagcctggaggcgtacttgggagtcggccat

SEQ ID NO: 436472 - DNA, 140 bp, Artificial Sequence
  Synthetic
atggccgactcccaagtacgcctccaggctcacattggccctttgccttgccaacaaccaggcttcgttccaagagctatcatcatcaccgtaagcccatgagtacactgttgctattctggagacccagcatggcgtat

SEQ ID NO: 436473 - DNA, 140 bp, Artificial Sequence
  Synthetic
atacgccatgctgggtctcctgtgcagccatcaattgggcatttgatgtacattatcatagaccatcagggaaatatcagatgggtgagctgttgtcttcgttcctttctagaatgagcacgtacttgggagtcggccat

SEQ ID NO: 436474 - DNA, 140 bp, Artificial Sequence
  Synthetic
atggccgactcccaagtacgtgctcattctagaaaggaacgaagacaacagctcacccatctgatatttccctgatggtctatgataatgtacatcaaatgcccaattgatggctgcacaggagacccagcatggcgtat

SEQ ID NO: 436475 - DNA, 140 bp, Artificial Sequence
  Synthetic
aggccctggctgctgatatgatatgacctacctcgacctgttgttgaatgaagagttagaagagttcacatttcttttgtgtgaaagcgatgaggatgtagtaccggacagattcgacaagaccttttgggacagcggtg

SEQ ID NO: 436476 - DNA, 140 bp, Artificial Sequence
  Synthetic
caccgctgtcccaaaaggtcttgtcgaatctgtccggtactacatcctcatcgctttcacacaaaagaaatgtgaactcttctaactcttcattcaacaacaggtcgaggtaggtcatatcatatcagcagccagggcct

SEQ ID NO: 436477 - DNA, 140 bp, Artificial Sequence
  Synthetic
atacgccatgctgggtctccatctccgtcgaggatctatcaaacagataagattgagagttgatccaggattcatttttgacgccctcgctgaggtaaatgtcagtcagccaaaggtcggcgtacttgggagtcggccat

SEQ ID NO: 436478 - DNA, 140 bp, Artificial Sequence
  Synthetic
atggccgactcccaagtacgccgacctttggctgactgacatttacctcagcgagggcgtcaaaaatgaatcctggatcaactctcaatcttatctgtttgatagatcctcgacggagatggagacccagcatggcgtat

SEQ ID NO: 436479 - DNA, 140 bp, Artificial Sequence
  Synthetic
aggccctggctgctgatatgactatagagaagctagaggaattggcagccatcttatcgatggctctactccttggcaaaataggatcaatactggtgattaagcttatgcctttcagcggaccttttgggacagcggtg

SEQ ID NO: 436480 - DNA, 140 bp, Artificial Sequence
  Synthetic
caccgctgtcccaaaaggtccgctgaaaggcataagcttaatcaccagtattgatcctattttgccaaggagtagagccatcgataagatggctgccaattcctctagcttctctatagtcatatcagcagccagggcct

SEQ ID NO: 436481 - DNA, 140 bp, Artificial Sequence
  Synthetic
atacgccatgctgggtctccagatcctggtctaggcgacaggaaggatgaatgccttatgtacatgtttctgctgggagttgttgaggacagcgatcccctagggcccccaatcgggcaacgtacttgggagtcggccat

SEQ ID NO: 436482 - DNA, 140 bp, Artificial Sequence
  Synthetic
atggccgactcccaagtacgttgcccgattgggggccctaggggatcgctgtcctcaacaactcccagcagaaacatgtacataaggcattcatccttcctgtcgcctagaccaggatctggagacccagcatggcgtat

SEQ ID NO: 436483 - DNA, 140 bp, Artificial Sequence
  Synthetic
atacgccatgctgggtctcccagggctcaatgaaaaattggtgttctacaacaacaccccactaactctcctcacaccttgaagaaaggtcccaacaacagggagtgtcctcaacgcaaacgtacttgggagtcggccat

SEQ ID NO: 436484 - DNA, 140 bp, Artificial Sequence
  Synthetic
atggccgactcccaagtacgtttgcgttgaggacactccctgttgttgggacctttcttcaaggtgtgaggagagttagtggggtgttgttgtagaacaccaatttttcattgagccctgggagacccagcatggcgtat

SEQ ID NO: 436485 - DNA, 140 bp, Artificial Sequence
  Synthetic
aggccctggctgctgatatgctcacaccttgaagaaaggtcccaacaacagggagtgtcctcaacgcaaaccaagtgtgcaatgcggttaatctgacaccgctggataccccgcagaggcgaccttttgggacagcggtg

SEQ ID NO: 436486 - DNA, 140 bp, Artificial Sequence
  Synthetic
caccgctgtcccaaaaggtcgcctctgcggggtatccagcggtgtcagattaaccgcattgcacacttggtttgcgttgaggacactccctgttgttgggacctttcttcaaggtgtgagcatatcagcagccagggcct

SEQ ID NO: 436487 - DNA, 140 bp, Artificial Sequence
  Synthetic
atacgccatgctgggtctccttaagcagcagataattgaatcatctgtgcggacttcacctggacttataggtcacatcctatccattaagcaactaagctgcatacaagcaattgtgggcgtacttgggagtcggccat

SEQ ID NO: 436488 - DNA, 140 bp, Artificial Sequence
  Synthetic
atggccgactcccaagtacgcccacaattgcttgtatgcagcttagttgcttaatggataggatgtgacctataagtccaggtgaagtccgcacagatgattcaattatctgctgcttaaggagacccagcatggcgtat

SEQ ID NO: 436489 - DNA, 140 bp, Artificial Sequence
  Synthetic
atacgccatgctgggtctccaggcgcagttagtagaggtgatatcaaccctattctgaaaaaacttacacctatagagcaggtgctgatcagttgcgggttggcaattaacggacctaaacgtacttgggagtcggccat

SEQ ID NO: 436490 - DNA, 140 bp, Artificial Sequence
  Synthetic
atggccgactcccaagtacgtttaggtccgttaattgccaacccgcaactgatcagcacctgctctataggtgtaagttttttcagaatagggttgatatcacctctactaactgcgcctggagacccagcatggcgtat

SEQ ID NO: 436491 - DNA, 140 bp, Artificial Sequence
  Synthetic
atacgccatgctgggtctcctgaagaccctaatcggctactctggaggagcagatgcaagatagtaagaattcaggcagttttgcagccatcagttcctcaagaattccgcatctacgaccgtacttgggagtcggccat

SEQ ID NO: 436492 - DNA, 140 bp, Artificial Sequence
  Synthetic
atggccgactcccaagtacggtcgtagatgcggaattcttgaggaactgatggctgcaaaactgcctgaattcttactatcttgcatctgctcctccagagtagccgattagggtcttcaggagacccagcatggcgtat

SEQ ID NO: 436493 - DNA, 140 bp, Artificial Sequence
  Synthetic
aggccctggctgctgatatgacgtgagtgggtttttaaggtaacagtcaaggagaccaaagaatggtataagttagtcggatacagcgctctgattaaggattaattggttgaactccgggaccttttgggacagcggtg

SEQ ID NO: 436494 - DNA, 140 bp, Artificial Sequence
  Synthetic
caccgctgtcccaaaaggtcccggagttcaaccaattaatccttaatcagagcgctgtatccgactaacttataccattctttggtctccttgactgttaccttaaaaacccactcacgtcatatcagcagccagggcct

SEQ ID NO: 436495 - DNA, 140 bp, Artificial Sequence
  Synthetic
aggccctggctgctgatatgcgaccgaggtgacccaaccgcaggcacccgaccccctagacagatcctctccccccggcaaactaaacaaaacttagggccaaggaacatacacacccaagaccttttgggacagcggtg

SEQ ID NO: 436496 - DNA, 140 bp, Artificial Sequence
  Synthetic
caccgctgtcccaaaaggtcttgggtgtgtatgttccttggccctaagttttgtttagtttgccggggggagaggatctgtctagggggtcgggtgcctgcggttgggtcacctcggtcgcatatcagcagccagggcct

SEQ ID NO: 436497 - DNA, 140 bp, Artificial Sequence
  Synthetic
atacgccatgctgggtctccagcgggagcccccaacccatcccgccggctcccccggcgctcacaggcagccacaccaacccccgaacagacccagcacccagccatcgacaatccaagacgtacttgggagtcggccat

SEQ ID NO: 436498 - DNA, 140 bp, Artificial Sequence
  Synthetic
atggccgactcccaagtacgtcttggattgtcgatggctgggtgctgggtctgttcgggggttggtgtggctgcctgtgagcgccgggggagccggcgggatgggttgggggctcccgctggagacccagcatggcgtat

SEQ ID NO: 436499 - DNA, 140 bp, Artificial Sequence
  Synthetic
atacgccatgctgggtctcccaggggggccccccccaaaaaaagcccccaggggctgacagccagcaccgcgaggaagcccacctaccccacacacgaccacggcaaccgaaccagaatccgtacttgggagtcggccat

SEQ ID NO: 436500 - DNA, 140 bp, Artificial Sequence
  Synthetic
atggccgactcccaagtacggattctggttcggttgccgtggtcgtgtgtggggtaggtgggcttcctcgcggtgctggctgtcagcccctgggggctttttttggggggggcccccctgggagacccagcatggcgtat

SEQ ID NO: 436501 - DNA, 140 bp, Artificial Sequence
  Synthetic
atacgccatgctgggtctcccagaccaccctgggccaccagctcccagactcggccatcaccccgggaaaagggaaggggacaacccgcgcaccccagccccgactcggcgggcagccaccgtacttgggagtcggccat

SEQ ID NO: 436502 - DNA, 140 bp, Artificial Sequence
  Synthetic
atggccgactcccaagtacggtggctgcccgccgagtcggggctggggtgcgcgggttgtccccttcccttttcccggggtgatggccgagtctgggagctggtggcccagggtggtctgggagacccagcatggcgtat

SEQ ID NO: 436503 - DNA, 140 bp, Artificial Sequence
  Synthetic
aggccctggctgctgatatgtgtccatcatgggtctcaaggtgaacgtctctgtcatattcatggcagtactgttaactctccaaacacccaccggtcaaattcattggggcaatctctcgaccttttgggacagcggtg

SEQ ID NO: 436504 - DNA, 140 bp, Artificial Sequence
  Synthetic
caccgctgtcccaaaaggtcgagagattgccccaatgaatttgaccggtgggtgtttggagagttaacagtactgccatgaatatgacagagacgttcaccttgagacccatgatggacacatatcagcagccagggcct

SEQ ID NO: 436505 - DNA, 140 bp, Artificial Sequence
  Synthetic
atacgccatgctgggtctccgttccagccatcaatccttagtcataaaatttaatgccaatacaactctcctcaataactgcacaagggtagagattgcagaatacaggagactactgagcgtacttgggagtcggccat

SEQ ID NO: 436506 - DNA, 140 bp, Artificial Sequence
  Synthetic
atggccgactcccaagtacgctcagtagtctcctgtattctgcaatctctacccttgtgcagttattgaggagagttgtattggcattaaattttatgactaaggattgatggctggaacggagacccagcatggcgtat

SEQ ID NO: 436507 - DNA, 140 bp, Artificial Sequence
  Synthetic
aggccctggctgctgatatgaacagctggcattgcacttcaccagtccatgctgaactctcaagccatcgacaatctgagagcgagcctggaaactactaatcaggcaattgaggcaatcgaccttttgggacagcggtg

SEQ ID NO: 436508 - DNA, 140 bp, Artificial Sequence
  Synthetic
caccgctgtcccaaaaggtcgattgcctcaattgcctgattagtagtttccaggctcgctctcagattgtcgatggcttgagagttcagcatggactggtgaagtgcaatgccagctgttcatatcagcagccagggcct

SEQ ID NO: 436509 - DNA, 140 bp, Artificial Sequence
  Synthetic
aggccctggctgctgatatgatgaggaagggggggttaacctctcgagtgataaccagattgtccaattatgactatgaacaattcagagcagggatggtgctattgacaggaagaaagagaccttttgggacagcggtg

SEQ ID NO: 436510 - DNA, 140 bp, Artificial Sequence
  Synthetic
caccgctgtcccaaaaggtctctttcttcctgtcaatagcaccatccctgctctgaattgttcatagtcataattggacaatctggttatcactcgagaggttaacccccccttcctcatcatatcagcagccagggcct

SEQ ID NO: 436511 - DNA, 140 bp, Artificial Sequence
  Synthetic
atacgccatgctgggtctccgaaatgtcctcattgacaaagagtcatgttcagtgcagctggcgagagctctaagaagccatatgtgggcaaggctagctcgaggacggcctatttacggcgtacttgggagtcggccat

SEQ ID NO: 436512 - DNA, 140 bp, Artificial Sequence
  Synthetic
atggccgactcccaagtacgccgtaaataggccgtcctcgagctagccttgcccacatatggcttcttagagctctcgccagctgcactgaacatgactctttgtcaatgaggacatttcggagacccagcatggcgtat

SEQ ID NO: 436513 - DNA, 140 bp, Artificial Sequence
  Synthetic
aggccctggctgctgatatggaacgaagcctggttgttagcaaggcaaagggccaatgtgagcctggaggagctaagggtaatcactcccatctcaacttcgaccaacttagcacacagggaccttttgggacagcggtg

SEQ ID NO: 436514 - DNA, 140 bp, Artificial Sequence
  Synthetic
caccgctgtcccaaaaggtccctgtgtgctaagttggtcgaagttgagatgggagtgattacccttagctcctccaggctcacattggccctttgccttgctaacaaccaggcttcgttccatatcagcagccagggcct

SEQ ID NO: 436515 - DNA, 140 bp, Artificial Sequence
  Synthetic
atacgccatgctgggtctcctcctgtgctcgtacactcgtatccgggtcctctggtaaccggttcattttatcacaagggaacctaatagtcaattgtgcatcaatcctttgcaagtgttcgtacttgggagtcggccat

SEQ ID NO: 436516 - DNA, 140 bp, Artificial Sequence
  Synthetic
atggccgactcccaagtacgaacacttgcaaaggattgatgcacaattgactattaggttcccttgtgataaaatgaaccggttaccagaggacccggatacgagtgtacgagcacaggaggagacccagcatggcgtat

SEQ ID NO: 436517 - DNA, 140 bp, Artificial Sequence
  Synthetic
aggccctggctgctgatatgaatgcaattgctaagttggaggatgccaaggaattgttggagtcatcggaccagatattgaggagtatgaaaggtttatcgagcactagcatagtttacagaccttttgggacagcggtg

SEQ ID NO: 436518 - DNA, 140 bp, Artificial Sequence
  Synthetic
caccgctgtcccaaaaggtctgtaaactatgctagtgctcgataaacctttcatactcctcaatatctggtccgatgactccaacaattccttggcatcctccaacttagcaattgcattcatatcagcagccagggcct

SEQ ID NO: 436519 - DNA, 140 bp, Artificial Sequence
  Synthetic
aggccctggctgctgatatgtgttgctgcagggggcgttgtaacaagaagggagaacaagttggtatgtcaagaccaggcctaaagcctgatcttacaggaacatcaaatcctatgtaaggaccttttgggacagcggtg

SEQ ID NO: 436520 - DNA, 140 bp, Artificial Sequence
  Synthetic
caccgctgtcccaaaaggtccttacataggatttgatgttcctgtaagatcaggctttaggcctggtcttgacataccaacttgttctcccttcttgttacaacgccccctgcagcaacacatatcagcagccagggcct

SEQ ID NO: 436521 - DNA, 140 bp, Artificial Sequence
  Synthetic
atacgccatgctgggtctcctcactcactctgggatggtgggcatgggagtcagctgcacagtcactcgggaagatggaaccaatcgcggatagggctgccagtgaaccaatcacatgatcgtacttgggagtcggccat

SEQ ID NO: 436522 - DNA, 140 bp, Artificial Sequence
  Synthetic
atggccgactcccaagtacgatcatgtgattggttcactggcagccctatccgcgattggttccatcttcccgagtgactgtgcagctgactcccatgcccaccatcccagagtgagtgaggagacccagcatggcgtat

SEQ ID NO: 436523 - DNA, 140 bp, Artificial Sequence
  Synthetic
atacgccatgctgggtctccgaagatggaaccaatcgcggatagggctgccagtgaaccaatcacatgatgtcacccagacatcaggcatatccgctagtgttaaatggacatcagcattcgtacttgggagtcggccat

SEQ ID NO: 436524 - DNA, 140 bp, Artificial Sequence
  Synthetic
atggccgactcccaagtacgaatgctgatgtccatttaacactagcggatatgcctgatgtctgggtgacatcatgtgattggttcactggcagccctatccgcgattggttccatcttcggagacccagcatggcgtat

SEQ ID NO: 436525 - DNA, 140 bp, Artificial Sequence
  Synthetic
atacgccatgctgggtctccattttccaaccaaatgattataaacaatgtagaggttgggaatgtcatcaagtccaagcttaggagttacccagcccactctcatattccatatccaaatcgtacttgggagtcggccat

SEQ ID NO: 436526 - DNA, 140 bp, Artificial Sequence
  Synthetic
atggccgactcccaagtacgatttggatatggaatatgagagtgggctgggtaactcctaagcttggacttgatgacattcccaacctctacattgtttataatcatttggttggaaaatggagacccagcatggcgtat

SEQ ID NO: 436527 - DNA, 140 bp, Artificial Sequence
  Synthetic
atacgccatgctgggtctccgaaaaggccacaacccgcacaccccagccccgatccggcggacagccccccaacccgaaccggcacccaagagcgatccccgaaggacccccaaatcacacgtacttgggagtcggccat

SEQ ID NO: 436528 - DNA, 140 bp, Artificial Sequence
  Synthetic
atggccgactcccaagtacgtgtgatttgggggtccttcggggatcgctcttgggtgccggttcgggttggggggctgtccgccggatcggggctggggtgtgcgggttgtggccttttcggagacccagcatggcgtat

SEQ ID NO: 436529 - DNA, 140 bp, Artificial Sequence
  Synthetic
aggccctggctgctgatatgcagagatgcaacaaggctatacacccagagccataggaggcaccttgtggaattcgttacatggtccacaccccaactatatcatattctagctaagtccgaccttttgggacagcggtg

SEQ ID NO: 436530 - DNA, 140 bp, Artificial Sequence
  Synthetic
caccgctgtcccaaaaggtcggacttagctagaatatgatatagttggggtgtggaccatgtaacgaattccacaaggtgcctcctatggctctgggtgtatagccttgttgcatctctgcatatcagcagccagggcct

SEQ ID NO: 436531 - DNA, 140 bp, Artificial Sequence
  Synthetic
aggccctggctgctgatatggcaagccatggcaggaatctcggaagaacaaggctcagacacggacacccccacagtgcacaatgacagaaatcttctagactaggtgcgagaggtcgaggaccttttgggacagcggtg

SEQ ID NO: 436532 - DNA, 140 bp, Artificial Sequence
  Synthetic
caccgctgtcccaaaaggtcctcgacctctcgcacctagtctagaagatttctgtcattgtgcactgtgggggtgtccgtgtctgagccttgttcttccgagattcctgccatggcttgccatatcagcagccagggcct

SEQ ID NO: 436533 - DNA, 140 bp, Artificial Sequence
  Synthetic
aggccctggctgctgatatggatccagacttctggaccggttggtcaggttaattggaaacccggatgtgagcgggcccaaactaacaggggcactaataggtatattatccttatttgtgaccttttgggacagcggtg

SEQ ID NO: 436534 - DNA, 140 bp, Artificial Sequence
  Synthetic
caccgctgtcccaaaaggtcacaaataaggataatatacctattagtgcccctgttagtttgggcccgctcacatccgggtttccaattaacctgaccaaccggtccagaagtctggatccatatcagcagccagggcct

SEQ ID NO: 436535 - DNA, 140 bp, Artificial Sequence
  Synthetic
atacgccatgctgggtctcccccacccttcaaggagacaccgggaatcccagaatcaagactcacctaatgtccatcatgggcctcaaggcgagcgtctctgccatattcatgacagtaccgtacttgggagtcggccat

SEQ ID NO: 436536 - DNA, 140 bp, Artificial Sequence
  Synthetic
atggccgactcccaagtacggtactgtcatgaatatggcagagacgctcgccttgaggcccatgatggacattaggtgagtcttgattctgggattcccggtgtctccttgaagggtgggggagacccagcatggcgtat

SEQ ID NO: 436537 - DNA, 140 bp, Artificial Sequence
  Synthetic
aggccctggctgctgatatgagatgcagttagtagaggtgatatcaaccctactctgaaaaaacttacacctatagagcaggtgctggtcaactgcgggttggcaattaacggacctaaagaccttttgggacagcggtg

SEQ ID NO: 436538 - DNA, 140 bp, Artificial Sequence
  Synthetic
caccgctgtcccaaaaggtctttaggtccgttaattgccaacccgcagttgaccagcacctgctctataggtgtaagttttttcagagtagggttgatatcacctctactaactgcatctcatatcagcagccagggcct

SEQ ID NO: 436539 - DNA, 140 bp, Artificial Sequence
  Synthetic
atacgccatgctgggtctccccaggattgctgaaatgatatgtgacattgatacatatatcgtagaggcaggattagccagttttatcctgactattaagtttgggatagaaactatgtacgtacttgggagtcggccat

SEQ ID NO: 436540 - DNA, 140 bp, Artificial Sequence
  Synthetic
atggccgactcccaagtacgtacatagtttctatcccaaacttaatagtcaggataaaactggctaatcctgcctctacgatatatgtatcaatgtcacatatcatttcagcaatcctggggagacccagcatggcgtat

SEQ ID NO: 436541 - DNA, 140 bp, Artificial Sequence
  Synthetic
aggccctggctgctgatatgctccggaaccctaatcctaccctaggtggttaggcattgtttgtaatatattaaagaaaactttgaaaatacgaagtttctattcccagctttgtctggtgaccttttgggacagcggtg

SEQ ID NO: 436542 - DNA, 140 bp, Artificial Sequence
  Synthetic
caccgctgtcccaaaaggtcaccagacaaagctgggaatagaaacttcgtattttcaaagttttctttaatatattacaaacaatgcctaaccacctagggtaggattagggttccggagcatatcagcagccagggcct

SEQ ID NO: 436543 - DNA, 140 bp, Artificial Sequence
  Synthetic
aggccctggctgctgatatgacagacgcgagattagcctcatttggaacggagatcgcgtctttattgacaggtggtgcaacccaatgtgctcgaaagtcaccctcggaaccatcagggcgaccttttgggacagcggtg

SEQ ID NO: 436544 - DNA, 140 bp, Artificial Sequence
  Synthetic
caccgctgtcccaaaaggtcgccctgatggttccgagggtgactttcgagcacattgggttgcaccacctgtcaataaagacgcgatctccgttccaaatgaggctaatctcgcgtctgtcatatcagcagccagggcct

SEQ ID NO: 436545 - DNA, 140 bp, Artificial Sequence
  Synthetic
atacgccatgctgggtctcctacaggagtggaaacccgaatctggtaccacaacctccccgagatcccagaataatgaagaagggggagaccattatgatgatgaactgttctctgatgtcgtacttgggagtcggccat

SEQ ID NO: 436546 - DNA, 140 bp, Artificial Sequence
  Synthetic
atggccgactcccaagtacgacatcagagaacagttcatcatcataatggtctcccccttcttcattattctgggatctcggggaggttgtggtaccagattcgggtttccactcctgtaggagacccagcatggcgtat

SEQ ID NO: 436547 - DNA, 140 bp, Artificial Sequence
  Synthetic
atacgccatgctgggtctcccagatgctgatgaagataataatgaagtagctacagctcaacttacctgccaaccccatgccagtcgacctaactagtacaacctaaatccaccacaaaacgtacttgggagtcggccat

SEQ ID NO: 436548 - DNA, 140 bp, Artificial Sequence
  Synthetic
atggccgactcccaagtacgttttgtggtggatttaggttgtactagttaggtcgactggcatggggttggcaggtaagttgagctgtagctacttcattattatcttcatcagcatctgggagacccagcatggcgtat

SEQ ID NO: 436549 - DNA, 140 bp, Artificial Sequence
  Synthetic
aggccctggctgctgatatgagccgtcgggtttgttcctgacaccggccctgcatcacgcagtgtaatccgctccattataaaatccagccggctagaggaggatcggaagcgttacctggaccttttgggacagcggtg

SEQ ID NO: 436550 - DNA, 140 bp, Artificial Sequence
  Synthetic
caccgctgtcccaaaaggtccaggtaacgcttccgatcctcctctagccggctggattttataatggagcggattacactgcgtgatgcagggccggtgtcaggaacaaacccgacggctcatatcagcagccagggcct

SEQ ID NO: 436551 - DNA, 140 bp, Artificial Sequence
  Synthetic
atacgccatgctgggtctccgacgtgatcataaatgatgaccaaggaccattcaaagctctgtagaccgcagtgccccgcaatgcccgaaaacgaccctcctcataatgacagccagaagcgtacttgggagtcggccat

SEQ ID NO: 436552 - DNA, 140 bp, Artificial Sequence
  Synthetic
atggccgactcccaagtacgcttctggctgtcattatgaggagggtcgttttcgggcattgcggggcactgcggtctacagagctttgaatggtccttggtcatcatttatgatcacgtcggagacccagcatggcgtat

SEQ ID NO: 436553 - DNA, 140 bp, Artificial Sequence
  Synthetic
atacgccatgctgggtctccttggggggcaaggaagataggagggtcaaacagagtcggggagaagccagggagagctacagagaaaccgggtctagcagagcaagcgatgcgagagctgcgtacttgggagtcggccat

SEQ ID NO: 436554 - DNA, 140 bp, Artificial Sequence
  Synthetic
atggccgactcccaagtacgcagctctcgcatcgcttgctctgctagacccggtttctctgtagctctccctggcttctccccgactctgtttgaccctcctatcttccttgccccccaaggagacccagcatggcgtat

SEQ ID NO: 436555 - DNA, 140 bp, Artificial Sequence
  Synthetic
atacgccatgctgggtctccgcgaccaaggtgatccaaccgcaggcacctgactccctagacagaccctctccccccgacaaactaaacaaaacttagggccaaggaacatacacacccacgtacttgggagtcggccat

SEQ ID NO: 436556 - DNA, 140 bp, Artificial Sequence
  Synthetic
atggccgactcccaagtacgtgggtgtgtatgttccttggccctaagttttgtttagtttgtcggggggagagggtctgtctagggagtcaggtgcctgcggttggatcaccttggtcgcggagacccagcatggcgtat

SEQ ID NO: 436557 - DNA, 140 bp, Artificial Sequence
  Synthetic
aggccctggctgctgatatggaaacatgagatcagcaaaagagtttgtagggttccctcaagtaattcggcaggaccaagacactaatcatccggagaacacggaaacctacgagacagtgaccttttgggacagcggtg

SEQ ID NO: 436558 - DNA, 140 bp, Artificial Sequence
  Synthetic
caccgctgtcccaaaaggtcactgtctcgtaggtttccgtgttctccggatgattagtgtcttggtcctgccgaattacttgagggaaccctacaaactcttttgctgatctcatgtttccatatcagcagccagggcct

SEQ ID NO: 436559 - DNA, 140 bp, Artificial Sequence
  Synthetic
aggccctggctgctgatatgggcacaccaacccccgaacagacccagcacccagccatcgacaatccaagacggggggccccccccaaaaaagcccccaggggccgacagccagcaccgcgaccttttgggacagcggtg

SEQ ID NO: 436560 - DNA, 140 bp, Artificial Sequence
  Synthetic
caccgctgtcccaaaaggtcgcggtgctggctgtcggcccctgggggcttttttggggggggccccccgtcttggattgtcgatggctgggtgctgggtctgttcgggggttggtgtgcccatatcagcagccagggcct

SEQ ID NO: 436561 - DNA, 140 bp, Artificial Sequence
  Synthetic
atacgccatgctgggtctcccaatctgagagcgagcctggaaactactaatcaggcaattgagacaatcagacaagcagggcaggagatgatattggctgttcagggtgtccaagactaccgtacttgggagtcggccat

SEQ ID NO: 436562 - DNA, 140 bp, Artificial Sequence
  Synthetic
atggccgactcccaagtacggtagtcttggacaccctgaacagccaatatcatctcctgccctgcttgtctgattgtctcaattgcctgattagtagtttccaggctcgctctcagattgggagacccagcatggcgtat

SEQ ID NO: 436563 - DNA, 140 bp, Artificial Sequence
  Synthetic
atacgccatgctgggtctccgctagagggggtctcgtacaacataggctctcaagagtggtacaccactgtgcctaagtatgtagcaacccaagggtaccttatctcaaattttgatgagcgtacttgggagtcggccat

SEQ ID NO: 436564 - DNA, 140 bp, Artificial Sequence
  Synthetic
atggccgactcccaagtacgctcatcaaaatttgagataaggtacccttgggttgctacatacttaggcacagtggtgtaccactcttgagagcctatgttgtacgagaccccctctagcggagacccagcatggcgtat

SEQ ID NO: 436565 - DNA, 140 bp, Artificial Sequence
  Synthetic
atacgccatgctgggtctcctcattaagtaccctatgggaggtgtagaagggtattgtcagaagctgtggaccatcagcaccattccctatttatacctggctgcttatgagagcggagtcgtacttgggagtcggccat

SEQ ID NO: 436566 - DNA, 140 bp, Artificial Sequence
  Synthetic
atggccgactcccaagtacgactccgctctcataagcagccaggtataaatagggaatggtgctgatggtccacagcttctgacaatacccttctacacctcccatagggtacttaatgaggagacccagcatggcgtat

SEQ ID NO: 436567 - DNA, 140 bp, Artificial Sequence
  Synthetic
aggccctggctgctgatatgaccaaacaaagttgggtaaggatagatcaatcaatgatcatattctagtgcacttaggattcaagatcctattatcagggacaagagcaggattagggatgaccttttgggacagcggtg

SEQ ID NO: 436568 - DNA, 140 bp, Artificial Sequence
  Synthetic
caccgctgtcccaaaaggtcatccctaatcctgctcttgtccctgataataggatcttgaatcctaagtgcactagaatatgatcattgattgatctatccttacccaactttgtttggtcatatcagcagccagggcct

SEQ ID NO: 436569 - DNA, 140 bp, Artificial Sequence
  Synthetic
atacgccatgctgggtctcccccggaccccggtagggccagcacttccgagacacccattaaaaagggcacagacgcgagattagcctcatttggaacggagatcgcgtctttattgacacgtacttgggagtcggccat

SEQ ID NO: 436570 - DNA, 140 bp, Artificial Sequence
  Synthetic
atggccgactcccaagtacgtgtcaataaagacgcgatctccgttccaaatgaggctaatctcgcgtctgtgccctttttaatgggtgtctcggaagtgctggccctaccggggtccgggggagacccagcatggcgtat

SEQ ID NO: 436571 - DNA, 140 bp, Artificial Sequence
  Synthetic
atacgccatgctgggtctccgcatttgggtccctgcccttaggtgttggcagatccacagcaaagcccgaagaactcctcaaagaggccactgagcttgacatagttgttagacgtacagcgtacttgggagtcggccat

SEQ ID NO: 436572 - DNA, 140 bp, Artificial Sequence
  Synthetic
atggccgactcccaagtacgctgtacgtctaacaactatgtcaagctcagtggcctctttgaggagttcttcgggctttgctgtggatctgccaacacctaagggcagggacccaaatgcggagacccagcatggcgtat

SEQ ID NO: 436573 - DNA, 140 bp, Artificial Sequence
  Synthetic
atacgccatgctgggtctccagtcgaggttacaatgtgtcatctatagtcactatgacatcccagggaatgtatgggggaacttacctagtggaaaagcctaatctgagcagcaaaaggtcgtacttgggagtcggccat

SEQ ID NO: 436574 - DNA, 140 bp, Artificial Sequence
  Synthetic
atggccgactcccaagtacgaccttttgctgctcagattaggcttttccactaggtaagttcccccatacattccctgggatgtcatagtgactatagatgacacattgtaacctcgactggagacccagcatggcgtat

SEQ ID NO: 436575 - DNA, 140 bp, Artificial Sequence
  Synthetic
atacgccatgctgggtctccaacctagccttaggtgtaatcaacacattggagtggataccgagattcaaggttagtcccaacctcttcactgtcccaattaaggaagcaggcgaagactcgtacttgggagtcggccat

SEQ ID NO: 436576 - DNA, 140 bp, Artificial Sequence
  Synthetic
atggccgactcccaagtacgagtcttcgcctgcttccttaattgggacagtgaagaggttgggactaaccttgaatctcggtatccactccaatgtgttgattacacctaaggctaggttggagacccagcatggcgtat

SEQ ID NO: 436577 - DNA, 140 bp, Artificial Sequence
  Synthetic
aggccctggctgctgatatggcccaggccgctcattttcttacttttatccttttaggttgcctataaagggggtccccatcgaattacaagtggaatgcttcacatgggaccaaaaactgaccttttgggacagcggtg

SEQ ID NO: 436578 - DNA, 140 bp, Artificial Sequence
  Synthetic
caccgctgtcccaaaaggtcagtttttggtcccatgtgaagcattccacttgtaattcgatggggaccccctttataggcaacctaaaaggataaaagtaagaaaatgagcggcctgggccatatcagcagccagggcct

SEQ ID NO: 436579 - DNA, 140 bp, Artificial Sequence
  Synthetic
atacgccatgctgggtctcccagcaacaacatctcaaatatgagcatcaaggatttcagacccccacacgatgatgttgcaaaattgctcaaagatatcaacacaagcaagcacaatcttcgtacttgggagtcggccat

SEQ ID NO: 436580 - DNA, 140 bp, Artificial Sequence
  Synthetic
atggccgactcccaagtacgaagattgtgcttgcttgtgttgatatctttgagcaattttgcaacatcatcgtgtgggggtctgaaatccttgatgctcatatttgagatgttgttgctgggagacccagcatggcgtat

SEQ ID NO: 436581 - DNA, 140 bp, Artificial Sequence
  Synthetic
atacgccatgctgggtctccaatcgggttgaactcatctgcttgctacaaagctgttgagatatcaacattaattaggagatgccttgagccaggggaagacggcttgttcttgggtgagcgtacttgggagtcggccat

SEQ ID NO: 436582 - DNA, 140 bp, Artificial Sequence
  Synthetic
atggccgactcccaagtacgctcacccaagaacaagccgtcttcccctggctcaaggcatctcctaattaatgttgatatctcaacagctttgtagcaagcagatgagttcaacccgattggagacccagcatggcgtat

SEQ ID NO: 436583 - DNA, 140 bp, Artificial Sequence
  Synthetic
atacgccatgctgggtctccgaacaaggaaatctcagatattgaagtgcaagatcccgagggattcaacatgattctgggtactatcctagctcaaatttgggtcttgctcgcaaaggcgcgtacttgggagtcggccat

SEQ ID NO: 436584 - DNA, 140 bp, Artificial Sequence
  Synthetic
atggccgactcccaagtacgcgcctttgcgagcaagacccaaatttgagctaggatagtacccagaatcatgttgaatccctcgggatcttgcacttcaatatctgagatttccttgttcggagacccagcatggcgtat

SEQ ID NO: 436585 - DNA, 140 bp, Artificial Sequence
  Synthetic
atacgccatgctgggtctccgacaagagatggttaggagatcagctggaaaggtcagttccacactggcatctgaactcggtatcacagccgaggatgcaaggcttgtttcagagattgccgtacttgggagtcggccat

SEQ ID NO: 436586 - DNA, 140 bp, Artificial Sequence
  Synthetic
atggccgactcccaagtacggcaatctctgaaacaagccttgcatcctcggctgtgataccgagttcagatgccagtgtggaactgacctttccagctgatctcctaaccatctcttgtcggagacccagcatggcgtat

SEQ ID NO: 436587 - DNA, 140 bp, Artificial Sequence
  Synthetic
aggccctggctgctgatatgtctgaactcggtatcacagccgaggatgcaaggcttgtttcagagattgcaatgcatactactgaggacaggaccagtagagcagttggacccaggcaaggaccttttgggacagcggtg

SEQ ID NO: 436588 - DNA, 140 bp, Artificial Sequence
  Synthetic
caccgctgtcccaaaaggtccttgcctgggtccaactgctctactggtcctgtcctcagtagtatgcattgcaatctctgaaacaagccttgcatcctcggctgtgataccgagttcagacatatcagcagccagggcct

SEQ ID NO: 436589 - DNA, 140 bp, Artificial Sequence
  Synthetic
atacgccatgctgggtctccggagaactccagagacaccgggcccagcagagcaagtgatgcgagagctgcccatctcccaaccagcacacccccagacattgacactgcatcggagtaccgtacttgggagtcggccat

SEQ ID NO: 436590 - DNA, 140 bp, Artificial Sequence
  Synthetic
atggccgactcccaagtacggtactccgatgcagtgtcaatgtctgggggtgtgctggttgggagatgggcagctctcgcatcacttgctctgctgggcccggtgtctctggagttctccggagacccagcatggcgtat

SEQ ID NO: 436591 - DNA, 140 bp, Artificial Sequence
  Synthetic
atacgccatgctgggtctccagccaagaaccacaggacagtcgaaggtcagctgacgccctgctcaagctgcaagccatggcagggatcctagaagaacaaggctcagacacggacaccccgtacttgggagtcggccat

SEQ ID NO: 436592 - DNA, 140 bp, Artificial Sequence
  Synthetic
atggccgactcccaagtacggggtgtccgtgtctgagccttgttcttctaggatccctgccatggcttgcagcttgagcagggcgtcagctgaccttcgactgtcctgtggttcttggctggagacccagcatggcgtat

SEQ ID NO: 436593 - DNA, 140 bp, Artificial Sequence
  Synthetic
aggccctggctgctgatatggagccgatggcagaagagcaggcacgccatgtcaaaaacgggctggaatgcatccgggctctcaaggccgagcccatcagctcactggccatcggggaaggaccttttgggacagcggtg

SEQ ID NO: 436594 - DNA, 140 bp, Artificial Sequence
  Synthetic
caccgctgtcccaaaaggtccttccccgatggccagtgagctgatgggctcggccttgagagcccggatgcattccagcccgtttttgacatggcgtgcctgctcttctgccatcggctccatatcagcagccagggcct

SEQ ID NO: 436595 - DNA, 140 bp, Artificial Sequence
  Synthetic
atacgccatgctgggtctcccacagcaattggatcagctgaaggcggtgcacctcgcatccgcggtcagggatctggagagagcgatgacaacactgaagttttgggaatcccctcaagacgtacttgggagtcggccat

SEQ ID NO: 436596 - DNA, 140 bp, Artificial Sequence
  Synthetic
atggccgactcccaagtacgtcttgaggggattcccaaaacttcagtgttgtcatcgctctctccagatccctgaccgcggatgcgaggtgcaccgccttcagctgatccaattgctgtgggagacccagcatggcgtat

SEQ ID NO: 436597 - DNA, 140 bp, Artificial Sequence
  Synthetic
atacgccatgctgggtctcccagacgcgaggttagcctcatttggaacggagatcgcgtctttattgaccggtggtgcaacccaatgtgctcaaaggtcacccttggaaccattagggcccgtacttgggagtcggccat

SEQ ID NO: 436598 - DNA, 140 bp, Artificial Sequence
  Synthetic
atggccgactcccaagtacgggccctaatggttccaagggtgacctttgagcacattgggttgcaccaccggtcaataaagacgcgatctccgttccaaatgaggctaacctcgcgtctgggagacccagcatggcgtat

SEQ ID NO: 436599 - DNA, 140 bp, Artificial Sequence
  Synthetic
atacgccatgctgggtctccgaccagaacaacatccgcctaccctccatcattgttataaaaaacttaggaaccaggtccacacagccgccagccaaccaaccatccactcccacgactgcgtacttgggagtcggccat

SEQ ID NO: 436600 - DNA, 140 bp, Artificial Sequence
  Synthetic
atggccgactcccaagtacgcagtcgtgggagtggatggttggttggctggcggctgtgtggacctggttcctaagttttttataacaatgatggagggtaggcggatgttgttctggtcggagacccagcatggcgtat

SEQ ID NO: 436601 - DNA, 140 bp, Artificial Sequence
  Synthetic
aggccctggctgctgatatgaaccaggtccacacagccgccagccaaccaaccatccactcccacgactggagccgatggcagaagagcaggcacgccatgtcaaaaacggactggaatggaccttttgggacagcggtg

SEQ ID NO: 436602 - DNA, 140 bp, Artificial Sequence
  Synthetic
caccgctgtcccaaaaggtccattccagtccgtttttgacatggcgtgcctgctcttctgccatcggctccagtcgtgggagtggatggttggttggctggcggctgtgtggacctggttcatatcagcagccagggcct

SEQ ID NO: 436603 - DNA, 140 bp, Artificial Sequence
  Synthetic
atacgccatgctgggtctcctgactctccttgatgatatcaaaggaaccaacgatcttgccaaattccaccagatgctgatgaagataataatgaagtagctacagctcaactcacctgccgtacttgggagtcggccat

SEQ ID NO: 436604 - DNA, 140 bp, Artificial Sequence
  Synthetic
atggccgactcccaagtacggcaggtgagttgagctgtagctacttcattattatcttcatcagcatctggtggaatttggcaagatcgttggttcctttgatatcatcaaggagagtcaggagacccagcatggcgtat

SEQ ID NO: 436605 - DNA, 140 bp, Artificial Sequence
  Synthetic
atacgccatgctgggtctccgcattcgggtccctgcccttaggtgttggtagatccacagcaaaacccgaggaactcctcaaagaggccactgagcttgacatagttgttagacgtacagcgtacttgggagtcggccat

SEQ ID NO: 436606 - DNA, 140 bp, Artificial Sequence
  Synthetic
atggccgactcccaagtacgctgtacgtctaacaactatgtcaagctcagtggcctctttgaggagttcctcgggttttgctgtggatctaccaacacctaagggcagggacccgaatgcggagacccagcatggcgtat

SEQ ID NO: 436607 - DNA, 140 bp, Artificial Sequence
  Synthetic
atacgccatgctgggtctccacagccccgacacaaggccaccaccagccatcccaatctgcgtcctcctcgtgggacccccgaggaccaaccccgaaggtcgctccgaacacagaccacccgtacttgggagtcggccat

SEQ ID NO: 436608 - DNA, 140 bp, Artificial Sequence
  Synthetic
atggccgactcccaagtacgggtggtctgtgttcggagcgaccttcggggttggtcctcgggggtcccacgaggaggacgcagattgggatggctggtggtggccttgtgtcggggctgtggagacccagcatggcgtat

SEQ ID NO: 436609 - DNA, 140 bp, Artificial Sequence
  Synthetic
atacgccatgctgggtctcccacaccaacccccgaacagacccagcacccagtcaccggtaatccaagacgggggggcttctccagaaaaaggcccccaggggccgacagccagcaccaccgtacttgggagtcggccat

SEQ ID NO: 436610 - DNA, 140 bp, Artificial Sequence
  Synthetic
atggccgactcccaagtacggtggtgctggctgtcggcccctgggggcctttttctggagaagcccccccgtcttggattaccggtgactgggtgctgggtctgttcgggggttggtgtgggagacccagcatggcgtat

SEQ ID NO: 436611 - DNA, 140 bp, Artificial Sequence
  Synthetic
atacgccatgctgggtctccgaggaggcccacccaccccacacacgaccacggcaaccaaactagagctcggaccaccctgggccaccagcccctagactcggccatcacccagaaggcacgtacttgggagtcggccat

SEQ ID NO: 436612 - DNA, 140 bp, Artificial Sequence
  Synthetic
atggccgactcccaagtacgtgccttctgggtgatggccgagtctaggggctggtggcccagggtggtccgagctctagtttggttgccgtggtcgtgtgtggggtgggtgggcctcctcggagacccagcatggcgtat

SEQ ID NO: 436613 - DNA, 140 bp, Artificial Sequence
  Synthetic
atacgccatgctgggtctccagaacccagaccccggcccgcggcaccgcgcccccaccccccgaaaaccagagggagcccccaaccaaacccgccggcccccccggtgcccacaggtaggcgtacttgggagtcggccat

SEQ ID NO: 436614 - DNA, 140 bp, Artificial Sequence
  Synthetic
atggccgactcccaagtacgcctacctgtgggcaccgggggggccggcgggtttggttgggggctccctctggttttcggggggtgggggcgcggtgccgcgggccggggtctgggttctggagacccagcatggcgtat

SEQ ID NO: 436615 - DNA, 140 bp, Artificial Sequence
  Synthetic
aggccctggctgctgatatggagggagcccccaaccaaacccgccggcccccccggtgcccacaggtaggcacaccaacccccgaccagacccagcacccagccaccgacaatccaagacgaccttttgggacagcggtg

SEQ ID NO: 436616 - DNA, 140 bp, Artificial Sequence
  Synthetic
caccgctgtcccaaaaggtcgtcttggattgtcggtggctgggtgctgggtctggtcgggggttggtgtgcctacctgtgggcaccgggggggccggcgggtttggttgggggctccctccatatcagcagccagggcct

SEQ ID NO: 436617 - DNA, 140 bp, Artificial Sequence
  Synthetic
atacgccatgctgggtctccaaggacatcagtatcccacagcctctccaagtcccccgatcttatcctctcctcgaagggaccaaaaaattaatccaccacacctaacgacactcaactccgtacttgggagtcggccat

SEQ ID NO: 436618 - DNA, 140 bp, Artificial Sequence
  Synthetic
atggccgactcccaagtacggagttgagtgtcgttaggtgtggtggattaattttttggtcccttcgaggagaggataagatcgggggacttggagaggctgtgggatactgatgtccttggagacccagcatggcgtat

SEQ ID NO: 436619 - DNA, 140 bp, Artificial Sequence
  Synthetic
atacgccatgctgggtctccggaaaggccacaacccgcgcaccccagccccgatccggcgggcagccactcaacccgaaccagcacccaagagcgatccctgggggacccccaaaccgcacgtacttgggagtcggccat

SEQ ID NO: 436620 - DNA, 140 bp, Artificial Sequence
  Synthetic
atggccgactcccaagtacgtgcggtttgggggtcccccagggatcgctcttgggtgctggttcgggttgagtggctgcccgccggatcggggctggggtgcgcgggttgtggcctttccggagacccagcatggcgtat

SEQ ID NO: 436621 - DNA, 140 bp, Artificial Sequence
  Synthetic
aggccctggctgctgatatgcaacccgaaccagcacccaagagcgatccctgggggacccccaaaccgcaaaagacatcagtatcccacagcctctccaagtcccccggtctcctcctctgaccttttgggacagcggtg

SEQ ID NO: 436622 - DNA, 140 bp, Artificial Sequence
  Synthetic
caccgctgtcccaaaaggtcagaggaggagaccgggggacttggagaggctgtgggatactgatgtcttttgcggtttgggggtcccccagggatcgctcttgggtgctggttcgggttgcatatcagcagccagggcct

SEQ ID NO: 436623 - DNA, 140 bp, Artificial Sequence
  Synthetic
atacgccatgctgggtctccaaagacatcagtatcccacagcctctccaagtcccccggtctcctcctcttctcgaagggaccaaaagatcaatccaccacatccgacgacactcaattccgtacttgggagtcggccat

SEQ ID NO: 436624 - DNA, 140 bp, Artificial Sequence
  Synthetic
atggccgactcccaagtacggaattgagtgtcgtcggatgtggtggattgatcttttggtcccttcgagaagaggaggagaccgggggacttggagaggctgtgggatactgatgtctttggagacccagcatggcgtat

SEQ ID NO: 436625 - DNA, 140 bp, Artificial Sequence
  Synthetic
aggccctggctgctgatatgtctcgaagggaccaaaagatcaatccaccacatccgacgacactcaattccccacccccaaaggagacaccgggaatcccagaatcaagactcatccagtgaccttttgggacagcggtg

SEQ ID NO: 436626 - DNA, 140 bp, Artificial Sequence
  Synthetic
caccgctgtcccaaaaggtcactggatgagtcttgattctgggattcccggtgtctcctttgggggtggggaattgagtgtcgtcggatgtggtggattgatcttttggtcccttcgagacatatcagcagccagggcct

SEQ ID NO: 436627 - DNA, 140 bp, Artificial Sequence
  Synthetic
atacgccatgctgggtctccacagttctggaaccaattagagatgcacttaacgcaatgacccagaacataagaccggtccagagtgtaacctcaaggaggagacacaagagatttgcagcgtacttgggagtcggccat

SEQ ID NO: 436628 - DNA, 140 bp, Artificial Sequence
  Synthetic
atggccgactcccaagtacgctgcaaatctcttgtgtctcctccttgaggttacactctggaccggtcttatgttctgggtcattgcgttaagtgcatctctaattggttccagaactgtggagacccagcatggcgtat

SEQ ID NO: 436629 - DNA, 140 bp, Artificial Sequence
  Synthetic
aggccctggctgctgatatgcattatttggccccagcttacgggaccccatatctgcggagatatccatccaggctttgagctatgcgcttggaggagatatcaataaggtattagaaaagaccttttgggacagcggtg

SEQ ID NO: 436630 - DNA, 140 bp, Artificial Sequence
  Synthetic
caccgctgtcccaaaaggtcttttctaataccttattgatatctcctccaagcgcatagctcaaagcctggatggatatctccgcagatatggggtcccgtaagctggggccaaataatgcatatcagcagccagggcct

SEQ ID NO: 436631 - DNA, 140 bp, Artificial Sequence
  Synthetic
atacgccatgctgggtctccgagtggtcctggcaggtgctgccctaggcgtcgccacggccgcccagataacagccggcattgcacttcaccagtccatgctgaattctcaagccattgacgtacttgggagtcggccat

SEQ ID NO: 436632 - DNA, 140 bp, Artificial Sequence
  Synthetic
atggccgactcccaagtacgtcaatggcttgagaattcagcatggactggtgaagtgcaatgccggctgttatctgggcggccgtggcgacgcctagggcagcacctgccaggaccactcggagacccagcatggcgtat

SEQ ID NO: 436633 - DNA, 140 bp, Artificial Sequence
  Synthetic
aggccctggctgctgatatgttgctgccgatcactgcccggtggtcgaggtgaacggtgtgaccatccaagtcgggagcaggaggtatccggacgcggtgtacctgcacagaattgacctgaccttttgggacagcggtg

SEQ ID NO: 436634 - DNA, 140 bp, Artificial Sequence
  Synthetic
caccgctgtcccaaaaggtcaggtcaattctgtgcaggtacaccgcgtccggatacctcctgctcccgacttggatggtcacaccgttcacctcgaccaccgggcagtgatcggcagcaacatatcagcagccagggcct

SEQ ID NO: 436635 - DNA, 140 bp, Artificial Sequence
  Synthetic
aggccctggctgctgatatgagaccaggcctaaagcctgatcttacagggacatcaaaatcctatgtaaggtcgctctgatcctctacaactcttgaaacacagatttcccacaagtctcgaccttttgggacagcggtg

SEQ ID NO: 436636 - DNA, 140 bp, Artificial Sequence
  Synthetic
caccgctgtcccaaaaggtcgagacttgtgggaaatctgtgtttcaagagttgtagaggatcagagcgaccttacataggattttgatgtccctgtaagatcaggctttaggcctggtctcatatcagcagccagggcct

SEQ ID NO: 436637 - DNA, 140 bp, Artificial Sequence
  Synthetic
atacgccatgctgggtctccgtcgctctgatcctctacaactcttgaaacacagatttcccacaagtctcctcttcgtcatcaagcaaccaccgcatccagcatcaagcccacctgaaatcgtacttgggagtcggccat

SEQ ID NO: 436638 - DNA, 140 bp, Artificial Sequence
  Synthetic
atggccgactcccaagtacgatttcaggtgggcttgatgctggatgcggtggttgcttgatgacgaagaggagacttgtgggaaatctgtgtttcaagagttgtagaggatcagagcgacggagacccagcatggcgtat

SEQ ID NO: 436639 - DNA, 140 bp, Artificial Sequence
  Synthetic
atacgccatgctgggtctcctgtctccggcttccctctggccgaacgatatcggtagttaattaaaacttagggtgcaagatcatccacaatgtcaccacaacgagaccgaataaatgcccgtacttgggagtcggccat

SEQ ID NO: 436640 - DNA, 140 bp, Artificial Sequence
  Synthetic
atggccgactcccaagtacgggcatttattcggtctcgttgtggtgacattgtggatgatcttgcaccctaagttttaattaactaccgatatcgttcggccagagggaagccggagacaggagacccagcatggcgtat

SEQ ID NO: 436641 - DNA, 140 bp, Artificial Sequence
  Synthetic
atacgccatgctgggtctccacgaccccactgcagatgtcgaactcaatcccgacctgaaacccatcataggcagagattcaggccgagcactggccgaagttctcaagaaacccgttgccgtacttgggagtcggccat

SEQ ID NO: 436642 - DNA, 140 bp, Artificial Sequence
  Synthetic
atggccgactcccaagtacggcaacgggtttcttgagaacttcggccagtgctcggcctgaatctctgcctatgatgggtttcaggtcgggattgagttcgacatctgcagtggggtcgtggagacccagcatggcgtat

SEQ ID NO: 436643 - DNA, 140 bp, Artificial Sequence
  Synthetic
aggccctggctgctgatatggaattgagggaggacatcaaggagaaaattattaacttgggagtttacatgcacagctcccaatggtttgagccctttctgttttggtttacagtcaagagaccttttgggacagcggtg

SEQ ID NO: 436644 - DNA, 140 bp, Artificial Sequence
  Synthetic
caccgctgtcccaaaaggtctcttgactgtaaaccaaaacagaaagggctcaaaccattgggagctgtgcatgtaaactcccaagttaataattttctccttgatgtcctccctcaattccatatcagcagccagggcct

SEQ ID NO: 436645 - DNA, 140 bp, Artificial Sequence
  Synthetic
atacgccatgctgggtctccgtcgctctgatcctccacaactcctgaaacacaaatgtcccacaagtcttctctttgtcatcaagcaaccactgcatccagcatcaatcccacctgaaatcgtacttgggagtcggccat

SEQ ID NO: 436646 - DNA, 140 bp, Artificial Sequence
  Synthetic
atggccgactcccaagtacgatttcaggtgggattgatgctggatgcagtggttgcttgatgacaaagagaagacttgtgggacatttgtgtttcaggagttgtggaggatcagagcgacggagacccagcatggcgtat

SEQ ID NO: 436647 - DNA, 140 bp, Artificial Sequence
  Synthetic
atacgccatgctgggtctccagacacacacctgtattcttcactggtagttcagttgagctgttaatctctcgtgaccttgttgctataatcagtaaggagtctcaacatgtatattacccgtacttgggagtcggccat

SEQ ID NO: 436648 - DNA, 140 bp, Artificial Sequence
  Synthetic
atggccgactcccaagtacgggtaatatacatgttgagactccttactgattatagcaacaaggtcacgagagattaacagctcaactgaactaccagtgaagaatacaggtgtgtgtctggagacccagcatggcgtat

SEQ ID NO: 436649 - DNA, 140 bp, Artificial Sequence
  Synthetic
atacgccatgctgggtctcctatctctggcttccttctggccgaatacgatcggtcattaacaaaaacttagggtgcaagatcatccacaatgtcaccgcaacgagaccggataaatgcccgtacttgggagtcggccat

SEQ ID NO: 436650 - DNA, 140 bp, Artificial Sequence
  Synthetic
atggccgactcccaagtacgggcatttatccggtctcgttgcggtgacattgtggatgatcttgcaccctaagtttttgttaatgaccgatcgtattcggccagaaggaagccagagataggagacccagcatggcgtat

SEQ ID NO: 436651 - DNA, 140 bp, Artificial Sequence
  Synthetic
atacgccatgctgggtctccactctggctgtctcaggagtccccaaagatctcaaagaaagtcacaggggggggccagtcttaaaaacctactcccgaagcccagtccacacaagtaccacgtacttgggagtcggccat

SEQ ID NO: 436652 - DNA, 140 bp, Artificial Sequence
  Synthetic
atggccgactcccaagtacgtggtacttgtgtggactgggcttcgggagtaggtttttaagactggcccccccctgtgactttctttgagatctttggggactcctgagacagccagagtggagacccagcatggcgtat

SEQ ID NO: 436653 - DNA, 140 bp, Artificial Sequence
  Synthetic
aggccctggctgctgatatgggtaggcagtatagattgcttcaatttcatagtcagtaatatccctacctctagtgtggggtttatccattcagatatagagaccttacctaacaaagatgaccttttgggacagcggtg

SEQ ID NO: 436654 - DNA, 140 bp, Artificial Sequence
  Synthetic
caccgctgtcccaaaaggtcatctttgttaggtaaggtctctatatctgaatggataaaccccacactagaggtagggatattactgactatgaaattgaagcaatctatactgcctacccatatcagcagccagggcct

SEQ ID NO: 436655 - DNA, 140 bp, Artificial Sequence
  Synthetic
atacgccatgctgggtctccgtgaaccttgtctaccctaggtacagcaacttcatatctactgaatcttatttagttatgacagatctcaaagctaaccggctaatgaatcctgaaaagacgtacttgggagtcggccat

SEQ ID NO: 436656 - DNA, 140 bp, Artificial Sequence
  Synthetic
atggccgactcccaagtacgtcttttcaggattcattagccggttagctttgagatctgtcataactaaataagattcagtagatatgaagttgctgtacctagggtagacaaggttcacggagacccagcatggcgtat

SEQ ID NO: 436657 - DNA, 140 bp, Artificial Sequence
  Synthetic
aggccctggctgctgatatgcagatgctgatgaagataataatgaagtagctacagctcaacttacctgccaacctcatgccaatcgacctaattagtacagcctaaatccattataaaagaccttttgggacagcggtg

SEQ ID NO: 436658 - DNA, 140 bp, Artificial Sequence
  Synthetic
caccgctgtcccaaaaggtcttttataatggatttaggctgtactaattaggtcgattggcatgaggttggcaggtaagttgagctgtagctacttcattattatcttcatcagcatctgcatatcagcagccagggcct

SEQ ID NO: 436659 - DNA, 140 bp, Artificial Sequence
  Synthetic
atacgccatgctgggtctcccagaattatcacaactgagcatgtaccgagtgtttgaagtaggtgttataagaaatccaggcttgggggctccggtgttccatatgacaaactattttgacgtacttgggagtcggccat

SEQ ID NO: 436660 - DNA, 140 bp, Artificial Sequence
  Synthetic
atggccgactcccaagtacgtcaaaatagtttgtcatatggaacaccggagcccccaagcctggatttcttataacacctacttcaaacactcggtacatgctcagttgtgataattctgggagacccagcatggcgtat

SEQ ID NO: 436661 - DNA, 140 bp, Artificial Sequence
  Synthetic
atacgccatgctgggtctccacaaccaatcagcaaggatctcagcaactgcatggtagctttgggggagctcaaactcgcagccctttgtcacgggggagattccatcacaattccctatcgtacttgggagtcggccat

SEQ ID NO: 436662 - DNA, 140 bp, Artificial Sequence
  Synthetic
atggccgactcccaagtacgatagggaattgtgatggaatctcccccgtgacaaagggctgcgagtttgagctcccccaaagctaccatgcagttgctgagatccttgctgattggttgtggagacccagcatggcgtat

SEQ ID NO: 436663 - DNA, 140 bp, Artificial Sequence
  Synthetic
atacgccatgctgggtctccaatcaagcaaattgggctgtcccgacaacacgaacagatgataagttgcggatggagacatgcttccagcaggcgtgcaagggcaaaatccaagcactctcgtacttgggagtcggccat

SEQ ID NO: 436664 - DNA, 140 bp, Artificial Sequence
  Synthetic
atggccgactcccaagtacgagagtgcttggattttgcccttgcacgcctgctggaagcatgtctccatccgcaacttatcatctgttcgtgttgtcgggacagcccaatttgcttgattggagacccagcatggcgtat

SEQ ID NO: 436665 - DNA, 140 bp, Artificial Sequence
  Synthetic
atacgccatgctgggtctccaccaaacaaagttgggtaaggatagatcaataaatgatcgtattctagcgcacttaggattcaagatcctattatcagggacaagagcaggattagggtacgtacttgggagtcggccat

SEQ ID NO: 436666 - DNA, 140 bp, Artificial Sequence
  Synthetic
atggccgactcccaagtacgtaccctaatcctgctcttgtccctgataataggatcttgaatcctaagtgcgctagaatacgatcatttattgatctatccttacccaactttgtttggtggagacccagcatggcgtat

SEQ ID NO: 436667 - DNA, 140 bp, Artificial Sequence
  Synthetic
atacgccatgctgggtctccgtgaaaatcccgagtgggcaccgttgaaggacagcaggattccttcatacggggtcttgtctgtcgacctgagtctggcagctgagcccaaaatcaaaatcgtacttgggagtcggccat

SEQ ID NO: 436668 - DNA, 140 bp, Artificial Sequence
  Synthetic
atggccgactcccaagtacgattttgattttgggctcagctgccagactcaggtcgacagacaagaccccgtatgaaggaatcctgctgtccttcaacggtgcccactcgggattttcacggagacccagcatggcgtat

SEQ ID NO: 436669 - DNA, 140 bp, Artificial Sequence
  Synthetic
atacgccatgctgggtctccaaacacattattatagtaccaatccctggggattcctcaattaccactcgatctagacttctggaccggttggttaggttaattggaaacccggatgtaacgtacttgggagtcggccat

SEQ ID NO: 436670 - DNA, 140 bp, Artificial Sequence
  Synthetic
atggccgactcccaagtacgttacatccgggtttccaattaacctaaccaaccggtccagaagtctagatcgagtggtaattgaggaatccccagggattggtactataataatgtgtttggagacccagcatggcgtat

SEQ ID NO: 436671 - DNA, 140 bp, Artificial Sequence
  Synthetic
atacgccatgctgggtctccaacttagccttaggtgtaatcaacacattggagtggataccgagactcaaggttagtcccaacctcttcactgtcccaattaaggaagctggcgagaactcgtacttgggagtcggccat

SEQ ID NO: 436672 - DNA, 140 bp, Artificial Sequence
  Synthetic
atggccgactcccaagtacgagttctcgccagcttccttaattgggacagtgaagaggttgggactaaccttgagtctcggtatccactccaatgtgttgattacacctaaggctaagttggagacccagcatggcgtat

SEQ ID NO: 436673 - DNA, 140 bp, Artificial Sequence
  Synthetic
atacgccatgctgggtctccgcgggcccaaattaacaggggcactaataggtatattgtccttatttgtggagtctccaggccaattgattcagaggatcaccgatgacccagacgttagcgtacttgggagtcggccat

SEQ ID NO: 436674 - DNA, 140 bp, Artificial Sequence
  Synthetic
atggccgactcccaagtacgctaacgtctgggtcatcggtgatcctctgaatcaattggcctggagactccacaaataaggacaatatacctattagtgcccctgttaatttgggcccgcggagacccagcatggcgtat

SEQ ID NO: 436675 - DNA, 140 bp, Artificial Sequence
  Synthetic
atacgccatgctgggtctcccataaggctattagaggttgtccagagtgaccaatcacaatccggccttaccttcgcgtcaagaggtactaacatggaggatgaggcagaccaatactttcgtacttgggagtcggccat

SEQ ID NO: 436676 - DNA, 140 bp, Artificial Sequence
  Synthetic
atggccgactcccaagtacgaaagtattggtctgcctcatcctccatgttagtacctcttgacgcgaaggtaaggccggattgtgattggtcactctggacaacctctaatagccttatgggagacccagcatggcgtat

SEQ ID NO: 436677 - DNA, 140 bp, Artificial Sequence
  Synthetic
aggccctggctgctgatatgccttcgcgtcaagaggtactaacatggaggatgaggcagaccaatacttttcgcatgacgatccaagcagtggtgatcaatccaggttcggatggttcgagaccttttgggacagcggtg

SEQ ID NO: 436678 - DNA, 140 bp, Artificial Sequence
  Synthetic
caccgctgtcccaaaaggtctcgaaccatccgaacctggattgatcaccactgcttggatcgtcatgcgaaaagtattggtctgcctcatcctccatgttagtacctcttgacgcgaaggcatatcagcagccagggcct

SEQ ID NO: 436679 - DNA, 140 bp, Artificial Sequence
  Synthetic
atacgccatgctgggtctccgaataaggaaatctcagatattgaagtgcaagatcctgagggattcaacatgattctaggtactatcctagctcaaatttgggtcttgcttgcaaaggcgcgtacttgggagtcggccat

SEQ ID NO: 436680 - DNA, 140 bp, Artificial Sequence
  Synthetic
atggccgactcccaagtacgcgcctttgcaagcaagacccaaatttgagctaggatagtacctagaatcatgttgaatccctcaggatcttgcacttcaatatctgagatttccttattcggagacccagcatggcgtat

SEQ ID NO: 436681 - DNA, 140 bp, Artificial Sequence
  Synthetic
atacgccatgctgggtctccgtcactgccccagacacggcagctgactcggagctaagaaggtggataaagtacacccaacaaagaagggtagtcggtgaatttagattggagagaaaatcgtacttgggagtcggccat

SEQ ID NO: 436682 - DNA, 140 bp, Artificial Sequence
  Synthetic
atggccgactcccaagtacgattttctctccaatctaaattcaccgactacccttctttgttgggtgtactttatccaccttcttagctccgagtcagctgccgtgtctggggcagtgacggagacccagcatggcgtat

SEQ ID NO: 436683 - DNA, 140 bp, Artificial Sequence
  Synthetic
aggccctggctgctgatatgttcactcagacatcaagaatacccaccagtgtggaatagacatcagaattaagaaaaacgtagggtccaagtggttccccgttatggactcgctgtctgtgaccttttgggacagcggtg

SEQ ID NO: 436684 - DNA, 140 bp, Artificial Sequence
  Synthetic
caccgctgtcccaaaaggtcacagacagcgagtccataacggggaaccacttggaccctacgtttttcttaattctgatgtctattccacactggtgggtattcttgatgtctgagtgaacatatcagcagccagggcct

SEQ ID NO: 436685 - DNA, 140 bp, Artificial Sequence
  Synthetic
atacgccatgctgggtctccggttggatgtggtgaggaataggattgctgaggacctctccttacgtcgattcatggtcgctctaatcctggacatcaagagaacacctggaaacaaacccgtacttgggagtcggccat

SEQ ID NO: 436686 - DNA, 140 bp, Artificial Sequence
  Synthetic
atggccgactcccaagtacgggtttgtttccaggtgttctcttgatgtccaggattagagcgaccatgaatcgacgtaaggagaggtcctcagcaatcctattcctcaccacatccaaccggagacccagcatggcgtat

SEQ ID NO: 436687 - DNA, 140 bp, Artificial Sequence
  Synthetic
atacgccatgctgggtctcccaggattgctgaaatgatatgtgacattgacacatatatcgtagaagcaggaatagccagttttattctgactattaagtttgggatagaaaccatgtatcgtacttgggagtcggccat

SEQ ID NO: 436688 - DNA, 140 bp, Artificial Sequence
  Synthetic
atggccgactcccaagtacgatacatggtttctatcccaaacttaatagtcagaataaaactggctattcctgcttctacgatatatgtgtcaatgtcacatatcatttcagcaatcctgggagacccagcatggcgtat

SEQ ID NO: 436689 - DNA, 140 bp, Artificial Sequence
  Synthetic
aggccctggctgctgatatggaatagccagttttattctgactattaagtttgggatagaaaccatgtatcctgctcttggactgcatgaatttgctggtgagttatccacacttgaatcgaccttttgggacagcggtg

SEQ ID NO: 436690 - DNA, 140 bp, Artificial Sequence
  Synthetic
caccgctgtcccaaaaggtcgattcaagtgtggataactcaccagcaaattcatgcagtccaagagcaggatacatggtttctatcccaaacttaatagtcagaataaaactggctattccatatcagcagccagggcct

SEQ ID NO: 436691 - DNA, 140 bp, Artificial Sequence
  Synthetic
atacgccatgctgggtctcccctgatgaatctttaccagcaaatgggggaaactgcaccttacatggtaattctggagaactcaattcagaacaaattcagtgcaggatcgtaccctctgcgtacttgggagtcggccat

SEQ ID NO: 436692 - DNA, 140 bp, Artificial Sequence
  Synthetic
atggccgactcccaagtacgcagagggtacgatcctgcactgaatttgttctgaattgagttctccagaattaccatgtaaggtgcagtttcccccatttgctggtaaagattcatcaggggagacccagcatggcgtat

SEQ ID NO: 436693 - DNA, 140 bp, Artificial Sequence
  Synthetic
atacgccatgctgggtctccctctggagctatgccatgggggtaggagtggaactggaaaactccatgggaggcttgaactttggtcgatcttactttgatccagcatattttagattagcgtacttgggagtcggccat

SEQ ID NO: 436694 - DNA, 140 bp, Artificial Sequence
  Synthetic
atggccgactcccaagtacgctaatctaaaatatgctggatcaaagtaagatcgaccaaagttcaagcctcccatggagttttccagttccactcctacccccatggcatagctccagagggagacccagcatggcgtat

SEQ ID NO: 436695 - DNA, 140 bp, Artificial Sequence
  Synthetic
atacgccatgctgggtctccgacaagagatggttagaaggtcagctggaaaggtcagttccacattggcatctgaactcggtatcacggccgaagatgcaaggcttgtttcagagattgccgtacttgggagtcggccat

SEQ ID NO: 436696 - DNA, 140 bp, Artificial Sequence
  Synthetic
atggccgactcccaagtacggcaatctctgaaacaagccttgcatcttcggccgtgataccgagttcagatgccaatgtggaactgacctttccagctgaccttctaaccatctcttgtcggagacccagcatggcgtat

SEQ ID NO: 436697 - DNA, 140 bp, Artificial Sequence
  Synthetic
aggccctggctgctgatatgtctgaactcggtatcacggccgaagatgcaaggcttgtttcagagattgcaatgcatactactgaagacagggccagtagagcggttggacccaggcaaggaccttttgggacagcggtg

SEQ ID NO: 436698 - DNA, 140 bp, Artificial Sequence
  Synthetic
caccgctgtcccaaaaggtccttgcctgggtccaaccgctctactggccctgtcttcagtagtatgcattgcaatctctgaaacaagccttgcatcttcggccgtgataccgagttcagacatatcagcagccagggcct

SEQ ID NO: 436699 - DNA, 140 bp, Artificial Sequence
  Synthetic
atacgccatgctgggtctcccccaagtctcatttttacacggtgatcaaagtgagaatgagctaccgggattggggggcaaggaagatagaagggtcaaacagagtcgaggggaaaccagcgtacttgggagtcggccat

SEQ ID NO: 436700 - DNA, 140 bp, Artificial Sequence
  Synthetic
atggccgactcccaagtacgctggtttcccctcgactctgtttgacccttctatcttccttgccccccaatcccggtagctcattctcactttgatcaccgtgtaaaaatgagacttgggggagacccagcatggcgtat

SEQ ID NO: 436701 - DNA, 140 bp, Artificial Sequence
  Synthetic
atacgccatgctgggtctccggagacctccagagaaactgggcccagcagagcaagtgatgcgagagctgcccatctcccaaccagcacacccccagacattgacactgcatcagagtaccgtacttgggagtcggccat

SEQ ID NO: 436702 - DNA, 140 bp, Artificial Sequence
  Synthetic
atggccgactcccaagtacggtactctgatgcagtgtcaatgtctgggggtgtgctggttgggagatgggcagctctcgcatcacttgctctgctgggcccagtttctctggaggtctccggagacccagcatggcgtat

SEQ ID NO: 436703 - DNA, 140 bp, Artificial Sequence
  Synthetic
atacgccatgctgggtctccagccaagacccacaggacagtcgaaggtcagctgacgccctactcaggctgcaagccatggcagggatcctggaagaacaaggctcagacacggacaccccgtacttgggagtcggccat

SEQ ID NO: 436704 - DNA, 140 bp, Artificial Sequence
  Synthetic
atggccgactcccaagtacggggtgtccgtgtctgagccttgttcttccaggatccctgccatggcttgcagcctgagtagggcgtcagctgaccttcgactgtcctgtgggtcttggctggagacccagcatggcgtat

SEQ ID NO: 436705 - DNA, 140 bp, Artificial Sequence
  Synthetic
atacgccatgctgggtctccctagagtgtacaacgatagagatcttctagactaggtacaagaggccggggaccagaacaacatccgcctaccctccatcattgttataaaaaacttaggcgtacttgggagtcggccat

SEQ ID NO: 436706 - DNA, 140 bp, Artificial Sequence
  Synthetic
atggccgactcccaagtacgcctaagttttttataacaatgatggagggtaggcggatgttgttctggtccccggcctcttgtacctagtctagaagatctctatcgttgtacactctagggagacccagcatggcgtat

SEQ ID NO: 436707 - DNA, 140 bp, Artificial Sequence
  Synthetic
atacgccatgctgggtctccaaccaggtccacacagccatcagcccatcaaccatccactcccacaattggagccgatggcagaagagcaggcacgccatgtcaaaaacggactggaatgcgtacttgggagtcggccat

SEQ ID NO: 436708 - DNA, 140 bp, Artificial Sequence
  Synthetic
atggccgactcccaagtacgcattccagtccgtttttgacatggcgtgcctgctcttctgccatcggctccaattgtgggagtggatggttgatgggctgatggctgtgtggacctggttggagacccagcatggcgtat

SEQ ID NO: 436709 - DNA, 140 bp, Artificial Sequence
  Synthetic
aggccctggctgctgatatggagccgatggcagaagagcaggcacgccatgtcaaaaacggactggaatgtatccgggctctcaaggccgagcccatcaacccactggccatcggggaaggaccttttgggacagcggtg

SEQ ID NO: 436710 - DNA, 140 bp, Artificial Sequence
  Synthetic
caccgctgtcccaaaaggtccttccccgatggccagtgggttgatgggctcggccttgagagcccggatacattccagtccgtttttgacatggcgtgcctgctcttctgccatcggctccatatcagcagccagggcct

SEQ ID NO: 436711 - DNA, 140 bp, Artificial Sequence
  Synthetic
atacgccatgctgggtctccggggccagtcccaaaaacccacccccgaaaccccgcccacacaagtaccagaaacatgagatcagcaaaagagtttgtagggttccctcaagtaattcggcgtacttgggagtcggccat

SEQ ID NO: 436712 - DNA, 140 bp, Artificial Sequence
  Synthetic
atggccgactcccaagtacgccgaattacttgagggaaccctacaaactcttttgctgatctcatgtttctggtacttgtgtgggcggggtttcgggggtgggtttttgggactggccccggagacccagcatggcgtat

SEQ ID NO: 436713 - DNA, 140 bp, Artificial Sequence
  Synthetic
atacgccatgctgggtctccccatggcagcatggtcagaaatatcagataacccaggacaggagcgagccacctgcaaggaagaggaggcaggcagttcgggtctcagcaaaccatgcttcgtacttgggagtcggccat

SEQ ID NO: 436714 - DNA, 140 bp, Artificial Sequence
  Synthetic
atggccgactcccaagtacgaagcatggtttgctgagacccgaactgcctgcctcctcttccttgcaggtggctcgctcctgtcctgggttatctgatatttctgaccatgctgccatggggagacccagcatggcgtat

SEQ ID NO: 436715 - DNA, 140 bp, Artificial Sequence
  Synthetic
atacgccatgctgggtctccctcagcaattggatcagctgaaggcggtgcacctcgcatccgcggtcagggatctggagagggcgatgacaacgctgaaattttgggaatcccctcaagacgtacttgggagtcggccat

SEQ ID NO: 436716 - DNA, 140 bp, Artificial Sequence
  Synthetic
atggccgactcccaagtacgtcttgaggggattcccaaaatttcagcgttgtcatcgccctctccagatccctgaccgcggatgcgaggtgcaccgccttcagctgatccaattgctgagggagacccagcatggcgtat

SEQ ID NO: 436717 - DNA, 140 bp, Artificial Sequence
  Synthetic
atacgccatgctgggtctccaatctccaggcatcaagcactgggttacagcgttatcatgtttatgatcacagcggtgaagcggttgagggaatccaagatgctgactctatcatggttccgtacttgggagtcggccat

SEQ ID NO: 436718 - DNA, 140 bp, Artificial Sequence
  Synthetic
atggccgactcccaagtacggaaccatgatagagtcagcatcttggattccctcaaccgcttcaccgctgtgatcataaacatgataacgctgtaacccagtgcttgatgcctggagattggagacccagcatggcgtat

SEQ ID NO: 436719 - DNA, 140 bp, Artificial Sequence
  Synthetic
aggccctggctgctgatatgcagcggtgaagcggttgagggaatccaagatgctgactctatcatggttcgatcaggccttgatgatgatagcgccgtctcaggaggagacaatgaatctgaccttttgggacagcggtg

SEQ ID NO: 436720 - DNA, 140 bp, Artificial Sequence
  Synthetic
caccgctgtcccaaaaggtcagattcattgtctcctcctgagacggcgctatcatcatcaaggcctgatcgaaccatgatagagtcagcatcttggattccctcaaccgcttcaccgctgcatatcagcagccagggcct

SEQ ID NO: 436721 - DNA, 140 bp, Artificial Sequence
  Synthetic
aggccctggctgctgatatgacaatcagaccatagccgtaacaaaaagggtgcccagcacatggccttacaaccttaagaaatgggaagctgccagagtaactagaaactactttgtaatgaccttttgggacagcggtg

SEQ ID NO: 436722 - DNA, 140 bp, Artificial Sequence
  Synthetic
caccgctgtcccaaaaggtcattacaaagtagtttctagttactctggcagcttcccatttcttaaggttgtaaggccatgtgctgggcaccctttttgttacggctatggtctgattgtcatatcagcagccagggcct

SEQ ID NO: 436723 - DNA, 140 bp, Artificial Sequence
  Synthetic
atacgccatgctgggtctccagaggcaacaacctttcgaagcttgggaaaactctcaatgttcctccgcctccggatcccagtagggccagcacttccgaaacacccattaaaaagggcacgtacttgggagtcggccat

SEQ ID NO: 436724 - DNA, 140 bp, Artificial Sequence
  Synthetic
atggccgactcccaagtacgtgccctttttaatgggtgtttcggaagtgctggccctactgggatccggaggcggaggaacattgagagttttcccaagcttcgaaaggttgttgcctctggagacccagcatggcgtat

SEQ ID NO: 436725 - DNA, 140 bp, Artificial Sequence
  Synthetic
atacgccatgctgggtctcccagacgcgaggttagcctcatttggaacggagatcgcgtctttattgacaggtggtgcaacccaatgtgctcgaaggtcaccctcggaaccattagggcccgtacttgggagtcggccat

SEQ ID NO: 436726 - DNA, 140 bp, Artificial Sequence
  Synthetic
atggccgactcccaagtacgggccctaatggttccgagggtgaccttcgagcacattgggttgcaccacctgtcaataaagacgcgatctccgttccaaatgaggctaacctcgcgtctgggagacccagcatggcgtat

SEQ ID NO: 436727 - DNA, 140 bp, Artificial Sequence
  Synthetic
atacgccatgctgggtctccaggtgcacctgcggggaatgtccccgagtttgtgagtaatgccgcactgatacaggagtggacacccgaatctggtaccacagtctcccagagatcccagcgtacttgggagtcggccat

SEQ ID NO: 436728 - DNA, 140 bp, Artificial Sequence
  Synthetic
atggccgactcccaagtacgctgggatctctgggagactgtggtaccagattcgggtgtccactcctgtatcagtgcggcattactcacaaactcggggacattccccgcaggtgcacctggagacccagcatggcgtat

SEQ ID NO: 436729 - DNA, 140 bp, Artificial Sequence
  Synthetic
atacgccatgctgggtctccaataatgaggaagggggagactattatgatgatgagctgttttctgatgtccaagatatcaagacagctttggccaaaatacacgaggataatcagaagacgtacttgggagtcggccat

SEQ ID NO: 436730 - DNA, 140 bp, Artificial Sequence
  Synthetic
atggccgactcccaagtacgtcttctgattatcctcgtgtattttggccaaagctgtcttgatatcttggacatcagaaaacagctcatcatcataatagtctcccccttcctcattattggagacccagcatggcgtat

SEQ ID NO: 436731 - DNA, 140 bp, Artificial Sequence
  Synthetic
aggccctggctgctgatatgacctagggcagctcatgagatcctagatcacagtgtcacaggggcaagagagtccattgcaggcatgctggacaccacaaaaggcctgattcgagccagcgaccttttgggacagcggtg

SEQ ID NO: 436732 - DNA, 140 bp, Artificial Sequence
  Synthetic
caccgctgtcccaaaaggtcgctggctcgaatcaggccttttgtggtgtccagcatgcctgcaatggactctcttgcccctgtgacactgtgatctaggatctcatgagctgccctaggtcatatcagcagccagggcct

SEQ ID NO: 436733 - DNA, 140 bp, Artificial Sequence
  Synthetic
atacgccatgctgggtctccgtgaccccactgcagatgtcgaaatcaatcccgacctgaaactcatcataggcagagactcaggccgagcactggccgaagtcctcaagaagcccgttgccgtacttgggagtcggccat

SEQ ID NO: 436734 - DNA, 140 bp, Artificial Sequence
  Synthetic
atggccgactcccaagtacggcaacgggcttcttgaggacttcggccagtgctcggcctgagtctctgcctatgatgagtttcaggtcgggattgatttcgacatctgcagtggggtcacggagacccagcatggcgtat

SEQ ID NO: 436735 - DNA, 140 bp, Artificial Sequence
  Synthetic
atacgccatgctgggtctcccagccgacaactccaaggaatgacaaatggacggaccagttccagaggacagctgctgaaggaattccagctaaagccgatcgggaaaaaggtgagctcgcgtacttgggagtcggccat

SEQ ID NO: 436736 - DNA, 140 bp, Artificial Sequence
  Synthetic
atggccgactcccaagtacgcgagctcacctttttcccgatcggctttagctggaattccttcagcagctgtcctctggaactggtccgtccatttgtcattccttggagttgtcggctgggagacccagcatggcgtat

SEQ ID NO: 436737 - DNA, 140 bp, Artificial Sequence
  Synthetic
atacgccatgctgggtctccgctgtcgggtttgttcctgacaccagccctacatcacgcagtgtaatccgctccattataaaatccagccggctagatgaggatcggaagcgttacctgacgtacttgggagtcggccat

SEQ ID NO: 436738 - DNA, 140 bp, Artificial Sequence
  Synthetic
atggccgactcccaagtacgtcaggtaacgcttccgatcctcatctagccggctggattttataatggagcggattacactgcgtgatgtagggctggtgtcaggaacaaacccgacagcggagacccagcatggcgtat

SEQ ID NO: 436739 - DNA, 140 bp, Artificial Sequence
  Synthetic
atacgccatgctgggtctcctgactctccttgatgatatcaaaggagccaacgatcttgccaggttccaccagatgctgatgaagataataatgaagtagctacagctcaactcacatgccgtacttgggagtcggccat

SEQ ID NO: 436740 - DNA, 140 bp, Artificial Sequence
  Synthetic
atggccgactcccaagtacggcatgtgagttgagctgtagctacttcattattatcttcatcagcatctggtggaacctggcaagatcgttggctcctttgatatcatcaaggagagtcaggagacccagcatggcgtat

SEQ ID NO: 436741 - DNA, 140 bp, Artificial Sequence
  Synthetic
atacgccatgctgggtctcccaaccccatgccagttgacccaaccaacacgacttaaatctattataaaaaacttaggagcaaagtgattgcctcccaagttccaacatgacagagatctcgtacttgggagtcggccat

SEQ ID NO: 436742 - DNA, 140 bp, Artificial Sequence
  Synthetic
atggccgactcccaagtacgagatctctgtcatgttggaacttgggaggcaatcactttgctcctaagttttttataatagatttaagtcgtgttggttgggtcaactggcatggggttgggagacccagcatggcgtat

SEQ ID NO: 436743 - DNA, 140 bp, Artificial Sequence
  Synthetic
atacgccatgctgggtctcccagataagaaggttgatactaactttatataccagcaaggaatgcttctagggttgggtgttttagaaacactatttcgacttgagaaagacaccgggtccgtacttgggagtcggccat

SEQ ID NO: 436744 - DNA, 140 bp, Artificial Sequence
  Synthetic
atggccgactcccaagtacggacccggtgtctttctcaagtcgaaatagtgtttctaaaacacccaaccctagaagcattccttgctggtatataaagttagtatcaaccttcttatctgggagacccagcatggcgtat

SEQ ID NO: 436745 - DNA, 140 bp, Artificial Sequence
  Synthetic
atacgccatgctgggtctccacgatttcgacaagtcggcatgggacatcaaagggtcgatcgctccgatacaacccaccacctataatgatggcaggctggtgcctcaggtcagagtcatcgtacttgggagtcggccat

SEQ ID NO: 436746 - DNA, 140 bp, Artificial Sequence
  Synthetic
atggccgactcccaagtacgatgactctgacctgaggcaccagcctgccatcattataggtggtgggttgtatcggagcgatcgaccctttgatgtcccatgccgacttgtcgaaatcgtggagacccagcatggcgtat

SEQ ID NO: 436747 - DNA, 140 bp, Artificial Sequence
  Synthetic
atacgccatgctgggtctccgcatttgggtccctgcccttaggtgttggtagatccacagcaaagcccgaagagctcctcaaagaggccactgagcttgacatagttgtcagacgtacagcgtacttgggagtcggccat

SEQ ID NO: 436748 - DNA, 140 bp, Artificial Sequence
  Synthetic
atggccgactcccaagtacgctgtacgtctgacaactatgtcaagctcagtggcctctttgaggagctcttcgggctttgctgtggatctaccaacacctaagggcagggacccaaatgcggagacccagcatggcgtat

SEQ ID NO: 436749 - DNA, 140 bp, Artificial Sequence
  Synthetic
aggccctggctgctgatatgctcacaccttggagaaaggtcctaacaacagggagtgtcttcaacgcaaaccaagtatgcaatgcggttaatctgataccgttggataccccgcagaggtgaccttttgggacagcggtg

SEQ ID NO: 436750 - DNA, 140 bp, Artificial Sequence
  Synthetic
caccgctgtcccaaaaggtcacctctgcggggtatccaacggtatcagattaaccgcattgcatacttggtttgcgttgaagacactccctgttgttaggacctttctccaaggtgtgagcatatcagcagccagggcct

SEQ ID NO: 436751 - DNA, 140 bp, Artificial Sequence
  Synthetic
atacgccatgctgggtctcccaacctactggtgacccttaggattgacaaggcgattggccctggaaagatcatcgacaatgcagagcagcttcctgaggcaacatttatggtccacatccgtacttgggagtcggccat

SEQ ID NO: 436752 - DNA, 140 bp, Artificial Sequence
  Synthetic
atggccgactcccaagtacggatgtggaccataaatgttgcctcaggaagctgctctgcattgtcgatgatctttccagggccaatcgccttgtcaatcctaagggtcaccagtaggttgggagacccagcatggcgtat

SEQ ID NO: 436753 - DNA, 140 bp, Artificial Sequence
  Synthetic
atacgccatgctgggtctccgggaatttcagaagaaagaagagtgaagtctactctgccgattattgcaaaatgaaaattgaaaagatgggcctggtttttgcacttggtgggataggggcgtacttgggagtcggccat

SEQ ID NO: 436754 - DNA, 140 bp, Artificial Sequence
  Synthetic
atggccgactcccaagtacgcccctatcccaccaagtgcaaaaaccaggcccatcttttcaattttcattttgcaataatcggcagagtagacttcactcttctttcttctgaaattcccggagacccagcatggcgtat

SEQ ID NO: 436755 - DNA, 140 bp, Artificial Sequence
  Synthetic
atacgccatgctgggtctccgcaccagtcttcacattagaagtacaggcaaaatgagcaagaccctccacgcacaactcgggttcaagaagaccttatgttacccgctgatggatatcaacgtacttgggagtcggccat

SEQ ID NO: 436756 - DNA, 140 bp, Artificial Sequence
  Synthetic
atggccgactcccaagtacgttgatatccatcagcgggtaacataaggtcttcttgaacccgagttgtgcgtggagggtcttgctcattttgcctgtacttctaatgtgaagactggtgcggagacccagcatggcgtat

SEQ ID NO: 436757 - DNA, 140 bp, Artificial Sequence
  Synthetic
atacgccatgctgggtctcccgaagaccttaatcgattgctctggagaagcagatgcaagatagtaagaatccaggcagttttgcagccatcagttccccaagaattccgcatttacgatcgtacttgggagtcggccat

SEQ ID NO: 436758 - DNA, 140 bp, Artificial Sequence
  Synthetic
atggccgactcccaagtacgatcgtaaatgcggaattcttggggaactgatggctgcaaaactgcctggattcttactatcttgcatctgcttctccagagcaatcgattaaggtcttcgggagacccagcatggcgtat

SEQ ID NO: 436759 - DNA, 140 bp, Artificial Sequence
  Synthetic
atacgccatgctgggtctccgacgtgatcataaatgatgaccaaggactgttcaaggttctgtagaccgcagtgcccagcaatgccaaaaaatgacccccttcacaatgacaaccagaagcgtacttgggagtcggccat

SEQ ID NO: 436760 - DNA, 140 bp, Artificial Sequence
  Synthetic
atggccgactcccaagtacgcttctggttgtcattgtgaagggggtcattttttggcattgctgggcactgcggtctacagaaccttgaacagtccttggtcatcatttatgatcacgtcggagacccagcatggcgtat

SEQ ID NO: 436761 - DNA, 140 bp, Artificial Sequence
  Synthetic
atacgccatgctgggtctccgcccggacaaaaaagccccccaggaaagactccatggaccaagcagtcaaccagccagcagccgacggcaagcacgaataccagccggcccaagcgcagacgtacttgggagtcggccat

SEQ ID NO: 436762 - DNA, 140 bp, Artificial Sequence
  Synthetic
atggccgactcccaagtacgtctgcgcttgggccggctggtattcgtgcttgccgtcggctgctggctggttgactgcttggtccatggagtctttcctggggggcttttttgtccgggcggagacccagcatggcgtat

SEQ ID NO: 436763 - DNA, 140 bp, Artificial Sequence
  Synthetic
atacgccatgctgggtctccaattggattgaactcgtctgcttgctacaaagctgttgagatatcaacattaattaggagatgccttgagccaggggaagacggcttgttcttgggcgagcgtacttgggagtcggccat

SEQ ID NO: 436764 - DNA, 140 bp, Artificial Sequence
  Synthetic
atggccgactcccaagtacgctcgcccaagaacaagccgtcttcccctggctcaaggcatctcctaattaatgttgatatctcaacagctttgtagcaagcagacgagttcaatccaattggagacccagcatggcgtat

SEQ ID NO: 436765 - DNA, 140 bp, Artificial Sequence
  Synthetic
atacgccatgctgggtctccacagccccgacacaaggccatcaccagccatcccaactcgcgtcctcctcgcgggacccccgaggaccagctccaaaggtcgcccccgacccaaaccacccgtacttgggagtcggccat

SEQ ID NO: 436766 - DNA, 140 bp, Artificial Sequence
  Synthetic
atggccgactcccaagtacgggtggtttgggtcgggggcgacctttggagctggtcctcgggggtcccgcgaggaggacgcgagttgggatggctggtgatggccttgtgtcggggctgtggagacccagcatggcgtat

SEQ ID NO: 436767 - DNA, 140 bp, Artificial Sequence
  Synthetic
atacgccatgctgggtctccgaccccgtccccgcactccccgaggaagaaacccccaccaactgggaggcccccttccccctctcccgacacaacaactccacaaccggatcgcacaagccgtacttgggagtcggccat

SEQ ID NO: 436768 - DNA, 140 bp, Artificial Sequence
  Synthetic
atggccgactcccaagtacggcttgtgcgatccggttgtggagttgttgtgtcgggagagggggaagggggcctcccagttggtgggggtttcttcctcggggagtgcggggacggggtcggagacccagcatggcgtat

SEQ ID NO: 436769 - DNA, 140 bp, Artificial Sequence
  Synthetic
atacgccatgctgggtctccggtaggcagtgtagattgcttcaatttcatagtcagtaatatccctacttctagtgtggggtttatccactctgatatagagaccttacctaataaagatcgtacttgggagtcggccat

SEQ ID NO: 436770 - DNA, 140 bp, Artificial Sequence
  Synthetic
atggccgactcccaagtacgatctttattaggtaaggtctctatatcagagtggataaaccccacactagaagtagggatattactgactatgaaattgaagcaatctacactgcctaccggagacccagcatggcgtat

SEQ ID NO: 436771 - DNA, 140 bp, Artificial Sequence
  Synthetic
atacgccatgctgggtctccgaccgaggtgacccaaccacaggcatccgactccttagacagatcctctcccctcggcagactaaacaaaactcagggccaaggaacacacacacccaaccgtacttgggagtcggccat

SEQ ID NO: 436772 - DNA, 140 bp, Artificial Sequence
  Synthetic
atggccgactcccaagtacggttgggtgtgtgtgttccttggccctgagttttgtttagtctgccgaggggagaggatctgtctaaggagtcggatgcctgtggttgggtcacctcggtcggagacccagcatggcgtat

SEQ ID NO: 436773 - DNA, 140 bp, Artificial Sequence
  Synthetic
atacgccatgctgggtctccagaacccaaactcccgcccactgcgccgcgcccccaccccccgacaacaagagggggcccccaaccaatcccgccagcatccccggcgcccgcaggcagacgtacttgggagtcggccat

SEQ ID NO: 436774 - DNA, 140 bp, Artificial Sequence
  Synthetic
atggccgactcccaagtacgtctgcctgcgggcgccggggatgctggcgggattggttgggggccccctcttgttgtcggggggtgggggcgcggcgcagtgggcgggagtttgggttctggagacccagcatggcgtat

SEQ ID NO: 436775 - DNA, 140 bp, Artificial Sequence
  Synthetic
atacgccatgctgggtctcccacaccaacccccgaacagacccagcacccagccaccgacaatccaagacgggggggctcctccaaaaaaagccccccaggggctgacagccagcaccaccgtacttgggagtcggccat

SEQ ID NO: 436776 - DNA, 140 bp, Artificial Sequence
  Synthetic
atggccgactcccaagtacggtggtgctggctgtcagcccctggggggctttttttggaggagcccccccgtcttggattgtcggtggctgggtgctgggtctgttcgggggttggtgtgggagacccagcatggcgtat

SEQ ID NO: 436777 - DNA, 140 bp, Artificial Sequence
  Synthetic
atacgccatgctgggtctccgaagaggcccacccacctcacacacgaccacggcaaccaaactagagcccggaccgccctgggccaccagcccccagattcggccatcacccagaaggcacgtacttgggagtcggccat

SEQ ID NO: 436778 - DNA, 140 bp, Artificial Sequence
  Synthetic
atggccgactcccaagtacgtgccttctgggtgatggccgaatctgggggctggtggcccagggcggtccgggctctagtttggttgccgtggtcgtgtgtgaggtgggtgggcctcttcggagacccagcatggcgtat

SEQ ID NO: 436779 - DNA, 140 bp, Artificial Sequence
  Synthetic
atacgccatgctgggtctccgaaaaggccacaaccctcacaccccggccccgatccggcggacagccacccaacccgaaccagcacccaagagcgatctccgaagggccctcaaaccacacgtacttgggagtcggccat

SEQ ID NO: 436780 - DNA, 140 bp, Artificial Sequence
  Synthetic
atggccgactcccaagtacgtgtggtttgagggcccttcggagatcgctcttgggtgctggttcgggttgggtggctgtccgccggatcggggccggggtgtgagggttgtggccttttcggagacccagcatggcgtat

SEQ ID NO: 436781 - DNA, 140 bp, Artificial Sequence
  Synthetic
atacgccatgctgggtctccaagaacaccaacgtcccacagcccctccaagtcccccgatctcatcttctcctcggagggaccaaaagatcaatctaccacacccgactacactcaactccgtacttgggagtcggccat

SEQ ID NO: 436782 - DNA, 140 bp, Artificial Sequence
  Synthetic
atggccgactcccaagtacggagttgagtgtagtcgggtgtggtagattgatcttttggtccctccgaggagaagatgagatcgggggacttggaggggctgtgggacgttggtgttcttggagacccagcatggcgtat

SEQ ID NO: 436783 - DNA, 140 bp, Artificial Sequence
  Synthetic
atacgccatgctgggtctcccccaccccaaaaggagacaccgggaatcccagaatcaagactcacctaatgtccatcatgggcctcaaggcgagcgtctctgccatattcatgacagtaccgtacttgggagtcggccat

SEQ ID NO: 436784 - DNA, 140 bp, Artificial Sequence
  Synthetic
atggccgactcccaagtacggtactgtcatgaatatggcagagacgctcgccttgaggcccatgatggacattaggtgagtcttgattctgggattcccggtgtctccttttggggtgggggagacccagcatggcgtat

SEQ ID NO: 436785 - DNA, 140 bp, Artificial Sequence
  Synthetic
atacgccatgctgggtctccctccagccaccaatcattagtcataaaattaatgcccaatataaccctcctcaacaactgcacgagggcagagattgcagaatacaggagactactgagacgtacttgggagtcggccat

SEQ ID NO: 436786 - DNA, 140 bp, Artificial Sequence
  Synthetic
atggccgactcccaagtacgtctcagtagtctcctgtattctgcaatctctgccctcgtgcagttgttgaggagggttatattgggcattaattttatgactaatgattggtggctggagggagacccagcatggcgtat

SEQ ID NO: 436787 - DNA, 140 bp, Artificial Sequence
  Synthetic
atacgccatgctgggtctccatagtcctggaaccaattagagatgcacttaacgcaatgacccagaacataagaccggtccagagtgtagcctcaagtaggagacacaagagatttgcagcgtacttgggagtcggccat

SEQ ID NO: 436788 - DNA, 140 bp, Artificial Sequence
  Synthetic
atggccgactcccaagtacgctgcaaatctcttgtgtctcctacttgaggctacactctggaccggtcttatgttctgggtcattgcgttaagtgcatctctaattggttccaggactatggagacccagcatggcgtat

SEQ ID NO: 436789 - DNA, 140 bp, Artificial Sequence
  Synthetic
atacgccatgctgggtctccgagtggtcctggcaggtgctgccctaggcgttgccacggccgctcagataacagccggcattgcgcttcaccagtccatgctgaactctcaagccattgacgtacttgggagtcggccat

SEQ ID NO: 436790 - DNA, 140 bp, Artificial Sequence
  Synthetic
atggccgactcccaagtacgtcaatggcttgagagttcagcatggactggtgaagcgcaatgccggctgttatctgagcggccgtggcaacgcctagggcagcacctgccaggaccactcggagacccagcatggcgtat

SEQ ID NO: 436791 - DNA, 140 bp, Artificial Sequence
  Synthetic
aggccctggctgctgatatggacaagcagggcaggagatgatattggctgtccagggtgtccaagattacatcaataatgagctgataccgtccatgaaccaactgtcttgtgatttaatgaccttttgggacagcggtg

SEQ ID NO: 436792 - DNA, 140 bp, Artificial Sequence
  Synthetic
caccgctgtcccaaaaggtcattaaatcacaagacagttggttcatggacggtatcagctcattattgatgtaatcttggacaccctggacagccaatatcatctcctgccctgcttgtccatatcagcagccagggcct

SEQ ID NO: 436793 - DNA, 140 bp, Artificial Sequence
  Synthetic
atacgccatgctgggtctcctaagggctcggataactcacgtcgacacagagtcctacttcattgtcctcagtatagcctatccgacactgtccgagattaagggggtcattgtccaccgcgtacttgggagtcggccat

SEQ ID NO: 436794 - DNA, 140 bp, Artificial Sequence
  Synthetic
atggccgactcccaagtacgcggtggacaatgacccccttaatctcggacagtgtcggataggctatactgaggacaatgaagtaggactctgtgtcgacgtgagttatccgagcccttaggagacccagcatggcgtat

SEQ ID NO: 436795 - DNA, 140 bp, Artificial Sequence
  Synthetic
atacgccatgctgggtctcctcatcgtgtactttcatgccagaagggaccgtgtgcggccaaaatgccttgtacccgatgagtcctctgcttcaagaatgcctccgggggtccaccaagtcgtacttgggagtcggccat

SEQ ID NO: 436796 - DNA, 140 bp, Artificial Sequence
  Synthetic
atggccgactcccaagtacgacttggtggacccccggaggcattcttgaagcagaggactcatcgggtacaaggcattttggccgcacacggtcccttctggcatgaaagtacacgatgaggagacccagcatggcgtat

SEQ ID NO: 436797 - DNA, 140 bp, Artificial Sequence
  Synthetic
atacgccatgctgggtctcccctgtgctcgtacacttgtatccgggtcttttgggaaccggttcattttatcacaagggaacctaatagctaattgtgcatcaatcctttgcaagtgttacgtacttgggagtcggccat

SEQ ID NO: 436798 - DNA, 140 bp, Artificial Sequence
  Synthetic
atggccgactcccaagtacgtaacacttgcaaaggattgatgcacaattagctattaggttcccttgtgataaaatgaaccggttcccaaaagacccggatacaagtgtacgagcacaggggagacccagcatggcgtat

SEQ ID NO: 436799 - DNA, 140 bp, Artificial Sequence
  Synthetic
atacgccatgctgggtctcccacaacaggaacgatcatcaatcaagaccctgacaagatcctgacatacattgctgccgactactgcccggtagtcgaggtgaacggcgtgaccatccaacgtacttgggagtcggccat

SEQ ID NO: 436800 - DNA, 140 bp, Artificial Sequence
  Synthetic
atggccgactcccaagtacgttggatggtcacgccgttcacctcgactaccgggcagtagtcggcagcaatgtatgtcaggatcttgtcagggtcttgattgatgatcgttcctgttgtgggagacccagcatggcgtat

SEQ ID NO: 436801 - DNA, 140 bp, Artificial Sequence
  Synthetic
atacgccatgctgggtctccgtcgggagcaggaagtacccagatgctgtgtacttgcacagaattgaccttggtcctcccatatcattggagaggttggacgtagggacaaacctggggacgtacttgggagtcggccat

SEQ ID NO: 436802 - DNA, 140 bp, Artificial Sequence
  Synthetic
atggccgactcccaagtacgtccccaggtttgtccctacgtccaacctctccaatgatatgggaggaccaaggtcaattctgtgcaagtacacagcatctgggtacttcctgctcccgacggagacccagcatggcgtat

SEQ ID NO: 436803 - DNA, 140 bp, Artificial Sequence
  Synthetic
atacgccatgctgggtctccatgcagttgccaagttggaggatgccaaggaattgttagagtcatcggaccagatattgaggagtatgaaaggtttgtcgagcactaacatagtctacatcgtacttgggagtcggccat

SEQ ID NO: 436804 - DNA, 140 bp, Artificial Sequence
  Synthetic
atggccgactcccaagtacgatgtagactatgttagtgctcgacaaacctttcatactcctcaatatctggtccgatgactctaacaattccttggcatcctccaacttggcaactgcatggagacccagcatggcgtat

SEQ ID NO: 436805 - DNA, 140 bp, Artificial Sequence
  Synthetic
atacgccatgctgggtctcccctgattgcagtgtgtcttggaggattgatagggattcccactttaatatgttgctgcagggggcgttgtaacaaaaagggaggacaggttggtatgtcacgtacttgggagtcggccat

SEQ ID NO: 436806 - DNA, 140 bp, Artificial Sequence
  Synthetic
atggccgactcccaagtacgtgacataccaacctgtcctccctttttgttacaacgccccctgcagcaacatattaaagtgggaatccctatcaatcctccaagacacactgcaatcaggggagacccagcatggcgtat

SEQ ID NO: 436807 - DNA, 140 bp, Artificial Sequence
  Synthetic
aggccctggctgctgatatggttgctgcagggggcgttgtaacaaaaagggaggacaggttggtatgtcaagaccaggcctaaagcctgatctgacaggaacatcaaaatcctatgtaaggaccttttgggacagcggtg

SEQ ID NO: 436808 - DNA, 140 bp, Artificial Sequence
  Synthetic
caccgctgtcccaaaaggtccttacataggattttgatgttcctgtcagatcaggctttaggcctggtcttgacataccaacctgtcctccctttttgttacaacgccccctgcagcaaccatatcagcagccagggcct

SEQ ID NO: 436809 - DNA, 140 bp, Artificial Sequence
  Synthetic
atacgccatgctgggtctccgtcgctctgatcctctacaactcccgaaacacaaatctcccacaagtctcctcttcgtaatcaagcaaccactgcatccagcatcaatcccacctgaaatcgtacttgggagtcggccat

SEQ ID NO: 436810 - DNA, 140 bp, Artificial Sequence
  Synthetic
atggccgactcccaagtacgatttcaggtgggattgatgctggatgcagtggttgcttgattacgaagaggagacttgtgggagatttgtgtttcgggagttgtagaggatcagagcgacggagacccagcatggcgtat

SEQ ID NO: 436811 - DNA, 140 bp, Artificial Sequence
  Synthetic
aggccctggctgctgatatgctcttcgtaatcaagcaaccactgcatccagcatcaatcccacctgaaattatctccggcttccttctggccgaatacgatcggtcattaataaaaacttgaccttttgggacagcggtg

SEQ ID NO: 436812 - DNA, 140 bp, Artificial Sequence
  Synthetic
caccgctgtcccaaaaggtcaagtttttattaatgaccgatcgtattcggccagaaggaagccggagataatttcaggtgggattgatgctggatgcagtggttgcttgattacgaagagcatatcagcagccagggcct

SEQ ID NO: 436813 - DNA, 140 bp, Artificial Sequence
  Synthetic
atacgccatgctgggtctccagggtgcaagatcatccacaatgtcaccacaacgagaccggataaatgccttctacaaagataaccctcattccaagggaagtaggatagttattaacagcgtacttgggagtcggccat

SEQ ID NO: 436814 - DNA, 140 bp, Artificial Sequence
  Synthetic
atggccgactcccaagtacgctgttaataactatcctacttcccttggaatgagggttatctttgtagaaggcatttatccggtctcgttgtggtgacattgtggatgatcttgcaccctggagacccagcatggcgtat

SEQ ID NO: 436815 - DNA, 140 bp, Artificial Sequence
  Synthetic
aggccctggctgctgatatgtcatgtttctgagcctgatcgggttgctggccattgcaggcattaggctccatcgggcagccatctacactgcagagatccataaaagcctcagcaccaagaccttttgggacagcggtg

SEQ ID NO: 436816 - DNA, 140 bp, Artificial Sequence
  Synthetic
caccgctgtcccaaaaggtcttggtgctgaggcttttatggatctctgcagtgtagatggctgcccgatggagcctaatgcctgcaatggccagcaacccgatcaggctcagaaacatgacatatcagcagccagggcct

SEQ ID NO: 436817 - DNA, 140 bp, Artificial Sequence
  Synthetic
atacgccatgctgggtctccagagaatcaaattgaattatgatcaatactgtgcagatgtggctgctgaagagctcatgaatgcactagtgaactcaactctactggagaccagaacaaccgtacttgggagtcggccat

SEQ ID NO: 436818 - DNA, 140 bp, Artificial Sequence
  Synthetic
atggccgactcccaagtacggttgttctggtctccagtagagttgagttcactagtgcattcatgagctcttcagcagccacatctgcacagtattgatcataattcaatttgattctctggagacccagcatggcgtat

SEQ ID NO: 436819 - DNA, 140 bp, Artificial Sequence
  Synthetic
aggccctggctgctgatatggagctcatgaatgcactagtgaactcaactctactggagaccagaacaaccaatcagttcctagctgtctctaaggggaactgctcagggcccactaccagaccttttgggacagcggtg

SEQ ID NO: 436820 - DNA, 140 bp, Artificial Sequence
  Synthetic
caccgctgtcccaaaaggtctggtagtgggccctgagcagttccccttagagacagctaggaactgattggttgttctggtctccagtagagttgagttcactagtgcattcatgagctccatatcagcagccagggcct

SEQ ID NO: 436821 - DNA, 140 bp, Artificial Sequence
  Synthetic
atacgccatgctgggtctcctcagaggtcaattctcaaacatgtcgctgtctctgttagacttatatttaagtcgaggttacaatgtgtcatctatagtcactatgacgtcccagggaatcgtacttgggagtcggccat

SEQ ID NO: 436822 - DNA, 140 bp, Artificial Sequence
  Synthetic
atggccgactcccaagtacgattccctgggacgtcatagtgactatagatgacacattgtaacctcgacttaaatataagtctaacagagacagcgacatgtttgagaattgacctctgaggagacccagcatggcgtat

SEQ ID NO: 436823 - DNA, 140 bp, Artificial Sequence
  Synthetic
aggccctggctgctgatatgagtcgaggttacaatgtgtcatctatagtcactatgacgtcccagggaatgtacgggggaacttacctagttgaaaagcccaatctgagcagcaaaggatgaccttttgggacagcggtg

SEQ ID NO: 436824 - DNA, 140 bp, Artificial Sequence
  Synthetic
caccgctgtcccaaaaggtcatcctttgctgctcagattgggcttttcaactaggtaagttcccccgtacattccctgggacgtcatagtgactatagatgacacattgtaacctcgactcatatcagcagccagggcct

SEQ ID NO: 436825 - DNA, 140 bp, Artificial Sequence
  Synthetic
atacgccatgctgggtctcctaggattatcacaactgagcatataccgagtgtttgaagtaggtgttataagaaatccaggcttgggggctccggtgttccatatgacaaactatcttgacgtacttgggagtcggccat

SEQ ID NO: 436826 - DNA, 140 bp, Artificial Sequence
  Synthetic
atggccgactcccaagtacgtcaagatagtttgtcatatggaacaccggagcccccaagcctggatttcttataacacctacttcaaacactcggtatatgctcagttgtgataatcctaggagacccagcatggcgtat

SEQ ID NO: 436827 - DNA, 140 bp, Artificial Sequence
  Synthetic
aggccctggctgctgatatgagaaatccaggcttgggggctccggtgttccatatgacaaactatcttgaacaaccgatcagtaatgatctcagcaattgcatggtagctttgggggagtgaccttttgggacagcggtg

SEQ ID NO: 436828 - DNA, 140 bp, Artificial Sequence
  Synthetic
caccgctgtcccaaaaggtcactcccccaaagctaccatgcaattgctgagatcattactgatcggttgttcaagatagtttgtcatatggaacaccggagcccccaagcctggatttctcatatcagcagccagggcct

SEQ ID NO: 436829 - DNA, 140 bp, Artificial Sequence
  Synthetic
aggccctggctgctgatatggaaatccccaaccgacatgcaatcctgggtccccctatcaacggatgacccagtgatagacgggctctacctctcatctcacagaggtgtcatcactggcgaccttttgggacagcggtg

SEQ ID NO: 436830 - DNA, 140 bp, Artificial Sequence
  Synthetic
caccgctgtcccaaaaggtcgccagtgatgacacctctgtgagatgagaggtagagcccgtctatcactgggtcatccgttgatagggggacccaggattgcatgtcggttggggatttccatatcagcagccagggcct

SEQ ID NO: 436831 - DNA, 140 bp, Artificial Sequence
  Synthetic
aggccctggctgctgatatgccgtgaactcctaaagaaggggaatgcgctgtactccaaagtcagtgataaggttttccaatgcttgagggacactaactcacggcttggtctaggctcggaccttttgggacagcggtg

SEQ ID NO: 436832 - DNA, 140 bp, Artificial Sequence
  Synthetic
caccgctgtcccaaaaggtccgagcctagaccaagccgtgagttagtgtccctcaagcattggaaaaccttatcactgactttggagtacagcgcattccccttctttaggagttcacggcatatcagcagccagggcct

SEQ ID NO: 436833 - DNA, 140 bp, Artificial Sequence
  Synthetic
atacgccatgctgggtctccaatcaagcaaattgggctgttccgacaacacgaacagatgataagttgcggatggagacatgcttccagcaggcgtgtaagggtaaaatccaagcactctcgtacttgggagtcggccat

SEQ ID NO: 436834 - DNA, 140 bp, Artificial Sequence
  Synthetic
atggccgactcccaagtacgagagtgcttggattttacccttacacgcctgctggaagcatgtctccatccgcaacttatcatctgttcgtgttgtcggaacagcccaatttgcttgattggagacccagcatggcgtat

SEQ ID NO: 436835 - DNA, 140 bp, Artificial Sequence
  Synthetic
atacgccatgctgggtctccgcgaaaatcccgagtgggcaccgttgaaggataacaggattccttcatacggggttttgtctgttgacctgagcctggcagttgagcttaaaatcaaaatcgtacttgggagtcggccat

SEQ ID NO: 436836 - DNA, 140 bp, Artificial Sequence
  Synthetic
atggccgactcccaagtacgattttgattttaagctcaactgccaggctcaggtcaacagacaaaaccccgtatgaaggaatcctgttatccttcaacggtgcccactcgggattttcgcggagacccagcatggcgtat

SEQ ID NO: 436837 - DNA, 140 bp, Artificial Sequence
  Synthetic
aggccctggctgctgatatgtgcttcgggattcggtccattgatcactcacggttcagggatggacctatacaaatccaaccacaacaatgtgtattggctgactatcccgccaatgaaggaccttttgggacagcggtg

SEQ ID NO: 436838 - DNA, 140 bp, Artificial Sequence
  Synthetic
caccgctgtcccaaaaggtccttcattggcgggatagtcagccaatacacattgttgtggttggatttgtataggtccatccctgaaccgtgagtgatcaatggaccgaatcccgaagcacatatcagcagccagggcct

SEQ ID NO: 436839 - DNA, 140 bp, Artificial Sequence
  Synthetic
aggccctggctgctgatatgagttccaatctggtgattctacctggtcaagatctccaatatgttttggcaacctacgatacttccagagttgaacatgctgtggtttattacgtttacagaccttttgggacagcggtg

SEQ ID NO: 436840 - DNA, 140 bp, Artificial Sequence
  Synthetic
caccgctgtcccaaaaggtctgtaaacgtaataaaccacagcatgttcaactctggaagtatcgtaggttgccaaaacatattggagatcttgaccaggtagaatcaccagattggaactcatatcagcagccagggcct

SEQ ID NO: 436841 - DNA, 140 bp, Artificial Sequence
  Synthetic
atacgccatgctgggtctccgcccaggccgctcattctcttacttttatccctttaggttacctataaaggggacccccatcgaattacaagtggaatgcttcacatgggaccaaagactcgtacttgggagtcggccat

SEQ ID NO: 436842 - DNA, 140 bp, Artificial Sequence
  Synthetic
atggccgactcccaagtacgagtctttggtcccatgtgaagcattccacttgtaattcgatgggggtcccctttataggtaacctaaagggataaaagtaagagaatgagcggcctgggcggagacccagcatggcgtat

SEQ ID NO: 436843 - DNA, 140 bp, Artificial Sequence
  Synthetic
atacgccatgctgggtctccctggtgccgtcacttctgtgtgcttgctgactcggaatctggtggacatatcacccactctgggatggtgggcatgggagttagctgcacagtcaaccggcgtacttgggagtcggccat

SEQ ID NO: 436844 - DNA, 140 bp, Artificial Sequence
  Synthetic
atggccgactcccaagtacgccggttgactgtgcagctaactcccatgcccaccatcccagagtgggtgatatgtccaccagattccgagtcagcaagcacacagaagtgacggcaccagggagacccagcatggcgtat

SEQ ID NO: 436845 - DNA, 140 bp, Artificial Sequence
  Synthetic
atacgccatgctgggtctccgaagatggagccaatcgcagatagggcagccagtgaactaacaacatgatttcactcagacatcaagaatacccaccagggtgaaatagacatcagaattcgtacttgggagtcggccat

SEQ ID NO: 436846 - DNA, 140 bp, Artificial Sequence
  Synthetic
atggccgactcccaagtacgaattctgatgtctatttcaccctggtgggtattcttgatgtctgagtgaaatcatgttgttagttcactggctgccctatctgcgattggctccatcttcggagacccagcatggcgtat

SEQ ID NO: 436847 - DNA, 140 bp, Artificial Sequence
  Synthetic
aggccctggctgctgatatgttcactcagacatcaagaatacccaccagggtgaaatagacatcagaattaagaaaaacgtagggtccaagcggttccccgtcatggactcgctgtctgtgaccttttgggacagcggtg

SEQ ID NO: 436848 - DNA, 140 bp, Artificial Sequence
  Synthetic
caccgctgtcccaaaaggtcacagacagcgagtccatgacggggaaccgcttggaccctacgtttttcttaattctgatgtctatttcaccctggtgggtattcttgatgtctgagtgaacatatcagcagccagggcct

SEQ ID NO: 436849 - DNA, 140 bp, Artificial Sequence
  Synthetic
atacgccatgctgggtctcccaaccagatcttataccctgaggttcacctagatagcccgatagttaccaacaaaatagtagccatcctggagtatgctcgagtccctcatgcttacagtcgtacttgggagtcggccat

SEQ ID NO: 436850 - DNA, 140 bp, Artificial Sequence
  Synthetic
atggccgactcccaagtacgactgtaagcatgagggactcgagcatactccaggatggctactattttgttggtaactatcgggctatctaggtgaacctcagggtataagatctggttgggagacccagcatggcgtat

SEQ ID NO: 436851 - DNA, 140 bp, Artificial Sequence
  Synthetic
aggccctggctgctgatatgacaaaatagtagccatcctggagtatgctcgagtccctcatgcttacagtctagaggaccctacactgtgtcagaacatcaagcaccgcctggaaacagggaccttttgggacagcggtg

SEQ ID NO: 436852 - DNA, 140 bp, Artificial Sequence
  Synthetic
caccgctgtcccaaaaggtccctgtttccaggcggtgcttgatgttctgacacagtgtagggtcctctagactgtaagcatgagggactcgagcatactccaggatggctactattttgtcatatcagcagccagggcct

SEQ ID NO: 436853 - DNA, 140 bp, Artificial Sequence
  Synthetic
aggccctggctgctgatatgtgtaatcaggatttatttaacatagaagacaaagagtcaacgaggaagatccgtgaactcctcaagaaggggaatgcgctgtactccaaagtcagtgatagaccttttgggacagcggtg

SEQ ID NO: 436854 - DNA, 140 bp, Artificial Sequence
  Synthetic
caccgctgtcccaaaaggtctatcactgactttggagtacagcgcattccccttcttgaggagttcacggatcttcctcgttgactctttgtcttctatgttaaataaatcctgattacacatatcagcagccagggcct

SEQ ID NO: 436855 - DNA, 140 bp, Artificial Sequence
  Synthetic
aggccctggctgctgatatgccgtgaactcctcaagaaggggaatgcgctgtactccaaagtcagtgataaggtttttcaatgcttgagggacactaactcacggcttggcctaggctcggaccttttgggacagcggtg

SEQ ID NO: 436856 - DNA, 140 bp, Artificial Sequence
  Synthetic
caccgctgtcccaaaaggtccgagcctaggccaagccgtgagttagtgtccctcaagcattgaaaaaccttatcactgactttggagtacagcgcattccccttcttgaggagttcacggcatatcagcagccagggcct

SEQ ID NO: 436857 - DNA, 140 bp, Artificial Sequence
  Synthetic
atacgccatgctgggtctccgaattgagcgaagacatcaaggagagagttattaacttgggagtttacatgcagagctctcgatggtttgagccctttctgttttggtttacagtcaagacgtacttgggagtcggccat

SEQ ID NO: 436858 - DNA, 140 bp, Artificial Sequence
  Synthetic
atggccgactcccaagtacgtcttgactgtaaaccaaaacagaaagggctcaaaccatcgagagctctgcatgtaaactcccaagttaataactctctccttgatgtcttcgctcaattcggagacccagcatggcgtat

SEQ ID NO: 436859 - DNA, 140 bp, Artificial Sequence
  Synthetic
atacgccatgctgggtctccctgagatgaggtcagtgattaaatcacaaacccatacgtgccataggaggagacacacacctgtattcttcactggtagttcagttgagctgctaatttccgtacttgggagtcggccat

SEQ ID NO: 436860 - DNA, 140 bp, Artificial Sequence
  Synthetic
atggccgactcccaagtacggaaattagcagctcaactgaactaccagtgaagaatacaggtgtgtgtctcctcctatggcacgtatgggtttgtgatttaatcactgacctcatctcagggagacccagcatggcgtat

SEQ ID NO: 436861 - DNA, 140 bp, Artificial Sequence
  Synthetic
atacgccatgctgggtctccggaaaggccacaacccgcgcacccctgccctgatccggtgggcggccacccaacccgaaccagcacccaagagcgatccccgaagggcccccgaaccgcacgtacttgggagtcggccat

SEQ ID NO: 436862 - DNA, 140 bp, Artificial Sequence
  Synthetic
atggccgactcccaagtacgtgcggttcgggggcccttcggggatcgctcttgggtgctggttcgggttgggtggccgcccaccggatcagggcaggggtgcgcgggttgtggcctttccggagacccagcatggcgtat

SEQ ID NO: 436863 - DNA, 140 bp, Artificial Sequence
  Synthetic
atacgccatgctgggtctccatgaagatacttatcatgagttaattgatgctctagattacattttcataactgatgacatacatctgacaggggagattttctcattttttagaagtttcgtacttgggagtcggccat

SEQ ID NO: 436864 - DNA, 140 bp, Artificial Sequence
  Synthetic
atggccgactcccaagtacgaaacttctaaaaaatgagaaaatctcccctgtcagatgtatgtcatcagttatgaaaatgtaatctagagcatcaattaactcatgataagtatcttcatggagacccagcatggcgtat

SEQ ID NO: 436865 - DNA, 140 bp, Artificial Sequence
  Synthetic
aggccctggctgctgatatgactgatgacatacatctgacaggggagattttctcattttttagaagtttcggccaccccagacttgaggcagtaacggctgctgcaaatgtcaggaaatgaccttttgggacagcggtg

SEQ ID NO: 436866 - DNA, 140 bp, Artificial Sequence
  Synthetic
caccgctgtcccaaaaggtcatttcctgacatttgcagcagccgttactgcctcaagtctggggtggccgaaacttctaaaaaatgagaaaatctcccctgtcagatgtatgtcatcagtcatatcagcagccagggcct

SEQ ID NO: 436867 - DNA, 140 bp, Artificial Sequence
  Synthetic
aggccctggctgctgatatgcagctggccaccgctgaccctccccctgcatgctgcagacccaatccggaatgctcaagcttcaggtgaggggttaacacatgagcagtgcgttgataacgaccttttgggacagcggtg

SEQ ID NO: 436868 - DNA, 140 bp, Artificial Sequence
  Synthetic
caccgctgtcccaaaaggtcgttatcaacgcactgctcatgtgttaacccctcacctgaagcttgagcattccggattgggtctgcagcatgcagggggagggtcagcggtggccagctgcatatcagcagccagggcct

SEQ ID NO: 436869 - DNA, 140 bp, Artificial Sequence
  Synthetic
atacgccatgctgggtctcctggaaatcctttgctgggatgaaatttggttgctttatgcctcttagcctggatagtgatttaacaatgtacctaaaggacaaggcacttgctgctcttccgtacttgggagtcggccat

SEQ ID NO: 436870 - DNA, 140 bp, Artificial Sequence
  Synthetic
atggccgactcccaagtacggaagagcagcaagtgccttgtcctttaggtacattgttaaatcactatccaggctaagaggcataaagcaaccaaatttcatcccagcaaaggatttccaggagacccagcatggcgtat

SEQ ID NO: 436871 - DNA, 140 bp, Artificial Sequence
  Synthetic
aggccctggctgctgatatgcccaagggaaccgggtcacggaggcttgtagatgttttccttaatgattcgagctttgacccatatgatatgataatgtatgttgtaagtggagcttaccgaccttttgggacagcggtg

SEQ ID NO: 436872 - DNA, 140 bp, Artificial Sequence
  Synthetic
caccgctgtcccaaaaggtcggtaagctccacttacaacatacattatcatatcatatgggtcaaagctcgaatcattaaggaaaacatctacaagcctccgtgacccggttcccttgggcatatcagcagccagggcct

SEQ ID NO: 436873 - DNA, 140 bp, Artificial Sequence
  Synthetic
atacgccatgctgggtctccggggccagtcccaaaaacccactcccgaagcccagctcacacaagtaccagaaacatgagatcagcaaaagagtttgtagggttccctcaagtaattcggcgtacttgggagtcggccat

SEQ ID NO: 436874 - DNA, 140 bp, Artificial Sequence
  Synthetic
atggccgactcccaagtacgccgaattacttgagggaaccctacaaactcttttgctgatctcatgtttctggtacttgtgtgagctgggcttcgggagtgggtttttgggactggccccggagacccagcatggcgtat

SEQ ID NO: 436875 - DNA, 140 bp, Artificial Sequence
  Synthetic
aggccctggctgctgatatggaaacatgagatcagcaaaagagtttgtagggttccctcaagtaattcggcaagaccaagacactaatcacccggagaacacggaaacttacgagacagtgaccttttgggacagcggtg

SEQ ID NO: 436876 - DNA, 140 bp, Artificial Sequence
  Synthetic
caccgctgtcccaaaaggtcactgtctcgtaagtttccgtgttctccgggtgattagtgtcttggtcttgccgaattacttgagggaaccctacaaactcttttgctgatctcatgtttccatatcagcagccagggcct

SEQ ID NO: 436877 - DNA, 140 bp, Artificial Sequence
  Synthetic
atacgccatgctgggtctccaagataggggtggtagggataggaagtgcaagctacaaagttatgactcgttccagccatcaatcattagtcataaaattaatgcccaatataactctcccgtacttgggagtcggccat

SEQ ID NO: 436878 - DNA, 140 bp, Artificial Sequence
  Synthetic
atggccgactcccaagtacgggagagttatattgggcattaattttatgactaatgattgatggctggaacgagtcataactttgtagcttgcacttcctatccctaccacccctatcttggagacccagcatggcgtat

SEQ ID NO: 436879 - DNA, 140 bp, Artificial Sequence
  Synthetic
atacgccatgctgggtctccccctcattctttcagtggctgcataagaggcttgagacctctgtcctgtatgtgagtgaccctcattgcccccccggccttgacgcccatgtcccattatcgtacttgggagtcggccat

SEQ ID NO: 436880 - DNA, 140 bp, Artificial Sequence
  Synthetic
atggccgactcccaagtacgataatgggacatgggcgtcaaggccgggggggcaatgagggtcactcacatacaggacagaggtctcaagcctcttatgcagccactgaaagaatgagggggagacccagcatggcgtat

SEQ ID NO: 436881 - DNA, 140 bp, Artificial Sequence
  Synthetic
atacgccatgctgggtctcccctggctgcttatgagagcggagtaaggattgcctcgttagtgcagggggacaatcagaccatagccgtaacaaaaagggtgcccagcacatggccttaccgtacttgggagtcggccat

SEQ ID NO: 436882 - DNA, 140 bp, Artificial Sequence
  Synthetic
atggccgactcccaagtacggtaaggccatgtgctgggcaccctttttgttacggctatggtctgattgtccccctgcactaacgaggcaatccttactccgctctcataagcagccaggggagacccagcatggcgtat

SEQ ID NO: 436883 - DNA, 140 bp, Artificial Sequence
  Synthetic
aggccctggctgctgatatgacaatcagaccatagccgtaacaaaaagggtgcccagcacatggccttacaaccttaagaaacgggaagctgctagagtaactaggaactacttcgtaatgaccttttgggacagcggtg

SEQ ID NO: 436884 - DNA, 140 bp, Artificial Sequence
  Synthetic
caccgctgtcccaaaaggtcattacgaagtagttcctagttactctagcagcttcccgtttcttaaggttgtaaggccatgtgctgggcaccctttttgttacggctatggtctgattgtcatatcagcagccagggcct

SEQ ID NO: 436885 - DNA, 140 bp, Artificial Sequence
  Synthetic
aggccctggctgctgatatgcaattgtttcatcacatttttttgtctattcaaaaggaatatattatgacgggctacttgtgtcccaatcactcaagagcatcgcaaggtgtgtattttggaccttttgggacagcggtg

SEQ ID NO: 436886 - DNA, 140 bp, Artificial Sequence
  Synthetic
caccgctgtcccaaaaggtccaaaatacacaccttgcgatgctcttgagtgattgggacacaagtagcccgtcataatatattccttttgaatagacaaaaaaatgtgatgaaacaattgcatatcagcagccagggcct

SEQ ID NO: 436887 - DNA, 140 bp, Artificial Sequence
  Synthetic
atacgccatgctgggtctcctccctgaacgtcccaaaagtaatacaacagattctgatctctcttggcttcacaatcaattcaaccatgacccgggatgtagtcatacccctcctcacaacgtacttgggagtcggccat

SEQ ID NO: 436888 - DNA, 140 bp, Artificial Sequence
  Synthetic
atggccgactcccaagtacgttgtgaggaggggtatgactacatcccgggtcatggttgaattgattgtgaagccaagagagatcagaatctgttgtattacttttgggacgttcagggaggagacccagcatggcgtat

SEQ ID NO: 436889 - DNA, 140 bp, Artificial Sequence
  Synthetic
atacgccatgctgggtctccagtaacatcatcaattgctgatctcaagagaatgattcatgcatcactaatgcctgaagagaccctccaacaggtaatgacacagcaaccaggggactctcgtacttgggagtcggccat

SEQ ID NO: 436890 - DNA, 140 bp, Artificial Sequence
  Synthetic
atggccgactcccaagtacgagagtcccctggttgctgtgtcattacctgttggagggtctcttcaggcattagtgatgcatgaatcattctcttgagatcagcaattgatgatgttactggagacccagcatggcgtat

SEQ ID NO: 436891 - DNA, 140 bp, Artificial Sequence
  Synthetic
aggccctggctgctgatatgtgcctgaagagaccctccaacaggtaatgacacagcaaccaggggactcttcattcctggactgggctagtgacccttactcagcaaatcttgtatgtgtgaccttttgggacagcggtg

SEQ ID NO: 436892 - DNA, 140 bp, Artificial Sequence
  Synthetic
caccgctgtcccaaaaggtcacacatacaagatttgctgagtaagggtcactagcccagtccaggaatgaagagtcccctggttgctgtgtcattacctgttggagggtctcttcaggcacatatcagcagccagggcct

SEQ ID NO: 436893 - DNA, 140 bp, Artificial Sequence
  Synthetic
atacgccatgctgggtctccgaagaagatgagagattggctgcattcctcatggacaggcatattatagtacctagggcagctcatgaaatcctggatcacagtgtcacaggggcaagagcgtacttgggagtcggccat

SEQ ID NO: 436894 - DNA, 140 bp, Artificial Sequence
  Synthetic
atggccgactcccaagtacgctcttgcccctgtgacactgtgatccaggatttcatgagctgccctaggtactataatatgcctgtccatgaggaatgcagccaatctctcatcttcttcggagacccagcatggcgtat

SEQ ID NO: 436895 - DNA, 140 bp, Artificial Sequence
  Synthetic
aggccctggctgctgatatgacctagggcagctcatgaaatcctggatcacagtgtcacaggggcaagagagtccattgcaggcatgctggataccacaaaagggctgattcgagccagcgaccttttgggacagcggtg

SEQ ID NO: 436896 - DNA, 140 bp, Artificial Sequence
  Synthetic
caccgctgtcccaaaaggtcgctggctcgaatcagcccttttgtggtatccagcatgcctgcaatggactctcttgcccctgtgacactgtgatccaggatttcatgagctgccctaggtcatatcagcagccagggcct

SEQ ID NO: 436897 - DNA, 140 bp, Artificial Sequence
  Synthetic
atacgccatgctgggtctccgaaatgtcctcattgataaggagtcatgctcagtgcagctggcgagagccctaagaagccatatgtgggcgagactagctcgaggaaggccaatttacggcgtacttgggagtcggccat

SEQ ID NO: 436898 - DNA, 140 bp, Artificial Sequence
  Synthetic
atggccgactcccaagtacgccgtaaattggccttcctcgagctagtctcgcccacatatggcttcttagggctctcgccagctgcactgagcatgactccttatcaatgaggacatttcggagacccagcatggcgtat

SEQ ID NO: 436899 - DNA, 140 bp, Artificial Sequence
  Synthetic
aggccctggctgctgatatgctaagaagccatatgtgggcgagactagctcgaggaaggccaatttacggccttgaagtccctgacgtactagaatctatgcgaggccaccttattcgacgaccttttgggacagcggtg

SEQ ID NO: 436900 - DNA, 140 bp, Artificial Sequence
  Synthetic
caccgctgtcccaaaaggtcgtcgaataaggtggcctcgcatagattctagtacgtcagggacttcaaggccgtaaattggccttcctcgagctagtctcgcccacatatggcttcttagcatatcagcagccagggcct

SEQ ID NO: 436901 - DNA, 140 bp, Artificial Sequence
  Synthetic
atacgccatgctgggtctccatccttgagagtcccgtatattggttctaccactgatgagagaacagatatgaagcttgccttcgtaagagctccaagtcgatccttgcgatctgccgttcgtacttgggagtcggccat

SEQ ID NO: 436902 - DNA, 140 bp, Artificial Sequence
  Synthetic
atggccgactcccaagtacgaacggcagatcgcaaggatcgacttggagctcttacgaaggcaagcttcatatctgttctctcatcagtggtagaaccaatatacgggactctcaaggatggagacccagcatggcgtat

SEQ ID NO: 436903 - DNA, 140 bp, Artificial Sequence
  Synthetic
atacgccatgctgggtctccaggatagcaacagtgtactcatgggcttcgggtgatgatgatagctcttggaacgaagcctggttgctagcaaggcaaagagccaatgtgagcctggaggcgtacttgggagtcggccat

SEQ ID NO: 436904 - DNA, 140 bp, Artificial Sequence
  Synthetic
atggccgactcccaagtacgcctccaggctcacattggctctttgccttgctagcaaccaggcttcgttccaagagctatcatcatcacccgaagcccatgagtacactgttgctatcctggagacccagcatggcgtat

SEQ ID NO: 436905 - DNA, 140 bp, Artificial Sequence
  Synthetic
aggccctggctgctgatatggaacgaagcctggttgctagcaaggcaaagagccaatgtgagcctggaggagctaagggtgatcactcccatctcaacttcaaccaatttagcgcatagagaccttttgggacagcggtg

SEQ ID NO: 436906 - DNA, 140 bp, Artificial Sequence
  Synthetic
caccgctgtcccaaaaggtctctatgcgctaaattggttgaagttgagatgggagtgatcacccttagctcctccaggctcacattggctctttgccttgctagcaaccaggcttcgttccatatcagcagccagggcct

SEQ ID NO: 436907 - DNA, 140 bp, Artificial Sequence
  Synthetic
atacgccatgctgggtctcccagataagaaggttgatactaattttacataccaacaaagaatgcttctagggttgggtgttttagaaacactatttcgactcaagaaagataccgggtccgtacttgggagtcggccat

SEQ ID NO: 436908 - DNA, 140 bp, Artificial Sequence
  Synthetic
atggccgactcccaagtacggacccggtatctttcttgagtcgaaatagtgtttctaaaacacccaaccctagaagcattctttgttggtatgtaaaattagtatcaaccttcttatctgggagacccagcatggcgtat

SEQ ID NO: 436909 - DNA, 140 bp, Artificial Sequence
  Synthetic
atacgccatgctgggtctccatctaatacggtattacaccttcacgtcgaaacagattgttgcgtgatcccgatgatagatcatcccaggatacccagctctcgcaagctagagctgaggcgtacttgggagtcggccat

SEQ ID NO: 436910 - DNA, 140 bp, Artificial Sequence
  Synthetic
atggccgactcccaagtacgcctcagctctagcttgcgagagctgggtatcctgggatgatctatcatcgggatcacgcaacaatctgtttcgacgtgaaggtgtaataccgtattagatggagacccagcatggcgtat

SEQ ID NO: 436911 - DNA, 140 bp, Artificial Sequence
  Synthetic
atacgccatgctgggtctccgcagagctatgtaccaacccattgatatatgataatgcccctttaattgacagggatgcaacaaggctatacacccagagtcatagaaggcaccttgtggcgtacttgggagtcggccat

SEQ ID NO: 436912 - DNA, 140 bp, Artificial Sequence
  Synthetic
atggccgactcccaagtacgccacaaggtgccttctatgactctgggtgtatagccttgttgcatccctgtcaattaaaggggcattatcatatatcaatgggttggtacatagctctgcggagacccagcatggcgtat

SEQ ID NO: 436913 - DNA, 140 bp, Artificial Sequence
  Synthetic
atacgccatgctgggtctccctgagttcctgcttatagagccaagactctttactatctacttgggccagtgtacggccatcaattgggcatttgatatacattatcacagaccatcaggcgtacttgggagtcggccat

SEQ ID NO: 436914 - DNA, 140 bp, Artificial Sequence
  Synthetic
atggccgactcccaagtacgcctgatggtctgtgataatgtatatcaaatgcccaattgatggccgtacactggcccaagtagatagtaaagagtcttggctctataagcaggaactcagggagacccagcatggcgtat

SEQ ID NO: 436915 - DNA, 140 bp, Artificial Sequence
  Synthetic
atacgccatgctgggtctccgaaatatcagatgggtgagctgttgtcatcattcctttctagaatgagcaaaggagtgtttaaagtgcttgtcgatgctttaagccacccaaagatctaccgtacttgggagtcggccat

SEQ ID NO: 436916 - DNA, 140 bp, Artificial Sequence
  Synthetic
atggccgactcccaagtacggtagatctttgggtggcttaaagcatcgacaagcactttaaacactcctttgctcattctagaaaggaatgatgacaacagctcacccatctgatatttcggagacccagcatggcgtat

SEQ ID NO: 436917 - DNA, 140 bp, Artificial Sequence
  Synthetic
atacgccatgctgggtctccaagaaattctggcattgtggtatcatagagcctatccacggtccttcacttgatgctcaaaacttgcacacaactgtgtgcaacatgatctacacatgctcgtacttgggagtcggccat

SEQ ID NO: 436918 - DNA, 140 bp, Artificial Sequence
  Synthetic
atggccgactcccaagtacgagcatgtgtagatcatgttgcacacagttgtgtgcaagttttgagcatcaagtgaaggaccgtggataggctctatgataccacaatgccagaatttcttggagacccagcatggcgtat

SEQ ID NO: 436919 - DNA, 140 bp, Artificial Sequence
  Synthetic
atacgccatgctgggtctccatatgacctacctcgatctgttgttgaatgaagaattagaagaattcacatttcttttgtgtgaaagcgacgaggatgtagtaccggaccgattcgacaacgtacttgggagtcggccat

SEQ ID NO: 436920 - DNA, 140 bp, Artificial Sequence
  Synthetic
atggccgactcccaagtacgttgtcgaatcggtccggtactacatcctcgtcgctttcacacaaaagaaatgtgaattcttctaattcttcattcaacaacagatcgaggtaggtcatatggagacccagcatggcgtat

SEQ ID NO: 436921 - DNA, 140 bp, Artificial Sequence
  Synthetic
atacgccatgctgggtctcctatccaagcaaaacacttgtgtgttttggcagatttgtactgtcaaccagggacctgcccaccaatccgaggtctaaaaccggtagagaaatgtgcggttcgtacttgggagtcggccat

SEQ ID NO: 436922 - DNA, 140 bp, Artificial Sequence
  Synthetic
atggccgactcccaagtacgaaccgcacatttctctaccggttttagacctcggattggtgggcaggtccctggttgacagtacaaatctgccaaaacacacaagtgttttgcttggataggagacccagcatggcgtat

SEQ ID NO: 436923 - DNA, 140 bp, Artificial Sequence
  Synthetic
aggccctggctgctgatatggtggaacataaatccaattattgtagaccattactcatgctctctgacttatctccgacgaggatcgattaaacagataaggttgagagtcgatccaggagaccttttgggacagcggtg

SEQ ID NO: 436924 - DNA, 140 bp, Artificial Sequence
  Synthetic
caccgctgtcccaaaaggtctcctggatcgactctcaaccttatctgtttaatcgatcctcgtcggagataagtcagagagcatgagtaatggtctacaataattggatttatgttccaccatatcagcagccagggcct

SEQ ID NO: 436925 - DNA, 140 bp, Artificial Sequence
  Synthetic
atacgccatgctgggtctccttcattttcgatgccctcgctgaggtaaatgtcagtcagccaaagattggcagcaacaacagttcaaatatgagcatcaaggatttcagacccccacacgcgtacttgggagtcggccat

SEQ ID NO: 436926 - DNA, 140 bp, Artificial Sequence
  Synthetic
atggccgactcccaagtacgcgtgtgggggtctgaaatccttgatgctcatatttgaactgttgttgctgccaatctttggctgactgacatttacctcagcgagggcatcgaaaatgaaggagacccagcatggcgtat

SEQ ID NO: 436927 - DNA, 140 bp, Artificial Sequence
  Synthetic
atacgccatgctgggtctccagttagcaccctacccctccgaagttggccttgtcgaacacagaatgggagtaggtaatattgtcaaggtgctctttaacgggaggcctgaagttacatgcgtacttgggagtcggccat

SEQ ID NO: 436928 - DNA, 140 bp, Artificial Sequence
  Synthetic
atggccgactcccaagtacgcatgtaacttcaggcctcccgttaaagagcaccttgacaatattacctactcccattctgtgttcgacaaggccaacttcggaggggtagggtgctaactggagacccagcatggcgtat

SEQ ID NO: 436929 - DNA, 140 bp, Artificial Sequence
  Synthetic
aggccctggctgctgatatgctagtgtggggtttatccattcagatatagagaccttaccaaataaagatactatagagaagctagaggaattggcagctatcttatcgatggctctgctgaccttttgggacagcggtg

SEQ ID NO: 436930 - DNA, 140 bp, Artificial Sequence
  Synthetic
caccgctgtcccaaaaggtcagcagagccatcgataagatagctgccaattcctctagcttctctatagtatctttatttggtaaggtctctatatctgaatggataaaccccacactagcatatcagcagccagggcct

SEQ ID NO: 436931 - DNA, 140 bp, Artificial Sequence
  Synthetic
aggccctggctgctgatatggggattttgttcagggatttataagttatgtagggtctcattatagagaagtgaaccttgtgtaccccagatacagcaacttcatatctactgagtcttagaccttttgggacagcggtg

SEQ ID NO: 436932 - DNA, 140 bp, Artificial Sequence
  Synthetic
caccgctgtcccaaaaggtctaagactcagtagatatgaagttgctgtatctggggtacacaaggttcacttctctataatgagaccctacataacttataaatccctgaacaaaatccccatatcagcagccagggcct

SEQ ID NO: 436933 - DNA, 140 bp, Artificial Sequence
  Synthetic
atacgccatgctgggtctccggtcacatcctatccattaagcaactgagctgcatacaagcaattgtgggagatgcagttagtagaggtgatatcaaccctactctgaaaaaacttacaccgtacttgggagtcggccat

SEQ ID NO: 436934 - DNA, 140 bp, Artificial Sequence
  Synthetic
atggccgactcccaagtacggtgtaagttttttcagagtagggttgatatcacctctactaactgcatctcccacaattgcttgtatgcagctcagttgcttaatggataggatgtgaccggagacccagcatggcgtat

SEQ ID NO: 436935 - DNA, 140 bp, Artificial Sequence
  Synthetic
aggccctggctgctgatatgagatgcagttagtagaggtgatatcaaccctactctgaaaaaacttacacctatagagcaggtgctggtcaattgtgggctggcaattaacggacctaaagaccttttgggacagcggtg

SEQ ID NO: 436936 - DNA, 140 bp, Artificial Sequence
  Synthetic
caccgctgtcccaaaaggtctttaggtccgttaattgccagcccacaattgaccagcacctgctctataggtgtaagttttttcagagtagggttgatatcacctctactaactgcatctcatatcagcagccagggcct

SEQ ID NO: 436937 - DNA, 140 bp, Artificial Sequence
  Synthetic
atacgccatgctgggtctccctgtgtaaagaattgatccaccatgatgttacctcggggcgagatggattgcttaactctatactcatcctctacagggagttggcaagattcaaagacacgtacttgggagtcggccat

SEQ ID NO: 436938 - DNA, 140 bp, Artificial Sequence
  Synthetic
atggccgactcccaagtacgtgtctttgaatcttgccaactccctgtagaggatgagtatagagttaagcaatccatctcgccccgaggtaacatcatggtggatcaattctttacacagggagacccagcatggcgtat

SEQ ID NO: 436939 - DNA, 140 bp, Artificial Sequence
  Synthetic
atacgccatgctgggtctccatcaaagaagtcaacaagggatgtttcacgcttaccccgtattggtgagtagtaggcaacgggaacttatatctaggatcacccgcaaattttgggggcacgtacttgggagtcggccat

SEQ ID NO: 436940 - DNA, 140 bp, Artificial Sequence
  Synthetic
atggccgactcccaagtacgtgcccccaaaatttgcgggtgatcctagatataagttcccgttgcctactactcaccaatacggggtaagcgtgaaacatcccttgttgacttctttgatggagacccagcatggcgtat

SEQ ID NO: 436941 - DNA, 140 bp, Artificial Sequence
  Synthetic
atacgccatgctgggtctcccattcttctttactccgggaacagaaagttgattaataagtttatccagaatctcaagtccggttatctgatactagacttacaccagaatatcttcgttcgtacttgggagtcggccat

SEQ ID NO: 436942 - DNA, 140 bp, Artificial Sequence
  Synthetic
atggccgactcccaagtacgaacgaagatattctggtgtaagtctagtatcagataaccggacttgagattctggataaacttattaatcaactttctgttcccggagtaaagaagaatgggagacccagcatggcgtat

SEQ ID NO: 436943 - DNA, 140 bp, Artificial Sequence
  Synthetic
atacgccatgctgggtctccaagaatctgtccaagtcagagaaacagattattatgacggggggtttgaaacgtgagtgggtttttaaggtaacagtcaaggagaccaaagaatggtatacgtacttgggagtcggccat

SEQ ID NO: 436944 - DNA, 140 bp, Artificial Sequence
  Synthetic
atggccgactcccaagtacgtataccattctttggtctccttgactgttaccttaaaaacccactcacgtttcaaaccccccgtcataataatctgtttctctgacttggacagattcttggagacccagcatggcgtat

SEQ ID NO: 436945 - DNA, 140 bp, Artificial Sequence
  Synthetic
atacgccatgctgggtctccattaagaagcagatcaacaggcaaaatatcagcatatccaccctggaaggacacctctcaagcatcatgatcgccattcctggacttgggaaggatcccacgtacttgggagtcggccat

SEQ ID NO: 436946 - DNA, 140 bp, Artificial Sequence
  Synthetic
atggccgactcccaagtacgtgggatccttcccaagtccaggaatggcgatcatgatgcttgagaggtgtccttccagggtggatatgctgatattttgcctgttgatctgcttcttaatggagacccagcatggcgtat

SEQ ID NO: 436947 - DNA, 140 bp, Artificial Sequence
  Synthetic
atacgccatgctgggtctccagttagtcggatacagtgccctgattaaggattaattggttggattccggaaccctaatcctgccctggatagttaggtattatttgcaatatattaaagcgtacttgggagtcggccat

SEQ ID NO: 436948 - DNA, 140 bp, Artificial Sequence
  Synthetic
atggccgactcccaagtacgctttaatatattgcaaataatacctaactatccagggcaggattagggttccggaatccaaccaattaatccttaatcagggcactgtatccgactaactggagacccagcatggcgtat

SEQ ID NO: 436949 - DNA, 140 bp, Artificial Sequence
  Synthetic
aggccctggctgctgatatgttccggaaccctaatcctgccctggatagttaggtattatttgcaatatattaaagaaaactttgaaaatacgaagtttctattcccagctttgtctggtgaccttttgggacagcggtg

SEQ ID NO: 436950 - DNA, 140 bp, Artificial Sequence
  Synthetic
caccgctgtcccaaaaggtcaccagacaaagctgggaatagaaacttcgtattttcaaagttttctttaatatattgcaaataatacctaactatccagggcaggattagggttccggaacatatcagcagccagggcct

SEQ ID NO: 436951 - DNA, 140 bp, Artificial Sequence
  Synthetic
aggccctggctgctgatatgcaccacatccgacgacactcaactccccacccctaaaagatacaccgggagtcccataatcaagactcatccaatgtccatcatgggtctcaaggtgaacgaccttttgggacagcggtg

SEQ ID NO: 436952 - DNA, 140 bp, Artificial Sequence
  Synthetic
caccgctgtcccaaaaggtcgttcaccttgagacccatgatggacattggatgagtcttgattatgggactcccggtgtatcttttaggggtggggagttgagtgtcgtcggatgtggtgcatatcagcagccagggcct

SEQ ID NO: 436953 - DNA, 140 bp, Artificial Sequence
  Synthetic
aggccctggctgctgatatgacacctctcaagcatcatgatcgccattcctggacttgggaaggatcccaacgaccccactgcagatgtcgaactcaatcccgacctgaaacccatcatagaccttttgggacagcggtg

SEQ ID NO: 436954 - DNA, 140 bp, Artificial Sequence
  Synthetic
caccgctgtcccaaaaggtctatgatgggtttcaggtcgggattgagttcgacatctgcagtggggtcgttgggatccttcccaagtccaggaatggcgatcatgatgcttgagaggtgtcatatcagcagccagggcct

SEQ ID NO: 436955 - DNA, 140 bp, Artificial Sequence
  Synthetic
aggccctggctgctgatatgagtgccccgcaatgcccgaaaacgaccctcctcataatgatagccagaaggcccggacaaaagaactccccccaaaaaaactccacggaccaaacgagaggaccttttgggacagcggtg

SEQ ID NO: 436956 - DNA, 140 bp, Artificial Sequence
  Synthetic
caccgctgtcccaaaaggtcctctcgtttggtccgtggagtttttttggggggagttcttttgtccgggccttctggctatcattatgaggagggtcgttttcgggcattgcggggcactcatatcagcagccagggcct

SEQ ID NO: 436957 - DNA, 140 bp, Artificial Sequence
  Synthetic
aggccctggctgctgatatgactaatcaggcaattgaggcaatcagacaagcagggcaggagatgatattagctgttcagggtgtccaagactacatcaataatgagctgataccgtctagaccttttgggacagcggtg

SEQ ID NO: 436958 - DNA, 140 bp, Artificial Sequence
  Synthetic
caccgctgtcccaaaaggtctagacggtatcagctcattattgatgtagtcttggacaccctgaacagctaatatcatctcctgccctgcttgtctgattgcctcaattgcctgattagtcatatcagcagccagggcct

SEQ ID NO: 436959 - DNA, 140 bp, Artificial Sequence
  Synthetic
aggccctggctgctgatatgagctgttcagggtgtccaagactacatcaataatgagctgataccgtctatgaaccaactatcttgtgatttaatcggccagaagctcgggctcaaattggaccttttgggacagcggtg

SEQ ID NO: 436960 - DNA, 140 bp, Artificial Sequence
  Synthetic
caccgctgtcccaaaaggtccaatttgagcccgagcttctggccgattaaatcacaagatagttggttcatagacggtatcagctcattattgatgtagtcttggacaccctgaacagctcatatcagcagccagggcct

SEQ ID NO: 436961 - DNA, 140 bp, Artificial Sequence
  Synthetic
aggccctggctgctgatatgccccatatctgcggagatatctatccaggctttgagctatgcgcttggaggagatattaataaggtcttagaaaagctcggatacagtggaggtgatttggaccttttgggacagcggtg

SEQ ID NO: 436962 - DNA, 140 bp, Artificial Sequence
  Synthetic
caccgctgtcccaaaaggtccaaatcacctccactgtatccgagcttttctaagaccttattaatatctcctccaagcgcatagctcaaagcctggatagatatctccgcagatatggggcatatcagcagccagggcct

SEQ ID NO: 436963 - DNA, 140 bp, Artificial Sequence
  Synthetic
atacgccatgctgggtctccgcccggacaaaaaagccccctccaaaagactccacggaccaagtgagaggccagccagcagccgacagcaagcgtggacaccaggcggcccaagcacggacgtacttgggagtcggccat

SEQ ID NO: 436964 - DNA, 140 bp, Artificial Sequence
  Synthetic
atggccgactcccaagtacgtccgtgcttgggccgcctggtgtccacgcttgctgtcggctgctggctggcctctcacttggtccgtggagtcttttggagggggcttttttgtccgggcggagacccagcatggcgtat

SEQ ID NO: 436965 - DNA, 140 bp, Artificial Sequence
  Synthetic
aggccctggctgctgatatgagattaagggggtgattgtccaccggctagagggggtctcgtacaacataggctctcaagagtggtataccactgtgcccaagtatgttgcaacccaagggaccttttgggacagcggtg

SEQ ID NO: 436966 - DNA, 140 bp, Artificial Sequence
  Synthetic
caccgctgtcccaaaaggtcccttgggttgcaacatacttgggcacagtggtataccactcttgagagcctatgttgtacgagaccccctctagccggtggacaatcacccccttaatctcatatcagcagccagggcct

SEQ ID NO: 436967 - DNA, 140 bp, Artificial Sequence
  Synthetic
aggccctggctgctgatatgcgaggtgaacggcgtgaccatccaagtcgggagcaggaggtatccagacgctgtgtacttgcacagaattgacctcggtcctcccatatcattggagagggaccttttgggacagcggtg

SEQ ID NO: 436968 - DNA, 140 bp, Artificial Sequence
  Synthetic
caccgctgtcccaaaaggtccctctccaatgatatgggaggaccgaggtcaattctgtgcaagtacacagcgtctggatacctcctgctcccgacttggatggtcacgccgttcacctcgcatatcagcagccagggcct

SEQ ID NO: 436969 - DNA, 140 bp, Artificial Sequence
  Synthetic
aggccctggctgctgatatgggtcacatcctatccattaagcaactaagctgcatacaagcaattgtgggagacgcagttagtagaggtgatatcaatcctactctgaaaaaacttacacgaccttttgggacagcggtg

SEQ ID NO: 436970 - DNA, 140 bp, Artificial Sequence
  Synthetic
caccgctgtcccaaaaggtcgtgtaagttttttcagagtaggattgatatcacctctactaactgcgtctcccacaattgcttgtatgcagcttagttgcttaatggataggatgtgacccatatcagcagccagggcct

SEQ ID NO: 436971 - DNA, 140 bp, Artificial Sequence
  Synthetic
aggccctggctgctgatatgaaaaggagaacaagttggtatgtcaagaccaggcctaaagcctgatcttacaggaacatcaaaatcctatgtaaggtcgctctgatcctctgcaactcatgaccttttgggacagcggtg

SEQ ID NO: 436972 - DNA, 140 bp, Artificial Sequence
  Synthetic
caccgctgtcccaaaaggtcatgagttgcagaggatcagagcgaccttacataggattttgatgttcctgtaagatcaggctttaggcctggtcttgacataccaacttgttctccttttcatatcagcagccagggcct

SEQ ID NO: 436973 - DNA, 140 bp, Artificial Sequence
  Synthetic
aggccctggctgctgatatgagggaagtaggatagttattaacagagaacatcttatgattgatagaccttatgttttgctggctgttctgttcgtcatgtttctgagcttgatcgggttgaccttttgggacagcggtg

SEQ ID NO: 436974 - DNA, 140 bp, Artificial Sequence
  Synthetic
caccgctgtcccaaaaggtcaacccgatcaagctcagaaacatgacgaacagaacagccagcaaaacataaggtctatcaatcataagatgttctctgttaataactatcctacttccctcatatcagcagccagggcct

SEQ ID NO: 436975 - DNA, 140 bp, Artificial Sequence
  Synthetic
aggccctggctgctgatatgaatgcttcacatgggaccaaaaactctggtgccgtcacttctgtgtgcttgcggactcagaatctggtggacatatcactcactctgggatggtgggcatgaccttttgggacagcggtg

SEQ ID NO: 436976 - DNA, 140 bp, Artificial Sequence
  Synthetic
caccgctgtcccaaaaggtcatgcccaccatcccagagtgagtgatatgtccaccagattctgagtccgcaagcacacagaagtgacggcaccagagtttttggtcccatgtgaagcattcatatcagcagccagggcct

SEQ ID NO: 436977 - DNA, 140 bp, Artificial Sequence
  Synthetic
aggccctggctgctgatatgaatgtggaagttgggaatgtcatcaagtccaagcttaggagttatccggcccactctcatattccatatccaaattgtaatcaggatttatttaacataggaccttttgggacagcggtg

SEQ ID NO: 436978 - DNA, 140 bp, Artificial Sequence
  Synthetic
caccgctgtcccaaaaggtcctatgttaaataaatcctgattacaatttggatatggaatatgagagtgggccggataactcctaagcttggacttgatgacattcccaacttccacattcatatcagcagccagggcct

SEQ ID NO: 436979 - DNA, 140 bp, Artificial Sequence
  Synthetic
atacgccatgctgggtctccactcaggtactcccgttgttgagtatctgtctaaagaagacctacatacattgtatgtagaccctaagtatcaagtcattgtcttaaaagacaatgtactcgtacttgggagtcggccat

SEQ ID NO: 436980 - DNA, 140 bp, Artificial Sequence
  Synthetic
atggccgactcccaagtacgagtacattgtcttttaagacaatgacttgatacttagggtctacatacaatgtatgtaggtcttctttagacagatactcaacaacgggagtacctgagtggagacccagcatggcgtat

SEQ ID NO: 436981 - DNA, 140 bp, Artificial Sequence
  Synthetic
aggccctggctgctgatatgattttaacgaacttaaataaaagccctgttgtttagcgtattgttgcacttgtctggtgggattgtggcattaatttgcctgctcatctaggcagtggacgaccttttgggacagcggtg

SEQ ID NO: 436982 - DNA, 140 bp, Artificial Sequence
  Synthetic
caccgctgtcccaaaaggtcgtccactgcctagatgagcaggcaaattaatgccacaatcccaccagacaagtgcaacaatacgctaaacaacagggcttttatttaagttcgttaaaatcatatcagcagccagggcct

SEQ ID NO: 436983 - DNA, 140 bp, Artificial Sequence
  Synthetic
aggccctggctgctgatatgtgtctggtgggattgtggcattaatttgcctgctcatctaggcagtggacatatgctcaacactgggtataattctaattgaatactatttttcagttaggaccttttgggacagcggtg

SEQ ID NO: 436984 - DNA, 140 bp, Artificial Sequence
  Synthetic
caccgctgtcccaaaaggtcctaactgaaaaatagtattcaattagaattatacccagtgttgagcatatgtccactgcctagatgagcaggcaaattaatgccacaatcccaccagacacatatcagcagccagggcct

SEQ ID NO: 436985 - DNA, 140 bp, Artificial Sequence
  Synthetic
atacgccatgctgggtctccatatgctcaacactgggtataattctaattgaatactatttttcagttagagcgtcgtgtctcttgtacgtctcggtcacaatacacggtttcgtccggtcgtacttgggagtcggccat

SEQ ID NO: 436986 - DNA, 140 bp, Artificial Sequence
  Synthetic
atggccgactcccaagtacgaccggacgaaaccgtgtattgtgaccgagacgtacaagagacacgacgctctaactgaaaaatagtattcaattagaattatacccagtgttgagcatatggagacccagcatggcgtat

SEQ ID NO: 436987 - DNA, 140 bp, Artificial Sequence
  Synthetic
atacgccatgctgggtctcctttggcatgttgagcgtaagaacgttccgtatgccaagcaaaccatctttactattaacagtgtggttcaatgtgatggcattcaagatgtgccaccccacgtacttgggagtcggccat

SEQ ID NO: 436988 - DNA, 140 bp, Artificial Sequence
  Synthetic
atggccgactcccaagtacgtggggtggcacatcttgaatgccatcacattgaaccacactgttaatagtaaagatggtttgcttggcatacggaacgttcttacgctcaacatgccaaaggagacccagcatggcgtat

SEQ ID NO: 436989 - DNA, 140 bp, Artificial Sequence
  Synthetic
aggccctggctgctgatatgagtgaatagcttggctatctcacttcccctcgttctcttgcagaactttgattttaacgaacttaaataaaagccctgttgtttagcgtattgttgcactgaccttttgggacagcggtg

SEQ ID NO: 436990 - DNA, 140 bp, Artificial Sequence
  Synthetic
caccgctgtcccaaaaggtcagtgcaacaatacgctaaacaacagggcttttatttaagttcgttaaaatcaaagttctgcaagagaacgaggggaagtgagatagccaagctattcactcatatcagcagccagggcct

SEQ ID NO: 436991 - DNA, 140 bp, Artificial Sequence
  Synthetic
atacgccatgctgggtctcccctgcttaagaagttggttggtggggattttattcctattgaccagttcatgtgtggtaaggatggtgcacctgtgcctgactatgccactttggctgctcgtacttgggagtcggccat

SEQ ID NO: 436992 - DNA, 140 bp, Artificial Sequence
  Synthetic
atggccgactcccaagtacgagcagccaaagtggcatagtcaggcacaggtgcaccatccttaccacacatgaactggtcaataggaataaaatccccaccaaccaacttcttaagcaggggagacccagcatggcgtat

SEQ ID NO: 436993 - DNA, 140 bp, Artificial Sequence
  Synthetic
atacgccatgctgggtctccagcggacgtcgcagcacgtgctgatgacgaaggcttcatcacattaaagaacaatctatatagattggtttggcatgttgagcgtaaagacgttccatatcgtacttgggagtcggccat

SEQ ID NO: 436994 - DNA, 140 bp, Artificial Sequence
  Synthetic
atggccgactcccaagtacgatatggaacgtctttacgctcaacatgccaaaccaatctatatagattgttctttaatgtgatgaagccttcgtcatcagcacgtgctgcgacgtccgctggagacccagcatggcgtat

SEQ ID NO: 436995 - DNA, 140 bp, Artificial Sequence
  Synthetic
atacgccatgctgggtctcctatggaaaggatgctcttgataaccattcttacatctaccattccgcctatgcagattgcactagttgtggtaagggtagttggctcacaggtaatgctgcgtacttgggagtcggccat

SEQ ID NO: 436996 - DNA, 140 bp, Artificial Sequence
  Synthetic
atggccgactcccaagtacgcagcattacctgtgagccaactacccttaccacaactagtgcaatctgcataggcggaatggtagatgtaagaatggttatcaagagcatcctttccataggagacccagcatggcgtat

SEQ ID NO: 436997 - DNA, 140 bp, Artificial Sequence
  Synthetic
atacgccatgctgggtctcctgcaaggctttgcatgcgattgtggtgcacaatactcggcaaatgatgtcgagcttcagtcttctggagttgttaaccccaatgctatcttttgtgctaccgtacttgggagtcggccat

SEQ ID NO: 436998 - DNA, 140 bp, Artificial Sequence
  Synthetic
atggccgactcccaagtacggtagcacaaaagatagcattggggttaacaactccagaagactgaagctcgacatcatttgccgagtattgtgcaccacaatcgcatgcaaagccttgcaggagacccagcatggcgtat

SEQ ID NO: 436999 - DNA, 140 bp, Artificial Sequence
  Synthetic
atacgccatgctgggtctccatgactcttaatggtctttggcttgacaacacagtctggtgtccacgacacgtaatgtgcccagctgaccagttgtctgatcctaattatgatgccttgtcgtacttgggagtcggccat

SEQ ID NO: 437000 - DNA, 140 bp, Artificial Sequence
  Synthetic
atggccgactcccaagtacgacaaggcatcataattaggatcagacaactggtcagctgggcacattacgtgtcgtggacaccagactgtgttgtcaagccaaagaccattaagagtcatggagacccagcatggcgtat

SEQ ID NO: 437001 - DNA, 140 bp, Artificial Sequence
  Synthetic
aggccctggctgctgatatgggtatgttcttcccttatgacatcgaacttgtcacaggaaagcaaaatattctcctgcgcaagtatggccgtggtggttatcactacaccccattccactgaccttttgggacagcggtg

SEQ ID NO: 437002 - DNA, 140 bp, Artificial Sequence
  Synthetic
caccgctgtcccaaaaggtcagtggaatggggtgtagtgataaccaccacggccatacttgcgcaggagaatattttgctttcctgtgacaagttcgatgtcataagggaagaacatacccatatcagcagccagggcct

SEQ ID NO: 437003 - DNA, 140 bp, Artificial Sequence
  Synthetic
atacgccatgctgggtctccatgagcgagacaacacctcttgccctgagtggatggacgattttgaggcggatcctaaaggcaaatatgcccagaatctgcttaagaagttgattggcggcgtacttgggagtcggccat

SEQ ID NO: 437004 - DNA, 140 bp, Artificial Sequence
  Synthetic
atggccgactcccaagtacgccgccaatcaacttcttaagcagattctgggcatatttgcctttaggatccgcctcaaaatcgtccatccactcagggcaagaggtgttgtctcgctcatggagacccagcatggcgtat

SEQ ID NO: 437005 - DNA, 140 bp, Artificial Sequence
  Synthetic
atacgccatgctgggtctcctgatgtcactccagttgaccaatacatgtgtggcgttgatggaaaacccattagtgcctacgcatttttaatggccaaggatggaataaccaaactggctcgtacttgggagtcggccat

SEQ ID NO: 437006 - DNA, 140 bp, Artificial Sequence
  Synthetic
atggccgactcccaagtacgagccagtttggttattccatccttggccattaaaaatgcgtaggcactaatgggttttccatcaacgccacacatgtattggtcaactggagtgacatcaggagacccagcatggcgtat

SEQ ID NO: 437007 - DNA, 140 bp, Artificial Sequence
  Synthetic
aggccctggctgctgatatgttagtgcctacgcatttttaatggccaaggatggaataaccaaactggctgatgttgaagcggacgtcgcagcacgtgctgatgacgaaggcttcatcacgaccttttgggacagcggtg

SEQ ID NO: 437008 - DNA, 140 bp, Artificial Sequence
  Synthetic
caccgctgtcccaaaaggtcgtgatgaagccttcgtcatcagcacgtgctgcgacgtccgcttcaacatcagccagtttggttattccatccttggccattaaaaatgcgtaggcactaacatatcagcagccagggcct

SEQ ID NO: 437009 - DNA, 140 bp, Artificial Sequence
  Synthetic
atacgccatgctgggtctccagtgagaatttaatctcactggctgacgttgcaaccgatgtttcagcccgcgctgattctgatggttacatcgatttcaagagcaaactttacaggattgcgtacttgggagtcggccat

SEQ ID NO: 437010 - DNA, 140 bp, Artificial Sequence
  Synthetic
atggccgactcccaagtacgcaatcctgtaaagtttgctcttgaaatcgatgtaaccatcagaatcagcgcgggctgaaacatcggttgcaacgtcagccagtgagattaaattctcactggagacccagcatggcgtat

SEQ ID NO: 437011 - DNA, 140 bp, Artificial Sequence
  Synthetic
aggccctggctgctgatatgattaaagaacaatctatatagattggtttggcatgttgagcgtaaagacgttccatatcctaagcaatctatttttactattaatagtgtggtccaaaaggaccttttgggacagcggtg

SEQ ID NO: 437012 - DNA, 140 bp, Artificial Sequence
  Synthetic
caccgctgtcccaaaaggtccttttggaccacactattaatagtaaaaatagattgcttaggatatggaacgtctttacgctcaacatgccaaaccaatctatatagattgttctttaatcatatcagcagccagggcct

SEQ ID NO: 437013 - DNA, 140 bp, Artificial Sequence
  Synthetic
aggccctggctgctgatatgttccatatcctaagcaatctatttttactattaatagtgtggtccaaaaggatggtgttgaaaacactcctcctcactattttactcttggatgcaaaatgaccttttgggacagcggtg

SEQ ID NO: 437014 - DNA, 140 bp, Artificial Sequence
  Synthetic
caccgctgtcccaaaaggtcattttgcatccaagagtaaaatagtgaggaggagtgttttcaacaccatccttttggaccacactattaatagtaaaaatagattgcttaggatatggaacatatcagcagccagggcct

SEQ ID NO: 437015 - DNA, 140 bp, Artificial Sequence
  Synthetic
aggccctggctgctgatatgtttaacgctcaccccacgcaacaagtggagtggcgtttctgacttgtccctcaaacaaaaactcctttacaccttctatggtaaggagtcacttgagaacgaccttttgggacagcggtg

SEQ ID NO: 437016 - DNA, 140 bp, Artificial Sequence
  Synthetic
caccgctgtcccaaaaggtcgttctcaagtgactccttaccatagaaggtgtaaaggagtttttgtttgagggacaagtcagaaacgccactccacttgttgcgtggggtgagcgttaaacatatcagcagccagggcct

SEQ ID NO: 437017 - DNA, 140 bp, Artificial Sequence
  Synthetic
atacgccatgctgggtctccccaacctacatttaccactccgcattcattgagtgtggaagttgtggtaatgattcctggcttacagggaatgctatccaagggtttgcctgtggatgtgcgtacttgggagtcggccat

SEQ ID NO: 437018 - DNA, 140 bp, Artificial Sequence
  Synthetic
atggccgactcccaagtacgcacatccacaggcaaacccttggatagcattccctgtaagccaggaatcattaccacaacttccacactcaatgaatgcggagtggtaaatgtaggttggggagacccagcatggcgtat

SEQ ID NO: 437019 - DNA, 140 bp, Artificial Sequence
  Synthetic
atacgccatgctgggtctcccgaacatgttactagtgtgaatctttttgacgttggttactcagttaattaacgaactctatggattacgtgtctctgcttaatcaaatttggcagaagtcgtacttgggagtcggccat

SEQ ID NO: 437020 - DNA, 140 bp, Artificial Sequence
  Synthetic
atggccgactcccaagtacgacttctgccaaatttgattaagcagagacacgtaatccatagagttcgttaattaactgagtaaccaacgtcaaaaagattcacactagtaacatgttcgggagacccagcatggcgtat

SEQ ID NO: 437021 - DNA, 140 bp, Artificial Sequence
  Synthetic
atacgccatgctgggtctccgggcatcatatacagctaatgatgtcgaagtccaatcatctggcatgattaagccaaatgctcttctttgtgctacttgcccctttgctaagggtgatagcgtacttgggagtcggccat

SEQ ID NO: 437022 - DNA, 140 bp, Artificial Sequence
  Synthetic
atggccgactcccaagtacgctatcacccttagcaaaggggcaagtagcacaaagaagagcatttggcttaatcatgccagatgattggacttcgacatcattagctgtatatgatgcccggagacccagcatggcgtat

SEQ ID NO: 437023 - DNA, 140 bp, Artificial Sequence
  Synthetic
atacgccatgctgggtctccctgttcttctaattgcaaacattcagttgctcagttggttagttacctttctgaacgttgtaatgttattgctgattctaagtccttcacacttatctttcgtacttgggagtcggccat

SEQ ID NO: 437024 - DNA, 140 bp, Artificial Sequence
  Synthetic
atggccgactcccaagtacgaaagataagtgtgaaggacttagaatcagcaataacattacaacgttcagaaaggtaactaaccaactgagcaactgaatgtttgcaattagaagaacagggagacccagcatggcgtat

SEQ ID NO: 437025 - DNA, 140 bp, Artificial Sequence
  Synthetic
atacgccatgctgggtctcctcaagagaggtatgtaaaaataactggattgtatccaactattactgtgcctgaggagtttgccaatcacgttgctaacttccaaaaagcaggttatagtcgtacttgggagtcggccat

SEQ ID NO: 437026 - DNA, 140 bp, Artificial Sequence
  Synthetic
atggccgactcccaagtacgactataacctgctttttggaagttagcaacgtgattggcaaactcctcaggcacagtaatagttggatacaatccagttatttttacatacctctcttgaggagacccagcatggcgtat

SEQ ID NO: 437027 - DNA, 140 bp, Artificial Sequence
  Synthetic
atacgccatgctgggtctccctacacgacaactggctttgttgctgtaggttgcaaggtttcaaatcttactaagcagctcttggagattctgtctaaagctatgcagcttttacacacacgtacttgggagtcggccat

SEQ ID NO: 437028 - DNA, 140 bp, Artificial Sequence
  Synthetic
atggccgactcccaagtacgtgtgtgtaaaagctgcatagctttagacagaatctccaagagctgcttagtaagatttgaaaccttgcaacctacagcaacaaagccagttgtcgtgtagggagacccagcatggcgtat

SEQ ID NO: 437029 - DNA, 140 bp, Artificial Sequence
  Synthetic
atacgccatgctgggtctccgcggtgccccattgacaaattgtgttaagatgcttactcctaaaactggtacaggtatagctatatctgttaaaccagagagtacagctgatcaagaaaccgtacttgggagtcggccat

SEQ ID NO: 437030 - DNA, 140 bp, Artificial Sequence
  Synthetic
atggccgactcccaagtacggtttcttgatcagctgtactctctggtttaacagatatagctatacctgtaccagttttaggagtaagcatcttaacacaatttgtcaatggggcaccgcggagacccagcatggcgtat

SEQ ID NO: 437031 - DNA, 140 bp, Artificial Sequence
  Synthetic
atacgccatgctgggtctccaaggtctcctgggctggtgctaaagttaaggctgttgtttacaacagtagggaatcacttgttttcccttcaggtacttactattgtgtggctgctcgtgcgtacttgggagtcggccat

SEQ ID NO: 437032 - DNA, 140 bp, Artificial Sequence
  Synthetic
atggccgactcccaagtacgcacgagcagccacacaatagtaagtacctgaagggaaaacaagtgattccctactgttgtaaacaacagccttaactttagcaccagcccaggagaccttggagacccagcatggcgtat

SEQ ID NO: 437033 - DNA, 140 bp, Artificial Sequence
  Synthetic
atacgccatgctgggtctccttggaacagactcagcattcccttaactttgtgggagagttcgttgtcaacgatgttgtcctcgcaattctctctggaaccacaactaatgttgacaaaacgtacttgggagtcggccat

SEQ ID NO: 437034 - DNA, 140 bp, Artificial Sequence
  Synthetic
atggccgactcccaagtacgttttgtcaacattagttgtggttccagagagaattgcgaggacaacatcgttgacaacgaactctcccacaaagttaagggaatgctgagtctgttccaaggagacccagcatggcgtat

SEQ ID NO: 437035 - DNA, 140 bp, Artificial Sequence
  Synthetic
atacgccatgctgggtctccctaatgctgtgcaacaagagtttagcgcagtattgcctggggagcttgcaaagaagcaattaggtttgcttgaacctgttcgccatgctaccaccgtggacgtacttgggagtcggccat

SEQ ID NO: 437036 - DNA, 140 bp, Artificial Sequence
  Synthetic
atggccgactcccaagtacgtccacggtggtagcatggcgaacaggttcaagcaaacctaattgcttctttgcaagctccccaggcaatactgcgctaaactcttgttgcacagcattagggagacccagcatggcgtat

SEQ ID NO: 437037 - DNA, 140 bp, Artificial Sequence
  Synthetic
atacgccatgctgggtctccattacaatctctcactcttgctctctctagtgcaagtggatgagtttgtatgtgataagattacacccgaagctctggcaactgggtgctattcttctctcgtacttgggagtcggccat

SEQ ID NO: 437038 - DNA, 140 bp, Artificial Sequence
  Synthetic
atggccgactcccaagtacgagagaagaatagcacccagttgccagagcttcgggtgtaatcttatcacatacaaactcatccacttgcactagagagagcaagagtgagagattgtaatggagacccagcatggcgtat

SEQ ID NO: 437039 - DNA, 140 bp, Artificial Sequence
  Synthetic
atacgccatgctgggtctcctgtgcaagtccaaaataaagtggtggatgtagttgttggccaacttgaagaaactaatatgcatagcccagacctcattgtaggcgactatgttgttattcgtacttgggagtcggccat

SEQ ID NO: 437040 - DNA, 140 bp, Artificial Sequence
  Synthetic
atggccgactcccaagtacgaataacaacatagtcgcctacaatgaggtctgggctatgcatattagtttcttcaagttggccaacaactacatccaccactttattttggacttgcacaggagacccagcatggcgtat

SEQ ID NO: 437041 - DNA, 140 bp, Artificial Sequence
  Synthetic
atacgccatgctgggtctccagtgataagctttttgtgcgttgtgaagaggatggtcagactgtcttctatccaatgtgcactaatggccaagctgttcctaccttattcagacttaaggcgtacttgggagtcggccat

SEQ ID NO: 437042 - DNA, 140 bp, Artificial Sequence
  Synthetic
atggccgactcccaagtacgccttaagtctgaataaggtaggaacagcttggccattagtgcacattggatagaagacagtctgaccatcctcttcacaacgcacaaaaagcttatcactggagacccagcatggcgtat

SEQ ID NO: 437043 - DNA, 140 bp, Artificial Sequence
  Synthetic
atacgccatgctgggtctcccgtgttgtacagagtttttccttatgacatggattctggtgtgtcatcctttagtgaactactttttgattgcgttgatctttcagtagcttctacctatcgtacttgggagtcggccat

SEQ ID NO: 437044 - DNA, 140 bp, Artificial Sequence
  Synthetic
atggccgactcccaagtacgataggtagaagctactgaaagatcaacgcaatcaaaaagtagttcactaaaggatgacacaccagaatccatgtcataaggaaaaactctgtacaacacgggagacccagcatggcgtat

SEQ ID NO: 437045 - DNA, 140 bp, Artificial Sequence
  Synthetic
aggccctggctgctgatatgtaatggtcgtccgactggtacattcactgttgtaatgcgccctaactacacaattaagggttcctttctgtgtggttcttgtggtagtgttggttaccacgaccttttgggacagcggtg

SEQ ID NO: 437046 - DNA, 140 bp, Artificial Sequence
  Synthetic
caccgctgtcccaaaaggtcgtggtaaccaacactaccacaagaaccacacagaaaggaacccttaattgtgtagttagggcgcattacaacagtgaatgtaccagtcggacgaccattacatatcagcagccagggcct

SEQ ID NO: 437047 - DNA, 140 bp, Artificial Sequence
  Synthetic
atacgccatgctgggtctcccacgtttaccctaggaggtaaggttgacttgattgtcccacgtaacaagtggacaggcaagacagcgcttaacctcaaacagaagatcctttacacctttcgtacttgggagtcggccat

SEQ ID NO: 437048 - DNA, 140 bp, Artificial Sequence
  Synthetic
atggccgactcccaagtacgaaaggtgtaaaggatcttctgtttgaggttaagcgctgtcttgcctgtccacttgttacgtgggacaatcaagtcaaccttacctcctagggtaaacgtgggagacccagcatggcgtat

SEQ ID NO: 437049 - DNA, 140 bp, Artificial Sequence
  Synthetic
aggccctggctgctgatatgtattacttcctgccaaactgctgttagtaagcttctagatacatgttttgaagctacagaagcaacatttaacttcttgttagatttggcaggattgttcgaccttttgggacagcggtg

SEQ ID NO: 437050 - DNA, 140 bp, Artificial Sequence
  Synthetic
caccgctgtcccaaaaggtcgaacaatcctgccaaatctaacaagaagttaaatgttgcttctgtagcttcaaaacatgtatctagaagcttactaacagcagtttggcaggaagtaatacatatcagcagccagggcct

SEQ ID NO: 437051 - DNA, 140 bp, Artificial Sequence
  Synthetic
atacgccatgctgggtctccttgctcactaagcttctgcgcggcgttgcattagatgactttgacttggagacttttattgatactccatgctactgttttaaccaggatggtgatgtaccgtacttgggagtcggccat

SEQ ID NO: 437052 - DNA, 140 bp, Artificial Sequence
  Synthetic
atggccgactcccaagtacggtacatcaccatcctggttaaaacagtagcatggagtatcaataaaagtctccaagtcaaagtcatctaatgcaacgccgcgcagaagcttagtgagcaaggagacccagcatggcgtat

SEQ ID NO: 437053 - DNA, 140 bp, Artificial Sequence
  Synthetic
atacgccatgctgggtctccagtggagttctactatgttcttttcaacacaccctgtagagtgtgatgatgagaatgaggaagagcctgcagatgatgatgcggaggattttgacgagtgcgtacttgggagtcggccat

SEQ ID NO: 437054 - DNA, 140 bp, Artificial Sequence
  Synthetic
atggccgactcccaagtacgcactcgtcaaaatcctccgcatcatcatctgcaggctcttcctcattctcatcatcacactctacagggtgtgttgaaaagaacatagtagaactccactggagacccagcatggcgtat

SEQ ID NO: 437055 - DNA, 140 bp, Artificial Sequence
  Synthetic
aggccctggctgctgatatgcaatcagtttctgtcgatcgtgagtcaacttcaactcatgatggtcctaacgaacatgttactagtgtgaatcttttagacgttggttactcagttaattgaccttttgggacagcggtg

SEQ ID NO: 437056 - DNA, 140 bp, Artificial Sequence
  Synthetic
caccgctgtcccaaaaggtcaattaactgagtaaccaacgtctaaaagattcacactagtaacatgttcgttaggaccatcatgagttgaagttgactcacgatcgacagaaactgattgcatatcagcagccagggcct

SEQ ID NO: 437057 - DNA, 140 bp, Artificial Sequence
  Synthetic
aggccctggctgctgatatgatcagtgctgttatctacagcggcagggagtctctaatattcccatcgggaacctattactgtgtcaccactaaggctaagtccgttcaacaagatcttggaccttttgggacagcggtg

SEQ ID NO: 437058 - DNA, 140 bp, Artificial Sequence
  Synthetic
caccgctgtcccaaaaggtccaagatcttgttgaacggacttagccttagtggtgacacagtaataggttcccgatgggaatattagagactccctgccgctgtagataacagcactgatcatatcagcagccagggcct

SEQ ID NO: 437059 - DNA, 140 bp, Artificial Sequence
  Synthetic
atacgccatgctgggtctccacgttattttgcctggtgagttttccaagaagcagttaggactgctccaacctactgacaattctacaactgttagtgttactgtatccagtaacatggtcgtacttgggagtcggccat

SEQ ID NO: 437060 - DNA, 140 bp, Artificial Sequence
  Synthetic
atggccgactcccaagtacgaccatgttactggatacagtaacactaacagttgtagaattgtcagtaggttggagcagtcctaactgcttcttggaaaactcaccaggcaaaataacgtggagacccagcatggcgtat

SEQ ID NO: 437061 - DNA, 140 bp, Artificial Sequence
  Synthetic
atacgccatgctgggtctcctgaaactgttgtgggtcaacttgagcaaactaatatgcatagtcctgatgttatagtaggtgactatgtcattattagtgaaaaattgtttgtgcgtagtcgtacttgggagtcggccat

SEQ ID NO: 437062 - DNA, 140 bp, Artificial Sequence
  Synthetic
atggccgactcccaagtacgactacgcacaaacaatttttcactaataatgacatagtcacctactataacatcaggactatgcatattagtttgctcaagttgacccacaacagtttcaggagacccagcatggcgtat

SEQ ID NO: 437063 - DNA, 140 bp, Artificial Sequence
  Synthetic
atacgccatgctgggtctccaaggaagaagacggatttgccttctaccctgcttgcactaatggtcatgctgtaccgactctctttagacttaagggaggtgcacctgtaaaaaaagtagcgtacttgggagtcggccat

SEQ ID NO: 437064 - DNA, 140 bp, Artificial Sequence
  Synthetic
atggccgactcccaagtacgctactttttttacaggtgcacctcccttaagtctaaagagagtcggtacagcatgaccattagtgcaagcagggtagaaggcaaatccgtcttcttccttggagacccagcatggcgtat

SEQ ID NO: 437065 - DNA, 140 bp, Artificial Sequence
  Synthetic
aggccctggctgctgatatggcttttaatcatcctattcaggttgatcaacttaatagtagttattttaaattaagtatacccactaatttttcctttggtgtgactcaggagtacattcgaccttttgggacagcggtg

SEQ ID NO: 437066 - DNA, 140 bp, Artificial Sequence
  Synthetic
caccgctgtcccaaaaggtcgaatgtactcctgagtcacaccaaaggaaaaattagtgggtatacttaatttaaaataactactattaagttgatcaacctgaataggatgattaaaagccatatcagcagccagggcct

SEQ ID NO: 437067 - DNA, 140 bp, Artificial Sequence
  Synthetic
atacgccatgctgggtctcccctttggcggtgatcaagtacatgaggttgctgctgtaagaagtgttactgtcgagtacaacattcatgctgtattagacacactacttgcttcttctagcgtacttgggagtcggccat

SEQ ID NO: 437068 - DNA, 140 bp, Artificial Sequence
  Synthetic
atggccgactcccaagtacgctagaagaagcaagtagtgtgtctaatacagcatgaatgttgtactcgacagtaacacttcttacagcagcaacctcatgtacttgatcaccgccaaaggggagacccagcatggcgtat

SEQ ID NO: 437069 - DNA, 140 bp, Artificial Sequence
  Synthetic
atacgccatgctgggtctccacaaagtcactatagctgatcctggttatatgcaaggttacgatgattgcatgcagcaaggtccagcatcagctcgtgatcttatttgtgctcaatatgtcgtacttgggagtcggccat

SEQ ID NO: 437070 - DNA, 140 bp, Artificial Sequence
  Synthetic
atggccgactcccaagtacgacatattgagcacaaataagatcacgagctgatgctggaccttgctgcatgcaatcatcgtaaccttgcatataaccaggatcagctatagtgactttgtggagacccagcatggcgtat

SEQ ID NO: 437071 - DNA, 140 bp, Artificial Sequence
  Synthetic
atacgccatgctgggtctcctcttagaacctttgttgtagataagtctttgtcaattgaggagtttgctgacgtagtaaaggaacaagtctcagacttgcttgttaaattactgcgtggacgtacttgggagtcggccat

SEQ ID NO: 437072 - DNA, 140 bp, Artificial Sequence
  Synthetic
atggccgactcccaagtacgtccacgcagtaatttaacaagcaagtctgagacttgttcctttactacgtcagcaaactcctcaattgacaaagacttatctacaacaaaggttctaagaggagacccagcatggcgtat

SEQ ID NO: 437073 - DNA, 140 bp, Artificial Sequence
  Synthetic
atacgccatgctgggtctccgacacctaaaaagcgcaatactaaaagtgtttcggccgctgctagtgatagcgacacgtcagttgatcctttagtatcttttaagcacaaggtttgcactcgtacttgggagtcggccat

SEQ ID NO: 437074 - DNA, 140 bp, Artificial Sequence
  Synthetic
atggccgactcccaagtacgagtgcaaaccttgtgcttaaaagatactaaaggatcaactgacgtgtcgctatcactagcagcggccgaaacacttttagtattgcgctttttaggtgtcggagacccagcatggcgtat

SEQ ID NO: 437075 - DNA, 140 bp, Artificial Sequence
  Synthetic
atacgccatgctgggtctccctcttcaccccgtcgagtgtgacgaggagtgttctgaagtagaggcttcagatttagaagaaggtgaatcagagtgcatttctgagacttcaactgaacacgtacttgggagtcggccat

SEQ ID NO: 437076 - DNA, 140 bp, Artificial Sequence
  Synthetic
atggccgactcccaagtacgtgttcagttgaagtctcagaaatgcactctgattcaccttcttctaaatctgaagcctctacttcagaacactcctcgtcacactcgacggggtgaagagggagacccagcatggcgtat

SEQ ID NO: 437077 - DNA, 140 bp, Artificial Sequence
  Synthetic
aggccctggctgctgatatggatttagaagaaggtgaatcagagtgcatttctgagacttcaactgaacaagttgacgtttctcatgaggtttctgacgacgagtgggctgctgcagttggaccttttgggacagcggtg

SEQ ID NO: 437078 - DNA, 140 bp, Artificial Sequence
  Synthetic
caccgctgtcccaaaaggtccaactgcagcagcccactcgtcgtcagaaacctcatgagaaacgtcaacttgttcagttgaagtctcagaaatgcactctgattcaccttcttctaaatccatatcagcagccagggcct

SEQ ID NO: 437079 - DNA, 140 bp, Artificial Sequence
  Synthetic
atacgccatgctgggtctccgtggtattgctgctgctataaataaggcatctcatggctcagtacaaatggagtctgatgagtatgttaactcaaaaggcccattgcaggttggtgatgccgtacttgggagtcggccat

SEQ ID NO: 437080 - DNA, 140 bp, Artificial Sequence
  Synthetic
atggccgactcccaagtacggcatcaccaacctgcaatgggccttttgagttaacatactcatcagactccatttgtactgagccatgagatgccttatttatagcagcagcaataccacggagacccagcatggcgtat

SEQ ID NO: 437081 - DNA, 140 bp, Artificial Sequence
  Synthetic
atacgccatgctgggtctcctgtattattaaaggggcatggtttagccaaaaatatcctccatgttgttggaccggatatgcgttctaaacaagatgtttctttgcttactaagtgttaccgtacttgggagtcggccat

SEQ ID NO: 437082 - DNA, 140 bp, Artificial Sequence
  Synthetic
atggccgactcccaagtacggtaacacttagtaagcaaagaaacatcttgtttagaacgcatatccggtccaacaacatggaggatatttttggctaaaccatgcccctttaataatacaggagacccagcatggcgtat

SEQ ID NO: 437083 - DNA, 140 bp, Artificial Sequence
  Synthetic
atacgccatgctgggtctcccatagctgacaccttacaggaaactcctgttgtgtctgatactgttgaagtcccaccgcaagtggtgaaacttccgtctgaacctcagactatccagccccgtacttgggagtcggccat

SEQ ID NO: 437084 - DNA, 140 bp, Artificial Sequence
  Synthetic
atggccgactcccaagtacggggctggatagtctgaggttcagacggaagtttcaccacttgcggtgggacttcaacagtatcagacacaacaggagtttcctgtaaggtgtcagctatgggagacccagcatggcgtat

SEQ ID NO: 437085 - DNA, 140 bp, Artificial Sequence
  Synthetic
atacgccatgctgggtctccaaggctatgaattcataccctttaattgtgacaccacttgtatctgcaggcatttttggagttgatcctaaggtgtcatttgagtatcttcagcgtgaggcgtacttgggagtcggccat

SEQ ID NO: 437086 - DNA, 140 bp, Artificial Sequence
  Synthetic
atggccgactcccaagtacgcctcacgctgaagatactcaaatgacaccttaggatcaactccaaaaatgcctgcagatacaagtggtgtcacaattaaagggtatgaattcatagccttggagacccagcatggcgtat

SEQ ID NO: 437087 - DNA, 140 bp, Artificial Sequence
  Synthetic
atacgccatgctgggtctccgaggtaaaagaagttgcacctgtctatgaggctgataccgaacagacacagagtgttactgttaaacctaagaggttacgcaaaaagcgtaatgttgacccgtacttgggagtcggccat

SEQ ID NO: 437088 - DNA, 140 bp, Artificial Sequence
  Synthetic
atggccgactcccaagtacgggtcaacattacgctttttgcgtaacctcttaggtttaacagtaacactctgtgtctgttcggtatcagcctcatagacaggtgcaacttcttttacctcggagacccagcatggcgtat

SEQ ID NO: 437089 - DNA, 140 bp, Artificial Sequence
  Synthetic
aggccctggctgctgatatggagtgttactgttaaacctaagaggttacgcaaaaagcgtaatgttgaccctttgtccaattttgaacataaggttattacagagtgcgttaccatagttgaccttttgggacagcggtg

SEQ ID NO: 437090 - DNA, 140 bp, Artificial Sequence
  Synthetic
caccgctgtcccaaaaggtcaactatggtaacgcactctgtaataaccttatgttcaaaattggacaaagggtcaacattacgctttttgcgtaacctcttaggtttaacagtaacactccatatcagcagccagggcct

SEQ ID NO: 437091 - DNA, 140 bp, Artificial Sequence
  Synthetic
atacgccatgctgggtctccacgtgctcttcacagggtcttgttgctgttaataacagcaaaccctatttcatacgaaactttgaacagcaatgtcgctgttctcgttgtttctacgtgccgtacttgggagtcggccat

SEQ ID NO: 437092 - DNA, 140 bp, Artificial Sequence
  Synthetic
atggccgactcccaagtacggcacgtagaaacaacgagaacagcgacattgctgttcaaagtttcgtatgaaatagggtttgctgttattaacagcaacaagaccctgtgaagagcacgtggagacccagcatggcgtat

SEQ ID NO: 437093 - DNA, 140 bp, Artificial Sequence
  Synthetic
atacgccatgctgggtctccttaggtgacgcaattcaagtagccaagtgctatggggagtctgtgttagttaatgctgctaacacacatcttaagcatggcggtggtatcgctggtgctacgtacttgggagtcggccat

SEQ ID NO: 437094 - DNA, 140 bp, Artificial Sequence
  Synthetic
atggccgactcccaagtacgtagcaccagcgataccaccgccatgcttaagatgtgtgttagcagcattaactaacacagactccccatagcacttggctacttgaattgcgtcacctaaggagacccagcatggcgtat

SEQ ID NO: 437095 - DNA, 140 bp, Artificial Sequence
  Synthetic
aggccctggctgctgatatgtaatgctgctaacacacatcttaagcatggcggtggtatcgctggtgctattaatgcggcttcaaaaggggctgtccaaaaagagtcagatgagtatattgaccttttgggacagcggtg

SEQ ID NO: 437096 - DNA, 140 bp, Artificial Sequence
  Synthetic
caccgctgtcccaaaaggtcaatatactcatctgactctttttggacagccccttttgaagccgcattaatagcaccagcgataccaccgccatgcttaagatgtgtgttagcagcattacatatcagcagccagggcct

SEQ ID NO: 437097 - DNA, 140 bp, Artificial Sequence
  Synthetic
atacgccatgctgggtctcctacactaaaaagcaagttacagtgggcggagtccattactattgttatagttcaaaggactttctgcctgaacttgtttctgcagctaatagtactagagcgtacttgggagtcggccat

SEQ ID NO: 437098 - DNA, 140 bp, Artificial Sequence
  Synthetic
atggccgactcccaagtacgctctagtactattagctgcagaaacaagttcaggcagaaagtcctttgaactataacaatagtaatggactccgcccactgtaacttgctttttagtgtaggagacccagcatggcgtat

SEQ ID NO: 437099 - DNA, 140 bp, Artificial Sequence
  Synthetic
atacgccatgctgggtctccctggctaaagggccgttacaagtaggagattcagttctcttgcaaggccattctctagctaagaatatcctgcatgtcgtaggcccagatgcccgcgctacgtacttgggagtcggccat

SEQ ID NO: 437100 - DNA, 140 bp, Artificial Sequence
  Synthetic
atggccgactcccaagtacgtagcgcgggcatctgggcctacgacatgcaggatattcttagctagagaatggccttgcaagagaactgaatctcctacttgtaacggccctttagccagggagacccagcatggcgtat

SEQ ID NO: 437101 - DNA, 140 bp, Artificial Sequence
  Synthetic
atacgccatgctgggtctccgaataatagctcatccattgggatatatatctcatggcttagatcttatgcaggctagagcttttgttaaaatggtacgtgtaccatatgtctgcctgctcgtacttgggagtcggccat

SEQ ID NO: 437102 - DNA, 140 bp, Artificial Sequence
  Synthetic
atggccgactcccaagtacgagcaggcagacatatggtacacgtaccattttaacaaaagctctagcctgcataagatctaagccatgagatatatatcccaatggatgagctattattcggagacccagcatggcgtat

SEQ ID NO: 437103 - DNA, 140 bp, Artificial Sequence
  Synthetic
atacgccatgctgggtctccaacaggatgtttctctccttagtaagtgctataaggctatgaatgcatatcctcttgtagtcactcctcttgtttcagcaggcatatttggtgtaaaacccgtacttgggagtcggccat

SEQ ID NO: 437104 - DNA, 140 bp, Artificial Sequence
  Synthetic
atggccgactcccaagtacgggttttacaccaaatatgcctgctgaaacaagaggagtgactacaagaggatatgcattcatagccttatagcacttactaaggagagaaacatcctgttggagacccagcatggcgtat

SEQ ID NO: 437105 - DNA, 140 bp, Artificial Sequence
  Synthetic
atacgccatgctgggtctccctgcccattcgcaaagggtgatagctgctcttcttcgtgcaaacacactttggctcaaatggttagtcaactgtctgagaagtgtgatgttgcacctgatcgtacttgggagtcggccat

SEQ ID NO: 437106 - DNA, 140 bp, Artificial Sequence
  Synthetic
atggccgactcccaagtacgatcaggtgcaacatcacacttctcagacagttgactaaccatttgagccaaagtgtgtttgcacgaagaagagcagctatcaccctttgcgaatgggcagggagacccagcatggcgtat

SEQ ID NO: 437107 - DNA, 140 bp, Artificial Sequence
  Synthetic
atacgccatgctgggtctccagctgtgtcttttgattatcttattagagaggctaagactagagttttagtcgtcgttaattcccaagatgtctataagagtcttaccatagttgacattcgtacttgggagtcggccat

SEQ ID NO: 437108 - DNA, 140 bp, Artificial Sequence
  Synthetic
atggccgactcccaagtacgaatgtcaactatggtaagactcttatagacatcttgggaattaacgacgactaaaactctagtcttagcctctctaataagataatcaaaagacacagctggagacccagcatggcgtat

SEQ ID NO: 437109 - DNA, 140 bp, Artificial Sequence
  Synthetic
atacgccatgctgggtctcccattggcatcttgtcaagggtgaaatcctccttaacaatgctatatataacaagttgttgcattggtctgatcaaaccatttgctacaaagaccagcagccgtacttgggagtcggccat

SEQ ID NO: 437110 - DNA, 140 bp, Artificial Sequence
  Synthetic
atggccgactcccaagtacggctgctggtctttgtagcaaatggtttgatcagaccaatgcaacaacttgttatatatagcattgttaaggaggatttcacccttgacaagatgccaatgggagacccagcatggcgtat

SEQ ID NO: 437111 - DNA, 140 bp, Artificial Sequence
  Synthetic
atacgccatgctgggtctccccacagagtttgactttttcatatgatgggttacgtggcgcaatacgtaaagctaaagattatggttttactgtttttgtgtgcacagataactctgctacgtacttgggagtcggccat

SEQ ID NO: 437112 - DNA, 140 bp, Artificial Sequence
  Synthetic
atggccgactcccaagtacgtagcagagttatctgtgcacacaaaaacagtaaaaccataatctttagctttacgtattgcgccacgtaacccatcatatgaaaaagtcaaactctgtggggagacccagcatggcgtat

SEQ ID NO: 437113 - DNA, 140 bp, Artificial Sequence
  Synthetic
atacgccatgctgggtctcctcttcgtgttaaagaacggttgtgctttaccatttgaagaccttaataagtgtcggacctatttgacttcaaggacggctcagcaattaacaatcgaagtcgtacttgggagtcggccat

SEQ ID NO: 437114 - DNA, 140 bp, Artificial Sequence
  Synthetic
atggccgactcccaagtacgacttcgattgttaattgctgagccgtccttgaagtcaaataggtccgacacttattaaggtcttcaaatggtaaagcacaaccgttctttaacacgaagaggagacccagcatggcgtat

SEQ ID NO: 437115 - DNA, 140 bp, Artificial Sequence
  Synthetic
atacgccatgctgggtctccacactaaagttcttaggaacaagggtgttgattatactaagaagtttcttacagttgacggtgtgcaatattattgctacacgtctaaggacactttagacgtacttgggagtcggccat

SEQ ID NO: 437116 - DNA, 140 bp, Artificial Sequence
  Synthetic
atggccgactcccaagtacgtctaaagtgtccttagacgtgtagcaataatattgcacaccgtcaactgtaagaaacttcttagtataatcaacacccttgttcctaagaactttagtgtggagacccagcatggcgtat

SEQ ID NO: 437117 - DNA, 140 bp, Artificial Sequence
  Synthetic
atacgccatgctgggtctccacttgttacggtcgatggtgttaattttcggacatgtgtccttaataatcaaagcacgtacagagcacaagtcggttgtgtttttcttgatggtgccgatcgtacttgggagtcggccat

SEQ ID NO: 437118 - DNA, 140 bp, Artificial Sequence
  Synthetic
atggccgactcccaagtacgatcggcaccatcaagaaaaacacaaccgacttgtgctctgtacgtgctttgattattaaggacacatgtccgaaaattaacaccatcgaccgtaacaagtggagacccagcatggcgtat

SEQ ID NO: 437119 - DNA, 140 bp, Artificial Sequence
  Synthetic
atacgccatgctgggtctcctgatatcttacaacaggctaataagtctgttggtattatatctatgcctttgggatatgtgtctcatggtttagacttaattcaagcagggagtgtcgtgcgtacttgggagtcggccat

SEQ ID NO: 437120 - DNA, 140 bp, Artificial Sequence
  Synthetic
atggccgactcccaagtacgcacgacactccctgcttgaattaagtctaaaccatgagacacatatcccaaaggcatagatataataccaacagacttattagcctgttgtaagatatcaggagacccagcatggcgtat

SEQ ID NO: 437121 - DNA, 140 bp, Artificial Sequence
  Synthetic
atacgccatgctgggtctccatatccgataccattccggatgaaaagcagaatggtttgggtttgtttttagccgacaatttgtctgcagctgagaaggatgtgcttaaacagttatatgcgtacttgggagtcggccat

SEQ ID NO: 437122 - DNA, 140 bp, Artificial Sequence
  Synthetic
atggccgactcccaagtacgcatataactgtttaagcacatccttctcagctgcagacaaattgtcggctaaaaacaaacccaaaccattctgcttttcatccggaatggtatcggatatggagacccagcatggcgtat

SEQ ID NO: 437123 - DNA, 140 bp, Artificial Sequence
  Synthetic
atacgccatgctgggtctcccgtagagttaacgtgccctacgtgtgtctcctagctaataaagagcaagaagctattttgatgtctgaagacgttaagttaaacccttcagaagattttacgtacttgggagtcggccat

SEQ ID NO: 437124 - DNA, 140 bp, Artificial Sequence
  Synthetic
atggccgactcccaagtacgtaaaatcttctgaagggtttaacttaacgtcttcagacatcaaaatagcttcttgctctttattagctaggagacacacgtagggcacgttaactctacgggagacccagcatggcgtat

SEQ ID NO: 437125 - DNA, 140 bp, Artificial Sequence
  Synthetic
aggccctggctgctgatatgagctattttgatgtctgaagacgttaagttaaacccttcagaagattttataaagcacgtccgcactaatggtggttacaattcttggcatttagtcgaggaccttttgggacagcggtg

SEQ ID NO: 437126 - DNA, 140 bp, Artificial Sequence
  Synthetic
caccgctgtcccaaaaggtcctcgactaaatgccaagaattgtaaccaccattagtgcggacgtgctttataaaatcttctgaagggtttaacttaacgtcttcagacatcaaaatagctcatatcagcagccagggcct

SEQ ID NO: 437127 - DNA, 140 bp, Artificial Sequence
  Synthetic
atacgccatgctgggtctccggtgaactattggtgcaagacttacgcttaaataagctcctgcattggtctgatcaaaccatatgctacaaggatagtgtgttttatgttgtaaagaatacgtacttgggagtcggccat

SEQ ID NO: 437128 - DNA, 140 bp, Artificial Sequence
  Synthetic
atggccgactcccaagtacgtattctttacaacataaaacacactatccttgtagcatatggtttgatcagaccaatgcaggagcttatttaagcgtaagtcttgcaccaatagttcaccggagacccagcatggcgtat

SEQ ID NO: 437129 - DNA, 140 bp, Artificial Sequence
  Synthetic
atacgccatgctgggtctccgtacagcttttccatttgaaacactttcagcatgtcgtgcgtatttggattcacgcacgacacagcagttaacaatcgaagtcttagtgactgtcgatggcgtacttgggagtcggccat

SEQ ID NO: 437130 - DNA, 140 bp, Artificial Sequence
  Synthetic
atggccgactcccaagtacgccatcgacagtcactaagacttcgattgttaactgctgtgtcgtgcgtgaatccaaatacgcacgacatgctgaaagtgtttcaaatggaaaagctgtacggagacccagcatggcgtat

SEQ ID NO: 437131 - DNA, 140 bp, Artificial Sequence
  Synthetic
atacgccatgctgggtctccatggctttctcggcgtctttatttaaacccgtccagctagtcccagtttctcctgcatttcatcgcattgagtctactgactctattgttttcacatacacgtacttgggagtcggccat

SEQ ID NO: 437132 - DNA, 140 bp, Artificial Sequence
  Synthetic
atggccgactcccaagtacgtgtatgtgaaaacaatagagtcagtagactcaatgcgatgaaatgcaggagaaactgggactagctggacgggtttaaataaagacgccgagaaagccatggagacccagcatggcgtat

SEQ ID NO: 437133 - DNA, 140 bp, Artificial Sequence
  Synthetic
atacgccatgctgggtctcctgtaaattttagaacagtcgttctaaataataagaacacttatagatcacagcttggatgcgttttctttaatggtgctgatatttctgataccattcctcgtacttgggagtcggccat

SEQ ID NO: 437134 - DNA, 140 bp, Artificial Sequence
  Synthetic
atggccgactcccaagtacgaggaatggtatcagaaatatcagcaccattaaagaaaacgcatccaagctgtgatctataagtgttcttattatttagaacgactgttctaaaatttacaggagacccagcatggcgtat

SEQ ID NO: 437135 - DNA, 140 bp, Artificial Sequence
  Synthetic
atacgccatgctgggtctccccacactatggagaattatgaacttgagaagaagtgctatgatcttcttaaagactgtgatgctgttgcgcgtcatgacttctttgtgtttgacgttgatcgtacttgggagtcggccat

SEQ ID NO: 437136 - DNA, 140 bp, Artificial Sequence
  Synthetic
atggccgactcccaagtacgatcaacgtcaaacacaaagaagtcatgacgcgcaacagcatcacagtctttaagaagatcatagcacttcttctcaagttcataattctccatagtgtggggagacccagcatggcgtat

SEQ ID NO: 437137 - DNA, 140 bp, Artificial Sequence
  Synthetic
atacgccatgctgggtctccgatgagaaacagaatggtcacagtttatatctagcagacaatttgactgctgatgaaacaaaggcgcttaaagagttatatggccccgttgatcctacttcgtacttgggagtcggccat

SEQ ID NO: 437138 - DNA, 140 bp, Artificial Sequence
  Synthetic
atggccgactcccaagtacgaagtaggatcaacggggccatataactctttaagcgcctttgtttcatcagcagtcaaattgtctgctagatataaactgtgaccattctgtttctcatcggagacccagcatggcgtat

SEQ ID NO: 437139 - DNA, 140 bp, Artificial Sequence
  Synthetic
aggccctggctgctgatatgtgatgaaacaaaggcgcttaaagagttatatggccccgttgatcctactttcttacacagattctattcacttaaggctgcagtccataagtggaagatggaccttttgggacagcggtg

SEQ ID NO: 437140 - DNA, 140 bp, Artificial Sequence
  Synthetic
caccgctgtcccaaaaggtccatcttccacttatggactgcagccttaagtgaatagaatctgtgtaagaaagtaggatcaacggggccatataactctttaagcgcctttgtttcatcacatatcagcagccagggcct

SEQ ID NO: 437141 - DNA, 140 bp, Artificial Sequence
  Synthetic
atacgccatgctgggtctccaacacaccttggctgcttctttcaggcaaacctagtgagcagatcgtttcaactgcgactagtcctgattttgaggcctttaatgtctttctgggctctgcgtacttgggagtcggccat

SEQ ID NO: 437142 - DNA, 140 bp, Artificial Sequence
  Synthetic
atggccgactcccaagtacgcagagcccagaaagacattaaaggcctcaaaatcaggactagtcgcagttgaaacgatctgctcactaggtttgcctgaaagaagcagccaaggtgtgttggagacccagcatggcgtat

SEQ ID NO: 437143 - DNA, 140 bp, Artificial Sequence
  Synthetic
atacgccatgctgggtctccgttgtgtgtgataaggtacgttctctcaaattgagtgataataattgttatcttaatgcagttattatgacacttgatttattgaaggacattaaatttgcgtacttgggagtcggccat

SEQ ID NO: 437144 - DNA, 140 bp, Artificial Sequence
  Synthetic
atggccgactcccaagtacgcaaatttaatgtccttcaataaatcaagtgtcataataactgcattaagataacaattattatcactcaatttgagagaacgtaccttatcacacacaacggagacccagcatggcgtat

SEQ ID NO: 437145 - DNA, 140 bp, Artificial Sequence
  Synthetic
atacgccatgctgggtctccaaacatccgtaggtcactacgttcatgtgcgcgtgaaggactctttattgtataagtatgattcaggttccttgaccaaagcctctgattggaagtgcaacgtacttgggagtcggccat

SEQ ID NO: 437146 - DNA, 140 bp, Artificial Sequence
  Synthetic
atggccgactcccaagtacgttgcacttccaatcagaggctttggtcaaggaacctgaatcatacttatacaataaagagtccttcacgcgcacatgaacgtagtgacctacggatgtttggagacccagcatggcgtat

SEQ ID NO: 437147 - DNA, 140 bp, Artificial Sequence
  Synthetic
atacgccatgctgggtctccttatacctgctctacagcatgcatttatgaaacataagggcggtgattcaactgacttcatagccctcattatggcttatggcaattgcacatttggtgccgtacttgggagtcggccat

SEQ ID NO: 437148 - DNA, 140 bp, Artificial Sequence
  Synthetic
atggccgactcccaagtacggcaccaaatgtgcaattgccataagccataatgagggctatgaagtcagttgaatcaccgcccttatgtttcataaatgcatgctgtagagcaggtataaggagacccagcatggcgtat

SEQ ID NO: 437149 - DNA, 140 bp, Artificial Sequence
  Synthetic
atacgccatgctgggtctcccaaaggtgggtgatgccatcttcactggatgtgtaggcacgtggtctaaggttgctactatcgcaagccttttcttggagcaaacacagcgttccttgaacgtacttgggagtcggccat

SEQ ID NO: 437150 - DNA, 140 bp, Artificial Sequence
  Synthetic
atggccgactcccaagtacgttcaaggaacgctgtgtttgctccaagaaaaggcttgcgatagtagcaaccttagaccacgtgcctacacatccagtgaagatggcatcacccacctttgggagacccagcatggcgtat

SEQ ID NO: 437151 - DNA, 140 bp, Artificial Sequence
  Synthetic
atacgccatgctgggtctcctccagatgatgcctctcggttacttcataccgtgcttgcaaaggctgagttatgctgttctgcacgcatggtttggagagagtggtgcaatgtctgtggccgtacttgggagtcggccat

SEQ ID NO: 437152 - DNA, 140 bp, Artificial Sequence
  Synthetic
atggccgactcccaagtacggccacagacattgcaccactctctccaaaccatgcgtgcagaacagcataactcagcctttgcaagcacggtatgaagtaaccgagaggcatcatctggaggagacccagcatggcgtat

SEQ ID NO: 437153 - DNA, 140 bp, Artificial Sequence
  Synthetic
atacgccatgctgggtctccttgtctgcatattatgttaaagatggtaagtactttacaagtacaccacctgtgtcatattcacctgctactgttatagcaggtagtgtttatactaatacgtacttgggagtcggccat

SEQ ID NO: 437154 - DNA, 140 bp, Artificial Sequence
  Synthetic
atggccgactcccaagtacgtattagtataaacactacctgctataacagtagcaggtgaatatgacacaggtggtgtacttgtaaagtacttaccatctttaacataatatgcagacaaggagacccagcatggcgtat

SEQ ID NO: 437155 - DNA, 140 bp, Artificial Sequence
  Synthetic
atacgccatgctgggtctccataaaagatgttgttctacaaggcttaaaagcttgttgttacgtgggtgtgcaaactgttgaagatctgcgtgctcgcatgacatatgtatgccagtgtgcgtacttgggagtcggccat

SEQ ID NO: 437156 - DNA, 140 bp, Artificial Sequence
  Synthetic
atggccgactcccaagtacgcacactggcatacatatgtcatgcgagcacgcagatcttcaacagtttgcacacccacgtaacaacaagcttttaagccttgtagaacaacatcttttatggagacccagcatggcgtat

SEQ ID NO: 437157 - DNA, 140 bp, Artificial Sequence
  Synthetic
atacgccatgctgggtctccgttgcctaattgctgctgatggccaagtgagtggtgatcctattagtttagcttttaataatatgctaggctatgatcctagtaagcctacttctaagaacgtacttgggagtcggccat

SEQ ID NO: 437158 - DNA, 140 bp, Artificial Sequence
  Synthetic
atggccgactcccaagtacgttcttagaagtaggcttactaggatcatagcctagcatattattaaaagctaaactaataggatcaccactcacttggccatcagcagcaattaggcaacggagacccagcatggcgtat

SEQ ID NO: 437159 - DNA, 140 bp, Artificial Sequence
  Synthetic
atacgccatgctgggtctccgtggtgaacgtcatcggcaaatagtcgaacacaccaccccctggttgctgctctcaggcacaccaaatgaaaaattggtgacaacctccacggcgcctgacgtacttgggagtcggccat

SEQ ID NO: 437160 - DNA, 140 bp, Artificial Sequence
  Synthetic
atggccgactcccaagtacgtcaggcgccgtggaggttgtcaccaatttttcatttggtgtgcctgagagcagcaaccagggggtggtgtgttcgactatttgccgatgacgttcaccacggagacccagcatggcgtat

SEQ ID NO: 437161 - DNA, 140 bp, Artificial Sequence
  Synthetic
aggccctggctgctgatatgctctcaggcacaccaaatgaaaaattggtgacaacctccacggcgcctgattttgtagcgtttaatgtctttcagggcattgaaacggctgttggccattgaccttttgggacagcggtg

SEQ ID NO: 437162 - DNA, 140 bp, Artificial Sequence
  Synthetic
caccgctgtcccaaaaggtcaatggccaacagccgtttcaatgccctgaaagacattaaacgctacaaaatcaggcgccgtggaggttgtcaccaatttttcatttggtgtgcctgagagcatatcagcagccagggcct

SEQ ID NO: 437163 - DNA, 140 bp, Artificial Sequence
  Synthetic
aggccctggctgctgatatgatgttcatgctcgcctgaagggtggtcttattttaaagtttgactctggcaccgttagcaagacttcagactggaagtgcaaggtgacagatgtacttttgaccttttgggacagcggtg

SEQ ID NO: 437164 - DNA, 140 bp, Artificial Sequence
  Synthetic
caccgctgtcccaaaaggtcaaaagtacatctgtcaccttgcacttccagtctgaagtcttgctaacggtgccagagtcaaactttaaaataagaccacccttcaggcgagcatgaacatcatatcagcagccagggcct

SEQ ID NO: 437165 - DNA, 140 bp, Artificial Sequence
  Synthetic
aggccctggctgctgatatgcttgcagaactttgattttaacgaacttaaataaaagccctgttgtttagcgtattgttgcacttgtctggtgggattgtggcattaatttgcctgctcagaccttttgggacagcggtg

SEQ ID NO: 437166 - DNA, 140 bp, Artificial Sequence
  Synthetic
caccgctgtcccaaaaggtctgagcaggcaaattaatgccacaatcccaccagacaagtgcaacaatacgctaaacaacagggcttttatttaagttcgttaaaatcaaagttctgcaagcatatcagcagccagggcct

SEQ ID NO: 437167 - DNA, 140 bp, Artificial Sequence
  Synthetic
atacgccatgctgggtctccccccggccaaaaatacagtagcgattgtaatgtcgtacggtattctttggacggtaatttcagaacagaggttgatcccgacctatctgctttctatgttcgtacttgggagtcggccat

SEQ ID NO: 437168 - DNA, 140 bp, Artificial Sequence
  Synthetic
atggccgactcccaagtacgaacatagaaagcagataggtcgggatcaacctctgttctgaaattaccgtccaaagaataccgtacgacattacaatcgctactgtatttttggccggggggagacccagcatggcgtat

SEQ ID NO: 437169 - DNA, 140 bp, Artificial Sequence
  Synthetic
aggccctggctgctgatatgacggtaatttcagaacagaggttgatcccgacctatctgctttctatgttaaggatggtaaatactttacaagtgaaccacccgtaacatattcaccagcgaccttttgggacagcggtg

SEQ ID NO: 437170 - DNA, 140 bp, Artificial Sequence
  Synthetic
caccgctgtcccaaaaggtcgctggtgaatatgttacgggtggttcacttgtaaagtatttaccatccttaacatagaaagcagataggtcgggatcaacctctgttctgaaattaccgtcatatcagcagccagggcct

SEQ ID NO: 437171 - DNA, 140 bp, Artificial Sequence
  Synthetic
atacgccatgctgggtctccttttgttggagagtttgtgcttaacgatgtcgttcttgctattctctctggcaccaccactaatgtggacaagctccgtaatcttgttaagcatttagatcgtacttgggagtcggccat

SEQ ID NO: 437172 - DNA, 140 bp, Artificial Sequence
  Synthetic
atggccgactcccaagtacgatctaaatgcttaacaagattacggagcttgtccacattagtggtggtgccagagagaatagcaagaacgacatcgttaagcacaaactctccaacaaaaggagacccagcatggcgtat

SEQ ID NO: 437173 - DNA, 140 bp, Artificial Sequence
  Synthetic
atacgccatgctgggtctcctacaattttagctggtagtgtctacactaatagctgccttgtatcgtctgatggacaacctggcggtgatgctattagtttgagttttaataaccttttacgtacttgggagtcggccat

SEQ ID NO: 437174 - DNA, 140 bp, Artificial Sequence
  Synthetic
atggccgactcccaagtacgtaaaaggttattaaaactcaaactaatagcatcaccgccaggttgtccatcagacgatacaaggcagctattagtgtagacactaccagctaaaattgtaggagacccagcatggcgtat

SEQ ID NO: 437175 - DNA, 140 bp, Artificial Sequence
  Synthetic
atacgccatgctgggtctcccatcaattgtatgtcgatcctaagcatcaattgattgtccttaatgacaatttcttatcgttgctctttggactgcataccgttcagagtggagatctcacgtacttgggagtcggccat

SEQ ID NO: 437176 - DNA, 140 bp, Artificial Sequence
  Synthetic
atggccgactcccaagtacgtgagatctccactctgaacggtatgcagtccaaagagcaacgataagaaattgtcattaaggacaatcaattgatgcttaggatcgacatacaattgatgggagacccagcatggcgtat

SEQ ID NO: 437177 - DNA, 140 bp, Artificial Sequence
  Synthetic
atacgccatgctgggtctccgggtttgattctagtaaaccagtcactaagaaatacacttactccttcttgcctaaagaagacggcgatgtgttgttggctgagtttgacacttatgacccgtacttgggagtcggccat

SEQ ID NO: 437178 - DNA, 140 bp, Artificial Sequence
  Synthetic
atggccgactcccaagtacgggtcataagtgtcaaactcagccaacaacacatcgccgtcttctttaggcaagaaggagtaagtgtatttcttagtgactggtttactagaatcaaacccggagacccagcatggcgtat

SEQ ID NO: 437179 - DNA, 140 bp, Artificial Sequence
  Synthetic
atacgccatgctgggtctccgcgttattgcagctaatgggtctttgacaaagaaagtccgtgcgctttttagggcttctgctttgttcaaggaatttgctagccgtaccttccaagctgccgtacttgggagtcggccat

SEQ ID NO: 437180 - DNA, 140 bp, Artificial Sequence
  Synthetic
atggccgactcccaagtacggcagcttggaaggtacggctagcaaattccttgaacaaagcagaagccctaaaaagcgcacggactttctttgtcaaagacccattagctgcaataacgcggagacccagcatggcgtat

SEQ ID NO: 437181 - DNA, 140 bp, Artificial Sequence
  Synthetic
atacgccatgctgggtctccctatttataagaatggtgccatgtataaaggcaaaccaattctttgggtcaacaaagcatcttatgatactaatcttaataagttcaatagagctagtttcgtacttgggagtcggccat

SEQ ID NO: 437182 - DNA, 140 bp, Artificial Sequence
  Synthetic
atggccgactcccaagtacgaaactagctctattgaacttattaagattagtatcataagatgctttgttgacccaaagaattggtttgcctttatacatggcaccattcttataaatagggagacccagcatggcgtat

SEQ ID NO: 437183 - DNA, 140 bp, Artificial Sequence
  Synthetic
atacgccatgctgggtctccatccctggtcgggagagctgttaggtttacggctcgtcattgtggtactgttgctagtgtcttctatagttgttacacaattataaagatgctatgtttacgtacttgggagtcggccat

SEQ ID NO: 437184 - DNA, 140 bp, Artificial Sequence
  Synthetic
atggccgactcccaagtacgtaaacatagcatctttataattgtgtaacaactatagaagacactagcaacagtaccacaatgacgagccgtaaacctaacagctctcccgaccagggatggagacccagcatggcgtat

SEQ ID NO: 437185 - DNA, 140 bp, Artificial Sequence
  Synthetic
aggccctggctgctgatatgtacctggttgagaggctcattgcttgtgaaaatccattcatggttaaccaattggcttatagctctagtgcaaatggcagcttggttggcacaactttgcgaccttttgggacagcggtg

SEQ ID NO: 437186 - DNA, 140 bp, Artificial Sequence
  Synthetic
caccgctgtcccaaaaggtcgcaaagttgtgccaaccaagctgccatttgcactagagctataagccaattggttaaccatgaatggattttcacaagcaatgagcctctcaaccaggtacatatcagcagccagggcct

SEQ ID NO: 437187 - DNA, 140 bp, Artificial Sequence
  Synthetic
atacgccatgctgggtctccatacctcttaattattttaaatcgagagggcctgttggtactgaggttgaagttagcgccttacgtactgcaggtatagtaacaggcaatgttgtcaagccgtacttgggagtcggccat

SEQ ID NO: 437188 - DNA, 140 bp, Artificial Sequence
  Synthetic
atggccgactcccaagtacggcttgacaacattgcctgttactatacctgcagtacgtaaggcgctaacttcaacctcagtaccaacaggccctctcgatttaaaataattaagaggtatggagacccagcatggcgtat

SEQ ID NO: 437189 - DNA, 140 bp, Artificial Sequence
  Synthetic
aggccctggctgctgatatggcacttcaacaggaaatgacaattgtcaaatgtaagggtttaaataaacctttcgtgaaggacaatgtcagtttcgttgctgatgactcaggtactcccggaccttttgggacagcggtg

SEQ ID NO: 437190 - DNA, 140 bp, Artificial Sequence
  Synthetic
caccgctgtcccaaaaggtccgggagtacctgagtcatcagcaacgaaactgacattgtccttcacgaaaggtttatttaaacccttacatttgacaattgtcatttcctgttgaagtgccatatcagcagccagggcct

SEQ ID NO: 437191 - DNA, 140 bp, Artificial Sequence
  Synthetic
atacgccatgctgggtctccagtgttgcacagcagctgtggatttgactattaccaaattgcaacgtattgattggaaagcatctttacggttgctacttgtactatgcacaactgggctcgtacttgggagtcggccat

SEQ ID NO: 437192 - DNA, 140 bp, Artificial Sequence
  Synthetic
atggccgactcccaagtacgagcccagttgtgcatagtacaagtagcaaccgtaaagatgctttccaatcaatacgttgcaatttggtaatagtcaaatccacagctgctgtgcaacactggagacccagcatggcgtat

SEQ ID NO: 437193 - DNA, 140 bp, Artificial Sequence
  Synthetic
aggccctggctgctgatatgggttgtggcacaaactgtatgggaaaacttaagtgtaatcgttgttgtgatagatacgaggaatacgacctcgagccgcataaggttcatgttcactaatgaccttttgggacagcggtg

SEQ ID NO: 437194 - DNA, 140 bp, Artificial Sequence
  Synthetic
caccgctgtcccaaaaggtcattagtgaacatgaaccttatgcggctcgaggtcgtattcctcgtatctatcacaacaacgattacacttaagttttcccatacagtttgtgccacaacccatatcagcagccagggcct

SEQ ID NO: 437195 - DNA, 140 bp, Artificial Sequence
  Synthetic
atacgccatgctgggtctccgttgacaagttacgtgagtatcttgctgactatgacattgctgtcacagttggaccctaccttgatggtgccattaatgttggtaagcaaggactacagtcgtacttgggagtcggccat

SEQ ID NO: 437196 - DNA, 140 bp, Artificial Sequence
  Synthetic
atggccgactcccaagtacgactgtagtccttgcttaccaacattaatggcaccatcaaggtagggtccaactgtgacagcaatgtcatagtcagcaagatactcacgtaacttgtcaacggagacccagcatggcgtat

SEQ ID NO: 437197 - DNA, 140 bp, Artificial Sequence
  Synthetic
atacgccatgctgggtctccattgcacaccgttgagtcaggtgatattaacgttgttgcagcttccggatctttgacacgtaaagtgaaattactatttagggcttcattttatttcaaacgtacttgggagtcggccat

SEQ ID NO: 437198 - DNA, 140 bp, Artificial Sequence
  Synthetic
atggccgactcccaagtacgtttgaaataaaatgaagccctaaatagtaatttcactttacgtgtcaaagatccggaagctgcaacaacgttaatatcacctgactcaacggtgtgcaatggagacccagcatggcgtat

SEQ ID NO: 437199 - DNA, 140 bp, Artificial Sequence
  Synthetic
aggccctggctgctgatatggtctcttgtacgtctcggtcacaatacacggtttcgtccggtgcgtggcaattcggggcacatcatgtctttcgtggctggtgtgaccgcgcaaggtgcggaccttttgggacagcggtg

SEQ ID NO: 437200 - DNA, 140 bp, Artificial Sequence
  Synthetic
caccgctgtcccaaaaggtccgcaccttgcgcggtcacaccagccacgaaagacatgatgtgccccgaattgccacgcaccggacgaaaccgtgtattgtgaccgagacgtacaagagaccatatcagcagccagggcct

SEQ ID NO: 437201 - DNA, 140 bp, Artificial Sequence
  Synthetic
atacgccatgctgggtctccctaatcatgtctaactcttcgctctccagtgagcaaattgttgctattgttaaagactggaactttgcatggtccattatctttctcttaataactatcgcgtacttgggagtcggccat

SEQ ID NO: 437202 - DNA, 140 bp, Artificial Sequence
  Synthetic
atggccgactcccaagtacgcgatagttattaagagaaagataatggaccatgcaaagttccagtctttaacaatagcaacaatttgctcactggagagcgaagagttagacatgattagggagacccagcatggcgtat

SEQ ID NO: 437203 - DNA, 140 bp, Artificial Sequence
  Synthetic
aggccctggctgctgatatgtcaatactcccgttctacgcgatcaatgcttaaacggcgagattctacatatggcccccttcagacacctgttggttgtgtcctaggacttgttaattccgaccttttgggacagcggtg

SEQ ID NO: 437204 - DNA, 140 bp, Artificial Sequence
  Synthetic
caccgctgtcccaaaaggtcggaattaacaagtcctaggacacaaccaacaggtgtctgaagggggccatatgtagaatctcgccgtttaagcattgatcgcgtagaacgggagtattgacatatcagcagccagggcct

SEQ ID NO: 437205 - DNA, 140 bp, Artificial Sequence
  Synthetic
atacgccatgctgggtctccgttttagttttgtcaagatgttatttatgcttccactagcttactttagtgattcaaaactcggcaccacagaggttaaagtgagtgctttgaaaacagccgtacttgggagtcggccat

SEQ ID NO: 437206 - DNA, 140 bp, Artificial Sequence
  Synthetic
atggccgactcccaagtacggctgttttcaaagcactcactttaacctctgtggtgccgagttttgaatcactaaagtaagctagtggaagcataaataacatcttgacaaaactaaaacggagacccagcatggcgtat

SEQ ID NO: 437207 - DNA, 140 bp, Artificial Sequence
  Synthetic
atacgccatgctgggtctccttggatgtggtttgtacttgagctccttgttgcatatgcattgtacacagcagcattcaattgggtgttgctggcatgtacattgcagtacttttttagtcgtacttgggagtcggccat

SEQ ID NO: 437208 - DNA, 140 bp, Artificial Sequence
  Synthetic
atggccgactcccaagtacgactaaaaaagtactgcaatgtacatgccagcaacacccaattgaatgctgctgtgtacaatgcatatgcaacaaggagctcaagtacaaaccacatccaaggagacccagcatggcgtat

SEQ ID NO: 437209 - DNA, 140 bp, Artificial Sequence
  Synthetic
aggccctggctgctgatatgcatcactcagcgcactcgcacccgtccaagtgttcagcctggtccaatgattgatgttaacactgattagtgtcactcaaagtaacaagatcgcggcaatgaccttttgggacagcggtg

SEQ ID NO: 437210 - DNA, 140 bp, Artificial Sequence
  Synthetic
caccgctgtcccaaaaggtcattgccgcgatcttgttactttgagtgacactaatcagtgttaacatcaatcattggaccaggctgaacacttggacgggtgcgagtgcgctgagtgatgcatatcagcagccagggcct

SEQ ID NO: 437211 - DNA, 140 bp, Artificial Sequence
  Synthetic
aggccctggctgctgatatgatttaagtatggataagttgcgccgtgtggattggaaatcaaccctacggttgttacttatgttatgcacaactatggtattgttgtcttctgtgtatcagaccttttgggacagcggtg

SEQ ID NO: 437212 - DNA, 140 bp, Artificial Sequence
  Synthetic
caccgctgtcccaaaaggtctgatacacagaagacaacaataccatagttgtgcataacataagtaacaaccgtagggttgatttccaatccacacggcgcaacttatccatacttaaatcatatcagcagccagggcct

SEQ ID NO: 437213 - DNA, 140 bp, Artificial Sequence
  Synthetic
atacgccatgctgggtctcccttgtatgtcttcaatcaggtcttatcaagtgatgttatgtttgaagatgcccaaggtttgaaaaagttctacaaagaagttagagcttacctaggaatccgtacttgggagtcggccat

SEQ ID NO: 437214 - DNA, 140 bp, Artificial Sequence
  Synthetic
atggccgactcccaagtacggattcctaggtaagctctaacttctttgtagaactttttcaaaccttgggcatcttcaaacataacatcacttgataagacctgattgaagacatacaagggagacccagcatggcgtat

SEQ ID NO: 437215 - DNA, 140 bp, Artificial Sequence
  Synthetic
atacgccatgctgggtctcctcttctgcttgtgacggtcttgcttcagcttatagggcgaattcctttgatgtacctacattctgcgcaaaccgttctgcaatgtgtaattggtgcttgacgtacttgggagtcggccat

SEQ ID NO: 437216 - DNA, 140 bp, Artificial Sequence
  Synthetic
atggccgactcccaagtacgtcaagcaccaattacacattgcagaacggtttgcgcagaatgtaggtacatcaaaggaattcgccctataagctgaagcaagaccgtcacaagcagaagaggagacccagcatggcgtat

SEQ ID NO: 437217 - DNA, 140 bp, Artificial Sequence
  Synthetic
aggccctggctgctgatatgtgtacctacattctgcgcaaaccgttctgcaatgtgtaattggtgcttgattagccaagattccataactcactacccagctcttaagatggttcaaacagaccttttgggacagcggtg

SEQ ID NO: 437218 - DNA, 140 bp, Artificial Sequence
  Synthetic
caccgctgtcccaaaaggtctgtttgaaccatcttaagagctgggtagtgagttatggaatcttggctaatcaagcaccaattacacattgcagaacggtttgcgcagaatgtaggtacacatatcagcagccagggcct

SEQ ID NO: 437219 - DNA, 140 bp, Artificial Sequence
  Synthetic
atacgccatgctgggtctccaattgtgtggagtgcgatgtagcaggtatagggagtacctttatctgcgaagaagtcgccaacgacctcactaccaccttgcgcaggcttgttaaacctacgtacttgggagtcggccat

SEQ ID NO: 437220 - DNA, 140 bp, Artificial Sequence
  Synthetic
atggccgactcccaagtacgtaggtttaacaagcctgcgcaaggtggtagtgaggtcgttggcgacttcttcgcagataaaggtactccctatacctgctacatcgcactccacacaattggagacccagcatggcgtat

SEQ ID NO: 437221 - DNA, 140 bp, Artificial Sequence
  Synthetic
atacgccatgctgggtctcccatcttagccactatgttcttaacatagattggttgtggtttgcatttgagactggtttggcatacatgctctatacctcggccttcaactggttgttgtcgtacttgggagtcggccat

SEQ ID NO: 437222 - DNA, 140 bp, Artificial Sequence
  Synthetic
atggccgactcccaagtacgacaacaaccagttgaaggccgaggtatagagcatgtatgccaaaccagtctcaaatgcaaaccacaaccaatctatgttaagaacatagtggctaagatgggagacccagcatggcgtat

SEQ ID NO: 437223 - DNA, 140 bp, Artificial Sequence
  Synthetic
aggccctggctgctgatatgctagatacatgttttgaagctacagaagcaacatttaacttcttgttagatttggcaggattgttcagaatctttcttcgcaatgcctatgtgtacacttgaccttttgggacagcggtg

SEQ ID NO: 437224 - DNA, 140 bp, Artificial Sequence
  Synthetic
caccgctgtcccaaaaggtcaagtgtacacataggcattgcgaagaaagattctgaacaatcctgccaaatctaacaagaagttaaatgttgcttctgtagcttcaaaacatgtatctagcatatcagcagccagggcct

SEQ ID NO: 437225 - DNA, 140 bp, Artificial Sequence
  Synthetic
atacgccatgctgggtctcctggcaggtacattgcattatttctttgcacagacttccatatttgtagactggcggtcatacaattatgctgtgtctagtgccttctggttattcacccacgtacttgggagtcggccat

SEQ ID NO: 437226 - DNA, 140 bp, Artificial Sequence
  Synthetic
atggccgactcccaagtacgtgggtgaataaccagaaggcactagacacagcataattgtatgaccgccagtctacaaatatggaagtctgtgcaaagaaataatgcaatgtacctgccaggagacccagcatggcgtat

SEQ ID NO: 437227 - DNA, 140 bp, Artificial Sequence
  Synthetic
atacgccatgctgggtctcctctctgtcacttttctaatatggataaactgaagttcaaagaggtttgtaaatctaccacgggtatacctgagcataactttatcatttatgacgctagtcgtacttgggagtcggccat

SEQ ID NO: 437228 - DNA, 140 bp, Artificial Sequence
  Synthetic
atggccgactcccaagtacgactagcgtcataaatgataaagttatgctcaggtatacccgtggtagatttacaaacctctttgaacttcagtttatccatattagaaaagtgacagagaggagacccagcatggcgtat

SEQ ID NO: 437229 - DNA, 140 bp, Artificial Sequence
  Synthetic
atacgccatgctgggtctcccattccaatggcgggtttggtacgaatgtataatttgttagcatgcctttggcttttacgcaagttttatcagcatgtaatcaatggttgcaaagatacgcgtacttgggagtcggccat

SEQ ID NO: 437230 - DNA, 140 bp, Artificial Sequence
  Synthetic
atggccgactcccaagtacgcgtatctttgcaaccattgattacatgctgataaaacttgcgtaaaagccaaaggcatgctaacaaattatacattcgtaccaaacccgccattggaatgggagacccagcatggcgtat

SEQ ID NO: 437231 - DNA, 140 bp, Artificial Sequence
  Synthetic
atacgccatgctgggtctccgatcgtggccaggagaatttggccaggtctgcttgtgtttactattctcaagttctgtgtaaaccaattttgttggttgattcaaacttggttacatctgcgtacttgggagtcggccat

SEQ ID NO: 437232 - DNA, 140 bp, Artificial Sequence
  Synthetic
atggccgactcccaagtacgcagatgtaaccaagtttgaatcaaccaacaaaattggtttacacagaacttgagaatagtaaacacaagcagacctggccaaattctcctggccacgatcggagacccagcatggcgtat

SEQ ID NO: 437233 - DNA, 140 bp, Artificial Sequence
  Synthetic
atacgccatgctgggtctccgcatgcttgctctgctataagaggaaccgacttactagagttgaagcttctaccgttgtctgtggtggaaaacgtacgttttatatcacagcaaatggcgcgtacttgggagtcggccat

SEQ ID NO: 437234 - DNA, 140 bp, Artificial Sequence
  Synthetic
atggccgactcccaagtacgcgccatttgctgtgatataaaacgtacgttttccaccacagacaacggtagaagcttcaactctagtaagtcggttcctcttatagcagagcaagcatgcggagacccagcatggcgtat

SEQ ID NO: 437235 - DNA, 140 bp, Artificial Sequence
  Synthetic
atacgccatgctgggtctccttggtgactcttgtgaaattgccactaaaatgtttgattcctttgttaatagttttgtctctctttacaatgtcactcgtgatcgccttgagaagttaatcgtacttgggagtcggccat

SEQ ID NO: 437236 - DNA, 140 bp, Artificial Sequence
  Synthetic
atggccgactcccaagtacgattaacttctcaaggcgatcacgagtgacattgtaaagagagacaaaactattaacaaaggaatcaaacattttagtggcaatttcacaagagtcaccaaggagacccagcatggcgtat

SEQ ID NO: 437237 - DNA, 140 bp, Artificial Sequence
  Synthetic
atacgccatgctgggtctccgtatttcattctgtcgtaggcataattggaattgtgtggattgtgacactgcaggtgtggggaataccttcatctgtgaagaagtcgcaaatgacctcaccgtacttgggagtcggccat

SEQ ID NO: 437238 - DNA, 140 bp, Artificial Sequence
  Synthetic
atggccgactcccaagtacggtgaggtcatttgcgacttcttcacagatgaaggtattccccacacctgcagtgtcacaatccacacaattccaattatgcctacgacagaatgaaatacggagacccagcatggcgtat

SEQ ID NO: 437239 - DNA, 140 bp, Artificial Sequence
  Synthetic
aggccctggctgctgatatggcaggtgtggggaataccttcatctgtgaagaagtcgcaaatgacctcactaccgccctacgcaggcctattaacgctacggatagatcacattattatggaccttttgggacagcggtg

SEQ ID NO: 437240 - DNA, 140 bp, Artificial Sequence
  Synthetic
caccgctgtcccaaaaggtccataataatgtgatctatccgtagcgttaataggcctgcgtagggcggtagtgaggtcatttgcgacttcttcacagatgaaggtattccccacacctgccatatcagcagccagggcct

SEQ ID NO: 437241 - DNA, 140 bp, Artificial Sequence
  Synthetic
aggccctggctgctgatatgtacgatgattgtatgcagcaaggtccagcatcagctcgtgatcttatttgtgctcaatatgtggctggttataaagtattacctcctcttatggatgttagaccttttgggacagcggtg

SEQ ID NO: 437242 - DNA, 140 bp, Artificial Sequence
  Synthetic
caccgctgtcccaaaaggtctaacatccataagaggaggtaatactttataaccagccacatattgagcacaaataagatcacgagctgatgctggaccttgctgcatacaatcatcgtacatatcagcagccagggcct

SEQ ID NO: 437243 - DNA, 140 bp, Artificial Sequence
  Synthetic
aggccctggctgctgatatgtggattccgttacagttaaagagactgttgttcagtttaattatcgtagagacggtcaaccattctacgagcggtttcccctctgcgcttttacaaatctgaccttttgggacagcggtg

SEQ ID NO: 437244 - DNA, 140 bp, Artificial Sequence
  Synthetic
caccgctgtcccaaaaggtcagatttgtaaaagcgcagaggggaaaccgctcgtagaatggttgaccgtctctacgataattaaactgaacaacagtctctttaactgtaacggaatccacatatcagcagccagggcct

SEQ ID NO: 437245 - DNA, 140 bp, Artificial Sequence
  Synthetic
atacgccatgctgggtctccagataagttgaagttcaaagaggtctgtaaaactactactggtatacctgaatacaactttatcatctacgactcatcagatcgtggccaggaaagtttacgtacttgggagtcggccat

SEQ ID NO: 437246 - DNA, 140 bp, Artificial Sequence
  Synthetic
atggccgactcccaagtacgtaaactttcctggccacgatctgatgagtcgtagatgataaagttgtattcaggtataccagtagtagttttacagacctctttgaacttcaacttatctggagacccagcatggcgtat

SEQ ID NO: 437247 - DNA, 140 bp, Artificial Sequence
  Synthetic
atacgccatgctgggtctccgctaggtctgcatgtgtttattattctcaagtcttgtgtaaatcaattcttttggttgactcaagtttggttacttctgttggtgattctagtgaaatcgcgtacttgggagtcggccat

SEQ ID NO: 437248 - DNA, 140 bp, Artificial Sequence
  Synthetic
atggccgactcccaagtacgcgatttcactagaatcaccaacagaagtaaccaaacttgagtcaaccaaaagaattgatttacacaagacttgagaataataaacacatgcagacctagcggagacccagcatggcgtat

SEQ ID NO: 437249 - DNA, 140 bp, Artificial Sequence
  Synthetic
atacgccatgctgggtctccccactaaaatgtttgattcctttgttaatagtttcgtctcgctgtataatgtcacacgcgataagttggaaaaacttatctctactgctcgtgatggcgtcgtacttgggagtcggccat

SEQ ID NO: 437250 - DNA, 140 bp, Artificial Sequence
  Synthetic
atggccgactcccaagtacgacgccatcacgagcagtagagataagtttttccaacttatcgcgtgtgacattatacagcgagacgaaactattaacaaaggaatcaaacattttagtggggagacccagcatggcgtat

SEQ ID NO: 437251 - DNA, 140 bp, Artificial Sequence
  Synthetic
atacgccatgctgggtctcctaaagagctatgtgtgtttgactttgctgcttgtcttatgtgctgtattgatgtatttcaccttgcctactttcaatatggaaactgttgaattctacgacgtacttgggagtcggccat

SEQ ID NO: 437252 - DNA, 140 bp, Artificial Sequence
  Synthetic
atggccgactcccaagtacgtcgtagaattcaacagtttccatattgaaagtaggcaaggtgaaatacatcaatacagcacataagacaagcagcaaagtcaaacacacatagctctttaggagacccagcatggcgtat

SEQ ID NO: 437253 - DNA, 140 bp, Artificial Sequence
  Synthetic
atacgccatgctgggtctccttactactgttaaaccaggcgcatcgtttagcgttttagcttgctataatggcaggccaactggtacatttacagttgttatgaggccgaaccacacaatcgtacttgggagtcggccat

SEQ ID NO: 437254 - DNA, 140 bp, Artificial Sequence
  Synthetic
atggccgactcccaagtacgattgtgtggttcggcctcataacaactgtaaatgtaccagttggcctgccattatagcaagctaaaacgctaaacgatgcgcctggtttaacagtagtaaggagacccagcatggcgtat

SEQ ID NO: 437255 - DNA, 140 bp, Artificial Sequence
  Synthetic
aggccctggctgctgatatggactctgtgcagtatgctcataaacatgacatacaaattactaatgagagttacaataattatgtaccctcatatgttaaacctgatagtgtgtctaccagaccttttgggacagcggtg

SEQ ID NO: 437256 - DNA, 140 bp, Artificial Sequence
  Synthetic
caccgctgtcccaaaaggtctggtagacacactatcaggtttaacatatgagggtacataattattgtaactctcattagtaatttgtatgtcatgtttatgagcatactgcacagagtccatatcagcagccagggcct

SEQ ID NO: 437257 - DNA, 140 bp, Artificial Sequence
  Synthetic
atacgccatgctgggtctcctattactgagactaacacagcggcttttaaggcggtgtgttctgttatagatttaaagcttgacgactttgttatgattttaaagagtcaagaccttggccgtacttgggagtcggccat

SEQ ID NO: 437258 - DNA, 140 bp, Artificial Sequence
  Synthetic
atggccgactcccaagtacggccaaggtcttgactctttaaaatcataacaaagtcgtcaagctttaaatctataacagaacacaccgccttaaaagccgctgtgttagtctcagtaataggagacccagcatggcgtat

SEQ ID NO: 437259 - DNA, 140 bp, Artificial Sequence
  Synthetic
atacgccatgctgggtctcctggtatcacgagcatgttggtggtagttttgataacgatatcgcatgccctgtgactgttgctgttattgcaggtgtagctggtgctagagtaccaggtgcgtacttgggagtcggccat

SEQ ID NO: 437260 - DNA, 140 bp, Artificial Sequence
  Synthetic
atggccgactcccaagtacgcacctggtactctagcaccagctacacctgcaataacagcaacagtcacagggcatgcgatatcgttatcaaaactaccaccaacatgctcgtgataccaggagacccagcatggcgtat

SEQ ID NO: 437261 - DNA, 140 bp, Artificial Sequence
  Synthetic
aggccctggctgctgatatggtcttgcgtaattctaatggtgcttgtatttggaacgctgctgcatatatgaaactctcggatgcacttaaacgacagattcgcattgcatgccgtaagtgaccttttgggacagcggtg

SEQ ID NO: 437262 - DNA, 140 bp, Artificial Sequence
  Synthetic
caccgctgtcccaaaaggtcacttacggcatgcaatgcgaatctgtcgtttaagtgcatccgagagtttcatatatgcagcagcgttccaaatacaagcaccattagaattacgcaagaccatatcagcagccagggcct

SEQ ID NO: 437263 - DNA, 140 bp, Artificial Sequence
  Synthetic
atacgccatgctgggtctcctgcctaccacattggcttgggttaagaaacaaattgttttctttgtttctagagtctttgccaattctcctaatgtctgctacacgccgcgtagtgagatcgtacttgggagtcggccat

SEQ ID NO: 437264 - DNA, 140 bp, Artificial Sequence
  Synthetic
atggccgactcccaagtacgatctcactacgcggcgtgtagcagacattaggagaattggcaaagactctagaaacaaagaaaacaatttgtttcttaacccaagccaatgtggtaggcaggagacccagcatggcgtat

SEQ ID NO: 437265 - DNA, 140 bp, Artificial Sequence
  Synthetic
atacgccatgctgggtctccgtaatttagctttccggttaaccacctcaaagctacgcgctaatgataatatcttatcagttagattcactgctaacaaaattgttggtggtgctcctaccgtacttgggagtcggccat

SEQ ID NO: 437266 - DNA, 140 bp, Artificial Sequence
  Synthetic
atggccgactcccaagtacggtaggagcaccaccaacaattttgttagcagtgaatctaactgataagatattatcattagcgcgtagctttgaggtggttaaccggaaagctaaattacggagacccagcatggcgtat

SEQ ID NO: 437267 - DNA, 140 bp, Artificial Sequence
  Synthetic
atacgccatgctgggtctccactggttgtggcacaaactgtatgggaaaacttaagtgtaatcgttgttgtgatagatacgaggaatacgacctcgagccgcataaggttcatgttcactcgtacttgggagtcggccat

SEQ ID NO: 437268 - DNA, 140 bp, Artificial Sequence
  Synthetic
atggccgactcccaagtacgagtgaacatgaaccttatgcggctcgaggtcgtattcctcgtatctatcacaacaacgattacacttaagttttcccatacagtttgtgccacaaccagtggagacccagcatggcgtat

SEQ ID NO: 437269 - DNA, 140 bp, Artificial Sequence
  Synthetic
atacgccatgctgggtctccatggtttaatgcgttgcgtgactttacgttaaagggttacgttcttgctaccattattgtgtttctgtgtgctgtactgatgtatttgtgtttacctacacgtacttgggagtcggccat

SEQ ID NO: 437270 - DNA, 140 bp, Artificial Sequence
  Synthetic
atggccgactcccaagtacgtgtaggtaaacacaaatacatcagtacagcacacagaaacacaataatggtagcaagaacgtaaccctttaacgtaaagtcacgcaacgcattaaaccatggagacccagcatggcgtat

SEQ ID NO: 437271 - DNA, 140 bp, Artificial Sequence
  Synthetic
atacgccatgctgggtctccactgtattaccaggtgctcatgcatatgcaaacatgaaacctcatgtgcgttatgacatgttcgaaggaaacatgtttattaaattccctgaagttgtgtcgtacttgggagtcggccat

SEQ ID NO: 437272 - DNA, 140 bp, Artificial Sequence
  Synthetic
atggccgactcccaagtacgacacaacttcagggaatttaataaacatgtttccttcgaacatgtcataacgcacatgaggtttcatgtttgcatatgcatgagcacctggtaatacagtggagacccagcatggcgtat

SEQ ID NO: 437273 - DNA, 140 bp, Artificial Sequence
  Synthetic
atacgccatgctgggtctccttttctatggtacctgttgaattttatgaagaccgcatcttggactttaaagttcttgataatggtatcattagggatgtaaatcctgatgataagtgctcgtacttgggagtcggccat

SEQ ID NO: 437274 - DNA, 140 bp, Artificial Sequence
  Synthetic
atggccgactcccaagtacgagcacttatcatcaggatttacatccctaatgataccattatcaagaactttaaagtccaagatgcggtcttcataaaattcaacaggtaccatagaaaaggagacccagcatggcgtat

SEQ ID NO: 437275 - DNA, 140 bp, Artificial Sequence
  Synthetic
atacgccatgctgggtctccttgaaagcactatcagggttactaaaactcttagcacacagtactgccgttttggtagttgcgagtatgctcaagagggtgtttgtattactactaatggcgtacttgggagtcggccat

SEQ ID NO: 437276 - DNA, 140 bp, Artificial Sequence
  Synthetic
atggccgactcccaagtacgccattagtagtaatacaaacaccctcttgagcatactcgcaactaccaaaacggcagtactgtgtgctaagagttttagtaaccctgatagtgctttcaaggagacccagcatggcgtat

SEQ ID NO: 437277 - DNA, 140 bp, Artificial Sequence
  Synthetic
atacgccatgctgggtctccttgctaataagcaccggtccttcacacaatggtatcatgagcatgttggtggtgtctatgacaactctatcacatgcccattgacagttgcagtaattgccgtacttgggagtcggccat

SEQ ID NO: 437278 - DNA, 140 bp, Artificial Sequence
  Synthetic
atggccgactcccaagtacggcaattactgcaactgtcaatgggcatgtgatagagttgtcatagacaccaccaacatgctcatgataccattgtgtgaaggaccggtgcttattagcaaggagacccagcatggcgtat

SEQ ID NO: 437279 - DNA, 140 bp, Artificial Sequence
  Synthetic
atacgccatgctgggtctcccgaagtttcttaatggatgcttcgaggctacaactgcaactgtcaactttctcttagaccttgcaaacctttttaagatctttcttacgcaggcctatgtcgtacttgggagtcggccat

SEQ ID NO: 437280 - DNA, 140 bp, Artificial Sequence
  Synthetic
atggccgactcccaagtacgacataggcctgcgtaagaaagatcttaaaaaggtttgcaaggtctaagagaaagttgacagttgcagttgtagcctcgaagcatccattaagaaacttcgggagacccagcatggcgtat

SEQ ID NO: 437281 - DNA, 140 bp, Artificial Sequence
  Synthetic
atacgccatgctgggtctcctggagttgctggtgctcgcattccagacgtacctactacattggcttgggtgaacaatcagataattttctttgtttctcgagtctttgctaatacaggccgtacttgggagtcggccat

SEQ ID NO: 437282 - DNA, 140 bp, Artificial Sequence
  Synthetic
atggccgactcccaagtacggcctgtattagcaaagactcgagaaacaaagaaaattatctgattgttcacccaagccaatgtagtaggtacgtctggaatgcgagcaccagcaactccaggagacccagcatggcgtat

SEQ ID NO: 437283 - DNA, 140 bp, Artificial Sequence
  Synthetic
atacgccatgctgggtctcccaacctattacctacttccagttgacaacgtcattggttcttggtattggtttgtgtgcctttatgactttagtcttttattacattaataaagttaagccgtacttgggagtcggccat

SEQ ID NO: 437284 - DNA, 140 bp, Artificial Sequence
  Synthetic
atggccgactcccaagtacggcttaactttattaatgtaataaaagactaaagtcataaaggcacacaaaccaataccaagaaccaatgacgttgtcaactggaagtaggtaataggttgggagacccagcatggcgtat

SEQ ID NO: 437285 - DNA, 140 bp, Artificial Sequence
  Synthetic
atacgccatgctgggtctccagtgtttgctacactcctatagatgagataccctataagagtttctctgatagtggttgcattcttccatctgagtgcactatgtttagggatgcagaggcgtacttgggagtcggccat

SEQ ID NO: 437286 - DNA, 140 bp, Artificial Sequence
  Synthetic
atggccgactcccaagtacgcctctgcatccctaaacatagtgcactcagatggaagaatgcaaccactatcagagaaactcttatagggtatctcatctataggagtgtagcaaacactggagacccagcatggcgtat

SEQ ID NO: 437287 - DNA, 140 bp, Artificial Sequence
  Synthetic
atacgccatgctgggtctccgtgcattggccgactatactcagtgtgcagttatagctgtctgtgcaactattatgaatagcttatgtctttgctttgtggttgcatgcccgttgtgcgtcgtacttgggagtcggccat

SEQ ID NO: 437288 - DNA, 140 bp, Artificial Sequence
  Synthetic
atggccgactcccaagtacgacgcacaacgggcatgcaaccacaaagcaaagacataagctattcataatagttgcacagacagctataactgcacactgagtatagtcggccaatgcacggagacccagcatggcgtat

SEQ ID NO: 437289 - DNA, 140 bp, Artificial Sequence
  Synthetic
atacgccatgctgggtctccgccgtatgacaccatactgccatgatcctactgttttgcctggggcttttgcgtacagtcagatgaggcctcatgttcgttacgacttgtatgatggtaacgtacttgggagtcggccat

SEQ ID NO: 437290 - DNA, 140 bp, Artificial Sequence
  Synthetic
atggccgactcccaagtacgttaccatcatacaagtcgtaacgaacatgaggcctcatctgactgtacgcaaaagccccaggcaaaacagtaggatcatggcagtatggtgtcatacggcggagacccagcatggcgtat

SEQ ID NO: 437291 - DNA, 140 bp, Artificial Sequence
  Synthetic
atacgccatgctgggtctcctgtaccctacaccgcattgtattattatgctactttctacttcacaaacgagcctgcatttataatgcatttgtcttggtttgtcatgtttggcgctgttcgtacttgggagtcggccat

SEQ ID NO: 437292 - DNA, 140 bp, Artificial Sequence
  Synthetic
atggccgactcccaagtacgaacagcgccaaacatgacaaaccaagacaaatgcattataaatgcaggctcgtttgtgaagtagaaagtagcataataatacaatgcggtgtagggtacaggagacccagcatggcgtat

SEQ ID NO: 437293 - DNA, 140 bp, Artificial Sequence
  Synthetic
atacgccatgctgggtctcccatgtttattaaatttcctgaagtagtatttgaaagtacacttaggattactagaactctgtcaactcagtactgccggttcggtagttgtgagtatgcacgtacttgggagtcggccat

SEQ ID NO: 437294 - DNA, 140 bp, Artificial Sequence
  Synthetic
atggccgactcccaagtacgtgcatactcacaactaccgaaccggcagtactgagttgacagagttctagtaatcctaagtgtactttcaaatactacttcaggaaatttaataaacatgggagacccagcatggcgtat

SEQ ID NO: 437295 - DNA, 140 bp, Artificial Sequence
  Synthetic
atacgccatgctgggtctccgttccagtatggacgacgtgtctttatgtagtggctatgtgttttagacacttcttttgggttcttgcatattttagtcgaaagcatgttgatgttttcacgtacttgggagtcggccat

SEQ ID NO: 437296 - DNA, 140 bp, Artificial Sequence
  Synthetic
atggccgactcccaagtacgtgaaaacatcaacatgctttcgactaaaatatgcaagaacccaaaagaagtgtctaaaacacatagccactacataaagacacgtcgtccatactggaacggagacccagcatggcgtat

SEQ ID NO: 437297 - DNA, 140 bp, Artificial Sequence
  Synthetic
atacgccatgctgggtctcccaagagggtgtttgtattaccacaaatggctcgtgggccatttttaatgaccaccatcttaatagacctggtgtctattgtggctctgattttattgacacgtacttgggagtcggccat

SEQ ID NO: 437298 - DNA, 140 bp, Artificial Sequence
  Synthetic
atggccgactcccaagtacgtgtcaataaaatcagagccacaatagacaccaggtctattaagatggtggtcattaaaaatggcccacgagccatttgtggtaatacaaacaccctcttgggagacccagcatggcgtat

SEQ ID NO: 437299 - DNA, 140 bp, Artificial Sequence
  Synthetic
atacgccatgctgggtctccctgatggcaagcttaattgtacattccaggaggctgctgctaatatttttgttgtaaacaaagatacttatgtggctcttaggaattctattaatgcagacgtacttgggagtcggccat

SEQ ID NO: 437300 - DNA, 140 bp, Artificial Sequence
  Synthetic
atggccgactcccaagtacgtctgcattaatagaattcctaagagccacataagtatctttgtttacaacaaaaatattagcagcagcctcctggaatgtacaattaagcttgccatcagggagacccagcatggcgtat

SEQ ID NO: 437301 - DNA, 140 bp, Artificial Sequence
  Synthetic
atacgccatgctgggtctccttgtcaggcggttagcagtatcactgttccagcctattacttatttccaattgactacctcattggtcttgggtataggtttgtgtgcgttcctgactttcgtacttgggagtcggccat

SEQ ID NO: 437302 - DNA, 140 bp, Artificial Sequence
  Synthetic
atggccgactcccaagtacgaaagtcaggaacgcacacaaacctatacccaagaccaatgaggtagtcaattggaaataagtaataggctggaacagtgatactgctaaccgcctgacaaggagacccagcatggcgtat

SEQ ID NO: 437303 - DNA, 140 bp, Artificial Sequence
  Synthetic
atacgccatgctgggtctcctgtgtatgcgaggtatctagccatgttcaacaagtacaagtacttttctggtgctatggatactgccgcatatagagaggctgctgcgtcccatctggctcgtacttgggagtcggccat

SEQ ID NO: 437304 - DNA, 140 bp, Artificial Sequence
  Synthetic
atggccgactcccaagtacgagccagatgggacgcagcagcctctctatatgcggcagtatccatagcaccagaaaagtacttgtacttgttgaacatggctagatacctcgcatacacaggagacccagcatggcgtat

SEQ ID NO: 437305 - DNA, 140 bp, Artificial Sequence
  Synthetic
atacgccatgctgggtctccgctcttctattatattaataaagtaaaacgtgcttttgcagattacacccagtgtgctgtaattgctgttgttgctgctgttcttaatagcttgtgcatccgtacttgggagtcggccat

SEQ ID NO: 437306 - DNA, 140 bp, Artificial Sequence
  Synthetic
atggccgactcccaagtacggatgcacaagctattaagaacagcagcaacaacagcaattacagcacactgggtgtaatctgcaaaagcacgttttactttattaatataatagaagagcggagacccagcatggcgtat

SEQ ID NO: 437307 - DNA, 140 bp, Artificial Sequence
  Synthetic
atacgccatgctgggtctccaaggctttacagacctatagtgaaactggtagcgaccttctttatcagccacctaactgtagcattacctccggtgtgttgcagagtggcttggttaagacgtacttgggagtcggccat

SEQ ID NO: 437308 - DNA, 140 bp, Artificial Sequence
  Synthetic
atggccgactcccaagtacgtcttaaccaagccactctgcaacacaccggaggtaatgctacagttaggtggctgataaagaaggtcgctaccagtttcactataggtctgtaaagccttggagacccagcatggcgtat

SEQ ID NO: 437309 - DNA, 140 bp, Artificial Sequence
  Synthetic
atacgccatgctgggtctcctgctttgttgcctctataccattgtgtatagtaccttacactgcattgtactattatgctacattctattttactaatgagcctgcatttattatgcatgcgtacttgggagtcggccat

SEQ ID NO: 437310 - DNA, 140 bp, Artificial Sequence
  Synthetic
atggccgactcccaagtacgcatgcataataaatgcaggctcattagtaaaatagaatgtagcataatagtacaatgcagtgtaaggtactatacacaatggtatagaggcaacaaagcaggagacccagcatggcgtat

SEQ ID NO: 437311 - DNA, 140 bp, Artificial Sequence
  Synthetic
atacgccatgctgggtctcctgtctcatccaagtggggctgtagaggcttgtatggttcaagttacatgtggtagcatgaccttgaatggcttatggttggacaattatgtctggtgccccgtacttgggagtcggccat

SEQ ID NO: 437312 - DNA, 140 bp, Artificial Sequence
  Synthetic
atggccgactcccaagtacggggcaccagacataattgtccaaccataagccattcaaggtcatgctaccacatgtaacttgaaccatacaagcctctacagccccacttggatgagacaggagacccagcatggcgtat

SEQ ID NO: 437313 - DNA, 140 bp, Artificial Sequence
  Synthetic
atacgccatgctgggtctcctttcttggtacattatgttcgggcctatcgttcccatatggatgacctgcgtctatacagttgcaatgtgctttagacacttcttctgggttttagcttacgtacttgggagtcggccat

SEQ ID NO: 437314 - DNA, 140 bp, Artificial Sequence
  Synthetic
atggccgactcccaagtacgtaagctaaaacccagaagaagtgtctaaagcacattgcaactgtatagacgcaggtcatccatatgggaacgataggcccgaacataatgtaccaagaaaggagacccagcatggcgtat

SEQ ID NO: 437315 - DNA, 140 bp, Artificial Sequence
  Synthetic
atacgccatgctgggtctccacgacatgttatgtgtcccgcagaccagcttaatgatccaaattatgatggtttgttgatttctatgactaaccatagttttactgtgcaaaagcatgttcgtacttgggagtcggccat

SEQ ID NO: 437316 - DNA, 140 bp, Artificial Sequence
  Synthetic
atggccgactcccaagtacgaacatgcttttgcacagtaaaactatggttagtcatagaaatcaacaaaccatcataatttggatcattaagctggtctgcgggacacataacatgtcgtggagacccagcatggcgtat

SEQ ID NO: 437317 - DNA, 140 bp, Artificial Sequence
  Synthetic
atacgccatgctgggtctccttttagtaagaaacatgtagaagtttttactgatggtaagcttaattgtagtttccaggacgctgcctctaatatctttgttattaacaaggacacttatcgtacttgggagtcggccat

SEQ ID NO: 437318 - DNA, 140 bp, Artificial Sequence
  Synthetic
atggccgactcccaagtacgataagtgtccttgttaataacaaagatattagaggcagcgtcctggaaactacaattaagcttaccatcagtaaaaacttctacatgtttcttactaaaaggagacccagcatggcgtat

SEQ ID NO: 437319 - DNA, 140 bp, Artificial Sequence
  Synthetic
atacgccatgctgggtctccggtgctcctgcaaacctgagggttattggtcacgccatgcaaggcacacttctgaagttgacggtggattctcctaatccgaatacacctgcctacacttcgtacttgggagtcggccat

SEQ ID NO: 437320 - DNA, 140 bp, Artificial Sequence
  Synthetic
atggccgactcccaagtacgaagtgtaggcaggtgtattcggattaggagaatccaccgtcaacttcagaagtgtgccttgcatggcgtgaccaataaccctcaggtttgcaggagcaccggagacccagcatggcgtat

SEQ ID NO: 437321 - DNA, 140 bp, Artificial Sequence
  Synthetic
atacgccatgctgggtctccgcagctcttagaaactctttaactaatgatgcctattcacgatttttggggttgtttaacaagtataagtacttctctggtgctatggaaacagccgcttcgtacttgggagtcggccat

SEQ ID NO: 437322 - DNA, 140 bp, Artificial Sequence
  Synthetic
atggccgactcccaagtacgaagcggctgtttccatagcaccagagaagtacttatacttgttaaacaaccccaaaaatcgtgaataggcatcattagttaaagagtttctaagagctgcggagacccagcatggcgtat

SEQ ID NO: 437323 - DNA, 140 bp, Artificial Sequence
  Synthetic
aggccctggctgctgatatggttgtttaacaagtataagtacttctctggtgctatggaaacagccgcttatcgtgaagctgcagcatgtcatcttgctaaagccttacaaacatacagcgaccttttgggacagcggtg

SEQ ID NO: 437324 - DNA, 140 bp, Artificial Sequence
  Synthetic
caccgctgtcccaaaaggtcgctgtatgtttgtaaggctttagcaagatgacatgctgcagcttcacgataagcggctgtttccatagcaccagagaagtacttatacttgttaaacaaccatatcagcagccagggcct

SEQ ID NO: 437325 - DNA, 140 bp, Artificial Sequence
  Synthetic
atacgccatgctgggtctccgagactggtagtgatcttctttaccaaccacccaactgtagcataacctctggcgtgttgcaaagcggtttggtgaaaatgtcacatcccagtggagatgcgtacttgggagtcggccat

SEQ ID NO: 437326 - DNA, 140 bp, Artificial Sequence
  Synthetic
atggccgactcccaagtacgcatctccactgggatgtgacattttcaccaaaccgctttgcaacacgccagaggttatgctacagttgggtggttggtaaagaagatcactaccagtctcggagacccagcatggcgtat

SEQ ID NO: 437327 - DNA, 140 bp, Artificial Sequence
  Synthetic
aggccctggctgctgatatgtggcgtgttgcaaagcggtttggtgaaaatgtcacatcccagtggagatgttgaggcttgtatggttcaggttacctgcggtagcatgactcttaatggtgaccttttgggacagcggtg

SEQ ID NO: 437328 - DNA, 140 bp, Artificial Sequence
  Synthetic
caccgctgtcccaaaaggtcaccattaagagtcatgctaccgcaggtaacctgaaccatacaagcctcaacatctccactgggatgtgacattttcaccaaaccgctttgcaacacgccacatatcagcagccagggcct

SEQ ID NO: 437329 - DNA, 140 bp, Artificial Sequence
  Synthetic
atacgccatgctgggtctccggtacacataccggctcttcatttgacggtaatatgtatggtgcattccaagatagacaagtgcaccaggcacagttgacagacaaatactgtactgtaacgtacttgggagtcggccat

SEQ ID NO: 437330 - DNA, 140 bp, Artificial Sequence
  Synthetic
atggccgactcccaagtacgttacagtacagtatttgtctgtcaactgtgcctggtgcacttgtctatcttggaatgcaccatacatattaccgtcaaatgaagagccggtatgtgtaccggagacccagcatggcgtat

SEQ ID NO: 437331 - DNA, 140 bp, Artificial Sequence
  Synthetic
aggccctggctgctgatatgtggcgactttatgtctacaattattacttcctgccaaactgctgttagtaagcttctagatacatgttttgaagctacagaagcaacatttaacttcttggaccttttgggacagcggtg

SEQ ID NO: 437332 - DNA, 140 bp, Artificial Sequence
  Synthetic
caccgctgtcccaaaaggtccaagaagttaaatgttgcttctgtagcttcaaaacatgtatctagaagcttactaacagcagtttggcaggaagtaataattgtagacataaagtcgccacatatcagcagccagggcct

SEQ ID NO: 437333 - DNA, 140 bp, Artificial Sequence
  Synthetic
aggccctggctgctgatatgtgaccagttgtctgatcctaattatgatgccttgttgatttctatgactaatcatagtttcagtgtgcaaaaacacattggcgctccagcaaacttgcgtgaccttttgggacagcggtg

SEQ ID NO: 437334 - DNA, 140 bp, Artificial Sequence
  Synthetic
caccgctgtcccaaaaggtcacgcaagtttgctggagcgccaatgtgtttttgcacactgaaactatgattagtcatagaaatcaacaaggcatcataattaggatcagacaactggtcacatatcagcagccagggcct

SEQ ID NO: 437335 - DNA, 140 bp, Artificial Sequence
  Synthetic
atacgccatgctgggtctccccttcactctttaaagttcaaaatgtaaatcttgaaccctgtcagcttgctaattacaagcagtcaatacccatgccacggggtgttcacatgaacgtggcgtacttgggagtcggccat

SEQ ID NO: 437336 - DNA, 140 bp, Artificial Sequence
  Synthetic
atggccgactcccaagtacgccacgttcatgtgaacaccccgtggcatgggtattgactgcttgtaattagcaagctgacagggttcaagatttacattttgaactttaaagagtgaaggggagacccagcatggcgtat

SEQ ID NO: 437337 - DNA, 140 bp, Artificial Sequence
  Synthetic
aggccctggctgctgatatggttgttggtcatgccatgcaaggcactcttttgaagttgactgtcgatgttgctaaccctagcactccagcctacacttttacaacagtgaaacctggcggaccttttgggacagcggtg

SEQ ID NO: 437338 - DNA, 140 bp, Artificial Sequence
  Synthetic
caccgctgtcccaaaaggtccgccaggtttcactgttgtaaaagtgtaggctggagtgctagggttagcaacatcgacagtcaacttcaaaagagtgccttgcatggcatgaccaacaaccatatcagcagccagggcct

SEQ ID NO: 437339 - DNA, 140 bp, Artificial Sequence
  Synthetic
aggccctggctgctgatatgctagtcccagtttctcctgcatttcatcgcattgagtctactgactctattgttttcacatacattcctgctagcggctatgtagctgctttagctgtcagaccttttgggacagcggtg

SEQ ID NO: 437340 - DNA, 140 bp, Artificial Sequence
  Synthetic
caccgctgtcccaaaaggtctgacagctaaagcagctacatagccgctagcaggaatgtatgtgaaaacaatagagtcagtagactcaatgcgatgaaatgcaggagaaactgggactagcatatcagcagccagggcct

SEQ ID NO: 437341 - DNA, 140 bp, Artificial Sequence
  Synthetic
atacgccatgctgggtctcccagcatttagtgtgttagcatgctataatggtcgtccgactggtacattcactgttgtaatgcgccctaactacacaattaagggttcctttctgtgtggcgtacttgggagtcggccat

SEQ ID NO: 437342 - DNA, 140 bp, Artificial Sequence
  Synthetic
atggccgactcccaagtacgccacacagaaaggaacccttaattgtgtagttagggcgcattacaacagtgaatgtaccagtcggacgaccattatagcatgctaacacactaaatgctgggagacccagcatggcgtat

SEQ ID NO: 437343 - DNA, 140 bp, Artificial Sequence
  Synthetic
aggccctggctgctgatatggattatggttttactgtttttgtgtgcacagacaactctgctaacactaaagttcttaggaacaagggtgttgattatactaagaagtttcttacagttggaccttttgggacagcggtg

SEQ ID NO: 437344 - DNA, 140 bp, Artificial Sequence
  Synthetic
caccgctgtcccaaaaggtccaactgtaagaaacttcttagtataatcaacacccttgttcctaagaactttagtgttagcagagttgtctgtgcacacaaaaacagtaaaaccataatccatatcagcagccagggcct

SEQ ID NO: 437345 - DNA, 140 bp, Artificial Sequence
  Synthetic
atacgccatgctgggtctccttcttgtggtagtgttggttacaccaaggagggtagtgtgatcaatttttgttacatgcatcaaatggaacttgctaatggtacacataccggttcagcacgtacttgggagtcggccat

SEQ ID NO: 437346 - DNA, 140 bp, Artificial Sequence
  Synthetic
atggccgactcccaagtacgtgctgaaccggtatgtgtaccattagcaagttccatttgatgcatgtaacaaaaattgatcacactaccctccttggtgtaaccaacactaccacaagaaggagacccagcatggcgtat

SEQ ID NO: 437347 - DNA, 140 bp, Artificial Sequence
  Synthetic
aggccctggctgctgatatgcggtgtgcaatattattgctacacgtctaaggacactttagatgatatcttacaacaggctaataagtctgttggtattatatctatgcctttgggatatgaccttttgggacagcggtg

SEQ ID NO: 437348 - DNA, 140 bp, Artificial Sequence
  Synthetic
caccgctgtcccaaaaggtcatatcccaaaggcatagatataataccaacagacttattagcctgttgtaagatatcatctaaagtgtccttagacgtgtagcaataatattgcacaccgcatatcagcagccagggcct

SEQ ID NO: 437349 - DNA, 140 bp, Artificial Sequence
  Synthetic
atacgccatgctgggtctcctttgatggtactatgtatggtgcctttatggataaacaagtgcaccaagttcagttaacagacaaatactgcagtgttaatgtagtagcttggctttacgcgtacttgggagtcggccat

SEQ ID NO: 437350 - DNA, 140 bp, Artificial Sequence
  Synthetic
atggccgactcccaagtacgcgtaaagccaagctactacattaacactgcagtatttgtctgttaactgaacttggtgcacttgtttatccataaaggcaccatacatagtaccatcaaaggagacccagcatggcgtat

SEQ ID NO: 437351 - DNA, 140 bp, Artificial Sequence
  Synthetic
atacgccatgctgggtctcccagcaatacttaatggttgcgcttggtttgtaaaacctaatcgcactagtgttgtttcttttaatgaatgggctcttgccaaccaattcactgaatttgtcgtacttgggagtcggccat

SEQ ID NO: 437352 - DNA, 140 bp, Artificial Sequence
  Synthetic
atggccgactcccaagtacgacaaattcagtgaattggttggcaagagcccattcattaaaagaaacaacactagtgcgattaggttttacaaaccaagcgcaaccattaagtattgctgggagacccagcatggcgtat

SEQ ID NO: 437353 - DNA, 140 bp, Artificial Sequence
  Synthetic
atacgccatgctgggtctcctggcactcaatccgttgacatgttagctgtcaaaacaggcgttgctattgaacagctgctttatgcgatccaacaactttatactgggttccagggaaagcgtacttgggagtcggccat

SEQ ID NO: 437354 - DNA, 140 bp, Artificial Sequence
  Synthetic
atggccgactcccaagtacgctttccctggaacccagtataaagttgttggatcgcataaagcagctgttcaatagcaacgcctgttttgacagctaacatgtcaacggattgagtgccaggagacccagcatggcgtat

SEQ ID NO: 437355 - DNA, 140 bp, Artificial Sequence
  Synthetic
aggccctggctgctgatatgcccctgctgcacctcgtgctgtttcctttgccgataacaatgatataacaaatacaaacctgtctcgaggtagaggacgtaatccaaaaccacgagctgcgaccttttgggacagcggtg

SEQ ID NO: 437356 - DNA, 140 bp, Artificial Sequence
  Synthetic
caccgctgtcccaaaaggtcgcagctcgtggttttggattacgtcctctacctcgagacaggtttgtatttgttatatcattgttatcggcaaaggaaacagcacgaggtgcagcaggggcatatcagcagccagggcct

SEQ ID NO: 437357 - DNA, 140 bp, Artificial Sequence
  Synthetic
atacgccatgctgggtctcccaaatccttggcagtactatgttggaagatgaattcacacctgaggatgttaatatgcagattatgggtgtggttatgcagagtggtgtgagaaaagttacgtacttgggagtcggccat

SEQ ID NO: 437358 - DNA, 140 bp, Artificial Sequence
  Synthetic
atggccgactcccaagtacgtaacttttctcacaccactctgcataaccacacccataatctgcatattaacatcctcaggtgtgaattcatcttccaacatagtactgccaaggatttgggagacccagcatggcgtat

SEQ ID NO: 437359 - DNA, 140 bp, Artificial Sequence
  Synthetic
atacgccatgctgggtctcccatatggtactgcgcattggttgttcgcgacccttgtctcaacctatgtgataatcttacaagccactaaatttactttgtggaactacttgtttgagaccgtacttgggagtcggccat

SEQ ID NO: 437360 - DNA, 140 bp, Artificial Sequence
  Synthetic
atggccgactcccaagtacggtctcaaacaagtagttccacaaagtaaatttagtggcttgtaagattatcacataggttgagacaagggtcgcgaacaaccaatgcgcagtaccatatgggagacccagcatggcgtat

SEQ ID NO: 437361 - DNA, 140 bp, Artificial Sequence
  Synthetic
atacgccatgctgggtctcctattcccacacagttgttcccactcttatttgtgactatggccttcgttatgttgttggttaaacacaaacacacctttttgacacttttcttgttgcctcgtacttgggagtcggccat

SEQ ID NO: 437362 - DNA, 140 bp, Artificial Sequence
  Synthetic
atggccgactcccaagtacgaggcaacaagaaaagtgtcaaaaaggtgtgtttgtgtttaaccaacaacataacgaaggccatagtcacaaataagagtgggaacaactgtgtgggaataggagacccagcatggcgtat

SEQ ID NO: 437363 - DNA, 140 bp, Artificial Sequence
  Synthetic
atacgccatgctgggtctcctaagggttctttcttgtgtggatcgtgtggtagtgttggttacacaaaggagggtaatgtgatcaacttttgttatatgcatcaaatggaattggcaaatcgtacttgggagtcggccat

SEQ ID NO: 437364 - DNA, 140 bp, Artificial Sequence
  Synthetic
atggccgactcccaagtacgatttgccaattccatttgatgcatataacaaaagttgatcacattaccctcctttgtgtaaccaacactaccacacgatccacacaagaaagaacccttaggagacccagcatggcgtat

SEQ ID NO: 437365 - DNA, 140 bp, Artificial Sequence
  Synthetic
atacgccatgctgggtctccgtggctatttgtttgacttatgcaaacatagtctacgagcccactactcccatttcgtcagcgctgattgcagttgcaaattggcttgcccccactaatgcgtacttgggagtcggccat

SEQ ID NO: 437366 - DNA, 140 bp, Artificial Sequence
  Synthetic
atggccgactcccaagtacgcattagtgggggcaagccaatttgcaactgcaatcagcgctgacgaaatgggagtagtgggctcgtagactatgtttgcataagtcaaacaaatagccacggagacccagcatggcgtat

SEQ ID NO: 437367 - DNA, 140 bp, Artificial Sequence
  Synthetic
atacgccatgctgggtctcccttatatgcgcactacacatactgatattggtgtctacattagtatgtcacttgtattagtcattgtagtgaagagattgtacaacccatcactttctaacgtacttgggagtcggccat

SEQ ID NO: 437368 - DNA, 140 bp, Artificial Sequence
  Synthetic
atggccgactcccaagtacgttagaaagtgatgggttgtacaatctcttcactacaatgactaatacaagtgacatactaatgtagacaccaatatcagtatgtgtagtgcgcatataagggagacccagcatggcgtat

SEQ ID NO: 437369 - DNA, 140 bp, Artificial Sequence
  Synthetic
atacgccatgctgggtctccagacgcgctgctttcaaattctaatcttagaactttctctgttgacaagtctcttactgtcgaggattttgttgatgtcgtgaaggacgaggtttgtgagcgtacttgggagtcggccat

SEQ ID NO: 437370 - DNA, 140 bp, Artificial Sequence
  Synthetic
atggccgactcccaagtacgctcacaaacctcgtccttcacgacatcaacaaaatcctcgacagtaagagacttgtcaacagagaaagttctaagattagaatttgaaagcagcgcgtctggagacccagcatggcgtat

SEQ ID NO: 437371 - DNA, 140 bp, Artificial Sequence
  Synthetic
atacgccatgctgggtctccctttgcgttagcattgtgcagtggtgtaatgtggttgtacacttatagcattggagaagcctcaagccccattgcctatctggtttttgtcactacactccgtacttgggagtcggccat

SEQ ID NO: 437372 - DNA, 140 bp, Artificial Sequence
  Synthetic
atggccgactcccaagtacggagtgtagtgacaaaaaccagataggcaatggggcttgaggcttctccaatgctataagtgtacaaccacattacaccactgcacaatgctaacgcaaagggagacccagcatggcgtat

SEQ ID NO: 437373 - DNA, 140 bp, Artificial Sequence
  Synthetic
atacgccatgctgggtctccactagtgattatacgattacagtctttgttactgtcaaccttgcaaaagtttgcacttatgccatctttgcttactcaccacagcttacacttgtgtttccgtacttgggagtcggccat

SEQ ID NO: 437374 - DNA, 140 bp, Artificial Sequence
  Synthetic
atggccgactcccaagtacggaaacacaagtgtaagctgtggtgagtaagcaaagatggcataagtgcaaacttttgcaaggttgacagtaacaaagactgtaatcgtataatcactagtggagacccagcatggcgtat

SEQ ID NO: 437375 - DNA, 140 bp, Artificial Sequence
  Synthetic
atacgccatgctgggtctccgtgtgcgctctgttccaggtgaaatgcgcttggcatccattgcttttaatcatcccattcaggttgatcaacttaatagtagttattttaaattaagtatcgtacttgggagtcggccat

SEQ ID NO: 437376 - DNA, 140 bp, Artificial Sequence
  Synthetic
atggccgactcccaagtacgatacttaatttaaaataactactattaagttgatcaacctgaatgggatgattaaaagcaatggatgccaagcgcatttcacctggaacagagcgcacacggagacccagcatggcgtat

SEQ ID NO: 437377 - DNA, 140 bp, Artificial Sequence
  Synthetic
atacgccatgctgggtctcccggaagtgaagatgatacttttattatacacatgtttaggtttcatgtgtacttgctattttggtgtcttctctcttttgaaccttaagcttagagcacccgtacttgggagtcggccat

SEQ ID NO: 437378 - DNA, 140 bp, Artificial Sequence
  Synthetic
atggccgactcccaagtacgggtgctctaagcttaaggttcaaaagagagaagacaccaaaatagcaagtacacatgaaacctaaacatgtgtataataaaagtatcatcttcacttccgggagacccagcatggcgtat

SEQ ID NO: 437379 - DNA, 140 bp, Artificial Sequence
  Synthetic
atacgccatgctgggtctccacccactaatttttcctttggtgtgactcaggagtacattcagacaaccattcagaaagttactgttgattgtaaacagtacgtttgcaatggtttccagcgtacttgggagtcggccat

SEQ ID NO: 437380 - DNA, 140 bp, Artificial Sequence
  Synthetic
atggccgactcccaagtacgctggaaaccattgcaaacgtactgtttacaatcaacagtaactttctgaatggttgtctgaatgtactcctgagtcacaccaaaggaaaaattagtgggtggagacccagcatggcgtat

SEQ ID NO: 437381 - DNA, 140 bp, Artificial Sequence
  Synthetic
atacgccatgctgggtctcctatgggtgtctatgactttaaggtctcaacacaagagttcagattcatgactgctaacaatctaactgcacctagaaattcttgggaggctatggctctgcgtacttgggagtcggccat

SEQ ID NO: 437382 - DNA, 140 bp, Artificial Sequence
  Synthetic
atggccgactcccaagtacgcagagccatagcctcccaagaatttctaggtgcagttagattgttagcagtcatgaatctgaactcttgtgttgagaccttaaagtcatagacacccataggagacccagcatggcgtat

SEQ ID NO: 437383 - DNA, 140 bp, Artificial Sequence
  Synthetic
aggccctggctgctgatatgctgctaacaatctaactgcacctagaaattcttgggaggctatggctctgaactttaagttaataggtattggcggtacaccttgtataaaggttgctgcgaccttttgggacagcggtg

SEQ ID NO: 437384 - DNA, 140 bp, Artificial Sequence
  Synthetic
caccgctgtcccaaaaggtcgcagcaacctttatacaaggtgtaccgccaatacctattaacttaaagttcagagccatagcctcccaagaatttctaggtgcagttagattgttagcagcatatcagcagccagggcct

SEQ ID NO: 437385 - DNA, 140 bp, Artificial Sequence
  Synthetic
aggccctggctgctgatatgctgtagatgtggtagcacttcaacaggaaatgacaattgtcaaatgtaagggtttaaataaacctttcgtgaaggacaatgtcagtttcgttgctgatgagaccttttgggacagcggtg

SEQ ID NO: 437386 - DNA, 140 bp, Artificial Sequence
  Synthetic
caccgctgtcccaaaaggtctcatcagcaacgaaactgacattgtccttcacgaaaggtttatttaaacccttacatttgacaattgtcatttcctgttgaagtgctaccacatctacagcatatcagcagccagggcct

SEQ ID NO: 437387 - DNA, 140 bp, Artificial Sequence
  Synthetic
atacgccatgctgggtctcctatgcagtctaaacttacagatcttaaatgcacatctgtggttctcctctctgtgctccaacagttacacttagaggctaatagtagggcctgggctttccgtacttgggagtcggccat

SEQ ID NO: 437388 - DNA, 140 bp, Artificial Sequence
  Synthetic
atggccgactcccaagtacggaaagcccaggccctactattagcctctaagtgtaactgttggagcacagagaggagaaccacagatgtgcatttaagatctgtaagtttagactgcataggagacccagcatggcgtat

SEQ ID NO: 437389 - DNA, 140 bp, Artificial Sequence
  Synthetic
atacgccatgctgggtctccttgtttggtatgattaagaagttggataacgatgttcttaatggtatcatagctaatgctaggaatggttgtataccacttagtattgtgccactgtgtgcgtacttgggagtcggccat

SEQ ID NO: 437390 - DNA, 140 bp, Artificial Sequence
  Synthetic
atggccgactcccaagtacgcacacagtggcacaatactaagtggtatacaaccattcctagcattagctatgataccattaagaacatcgttatccaacttcttaatcataccaaacaaggagacccagcatggcgtat

SEQ ID NO: 437391 - DNA, 140 bp, Artificial Sequence
  Synthetic
atacgccatgctgggtctcctgtgttaaatgccataatgatatattggcagcaacagaccccagtgaggctttcgagaaattcgtaagtctctttgccactttaatgactttttctggtacgtacttgggagtcggccat

SEQ ID NO: 437392 - DNA, 140 bp, Artificial Sequence
  Synthetic
atggccgactcccaagtacgtaccagaaaaagtcattaaagtggcaaagagacttacgaatttctcgaaagcctcactggggtctgttgctgccaatatatcattatggcatttaacacaggagacccagcatggcgtat

SEQ ID NO: 437393 - DNA, 140 bp, Artificial Sequence
  Synthetic
atacgccatgctgggtctccagttgttgttaataatttagacaagagtgctggccatccttttaacaagtttggcaaagcccgcgtctattatgagagcatgtcttatcaggagcaagatcgtacttgggagtcggccat

SEQ ID NO: 437394 - DNA, 140 bp, Artificial Sequence
  Synthetic
atggccgactcccaagtacgatcttgctcctgataagacatgctctcataatagacgcgggctttgccaaacttgttaaaaggatggccagcactcttgtctaaattattaacaacaactggagacccagcatggcgtat

SEQ ID NO: 437395 - DNA, 140 bp, Artificial Sequence
  Synthetic
atacgccatgctgggtctccatgtagatcttgatgcgttagctagtgatatttttgacactcctagcgtacttcaagctactctttctgagttttcacacttagctacctttgctgagttcgtacttgggagtcggccat

SEQ ID NO: 437396 - DNA, 140 bp, Artificial Sequence
  Synthetic
atggccgactcccaagtacgaactcagcaaaggtagctaagtgtgaaaactcagaaagagtagcttgaagtacgctaggagtgtcaaaaatatcactagctaacgcatcaagatctacatggagacccagcatggcgtat

SEQ ID NO: 437397 - DNA, 140 bp, Artificial Sequence
  Synthetic
atacgccatgctgggtctccatctattaacaatgtggataatgaaattatcaaatcctcagatgtttcagaaaacaatgagcatttgacatggccacttgtattggaatgcactagagctcgtacttgggagtcggccat

SEQ ID NO: 437398 - DNA, 140 bp, Artificial Sequence
  Synthetic
atggccgactcccaagtacgagctctagtgcattccaatacaagtggccatgtcaaatgctcattgttttctgaaacatctgaggatttgataatttcattatccacattgttaatagatggagacccagcatggcgtat

SEQ ID NO: 437399 - DNA, 140 bp, Artificial Sequence
  Synthetic
atacgccatgctgggtctccggaagctgcgcagaaagcctatcaggaagctatggactctggtgacacctcaccacaagttcttaaggctttgcagaaggctgttaatatagctaaaaaccgtacttgggagtcggccat

SEQ ID NO: 437400 - DNA, 140 bp, Artificial Sequence
  Synthetic
atggccgactcccaagtacggtttttagctatattaacagccttctgcaaagccttaagaacttgtggtgaggtgtcaccagagtccatagcttcctgataggctttctgcgcagcttccggagacccagcatggcgtat

SEQ ID NO: 437401 - DNA, 140 bp, Artificial Sequence
  Synthetic
atacgccatgctgggtctccgcagcttctgcagttaaattgcaaaataatgagattaggccgacggggcttaaaactatggttgtaacggctggtttagatcagacgtcgtttaatataacgtacttgggagtcggccat

SEQ ID NO: 437402 - DNA, 140 bp, Artificial Sequence
  Synthetic
atggccgactcccaagtacgttatattaaacgacgtctgatctaaaccagccgttacaaccatagttttaagccccgtcggcctaatctcattattttgcaatttaactgcagaagctgcggagacccagcatggcgtat

SEQ ID NO: 437403 - DNA, 140 bp, Artificial Sequence
  Synthetic
atacgccatgctgggtctccgcctatgagaaggataaggcagtggcccgtaagttagaacgtatggctgatcaggctatgacttctatgtataagcaagcacgtgctgaagacaagaaagcgtacttgggagtcggccat

SEQ ID NO: 437404 - DNA, 140 bp, Artificial Sequence
  Synthetic
atggccgactcccaagtacgctttcttgtcttcagcacgtgcttgcttatacatagaagtcatagcctgatcagccatacgttctaacttacgggccactgccttatccttctcataggcggagacccagcatggcgtat

SEQ ID NO: 437405 - DNA, 140 bp, Artificial Sequence
  Synthetic
atacgccatgctgggtctccactccttagcttattatgagcctattcaaggtcgtaagatgctaatgggtcttttgtctgaaaatgcataccttaagtatgctaaagttgaaagtcaggacgtacttgggagtcggccat

SEQ ID NO: 437406 - DNA, 140 bp, Artificial Sequence
  Synthetic
atggccgactcccaagtacgtcctgactttcaactttagcatacttaaggtatgcattttcagacaaaagacccattagcatcttacgaccttgaataggctcataataagctaaggagtggagacccagcatggcgtat

SEQ ID NO: 437407 - DNA, 140 bp, Artificial Sequence
  Synthetic
atacgccatgctgggtctcccaaaaattgtcagtgctatgcaaactatgttgtttggtatgattaagaagctcgacaacgatgttcttaatggtatcatttctaacgctaggaatggttgcgtacttgggagtcggccat

SEQ ID NO: 437408 - DNA, 140 bp, Artificial Sequence
  Synthetic
atggccgactcccaagtacgcaaccattcctagcgttagaaatgataccattaagaacatcgttgtcgagcttcttaatcataccaaacaacatagtttgcatagcactgacaatttttgggagacccagcatggcgtat

SEQ ID NO: 437409 - DNA, 140 bp, Artificial Sequence
  Synthetic
atacgccatgctgggtctccgcggagcacctattaagaaagtcacttttggcgatgaggaagtacacgaagtggctgcaacaagaagtgttacagtcaagtacaacattcatgctgtgctcgtacttgggagtcggccat

SEQ ID NO: 437410 - DNA, 140 bp, Artificial Sequence
  Synthetic
atggccgactcccaagtacgagcacagcatgaatgttgtacttgactgtaacacttcttgttgcagccacttcgtgtacttcctcatcgccaaaagtgactttcttaataggtgctccgcggagacccagcatggcgtat

SEQ ID NO: 437411 - DNA, 140 bp, Artificial Sequence
  Synthetic
aggccctggctgctgatatgtaattcctgacttcaccgtctggaatcaggtagtcacatatccctcgcttaactacgctggggctttgtgggacattacagttataaacaatgtggacaagaccttttgggacagcggtg

SEQ ID NO: 437412 - DNA, 140 bp, Artificial Sequence
  Synthetic
caccgctgtcccaaaaggtcttgtccacattgtttataactgtaatgtcccacaaagccccagcgtagttaagcgagggatatgtgactacctgattccagacggtgaagtcaggaattacatatcagcagccagggcct

SEQ ID NO: 437413 - DNA, 140 bp, Artificial Sequence
  Synthetic
aggccctggctgctgatatgcctaaggagcagcgtgtgcaaggtagcatcactcagcgcactcgcacccgtccaagtgttcagcctggtccaatgattgatgttaacactgattagtgtcgaccttttgggacagcggtg

SEQ ID NO: 437414 - DNA, 140 bp, Artificial Sequence
  Synthetic
caccgctgtcccaaaaggtcgacactaatcagtgttaacatcaatcattggaccaggctgaacacttggacgggtgcgagtgcgctgagtgatgctaccttgcacacgctgctccttaggcatatcagcagccagggcct

SEQ ID NO: 437415 - DNA, 140 bp, Artificial Sequence
  Synthetic
atacgccatgctgggtctcctgaaattgttaagtcttcagatgttgtagacagcaatgaaaatttaacatggccacttgttttagaatgcactagggcatccacttctgccgttaagttgcgtacttgggagtcggccat

SEQ ID NO: 437416 - DNA, 140 bp, Artificial Sequence
  Synthetic
atggccgactcccaagtacgcaacttaacggcagaagtggatgccctagtgcattctaaaacaagtggccatgttaaattttcattgctgtctacaacatctgaagacttaacaatttcaggagacccagcatggcgtat

SEQ ID NO: 437417 - DNA, 140 bp, Artificial Sequence
  Synthetic
aggccctggctgctgatatgggccacttgttttagaatgcactagggcatccacttctgccgttaagttgcaaaataatgagatcaaaccttcaggtttaaaaaccatggttgtgtctgcgaccttttgggacagcggtg

SEQ ID NO: 437418 - DNA, 140 bp, Artificial Sequence
  Synthetic
caccgctgtcccaaaaggtcgcagacacaaccatggtttttaaacctgaaggtttgatctcattattttgcaacttaacggcagaagtggatgccctagtgcattctaaaacaagtggcccatatcagcagccagggcct

SEQ ID NO: 437419 - DNA, 140 bp, Artificial Sequence
  Synthetic
atacgccatgctgggtctcctggtacgggtattgcgatatctgtcaagcctgagagtaatgcagatcaagaaacttacggtggtgcttcagtatgtctttattgccgtgcgcatatagagcgtacttgggagtcggccat

SEQ ID NO: 437420 - DNA, 140 bp, Artificial Sequence
  Synthetic
atggccgactcccaagtacgctctatatgcgcacggcaataaagacatactgaagcaccaccgtaagtttcttgatctgcattactctcaggcttgacagatatcgcaatacccgtaccaggagacccagcatggcgtat

SEQ ID NO: 437421 - DNA, 140 bp, Artificial Sequence
  Synthetic
atacgccatgctgggtctccaggtcaagagcaaactaactgtaatactagttccttagcttattacgaacctgtgcagggtcgtaaaatgctgatggctcttctttctgataatgcctatcgtacttgggagtcggccat

SEQ ID NO: 437422 - DNA, 140 bp, Artificial Sequence
  Synthetic
atggccgactcccaagtacgataggcattatcagaaagaagagccatcagcattttacgaccctgcacaggttcgtaataagctaaggaactagtattacagttagtttgctcttgacctggagacccagcatggcgtat

SEQ ID NO: 437423 - DNA, 140 bp, Artificial Sequence
  Synthetic
aggccctggctgctgatatgctgtgcagggtcgtaaaatgctgatggctcttctttctgataatgcctatctcaaatgggcgcgtgttgaaggtaaggacggatttgttagtgtagagctgaccttttgggacagcggtg

SEQ ID NO: 437424 - DNA, 140 bp, Artificial Sequence
  Synthetic
caccgctgtcccaaaaggtcagctctacactaacaaatccgtccttaccttcaacacgcgcccatttgagataggcattatcagaaagaagagccatcagcattttacgaccctgcacagcatatcagcagccagggcct

SEQ ID NO: 437425 - DNA, 140 bp, Artificial Sequence
  Synthetic
atacgccatgctgggtctccccaatacactccttgtcttggccttgccgctaatggatttgagaagagctatcaaacccatcgcgaccctgtgtctaagcttgccgtcacaggtgtcgtccgtacttgggagtcggccat

SEQ ID NO: 437426 - DNA, 140 bp, Artificial Sequence
  Synthetic
atggccgactcccaagtacggacgacacctgtgacggcaagcttagacacagggtcgcgatgggtttgatagctcttctcaaatccattagcggcaaggccaagacaaggagtgtattggggagacccagcatggcgtat

SEQ ID NO: 437427 - DNA, 140 bp, Artificial Sequence
  Synthetic
aggccctggctgctgatatgacaacctccttgcaaattcttgattgcgggaccaaaaggacctgaaatccgatatctctattttgttaaaaatcttaacaaccttcatcgcgggcaagtggaccttttgggacagcggtg

SEQ ID NO: 437428 - DNA, 140 bp, Artificial Sequence
  Synthetic
caccgctgtcccaaaaggtccacttgcccgcgatgaaggttgttaagatttttaacaaaatagagatatcggatttcaggtccttttggtcccgcaatcaagaatttgcaaggaggttgtcatatcagcagccagggcct

SEQ ID NO: 437429 - DNA, 140 bp, Artificial Sequence
  Synthetic
atacgccatgctgggtctccttagggcacattgctgcgactgttagattgcaagctggttctaacaccgagtttgcctctaattcttcggtgttgtcacttgttaacttcaccgttgatccgtacttgggagtcggccat

SEQ ID NO: 437430 - DNA, 140 bp, Artificial Sequence
  Synthetic
atggccgactcccaagtacggatcaacggtgaagttaacaagtgacaacaccgaagaattagaggcaaactcggtgttagaaccagcttgcaatctaacagtcgcagcaatgtgccctaaggagacccagcatggcgtat

SEQ ID NO: 437431 - DNA, 140 bp, Artificial Sequence
  Synthetic
aggccctggctgctgatatggtttgcctctaattcttcggtgttgtcacttgttaacttcaccgttgatcctcaaaaagcttatctcgatttcgtcaatgcgggaggtgccccattgacagaccttttgggacagcggtg

SEQ ID NO: 437432 - DNA, 140 bp, Artificial Sequence
  Synthetic
caccgctgtcccaaaaggtctgtcaatggggcacctcccgcattgacgaaatcgagataagctttttgaggatcaacggtgaagttaacaagtgacaacaccgaagaattagaggcaaaccatatcagcagccagggcct

SEQ ID NO: 437433 - DNA, 140 bp, Artificial Sequence
  Synthetic
atacgccatgctgggtctccctcaaaaagcttatctcgatttcgtcaatgcgggaggtgccccattgacaaattgtgttaagatgcttactcctaaaactggtacaggtatagctatatccgtacttgggagtcggccat

SEQ ID NO: 437434 - DNA, 140 bp, Artificial Sequence
  Synthetic
atggccgactcccaagtacggatatagctatacctgtaccagttttaggagtaagcatcttaacacaatttgtcaatggggcacctcccgcattgacgaaatcgagataagctttttgagggagacccagcatggcgtat

SEQ ID NO: 437435 - DNA, 140 bp, Artificial Sequence
  Synthetic
atacgccatgctgggtctcctgttaaaccagagagtacagctgatcaagagacttatggtggagcttcagtgtgtctctattgccgtgcgcatatagaacatcctgatgtctctggtgttcgtacttgggagtcggccat

SEQ ID NO: 437436 - DNA, 140 bp, Artificial Sequence
  Synthetic
atggccgactcccaagtacgaacaccagagacatcaggatgttctatatgcgcacggcaatagagacacactgaagctccaccataagtctcttgatcagctgtactctctggtttaacaggagacccagcatggcgtat

SEQ ID NO: 437437 - DNA, 140 bp, Artificial Sequence
  Synthetic
aggccctggctgctgatatgtgtgtctctattgccgtgcgcatatagaacatcctgatgtctctggtgtttgtaaatataagggtaagtttgtccaaatccctgctcagtgtgtccgtgagaccttttgggacagcggtg

SEQ ID NO: 437438 - DNA, 140 bp, Artificial Sequence
  Synthetic
caccgctgtcccaaaaggtctcacggacacactgagcagggatttggacaaacttacccttatatttacaaacaccagagacatcaggatgttctatatgcgcacggcaatagagacacacatatcagcagccagggcct

SEQ ID NO: 437439 - DNA, 140 bp, Artificial Sequence
  Synthetic
atacgccatgctgggtctccaaagtcaaaactccccatatagtccgtcaaaggcttactgagtatactatgatggatcttgtctatgcattacggcacttcgatcagaataactgcgaagcgtacttgggagtcggccat

SEQ ID NO: 437440 - DNA, 140 bp, Artificial Sequence
  Synthetic
atggccgactcccaagtacgcttcgcagttattctgatcgaagtgccgtaatgcatagacaagatccatcatagtatactcagtaagcctttgacggactatatggggagttttgactttggagacccagcatggcgtat

SEQ ID NO: 437441 - DNA, 140 bp, Artificial Sequence
  Synthetic
atacgccatgctgggtctccccctgtgggattttgtttgtcaaataccccctgtaatgtctgtcaatattggattggatatgggtgcaattgtgactcgcttaggcaagcagcactgccccgtacttgggagtcggccat

SEQ ID NO: 437442 - DNA, 140 bp, Artificial Sequence
  Synthetic
atggccgactcccaagtacggggcagtgctgcttgcctaagcgagtcacaattgcacccatatccaatccaatattgacagacattacagggggtatttgacaaacaaaatcccacagggggagacccagcatggcgtat

SEQ ID NO: 437443 - DNA, 140 bp, Artificial Sequence
  Synthetic
aggccctggctgctgatatgggattggatatgggtgcaattgtgactcgcttaggcaagcagcactgccccaatctaaagattccaattttttaaacgagtccggggttctattgtaaatgaccttttgggacagcggtg

SEQ ID NO: 437444 - DNA, 140 bp, Artificial Sequence
  Synthetic
caccgctgtcccaaaaggtcatttacaatagaaccccggactcgtttaaaaaattggaatctttagattggggcagtgctgcttgcctaagcgagtcacaattgcacccatatccaatcccatatcagcagccagggcct

SEQ ID NO: 437445 - DNA, 140 bp, Artificial Sequence
  Synthetic
atacgccatgctgggtctccgcccgaatagaaccctgttcaagtggtttgtccactgatgtcgtctttagggcatttgacatctgcaactataaggctaaggttgctggtattggaaaatcgtacttgggagtcggccat

SEQ ID NO: 437446 - DNA, 140 bp, Artificial Sequence
  Synthetic
atggccgactcccaagtacgattttccaataccagcaaccttagccttatagttgcagatgtcaaatgccctaaagacgacatcagtggacaaaccacttgaacagggttctattcgggcggagacccagcatggcgtat

SEQ ID NO: 437447 - DNA, 140 bp, Artificial Sequence
  Synthetic
atacgccatgctgggtctccactacaagactaatacttgtaggtttgtagaattagatgaccaagggcatcatttagactcctattttgtcgttaagaggcatactatggagaattatgacgtacttgggagtcggccat

SEQ ID NO: 437448 - DNA, 140 bp, Artificial Sequence
  Synthetic
atggccgactcccaagtacgtcataattctccatagtatgcctcttaacgacaaaataggagtctaaatgatgcccttggtcatctaattctacaaacctacaagtattagtcttgtagtggagacccagcatggcgtat

SEQ ID NO: 437449 - DNA, 140 bp, Artificial Sequence
  Synthetic
aggccctggctgctgatatggctcgtgatggcgtaaggcgaggcgataacttccatagtgtcttaacaacattcattgacgcagcacgaggccccgcaggtgtggagtctgatgttgagagaccttttgggacagcggtg

SEQ ID NO: 437450 - DNA, 140 bp, Artificial Sequence
  Synthetic
caccgctgtcccaaaaggtctctcaacatcagactccacacctgcggggcctcgtgctgcgtcaatgaatgttgttaagacactatggaagttatcgcctcgccttacgccatcacgagccatatcagcagccagggcct

SEQ ID NO: 437451 - DNA, 140 bp, Artificial Sequence
  Synthetic
atacgccatgctgggtctccactagagaagcactgttacgatttgttacgtgactgtgatgctgtagctccccatgatttcttcatctttgatgtagacaaagttaaaacacctcatattcgtacttgggagtcggccat

SEQ ID NO: 437452 - DNA, 140 bp, Artificial Sequence
  Synthetic
atggccgactcccaagtacgaatatgaggtgttttaactttgtctacatcaaagatgaagaaatcatggggagctacagcatcacagtcacgtaacaaatcgtaacagtgcttctctagtggagacccagcatggcgtat

SEQ ID NO: 437453 - DNA, 140 bp, Artificial Sequence
  Synthetic
atacgccatgctgggtctccgacaatcaagacttaaacggcctctggtatgattttggtgattttgttatcacacaacctggttctggagtagctgtcgtagatagttactattcttattcgtacttgggagtcggccat

SEQ ID NO: 437454 - DNA, 140 bp, Artificial Sequence
  Synthetic
atggccgactcccaagtacgaataagaatagtaactatctacgacagctactccagaaccaggttgtgtgataacaaaatcaccaaaatcataccagaggccgtttaagtcttgattgtcggagacccagcatggcgtat

SEQ ID NO: 437455 - DNA, 140 bp, Artificial Sequence
  Synthetic
atacgccatgctgggtctccgtacgtcagcgtttaactgagtacactatgatggatcttgtatatgccctgaggcactttgatcaaaatagcgaagtgcttaaggctatcttagtgaagtcgtacttgggagtcggccat

SEQ ID NO: 437456 - DNA, 140 bp, Artificial Sequence
  Synthetic
atggccgactcccaagtacgacttcactaagatagccttaagcacttcgctattttgatcaaagtgcctcagggcatatacaagatccatcatagtgtactcagttaaacgctgacgtacggagacccagcatggcgtat

SEQ ID NO: 437457 - DNA, 140 bp, Artificial Sequence
  Synthetic
atacgccatgctgggtctccttatcacaagcttggcgagcgtattcgcaaagctgttttaaacactgtaaaattttgtgaccagatggtgtctgcaggtcttgtaggagttctaacactccgtacttgggagtcggccat

SEQ ID NO: 437458 - DNA, 140 bp, Artificial Sequence
  Synthetic
atggccgactcccaagtacggagtgttagaactcctacaagacctgcagacaccatctggtcacaaaattttacagtgtttaaaacagctttgcgaatacgctcgccaagcttgtgataaggagacccagcatggcgtat

SEQ ID NO: 437459 - DNA, 140 bp, Artificial Sequence
  Synthetic
atacgccatgctgggtctccatggttgctgtgatgttacctactttgaaaataaactctggtttgattttgttgaaaatcccagtgttattggtgtttatcataaacttggagaacgtgtcgtacttgggagtcggccat

SEQ ID NO: 437460 - DNA, 140 bp, Artificial Sequence
  Synthetic
atggccgactcccaagtacgacacgttctccaagtttatgataaacaccaataacactgggattttcaacaaaatcaaaccagagtttattttcaaagtaggtaacatcacagcaaccatggagacccagcatggcgtat

SEQ ID NO: 437461 - DNA, 140 bp, Artificial Sequence
  Synthetic
atacgccatgctgggtctcctcgcaagagcttgccatgcggtctcagggtgatgcatcaacgcaggttcaggctcagcctcaatctgttgctgctgcacaacctgaggtacctgtgggagcgtacttgggagtcggccat

SEQ ID NO: 437462 - DNA, 140 bp, Artificial Sequence
  Synthetic
atggccgactcccaagtacgctcccacaggtacctcaggttgtgcagcagcaacagattgaggctgagcctgaacctgcgttgatgcatcaccctgagaccgcatggcaagctcttgcgaggagacccagcatggcgtat

SEQ ID NO: 437463 - DNA, 140 bp, Artificial Sequence
  Synthetic
atacgccatgctgggtctccacgccaagctatcttaaacactgttaaattttgtgaccacatggtcaaggctggtttagtcggtgtgctcacactagacaaccaggaccttaatggcaagcgtacttgggagtcggccat

SEQ ID NO: 437464 - DNA, 140 bp, Artificial Sequence
  Synthetic
atggccgactcccaagtacgcttgccattaaggtcctggttgtctagtgtgagcacaccgactaaaccagccttgaccatgtggtcacaaaatttaacagtgtttaagatagcttggcgtggagacccagcatggcgtat

SEQ ID NO: 437465 - DNA, 140 bp, Artificial Sequence
  Synthetic
aggccctggctgctgatatgaacgctgctgcatatatgaaactctcggatgcacttaaacgacagattcgcattgcatgccgtaagtgtaatttagctttccgatgtaggagatccagcagaccttttgggacagcggtg

SEQ ID NO: 437466 - DNA, 140 bp, Artificial Sequence
  Synthetic
caccgctgtcccaaaaggtctgctggatctcctacatcggaaagctaaattacacttacggcatgcaatgcgaatctgtcgtttaagtgcatccgagagtttcatatatgcagcagcgttcatatcagcagccagggcct

SEQ ID NO: 437467 - DNA, 140 bp, Artificial Sequence
  Synthetic
atacgccatgctgggtctcctggtatgattttggtgacttcgtaatcactcaacctggttcaggagtagctatagttgatagctactattcttatttgatgcctgtgctctcaatgaccgcgtacttgggagtcggccat

SEQ ID NO: 437468 - DNA, 140 bp, Artificial Sequence
  Synthetic
atggccgactcccaagtacgcggtcattgagagcacaggcatcaaataagaatagtagctatcaactatagctactcctgaaccaggttgagtgattacgaagtcaccaaaatcataccaggagacccagcatggcgtat

SEQ ID NO: 437469 - DNA, 140 bp, Artificial Sequence
  Synthetic
atacgccatgctgggtctccattgtctggccgctgagacacatagggattgtgattttaataaaccactcattgagtggccacttactgagtatgattttactgattataaggtacaactcgtacttgggagtcggccat

SEQ ID NO: 437470 - DNA, 140 bp, Artificial Sequence
  Synthetic
atggccgactcccaagtacgagttgtaccttataatcagtaaaatcatactcagtaagtggccactcaatgagtggtttattaaaatcacaatccctatgtgtctcagcggccagacaatggagacccagcatggcgtat

SEQ ID NO: 437471 - DNA, 140 bp, Artificial Sequence
  Synthetic
aggccctggctgctgatatgatcctttagtgaactactttttgattgcgttgatctttcagtagcttctacctattttttagtccgccggcagggagtctctaatattcccatcgggaacgaccttttgggacagcggtg

SEQ ID NO: 437472 - DNA, 140 bp, Artificial Sequence
  Synthetic
caccgctgtcccaaaaggtcgttcccgatgggaatattagagactccctgccggcggactaaaaaataggtagaagctactgaaagatcaacgcaatcaaaaagtagttcactaaaggatcatatcagcagccagggcct

SEQ ID NO: 437473 - DNA, 140 bp, Artificial Sequence
  Synthetic
atacgccatgctgggtctcctctttgctcaggatgggcatgctgctattacagattataactattattcttataatctgcctactatgtgtgacatcaagcagatgttattctgtatggacgtacttgggagtcggccat

SEQ ID NO: 437474 - DNA, 140 bp, Artificial Sequence
  Synthetic
atggccgactcccaagtacgtccatacagaataacatctgcttgatgtcacacatagtaggcagattataagaataatagttataatctgtaatagcagcatgcccatcctgagcaaagaggagacccagcatggcgtat

SEQ ID NO: 437475 - DNA, 140 bp, Artificial Sequence
  Synthetic
atacgccatgctgggtctccggttgttaacaaatacttcgaaatctatgatggcggttgccttaatgcttccgaagttgtagttaacaatttagataaaagcgctggctatccttttaaccgtacttgggagtcggccat

SEQ ID NO: 437476 - DNA, 140 bp, Artificial Sequence
  Synthetic
atggccgactcccaagtacggttaaaaggatagccagcgcttttatctaaattgttaactacaacttcggaagcattaaggcaaccgccatcatagatttcgaagtatttgttaacaaccggagacccagcatggcgtat

SEQ ID NO: 437477 - DNA, 140 bp, Artificial Sequence
  Synthetic
aggccctggctgctgatatggatctttgttgatggcgtgccatttgtagtatcttgtggttatcactacaaagaattaggtttagtcatgaatatggatgttagtctccatagacatagggaccttttgggacagcggtg

SEQ ID NO: 437478 - DNA, 140 bp, Artificial Sequence
  Synthetic
caccgctgtcccaaaaggtccctatgtctatggagactaacatccatattcatgactaaacctaattctttgtagtgataaccacaagatactacaaatggcacgccatcaacaaagatccatatcagcagccagggcct

SEQ ID NO: 437479 - DNA, 140 bp, Artificial Sequence
  Synthetic
atacgccatgctgggtctccaagtttggtaaggcccgcgtttattatgagagtatgtcatatcaggagcaggacgagttgtttgctatgaccaaacgcaacgtcattcctaccattactccgtacttgggagtcggccat

SEQ ID NO: 437480 - DNA, 140 bp, Artificial Sequence
  Synthetic
atggccgactcccaagtacggagtaatggtaggaatgacgttgcgtttggtcatagcaaacaactcgtcctgctcctgatatgacatactctcataataaacgcgggccttaccaaacttggagacccagcatggcgtat

SEQ ID NO: 437481 - DNA, 140 bp, Artificial Sequence
  Synthetic
aggccctggctgctgatatgctctctcttaaggagttgatgatgtatgccgctgatccagccatgcacattgcctcctctaacgcttttcttgatttgaggacatcatgttttagtgtcggaccttttgggacagcggtg

SEQ ID NO: 437482 - DNA, 140 bp, Artificial Sequence
  Synthetic
caccgctgtcccaaaaggtccgacactaaaacatgatgtcctcaaatcaagaaaagcgttagaggaggcaatgtgcatggctggatcagcggcatacatcatcaactccttaagagagagcatatcagcagccagggcct

SEQ ID NO: 437483 - DNA, 140 bp, Artificial Sequence
  Synthetic
atacgccatgctgggtctccagatgaatttaaaatatgctattagtgctaaaaatcgtgctcgcactgttgcaggcgtctctattcttagcaccatgactaatcgccagtaccaccaaaacgtacttgggagtcggccat

SEQ ID NO: 437484 - DNA, 140 bp, Artificial Sequence
  Synthetic
atggccgactcccaagtacgttttggtggtactggcgattagtcatggtgctaagaatagagacgcctgcaacagtgcgagcacgatttttagcactaatagcatattttaaattcatctggagacccagcatggcgtat

SEQ ID NO: 437485 - DNA, 140 bp, Artificial Sequence
  Synthetic
aggccctggctgctgatatgggaagaggagtcattctccaactaagaaactgcgctacgttaagcgtagattttctcttctgcgccctgaagaccttagtgttattgtccaaccaacacagaccttttgggacagcggtg

SEQ ID NO: 437486 - DNA, 140 bp, Artificial Sequence
  Synthetic
caccgctgtcccaaaaggtctgtgttggttggacaataacactaaggtcttcagggcgcagaagagaaaatctacgcttaacgtagcgcagtttcttagttggagaatgactcctcttcccatatcagcagccagggcct

SEQ ID NO: 437487 - DNA, 140 bp, Artificial Sequence
  Synthetic
aggccctggctgctgatatgggcgtctttatttaaacccgtccagctagtcccagtttctcctgcatttcatcgcattgagtctactgactctattgttttcacatacattcctgctagcgaccttttgggacagcggtg

SEQ ID NO: 437488 - DNA, 140 bp, Artificial Sequence
  Synthetic
caccgctgtcccaaaaggtcgctagcaggaatgtatgtgaaaacaatagagtcagtagactcaatgcgatgaaatgcaggagaaactgggactagctggacgggtttaaataaagacgcccatatcagcagccagggcct

SEQ ID NO: 437489 - DNA, 140 bp, Artificial Sequence
  Synthetic
atacgccatgctgggtctccctcttcagtgacgctcaaacattttttctttgctcaagatggtaatgctgctattacagattataattactattcttataatctgcctactatgtgtgaccgtacttgggagtcggccat

SEQ ID NO: 437490 - DNA, 140 bp, Artificial Sequence
  Synthetic
atggccgactcccaagtacggtcacacatagtaggcagattataagaatagtaattataatctgtaatagcagcattaccatcttgagcaaagaaaaaatgtttgagcgtcactgaagagggagacccagcatggcgtat

SEQ ID NO: 437491 - DNA, 140 bp, Artificial Sequence
  Synthetic
atacgccatgctgggtctccttcaggtgacgaagcctgggctagtcttgttgatgaggcatttcctatggatgacgatgaggagtccattgtagatgagcctaagcctattcagctctgtcgtacttgggagtcggccat

SEQ ID NO: 437492 - DNA, 140 bp, Artificial Sequence
  Synthetic
atggccgactcccaagtacgacagagctgaataggcttaggctcatctacaatggactcctcatcgtcatccataggaaatgcctcatcaacaagactagcccaggcttcgtcacctgaaggagacccagcatggcgtat

SEQ ID NO: 437493 - DNA, 140 bp, Artificial Sequence
  Synthetic
atacgccatgctgggtctccatcaaacaaatgttgttctgcatggaagttgtaaacaagtacttcgaaatctatgacggtggttgtcttaatgcttctgaagtggttgttaataatttagcgtacttgggagtcggccat

SEQ ID NO: 437494 - DNA, 140 bp, Artificial Sequence
  Synthetic
atggccgactcccaagtacgctaaattattaacaaccacttcagaagcattaagacaaccaccgtcatagatttcgaagtacttgtttacaacttccatgcagaacaacatttgtttgatggagacccagcatggcgtat

SEQ ID NO: 437495 - DNA, 140 bp, Artificial Sequence
  Synthetic
atacgccatgctgggtctccaacatggcacttgctgcactaccagagatagattttatcgcttagccaatgagtgcgctcaggttttaagtgagtatgtgttatgcggtggtggctactacgtacttgggagtcggccat

SEQ ID NO: 437496 - DNA, 140 bp, Artificial Sequence
  Synthetic
atggccgactcccaagtacgtagtagccaccaccgcataacacatactcacttaaaacctgagcgcactcattggctaagcgataaaatctatctctggtagtgcagcaagtgccatgttggagacccagcatggcgtat

SEQ ID NO: 437497 - DNA, 140 bp, Artificial Sequence
  Synthetic
atacgccatgctgggtctccacaagagtgctggccatccttttaataagtttggcaaagctcgtgtctattatgagagcatgtcttaccaggagcaagatgaactctttgccatgacaaacgtacttgggagtcggccat

SEQ ID NO: 437498 - DNA, 140 bp, Artificial Sequence
  Synthetic
atggccgactcccaagtacgtttgtcatggcaaagagttcatcttgctcctggtaagacatgctctcataatagacacgagctttgccaaacttattaaaaggatggccagcactcttgtggagacccagcatggcgtat

SEQ ID NO: 437499 - DNA, 140 bp, Artificial Sequence
  Synthetic
atacgccatgctgggtctcccgtcaagccaggaggtacgagtagtggtgatgccacaaccgcatatgccaatagtgtgtttaacattttgcaggcgacaactgctaatgtgagcgcacttcgtacttgggagtcggccat

SEQ ID NO: 437500 - DNA, 140 bp, Artificial Sequence
  Synthetic
atggccgactcccaagtacgaagtgcgctcacattagcagttgtcgcctgcaaaatgttaaacacactattggcatatgcggttgtggcatcaccactactcgtacctcctggcttgacgggagacccagcatggcgtat

SEQ ID NO: 437501 - DNA, 140 bp, Artificial Sequence
  Synthetic
atacgccatgctgggtctccgcgtaacgtcattcctaccatgactcaaatgaatctaaaatatgctattagtgctaagaatagagctcgcactgttgcaggcgtgtccatacttagcacacgtacttgggagtcggccat

SEQ ID NO: 437502 - DNA, 140 bp, Artificial Sequence
  Synthetic
atggccgactcccaagtacgtgtgctaagtatggacacgcctgcaacagtgcgagctctattcttagcactaatagcatattttagattcatttgagtcatggtaggaatgacgttacgcggagacccagcatggcgtat

SEQ ID NO: 437503 - DNA, 140 bp, Artificial Sequence
  Synthetic
atacgccatgctgggtctccatgggtgctaatggcaacaagattgttgataaagaaattagagacatgcagtttgatctgtatgttaatgtttatagacgtaatatgcctgatcaaaagtcgtacttgggagtcggccat

SEQ ID NO: 437504 - DNA, 140 bp, Artificial Sequence
  Synthetic
atggccgactcccaagtacgacttttgatcaggcatattacgtctataaacattaacatacagatcaaactgcatgtctctaatttctttatcaacaatcttgttgccattagcacccatggagacccagcatggcgtat

SEQ ID NO: 437505 - DNA, 140 bp, Artificial Sequence
  Synthetic
atacgccatgctgggtctccatgactaatcgccagtaccatcagaaaatgcttaagtccatggctgcaactcgtggagcgacttgcgtcattggtactacaaagttctatggtggctgggcgtacttgggagtcggccat

SEQ ID NO: 437506 - DNA, 140 bp, Artificial Sequence
  Synthetic
atggccgactcccaagtacgcccagccaccatagaactttgtagtaccaatgacgcaagtcgctccacgagttgcagccatggacttaagcattttctgatggtactggcgattagtcatggagacccagcatggcgtat

SEQ ID NO: 437507 - DNA, 140 bp, Artificial Sequence
  Synthetic
aggccctggctgctgatatgtcgtggagcgacttgcgtcattggtactacaaagttctatggtggctgggatttcatgcttaaaacattgtacaaagatgttgataatccgcatcttatggaccttttgggacagcggtg

SEQ ID NO: 437508 - DNA, 140 bp, Artificial Sequence
  Synthetic
caccgctgtcccaaaaggtccataagatgcggattatcaacatctttgtacaatgttttaagcatgaaatcccagccaccatagaactttgtagtaccaatgacgcaagtcgctccacgacatatcagcagccagggcct

SEQ ID NO: 437509 - DNA, 140 bp, Artificial Sequence
  Synthetic
atacgccatgctgggtctccggttgggattaccctaagtgtgatagagctatgcctaatatgtgtagaatcttcgcttcactcatattagctcgtaaacatggcacttgttgtactacaacgtacttgggagtcggccat

SEQ ID NO: 437510 - DNA, 140 bp, Artificial Sequence
  Synthetic
atggccgactcccaagtacgttgtagtacaacaagtgccatgtttacgagctaatatgagtgaagcgaagattctacacatattaggcatagctctatcacacttagggtaatcccaaccggagacccagcatggcgtat

SEQ ID NO: 437511 - DNA, 140 bp, Artificial Sequence
  Synthetic
aggccctggctgctgatatgaggctctgggagctatgcaaacaggcttcactacaactaatgaagcttttcggaaggttcaggatgctgtgaacaacaatgcacaggctctatccaaattgaccttttgggacagcggtg

SEQ ID NO: 437512 - DNA, 140 bp, Artificial Sequence
  Synthetic
caccgctgtcccaaaaggtcaatttggatagagcctgtgcattgttgttcacagcatcctgaaccttccgaaaagcttcattagttgtagtgaagcctgtttgcatagctcccagagcctcatatcagcagccagggcct

SEQ ID NO: 437513 - DNA, 140 bp, Artificial Sequence
  Synthetic
atacgccatgctgggtctccgggacagattttatcgcttggcaaatgagtgtgctcaggtgctaagcgaatatgttctatgtggtggtggttactacgtcaaacctggaggtaccagtagcgtacttgggagtcggccat

SEQ ID NO: 437514 - DNA, 140 bp, Artificial Sequence
  Synthetic
atggccgactcccaagtacgctactggtacctccaggtttgacgtagtaaccaccaccacatagaacatattcgcttagcacctgagcacactcatttgccaagcgataaaatctgtcccggagacccagcatggcgtat

SEQ ID NO: 437515 - DNA, 140 bp, Artificial Sequence
  Synthetic
atacgccatgctgggtctcccggagatgccaccactgcatatgccaatagtgtctttaacattttgcaggcgacaactgctaatgtcagtgcacttatgggtgctaatggcaacaagattcgtacttgggagtcggccat

SEQ ID NO: 437516 - DNA, 140 bp, Artificial Sequence
  Synthetic
atggccgactcccaagtacgaatcttgttgccattagcacccataagtgcactgacattagcagttgtcgcctgcaaaatgttaaagacactattggcatatgcagtggtggcatctccgggagacccagcatggcgtat

SEQ ID NO: 437517 - DNA, 140 bp, Artificial Sequence
  Synthetic
atacgccatgctgggtctccgttgacaaagaagttaaagacatgcagtttgatttgtatgtcaatgtttacaggagcactagcccagaccccaaatttgttgataaatactatgcttttccgtacttgggagtcggccat

SEQ ID NO: 437518 - DNA, 140 bp, Artificial Sequence
  Synthetic
atggccgactcccaagtacggaaaagcatagtatttatcaacaaatttggggtctgggctagtgctcctgtaaacattgacatacaaatcaaactgcatgtctttaacttctttgtcaacggagacccagcatggcgtat

SEQ ID NO: 437519 - DNA, 140 bp, Artificial Sequence
  Synthetic
atacgccatgctgggtctccaccgtagcttgtgctattatacttttagtttgtatggcattccttacggccacgcgattatgtgtgcagtgtgcaatagggctcaatgctctgttagttccgtacttgggagtcggccat

SEQ ID NO: 437520 - DNA, 140 bp, Artificial Sequence
  Synthetic
atggccgactcccaagtacggaactaacagagcattgagccctattgcacactgcacacataatcgcgtggccgtaaggaatgccatacaaactaaaagtataatagcacaagctacggtggagacccagcatggcgtat

SEQ ID NO: 437521 - DNA, 140 bp, Artificial Sequence
  Synthetic
atacgccatgctgggtctccttaataagcacttttctatgatgatactgtctgatgacggtgtcgtttgctataatagtgattatgcagctaagggttacattgctggaatacagaatttcgtacttgggagtcggccat

SEQ ID NO: 437522 - DNA, 140 bp, Artificial Sequence
  Synthetic
atggccgactcccaagtacgaaattctgtattccagcaatgtaacccttagctgcataatcactattatagcaaacgacaccgtcatcagacagtatcatcatagaaaagtgcttattaaggagacccagcatggcgtat

SEQ ID NO: 437523 - DNA, 140 bp, Artificial Sequence
  Synthetic
atacgccatgctgggtctcctaaggaaacgctgtattatcagaacaatgtctttatgtctgaagctaaatgctgggtggaaaccgatctgaagaaagggccacatgaattctgttcacagcgtacttgggagtcggccat

SEQ ID NO: 437524 - DNA, 140 bp, Artificial Sequence
  Synthetic
atggccgactcccaagtacgctgtgaacagaattcatgtggccctttcttcagatcggtttccacccagcatttagcttcagacataaagacattgttctgataatacagcgtttccttaggagacccagcatggcgtat

SEQ ID NO: 437525 - DNA, 140 bp, Artificial Sequence
  Synthetic
aggccctggctgctgatatgcagcaaacttgcgtgttgttggtcatgccatgcaaggcactcttttgaagttgactgtcgatgttgctaaccctagcactccagcctacacttttacaacgaccttttgggacagcggtg

SEQ ID NO: 437526 - DNA, 140 bp, Artificial Sequence
  Synthetic
caccgctgtcccaaaaggtcgttgtaaaagtgtaggctggagtgctagggttagcaacatcgacagtcaacttcaaaagagtgccttgcatggcatgaccaacaacacgcaagtttgctgcatatcagcagccagggcct

SEQ ID NO: 437527 - DNA, 140 bp, Artificial Sequence
  Synthetic
atacgccatgctgggtctcccatacgctttatattaaggatggcgacgatggttacttccttccttatccagacccttcaagaattttgtctgccggttgctttgtagatgatatcgttacgtacttgggagtcggccat

SEQ ID NO: 437528 - DNA, 140 bp, Artificial Sequence
  Synthetic
atggccgactcccaagtacgtaacgatatcatctacaaagcaaccggcagacaaaattcttgaagggtctggataaggaaggaagtaaccatcgtcgccatccttaatataaagcgtatgggagacccagcatggcgtat

SEQ ID NO: 437529 - DNA, 140 bp, Artificial Sequence
  Synthetic
atacgccatgctgggtctccagactgacggtacactcatggtagagcggtttgtgtctttggctatagatgcttaccctctcacaaagcatgaagatatagaataccagaatgtattctgcgtacttgggagtcggccat

SEQ ID NO: 437530 - DNA, 140 bp, Artificial Sequence
  Synthetic
atggccgactcccaagtacgcagaatacattctggtattctatatcttcatgctttgtgagagggtaagcatctatagccaaagacacaaaccgctctaccatgagtgtaccgtcagtctggagacccagcatggcgtat

SEQ ID NO: 437531 - DNA, 140 bp, Artificial Sequence
  Synthetic
atacgccatgctgggtctccggtctacttacagtatatagaaaaactgtataaagaccttacaggacacatgcttgacagttattctgtcatgctatgtggtgataattctgctaagtttcgtacttgggagtcggccat

SEQ ID NO: 437532 - DNA, 140 bp, Artificial Sequence
  Synthetic
atggccgactcccaagtacgaaacttagcagaattatcaccacatagcatgacagaataactgtcaagcatgtgtcctgtaaggtctttatacagtttttctatatactgtaagtagaccggagacccagcatggcgtat

SEQ ID NO: 437533 - DNA, 140 bp, Artificial Sequence
  Synthetic
atacgccatgctgggtctcctgggaagaggcattctatagagatctctatagttcgcctaccactttgcaggctgtcggttcatgcgttgtatgccattcacagacttccctacgctgtgcgtacttgggagtcggccat

SEQ ID NO: 437534 - DNA, 140 bp, Artificial Sequence
  Synthetic
atggccgactcccaagtacgcacagcgtagggaagtctgtgaatggcatacaacgcatgaaccgacagcctgcaaagtggtaggcgaactatagagatctctatagaatgcctcttcccaggagacccagcatggcgtat

SEQ ID NO: 437535 - DNA, 140 bp, Artificial Sequence
  Synthetic
aggccctggctgctgatatgggctgtcggttcatgcgttgtatgccattcacagacttccctacgctgtgggacatgcatccgtagaccatttctctgctgtaaatgctgctatgatcatgaccttttgggacagcggtg

SEQ ID NO: 437536 - DNA, 140 bp, Artificial Sequence
  Synthetic
caccgctgtcccaaaaggtcatgatcatagcagcatttacagcagagaaatggtctacggatgcatgtcccacagcgtagggaagtctgtgaatggcatacaacgcatgaaccgacagcccatatcagcagccagggcct

SEQ ID NO: 437537 - DNA, 140 bp, Artificial Sequence
  Synthetic
atacgccatgctgggtctccggacatgcatccgtagaccatttctctgctgtaaatgctgctatgatcatgttatagcaactccacataagatggttttgtctgtttctccttacgtttgcgtacttgggagtcggccat

SEQ ID NO: 437538 - DNA, 140 bp, Artificial Sequence
  Synthetic
atggccgactcccaagtacgcaaacgtaaggagaaacagacaaaaccatcttatgtggagttgctataacatgatcatagcagcatttacagcagagaaatggtctacggatgcatgtccggagacccagcatggcgtat

SEQ ID NO: 437539 - DNA, 140 bp, Artificial Sequence
  Synthetic
atacgccatgctgggtctcctaatgcccctggttgtggcgtttcagacgttactaagctatatttaggtggtatgagctacttttgtgtagatcatagacctgtgtgtagttttccacttcgtacttgggagtcggccat

SEQ ID NO: 437540 - DNA, 140 bp, Artificial Sequence
  Synthetic
atggccgactcccaagtacgaagtggaaaactacacacaggtctatgatctacacaaaagtagctcataccacctaaatatagcttagtaacgtctgaaacgccacaaccaggggcattaggagacccagcatggcgtat

SEQ ID NO: 437541 - DNA, 140 bp, Artificial Sequence
  Synthetic
atacgccatgctgggtctcctgcgctaatggtcttgtattcggcttatacaagaatatgtgcacaggtagtccttctatagttgaatttaataggttggctacctgtgactggactgaaacgtacttgggagtcggccat

SEQ ID NO: 437542 - DNA, 140 bp, Artificial Sequence
  Synthetic
atggccgactcccaagtacgtttcagtccagtcacaggtagccaacctattaaattcaactatagaaggactacctgtgcacatattcttgtataagccgaatacaagaccattagcgcaggagacccagcatggcgtat

SEQ ID NO: 437543 - DNA, 140 bp, Artificial Sequence
  Synthetic
atacgccatgctgggtctccggactttgttgactaggggcacgttggaacccgaaaatttcaatagtgtcactagacttatgtgtaacctaggacctgacatattcttgagtatgtgctacgtacttgggagtcggccat

SEQ ID NO: 437544 - DNA, 140 bp, Artificial Sequence
  Synthetic
atggccgactcccaagtacgtagcacatactcaagaatatgtcaggtcctaggttacacataagtctagtgacactattgaaattttcgggttccaacgtgcccctagtcaacaaagtccggagacccagcatggcgtat

SEQ ID NO: 437545 - DNA, 140 bp, Artificial Sequence
  Synthetic
atacgccatgctgggtctccgtggtgattacacccttgccaatactacaacagaaccactcaaactttttgctgctgagactttacgtgccactgaagaggcgtctaagcagtcttatgccgtacttgggagtcggccat

SEQ ID NO: 437546 - DNA, 140 bp, Artificial Sequence
  Synthetic
atggccgactcccaagtacggcataagactgcttagacgcctcttcagtggcacgtaaagtctcagcagcaaaaagtttgagtggttctgttgtagtattggcaagggtgtaatcaccacggagacccagcatggcgtat

SEQ ID NO: 437547 - DNA, 140 bp, Artificial Sequence
  Synthetic
atacgccatgctgggtctccgttcgcatgctgctgttgatgcattatgcgaaaaagcttttaagtatttgaacattggtaaatgttctcgtattatacctgccaaagcacgtgtagagtgcgtacttgggagtcggccat

SEQ ID NO: 437548 - DNA, 140 bp, Artificial Sequence
  Synthetic
atggccgactcccaagtacgcactctacacgtgctttggcaggtataatacgagaacatttaccaatgttcaaatacttaaaagctttttcgcataatgcatcaacagcagcatgcgaacggagacccagcatggcgtat

SEQ ID NO: 437549 - DNA, 140 bp, Artificial Sequence
  Synthetic
aggccctggctgctgatatggtttctgtaactgacttctccttaaacggcaatgtttccactgttttcgtgcctgcaacgcgcgattccaatcgatctagcttcccagataatctctggcgaccttttgggacagcggtg

SEQ ID NO: 437550 - DNA, 140 bp, Artificial Sequence
  Synthetic
caccgctgtcccaaaaggtcgccagagattatctgggaagctagatcgattggaatcgcgcgttgcaggcacgaaaacagtggaaacattgccgtttaaggagaagtcagttacagaaaccatatcagcagccagggcct

SEQ ID NO: 437551 - DNA, 140 bp, Artificial Sequence
  Synthetic
atacgccatgctgggtctccctatgataggtttaaagttaatgagacaaattctcagtatttgtttagtactattaatgcattaccagaaacatctgctgatattctggttgttgatgaacgtacttgggagtcggccat

SEQ ID NO: 437552 - DNA, 140 bp, Artificial Sequence
  Synthetic
atggccgactcccaagtacgttcatcaacaaccagaatatcagcagatgtttctggtaatgcattaatagtactaaacaaatactgagaatttgtctcattaactttaaacctatcatagggagacccagcatggcgtat

SEQ ID NO: 437553 - DNA, 140 bp, Artificial Sequence
  Synthetic
aggccctggctgctgatatgcgagcgcattgattatagtgatgctgtatcctacaagtctagtacaacgtataaactgactgtaggtgacatcttcgtacttacctctcactctgtggctgaccttttgggacagcggtg

SEQ ID NO: 437554 - DNA, 140 bp, Artificial Sequence
  Synthetic
caccgctgtcccaaaaggtcagccacagagtgagaggtaagtacgaagatgtcacctacagtcagtttatacgttgtactagacttgtaggatacagcatcactataatcaatgcgctcgcatatcagcagccagggcct

SEQ ID NO: 437555 - DNA, 140 bp, Artificial Sequence
  Synthetic
atacgccatgctgggtctccgttagtatgtgcactaattatgatctttcgatcattaatgcacgtattaaagctaaacacatagtctatgtaggtgaccctgcacagttgccggcacctacgtacttgggagtcggccat

SEQ ID NO: 437556 - DNA, 140 bp, Artificial Sequence
  Synthetic
atggccgactcccaagtacgtaggtgccggcaactgtgcagggtcacctacatagactatgtgtttagctttaatacgtgcattaatgatcgaaagatcataattagtgcacatactaacggagacccagcatggcgtat

SEQ ID NO: 437557 - DNA, 140 bp, Artificial Sequence
  Synthetic
aggccctggctgctgatatgaccttgacggcgcccacaattgtgaatcaagagaggtatgttaaaattactgggttgtacccaaccattacggtacctgaagagttcgcaagtcatgttggaccttttgggacagcggtg

SEQ ID NO: 437558 - DNA, 140 bp, Artificial Sequence
  Synthetic
caccgctgtcccaaaaggtccaacatgacttgcgaactcttcaggtaccgtaatggttgggtacaacccagtaattttaacatacctctcttgattcacaattgtgggcgccgtcaaggtcatatcagcagccagggcct

SEQ ID NO: 437559 - DNA, 140 bp, Artificial Sequence
  Synthetic
atacgccatgctgggtctcctgggttgtacccaaccattacggtacctgaagagttcgcaagtcatgttgccaacttccaaaaatcaggttatagtaaatatgtcactgttcagggaccacgtacttgggagtcggccat

SEQ ID NO: 437560 - DNA, 140 bp, Artificial Sequence
  Synthetic
atggccgactcccaagtacgtggtccctgaacagtgacatatttactataacctgatttttggaagttggcaacatgacttgcgaactcttcaggtaccgtaatggttgggtacaacccaggagacccagcatggcgtat

SEQ ID NO: 437561 - DNA, 140 bp, Artificial Sequence
  Synthetic
atacgccatgctgggtctcccctggcactggcaaaagtcattttgctatagggttagcgatttactaccctacagcacgtgttgtttatacagcatgttcacacgcagctgttgatgcttcgtacttgggagtcggccat

SEQ ID NO: 437562 - DNA, 140 bp, Artificial Sequence
  Synthetic
atggccgactcccaagtacgaagcatcaacagctgcgtgtgaacatgctgtataaacaacacgtgctgtagggtagtaaatcgctaaccctatagcaaaatgacttttgccagtgccaggggagacccagcatggcgtat

SEQ ID NO: 437563 - DNA, 140 bp, Artificial Sequence
  Synthetic
atacgccatgctgggtctccatatagttgcttggctttatgcggctatactaaatggttgcacatggtttgttaaacctagtcgcactagtgtagtctcttttaatgaatgggccatggccgtacttgggagtcggccat

SEQ ID NO: 437564 - DNA, 140 bp, Artificial Sequence
  Synthetic
atggccgactcccaagtacggccatggcccattcattaaaagagactacactagtgcgactaggtttaacaaaccatgtgcaaccatttagtatagccgcataaagccaagcaactatatggagacccagcatggcgtat

SEQ ID NO: 437565 - DNA, 140 bp, Artificial Sequence
  Synthetic
atacgccatgctgggtctcctgtgtgaaaaagcttttaaatatttgaacattgctaaatgttcccgtatcattcctgcaaaggcacgtgttgagtgctatgacaggtttaaagttaatgacgtacttgggagtcggccat

SEQ ID NO: 437566 - DNA, 140 bp, Artificial Sequence
  Synthetic
atggccgactcccaagtacgtcattaactttaaacctgtcatagcactcaacacgtgcctttgcaggaatgatacgggaacatttagcaatgttcaaatatttaaaagctttttcacacaggagacccagcatggcgtat

SEQ ID NO: 437567 - DNA, 140 bp, Artificial Sequence
  Synthetic
atacgccatgctgggtctccgacaaattctcaatatttgtttagtactattaatgctctaccagaaacttctgccgatattctggtggttgatgaggttagtatgtgcactaattatgatcgtacttgggagtcggccat

SEQ ID NO: 437568 - DNA, 140 bp, Artificial Sequence
  Synthetic
atggccgactcccaagtacgatcataattagtgcacatactaacctcatcaaccaccagaatatcggcagaagtttctggtagagcattaatagtactaaacaaatattgagaatttgtcggagacccagcatggcgtat

SEQ ID NO: 437569 - DNA, 140 bp, Artificial Sequence
  Synthetic
aggccctggctgctgatatgctgccgatattctggtggttgatgaggttagtatgtgcactaattatgatctttcaattattaatgcacgtattaaagctaagcacattgtctatgtagggaccttttgggacagcggtg

SEQ ID NO: 437570 - DNA, 140 bp, Artificial Sequence
  Synthetic
caccgctgtcccaaaaggtccctacatagacaatgtgcttagctttaatacgtgcattaataattgaaagatcataattagtgcacatactaacctcatcaaccaccagaatatcggcagcatatcagcagccagggcct

SEQ ID NO: 437571 - DNA, 140 bp, Artificial Sequence
  Synthetic
atacgccatgctgggtctccttatgtcatcttctgccagacagcagacacagcacatgctaacaatcttaataggtttaatgttgctgtgactcgagcacagaagggtattctttgtgttcgtacttgggagtcggccat

SEQ ID NO: 437572 - DNA, 140 bp, Artificial Sequence
  Synthetic
atggccgactcccaagtacgaacacaaagaatacccttctgtgctcgagtcacagcaacattaaacctattaagattgttagcatgtgctgtgtctgctgtctggcagaagatgacataaggagacccagcatggcgtat

SEQ ID NO: 437573 - DNA, 140 bp, Artificial Sequence
  Synthetic
atacgccatgctgggtctccagatccagcacagttgccagctcctaggactttgttgactagaggcacattggaaccagaaaatttcaatagtgtcactagattgatgtgtaacttaggtcgtacttgggagtcggccat

SEQ ID NO: 437574 - DNA, 140 bp, Artificial Sequence
  Synthetic
atggccgactcccaagtacgacctaagttacacatcaatctagtgacactattgaaattttctggttccaatgtgcctctagtcaacaaagtcctaggagctggcaactgtgctggatctggagacccagcatggcgtat

SEQ ID NO: 437575 - DNA, 140 bp, Artificial Sequence
  Synthetic
atacgccatgctgggtctccatgacttcgcagtcgctgtttgaatctttacagtttgctgagttgtctactaagaactacaagctgcagtctcagattgtaactggtttgtttaaagattcgtacttgggagtcggccat

SEQ ID NO: 437576 - DNA, 140 bp, Artificial Sequence
  Synthetic
atggccgactcccaagtacgaatctttaaacaaaccagttacaatctgagactgcagcttgtagttcttagtagacaactcagcaaactgtaaagattcaaacagcgactgcgaagtcatggagacccagcatggcgtat

SEQ ID NO: 437577 - DNA, 140 bp, Artificial Sequence
  Synthetic
atacgccatgctgggtctcccctgacatatttttaagtatgtgctacaggtgtcctaaggaaatagtaagcactgtgagcgctcttgtctacaataataaattgttagccaagaaggagccgtacttgggagtcggccat

SEQ ID NO: 437578 - DNA, 140 bp, Artificial Sequence
  Synthetic
atggccgactcccaagtacggctccttcttggctaacaatttattattgtagacaagagcgctcacagtgcttactatttccttaggacacctgtagcacatacttaaaaatatgtcaggggagacccagcatggcgtat

SEQ ID NO: 437579 - DNA, 140 bp, Artificial Sequence
  Synthetic
atacgccatgctgggtctccgctccagagaaccgtctggattgcctcctgcttatgcaccaacatatgttagtgttgatgataagtataagactagcgatgagctttgcgcgaatttgaacgtacttgggagtcggccat

SEQ ID NO: 437580 - DNA, 140 bp, Artificial Sequence
  Synthetic
atggccgactcccaagtacgttcaaattcgcgcaaagctcatcgctagtcttatacttatcatcaacactaacatatgttggtgcataagcaggaggcaatccagacggttctctggagcggagacccagcatggcgtat

SEQ ID NO: 437581 - DNA, 140 bp, Artificial Sequence
  Synthetic
atacgccatgctgggtctcctttcaggccagtgctttaaaatactctataagggcaatgtgacgcatgatgctagctctgccattaatagaccacaactcacatttgtgaagaattttatcgtacttgggagtcggccat

SEQ ID NO: 437582 - DNA, 140 bp, Artificial Sequence
  Synthetic
atggccgactcccaagtacgataaaattcttcacaaatgtgagttgtggtctattaatggcagagctagcatcatgcgtcacattgcccttatagagtattttaaagcactggcctgaaaggagacccagcatggcgtat

SEQ ID NO: 437583 - DNA, 140 bp, Artificial Sequence
  Synthetic
atacgccatgctgggtctcctcttcccgcaaatgttccttattcgcgtgttatatcaaggatggggtttaagcttgatgcgacaatccctggttatccgaagctcttcataactcgtgagcgtacttgggagtcggccat

SEQ ID NO: 437584 - DNA, 140 bp, Artificial Sequence
  Synthetic
atggccgactcccaagtacgctcacgagttatgaagagcttcggataaccagggattgtcgcatcaagcttaaaccccatccttgatataacacgcgaataaggaacatttgcgggaagaggagacccagcatggcgtat

SEQ ID NO: 437585 - DNA, 140 bp, Artificial Sequence
  Synthetic
atacgccatgctgggtctccttgttgacaggtactatgcatttcttaataagaatttctctatgatgatactgtcagacgacggtgttgtttgctataacagtgattatgcagctaaaggcgtacttgggagtcggccat

SEQ ID NO: 437586 - DNA, 140 bp, Artificial Sequence
  Synthetic
atggccgactcccaagtacgcctttagctgcataatcactgttatagcaaacaacaccgtcgtctgacagtatcatcatagagaaattcttattaagaaatgcatagtacctgtcaacaaggagacccagcatggcgtat

SEQ ID NO: 437587 - DNA, 140 bp, Artificial Sequence
  Synthetic
atacgccatgctgggtctccccgtgactccagcagctactgctaaaccggaaattccggcttctagcaactatgaagctgacgtggaggttgaacaaccagttgtgcgacctaaggtaaacgtacttgggagtcggccat

SEQ ID NO: 437588 - DNA, 140 bp, Artificial Sequence
  Synthetic
atggccgactcccaagtacgtttaccttaggtcgcacaactggttgttcaacctccacgtcagcttcatagttgctagaagccggaatttccggtttagcagtagctgctggagtcacggggagacccagcatggcgtat

SEQ ID NO: 437589 - DNA, 140 bp, Artificial Sequence
  Synthetic
atacgccatgctgggtctccgattcctcacagggttcagaataccagtacgttatcttctgtcaaacagcagatacggcacatgctaacaacattaacagatttaatgttgcaatcactccgtacttgggagtcggccat

SEQ ID NO: 437590 - DNA, 140 bp, Artificial Sequence
  Synthetic
atggccgactcccaagtacggagtgattgcaacattaaatctgttaatgttgttagcatgtgccgtatctgctgtttgacagaagataacgtactggtattctgaaccctgtgaggaatcggagacccagcatggcgtat

SEQ ID NO: 437591 - DNA, 140 bp, Artificial Sequence
  Synthetic
aggccctggctgctgatatgtgattgcaagtgaacagtgccccccgggaagagctctacagtgtgaaatgtaaataaaaatagctattattcaattagattaggctaattagatgatttggaccttttgggacagcggtg

SEQ ID NO: 437592 - DNA, 140 bp, Artificial Sequence
  Synthetic
caccgctgtcccaaaaggtccaaatcatctaattagcctaatctaattgaataatagctatttttatttacatttcacactgtagagctcttcccggggggcactgttcacttgcaatcacatatcagcagccagggcct

SEQ ID NO: 437593 - DNA, 140 bp, Artificial Sequence
  Synthetic
atacgccatgctgggtctccgtgcccaaaaaggtattctttgtgttatgacatctcaggcactctttgagtccttagagtttactgaattgtcttttactaattacaagcttcagtctcacgtacttgggagtcggccat

SEQ ID NO: 437594 - DNA, 140 bp, Artificial Sequence
  Synthetic
atggccgactcccaagtacgtgagactgaagcttgtaattagtaaaagacaattcagtaaactctaaggactcaaagagtgcctgagatgtcataacacaaagaatacctttttgggcacggagacccagcatggcgtat

SEQ ID NO: 437595 - DNA, 140 bp, Artificial Sequence
  Synthetic
aggccctggctgctgatatgtattaagtattactctatcattcctcacagtattcgttctatccaaagtgatagaaaagcttgggctgccttctacgtatataaacttcaaccgttaactgaccttttgggacagcggtg

SEQ ID NO: 437596 - DNA, 140 bp, Artificial Sequence
  Synthetic
caccgctgtcccaaaaggtcagttaacggttgaagtttatatacgtagaaggcagcccaagcttttctatcactttggatagaacgaatactgtgaggaatgatagagtaatacttaatacatatcagcagccagggcct

SEQ ID NO: 437597 - DNA, 140 bp, Artificial Sequence
  Synthetic
atacgccatgctgggtctcccacctgcttatgcaccaacatacgttagtgttgatgacaagtataagacgagtgatgagctttgcgtgaatcttaatttacccgcaaatgtcccatactccgtacttgggagtcggccat

SEQ ID NO: 437598 - DNA, 140 bp, Artificial Sequence
  Synthetic
atggccgactcccaagtacggagtatgggacatttgcgggtaaattaagattcacgcaaagctcatcactcgtcttatacttgtcatcaacactaacgtatgttggtgcataagcaggtgggagacccagcatggcgtat

SEQ ID NO: 437599 - DNA, 140 bp, Artificial Sequence
  Synthetic
atacgccatgctgggtctccatagacgcgctggtgcttattcttcccctctgcaatcgtatgcctgttgggcacactcttgcgggtatgattatgtctacaacccattctttgttgatgtcgtacttgggagtcggccat

SEQ ID NO: 437600 - DNA, 140 bp, Artificial Sequence
  Synthetic
atggccgactcccaagtacgacatcaacaaagaatgggttgtagacataatcatacccgcaagagtgtgcccaacaggcatacgattgcagaggggaagaataagcaccagcgcgtctatggagacccagcatggcgtat

SEQ ID NO: 437601 - DNA, 140 bp, Artificial Sequence
  Synthetic
aggccctggctgctgatatgtggataggcttcgatgttgagggtgctcatgcttcccgtaatgcatgtggcaccaatgtgcctctacaattaggattttcaactggtgtgaactttgttggaccttttgggacagcggtg

SEQ ID NO: 437602 - DNA, 140 bp, Artificial Sequence
  Synthetic
caccgctgtcccaaaaggtccaacaaagttcacaccagttgaaaatcctaattgtagaggcacattggtgccacatgcattacgggaagcatgagcaccctcaacatcgaagcctatccacatatcagcagccagggcct

SEQ ID NO: 437603 - DNA, 140 bp, Artificial Sequence
  Synthetic
aggccctggctgctgatatgctagtgcaaatggcagcttggttggcacaactttgcagggcaagcctattggtatgttcttcccttatgacatcgaacttgtcacaggaaagcaaaatatgaccttttgggacagcggtg

SEQ ID NO: 437604 - DNA, 140 bp, Artificial Sequence
  Synthetic
caccgctgtcccaaaaggtcatattttgctttcctgtgacaagttcgatgtcataagggaagaacataccaataggcttgccctgcaaagttgtgccaaccaagctgccatttgcactagcatatcagcagccagggcct

SEQ ID NO: 437605 - DNA, 140 bp, Artificial Sequence
  Synthetic
aggccctggctgctgatatgttcagccagttggtgttgtagacactgagtggggtaacatgttaacgggcattgctgcccgtcctccaccaggtgaacagtttaagcacctcgtgcctctgaccttttgggacagcggtg

SEQ ID NO: 437606 - DNA, 140 bp, Artificial Sequence
  Synthetic
caccgctgtcccaaaaggtcagaggcacgaggtgcttaaactgttcacctggtggaggacgggcagcaatgcccgttaacatgttaccccactcagtgtctacaacaccaactggctgaacatatcagcagccagggcct

SEQ ID NO: 437607 - DNA, 140 bp, Artificial Sequence
  Synthetic
aggccctggctgctgatatgattgctgcccgtcctccaccaggtgaacagtttaagcacctcgtgcctcttatgcataagggggctgcatggcctattgttagacgacgtatagtgcaaagaccttttgggacagcggtg

SEQ ID NO: 437608 - DNA, 140 bp, Artificial Sequence
  Synthetic
caccgctgtcccaaaaggtctttgcactatacgtcgtctaacaataggccatgcagcccccttatgcataagaggcacgaggtgcttaaactgttcacctggtggaggacgggcagcaatcatatcagcagccagggcct

SEQ ID NO: 437609 - DNA, 140 bp, Artificial Sequence
  Synthetic
atacgccatgctgggtctccttgtcgagcgcaatgtagtgcgtgctgcattacttgctggcgcatttgaacgcgtctatgatataggcaaccctaagggaattcctattgttgatgaccccgtacttgggagtcggccat

SEQ ID NO: 437610 - DNA, 140 bp, Artificial Sequence
  Synthetic
atggccgactcccaagtacggggtcatcaacaataggaattcccttagggttgcctatatcatagacgcgttcaaatgcgccagcaagtaatgcagcacgcactacattgcgctcgacaaggagacccagcatggcgtat

SEQ ID NO: 437611 - DNA, 140 bp, Artificial Sequence
  Synthetic
aggccctggctgctgatatgtgttgtcagacactttagacaaattgtctgattactgtacgtttgtttgttgggctcatggctttgaattaacgtctgcatcatacttttgcaagatagggaccttttgggacagcggtg

SEQ ID NO: 437612 - DNA, 140 bp, Artificial Sequence
  Synthetic
caccgctgtcccaaaaggtccctatcttgcaaaagtatgatgcagacgttaattcaaagccatgagcccaacaaacaaacgtacagtaatcagacaatttgtctaaagtgtctgacaacacatatcagcagccagggcct

SEQ ID NO: 437613 - DNA, 140 bp, Artificial Sequence
  Synthetic
atacgccatgctgggtctcctgggctcatggctttgaattaacgtctgcatcatacttttgcaagataggtaaggaacagaagtgttgcatgtgcaatagacgcgctgcagcgtactcttcgtacttgggagtcggccat

SEQ ID NO: 437614 - DNA, 140 bp, Artificial Sequence
  Synthetic
atggccgactcccaagtacgaagagtacgctgcagcgcgtctattgcacatgcaacacttctgttccttacctatcttgcaaaagtatgatgcagacgttaattcaaagccatgagcccaggagacccagcatggcgtat

SEQ ID NO: 437615 - DNA, 140 bp, Artificial Sequence
  Synthetic
atacgccatgctgggtctcccacctctgcaatcttatgcctgctggactcattcctgcggttatgattatgtctacaaccctttctttgtcgatgttcaacagtggggttatgtaggcaacgtacttgggagtcggccat

SEQ ID NO: 437616 - DNA, 140 bp, Artificial Sequence
  Synthetic
atggccgactcccaagtacgttgcctacataaccccactgttgaacatcgacaaagaaagggttgtagacataatcataaccgcaggaatgagtccagcaggcataagattgcagaggtgggagacccagcatggcgtat

SEQ ID NO: 437617 - DNA, 140 bp, Artificial Sequence
  Synthetic
atacgccatgctgggtctcctccaggatgggctttaaactcgatgcaacagttcctggatatcctaagcttttcattactcgtgaagaggctgtaaggcaagttcgaagctggataggctcgtacttgggagtcggccat

SEQ ID NO: 437618 - DNA, 140 bp, Artificial Sequence
  Synthetic
atggccgactcccaagtacgagcctatccagcttcgaacttgccttacagcctcttcacgagtaatgaaaagcttaggatatccaggaactgttgcatcgagtttaaagcccatcctggaggagacccagcatggcgtat

SEQ ID NO: 437619 - DNA, 140 bp, Artificial Sequence
  Synthetic
atacgccatgctgggtctcctcttgccactaatcacgatcgttattgctctgtccatcaaggagctcatgtggcttctaatgatgcaataatgactcgttgtttagctattcattcttgtcgtacttgggagtcggccat

SEQ ID NO: 437620 - DNA, 140 bp, Artificial Sequence
  Synthetic
atggccgactcccaagtacgacaagaatgaatagctaaacaacgagtcattattgcatcattagaagccacatgagctccttgatggacagagcaataacgatcgtgattagtggcaagaggagacccagcatggcgtat

SEQ ID NO: 437621 - DNA, 140 bp, Artificial Sequence
  Synthetic
aggccctggctgctgatatgtggcttctaatgatgcaataatgactcgttgtttagctattcattcttgttttatagaacgtgtggattgggatatagagtatccttatatctcacatgagaccttttgggacagcggtg

SEQ ID NO: 437622 - DNA, 140 bp, Artificial Sequence
  Synthetic
caccgctgtcccaaaaggtctcatgtgagatataaggatactctatatcccaatccacacgttctataaaacaagaatgaatagctaaacaacgagtcattattgcatcattagaagccacatatcagcagccagggcct

SEQ ID NO: 437623 - DNA, 140 bp, Artificial Sequence
  Synthetic
atacgccatgctgggtctcctaccacaccatgtgaagtgcatggtaatggtagtatgttagaagatattgattatgtacccctcaagtcagctgtctgtgtgacagcatgtaaccttggtcgtacttgggagtcggccat

SEQ ID NO: 437624 - DNA, 140 bp, Artificial Sequence
  Synthetic
atggccgactcccaagtacgaccaaggttacatgctgtcacacagacagctgacttgaggggtacataatcaatatcttctaacatactaccattaccatgcacttcacatggtgtggtaggagacccagcatggcgtat

SEQ ID NO: 437625 - DNA, 140 bp, Artificial Sequence
  Synthetic
atacgccatgctgggtctccaaagaaattgaattcctgttgtagaatcgttgagcgcaacgtcgtacgtgctgctcttcttgccggttcatttgacaaagtctatgatattggcaatcctcgtacttgggagtcggccat

SEQ ID NO: 437626 - DNA, 140 bp, Artificial Sequence
  Synthetic
atggccgactcccaagtacgaggattgccaatatcatagactttgtcaaatgaaccggcaagaagagcagcacgtacgacgttgcgctcaacgattctacaacaggaattcaatttctttggagacccagcatggcgtat

SEQ ID NO: 437627 - DNA, 140 bp, Artificial Sequence
  Synthetic
atacgccatgctgggtctccgatagtgttacacttgttttgtgtgacgctattaagctagccaagtgctttaaagattgtgtgttggttaatgctgctaacacacatcttaaacatggtgcgtacttgggagtcggccat

SEQ ID NO: 437628 - DNA, 140 bp, Artificial Sequence
  Synthetic
atggccgactcccaagtacgcaccatgtttaagatgtgtgttagcagcattaaccaacacacaatctttaaagcacttggctagcttaatagcgtcacacaaaacaagtgtaacactatcggagacccagcatggcgtat

SEQ ID NO: 437629 - DNA, 140 bp, Artificial Sequence
  Synthetic
atacgccatgctgggtctccaaaggaattcctattgttgatgaccctgtggttgattggcattattttgatgcacagcccttgaccaggaaggtacaacagcttttctatacagaggacacgtacttgggagtcggccat

SEQ ID NO: 437630 - DNA, 140 bp, Artificial Sequence
  Synthetic
atggccgactcccaagtacgtgtcctctgtatagaaaagctgttgtaccttcctggtcaagggctgtgcatcaaaataatgccaatcaaccacagggtcatcaacaataggaattcctttggagacccagcatggcgtat

SEQ ID NO: 437631 - DNA, 140 bp, Artificial Sequence
  Synthetic
atacgccatgctgggtctccttgatatttataatctttggtctacctttactaaggttcaaggtcttgagaacatcgcttataatgttgttaaacaaggccactttactggtgttgacggcgtacttgggagtcggccat

SEQ ID NO: 437632 - DNA, 140 bp, Artificial Sequence
  Synthetic
atggccgactcccaagtacgccgtcaacaccagtaaagtggccttgtttaacaacattataagcgatgttctcaagaccttgaaccttagtaaaggtagaccaaagattataaatatcaaggagacccagcatggcgtat

SEQ ID NO: 437633 - DNA, 140 bp, Artificial Sequence
  Synthetic
atacgccatgctgggtctcctgaactgcctgtagcggtagtcaatgacaagatcttcaccaagagtggtgtcaatgacatttgtgtcttcgagaataagacatctctgcctactaatatacgtacttgggagtcggccat

SEQ ID NO: 437634 - DNA, 140 bp, Artificial Sequence
  Synthetic
atggccgactcccaagtacgtatattagtaggcagagatgtcttattctcgaagacacaaatgtcattgacaccactcttggtgaagatcttgtcattgactaccgctacaggcagttcaggagacccagcatggcgtat

SEQ ID NO: 437635 - DNA, 140 bp, Artificial Sequence
  Synthetic
aggccctggctgctgatatgttctgagttcaatttgccaggttgtgatggcggtagtttgtatgttaacaagcacgcttttcatacaccagcatatgatgtgagtgcattccgtgatctggaccttttgggacagcggtg

SEQ ID NO: 437636 - DNA, 140 bp, Artificial Sequence
  Synthetic
caccgctgtcccaaaaggtccagatcacggaatgcactcacatcatatgctggtgtatgaaaagcgtgcttgttaacatacaaactaccgccatcacaacctggcaaattgaactcagaacatatcagcagccagggcct

SEQ ID NO: 437637 - DNA, 140 bp, Artificial Sequence
  Synthetic
aggccctggctgctgatatgcttggctatctcacttcccctcgttctcttgcagaactttgattttaacgaacttaaataaaagccctgttgtttagcgtattgttgcacttgtctggtggaccttttgggacagcggtg

SEQ ID NO: 437638 - DNA, 140 bp, Artificial Sequence
  Synthetic
caccgctgtcccaaaaggtccaccagacaagtgcaacaatacgctaaacaacagggcttttatttaagttcgttaaaatcaaagttctgcaagagaacgaggggaagtgagatagccaagcatatcagcagccagggcct

SEQ ID NO: 437639 - DNA, 140 bp, Artificial Sequence
  Synthetic
atacgccatgctgggtctccaaacctttaccattcttttattattctactacaccatgtgaagtgcatggtaatggtagtatgatagaggatattgattatgtacccctaaaatctgcagcgtacttgggagtcggccat

SEQ ID NO: 437640 - DNA, 140 bp, Artificial Sequence
  Synthetic
atggccgactcccaagtacgctgcagattttaggggtacataatcaatatcctctatcatactaccattaccatgcacttcacatggtgtagtagaataataaaagaatggtaaaggtttggagacccagcatggcgtat

SEQ ID NO: 437641 - DNA, 140 bp, Artificial Sequence
  Synthetic
atacgccatgctgggtctccattatgagcgtagtaacatttatggtacggctactattggtgtgtgtaaatacaccgatattgatgtcaatgcagctttgaatgtctgctttgacattcgcgtacttgggagtcggccat

SEQ ID NO: 437642 - DNA, 140 bp, Artificial Sequence
  Synthetic
atggccgactcccaagtacgcgaatgtcaaagcagacattcaaagctgcattgacatcaatatcggtgtatttacacacaccaatagtagccgtaccataaatgttactacgctcataatggagacccagcatggcgtat

SEQ ID NO: 437643 - DNA, 140 bp, Artificial Sequence
  Synthetic
atacgccatgctgggtctcctctgtattacaacttgtaatttagggggcgctgtttgtaggaagcatgctacagagtacagagagtatatggaagcatataatcttgtctctgcatcaggcgtacttgggagtcggccat

SEQ ID NO: 437644 - DNA, 140 bp, Artificial Sequence
  Synthetic
atggccgactcccaagtacgcctgatgcagagacaagattatatgcttccatatactctctgtactctgtagcatgcttcctacaaacagcgccccctaaattacaagttgtaatacagaggagacccagcatggcgtat

SEQ ID NO: 437645 - DNA, 140 bp, Artificial Sequence
  Synthetic
atacgccatgctgggtctcctgataatggttcattagaggtgttcatgaacacacctaatgctatattaatatctgatagaaaaatcaagaactacccatgtatggttggtcctgattatcgtacttgggagtcggccat

SEQ ID NO: 437646 - DNA, 140 bp, Artificial Sequence
  Synthetic
atggccgactcccaagtacgataatcaggaccaaccatacatgggtagttcttgatttttctatcagatattaatatagcattaggtgtgttcatgaacacctctaatgaaccattatcaggagacccagcatggcgtat

SEQ ID NO: 437647 - DNA, 140 bp, Artificial Sequence
  Synthetic
atacgccatgctgggtctcctttccgcctttggtgttataagacctttgatatttataatctctggtctacttttacaaaagttcaaggtttggaaaacattgcttttaatgttgttaaacgtacttgggagtcggccat

SEQ ID NO: 437648 - DNA, 140 bp, Artificial Sequence
  Synthetic
atggccgactcccaagtacgtttaacaacattaaaagcaatgttttccaaaccttgaacttttgtaaaagtagaccagagattataaatatcaaaggtcttataacaccaaaggcggaaaggagacccagcatggcgtat

SEQ ID NO: 437649 - DNA, 140 bp, Artificial Sequence
  Synthetic
atacgccatgctgggtctccgcttacttcaatggagccatcattcgtgatggtaatgctaagcagccagtgaagttttatatatataaaagggttaacaatgaatttgttaacttcactacgtacttgggagtcggccat

SEQ ID NO: 437650 - DNA, 140 bp, Artificial Sequence
  Synthetic
atggccgactcccaagtacgtagtgaagttaacaaattcattgttaacccttttatatatataaaacttcactggctgcttagcattaccatcacgaatgatggctccattgaagtaagcggagacccagcatggcgtat

SEQ ID NO: 437651 - DNA, 140 bp, Artificial Sequence
  Synthetic
atacgccatgctgggtctcccaaggccattttattggtgttgagggtgaactacctgtagctgtagtcaatgataagatcttcaccaagagtggcgttaatgacatttgtatgtttgagacgtacttgggagtcggccat

SEQ ID NO: 437652 - DNA, 140 bp, Artificial Sequence
  Synthetic
atggccgactcccaagtacgtctcaaacatacaaatgtcattaacgccactcttggtgaagatcttatcattgactacagctacaggtagttcaccctcaacaccaataaaatggccttgggagacccagcatggcgtat

SEQ ID NO: 437653 - DNA, 140 bp, Artificial Sequence
  Synthetic
atacgccatgctgggtctccgttccttctacacccaaggacgctcaaatgaagattttgcgccgatgtccgatatggagaaggactttctttctttggaaagcgatgttttcattaagaacgtacttgggagtcggccat

SEQ ID NO: 437654 - DNA, 140 bp, Artificial Sequence
  Synthetic
atggccgactcccaagtacgttcttaatgaaaacatcgctttccaaagaaagaaagtccttctccatatcggacatcggcgcaaaatcttcatttgagcgtccttgggtgtagaaggaacggagacccagcatggcgtat

SEQ ID NO: 437655 - DNA, 140 bp, Artificial Sequence
  Synthetic
atacgccatgctgggtctccataaaaccactttgcctactaatatagcttttgaactctatgctaagcgtgctgtacgctcgcatcccgatttcaaattgctacacaatttacaagcagacgtacttgggagtcggccat

SEQ ID NO: 437656 - DNA, 140 bp, Artificial Sequence
  Synthetic
atggccgactcccaagtacgtctgcttgtaaattgtgtagcaatttgaaatcgggatgcgagcgtacagcacgcttagcatagagttcaaaagctatattagtaggcaaagtggttttatggagacccagcatggcgtat

SEQ ID NO: 437657 - DNA, 140 bp, Artificial Sequence
  Synthetic
atacgccatgctgggtctccgtataagttggaaaactatgcttttgaacatgtagtttatggtgatttttcacatactacattgggtggtctacacttgcttattggcttacacaagaagcgtacttgggagtcggccat

SEQ ID NO: 437658 - DNA, 140 bp, Artificial Sequence
  Synthetic
atggccgactcccaagtacgcttcttgtgtaagccaataagcaagtgtagaccacccaatgtagtatgtgaaaaatcaccataaactacatgttcaaaagcatagttttccaacttatacggagacccagcatggcgtat

SEQ ID NO: 437659 - DNA, 140 bp, Artificial Sequence
  Synthetic
atacgccatgctgggtctcccatttgctacaagttcgtcctttgggattatgaacgtagcaatatttatggtactgctactattggtgtatgtaagtacactgatattgatgttaattcacgtacttgggagtcggccat

SEQ ID NO: 437660 - DNA, 140 bp, Artificial Sequence
  Synthetic
atggccgactcccaagtacgtgaattaacatcaatatcagtgtacttacatacaccaatagtagcagtaccataaatattgctacgttcataatcccaaaggacgaacttgtagcaaatgggagacccagcatggcgtat

SEQ ID NO: 437661 - DNA, 140 bp, Artificial Sequence
  Synthetic
atacgccatgctgggtctcctcagtggaaggtcatattattatggaagagatgctcaaaggtagtgcaactatccataactattttattactgaaactaacacagcgtcttttaaggcggcgtacttgggagtcggccat

SEQ ID NO: 437662 - DNA, 140 bp, Artificial Sequence
  Synthetic
atggccgactcccaagtacgccgccttaaaagacgctgtgttagtttcagtaataaaatagttatggatagttgcactacctttgagcatctcttccataataatatgaccttccactgaggagacccagcatggcgtat

SEQ ID NO: 437663 - DNA, 140 bp, Artificial Sequence
  Synthetic
atacgccatgctgggtctcctgtgttctgttatagatttaaagcttgacgactttgtagaaataataaagagtcaagaccttagcgttgtatctaaggttgtcaaggtccctattgatttcgtacttgggagtcggccat

SEQ ID NO: 437664 - DNA, 140 bp, Artificial Sequence
  Synthetic
atggccgactcccaagtacgaaatcaatagggaccttgacaaccttagatacaacgctaaggtcttgactctttattatttctacaaagtcgtcaagctttaaatctataacagaacacaggagacccagcatggcgtat

SEQ ID NO: 437665 - DNA, 140 bp, Artificial Sequence
  Synthetic
aggccctggctgctgatatgacccttgtatggtaggtcctgattatgcttacttcaatggtgctatcatccgtgatagtgatgttgttaaacaaccagtgaagttctacttgtataagaagaccttttgggacagcggtg

SEQ ID NO: 437666 - DNA, 140 bp, Artificial Sequence
  Synthetic
caccgctgtcccaaaaggtcttcttatacaagtagaacttcactggttgtttaacaacatcactatcacggatgatagcaccattgaagtaagcataatcaggacctaccatacaagggtcatatcagcagccagggcct

SEQ ID NO: 437667 - DNA, 140 bp, Artificial Sequence
  Synthetic
atacgccatgctgggtctccaactttggttgaatttatgttgtggtgcaaggatggccaagttcaaactttctatcctagactacaggcttccaatgattggaaacctgggttagccatgcgtacttgggagtcggccat

SEQ ID NO: 437668 - DNA, 140 bp, Artificial Sequence
  Synthetic
atggccgactcccaagtacgcatggctaacccaggtttccaatcattggaagcctgtagtctaggatagaaagtttgaacttggccatccttgcaccacaacataaattcaaccaaagttggagacccagcatggcgtat

SEQ ID NO: 437669 - DNA, 140 bp, Artificial Sequence
  Synthetic
aggccctggctgctgatatgtactttcttacacagattctattcacttaaggctgcagtccatgagtggaagatggttgtgtgtgataaggtacgttctctcaaattgagtgataataatgaccttttgggacagcggtg

SEQ ID NO: 437670 - DNA, 140 bp, Artificial Sequence
  Synthetic
caccgctgtcccaaaaggtcattattatcactcaatttgagagaacgtaccttatcacacacaaccatcttccactcatggactgcagccttaagtgaatagaatctgtgtaagaaagtacatatcagcagccagggcct

SEQ ID NO: 437671 - DNA, 140 bp, Artificial Sequence
  Synthetic
aggccctggctgctgatatggctcttgtagtgacttcctacccctgtctgacatggagaaagactttctatcttttgatagtgatgttttcattaagaagtatggcttggaaaactatgcgaccttttgggacagcggtg

SEQ ID NO: 437672 - DNA, 140 bp, Artificial Sequence
  Synthetic
caccgctgtcccaaaaggtcgcatagttttccaagccatacttcttaatgaaaacatcactatcaaaagatagaaagtctttctccatgtcagacaggggtaggaagtcactacaagagccatatcagcagccagggcct

SEQ ID NO: 437673 - DNA, 140 bp, Artificial Sequence
  Synthetic
atacgccatgctgggtctcccccctgttaatggctactttattaaaactaataacactaggcaattgtctagcttcccagataatctctggcattgtagcagctgtttcagctatgatgtcgtacttgggagtcggccat

SEQ ID NO: 437674 - DNA, 140 bp, Artificial Sequence
  Synthetic
atggccgactcccaagtacgacatcatagctgaaacagctgctacaatgccagagattatctgggaagctagacaattgcctagtgttattagttttaataaagtagccattaacaggggggagacccagcatggcgtat

SEQ ID NO: 437675 - DNA, 140 bp, Artificial Sequence
  Synthetic
atacgccatgctgggtctccctaagtatatgcagttgtgccagtatttgaatacgtgctcaattgctgtacctgccaatatgcgtgtcatgcattttggtgctggttccgataagggtatcgtacttgggagtcggccat

SEQ ID NO: 437676 - DNA, 140 bp, Artificial Sequence
  Synthetic
atggccgactcccaagtacgatacccttatcggaaccagcaccaaaatgcatgacacgcatattggcaggtacagcaattgagcacgtattcaaatactggcacaactgcatatacttagggagacccagcatggcgtat

SEQ ID NO: 437677 - DNA, 140 bp, Artificial Sequence
  Synthetic
aggccctggctgctgatatgttcacttgcttattggtttatacaagaagcaacaggaaggtcatattattatggaagaaatgctaaaaggtagctcaactattcataactattttattacgaccttttgggacagcggtg

SEQ ID NO: 437678 - DNA, 140 bp, Artificial Sequence
  Synthetic
caccgctgtcccaaaaggtcgtaataaaatagttatgaatagttgagctaccttttagcatttcttccataataatatgaccttcctgttgcttcttgtataaaccaataagcaagtgaacatatcagcagccagggcct

SEQ ID NO: 437679 - DNA, 140 bp, Artificial Sequence
  Synthetic
atacgccatgctgggtctcctgctcccggtacctctgttttaaggcaatggctacctgtcgatgccttgcttattgataatgacctgaacgagtatgtgtcagatgctgacattagcttgcgtacttgggagtcggccat

SEQ ID NO: 437680 - DNA, 140 bp, Artificial Sequence
  Synthetic
atggccgactcccaagtacgcaagctaatgtcagcatctgacacatactcgttcaggtcattatcaataagcaaggcatcgacaggtagccattgccttaaaacagaggtaccgggagcaggagacccagcatggcgtat

SEQ ID NO: 437681 - DNA, 140 bp, Artificial Sequence
  Synthetic
aggccctggctgctgatatgcactcactagtgattatacgattacagtctttgttactgttaaccttgcaaaagtttgcacttatgccatctttgcttactcaccacagcttacacttgtgaccttttgggacagcggtg

SEQ ID NO: 437682 - DNA, 140 bp, Artificial Sequence
  Synthetic
caccgctgtcccaaaaggtcacaagtgtaagctgtggtgagtaagcaaagatggcataagtgcaaacttttgcaaggttaacagtaacaaagactgtaatcgtataatcactagtgagtgcatatcagcagccagggcct

SEQ ID NO: 437683 - DNA, 140 bp, Artificial Sequence
  Synthetic
atacgccatgctgggtctccctaaggccttattctttacttacctttgtaattttattaataataatcttgctctcggcggcactgttgcaattaagataacagagcattcctggagcgccgtacttgggagtcggccat

SEQ ID NO: 437684 - DNA, 140 bp, Artificial Sequence
  Synthetic
atggccgactcccaagtacggcgctccaggaatgctctgttatcttaattgcaacagtgccgccgagagcaagattattattaataaaattacaaaggtaagtaaagaataaggccttagggagacccagcatggcgtat

SEQ ID NO: 437685 - DNA, 140 bp, Artificial Sequence
  Synthetic
aggccctggctgctgatatgctgcagattggaaacctggtcatgcaatgccatccctctttaaagttcaaaatgtaaaccttgaacgttgtgagcttgctaattacaagcaatctattccgaccttttgggacagcggtg

SEQ ID NO: 437686 - DNA, 140 bp, Artificial Sequence
  Synthetic
caccgctgtcccaaaaggtcggaatagattgcttgtaattagcaagctcacaacgttcaaggtttacattttgaactttaaagagggatggcattgcatgaccaggtttccaatctgcagcatatcagcagccagggcct

SEQ ID NO: 437687 - DNA, 140 bp, Artificial Sequence
  Synthetic
atacgccatgctgggtctccaatgtaaaccttgaacgttgtgagcttgctaattacaagcaatctattcctatgcctcgcggtgtgcacatgaacatcgctaaatatatgcaattgtgcccgtacttgggagtcggccat

SEQ ID NO: 437688 - DNA, 140 bp, Artificial Sequence
  Synthetic
atggccgactcccaagtacgggcacaattgcatatatttagcgatgttcatgtgcacaccgcgaggcataggaatagattgcttgtaattagcaagctcacaacgttcaaggtttacattggagacccagcatggcgtat

SEQ ID NO: 437689 - DNA, 140 bp, Artificial Sequence
  Synthetic
aggccctggctgctgatatgtatgcctcgcggtgtgcacatgaacatcgctaaatatatgcaattgtgccagtatttaaatacttgcacattagccgtgcctgccaatatgcgtgttatagaccttttgggacagcggtg

SEQ ID NO: 437690 - DNA, 140 bp, Artificial Sequence
  Synthetic
caccgctgtcccaaaaggtctataacacgcatattggcaggcacggctaatgtgcaagtatttaaatactggcacaattgcatatatttagcgatgttcatgtgcacaccgcgaggcatacatatcagcagccagggcct

SEQ ID NO: 437691 - DNA, 140 bp, Artificial Sequence
  Synthetic
atacgccatgctgggtctccttgggtactattagagaagttgttgatggcaacgccatgcacgctaattatatattctggagaaattccactcctatgaatttgagtacttactcactttcgtacttgggagtcggccat

SEQ ID NO: 437692 - DNA, 140 bp, Artificial Sequence
  Synthetic
atggccgactcccaagtacgaaagtgagtaagtactcaaattcataggagtggaatttctccagaatatataattagcgtgcatggcgttgccatcaacaacttctctaatagtacccaaggagacccagcatggcgtat

SEQ ID NO: 437693 - DNA, 140 bp, Artificial Sequence
  Synthetic
aggccctggctgctgatatgggcttatcctcctttgctgctattccatttgcacagagtatcttttataggttaaacgtgttgaattgatctagcttcccagataatctctggcattgtagaccttttgggacagcggtg

SEQ ID NO: 437694 - DNA, 140 bp, Artificial Sequence
  Synthetic
caccgctgtcccaaaaggtctacaatgccagagattatctgggaagctagatcaattcaacacgtttaacctataaaagatactctgtgcaaatggaatagcagcaaaggaggataagcccatatcagcagccagggcct

SEQ ID NO: 437695 - DNA, 140 bp, Artificial Sequence
  Synthetic
aggccctggctgctgatatgacgacagtggcttcctacagatgccattattatagataatgatttaaatgagttcgtgtcagatgctgacataactttatttggagattgtgtaactgtagaccttttgggacagcggtg

SEQ ID NO: 437696 - DNA, 140 bp, Artificial Sequence
  Synthetic
caccgctgtcccaaaaggtctacagttacacaatctccaaataaagttatgtcagcatctgacacgaactcatttaaatcattatctataataatggcatctgtaggaagccactgtcgtcatatcagcagccagggcct

SEQ ID NO: 437697 - DNA, 140 bp, Artificial Sequence
  Synthetic
atacgccatgctgggtctccagttcgtgtcagatgctgacataactttatttggagattgtgtaactgtacgtgtcggccaacaagtggatcttgttatttccgacatgtatgatcctaccgtacttgggagtcggccat

SEQ ID NO: 437698 - DNA, 140 bp, Artificial Sequence
  Synthetic
atggccgactcccaagtacggtaggatcatacatgtcggaaataacaagatccacttgttggccgacacgtacagttacacaatctccaaataaagttatgtcagcatctgacacgaactggagacccagcatggcgtat

SEQ ID NO: 437699 - DNA, 140 bp, Artificial Sequence
  Synthetic
aggccctggctgctgatatgcgtgtcggccaacaagtggatcttgttatttccgacatgtatgatcctactactaagaatgtaacaggtagtaatgagtcaaaggctttattctttacttgaccttttgggacagcggtg
